United States Patent 11,369,692 (MATERIALS AND METHODS FOR TREATMENT OF DUCHENNE MUSCULAR DYSTROPHY) - sequence listing, part 17

SEQ ID NO: 549113 - DNA, 20 bp, Artificial Sequence
  chemically synthesized
aaatcacgattttgttgttg

SEQ ID NO: 549114 - DNA, 20 bp, Artificial Sequence
  chemically synthesized
atcaggaaaacaaaactatc

SEQ ID NO: 549115 - DNA, 20 bp, Artificial Sequence
  chemically synthesized
ctcaagtcttacatttcaga

SEQ ID NO: 549116 - DNA, 20 bp, Artificial Sequence
  chemically synthesized
caaccaagagttgacaagca

SEQ ID NO: 549117 - DNA, 20 bp, Artificial Sequence
  chemically synthesized
tgaaggaatggagtctaaag

SEQ ID NO: 549118 - DNA, 20 bp, Artificial Sequence
  chemically synthesized
ttccttcagattccatcata

SEQ ID NO: 549119 - DNA, 20 bp, Artificial Sequence
  chemically synthesized
tgcatttttgcatcgaagta

SEQ ID NO: 549120 - DNA, 20 bp, Artificial Sequence
  chemically synthesized
ctactcgggaggctgaggca

SEQ ID NO: 549121 - DNA, 20 bp, Artificial Sequence
  chemically synthesized
caccataccctgggtacatt

SEQ ID NO: 549122 - DNA, 20 bp, Artificial Sequence
  chemically synthesized
tttatatgcactgcattttc

SEQ ID NO: 549123 - DNA, 20 bp, Artificial Sequence
  chemically synthesized
taccaaatgttattaatcat

SEQ ID NO: 549124 - DNA, 20 bp, Artificial Sequence
  chemically synthesized
ttaattattcaatatgaaaa

SEQ ID NO: 549125 - DNA, 20 bp, Artificial Sequence
  chemically synthesized
ttttttacaaggtaattgtt

SEQ ID NO: 549126 - DNA, 20 bp, Artificial Sequence
  chemically synthesized
actcccattactatcctcaa

SEQ ID NO: 549127 - DNA, 20 bp, Artificial Sequence
  chemically synthesized
taaaacctatacggtacata

SEQ ID NO: 549128 - DNA, 20 bp, Artificial Sequence
  chemically synthesized
tagaagaaaaaaagttttta

SEQ ID NO: 549129 - DNA, 20 bp, Artificial Sequence
  chemically synthesized
ctgctcaggaggttgagaca

SEQ ID NO: 549130 - DNA, 20 bp, Artificial Sequence
  chemically synthesized
gcaagactccatctcacaaa

SEQ ID NO: 549131 - DNA, 20 bp, Artificial Sequence
  chemically synthesized
ccatctcacaaaaaagaaaa

SEQ ID NO: 549132 - DNA, 20 bp, Artificial Sequence
  chemically synthesized
aagaaataatgtatacatat

SEQ ID NO: 549133 - DNA, 20 bp, Artificial Sequence
  chemically synthesized
tacagggctttccttcacaa

SEQ ID NO: 549134 - DNA, 20 bp, Artificial Sequence
  chemically synthesized
agactcaacccagagtaatt

SEQ ID NO: 549135 - DNA, 20 bp, Artificial Sequence
  chemically synthesized
gaaggaagagtctattatac

SEQ ID NO: 549136 - DNA, 20 bp, Artificial Sequence
  chemically synthesized
aaaaacatggtgtttgaccc

SEQ ID NO: 549137 - DNA, 20 bp, Artificial Sequence
  chemically synthesized
tgtgggaaggaaatggagga

SEQ ID NO: 549138 - DNA, 20 bp, Artificial Sequence
  chemically synthesized
taaattgaatatcaaatact

SEQ ID NO: 549139 - DNA, 20 bp, Artificial Sequence
  chemically synthesized
ttttcacagccaggaaaaac

SEQ ID NO: 549140 - DNA, 20 bp, Artificial Sequence
  chemically synthesized
gataaacaggaaaaacttta

SEQ ID NO: 549141 - DNA, 20 bp, Artificial Sequence
  chemically synthesized
gcaggaagagtttactacac

SEQ ID NO: 549142 - DNA, 20 bp, Artificial Sequence
  chemically synthesized
ttgctatatagctgccttgc

SEQ ID NO: 549143 - DNA, 20 bp, Artificial Sequence
  chemically synthesized
ttgcttagaaacttcttcta

SEQ ID NO: 549144 - DNA, 20 bp, Artificial Sequence
  chemically synthesized
ttcctgagataaaggcagaa

SEQ ID NO: 549145 - DNA, 20 bp, Artificial Sequence
  chemically synthesized
tggaatttcctgagataaag

SEQ ID NO: 549146 - DNA, 20 bp, Artificial Sequence
  chemically synthesized
ggtgtactagttgactccat

SEQ ID NO: 549147 - DNA, 20 bp, Artificial Sequence
  chemically synthesized
tagaaaattatttctcctag

SEQ ID NO: 549148 - DNA, 20 bp, Artificial Sequence
  chemically synthesized
taatctaagatttctgtcta

SEQ ID NO: 549149 - DNA, 20 bp, Artificial Sequence
  chemically synthesized
attgtggttttgtacaaaat

SEQ ID NO: 549150 - DNA, 20 bp, Artificial Sequence
  chemically synthesized
atctccattataaattggca

SEQ ID NO: 549151 - DNA, 20 bp, Artificial Sequence
  chemically synthesized
aaagttggctttgccaaaat

SEQ ID NO: 549152 - DNA, 20 bp, Artificial Sequence
  chemically synthesized
tctccagagtaactctaagc

SEQ ID NO: 549153 - DNA, 20 bp, Artificial Sequence
  chemically synthesized
tgtttaatttatcaatgttc

SEQ ID NO: 549154 - DNA, 20 bp, Artificial Sequence
  chemically synthesized
tttggttgccatgaaccaaa

SEQ ID NO: 549155 - DNA, 20 bp, Artificial Sequence
  chemically synthesized
ggaataaaattataatcaac

SEQ ID NO: 549156 - DNA, 20 bp, Artificial Sequence
  chemically synthesized
attataatcaacctagaaaa

SEQ ID NO: 549157 - DNA, 20 bp, Artificial Sequence
  chemically synthesized
gtagatgggatctcactggt

SEQ ID NO: 549158 - DNA, 20 bp, Artificial Sequence
  chemically synthesized
aatctcctttacaacagcca

SEQ ID NO: 549159 - DNA, 20 bp, Artificial Sequence
  chemically synthesized
ctattgtgggtttgggtcct

SEQ ID NO: 549160 - DNA, 20 bp, Artificial Sequence
  chemically synthesized
cctttagaaatttctctgag

SEQ ID NO: 549161 - DNA, 20 bp, Artificial Sequence
  chemically synthesized
caacttaatgtttcttcctc

SEQ ID NO: 549162 - DNA, 20 bp, Artificial Sequence
  chemically synthesized
gatagtagtcctgtatttta

SEQ ID NO: 549163 - DNA, 20 bp, Artificial Sequence
  chemically synthesized
ggttggagagaagtggaaaa

SEQ ID NO: 549164 - DNA, 20 bp, Artificial Sequence
  chemically synthesized
aaactccgtctctactaaaa

SEQ ID NO: 549165 - DNA, 20 bp, Artificial Sequence
  chemically synthesized
aatggagtacagggtattag

SEQ ID NO: 549166 - DNA, 20 bp, Artificial Sequence
  chemically synthesized
aagacatgataaatttttaa

SEQ ID NO: 549167 - DNA, 20 bp, Artificial Sequence
  chemically synthesized
tattacttatagatggagtt

SEQ ID NO: 549168 - DNA, 20 bp, Artificial Sequence
  chemically synthesized
catgtactccaattaagaaa

SEQ ID NO: 549169 - DNA, 20 bp, Artificial Sequence
  chemically synthesized
gtccctccatgtactccaat

SEQ ID NO: 549170 - DNA, 20 bp, Artificial Sequence
  chemically synthesized
agtttgaataagcaaactct

SEQ ID NO: 549171 - DNA, 20 bp, Artificial Sequence
  chemically synthesized
tggacagcacaaggaaaatg

SEQ ID NO: 549172 - DNA, 20 bp, Artificial Sequence
  chemically synthesized
tccagtgctagagagacatt

SEQ ID NO: 549173 - DNA, 20 bp, Artificial Sequence
  chemically synthesized
tccagttaatgagcatctca

SEQ ID NO: 549174 - DNA, 20 bp, Artificial Sequence
  chemically synthesized
aacataatttagttatagta

SEQ ID NO: 549175 - DNA, 20 bp, Artificial Sequence
  chemically synthesized
gtatgtgggggtatgtcaaa

SEQ ID NO: 549176 - DNA, 20 bp, Artificial Sequence
  chemically synthesized
ctctgctggaaataaaaaat

SEQ ID NO: 549177 - DNA, 20 bp, Artificial Sequence
  chemically synthesized
ataaaaaataaagaaaaaaa

SEQ ID NO: 549178 - DNA, 20 bp, Artificial Sequence
  chemically synthesized
tgttggcacctgagaacatc

SEQ ID NO: 549179 - DNA, 20 bp, Artificial Sequence
  chemically synthesized
gcatttttcaaatctcatga

SEQ ID NO: 549180 - DNA, 20 bp, Artificial Sequence
  chemically synthesized
ctttaattagagaatgatcg

SEQ ID NO: 549181 - DNA, 20 bp, Artificial Sequence
  chemically synthesized
ttaccgttaatactttaatt

SEQ ID NO: 549182 - DNA, 20 bp, Artificial Sequence
  chemically synthesized
ttgctagggtgacatatatt

SEQ ID NO: 549183 - DNA, 20 bp, Artificial Sequence
  chemically synthesized
cttagtattataatgaggtg

SEQ ID NO: 549184 - DNA, 20 bp, Artificial Sequence
  chemically synthesized
tgtaacagcaaaaaaactac

SEQ ID NO: 549185 - DNA, 20 bp, Artificial Sequence
  chemically synthesized
taaatagactttttcatgag

SEQ ID NO: 549186 - DNA, 20 bp, Artificial Sequence
  chemically synthesized
ttcctaaatagactttttca

SEQ ID NO: 549187 - DNA, 20 bp, Artificial Sequence
  chemically synthesized
aaccagcagtcgaaagcagc

SEQ ID NO: 549188 - DNA, 20 bp, Artificial Sequence
  chemically synthesized
ttgcatctacccatcctgtc

SEQ ID NO: 549189 - DNA, 20 bp, Artificial Sequence
  chemically synthesized
aggatgggtagatgcaatcc

SEQ ID NO: 549190 - DNA, 20 bp, Artificial Sequence
  chemically synthesized
tattttcagttggaaacttt

SEQ ID NO: 549191 - DNA, 20 bp, Artificial Sequence
  chemically synthesized
actttggagaaattgtagtt

SEQ ID NO: 549192 - DNA, 20 bp, Artificial Sequence
  chemically synthesized
gcaccctcacaggaccagag

SEQ ID NO: 549193 - DNA, 20 bp, Artificial Sequence
  chemically synthesized
tagcccttattaccagagac

SEQ ID NO: 549194 - DNA, 20 bp, Artificial Sequence
  chemically synthesized
tatctcctagtgactcccct

SEQ ID NO: 549195 - DNA, 20 bp, Artificial Sequence
  chemically synthesized
ggaaagcaatgacaggataa

SEQ ID NO: 549196 - DNA, 20 bp, Artificial Sequence
  chemically synthesized
catgtacgtggagatcatca

SEQ ID NO: 549197 - DNA, 20 bp, Artificial Sequence
  chemically synthesized
atcaggcagaaaacaaaaga

SEQ ID NO: 549198 - DNA, 20 bp, Artificial Sequence
  chemically synthesized
tcgacatcaggcagaaaaca

SEQ ID NO: 549199 - DNA, 20 bp, Artificial Sequence
  chemically synthesized
agaaaccaaatcgacatcag

SEQ ID NO: 549200 - DNA, 20 bp, Artificial Sequence
  chemically synthesized
agtaggctcttcagttggat

SEQ ID NO: 549201 - DNA, 20 bp, Artificial Sequence
  chemically synthesized
acacacatataggaacaccg

SEQ ID NO: 549202 - DNA, 20 bp, Artificial Sequence
  chemically synthesized
actataatataatatcacag

SEQ ID NO: 549203 - DNA, 20 bp, Artificial Sequence
  chemically synthesized
gtagatacatatacagttaa

SEQ ID NO: 549204 - DNA, 20 bp, Artificial Sequence
  chemically synthesized
gaacatctagtgaaatccaa

SEQ ID NO: 549205 - DNA, 20 bp, Artificial Sequence
  chemically synthesized
gattttattcactatataat

SEQ ID NO: 549206 - DNA, 20 bp, Artificial Sequence
  chemically synthesized
ggtaaaggacatagctttaa

SEQ ID NO: 549207 - DNA, 20 bp, Artificial Sequence
  chemically synthesized
gcattccttccctgccagct

SEQ ID NO: 549208 - DNA, 20 bp, Artificial Sequence
  chemically synthesized
tataagagaggtgagacatg

SEQ ID NO: 549209 - DNA, 20 bp, Artificial Sequence
  chemically synthesized
ctacttgggaggctgaggca

SEQ ID NO: 549210 - DNA, 20 bp, Artificial Sequence
  chemically synthesized
tggaacataattgattccca

SEQ ID NO: 549211 - DNA, 20 bp, Artificial Sequence
  chemically synthesized
agtacactatgtaagtgcta

SEQ ID NO: 549212 - DNA, 20 bp, Artificial Sequence
  chemically synthesized
gtgtaattaactccatggat

SEQ ID NO: 549213 - DNA, 20 bp, Artificial Sequence
  chemically synthesized
gtgcagcttcaggtcttcca

SEQ ID NO: 549214 - DNA, 20 bp, Artificial Sequence
  chemically synthesized
caggtcttccactagaaata

SEQ ID NO: 549215 - DNA, 20 bp, Artificial Sequence
  chemically synthesized
tattcacttatcacccgttt

SEQ ID NO: 549216 - DNA, 20 bp, Artificial Sequence
  chemically synthesized
gatttctttatcaatataag

SEQ ID NO: 549217 - DNA, 20 bp, Artificial Sequence
  chemically synthesized
agtttctatcttatattgat

SEQ ID NO: 549218 - DNA, 20 bp, Artificial Sequence
  chemically synthesized
tcctaagctctacatctgta

SEQ ID NO: 549219 - DNA, 20 bp, Artificial Sequence
  chemically synthesized
tgcatgtgtgtatgcacaca

SEQ ID NO: 549220 - DNA, 20 bp, Artificial Sequence
  chemically synthesized
gcatacacacatgcacagct

SEQ ID NO: 549221 - DNA, 20 bp, Artificial Sequence
  chemically synthesized
tacatcttatgtctaaaatc

SEQ ID NO: 549222 - DNA, 20 bp, Artificial Sequence
  chemically synthesized
gcatgtgttatggtaggtat

SEQ ID NO: 549223 - DNA, 20 bp, Artificial Sequence
  chemically synthesized
ataacacatgcatacatctg

SEQ ID NO: 549224 - DNA, 20 bp, Artificial Sequence
  chemically synthesized
tcagaaaaaaaaaatcatat

SEQ ID NO: 549225 - DNA, 20 bp, Artificial Sequence
  chemically synthesized
actcaaatcagaagagtgta

SEQ ID NO: 549226 - DNA, 20 bp, Artificial Sequence
  chemically synthesized
acactcttctgatttgagtc

SEQ ID NO: 549227 - DNA, 20 bp, Artificial Sequence
  chemically synthesized
ccaagtagacagatgccaaa

SEQ ID NO: 549228 - DNA, 20 bp, Artificial Sequence
  chemically synthesized
gcttttcattgtgggggttg

SEQ ID NO: 549229 - DNA, 20 bp, Artificial Sequence
  chemically synthesized
ttgtgggggttgctagaaac

SEQ ID NO: 549230 - DNA, 20 bp, Artificial Sequence
  chemically synthesized
acatgcatctttcctctagc

SEQ ID NO: 549231 - DNA, 20 bp, Artificial Sequence
  chemically synthesized
gcatggagagaagtcgcaat

SEQ ID NO: 549232 - DNA, 20 bp, Artificial Sequence
  chemically synthesized
gcatcacactgctattttaa

SEQ ID NO: 549233 - DNA, 20 bp, Artificial Sequence
  chemically synthesized
aagtaactgatatctcctaa

SEQ ID NO: 549234 - DNA, 20 bp, Artificial Sequence
  chemically synthesized
gtttaggagatatcagttac

SEQ ID NO: 549235 - DNA, 20 bp, Artificial Sequence
  chemically synthesized
actataaataagtcttacat

SEQ ID NO: 549236 - DNA, 20 bp, Artificial Sequence
  chemically synthesized
attacctttttttggtgact

SEQ ID NO: 549237 - DNA, 20 bp, Artificial Sequence
  chemically synthesized
gactttagaaatttagggcg

SEQ ID NO: 549238 - DNA, 20 bp, Artificial Sequence
  chemically synthesized
ggcgtaagaaataacttttc

SEQ ID NO: 549239 - DNA, 20 bp, Artificial Sequence
  chemically synthesized
tctggatgctttgatcccat

SEQ ID NO: 549240 - DNA, 20 bp, Artificial Sequence
  chemically synthesized
tatctgtgaagcatacatca

SEQ ID NO: 549241 - DNA, 20 bp, Artificial Sequence
  chemically synthesized
aaagggatgagcacacttta

SEQ ID NO: 549242 - DNA, 20 bp, Artificial Sequence
  chemically synthesized
tcacagtagtactagacatt

SEQ ID NO: 549243 - DNA, 20 bp, Artificial Sequence
  chemically synthesized
ctagtacccacaatatagtt

SEQ ID NO: 549244 - DNA, 20 bp, Artificial Sequence
  chemically synthesized
cccacaatatagttctagaa

SEQ ID NO: 549245 - DNA, 20 bp, Artificial Sequence
  chemically synthesized
cttgcattcctgactagtag

SEQ ID NO: 549246 - DNA, 20 bp, Artificial Sequence
  chemically synthesized
actgccacattctaattaaa

SEQ ID NO: 549247 - DNA, 20 bp, Artificial Sequence
  chemically synthesized
gaaagaattttctcctttaa

SEQ ID NO: 549248 - DNA, 20 bp, Artificial Sequence
  chemically synthesized
ctaaatggaaaggagaaaag

SEQ ID NO: 549249 - DNA, 20 bp, Artificial Sequence
  chemically synthesized
catgctaaatggaaaggaga

SEQ ID NO: 549250 - DNA, 20 bp, Artificial Sequence
  chemically synthesized
catttcatgctaaatggaaa

SEQ ID NO: 549251 - DNA, 20 bp, Artificial Sequence
  chemically synthesized
cagcctctacaagtagcagg

SEQ ID NO: 549252 - DNA, 20 bp, Artificial Sequence
  chemically synthesized
taattcatctaagtttaatg

SEQ ID NO: 549253 - DNA, 20 bp, Artificial Sequence
  chemically synthesized
gatattttacatatgtaaaa

SEQ ID NO: 549254 - DNA, 20 bp, Artificial Sequence
  chemically synthesized
caattagaacttctccgata

SEQ ID NO: 549255 - DNA, 20 bp, Artificial Sequence
  chemically synthesized
gtggctgattcagattccag

SEQ ID NO: 549256 - DNA, 20 bp, Artificial Sequence
  chemically synthesized
gtgtgtggctgattcagatt

SEQ ID NO: 549257 - DNA, 20 bp, Artificial Sequence
  chemically synthesized
gctaatcttaatgaataaag

SEQ ID NO: 549258 - DNA, 20 bp, Artificial Sequence
  chemically synthesized
tcattaagattagcagcctt

SEQ ID NO: 549259 - DNA, 20 bp, Artificial Sequence
  chemically synthesized
attgaagacattaagacggt

SEQ ID NO: 549260 - DNA, 20 bp, Artificial Sequence
  chemically synthesized
tagtgtgactatgtatgcat

SEQ ID NO: 549261 - DNA, 20 bp, Artificial Sequence
  chemically synthesized
gtaataaaatcagtgtttca

SEQ ID NO: 549262 - DNA, 20 bp, Artificial Sequence
  chemically synthesized
acctgtaatgcccatctctt

SEQ ID NO: 549263 - DNA, 20 bp, Artificial Sequence
  chemically synthesized
tattttctttttgaattata

SEQ ID NO: 549264 - DNA, 20 bp, Artificial Sequence
  chemically synthesized
caaattctgctataattcaa

SEQ ID NO: 549265 - DNA, 20 bp, Artificial Sequence
  chemically synthesized
gaaaataatgaagggaaata

SEQ ID NO: 549266 - DNA, 20 bp, Artificial Sequence
  chemically synthesized
taatgaagggaaataaaaga

SEQ ID NO: 549267 - DNA, 20 bp, Artificial Sequence
  chemically synthesized
ttttagcttctttcaaagct

SEQ ID NO: 549268 - DNA, 20 bp, Artificial Sequence
  chemically synthesized
gttcagaacatatgtcaaac

SEQ ID NO: 549269 - DNA, 20 bp, Artificial Sequence
  chemically synthesized
ccaccgattcccagacaaaa

SEQ ID NO: 549270 - DNA, 20 bp, Artificial Sequence
  chemically synthesized
agttgctacatgactctgag

SEQ ID NO: 549271 - DNA, 20 bp, Artificial Sequence
  chemically synthesized
tgattagcatcaaagtaagt

SEQ ID NO: 549272 - DNA, 20 bp, Artificial Sequence
  chemically synthesized
tggtgttaacaatatgtact

SEQ ID NO: 549273 - DNA, 20 bp, Artificial Sequence
  chemically synthesized
gatatttgaccttcacacga

SEQ ID NO: 549274 - DNA, 20 bp, Artificial Sequence
  chemically synthesized
ccataaaaatagtttttaaa

SEQ ID NO: 549275 - DNA, 20 bp, Artificial Sequence
  chemically synthesized
ttatggaatatattaatttt

SEQ ID NO: 549276 - DNA, 20 bp, Artificial Sequence
  chemically synthesized
taataccaaaaatttaatgg

SEQ ID NO: 549277 - DNA, 20 bp, Artificial Sequence
  chemically synthesized
atatacaggcaaaaatttaa

SEQ ID NO: 549278 - DNA, 20 bp, Artificial Sequence
  chemically synthesized
ctaagaaaatggagtgacaa

SEQ ID NO: 549279 - DNA, 20 bp, Artificial Sequence
  chemically synthesized
ttagattctggccctacagc

SEQ ID NO: 549280 - DNA, 20 bp, Artificial Sequence
  chemically synthesized
ccattttcttagctgtaggg

SEQ ID NO: 549281 - DNA, 20 bp, Artificial Sequence
  chemically synthesized
taggctaaggaacagaatag

SEQ ID NO: 549282 - DNA, 20 bp, Artificial Sequence
  chemically synthesized
tgaaacctttaggctaagga

SEQ ID NO: 549283 - DNA, 20 bp, Artificial Sequence
  chemically synthesized
ttcataactctgtatgaaaa

SEQ ID NO: 549284 - DNA, 20 bp, Artificial Sequence
  chemically synthesized
caactgcaatgttactgcac

SEQ ID NO: 549285 - DNA, 20 bp, Artificial Sequence
  chemically synthesized
gataacggtgtcttcttctc

SEQ ID NO: 549286 - DNA, 20 bp, Artificial Sequence
  chemically synthesized
tgaatgaatcctggattaat

SEQ ID NO: 549287 - DNA, 20 bp, Artificial Sequence
  chemically synthesized
cttgaagggaaagagatttg

SEQ ID NO: 549288 - DNA, 20 bp, Artificial Sequence
  chemically synthesized
acttacagtgacagcatagc

SEQ ID NO: 549289 - DNA, 20 bp, Artificial Sequence
  chemically synthesized
tcactgtaagtagcattatt

SEQ ID NO: 549290 - DNA, 20 bp, Artificial Sequence
  chemically synthesized
acaaggtttgtgtcacacaa

SEQ ID NO: 549291 - DNA, 20 bp, Artificial Sequence
  chemically synthesized
ccacagcagtaatggtaaca

SEQ ID NO: 549292 - DNA, 20 bp, Artificial Sequence
  chemically synthesized
taatggtaacagaagaataa

SEQ ID NO: 549293 - DNA, 20 bp, Artificial Sequence
  chemically synthesized
tccatataccaagctttatc

SEQ ID NO: 549294 - DNA, 20 bp, Artificial Sequence
  chemically synthesized
atcactgtggtaagcagtct

SEQ ID NO: 549295 - DNA, 20 bp, Artificial Sequence
  chemically synthesized
ttttccaattataataataa

SEQ ID NO: 549296 - DNA, 20 bp, Artificial Sequence
  chemically synthesized
atatatataattttgaagta

SEQ ID NO: 549297 - DNA, 20 bp, Artificial Sequence
  chemically synthesized
gtaccttagaaataacctga

SEQ ID NO: 549298 - DNA, 20 bp, Artificial Sequence
  chemically synthesized
ttaacaaaaatcaaagtacc

SEQ ID NO: 549299 - DNA, 20 bp, Artificial Sequence
  chemically synthesized
tttaaattccacgtttttat

SEQ ID NO: 549300 - DNA, 20 bp, Artificial Sequence
  chemically synthesized
cgattgcacttttgaatata

SEQ ID NO: 549301 - DNA, 20 bp, Artificial Sequence
  chemically synthesized
atactttcatctcaatgtag

SEQ ID NO: 549302 - DNA, 20 bp, Artificial Sequence
  chemically synthesized
caaaatactttcatctcaat

SEQ ID NO: 549303 - DNA, 20 bp, Artificial Sequence
  chemically synthesized
agctaaaccagcattgtcca

SEQ ID NO: 549304 - DNA, 20 bp, Artificial Sequence
  chemically synthesized
aatttaaattagtgaaagta

SEQ ID NO: 549305 - DNA, 20 bp, Artificial Sequence
  chemically synthesized
ccaaattggacagcacaagt

SEQ ID NO: 549306 - DNA, 20 bp, Artificial Sequence
  chemically synthesized
ttcctcacattaaagtgaag

SEQ ID NO: 549307 - DNA, 20 bp, Artificial Sequence
  chemically synthesized
gggaaaaaatctccagtctt

SEQ ID NO: 549308 - DNA, 20 bp, Artificial Sequence
  chemically synthesized
attttttccccaaaaactaa

SEQ ID NO: 549309 - DNA, 20 bp, Artificial Sequence
  chemically synthesized
gttttgccaaagtttcaaga

SEQ ID NO: 549310 - DNA, 20 bp, Artificial Sequence
  chemically synthesized
taatagttttgccaaagttt

SEQ ID NO: 549311 - DNA, 20 bp, Artificial Sequence
  chemically synthesized
ttttgtcattcatttaaaat

SEQ ID NO: 549312 - DNA, 20 bp, Artificial Sequence
  chemically synthesized
aaatgcatacttaacaattt

SEQ ID NO: 549313 - DNA, 20 bp, Artificial Sequence
  chemically synthesized
aaagaataagccctcaccaa

SEQ ID NO: 549314 - DNA, 20 bp, Artificial Sequence
  chemically synthesized
tcaaatagatgttacttttt

SEQ ID NO: 549315 - DNA, 20 bp, Artificial Sequence
  chemically synthesized
tgatgtagatctgtgatctg

SEQ ID NO: 549316 - DNA, 20 bp, Artificial Sequence
  chemically synthesized
gcatgcatcttaatttatct

SEQ ID NO: 549317 - DNA, 20 bp, Artificial Sequence
  chemically synthesized
attaagatgcatgctttcat

SEQ ID NO: 549318 - DNA, 20 bp, Artificial Sequence
  chemically synthesized
ggcaagttatttagaaatat

SEQ ID NO: 549319 - DNA, 20 bp, Artificial Sequence
  chemically synthesized
acctggaaaaggcaagttat

SEQ ID NO: 549320 - DNA, 20 bp, Artificial Sequence
  chemically synthesized
cttttccaggttttctgagg

SEQ ID NO: 549321 - DNA, 20 bp, Artificial Sequence
  chemically synthesized
atcattcaggaattcttacc

SEQ ID NO: 549322 - DNA, 20 bp, Artificial Sequence
  chemically synthesized
ccaacagtctgttcttaaag

SEQ ID NO: 549323 - DNA, 20 bp, Artificial Sequence
  chemically synthesized
ctggccaacagtctgttctt

SEQ ID NO: 549324 - DNA, 20 bp, Artificial Sequence
  chemically synthesized
ttctccatattagctataaa

SEQ ID NO: 549325 - DNA, 20 bp, Artificial Sequence
  chemically synthesized
ttctgatttatagctaatat

SEQ ID NO: 549326 - DNA, 20 bp, Artificial Sequence
  chemically synthesized
atggagaaaagttaggaaat

SEQ ID NO: 549327 - DNA, 20 bp, Artificial Sequence
  chemically synthesized
ctacttgggaggctgtggca

SEQ ID NO: 549328 - DNA, 20 bp, Artificial Sequence
  chemically synthesized
aaaaggaaaaaaaaaaacaa

SEQ ID NO: 549329 - DNA, 20 bp, Artificial Sequence
  chemically synthesized
gaaaaaaaaaaacaaataga

SEQ ID NO: 549330 - DNA, 20 bp, Artificial Sequence
  chemically synthesized
cccaaaacacacagacacat

SEQ ID NO: 549331 - DNA, 20 bp, Artificial Sequence
  chemically synthesized
attgttcacaatccaattta

SEQ ID NO: 549332 - DNA, 20 bp, Artificial Sequence
  chemically synthesized
tggattgtgaacaatgtagg

SEQ ID NO: 549333 - DNA, 20 bp, Artificial Sequence
  chemically synthesized
tagctgagacccctatagca

SEQ ID NO: 549334 - DNA, 20 bp, Artificial Sequence
  chemically synthesized
tagcaaaagaaaggttaaca

SEQ ID NO: 549335 - DNA, 20 bp, Artificial Sequence
  chemically synthesized
ataccaggacacaggagcat

SEQ ID NO: 549336 - DNA, 20 bp, Artificial Sequence
  chemically synthesized
gcattcagaaatgaatacct

SEQ ID NO: 549337 - DNA, 20 bp, Artificial Sequence
  chemically synthesized
ttcctctgaagcagatcaga

SEQ ID NO: 549338 - DNA, 20 bp, Artificial Sequence
  chemically synthesized
ccattttcctctgaagcaga

SEQ ID NO: 549339 - DNA, 20 bp, Artificial Sequence
  chemically synthesized
atttcgggaaacagcggaag

SEQ ID NO: 549340 - DNA, 20 bp, Artificial Sequence
  chemically synthesized
gggaatcttgaaaatattaa

SEQ ID NO: 549341 - DNA, 20 bp, Artificial Sequence
  chemically synthesized
ttgttcaaggctaaacggag

SEQ ID NO: 549342 - DNA, 20 bp, Artificial Sequence
  chemically synthesized
taacttgttcaaggctaaac

SEQ ID NO: 549343 - DNA, 20 bp, Artificial Sequence
  chemically synthesized
acatatgacagaaccaaagc

SEQ ID NO: 549344 - DNA, 20 bp, Artificial Sequence
  chemically synthesized
tctatctcagtacgttgctt

SEQ ID NO: 549345 - DNA, 20 bp, Artificial Sequence
  chemically synthesized
cactaacttatgttttgtgg

SEQ ID NO: 549346 - DNA, 20 bp, Artificial Sequence
  chemically synthesized
ttttaatctatgaatatatt

SEQ ID NO: 549347 - DNA, 20 bp, Artificial Sequence
  chemically synthesized
acggcatttaagttaaaaag

SEQ ID NO: 549348 - DNA, 20 bp, Artificial Sequence
  chemically synthesized
ttatacggcatttaagttaa

SEQ ID NO: 549349 - DNA, 20 bp, Artificial Sequence
  chemically synthesized
cactcttttaaataatgtac

SEQ ID NO: 549350 - DNA, 20 bp, Artificial Sequence
  chemically synthesized
caagtacagagaaattcata

SEQ ID NO: 549351 - DNA, 20 bp, Artificial Sequence
  chemically synthesized
gacagtaacatttcaagtac

SEQ ID NO: 549352 - DNA, 20 bp, Artificial Sequence
  chemically synthesized
catgcctgtcaccttattca

SEQ ID NO: 549353 - DNA, 20 bp, Artificial Sequence
  chemically synthesized
tatgattatttcacacaata

SEQ ID NO: 549354 - DNA, 20 bp, Artificial Sequence
  chemically synthesized
tgcactgaccacataagaaa

SEQ ID NO: 549355 - DNA, 20 bp, Artificial Sequence
  chemically synthesized
aactgtttgcactgaccaca

SEQ ID NO: 549356 - DNA, 20 bp, Artificial Sequence
  chemically synthesized
actacgttttcattacttgg

SEQ ID NO: 549357 - DNA, 20 bp, Artificial Sequence
  chemically synthesized
gacatttttggataaaataa

SEQ ID NO: 549358 - DNA, 20 bp, Artificial Sequence
  chemically synthesized
tagtacacattgtaatattt

SEQ ID NO: 549359 - DNA, 20 bp, Artificial Sequence
  chemically synthesized
aaaaaatggaatttgatgcc

SEQ ID NO: 549360 - DNA, 20 bp, Artificial Sequence
  chemically synthesized
aaatatgtcacaaaatatgt

SEQ ID NO: 549361 - DNA, 20 bp, Artificial Sequence
  chemically synthesized
ctacctgggaggccgaggca

SEQ ID NO: 549362 - DNA, 20 bp, Artificial Sequence
  chemically synthesized
tgtgccctatgagcacaact

SEQ ID NO: 549363 - DNA, 20 bp, Artificial Sequence
  chemically synthesized
ttgtgctcatagggcacaat

SEQ ID NO: 549364 - DNA, 20 bp, Artificial Sequence
  chemically synthesized
gctcatagggcacaatggag

SEQ ID NO: 549365 - DNA, 20 bp, Artificial Sequence
  chemically synthesized
aaaacagattaatgaatcta

SEQ ID NO: 549366 - DNA, 20 bp, Artificial Sequence
  chemically synthesized
ctaaatctataaaaataaca

SEQ ID NO: 549367 - DNA, 20 bp, Artificial Sequence
  chemically synthesized
tgtggcaggggagtgaggag

SEQ ID NO: 549368 - DNA, 20 bp, Artificial Sequence
  chemically synthesized
gcgggaggctctcatgtacc

SEQ ID NO: 549369 - DNA, 20 bp, Artificial Sequence
  chemically synthesized
ctattcaggagaccgaggca

SEQ ID NO: 549370 - DNA, 20 bp, Artificial Sequence
  chemically synthesized
tggcatattttcatgaacat

SEQ ID NO: 549371 - DNA, 20 bp, Artificial Sequence
  chemically synthesized
tgtccatcctctcctctcta

SEQ ID NO: 549372 - DNA, 20 bp, Artificial Sequence
  chemically synthesized
gatggtagataaaggctagt

SEQ ID NO: 549373 - DNA, 20 bp, Artificial Sequence
  chemically synthesized
aaaacgtattgttctttgtc

SEQ ID NO: 549374 - DNA, 20 bp, Artificial Sequence
  chemically synthesized
tataacaaaagagatatcaa

SEQ ID NO: 549375 - DNA, 20 bp, Artificial Sequence
  chemically synthesized
tttgttataggagtcccagt

SEQ ID NO: 549376 - DNA, 20 bp, Artificial Sequence
  chemically synthesized
tattattttttttacttttt

SEQ ID NO: 549377 - DNA, 20 bp, Artificial Sequence
  chemically synthesized
aagaaacacattgcataggg

SEQ ID NO: 549378 - DNA, 20 bp, Artificial Sequence
  chemically synthesized
gctaaataaacatttaaata

SEQ ID NO: 549379 - DNA, 20 bp, Artificial Sequence
  chemically synthesized
tagctcaagtcaggtaaatt

SEQ ID NO: 549380 - DNA, 20 bp, Artificial Sequence
  chemically synthesized
acagaaaatgaataaaacaa

SEQ ID NO: 549381 - DNA, 20 bp, Artificial Sequence
  chemically synthesized
caataagttagttaaaatac

SEQ ID NO: 549382 - DNA, 20 bp, Artificial Sequence
  chemically synthesized
ctttacattgttcaactact

SEQ ID NO: 549383 - DNA, 20 bp, Artificial Sequence
  chemically synthesized
ctccagtagttgaacaatgt

SEQ ID NO: 549384 - DNA, 20 bp, Artificial Sequence
  chemically synthesized
ttagaataaagtcatacata

SEQ ID NO: 549385 - DNA, 20 bp, Artificial Sequence
  chemically synthesized
gtacccaagaaatatgaatg

SEQ ID NO: 549386 - DNA, 20 bp, Artificial Sequence
  chemically synthesized
cctaacatttagtaagtacc

SEQ ID NO: 549387 - DNA, 20 bp, Artificial Sequence
  chemically synthesized
aaggatttatacatgcagaa

SEQ ID NO: 549388 - DNA, 20 bp, Artificial Sequence
  chemically synthesized
atagcagtagggaaaatttt

SEQ ID NO: 549389 - DNA, 20 bp, Artificial Sequence
  chemically synthesized
aaaaatatctcatgatgttt

SEQ ID NO: 549390 - DNA, 20 bp, Artificial Sequence
  chemically synthesized
agcttccctgggccacactg

SEQ ID NO: 549391 - DNA, 20 bp, Artificial Sequence
  chemically synthesized
cttaaaagggagtcttcaaa

SEQ ID NO: 549392 - DNA, 20 bp, Artificial Sequence
  chemically synthesized
tttaaacattgatgaccaac

SEQ ID NO: 549393 - DNA, 20 bp, Artificial Sequence
  chemically synthesized
ctactcaggaggctgaggca

SEQ ID NO: 549394 - DNA, 20 bp, Artificial Sequence
  chemically synthesized
caaaaaaaaaaccgaaaaaa

SEQ ID NO: 549395 - DNA, 20 bp, Artificial Sequence
  chemically synthesized
gtcaaatgcacagaccagaa

SEQ ID NO: 549396 - DNA, 20 bp, Artificial Sequence
  chemically synthesized
gctcaagtcaaatgcacaga

SEQ ID NO: 549397 - DNA, 20 bp, Artificial Sequence
  chemically synthesized
gttacatgggagagtgatca

SEQ ID NO: 549398 - DNA, 20 bp, Artificial Sequence
  chemically synthesized
ctttcaatactccaaagcag

SEQ ID NO: 549399 - DNA, 20 bp, Artificial Sequence
  chemically synthesized
tgtaactatagaggaatctt

SEQ ID NO: 549400 - DNA, 20 bp, Artificial Sequence
  chemically synthesized
aaacttaattgcaaaggaaa

SEQ ID NO: 549401 - DNA, 20 bp, Artificial Sequence
  chemically synthesized
aaagtcccttcctgacttag

SEQ ID NO: 549402 - DNA, 20 bp, Artificial Sequence
  chemically synthesized
agcatagctatagaggggtc

SEQ ID NO: 549403 - DNA, 20 bp, Artificial Sequence
  chemically synthesized
tgatatagtgattacctgtt

SEQ ID NO: 549404 - DNA, 20 bp, Artificial Sequence
  chemically synthesized
tagcctcatttaaaaactga

SEQ ID NO: 549405 - DNA, 20 bp, Artificial Sequence
  chemically synthesized
tcagtttttaaatgaggcta

SEQ ID NO: 549406 - DNA, 20 bp, Artificial Sequence
  chemically synthesized
gaagtttggcagcacatcca

SEQ ID NO: 549407 - DNA, 20 bp, Artificial Sequence
  chemically synthesized
tgaatggtagatgtagtaga

SEQ ID NO: 549408 - DNA, 20 bp, Artificial Sequence
  chemically synthesized
agaaatgaatggtagatgta

SEQ ID NO: 549409 - DNA, 20 bp, Artificial Sequence
  chemically synthesized
aatatagaataattaatgat

SEQ ID NO: 549410 - DNA, 20 bp, Artificial Sequence
  chemically synthesized
gtaaatttataataaaaaat

SEQ ID NO: 549411 - DNA, 20 bp, Artificial Sequence
  chemically synthesized
gtggtcctcaatacaaccat

SEQ ID NO: 549412 - DNA, 20 bp, Artificial Sequence
  chemically synthesized
tgctgggtcctgcctattag

SEQ ID NO: 549413 - DNA, 20 bp, Artificial Sequence
  chemically synthesized
caccacagtccctgaaggcc

SEQ ID NO: 549414 - DNA, 20 bp, Artificial Sequence
  chemically synthesized
cagacaattttttcttttga

SEQ ID NO: 549415 - DNA, 20 bp, Artificial Sequence
  chemically synthesized
ccacccacattttctcttca

SEQ ID NO: 549416 - DNA, 20 bp, Artificial Sequence
  chemically synthesized
acacaaaacaaaaaagttgt

SEQ ID NO: 549417 - DNA, 20 bp, Artificial Sequence
  chemically synthesized
tagacactgtctaatgttac

SEQ ID NO: 549418 - DNA, 20 bp, Artificial Sequence
  chemically synthesized
actgtctaatgttacataga

SEQ ID NO: 549419 - DNA, 20 bp, Artificial Sequence
  chemically synthesized
agaaaagaattggttgaaga

SEQ ID NO: 549420 - DNA, 20 bp, Artificial Sequence
  chemically synthesized
gacaagaaagacagcgtcta

SEQ ID NO: 549421 - DNA, 20 bp, Artificial Sequence
  chemically synthesized
cgtctaacagaatataaaat

SEQ ID NO: 549422 - DNA, 20 bp, Artificial Sequence
  chemically synthesized
attcaaataattaatatgaa

SEQ ID NO: 549423 - DNA, 20 bp, Artificial Sequence
  chemically synthesized
actgaaactgtctagccaaa

SEQ ID NO: 549424 - DNA, 20 bp, Artificial Sequence
  chemically synthesized
atattagaaaaaaagactta

SEQ ID NO: 549425 - DNA, 20 bp, Artificial Sequence
  chemically synthesized
gagaaacaatgcttaaaata

SEQ ID NO: 549426 - DNA, 20 bp, Artificial Sequence
  chemically synthesized
tagattaagtaagataatga

SEQ ID NO: 549427 - DNA, 20 bp, Artificial Sequence
  chemically synthesized
ataaaagtagagattttaaa

SEQ ID NO: 549428 - DNA, 20 bp, Artificial Sequence
  chemically synthesized
taatactaacaaattttact

SEQ ID NO: 549429 - DNA, 20 bp, Artificial Sequence
  chemically synthesized
agcttactaattcattttta

SEQ ID NO: 549430 - DNA, 20 bp, Artificial Sequence
  chemically synthesized
cctacacttttaccttctga

SEQ ID NO: 549431 - DNA, 20 bp, Artificial Sequence
  chemically synthesized
aggttcttggtgtcttgatc

SEQ ID NO: 549432 - DNA, 20 bp, Artificial Sequence
  chemically synthesized
agcggctcaagtgcccagat

SEQ ID NO: 549433 - DNA, 20 bp, Artificial Sequence
  chemically synthesized
gccaatttcccatctgctac

SEQ ID NO: 549434 - DNA, 20 bp, Artificial Sequence
  chemically synthesized
aatatcacacatttgaggca

SEQ ID NO: 549435 - DNA, 20 bp, Artificial Sequence
  chemically synthesized
tttttttttttttttttttt

SEQ ID NO: 549436 - DNA, 20 bp, Artificial Sequence
  chemically synthesized
aaaaaaaaaaaaaaaaagaa

SEQ ID NO: 549437 - DNA, 20 bp, Artificial Sequence
  chemically synthesized
aaaaaaaaaagaagaagaaa

SEQ ID NO: 549438 - DNA, 20 bp, Artificial Sequence
  chemically synthesized
aaagaagaagaaaaaagaaa

SEQ ID NO: 549439 - DNA, 20 bp, Artificial Sequence
  chemically synthesized
gaagaaaaaagaaaaaagaa

SEQ ID NO: 549440 - DNA, 20 bp, Artificial Sequence
  chemically synthesized
actatgaggatgcaaaggca

SEQ ID NO: 549441 - DNA, 20 bp, Artificial Sequence
  chemically synthesized
ccattcctgaattactttac

SEQ ID NO: 549442 - DNA, 20 bp, Artificial Sequence
  chemically synthesized
cctgtacttccctttcaacc

SEQ ID NO: 549443 - DNA, 20 bp, Artificial Sequence
  chemically synthesized
caacaaatgttatcatttat

SEQ ID NO: 549444 - DNA, 20 bp, Artificial Sequence
  chemically synthesized
cttgtgtattttggggagtg

SEQ ID NO: 549445 - DNA, 20 bp, Artificial Sequence
  chemically synthesized
ttacctataacaaagtggaa

SEQ ID NO: 549446 - DNA, 20 bp, Artificial Sequence
  chemically synthesized
tattcatataatgtaactgt

SEQ ID NO: 549447 - DNA, 20 bp, Artificial Sequence
  chemically synthesized
tgaattaaaaaaacggacaa

SEQ ID NO: 549448 - DNA, 20 bp, Artificial Sequence
  chemically synthesized
atagctcgtttaatatatta

SEQ ID NO: 549449 - DNA, 20 bp, Artificial Sequence
  chemically synthesized
cttcattttaaatgcttctt

SEQ ID NO: 549450 - DNA, 20 bp, Artificial Sequence
  chemically synthesized
cttttaagaataaagtcata

SEQ ID NO: 549451 - DNA, 20 bp, Artificial Sequence
  chemically synthesized
tatgactttattcttaaaag

SEQ ID NO: 549452 - DNA, 20 bp, Artificial Sequence
  chemically synthesized
gtgatttagtttctctcttt

SEQ ID NO: 549453 - DNA, 20 bp, Artificial Sequence
  chemically synthesized
attttctctgatggtctctt

SEQ ID NO: 549454 - DNA, 20 bp, Artificial Sequence
  chemically synthesized
agattcttgaagagaccatc

SEQ ID NO: 549455 - DNA, 20 bp, Artificial Sequence
  chemically synthesized
tatattttcctgatactgaa

SEQ ID NO: 549456 - DNA, 20 bp, Artificial Sequence
  chemically synthesized
cctttccaataaaatgacag

SEQ ID NO: 549457 - DNA, 20 bp, Artificial Sequence
  chemically synthesized
aggtgtaactctacaagcat

SEQ ID NO: 549458 - DNA, 20 bp, Artificial Sequence
  chemically synthesized
caagcataaagaaaacagga

SEQ ID NO: 549459 - DNA, 20 bp, Artificial Sequence
  chemically synthesized
aaagaagtcacagctcatta

SEQ ID NO: 549460 - DNA, 20 bp, Artificial Sequence
  chemically synthesized
ctaccagaccttcccagctg

SEQ ID NO: 549461 - DNA, 20 bp, Artificial Sequence
  chemically synthesized
aaatacacaagtaaaaataa

SEQ ID NO: 549462 - DNA, 20 bp, Artificial Sequence
  chemically synthesized
tataatcaatttatccaact

SEQ ID NO: 549463 - DNA, 20 bp, Artificial Sequence
  chemically synthesized
acaacccaaaaggaaatcaa

SEQ ID NO: 549464 - DNA, 20 bp, Artificial Sequence
  chemically synthesized
aaaacaagaaacacatttaa

SEQ ID NO: 549465 - DNA, 20 bp, Artificial Sequence
  chemically synthesized
aatagcaacaacagcaaaaa

SEQ ID NO: 549466 - DNA, 20 bp, Artificial Sequence
  chemically synthesized
aatgggatcccaatttacag

SEQ ID NO: 549467 - DNA, 20 bp, Artificial Sequence
  chemically synthesized
tatggttttcctgtctttat

SEQ ID NO: 549468 - DNA, 20 bp, Artificial Sequence
  chemically synthesized
aagtttgtacattacttaaa

SEQ ID NO: 549469 - DNA, 20 bp, Artificial Sequence
  chemically synthesized
taaagtacatttaatataaa

SEQ ID NO: 549470 - DNA, 20 bp, Artificial Sequence
  chemically synthesized
ttgaggaatgacttcaataa

SEQ ID NO: 549471 - DNA, 20 bp, Artificial Sequence
  chemically synthesized
taagaacaaatgggaagaag

SEQ ID NO: 549472 - DNA, 20 bp, Artificial Sequence
  chemically synthesized
acatgagcaatgcaagcaga

SEQ ID NO: 549473 - DNA, 20 bp, Artificial Sequence
  chemically synthesized
gaaaattataattgaggtcc

SEQ ID NO: 549474 - DNA, 20 bp, Artificial Sequence
  chemically synthesized
gaggtccacagaaagttagg

SEQ ID NO: 549475 - DNA, 20 bp, Artificial Sequence
  chemically synthesized
attgacatcctatttagtgg

SEQ ID NO: 549476 - DNA, 20 bp, Artificial Sequence
  chemically synthesized
tgtcttgttcctgatcttcc

SEQ ID NO: 549477 - DNA, 20 bp, Artificial Sequence
  chemically synthesized
cctagctaatgcaataagac

SEQ ID NO: 549478 - DNA, 20 bp, Artificial Sequence
  chemically synthesized
atagacatatctattggaat

SEQ ID NO: 549479 - DNA, 20 bp, Artificial Sequence
  chemically synthesized
tagatggtcatgtcatctat

SEQ ID NO: 549480 - DNA, 20 bp, Artificial Sequence
  chemically synthesized
tagatgacatgaccatctat

SEQ ID NO: 549481 - DNA, 20 bp, Artificial Sequence
  chemically synthesized
ccatctatgtagaaaatctg

SEQ ID NO: 549482 - DNA, 20 bp, Artificial Sequence
  chemically synthesized
acttgttcactgctggtgtg

SEQ ID NO: 549483 - DNA, 20 bp, Artificial Sequence
  chemically synthesized
aaaaatatacaagatcttta

SEQ ID NO: 549484 - DNA, 20 bp, Artificial Sequence
  chemically synthesized
gaaatattcagtgttcatgg

SEQ ID NO: 549485 - DNA, 20 bp, Artificial Sequence
  chemically synthesized
ttttgcctttcatataaact

SEQ ID NO: 549486 - DNA, 20 bp, Artificial Sequence
  chemically synthesized
ttatatgaaaggcaaaagac

SEQ ID NO: 549487 - DNA, 20 bp, Artificial Sequence
  chemically synthesized
tagacaaatacatcaataga

SEQ ID NO: 549488 - DNA, 20 bp, Artificial Sequence
  chemically synthesized
ttgacaaacgagcaatggca

SEQ ID NO: 549489 - DNA, 20 bp, Artificial Sequence
  chemically synthesized
ctaaaatttatcctcaagaa

SEQ ID NO: 549490 - DNA, 20 bp, Artificial Sequence
  chemically synthesized
gggatggttatttactggga

SEQ ID NO: 549491 - DNA, 20 bp, Artificial Sequence
  chemically synthesized
aaaatggagattgagagagt

SEQ ID NO: 549492 - DNA, 20 bp, Artificial Sequence
  chemically synthesized
gttgatgtccatggatctgg

SEQ ID NO: 549493 - DNA, 20 bp, Artificial Sequence
  chemically synthesized
gtagccagaaataatgtaag

SEQ ID NO: 549494 - DNA, 20 bp, Artificial Sequence
  chemically synthesized
ttgagagttctgaacagtag

SEQ ID NO: 549495 - DNA, 20 bp, Artificial Sequence
  chemically synthesized
aagagagttctaggcagagg

SEQ ID NO: 549496 - DNA, 20 bp, Artificial Sequence
  chemically synthesized
aaaaataaagcaggataagg

SEQ ID NO: 549497 - DNA, 20 bp, Artificial Sequence
  chemically synthesized
tcagagagtgacaagtgcta

SEQ ID NO: 549498 - DNA, 20 bp, Artificial Sequence
  chemically synthesized
tttctctctgcaagtagaat

SEQ ID NO: 549499 - DNA, 20 bp, Artificial Sequence
  chemically synthesized
attctatattctacttgcag

SEQ ID NO: 549500 - DNA, 20 bp, Artificial Sequence
  chemically synthesized
tttgttttttctctctgcaa

SEQ ID NO: 549501 - DNA, 20 bp, Artificial Sequence
  chemically synthesized
gcacctgatatgaaatagat

SEQ ID NO: 549502 - DNA, 20 bp, Artificial Sequence
  chemically synthesized
atttaaggaaacatgctttg

SEQ ID NO: 549503 - DNA, 20 bp, Artificial Sequence
  chemically synthesized
ctgcagttattatgtcagtc

SEQ ID NO: 549504 - DNA, 20 bp, Artificial Sequence
  chemically synthesized
tgatttagtttacctggcct

SEQ ID NO: 549505 - DNA, 20 bp, Artificial Sequence
  chemically synthesized
caggccaggtaaactaaatc

SEQ ID NO: 549506 - DNA, 20 bp, Artificial Sequence
  chemically synthesized
ccaggtaaactaaatcaaag

SEQ ID NO: 549507 - DNA, 20 bp, Artificial Sequence
  chemically synthesized
caaactaagagaccttttca

SEQ ID NO: 549508 - DNA, 20 bp, Artificial Sequence
  chemically synthesized
gtgatcactttcggtcttgt

SEQ ID NO: 549509 - DNA, 20 bp, Artificial Sequence
  chemically synthesized
tctgccctccatgtgcatta

SEQ ID NO: 549510 - DNA, 20 bp, Artificial Sequence
  chemically synthesized
gtactgatataactttaact

SEQ ID NO: 549511 - DNA, 20 bp, Artificial Sequence
  chemically synthesized
gatcatggtagccagaacac

SEQ ID NO: 549512 - DNA, 20 bp, Artificial Sequence
  chemically synthesized
accaagattcctatggattc

SEQ ID NO: 549513 - DNA, 20 bp, Artificial Sequence
  chemically synthesized
aattggaaatgttttattct

SEQ ID NO: 549514 - DNA, 20 bp, Artificial Sequence
  chemically synthesized
gggctactatatatttttct

SEQ ID NO: 549515 - DNA, 20 bp, Artificial Sequence
  chemically synthesized
cccatgaaaggattgcagtg

SEQ ID NO: 549516 - DNA, 20 bp, Artificial Sequence
  chemically synthesized
aatataattgtgttcaaagg

SEQ ID NO: 549517 - DNA, 20 bp, Artificial Sequence
  chemically synthesized
aaatccaaaatgctcccaaa

SEQ ID NO: 549518 - DNA, 20 bp, Artificial Sequence
  chemically synthesized
caagtccaaaaatctgaaat

SEQ ID NO: 549519 - DNA, 20 bp, Artificial Sequence
  chemically synthesized
ttcgtccaaaacgtttgaaa

SEQ ID NO: 549520 - DNA, 20 bp, Artificial Sequence
  chemically synthesized
tattttcaaacgttttggac

SEQ ID NO: 549521 - DNA, 20 bp, Artificial Sequence
  chemically synthesized
gggaatgacctttttccagt

SEQ ID NO: 549522 - DNA, 20 bp, Artificial Sequence
  chemically synthesized
aatttaatcaggtctgtagt

SEQ ID NO: 549523 - DNA, 20 bp, Artificial Sequence
  chemically synthesized
acactttgagaaccacagtg

SEQ ID NO: 549524 - DNA, 20 bp, Artificial Sequence
  chemically synthesized
cagcatcacctgaggacctg

SEQ ID NO: 549525 - DNA, 20 bp, Artificial Sequence
  chemically synthesized
cccaccctagacctatggaa

SEQ ID NO: 549526 - DNA, 20 bp, Artificial Sequence
  chemically synthesized
gcaaaacgcattggaattac

SEQ ID NO: 549527 - DNA, 20 bp, Artificial Sequence
  chemically synthesized
taaaacaacaggcaatgata

SEQ ID NO: 549528 - DNA, 20 bp, Artificial Sequence
  chemically synthesized
cccacaacaatataattctt

SEQ ID NO: 549529 - DNA, 20 bp, Artificial Sequence
  chemically synthesized
gggcatataatgccattctt

SEQ ID NO: 549530 - DNA, 20 bp, Artificial Sequence
  chemically synthesized
gaaggcagaaggaattgcat

SEQ ID NO: 549531 - DNA, 20 bp, Artificial Sequence
  chemically synthesized
tgtctacgcagagacaattt

SEQ ID NO: 549532 - DNA, 20 bp, Artificial Sequence
  chemically synthesized
atgctgtgggaacatagaag

SEQ ID NO: 549533 - DNA, 20 bp, Artificial Sequence
  chemically synthesized
aaaacataatctttaatgca

SEQ ID NO: 549534 - DNA, 20 bp, Artificial Sequence
  chemically synthesized
ctctccaagagattatcatc

SEQ ID NO: 549535 - DNA, 20 bp, Artificial Sequence
  chemically synthesized
cattagtgaagcatttttat

SEQ ID NO: 549536 - DNA, 20 bp, Artificial Sequence
  chemically synthesized
tgtccatgtatgttgttttg

SEQ ID NO: 549537 - DNA, 20 bp, Artificial Sequence
  chemically synthesized
tggataggcccatcagccat

SEQ ID NO: 549538 - DNA, 20 bp, Artificial Sequence
  chemically synthesized
cttggcactgagaccactcc

SEQ ID NO: 549539 - DNA, 20 bp, Artificial Sequence
  chemically synthesized
taggttatcatgtcctgata

SEQ ID NO: 549540 - DNA, 20 bp, Artificial Sequence
  chemically synthesized
gataaacagcaacatatttc

SEQ ID NO: 549541 - DNA, 20 bp, Artificial Sequence
  chemically synthesized
gttaatagtaaagaagtttc

SEQ ID NO: 549542 - DNA, 20 bp, Artificial Sequence
  chemically synthesized
tgataggtctcactgttttc

SEQ ID NO: 549543 - DNA, 20 bp, Artificial Sequence
  chemically synthesized
caataatttgtttatgagta

SEQ ID NO: 549544 - DNA, 20 bp, Artificial Sequence
  chemically synthesized
tgtaaggtgatactcattta

SEQ ID NO: 549545 - DNA, 20 bp, Artificial Sequence
  chemically synthesized
tactgtactgaaagtgaaaa

SEQ ID NO: 549546 - DNA, 20 bp, Artificial Sequence
  chemically synthesized
caagttgaggggcatttgta

SEQ ID NO: 549547 - DNA, 20 bp, Artificial Sequence
  chemically synthesized
gcatttgtattagaaatcat

SEQ ID NO: 549548 - DNA, 20 bp, Artificial Sequence
  chemically synthesized
ttgtattagaaatcattcag

SEQ ID NO: 549549 - DNA, 20 bp, Artificial Sequence
  chemically synthesized
ggagagatgaagctaggacc

SEQ ID NO: 549550 - DNA, 20 bp, Artificial Sequence
  chemically synthesized
aacttacggaaatcctcgtt

SEQ ID NO: 549551 - DNA, 20 bp, Artificial Sequence
  chemically synthesized
ttgtttttatctgataatag

SEQ ID NO: 549552 - DNA, 20 bp, Artificial Sequence
  chemically synthesized
tgtgttagctatatacagat

SEQ ID NO: 549553 - DNA, 20 bp, Artificial Sequence
  chemically synthesized
cttctaagctcattttaaat

SEQ ID NO: 549554 - DNA, 20 bp, Artificial Sequence
  chemically synthesized
tagccaaaaccataatcaat

SEQ ID NO: 549555 - DNA, 20 bp, Artificial Sequence
  chemically synthesized
tccaaagggccaggtagagt

SEQ ID NO: 549556 - DNA, 20 bp, Artificial Sequence
  chemically synthesized
aatggaagtgggaagaagta

SEQ ID NO: 549557 - DNA, 20 bp, Artificial Sequence
  chemically synthesized
aaccccaacaatctgactgg

SEQ ID NO: 549558 - DNA, 20 bp, Artificial Sequence
  chemically synthesized
ggaacagattcaaccaatgt

SEQ ID NO: 549559 - DNA, 20 bp, Artificial Sequence
  chemically synthesized
ggcttattacaaactaggtt

SEQ ID NO: 549560 - DNA, 20 bp, Artificial Sequence
  chemically synthesized
agaccaggtaacatcatgga

SEQ ID NO: 549561 - DNA, 20 bp, Artificial Sequence
  chemically synthesized
aaataagaaggagagattca

SEQ ID NO: 549562 - DNA, 20 bp, Artificial Sequence
  chemically synthesized
tatgcatttttcaattcaat

SEQ ID NO: 549563 - DNA, 20 bp, Artificial Sequence
  chemically synthesized
tacaagtaggcaagaacata

SEQ ID NO: 549564 - DNA, 20 bp, Artificial Sequence
  chemically synthesized
atataagaaaaataagactc

SEQ ID NO: 549565 - DNA, 20 bp, Artificial Sequence
  chemically synthesized
ccatactttaatttatttga

SEQ ID NO: 549566 - DNA, 20 bp, Artificial Sequence
  chemically synthesized
tcacactactctctacctta

SEQ ID NO: 549567 - DNA, 20 bp, Artificial Sequence
  chemically synthesized
taacgtgctggtggggctgc

SEQ ID NO: 549568 - DNA, 20 bp, Artificial Sequence
  chemically synthesized
ccattactgggcatgtaccc

SEQ ID NO: 549569 - DNA, 20 bp, Artificial Sequence
  chemically synthesized
atatgtatgcgtgtcttata

SEQ ID NO: 549570 - DNA, 20 bp, Artificial Sequence
  chemically synthesized
ccgtcaatgatagactggac

SEQ ID NO: 549571 - DNA, 20 bp, Artificial Sequence
  chemically synthesized
catggaatactatgtagcca

SEQ ID NO: 549572 - DNA, 20 bp, Artificial Sequence
  chemically synthesized
gaatactatgtagccataag

SEQ ID NO: 549573 - DNA, 20 bp, Artificial Sequence
  chemically synthesized
cttagcaaaatgatgcagga

SEQ ID NO: 549574 - DNA, 20 bp, Artificial Sequence
  chemically synthesized
acttaaaataaaagttaaaa

SEQ ID NO: 549575 - DNA, 20 bp, Artificial Sequence
  chemically synthesized
ctggctaaaaggtaaattaa

SEQ ID NO: 549576 - DNA, 20 bp, Artificial Sequence
  chemically synthesized
taattctaaaagggtcctgt

SEQ ID NO: 549577 - DNA, 20 bp, Artificial Sequence
  chemically synthesized
gaattcttaacaggaccctt

SEQ ID NO: 549578 - DNA, 20 bp, Artificial Sequence
  chemically synthesized
aaaagctttattgggggtct

SEQ ID NO: 549579 - DNA, 20 bp, Artificial Sequence
  chemically synthesized
tcttctccctgtaaccactt

SEQ ID NO: 549580 - DNA, 20 bp, Artificial Sequence
  chemically synthesized
tgcatctcgttattgggcca

SEQ ID NO: 549581 - DNA, 20 bp, Artificial Sequence
  chemically synthesized
gcatgtttgacttaaatgaa

SEQ ID NO: 549582 - DNA, 20 bp, Artificial Sequence
  chemically synthesized
atgtgcttgatgtttgtgtt

SEQ ID NO: 549583 - DNA, 20 bp, Artificial Sequence
  chemically synthesized
catatcaataaattacatgg

SEQ ID NO: 549584 - DNA, 20 bp, Artificial Sequence
  chemically synthesized
ttactctgaattaatcttat

SEQ ID NO: 549585 - DNA, 20 bp, Artificial Sequence
  chemically synthesized
atgtgataaatcacattcta

SEQ ID NO: 549586 - DNA, 20 bp, Artificial Sequence
  chemically synthesized
tttgattccaaaaaattcta

SEQ ID NO: 549587 - DNA, 20 bp, Artificial Sequence
  chemically synthesized
gtgtctaatttaccacacag

SEQ ID NO: 549588 - DNA, 20 bp, Artificial Sequence
  chemically synthesized
agactttaaaaagagaaaaa

SEQ ID NO: 549589 - DNA, 20 bp, Artificial Sequence
  chemically synthesized
tgttgaagaagactttaaaa

SEQ ID NO: 549590 - DNA, 20 bp, Artificial Sequence
  chemically synthesized
ctatgctaactgtagaaaca

SEQ ID NO: 549591 - DNA, 20 bp, Artificial Sequence
  chemically synthesized
tcattaaatctatgctaact

SEQ ID NO: 549592 - DNA, 20 bp, Artificial Sequence
  chemically synthesized
gggaatctggtaacctttat

SEQ ID NO: 549593 - DNA, 20 bp, Artificial Sequence
  chemically synthesized
aatctgtgtatcctacaggg

SEQ ID NO: 549594 - DNA, 20 bp, Artificial Sequence
  chemically synthesized
gcatcgctgcatgcctttca

SEQ ID NO: 549595 - DNA, 20 bp, Artificial Sequence
  chemically synthesized
atcttcttcaaaagtgtcta

SEQ ID NO: 549596 - DNA, 20 bp, Artificial Sequence
  chemically synthesized
agtcacttagctaagttttg

SEQ ID NO: 549597 - DNA, 20 bp, Artificial Sequence
  chemically synthesized
cttagctaagttttgacaga

SEQ ID NO: 549598 - DNA, 20 bp, Artificial Sequence
  chemically synthesized
taagttttgacagaaaagaa

SEQ ID NO: 549599 - DNA, 20 bp, Artificial Sequence
  chemically synthesized
ttctaattttgagaacttgc

SEQ ID NO: 549600 - DNA, 20 bp, Artificial Sequence
  chemically synthesized
taaaagtttacaaagacaga

SEQ ID NO: 549601 - DNA, 20 bp, Artificial Sequence
  chemically synthesized
gcatatcctaggtgtcagga

SEQ ID NO: 549602 - DNA, 20 bp, Artificial Sequence
  chemically synthesized
cacctaggatatgcttgata

SEQ ID NO: 549603 - DNA, 20 bp, Artificial Sequence
  chemically synthesized
taatagaatttctgtacttg

SEQ ID NO: 549604 - DNA, 20 bp, Artificial Sequence
  chemically synthesized
gagtcaccattctttcaagt

SEQ ID NO: 549605 - DNA, 20 bp, Artificial Sequence
  chemically synthesized
tagaggatgcaaatattttg

SEQ ID NO: 549606 - DNA, 20 bp, Artificial Sequence
  chemically synthesized
agatatgggcattcataagg

SEQ ID NO: 549607 - DNA, 20 bp, Artificial Sequence
  chemically synthesized
atcacaactcacctgttaat

SEQ ID NO: 549608 - DNA, 20 bp, Artificial Sequence
  chemically synthesized
gtattgttacatttactatt

SEQ ID NO: 549609 - DNA, 20 bp, Artificial Sequence
  chemically synthesized
tacagacaaatcagaattgt

SEQ ID NO: 549610 - DNA, 20 bp, Artificial Sequence
  chemically synthesized
caaacaaacatacagacaaa

SEQ ID NO: 549611 - DNA, 20 bp, Artificial Sequence
  chemically synthesized
aaatatgtctcttgtctgct

SEQ ID NO: 549612 - DNA, 20 bp, Artificial Sequence
  chemically synthesized
taaccatcttataaatattc

SEQ ID NO: 549613 - DNA, 20 bp, Artificial Sequence
  chemically synthesized
aatataacaacacaaatata

SEQ ID NO: 549614 - DNA, 20 bp, Artificial Sequence
  chemically synthesized
aatttctattacagacgtaa

SEQ ID NO: 549615 - DNA, 20 bp, Artificial Sequence
  chemically synthesized
tgtttctgtttacgtctgta

SEQ ID NO: 549616 - DNA, 20 bp, Artificial Sequence
  chemically synthesized
attctttgtggtatttggta

SEQ ID NO: 549617 - DNA, 20 bp, Artificial Sequence
  chemically synthesized
attctactaccaaataccac

SEQ ID NO: 549618 - DNA, 20 bp, Artificial Sequence
  chemically synthesized
cttttctatgacaaacattt

SEQ ID NO: 549619 - DNA, 20 bp, Artificial Sequence
  chemically synthesized
atattctaaaaatgtttgtc

SEQ ID NO: 549620 - DNA, 20 bp, Artificial Sequence
  chemically synthesized
taagagtttcaggcatttta

SEQ ID NO: 549621 - DNA, 20 bp, Artificial Sequence
  chemically synthesized
gactctttaaatcattacaa

SEQ ID NO: 549622 - DNA, 20 bp, Artificial Sequence
  chemically synthesized
aaacattcatgatggaaaca

SEQ ID NO: 549623 - DNA, 20 bp, Artificial Sequence
  chemically synthesized
tttgattgatttacccaaat

SEQ ID NO: 549624 - DNA, 20 bp, Artificial Sequence
  chemically synthesized
cctaatactagttttcaagg

SEQ ID NO: 549625 - DNA, 20 bp, Artificial Sequence
  chemically synthesized
ctcttggtctttaccaagtt

SEQ ID NO: 549626 - DNA, 20 bp, Artificial Sequence
  chemically synthesized
tgcaatcttccatcaagtag

SEQ ID NO: 549627 - DNA, 20 bp, Artificial Sequence
  chemically synthesized
ctctgaggactcatgtcatt

SEQ ID NO: 549628 - DNA, 20 bp, Artificial Sequence
  chemically synthesized
aaagaaactcacattgtcaa

SEQ ID NO: 549629 - DNA, 20 bp, Artificial Sequence
  chemically synthesized
taaaataaaatgacactatg

SEQ ID NO: 549630 - DNA, 20 bp, Artificial Sequence
  chemically synthesized
agtaacaaaccattcttacc

SEQ ID NO: 549631 - DNA, 20 bp, Artificial Sequence
  chemically synthesized
aaatgcacaattttctaagg

SEQ ID NO: 549632 - DNA, 20 bp, Artificial Sequence
  chemically synthesized
gatgaaagagaagatgttca

SEQ ID NO: 549633 - DNA, 20 bp, Artificial Sequence
  chemically synthesized
ctacttgggaggctgaggca

SEQ ID NO: 549634 - DNA, 20 bp, Artificial Sequence
  chemically synthesized
tagatactccagtataatta

SEQ ID NO: 549635 - DNA, 20 bp, Artificial Sequence
  chemically synthesized
catgccatccacccaaccat

SEQ ID NO: 549636 - DNA, 20 bp, Artificial Sequence
  chemically synthesized
tgtctgaacaaattaagagc

SEQ ID NO: 549637 - DNA, 20 bp, Artificial Sequence
  chemically synthesized
gtcctagaaattttagagtt

SEQ ID NO: 549638 - DNA, 20 bp, Artificial Sequence
  chemically synthesized
cttttagatgaaaagaggtc

SEQ ID NO: 549639 - DNA, 20 bp, Artificial Sequence
  chemically synthesized
tgccttacatataaatactc

SEQ ID NO: 549640 - DNA, 20 bp, Artificial Sequence
  chemically synthesized
gatttatactaagggattag

SEQ ID NO: 549641 - DNA, 20 bp, Artificial Sequence
  chemically synthesized
attagtattaagtcaaatgg

SEQ ID NO: 549642 - DNA, 20 bp, Artificial Sequence
  chemically synthesized
aaaaaaatagtcttttgctt

SEQ ID NO: 549643 - DNA, 20 bp, Artificial Sequence
  chemically synthesized
gtagattcctttagtcaata

SEQ ID NO: 549644 - DNA, 20 bp, Artificial Sequence
  chemically synthesized
tttcaaactgtcatcttagg

SEQ ID NO: 549645 - DNA, 20 bp, Artificial Sequence
  chemically synthesized
gtgtgaataacataattaaa

SEQ ID NO: 549646 - DNA, 20 bp, Artificial Sequence
  chemically synthesized
aagtaaagatttgaaggagg

SEQ ID NO: 549647 - DNA, 20 bp, Artificial Sequence
  chemically synthesized
cccttccaaaataattttaa

SEQ ID NO: 549648 - DNA, 20 bp, Artificial Sequence
  chemically synthesized
atgtgcatgcgtactttctg

SEQ ID NO: 549649 - DNA, 20 bp, Artificial Sequence
  chemically synthesized
catttactctctgctttctg

SEQ ID NO: 549650 - DNA, 20 bp, Artificial Sequence
  chemically synthesized
ttttaagtgaaaaatacgta

SEQ ID NO: 549651 - DNA, 20 bp, Artificial Sequence
  chemically synthesized
ctccttgtccatataattga

SEQ ID NO: 549652 - DNA, 20 bp, Artificial Sequence
  chemically synthesized
tcacctctacgtctttaata

SEQ ID NO: 549653 - DNA, 20 bp, Artificial Sequence
  chemically synthesized
gtattaataattattatgtt

SEQ ID NO: 549654 - DNA, 20 bp, Artificial Sequence
  chemically synthesized
acttatgaatagtaaggcac

SEQ ID NO: 549655 - DNA, 20 bp, Artificial Sequence
  chemically synthesized
aggaataaagctattaagtg

SEQ ID NO: 549656 - DNA, 20 bp, Artificial Sequence
  chemically synthesized
gaaaagccatggactttgat

SEQ ID NO: 549657 - DNA, 20 bp, Artificial Sequence
  chemically synthesized
ataattgcataattaacaat

SEQ ID NO: 549658 - DNA, 20 bp, Artificial Sequence
  chemically synthesized
aaagaatattattttggtta

SEQ ID NO: 549659 - DNA, 20 bp, Artificial Sequence
  chemically synthesized
tgataaaataagtgaaaaag

SEQ ID NO: 549660 - DNA, 20 bp, Artificial Sequence
  chemically synthesized
tttatgataaaataagtgaa

SEQ ID NO: 549661 - DNA, 20 bp, Artificial Sequence
  chemically synthesized
cacacccacttctactggta

SEQ ID NO: 549662 - DNA, 20 bp, Artificial Sequence
  chemically synthesized
cccacttctactggtagcag

SEQ ID NO: 549663 - DNA, 20 bp, Artificial Sequence
  chemically synthesized
tttgacaaaaataggaacat

SEQ ID NO: 549664 - DNA, 20 bp, Artificial Sequence
  chemically synthesized
agcccatgacttgaaatgtt

SEQ ID NO: 549665 - DNA, 20 bp, Artificial Sequence
  chemically synthesized
gaaaataatgaaccttctct

SEQ ID NO: 549666 - DNA, 20 bp, Artificial Sequence
  chemically synthesized
tagagttcactgacctcctt

SEQ ID NO: 549667 - DNA, 20 bp, Artificial Sequence
  chemically synthesized
tcacacatatataaattgtt

SEQ ID NO: 549668 - DNA, 20 bp, Artificial Sequence
  chemically synthesized
ttactatagactatgtgact

SEQ ID NO: 549669 - DNA, 20 bp, Artificial Sequence
  chemically synthesized
gcaatcagcaacaaagcaaa

SEQ ID NO: 549670 - DNA, 20 bp, Artificial Sequence
  chemically synthesized
cagcaacaaagcaaatgaga

SEQ ID NO: 549671 - DNA, 20 bp, Artificial Sequence
  chemically synthesized
caaaccctaaaggaaatgaa

SEQ ID NO: 549672 - DNA, 20 bp, Artificial Sequence
  chemically synthesized
atattaataagagaggcaaa

SEQ ID NO: 549673 - DNA, 20 bp, Artificial Sequence
  chemically synthesized
tatatgggatttccccgtag

SEQ ID NO: 549674 - DNA, 20 bp, Artificial Sequence
  chemically synthesized
aatacaatttttatgtcatg

SEQ ID NO: 549675 - DNA, 20 bp, Artificial Sequence
  chemically synthesized
agtaacttgctcttgtgaat

SEQ ID NO: 549676 - DNA, 20 bp, Artificial Sequence
  chemically synthesized
cacaagagcaagttactgca

SEQ ID NO: 549677 - DNA, 20 bp, Artificial Sequence
  chemically synthesized
cagtggctttgcaggactta

SEQ ID NO: 549678 - DNA, 20 bp, Artificial Sequence
  chemically synthesized
tagcgtctttaactgtgaaa

SEQ ID NO: 549679 - DNA, 20 bp, Artificial Sequence
  chemically synthesized
aatttataaaataaatattt

SEQ ID NO: 549680 - DNA, 20 bp, Artificial Sequence
  chemically synthesized
aaagcgtattataggagcat

SEQ ID NO: 549681 - DNA, 20 bp, Artificial Sequence
  chemically synthesized
aatatgtagccacatgggtg

SEQ ID NO: 549682 - DNA, 20 bp, Artificial Sequence
  chemically synthesized
aggttgagttcagaaggatg

SEQ ID NO: 549683 - DNA, 20 bp, Artificial Sequence
  chemically synthesized
taaggacaaggacagagtga

SEQ ID NO: 549684 - DNA, 20 bp, Artificial Sequence
  chemically synthesized
acattttagagtgcaacaaa

SEQ ID NO: 549685 - DNA, 20 bp, Artificial Sequence
  chemically synthesized
ttttgttgcactctaaaatg

SEQ ID NO: 549686 - DNA, 20 bp, Artificial Sequence
  chemically synthesized
aaactgggggaaaaaaaaaa

SEQ ID NO: 549687 - DNA, 20 bp, Artificial Sequence
  chemically synthesized
gcaattaaccataatctgta

SEQ ID NO: 549688 - DNA, 20 bp, Artificial Sequence
  chemically synthesized
ctactgaggaggcagaggtg

SEQ ID NO: 549689 - DNA, 20 bp, Artificial Sequence
  chemically synthesized
ggggagaccccatctttaca

SEQ ID NO: 549690 - DNA, 20 bp, Artificial Sequence
  chemically synthesized
catgagccaccacattcggc

SEQ ID NO: 549691 - DNA, 20 bp, Artificial Sequence
  chemically synthesized
atcttcatccctaatgtgac

SEQ ID NO: 549692 - DNA, 20 bp, Artificial Sequence
  chemically synthesized
atattaaagttgataccagt

SEQ ID NO: 549693 - DNA, 20 bp, Artificial Sequence
  chemically synthesized
agtttagaaactcacgtagt

SEQ ID NO: 549694 - DNA, 20 bp, Artificial Sequence
  chemically synthesized
gggatgagttaatttcactt

SEQ ID NO: 549695 - DNA, 20 bp, Artificial Sequence
  chemically synthesized
aaaaaaaaaaaaaaaaaaaa

SEQ ID NO: 549696 - DNA, 20 bp, Artificial Sequence
  chemically synthesized
aaaaaaaaaaaaaaaaaaag

SEQ ID NO: 549697 - DNA, 20 bp, Artificial Sequence
  chemically synthesized
aaaaaaaaaaaaaagaaaga

SEQ ID NO: 549698 - DNA, 20 bp, Artificial Sequence
  chemically synthesized
ttctcatgtttgatggaagc

SEQ ID NO: 549699 - DNA, 20 bp, Artificial Sequence
  chemically synthesized
ttctctgcttccatcaaaca

SEQ ID NO: 549700 - DNA, 20 bp, Artificial Sequence
  chemically synthesized
gaaacaaatttaggacatat

SEQ ID NO: 549701 - DNA, 20 bp, Artificial Sequence
  chemically synthesized
aagactattactcagattta

SEQ ID NO: 549702 - DNA, 20 bp, Artificial Sequence
  chemically synthesized
cactaacgtcacctcaggcg

SEQ ID NO: 549703 - DNA, 20 bp, Artificial Sequence
  chemically synthesized
attaaacttctgcacgaaga

SEQ ID NO: 549704 - DNA, 20 bp, Artificial Sequence
  chemically synthesized
ctgtaaagcgaatgggaaat

SEQ ID NO: 549705 - DNA, 20 bp, Artificial Sequence
  chemically synthesized
gacagtcactctcttggaaa

SEQ ID NO: 549706 - DNA, 20 bp, Artificial Sequence
  chemically synthesized
ctgtaatcccagcacttagc

SEQ ID NO: 549707 - DNA, 20 bp, Artificial Sequence
  chemically synthesized
atagaattaatatctgcaga

SEQ ID NO: 549708 - DNA, 20 bp, Artificial Sequence
  chemically synthesized
attctgcctaccagagttta

SEQ ID NO: 549709 - DNA, 20 bp, Artificial Sequence
  chemically synthesized
attctattaaactctggtag

SEQ ID NO: 549710 - DNA, 20 bp, Artificial Sequence
  chemically synthesized
gcaaagtggaattattgcag

SEQ ID NO: 549711 - DNA, 20 bp, Artificial Sequence
  chemically synthesized
ccctatcaaaagttagctaa

SEQ ID NO: 549712 - DNA, 20 bp, Artificial Sequence
  chemically synthesized
ggggaaatgttggcataagg

SEQ ID NO: 549713 - DNA, 20 bp, Artificial Sequence
  chemically synthesized
atgttggcataaggggagaa

SEQ ID NO: 549714 - DNA, 20 bp, Artificial Sequence
  chemically synthesized
ccaaataacgtgggaattct

SEQ ID NO: 549715 - DNA, 20 bp, Artificial Sequence
  chemically synthesized
ccttgccttttccattttct

SEQ ID NO: 549716 - DNA, 20 bp, Artificial Sequence
  chemically synthesized
gtacttttggatgctccagg

SEQ ID NO: 549717 - DNA, 20 bp, Artificial Sequence
  chemically synthesized
ttctcagacagttctgcagg

SEQ ID NO: 549718 - DNA, 20 bp, Artificial Sequence
  chemically synthesized
ttctgacctgcagaactgtc

SEQ ID NO: 549719 - DNA, 20 bp, Artificial Sequence
  chemically synthesized
gtactgacacctactaggtg

SEQ ID NO: 549720 - DNA, 20 bp, Artificial Sequence
  chemically synthesized
aggtggtagaaaaacaactg

SEQ ID NO: 549721 - DNA, 20 bp, Artificial Sequence
  chemically synthesized
atacagataagttgcctgat

SEQ ID NO: 549722 - DNA, 20 bp, Artificial Sequence
  chemically synthesized
taagagcagagagacaagtg

SEQ ID NO: 549723 - DNA, 20 bp, Artificial Sequence
  chemically synthesized
aagtggtagaaaagagaact

SEQ ID NO: 549724 - DNA, 20 bp, Artificial Sequence
  chemically synthesized
ggtgaaagtgtcaggatgtg

SEQ ID NO: 549725 - DNA, 20 bp, Artificial Sequence
  chemically synthesized
taaaaatggcagagatgacc

SEQ ID NO: 549726 - DNA, 20 bp, Artificial Sequence
  chemically synthesized
gagggcagttcgaaatcaaa

SEQ ID NO: 549727 - DNA, 20 bp, Artificial Sequence
  chemically synthesized
agcaatgtcaggcttggctt

SEQ ID NO: 549728 - DNA, 20 bp, Artificial Sequence
  chemically synthesized
agaaataaatttcacagtgt

SEQ ID NO: 549729 - DNA, 20 bp, Artificial Sequence
  chemically synthesized
ataaagctaaattccctgat

SEQ ID NO: 549730 - DNA, 20 bp, Artificial Sequence
  chemically synthesized
gaggttacaggctagattat

SEQ ID NO: 549731 - DNA, 20 bp, Artificial Sequence
  chemically synthesized
aaagcatatgatttatttat

SEQ ID NO: 549732 - DNA, 20 bp, Artificial Sequence
  chemically synthesized
gcatgaacaaaggactaaag

SEQ ID NO: 549733 - DNA, 20 bp, Artificial Sequence
  chemically synthesized
gtcctttgttcatgcactcc

SEQ ID NO: 549734 - DNA, 20 bp, Artificial Sequence
  chemically synthesized
tgtgtaacacatatgcataa

SEQ ID NO: 549735 - DNA, 20 bp, Artificial Sequence
  chemically synthesized
acacacatacacacacacaa

SEQ ID NO: 549736 - DNA, 20 bp, Artificial Sequence
  chemically synthesized
aatgtgaccacacttagatg

SEQ ID NO: 549737 - DNA, 20 bp, Artificial Sequence
  chemically synthesized
accaaacatggtatactgaa

SEQ ID NO: 549738 - DNA, 20 bp, Artificial Sequence
  chemically synthesized
ctacaatgaataaaaaatta

SEQ ID NO: 549739 - DNA, 20 bp, Artificial Sequence
  chemically synthesized
aatgaataaaaaattaagag

SEQ ID NO: 549740 - DNA, 20 bp, Artificial Sequence
  chemically synthesized
aaataaaggcagattgtttg

SEQ ID NO: 549741 - DNA, 20 bp, Artificial Sequence
  chemically synthesized
ttacagagtgaaattcacct

SEQ ID NO: 549742 - DNA, 20 bp, Artificial Sequence
  chemically synthesized
aaaaaagcaattgacctacc

SEQ ID NO: 549743 - DNA, 20 bp, Artificial Sequence
  chemically synthesized
attgtagggagttgttggac

SEQ ID NO: 549744 - DNA, 20 bp, Artificial Sequence
  chemically synthesized
ccattccctgccacttaatc

SEQ ID NO: 549745 - DNA, 20 bp, Artificial Sequence
  chemically synthesized
ggaaacatagcacaagtatt

SEQ ID NO: 549746 - DNA, 20 bp, Artificial Sequence
  chemically synthesized
tattgtagaaatatacttgt

SEQ ID NO: 549747 - DNA, 20 bp, Artificial Sequence
  chemically synthesized
gacataatgacaatgagatt

SEQ ID NO: 549748 - DNA, 20 bp, Artificial Sequence
  chemically synthesized
tgaagaaatgtattagagtg

SEQ ID NO: 549749 - DNA, 20 bp, Artificial Sequence
  chemically synthesized
cacatgcaattttaagagga

SEQ ID NO: 549750 - DNA, 20 bp, Artificial Sequence
  chemically synthesized
catgtatgacatattaatgc

SEQ ID NO: 549751 - DNA, 20 bp, Artificial Sequence
  chemically synthesized
tgacatattaatgctgagaa

SEQ ID NO: 549752 - DNA, 20 bp, Artificial Sequence
  chemically synthesized
attatacctcctcatgctca

SEQ ID NO: 549753 - DNA, 20 bp, Artificial Sequence
  chemically synthesized
tttataaattataatgcacc

SEQ ID NO: 549754 - DNA, 20 bp, Artificial Sequence
  chemically synthesized
atgtgctttggtagtgttca

SEQ ID NO: 549755 - DNA, 20 bp, Artificial Sequence
  chemically synthesized
ataaccatagactaattatg

SEQ ID NO: 549756 - DNA, 20 bp, Artificial Sequence
  chemically synthesized
tatttttttaaattttcagg

SEQ ID NO: 549757 - DNA, 20 bp, Artificial Sequence
  chemically synthesized
catactgttaatgagatgct

SEQ ID NO: 549758 - DNA, 20 bp, Artificial Sequence
  chemically synthesized
gtgaggaatcttcagcatcc

SEQ ID NO: 549759 - DNA, 20 bp, Artificial Sequence
  chemically synthesized
actgaagaaagccttaacac

SEQ ID NO: 549760 - DNA, 20 bp, Artificial Sequence
  chemically synthesized
ttaccaagccctcctaaact

SEQ ID NO: 549761 - DNA, 20 bp, Artificial Sequence
  chemically synthesized
tgttgcatgggatatgtaat

SEQ ID NO: 549762 - DNA, 20 bp, Artificial Sequence
  chemically synthesized
taactagtgcatgatcaagc

SEQ ID NO: 549763 - DNA, 20 bp, Artificial Sequence
  chemically synthesized
catgcactagttatgcagtg

SEQ ID NO: 549764 - DNA, 20 bp, Artificial Sequence
  chemically synthesized
ctacttgggaggctgacgca

SEQ ID NO: 549765 - DNA, 20 bp, Artificial Sequence
  chemically synthesized
aacaaacaaacaaacaaaac

SEQ ID NO: 549766 - DNA, 20 bp, Artificial Sequence
  chemically synthesized
aacaaacaaacaaaacaaag

SEQ ID NO: 549767 - DNA, 20 bp, Artificial Sequence
  chemically synthesized
caagtggaaaggaggaagaa

SEQ ID NO: 549768 - DNA, 20 bp, Artificial Sequence
  chemically synthesized
ccatggcaagtggaaaggag

SEQ ID NO: 549769 - DNA, 20 bp, Artificial Sequence
  chemically synthesized
atgattcttaagcccctagc

SEQ ID NO: 549770 - DNA, 20 bp, Artificial Sequence
  chemically synthesized
tcaattctgagctaggggct

SEQ ID NO: 549771 - DNA, 20 bp, Artificial Sequence
  chemically synthesized
ctgacaaagggaggaaggac

SEQ ID NO: 549772 - DNA, 20 bp, Artificial Sequence
  chemically synthesized
aattgaacctgacatgtgaa

SEQ ID NO: 549773 - DNA, 20 bp, Artificial Sequence
  chemically synthesized
gtaaatagtaaatgtggccc

SEQ ID NO: 549774 - DNA, 20 bp, Artificial Sequence
  chemically synthesized
cattaaatttaaaataagct

SEQ ID NO: 549775 - DNA, 20 bp, Artificial Sequence
  chemically synthesized
gctttccaaaaattgccctt

SEQ ID NO: 549776 - DNA, 20 bp, Artificial Sequence
  chemically synthesized
aattttgaatggtatggtaa

SEQ ID NO: 549777 - DNA, 20 bp, Artificial Sequence
  chemically synthesized
atggccaagtattagcacag

SEQ ID NO: 549778 - DNA, 20 bp, Artificial Sequence
  chemically synthesized
tagcacagacagaaatcaat

SEQ ID NO: 549779 - DNA, 20 bp, Artificial Sequence
  chemically synthesized
aaatactgaaagcacttaaa

SEQ ID NO: 549780 - DNA, 20 bp, Artificial Sequence
  chemically synthesized
agaacattagagtcagtctt

SEQ ID NO: 549781 - DNA, 20 bp, Artificial Sequence
  chemically synthesized
agggtttggaaaattattac

SEQ ID NO: 549782 - DNA, 20 bp, Artificial Sequence
  chemically synthesized
aaattattactgagaataca

SEQ ID NO: 549783 - DNA, 20 bp, Artificial Sequence
  chemically synthesized
agaaaagagaagtctttcat

SEQ ID NO: 549784 - DNA, 20 bp, Artificial Sequence
  chemically synthesized
atccagtggcataataaacc

SEQ ID NO: 549785 - DNA, 20 bp, Artificial Sequence
  chemically synthesized
gtcctgtcaccgatcttagt

SEQ ID NO: 549786 - DNA, 20 bp, Artificial Sequence
  chemically synthesized
ctacttgggaggctgagaca

SEQ ID NO: 549787 - DNA, 20 bp, Artificial Sequence
  chemically synthesized
aacttgtagaggaaaatata

SEQ ID NO: 549788 - DNA, 20 bp, Artificial Sequence
  chemically synthesized
ttacaaaagatttagacatt

SEQ ID NO: 549789 - DNA, 20 bp, Artificial Sequence
  chemically synthesized
ttaaaatgctgtttttcgaa

SEQ ID NO: 549790 - DNA, 20 bp, Artificial Sequence
  chemically synthesized
cttaaagtcttttgtaatga

SEQ ID NO: 549791 - DNA, 20 bp, Artificial Sequence
  chemically synthesized
tcatgaattttatattcata

SEQ ID NO: 549792 - DNA, 20 bp, Artificial Sequence
  chemically synthesized
aacattaaaatgattgtaaa

SEQ ID NO: 549793 - DNA, 20 bp, Artificial Sequence
  chemically synthesized
atgattgtaaagtagaatct

SEQ ID NO: 549794 - DNA, 20 bp, Artificial Sequence
  chemically synthesized
ggaatgatcaaatctttaaa

SEQ ID NO: 549795 - DNA, 20 bp, Artificial Sequence
  chemically synthesized
gtgcctctgtttcctcacct

SEQ ID NO: 549796 - DNA, 20 bp, Artificial Sequence
  chemically synthesized
aatttcctcaactttaaaac

SEQ ID NO: 549797 - DNA, 20 bp, Artificial Sequence
  chemically synthesized
ttttagaactggcggaacac

SEQ ID NO: 549798 - DNA, 20 bp, Artificial Sequence
  chemically synthesized
acaaataaacaaacaaaaac

SEQ ID NO: 549799 - DNA, 20 bp, Artificial Sequence
  chemically synthesized
aggactgtaaactgcatcct

SEQ ID NO: 549800 - DNA, 20 bp, Artificial Sequence
  chemically synthesized
gaaaagttatgtaaataaat

SEQ ID NO: 549801 - DNA, 20 bp, Artificial Sequence
  chemically synthesized
acagatgagaaaactaaagg

SEQ ID NO: 549802 - DNA, 20 bp, Artificial Sequence
  chemically synthesized
tttagtacctattttacaga

SEQ ID NO: 549803 - DNA, 20 bp, Artificial Sequence
  chemically synthesized
agccattatctttatatggc

SEQ ID NO: 549804 - DNA, 20 bp, Artificial Sequence
  chemically synthesized
tttcaaaccatggagccctt

SEQ ID NO: 549805 - DNA, 20 bp, Artificial Sequence
  chemically synthesized
atcattaatatccataagag

SEQ ID NO: 549806 - DNA, 20 bp, Artificial Sequence
  chemically synthesized
ttgctgttaatgccactgtt

SEQ ID NO: 549807 - DNA, 20 bp, Artificial Sequence
  chemically synthesized
catgtaaaaaaaagcaaagt

SEQ ID NO: 549808 - DNA, 20 bp, Artificial Sequence
  chemically synthesized
tactgtgtgtatatccataa

SEQ ID NO: 549809 - DNA, 20 bp, Artificial Sequence
  chemically synthesized
atatacactgcagctatgcc

SEQ ID NO: 549810 - DNA, 20 bp, Artificial Sequence
  chemically synthesized
agtaatatctaagagaatat

SEQ ID NO: 549811 - DNA, 20 bp, Artificial Sequence
  chemically synthesized
tggctgaagagtaatatcta

SEQ ID NO: 549812 - DNA, 20 bp, Artificial Sequence
  chemically synthesized
catctgtgtatatggaagca

SEQ ID NO: 549813 - DNA, 20 bp, Artificial Sequence
  chemically synthesized
cattgcaatataatgggtga

SEQ ID NO: 549814 - DNA, 20 bp, Artificial Sequence
  chemically synthesized
agaaaaaggctgggctcttt

SEQ ID NO: 549815 - DNA, 20 bp, Artificial Sequence
  chemically synthesized
acttactgtcaaagtacatt

SEQ ID NO: 549816 - DNA, 20 bp, Artificial Sequence
  chemically synthesized
tgtaatacagtaattggaac

SEQ ID NO: 549817 - DNA, 20 bp, Artificial Sequence
  chemically synthesized
tgacatgggctgctctaact

SEQ ID NO: 549818 - DNA, 20 bp, Artificial Sequence
  chemically synthesized
ataaaaaacatcatgccata

SEQ ID NO: 549819 - DNA, 20 bp, Artificial Sequence
  chemically synthesized
tgtgaattcactgtatctat

SEQ ID NO: 549820 - DNA, 20 bp, Artificial Sequence
  chemically synthesized
aagcgtggtatgaaagtgtc

SEQ ID NO: 549821 - DNA, 20 bp, Artificial Sequence
  chemically synthesized
taaactctcagcagagatca

SEQ ID NO: 549822 - DNA, 20 bp, Artificial Sequence
  chemically synthesized
ttggcaaagtaatccaaaaa

SEQ ID NO: 549823 - DNA, 20 bp, Artificial Sequence
  chemically synthesized
aggaaatcaaaattcaagat

SEQ ID NO: 549824 - DNA, 20 bp, Artificial Sequence
  chemically synthesized
ttatgtttattagccaaatt

SEQ ID NO: 549825 - DNA, 20 bp, Artificial Sequence
  chemically synthesized
ttagccaaattttagaaact

SEQ ID NO: 549826 - DNA, 20 bp, Artificial Sequence
  chemically synthesized
gaaaacctgttattttaaat

SEQ ID NO: 549827 - DNA, 20 bp, Artificial Sequence
  chemically synthesized
ccaaatgtgggattattacc

SEQ ID NO: 549828 - DNA, 20 bp, Artificial Sequence
  chemically synthesized
acctacattgaatacattaa

SEQ ID NO: 549829 - DNA, 20 bp, Artificial Sequence
  chemically synthesized
acatacatacgtatgtattt

SEQ ID NO: 549830 - DNA, 20 bp, Artificial Sequence
  chemically synthesized
aaagaatttagacttgggtc

SEQ ID NO: 549831 - DNA, 20 bp, Artificial Sequence
  chemically synthesized
agggcaaattgcagtacacc

SEQ ID NO: 549832 - DNA, 20 bp, Artificial Sequence
  chemically synthesized
caatttgccctaacctgcct

SEQ ID NO: 549833 - DNA, 20 bp, Artificial Sequence
  chemically synthesized
cttgagaaacattttaatcc

SEQ ID NO: 549834 - DNA, 20 bp, Artificial Sequence
  chemically synthesized
aagtagtttactgcttaaca

SEQ ID NO: 549835 - DNA, 20 bp, Artificial Sequence
  chemically synthesized
tctatatctgcaaactcaag

SEQ ID NO: 549836 - DNA, 20 bp, Artificial Sequence
  chemically synthesized
agataaataccaattaagta

SEQ ID NO: 549837 - DNA, 20 bp, Artificial Sequence
  chemically synthesized
tctgagtctaatgaaactaa

SEQ ID NO: 549838 - DNA, 20 bp, Artificial Sequence
  chemically synthesized
ttcattagactcagacttaa

SEQ ID NO: 549839 - DNA, 20 bp, Artificial Sequence
  chemically synthesized
cagtattatttaaatttcag

SEQ ID NO: 549840 - DNA, 20 bp, Artificial Sequence
  chemically synthesized
tgtctgtgatggaaactggt

SEQ ID NO: 549841 - DNA, 20 bp, Artificial Sequence
  chemically synthesized
ttttatagaagttactaatt

SEQ ID NO: 549842 - DNA, 20 bp, Artificial Sequence
  chemically synthesized
agctgtaaccaaaaagtaac

SEQ ID NO: 549843 - DNA, 20 bp, Artificial Sequence
  chemically synthesized
tataaggagatgaaagggat

SEQ ID NO: 549844 - DNA, 20 bp, Artificial Sequence
  chemically synthesized
aaataagtttaagtcagtgc

SEQ ID NO: 549845 - DNA, 20 bp, Artificial Sequence
  chemically synthesized
aggattaaacttgttaatta

SEQ ID NO: 549846 - DNA, 20 bp, Artificial Sequence
  chemically synthesized
tgagctgggagtcaaggtga

SEQ ID NO: 549847 - DNA, 20 bp, Artificial Sequence
  chemically synthesized
ctgaaaagttttgtaaaact

SEQ ID NO: 549848 - DNA, 20 bp, Artificial Sequence
  chemically synthesized
ctactcgcaagtctcaggca

SEQ ID NO: 549849 - DNA, 20 bp, Artificial Sequence
  chemically synthesized
gagcgaggcttcgtctcaaa

SEQ ID NO: 549850 - DNA, 20 bp, Artificial Sequence
  chemically synthesized
ttcgtctcaaaaaagaaaaa

SEQ ID NO: 549851 - DNA, 20 bp, Artificial Sequence
  chemically synthesized
tcttcatttactataaaatt

SEQ ID NO: 549852 - DNA, 20 bp, Artificial Sequence
  chemically synthesized
tcttcaattttatagtaaat

SEQ ID NO: 549853 - DNA, 20 bp, Artificial Sequence
  chemically synthesized
tgtcaatcaaaatagtcttc

SEQ ID NO: 549854 - DNA, 20 bp, Artificial Sequence
  chemically synthesized
ttgtatctcattgaagtaac

SEQ ID NO: 549855 - DNA, 20 bp, Artificial Sequence
  chemically synthesized
aactccctggtgactgcact

SEQ ID NO: 549856 - DNA, 20 bp, Artificial Sequence
  chemically synthesized
ggggtgggcgtaggaaggaa

SEQ ID NO: 549857 - DNA, 20 bp, Artificial Sequence
  chemically synthesized
ctcaaaagcattttgtatat

SEQ ID NO: 549858 - DNA, 20 bp, Artificial Sequence
  chemically synthesized
agagcttttaatttaaaggt

SEQ ID NO: 549859 - DNA, 20 bp, Artificial Sequence
  chemically synthesized
gggaaaagtcatgaaaagct

SEQ ID NO: 549860 - DNA, 20 bp, Artificial Sequence
  chemically synthesized
gaataatacttatttttatt

SEQ ID NO: 549861 - DNA, 20 bp, Artificial Sequence
  chemically synthesized
aagaacgttgctccacccaa

SEQ ID NO: 549862 - DNA, 20 bp, Artificial Sequence
  chemically synthesized
agtcatcgtaggagcaggaa

SEQ ID NO: 549863 - DNA, 20 bp, Artificial Sequence
  chemically synthesized
accagcccacacctgacttt

SEQ ID NO: 549864 - DNA, 20 bp, Artificial Sequence
  chemically synthesized
gaagtttgtggaaaagaatt

SEQ ID NO: 549865 - DNA, 20 bp, Artificial Sequence
  chemically synthesized
tcccaatagaagtttgtgga

SEQ ID NO: 549866 - DNA, 20 bp, Artificial Sequence
  chemically synthesized
atcattctgtttttattggt

SEQ ID NO: 549867 - DNA, 20 bp, Artificial Sequence
  chemically synthesized
aggattctgcaccaataaaa

SEQ ID NO: 549868 - DNA, 20 bp, Artificial Sequence
  chemically synthesized
actgaggatggaacaagaag

SEQ ID NO: 549869 - DNA, 20 bp, Artificial Sequence
  chemically synthesized
aaccccatactagcagtatg

SEQ ID NO: 549870 - DNA, 20 bp, Artificial Sequence
  chemically synthesized
gtcatgtatagaagaaaaat

SEQ ID NO: 549871 - DNA, 20 bp, Artificial Sequence
  chemically synthesized
aatgttagatgtcatgtata

SEQ ID NO: 549872 - DNA, 20 bp, Artificial Sequence
  chemically synthesized
tgacatctaacattcactaa

SEQ ID NO: 549873 - DNA, 20 bp, Artificial Sequence
  chemically synthesized
aatagattcatctagatact

SEQ ID NO: 549874 - DNA, 20 bp, Artificial Sequence
  chemically synthesized
gtaatttaacattttttata

SEQ ID NO: 549875 - DNA, 20 bp, Artificial Sequence
  chemically synthesized
taaaaaatgttaaattacaa

SEQ ID NO: 549876 - DNA, 20 bp, Artificial Sequence
  chemically synthesized
aaaaagaggcaaaacaacaa

SEQ ID NO: 549877 - DNA, 20 bp, Artificial Sequence
  chemically synthesized
aaaagcaggcagagatccta

SEQ ID NO: 549878 - DNA, 20 bp, Artificial Sequence
  chemically synthesized
atttggatcttcaacagata

SEQ ID NO: 549879 - DNA, 20 bp, Artificial Sequence
  chemically synthesized
aatgcaaaaaccaccccata

SEQ ID NO: 549880 - DNA, 20 bp, Artificial Sequence
  chemically synthesized
tgcggtgtgttcaagtagta

SEQ ID NO: 549881 - DNA, 20 bp, Artificial Sequence
  chemically synthesized
tttgacatattaaattagac

SEQ ID NO: 549882 - DNA, 20 bp, Artificial Sequence
  chemically synthesized
atgatgggatggggttgggg

SEQ ID NO: 549883 - DNA, 20 bp, Artificial Sequence
  chemically synthesized
accccatcccatcatataga

SEQ ID NO: 549884 - DNA, 20 bp, Artificial Sequence
  chemically synthesized
aattatatattgaaaatgtg

SEQ ID NO: 549885 - DNA, 20 bp, Artificial Sequence
  chemically synthesized
aaacttgaaatgatatatta

SEQ ID NO: 549886 - DNA, 20 bp, Artificial Sequence
  chemically synthesized
cattcgccaatccagaaatg

SEQ ID NO: 549887 - DNA, 20 bp, Artificial Sequence
  chemically synthesized
attttatcccattcgccaat

SEQ ID NO: 549888 - DNA, 20 bp, Artificial Sequence
  chemically synthesized
aatgggataaaatgttcagg

SEQ ID NO: 549889 - DNA, 20 bp, Artificial Sequence
  chemically synthesized
gatttttcattgaactcaga

SEQ ID NO: 549890 - DNA, 20 bp, Artificial Sequence
  chemically synthesized
acagtagaagaaaaatgcag

SEQ ID NO: 549891 - DNA, 20 bp, Artificial Sequence
  chemically synthesized
ctgtacagtagaagaaaaat

SEQ ID NO: 549892 - DNA, 20 bp, Artificial Sequence
  chemically synthesized
tgaataacaactgtacagta

SEQ ID NO: 549893 - DNA, 20 bp, Artificial Sequence
  chemically synthesized
ataacaagcttcaaattaaa

SEQ ID NO: 549894 - DNA, 20 bp, Artificial Sequence
  chemically synthesized
taggagctatagattgtgca

SEQ ID NO: 549895 - DNA, 20 bp, Artificial Sequence
  chemically synthesized
tgcacaatctatagctccta

SEQ ID NO: 549896 - DNA, 20 bp, Artificial Sequence
  chemically synthesized
gtgacaaatgtgggaacatt

SEQ ID NO: 549897 - DNA, 20 bp, Artificial Sequence
  chemically synthesized
tgaaaccttcgtgaggattt

SEQ ID NO: 549898 - DNA, 20 bp, Artificial Sequence
  chemically synthesized
ttaaacatgaaccaatcttt

SEQ ID NO: 549899 - DNA, 20 bp, Artificial Sequence
  chemically synthesized
gccttccagttaccacagtg

SEQ ID NO: 549900 - DNA, 20 bp, Artificial Sequence
  chemically synthesized
taaagagtaggcaaaaaagg

SEQ ID NO: 549901 - DNA, 20 bp, Artificial Sequence
  chemically synthesized
aacacaaatttagaagctat

SEQ ID NO: 549902 - DNA, 20 bp, Artificial Sequence
  chemically synthesized
agaagctatagagaaaataa

SEQ ID NO: 549903 - DNA, 20 bp, Artificial Sequence
  chemically synthesized
ggccccggtgtgtgagggaa

SEQ ID NO: 549904 - DNA, 20 bp, Artificial Sequence
  chemically synthesized
gctgcaggatgggaaaacaa

SEQ ID NO: 549905 - DNA, 20 bp, Artificial Sequence
  chemically synthesized
ctactagggaggcttaggca

SEQ ID NO: 549906 - DNA, 20 bp, Artificial Sequence
  chemically synthesized
agagcaagagtcagtctcaa

SEQ ID NO: 549907 - DNA, 20 bp, Artificial Sequence
  chemically synthesized
ggcaatatgtagcagtcatt

SEQ ID NO: 549908 - DNA, 20 bp, Artificial Sequence
  chemically synthesized
ttcttacctgacgatggagt

SEQ ID NO: 549909 - DNA, 20 bp, Artificial Sequence
  chemically synthesized
atactgaaaaaggagatgca

SEQ ID NO: 549910 - DNA, 20 bp, Artificial Sequence
  chemically synthesized
ctggattgtttaaggatggc

SEQ ID NO: 549911 - DNA, 20 bp, Artificial Sequence
  chemically synthesized
taggtcaagaaacattgaac

SEQ ID NO: 549912 - DNA, 20 bp, Artificial Sequence
  chemically synthesized
tttccttacgagaagtaggt

SEQ ID NO: 549913 - DNA, 20 bp, Artificial Sequence
  chemically synthesized
gaattccttctggtattcag

SEQ ID NO: 549914 - DNA, 20 bp, Artificial Sequence
  chemically synthesized
ctatgcatgaatataaaaaa

SEQ ID NO: 549915 - DNA, 20 bp, Artificial Sequence
  chemically synthesized
tgtgataacaattcacatgt

SEQ ID NO: 549916 - DNA, 20 bp, Artificial Sequence
  chemically synthesized
tacttgcaaaggatggaact

SEQ ID NO: 549917 - DNA, 20 bp, Artificial Sequence
  chemically synthesized
ttcttctatatctgtttatg

SEQ ID NO: 549918 - DNA, 20 bp, Artificial Sequence
  chemically synthesized
ttctggcataaacagatata

SEQ ID NO: 549919 - DNA, 20 bp, Artificial Sequence
  chemically synthesized
agacaccccaaatcctggag

SEQ ID NO: 549920 - DNA, 20 bp, Artificial Sequence
  chemically synthesized
catctctgtgtgtccttgac

SEQ ID NO: 549921 - DNA, 20 bp, Artificial Sequence
  chemically synthesized
tgaattttattaagatttcc

SEQ ID NO: 549922 - DNA, 20 bp, Artificial Sequence
  chemically synthesized
atttcctgagaatggtatat

SEQ ID NO: 549923 - DNA, 20 bp, Artificial Sequence
  chemically synthesized
aaattaaaagaggaaccaaa

SEQ ID NO: 549924 - DNA, 20 bp, Artificial Sequence
  chemically synthesized
aatagaaatttaatttagct

SEQ ID NO: 549925 - DNA, 20 bp, Artificial Sequence
  chemically synthesized
actattaatactatcaacat

SEQ ID NO: 549926 - DNA, 20 bp, Artificial Sequence
  chemically synthesized
atactatcaacatgtagaaa

SEQ ID NO: 549927 - DNA, 20 bp, Artificial Sequence
  chemically synthesized
aataacttttagattgagta

SEQ ID NO: 549928 - DNA, 20 bp, Artificial Sequence
  chemically synthesized
ttacatatgaggaaatggag

SEQ ID NO: 549929 - DNA, 20 bp, Artificial Sequence
  chemically synthesized
catttttattttcataaata

SEQ ID NO: 549930 - DNA, 20 bp, Artificial Sequence
  chemically synthesized
taaagtggcacaaacagagg

SEQ ID NO: 549931 - DNA, 20 bp, Artificial Sequence
  chemically synthesized
tttttaggttggacagtacc

SEQ ID NO: 549932 - DNA, 20 bp, Artificial Sequence
  chemically synthesized
tgctttcctccaaaacgccc

SEQ ID NO: 549933 - DNA, 20 bp, Artificial Sequence
  chemically synthesized
ttttttggaatgaaattcac

SEQ ID NO: 549934 - DNA, 20 bp, Artificial Sequence
  chemically synthesized
tctgtgaatttcattccaaa

SEQ ID NO: 549935 - DNA, 20 bp, Artificial Sequence
  chemically synthesized
tttatttcaaatcacttttg

SEQ ID NO: 549936 - DNA, 20 bp, Artificial Sequence
  chemically synthesized
ttccattgatcttcagtgtt

SEQ ID NO: 549937 - DNA, 20 bp, Artificial Sequence
  chemically synthesized
cactgaagatcaatggaagc

SEQ ID NO: 549938 - DNA, 20 bp, Artificial Sequence
  chemically synthesized
agatcaatggaagctaagaa

SEQ ID NO: 549939 - DNA, 20 bp, Artificial Sequence
  chemically synthesized
tatgcatataatatttttgt

SEQ ID NO: 549940 - DNA, 20 bp, Artificial Sequence
  chemically synthesized
taatatttttgttaagaaac

SEQ ID NO: 549941 - DNA, 20 bp, Artificial Sequence
  chemically synthesized
gttaagaaacatagaattct

SEQ ID NO: 549942 - DNA, 20 bp, Artificial Sequence
  chemically synthesized
atataaaattgaattattct

SEQ ID NO: 549943 - DNA, 20 bp, Artificial Sequence
  chemically synthesized
taaccagctaatataaatat

SEQ ID NO: 549944 - DNA, 20 bp, Artificial Sequence
  chemically synthesized
ctttacactgaaaattgttt

SEQ ID NO: 549945 - DNA, 20 bp, Artificial Sequence
  chemically synthesized
acactgaaaattgtttagag

SEQ ID NO: 549946 - DNA, 20 bp, Artificial Sequence
  chemically synthesized
tcccgtctctactaaaaata

SEQ ID NO: 549947 - DNA, 20 bp, Artificial Sequence
  chemically synthesized
tattcgggaggctgagggca

SEQ ID NO: 549948 - DNA, 20 bp, Artificial Sequence
  chemically synthesized
aaaaaaaaaaaaggagagag

SEQ ID NO: 549949 - DNA, 20 bp, Artificial Sequence
  chemically synthesized
cactcttcatatggcaaact

SEQ ID NO: 549950 - DNA, 20 bp, Artificial Sequence
  chemically synthesized
actaaagaaagggggcaccg

SEQ ID NO: 549951 - DNA, 20 bp, Artificial Sequence
  chemically synthesized
gtattgccagagcttgaagg

SEQ ID NO: 549952 - DNA, 20 bp, Artificial Sequence
  chemically synthesized
aatacactggccctaaagca

SEQ ID NO: 549953 - DNA, 20 bp, Artificial Sequence
  chemically synthesized
caaacaaatccttgggaact

SEQ ID NO: 549954 - DNA, 20 bp, Artificial Sequence
  chemically synthesized
gcaatgtttctaaagtcagt

SEQ ID NO: 549955 - DNA, 20 bp, Artificial Sequence
  chemically synthesized
gggaagtttctgtactgact

SEQ ID NO: 549956 - DNA, 20 bp, Artificial Sequence
  chemically synthesized
tggggaaatatacagtcttc

SEQ ID NO: 549957 - DNA, 20 bp, Artificial Sequence
  chemically synthesized
ctgccattaatactgtaggt

SEQ ID NO: 549958 - DNA, 20 bp, Artificial Sequence
  chemically synthesized
cttaacctacagtattaatg

SEQ ID NO: 549959 - DNA, 20 bp, Artificial Sequence
  chemically synthesized
ttgaatttacatatttggtt

SEQ ID NO: 549960 - DNA, 20 bp, Artificial Sequence
  chemically synthesized
atttgcaaatatattcgtct

SEQ ID NO: 549961 - DNA, 20 bp, Artificial Sequence
  chemically synthesized
ttcctccttaacctttttaa

SEQ ID NO: 549962 - DNA, 20 bp, Artificial Sequence
  chemically synthesized
ctttttaagtagaaattaaa

SEQ ID NO: 549963 - DNA, 20 bp, Artificial Sequence
  chemically synthesized
gaaaaagtaaatgtctgtta

SEQ ID NO: 549964 - DNA, 20 bp, Artificial Sequence
  chemically synthesized
aaaaactaaaccaattcatg

SEQ ID NO: 549965 - DNA, 20 bp, Artificial Sequence
  chemically synthesized
aaaccattccaaaaaaaact

SEQ ID NO: 549966 - DNA, 20 bp, Artificial Sequence
  chemically synthesized
gcaaacataacaaacatcca

SEQ ID NO: 549967 - DNA, 20 bp, Artificial Sequence
  chemically synthesized
ctctatgctgccttgctttg

SEQ ID NO: 549968 - DNA, 20 bp, Artificial Sequence
  chemically synthesized
attaaaaggtcttaagtgcc

SEQ ID NO: 549969 - DNA, 20 bp, Artificial Sequence
  chemically synthesized
ggtcttaagtgccccagaat

SEQ ID NO: 549970 - DNA, 20 bp, Artificial Sequence
  chemically synthesized
gtggtagtggtgagggtggg

SEQ ID NO: 549971 - DNA, 20 bp, Artificial Sequence
  chemically synthesized
taccgctggaaaaaatgcac

SEQ ID NO: 549972 - DNA, 20 bp, Artificial Sequence
  chemically synthesized
ggaaaatcaagtacacacgt

SEQ ID NO: 549973 - DNA, 20 bp, Artificial Sequence
  chemically synthesized
tagcccatgacaaagcttga

SEQ ID NO: 549974 - DNA, 20 bp, Artificial Sequence
  chemically synthesized
ctaaatggctacacaggtat

SEQ ID NO: 549975 - DNA, 20 bp, Artificial Sequence
  chemically synthesized
ctcaatacctgtgtagccat

SEQ ID NO: 549976 - DNA, 20 bp, Artificial Sequence
  chemically synthesized
tttagaaatctaaagagcaa

SEQ ID NO: 549977 - DNA, 20 bp, Artificial Sequence
  chemically synthesized
agaaaagaggaagaaattgc

SEQ ID NO: 549978 - DNA, 20 bp, Artificial Sequence
  chemically synthesized
ttctgctcttgagaaaagag

SEQ ID NO: 549979 - DNA, 20 bp, Artificial Sequence
  chemically synthesized
ttcttcctcttttctcaaga

SEQ ID NO: 549980 - DNA, 20 bp, Artificial Sequence
  chemically synthesized
gtctatctcaattctgctct

SEQ ID NO: 549981 - DNA, 20 bp, Artificial Sequence
  chemically synthesized
atgggtctgagaacggccta

SEQ ID NO: 549982 - DNA, 20 bp, Artificial Sequence
  chemically synthesized
ttcacatggtgctcatgttt

SEQ ID NO: 549983 - DNA, 20 bp, Artificial Sequence
  chemically synthesized
tgtgtgttatctagttttaa

SEQ ID NO: 549984 - DNA, 20 bp, Artificial Sequence
  chemically synthesized
agtctcaaaaaaaaaaaaaa

SEQ ID NO: 549985 - DNA, 20 bp, Artificial Sequence
  chemically synthesized
ctacttaggaggctgaggca

SEQ ID NO: 549986 - DNA, 20 bp, Artificial Sequence
  chemically synthesized
tgggtctccaaatatacatt

SEQ ID NO: 549987 - DNA, 20 bp, Artificial Sequence
  chemically synthesized
tgaaatgtatatttggagac

SEQ ID NO: 549988 - DNA, 20 bp, Artificial Sequence
  chemically synthesized
cttagaggaaataaatctta

SEQ ID NO: 549989 - DNA, 20 bp, Artificial Sequence
  chemically synthesized
tttttacagcatttcgaaca

SEQ ID NO: 549990 - DNA, 20 bp, Artificial Sequence
  chemically synthesized
tggttctaggaaattttgct

SEQ ID NO: 549991 - DNA, 20 bp, Artificial Sequence
  chemically synthesized
ttaaatcacctccaagtttc

SEQ ID NO: 549992 - DNA, 20 bp, Artificial Sequence
  chemically synthesized
catttgtatgttgaagattc

SEQ ID NO: 549993 - DNA, 20 bp, Artificial Sequence
  chemically synthesized
actgtttttccaaatatata

SEQ ID NO: 549994 - DNA, 20 bp, Artificial Sequence
  chemically synthesized
agaatgactttttttctccc

SEQ ID NO: 549995 - DNA, 20 bp, Artificial Sequence
  chemically synthesized
catcaatagctaattctagg

SEQ ID NO: 549996 - DNA, 20 bp, Artificial Sequence
  chemically synthesized
tccgtgtgttttaaactata

SEQ ID NO: 549997 - DNA, 20 bp, Artificial Sequence
  chemically synthesized
gggactgaacacacatagtc

SEQ ID NO: 549998 - DNA, 20 bp, Artificial Sequence
  chemically synthesized
ctgaacacacatagtcacag

SEQ ID NO: 549999 - DNA, 20 bp, Artificial Sequence
  chemically synthesized
gctagaacaagattgctaag

SEQ ID NO: 550000 - DNA, 20 bp, Artificial Sequence
  chemically synthesized
aattatatattttgagggtg

SEQ ID NO: 550001 - DNA, 20 bp, Artificial Sequence
  chemically synthesized
gtacatttatgtaaaatttc

SEQ ID NO: 550002 - DNA, 20 bp, Artificial Sequence
  chemically synthesized
attgattagggcttagattc

SEQ ID NO: 550003 - DNA, 20 bp, Artificial Sequence
  chemically synthesized
tacaatgcatagttatcaca

SEQ ID NO: 550004 - DNA, 20 bp, Artificial Sequence
  chemically synthesized
ctactcgggaggctgagaca

SEQ ID NO: 550005 - DNA, 20 bp, Artificial Sequence
  chemically synthesized
agcaagactccatctcaaaa

SEQ ID NO: 550006 - DNA, 20 bp, Artificial Sequence
  chemically synthesized
gactccatctcaaaaaaaga

SEQ ID NO: 550007 - DNA, 20 bp, Artificial Sequence
  chemically synthesized
ccatctcaaaaaaagaaaag

SEQ ID NO: 550008 - DNA, 20 bp, Artificial Sequence
  chemically synthesized
ctcaaaaaaagaaaagaaag

SEQ ID NO: 550009 - DNA, 20 bp, Artificial Sequence
  chemically synthesized
aaaagaaagaaagaaaacaa

SEQ ID NO: 550010 - DNA, 20 bp, Artificial Sequence
  chemically synthesized
gtctcctttttggaacatac

SEQ ID NO: 550011 - DNA, 20 bp, Artificial Sequence
  chemically synthesized
ggtgggagatgacatttcca

SEQ ID NO: 550012 - DNA, 20 bp, Artificial Sequence
  chemically synthesized
ttccagaagaataacagaag

SEQ ID NO: 550013 - DNA, 20 bp, Artificial Sequence
  chemically synthesized
agagattggtagagcatctt

SEQ ID NO: 550014 - DNA, 20 bp, Artificial Sequence
  chemically synthesized
agatttcacttttggggcaa

SEQ ID NO: 550015 - DNA, 20 bp, Artificial Sequence
  chemically synthesized
ctaaggtaacagccatggaa

SEQ ID NO: 550016 - DNA, 20 bp, Artificial Sequence
  chemically synthesized
tgtgtatagagacataattt

SEQ ID NO: 550017 - DNA, 20 bp, Artificial Sequence
  chemically synthesized
tattgtgatcagtggatatg

SEQ ID NO: 550018 - DNA, 20 bp, Artificial Sequence
  chemically synthesized
gatgctgagggcttaacatt

SEQ ID NO: 550019 - DNA, 20 bp, Artificial Sequence
  chemically synthesized
tattcagttaaatttatttt

SEQ ID NO: 550020 - DNA, 20 bp, Artificial Sequence
  chemically synthesized
tcgattgtgtcatcttcccc

SEQ ID NO: 550021 - DNA, 20 bp, Artificial Sequence
  chemically synthesized
attcagttttccacatgcag

SEQ ID NO: 550022 - DNA, 20 bp, Artificial Sequence
  chemically synthesized
gttagaacagtgatctcgag

SEQ ID NO: 550023 - DNA, 20 bp, Artificial Sequence
  chemically synthesized
agtgatctcgagggagaatg

SEQ ID NO: 550024 - DNA, 20 bp, Artificial Sequence
  chemically synthesized
tcaatgagctagagaaggag

SEQ ID NO: 550025 - DNA, 20 bp, Artificial Sequence
  chemically synthesized
ggggataggtctctagctca

SEQ ID NO: 550026 - DNA, 20 bp, Artificial Sequence
  chemically synthesized
gctatggattttgatgagat

SEQ ID NO: 550027 - DNA, 20 bp, Artificial Sequence
  chemically synthesized
acgataggagagcaaccctc

SEQ ID NO: 550028 - DNA, 20 bp, Artificial Sequence
  chemically synthesized
gttgccctgagacaggaaaa

SEQ ID NO: 550029 - DNA, 20 bp, Artificial Sequence
  chemically synthesized
aggaagtagatacaatgagc

SEQ ID NO: 550030 - DNA, 20 bp, Artificial Sequence
  chemically synthesized
taggagattaaaaactaata

SEQ ID NO: 550031 - DNA, 20 bp, Artificial Sequence
  chemically synthesized
ctgacacaaatgcctgaacg

SEQ ID NO: 550032 - DNA, 20 bp, Artificial Sequence
  chemically synthesized
taaaatacaaatgtctggtt

SEQ ID NO: 550033 - DNA, 20 bp, Artificial Sequence
  chemically synthesized
tgctacagcattacctttga

SEQ ID NO: 550034 - DNA, 20 bp, Artificial Sequence
  chemically synthesized
gttactgctttgtttacaaa

SEQ ID NO: 550035 - DNA, 20 bp, Artificial Sequence
  chemically synthesized
gcagtaacaatagctctttt

SEQ ID NO: 550036 - DNA, 20 bp, Artificial Sequence
  chemically synthesized
ctcttttatagaatcatgga

SEQ ID NO: 550037 - DNA, 20 bp, Artificial Sequence
  chemically synthesized
aacttcttataatacctctc

SEQ ID NO: 550038 - DNA, 20 bp, Artificial Sequence
  chemically synthesized
tagtaggtctccgcacagcc

SEQ ID NO: 550039 - DNA, 20 bp, Artificial Sequence
  chemically synthesized
caatatcacctggaaatttg

SEQ ID NO: 550040 - DNA, 20 bp, Artificial Sequence
  chemically synthesized
agcctggggctgtctccatc

SEQ ID NO: 550041 - DNA, 20 bp, Artificial Sequence
  chemically synthesized
gttcccttaggttcctgaaa

SEQ ID NO: 550042 - DNA, 20 bp, Artificial Sequence
  chemically synthesized
tggggatgttaatgcccatg

SEQ ID NO: 550043 - DNA, 20 bp, Artificial Sequence
  chemically synthesized
gaaaagaaaaaagaaaagaa

SEQ ID NO: 550044 - DNA, 20 bp, Artificial Sequence
  chemically synthesized
cgaaaagaaaagaaaaaaga

SEQ ID NO: 550045 - DNA, 20 bp, Artificial Sequence
  chemically synthesized
cgtctcgaaaagaaaagaaa

SEQ ID NO: 550046 - DNA, 20 bp, Artificial Sequence
  chemically synthesized
aaaactccgtctcgaaaaga

SEQ ID NO: 550047 - DNA, 20 bp, Artificial Sequence
  chemically synthesized
agagcaaaactccgtctcga

SEQ ID NO: 550048 - DNA, 20 bp, Artificial Sequence
  chemically synthesized
ctacttgggaggctgaggca

SEQ ID NO: 550049 - DNA, 20 bp, Artificial Sequence
  chemically synthesized
actagatcaaagcaaatatg

SEQ ID NO: 550050 - DNA, 20 bp, Artificial Sequence
  chemically synthesized
cacagactccatgatataag

SEQ ID NO: 550051 - DNA, 20 bp, Artificial Sequence
  chemically synthesized
tcataacagagaacgagaaa

SEQ ID NO: 550052 - DNA, 20 bp, Artificial Sequence
  chemically synthesized
tgctttttcataacagagaa

SEQ ID NO: 550053 - DNA, 20 bp, Artificial Sequence
  chemically synthesized
ttatgtatatatggaatttc

SEQ ID NO: 550054 - DNA, 20 bp, Artificial Sequence
  chemically synthesized
aaacaagatggacaggcact

SEQ ID NO: 550055 - DNA, 20 bp, Artificial Sequence
  chemically synthesized
tcagtgcctgtccatcttgt

SEQ ID NO: 550056 - DNA, 20 bp, Artificial Sequence
  chemically synthesized
ggctaggcaaagtaaggaat

SEQ ID NO: 550057 - DNA, 20 bp, Artificial Sequence
  chemically synthesized
cttctaaaatacctctagtc

SEQ ID NO: 550058 - DNA, 20 bp, Artificial Sequence
  chemically synthesized
tatggagattctacgcatgc

SEQ ID NO: 550059 - DNA, 20 bp, Artificial Sequence
  chemically synthesized
acctagttttctatgcatgc

SEQ ID NO: 550060 - DNA, 20 bp, Artificial Sequence
  chemically synthesized
atacttgcttacagaaatgt

SEQ ID NO: 550061 - DNA, 20 bp, Artificial Sequence
  chemically synthesized
tttttccttgatacttgctt

SEQ ID NO: 550062 - DNA, 20 bp, Artificial Sequence
  chemically synthesized
tattcccaccagcctctcag

SEQ ID NO: 550063 - DNA, 20 bp, Artificial Sequence
  chemically synthesized
taataaaaacctgctacttg

SEQ ID NO: 550064 - DNA, 20 bp, Artificial Sequence
  chemically synthesized
ctactcaggaggctaaggca

SEQ ID NO: 550065 - DNA, 20 bp, Artificial Sequence
  chemically synthesized
ataacttgtgtccctcagaa

SEQ ID NO: 550066 - DNA, 20 bp, Artificial Sequence
  chemically synthesized
cctgatataacttgtgtccc

SEQ ID NO: 550067 - DNA, 20 bp, Artificial Sequence
  chemically synthesized
agaccctgtctcaaaaaagg

SEQ ID NO: 550068 - DNA, 20 bp, Artificial Sequence
  chemically synthesized
ctactccagaggctgagatg

SEQ ID NO: 550069 - DNA, 20 bp, Artificial Sequence
  chemically synthesized
ctctcatatgtatgtgttca

SEQ ID NO: 550070 - DNA, 20 bp, Artificial Sequence
  chemically synthesized
aagacaatatcaagtattgg

SEQ ID NO: 550071 - DNA, 20 bp, Artificial Sequence
  chemically synthesized
gcctaacttcattagtaatc

SEQ ID NO: 550072 - DNA, 20 bp, Artificial Sequence
  chemically synthesized
ttcacaagacgtatatctga

SEQ ID NO: 550073 - DNA, 20 bp, Artificial Sequence
  chemically synthesized
aaaagaaaagtcatggactg

SEQ ID NO: 550074 - DNA, 20 bp, Artificial Sequence
  chemically synthesized
taatacactaataacagtga

SEQ ID NO: 550075 - DNA, 20 bp, Artificial Sequence
  chemically synthesized
ttattagtgtattataatag

SEQ ID NO: 550076 - DNA, 20 bp, Artificial Sequence
  chemically synthesized
aaattgagcttcattaaaac

SEQ ID NO: 550077 - DNA, 20 bp, Artificial Sequence
  chemically synthesized
gattaagtaaacatagtcaa

SEQ ID NO: 550078 - DNA, 20 bp, Artificial Sequence
  chemically synthesized
gagtctctgaataagggata

SEQ ID NO: 550079 - DNA, 20 bp, Artificial Sequence
  chemically synthesized
tagagggaaattattttagc

SEQ ID NO: 550080 - DNA, 20 bp, Artificial Sequence
  chemically synthesized
agagagagagagagagagag

SEQ ID NO: 550081 - DNA, 20 bp, Artificial Sequence
  chemically synthesized
ttggagagagagagagagag

SEQ ID NO: 550082 - DNA, 20 bp, Artificial Sequence
  chemically synthesized
catggcctcgatataatttt

SEQ ID NO: 550083 - DNA, 20 bp, Artificial Sequence
  chemically synthesized
cttggttttgaaggtatgtt

SEQ ID NO: 550084 - DNA, 20 bp, Artificial Sequence
  chemically synthesized
ttttgaaggtatgttataga

SEQ ID NO: 550085 - DNA, 20 bp, Artificial Sequence
  chemically synthesized
atagtggttggtgatggtgg

SEQ ID NO: 550086 - DNA, 20 bp, Artificial Sequence
  chemically synthesized
atcaatgtattaaattttca

SEQ ID NO: 550087 - DNA, 20 bp, Artificial Sequence
  chemically synthesized
gttctacatagattgaagac

SEQ ID NO: 550088 - DNA, 20 bp, Artificial Sequence
  chemically synthesized
atcttggctgggtatcactg

SEQ ID NO: 550089 - DNA, 20 bp, Artificial Sequence
  chemically synthesized
tgtgcgatccttatactgtt

SEQ ID NO: 550090 - DNA, 20 bp, Artificial Sequence
  chemically synthesized
agcaggccagatcagtttag

SEQ ID NO: 550091 - DNA, 20 bp, Artificial Sequence
  chemically synthesized
cctgctaaaactaaatttta

SEQ ID NO: 550092 - DNA, 20 bp, Artificial Sequence
  chemically synthesized
attttttttgtatttttagt

SEQ ID NO: 550093 - DNA, 20 bp, Artificial Sequence
  chemically synthesized
ctaaccgggaggctgaagca

SEQ ID NO: 550094 - DNA, 20 bp, Artificial Sequence
  chemically synthesized
atttcctttgtgacgtaggt

SEQ ID NO: 550095 - DNA, 20 bp, Artificial Sequence
  chemically synthesized
tactttaacttgctatcaag

SEQ ID NO: 550096 - DNA, 20 bp, Artificial Sequence
  chemically synthesized
ctttttctcttggatataaa

SEQ ID NO: 550097 - DNA, 20 bp, Artificial Sequence
  chemically synthesized
gttattctcttttatatcca

SEQ ID NO: 550098 - DNA, 20 bp, Artificial Sequence
  chemically synthesized
ctcttttatatccaagagaa

SEQ ID NO: 550099 - DNA, 20 bp, Artificial Sequence
  chemically synthesized
tgcagaagaggattatataa

SEQ ID NO: 550100 - DNA, 20 bp, Artificial Sequence
  chemically synthesized
acagctatcgtctaaccatt

SEQ ID NO: 550101 - DNA, 20 bp, Artificial Sequence
  chemically synthesized
cagaggtgtgtgggaaaccc

SEQ ID NO: 550102 - DNA, 20 bp, Artificial Sequence
  chemically synthesized
aagggtcaacgaaatctaag

SEQ ID NO: 550103 - DNA, 20 bp, Artificial Sequence
  chemically synthesized
ttgtccatataaatagacgg

SEQ ID NO: 550104 - DNA, 20 bp, Artificial Sequence
  chemically synthesized
cagcagaagttgattgtatt

SEQ ID NO: 550105 - DNA, 20 bp, Artificial Sequence
  chemically synthesized
tgattgtattccagaaaagg

SEQ ID NO: 550106 - DNA, 20 bp, Artificial Sequence
  chemically synthesized
ttcaaaaatagaggttggat

SEQ ID NO: 550107 - DNA, 20 bp, Artificial Sequence
  chemically synthesized
ataaactccttgaattccag

SEQ ID NO: 550108 - DNA, 20 bp, Artificial Sequence
  chemically synthesized
aataaataaaaacaaaaatt

SEQ ID NO: 550109 - DNA, 20 bp, Artificial Sequence
  chemically synthesized
ctactcgggaggctgaggca

SEQ ID NO: 550110 - DNA, 20 bp, Artificial Sequence
  chemically synthesized
gcctggctattctacaattt

SEQ ID NO: 550111 - DNA, 20 bp, Artificial Sequence
  chemically synthesized
ttgctacctttctaaaaatt

SEQ ID NO: 550112 - DNA, 20 bp, Artificial Sequence
  chemically synthesized
ttttgaaactcttatttgaa

SEQ ID NO: 550113 - DNA, 20 bp, Artificial Sequence
  chemically synthesized
tatgtgtaaatttctactta

SEQ ID NO: 550114 - DNA, 20 bp, Artificial Sequence
  chemically synthesized
aacagtatatattctattaa

SEQ ID NO: 550115 - DNA, 20 bp, Artificial Sequence
  chemically synthesized
attataataaaactagtagc

SEQ ID NO: 550116 - DNA, 20 bp, Artificial Sequence
  chemically synthesized
atttacatatgaaaaaaata

SEQ ID NO: 550117 - DNA, 20 bp, Artificial Sequence
  chemically synthesized
tgaaaaaaatagaagaaaaa

SEQ ID NO: 550118 - DNA, 20 bp, Artificial Sequence
  chemically synthesized
gataataattataatttttc

SEQ ID NO: 550119 - DNA, 20 bp, Artificial Sequence
  chemically synthesized
gtacagaacatatgtctcta

SEQ ID NO: 550120 - DNA, 20 bp, Artificial Sequence
  chemically synthesized
ctgtaccttcctaagtccac

SEQ ID NO: 550121 - DNA, 20 bp, Artificial Sequence
  chemically synthesized
attttcaatgctctgtgaag

SEQ ID NO: 550122 - DNA, 20 bp, Artificial Sequence
  chemically synthesized
gtctattttcaatgctctgt

SEQ ID NO: 550123 - DNA, 20 bp, Artificial Sequence
  chemically synthesized
ttttattatactttttatac

SEQ ID NO: 550124 - DNA, 20 bp, Artificial Sequence
  chemically synthesized
aaaaatgccacctctactag

SEQ ID NO: 550125 - DNA, 20 bp, Artificial Sequence
  chemically synthesized
gccacctctactagtaagaa

SEQ ID NO: 550126 - DNA, 20 bp, Artificial Sequence
  chemically synthesized
tttagaaagttgccgcaata

SEQ ID NO: 550127 - DNA, 20 bp, Artificial Sequence
  chemically synthesized
tcctgtgtttttttttcctt

SEQ ID NO: 550128 - DNA, 20 bp, Artificial Sequence
  chemically synthesized
gaaacaaaagagagtgagat

SEQ ID NO: 550129 - DNA, 20 bp, Artificial Sequence
  chemically synthesized
tcactctcttttgtttcatc

SEQ ID NO: 550130 - DNA, 20 bp, Artificial Sequence
  chemically synthesized
atagatgtaaacaaatgtaa

SEQ ID NO: 550131 - DNA, 20 bp, Artificial Sequence
  chemically synthesized
ctacttgggagactgaggtg

SEQ ID NO: 550132 - DNA, 20 bp, Artificial Sequence
  chemically synthesized
ggtcagagagagacttcatc

SEQ ID NO: 550133 - DNA, 20 bp, Artificial Sequence
  chemically synthesized
agactttcagttcttacttc

SEQ ID NO: 550134 - DNA, 20 bp, Artificial Sequence
  chemically synthesized
atatttatggtcatatttgg

SEQ ID NO: 550135 - DNA, 20 bp, Artificial Sequence
  chemically synthesized
aatatttgtgcttacaatac

SEQ ID NO: 550136 - DNA, 20 bp, Artificial Sequence
  chemically synthesized
tatagattacttttaatgag

SEQ ID NO: 550137 - DNA, 20 bp, Artificial Sequence
  chemically synthesized
ttaagggacaatatcacttt

SEQ ID NO: 550138 - DNA, 20 bp, Artificial Sequence
  chemically synthesized
ctctggccctttatataacc

SEQ ID NO: 550139 - DNA, 20 bp, Artificial Sequence
  chemically synthesized
tcgacctggtgtaaaattcc

SEQ ID NO: 550140 - DNA, 20 bp, Artificial Sequence
  chemically synthesized
agcattcacttagaggagag

SEQ ID NO: 550141 - DNA, 20 bp, Artificial Sequence
  chemically synthesized
ctactcaggagggtgaggca

SEQ ID NO: 550142 - DNA, 20 bp, Artificial Sequence
  chemically synthesized
aaaaggaaggaaggaaggaa

SEQ ID NO: 550143 - DNA, 20 bp, Artificial Sequence
  chemically synthesized
gaaggaaggaaggaaaaaga

SEQ ID NO: 550144 - DNA, 20 bp, Artificial Sequence
  chemically synthesized
atcttaggaagctggctgga

SEQ ID NO: 550145 - DNA, 20 bp, Artificial Sequence
  chemically synthesized
taaacctggcagaactttag

SEQ ID NO: 550146 - DNA, 20 bp, Artificial Sequence
  chemically synthesized
tagtgcacataaagcatgca

SEQ ID NO: 550147 - DNA, 20 bp, Artificial Sequence
  chemically synthesized
tgctttgttttttctcaatg

SEQ ID NO: 550148 - DNA, 20 bp, Artificial Sequence
  chemically synthesized
tatgcttggatttctcccat

SEQ ID NO: 550149 - DNA, 20 bp, Artificial Sequence
  chemically synthesized
aatccaagcataggccccct

SEQ ID NO: 550150 - DNA, 20 bp, Artificial Sequence
  chemically synthesized
taaattattttcatacaagt

SEQ ID NO: 550151 - DNA, 20 bp, Artificial Sequence
  chemically synthesized
agagaacatgtatgaaagag

SEQ ID NO: 550152 - DNA, 20 bp, Artificial Sequence
  chemically synthesized
gctgagttcactcattaaat

SEQ ID NO: 550153 - DNA, 20 bp, Artificial Sequence
  chemically synthesized
taaggcttttataatcattc

SEQ ID NO: 550154 - DNA, 20 bp, Artificial Sequence
  chemically synthesized
gaatgattataaaagcctta

SEQ ID NO: 550155 - DNA, 20 bp, Artificial Sequence
  chemically synthesized
ttgttacaaagattccaggc

SEQ ID NO: 550156 - DNA, 20 bp, Artificial Sequence
  chemically synthesized
taatcaaagaggtgattttc

SEQ ID NO: 550157 - DNA, 20 bp, Artificial Sequence
  chemically synthesized
gtgtttccttagccatattc

SEQ ID NO: 550158 - DNA, 20 bp, Artificial Sequence
  chemically synthesized
ccaccgctcctggcctcgct

SEQ ID NO: 550159 - DNA, 20 bp, Artificial Sequence
  chemically synthesized
ctacttgggaagctgaggca

SEQ ID NO: 550160 - DNA, 20 bp, Artificial Sequence
  chemically synthesized
cattaacagttcatctcact

SEQ ID NO: 550161 - DNA, 20 bp, Artificial Sequence
  chemically synthesized
aaagttacagtaatttataa

SEQ ID NO: 550162 - DNA, 20 bp, Artificial Sequence
  chemically synthesized
tactgttcctctaacaatct

SEQ ID NO: 550163 - DNA, 20 bp, Artificial Sequence
  chemically synthesized
catatattttgttacaattt

SEQ ID NO: 550164 - DNA, 20 bp, Artificial Sequence
  chemically synthesized
tattttgttacaatttcgag

SEQ ID NO: 550165 - DNA, 20 bp, Artificial Sequence
  chemically synthesized
ttcgagaaagaattcaaaac

SEQ ID NO: 550166 - DNA, 20 bp, Artificial Sequence
  chemically synthesized
cttttagagttgtgtttctc

SEQ ID NO: 550167 - DNA, 20 bp, Artificial Sequence
  chemically synthesized
gtattcctggggtctttctt

SEQ ID NO: 550168 - DNA, 20 bp, Artificial Sequence
  chemically synthesized
tgacttgtaaagacctacca

SEQ ID NO: 550169 - DNA, 20 bp, Artificial Sequence
  chemically synthesized
acctaccagaagaatatcat

SEQ ID NO: 550170 - DNA, 20 bp, Artificial Sequence
  chemically synthesized
atatcatttagaatggggct

SEQ ID NO: 550171 - DNA, 20 bp, Artificial Sequence
  chemically synthesized
ctagaatacagcagaatccc

SEQ ID NO: 550172 - DNA, 20 bp, Artificial Sequence
  chemically synthesized
ttcccaaactctagaataca

SEQ ID NO: 550173 - DNA, 20 bp, Artificial Sequence
  chemically synthesized
taggcagtccttcccaaact

SEQ ID NO: 550174 - DNA, 20 bp, Artificial Sequence
  chemically synthesized
gttagactcactgggagaac

SEQ ID NO: 550175 - DNA, 20 bp, Artificial Sequence
  chemically synthesized
cccagtgagtctaacagcca

SEQ ID NO: 550176 - DNA, 20 bp, Artificial Sequence
  chemically synthesized
actttgccaaggaagtatgc

SEQ ID NO: 550177 - DNA, 20 bp, Artificial Sequence
  chemically synthesized
atttcatttcactcttaaat

SEQ ID NO: 550178 - DNA, 20 bp, Artificial Sequence
  chemically synthesized
tatacacaacacatacagtg

SEQ ID NO: 550179 - DNA, 20 bp, Artificial Sequence
  chemically synthesized
ggaaaggtataggaaggagc

SEQ ID NO: 550180 - DNA, 20 bp, Artificial Sequence
  chemically synthesized
gagatgaaaaacaagaagct

SEQ ID NO: 550181 - DNA, 20 bp, Artificial Sequence
  chemically synthesized
taccattgtatttttttaag

SEQ ID NO: 550182 - DNA, 20 bp, Artificial Sequence
  chemically synthesized
taggaatagtatgtaaattg

SEQ ID NO: 550183 - DNA, 20 bp, Artificial Sequence
  chemically synthesized
gaattctggttgaaaaattg

SEQ ID NO: 550184 - DNA, 20 bp, Artificial Sequence
  chemically synthesized
tcattctttcaatttttcaa

SEQ ID NO: 550185 - DNA, 20 bp, Artificial Sequence
  chemically synthesized
ttcaaccagaattcatatac

SEQ ID NO: 550186 - DNA, 20 bp, Artificial Sequence
  chemically synthesized
gcttgaaggaactcaggaaa

SEQ ID NO: 550187 - DNA, 20 bp, Artificial Sequence
  chemically synthesized
ttaggctataattgctcatt

SEQ ID NO: 550188 - DNA, 20 bp, Artificial Sequence
  chemically synthesized
taaacgaagtccatttctta

SEQ ID NO: 550189 - DNA, 20 bp, Artificial Sequence
  chemically synthesized
ttgcctatgagtttttctgc

SEQ ID NO: 550190 - DNA, 20 bp, Artificial Sequence
  chemically synthesized
aatgtattccaaggtagctc

SEQ ID NO: 550191 - DNA, 20 bp, Artificial Sequence
  chemically synthesized
cacagaataatcaggattta

SEQ ID NO: 550192 - DNA, 20 bp, Artificial Sequence
  chemically synthesized
agattttttaccatcatttg

SEQ ID NO: 550193 - DNA, 20 bp, Artificial Sequence
  chemically synthesized
agtattatggttaaggaatc

SEQ ID NO: 550194 - DNA, 20 bp, Artificial Sequence
  chemically synthesized
tgagcagagttcttgtttca

SEQ ID NO: 550195 - DNA, 20 bp, Artificial Sequence
  chemically synthesized
ttacatcaacaaaaatggag

SEQ ID NO: 550196 - DNA, 20 bp, Artificial Sequence
  chemically synthesized
ataatatcaaaaagatgggg

SEQ ID NO: 550197 - DNA, 20 bp, Artificial Sequence
  chemically synthesized
aaagcctgctagcagattgc

SEQ ID NO: 550198 - DNA, 20 bp, Artificial Sequence
  chemically synthesized
cctgctagcagattgcctag

SEQ ID NO: 550199 - DNA, 20 bp, Artificial Sequence
  chemically synthesized
ttagatgagattttaacata

SEQ ID NO: 550200 - DNA, 20 bp, Artificial Sequence
  chemically synthesized
gtgtgcgtgtacataggcac

SEQ ID NO: 550201 - DNA, 20 bp, Artificial Sequence
  chemically synthesized
cagctcttactgcatcaata

SEQ ID NO: 550202 - DNA, 20 bp, Artificial Sequence
  chemically synthesized
tgtaaagaacacaaaaggta

SEQ ID NO: 550203 - DNA, 20 bp, Artificial Sequence
  chemically synthesized
taattctttatttaagaagt

SEQ ID NO: 550204 - DNA, 20 bp, Artificial Sequence
  chemically synthesized
tgtttctttacttcttaaat

SEQ ID NO: 550205 - DNA, 20 bp, Artificial Sequence
  chemically synthesized
taagcatcttttttcaagcg

SEQ ID NO: 550206 - DNA, 20 bp, Artificial Sequence
  chemically synthesized
ccttgtcaatattcgccatc

SEQ ID NO: 550207 - DNA, 20 bp, Artificial Sequence
  chemically synthesized
aatggtgaaagcaaatctat

SEQ ID NO: 550208 - DNA, 20 bp, Artificial Sequence
  chemically synthesized
gcaatgagtatgtaggaagg

SEQ ID NO: 550209 - DNA, 20 bp, Artificial Sequence
  chemically synthesized
attatacaaagaaggaacac

SEQ ID NO: 550210 - DNA, 20 bp, Artificial Sequence
  chemically synthesized
aaagaacattatacttgaag

SEQ ID NO: 550211 - DNA, 20 bp, Artificial Sequence
  chemically synthesized
ccggcctgtatgtccatttt

SEQ ID NO: 550212 - DNA, 20 bp, Artificial Sequence
  chemically synthesized
acaagagttcagctgagctt

SEQ ID NO: 550213 - DNA, 20 bp, Artificial Sequence
  chemically synthesized
aaatagtacaatcttttcac

SEQ ID NO: 550214 - DNA, 20 bp, Artificial Sequence
  chemically synthesized
tgtcctctaaatggcactaa

SEQ ID NO: 550215 - DNA, 20 bp, Artificial Sequence
  chemically synthesized
gtccaaaggcatgtgatggt

SEQ ID NO: 550216 - DNA, 20 bp, Artificial Sequence
  chemically synthesized
ctactcgggaggctgaggta

SEQ ID NO: 550217 - DNA, 20 bp, Artificial Sequence
  chemically synthesized
agatgtctaaaagtaattcc

SEQ ID NO: 550218 - DNA, 20 bp, Artificial Sequence
  chemically synthesized
tggaatttttattgaacatg

SEQ ID NO: 550219 - DNA, 20 bp, Artificial Sequence
  chemically synthesized
gagcatttcatcagtttgga

SEQ ID NO: 550220 - DNA, 20 bp, Artificial Sequence
  chemically synthesized
caaattctttttacctgagt

SEQ ID NO: 550221 - DNA, 20 bp, Artificial Sequence
  chemically synthesized
ccttttctcaactcaggtaa

SEQ ID NO: 550222 - DNA, 20 bp, Artificial Sequence
  chemically synthesized
tttgaggtatccctatttgg

SEQ ID NO: 550223 - DNA, 20 bp, Artificial Sequence
  chemically synthesized
tagagcaaaagatgttcaat

SEQ ID NO: 550224 - DNA, 20 bp, Artificial Sequence
  chemically synthesized
aaactgataaataacattaa

SEQ ID NO: 550225 - DNA, 20 bp, Artificial Sequence
  chemically synthesized
taatatgtcacagctctagg

SEQ ID NO: 550226 - DNA, 20 bp, Artificial Sequence
  chemically synthesized
agctctaggtaagaatatag

SEQ ID NO: 550227 - DNA, 20 bp, Artificial Sequence
  chemically synthesized
taaatagaattgtacaggac

SEQ ID NO: 550228 - DNA, 20 bp, Artificial Sequence
  chemically synthesized
gaaattttgcctatttttaa

SEQ ID NO: 550229 - DNA, 20 bp, Artificial Sequence
  chemically synthesized
attctccttacatacaaagt

SEQ ID NO: 550230 - DNA, 20 bp, Artificial Sequence
  chemically synthesized
tttctccactttgtatgtaa

SEQ ID NO: 550231 - DNA, 20 bp, Artificial Sequence
  chemically synthesized
ctactcgagaggctgaggca

SEQ ID NO: 550232 - DNA, 20 bp, Artificial Sequence
  chemically synthesized
taaatgcaaaataataagtt

SEQ ID NO: 550233 - DNA, 20 bp, Artificial Sequence
  chemically synthesized
tcagcagtgtataactggct

SEQ ID NO: 550234 - DNA, 20 bp, Artificial Sequence
  chemically synthesized
gtagaaatcggaagtgagat

SEQ ID NO: 550235 - DNA, 20 bp, Artificial Sequence
  chemically synthesized
aaaaaaaagtaaagtgacat

SEQ ID NO: 550236 - DNA, 20 bp, Artificial Sequence
  chemically synthesized
actccaggggtgccttgtgg

SEQ ID NO: 550237 - DNA, 20 bp, Artificial Sequence
  chemically synthesized
atttgcgaatcaggcagccc

SEQ ID NO: 550238 - DNA, 20 bp, Artificial Sequence
  chemically synthesized
aaaaaaaaaatatagtgtta

SEQ ID NO: 550239 - DNA, 20 bp, Artificial Sequence
  chemically synthesized
ctttgcaaaaattataacgg

SEQ ID NO: 550240 - DNA, 20 bp, Artificial Sequence
  chemically synthesized
tcctgtatgtctacaccgca

SEQ ID NO: 550241 - DNA, 20 bp, Artificial Sequence
  chemically synthesized
tttcttacagttatggaggc

SEQ ID NO: 550242 - DNA, 20 bp, Artificial Sequence
  chemically synthesized
attctgagcctccataactg

SEQ ID NO: 550243 - DNA, 20 bp, Artificial Sequence
  chemically synthesized
tcatttgctgttgctataaa

SEQ ID NO: 550244 - DNA, 20 bp, Artificial Sequence
  chemically synthesized
ctaacaaaatagccaaaaga

SEQ ID NO: 550245 - DNA, 20 bp, Artificial Sequence
  chemically synthesized
caagacagggaaattgcaat

SEQ ID NO: 550246 - DNA, 20 bp, Artificial Sequence
  chemically synthesized
gggactttaaattttaaaac

SEQ ID NO: 550247 - DNA, 20 bp, Artificial Sequence
  chemically synthesized
aaaaacaaacaaaaataaaa

SEQ ID NO: 550248 - DNA, 20 bp, Artificial Sequence
  chemically synthesized
aattaggccatagggcaaag

SEQ ID NO: 550249 - DNA, 20 bp, Artificial Sequence
  chemically synthesized
caagacaggggaattgcaat

SEQ ID NO: 550250 - DNA, 20 bp, Artificial Sequence
  chemically synthesized
taggagcagtttggtggggg

SEQ ID NO: 550251 - DNA, 20 bp, Artificial Sequence
  chemically synthesized
gactaacatcagccacagtg

SEQ ID NO: 550252 - DNA, 20 bp, Artificial Sequence
  chemically synthesized
cataggctgaactaactttg

SEQ ID NO: 550253 - DNA, 20 bp, Artificial Sequence
  chemically synthesized
tataccttagggttaaagtg

SEQ ID NO: 550254 - DNA, 20 bp, Artificial Sequence
  chemically synthesized
gggcttccaaggcttgcgtg

SEQ ID NO: 550255 - DNA, 20 bp, Artificial Sequence
  chemically synthesized
acttctaacccacaaacaat

SEQ ID NO: 550256 - DNA, 20 bp, Artificial Sequence
  chemically synthesized
tttagaatttagtctaaact

SEQ ID NO: 550257 - DNA, 20 bp, Artificial Sequence
  chemically synthesized
ctaaactgaagaattaacct

SEQ ID NO: 550258 - DNA, 20 bp, Artificial Sequence
  chemically synthesized
cagagaaatattatgcttca

SEQ ID NO: 550259 - DNA, 20 bp, Artificial Sequence
  chemically synthesized
aataaaaatggggactgaac

SEQ ID NO: 550260 - DNA, 20 bp, Artificial Sequence
  chemically synthesized
tttattaaaaacaaatcatg

SEQ ID NO: 550261 - DNA, 20 bp, Artificial Sequence
  chemically synthesized
attatttgcatgaagtgcag

SEQ ID NO: 550262 - DNA, 20 bp, Artificial Sequence
  chemically synthesized
ttgatggaactctgttccat

SEQ ID NO: 550263 - DNA, 20 bp, Artificial Sequence
  chemically synthesized
acttggggttcctgggcctg

SEQ ID NO: 550264 - DNA, 20 bp, Artificial Sequence
  chemically synthesized
gttcctgacctgtggtaagt

SEQ ID NO: 550265 - DNA, 20 bp, Artificial Sequence
  chemically synthesized
tggaatggcatgcttccttt

SEQ ID NO: 550266 - DNA, 20 bp, Artificial Sequence
  chemically synthesized
ttttgtaacaggacaccatt

SEQ ID NO: 550267 - DNA, 20 bp, Artificial Sequence
  chemically synthesized
tccaatggtgtcctgttaca

SEQ ID NO: 550268 - DNA, 20 bp, Artificial Sequence
  chemically synthesized
agttaattgcatacgtgcaa

SEQ ID NO: 550269 - DNA, 20 bp, Artificial Sequence
  chemically synthesized
ttaactatactgtcataaat

SEQ ID NO: 550270 - DNA, 20 bp, Artificial Sequence
  chemically synthesized
acaaatggtttccaaattct

SEQ ID NO: 550271 - DNA, 20 bp, Artificial Sequence
  chemically synthesized
tttctctctacctgatttct

SEQ ID NO: 550272 - DNA, 20 bp, Artificial Sequence
  chemically synthesized
attctagagaaatcaggtag

SEQ ID NO: 550273 - DNA, 20 bp, Artificial Sequence
  chemically synthesized
taaaagtggcaaatagctct

SEQ ID NO: 550274 - DNA, 20 bp, Artificial Sequence
  chemically synthesized
ttattaatagtgaaatcata

SEQ ID NO: 550275 - DNA, 20 bp, Artificial Sequence
  chemically synthesized
tatttatacaaatacagtcc

SEQ ID NO: 550276 - DNA, 20 bp, Artificial Sequence
  chemically synthesized
taactctggagattgtgacg

SEQ ID NO: 550277 - DNA, 20 bp, Artificial Sequence
  chemically synthesized
acaatctccagagttattaa

SEQ ID NO: 550278 - DNA, 20 bp, Artificial Sequence
  chemically synthesized
actccagcctgggcaacaag

SEQ ID NO: 550279 - DNA, 20 bp, Artificial Sequence
  chemically synthesized
ctactcgggagaccgaggca

SEQ ID NO: 550280 - DNA, 20 bp, Artificial Sequence
  chemically synthesized
aagaccagcctgaccaacat

SEQ ID NO: 550281 - DNA, 20 bp, Artificial Sequence
  chemically synthesized
ataacatatactaagtcata

SEQ ID NO: 550282 - DNA, 20 bp, Artificial Sequence
  chemically synthesized
ctaatatctaaaagattagg

SEQ ID NO: 550283 - DNA, 20 bp, Artificial Sequence
  chemically synthesized
aaaacactggatatcacaaa

SEQ ID NO: 550284 - DNA, 20 bp, Artificial Sequence
  chemically synthesized
acgataactccaaaatctta

SEQ ID NO: 550285 - DNA, 20 bp, Artificial Sequence
  chemically synthesized
ggaaagctaagtctcctctg

SEQ ID NO: 550286 - DNA, 20 bp, Artificial Sequence
  chemically synthesized
tcccctgccatttacccaaa

SEQ ID NO: 550287 - DNA, 20 bp, Artificial Sequence
  chemically synthesized
acaaaaaaatcgtcttcaaa

SEQ ID NO: 550288 - DNA, 20 bp, Artificial Sequence
  chemically synthesized
aaagcgttctaaaaagttta

SEQ ID NO: 550289 - DNA, 20 bp, Artificial Sequence
  chemically synthesized
gtccaaataacagggtcttc

SEQ ID NO: 550290 - DNA, 20 bp, Artificial Sequence
  chemically synthesized
attaaagtcatactgtgggg

SEQ ID NO: 550291 - DNA, 20 bp, Artificial Sequence
  chemically synthesized
tgactttaatattttaacct

SEQ ID NO: 550292 - DNA, 20 bp, Artificial Sequence
  chemically synthesized
tagccaacttgtttataccc

SEQ ID NO: 550293 - DNA, 20 bp, Artificial Sequence
  chemically synthesized
aggaatatggcttttgttga

SEQ ID NO: 550294 - DNA, 20 bp, Artificial Sequence
  chemically synthesized
aacatgaaatcgaggttact

SEQ ID NO: 550295 - DNA, 20 bp, Artificial Sequence
  chemically synthesized
caaggaaacagtttgacctt

SEQ ID NO: 550296 - DNA, 20 bp, Artificial Sequence
  chemically synthesized
aaaaatattttgtcagaaaa

SEQ ID NO: 550297 - DNA, 20 bp, Artificial Sequence
  chemically synthesized
ttaaataaaaaaatattttg

SEQ ID NO: 550298 - DNA, 20 bp, Artificial Sequence
  chemically synthesized
cctgaagccagtaatctgat

SEQ ID NO: 550299 - DNA, 20 bp, Artificial Sequence
  chemically synthesized
ccttcagctgtgattaagcc

SEQ ID NO: 550300 - DNA, 20 bp, Artificial Sequence
  chemically synthesized
ttatactgcaacccaaaagg

SEQ ID NO: 550301 - DNA, 20 bp, Artificial Sequence
  chemically synthesized
agaaagaaacaaaaataaga

SEQ ID NO: 550302 - DNA, 20 bp, Artificial Sequence
  chemically synthesized
aagaaagaaagaaacaaaaa

SEQ ID NO: 550303 - DNA, 20 bp, Artificial Sequence
  chemically synthesized
actccgtcttaaaaagaaag

SEQ ID NO: 550304 - DNA, 20 bp, Artificial Sequence
  chemically synthesized
cgagactccgtcttaaaaag

SEQ ID NO: 550305 - DNA, 20 bp, Artificial Sequence
  chemically synthesized
agagcgagactccgtcttaa

SEQ ID NO: 550306 - DNA, 20 bp, Artificial Sequence
  chemically synthesized
ctacttgagaggctaaggca

SEQ ID NO: 550307 - DNA, 20 bp, Artificial Sequence
  chemically synthesized
acatggtgaaaccccgtctc

SEQ ID NO: 550308 - DNA, 20 bp, Artificial Sequence
  chemically synthesized
ggttttgagttttggggata

SEQ ID NO: 550309 - DNA, 20 bp, Artificial Sequence
  chemically synthesized
caagacaaaaaaattaaaaa

SEQ ID NO: 550310 - DNA, 20 bp, Artificial Sequence
  chemically synthesized
attaaaaaagagaaaaaaat

SEQ ID NO: 550311 - DNA, 20 bp, Artificial Sequence
  chemically synthesized
aaaataattcagtcggctga

SEQ ID NO: 550312 - DNA, 20 bp, Artificial Sequence
  chemically synthesized
caaaaaaacaagttccaaga

SEQ ID NO: 550313 - DNA, 20 bp, Artificial Sequence
  chemically synthesized
taaccatagtgctctttaaa

SEQ ID NO: 550314 - DNA, 20 bp, Artificial Sequence
  chemically synthesized
attaggtaataagagatcta

SEQ ID NO: 550315 - DNA, 20 bp, Artificial Sequence
  chemically synthesized
ggagattctaaatcttgtaa

SEQ ID NO: 550316 - DNA, 20 bp, Artificial Sequence
  chemically synthesized
gaagtttctttttacaagat

SEQ ID NO: 550317 - DNA, 20 bp, Artificial Sequence
  chemically synthesized
gaatctccacaaggtagtcc

SEQ ID NO: 550318 - DNA, 20 bp, Artificial Sequence
  chemically synthesized
ggaaaattcaagagaggaaa

SEQ ID NO: 550319 - DNA, 20 bp, Artificial Sequence
  chemically synthesized
attcaagagaggaaatcaga

SEQ ID NO: 550320 - DNA, 20 bp, Artificial Sequence
  chemically synthesized
aaagctacacaaataacaaa

SEQ ID NO: 550321 - DNA, 20 bp, Artificial Sequence
  chemically synthesized
tactgagctatatacagcgt

SEQ ID NO: 550322 - DNA, 20 bp, Artificial Sequence
  chemically synthesized
ggctccttctgggaaaagca

SEQ ID NO: 550323 - DNA, 20 bp, Artificial Sequence
  chemically synthesized
ttgcaaggcttttaactgct

SEQ ID NO: 550324 - DNA, 20 bp, Artificial Sequence
  chemically synthesized
aaattcctgtcctctggatg

SEQ ID NO: 550325 - DNA, 20 bp, Artificial Sequence
  chemically synthesized
cctctggatggtagaaacca

SEQ ID NO: 550326 - DNA, 20 bp, Artificial Sequence
  chemically synthesized
ttaaggacacaaaacaagac

SEQ ID NO: 550327 - DNA, 20 bp, Artificial Sequence
  chemically synthesized
ccctctctccattacataac

SEQ ID NO: 550328 - DNA, 20 bp, Artificial Sequence
  chemically synthesized
acatctgatgtagtttgtgc

SEQ ID NO: 550329 - DNA, 20 bp, Artificial Sequence
  chemically synthesized
cctctgcaagggtttggtta

SEQ ID NO: 550330 - DNA, 20 bp, Artificial Sequence
  chemically synthesized
agtttactatttaacaatgc

SEQ ID NO: 550331 - DNA, 20 bp, Artificial Sequence
  chemically synthesized
gagagagagagagagagaga

SEQ ID NO: 550332 - DNA, 20 bp, Artificial Sequence
  chemically synthesized
gagaccagaaacttgactga

SEQ ID NO: 550333 - DNA, 20 bp, Artificial Sequence
  chemically synthesized
tggcatcccagcaataaggg

SEQ ID NO: 550334 - DNA, 20 bp, Artificial Sequence
  chemically synthesized
aagctgcagagaaagggaac

SEQ ID NO: 550335 - DNA, 20 bp, Artificial Sequence
  chemically synthesized
tccgttcttctggaagctgc

SEQ ID NO: 550336 - DNA, 20 bp, Artificial Sequence
  chemically synthesized
ttgggcagaatcttgcaaat

SEQ ID NO: 550337 - DNA, 20 bp, Artificial Sequence
  chemically synthesized
ttccccatgcagcccgttgg

SEQ ID NO: 550338 - DNA, 20 bp, Artificial Sequence
  chemically synthesized
ctatcctcctattttctgta

SEQ ID NO: 550339 - DNA, 20 bp, Artificial Sequence
  chemically synthesized
attttgaggaggtttctcat

SEQ ID NO: 550340 - DNA, 20 bp, Artificial Sequence
  chemically synthesized
accagtagtcttcctactag

SEQ ID NO: 550341 - DNA, 20 bp, Artificial Sequence
  chemically synthesized
tagggctacagaaccagtca

SEQ ID NO: 550342 - DNA, 20 bp, Artificial Sequence
  chemically synthesized
cagagtcagcccccagtcca

SEQ ID NO: 550343 - DNA, 20 bp, Artificial Sequence
  chemically synthesized
caagacaggggaattgcaat

SEQ ID NO: 550344 - DNA, 20 bp, Artificial Sequence
  chemically synthesized
taggagcagtttggtggggg

SEQ ID NO: 550345 - DNA, 20 bp, Artificial Sequence
  chemically synthesized
gactaacatcagccacagta

SEQ ID NO: 550346 - DNA, 20 bp, Artificial Sequence
  chemically synthesized
cccccaccccattgcagtca

SEQ ID NO: 550347 - DNA, 20 bp, Artificial Sequence
  chemically synthesized
cattaaactaagataggctt

SEQ ID NO: 550348 - DNA, 20 bp, Artificial Sequence
  chemically synthesized
gtaagtcaatattattttta

SEQ ID NO: 550349 - DNA, 20 bp, Artificial Sequence
  chemically synthesized
attatatctttgtaaggcct

SEQ ID NO: 550350 - DNA, 20 bp, Artificial Sequence
  chemically synthesized
ttatggtaattattttctaa

SEQ ID NO: 550351 - DNA, 20 bp, Artificial Sequence
  chemically synthesized
tagtaaaagtaaatttctaa

SEQ ID NO: 550352 - DNA, 20 bp, Artificial Sequence
  chemically synthesized
tggtgtcttctagatgggaa

SEQ ID NO: 550353 - DNA, 20 bp, Artificial Sequence
  chemically synthesized
aaatgcattttgtcacaacc

SEQ ID NO: 550354 - DNA, 20 bp, Artificial Sequence
  chemically synthesized
tcagtttatgtttcattaat

SEQ ID NO: 550355 - DNA, 20 bp, Artificial Sequence
  chemically synthesized
aaggaaaatctgacttgaaa

SEQ ID NO: 550356 - DNA, 20 bp, Artificial Sequence
  chemically synthesized
tatgcgaattgagtgcctct

SEQ ID NO: 550357 - DNA, 20 bp, Artificial Sequence
  chemically synthesized
tgtagaggcactcaattcgc

SEQ ID NO: 550358 - DNA, 20 bp, Artificial Sequence
  chemically synthesized
ccagttttgcaaatattaag

SEQ ID NO: 550359 - DNA, 20 bp, Artificial Sequence
  chemically synthesized
gccatgatgtaaaaacaaaa

SEQ ID NO: 550360 - DNA, 20 bp, Artificial Sequence
  chemically synthesized
aaaaaaagttattagtacaa

SEQ ID NO: 550361 - DNA, 20 bp, Artificial Sequence
  chemically synthesized
tatgtgataacattcacaag

SEQ ID NO: 550362 - DNA, 20 bp, Artificial Sequence
  chemically synthesized
attcacagtgaagaaaatga

SEQ ID NO: 550363 - DNA, 20 bp, Artificial Sequence
  chemically synthesized
agtctgtctgaattcacagt

SEQ ID NO: 550364 - DNA, 20 bp, Artificial Sequence
  chemically synthesized
atcattcaaaggtttgctat

SEQ ID NO: 550365 - DNA, 20 bp, Artificial Sequence
  chemically synthesized
caaaggtttgctatacagaa

SEQ ID NO: 550366 - DNA, 20 bp, Artificial Sequence
  chemically synthesized
tcccatgaaaatcagataat

SEQ ID NO: 550367 - DNA, 20 bp, Artificial Sequence
  chemically synthesized
tcccattttaaaagtaggta

SEQ ID NO: 550368 - DNA, 20 bp, Artificial Sequence
  chemically synthesized
aaactaaaatattaaacact

SEQ ID NO: 550369 - DNA, 20 bp, Artificial Sequence
  chemically synthesized
taaagggccaaggaataaaa

SEQ ID NO: 550370 - DNA, 20 bp, Artificial Sequence
  chemically synthesized
aataaaataagaatgcgaag

SEQ ID NO: 550371 - DNA, 20 bp, Artificial Sequence
  chemically synthesized
atgcagcactttatcctcaa

SEQ ID NO: 550372 - DNA, 20 bp, Artificial Sequence
  chemically synthesized
ttgcttttttataccaagag

SEQ ID NO: 550373 - DNA, 20 bp, Artificial Sequence
  chemically synthesized
tataacctctcaaacagtag

SEQ ID NO: 550374 - DNA, 20 bp, Artificial Sequence
  chemically synthesized
cctcttccccaaggatttct

SEQ ID NO: 550375 - DNA, 20 bp, Artificial Sequence
  chemically synthesized
caaatcaaataaacatttct

SEQ ID NO: 550376 - DNA, 20 bp, Artificial Sequence
  chemically synthesized
atacatttccagctttgttc

SEQ ID NO: 550377 - DNA, 20 bp, Artificial Sequence
  chemically synthesized
aacagaatgaatgaatgtga

SEQ ID NO: 550378 - DNA, 20 bp, Artificial Sequence
  chemically synthesized
tgaacacagtattgtactga

SEQ ID NO: 550379 - DNA, 20 bp, Artificial Sequence
  chemically synthesized
attatgctgaggctttaaaa

SEQ ID NO: 550380 - DNA, 20 bp, Artificial Sequence
  chemically synthesized
gataaaacagatctttcttc

SEQ ID NO: 550381 - DNA, 20 bp, Artificial Sequence
  chemically synthesized
atgcttgaaataatttctat

SEQ ID NO: 550382 - DNA, 20 bp, Artificial Sequence
  chemically synthesized
cataaagatccaaaaagaac

SEQ ID NO: 550383 - DNA, 20 bp, Artificial Sequence
  chemically synthesized
catctagaatttcaatagac

SEQ ID NO: 550384 - DNA, 20 bp, Artificial Sequence
  chemically synthesized
aggtgacatcttgaagacat

SEQ ID NO: 550385 - DNA, 20 bp, Artificial Sequence
  chemically synthesized
gaagctatgggccgcaaagc

SEQ ID NO: 550386 - DNA, 20 bp, Artificial Sequence
  chemically synthesized
ctagtctggaggctgagaca

SEQ ID NO: 550387 - DNA, 20 bp, Artificial Sequence
  chemically synthesized
gacccctgtctctactaaaa

SEQ ID NO: 550388 - DNA, 20 bp, Artificial Sequence
  chemically synthesized
atggctttggacaaagtaca

SEQ ID NO: 550389 - DNA, 20 bp, Artificial Sequence
  chemically synthesized
atggaagcaccttgcaattg

SEQ ID NO: 550390 - DNA, 20 bp, Artificial Sequence
  chemically synthesized
ctcttagcagcttcttaatt

SEQ ID NO: 550391 - DNA, 20 bp, Artificial Sequence
  chemically synthesized
ctactcgggaggctgaggca

SEQ ID NO: 550392 - DNA, 20 bp, Artificial Sequence
  chemically synthesized
gcgagactccatctcaaaaa

SEQ ID NO: 550393 - DNA, 20 bp, Artificial Sequence
  chemically synthesized
ttttattataagttttaata

SEQ ID NO: 550394 - DNA, 20 bp, Artificial Sequence
  chemically synthesized
aaattaactgtttaattttc

SEQ ID NO: 550395 - DNA, 20 bp, Artificial Sequence
  chemically synthesized
cagagccagtcattaatgaa

SEQ ID NO: 550396 - DNA, 20 bp, Artificial Sequence
  chemically synthesized
aaaccccgtctctactaaaa

SEQ ID NO: 550397 - DNA, 20 bp, Artificial Sequence
  chemically synthesized
gtaaagctggagcaatcagt

SEQ ID NO: 550398 - DNA, 20 bp, Artificial Sequence
  chemically synthesized
ctacctgggggactgaagtg

SEQ ID NO: 550399 - DNA, 20 bp, Artificial Sequence
  chemically synthesized
ctacttctgtatcttaccgt

SEQ ID NO: 550400 - DNA, 20 bp, Artificial Sequence
  chemically synthesized
aagatacagaagtagagttc

SEQ ID NO: 550401 - DNA, 20 bp, Artificial Sequence
  chemically synthesized
aaaaaaaaagaagcctctcg

SEQ ID NO: 550402 - DNA, 20 bp, Artificial Sequence
  chemically synthesized
gtttcatattaaatgatagt

SEQ ID NO: 550403 - DNA, 20 bp, Artificial Sequence
  chemically synthesized
ctataataatatagtataga

SEQ ID NO: 550404 - DNA, 20 bp, Artificial Sequence
  chemically synthesized
atattctataataatatagt

SEQ ID NO: 550405 - DNA, 20 bp, Artificial Sequence
  chemically synthesized
ctattctatactatattatt

SEQ ID NO: 550406 - DNA, 20 bp, Artificial Sequence
  chemically synthesized
tatatatgttataatataga

SEQ ID NO: 550407 - DNA, 20 bp, Artificial Sequence
  chemically synthesized
tataatatatatgttataat

SEQ ID NO: 550408 - DNA, 20 bp, Artificial Sequence
  chemically synthesized
agcagccatgagtatctcct

SEQ ID NO: 550409 - DNA, 20 bp, Artificial Sequence
  chemically synthesized
gcatttgactatcatatgcc

SEQ ID NO: 550410 - DNA, 20 bp, Artificial Sequence
  chemically synthesized
tttttttaagaagatgaagc

SEQ ID NO: 550411 - DNA, 20 bp, Artificial Sequence
  chemically synthesized
tattatttttatgtacttct

SEQ ID NO: 550412 - DNA, 20 bp, Artificial Sequence
  chemically synthesized
tttatctactttaaaataga

SEQ ID NO: 550413 - DNA, 20 bp, Artificial Sequence
  chemically synthesized
tatattttatctactttaaa

SEQ ID NO: 550414 - DNA, 20 bp, Artificial Sequence
  chemically synthesized
gaaccaaaataataggagaa

SEQ ID NO: 550415 - DNA, 20 bp, Artificial Sequence
  chemically synthesized
ctcatagaaccaaaataata

SEQ ID NO: 550416 - DNA, 20 bp, Artificial Sequence
  chemically synthesized
cctattattttggttctatg

SEQ ID NO: 550417 - DNA, 20 bp, Artificial Sequence
  chemically synthesized
tggttctatgagagaatgtt

SEQ ID NO: 550418 - DNA, 20 bp, Artificial Sequence
  chemically synthesized
cccaactctcagtccaggac

SEQ ID NO: 550419 - DNA, 20 bp, Artificial Sequence
  chemically synthesized
agaagtgtgtgtctgcttta

SEQ ID NO: 550420 - DNA, 20 bp, Artificial Sequence
  chemically synthesized
cagaagatacataaatataa

SEQ ID NO: 550421 - DNA, 20 bp, Artificial Sequence
  chemically synthesized
gataaaagctgtgggactcc

SEQ ID NO: 550422 - DNA, 20 bp, Artificial Sequence
  chemically synthesized
ggtctttataacctctatac

SEQ ID NO: 550423 - DNA, 20 bp, Artificial Sequence
  chemically synthesized
tgtccagctggaaataaaaa

SEQ ID NO: 550424 - DNA, 20 bp, Artificial Sequence
  chemically synthesized
acttcactgggggcttgaag

SEQ ID NO: 550425 - DNA, 20 bp, Artificial Sequence
  chemically synthesized
taataaattgtgaacaaagt

SEQ ID NO: 550426 - DNA, 20 bp, Artificial Sequence
  chemically synthesized
atagtcatgaaggctgcttt

SEQ ID NO: 550427 - DNA, 20 bp, Artificial Sequence
  chemically synthesized
gaagagcattagaaaatctg

SEQ ID NO: 550428 - DNA, 20 bp, Artificial Sequence
  chemically synthesized
aacagtgatgtggaagagca

SEQ ID NO: 550429 - DNA, 20 bp, Artificial Sequence
  chemically synthesized
ctaaaatgtaaagggtgaac

SEQ ID NO: 550430 - DNA, 20 bp, Artificial Sequence
  chemically synthesized
tctcatgcacttatttttat

SEQ ID NO: 550431 - DNA, 20 bp, Artificial Sequence
  chemically synthesized
gacaagcatatgtaagtagt

SEQ ID NO: 550432 - DNA, 20 bp, Artificial Sequence
  chemically synthesized
tttttttaagaagatgaagc

SEQ ID NO: 550433 - DNA, 20 bp, Artificial Sequence
  chemically synthesized
gcatttgactgtcatatgcc

SEQ ID NO: 550434 - DNA, 20 bp, Artificial Sequence
  chemically synthesized
agcagccatgaatatctcct

SEQ ID NO: 550435 - DNA, 20 bp, Artificial Sequence
  chemically synthesized
ctgaaattaaggcataatct

SEQ ID NO: 550436 - DNA, 20 bp, Artificial Sequence
  chemically synthesized
ctgatcattatgtatcaata

SEQ ID NO: 550437 - DNA, 20 bp, Artificial Sequence
  chemically synthesized
agtaagttttagcaaaacct

SEQ ID NO: 550438 - DNA, 20 bp, Artificial Sequence
  chemically synthesized
ttttgtataattgtctacta

SEQ ID NO: 550439 - DNA, 20 bp, Artificial Sequence
  chemically synthesized
aaaattcttattttcagaga

SEQ ID NO: 550440 - DNA, 20 bp, Artificial Sequence
  chemically synthesized
gcatttcttgtctctgaaaa

SEQ ID NO: 550441 - DNA, 20 bp, Artificial Sequence
  chemically synthesized
ttctgggacccctagaagcc

SEQ ID NO: 550442 - DNA, 20 bp, Artificial Sequence
  chemically synthesized
ttctttggcttctaggggtc

SEQ ID NO: 550443 - DNA, 20 bp, Artificial Sequence
  chemically synthesized
gctctttattggtgaggtta

SEQ ID NO: 550444 - DNA, 20 bp, Artificial Sequence
  chemically synthesized
aaaagcagtagtatgctatt

SEQ ID NO: 550445 - DNA, 20 bp, Artificial Sequence
  chemically synthesized
tacacagaagcctcttcatt

SEQ ID NO: 550446 - DNA, 20 bp, Artificial Sequence
  chemically synthesized
aaataaaataaataaataaa

SEQ ID NO: 550447 - DNA, 20 bp, Artificial Sequence
  chemically synthesized
ctacttgggaggctgaggct

SEQ ID NO: 550448 - DNA, 20 bp, Artificial Sequence
  chemically synthesized
gccagggtaactatatctaa

SEQ ID NO: 550449 - DNA, 20 bp, Artificial Sequence
  chemically synthesized
agctcctattgtgggaagga

SEQ ID NO: 550450 - DNA, 20 bp, Artificial Sequence
  chemically synthesized
tgcataagctctttactcca

SEQ ID NO: 550451 - DNA, 20 bp, Artificial Sequence
  chemically synthesized
tacattatctgtattcagaa

SEQ ID NO: 550452 - DNA, 20 bp, Artificial Sequence
  chemically synthesized
aatatttacattatctgtat

SEQ ID NO: 550453 - DNA, 20 bp, Artificial Sequence
  chemically synthesized
gggaagacgtacactcagtc

SEQ ID NO: 550454 - DNA, 20 bp, Artificial Sequence
  chemically synthesized
tgctagttgctggagtatga

SEQ ID NO: 550455 - DNA, 20 bp, Artificial Sequence
  chemically synthesized
atgagtttatacgcacctta

SEQ ID NO: 550456 - DNA, 20 bp, Artificial Sequence
  chemically synthesized
agcaacccatcatgatacaa

SEQ ID NO: 550457 - DNA, 20 bp, Artificial Sequence
  chemically synthesized
ctgaatgtgaagattgtact

SEQ ID NO: 550458 - DNA, 20 bp, Artificial Sequence
  chemically synthesized
ttgtttacacacaatcacct

SEQ ID NO: 550459 - DNA, 20 bp, Artificial Sequence
  chemically synthesized
ttgaatgaatgaagaaatga

SEQ ID NO: 550460 - DNA, 20 bp, Artificial Sequence
  chemically synthesized
gtcagtgttgttgaatgaat

SEQ ID NO: 550461 - DNA, 20 bp, Artificial Sequence
  chemically synthesized
tcaatgaacttacagtcttt

SEQ ID NO: 550462 - DNA, 20 bp, Artificial Sequence
  chemically synthesized
cagcatgacttgacaaatct

SEQ ID NO: 550463 - DNA, 20 bp, Artificial Sequence
  chemically synthesized
aatcttaagaaaaaagagcc

SEQ ID NO: 550464 - DNA, 20 bp, Artificial Sequence
  chemically synthesized
gaaaaaagagccagagaaac

SEQ ID NO: 550465 - DNA, 20 bp, Artificial Sequence
  chemically synthesized
gagggatctaaattaggcta

SEQ ID NO: 550466 - DNA, 20 bp, Artificial Sequence
  chemically synthesized
ggaggaagggtgtcccagac

SEQ ID NO: 550467 - DNA, 20 bp, Artificial Sequence
  chemically synthesized
ataaaattacataatatatt

SEQ ID NO: 550468 - DNA, 20 bp, Artificial Sequence
  chemically synthesized
ctactcgggaggctgaggag

SEQ ID NO: 550469 - DNA, 20 bp, Artificial Sequence
  chemically synthesized
tccatctcaaaaaaaaaaaa

SEQ ID NO: 550470 - DNA, 20 bp, Artificial Sequence
  chemically synthesized
aaaaaaaaaaaaaagaaaaa

SEQ ID NO: 550471 - DNA, 20 bp, Artificial Sequence
  chemically synthesized
aaaagaaaaaaaagaaagag

SEQ ID NO: 550472 - DNA, 20 bp, Artificial Sequence
  chemically synthesized
ttttttcctttcaaatatgt

SEQ ID NO: 550473 - DNA, 20 bp, Artificial Sequence
  chemically synthesized
cacacgggtggtataagtac

SEQ ID NO: 550474 - DNA, 20 bp, Artificial Sequence
  chemically synthesized
actacagaaaagagaattaa

SEQ ID NO: 550475 - DNA, 20 bp, Artificial Sequence
  chemically synthesized
gagtttgtacactacagaaa

SEQ ID NO: 550476 - DNA, 20 bp, Artificial Sequence
  chemically synthesized
gatacatgagtttgtacact

SEQ ID NO: 550477 - DNA, 20 bp, Artificial Sequence
  chemically synthesized
gggggctattagcactacct

SEQ ID NO: 550478 - DNA, 20 bp, Artificial Sequence
  chemically synthesized
tgtatgcattttgagatggc

SEQ ID NO: 550479 - DNA, 20 bp, Artificial Sequence
  chemically synthesized
ctcaaaatgcatacaaattg

SEQ ID NO: 550480 - DNA, 20 bp, Artificial Sequence
  chemically synthesized
aaatgaagacaggatagata

SEQ ID NO: 550481 - DNA, 20 bp, Artificial Sequence
  chemically synthesized
taaatcaaacactacttctt

SEQ ID NO: 550482 - DNA, 20 bp, Artificial Sequence
  chemically synthesized
ctactctggaggctgaggca

SEQ ID NO: 550483 - DNA, 20 bp, Artificial Sequence
  chemically synthesized
ccaccgcgcccggccttctt

SEQ ID NO: 550484 - DNA, 20 bp, Artificial Sequence
  chemically synthesized
atatcttacagaaacattat

SEQ ID NO: 550485 - DNA, 20 bp, Artificial Sequence
  chemically synthesized
tagatttaaaaatatatctt

SEQ ID NO: 550486 - DNA, 20 bp, Artificial Sequence
  chemically synthesized
ctacttgggaggctgaggca

SEQ ID NO: 550487 - DNA, 20 bp, Artificial Sequence
  chemically synthesized
gtaaactttccctttgacct

SEQ ID NO: 550488 - DNA, 20 bp, Artificial Sequence
  chemically synthesized
agggtatctgggaatatcaa

SEQ ID NO: 550489 - DNA, 20 bp, Artificial Sequence
  chemically synthesized
tcataagcaaattataatgt

SEQ ID NO: 550490 - DNA, 20 bp, Artificial Sequence
  chemically synthesized
atcaagtttgtgttttacca

SEQ ID NO: 550491 - DNA, 20 bp, Artificial Sequence
  chemically synthesized
taccagcagaatcaaaatta

SEQ ID NO: 550492 - DNA, 20 bp, Artificial Sequence
  chemically synthesized
ctatgtgctataaggatcct

SEQ ID NO: 550493 - DNA, 20 bp, Artificial Sequence
  chemically synthesized
taaaaaataatacctgttct

SEQ ID NO: 550494 - DNA, 20 bp, Artificial Sequence
  chemically synthesized
agaatcttatttaacagttg

SEQ ID NO: 550495 - DNA, 20 bp, Artificial Sequence
  chemically synthesized
tctctgaggtgataaaagtc

SEQ ID NO: 550496 - DNA, 20 bp, Artificial Sequence
  chemically synthesized
taggaaaatactgtattttt

SEQ ID NO: 550497 - DNA, 20 bp, Artificial Sequence
  chemically synthesized
ctgcttctatgtggaaccat

SEQ ID NO: 550498 - DNA, 20 bp, Artificial Sequence
  chemically synthesized
ctagatggttccacatagaa

SEQ ID NO: 550499 - DNA, 20 bp, Artificial Sequence
  chemically synthesized
atagaagcagaaaaaaaata

SEQ ID NO: 550500 - DNA, 20 bp, Artificial Sequence
  chemically synthesized
aagcagaaaaaaaatacaag

SEQ ID NO: 550501 - DNA, 20 bp, Artificial Sequence
  chemically synthesized
ttgttgatacagatgttact

SEQ ID NO: 550502 - DNA, 20 bp, Artificial Sequence
  chemically synthesized
ctgcttgggaggctgaggca

SEQ ID NO: 550503 - DNA, 20 bp, Artificial Sequence
  chemically synthesized
agatacagaacatttctatt

SEQ ID NO: 550504 - DNA, 20 bp, Artificial Sequence
  chemically synthesized
tgctaatagaactttctgca

SEQ ID NO: 550505 - DNA, 20 bp, Artificial Sequence
  chemically synthesized
ttgaatctttcccagatagg

SEQ ID NO: 550506 - DNA, 20 bp, Artificial Sequence
  chemically synthesized
aatatatgtatttgttctgt

SEQ ID NO: 550507 - DNA, 20 bp, Artificial Sequence
  chemically synthesized
attcatcccagtttagcgga

SEQ ID NO: 550508 - DNA, 20 bp, Artificial Sequence
  chemically synthesized
aaaactggtgcttatctatc

SEQ ID NO: 550509 - DNA, 20 bp, Artificial Sequence
  chemically synthesized
accatgagaaactataattc

SEQ ID NO: 550510 - DNA, 20 bp, Artificial Sequence
  chemically synthesized
agcagaattggtttacacca

SEQ ID NO: 550511 - DNA, 20 bp, Artificial Sequence
  chemically synthesized
atgacagcagacccattcaa

SEQ ID NO: 550512 - DNA, 20 bp, Artificial Sequence
  chemically synthesized
tatatgtaaacaatgtttat

SEQ ID NO: 550513 - DNA, 20 bp, Artificial Sequence
  chemically synthesized
taaacaatgtttatttagaa

SEQ ID NO: 550514 - DNA, 20 bp, Artificial Sequence
  chemically synthesized
tgcttgttccctggtgctgc

SEQ ID NO: 550515 - DNA, 20 bp, Artificial Sequence
  chemically synthesized
caaggtcatttttacttttt

SEQ ID NO: 550516 - DNA, 20 bp, Artificial Sequence
  chemically synthesized
gctagccaatcgggacaaat

SEQ ID NO: 550517 - DNA, 20 bp, Artificial Sequence
  chemically synthesized
tgtttccacaagttacttgc

SEQ ID NO: 550518 - DNA, 20 bp, Artificial Sequence
  chemically synthesized
aaatatctactagccgtaat

SEQ ID NO: 550519 - DNA, 20 bp, Artificial Sequence
  chemically synthesized
tattacggctagtagatatt

SEQ ID NO: 550520 - DNA, 20 bp, Artificial Sequence
  chemically synthesized
gggtaggaaagtttctttgg

SEQ ID NO: 550521 - DNA, 20 bp, Artificial Sequence
  chemically synthesized
aaaagtagaggtttctctcc

SEQ ID NO: 550522 - DNA, 20 bp, Artificial Sequence
  chemically synthesized
caagagctgtgacctttgaa

SEQ ID NO: 550523 - DNA, 20 bp, Artificial Sequence
  chemically synthesized
ggcccctggctctggggaca

SEQ ID NO: 550524 - DNA, 20 bp, Artificial Sequence
  chemically synthesized
gggtaaactatgagaggcaa

SEQ ID NO: 550525 - DNA, 20 bp, Artificial Sequence
  chemically synthesized
gcttatctatcagagatcag

SEQ ID NO: 550526 - DNA, 20 bp, Artificial Sequence
  chemically synthesized
tgtggttgttccatatctat

SEQ ID NO: 550527 - DNA, 20 bp, Artificial Sequence
  chemically synthesized
atctatctagaaacatatct

SEQ ID NO: 550528 - DNA, 20 bp, Artificial Sequence
  chemically synthesized
tatgaaaggaagttccattt

SEQ ID NO: 550529 - DNA, 20 bp, Artificial Sequence
  chemically synthesized
tcttggctgtaaaaaacagt

SEQ ID NO: 550530 - DNA, 20 bp, Artificial Sequence
  chemically synthesized
tctttactgttttttacagc

SEQ ID NO: 550531 - DNA, 20 bp, Artificial Sequence
  chemically synthesized
gacacgcaacataagaagat

SEQ ID NO: 550532 - DNA, 20 bp, Artificial Sequence
  chemically synthesized
ggtaatatttaaaaatatat

SEQ ID NO: 550533 - DNA, 20 bp, Artificial Sequence
  chemically synthesized
ctgagttggtgtgccccttg

SEQ ID NO: 550534 - DNA, 20 bp, Artificial Sequence
  chemically synthesized
ttctacagcaaaaccatatg

SEQ ID NO: 550535 - DNA, 20 bp, Artificial Sequence
  chemically synthesized
aaggaaaaaataaactgttt

SEQ ID NO: 550536 - DNA, 20 bp, Artificial Sequence
  chemically synthesized
caaagaaatacatgatattt

SEQ ID NO: 550537 - DNA, 20 bp, Artificial Sequence
  chemically synthesized
tcatcgtttccatctttaac

SEQ ID NO: 550538 - DNA, 20 bp, Artificial Sequence
  chemically synthesized
atactcgggaagctgaggca

SEQ ID NO: 550539 - DNA, 20 bp, Artificial Sequence
  chemically synthesized
tgtaaaactcctgaatttgg

SEQ ID NO: 550540 - DNA, 20 bp, Artificial Sequence
  chemically synthesized
ctgaatttggatagaatatc

SEQ ID NO: 550541 - DNA, 20 bp, Artificial Sequence
  chemically synthesized
gccactaggaagctgctgga

SEQ ID NO: 550542 - DNA, 20 bp, Artificial Sequence
  chemically synthesized
cccacacttgtcacatggct

SEQ ID NO: 550543 - DNA, 20 bp, Artificial Sequence
  chemically synthesized
ccaacaaagtatctttaatg

SEQ ID NO: 550544 - DNA, 20 bp, Artificial Sequence
  chemically synthesized
gattttacagctcctaggtg

SEQ ID NO: 550545 - DNA, 20 bp, Artificial Sequence
  chemically synthesized
tatattgatgaatgggcata

SEQ ID NO: 550546 - DNA, 20 bp, Artificial Sequence
  chemically synthesized
ccccgtctctactaaaaaat

SEQ ID NO: 550547 - DNA, 20 bp, Artificial Sequence
  chemically synthesized
ctacttgggaagctaaggca

SEQ ID NO: 550548 - DNA, 20 bp, Artificial Sequence
  chemically synthesized
caagactccatctctcaaaa

SEQ ID NO: 550549 - DNA, 20 bp, Artificial Sequence
  chemically synthesized
ctccatctctcaaaaaaaga

SEQ ID NO: 550550 - DNA, 20 bp, Artificial Sequence
  chemically synthesized
ctcaaaaaaagaaaagaaaa

SEQ ID NO: 550551 - DNA, 20 bp, Artificial Sequence
  chemically synthesized
gaaaagaaaagaagaaaaaa

SEQ ID NO: 550552 - DNA, 20 bp, Artificial Sequence
  chemically synthesized
agaaaagaagaaaaaaaaag

SEQ ID NO: 550553 - DNA, 20 bp, Artificial Sequence
  chemically synthesized
atattatttacttcctcatt

SEQ ID NO: 550554 - DNA, 20 bp, Artificial Sequence
  chemically synthesized
ttgtgaatataatttaaaaa

SEQ ID NO: 550555 - DNA, 20 bp, Artificial Sequence
  chemically synthesized
tgaaagttttatcaaaggag

SEQ ID NO: 550556 - DNA, 20 bp, Artificial Sequence
  chemically synthesized
tctttgaaagttttatcaaa

SEQ ID NO: 550557 - DNA, 20 bp, Artificial Sequence
  chemically synthesized
acaatggttattttactgtc

SEQ ID NO: 550558 - DNA, 20 bp, Artificial Sequence
  chemically synthesized
atattattttatttcaaaga

SEQ ID NO: 550559 - DNA, 20 bp, Artificial Sequence
  chemically synthesized
actctaaaatttattcatta

SEQ ID NO: 550560 - DNA, 20 bp, Artificial Sequence
  chemically synthesized
ttaagtataattttggaaaa

SEQ ID NO: 550561 - DNA, 20 bp, Artificial Sequence
  chemically synthesized
aataacattgcctttaattc

SEQ ID NO: 550562 - DNA, 20 bp, Artificial Sequence
  chemically synthesized
gttatctgatgagaaaattt

SEQ ID NO: 550563 - DNA, 20 bp, Artificial Sequence
  chemically synthesized
atatttgagaggttatctga

SEQ ID NO: 550564 - DNA, 20 bp, Artificial Sequence
  chemically synthesized
atttctaagaagttatttga

SEQ ID NO: 550565 - DNA, 20 bp, Artificial Sequence
  chemically synthesized
ttttctcatcaaataacttc

SEQ ID NO: 550566 - DNA, 20 bp, Artificial Sequence
  chemically synthesized
attgaaatcttcctaaagtg

SEQ ID NO: 550567 - DNA, 20 bp, Artificial Sequence
  chemically synthesized
gtggaatcaataaagcattc

SEQ ID NO: 550568 - DNA, 20 bp, Artificial Sequence
  chemically synthesized
acatatatacgatgtaaaat

SEQ ID NO: 550569 - DNA, 20 bp, Artificial Sequence
  chemically synthesized
aagtgaacgcttttcattgg

SEQ ID NO: 550570 - DNA, 20 bp, Artificial Sequence
  chemically synthesized
aaatgagactaccccttgtc

SEQ ID NO: 550571 - DNA, 20 bp, Artificial Sequence
  chemically synthesized
atttcacagtagtcttcagt

SEQ ID NO: 550572 - DNA, 20 bp, Artificial Sequence
  chemically synthesized
tgttacaacttgatacacaa

SEQ ID NO: 550573 - DNA, 20 bp, Artificial Sequence
  chemically synthesized
tatttaatatcgtgatgcta

SEQ ID NO: 550574 - DNA, 20 bp, Artificial Sequence
  chemically synthesized
catcacgatattaaatacgt

SEQ ID NO: 550575 - DNA, 20 bp, Artificial Sequence
  chemically synthesized
gaaccaaaagttaatttttg

SEQ ID NO: 550576 - DNA, 20 bp, Artificial Sequence
  chemically synthesized
ccagatggcctgaagtaact

SEQ ID NO: 550577 - DNA, 20 bp, Artificial Sequence
  chemically synthesized
gacgcgactgaaatgaccca

SEQ ID NO: 550578 - DNA, 20 bp, Artificial Sequence
  chemically synthesized
aatttttaaaaaatgtaaac

SEQ ID NO: 550579 - DNA, 20 bp, Artificial Sequence
  chemically synthesized
atggaatcactaaaaaaatt

SEQ ID NO: 550580 - DNA, 20 bp, Artificial Sequence
  chemically synthesized
ttcttaggaaaaatatattt

SEQ ID NO: 550581 - DNA, 20 bp, Artificial Sequence
  chemically synthesized
aaagtgagagtaatttaaaa

SEQ ID NO: 550582 - DNA, 20 bp, Artificial Sequence
  chemically synthesized
aatatcagtagattttagca

SEQ ID NO: 550583 - DNA, 20 bp, Artificial Sequence
  chemically synthesized
taaaatatgacaaaactcta

SEQ ID NO: 550584 - DNA, 20 bp, Artificial Sequence
  chemically synthesized
atttaagtgggctaactcat

SEQ ID NO: 550585 - DNA, 20 bp, Artificial Sequence
  chemically synthesized
ttttctgtgctagaaaattt

SEQ ID NO: 550586 - DNA, 20 bp, Artificial Sequence
  chemically synthesized
gtttcttaaaattttctagc

SEQ ID NO: 550587 - DNA, 20 bp, Artificial Sequence
  chemically synthesized
tattaacatatttttctgtg

SEQ ID NO: 550588 - DNA, 20 bp, Artificial Sequence
  chemically synthesized
catgatagtctctttattca

SEQ ID NO: 550589 - DNA, 20 bp, Artificial Sequence
  chemically synthesized
ttgaataaagagactatcat

SEQ ID NO: 550590 - DNA, 20 bp, Artificial Sequence
  chemically synthesized
tcttcacacggacgcgtatg

SEQ ID NO: 550591 - DNA, 20 bp, Artificial Sequence
  chemically synthesized
ttgggcgtctgtgtttgaat

SEQ ID NO: 550592 - DNA, 20 bp, Artificial Sequence
  chemically synthesized
ttcaaacacagacgcccaag

SEQ ID NO: 550593 - DNA, 20 bp, Artificial Sequence
  chemically synthesized
gagagttttcacattgtctt

SEQ ID NO: 550594 - DNA, 20 bp, Artificial Sequence
  chemically synthesized
gtgaaaactctcattaggca

SEQ ID NO: 550595 - DNA, 20 bp, Artificial Sequence
  chemically synthesized
cactgttcattttaactggg

SEQ ID NO: 550596 - DNA, 20 bp, Artificial Sequence
  chemically synthesized
ttcctacatagaccattgga

SEQ ID NO: 550597 - DNA, 20 bp, Artificial Sequence
  chemically synthesized
aaatgggacaaccacatgtg

SEQ ID NO: 550598 - DNA, 20 bp, Artificial Sequence
  chemically synthesized
ctgaaaccataaaactcctc

SEQ ID NO: 550599 - DNA, 20 bp, Artificial Sequence
  chemically synthesized
tcctggacattggcctaggt

SEQ ID NO: 550600 - DNA, 20 bp, Artificial Sequence
  chemically synthesized
taaaaagcttctgcacagca

SEQ ID NO: 550601 - DNA, 20 bp, Artificial Sequence
  chemically synthesized
agaaataaccatcaacgtaa

SEQ ID NO: 550602 - DNA, 20 bp, Artificial Sequence
  chemically synthesized
tcaacgtaaacagaaaaccg

SEQ ID NO: 550603 - DNA, 20 bp, Artificial Sequence
  chemically synthesized
gaactcaagcaaatcagcaa

SEQ ID NO: 550604 - DNA, 20 bp, Artificial Sequence
  chemically synthesized
tttaaaaagcttggaaacga

SEQ ID NO: 550605 - DNA, 20 bp, Artificial Sequence
  chemically synthesized
atcatttgtatatcttcttt

SEQ ID NO: 550606 - DNA, 20 bp, Artificial Sequence
  chemically synthesized
gagatacttccttatcttag

SEQ ID NO: 550607 - DNA, 20 bp, Artificial Sequence
  chemically synthesized
tatacctacttctagttctt

SEQ ID NO: 550608 - DNA, 20 bp, Artificial Sequence
  chemically synthesized
caattcacaatcgcaaagat

SEQ ID NO: 550609 - DNA, 20 bp, Artificial Sequence
  chemically synthesized
gaatccaccttagagtggat

SEQ ID NO: 550610 - DNA, 20 bp, Artificial Sequence
  chemically synthesized
cacacacacacacacacacc

SEQ ID NO: 550611 - DNA, 20 bp, Artificial Sequence
  chemically synthesized
ccatttctgagttacttcac

SEQ ID NO: 550612 - DNA, 20 bp, Artificial Sequence
  chemically synthesized
attattctaagtgaagtaac

SEQ ID NO: 550613 - DNA, 20 bp, Artificial Sequence
  chemically synthesized
atgtacaatttgctgagcaa

SEQ ID NO: 550614 - DNA, 20 bp, Artificial Sequence
  chemically synthesized
cctgttgtggctgacaggca

SEQ ID NO: 550615 - DNA, 20 bp, Artificial Sequence
  chemically synthesized
gtggctgacaggcattagaa

SEQ ID NO: 550616 - DNA, 20 bp, Artificial Sequence
  chemically synthesized
attaactcaatacgtataaa

SEQ ID NO: 550617 - DNA, 20 bp, Artificial Sequence
  chemically synthesized
ctactcgggaggctgaggca

SEQ ID NO: 550618 - DNA, 20 bp, Artificial Sequence
  chemically synthesized
tgccttcctaataaacttgt

SEQ ID NO: 550619 - DNA, 20 bp, Artificial Sequence
  chemically synthesized
aaatcagcatttttttaaat

SEQ ID NO: 550620 - DNA, 20 bp, Artificial Sequence
  chemically synthesized
aaagcaaacttgcatttata

SEQ ID NO: 550621 - DNA, 20 bp, Artificial Sequence
  chemically synthesized
atagaaatgagaacaaagca

SEQ ID NO: 550622 - DNA, 20 bp, Artificial Sequence
  chemically synthesized
ttcattcattcagcaaaaaa

SEQ ID NO: 550623 - DNA, 20 bp, Artificial Sequence
  chemically synthesized
taaagtcattattaatttat

SEQ ID NO: 550624 - DNA, 20 bp, Artificial Sequence
  chemically synthesized
aatggtactttattaaattc

SEQ ID NO: 550625 - DNA, 20 bp, Artificial Sequence
  chemically synthesized
ttaaaagtcataatctatca

SEQ ID NO: 550626 - DNA, 20 bp, Artificial Sequence
  chemically synthesized
ccattaactaaaataaataa

SEQ ID NO: 550627 - DNA, 20 bp, Artificial Sequence
  chemically synthesized
acagaagacaaacaacagca

SEQ ID NO: 550628 - DNA, 20 bp, Artificial Sequence
  chemically synthesized
tactcgggggtgctgaggca

SEQ ID NO: 550629 - DNA, 20 bp, Artificial Sequence
  chemically synthesized
catgatccaccgtgctgggc

SEQ ID NO: 550630 - DNA, 20 bp, Artificial Sequence
  chemically synthesized
ctactcatgaggctgaggca

SEQ ID NO: 550631 - DNA, 20 bp, Artificial Sequence
  chemically synthesized
atcttaaataaaaattatat

SEQ ID NO: 550632 - DNA, 20 bp, Artificial Sequence
  chemically synthesized
attattggccttgatttcaa

SEQ ID NO: 550633 - DNA, 20 bp, Artificial Sequence
  chemically synthesized
tgtgaaccttcttgctcaac

SEQ ID NO: 550634 - DNA, 20 bp, Artificial Sequence
  chemically synthesized
aactatgatttaaagaagca

SEQ ID NO: 550635 - DNA, 20 bp, Artificial Sequence
  chemically synthesized
cagattataatgaagttcat

SEQ ID NO: 550636 - DNA, 20 bp, Artificial Sequence
  chemically synthesized
aattcacattgacatttctc

SEQ ID NO: 550637 - DNA, 20 bp, Artificial Sequence
  chemically synthesized
gtgctttatttggctttctg

SEQ ID NO: 550638 - DNA, 20 bp, Artificial Sequence
  chemically synthesized
aagccaaataaagcacacat

SEQ ID NO: 550639 - DNA, 20 bp, Artificial Sequence
  chemically synthesized
tatttcatatagacaacagg

SEQ ID NO: 550640 - DNA, 20 bp, Artificial Sequence
  chemically synthesized
gtcagttaaaataaaaagcc

SEQ ID NO: 550641 - DNA, 20 bp, Artificial Sequence
  chemically synthesized
tttttattaatcattagtga

SEQ ID NO: 550642 - DNA, 20 bp, Artificial Sequence
  chemically synthesized
ttgcacattgacaaatgaaa

SEQ ID NO: 550643 - DNA, 20 bp, Artificial Sequence
  chemically synthesized
ctgtggcaatgtaaacaaac

SEQ ID NO: 550644 - DNA, 20 bp, Artificial Sequence
  chemically synthesized
tgcacctacttttctctttt

SEQ ID NO: 550645 - DNA, 20 bp, Artificial Sequence
  chemically synthesized
gagagagggcattctaaaaa

SEQ ID NO: 550646 - DNA, 20 bp, Artificial Sequence
  chemically synthesized
ctctctcacatgttaccact

SEQ ID NO: 550647 - DNA, 20 bp, Artificial Sequence
  chemically synthesized
agtacatataataccatggt

SEQ ID NO: 550648 - DNA, 20 bp, Artificial Sequence
  chemically synthesized
ttgcttatcttcataaaggg

SEQ ID NO: 550649 - DNA, 20 bp, Artificial Sequence
  chemically synthesized
tgcccttatcacatcacaag

SEQ ID NO: 550650 - DNA, 20 bp, Artificial Sequence
  chemically synthesized
caagcatctgtgtataagca

SEQ ID NO: 550651 - DNA, 20 bp, Artificial Sequence
  chemically synthesized
ctattgacttagggaaaagt

SEQ ID NO: 550652 - DNA, 20 bp, Artificial Sequence
  chemically synthesized
cccacaaagcttaaacctct

SEQ ID NO: 550653 - DNA, 20 bp, Artificial Sequence
  chemically synthesized
agtccctacaacacatcctt

SEQ ID NO: 550654 - DNA, 20 bp, Artificial Sequence
  chemically synthesized
ctcaccttcattacttaata

SEQ ID NO: 550655 - DNA, 20 bp, Artificial Sequence
  chemically synthesized
acaaagaaataaccgtggat

SEQ ID NO: 550656 - DNA, 20 bp, Artificial Sequence
  chemically synthesized
ggcacggttcttagtataac

SEQ ID NO: 550657 - DNA, 20 bp, Artificial Sequence
  chemically synthesized
ctctaatttgattaaattga

SEQ ID NO: 550658 - DNA, 20 bp, Artificial Sequence
  chemically synthesized
ctgttcaatttaatcaaatt

SEQ ID NO: 550659 - DNA, 20 bp, Artificial Sequence
  chemically synthesized
aaaaacacacacgcacatta

SEQ ID NO: 550660 - DNA, 20 bp, Artificial Sequence
  chemically synthesized
gaatgaaacttcgtctcaaa

SEQ ID NO: 550661 - DNA, 20 bp, Artificial Sequence
  chemically synthesized
ctcgaatcgagcctgggcaa

SEQ ID NO: 550662 - DNA, 20 bp, Artificial Sequence
  chemically synthesized
ttacttgggaggctgagtca

SEQ ID NO: 550663 - DNA, 20 bp, Artificial Sequence
  chemically synthesized
aaccccggtctctactaaaa

SEQ ID NO: 550664 - DNA, 20 bp, Artificial Sequence
  chemically synthesized
ttgttatatgtgtatgtata

SEQ ID NO: 550665 - DNA, 20 bp, Artificial Sequence
  chemically synthesized
gattaattatttctaccatt

SEQ ID NO: 550666 - DNA, 20 bp, Artificial Sequence
  chemically synthesized
ctcattttaattctgtaatg

SEQ ID NO: 550667 - DNA, 20 bp, Artificial Sequence
  chemically synthesized
tcaaaaattatttctaattc

SEQ ID NO: 550668 - DNA, 20 bp, Artificial Sequence
  chemically synthesized
tctctttgaatttctctgaa

SEQ ID NO: 550669 - DNA, 20 bp, Artificial Sequence
  chemically synthesized
ttaatagttaattgcttgaa

SEQ ID NO: 550670 - DNA, 20 bp, Artificial Sequence
  chemically synthesized
aacttattcaactgttaaag

SEQ ID NO: 550671 - DNA, 20 bp, Artificial Sequence
  chemically synthesized
cactttgggaggctgacaca

SEQ ID NO: 550672 - DNA, 20 bp, Artificial Sequence
  chemically synthesized
aaatattaattgcatacaaa

SEQ ID NO: 550673 - DNA, 20 bp, Artificial Sequence
  chemically synthesized
ctactagggaggctgaggca

SEQ ID NO: 550674 - DNA, 20 bp, Artificial Sequence
  chemically synthesized
cccgtctctactaaaaatac

SEQ ID NO: 550675 - DNA, 20 bp, Artificial Sequence
  chemically synthesized
cccaataaatttcaaacgaa

SEQ ID NO: 550676 - DNA, 20 bp, Artificial Sequence
  chemically synthesized
gatttttttggggggggggg

SEQ ID NO: 550677 - DNA, 20 bp, Artificial Sequence
  chemically synthesized
atgatgtttatgtaatctaa

SEQ ID NO: 550678 - DNA, 20 bp, Artificial Sequence
  chemically synthesized
tcgaaacatctaatattaca

SEQ ID NO: 550679 - DNA, 20 bp, Artificial Sequence
  chemically synthesized
taaccaagacaaaaaatact

SEQ ID NO: 550680 - DNA, 20 bp, Artificial Sequence
  chemically synthesized
tatttttttttttttttgag

SEQ ID NO: 550681 - DNA, 20 bp, Artificial Sequence
  chemically synthesized
ctactcgggaggctgagaca

SEQ ID NO: 550682 - DNA, 20 bp, Artificial Sequence
  chemically synthesized
gtaatttttaagttgaattt

SEQ ID NO: 550683 - DNA, 20 bp, Artificial Sequence
  chemically synthesized
attcaacttaaaaattactc

SEQ ID NO: 550684 - DNA, 20 bp, Artificial Sequence
  chemically synthesized
attttaaaaagcttactgta

SEQ ID NO: 550685 - DNA, 20 bp, Artificial Sequence
  chemically synthesized
ttatatttattttcaacttt

SEQ ID NO: 550686 - DNA, 20 bp, Artificial Sequence
  chemically synthesized
acactagctttactctgaaa

SEQ ID NO: 550687 - DNA, 20 bp, Artificial Sequence
  chemically synthesized
tcaacatctcatttaaatat

SEQ ID NO: 550688 - DNA, 20 bp, Artificial Sequence
  chemically synthesized
tgtttggtagtaaacatgaa

SEQ ID NO: 550689 - DNA, 20 bp, Artificial Sequence
  chemically synthesized
tatgtggagtgtatatccct

SEQ ID NO: 550690 - DNA, 20 bp, Artificial Sequence
  chemically synthesized
ctttttgtcacttaacttga

SEQ ID NO: 550691 - DNA, 20 bp, Artificial Sequence
  chemically synthesized
aaattatccccttgtctatg

SEQ ID NO: 550692 - DNA, 20 bp, Artificial Sequence
  chemically synthesized
tacacttgtggcttacattg

SEQ ID NO: 550693 - DNA, 20 bp, Artificial Sequence
  chemically synthesized
ctccatctcgaaaaaaaaaa

SEQ ID NO: 550694 - DNA, 20 bp, Artificial Sequence
  chemically synthesized
ctactcaggaggctgaggca

SEQ ID NO: 550695 - DNA, 20 bp, Artificial Sequence
  chemically synthesized
tgagccactgcgcccggcca

SEQ ID NO: 550696 - DNA, 20 bp, Artificial Sequence
  chemically synthesized
gtataagtaatactgtgttc

SEQ ID NO: 550697 - DNA, 20 bp, Artificial Sequence
  chemically synthesized
ctgctattcgggaggctgag

SEQ ID NO: 550698 - DNA, 20 bp, Artificial Sequence
  chemically synthesized
tgcactccatcctggatgac

SEQ ID NO: 550699 - DNA, 20 bp, Artificial Sequence
  chemically synthesized
agagctactgaggtatttac

SEQ ID NO: 550700 - DNA, 20 bp, Artificial Sequence
  chemically synthesized
gcaattatgtcgataactgg

SEQ ID NO: 550701 - DNA, 20 bp, Artificial Sequence
  chemically synthesized
actatgtggaacaaaagttc

SEQ ID NO: 550702 - DNA, 20 bp, Artificial Sequence
  chemically synthesized
aagaggtgtttcaagccgtt

SEQ ID NO: 550703 - DNA, 20 bp, Artificial Sequence
  chemically synthesized
gtcgatggaggaaaaagatt

SEQ ID NO: 550704 - DNA, 20 bp, Artificial Sequence
  chemically synthesized
tccagaaagggggaatcaga

SEQ ID NO: 550705 - DNA, 20 bp, Artificial Sequence
  chemically synthesized
ggggaatcagactagaaaag

SEQ ID NO: 550706 - DNA, 20 bp, Artificial Sequence
  chemically synthesized
tgagctggcctgtataggag

SEQ ID NO: 550707 - DNA, 20 bp, Artificial Sequence
  chemically synthesized
tgagagcagtatgaatcctg

SEQ ID NO: 550708 - DNA, 20 bp, Artificial Sequence
  chemically synthesized
agaagatactctactagatt

SEQ ID NO: 550709 - DNA, 20 bp, Artificial Sequence
  chemically synthesized
ggggaaatgctggtcgaagg

SEQ ID NO: 550710 - DNA, 20 bp, Artificial Sequence
  chemically synthesized
acttgattgtgataatcatt

SEQ ID NO: 550711 - DNA, 20 bp, Artificial Sequence
  chemically synthesized
tactgcttaccctgtggctt

SEQ ID NO: 550712 - DNA, 20 bp, Artificial Sequence
  chemically synthesized
agcgtatggtaccagatttc

SEQ ID NO: 550713 - DNA, 20 bp, Artificial Sequence
  chemically synthesized
catacgctaatcaactatgg

SEQ ID NO: 550714 - DNA, 20 bp, Artificial Sequence
  chemically synthesized
tactacgggacaaaacagaa

SEQ ID NO: 550715 - DNA, 20 bp, Artificial Sequence
  chemically synthesized
ctactcgggaggctgaggca

SEQ ID NO: 550716 - DNA, 20 bp, Artificial Sequence
  chemically synthesized
tgtcttactcagtcctagga

SEQ ID NO: 550717 - DNA, 20 bp, Artificial Sequence
  chemically synthesized
ctaatgtaatacccatgatg

SEQ ID NO: 550718 - DNA, 20 bp, Artificial Sequence
  chemically synthesized
acagtggtgaagaagcatgc

SEQ ID NO: 550719 - DNA, 20 bp, Artificial Sequence
  chemically synthesized
taaaatgagctcaaggaagt

SEQ ID NO: 550720 - DNA, 20 bp, Artificial Sequence
  chemically synthesized
agcaaagaggagtaggtatt

SEQ ID NO: 550721 - DNA, 20 bp, Artificial Sequence
  chemically synthesized
gcagtacagagactggcatt

SEQ ID NO: 550722 - DNA, 20 bp, Artificial Sequence
  chemically synthesized
tgaaatgcagcaagactgca

SEQ ID NO: 550723 - DNA, 20 bp, Artificial Sequence
  chemically synthesized
gcaagactgcagaagaaaag

SEQ ID NO: 550724 - DNA, 20 bp, Artificial Sequence
  chemically synthesized
ccatgtagagtatggagtga

SEQ ID NO: 550725 - DNA, 20 bp, Artificial Sequence
  chemically synthesized
gaaaaggctcatggaacagc

SEQ ID NO: 550726 - DNA, 20 bp, Artificial Sequence
  chemically synthesized
gaccagatagcccagtaagt

SEQ ID NO: 550727 - DNA, 20 bp, Artificial Sequence
  chemically synthesized
aaagtaacacagaaggttag

SEQ ID NO: 550728 - DNA, 20 bp, Artificial Sequence
  chemically synthesized
ttgcctcagtgtctgtctgg

SEQ ID NO: 550729 - DNA, 20 bp, Artificial Sequence
  chemically synthesized
aaaagtacaagtgagaggaa

SEQ ID NO: 550730 - DNA, 20 bp, Artificial Sequence
  chemically synthesized
ttcaccagcaggactgagcc

SEQ ID NO: 550731 - DNA, 20 bp, Artificial Sequence
  chemically synthesized
gaagctgtgaggaacatgcc

SEQ ID NO: 550732 - DNA, 20 bp, Artificial Sequence
  chemically synthesized
ttgctataaacaggagtaag

SEQ ID NO: 550733 - DNA, 20 bp, Artificial Sequence
  chemically synthesized
tgcatggaactcgggtgggg

SEQ ID NO: 550734 - DNA, 20 bp, Artificial Sequence
  chemically synthesized
aaaaagtgtttcaatagagg

SEQ ID NO: 550735 - DNA, 20 bp, Artificial Sequence
  chemically synthesized
ctactcgggaggctgaggca

SEQ ID NO: 550736 - DNA, 20 bp, Artificial Sequence
  chemically synthesized
ccaaccctattatgtgaaga

SEQ ID NO: 550737 - DNA, 20 bp, Artificial Sequence
  chemically synthesized
aaatagcattccaaaaatcg

SEQ ID NO: 550738 - DNA, 20 bp, Artificial Sequence
  chemically synthesized
acttatacatttaagtgggc

SEQ ID NO: 550739 - DNA, 20 bp, Artificial Sequence
  chemically synthesized
cgtctcaataaaaaaaaaaa

SEQ ID NO: 550740 - DNA, 20 bp, Artificial Sequence
  chemically synthesized
ctactagggaggctgaggca

SEQ ID NO: 550741 - DNA, 20 bp, Artificial Sequence
  chemically synthesized
ttaaaagtctgcaaattaaa

SEQ ID NO: 550742 - DNA, 20 bp, Artificial Sequence
  chemically synthesized
cttacgttccaaaatgctct

SEQ ID NO: 550743 - DNA, 20 bp, Artificial Sequence
  chemically synthesized
tttgtggttttttgaaatga

SEQ ID NO: 550744 - DNA, 20 bp, Artificial Sequence
  chemically synthesized
ctagaaatatttttagggcc

SEQ ID NO: 550745 - DNA, 20 bp, Artificial Sequence
  chemically synthesized
gaaacctccaaggtaagtgt

SEQ ID NO: 550746 - DNA, 20 bp, Artificial Sequence
  chemically synthesized
tgaacagcaggctagctcac

SEQ ID NO: 550747 - DNA, 20 bp, Artificial Sequence
  chemically synthesized
ttactgaggaggctcaggca

SEQ ID NO: 550748 - DNA, 20 bp, Artificial Sequence
  chemically synthesized
tcattatctttaattacatg

SEQ ID NO: 550749 - DNA, 20 bp, Artificial Sequence
  chemically synthesized
ttttggttaaagagtaatga

SEQ ID NO: 550750 - DNA, 20 bp, Artificial Sequence
  chemically synthesized
tctttaaccaaaaggctgtg

SEQ ID NO: 550751 - DNA, 20 bp, Artificial Sequence
  chemically synthesized
tcactcaattatcaggaaat

SEQ ID NO: 550752 - DNA, 20 bp, Artificial Sequence
  chemically synthesized
cagctctaaatttgtccaaa

SEQ ID NO: 550753 - DNA, 20 bp, Artificial Sequence
  chemically synthesized
ggaacacagttgagagaggg

SEQ ID NO: 550754 - DNA, 20 bp, Artificial Sequence
  chemically synthesized
aaactcagcctctgtgtttt

SEQ ID NO: 550755 - DNA, 20 bp, Artificial Sequence
  chemically synthesized
ttggaattgaaatggaagct

SEQ ID NO: 550756 - DNA, 20 bp, Artificial Sequence
  chemically synthesized
tcaattccaagtgtggccca

SEQ ID NO: 550757 - DNA, 20 bp, Artificial Sequence
  chemically synthesized
ctgtacaggtttgtagccaa

SEQ ID NO: 550758 - DNA, 20 bp, Artificial Sequence
  chemically synthesized
attaccttagtatggattga

SEQ ID NO: 550759 - DNA, 20 bp, Artificial Sequence
  chemically synthesized
gattccttcaccatgaggaa

SEQ ID NO: 550760 - DNA, 20 bp, Artificial Sequence
  chemically synthesized
ttctgtctcaaaaaaaaaca

SEQ ID NO: 550761 - DNA, 20 bp, Artificial Sequence
  chemically synthesized
ttcttttgtttttttttgag

SEQ ID NO: 550762 - DNA, 20 bp, Artificial Sequence
  chemically synthesized
ctactcgggaggctgaggca

SEQ ID NO: 550763 - DNA, 20 bp, Artificial Sequence
  chemically synthesized
aatattaaaacaaacgaaaa

SEQ ID NO: 550764 - DNA, 20 bp, Artificial Sequence
  chemically synthesized
aattcataatctaatagcta

SEQ ID NO: 550765 - DNA, 20 bp, Artificial Sequence
  chemically synthesized
tcatatttattattcatttg

SEQ ID NO: 550766 - DNA, 20 bp, Artificial Sequence
  chemically synthesized
ttacttgggaggctgaggca

SEQ ID NO: 550767 - DNA, 20 bp, Artificial Sequence
  chemically synthesized
gcgaatcacgaggtcaggag

SEQ ID NO: 550768 - DNA, 20 bp, Artificial Sequence
  chemically synthesized
ctattcgggaggctgacgca

SEQ ID NO: 550769 - DNA, 20 bp, Artificial Sequence
  chemically synthesized
aaaaaaaaaaaaaaaaaccg

SEQ ID NO: 550770 - DNA, 20 bp, Artificial Sequence
  chemically synthesized
ctacagacaattttgccaag

SEQ ID NO: 550771 - DNA, 20 bp, Artificial Sequence
  chemically synthesized
tttagagcataaatctgaga

SEQ ID NO: 550772 - DNA, 20 bp, Artificial Sequence
  chemically synthesized
ggaattttagagcataaatc

SEQ ID NO: 550773 - DNA, 20 bp, Artificial Sequence
  chemically synthesized
tttatgctctaaaattccgt

SEQ ID NO: 550774 - DNA, 20 bp, Artificial Sequence
  chemically synthesized
gagaccagcctgaccaacat

SEQ ID NO: 550775 - DNA, 20 bp, Artificial Sequence
  chemically synthesized
ctactcgggaggctgaggca

SEQ ID NO: 550776 - DNA, 20 bp, Artificial Sequence
  chemically synthesized
aaaaaaggctttatttttat

SEQ ID NO: 550777 - DNA, 20 bp, Artificial Sequence
  chemically synthesized
ttcaatataatatttaaaga

SEQ ID NO: 550778 - DNA, 20 bp, Artificial Sequence
  chemically synthesized
tgataagatggagctgatct

SEQ ID NO: 550779 - DNA, 20 bp, Artificial Sequence
  chemically synthesized
actggccaaaaattaataca

SEQ ID NO: 550780 - DNA, 20 bp, Artificial Sequence
  chemically synthesized
atatgtttaatcaaaaacat

SEQ ID NO: 550781 - DNA, 20 bp, Artificial Sequence
  chemically synthesized
aatctaaacgttgcgcccca

SEQ ID NO: 550782 - DNA, 20 bp, Artificial Sequence
  chemically synthesized
caaaagcttacattttacta

SEQ ID NO: 550783 - DNA, 20 bp, Artificial Sequence
  chemically synthesized
tagactaaaactttacatag

SEQ ID NO: 550784 - DNA, 20 bp, Artificial Sequence
  chemically synthesized
tttacatagggagaaatcgc

SEQ ID NO: 550785 - DNA, 20 bp, Artificial Sequence
  chemically synthesized
tagggagaaatcgcagagaa

SEQ ID NO: 550786 - DNA, 20 bp, Artificial Sequence
  chemically synthesized
ggttttgggaggctgaggca

SEQ ID NO: 550787 - DNA, 20 bp, Artificial Sequence
  chemically synthesized
gacagagcgagactccgtct

SEQ ID NO: 550788 - DNA, 20 bp, Artificial Sequence
  chemically synthesized
ttttaatatattaatcttta

SEQ ID NO: 550789 - DNA, 20 bp, Artificial Sequence
  chemically synthesized
gttgtttagtttacactgta

SEQ ID NO: 550790 - DNA, 20 bp, Artificial Sequence
  chemically synthesized
tgagtgttctaatacaaaga

SEQ ID NO: 550791 - DNA, 20 bp, Artificial Sequence
  chemically synthesized
atgctgctagattactaaga

SEQ ID NO: 550792 - DNA, 20 bp, Artificial Sequence
  chemically synthesized
cccacttcagaaggactgaa

SEQ ID NO: 550793 - DNA, 20 bp, Artificial Sequence
  chemically synthesized
caagagtgtgtgggaagatc

SEQ ID NO: 550794 - DNA, 20 bp, Artificial Sequence
  chemically synthesized
gtaaaacagcaatctgtaag

SEQ ID NO: 550795 - DNA, 20 bp, Artificial Sequence
  chemically synthesized
ttttcccataacttgatttg

SEQ ID NO: 550796 - DNA, 20 bp, Artificial Sequence
  chemically synthesized
ctagctgtcttcctaaagat

SEQ ID NO: 550797 - DNA, 20 bp, Artificial Sequence
  chemically synthesized
atagagaaaacttgtccaag

SEQ ID NO: 550798 - DNA, 20 bp, Artificial Sequence
  chemically synthesized
tttaataaaagtaacataat

SEQ ID NO: 550799 - DNA, 20 bp, Artificial Sequence
  chemically synthesized
actgacagtatatattggca

SEQ ID NO: 550800 - DNA, 20 bp, Artificial Sequence
  chemically synthesized
gcaacagaatatatgctaat

SEQ ID NO: 550801 - DNA, 20 bp, Artificial Sequence
  chemically synthesized
tatcaggtttttttttaatt

SEQ ID NO: 550802 - DNA, 20 bp, Artificial Sequence
  chemically synthesized
gcctaattatctgaaatatc

SEQ ID NO: 550803 - DNA, 20 bp, Artificial Sequence
  chemically synthesized
gagggatttttatattaaca

SEQ ID NO: 550804 - DNA, 20 bp, Artificial Sequence
  chemically synthesized
agactacattcataaactca

SEQ ID NO: 550805 - DNA, 20 bp, Artificial Sequence
  chemically synthesized
tatgaatgtagtctacgtcc

SEQ ID NO: 550806 - DNA, 20 bp, Artificial Sequence
  chemically synthesized
aattatttctagtatgaaga

SEQ ID NO: 550807 - DNA, 20 bp, Artificial Sequence
  chemically synthesized
atttttttcttttcttcata

SEQ ID NO: 550808 - DNA, 20 bp, Artificial Sequence
  chemically synthesized
tctaaaattatttctagtat

SEQ ID NO: 550809 - DNA, 20 bp, Artificial Sequence
  chemically synthesized
ttaaagccacaacccaaaaa

SEQ ID NO: 550810 - DNA, 20 bp, Artificial Sequence
  chemically synthesized
ggcttttgttgtgaggaagg

SEQ ID NO: 550811 - DNA, 20 bp, Artificial Sequence
  chemically synthesized
aaagccccaatttaactttt

SEQ ID NO: 550812 - DNA, 20 bp, Artificial Sequence
  chemically synthesized
ataaatgcaacagccattca

SEQ ID NO: 550813 - DNA, 20 bp, Artificial Sequence
  chemically synthesized
aaggtgtgtagccagcctcc

SEQ ID NO: 550814 - DNA, 20 bp, Artificial Sequence
  chemically synthesized
cataccccatagaatgtgta

SEQ ID NO: 550815 - DNA, 20 bp, Artificial Sequence
  chemically synthesized
ctccaggtttaccatacccc

SEQ ID NO: 550816 - DNA, 20 bp, Artificial Sequence
  chemically synthesized
caagcacagataaagcaggc

SEQ ID NO: 550817 - DNA, 20 bp, Artificial Sequence
  chemically synthesized
tattcacggcaaccggagtg

SEQ ID NO: 550818 - DNA, 20 bp, Artificial Sequence
  chemically synthesized
ggtagattgagccggtgagg

SEQ ID NO: 550819 - DNA, 20 bp, Artificial Sequence
  chemically synthesized
aatcagtaacctcagttcct

SEQ ID NO: 550820 - DNA, 20 bp, Artificial Sequence
  chemically synthesized
aggatttatctgagtctgaa

SEQ ID NO: 550821 - DNA, 20 bp, Artificial Sequence
  chemically synthesized
tgcaaactggtgttagtgaa

SEQ ID NO: 550822 - DNA, 20 bp, Artificial Sequence
  chemically synthesized
gcacctgtgtgatgctagga

SEQ ID NO: 550823 - DNA, 20 bp, Artificial Sequence
  chemically synthesized
ttcttaatctccatttgcct

SEQ ID NO: 550824 - DNA, 20 bp, Artificial Sequence
  chemically synthesized
ataaaccctgtgttttaaaa

SEQ ID NO: 550825 - DNA, 20 bp, Artificial Sequence
  chemically synthesized
gaatcctgcttcttgaaaaa

SEQ ID NO: 550826 - DNA, 20 bp, Artificial Sequence
  chemically synthesized
tcattttaacaacttactct

SEQ ID NO: 550827 - DNA, 20 bp, Artificial Sequence
  chemically synthesized
aaatgattgaagttcatgta

SEQ ID NO: 550828 - DNA, 20 bp, Artificial Sequence
  chemically synthesized
attgccaaatattttatatt

SEQ ID NO: 550829 - DNA, 20 bp, Artificial Sequence
  chemically synthesized
gaaaattgagagtagggaac

SEQ ID NO: 550830 - DNA, 20 bp, Artificial Sequence
  chemically synthesized
atccaaattacagaagaact

SEQ ID NO: 550831 - DNA, 20 bp, Artificial Sequence
  chemically synthesized
attactcattgtcgtactgc

SEQ ID NO: 550832 - DNA, 20 bp, Artificial Sequence
  chemically synthesized
acgcctaaagtaataccaca

SEQ ID NO: 550833 - DNA, 20 bp, Artificial Sequence
  chemically synthesized
gtttcacatttaagagggaa

SEQ ID NO: 550834 - DNA, 20 bp, Artificial Sequence
  chemically synthesized
atgtgaaacaattacactat

SEQ ID NO: 550835 - DNA, 20 bp, Artificial Sequence
  chemically synthesized
gaaacaattacactataaag

SEQ ID NO: 550836 - DNA, 20 bp, Artificial Sequence
  chemically synthesized
tatttagttgggccaaagtt

SEQ ID NO: 550837 - DNA, 20 bp, Artificial Sequence
  chemically synthesized
tgggccaaagttagagaaat

SEQ ID NO: 550838 - DNA, 20 bp, Artificial Sequence
  chemically synthesized
ccctatatatgagtttctgt

SEQ ID NO: 550839 - DNA, 20 bp, Artificial Sequence
  chemically synthesized
ggccaagagctaatttcttt

SEQ ID NO: 550840 - DNA, 20 bp, Artificial Sequence
  chemically synthesized
gaaattagctcttggccagg

SEQ ID NO: 550841 - DNA, 20 bp, Artificial Sequence
  chemically synthesized
tccgctaaaaggataaatga

SEQ ID NO: 550842 - DNA, 20 bp, Artificial Sequence
  chemically synthesized
aaaaggaacctttataaata

SEQ ID NO: 550843 - DNA, 20 bp, Artificial Sequence
  chemically synthesized
ctgctccggaggctgaggca

SEQ ID NO: 550844 - DNA, 20 bp, Artificial Sequence
  chemically synthesized
gagaccagcctgaccaacat

SEQ ID NO: 550845 - DNA, 20 bp, Artificial Sequence
  chemically synthesized
tgagtttcaggtattgcatt

SEQ ID NO: 550846 - DNA, 20 bp, Artificial Sequence
  chemically synthesized
tccaactaaccggaagtgct

SEQ ID NO: 550847 - DNA, 20 bp, Artificial Sequence
  chemically synthesized
ccagggaacttattggaaat

SEQ ID NO: 550848 - DNA, 20 bp, Artificial Sequence
  chemically synthesized
gttctccaactttgctgata

SEQ ID NO: 550849 - DNA, 20 bp, Artificial Sequence
  chemically synthesized
aatcccctgaagaacttctt

SEQ ID NO: 550850 - DNA, 20 bp, Artificial Sequence
  chemically synthesized
tatcaatgaaatcagagtct

SEQ ID NO: 550851 - DNA, 20 bp, Artificial Sequence
  chemically synthesized
ttctcaaacttggctgttca

SEQ ID NO: 550852 - DNA, 20 bp, Artificial Sequence
  chemically synthesized
ttctaatgaacagccaagtt

SEQ ID NO: 550853 - DNA, 20 bp, Artificial Sequence
  chemically synthesized
gttatcaaattaggtgctca

SEQ ID NO: 550854 - DNA, 20 bp, Artificial Sequence
  chemically synthesized
ggttctcaaactgttggata

SEQ ID NO: 550855 - DNA, 20 bp, Artificial Sequence
  chemically synthesized
ttgatttgaaggagcatggt

SEQ ID NO: 550856 - DNA, 20 bp, Artificial Sequence
  chemically synthesized
agggaagatgttagatcatg

SEQ ID NO: 550857 - DNA, 20 bp, Artificial Sequence
  chemically synthesized
gatatctcccttaatattat

SEQ ID NO: 550858 - DNA, 20 bp, Artificial Sequence
  chemically synthesized
ccacagaatagccaattttg

SEQ ID NO: 550859 - DNA, 20 bp, Artificial Sequence
  chemically synthesized
cctccccacttcccaaatcc

SEQ ID NO: 550860 - DNA, 20 bp, Artificial Sequence
  chemically synthesized
ggcaaacatattactaaaag

SEQ ID NO: 550861 - DNA, 20 bp, Artificial Sequence
  chemically synthesized
tttgccatatctttgatttt

SEQ ID NO: 550862 - DNA, 20 bp, Artificial Sequence
  chemically synthesized
ctacccatctcctattacaa

SEQ ID NO: 550863 - DNA, 20 bp, Artificial Sequence
  chemically synthesized
ccgggatcctttactcttat

SEQ ID NO: 550864 - DNA, 20 bp, Artificial Sequence
  chemically synthesized
cacaccacagtgatgagatt

SEQ ID NO: 550865 - DNA, 20 bp, Artificial Sequence
  chemically synthesized
tccaaaaataaatgggtcat

SEQ ID NO: 550866 - DNA, 20 bp, Artificial Sequence
  chemically synthesized
tatttgctttcaaaagtcaa

SEQ ID NO: 550867 - DNA, 20 bp, Artificial Sequence
  chemically synthesized
cctgatgaccaaaaatcatt

SEQ ID NO: 550868 - DNA, 20 bp, Artificial Sequence
  chemically synthesized
gattccattactcagttcat

SEQ ID NO: 550869 - DNA, 20 bp, Artificial Sequence
  chemically synthesized
accttccccactgataagca

SEQ ID NO: 550870 - DNA, 20 bp, Artificial Sequence
  chemically synthesized
atagttgatgggttttgttg

SEQ ID NO: 550871 - DNA, 20 bp, Artificial Sequence
  chemically synthesized
actgcagaagatccagtctc

SEQ ID NO: 550872 - DNA, 20 bp, Artificial Sequence
  chemically synthesized
cacttggccctgagattatc

SEQ ID NO: 550873 - DNA, 20 bp, Artificial Sequence
  chemically synthesized
tataggtttcaaaattgcta

SEQ ID NO: 550874 - DNA, 20 bp, Artificial Sequence
  chemically synthesized
ttttgatctatgtgtatgtt

SEQ ID NO: 550875 - DNA, 20 bp, Artificial Sequence
  chemically synthesized
tcaaaggctgattttaagtg

SEQ ID NO: 550876 - DNA, 20 bp, Artificial Sequence
  chemically synthesized
tatttattatcacaaaattt

SEQ ID NO: 550877 - DNA, 20 bp, Artificial Sequence
  chemically synthesized
gaactggacttattttattt

SEQ ID NO: 550878 - DNA, 20 bp, Artificial Sequence
  chemically synthesized
agaatgacagtaggtgatat

SEQ ID NO: 550879 - DNA, 20 bp, Artificial Sequence
  chemically synthesized
cttatcaagagttggggtta

SEQ ID NO: 550880 - DNA, 20 bp, Artificial Sequence
  chemically synthesized
tagaagcaagcttagtgtac

SEQ ID NO: 550881 - DNA, 20 bp, Artificial Sequence
  chemically synthesized
tctaatggagagagaaacct

SEQ ID NO: 550882 - DNA, 20 bp, Artificial Sequence
  chemically synthesized
tatcttataatctaatggag

SEQ ID NO: 550883 - DNA, 20 bp, Artificial Sequence
  chemically synthesized
agattataagatatttaaga

SEQ ID NO: 550884 - DNA, 20 bp, Artificial Sequence
  chemically synthesized
tttgcttctaatttttcaca

SEQ ID NO: 550885 - DNA, 20 bp, Artificial Sequence
  chemically synthesized
gcaaactaaatattcatgaa

SEQ ID NO: 550886 - DNA, 20 bp, Artificial Sequence
  chemically synthesized
aaatatattaataggatgta

SEQ ID NO: 550887 - DNA, 20 bp, Artificial Sequence
  chemically synthesized
caacgtagttaaatattcca

SEQ ID NO: 550888 - DNA, 20 bp, Artificial Sequence
  chemically synthesized
gagcctaggtttttaaccac

SEQ ID NO: 550889 - DNA, 20 bp, Artificial Sequence
  chemically synthesized
ctggagcctgaatgcctggt

SEQ ID NO: 550890 - DNA, 20 bp, Artificial Sequence
  chemically synthesized
ctcactgccaaaagtagaat

SEQ ID NO: 550891 - DNA, 20 bp, Artificial Sequence
  chemically synthesized
atatacactcactgccaaaa

SEQ ID NO: 550892 - DNA, 20 bp, Artificial Sequence
  chemically synthesized
ccacgcctggctgatttaaa

SEQ ID NO: 550893 - DNA, 20 bp, Artificial Sequence
  chemically synthesized
tgtccctccaaaattcatat

SEQ ID NO: 550894 - DNA, 20 bp, Artificial Sequence
  chemically synthesized
gatcttggatttcctgggct

SEQ ID NO: 550895 - DNA, 20 bp, Artificial Sequence
  chemically synthesized
caattaggagtaagaagtac

SEQ ID NO: 550896 - DNA, 20 bp, Artificial Sequence
  chemically synthesized
atatgatgaggttaaaaatt

SEQ ID NO: 550897 - DNA, 20 bp, Artificial Sequence
  chemically synthesized
atagaaaagatatttctaca

SEQ ID NO: 550898 - DNA, 20 bp, Artificial Sequence
  chemically synthesized
taccacttaaaaattcttct

SEQ ID NO: 550899 - DNA, 20 bp, Artificial Sequence
  chemically synthesized
tatcacataaaaatacctct

SEQ ID NO: 550900 - DNA, 20 bp, Artificial Sequence
  chemically synthesized
aaatgatgaggttaaaaatt

SEQ ID NO: 550901 - DNA, 20 bp, Artificial Sequence
  chemically synthesized
cccctgctcccttaaagttt

SEQ ID NO: 550902 - DNA, 20 bp, Artificial Sequence
  chemically synthesized
gcatgaggactattagtcta

SEQ ID NO: 550903 - DNA, 20 bp, Artificial Sequence
  chemically synthesized
gtggtggggggaggataacg

SEQ ID NO: 550904 - DNA, 20 bp, Artificial Sequence
  chemically synthesized
tttcactaggaacggacaaa

SEQ ID NO: 550905 - DNA, 20 bp, Artificial Sequence
  chemically synthesized
agaaagtgaaatgtgagaca

SEQ ID NO: 550906 - DNA, 20 bp, Artificial Sequence
  chemically synthesized
aaggagctcataaaaataaa

SEQ ID NO: 550907 - DNA, 20 bp, Artificial Sequence
  chemically synthesized
cttaccatatacaggcactg

SEQ ID NO: 550908 - DNA, 20 bp, Artificial Sequence
  chemically synthesized
atttcttttttgcctcaact

SEQ ID NO: 550909 - DNA, 20 bp, Artificial Sequence
  chemically synthesized
cattctgcagttgaggcaaa

SEQ ID NO: 550910 - DNA, 20 bp, Artificial Sequence
  chemically synthesized
acctcataggattgctgaga

SEQ ID NO: 550911 - DNA, 20 bp, Artificial Sequence
  chemically synthesized
attaactctatttttcagat

SEQ ID NO: 550912 - DNA, 20 bp, Artificial Sequence
  chemically synthesized
agtcctacagtacagtactg

SEQ ID NO: 550913 - DNA, 20 bp, Artificial Sequence
  chemically synthesized
gaaagagttggatttccaac

SEQ ID NO: 550914 - DNA, 20 bp, Artificial Sequence
  chemically synthesized
agacaatatagacagatgtt

SEQ ID NO: 550915 - DNA, 20 bp, Artificial Sequence
  chemically synthesized
tttttaatgtcccttgagtt

SEQ ID NO: 550916 - DNA, 20 bp, Artificial Sequence
  chemically synthesized
tactattacctattcgacag

SEQ ID NO: 550917 - DNA, 20 bp, Artificial Sequence
  chemically synthesized
tcgacaggaagaaacatcag

SEQ ID NO: 550918 - DNA, 20 bp, Artificial Sequence
  chemically synthesized
aatacgaattaagtaatgcc

SEQ ID NO: 550919 - DNA, 20 bp, Artificial Sequence
  chemically synthesized
ataggagaatgctgttactg

SEQ ID NO: 550920 - DNA, 20 bp, Artificial Sequence
  chemically synthesized
agcactgagaattagggata

SEQ ID NO: 550921 - DNA, 20 bp, Artificial Sequence
  chemically synthesized
tgggaaatagcctaaagcac

SEQ ID NO: 550922 - DNA, 20 bp, Artificial Sequence
  chemically synthesized
aaaaataaaagtagacagat

SEQ ID NO: 550923 - DNA, 20 bp, Artificial Sequence
  chemically synthesized
gagatagagtgtttagggaa

SEQ ID NO: 550924 - DNA, 20 bp, Artificial Sequence
  chemically synthesized
gaaacactactccaaggcaa

SEQ ID NO: 550925 - DNA, 20 bp, Artificial Sequence
  chemically synthesized
aataatctattccaggatga

SEQ ID NO: 550926 - DNA, 20 bp, Artificial Sequence
  chemically synthesized
ctgaagaatggcaataaaaa

SEQ ID NO: 550927 - DNA, 20 bp, Artificial Sequence
  chemically synthesized
taagtaccagtaaaaatgct

SEQ ID NO: 550928 - DNA, 20 bp, Artificial Sequence
  chemically synthesized
aaacccacgccagaagccag

SEQ ID NO: 550929 - DNA, 20 bp, Artificial Sequence
  chemically synthesized
atatgcgaaacatcaaagaa

SEQ ID NO: 550930 - DNA, 20 bp, Artificial Sequence
  chemically synthesized
aacgtggcagaaagcagggg

SEQ ID NO: 550931 - DNA, 20 bp, Artificial Sequence
  chemically synthesized
atagcaaagaggtaaacgtg

SEQ ID NO: 550932 - DNA, 20 bp, Artificial Sequence
  chemically synthesized
gctgatttcatgagtaagct

SEQ ID NO: 550933 - DNA, 20 bp, Artificial Sequence
  chemically synthesized
accacatctggctcattttt

SEQ ID NO: 550934 - DNA, 20 bp, Artificial Sequence
  chemically synthesized
ggatgatgataaaccactcg

SEQ ID NO: 550935 - DNA, 20 bp, Artificial Sequence
  chemically synthesized
ttttaagcaaccgtatctca

SEQ ID NO: 550936 - DNA, 20 bp, Artificial Sequence
  chemically synthesized
cgcaagatgaggtaattttt

SEQ ID NO: 550937 - DNA, 20 bp, Artificial Sequence
  chemically synthesized
gtcaattctcacactgccat

SEQ ID NO: 550938 - DNA, 20 bp, Artificial Sequence
  chemically synthesized
cgtatttctttatggcagtg

SEQ ID NO: 550939 - DNA, 20 bp, Artificial Sequence
  chemically synthesized
aaaactcttaactattgata

SEQ ID NO: 550940 - DNA, 20 bp, Artificial Sequence
  chemically synthesized
acagggagtgactgctgact

SEQ ID NO: 550941 - DNA, 20 bp, Artificial Sequence
  chemically synthesized
ggcaatcccacttgaaattc

SEQ ID NO: 550942 - DNA, 20 bp, Artificial Sequence
  chemically synthesized
gaataacattcataatctta

SEQ ID NO: 550943 - DNA, 20 bp, Artificial Sequence
  chemically synthesized
ataaaaacaacctaaaattt

SEQ ID NO: 550944 - DNA, 20 bp, Artificial Sequence
  chemically synthesized
tttgtactatttagaaaaac

SEQ ID NO: 550945 - DNA, 20 bp, Artificial Sequence
  chemically synthesized
cctgaacatctttgtactat

SEQ ID NO: 550946 - DNA, 20 bp, Artificial Sequence
  chemically synthesized
agtacaaagatgttcaggag

SEQ ID NO: 550947 - DNA, 20 bp, Artificial Sequence
  chemically synthesized
atagatgagaaaactgagaa

SEQ ID NO: 550948 - DNA, 20 bp, Artificial Sequence
  chemically synthesized
tattttatagatgagaaaac

SEQ ID NO: 550949 - DNA, 20 bp, Artificial Sequence
  chemically synthesized
caattcccatattttataga

SEQ ID NO: 550950 - DNA, 20 bp, Artificial Sequence
  chemically synthesized
tacttacacaacactactcc

SEQ ID NO: 550951 - DNA, 20 bp, Artificial Sequence
  chemically synthesized
ggggtgaccccaaaaggcca

SEQ ID NO: 550952 - DNA, 20 bp, Artificial Sequence
  chemically synthesized
ccaaaaggccaacagaaatt

SEQ ID NO: 550953 - DNA, 20 bp, Artificial Sequence
  chemically synthesized
gcaacctcacaatagatgaa

SEQ ID NO: 550954 - DNA, 20 bp, Artificial Sequence
  chemically synthesized
cctgactccagcaggccttt

SEQ ID NO: 550955 - DNA, 20 bp, Artificial Sequence
  chemically synthesized
cacactgagagtaccgctca

SEQ ID NO: 550956 - DNA, 20 bp, Artificial Sequence
  chemically synthesized
aaaagtactataaatataga

SEQ ID NO: 550957 - DNA, 20 bp, Artificial Sequence
  chemically synthesized
aaactttattaagagactag

SEQ ID NO: 550958 - DNA, 20 bp, Artificial Sequence
  chemically synthesized
tttacttgtgtgatgactgc

SEQ ID NO: 550959 - DNA, 20 bp, Artificial Sequence
  chemically synthesized
tgtcatagtgttgggatcat

SEQ ID NO: 550960 - DNA, 20 bp, Artificial Sequence
  chemically synthesized
tgtgtccaaatatatacaca

SEQ ID NO: 550961 - DNA, 20 bp, Artificial Sequence
  chemically synthesized
tttgtcaagctaaaatctgg

SEQ ID NO: 550962 - DNA, 20 bp, Artificial Sequence
  chemically synthesized
gctaattttgcgtttttagt

SEQ ID NO: 550963 - DNA, 20 bp, Artificial Sequence
  chemically synthesized
gattgagggaaggaggtgcc

SEQ ID NO: 550964 - DNA, 20 bp, Artificial Sequence
  chemically synthesized
atctttgaaaggcgtcaaat

SEQ ID NO: 550965 - DNA, 20 bp, Artificial Sequence
  chemically synthesized
atagaggtcccaagttgtct

SEQ ID NO: 550966 - DNA, 20 bp, Artificial Sequence
  chemically synthesized
aaaatactcactaaaccaac

SEQ ID NO: 550967 - DNA, 20 bp, Artificial Sequence
  chemically synthesized
gttaatatatataaaaattt

SEQ ID NO: 550968 - DNA, 20 bp, Artificial Sequence
  chemically synthesized
atacaaacttcactttggta

SEQ ID NO: 550969 - DNA, 20 bp, Artificial Sequence
  chemically synthesized
taacgttataatttttacaa

SEQ ID NO: 550970 - DNA, 20 bp, Artificial Sequence
  chemically synthesized
tattatcaatattggttatc

SEQ ID NO: 550971 - DNA, 20 bp, Artificial Sequence
  chemically synthesized
aaagacttcataagttgcca

SEQ ID NO: 550972 - DNA, 20 bp, Artificial Sequence
  chemically synthesized
atttataaggcaattgagtc

SEQ ID NO: 550973 - DNA, 20 bp, Artificial Sequence
  chemically synthesized
gatagtataaggtcatcctt

SEQ ID NO: 550974 - DNA, 20 bp, Artificial Sequence
  chemically synthesized
ctacagtcaaaagaataagc

SEQ ID NO: 550975 - DNA, 20 bp, Artificial Sequence
  chemically synthesized
ataatataatgctacagtca

SEQ ID NO: 550976 - DNA, 20 bp, Artificial Sequence
  chemically synthesized
tatattatgttcctgtagtt

SEQ ID NO: 550977 - DNA, 20 bp, Artificial Sequence
  chemically synthesized
tataacacagtgtccaaaaa

SEQ ID NO: 550978 - DNA, 20 bp, Artificial Sequence
  chemically synthesized
tactgttgatggttttaata

SEQ ID NO: 550979 - DNA, 20 bp, Artificial Sequence
  chemically synthesized
tcttattcttcaaattatgc

SEQ ID NO: 550980 - DNA, 20 bp, Artificial Sequence
  chemically synthesized
cacatttctctgcataattt

SEQ ID NO: 550981 - DNA, 20 bp, Artificial Sequence
  chemically synthesized
acagttttttttaaaccaag

SEQ ID NO: 550982 - DNA, 20 bp, Artificial Sequence
  chemically synthesized
aacaaataaatatgaagacc

SEQ ID NO: 550983 - DNA, 20 bp, Artificial Sequence
  chemically synthesized
aacaaagaggaatccattta

SEQ ID NO: 550984 - DNA, 20 bp, Artificial Sequence
  chemically synthesized
cacagcatacattcaaaata

SEQ ID NO: 550985 - DNA, 20 bp, Artificial Sequence
  chemically synthesized
tcaaataatttaagcaaatt

SEQ ID NO: 550986 - DNA, 20 bp, Artificial Sequence
  chemically synthesized
ttgtctaatcaaaacacaac

SEQ ID NO: 550987 - DNA, 20 bp, Artificial Sequence
  chemically synthesized
aaaaaattgatctcatggag

SEQ ID NO: 550988 - DNA, 20 bp, Artificial Sequence
  chemically synthesized
gtacccacaataattaaaaa

SEQ ID NO: 550989 - DNA, 20 bp, Artificial Sequence
  chemically synthesized
ccacaataattaaaaagaag

SEQ ID NO: 550990 - DNA, 20 bp, Artificial Sequence
  chemically synthesized
gagagaaatccaaagacaag

SEQ ID NO: 550991 - DNA, 20 bp, Artificial Sequence
  chemically synthesized
gcgtgtgcatctatggctgg

SEQ ID NO: 550992 - DNA, 20 bp, Artificial Sequence
  chemically synthesized
ccatttccttcatcatagat

SEQ ID NO: 550993 - DNA, 20 bp, Artificial Sequence
  chemically synthesized
taacaatggtagttggaact

SEQ ID NO: 550994 - DNA, 20 bp, Artificial Sequence
  chemically synthesized
cttttttgcataagacctgt

SEQ ID NO: 550995 - DNA, 20 bp, Artificial Sequence
  chemically synthesized
catgttagttatttcatata

SEQ ID NO: 550996 - DNA, 20 bp, Artificial Sequence
  chemically synthesized
gaatttcttatattttgtgt

SEQ ID NO: 550997 - DNA, 20 bp, Artificial Sequence
  chemically synthesized
gcatttctaaacacaaaata

SEQ ID NO: 550998 - DNA, 20 bp, Artificial Sequence
  chemically synthesized
aggaagaaccttccagaagg

SEQ ID NO: 550999 - DNA, 20 bp, Artificial Sequence
  chemically synthesized
tattccagcttcagtagtaa

SEQ ID NO: 551000 - DNA, 20 bp, Artificial Sequence
  chemically synthesized
tgtctcttgtgataaataaa

SEQ ID NO: 551001 - DNA, 20 bp, Artificial Sequence
  chemically synthesized
caagagacataatttctttt

SEQ ID NO: 551002 - DNA, 20 bp, Artificial Sequence
  chemically synthesized
acagagcctacatttctgaa

SEQ ID NO: 551003 - DNA, 20 bp, Artificial Sequence
  chemically synthesized
tatatatacagtaatgtcca

SEQ ID NO: 551004 - DNA, 20 bp, Artificial Sequence
  chemically synthesized
ggatgagagaccggtatatt

SEQ ID NO: 551005 - DNA, 20 bp, Artificial Sequence
  chemically synthesized
aaataaataaataaaggaaa

SEQ ID NO: 551006 - DNA, 20 bp, Artificial Sequence
  chemically synthesized
ctgctcgggagactgaggca

SEQ ID NO: 551007 - DNA, 20 bp, Artificial Sequence
  chemically synthesized
gctgacgaaaatgttttata

SEQ ID NO: 551008 - DNA, 20 bp, Artificial Sequence
  chemically synthesized
aacattttcgtcagcccaaa

SEQ ID NO: 551009 - DNA, 20 bp, Artificial Sequence
  chemically synthesized
ttagtagggcctggggacgt

SEQ ID NO: 551010 - DNA, 20 bp, Artificial Sequence
  chemically synthesized
gaatagtctaatcaatacag

SEQ ID NO: 551011 - DNA, 20 bp, Artificial Sequence
  chemically synthesized
atgagatttacataaagttt

SEQ ID NO: 551012 - DNA, 20 bp, Artificial Sequence
  chemically synthesized
gattatatgagctaaagcat

SEQ ID NO: 551013 - DNA, 20 bp, Artificial Sequence
  chemically synthesized
gcatctgtagaaagattgta

SEQ ID NO: 551014 - DNA, 20 bp, Artificial Sequence
  chemically synthesized
cagtttttccatttgcatct

SEQ ID NO: 551015 - DNA, 20 bp, Artificial Sequence
  chemically synthesized
aaaactgaggcacacgagtt

SEQ ID NO: 551016 - DNA, 20 bp, Artificial Sequence
  chemically synthesized
cagagcaagactcgtctcaa

SEQ ID NO: 551017 - DNA, 20 bp, Artificial Sequence
  chemically synthesized
ctactcgggaggctgaggca

SEQ ID NO: 551018 - DNA, 20 bp, Artificial Sequence
  chemically synthesized
gacaaaagaaaggagagcag

SEQ ID NO: 551019 - DNA, 20 bp, Artificial Sequence
  chemically synthesized
atccagggaaataacagaca

SEQ ID NO: 551020 - DNA, 20 bp, Artificial Sequence
  chemically synthesized
ggaactaattttgattgcca

SEQ ID NO: 551021 - DNA, 20 bp, Artificial Sequence
  chemically synthesized
gtaaatattaaagcaaattt

SEQ ID NO: 551022 - DNA, 20 bp, Artificial Sequence
  chemically synthesized
acaaacatgcaattttctaa

SEQ ID NO: 551023 - DNA, 20 bp, Artificial Sequence
  chemically synthesized
cctggtgtgtgttattctac

SEQ ID NO: 551024 - DNA, 20 bp, Artificial Sequence
  chemically synthesized
acagtatgccattccttaaa

SEQ ID NO: 551025 - DNA, 20 bp, Artificial Sequence
  chemically synthesized
tttagatcttaataatttta

SEQ ID NO: 551026 - DNA, 20 bp, Artificial Sequence
  chemically synthesized
aaatttatatattttgccct

SEQ ID NO: 551027 - DNA, 20 bp, Artificial Sequence
  chemically synthesized
tttaagagctagattttatt

SEQ ID NO: 551028 - DNA, 20 bp, Artificial Sequence
  chemically synthesized
tcttaaaattctattcagac

SEQ ID NO: 551029 - DNA, 20 bp, Artificial Sequence
  chemically synthesized
aaggatcattctaggtctga

SEQ ID NO: 551030 - DNA, 20 bp, Artificial Sequence
  chemically synthesized
cttgttttactgcatctgcc

SEQ ID NO: 551031 - DNA, 20 bp, Artificial Sequence
  chemically synthesized
tattcagatgaatctctcta

SEQ ID NO: 551032 - DNA, 20 bp, Artificial Sequence
  chemically synthesized
ttctatttctgtttgaaccc

SEQ ID NO: 551033 - DNA, 20 bp, Artificial Sequence
  chemically synthesized
tgatatttcttagggttcaa

SEQ ID NO: 551034 - DNA, 20 bp, Artificial Sequence
  chemically synthesized
ttcttagggttcaaacagaa

SEQ ID NO: 551035 - DNA, 20 bp, Artificial Sequence
  chemically synthesized
tctaaaagttagagaacgaa

SEQ ID NO: 551036 - DNA, 20 bp, Artificial Sequence
  chemically synthesized
aaatgaatttactttaatat

SEQ ID NO: 551037 - DNA, 20 bp, Artificial Sequence
  chemically synthesized
acactatgaataataaaaaa

SEQ ID NO: 551038 - DNA, 20 bp, Artificial Sequence
  chemically synthesized
aaataatgaatggaattata

SEQ ID NO: 551039 - DNA, 20 bp, Artificial Sequence
  chemically synthesized
gacctgctgaaaaaccttaa

SEQ ID NO: 551040 - DNA, 20 bp, Artificial Sequence
  chemically synthesized
aaagactttacctccccagt

SEQ ID NO: 551041 - DNA, 20 bp, Artificial Sequence
  chemically synthesized
tgggttctgtggctgctcta

SEQ ID NO: 551042 - DNA, 20 bp, Artificial Sequence
  chemically synthesized
ggctgctctaatagaatgca

SEQ ID NO: 551043 - DNA, 20 bp, Artificial Sequence
  chemically synthesized
aatacaatgtaataataata

SEQ ID NO: 551044 - DNA, 20 bp, Artificial Sequence
  chemically synthesized
attatgtaactcaccatatc

SEQ ID NO: 551045 - DNA, 20 bp, Artificial Sequence
  chemically synthesized
tgggaccgtctagttgcagg

SEQ ID NO: 551046 - DNA, 20 bp, Artificial Sequence
  chemically synthesized
cagggttaggcctgaagata

SEQ ID NO: 551047 - DNA, 20 bp, Artificial Sequence
  chemically synthesized
gctggcagatgagctggtca

SEQ ID NO: 551048 - DNA, 20 bp, Artificial Sequence
  chemically synthesized
aatagataaccggaacatag

SEQ ID NO: 551049 - DNA, 20 bp, Artificial Sequence
  chemically synthesized
ttactgataatttgtatttt

SEQ ID NO: 551050 - DNA, 20 bp, Artificial Sequence
  chemically synthesized
attatcagtaaaaattagct

SEQ ID NO: 551051 - DNA, 20 bp, Artificial Sequence
  chemically synthesized
aggcctttgggagagggata

SEQ ID NO: 551052 - DNA, 20 bp, Artificial Sequence
  chemically synthesized
ctgtgttctttctctactgc

SEQ ID NO: 551053 - DNA, 20 bp, Artificial Sequence
  chemically synthesized
cgttttcgtttctgtgcagt

SEQ ID NO: 551054 - DNA, 20 bp, Artificial Sequence
  chemically synthesized
aaaagactgacttttataag

SEQ ID NO: 551055 - DNA, 20 bp, Artificial Sequence
  chemically synthesized
ctactcaggaggctgaggca

SEQ ID NO: 551056 - DNA, 20 bp, Artificial Sequence
  chemically synthesized
accctgaagcaaaccacaac

SEQ ID NO: 551057 - DNA, 20 bp, Artificial Sequence
  chemically synthesized
cataacttatatgtttcaga

SEQ ID NO: 551058 - DNA, 20 bp, Artificial Sequence
  chemically synthesized
cttttcactaatgtattaat

SEQ ID NO: 551059 - DNA, 20 bp, Artificial Sequence
  chemically synthesized
tttagttaaattgaagaaaa

SEQ ID NO: 551060 - DNA, 20 bp, Artificial Sequence
  chemically synthesized
ttcagttctttagttaaatt

SEQ ID NO: 551061 - DNA, 20 bp, Artificial Sequence
  chemically synthesized
tttttaaaagaagacacatt

SEQ ID NO: 551062 - DNA, 20 bp, Artificial Sequence
  chemically synthesized
actacaagtaagtggcagag

SEQ ID NO: 551063 - DNA, 20 bp, Artificial Sequence
  chemically synthesized
ataggcaatgaaattggaga

SEQ ID NO: 551064 - DNA, 20 bp, Artificial Sequence
  chemically synthesized
ccaatttcattgcctataaa

SEQ ID NO: 551065 - DNA, 20 bp, Artificial Sequence
  chemically synthesized
ataaagcagtttaaaaaact

SEQ ID NO: 551066 - DNA, 20 bp, Artificial Sequence
  chemically synthesized
ctgaagaatcaattatttct

SEQ ID NO: 551067 - DNA, 20 bp, Artificial Sequence
  chemically synthesized
caattatttctgaagaaaaa

SEQ ID NO: 551068 - DNA, 20 bp, Artificial Sequence
  chemically synthesized
ttaccaattcttttttttct

SEQ ID NO: 551069 - DNA, 20 bp, Artificial Sequence
  chemically synthesized
ttaggaaaataaaaatagtg

SEQ ID NO: 551070 - DNA, 20 bp, Artificial Sequence
  chemically synthesized
ttttattctcattgtatctt

SEQ ID NO: 551071 - DNA, 20 bp, Artificial Sequence
  chemically synthesized
agtatttctagaagatacaa

SEQ ID NO: 551072 - DNA, 20 bp, Artificial Sequence
  chemically synthesized
attttaaagcactgttatta

SEQ ID NO: 551073 - DNA, 20 bp, Artificial Sequence
  chemically synthesized
aaattagcaaaaaaattaaa

SEQ ID NO: 551074 - DNA, 20 bp, Artificial Sequence
  chemically synthesized
ctacctgggaggctgaggca

SEQ ID NO: 551075 - DNA, 20 bp, Artificial Sequence
  chemically synthesized
cagctttcctatttttctaa

SEQ ID NO: 551076 - DNA, 20 bp, Artificial Sequence
  chemically synthesized
aacaagctactattttctca

SEQ ID NO: 551077 - DNA, 20 bp, Artificial Sequence
  chemically synthesized
atataaatgcaacgtatcct

SEQ ID NO: 551078 - DNA, 20 bp, Artificial Sequence
  chemically synthesized
gaacttagccgcttgcctac

SEQ ID NO: 551079 - DNA, 20 bp, Artificial Sequence
  chemically synthesized
cattttatggtcattccaaa

SEQ ID NO: 551080 - DNA, 20 bp, Artificial Sequence
  chemically synthesized
catattgctattataattca

SEQ ID NO: 551081 - DNA, 20 bp, Artificial Sequence
  chemically synthesized
agtgactgtctattggagga

SEQ ID NO: 551082 - DNA, 20 bp, Artificial Sequence
  chemically synthesized
ctacaaatcatttatatttc

SEQ ID NO: 551083 - DNA, 20 bp, Artificial Sequence
  chemically synthesized
aagaccagcctgaccaacat

SEQ ID NO: 551084 - DNA, 20 bp, Artificial Sequence
  chemically synthesized
cggctaactttgtattttta

SEQ ID NO: 551085 - DNA, 20 bp, Artificial Sequence
  chemically synthesized
ctacttgggaggctgaggca

SEQ ID NO: 551086 - DNA, 20 bp, Artificial Sequence
  chemically synthesized
taatgttacgcaatttttca

SEQ ID NO: 551087 - DNA, 20 bp, Artificial Sequence
  chemically synthesized
aaatacattaaatattgttt

SEQ ID NO: 551088 - DNA, 20 bp, Artificial Sequence
  chemically synthesized
aatgtgccccacagctttta

SEQ ID NO: 551089 - DNA, 20 bp, Artificial Sequence
  chemically synthesized
gttgtttttcatctattaaa

SEQ ID NO: 551090 - DNA, 20 bp, Artificial Sequence
  chemically synthesized
ttaatagatgaaaaacaact

SEQ ID NO: 551091 - DNA, 20 bp, Artificial Sequence
  chemically synthesized
acaatatgtctaattgatat

SEQ ID NO: 551092 - DNA, 20 bp, Artificial Sequence
  chemically synthesized
caagattcttggatatagct

SEQ ID NO: 551093 - DNA, 20 bp, Artificial Sequence
  chemically synthesized
tttatttctaaagctatatc

SEQ ID NO: 551094 - DNA, 20 bp, Artificial Sequence
  chemically synthesized
tttgaaaaatagaatgtttg

SEQ ID NO: 551095 - DNA, 20 bp, Artificial Sequence
  chemically synthesized
atgaaacctaattttgaaaa

SEQ ID NO: 551096 - DNA, 20 bp, Artificial Sequence
  chemically synthesized
tttgagcatcagtaacttta

SEQ ID NO: 551097 - DNA, 20 bp, Artificial Sequence
  chemically synthesized
ctacttaggaggctgaggca

SEQ ID NO: 551098 - DNA, 20 bp, Artificial Sequence
  chemically synthesized
ctgggcagcaaaacgagcac

SEQ ID NO: 551099 - DNA, 20 bp, Artificial Sequence
  chemically synthesized
gaggagatacacctaattta

SEQ ID NO: 551100 - DNA, 20 bp, Artificial Sequence
  chemically synthesized
tccatctttgtggcagggag

SEQ ID NO: 551101 - DNA, 20 bp, Artificial Sequence
  chemically synthesized
ttgttttggtgatttttaat

SEQ ID NO: 551102 - DNA, 20 bp, Artificial Sequence
  chemically synthesized
aaaatcaccaaaacaaggag

SEQ ID NO: 551103 - DNA, 20 bp, Artificial Sequence
  chemically synthesized
caacaaaaaaacacaaatat

SEQ ID NO: 551104 - DNA, 20 bp, Artificial Sequence
  chemically synthesized
accccatgaatagagtttat

SEQ ID NO: 551105 - DNA, 20 bp, Artificial Sequence
  chemically synthesized
caactcattatattatcctt

SEQ ID NO: 551106 - DNA, 20 bp, Artificial Sequence
  chemically synthesized
tgagtaattccaatatcctc

SEQ ID NO: 551107 - DNA, 20 bp, Artificial Sequence
  chemically synthesized
tcctcacctcctacttagca

SEQ ID NO: 551108 - DNA, 20 bp, Artificial Sequence
  chemically synthesized
tgtaattaaatcactaaaaa

SEQ ID NO: 551109 - DNA, 20 bp, Artificial Sequence
  chemically synthesized
gatgaagaaaatcacatgga

SEQ ID NO: 551110 - DNA, 20 bp, Artificial Sequence
  chemically synthesized
ataattttgttaaattagat

SEQ ID NO: 551111 - DNA, 20 bp, Artificial Sequence
  chemically synthesized
tttgtcttgtacttctggaa

SEQ ID NO: 551112 - DNA, 20 bp, Artificial Sequence
  chemically synthesized
gggagaatgtaagattataa

SEQ ID NO: 551113 - DNA, 20 bp, Artificial Sequence
  chemically synthesized
agagctgtgtgaatccatgg

SEQ ID NO: 551114 - DNA, 20 bp, Artificial Sequence
  chemically synthesized
gaggaatattactttcatta

SEQ ID NO: 551115 - DNA, 20 bp, Artificial Sequence
  chemically synthesized
aggggaaggaaaacaccaaa

SEQ ID NO: 551116 - DNA, 20 bp, Artificial Sequence
  chemically synthesized
ctgtctaaaaaaaaaaaaaa

SEQ ID NO: 551117 - DNA, 20 bp, Artificial Sequence
  chemically synthesized
ctactcaggaggccaaggca

SEQ ID NO: 551118 - DNA, 20 bp, Artificial Sequence
  chemically synthesized
cacaggaggctctgggcctt

SEQ ID NO: 551119 - DNA, 20 bp, Artificial Sequence
  chemically synthesized
cagggagatgccatctctac

SEQ ID NO: 551120 - DNA, 20 bp, Artificial Sequence
  chemically synthesized
cttattcatttatttatttt

SEQ ID NO: 551121 - DNA, 20 bp, Artificial Sequence
  chemically synthesized
ctaaaaaataaataaatgaa

SEQ ID NO: 551122 - DNA, 20 bp, Artificial Sequence
  chemically synthesized
aaaataaataaatgaataag

SEQ ID NO: 551123 - DNA, 20 bp, Artificial Sequence
  chemically synthesized
ataaatatactaaccagtgg

SEQ ID NO: 551124 - DNA, 20 bp, Artificial Sequence
  chemically synthesized
tccattgtgttcacaaaatc

SEQ ID NO: 551125 - DNA, 20 bp, Artificial Sequence
  chemically synthesized
aaataatcctttttcatctc

SEQ ID NO: 551126 - DNA, 20 bp, Artificial Sequence
  chemically synthesized
cagcttttctgaacattagt

SEQ ID NO: 551127 - DNA, 20 bp, Artificial Sequence
  chemically synthesized
aaggaattcttcactaatgt

SEQ ID NO: 551128 - DNA, 20 bp, Artificial Sequence
  chemically synthesized
taaaacaaagtagaaggagg

SEQ ID NO: 551129 - DNA, 20 bp, Artificial Sequence
  chemically synthesized
ggaggaaagaatgggtgttt

SEQ ID NO: 551130 - DNA, 20 bp, Artificial Sequence
  chemically synthesized
ataggagtatgaaaatacac

SEQ ID NO: 551131 - DNA, 20 bp, Artificial Sequence
  chemically synthesized
tagcgtatttcgatatactg

SEQ ID NO: 551132 - DNA, 20 bp, Artificial Sequence
  chemically synthesized
acatgcacagaaggttattg

SEQ ID NO: 551133 - DNA, 20 bp, Artificial Sequence
  chemically synthesized
ttcaaacgtttgggtacctt

SEQ ID NO: 551134 - DNA, 20 bp, Artificial Sequence
  chemically synthesized
ttaaacatcttattatctat

SEQ ID NO: 551135 - DNA, 20 bp, Artificial Sequence
  chemically synthesized
agttgtttgtttgtttttta

SEQ ID NO: 551136 - DNA, 20 bp, Artificial Sequence
  chemically synthesized
ttgctggcaataccagaagc

SEQ ID NO: 551137 - DNA, 20 bp, Artificial Sequence
  chemically synthesized
gagtgacgtgtctataagcc

SEQ ID NO: 551138 - DNA, 20 bp, Artificial Sequence
  chemically synthesized
aatacagagaagacacacag

SEQ ID NO: 551139 - DNA, 20 bp, Artificial Sequence
  chemically synthesized
atgtccttataagaagaaga

SEQ ID NO: 551140 - DNA, 20 bp, Artificial Sequence
  chemically synthesized
aaaaccacatttttgaagtt

SEQ ID NO: 551141 - DNA, 20 bp, Artificial Sequence
  chemically synthesized
aaacaaatatatgtattgaa

SEQ ID NO: 551142 - DNA, 20 bp, Artificial Sequence
  chemically synthesized
ctaccctggaggctgaggcg

SEQ ID NO: 551143 - DNA, 20 bp, Artificial Sequence
  chemically synthesized
agtgaaactccatctcaaaa

SEQ ID NO: 551144 - DNA, 20 bp, Artificial Sequence
  chemically synthesized
gccaagcatgacttctctgc

SEQ ID NO: 551145 - DNA, 20 bp, Artificial Sequence
  chemically synthesized
ctataaagctatgaaagtac

SEQ ID NO: 551146 - DNA, 20 bp, Artificial Sequence
  chemically synthesized
aagtattatgaaggaccaac

SEQ ID NO: 551147 - DNA, 20 bp, Artificial Sequence
  chemically synthesized
cataatacttggatttacat

SEQ ID NO: 551148 - DNA, 20 bp, Artificial Sequence
  chemically synthesized
cagagcacttaaaatatgat

SEQ ID NO: 551149 - DNA, 20 bp, Artificial Sequence
  chemically synthesized
gcccatggtggccagcttca

SEQ ID NO: 551150 - DNA, 20 bp, Artificial Sequence
  chemically synthesized
ccgaatagacaatgcaaggc

SEQ ID NO: 551151 - DNA, 20 bp, Artificial Sequence
  chemically synthesized
tgacccaccactgggcatgc

SEQ ID NO: 551152 - DNA, 20 bp, Artificial Sequence
  chemically synthesized
gaatggtaattaactaacat

SEQ ID NO: 551153 - DNA, 20 bp, Artificial Sequence
  chemically synthesized
gactcctatcttttaagcat

SEQ ID NO: 551154 - DNA, 20 bp, Artificial Sequence
  chemically synthesized
ctgcaacaggcaaagccact

SEQ ID NO: 551155 - DNA, 20 bp, Artificial Sequence
  chemically synthesized
gcatgttctgcacatgtatc

SEQ ID NO: 551156 - DNA, 20 bp, Artificial Sequence
  chemically synthesized
ctatgggagggatagcatta

SEQ ID NO: 551157 - DNA, 20 bp, Artificial Sequence
  chemically synthesized
ctgttcctgtgttagtctga

SEQ ID NO: 551158 - DNA, 20 bp, Artificial Sequence
  chemically synthesized
ccatcagtgatagactggat

SEQ ID NO: 551159 - DNA, 20 bp, Artificial Sequence
  chemically synthesized
cgtgtacatgtgtctttata

SEQ ID NO: 551160 - DNA, 20 bp, Artificial Sequence
  chemically synthesized
aattcctcaaggatctagaa

SEQ ID NO: 551161 - DNA, 20 bp, Artificial Sequence
  chemically synthesized
tatgaaatagtgcacattca

SEQ ID NO: 551162 - DNA, 20 bp, Artificial Sequence
  chemically synthesized
tactgtacttaaagtgaaaa

SEQ ID NO: 551163 - DNA, 20 bp, Artificial Sequence
  chemically synthesized
actcaacactttattataaa

SEQ ID NO: 551164 - DNA, 20 bp, Artificial Sequence
  chemically synthesized
ttggcagggcaaagttaagt

SEQ ID NO: 551165 - DNA, 20 bp, Artificial Sequence
  chemically synthesized
tctaagatcactgaaggact

SEQ ID NO: 551166 - DNA, 20 bp, Artificial Sequence
  chemically synthesized
tatctactcaacaccctttg

SEQ ID NO: 551167 - DNA, 20 bp, Artificial Sequence
  chemically synthesized
ggagaaattattagagtaat

SEQ ID NO: 551168 - DNA, 20 bp, Artificial Sequence
  chemically synthesized
gaatatgttacaaaatttgg

SEQ ID NO: 551169 - DNA, 20 bp, Artificial Sequence
  chemically synthesized
acaaaagtcttgtgtttccc

SEQ ID NO: 551170 - DNA, 20 bp, Artificial Sequence
  chemically synthesized
gcccaaggtcaaatgctggt

SEQ ID NO: 551171 - DNA, 20 bp, Artificial Sequence
  chemically synthesized
aatatatataaagagttttg

SEQ ID NO: 551172 - DNA, 20 bp, Artificial Sequence
  chemically synthesized
tatgttcagtattttaggaa

SEQ ID NO: 551173 - DNA, 20 bp, Artificial Sequence
  chemically synthesized
attattgataaatctgaggt

SEQ ID NO: 551174 - DNA, 20 bp, Artificial Sequence
  chemically synthesized
ttctgggaagaatacatgtt

SEQ ID NO: 551175 - DNA, 20 bp, Artificial Sequence
  chemically synthesized
ttctgaaacatgtattcttc

SEQ ID NO: 551176 - DNA, 20 bp, Artificial Sequence
  chemically synthesized
gagattaaaggttattctgg

SEQ ID NO: 551177 - DNA, 20 bp, Artificial Sequence
  chemically synthesized
attcgtggtagacatagagc

SEQ ID NO: 551178 - DNA, 20 bp, Artificial Sequence
  chemically synthesized
acgaataagcccaagagtag

SEQ ID NO: 551179 - DNA, 20 bp, Artificial Sequence
  chemically synthesized
ttgttgactaaggaagagaa

SEQ ID NO: 551180 - DNA, 20 bp, Artificial Sequence
  chemically synthesized
taaatgttgttgactaagga

SEQ ID NO: 551181 - DNA, 20 bp, Artificial Sequence
  chemically synthesized
tcaaaatgaaataatttcag

SEQ ID NO: 551182 - DNA, 20 bp, Artificial Sequence
  chemically synthesized
agtgtgactaagacactgtt

SEQ ID NO: 551183 - DNA, 20 bp, Artificial Sequence
  chemically synthesized
tctgtaagttgtcaaatttc

SEQ ID NO: 551184 - DNA, 20 bp, Artificial Sequence
  chemically synthesized
tacctggcacagatggtttt

SEQ ID NO: 551185 - DNA, 20 bp, Artificial Sequence
  chemically synthesized
taattattttttcaactttc

SEQ ID NO: 551186 - DNA, 20 bp, Artificial Sequence
  chemically synthesized
aaagttgaaaaaataattag

SEQ ID NO: 551187 - DNA, 20 bp, Artificial Sequence
  chemically synthesized
ctacactaggatgatagcac

SEQ ID NO: 551188 - DNA, 20 bp, Artificial Sequence
  chemically synthesized
tgttggaagagtgggagcaa

SEQ ID NO: 551189 - DNA, 20 bp, Artificial Sequence
  chemically synthesized
aagagtgggagcaaatagaa

SEQ ID NO: 551190 - DNA, 20 bp, Artificial Sequence
  chemically synthesized
aaacagcataaaaacagaga

SEQ ID NO: 551191 - DNA, 20 bp, Artificial Sequence
  chemically synthesized
atataagcaataaaaatttt

SEQ ID NO: 551192 - DNA, 20 bp, Artificial Sequence
  chemically synthesized
ttattgcttatatgcttgtg

SEQ ID NO: 551193 - DNA, 20 bp, Artificial Sequence
  chemically synthesized
tattatttgttatattaggt

SEQ ID NO: 551194 - DNA, 20 bp, Artificial Sequence
  chemically synthesized
ggactttcctccagtttatt

SEQ ID NO: 551195 - DNA, 20 bp, Artificial Sequence
  chemically synthesized
tcacaatgttttatgagaaa

SEQ ID NO: 551196 - DNA, 20 bp, Artificial Sequence
  chemically synthesized
tgacatatcacaatgtttta

SEQ ID NO: 551197 - DNA, 20 bp, Artificial Sequence
  chemically synthesized
aatgatggaatcaaatcctc

SEQ ID NO: 551198 - DNA, 20 bp, Artificial Sequence
  chemically synthesized
gtacctgggaggctgaagca

SEQ ID NO: 551199 - DNA, 20 bp, Artificial Sequence
  chemically synthesized
tctatctatataaagtttta

SEQ ID NO: 551200 - DNA, 20 bp, Artificial Sequence
  chemically synthesized
aagttttaggagaaatctgc

SEQ ID NO: 551201 - DNA, 20 bp, Artificial Sequence
  chemically synthesized
aagtaaaaacattctcaact

SEQ ID NO: 551202 - DNA, 20 bp, Artificial Sequence
  chemically synthesized
tacatgttgttttctggagt

SEQ ID NO: 551203 - DNA, 20 bp, Artificial Sequence
  chemically synthesized
caactttctaagatattggc

SEQ ID NO: 551204 - DNA, 20 bp, Artificial Sequence
  chemically synthesized
atgttttctaagccaatatc

SEQ ID NO: 551205 - DNA, 20 bp, Artificial Sequence
  chemically synthesized
aagacatacaatacaataaa

SEQ ID NO: 551206 - DNA, 20 bp, Artificial Sequence
  chemically synthesized
tggattttattttggcaagt

SEQ ID NO: 551207 - DNA, 20 bp, Artificial Sequence
  chemically synthesized
tatttaatatatataaataa

SEQ ID NO: 551208 - DNA, 20 bp, Artificial Sequence
  chemically synthesized
ccaaattcatctgtgtaaca

SEQ ID NO: 551209 - DNA, 20 bp, Artificial Sequence
  chemically synthesized
ttccaatgatagcttaaagc

SEQ ID NO: 551210 - DNA, 20 bp, Artificial Sequence
  chemically synthesized
ataactctgcttatctgctt

SEQ ID NO: 551211 - DNA, 20 bp, Artificial Sequence
  chemically synthesized
agataagcagagttattgaa

SEQ ID NO: 551212 - DNA, 20 bp, Artificial Sequence
  chemically synthesized
agcatacctttaatcaagta

SEQ ID NO: 551213 - DNA, 20 bp, Artificial Sequence
  chemically synthesized
cagaaataaagtagaacaca

SEQ ID NO: 551214 - DNA, 20 bp, Artificial Sequence
  chemically synthesized
atgcaaaaaaaaaaaaaaag

SEQ ID NO: 551215 - DNA, 20 bp, Artificial Sequence
  chemically synthesized
ctgtatgcaaaaaaaaaaaa

SEQ ID NO: 551216 - DNA, 20 bp, Artificial Sequence
  chemically synthesized
gtagattcaagtaaacactt

SEQ ID NO: 551217 - DNA, 20 bp, Artificial Sequence
  chemically synthesized
agtgagtttattaggctgag

SEQ ID NO: 551218 - DNA, 20 bp, Artificial Sequence
  chemically synthesized
attatgaacttctaacacat

SEQ ID NO: 551219 - DNA, 20 bp, Artificial Sequence
  chemically synthesized
taaattacacaaaggtgtgt

SEQ ID NO: 551220 - DNA, 20 bp, Artificial Sequence
  chemically synthesized
aggtgtgtttagaatataca

SEQ ID NO: 551221 - DNA, 20 bp, Artificial Sequence
  chemically synthesized
tatgaaaaaaaaatgtattc

SEQ ID NO: 551222 - DNA, 20 bp, Artificial Sequence
  chemically synthesized
atcctatgtcgtcccttagc

SEQ ID NO: 551223 - DNA, 20 bp, Artificial Sequence
  chemically synthesized
ttcagtacatatttatacaa

SEQ ID NO: 551224 - DNA, 20 bp, Artificial Sequence
  chemically synthesized
gtaatttgcaatgctcatgc

SEQ ID NO: 551225 - DNA, 20 bp, Artificial Sequence
  chemically synthesized
tgaaggtaataatagcacaa

SEQ ID NO: 551226 - DNA, 20 bp, Artificial Sequence
  chemically synthesized
agggcatcaagtaagaagag

SEQ ID NO: 551227 - DNA, 20 bp, Artificial Sequence
  chemically synthesized
aagaagatggggcgttaaaa

SEQ ID NO: 551228 - DNA, 20 bp, Artificial Sequence
  chemically synthesized
ttaatgatgttgttttggca

SEQ ID NO: 551229 - DNA, 20 bp, Artificial Sequence
  chemically synthesized
cagcatcctttccaatcagt

SEQ ID NO: 551230 - DNA, 20 bp, Artificial Sequence
  chemically synthesized
ctccattatatttttaaaac

SEQ ID NO: 551231 - DNA, 20 bp, Artificial Sequence
  chemically synthesized
tttgaatagtagtctaggtg

SEQ ID NO: 551232 - DNA, 20 bp, Artificial Sequence
  chemically synthesized
atatcattatcaatcatcgc

SEQ ID NO: 551233 - DNA, 20 bp, Artificial Sequence
  chemically synthesized
ataagatatatgagaagatg

SEQ ID NO: 551234 - DNA, 20 bp, Artificial Sequence
  chemically synthesized
caaatttacttccatgtttt

SEQ ID NO: 551235 - DNA, 20 bp, Artificial Sequence
  chemically synthesized
ttaaaacatggaagtaaatt

SEQ ID NO: 551236 - DNA, 20 bp, Artificial Sequence
  chemically synthesized
cttactgaattcatccgtat

SEQ ID NO: 551237 - DNA, 20 bp, Artificial Sequence
  chemically synthesized
catacggatgaattcagtaa

SEQ ID NO: 551238 - DNA, 20 bp, Artificial Sequence
  chemically synthesized
taactttgcgctttcaattt

SEQ ID NO: 551239 - DNA, 20 bp, Artificial Sequence
  chemically synthesized
cattctttgaactgaaaaga

SEQ ID NO: 551240 - DNA, 20 bp, Artificial Sequence
  chemically synthesized
atttctcctcttttcagttc

SEQ ID NO: 551241 - DNA, 20 bp, Artificial Sequence
  chemically synthesized
atatatgtatgtatgtatat

SEQ ID NO: 551242 - DNA, 20 bp, Artificial Sequence
  chemically synthesized
ttttactagtctatcaaata

SEQ ID NO: 551243 - DNA, 20 bp, Artificial Sequence
  chemically synthesized
agccttctagatttatttga

SEQ ID NO: 551244 - DNA, 20 bp, Artificial Sequence
  chemically synthesized
acatttaaaagtggtttaaa

SEQ ID NO: 551245 - DNA, 20 bp, Artificial Sequence
  chemically synthesized
gacgtatttctgagaagtcc

SEQ ID NO: 551246 - DNA, 20 bp, Artificial Sequence
  chemically synthesized
gaaagaattctcaggacttc

SEQ ID NO: 551247 - DNA, 20 bp, Artificial Sequence
  chemically synthesized
agcgttgtttcctactacag

SEQ ID NO: 551248 - DNA, 20 bp, Artificial Sequence
  chemically synthesized
ttcaagcgttgtttcctact

SEQ ID NO: 551249 - DNA, 20 bp, Artificial Sequence
  chemically synthesized
gtgtttttaaatgttcttca

SEQ ID NO: 551250 - DNA, 20 bp, Artificial Sequence
  chemically synthesized
ttaaaatgcataaaataata

SEQ ID NO: 551251 - DNA, 20 bp, Artificial Sequence
  chemically synthesized
tcctccctgaagttgtgcaa

SEQ ID NO: 551252 - DNA, 20 bp, Artificial Sequence
  chemically synthesized
aacttcagggaggactgttc

SEQ ID NO: 551253 - DNA, 20 bp, Artificial Sequence
  chemically synthesized
aaataattactagtcgaatt

SEQ ID NO: 551254 - DNA, 20 bp, Artificial Sequence
  chemically synthesized
atttttaactttataatttg

SEQ ID NO: 551255 - DNA, 20 bp, Artificial Sequence
  chemically synthesized
aattctgggtgaaggataca

SEQ ID NO: 551256 - DNA, 20 bp, Artificial Sequence
  chemically synthesized
tattctaatgtatccttcac

SEQ ID NO: 551257 - DNA, 20 bp, Artificial Sequence
  chemically synthesized
tgactctaaaatacagacaa

SEQ ID NO: 551258 - DNA, 20 bp, Artificial Sequence
  chemically synthesized
ttatatacttgttcttctga

SEQ ID NO: 551259 - DNA, 20 bp, Artificial Sequence
  chemically synthesized
actgttaaaatgtgtgtggc

SEQ ID NO: 551260 - DNA, 20 bp, Artificial Sequence
  chemically synthesized
cttactagacatgatattgc

SEQ ID NO: 551261 - DNA, 20 bp, Artificial Sequence
  chemically synthesized
taaattccttttgtgtaaag

SEQ ID NO: 551262 - DNA, 20 bp, Artificial Sequence
  chemically synthesized
agttaatatttataaagtgc

SEQ ID NO: 551263 - DNA, 20 bp, Artificial Sequence
  chemically synthesized
ccatgatttgacattacaaa

SEQ ID NO: 551264 - DNA, 20 bp, Artificial Sequence
  chemically synthesized
acacttgaactctgagataa

SEQ ID NO: 551265 - DNA, 20 bp, Artificial Sequence
  chemically synthesized
atttattttcactacattgt

SEQ ID NO: 551266 - DNA, 20 bp, Artificial Sequence
  chemically synthesized
ttactatatattttttaaca

SEQ ID NO: 551267 - DNA, 20 bp, Artificial Sequence
  chemically synthesized
gttgtttttgaaattgaatc

SEQ ID NO: 551268 - DNA, 20 bp, Artificial Sequence
  chemically synthesized
taaatttaaattaaccctat

SEQ ID NO: 551269 - DNA, 20 bp, Artificial Sequence
  chemically synthesized
agcaagcagataaatgaaaa

SEQ ID NO: 551270 - DNA, 20 bp, Artificial Sequence
  chemically synthesized
tctacctggattattgatgg

SEQ ID NO: 551271 - DNA, 20 bp, Artificial Sequence
  chemically synthesized
aaaataattagttataggat

SEQ ID NO: 551272 - DNA, 20 bp, Artificial Sequence
  chemically synthesized
taatgtaactggcacagaac

SEQ ID NO: 551273 - DNA, 20 bp, Artificial Sequence
  chemically synthesized
tcaaagactttgtgcatgca

SEQ ID NO: 551274 - DNA, 20 bp, Artificial Sequence
  chemically synthesized
actgttgaaggtaaatctga

SEQ ID NO: 551275 - DNA, 20 bp, Artificial Sequence
  chemically synthesized
atgcttttattacccaatga

SEQ ID NO: 551276 - DNA, 20 bp, Artificial Sequence
  chemically synthesized
acatttgcaaaaatcaatag

SEQ ID NO: 551277 - DNA, 20 bp, Artificial Sequence
  chemically synthesized
catctagacatttttgttgt

SEQ ID NO: 551278 - DNA, 20 bp, Artificial Sequence
  chemically synthesized
gtgacaggtgcactaaaatc

SEQ ID NO: 551279 - DNA, 20 bp, Artificial Sequence
  chemically synthesized
tcctagaactcttgatgaat

SEQ ID NO: 551280 - DNA, 20 bp, Artificial Sequence
  chemically synthesized
ttgatgaattcagaatctag

SEQ ID NO: 551281 - DNA, 20 bp, Artificial Sequence
  chemically synthesized
ttcagaatctagggagaaag

SEQ ID NO: 551282 - DNA, 20 bp, Artificial Sequence
  chemically synthesized
ttgataatctttatgtaact

SEQ ID NO: 551283 - DNA, 20 bp, Artificial Sequence
  chemically synthesized
caaaatctaaactgaatgtt

SEQ ID NO: 551284 - DNA, 20 bp, Artificial Sequence
  chemically synthesized
tcagtttctttatatctgaa

SEQ ID NO: 551285 - DNA, 20 bp, Artificial Sequence
  chemically synthesized
tttatttctcattcagatat

SEQ ID NO: 551286 - DNA, 20 bp, Artificial Sequence
  chemically synthesized
gatacccacattacaaataa

SEQ ID NO: 551287 - DNA, 20 bp, Artificial Sequence
  chemically synthesized
caatatggatgtgatttctg

SEQ ID NO: 551288 - DNA, 20 bp, Artificial Sequence
  chemically synthesized
ggatgtgatttctgtaagaa

SEQ ID NO: 551289 - DNA, 20 bp, Artificial Sequence
  chemically synthesized
agattatttttctctttctt

SEQ ID NO: 551290 - DNA, 20 bp, Artificial Sequence
  chemically synthesized
acctagacctcatacctact

SEQ ID NO: 551291 - DNA, 20 bp, Artificial Sequence
  chemically synthesized
aattgaacagaataaagagt

SEQ ID NO: 551292 - DNA, 20 bp, Artificial Sequence
  chemically synthesized
ttgacacatagatcaattga

SEQ ID NO: 551293 - DNA, 20 bp, Artificial Sequence
  chemically synthesized
aacagatgagagcttcttat

SEQ ID NO: 551294 - DNA, 20 bp, Artificial Sequence
  chemically synthesized
ttgaaacctctgggggttta

SEQ ID NO: 551295 - DNA, 20 bp, Artificial Sequence
  chemically synthesized
tagaggtctcaaatctgctt

SEQ ID NO: 551296 - DNA, 20 bp, Artificial Sequence
  chemically synthesized
caaaggtggaaaaaactgta

SEQ ID NO: 551297 - DNA, 20 bp, Artificial Sequence
  chemically synthesized
aacctacgagtaggtgaaaa

SEQ ID NO: 551298 - DNA, 20 bp, Artificial Sequence
  chemically synthesized
agtggttggtttcaagtgat

SEQ ID NO: 551299 - DNA, 20 bp, Artificial Sequence
  chemically synthesized
agtaagtcatgcaaaataat

SEQ ID NO: 551300 - DNA, 20 bp, Artificial Sequence
  chemically synthesized
caaaatggttaagaaggtga

SEQ ID NO: 551301 - DNA, 20 bp, Artificial Sequence
  chemically synthesized
attattataaatgtgagtaa

SEQ ID NO: 551302 - DNA, 20 bp, Artificial Sequence
  chemically synthesized
aaagtatggcggggaattat

SEQ ID NO: 551303 - DNA, 20 bp, Artificial Sequence
  chemically synthesized
agcaactagcaatagacaaa

SEQ ID NO: 551304 - DNA, 20 bp, Artificial Sequence
  chemically synthesized
aaggagaaaaatcgaaacag

SEQ ID NO: 551305 - DNA, 20 bp, Artificial Sequence
  chemically synthesized
agaaaaatcgaaacagagag

SEQ ID NO: 551306 - DNA, 20 bp, Artificial Sequence
  chemically synthesized
catgtaattaaatccctttg

SEQ ID NO: 551307 - DNA, 20 bp, Artificial Sequence
  chemically synthesized
taatttttttctcaacaaac

SEQ ID NO: 551308 - DNA, 20 bp, Artificial Sequence
  chemically synthesized
tttattatttctgtgtttgt

SEQ ID NO: 551309 - DNA, 20 bp, Artificial Sequence
  chemically synthesized
aaacacagaaataataaaat

SEQ ID NO: 551310 - DNA, 20 bp, Artificial Sequence
  chemically synthesized
taatttacttagagggggtt

SEQ ID NO: 551311 - DNA, 20 bp, Artificial Sequence
  chemically synthesized
cttaacaaattttttttaca

SEQ ID NO: 551312 - DNA, 20 bp, Artificial Sequence
  chemically synthesized
ataaacttagtgattgaatt

SEQ ID NO: 551313 - DNA, 20 bp, Artificial Sequence
  chemically synthesized
ttcaatcactaagtttattt

SEQ ID NO: 551314 - DNA, 20 bp, Artificial Sequence
  chemically synthesized
tttaaaaatcaaatgtaaac

SEQ ID NO: 551315 - DNA, 20 bp, Artificial Sequence
  chemically synthesized
agattcaaaagagagaggaa

SEQ ID NO: 551316 - DNA, 20 bp, Artificial Sequence
  chemically synthesized
agttgggaataataagctcg

SEQ ID NO: 551317 - DNA, 20 bp, Artificial Sequence
  chemically synthesized
cttggattgccaagttcttc

SEQ ID NO: 551318 - DNA, 20 bp, Artificial Sequence
  chemically synthesized
taagactaataaaatattac

SEQ ID NO: 551319 - DNA, 20 bp, Artificial Sequence
  chemically synthesized
aataaaatattacaaagaat

SEQ ID NO: 551320 - DNA, 20 bp, Artificial Sequence
  chemically synthesized
tggtattatatgacataata

SEQ ID NO: 551321 - DNA, 20 bp, Artificial Sequence
  chemically synthesized
acaaccagattttaaggtcc

SEQ ID NO: 551322 - DNA, 20 bp, Artificial Sequence
  chemically synthesized
tacaaaaaaaaaaaaaaaaa

SEQ ID NO: 551323 - DNA, 20 bp, Artificial Sequence
  chemically synthesized
aaaaaaaaaaaaaagaatcc

SEQ ID NO: 551324 - DNA, 20 bp, Artificial Sequence
  chemically synthesized
ccccagaatccccagaccct

SEQ ID NO: 551325 - DNA, 20 bp, Artificial Sequence
  chemically synthesized
ctgcagaattgggattgagg

SEQ ID NO: 551326 - DNA, 20 bp, Artificial Sequence
  chemically synthesized
agaagccgcaaaaccaagga

SEQ ID NO: 551327 - DNA, 20 bp, Artificial Sequence
  chemically synthesized
aaaagtgttaaaacagatat

SEQ ID NO: 551328 - DNA, 20 bp, Artificial Sequence
  chemically synthesized
aaattagggtaaacttcaaa

SEQ ID NO: 551329 - DNA, 20 bp, Artificial Sequence
  chemically synthesized
cttaagtgaaaacataaaat

SEQ ID NO: 551330 - DNA, 20 bp, Artificial Sequence
  chemically synthesized
taaacagatcaacaggcatg

SEQ ID NO: 551331 - DNA, 20 bp, Artificial Sequence
  chemically synthesized
agattcgatgcatgatcatt

SEQ ID NO: 551332 - DNA, 20 bp, Artificial Sequence
  chemically synthesized
atagccttttggaggctgag

SEQ ID NO: 551333 - DNA, 20 bp, Artificial Sequence
  chemically synthesized
cttgatagccttttggaggc

SEQ ID NO: 551334 - DNA, 20 bp, Artificial Sequence
  chemically synthesized
tggtaatacaggggctaaac

SEQ ID NO: 551335 - DNA, 20 bp, Artificial Sequence
  chemically synthesized
aatacaggggctaaacaaag

SEQ ID NO: 551336 - DNA, 20 bp, Artificial Sequence
  chemically synthesized
gcttagcctcttaatagttc

SEQ ID NO: 551337 - DNA, 20 bp, Artificial Sequence
  chemically synthesized
atgcttccctgttttactaa

SEQ ID NO: 551338 - DNA, 20 bp, Artificial Sequence
  chemically synthesized
ggaaactaaagctcagattt

SEQ ID NO: 551339 - DNA, 20 bp, Artificial Sequence
  chemically synthesized
gcttgaaaatcaggagggtc

SEQ ID NO: 551340 - DNA, 20 bp, Artificial Sequence
  chemically synthesized
gtaacagagttactcataca

SEQ ID NO: 551341 - DNA, 20 bp, Artificial Sequence
  chemically synthesized
cagaaacagaagtttccaga

SEQ ID NO: 551342 - DNA, 20 bp, Artificial Sequence
  chemically synthesized
taaattagttcaggtctaat

SEQ ID NO: 551343 - DNA, 20 bp, Artificial Sequence
  chemically synthesized
acaataaatattgtgcataa

SEQ ID NO: 551344 - DNA, 20 bp, Artificial Sequence
  chemically synthesized
tgtgagtgaagggatgaaaa

SEQ ID NO: 551345 - DNA, 20 bp, Artificial Sequence
  chemically synthesized
tctcaaaaaataaaataaaa

SEQ ID NO: 551346 - DNA, 20 bp, Artificial Sequence
  chemically synthesized
aaaaagagaaagtgctcaaa

SEQ ID NO: 551347 - DNA, 20 bp, Artificial Sequence
  chemically synthesized
agggcttggggaaaacaaaa

SEQ ID NO: 551348 - DNA, 20 bp, Artificial Sequence
  chemically synthesized
cagagacttgttcttaccct

SEQ ID NO: 551349 - DNA, 20 bp, Artificial Sequence
  chemically synthesized
tcagtgcccactagagtcag

SEQ ID NO: 551350 - DNA, 20 bp, Artificial Sequence
  chemically synthesized
atttttaatatcatgagact

SEQ ID NO: 551351 - DNA, 20 bp, Artificial Sequence
  chemically synthesized
aattccagtttggaaccctt

SEQ ID NO: 551352 - DNA, 20 bp, Artificial Sequence
  chemically synthesized
taacacggatgtatgccctc

SEQ ID NO: 551353 - DNA, 20 bp, Artificial Sequence
  chemically synthesized
atgccctcagagaatgggaa

SEQ ID NO: 551354 - DNA, 20 bp, Artificial Sequence
  chemically synthesized
tccactgcaagggaaagtaa

SEQ ID NO: 551355 - DNA, 20 bp, Artificial Sequence
  chemically synthesized
catcgaagaccgaaagttgc

SEQ ID NO: 551356 - DNA, 20 bp, Artificial Sequence
  chemically synthesized
tggctgcgtgtatcagaaat

SEQ ID NO: 551357 - DNA, 20 bp, Artificial Sequence
  chemically synthesized
attgggtttggctgcgtgta

SEQ ID NO: 551358 - DNA, 20 bp, Artificial Sequence
  chemically synthesized
agagagatttggtacttttc

SEQ ID NO: 551359 - DNA, 20 bp, Artificial Sequence
  chemically synthesized
ttattaccactgggataaaa

SEQ ID NO: 551360 - DNA, 20 bp, Artificial Sequence
  chemically synthesized
gatatttcacactctaatac

SEQ ID NO: 551361 - DNA, 20 bp, Artificial Sequence
  chemically synthesized
tcattaaaattgtaacagag

SEQ ID NO: 551362 - DNA, 20 bp, Artificial Sequence
  chemically synthesized
aagcttacttcagagatctc

SEQ ID NO: 551363 - DNA, 20 bp, Artificial Sequence
  chemically synthesized
agttacattaaatccctcgt

SEQ ID NO: 551364 - DNA, 20 bp, Artificial Sequence
  chemically synthesized
cgagggatttaatgtaacta

SEQ ID NO: 551365 - DNA, 20 bp, Artificial Sequence
  chemically synthesized
ataaaattgaatttgggtct

SEQ ID NO: 551366 - DNA, 20 bp, Artificial Sequence
  chemically synthesized
ttgaatttgggtcttcagaa

SEQ ID NO: 551367 - DNA, 20 bp, Artificial Sequence
  chemically synthesized
tcttcagaattagaaactta

SEQ ID NO: 551368 - DNA, 20 bp, Artificial Sequence
  chemically synthesized
aacagaaaaaggaggtcatt

SEQ ID NO: 551369 - DNA, 20 bp, Artificial Sequence
  chemically synthesized
attttgtttttatgcctaat

SEQ ID NO: 551370 - DNA, 20 bp, Artificial Sequence
  chemically synthesized
ctaatttttttgtattttta

SEQ ID NO: 551371 - DNA, 20 bp, Artificial Sequence
  chemically synthesized
ctactcgggagcctgaggca

SEQ ID NO: 551372 - DNA, 20 bp, Artificial Sequence
  chemically synthesized
actccgtctcaaaaaaaaaa

SEQ ID NO: 551373 - DNA, 20 bp, Artificial Sequence
  chemically synthesized
cgtctcaaaaaaaaaaaaag

SEQ ID NO: 551374 - DNA, 20 bp, Artificial Sequence
  chemically synthesized
caaaaaaaaaaaaagaaaga

SEQ ID NO: 551375 - DNA, 20 bp, Artificial Sequence
  chemically synthesized
tatttttggctacatttatt

SEQ ID NO: 551376 - DNA, 20 bp, Artificial Sequence
  chemically synthesized
ataccaaaactattacaatc

SEQ ID NO: 551377 - DNA, 20 bp, Artificial Sequence
  chemically synthesized
ctactcaggaagctgaggca

SEQ ID NO: 551378 - DNA, 20 bp, Artificial Sequence
  chemically synthesized
aaacatgtgatatgtctctt

SEQ ID NO: 551379 - DNA, 20 bp, Artificial Sequence
  chemically synthesized
atatttatcacgcacttttt

SEQ ID NO: 551380 - DNA, 20 bp, Artificial Sequence
  chemically synthesized
tctgtttgtaaaataaatat

SEQ ID NO: 551381 - DNA, 20 bp, Artificial Sequence
  chemically synthesized
tctaaatatttattttacaa

SEQ ID NO: 551382 - DNA, 20 bp, Artificial Sequence
  chemically synthesized
attcatgtagcccaagaata

SEQ ID NO: 551383 - DNA, 20 bp, Artificial Sequence
  chemically synthesized
taataatgattcatgtagcc

SEQ ID NO: 551384 - DNA, 20 bp, Artificial Sequence
  chemically synthesized
gattacttgtaattgactct

SEQ ID NO: 551385 - DNA, 20 bp, Artificial Sequence
  chemically synthesized
aatcctaggtcttctgttgg

SEQ ID NO: 551386 - DNA, 20 bp, Artificial Sequence
  chemically synthesized
atcattgtacctcaattcca

SEQ ID NO: 551387 - DNA, 20 bp, Artificial Sequence
  chemically synthesized
agagcctttgaaaacacagt

SEQ ID NO: 551388 - DNA, 20 bp, Artificial Sequence
  chemically synthesized
aaaaacctagcaaaccagtt

SEQ ID NO: 551389 - DNA, 20 bp, Artificial Sequence
  chemically synthesized
tgctaggtttttgtaaatta

SEQ ID NO: 551390 - DNA, 20 bp, Artificial Sequence
  chemically synthesized
atgtatattttggttgagat

SEQ ID NO: 551391 - DNA, 20 bp, Artificial Sequence
  chemically synthesized
taacagcaagggatagggaa

SEQ ID NO: 551392 - DNA, 20 bp, Artificial Sequence
  chemically synthesized
tttcaaagtctaattctaac

SEQ ID NO: 551393 - DNA, 20 bp, Artificial Sequence
  chemically synthesized
tacagatgaagaattctgag

SEQ ID NO: 551394 - DNA, 20 bp, Artificial Sequence
  chemically synthesized
attgttcccattttacagat

SEQ ID NO: 551395 - DNA, 20 bp, Artificial Sequence
  chemically synthesized
ctatgtgaaagtcattaaaa

SEQ ID NO: 551396 - DNA, 20 bp, Artificial Sequence
  chemically synthesized
cagaaataacaggcaatgtg

SEQ ID NO: 551397 - DNA, 20 bp, Artificial Sequence
  chemically synthesized
ttatttatttattttcctga

SEQ ID NO: 551398 - DNA, 20 bp, Artificial Sequence
  chemically synthesized
tttttccacctttatatgaa

SEQ ID NO: 551399 - DNA, 20 bp, Artificial Sequence
  chemically synthesized
ttgcatctggggaatacaca

SEQ ID NO: 551400 - DNA, 20 bp, Artificial Sequence
  chemically synthesized
ctcatgtcttggatagattt

SEQ ID NO: 551401 - DNA, 20 bp, Artificial Sequence
  chemically synthesized
cagagcaagattatgtctca

SEQ ID NO: 551402 - DNA, 20 bp, Artificial Sequence
  chemically synthesized
tctctacaaaaaaaaaatga

SEQ ID NO: 551403 - DNA, 20 bp, Artificial Sequence
  chemically synthesized
tttgctactttgattaagac

SEQ ID NO: 551404 - DNA, 20 bp, Artificial Sequence
  chemically synthesized
catcacatgccaatattaac

SEQ ID NO: 551405 - DNA, 20 bp, Artificial Sequence
  chemically synthesized
ttaacaaagaaaaaggaaga

SEQ ID NO: 551406 - DNA, 20 bp, Artificial Sequence
  chemically synthesized
aactgatatctttatgcaaa

SEQ ID NO: 551407 - DNA, 20 bp, Artificial Sequence
  chemically synthesized
ctatcaaggaaaataagcct

SEQ ID NO: 551408 - DNA, 20 bp, Artificial Sequence
  chemically synthesized
cacatatccaatctactgtt

SEQ ID NO: 551409 - DNA, 20 bp, Artificial Sequence
  chemically synthesized
tctactgttttagaaaaaat

SEQ ID NO: 551410 - DNA, 20 bp, Artificial Sequence
  chemically synthesized
tttgcgttgcatacattttt

SEQ ID NO: 551411 - DNA, 20 bp, Artificial Sequence
  chemically synthesized
acaggatattccgctttaaa

SEQ ID NO: 551412 - DNA, 20 bp, Artificial Sequence
  chemically synthesized
ttattttcttatttaattta

SEQ ID NO: 551413 - DNA, 20 bp, Artificial Sequence
  chemically synthesized
ttaaattctactaaattaaa

SEQ ID NO: 551414 - DNA, 20 bp, Artificial Sequence
  chemically synthesized
caaaggcaattgtttttaaa

SEQ ID NO: 551415 - DNA, 20 bp, Artificial Sequence
  chemically synthesized
acaatcactctcaaacagtt

SEQ ID NO: 551416 - DNA, 20 bp, Artificial Sequence
  chemically synthesized
tcatgggcaaggagaaggat

SEQ ID NO: 551417 - DNA, 20 bp, Artificial Sequence
  chemically synthesized
aaggagaaggatttagaaaa

SEQ ID NO: 551418 - DNA, 20 bp, Artificial Sequence
  chemically synthesized
ttccaattgatcaccgaaac

SEQ ID NO: 551419 - DNA, 20 bp, Artificial Sequence
  chemically synthesized
ttgagtgtgcacctgttgag

SEQ ID NO: 551420 - DNA, 20 bp, Artificial Sequence
  chemically synthesized
cgcctctggctgccactaca

SEQ ID NO: 551421 - DNA, 20 bp, Artificial Sequence
  chemically synthesized
ccacaggtgacttggtgacc

SEQ ID NO: 551422 - DNA, 20 bp, Artificial Sequence
  chemically synthesized
ggagaggagctgggaaaagc

SEQ ID NO: 551423 - DNA, 20 bp, Artificial Sequence
  chemically synthesized
atggcttcaaggtctagaga

SEQ ID NO: 551424 - DNA, 20 bp, Artificial Sequence
  chemically synthesized
cactctgcagctgcttctat

SEQ ID NO: 551425 - DNA, 20 bp, Artificial Sequence
  chemically synthesized
taccactgtgcttaaaaaca

SEQ ID NO: 551426 - DNA, 20 bp, Artificial Sequence
  chemically synthesized
ttttgatagttaaaagggag

SEQ ID NO: 551427 - DNA, 20 bp, Artificial Sequence
  chemically synthesized
atccagaaggttaatatgtc

SEQ ID NO: 551428 - DNA, 20 bp, Artificial Sequence
  chemically synthesized
agaagacaaaaaaatctaat

SEQ ID NO: 551429 - DNA, 20 bp, Artificial Sequence
  chemically synthesized
aacaaaaaaaaatcattaaa

SEQ ID NO: 551430 - DNA, 20 bp, Artificial Sequence
  chemically synthesized
aaaaaaaaaaaaaaaaaaag

SEQ ID NO: 551431 - DNA, 20 bp, Artificial Sequence
  chemically synthesized
tcaaaaaaaaaaaaaaaaaa

SEQ ID NO: 551432 - DNA, 20 bp, Artificial Sequence
  chemically synthesized
ctactcaggaggctgaggca

SEQ ID NO: 551433 - DNA, 20 bp, Artificial Sequence
  chemically synthesized
tatgcagagatcagcctgct

SEQ ID NO: 551434 - DNA, 20 bp, Artificial Sequence
  chemically synthesized
ttaaaaatgtattatactcc

SEQ ID NO: 551435 - DNA, 20 bp, Artificial Sequence
  chemically synthesized
acttattagttatatggcct

SEQ ID NO: 551436 - DNA, 20 bp, Artificial Sequence
  chemically synthesized
ttcagaaccagatcatgagg

SEQ ID NO: 551437 - DNA, 20 bp, Artificial Sequence
  chemically synthesized
ttgatagtgtattccctccg

SEQ ID NO: 551438 - DNA, 20 bp, Artificial Sequence
  chemically synthesized
agacttaagagagaaatact

SEQ ID NO: 551439 - DNA, 20 bp, Artificial Sequence
  chemically synthesized
actaaagagttagacttaag

SEQ ID NO: 551440 - DNA, 20 bp, Artificial Sequence
  chemically synthesized
ttttgttttgagacatcaac

SEQ ID NO: 551441 - DNA, 20 bp, Artificial Sequence
  chemically synthesized
atggtaacattaacagaagt

SEQ ID NO: 551442 - DNA, 20 bp, Artificial Sequence
  chemically synthesized
tgattagctattaacaattt

SEQ ID NO: 551443 - DNA, 20 bp, Artificial Sequence
  chemically synthesized
tctttgcatatgcattacat

SEQ ID NO: 551444 - DNA, 20 bp, Artificial Sequence
  chemically synthesized
agatttacaaaagcagtagc

SEQ ID NO: 551445 - DNA, 20 bp, Artificial Sequence
  chemically synthesized
gagagtttgagatgttagaa

SEQ ID NO: 551446 - DNA, 20 bp, Artificial Sequence
  chemically synthesized
tgaattgagagtttgagatg

SEQ ID NO: 551447 - DNA, 20 bp, Artificial Sequence
  chemically synthesized
ctctcaattcaatatcttct

SEQ ID NO: 551448 - DNA, 20 bp, Artificial Sequence
  chemically synthesized
tacccatctttgtatctctt

SEQ ID NO: 551449 - DNA, 20 bp, Artificial Sequence
  chemically synthesized
accacataaatgttgtgaaa

SEQ ID NO: 551450 - DNA, 20 bp, Artificial Sequence
  chemically synthesized
ttcacaataaaatgctcact

SEQ ID NO: 551451 - DNA, 20 bp, Artificial Sequence
  chemically synthesized
aaaaaataaaaatgtaaata

SEQ ID NO: 551452 - DNA, 20 bp, Artificial Sequence
  chemically synthesized
tagctctggaagctaaatct

SEQ ID NO: 551453 - DNA, 20 bp, Artificial Sequence
  chemically synthesized
acatttaattggcattattg

SEQ ID NO: 551454 - DNA, 20 bp, Artificial Sequence
  chemically synthesized
gatccatttcttaatttcca

SEQ ID NO: 551455 - DNA, 20 bp, Artificial Sequence
  chemically synthesized
tagatgattcttttggaaat

SEQ ID NO: 551456 - DNA, 20 bp, Artificial Sequence
  chemically synthesized
attcaatacccatatacaca

SEQ ID NO: 551457 - DNA, 20 bp, Artificial Sequence
  chemically synthesized
tgatttacattgcttacagc

SEQ ID NO: 551458 - DNA, 20 bp, Artificial Sequence
  chemically synthesized
aaaaataaacccttgaatgg

SEQ ID NO: 551459 - DNA, 20 bp, Artificial Sequence
  chemically synthesized
gtaaataagtaatttctata

SEQ ID NO: 551460 - DNA, 20 bp, Artificial Sequence
  chemically synthesized
agaacaaaagttattctgtt

SEQ ID NO: 551461 - DNA, 20 bp, Artificial Sequence
  chemically synthesized
agcaggccacagatccttaa

SEQ ID NO: 551462 - DNA, 20 bp, Artificial Sequence
  chemically synthesized
gctaaactaccttatttttt

SEQ ID NO: 551463 - DNA, 20 bp, Artificial Sequence
  chemically synthesized
caacaacaacaaacagtatt

SEQ ID NO: 551464 - DNA, 20 bp, Artificial Sequence
  chemically synthesized
tgttgttgttttctgcatat

SEQ ID NO: 551465 - DNA, 20 bp, Artificial Sequence
  chemically synthesized
tctaccaattttctatatat

SEQ ID NO: 551466 - DNA, 20 bp, Artificial Sequence
  chemically synthesized
cacgctatacagttgtaggt

SEQ ID NO: 551467 - DNA, 20 bp, Artificial Sequence
  chemically synthesized
ggaaagtgagactccagttc

SEQ ID NO: 551468 - DNA, 20 bp, Artificial Sequence
  chemically synthesized
atcacaactgcagaaaacct

SEQ ID NO: 551469 - DNA, 20 bp, Artificial Sequence
  chemically synthesized
ggtcatagatcatcacaact

SEQ ID NO: 551470 - DNA, 20 bp, Artificial Sequence
  chemically synthesized
ggctggaagaatgggaaaat

SEQ ID NO: 551471 - DNA, 20 bp, Artificial Sequence
  chemically synthesized
ccgaaaagagcaaagggctg

SEQ ID NO: 551472 - DNA, 20 bp, Artificial Sequence
  chemically synthesized
aagtcctaacccccattgtc

SEQ ID NO: 551473 - DNA, 20 bp, Artificial Sequence
  chemically synthesized
aactaaggagggaggcttca

SEQ ID NO: 551474 - DNA, 20 bp, Artificial Sequence
  chemically synthesized
tacctagcctttactactgt

SEQ ID NO: 551475 - DNA, 20 bp, Artificial Sequence
  chemically synthesized
ggagaaaataaatttctgtt

SEQ ID NO: 551476 - DNA, 20 bp, Artificial Sequence
  chemically synthesized
cagtagactgggtttcttaa

SEQ ID NO: 551477 - DNA, 20 bp, Artificial Sequence
  chemically synthesized
tatatatacaaaggggagaa

SEQ ID NO: 551478 - DNA, 20 bp, Artificial Sequence
  chemically synthesized
tctatatatatatacaaagg

SEQ ID NO: 551479 - DNA, 20 bp, Artificial Sequence
  chemically synthesized
tcaatttatttactttaata

SEQ ID NO: 551480 - DNA, 20 bp, Artificial Sequence
  chemically synthesized
tgagtaaaatgtacattcac

SEQ ID NO: 551481 - DNA, 20 bp, Artificial Sequence
  chemically synthesized
agagctttatttcagctaac

SEQ ID NO: 551482 - DNA, 20 bp, Artificial Sequence
  chemically synthesized
taaattataacagtcattat

SEQ ID NO: 551483 - DNA, 20 bp, Artificial Sequence
  chemically synthesized
catagttatgaattgagctc

SEQ ID NO: 551484 - DNA, 20 bp, Artificial Sequence
  chemically synthesized
taaacttataatttaagttt

SEQ ID NO: 551485 - DNA, 20 bp, Artificial Sequence
  chemically synthesized
aaaaaaaaaaaaaaaaaaag

SEQ ID NO: 551486 - DNA, 20 bp, Artificial Sequence
  chemically synthesized
aaaaaaaaaaaaaaaaaaaa

SEQ ID NO: 551487 - DNA, 20 bp, Artificial Sequence
  chemically synthesized
ctactcgggaggctgaggca

SEQ ID NO: 551488 - DNA, 20 bp, Artificial Sequence
  chemically synthesized
cagaaagcttatatgtatag

SEQ ID NO: 551489 - DNA, 20 bp, Artificial Sequence
  chemically synthesized
tggacagaaagcttatatgt

SEQ ID NO: 551490 - DNA, 20 bp, Artificial Sequence
  chemically synthesized
tacttccttttataaattgg

SEQ ID NO: 551491 - DNA, 20 bp, Artificial Sequence
  chemically synthesized
gtacacctatactgccctag

SEQ ID NO: 551492 - DNA, 20 bp, Artificial Sequence
  chemically synthesized
aaaagtaaaagtaaaaaagc

SEQ ID NO: 551493 - DNA, 20 bp, Artificial Sequence
  chemically synthesized
ctgcttgggaggctgaggca

SEQ ID NO: 551494 - DNA, 20 bp, Artificial Sequence
  chemically synthesized
tactaggtgaggagtagatg

SEQ ID NO: 551495 - DNA, 20 bp, Artificial Sequence
  chemically synthesized
tttgggtatgaatggtggaa

SEQ ID NO: 551496 - DNA, 20 bp, Artificial Sequence
  chemically synthesized
atacccaaacccaaaccaaa

SEQ ID NO: 551497 - DNA, 20 bp, Artificial Sequence
  chemically synthesized
aataaactcaccgcctattg

SEQ ID NO: 551498 - DNA, 20 bp, Artificial Sequence
  chemically synthesized
tgtaaacagtggataaagga

SEQ ID NO: 551499 - DNA, 20 bp, Artificial Sequence
  chemically synthesized
gacaagaattgcatgcagtt

SEQ ID NO: 551500 - DNA, 20 bp, Artificial Sequence
  chemically synthesized
aacacgagtattttgatgaa

SEQ ID NO: 551501 - DNA, 20 bp, Artificial Sequence
  chemically synthesized
gactgttatgctttgaagat

SEQ ID NO: 551502 - DNA, 20 bp, Artificial Sequence
  chemically synthesized
tactctatgagcagattcat

SEQ ID NO: 551503 - DNA, 20 bp, Artificial Sequence
  chemically synthesized
actcatcgactgagcactaa

SEQ ID NO: 551504 - DNA, 20 bp, Artificial Sequence
  chemically synthesized
attaaattgttgcatattac

SEQ ID NO: 551505 - DNA, 20 bp, Artificial Sequence
  chemically synthesized
caagatcattgctatataaa

SEQ ID NO: 551506 - DNA, 20 bp, Artificial Sequence
  chemically synthesized
taaaagaaaaaaatcatggc

SEQ ID NO: 551507 - DNA, 20 bp, Artificial Sequence
  chemically synthesized
tattgtaatatttgccacta

SEQ ID NO: 551508 - DNA, 20 bp, Artificial Sequence
  chemically synthesized
agaatttatttggacacatt

SEQ ID NO: 551509 - DNA, 20 bp, Artificial Sequence
  chemically synthesized
cgagagaagaaattttacag

SEQ ID NO: 551510 - DNA, 20 bp, Artificial Sequence
  chemically synthesized
gccaccacacccagccgaga

SEQ ID NO: 551511 - DNA, 20 bp, Artificial Sequence
  chemically synthesized
ttactcaggaggctgagaca

SEQ ID NO: 551512 - DNA, 20 bp, Artificial Sequence
  chemically synthesized
gcgagactctgtctcaaaaa

SEQ ID NO: 551513 - DNA, 20 bp, Artificial Sequence
  chemically synthesized
agaaatttgtacataagaga

SEQ ID NO: 551514 - DNA, 20 bp, Artificial Sequence
  chemically synthesized
cccattggagaaaaatggag

SEQ ID NO: 551515 - DNA, 20 bp, Artificial Sequence
  chemically synthesized
tccaaatttaaattcccatt

SEQ ID NO: 551516 - DNA, 20 bp, Artificial Sequence
  chemically synthesized
gtatcctttttatacttcta

SEQ ID NO: 551517 - DNA, 20 bp, Artificial Sequence
  chemically synthesized
gaattgatagcatgttattt

SEQ ID NO: 551518 - DNA, 20 bp, Artificial Sequence
  chemically synthesized
ctctcagataacttcaaaaa

SEQ ID NO: 551519 - DNA, 20 bp, Artificial Sequence
  chemically synthesized
tcatctaatggtttgaaaca

SEQ ID NO: 551520 - DNA, 20 bp, Artificial Sequence
  chemically synthesized
ttaatatccaaaagtgatgg

SEQ ID NO: 551521 - DNA, 20 bp, Artificial Sequence
  chemically synthesized
aggaaatattcaaaactcta

SEQ ID NO: 551522 - DNA, 20 bp, Artificial Sequence
  chemically synthesized
cagttacctcatctgacaag

SEQ ID NO: 551523 - DNA, 20 bp, Artificial Sequence
  chemically synthesized
agagttctaattcatgacat

SEQ ID NO: 551524 - DNA, 20 bp, Artificial Sequence
  chemically synthesized
ttgaaaatatagactctgat

SEQ ID NO: 551525 - DNA, 20 bp, Artificial Sequence
  chemically synthesized
ttctgcctggggctcacatt

SEQ ID NO: 551526 - DNA, 20 bp, Artificial Sequence
  chemically synthesized
tacaatgtgagccccaggca

SEQ ID NO: 551527 - DNA, 20 bp, Artificial Sequence
  chemically synthesized
aaaagcagagaattgaccag

SEQ ID NO: 551528 - DNA, 20 bp, Artificial Sequence
  chemically synthesized
gatctccgtatgccaaaagc

SEQ ID NO: 551529 - DNA, 20 bp, Artificial Sequence
  chemically synthesized
acaataatatacactttcat

SEQ ID NO: 551530 - DNA, 20 bp, Artificial Sequence
  chemically synthesized
tgacttataaaatttcaacc

SEQ ID NO: 551531 - DNA, 20 bp, Artificial Sequence
  chemically synthesized
ctcctcaaagataaaatatt

SEQ ID NO: 551532 - DNA, 20 bp, Artificial Sequence
  chemically synthesized
tactatggtcttattagttt

SEQ ID NO: 551533 - DNA, 20 bp, Artificial Sequence
  chemically synthesized
tggtatgcacaggcatttta

SEQ ID NO: 551534 - DNA, 20 bp, Artificial Sequence
  chemically synthesized
ctttcaatttccaaagtatt

SEQ ID NO: 551535 - DNA, 20 bp, Artificial Sequence
  chemically synthesized
aagtatgcccaaattcaagg

SEQ ID NO: 551536 - DNA, 20 bp, Artificial Sequence
  chemically synthesized
ggtgtctgaggacagattac

SEQ ID NO: 551537 - DNA, 20 bp, Artificial Sequence
  chemically synthesized
ggtgagcagagtagaaattt

SEQ ID NO: 551538 - DNA, 20 bp, Artificial Sequence
  chemically synthesized
gtggtggagaggtgagcaga

SEQ ID NO: 551539 - DNA, 20 bp, Artificial Sequence
  chemically synthesized
ttggacatttcctttgagac

SEQ ID NO: 551540 - DNA, 20 bp, Artificial Sequence
  chemically synthesized
acatttcctttgagactaag

SEQ ID NO: 551541 - DNA, 20 bp, Artificial Sequence
  chemically synthesized
cctttgagactaagaaagaa

SEQ ID NO: 551542 - DNA, 20 bp, Artificial Sequence
  chemically synthesized
taggggatataattgcttgt

SEQ ID NO: 551543 - DNA, 20 bp, Artificial Sequence
  chemically synthesized
tatccatagtgagtttacaa

SEQ ID NO: 551544 - DNA, 20 bp, Artificial Sequence
  chemically synthesized
gaattccttactaccctagg

SEQ ID NO: 551545 - DNA, 20 bp, Artificial Sequence
  chemically synthesized
tccttatagaatattgttta

SEQ ID NO: 551546 - DNA, 20 bp, Artificial Sequence
  chemically synthesized
tattatttttatctttcctt

SEQ ID NO: 551547 - DNA, 20 bp, Artificial Sequence
  chemically synthesized
cctccagcttaacgtccttt

SEQ ID NO: 551548 - DNA, 20 bp, Artificial Sequence
  chemically synthesized
ggcacacaatcttatttgtt

SEQ ID NO: 551549 - DNA, 20 bp, Artificial Sequence
  chemically synthesized
ccttgctttcaatctggtct

SEQ ID NO: 551550 - DNA, 20 bp, Artificial Sequence
  chemically synthesized
aataatagttaaaataatac

SEQ ID NO: 551551 - DNA, 20 bp, Artificial Sequence
  chemically synthesized
cttggtgagggtcaaagtgt

SEQ ID NO: 551552 - DNA, 20 bp, Artificial Sequence
  chemically synthesized
ctcaacactttgaccctcac

SEQ ID NO: 551553 - DNA, 20 bp, Artificial Sequence
  chemically synthesized
tagacatgctcagctcagtg

SEQ ID NO: 551554 - DNA, 20 bp, Artificial Sequence
  chemically synthesized
caccttacaaagtaggacat

SEQ ID NO: 551555 - DNA, 20 bp, Artificial Sequence
  chemically synthesized
gtgatgcacgttcccatata

SEQ ID NO: 551556 - DNA, 20 bp, Artificial Sequence
  chemically synthesized
gatggtttaatgctaatctg

SEQ ID NO: 551557 - DNA, 20 bp, Artificial Sequence
  chemically synthesized
tggtgatgataccctagcct

SEQ ID NO: 551558 - DNA, 20 bp, Artificial Sequence
  chemically synthesized
atagactcacaggaagtcgc

SEQ ID NO: 551559 - DNA, 20 bp, Artificial Sequence
  chemically synthesized
tatttcagtaatgttatata

SEQ ID NO: 551560 - DNA, 20 bp, Artificial Sequence
  chemically synthesized
atgaatgcagtagctagaaa

SEQ ID NO: 551561 - DNA, 20 bp, Artificial Sequence
  chemically synthesized
ccttgacatgaatgcagtag

SEQ ID NO: 551562 - DNA, 20 bp, Artificial Sequence
  chemically synthesized
ttgtactcttgatatttatc

SEQ ID NO: 551563 - DNA, 20 bp, Artificial Sequence
  chemically synthesized
tgactgcatgtttaatttta

SEQ ID NO: 551564 - DNA, 20 bp, Artificial Sequence
  chemically synthesized
agaaactcctaaactgtttt

SEQ ID NO: 551565 - DNA, 20 bp, Artificial Sequence
  chemically synthesized
tgtaaaatggtacaaccatt

SEQ ID NO: 551566 - DNA, 20 bp, Artificial Sequence
  chemically synthesized
ttacattcccatcagcaata

SEQ ID NO: 551567 - DNA, 20 bp, Artificial Sequence
  chemically synthesized
cagaatggctaaaattaaaa

SEQ ID NO: 551568 - DNA, 20 bp, Artificial Sequence
  chemically synthesized
gagttatcactatacaccta

SEQ ID NO: 551569 - DNA, 20 bp, Artificial Sequence
  chemically synthesized
gttcagcttcactagccatt

SEQ ID NO: 551570 - DNA, 20 bp, Artificial Sequence
  chemically synthesized
gaagaggatatacagatggt

SEQ ID NO: 551571 - DNA, 20 bp, Artificial Sequence
  chemically synthesized
aagtctcaaagaactagtat

SEQ ID NO: 551572 - DNA, 20 bp, Artificial Sequence
  chemically synthesized
tttacaaagatagattaagg

SEQ ID NO: 551573 - DNA, 20 bp, Artificial Sequence
  chemically synthesized
aacggggaggttctagacaa

SEQ ID NO: 551574 - DNA, 20 bp, Artificial Sequence
  chemically synthesized
tatacctagtcagggaacaa

SEQ ID NO: 551575 - DNA, 20 bp, Artificial Sequence
  chemically synthesized
tttggctttcctagcaacca

SEQ ID NO: 551576 - DNA, 20 bp, Artificial Sequence
  chemically synthesized
aagtttagagagtggattat

SEQ ID NO: 551577 - DNA, 20 bp, Artificial Sequence
  chemically synthesized
tggattatcaagaatacgaa

SEQ ID NO: 551578 - DNA, 20 bp, Artificial Sequence
  chemically synthesized
aagaatacgaaagagaatgc

SEQ ID NO: 551579 - DNA, 20 bp, Artificial Sequence
  chemically synthesized
aggctgctgtattcctagtg

SEQ ID NO: 551580 - DNA, 20 bp, Artificial Sequence
  chemically synthesized
ccacagtgactggcaatgac

SEQ ID NO: 551581 - DNA, 20 bp, Artificial Sequence
  chemically synthesized
cattcacccagtttcacaag

SEQ ID NO: 551582 - DNA, 20 bp, Artificial Sequence
  chemically synthesized
atggttgcaccattcaatga

SEQ ID NO: 551583 - DNA, 20 bp, Artificial Sequence
  chemically synthesized
aagcaggttttgtgcggtga

SEQ ID NO: 551584 - DNA, 20 bp, Artificial Sequence
  chemically synthesized
agagggaggtgactatcaca

SEQ ID NO: 551585 - DNA, 20 bp, Artificial Sequence
  chemically synthesized
tcacagttctggaattcatt

SEQ ID NO: 551586 - DNA, 20 bp, Artificial Sequence
  chemically synthesized
aggaagagatcattatgaga

SEQ ID NO: 551587 - DNA, 20 bp, Artificial Sequence
  chemically synthesized
acgacaacatttttaagaag

SEQ ID NO: 551588 - DNA, 20 bp, Artificial Sequence
  chemically synthesized
ctattgaccttctgcaagtt

SEQ ID NO: 551589 - DNA, 20 bp, Artificial Sequence
  chemically synthesized
tctgcaagttcaagaaagac

SEQ ID NO: 551590 - DNA, 20 bp, Artificial Sequence
  chemically synthesized
cttagcagggtgaagcttga

SEQ ID NO: 551591 - DNA, 20 bp, Artificial Sequence
  chemically synthesized
ataatgaaagcatgcaatta

SEQ ID NO: 551592 - DNA, 20 bp, Artificial Sequence
  chemically synthesized
aagcatgcaattaaaagaaa

SEQ ID NO: 551593 - DNA, 20 bp, Artificial Sequence
  chemically synthesized
ccaactgatgcatataagag

SEQ ID NO: 551594 - DNA, 20 bp, Artificial Sequence
  chemically synthesized
atttttgtatttttaccata

SEQ ID NO: 551595 - DNA, 20 bp, Artificial Sequence
  chemically synthesized
ttcttttttgataatttgtt

SEQ ID NO: 551596 - DNA, 20 bp, Artificial Sequence
  chemically synthesized
ttcttaaacaaattatcaaa

SEQ ID NO: 551597 - DNA, 20 bp, Artificial Sequence
  chemically synthesized
attattaatagcttcttaat

SEQ ID NO: 551598 - DNA, 20 bp, Artificial Sequence
  chemically synthesized
cctctgtgtatgtatgatag

SEQ ID NO: 551599 - DNA, 20 bp, Artificial Sequence
  chemically synthesized
tatgcacactagtaatattg

SEQ ID NO: 551600 - DNA, 20 bp, Artificial Sequence
  chemically synthesized
cataaagactttcttttttc

SEQ ID NO: 551601 - DNA, 20 bp, Artificial Sequence
  chemically synthesized
gataccacttttctaggaaa

SEQ ID NO: 551602 - DNA, 20 bp, Artificial Sequence
  chemically synthesized
acctcatctaatctcataca

SEQ ID NO: 551603 - DNA, 20 bp, Artificial Sequence
  chemically synthesized
tatataaaaataagaaattg

SEQ ID NO: 551604 - DNA, 20 bp, Artificial Sequence
  chemically synthesized
gatgtgtgattatataaaaa

SEQ ID NO: 551605 - DNA, 20 bp, Artificial Sequence
  chemically synthesized
ctatagaaataagccttaat

SEQ ID NO: 551606 - DNA, 20 bp, Artificial Sequence
  chemically synthesized
tattgatctttggataagct

SEQ ID NO: 551607 - DNA, 20 bp, Artificial Sequence
  chemically synthesized
ctactcaggaggctgtggca

SEQ ID NO: 551608 - DNA, 20 bp, Artificial Sequence
  chemically synthesized
gggtgggaggcaaagggaag

SEQ ID NO: 551609 - DNA, 20 bp, Artificial Sequence
  chemically synthesized
atgtcagagatcgtgatgga

SEQ ID NO: 551610 - DNA, 20 bp, Artificial Sequence
  chemically synthesized
cattacctctttatgagatg

SEQ ID NO: 551611 - DNA, 20 bp, Artificial Sequence
  chemically synthesized
ataaaattgcttgtgaagtc

SEQ ID NO: 551612 - DNA, 20 bp, Artificial Sequence
  chemically synthesized
tggcattctcatatatatga

SEQ ID NO: 551613 - DNA, 20 bp, Artificial Sequence
  chemically synthesized
attatttctaatcatatata

SEQ ID NO: 551614 - DNA, 20 bp, Artificial Sequence
  chemically synthesized
gtccacgttactggtacact

SEQ ID NO: 551615 - DNA, 20 bp, Artificial Sequence
  chemically synthesized
tgactaacataatgaagata

SEQ ID NO: 551616 - DNA, 20 bp, Artificial Sequence
  chemically synthesized
ctgtttatgccaagtactat

SEQ ID NO: 551617 - DNA, 20 bp, Artificial Sequence
  chemically synthesized
acagctccctatgcaagtct

SEQ ID NO: 551618 - DNA, 20 bp, Artificial Sequence
  chemically synthesized
aggatatctcagtttttatc

SEQ ID NO: 551619 - DNA, 20 bp, Artificial Sequence
  chemically synthesized
tatattttgttctatccttt

SEQ ID NO: 551620 - DNA, 20 bp, Artificial Sequence
  chemically synthesized
tcacgatctctcagatttta

SEQ ID NO: 551621 - DNA, 20 bp, Artificial Sequence
  chemically synthesized
gatcgtgacaactgactggt

SEQ ID NO: 551622 - DNA, 20 bp, Artificial Sequence
  chemically synthesized
tcattgaagattaggtgaat

SEQ ID NO: 551623 - DNA, 20 bp, Artificial Sequence
  chemically synthesized
gacatacagagatgtgaatt

SEQ ID NO: 551624 - DNA, 20 bp, Artificial Sequence
  chemically synthesized
tataaaaatggattcttcaa

SEQ ID NO: 551625 - DNA, 20 bp, Artificial Sequence
  chemically synthesized
tgattatggacattctcatt

SEQ ID NO: 551626 - DNA, 20 bp, Artificial Sequence
  chemically synthesized
gtacaactactataaaatat

SEQ ID NO: 551627 - DNA, 20 bp, Artificial Sequence
  chemically synthesized
tttggaggaagtaagactcg

SEQ ID NO: 551628 - DNA, 20 bp, Artificial Sequence
  chemically synthesized
acatttcagtttaaataaag

SEQ ID NO: 551629 - DNA, 20 bp, Artificial Sequence
  chemically synthesized
tgcaaaaatggtaaaaatac

SEQ ID NO: 551630 - DNA, 20 bp, Artificial Sequence
  chemically synthesized
tcactttcactaacggtcct

SEQ ID NO: 551631 - DNA, 20 bp, Artificial Sequence
  chemically synthesized
agttaatatagatgcttatt

SEQ ID NO: 551632 - DNA, 20 bp, Artificial Sequence
  chemically synthesized
aaaatcatcctttagagaat

SEQ ID NO: 551633 - DNA, 20 bp, Artificial Sequence
  chemically synthesized
aatatgaaaaatcatccttt

SEQ ID NO: 551634 - DNA, 20 bp, Artificial Sequence
  chemically synthesized
tctcaatttcaattgctcag

SEQ ID NO: 551635 - DNA, 20 bp, Artificial Sequence
  chemically synthesized
attaccaaaatgttgcctta

SEQ ID NO: 551636 - DNA, 20 bp, Artificial Sequence
  chemically synthesized
gcaacattttggtaatattc

SEQ ID NO: 551637 - DNA, 20 bp, Artificial Sequence
  chemically synthesized
ttatggaaatattattttcc

SEQ ID NO: 551638 - DNA, 20 bp, Artificial Sequence
  chemically synthesized
aaaaatcagagaagacacat

SEQ ID NO: 551639 - DNA, 20 bp, Artificial Sequence
  chemically synthesized
catggagtggatgagaccag

SEQ ID NO: 551640 - DNA, 20 bp, Artificial Sequence
  chemically synthesized
gtagcgcgtgggtattgtgc

SEQ ID NO: 551641 - DNA, 20 bp, Artificial Sequence
  chemically synthesized
attcaagatttgtatatgag

SEQ ID NO: 551642 - DNA, 20 bp, Artificial Sequence
  chemically synthesized
ccaaaagaaggtgatttgga

SEQ ID NO: 551643 - DNA, 20 bp, Artificial Sequence
  chemically synthesized
gacagccttatgggtttcag

SEQ ID NO: 551644 - DNA, 20 bp, Artificial Sequence
  chemically synthesized
gtccattgatcttagtataa

SEQ ID NO: 551645 - DNA, 20 bp, Artificial Sequence
  chemically synthesized
cattcagagccttgaaggtt

SEQ ID NO: 551646 - DNA, 20 bp, Artificial Sequence
  chemically synthesized
tttcctagagtacagtgagg

SEQ ID NO: 551647 - DNA, 20 bp, Artificial Sequence
  chemically synthesized
ctgaatgtggaaaatggtat

SEQ ID NO: 551648 - DNA, 20 bp, Artificial Sequence
  chemically synthesized
ctccataccattttccacat

SEQ ID NO: 551649 - DNA, 20 bp, Artificial Sequence
  chemically synthesized
ggttagagtatagttgtcca

SEQ ID NO: 551650 - DNA, 20 bp, Artificial Sequence
  chemically synthesized
aatattcaaagcaaggcaaa

SEQ ID NO: 551651 - DNA, 20 bp, Artificial Sequence
  chemically synthesized
cgaaattggggaaatacttc

SEQ ID NO: 551652 - DNA, 20 bp, Artificial Sequence
  chemically synthesized
gaataaagcacacattgtaa

SEQ ID NO: 551653 - DNA, 20 bp, Artificial Sequence
  chemically synthesized
ttgcattggagataagggct

SEQ ID NO: 551654 - DNA, 20 bp, Artificial Sequence
  chemically synthesized
ctctctttgagttcacttgt

SEQ ID NO: 551655 - DNA, 20 bp, Artificial Sequence
  chemically synthesized
ttaaagagcgtaatcagatg

SEQ ID NO: 551656 - DNA, 20 bp, Artificial Sequence
  chemically synthesized
tggtgcttaagaacgatgta

SEQ ID NO: 551657 - DNA, 20 bp, Artificial Sequence
  chemically synthesized
aagaaagaaaaatcacaaaa

SEQ ID NO: 551658 - DNA, 20 bp, Artificial Sequence
  chemically synthesized
ggaaaaattaaagaaataag

SEQ ID NO: 551659 - DNA, 20 bp, Artificial Sequence
  chemically synthesized
gtgaggaaaaattaaagaaa

SEQ ID NO: 551660 - DNA, 20 bp, Artificial Sequence
  chemically synthesized
aagctgtgtgaggaaaaatt

SEQ ID NO: 551661 - DNA, 20 bp, Artificial Sequence
  chemically synthesized
ataaagatgagtgccaggaa

SEQ ID NO: 551662 - DNA, 20 bp, Artificial Sequence
  chemically synthesized
gagaggattaagataatttt

SEQ ID NO: 551663 - DNA, 20 bp, Artificial Sequence
  chemically synthesized
tgcttatccatgtaatgaaa

SEQ ID NO: 551664 - DNA, 20 bp, Artificial Sequence
  chemically synthesized
tagtttagttatttatttta

SEQ ID NO: 551665 - DNA, 20 bp, Artificial Sequence
  chemically synthesized
gtctaattgccatttgaata

SEQ ID NO: 551666 - DNA, 20 bp, Artificial Sequence
  chemically synthesized
ttcagatttccaaattggca

SEQ ID NO: 551667 - DNA, 20 bp, Artificial Sequence
  chemically synthesized
attttgattacataccattt

SEQ ID NO: 551668 - DNA, 20 bp, Artificial Sequence
  chemically synthesized
gttgttcttaaatgactctt

SEQ ID NO: 551669 - DNA, 20 bp, Artificial Sequence
  chemically synthesized
cctcactaatgggaactggg

SEQ ID NO: 551670 - DNA, 20 bp, Artificial Sequence
  chemically synthesized
ggagaaggcaaaagatcaca

SEQ ID NO: 551671 - DNA, 20 bp, Artificial Sequence
  chemically synthesized
cttagtagtctggatttggt

SEQ ID NO: 551672 - DNA, 20 bp, Artificial Sequence
  chemically synthesized
tatgtaatgatagtaagccc

SEQ ID NO: 551673 - DNA, 20 bp, Artificial Sequence
  chemically synthesized
ccttcagaggttgtaggcct

SEQ ID NO: 551674 - DNA, 20 bp, Artificial Sequence
  chemically synthesized
aagatcgagctcagagttga

SEQ ID NO: 551675 - DNA, 20 bp, Artificial Sequence
  chemically synthesized
ttaaaagtgtcctcatatag

SEQ ID NO: 551676 - DNA, 20 bp, Artificial Sequence
  chemically synthesized
tctgataggcagcagacaaa

SEQ ID NO: 551677 - DNA, 20 bp, Artificial Sequence
  chemically synthesized
tctcatttgtctgctgccta

SEQ ID NO: 551678 - DNA, 20 bp, Artificial Sequence
  chemically synthesized
ctgcctatcagaattgtgct

SEQ ID NO: 551679 - DNA, 20 bp, Artificial Sequence
  chemically synthesized
aagtaatcttgaatggggaa

SEQ ID NO: 551680 - DNA, 20 bp, Artificial Sequence
  chemically synthesized
tctcccattcgaaggggtta

SEQ ID NO: 551681 - DNA, 20 bp, Artificial Sequence
  chemically synthesized
tttttctatttatgtcactt

SEQ ID NO: 551682 - DNA, 20 bp, Artificial Sequence
  chemically synthesized
caattctataagtgacataa

SEQ ID NO: 551683 - DNA, 20 bp, Artificial Sequence
  chemically synthesized
actgcagcccatgaccttcc

SEQ ID NO: 551684 - DNA, 20 bp, Artificial Sequence
  chemically synthesized
aggactatagcaggactttg

SEQ ID NO: 551685 - DNA, 20 bp, Artificial Sequence
  chemically synthesized
ctatagcaggactttgtgag

SEQ ID NO: 551686 - DNA, 20 bp, Artificial Sequence
  chemically synthesized
actttaatcaatgtatcttt

SEQ ID NO: 551687 - DNA, 20 bp, Artificial Sequence
  chemically synthesized
gtatcttttcagaatgaaag

SEQ ID NO: 551688 - DNA, 20 bp, Artificial Sequence
  chemically synthesized
taatgcagattagagagtta

SEQ ID NO: 551689 - DNA, 20 bp, Artificial Sequence
  chemically synthesized
attaaataaaaggttgtctt

SEQ ID NO: 551690 - DNA, 20 bp, Artificial Sequence
  chemically synthesized
tgagaaataataaatgctct

SEQ ID NO: 551691 - DNA, 20 bp, Artificial Sequence
  chemically synthesized
ttcatacagaggtgatttcc

SEQ ID NO: 551692 - DNA, 20 bp, Artificial Sequence
  chemically synthesized
gtgctattttaagaaaaata

SEQ ID NO: 551693 - DNA, 20 bp, Artificial Sequence
  chemically synthesized
tacaattgggggtgctattt

SEQ ID NO: 551694 - DNA, 20 bp, Artificial Sequence
  chemically synthesized
gacaacacagaacgaaccag

SEQ ID NO: 551695 - DNA, 20 bp, Artificial Sequence
  chemically synthesized
aaaaatgatgtgtgtttaaa

SEQ ID NO: 551696 - DNA, 20 bp, Artificial Sequence
  chemically synthesized
gtgtgtttaaaatagaaaat

SEQ ID NO: 551697 - DNA, 20 bp, Artificial Sequence
  chemically synthesized
tagaaaatttagaaaaatga

SEQ ID NO: 551698 - DNA, 20 bp, Artificial Sequence
  chemically synthesized
atgaacagaaaattatcttt

SEQ ID NO: 551699 - DNA, 20 bp, Artificial Sequence
  chemically synthesized
agtttcctaagagggtctaa

SEQ ID NO: 551700 - DNA, 20 bp, Artificial Sequence
  chemically synthesized
tctttatttcatcacacata

SEQ ID NO: 551701 - DNA, 20 bp, Artificial Sequence
  chemically synthesized
ttttgatgaaagataataaa

SEQ ID NO: 551702 - DNA, 20 bp, Artificial Sequence
  chemically synthesized
caccttttagaatttcatct

SEQ ID NO: 551703 - DNA, 20 bp, Artificial Sequence
  chemically synthesized
aggtctaataaaatcacctt

SEQ ID NO: 551704 - DNA, 20 bp, Artificial Sequence
  chemically synthesized
ttactcaaataatgcattgt

SEQ ID NO: 551705 - DNA, 20 bp, Artificial Sequence
  chemically synthesized
acatattgtattgttcactt

SEQ ID NO: 551706 - DNA, 20 bp, Artificial Sequence
  chemically synthesized
caacatgacaatgagtttgg

SEQ ID NO: 551707 - DNA, 20 bp, Artificial Sequence
  chemically synthesized
gattacctttcttcgcattc

SEQ ID NO: 551708 - DNA, 20 bp, Artificial Sequence
  chemically synthesized
actttcaattcttagaatgc

SEQ ID NO: 551709 - DNA, 20 bp, Artificial Sequence
  chemically synthesized
attcaaataactttcaattc

SEQ ID NO: 551710 - DNA, 20 bp, Artificial Sequence
  chemically synthesized
atttaccttgcttaatttca

SEQ ID NO: 551711 - DNA, 20 bp, Artificial Sequence
  chemically synthesized
aagtatatagagcaattttg

SEQ ID NO: 551712 - DNA, 20 bp, Artificial Sequence
  chemically synthesized
ttgtatatgatgttaattat

SEQ ID NO: 551713 - DNA, 20 bp, Artificial Sequence
  chemically synthesized
gtatttatgttacatatatc

SEQ ID NO: 551714 - DNA, 20 bp, Artificial Sequence
  chemically synthesized
agtaataatgatgtccacca

SEQ ID NO: 551715 - DNA, 20 bp, Artificial Sequence
  chemically synthesized
atgagggcaatgcctataat

SEQ ID NO: 551716 - DNA, 20 bp, Artificial Sequence
  chemically synthesized
gcattgccctcatatctatt

SEQ ID NO: 551717 - DNA, 20 bp, Artificial Sequence
  chemically synthesized
acaactatttcgtttatttt

SEQ ID NO: 551718 - DNA, 20 bp, Artificial Sequence
  chemically synthesized
ttttttagtttgtctttcat

SEQ ID NO: 551719 - DNA, 20 bp, Artificial Sequence
  chemically synthesized
aagtttgtatgtcgtttacc

SEQ ID NO: 551720 - DNA, 20 bp, Artificial Sequence
  chemically synthesized
aataattatcatgatatgct

SEQ ID NO: 551721 - DNA, 20 bp, Artificial Sequence
  chemically synthesized
tttgaaatagtaaatgtgag

SEQ ID NO: 551722 - DNA, 20 bp, Artificial Sequence
  chemically synthesized
tgacacatcatggataaaat

SEQ ID NO: 551723 - DNA, 20 bp, Artificial Sequence
  chemically synthesized
tattttatccatgatgtgtc

SEQ ID NO: 551724 - DNA, 20 bp, Artificial Sequence
  chemically synthesized
actacatggaggcctaaaag

SEQ ID NO: 551725 - DNA, 20 bp, Artificial Sequence
  chemically synthesized
tatacagtagttagttcaat

SEQ ID NO: 551726 - DNA, 20 bp, Artificial Sequence
  chemically synthesized
ccactgcagtaatagaatat

SEQ ID NO: 551727 - DNA, 20 bp, Artificial Sequence
  chemically synthesized
attaacaaaccactgcagta

SEQ ID NO: 551728 - DNA, 20 bp, Artificial Sequence
  chemically synthesized
tactgcagtggtttgttaat

SEQ ID NO: 551729 - DNA, 20 bp, Artificial Sequence
  chemically synthesized
catgtgtttagttctatcgc

SEQ ID NO: 551730 - DNA, 20 bp, Artificial Sequence
  chemically synthesized
ttcattgggaaaacttttca

SEQ ID NO: 551731 - DNA, 20 bp, Artificial Sequence
  chemically synthesized
tccagtaggcttaaaaacaa

SEQ ID NO: 551732 - DNA, 20 bp, Artificial Sequence
  chemically synthesized
tctgggaggcaattaccttc

SEQ ID NO: 551733 - DNA, 20 bp, Artificial Sequence
  chemically synthesized
tgaaatatccgggggcctct

SEQ ID NO: 551734 - DNA, 20 bp, Artificial Sequence
  chemically synthesized
tgttctgattaatatccaaa

SEQ ID NO: 551735 - DNA, 20 bp, Artificial Sequence
  chemically synthesized
aataaattcacatgaaagtt

SEQ ID NO: 551736 - DNA, 20 bp, Artificial Sequence
  chemically synthesized
catgtgaatttattaacaga

SEQ ID NO: 551737 - DNA, 20 bp, Artificial Sequence
  chemically synthesized
taccaaataaaaaggaatgc

SEQ ID NO: 551738 - DNA, 20 bp, Artificial Sequence
  chemically synthesized
tctgaataagagaagcagca

SEQ ID NO: 551739 - DNA, 20 bp, Artificial Sequence
  chemically synthesized
gcagcagctgaattctgaag

SEQ ID NO: 551740 - DNA, 20 bp, Artificial Sequence
  chemically synthesized
tacacacacacattctgcct

SEQ ID NO: 551741 - DNA, 20 bp, Artificial Sequence
  chemically synthesized
acatgttttcctgctaaaat

SEQ ID NO: 551742 - DNA, 20 bp, Artificial Sequence
  chemically synthesized
gaatactcttataatgcagg

SEQ ID NO: 551743 - DNA, 20 bp, Artificial Sequence
  chemically synthesized
cacaactgaaatttaggatt

SEQ ID NO: 551744 - DNA, 20 bp, Artificial Sequence
  chemically synthesized
tggcaccagagaaatggaag

SEQ ID NO: 551745 - DNA, 20 bp, Artificial Sequence
  chemically synthesized
gaattggcaccagagaaatg

SEQ ID NO: 551746 - DNA, 20 bp, Artificial Sequence
  chemically synthesized
gtgttttaagaattggcacc

SEQ ID NO: 551747 - DNA, 20 bp, Artificial Sequence
  chemically synthesized
tgtctaaaaaaatggtgttt

SEQ ID NO: 551748 - DNA, 20 bp, Artificial Sequence
  chemically synthesized
tacaactgtattcacttaat

SEQ ID NO: 551749 - DNA, 20 bp, Artificial Sequence
  chemically synthesized
atgtaaatcattctttgcca

SEQ ID NO: 551750 - DNA, 20 bp, Artificial Sequence
  chemically synthesized
tgaagaagctttctattggc

SEQ ID NO: 551751 - DNA, 20 bp, Artificial Sequence
  chemically synthesized
aacaggcgagcccaaaattg

SEQ ID NO: 551752 - DNA, 20 bp, Artificial Sequence
  chemically synthesized
aaacattggaaacatttttt

SEQ ID NO: 551753 - DNA, 20 bp, Artificial Sequence
  chemically synthesized
agggattattataactataa

SEQ ID NO: 551754 - DNA, 20 bp, Artificial Sequence
  chemically synthesized
caagcagttgaatgtttgac

SEQ ID NO: 551755 - DNA, 20 bp, Artificial Sequence
  chemically synthesized
ttaattgtacattttgtgtt

SEQ ID NO: 551756 - DNA, 20 bp, Artificial Sequence
  chemically synthesized
gaaaggaggtgacctaggga

SEQ ID NO: 551757 - DNA, 20 bp, Artificial Sequence
  chemically synthesized
caaaattttcataaaacaac

SEQ ID NO: 551758 - DNA, 20 bp, Artificial Sequence
  chemically synthesized
ctaaacaagggtttatgttt

SEQ ID NO: 551759 - DNA, 20 bp, Artificial Sequence
  chemically synthesized
caatatcacgtgggaacttc

SEQ ID NO: 551760 - DNA, 20 bp, Artificial Sequence
  chemically synthesized
ttgacacgagacctcaaaag

SEQ ID NO: 551761 - DNA, 20 bp, Artificial Sequence
  chemically synthesized
cagagtgctgtgtcccaacc

SEQ ID NO: 551762 - DNA, 20 bp, Artificial Sequence
  chemically synthesized
ttctcaaagttgaccatgca

SEQ ID NO: 551763 - DNA, 20 bp, Artificial Sequence
  chemically synthesized
ttctaatgcatggtcaactt

SEQ ID NO: 551764 - DNA, 20 bp, Artificial Sequence
  chemically synthesized
atttagaaccacggttgttt

SEQ ID NO: 551765 - DNA, 20 bp, Artificial Sequence
  chemically synthesized
cattcagccttagttgataa

SEQ ID NO: 551766 - DNA, 20 bp, Artificial Sequence
  chemically synthesized
gtatatgcattccacacaat

SEQ ID NO: 551767 - DNA, 20 bp, Artificial Sequence
  chemically synthesized
agataagtgattaagggaca

SEQ ID NO: 551768 - DNA, 20 bp, Artificial Sequence
  chemically synthesized
tagttattctgaggactaaa

SEQ ID NO: 551769 - DNA, 20 bp, Artificial Sequence
  chemically synthesized
ttatctttctcctttagtcc

SEQ ID NO: 551770 - DNA, 20 bp, Artificial Sequence
  chemically synthesized
ttccatttttaataactgtc

SEQ ID NO: 551771 - DNA, 20 bp, Artificial Sequence
  chemically synthesized
gttattgtagttaatctttg

SEQ ID NO: 551772 - DNA, 20 bp, Artificial Sequence
  chemically synthesized
ttacacaaatcagtgatgaa

SEQ ID NO: 551773 - DNA, 20 bp, Artificial Sequence
  chemically synthesized
tcactgtaattttgtcattt

SEQ ID NO: 551774 - DNA, 20 bp, Artificial Sequence
  chemically synthesized
aacttaaatggatctcaagt

SEQ ID NO: 551775 - DNA, 20 bp, Artificial Sequence
  chemically synthesized
tataatttaccatataaatt

SEQ ID NO: 551776 - DNA, 20 bp, Artificial Sequence
  chemically synthesized
atagatctacagatctatct

SEQ ID NO: 551777 - DNA, 20 bp, Artificial Sequence
  chemically synthesized
atctacagaatatctttcag

SEQ ID NO: 551778 - DNA, 20 bp, Artificial Sequence
  chemically synthesized
aaaattatgaatacattttg

SEQ ID NO: 551779 - DNA, 20 bp, Artificial Sequence
  chemically synthesized
ccgacagtagtgccattata

SEQ ID NO: 551780 - DNA, 20 bp, Artificial Sequence
  chemically synthesized
tcctgtttgtttttgctttt

SEQ ID NO: 551781 - DNA, 20 bp, Artificial Sequence
  chemically synthesized
tgcctcaacttctcaaagta

SEQ ID NO: 551782 - DNA, 20 bp, Artificial Sequence
  chemically synthesized
ccactcaggaggctgaggct

SEQ ID NO: 551783 - DNA, 20 bp, Artificial Sequence
  chemically synthesized
ggcctagtatccagaatcta

SEQ ID NO: 551784 - DNA, 20 bp, Artificial Sequence
  chemically synthesized
atctgacaaaggcctagtat

SEQ ID NO: 551785 - DNA, 20 bp, Artificial Sequence
  chemically synthesized
aagtaaacagacgaagaatg

SEQ ID NO: 551786 - DNA, 20 bp, Artificial Sequence
  chemically synthesized
catcaacaaagtaaacagac

SEQ ID NO: 551787 - DNA, 20 bp, Artificial Sequence
  chemically synthesized
caaagagcttctgcaaagca

SEQ ID NO: 551788 - DNA, 20 bp, Artificial Sequence
  chemically synthesized
ttttttacattggtcttggc

SEQ ID NO: 551789 - DNA, 20 bp, Artificial Sequence
  chemically synthesized
tcatactgtaaaaaatccta

SEQ ID NO: 551790 - DNA, 20 bp, Artificial Sequence
  chemically synthesized
aatggaacagaatagtgaac

SEQ ID NO: 551791 - DNA, 20 bp, Artificial Sequence
  chemically synthesized
acagaccatagaccaatgga

SEQ ID NO: 551792 - DNA, 20 bp, Artificial Sequence
  chemically synthesized
gccaaagcaatcttaagcta

SEQ ID NO: 551793 - DNA, 20 bp, Artificial Sequence
  chemically synthesized
attttcatttttcattttca

SEQ ID NO: 551794 - DNA, 20 bp, Artificial Sequence
  chemically synthesized
catttcatgctcttggattg

SEQ ID NO: 551795 - DNA, 20 bp, Artificial Sequence
  chemically synthesized
agaactacaaaacactgctg

SEQ ID NO: 551796 - DNA, 20 bp, Artificial Sequence
  chemically synthesized
gttagctgcatggtcatgaa

SEQ ID NO: 551797 - DNA, 20 bp, Artificial Sequence
  chemically synthesized
ctatgcaaattaacacagga

SEQ ID NO: 551798 - DNA, 20 bp, Artificial Sequence
  chemically synthesized
ttaaatagatggcatattaa

SEQ ID NO: 551799 - DNA, 20 bp, Artificial Sequence
  chemically synthesized
ctttagggtttccaattatt

SEQ ID NO: 551800 - DNA, 20 bp, Artificial Sequence
  chemically synthesized
tcacaggacaaataagttga

SEQ ID NO: 551801 - DNA, 20 bp, Artificial Sequence
  chemically synthesized
gatcactgtggaaaaaggaa

SEQ ID NO: 551802 - DNA, 20 bp, Artificial Sequence
  chemically synthesized
aaagagattttttaaacacc

SEQ ID NO: 551803 - DNA, 20 bp, Artificial Sequence
  chemically synthesized
tgagtttataggcactagga

SEQ ID NO: 551804 - DNA, 20 bp, Artificial Sequence
  chemically synthesized
gaccagaaaaaataagacaa

SEQ ID NO: 551805 - DNA, 20 bp, Artificial Sequence
  chemically synthesized
caaactatagattagttttg

SEQ ID NO: 551806 - DNA, 20 bp, Artificial Sequence
  chemically synthesized
aacaatacagcattataatt

SEQ ID NO: 551807 - DNA, 20 bp, Artificial Sequence
  chemically synthesized
ggtattctacaaagttactc

SEQ ID NO: 551808 - DNA, 20 bp, Artificial Sequence
  chemically synthesized
tcatttctaagagtaacttt

SEQ ID NO: 551809 - DNA, 20 bp, Artificial Sequence
  chemically synthesized
ttctagctagtgtaaaaatg

SEQ ID NO: 551810 - DNA, 20 bp, Artificial Sequence
  chemically synthesized
tgccttaatcctaatattag

SEQ ID NO: 551811 - DNA, 20 bp, Artificial Sequence
  chemically synthesized
ctaacattgtaataataatg

SEQ ID NO: 551812 - DNA, 20 bp, Artificial Sequence
  chemically synthesized
caacttggaaaagaataact

SEQ ID NO: 551813 - DNA, 20 bp, Artificial Sequence
  chemically synthesized
gagaacgtcctcaacttgga

SEQ ID NO: 551814 - DNA, 20 bp, Artificial Sequence
  chemically synthesized
cccatttatgataaaagctc

SEQ ID NO: 551815 - DNA, 20 bp, Artificial Sequence
  chemically synthesized
cattatattaagaagctaaa

SEQ ID NO: 551816 - DNA, 20 bp, Artificial Sequence
  chemically synthesized
aaggagagaactgtcaactt

SEQ ID NO: 551817 - DNA, 20 bp, Artificial Sequence
  chemically synthesized
cgggctttcatggtttcaca

SEQ ID NO: 551818 - DNA, 20 bp, Artificial Sequence
  chemically synthesized
aaagtcttaaaaacagtgaa

SEQ ID NO: 551819 - DNA, 20 bp, Artificial Sequence
  chemically synthesized
tgagtatacaggataaaccc

SEQ ID NO: 551820 - DNA, 20 bp, Artificial Sequence
  chemically synthesized
ttataatcccataggacaac

SEQ ID NO: 551821 - DNA, 20 bp, Artificial Sequence
  chemically synthesized
gtgtgcagaaagataggaca

SEQ ID NO: 551822 - DNA, 20 bp, Artificial Sequence
  chemically synthesized
gagacaggggaaatctgtgt

SEQ ID NO: 551823 - DNA, 20 bp, Artificial Sequence
  chemically synthesized
ttcaataaatggtctcaaca

SEQ ID NO: 551824 - DNA, 20 bp, Artificial Sequence
  chemically synthesized
taaaaaatgggaaaagtcag

SEQ ID NO: 551825 - DNA, 20 bp, Artificial Sequence
  chemically synthesized
caaataaaaaatgggaaaag

SEQ ID NO: 551826 - DNA, 20 bp, Artificial Sequence
  chemically synthesized
atactgacatgacaaagatg

SEQ ID NO: 551827 - DNA, 20 bp, Artificial Sequence
  chemically synthesized
gtaatatcccaaatgccaaa

SEQ ID NO: 551828 - DNA, 20 bp, Artificial Sequence
  chemically synthesized
atcagtactatctatagagt

SEQ ID NO: 551829 - DNA, 20 bp, Artificial Sequence
  chemically synthesized
gtactatctatagagtcaag

SEQ ID NO: 551830 - DNA, 20 bp, Artificial Sequence
  chemically synthesized
tttttaaagatttctgaatg

SEQ ID NO: 551831 - DNA, 20 bp, Artificial Sequence
  chemically synthesized
tcataatacctttcttacat

SEQ ID NO: 551832 - DNA, 20 bp, Artificial Sequence
  chemically synthesized
atgcattgatgctagtgagc

SEQ ID NO: 551833 - DNA, 20 bp, Artificial Sequence
  chemically synthesized
ttgacatattaggcctggag

SEQ ID NO: 551834 - DNA, 20 bp, Artificial Sequence
  chemically synthesized
ggaataatgttggaatagca

SEQ ID NO: 551835 - DNA, 20 bp, Artificial Sequence
  chemically synthesized
tccagggcaaaaaacagggc

SEQ ID NO: 551836 - DNA, 20 bp, Artificial Sequence
  chemically synthesized
ccactgccactaatacaact

SEQ ID NO: 551837 - DNA, 20 bp, Artificial Sequence
  chemically synthesized
cagtactagtgtgatacctt

SEQ ID NO: 551838 - DNA, 20 bp, Artificial Sequence
  chemically synthesized
aagggagtaaagctgcatgc

SEQ ID NO: 551839 - DNA, 20 bp, Artificial Sequence
  chemically synthesized
ggagcttgccttccatcagg

SEQ ID NO: 551840 - DNA, 20 bp, Artificial Sequence
  chemically synthesized
atacacaaaggatataatac

SEQ ID NO: 551841 - DNA, 20 bp, Artificial Sequence
  chemically synthesized
gtaaatttaaacaaagccca

SEQ ID NO: 551842 - DNA, 20 bp, Artificial Sequence
  chemically synthesized
agctgtaaacttcttgatat

SEQ ID NO: 551843 - DNA, 20 bp, Artificial Sequence
  chemically synthesized
aacaggcaagagagggaaat

SEQ ID NO: 551844 - DNA, 20 bp, Artificial Sequence
  chemically synthesized
ctctttgagagtgtatgcta

SEQ ID NO: 551845 - DNA, 20 bp, Artificial Sequence
  chemically synthesized
cccagttccattgttttaaa

SEQ ID NO: 551846 - DNA, 20 bp, Artificial Sequence
  chemically synthesized
tgttagctcatatctttaat

SEQ ID NO: 551847 - DNA, 20 bp, Artificial Sequence
  chemically synthesized
attataccttgggtatatta

SEQ ID NO: 551848 - DNA, 20 bp, Artificial Sequence
  chemically synthesized
aatcaaagttctcatctcaa

SEQ ID NO: 551849 - DNA, 20 bp, Artificial Sequence
  chemically synthesized
aaaaactaatcaaaataaaa

SEQ ID NO: 551850 - DNA, 20 bp, Artificial Sequence
  chemically synthesized
gacaatgtgctaaaagtgac

SEQ ID NO: 551851 - DNA, 20 bp, Artificial Sequence
  chemically synthesized
gaggacacaagttacccgta

SEQ ID NO: 551852 - DNA, 20 bp, Artificial Sequence
  chemically synthesized
actacaggcctggaaaatac

SEQ ID NO: 551853 - DNA, 20 bp, Artificial Sequence
  chemically synthesized
aaattattaaatacttatgt

SEQ ID NO: 551854 - DNA, 20 bp, Artificial Sequence
  chemically synthesized
tacagtagtttgtgcctttt

SEQ ID NO: 551855 - DNA, 20 bp, Artificial Sequence
  chemically synthesized
gaaaagtatgccaatcttgt

SEQ ID NO: 551856 - DNA, 20 bp, Artificial Sequence
  chemically synthesized
catgttctggaaaagaatgt

SEQ ID NO: 551857 - DNA, 20 bp, Artificial Sequence
  chemically synthesized
cttcccttccatgttctgga

SEQ ID NO: 551858 - DNA, 20 bp, Artificial Sequence
  chemically synthesized
cttttccagaacatggaagg

SEQ ID NO: 551859 - DNA, 20 bp, Artificial Sequence
  chemically synthesized
gctggactcaacacatatac

SEQ ID NO: 551860 - DNA, 20 bp, Artificial Sequence
  chemically synthesized
gcaatagcctgatacccaaa

SEQ ID NO: 551861 - DNA, 20 bp, Artificial Sequence
  chemically synthesized
accagaaaaacagtacaaaa

SEQ ID NO: 551862 - DNA, 20 bp, Artificial Sequence
  chemically synthesized
gtctgaaaaataggactaaa

SEQ ID NO: 551863 - DNA, 20 bp, Artificial Sequence
  chemically synthesized
agctatctataaataatctc

SEQ ID NO: 551864 - DNA, 20 bp, Artificial Sequence
  chemically synthesized
tattttgctagttttagatc

SEQ ID NO: 551865 - DNA, 20 bp, Artificial Sequence
  chemically synthesized
aaaactgcaaccctctgatg

SEQ ID NO: 551866 - DNA, 20 bp, Artificial Sequence
  chemically synthesized
attgagtctatagatcaatt

SEQ ID NO: 551867 - DNA, 20 bp, Artificial Sequence
  chemically synthesized
cttgcctttccatatcattt

SEQ ID NO: 551868 - DNA, 20 bp, Artificial Sequence
  chemically synthesized
ctaaaaatgatatggaaagg

SEQ ID NO: 551869 - DNA, 20 bp, Artificial Sequence
  chemically synthesized
ctacttgagaggctgaaatg

SEQ ID NO: 551870 - DNA, 20 bp, Artificial Sequence
  chemically synthesized
caaaagaagagatcaatgga

SEQ ID NO: 551871 - DNA, 20 bp, Artificial Sequence
  chemically synthesized
aaacattaactcaaaatgga

SEQ ID NO: 551872 - DNA, 20 bp, Artificial Sequence
  chemically synthesized
agcccacagaagataacata

SEQ ID NO: 551873 - DNA, 20 bp, Artificial Sequence
  chemically synthesized
caccaaagacatgacctatg

SEQ ID NO: 551874 - DNA, 20 bp, Artificial Sequence
  chemically synthesized
ttgacaatgtcttttgcagc

SEQ ID NO: 551875 - DNA, 20 bp, Artificial Sequence
  chemically synthesized
tgctgcaaaagacattgtca

SEQ ID NO: 551876 - DNA, 20 bp, Artificial Sequence
  chemically synthesized
aaagaatgtaaagacaagcc

SEQ ID NO: 551877 - DNA, 20 bp, Artificial Sequence
  chemically synthesized
aagacaagccacagaatagg

SEQ ID NO: 551878 - DNA, 20 bp, Artificial Sequence
  chemically synthesized
gaactgttaaaaatcaacaa

SEQ ID NO: 551879 - DNA, 20 bp, Artificial Sequence
  chemically synthesized
gtgatgctactacatacctc

SEQ ID NO: 551880 - DNA, 20 bp, Artificial Sequence
  chemically synthesized
gaactcttgttcattgcttg

SEQ ID NO: 551881 - DNA, 20 bp, Artificial Sequence
  chemically synthesized
attcagactatagatgctaa

SEQ ID NO: 551882 - DNA, 20 bp, Artificial Sequence
  chemically synthesized
ttcagattggcttccttcag

SEQ ID NO: 551883 - DNA, 20 bp, Artificial Sequence
  chemically synthesized
ctataaatttgtccaaacac

SEQ ID NO: 551884 - DNA, 20 bp, Artificial Sequence
  chemically synthesized
catatgttcattattaattc

SEQ ID NO: 551885 - DNA, 20 bp, Artificial Sequence
  chemically synthesized
catagaacatctaaattaat

SEQ ID NO: 551886 - DNA, 20 bp, Artificial Sequence
  chemically synthesized
tatgtgaaaaggcaatggat

SEQ ID NO: 551887 - DNA, 20 bp, Artificial Sequence
  chemically synthesized
gctaaaacaatgttgaaaag

SEQ ID NO: 551888 - DNA, 20 bp, Artificial Sequence
  chemically synthesized
tagacacgcagattaatgga

SEQ ID NO: 551889 - DNA, 20 bp, Artificial Sequence
  chemically synthesized
aatggaacagaatagagact

SEQ ID NO: 551890 - DNA, 20 bp, Artificial Sequence
  chemically synthesized
caagtggacaaaaataatgg

SEQ ID NO: 551891 - DNA, 20 bp, Artificial Sequence
  chemically synthesized
aaaataatggaaagaaaaaa

SEQ ID NO: 551892 - DNA, 20 bp, Artificial Sequence
  chemically synthesized
aaaattttaaaattttgctc

SEQ ID NO: 551893 - DNA, 20 bp, Artificial Sequence
  chemically synthesized
tgaagagacaggctgcacat

SEQ ID NO: 551894 - DNA, 20 bp, Artificial Sequence
  chemically synthesized
cactagtatctagactaaat

SEQ ID NO: 551895 - DNA, 20 bp, Artificial Sequence
  chemically synthesized
aatagacacaaaaaaatcca

SEQ ID NO: 551896 - DNA, 20 bp, Artificial Sequence
  chemically synthesized
acgatataactctgtgcata

SEQ ID NO: 551897 - DNA, 20 bp, Artificial Sequence
  chemically synthesized
gtgacaacatcaaacactgg

SEQ ID NO: 551898 - DNA, 20 bp, Artificial Sequence
  chemically synthesized
tcaaacactggcaagaatgc

SEQ ID NO: 551899 - DNA, 20 bp, Artificial Sequence
  chemically synthesized
acatacaactaacctacagc

SEQ ID NO: 551900 - DNA, 20 bp, Artificial Sequence
  chemically synthesized
agcagctgtatttgtaatag

SEQ ID NO: 551901 - DNA, 20 bp, Artificial Sequence
  chemically synthesized
tgatgcacattacaaatctg

SEQ ID NO: 551902 - DNA, 20 bp, Artificial Sequence
  chemically synthesized
acaaatctggaagaatctcc

SEQ ID NO: 551903 - DNA, 20 bp, Artificial Sequence
  chemically synthesized
atgcagttgtaagaaataat

SEQ ID NO: 551904 - DNA, 20 bp, Artificial Sequence
  chemically synthesized
tgtaaattcacatgcagttg

SEQ ID NO: 551905 - DNA, 20 bp, Artificial Sequence
  chemically synthesized
tatataacgtaacacactta

SEQ ID NO: 551906 - DNA, 20 bp, Artificial Sequence
  chemically synthesized
gaaaattttaaatatgcaaa

SEQ ID NO: 551907 - DNA, 20 bp, Artificial Sequence
  chemically synthesized
atattttatttaaacgatac

SEQ ID NO: 551908 - DNA, 20 bp, Artificial Sequence
  chemically synthesized
tagaccaagttattactaca

SEQ ID NO: 551909 - DNA, 20 bp, Artificial Sequence
  chemically synthesized
attactacacaagaaagagt

SEQ ID NO: 551910 - DNA, 20 bp, Artificial Sequence
  chemically synthesized
tttcttttgcttttttaaag

SEQ ID NO: 551911 - DNA, 20 bp, Artificial Sequence
  chemically synthesized
tttttttcttttgctttttt

SEQ ID NO: 551912 - DNA, 20 bp, Artificial Sequence
  chemically synthesized
tttctttctttaaaaaagca

SEQ ID NO: 551913 - DNA, 20 bp, Artificial Sequence
  chemically synthesized
agaaaaaaatcccctccctg

SEQ ID NO: 551914 - DNA, 20 bp, Artificial Sequence
  chemically synthesized
taggatgacacattaaacct

SEQ ID NO: 551915 - DNA, 20 bp, Artificial Sequence
  chemically synthesized
gaaggtttaatgtgtcatcc

SEQ ID NO: 551916 - DNA, 20 bp, Artificial Sequence
  chemically synthesized
tcatcctaagaaacaattgg

SEQ ID NO: 551917 - DNA, 20 bp, Artificial Sequence
  chemically synthesized
gctcgaaaaatatgcacaac

SEQ ID NO: 551918 - DNA, 20 bp, Artificial Sequence
  chemically synthesized
ctctctctttaaaaactatt

SEQ ID NO: 551919 - DNA, 20 bp, Artificial Sequence
  chemically synthesized
cctgttttgaatacctcact

SEQ ID NO: 551920 - DNA, 20 bp, Artificial Sequence
  chemically synthesized
ctcactacagaatgccttaa

SEQ ID NO: 551921 - DNA, 20 bp, Artificial Sequence
  chemically synthesized
aatgccttaaaaagaaatgg

SEQ ID NO: 551922 - DNA, 20 bp, Artificial Sequence
  chemically synthesized
aagtatattcattgtggggc

SEQ ID NO: 551923 - DNA, 20 bp, Artificial Sequence
  chemically synthesized
agagcctgttaatggaaatc

SEQ ID NO: 551924 - DNA, 20 bp, Artificial Sequence
  chemically synthesized
taaacattttataaaactga

SEQ ID NO: 551925 - DNA, 20 bp, Artificial Sequence
  chemically synthesized
tgtttagacatctattaaac

SEQ ID NO: 551926 - DNA, 20 bp, Artificial Sequence
  chemically synthesized
aagttcctgaaggtattacc

SEQ ID NO: 551927 - DNA, 20 bp, Artificial Sequence
  chemically synthesized
acttggagaagagagtaaga

SEQ ID NO: 551928 - DNA, 20 bp, Artificial Sequence
  chemically synthesized
aagagcagcagttaaataca

SEQ ID NO: 551929 - DNA, 20 bp, Artificial Sequence
  chemically synthesized
tctcaaaaaaaaaaaaagct

SEQ ID NO: 551930 - DNA, 20 bp, Artificial Sequence
  chemically synthesized
gatcactcgtacattactga

SEQ ID NO: 551931 - DNA, 20 bp, Artificial Sequence
  chemically synthesized
caaataactagcaaaaatgt

SEQ ID NO: 551932 - DNA, 20 bp, Artificial Sequence
  chemically synthesized
agggactatatacgaagaac

SEQ ID NO: 551933 - DNA, 20 bp, Artificial Sequence
  chemically synthesized
gaaatacaaggtacagaatg

SEQ ID NO: 551934 - DNA, 20 bp, Artificial Sequence
  chemically synthesized
taagaagtgaaatacaaggt

SEQ ID NO: 551935 - DNA, 20 bp, Artificial Sequence
  chemically synthesized
caaatagcacaatccataaa

SEQ ID NO: 551936 - DNA, 20 bp, Artificial Sequence
  chemically synthesized
atattttagaaaaacatatg

SEQ ID NO: 551937 - DNA, 20 bp, Artificial Sequence
  chemically synthesized
aacataaaactacaaatatt

SEQ ID NO: 551938 - DNA, 20 bp, Artificial Sequence
  chemically synthesized
cttgctcaaacaccactcac

SEQ ID NO: 551939 - DNA, 20 bp, Artificial Sequence
  chemically synthesized
cactatttgttgaaaaggct

SEQ ID NO: 551940 - DNA, 20 bp, Artificial Sequence
  chemically synthesized
aatgcaatagaatagagatt

SEQ ID NO: 551941 - DNA, 20 bp, Artificial Sequence
  chemically synthesized
tagacgcatagttcaatgca

SEQ ID NO: 551942 - DNA, 20 bp, Artificial Sequence
  chemically synthesized
gacaaagaagaataaagtgg

SEQ ID NO: 551943 - DNA, 20 bp, Artificial Sequence
  chemically synthesized
gctaatacaatcttgacaaa

SEQ ID NO: 551944 - DNA, 20 bp, Artificial Sequence
  chemically synthesized
ttgtacttttccgtataaat

SEQ ID NO: 551945 - DNA, 20 bp, Artificial Sequence
  chemically synthesized
aagaccttgctggtatttta

SEQ ID NO: 551946 - DNA, 20 bp, Artificial Sequence
  chemically synthesized
aatagcacattgtaagtata

SEQ ID NO: 551947 - DNA, 20 bp, Artificial Sequence
  chemically synthesized
aaaaggtctaaaattatgat

SEQ ID NO: 551948 - DNA, 20 bp, Artificial Sequence
  chemically synthesized
gtctaaaattatgatttaga

SEQ ID NO: 551949 - DNA, 20 bp, Artificial Sequence
  chemically synthesized
gtatcataaaactgtaggct

SEQ ID NO: 551950 - DNA, 20 bp, Artificial Sequence
  chemically synthesized
gcactaaatttaaaagtgaa

SEQ ID NO: 551951 - DNA, 20 bp, Artificial Sequence
  chemically synthesized
ctttagggttttaagatact

SEQ ID NO: 551952 - DNA, 20 bp, Artificial Sequence
  chemically synthesized
tgtggatgtagagtcattgg

SEQ ID NO: 551953 - DNA, 20 bp, Artificial Sequence
  chemically synthesized
ccatgttgaattagatatta

SEQ ID NO: 551954 - DNA, 20 bp, Artificial Sequence
  chemically synthesized
tggaaacaaataattaagag

SEQ ID NO: 551955 - DNA, 20 bp, Artificial Sequence
  chemically synthesized
cacgttggttaagtggctgt

SEQ ID NO: 551956 - DNA, 20 bp, Artificial Sequence
  chemically synthesized
taaccaacgtgctaagtttt

SEQ ID NO: 551957 - DNA, 20 bp, Artificial Sequence
  chemically synthesized
gtatccttagttaagtacca

SEQ ID NO: 551958 - DNA, 20 bp, Artificial Sequence
  chemically synthesized
ttcagtaatgatgtgcttgc

SEQ ID NO: 551959 - DNA, 20 bp, Artificial Sequence
  chemically synthesized
catatgtacaacttgggctc

SEQ ID NO: 551960 - DNA, 20 bp, Artificial Sequence
  chemically synthesized
tcgctcaagaagtaagggtt

SEQ ID NO: 551961 - DNA, 20 bp, Artificial Sequence
  chemically synthesized
accagatagagtcatgaaaa

SEQ ID NO: 551962 - DNA, 20 bp, Artificial Sequence
  chemically synthesized
aatgaaactcatagttactt

SEQ ID NO: 551963 - DNA, 20 bp, Artificial Sequence
  chemically synthesized
acatggctgataaagggaga

SEQ ID NO: 551964 - DNA, 20 bp, Artificial Sequence
  chemically synthesized
tttatcagccatgtccctgg

SEQ ID NO: 551965 - DNA, 20 bp, Artificial Sequence
  chemically synthesized
agccatgtccctggcaagaa

SEQ ID NO: 551966 - DNA, 20 bp, Artificial Sequence
  chemically synthesized
tcagaggtgtgaatgggctt

SEQ ID NO: 551967 - DNA, 20 bp, Artificial Sequence
  chemically synthesized
ggctctatctcttactggat

SEQ ID NO: 551968 - DNA, 20 bp, Artificial Sequence
  chemically synthesized
tatatctctaactatcctgt

SEQ ID NO: 551969 - DNA, 20 bp, Artificial Sequence
  chemically synthesized
cataaacataagacagaaag

SEQ ID NO: 551970 - DNA, 20 bp, Artificial Sequence
  chemically synthesized
atggaaggcataaacataag

SEQ ID NO: 551971 - DNA, 20 bp, Artificial Sequence
  chemically synthesized
aatggattgggccaagccag

SEQ ID NO: 551972 - DNA, 20 bp, Artificial Sequence
  chemically synthesized
ctgaaatatttaaaatttag

SEQ ID NO: 551973 - DNA, 20 bp, Artificial Sequence
  chemically synthesized
aattatccttcaaaagtaaa

SEQ ID NO: 551974 - DNA, 20 bp, Artificial Sequence
  chemically synthesized
ctgccagtagatctgccttg

SEQ ID NO: 551975 - DNA, 20 bp, Artificial Sequence
  chemically synthesized
aatgtcaaaagaaggacttc

SEQ ID NO: 551976 - DNA, 20 bp, Artificial Sequence
  chemically synthesized
aaaagaaggacttcagagaa

SEQ ID NO: 551977 - DNA, 20 bp, Artificial Sequence
  chemically synthesized
gaaaaagaaaatgatgtaag

SEQ ID NO: 551978 - DNA, 20 bp, Artificial Sequence
  chemically synthesized
tcagaaacttagatctacat

SEQ ID NO: 551979 - DNA, 20 bp, Artificial Sequence
  chemically synthesized
attagatcaatcaggaatag

SEQ ID NO: 551980 - DNA, 20 bp, Artificial Sequence
  chemically synthesized
gttcaatataataacagcaa

SEQ ID NO: 551981 - DNA, 20 bp, Artificial Sequence
  chemically synthesized
atgattagagcttatggata

SEQ ID NO: 551982 - DNA, 20 bp, Artificial Sequence
  chemically synthesized
tccaatccgttttttcccac

SEQ ID NO: 551983 - DNA, 20 bp, Artificial Sequence
  chemically synthesized
aaaaacggattggagtggga

SEQ ID NO: 551984 - DNA, 20 bp, Artificial Sequence
  chemically synthesized
cctttagcttttaagaagag

SEQ ID NO: 551985 - DNA, 20 bp, Artificial Sequence
  chemically synthesized
ggctcctttagcttttaaga

SEQ ID NO: 551986 - DNA, 20 bp, Artificial Sequence
  chemically synthesized
ctactcaagagactgaggca

SEQ ID NO: 551987 - DNA, 20 bp, Artificial Sequence
  chemically synthesized
atttattcatctgatgatgg

SEQ ID NO: 551988 - DNA, 20 bp, Artificial Sequence
  chemically synthesized
aatctaaaaaagttgaactc

SEQ ID NO: 551989 - DNA, 20 bp, Artificial Sequence
  chemically synthesized
tgaactcatagaaatacaga

SEQ ID NO: 551990 - DNA, 20 bp, Artificial Sequence
  chemically synthesized
agattagaatgaagattacc

SEQ ID NO: 551991 - DNA, 20 bp, Artificial Sequence
  chemically synthesized
gcggaagggtcctaccggga

SEQ ID NO: 551992 - DNA, 20 bp, Artificial Sequence
  chemically synthesized
aaatattaattgtcaatgaa

SEQ ID NO: 551993 - DNA, 20 bp, Artificial Sequence
  chemically synthesized
cactcctgggcatttatccc

SEQ ID NO: 551994 - DNA, 20 bp, Artificial Sequence
  chemically synthesized
atttcaagaatattatgcaa

SEQ ID NO: 551995 - DNA, 20 bp, Artificial Sequence
  chemically synthesized
tgtctataattttgtcattt

SEQ ID NO: 551996 - DNA, 20 bp, Artificial Sequence
  chemically synthesized
tgacacaagctaagcaagct

SEQ ID NO: 551997 - DNA, 20 bp, Artificial Sequence
  chemically synthesized
atctaaaatctattggtagc

SEQ ID NO: 551998 - DNA, 20 bp, Artificial Sequence
  chemically synthesized
tgaatgtgtgacaccttgga

SEQ ID NO: 551999 - DNA, 20 bp, Artificial Sequence
  chemically synthesized
acttaatatcgacaatgcac

SEQ ID NO: 552000 - DNA, 20 bp, Artificial Sequence
  chemically synthesized
tattattactactactgatt

SEQ ID NO: 552001 - DNA, 20 bp, Artificial Sequence
  chemically synthesized
atatgaaaaatgttctttta

SEQ ID NO: 552002 - DNA, 20 bp, Artificial Sequence
  chemically synthesized
gagaagcaaaatctcttttc

SEQ ID NO: 552003 - DNA, 20 bp, Artificial Sequence
  chemically synthesized
agcgaacagtggcctgggcg

SEQ ID NO: 552004 - DNA, 20 bp, Artificial Sequence
  chemically synthesized
gttgggattgggggtaacta

SEQ ID NO: 552005 - DNA, 20 bp, Artificial Sequence
  chemically synthesized
agagaattacgttaagggat

SEQ ID NO: 552006 - DNA, 20 bp, Artificial Sequence
  chemically synthesized
gcttggtcttgtgttgtgta

SEQ ID NO: 552007 - DNA, 20 bp, Artificial Sequence
  chemically synthesized
tagccttcaataggaaagag

SEQ ID NO: 552008 - DNA, 20 bp, Artificial Sequence
  chemically synthesized
agcttgaaaatggaggcctt

SEQ ID NO: 552009 - DNA, 20 bp, Artificial Sequence
  chemically synthesized
aaaaggcctccattttcaag

SEQ ID NO: 552010 - DNA, 20 bp, Artificial Sequence
  chemically synthesized
gtattgatctaagcaactca

SEQ ID NO: 552011 - DNA, 20 bp, Artificial Sequence
  chemically synthesized
ttaaaatgtgaaatgtcatc

SEQ ID NO: 552012 - DNA, 20 bp, Artificial Sequence
  chemically synthesized
gattttaagacatattgatt

SEQ ID NO: 552013 - DNA, 20 bp, Artificial Sequence
  chemically synthesized
ttgctgtatgtcattgaatc

SEQ ID NO: 552014 - DNA, 20 bp, Artificial Sequence
  chemically synthesized
tgatccaagagcctgtaccc

SEQ ID NO: 552015 - DNA, 20 bp, Artificial Sequence
  chemically synthesized
aatctaattcatagtgagga

SEQ ID NO: 552016 - DNA, 20 bp, Artificial Sequence
  chemically synthesized
ctactcaggaggcagaggca

SEQ ID NO: 552017 - DNA, 20 bp, Artificial Sequence
  chemically synthesized
agggaaactttgtcaaaaaa

SEQ ID NO: 552018 - DNA, 20 bp, Artificial Sequence
  chemically synthesized
ctacttgagaggctgaggca

SEQ ID NO: 552019 - DNA, 20 bp, Artificial Sequence
  chemically synthesized
aggccttatcaaacaccagg

SEQ ID NO: 552020 - DNA, 20 bp, Artificial Sequence
  chemically synthesized
atttgggagtttttgctagg

SEQ ID NO: 552021 - DNA, 20 bp, Artificial Sequence
  chemically synthesized
atatttgactcctctaaaat

SEQ ID NO: 552022 - DNA, 20 bp, Artificial Sequence
  chemically synthesized
aaaaaaaaagagagaaagaa

SEQ ID NO: 552023 - DNA, 20 bp, Artificial Sequence
  chemically synthesized
atttcaaaaaaaaaagagag

SEQ ID NO: 552024 - DNA, 20 bp, Artificial Sequence
  chemically synthesized
ctccatttcaaaaaaaaaag

SEQ ID NO: 552025 - DNA, 20 bp, Artificial Sequence
  chemically synthesized
ctacttgggaggctgaggca

SEQ ID NO: 552026 - DNA, 20 bp, Artificial Sequence
  chemically synthesized
tacctcaaaaaggtgtagcc

SEQ ID NO: 552027 - DNA, 20 bp, Artificial Sequence
  chemically synthesized
aatgccataatcttcatgta

SEQ ID NO: 552028 - DNA, 20 bp, Artificial Sequence
  chemically synthesized
tatccgtgcccacttcacaa

SEQ ID NO: 552029 - DNA, 20 bp, Artificial Sequence
  chemically synthesized
ggcacggatatattaaaaat

SEQ ID NO: 552030 - DNA, 20 bp, Artificial Sequence
  chemically synthesized
aaaaatttagtaataaaaac

SEQ ID NO: 552031 - DNA, 20 bp, Artificial Sequence
  chemically synthesized
cacttggaaagggatctaaa

SEQ ID NO: 552032 - DNA, 20 bp, Artificial Sequence
  chemically synthesized
cccacaaatatcatgcatat

SEQ ID NO: 552033 - DNA, 20 bp, Artificial Sequence
  chemically synthesized
cccacaattatcatgtgaat

SEQ ID NO: 552034 - DNA, 20 bp, Artificial Sequence
  chemically synthesized
attaacacagtattgtgtaa

SEQ ID NO: 552035 - DNA, 20 bp, Artificial Sequence
  chemically synthesized
aattattcacattttgcaga

SEQ ID NO: 552036 - DNA, 20 bp, Artificial Sequence
  chemically synthesized
gtgagggcttccatcaatac

SEQ ID NO: 552037 - DNA, 20 bp, Artificial Sequence
  chemically synthesized
ctactctgggggctgaggca

SEQ ID NO: 552038 - DNA, 20 bp, Artificial Sequence
  chemically synthesized
ctttgtttcttgttacacct

SEQ ID NO: 552039 - DNA, 20 bp, Artificial Sequence
  chemically synthesized
gctatattctacaggtgtaa

SEQ ID NO: 552040 - DNA, 20 bp, Artificial Sequence
  chemically synthesized
atattatctgatcagggcga

SEQ ID NO: 552041 - DNA, 20 bp, Artificial Sequence
  chemically synthesized
tgcatctaagttaaaaaaat

SEQ ID NO: 552042 - DNA, 20 bp, Artificial Sequence
  chemically synthesized
ttaaaaaataagcttgaaaa

SEQ ID NO: 552043 - DNA, 20 bp, Artificial Sequence
  chemically synthesized
cttattttttaaatgaacat

SEQ ID NO: 552044 - DNA, 20 bp, Artificial Sequence
  chemically synthesized
tacatatttacagttagata

SEQ ID NO: 552045 - DNA, 20 bp, Artificial Sequence
  chemically synthesized
gaaaaggttgattttaaagt

SEQ ID NO: 552046 - DNA, 20 bp, Artificial Sequence
  chemically synthesized
gttaaataagccaggcagag

SEQ ID NO: 552047 - DNA, 20 bp, Artificial Sequence
  chemically synthesized
ttaagttaaataagccaggc

SEQ ID NO: 552048 - DNA, 20 bp, Artificial Sequence
  chemically synthesized
agaatactgttcatccatga

SEQ ID NO: 552049 - DNA, 20 bp, Artificial Sequence
  chemically synthesized
aaatgtggtatacgtacaca

SEQ ID NO: 552050 - DNA, 20 bp, Artificial Sequence
  chemically synthesized
catcaactggtgaatgaata

SEQ ID NO: 552051 - DNA, 20 bp, Artificial Sequence
  chemically synthesized
agttctagttttaatttttt

SEQ ID NO: 552052 - DNA, 20 bp, Artificial Sequence
  chemically synthesized
acaagtgttcctgagaaggt

SEQ ID NO: 552053 - DNA, 20 bp, Artificial Sequence
  chemically synthesized
gagatatcaactcaaacctg

SEQ ID NO: 552054 - DNA, 20 bp, Artificial Sequence
  chemically synthesized
gctatgtgaatgtcttctct

SEQ ID NO: 552055 - DNA, 20 bp, Artificial Sequence
  chemically synthesized
taactcaaacaaataaatag

SEQ ID NO: 552056 - DNA, 20 bp, Artificial Sequence
  chemically synthesized
acagagtgaagagaaaacct

SEQ ID NO: 552057 - DNA, 20 bp, Artificial Sequence
  chemically synthesized
ggaaagaatcaacagagtga

SEQ ID NO: 552058 - DNA, 20 bp, Artificial Sequence
  chemically synthesized
aaagttctgcacagtaaagg

SEQ ID NO: 552059 - DNA, 20 bp, Artificial Sequence
  chemically synthesized
ctgtgcttttgaggtcatat

SEQ ID NO: 552060 - DNA, 20 bp, Artificial Sequence
  chemically synthesized
gaaaaaatagatatccacat

SEQ ID NO: 552061 - DNA, 20 bp, Artificial Sequence
  chemically synthesized
cagaggccagaaataaatcc

SEQ ID NO: 552062 - DNA, 20 bp, Artificial Sequence
  chemically synthesized
ccaatggaataaaacagagg

SEQ ID NO: 552063 - DNA, 20 bp, Artificial Sequence
  chemically synthesized
aaacaccagtgacatttttt

SEQ ID NO: 552064 - DNA, 20 bp, Artificial Sequence
  chemically synthesized
tgataaagattgcattgact

SEQ ID NO: 552065 - DNA, 20 bp, Artificial Sequence
  chemically synthesized
tattctgtgttcatgtattg

SEQ ID NO: 552066 - DNA, 20 bp, Artificial Sequence
  chemically synthesized
aattcttccaatacatgaac

SEQ ID NO: 552067 - DNA, 20 bp, Artificial Sequence
  chemically synthesized
ctacctgggtggccgaggca

SEQ ID NO: 552068 - DNA, 20 bp, Artificial Sequence
  chemically synthesized
gctataagaacacaaaggca

SEQ ID NO: 552069 - DNA, 20 bp, Artificial Sequence
  chemically synthesized
ccattcctgagttacttcac

SEQ ID NO: 552070 - DNA, 20 bp, Artificial Sequence
  chemically synthesized
ataactgtggccacaaaaag

SEQ ID NO: 552071 - DNA, 20 bp, Artificial Sequence
  chemically synthesized
atcaatcaacgagtggataa

SEQ ID NO: 552072 - DNA, 20 bp, Artificial Sequence
  chemically synthesized
gtgataccaccttactcctg

SEQ ID NO: 552073 - DNA, 20 bp, Artificial Sequence
  chemically synthesized
atctgacagaggactaatat

SEQ ID NO: 552074 - DNA, 20 bp, Artificial Sequence
  chemically synthesized
aacagacaacacacagagcg

SEQ ID NO: 552075 - DNA, 20 bp, Artificial Sequence
  chemically synthesized
ggtttttccaatgttatctt

SEQ ID NO: 552076 - DNA, 20 bp, Artificial Sequence
  chemically synthesized
cccatagcaatctatctgaa

SEQ ID NO: 552077 - DNA, 20 bp, Artificial Sequence
  chemically synthesized
aaaaattccaccaaaaactg

SEQ ID NO: 552078 - DNA, 20 bp, Artificial Sequence
  chemically synthesized
ccacatgttggcaaggatat

SEQ ID NO: 552079 - DNA, 20 bp, Artificial Sequence
  chemically synthesized
aattagtacatctatgaaaa

SEQ ID NO: 552080 - DNA, 20 bp, Artificial Sequence
  chemically synthesized
aaatagaatggagatttctc

SEQ ID NO: 552081 - DNA, 20 bp, Artificial Sequence
  chemically synthesized
tagctctatttttaattctt

SEQ ID NO: 552082 - DNA, 20 bp, Artificial Sequence
  chemically synthesized
tttgggtagatacccagttg

SEQ ID NO: 552083 - DNA, 20 bp, Artificial Sequence
  chemically synthesized
ctgggtatctacccaaatga

SEQ ID NO: 552084 - DNA, 20 bp, Artificial Sequence
  chemically synthesized
ctattcacaatagcaaatat

SEQ ID NO: 552085 - DNA, 20 bp, Artificial Sequence
  chemically synthesized
catgggagggggttgtatga

SEQ ID NO: 552086 - DNA, 20 bp, Artificial Sequence
  chemically synthesized
tcctggaagtaattaggcaa

SEQ ID NO: 552087 - DNA, 20 bp, Artificial Sequence
  chemically synthesized
agtataattcttgctttatt

SEQ ID NO: 552088 - DNA, 20 bp, Artificial Sequence
  chemically synthesized
tggcattttcttcaataaag

SEQ ID NO: 552089 - DNA, 20 bp, Artificial Sequence
  chemically synthesized
agttggatcttattaataag

SEQ ID NO: 552090 - DNA, 20 bp, Artificial Sequence
  chemically synthesized
actaaacttgcaaactcaga

SEQ ID NO: 552091 - DNA, 20 bp, Artificial Sequence
  chemically synthesized
ttgggaagctcagctgtgct

SEQ ID NO: 552092 - DNA, 20 bp, Artificial Sequence
  chemically synthesized
agctgagcttcccaaatgcc

SEQ ID NO: 552093 - DNA, 20 bp, Artificial Sequence
  chemically synthesized
catagaaacaaaacgaaatg

SEQ ID NO: 552094 - DNA, 20 bp, Artificial Sequence
  chemically synthesized
gtgtattttgatgtgaccta

SEQ ID NO: 552095 - DNA, 20 bp, Artificial Sequence
  chemically synthesized
acccatttctcatgatacac

SEQ ID NO: 552096 - DNA, 20 bp, Artificial Sequence
  chemically synthesized
taacttttctaagtgtatca

SEQ ID NO: 552097 - DNA, 20 bp, Artificial Sequence
  chemically synthesized
gcttttttaagtggtagcag

SEQ ID NO: 552098 - DNA, 20 bp, Artificial Sequence
  chemically synthesized
tctgaaaagtaaaaaaaaaa

SEQ ID NO: 552099 - DNA, 20 bp, Artificial Sequence
  chemically synthesized
attaactcccagctttttcc

SEQ ID NO: 552100 - DNA, 20 bp, Artificial Sequence
  chemically synthesized
gggagttaattggaaagtga

SEQ ID NO: 552101 - DNA, 20 bp, Artificial Sequence
  chemically synthesized
cagcagaacaagacaacaac

SEQ ID NO: 552102 - DNA, 20 bp, Artificial Sequence
  chemically synthesized
caaaacaactatgaatttta

SEQ ID NO: 552103 - DNA, 20 bp, Artificial Sequence
  chemically synthesized
taacagaattgcatgaagtg

SEQ ID NO: 552104 - DNA, 20 bp, Artificial Sequence
  chemically synthesized
ttgcatgattccacattttt

SEQ ID NO: 552105 - DNA, 20 bp, Artificial Sequence
  chemically synthesized
atttttgtaatccattaaga

SEQ ID NO: 552106 - DNA, 20 bp, Artificial Sequence
  chemically synthesized
ctttttcaaggtggaatatc

SEQ ID NO: 552107 - DNA, 20 bp, Artificial Sequence
  chemically synthesized
atgatgctgaggactagatg

SEQ ID NO: 552108 - DNA, 20 bp, Artificial Sequence
  chemically synthesized
gcaaagagctaggagcaaca

SEQ ID NO: 552109 - DNA, 20 bp, Artificial Sequence
  chemically synthesized
actcttggggagcagaagaa

SEQ ID NO: 552110 - DNA, 20 bp, Artificial Sequence
  chemically synthesized
tcaaagactcttggggagca

SEQ ID NO: 552111 - DNA, 20 bp, Artificial Sequence
  chemically synthesized
gtgtcctaaattgtcaagta

SEQ ID NO: 552112 - DNA, 20 bp, Artificial Sequence
  chemically synthesized
acaatttaggacactgatga

SEQ ID NO: 552113 - DNA, 20 bp, Artificial Sequence
  chemically synthesized
gccatttaaaaatttataca

SEQ ID NO: 552114 - DNA, 20 bp, Artificial Sequence
  chemically synthesized
ctaatttcatttaatgcctg

SEQ ID NO: 552115 - DNA, 20 bp, Artificial Sequence
  chemically synthesized
ctcaggcattaaatgaaatt

SEQ ID NO: 552116 - DNA, 20 bp, Artificial Sequence
  chemically synthesized
gataaaagttcattttcaat

SEQ ID NO: 552117 - DNA, 20 bp, Artificial Sequence
  chemically synthesized
ctttaactggactcaaggaa

SEQ ID NO: 552118 - DNA, 20 bp, Artificial Sequence
  chemically synthesized
aatataagaaacaaaatata

SEQ ID NO: 552119 - DNA, 20 bp, Artificial Sequence
  chemically synthesized
gctactaaattttaagaata

SEQ ID NO: 552120 - DNA, 20 bp, Artificial Sequence
  chemically synthesized
atgtatttgctactaaattt

SEQ ID NO: 552121 - DNA, 20 bp, Artificial Sequence
  chemically synthesized
atactctgttagtacaattc

SEQ ID NO: 552122 - DNA, 20 bp, Artificial Sequence
  chemically synthesized
ttctgtactccatatgttta

SEQ ID NO: 552123 - DNA, 20 bp, Artificial Sequence
  chemically synthesized
attttctgaattagagtcta

SEQ ID NO: 552124 - DNA, 20 bp, Artificial Sequence
  chemically synthesized
aatttctcatagactctaat

SEQ ID NO: 552125 - DNA, 20 bp, Artificial Sequence
  chemically synthesized
tggcaatcacttgtatttat

SEQ ID NO: 552126 - DNA, 20 bp, Artificial Sequence
  chemically synthesized
gtaagactcatgctcataat

SEQ ID NO: 552127 - DNA, 20 bp, Artificial Sequence
  chemically synthesized
ctactggggaggctgaggca

SEQ ID NO: 552128 - DNA, 20 bp, Artificial Sequence
  chemically synthesized
tgagccactgcgcctggccg

SEQ ID NO: 552129 - DNA, 20 bp, Artificial Sequence
  chemically synthesized
cgagaataaataatattttc

SEQ ID NO: 552130 - DNA, 20 bp, Artificial Sequence
  chemically synthesized
aaaattaaaagttaattttc

SEQ ID NO: 552131 - DNA, 20 bp, Artificial Sequence
  chemically synthesized
aaaataatgataatttcctc

SEQ ID NO: 552132 - DNA, 20 bp, Artificial Sequence
  chemically synthesized
gttttactaaaaataaaatg

SEQ ID NO: 552133 - DNA, 20 bp, Artificial Sequence
  chemically synthesized
aattgtcatttttttacaga

SEQ ID NO: 552134 - DNA, 20 bp, Artificial Sequence
  chemically synthesized
cagaccagaaactctgaaaa

SEQ ID NO: 552135 - DNA, 20 bp, Artificial Sequence
  chemically synthesized
atggcataattaccagagga

SEQ ID NO: 552136 - DNA, 20 bp, Artificial Sequence
  chemically synthesized
tcctatcaattgaattttat

SEQ ID NO: 552137 - DNA, 20 bp, Artificial Sequence
  chemically synthesized
taacgatttgctgaaacaac

SEQ ID NO: 552138 - DNA, 20 bp, Artificial Sequence
  chemically synthesized
acaacccagaaatgattgat

SEQ ID NO: 552139 - DNA, 20 bp, Artificial Sequence
  chemically synthesized
aactttgaattaggaaaatt

SEQ ID NO: 552140 - DNA, 20 bp, Artificial Sequence
  chemically synthesized
tttctgtcaataacaagatt

SEQ ID NO: 552141 - DNA, 20 bp, Artificial Sequence
  chemically synthesized
tttcttcaatcttgttattg

SEQ ID NO: 552142 - DNA, 20 bp, Artificial Sequence
  chemically synthesized
attgacagaaatttgtatgt

SEQ ID NO: 552143 - DNA, 20 bp, Artificial Sequence
  chemically synthesized
ctactagggaggctgaggca

SEQ ID NO: 552144 - DNA, 20 bp, Artificial Sequence
  chemically synthesized
ataaaaagaaaagaaatgat

SEQ ID NO: 552145 - DNA, 20 bp, Artificial Sequence
  chemically synthesized
ttaataaacatataaaaaga

SEQ ID NO: 552146 - DNA, 20 bp, Artificial Sequence
  chemically synthesized
tgtgtttaataaacatataa

SEQ ID NO: 552147 - DNA, 20 bp, Artificial Sequence
  chemically synthesized
tatcaagggatactgtactc

SEQ ID NO: 552148 - DNA, 20 bp, Artificial Sequence
  chemically synthesized
atgttagcagtataatatcc

SEQ ID NO: 552149 - DNA, 20 bp, Artificial Sequence
  chemically synthesized
cagtagggttggctctccta

SEQ ID NO: 552150 - DNA, 20 bp, Artificial Sequence
  chemically synthesized
ttcaaggtaagttttggcaa

SEQ ID NO: 552151 - DNA, 20 bp, Artificial Sequence
  chemically synthesized
atttgaataaatatgatagt

SEQ ID NO: 552152 - DNA, 20 bp, Artificial Sequence
  chemically synthesized
atcaaatttgttaaacaggt

SEQ ID NO: 552153 - DNA, 20 bp, Artificial Sequence
  chemically synthesized
acaaataaaaaatatataat

SEQ ID NO: 552154 - DNA, 20 bp, Artificial Sequence
  chemically synthesized
gtgcagaggaatgcagttgt

SEQ ID NO: 552155 - DNA, 20 bp, Artificial Sequence
  chemically synthesized
aaaagatgcatagataaccc

SEQ ID NO: 552156 - DNA, 20 bp, Artificial Sequence
  chemically synthesized
tgcatagataaccctaagaa

SEQ ID NO: 552157 - DNA, 20 bp, Artificial Sequence
  chemically synthesized
taccattgctaattagtcag

SEQ ID NO: 552158 - DNA, 20 bp, Artificial Sequence
  chemically synthesized
ccaaagtacgggctcagcaa

SEQ ID NO: 552159 - DNA, 20 bp, Artificial Sequence
  chemically synthesized
taaaggtaattatgtaagat

SEQ ID NO: 552160 - DNA, 20 bp, Artificial Sequence
  chemically synthesized
tatgtaagattaagaaagtc

SEQ ID NO: 552161 - DNA, 20 bp, Artificial Sequence
  chemically synthesized
attaagaaagtcacagaaac

SEQ ID NO: 552162 - DNA, 20 bp, Artificial Sequence
  chemically synthesized
atgcatttttagacatagac

SEQ ID NO: 552163 - DNA, 20 bp, Artificial Sequence
  chemically synthesized
gtgcatttttagacatagag

SEQ ID NO: 552164 - DNA, 20 bp, Artificial Sequence
  chemically synthesized
aattgtgcatttttagacat

SEQ ID NO: 552165 - DNA, 20 bp, Artificial Sequence
  chemically synthesized
tccattccaggcagtccctg

SEQ ID NO: 552166 - DNA, 20 bp, Artificial Sequence
  chemically synthesized
ttgagatgcctaaaccaatg

SEQ ID NO: 552167 - DNA, 20 bp, Artificial Sequence
  chemically synthesized
tcagttggtatctctgggga

SEQ ID NO: 552168 - DNA, 20 bp, Artificial Sequence
  chemically synthesized
ttctccccagagataccaac

SEQ ID NO: 552169 - DNA, 20 bp, Artificial Sequence
  chemically synthesized
gtggcttgtgggccacatct

SEQ ID NO: 552170 - DNA, 20 bp, Artificial Sequence
  chemically synthesized
atatgtttagtttaacttgt

SEQ ID NO: 552171 - DNA, 20 bp, Artificial Sequence
  chemically synthesized
agctctaagggtatccccaa

SEQ ID NO: 552172 - DNA, 20 bp, Artificial Sequence
  chemically synthesized
ttcaaacaattccaactgaa

SEQ ID NO: 552173 - DNA, 20 bp, Artificial Sequence
  chemically synthesized
atatttatttccatttgtaa

SEQ ID NO: 552174 - DNA, 20 bp, Artificial Sequence
  chemically synthesized
taaatatcttgaagatgaag

SEQ ID NO: 552175 - DNA, 20 bp, Artificial Sequence
  chemically synthesized
aataccatgcctcttgaaca

SEQ ID NO: 552176 - DNA, 20 bp, Artificial Sequence
  chemically synthesized
gtgttcaagaggcatggtat

SEQ ID NO: 552177 - DNA, 20 bp, Artificial Sequence
  chemically synthesized
atggtattgagaaacaattt

SEQ ID NO: 552178 - DNA, 20 bp, Artificial Sequence
  chemically synthesized
agacaaaaggagatagtact

SEQ ID NO: 552179 - DNA, 20 bp, Artificial Sequence
  chemically synthesized
cctttgcaagttcaaggaac

SEQ ID NO: 552180 - DNA, 20 bp, Artificial Sequence
  chemically synthesized
aatgccacatgttttaaagc

SEQ ID NO: 552181 - DNA, 20 bp, Artificial Sequence
  chemically synthesized
taggaagaactagtcctccc

SEQ ID NO: 552182 - DNA, 20 bp, Artificial Sequence
  chemically synthesized
tttcctcataagggaaaaac

SEQ ID NO: 552183 - DNA, 20 bp, Artificial Sequence
  chemically synthesized
atatttatatttaaaatgtg

SEQ ID NO: 552184 - DNA, 20 bp, Artificial Sequence
  chemically synthesized
tattattggctaaagtgaat

SEQ ID NO: 552185 - DNA, 20 bp, Artificial Sequence
  chemically synthesized
aattatccaactaaatcata

SEQ ID NO: 552186 - DNA, 20 bp, Artificial Sequence
  chemically synthesized
atttcaaactgactcataat

SEQ ID NO: 552187 - DNA, 20 bp, Artificial Sequence
  chemically synthesized
taaaaggatccacctcctat

SEQ ID NO: 552188 - DNA, 20 bp, Artificial Sequence
  chemically synthesized
attggaactttggtatggac

SEQ ID NO: 552189 - DNA, 20 bp, Artificial Sequence
  chemically synthesized
tctactaatttaatagaact

SEQ ID NO: 552190 - DNA, 20 bp, Artificial Sequence
  chemically synthesized
atcagggaaagacaagctgt

SEQ ID NO: 552191 - DNA, 20 bp, Artificial Sequence
  chemically synthesized
gctgtatagaatttaaagtg

SEQ ID NO: 552192 - DNA, 20 bp, Artificial Sequence
  chemically synthesized
gagatattgaaagtttaact

SEQ ID NO: 552193 - DNA, 20 bp, Artificial Sequence
  chemically synthesized
tagagcaagtatgcttggca

SEQ ID NO: 552194 - DNA, 20 bp, Artificial Sequence
  chemically synthesized
tgtaaaatatcgagaggcca

SEQ ID NO: 552195 - DNA, 20 bp, Artificial Sequence
  chemically synthesized
aaataacaaaaattgataac

SEQ ID NO: 552196 - DNA, 20 bp, Artificial Sequence
  chemically synthesized
taatgtcatgatccctttaa

SEQ ID NO: 552197 - DNA, 20 bp, Artificial Sequence
  chemically synthesized
taatgagaaactagccatta

SEQ ID NO: 552198 - DNA, 20 bp, Artificial Sequence
  chemically synthesized
aaaataatatgtacttatat

SEQ ID NO: 552199 - DNA, 20 bp, Artificial Sequence
  chemically synthesized
tattattttgtaaacagtta

SEQ ID NO: 552200 - DNA, 20 bp, Artificial Sequence
  chemically synthesized
catttttgcatttgaatatc

SEQ ID NO: 552201 - DNA, 20 bp, Artificial Sequence
  chemically synthesized
aatataggtttataaactgg

SEQ ID NO: 552202 - DNA, 20 bp, Artificial Sequence
  chemically synthesized
tttaggataatgataaactt

SEQ ID NO: 552203 - DNA, 20 bp, Artificial Sequence
  chemically synthesized
agcaaatttttgaatgtgtc

SEQ ID NO: 552204 - DNA, 20 bp, Artificial Sequence
  chemically synthesized
ttatttgatgtgatgattcg

SEQ ID NO: 552205 - DNA, 20 bp, Artificial Sequence
  chemically synthesized
tgattcgaaagaaataaatc

SEQ ID NO: 552206 - DNA, 20 bp, Artificial Sequence
  chemically synthesized
taagagttattaaaacttgt

SEQ ID NO: 552207 - DNA, 20 bp, Artificial Sequence
  chemically synthesized
accatcacattttgcaataa

SEQ ID NO: 552208 - DNA, 20 bp, Artificial Sequence
  chemically synthesized
aaaagatatttgaatgattt

SEQ ID NO: 552209 - DNA, 20 bp, Artificial Sequence
  chemically synthesized
atataaagaaggataatata

SEQ ID NO: 552210 - DNA, 20 bp, Artificial Sequence
  chemically synthesized
atatgtttacacataaacac

SEQ ID NO: 552211 - DNA, 20 bp, Artificial Sequence
  chemically synthesized
catgatcaagagtgttacac

SEQ ID NO: 552212 - DNA, 20 bp, Artificial Sequence
  chemically synthesized
aacagatatttaccaactat

SEQ ID NO: 552213 - DNA, 20 bp, Artificial Sequence
  chemically synthesized
ttatactgaatgtagtcaat

SEQ ID NO: 552214 - DNA, 20 bp, Artificial Sequence
  chemically synthesized
aaagcacttcccacatttat

SEQ ID NO: 552215 - DNA, 20 bp, Artificial Sequence
  chemically synthesized
tattttataggaaaggtact

SEQ ID NO: 552216 - DNA, 20 bp, Artificial Sequence
  chemically synthesized
aagtggtatttgttaagaag

SEQ ID NO: 552217 - DNA, 20 bp, Artificial Sequence
  chemically synthesized
acagactagatgatctctca

SEQ ID NO: 552218 - DNA, 20 bp, Artificial Sequence
  chemically synthesized
aaaatactgaaaggcaggac

SEQ ID NO: 552219 - DNA, 20 bp, Artificial Sequence
  chemically synthesized
tagcattgcataagatcaaa

SEQ ID NO: 552220 - DNA, 20 bp, Artificial Sequence
  chemically synthesized
agataacaaaaatcactaat

SEQ ID NO: 552221 - DNA, 20 bp, Artificial Sequence
  chemically synthesized
ctttcttcatgcatatgatt

SEQ ID NO: 552222 - DNA, 20 bp, Artificial Sequence
  chemically synthesized
ctttctgtaatcatatgcat

SEQ ID NO: 552223 - DNA, 20 bp, Artificial Sequence
  chemically synthesized
ctgtaatcatatgcatgaag

SEQ ID NO: 552224 - DNA, 20 bp, Artificial Sequence
  chemically synthesized
ataatatttatgtttacaat

SEQ ID NO: 552225 - DNA, 20 bp, Artificial Sequence
  chemically synthesized
gataatatttatagcttatt

SEQ ID NO: 552226 - DNA, 20 bp, Artificial Sequence
  chemically synthesized
actagttcaaaattatctgg

SEQ ID NO: 552227 - DNA, 20 bp, Artificial Sequence
  chemically synthesized
aaaattagtattcaacagtc

SEQ ID NO: 552228 - DNA, 20 bp, Artificial Sequence
  chemically synthesized
cttttctaggaaaaatatta

SEQ ID NO: 552229 - DNA, 20 bp, Artificial Sequence
  chemically synthesized
catttctcttaatatttttc

SEQ ID NO: 552230 - DNA, 20 bp, Artificial Sequence
  chemically synthesized
atatttcctctcatcctaga

SEQ ID NO: 552231 - DNA, 20 bp, Artificial Sequence
  chemically synthesized
tacattaatcttgatttaaa

SEQ ID NO: 552232 - DNA, 20 bp, Artificial Sequence
  chemically synthesized
atagaaacctacttttcaac

SEQ ID NO: 552233 - DNA, 20 bp, Artificial Sequence
  chemically synthesized
agttcaggtgaaacaaaaaa

SEQ ID NO: 552234 - DNA, 20 bp, Artificial Sequence
  chemically synthesized
acctgaactaacatgtagtt

SEQ ID NO: 552235 - DNA, 20 bp, Artificial Sequence
  chemically synthesized
tgtagttagagaaatacatt

SEQ ID NO: 552236 - DNA, 20 bp, Artificial Sequence
  chemically synthesized
tgcacttgccatttaataat

SEQ ID NO: 552237 - DNA, 20 bp, Artificial Sequence
  chemically synthesized
caatatcataatactgtaaa

SEQ ID NO: 552238 - DNA, 20 bp, Artificial Sequence
  chemically synthesized
tgcattttattaatactaaa

SEQ ID NO: 552239 - DNA, 20 bp, Artificial Sequence
  chemically synthesized
cacatatcgtaaaatggtga

SEQ ID NO: 552240 - DNA, 20 bp, Artificial Sequence
  chemically synthesized
tacctacaatttttctattt

SEQ ID NO: 552241 - DNA, 20 bp, Artificial Sequence
  chemically synthesized
gcaagtatggctttctgaaa

SEQ ID NO: 552242 - DNA, 20 bp, Artificial Sequence
  chemically synthesized
acattttcccttctcggtct

SEQ ID NO: 552243 - DNA, 20 bp, Artificial Sequence
  chemically synthesized
agggaaaatgtgtccatttc

SEQ ID NO: 552244 - DNA, 20 bp, Artificial Sequence
  chemically synthesized
tttcctacagtgagtgtttc

SEQ ID NO: 552245 - DNA, 20 bp, Artificial Sequence
  chemically synthesized
tttcgttccttttaattaaa

SEQ ID NO: 552246 - DNA, 20 bp, Artificial Sequence
  chemically synthesized
tccttttaattaaaagagaa

SEQ ID NO: 552247 - DNA, 20 bp, Artificial Sequence
  chemically synthesized
aaaacttttattttttatgt

SEQ ID NO: 552248 - DNA, 20 bp, Artificial Sequence
  chemically synthesized
tttgcaatcaactaccatat

SEQ ID NO: 552249 - DNA, 20 bp, Artificial Sequence
  chemically synthesized
agggaggaccatctctacat

SEQ ID NO: 552250 - DNA, 20 bp, Artificial Sequence
  chemically synthesized
tagcatcatgctattttcat

SEQ ID NO: 552251 - DNA, 20 bp, Artificial Sequence
  chemically synthesized
tcaccatgctaagtgatcca

SEQ ID NO: 552252 - DNA, 20 bp, Artificial Sequence
  chemically synthesized
agagtaaatgacattacttg

SEQ ID NO: 552253 - DNA, 20 bp, Artificial Sequence
  chemically synthesized
ttactcatcctcagtgccaa

SEQ ID NO: 552254 - DNA, 20 bp, Artificial Sequence
  chemically synthesized
tgttgtatctaaagatcaag

SEQ ID NO: 552255 - DNA, 20 bp, Artificial Sequence
  chemically synthesized
tttttggaaactggttacac

SEQ ID NO: 552256 - DNA, 20 bp, Artificial Sequence
  chemically synthesized
taatgctattatttttcact

SEQ ID NO: 552257 - DNA, 20 bp, Artificial Sequence
  chemically synthesized
acagttcaaactaccacaat

SEQ ID NO: 552258 - DNA, 20 bp, Artificial Sequence
  chemically synthesized
ttaccatcaaagcaatattt

SEQ ID NO: 552259 - DNA, 20 bp, Artificial Sequence
  chemically synthesized
aagacatactaggataaagt

SEQ ID NO: 552260 - DNA, 20 bp, Artificial Sequence
  chemically synthesized
aattaccatgttaaatatat

SEQ ID NO: 552261 - DNA, 20 bp, Artificial Sequence
  chemically synthesized
tcgtagggctagatggtata

SEQ ID NO: 552262 - DNA, 20 bp, Artificial Sequence
  chemically synthesized
tcaacgatgtgtccaccact

SEQ ID NO: 552263 - DNA, 20 bp, Artificial Sequence
  chemically synthesized
tgatcatagttttgccattt

SEQ ID NO: 552264 - DNA, 20 bp, Artificial Sequence
  chemically synthesized
aatttcgactatgtggcatt

SEQ ID NO: 552265 - DNA, 20 bp, Artificial Sequence
  chemically synthesized
tgaacaggtacatgcagcca

SEQ ID NO: 552266 - DNA, 20 bp, Artificial Sequence
  chemically synthesized
taagtgtgtgtttagttttg

SEQ ID NO: 552267 - DNA, 20 bp, Artificial Sequence
  chemically synthesized
atttacctgttaagcacctc

SEQ ID NO: 552268 - DNA, 20 bp, Artificial Sequence
  chemically synthesized
gaatttttttaaaatctttt

SEQ ID NO: 552269 - DNA, 20 bp, Artificial Sequence
  chemically synthesized
aagattttaaaaaaattctt

SEQ ID NO: 552270 - DNA, 20 bp, Artificial Sequence
  chemically synthesized
ggagtgtgtcgctgattctt

SEQ ID NO: 552271 - DNA, 20 bp, Artificial Sequence
  chemically synthesized
tactgaaaagtaactggact

SEQ ID NO: 552272 - DNA, 20 bp, Artificial Sequence
  chemically synthesized
tgtgttctcaaaacatcatc

SEQ ID NO: 552273 - DNA, 20 bp, Artificial Sequence
  chemically synthesized
aattaaaattagcgaagaca

SEQ ID NO: 552274 - DNA, 20 bp, Artificial Sequence
  chemically synthesized
aaactcatcaaatgcctcac

SEQ ID NO: 552275 - DNA, 20 bp, Artificial Sequence
  chemically synthesized
gagcaagaaaacagaatgaa

SEQ ID NO: 552276 - DNA, 20 bp, Artificial Sequence
  chemically synthesized
ataaagtgatgagcaagaaa

SEQ ID NO: 552277 - DNA, 20 bp, Artificial Sequence
  chemically synthesized
taattgtataaagtgatgag

SEQ ID NO: 552278 - DNA, 20 bp, Artificial Sequence
  chemically synthesized
ctgtctataatacaggttct

SEQ ID NO: 552279 - DNA, 20 bp, Artificial Sequence
  chemically synthesized
attaaaattcagctttaata

SEQ ID NO: 552280 - DNA, 20 bp, Artificial Sequence
  chemically synthesized
tgacacttatttaatatata

SEQ ID NO: 552281 - DNA, 20 bp, Artificial Sequence
  chemically synthesized
ttatttaatatatagaagaa

SEQ ID NO: 552282 - DNA, 20 bp, Artificial Sequence
  chemically synthesized
ttaatatatagaagaataag

SEQ ID NO: 552283 - DNA, 20 bp, Artificial Sequence
  chemically synthesized
ataagaaagaaaatataaaa

SEQ ID NO: 552284 - DNA, 20 bp, Artificial Sequence
  chemically synthesized
gtccacatgtacaggataaa

SEQ ID NO: 552285 - DNA, 20 bp, Artificial Sequence
  chemically synthesized
cacccagcaatcattcttga

SEQ ID NO: 552286 - DNA, 20 bp, Artificial Sequence
  chemically synthesized
ttttaagacatttttctttt

SEQ ID NO: 552287 - DNA, 20 bp, Artificial Sequence
  chemically synthesized
ctgtttgtggtgataattaa

SEQ ID NO: 552288 - DNA, 20 bp, Artificial Sequence
  chemically synthesized
acccttttactctaaatgct

SEQ ID NO: 552289 - DNA, 20 bp, Artificial Sequence
  chemically synthesized
taaataaaggcctaaaaaag

SEQ ID NO: 552290 - DNA, 20 bp, Artificial Sequence
  chemically synthesized
atgttcttcagacatctata

SEQ ID NO: 552291 - DNA, 20 bp, Artificial Sequence
  chemically synthesized
aacatttttaaataatatgt

SEQ ID NO: 552292 - DNA, 20 bp, Artificial Sequence
  chemically synthesized
ttatcttttaattttattgt

SEQ ID NO: 552293 - DNA, 20 bp, Artificial Sequence
  chemically synthesized
tagttataaaacaaaagcat

SEQ ID NO: 552294 - DNA, 20 bp, Artificial Sequence
  chemically synthesized
ttaaaataatttcatattga

SEQ ID NO: 552295 - DNA, 20 bp, Artificial Sequence
  chemically synthesized
gtagtaaatgaatcaatttt

SEQ ID NO: 552296 - DNA, 20 bp, Artificial Sequence
  chemically synthesized
gtgaattagaagatactaat

SEQ ID NO: 552297 - DNA, 20 bp, Artificial Sequence
  chemically synthesized
acaataagagttcctaaaga

SEQ ID NO: 552298 - DNA, 20 bp, Artificial Sequence
  chemically synthesized
gacaaagggcaaggtttatc

SEQ ID NO: 552299 - DNA, 20 bp, Artificial Sequence
  chemically synthesized
ggtttatctaagaaagtttt

SEQ ID NO: 552300 - DNA, 20 bp, Artificial Sequence
  chemically synthesized
aacagaacaaaaaaagatgc

SEQ ID NO: 552301 - DNA, 20 bp, Artificial Sequence
  chemically synthesized
aggtgacactacaggtgaat

SEQ ID NO: 552302 - DNA, 20 bp, Artificial Sequence
  chemically synthesized
agggaaaaactgtaatacct

SEQ ID NO: 552303 - DNA, 20 bp, Artificial Sequence
  chemically synthesized
cctaaagaattacatgaaaa

SEQ ID NO: 552304 - DNA, 20 bp, Artificial Sequence
  chemically synthesized
aagtgtcaatatctagttga

SEQ ID NO: 552305 - DNA, 20 bp, Artificial Sequence
  chemically synthesized
acattttgccgtacttgatt

SEQ ID NO: 552306 - DNA, 20 bp, Artificial Sequence
  chemically synthesized
tcaaaatagctcaatttaaa

SEQ ID NO: 552307 - DNA, 20 bp, Artificial Sequence
  chemically synthesized
ttaaatatataggatctata

SEQ ID NO: 552308 - DNA, 20 bp, Artificial Sequence
  chemically synthesized
aaaaatatatatatatatat

SEQ ID NO: 552309 - DNA, 20 bp, Artificial Sequence
  chemically synthesized
aaactcaaaatccatataac

SEQ ID NO: 552310 - DNA, 20 bp, Artificial Sequence
  chemically synthesized
aaaattccatagctcaaaac

SEQ ID NO: 552311 - DNA, 20 bp, Artificial Sequence
  chemically synthesized
taaaaagaataaacccatag

SEQ ID NO: 552312 - DNA, 20 bp, Artificial Sequence
  chemically synthesized
cttttaaaaagaataaaccc

SEQ ID NO: 552313 - DNA, 20 bp, Artificial Sequence
  chemically synthesized
ctaaatagcactacttttaa

SEQ ID NO: 552314 - DNA, 20 bp, Artificial Sequence
  chemically synthesized
gatgaatatgacaccaagtg

SEQ ID NO: 552315 - DNA, 20 bp, Artificial Sequence
  chemically synthesized
taatttataccctgaaataa

SEQ ID NO: 552316 - DNA, 20 bp, Artificial Sequence
  chemically synthesized
tgtgcaatttgttgaacaaa

SEQ ID NO: 552317 - DNA, 20 bp, Artificial Sequence
  chemically synthesized
aggcaatcaacacagttaat

SEQ ID NO: 552318 - DNA, 20 bp, Artificial Sequence
  chemically synthesized
gactcgacagtgcatttatt

SEQ ID NO: 552319 - DNA, 20 bp, Artificial Sequence
  chemically synthesized
ccagataataattctaaaaa

SEQ ID NO: 552320 - DNA, 20 bp, Artificial Sequence
  chemically synthesized
ttatttttggtttcttgttt

SEQ ID NO: 552321 - DNA, 20 bp, Artificial Sequence
  chemically synthesized
agtaggtgacgaagatggtg

SEQ ID NO: 552322 - DNA, 20 bp, Artificial Sequence
  chemically synthesized
tagggtggtgtgtcataaga

SEQ ID NO: 552323 - DNA, 20 bp, Artificial Sequence
  chemically synthesized
tttaggcggtaaaaactgaa

SEQ ID NO: 552324 - DNA, 20 bp, Artificial Sequence
  chemically synthesized
ggtcctagtttaccctagga

SEQ ID NO: 552325 - DNA, 20 bp, Artificial Sequence
  chemically synthesized
acaaaataaagtcagttgga

SEQ ID NO: 552326 - DNA, 20 bp, Artificial Sequence
  chemically synthesized
gtctccactcttctttcccc

SEQ ID NO: 552327 - DNA, 20 bp, Artificial Sequence
  chemically synthesized
tcctccagattcataacgaa

SEQ ID NO: 552328 - DNA, 20 bp, Artificial Sequence
  chemically synthesized
ggcattcataatcaattttc

SEQ ID NO: 552329 - DNA, 20 bp, Artificial Sequence
  chemically synthesized
ccacaacctactatgactgt

SEQ ID NO: 552330 - DNA, 20 bp, Artificial Sequence
  chemically synthesized
tctgtgccaggataacaagc

SEQ ID NO: 552331 - DNA, 20 bp, Artificial Sequence
  chemically synthesized
tctgagcttgttatcctggc

SEQ ID NO: 552332 - DNA, 20 bp, Artificial Sequence
  chemically synthesized
aaggagtaaggaaaaattat

SEQ ID NO: 552333 - DNA, 20 bp, Artificial Sequence
  chemically synthesized
aaggaaaaattatgcagaaa

SEQ ID NO: 552334 - DNA, 20 bp, Artificial Sequence
  chemically synthesized
gtcagtaatatttcaagtga

SEQ ID NO: 552335 - DNA, 20 bp, Artificial Sequence
  chemically synthesized
agtcaggatctaggcaaaat

SEQ ID NO: 552336 - DNA, 20 bp, Artificial Sequence
  chemically synthesized
agggctcttgttggaaacct

SEQ ID NO: 552337 - DNA, 20 bp, Artificial Sequence
  chemically synthesized
aatttatttgtataaactgc

SEQ ID NO: 552338 - DNA, 20 bp, Artificial Sequence
  chemically synthesized
acatgggccaagactgaatc

SEQ ID NO: 552339 - DNA, 20 bp, Artificial Sequence
  chemically synthesized
ttggcccatgtaaatctgtg

SEQ ID NO: 552340 - DNA, 20 bp, Artificial Sequence
  chemically synthesized
agtcctaagagtccatatta

SEQ ID NO: 552341 - DNA, 20 bp, Artificial Sequence
  chemically synthesized
ctgatgtgtctgactattcc

SEQ ID NO: 552342 - DNA, 20 bp, Artificial Sequence
  chemically synthesized
acaccgaagccccactatgt

SEQ ID NO: 552343 - DNA, 20 bp, Artificial Sequence
  chemically synthesized
ggccaaggctgatttaataa

SEQ ID NO: 552344 - DNA, 20 bp, Artificial Sequence
  chemically synthesized
tgaagcaaactttcctcttt

SEQ ID NO: 552345 - DNA, 20 bp, Artificial Sequence
  chemically synthesized
acaaggctggcaataaaaag

SEQ ID NO: 552346 - DNA, 20 bp, Artificial Sequence
  chemically synthesized
tcaaccccattatgttctct

SEQ ID NO: 552347 - DNA, 20 bp, Artificial Sequence
  chemically synthesized
tatgttctctatagaaaacc

SEQ ID NO: 552348 - DNA, 20 bp, Artificial Sequence
  chemically synthesized
tatgatgtttgcaggtttta

SEQ ID NO: 552349 - DNA, 20 bp, Artificial Sequence
  chemically synthesized
agccacccatactttttatt

SEQ ID NO: 552350 - DNA, 20 bp, Artificial Sequence
  chemically synthesized
acttaaatatttttaattgc

SEQ ID NO: 552351 - DNA, 20 bp, Artificial Sequence
  chemically synthesized
ctcatcaagtaaaaagtaga

SEQ ID NO: 552352 - DNA, 20 bp, Artificial Sequence
  chemically synthesized
aaacaagacgctaagcatag

SEQ ID NO: 552353 - DNA, 20 bp, Artificial Sequence
  chemically synthesized
agaaagtgtcctattttaat

SEQ ID NO: 552354 - DNA, 20 bp, Artificial Sequence
  chemically synthesized
ctagccacagcaattaggca

SEQ ID NO: 552355 - DNA, 20 bp, Artificial Sequence
  chemically synthesized
ccacagcaattaggcaagag

SEQ ID NO: 552356 - DNA, 20 bp, Artificial Sequence
  chemically synthesized
aagaaataaaatgcatccaa

SEQ ID NO: 552357 - DNA, 20 bp, Artificial Sequence
  chemically synthesized
ctgacggtatgattctatac

SEQ ID NO: 552358 - DNA, 20 bp, Artificial Sequence
  chemically synthesized
agtctttgggttttctaagt

SEQ ID NO: 552359 - DNA, 20 bp, Artificial Sequence
  chemically synthesized
agcttggtcattattgttgt

SEQ ID NO: 552360 - DNA, 20 bp, Artificial Sequence
  chemically synthesized
caatcccatttacaatagcc

SEQ ID NO: 552361 - DNA, 20 bp, Artificial Sequence
  chemically synthesized
agtattaaaaaacattgttg

SEQ ID NO: 552362 - DNA, 20 bp, Artificial Sequence
  chemically synthesized
aaagcattccatgctcattg

SEQ ID NO: 552363 - DNA, 20 bp, Artificial Sequence
  chemically synthesized
aactaccaaggtcattcctc

SEQ ID NO: 552364 - DNA, 20 bp, Artificial Sequence
  chemically synthesized
caaggtcattcctcacagaa

SEQ ID NO: 552365 - DNA, 20 bp, Artificial Sequence
  chemically synthesized
tttttggttgcatatgaatt

SEQ ID NO: 552366 - DNA, 20 bp, Artificial Sequence
  chemically synthesized
caatacagcataatattggt

SEQ ID NO: 552367 - DNA, 20 bp, Artificial Sequence
  chemically synthesized
cagacatatagaccaatgga

SEQ ID NO: 552368 - DNA, 20 bp, Artificial Sequence
  chemically synthesized
atatagaccaatggaacaga

SEQ ID NO: 552369 - DNA, 20 bp, Artificial Sequence
  chemically synthesized
aatggaacagaatagaaaac

SEQ ID NO: 552370 - DNA, 20 bp, Artificial Sequence
  chemically synthesized
tcactggctagccatatgca

SEQ ID NO: 552371 - DNA, 20 bp, Artificial Sequence
  chemically synthesized
aagacctaaaactacaaatc

SEQ ID NO: 552372 - DNA, 20 bp, Artificial Sequence
  chemically synthesized
aggcactgcgcccggccggc

SEQ ID NO: 552373 - DNA, 20 bp, Artificial Sequence
  chemically synthesized
taaagagcttctgcacagcc

SEQ ID NO: 552374 - DNA, 20 bp, Artificial Sequence
  chemically synthesized
acaaagtaaacagataatct

SEQ ID NO: 552375 - DNA, 20 bp, Artificial Sequence
  chemically synthesized
aacagataatctacagaatg

SEQ ID NO: 552376 - DNA, 20 bp, Artificial Sequence
  chemically synthesized
caagcgaccaacaaacatac

SEQ ID NO: 552377 - DNA, 20 bp, Artificial Sequence
  chemically synthesized
gctcatcatcattaatcatc

SEQ ID NO: 552378 - DNA, 20 bp, Artificial Sequence
  chemically synthesized
gagataccatctcacaccaa

SEQ ID NO: 552379 - DNA, 20 bp, Artificial Sequence
  chemically synthesized
aatggctattatttaaaagt

SEQ ID NO: 552380 - DNA, 20 bp, Artificial Sequence
  chemically synthesized
ctgctagggaggctgcagca

SEQ ID NO: 552381 - DNA, 20 bp, Artificial Sequence
  chemically synthesized
tagatctgttttaagttctg

SEQ ID NO: 552382 - DNA, 20 bp, Artificial Sequence
  chemically synthesized
tcatcaatggttgactggat

SEQ ID NO: 552383 - DNA, 20 bp, Artificial Sequence
  chemically synthesized
ttaagcgaagtaatgcaaga

SEQ ID NO: 552384 - DNA, 20 bp, Artificial Sequence
  chemically synthesized
aaataaaagtgtcctacttt

SEQ ID NO: 552385 - DNA, 20 bp, Artificial Sequence
  chemically synthesized
tactttactgcattttatga

SEQ ID NO: 552386 - DNA, 20 bp, Artificial Sequence
  chemically synthesized
tgtgttgatcagggtagagt

SEQ ID NO: 552387 - DNA, 20 bp, Artificial Sequence
  chemically synthesized
catcaatgggtattcaagga

SEQ ID NO: 552388 - DNA, 20 bp, Artificial Sequence
  chemically synthesized
tgtataagggttgaaaacat

SEQ ID NO: 552389 - DNA, 20 bp, Artificial Sequence
  chemically synthesized
aggaaaaaaaaaaatcagac

SEQ ID NO: 552390 - DNA, 20 bp, Artificial Sequence
  chemically synthesized
accctaaaaatcaccagggc

SEQ ID NO: 552391 - DNA, 20 bp, Artificial Sequence
  chemically synthesized
gcctcagcttagacacttga

SEQ ID NO: 552392 - DNA, 20 bp, Artificial Sequence
  chemically synthesized
ttatggtcaataattggtct

SEQ ID NO: 552393 - DNA, 20 bp, Artificial Sequence
  chemically synthesized
tgaataaactattaattttt

SEQ ID NO: 552394 - DNA, 20 bp, Artificial Sequence
  chemically synthesized
tattatcaacagctgtggct

SEQ ID NO: 552395 - DNA, 20 bp, Artificial Sequence
  chemically synthesized
attgctaattttaagatctt

SEQ ID NO: 552396 - DNA, 20 bp, Artificial Sequence
  chemically synthesized
ttggaactgtaacttagcaa

SEQ ID NO: 552397 - DNA, 20 bp, Artificial Sequence
  chemically synthesized
atgatacttttattatttaa

SEQ ID NO: 552398 - DNA, 20 bp, Artificial Sequence
  chemically synthesized
caattatctatctgtctatc

SEQ ID NO: 552399 - DNA, 20 bp, Artificial Sequence
  chemically synthesized
ctacttgggaggctgaggca

SEQ ID NO: 552400 - DNA, 20 bp, Artificial Sequence
  chemically synthesized
aaaaaaaaaaaaaccaaaaa

SEQ ID NO: 552401 - DNA, 20 bp, Artificial Sequence
  chemically synthesized
ctactagggaggctgaggca

SEQ ID NO: 552402 - DNA, 20 bp, Artificial Sequence
  chemically synthesized
cttatatgcatatacatgag

SEQ ID NO: 552403 - DNA, 20 bp, Artificial Sequence
  chemically synthesized
cagagaggaaatgtatttat

SEQ ID NO: 552404 - DNA, 20 bp, Artificial Sequence
  chemically synthesized
aaagaacaaaaaggacgaaa

SEQ ID NO: 552405 - DNA, 20 bp, Artificial Sequence
  chemically synthesized
acgaaagaagaataaagcag

SEQ ID NO: 552406 - DNA, 20 bp, Artificial Sequence
  chemically synthesized
agaaagactttagctctatc

SEQ ID NO: 552407 - DNA, 20 bp, Artificial Sequence
  chemically synthesized
gtggtttcaaccatgactct

SEQ ID NO: 552408 - DNA, 20 bp, Artificial Sequence
  chemically synthesized
aaaaaaaaaacacacacaca

SEQ ID NO: 552409 - DNA, 20 bp, Artificial Sequence
  chemically synthesized
tatctccacattgttctggg

SEQ ID NO: 552410 - DNA, 20 bp, Artificial Sequence
  chemically synthesized
ggtaaaaatagtgaataaaa

SEQ ID NO: 552411 - DNA, 20 bp, Artificial Sequence
  chemically synthesized
agtgaataaaaagagaaaga

SEQ ID NO: 552412 - DNA, 20 bp, Artificial Sequence
  chemically synthesized
aaaaagaagcatttaccatg

SEQ ID NO: 552413 - DNA, 20 bp, Artificial Sequence
  chemically synthesized
gaaaaaggacaacattgctt

SEQ ID NO: 552414 - DNA, 20 bp, Artificial Sequence
  chemically synthesized
atgtgcatacatataaacat

SEQ ID NO: 552415 - DNA, 20 bp, Artificial Sequence
  chemically synthesized
atgatatcccttactgccac

SEQ ID NO: 552416 - DNA, 20 bp, Artificial Sequence
  chemically synthesized
aaatataaaaagtcaaactt

SEQ ID NO: 552417 - DNA, 20 bp, Artificial Sequence
  chemically synthesized
cttcaacaaaagcaatataa

SEQ ID NO: 552418 - DNA, 20 bp, Artificial Sequence
  chemically synthesized
cctggcactggtgctaagat

SEQ ID NO: 552419 - DNA, 20 bp, Artificial Sequence
  chemically synthesized
cacatttcccagcatacata

SEQ ID NO: 552420 - DNA, 20 bp, Artificial Sequence
  chemically synthesized
aaagatattaaagagtatgt

SEQ ID NO: 552421 - DNA, 20 bp, Artificial Sequence
  chemically synthesized
gtagtttgatggtaaatcct

SEQ ID NO: 552422 - DNA, 20 bp, Artificial Sequence
  chemically synthesized
gtgtttaagaaatatgaaca

SEQ ID NO: 552423 - DNA, 20 bp, Artificial Sequence
  chemically synthesized
taatgaagaaaatatgtgtt

SEQ ID NO: 552424 - DNA, 20 bp, Artificial Sequence
  chemically synthesized
tgtaatacataaagtataat

SEQ ID NO: 552425 - DNA, 20 bp, Artificial Sequence
  chemically synthesized
aaggtctaagctgaaaatat

SEQ ID NO: 552426 - DNA, 20 bp, Artificial Sequence
  chemically synthesized
aatatttagaaaattcatgt

SEQ ID NO: 552427 - DNA, 20 bp, Artificial Sequence
  chemically synthesized
aaaattcatgttgagaatat

SEQ ID NO: 552428 - DNA, 20 bp, Artificial Sequence
  chemically synthesized
ggtcagagtcttagtctgaa

SEQ ID NO: 552429 - DNA, 20 bp, Artificial Sequence
  chemically synthesized
gcatgcatgtaaggcacatg

SEQ ID NO: 552430 - DNA, 20 bp, Artificial Sequence
  chemically synthesized
tttgtgagcaaaggaagaag

SEQ ID NO: 552431 - DNA, 20 bp, Artificial Sequence
  chemically synthesized
tctataggataaggtggagt

SEQ ID NO: 552432 - DNA, 20 bp, Artificial Sequence
  chemically synthesized
ccctaattttcatctccctg

SEQ ID NO: 552433 - DNA, 20 bp, Artificial Sequence
  chemically synthesized
tctgttgtttgagtctctca

SEQ ID NO: 552434 - DNA, 20 bp, Artificial Sequence
  chemically synthesized
tccaggaagatttgagggcc

SEQ ID NO: 552435 - DNA, 20 bp, Artificial Sequence
  chemically synthesized
acctgtggtgagtcaaggct

SEQ ID NO: 552436 - DNA, 20 bp, Artificial Sequence
  chemically synthesized
gataggagactgccctttgc

SEQ ID NO: 552437 - DNA, 20 bp, Artificial Sequence
  chemically synthesized
tgtattcttttgaatgaata

SEQ ID NO: 552438 - DNA, 20 bp, Artificial Sequence
  chemically synthesized
gtcattcttatattcattca

SEQ ID NO: 552439 - DNA, 20 bp, Artificial Sequence
  chemically synthesized
tggagagtcacacatgggaa

SEQ ID NO: 552440 - DNA, 20 bp, Artificial Sequence
  chemically synthesized
ttttctgcccatttttcaga

SEQ ID NO: 552441 - DNA, 20 bp, Artificial Sequence
  chemically synthesized
ttttctcatctgaaaaatgg

SEQ ID NO: 552442 - DNA, 20 bp, Artificial Sequence
  chemically synthesized
aatgtgggattttgtgagga

SEQ ID NO: 552443 - DNA, 20 bp, Artificial Sequence
  chemically synthesized
tacgctatatacttttttaa

SEQ ID NO: 552444 - DNA, 20 bp, Artificial Sequence
  chemically synthesized
atggtatgtctcagcttgtc

SEQ ID NO: 552445 - DNA, 20 bp, Artificial Sequence
  chemically synthesized
tgctatttaggaagtgttcc

SEQ ID NO: 552446 - DNA, 20 bp, Artificial Sequence
  chemically synthesized
agagactgagtgttaacatc

SEQ ID NO: 552447 - DNA, 20 bp, Artificial Sequence
  chemically synthesized
catatacatatcatttgcac

SEQ ID NO: 552448 - DNA, 20 bp, Artificial Sequence
  chemically synthesized
atgtgattttaatgaacttc

SEQ ID NO: 552449 - DNA, 20 bp, Artificial Sequence
  chemically synthesized
accgaatcagagaaaacttg

SEQ ID NO: 552450 - DNA, 20 bp, Artificial Sequence
  chemically synthesized
caaatggcatttaccgaatc

SEQ ID NO: 552451 - DNA, 20 bp, Artificial Sequence
  chemically synthesized
aaacttggaaggacctgatc

SEQ ID NO: 552452 - DNA, 20 bp, Artificial Sequence
  chemically synthesized
cttctcaccattgtaatata

SEQ ID NO: 552453 - DNA, 20 bp, Artificial Sequence
  chemically synthesized
agaagccctaattagcaaag

SEQ ID NO: 552454 - DNA, 20 bp, Artificial Sequence
  chemically synthesized
tcaactaaatttaaaacaag

SEQ ID NO: 552455 - DNA, 20 bp, Artificial Sequence
  chemically synthesized
gaatttaattggggagctct

SEQ ID NO: 552456 - DNA, 20 bp, Artificial Sequence
  chemically synthesized
atactggtattgtaagtaaa

SEQ ID NO: 552457 - DNA, 20 bp, Artificial Sequence
  chemically synthesized
attacatatttttgacaaag

SEQ ID NO: 552458 - DNA, 20 bp, Artificial Sequence
  chemically synthesized
gtagattacatatttttgac

SEQ ID NO: 552459 - DNA, 20 bp, Artificial Sequence
  chemically synthesized
cttgtagtttatcaaattaa

SEQ ID NO: 552460 - DNA, 20 bp, Artificial Sequence
  chemically synthesized
aaaactgcggtataatatca

SEQ ID NO: 552461 - DNA, 20 bp, Artificial Sequence
  chemically synthesized
ggtcacccaaatccttagag

SEQ ID NO: 552462 - DNA, 20 bp, Artificial Sequence
  chemically synthesized
ggagtcataaacacgttgtg

SEQ ID NO: 552463 - DNA, 20 bp, Artificial Sequence
  chemically synthesized
aggctggatccatagatata

SEQ ID NO: 552464 - DNA, 20 bp, Artificial Sequence
  chemically synthesized
tttgccataataatgttact

SEQ ID NO: 552465 - DNA, 20 bp, Artificial Sequence
  chemically synthesized
gtgcctgtagtcccagctat

SEQ ID NO: 552466 - DNA, 20 bp, Artificial Sequence
  chemically synthesized
ctaagcgaattaacacagaa

SEQ ID NO: 552467 - DNA, 20 bp, Artificial Sequence
  chemically synthesized
attatcctaagcgaattaac

SEQ ID NO: 552468 - DNA, 20 bp, Artificial Sequence
  chemically synthesized
aatcctatgcagcaataaaa

SEQ ID NO: 552469 - DNA, 20 bp, Artificial Sequence
  chemically synthesized
cccacaatggttgattggct

SEQ ID NO: 552470 - DNA, 20 bp, Artificial Sequence
  chemically synthesized
cccagtgcatatgatttttg

SEQ ID NO: 552471 - DNA, 20 bp, Artificial Sequence
  chemically synthesized
agtccttacttttagttctt

SEQ ID NO: 552472 - DNA, 20 bp, Artificial Sequence
  chemically synthesized
tgataaagggtgtaattcaa

SEQ ID NO: 552473 - DNA, 20 bp, Artificial Sequence
  chemically synthesized
gtgttagaccgatcactgag

SEQ ID NO: 552474 - DNA, 20 bp, Artificial Sequence
  chemically synthesized
cactgaggcagaaaactaac

SEQ ID NO: 552475 - DNA, 20 bp, Artificial Sequence
  chemically synthesized
ggtcaagagtcaaatttaat

SEQ ID NO: 552476 - DNA, 20 bp, Artificial Sequence
  chemically synthesized
atactactttacccaaaacc

SEQ ID NO: 552477 - DNA, 20 bp, Artificial Sequence
  chemically synthesized
tacattctgtgtgcagatga

SEQ ID NO: 552478 - DNA, 20 bp, Artificial Sequence
  chemically synthesized
tacattcttctcatctgcac

SEQ ID NO: 552479 - DNA, 20 bp, Artificial Sequence
  chemically synthesized
atttttattccactgtggtc

SEQ ID NO: 552480 - DNA, 20 bp, Artificial Sequence
  chemically synthesized
tggaccacagtggaataaaa

SEQ ID NO: 552481 - DNA, 20 bp, Artificial Sequence
  chemically synthesized
aaatgaaaacttgttttcat

SEQ ID NO: 552482 - DNA, 20 bp, Artificial Sequence
  chemically synthesized
aaaacaagttttcatttttt

SEQ ID NO: 552483 - DNA, 20 bp, Artificial Sequence
  chemically synthesized
ccagatgctggcaaggaagc

SEQ ID NO: 552484 - DNA, 20 bp, Artificial Sequence
  chemically synthesized
agtagtcaaaatggctaaaa

SEQ ID NO: 552485 - DNA, 20 bp, Artificial Sequence
  chemically synthesized
tcaacattttaaaaatccaa

SEQ ID NO: 552486 - DNA, 20 bp, Artificial Sequence
  chemically synthesized
gaaatacgagctacagactg

SEQ ID NO: 552487 - DNA, 20 bp, Artificial Sequence
  chemically synthesized
ataccactgcactctcaaaa

SEQ ID NO: 552488 - DNA, 20 bp, Artificial Sequence
  chemically synthesized
ctacttgggaagctgaggca

SEQ ID NO: 552489 - DNA, 20 bp, Artificial Sequence
  chemically synthesized
cccggttatatttcttctta

SEQ ID NO: 552490 - DNA, 20 bp, Artificial Sequence
  chemically synthesized
tatgcaaaatattctgttaa

SEQ ID NO: 552491 - DNA, 20 bp, Artificial Sequence
  chemically synthesized
agtgaaacagaatagagagc

SEQ ID NO: 552492 - DNA, 20 bp, Artificial Sequence
  chemically synthesized
cagactcatatatcagtgaa

SEQ ID NO: 552493 - DNA, 20 bp, Artificial Sequence
  chemically synthesized
caccaccagtatcagactgt

SEQ ID NO: 552494 - DNA, 20 bp, Artificial Sequence
  chemically synthesized
tgaataaggaaaaattaatt

SEQ ID NO: 552495 - DNA, 20 bp, Artificial Sequence
  chemically synthesized
ataaaaattatataggatgt

SEQ ID NO: 552496 - DNA, 20 bp, Artificial Sequence
  chemically synthesized
aaacattgctaaaattttcg

SEQ ID NO: 552497 - DNA, 20 bp, Artificial Sequence
  chemically synthesized
ttaaaaatagatcaacttag

SEQ ID NO: 552498 - DNA, 20 bp, Artificial Sequence
  chemically synthesized
ataaaactaacaaaacatgc

SEQ ID NO: 552499 - DNA, 20 bp, Artificial Sequence
  chemically synthesized
gtaagagtttcattttcttt

SEQ ID NO: 552500 - DNA, 20 bp, Artificial Sequence
  chemically synthesized
atagcatttatgatttctgc

SEQ ID NO: 552501 - DNA, 20 bp, Artificial Sequence
  chemically synthesized
tagatgttgaaattatctga

SEQ ID NO: 552502 - DNA, 20 bp, Artificial Sequence
  chemically synthesized
acaaacaaacaaaactagaa

SEQ ID NO: 552503 - DNA, 20 bp, Artificial Sequence
  chemically synthesized
accaaaacaaacaaacaaaa

SEQ ID NO: 552504 - DNA, 20 bp, Artificial Sequence
  chemically synthesized
acattttgtccattatatat

SEQ ID NO: 552505 - DNA, 20 bp, Artificial Sequence
  chemically synthesized
tgggaccacagcccataaaa

SEQ ID NO: 552506 - DNA, 20 bp, Artificial Sequence
  chemically synthesized
ccaagcaggcctcaataaca

SEQ ID NO: 552507 - DNA, 20 bp, Artificial Sequence
  chemically synthesized
ggggaactccttctgcccac

SEQ ID NO: 552508 - DNA, 20 bp, Artificial Sequence
  chemically synthesized
cacttttatctctatagatc

SEQ ID NO: 552509 - DNA, 20 bp, Artificial Sequence
  chemically synthesized
tcctagataggattattgtg

SEQ ID NO: 552510 - DNA, 20 bp, Artificial Sequence
  chemically synthesized
cccgttggacgctatggcca

SEQ ID NO: 552511 - DNA, 20 bp, Artificial Sequence
  chemically synthesized
atcataataagtgacctggt

SEQ ID NO: 552512 - DNA, 20 bp, Artificial Sequence
  chemically synthesized
gaagacatcgaggtggaaag

SEQ ID NO: 552513 - DNA, 20 bp, Artificial Sequence
  chemically synthesized
cctcaagaacaaaatcccat

SEQ ID NO: 552514 - DNA, 20 bp, Artificial Sequence
  chemically synthesized
ctgttggataggggcacata

SEQ ID NO: 552515 - DNA, 20 bp, Artificial Sequence
  chemically synthesized
gaaaattgtaaaggatagtc

SEQ ID NO: 552516 - DNA, 20 bp, Artificial Sequence
  chemically synthesized
aacaaaacaagaggccatca

SEQ ID NO: 552517 - DNA, 20 bp, Artificial Sequence
  chemically synthesized
gtgaagaagaacaataaaac

SEQ ID NO: 552518 - DNA, 20 bp, Artificial Sequence
  chemically synthesized
aaaacatattaaaacaagac

SEQ ID NO: 552519 - DNA, 20 bp, Artificial Sequence
  chemically synthesized
aaaatgtgcacaacttttaa

SEQ ID NO: 552520 - DNA, 20 bp, Artificial Sequence
  chemically synthesized
gcactcgggaggctgaggca

SEQ ID NO: 552521 - DNA, 20 bp, Artificial Sequence
  chemically synthesized
aaagagcaaaatttggtctc

SEQ ID NO: 552522 - DNA, 20 bp, Artificial Sequence
  chemically synthesized
tcaactataccaagtgatga

SEQ ID NO: 552523 - DNA, 20 bp, Artificial Sequence
  chemically synthesized
caataaaaatatctcaattt

SEQ ID NO: 552524 - DNA, 20 bp, Artificial Sequence
  chemically synthesized
ctactcaggaggctgaggca

SEQ ID NO: 552525 - DNA, 20 bp, Artificial Sequence
  chemically synthesized
tgcactccagcctgggcgac

SEQ ID NO: 552526 - DNA, 20 bp, Artificial Sequence
  chemically synthesized
tgatcttggctaaaacatct

SEQ ID NO: 552527 - DNA, 20 bp, Artificial Sequence
  chemically synthesized
tgttaaaaaacactaattgt

SEQ ID NO: 552528 - DNA, 20 bp, Artificial Sequence
  chemically synthesized
tttatcttgtgtttaatgaa

SEQ ID NO: 552529 - DNA, 20 bp, Artificial Sequence
  chemically synthesized
tgtaagccatgataaaaagc

SEQ ID NO: 552530 - DNA, 20 bp, Artificial Sequence
  chemically synthesized
cttttgaattttgaattgag

SEQ ID NO: 552531 - DNA, 20 bp, Artificial Sequence
  chemically synthesized
ctatctcaattcaaaattca

SEQ ID NO: 552532 - DNA, 20 bp, Artificial Sequence
  chemically synthesized
taaaaatgtactttgtaagt

SEQ ID NO: 552533 - DNA, 20 bp, Artificial Sequence
  chemically synthesized
ttacaaagtacatttttaaa

SEQ ID NO: 552534 - DNA, 20 bp, Artificial Sequence
  chemically synthesized
tgatttaaatagagagataa

SEQ ID NO: 552535 - DNA, 20 bp, Artificial Sequence
  chemically synthesized
tcataattcaaagtaacatg

SEQ ID NO: 552536 - DNA, 20 bp, Artificial Sequence
  chemically synthesized
aattcaaagtaacatgatag

SEQ ID NO: 552537 - DNA, 20 bp, Artificial Sequence
  chemically synthesized
ggaggatcaaataatataac

SEQ ID NO: 552538 - DNA, 20 bp, Artificial Sequence
  chemically synthesized
gttccacattattttgacag

SEQ ID NO: 552539 - DNA, 20 bp, Artificial Sequence
  chemically synthesized
tcttgttccacattattttg

SEQ ID NO: 552540 - DNA, 20 bp, Artificial Sequence
  chemically synthesized
tctgtcaaaataatgtggaa

SEQ ID NO: 552541 - DNA, 20 bp, Artificial Sequence
  chemically synthesized
ggtgatagtcgccagagaag

SEQ ID NO: 552542 - DNA, 20 bp, Artificial Sequence
  chemically synthesized
tttacctgagactcataaaa

SEQ ID NO: 552543 - DNA, 20 bp, Artificial Sequence
  chemically synthesized
tctccatagtggtatgctac

SEQ ID NO: 552544 - DNA, 20 bp, Artificial Sequence
  chemically synthesized
gattatctactggtagaacc

SEQ ID NO: 552545 - DNA, 20 bp, Artificial Sequence
  chemically synthesized
gtttgggtttctgtttcttg

SEQ ID NO: 552546 - DNA, 20 bp, Artificial Sequence
  chemically synthesized
gtctttctttcttgcaagaa

SEQ ID NO: 552547 - DNA, 20 bp, Artificial Sequence
  chemically synthesized
gggtttctgtttcttgcaag

SEQ ID NO: 552548 - DNA, 20 bp, Artificial Sequence
  chemically synthesized
aataatgtctttctttcttg

SEQ ID NO: 552549 - DNA, 20 bp, Artificial Sequence
  chemically synthesized
taaaaatcaggtatattcta

SEQ ID NO: 552550 - DNA, 20 bp, Artificial Sequence
  chemically synthesized
aagtagtctcatcttttctt

SEQ ID NO: 552551 - DNA, 20 bp, Artificial Sequence
  chemically synthesized
aaaattctagatatataaaa

SEQ ID NO: 552552 - DNA, 20 bp, Artificial Sequence
  chemically synthesized
aaaattcttgttttatatat

SEQ ID NO: 552553 - DNA, 20 bp, Artificial Sequence
  chemically synthesized
tcaacttatttattttcttt

SEQ ID NO: 552554 - DNA, 20 bp, Artificial Sequence
  chemically synthesized
ctctaattttacctttctca

SEQ ID NO: 552555 - DNA, 20 bp, Artificial Sequence
  chemically synthesized
ttgtgcataatctaattata

SEQ ID NO: 552556 - DNA, 20 bp, Artificial Sequence
  chemically synthesized
ttgagctaatgagctatcca

SEQ ID NO: 552557 - DNA, 20 bp, Artificial Sequence
  chemically synthesized
tatttgatttgtttctccca

SEQ ID NO: 552558 - DNA, 20 bp, Artificial Sequence
  chemically synthesized
cttccactcatattctactg

SEQ ID NO: 552559 - DNA, 20 bp, Artificial Sequence
  chemically synthesized
gcatacatccatagaatggg

SEQ ID NO: 552560 - DNA, 20 bp, Artificial Sequence
  chemically synthesized
agagtcatctgcatacatcc

SEQ ID NO: 552561 - DNA, 20 bp, Artificial Sequence
  chemically synthesized
tgctatgctagctagcatta

SEQ ID NO: 552562 - DNA, 20 bp, Artificial Sequence
  chemically synthesized
tttgcattgtaggatgtttg

SEQ ID NO: 552563 - DNA, 20 bp, Artificial Sequence
  chemically synthesized
ccatactagctgcttaagaa

SEQ ID NO: 552564 - DNA, 20 bp, Artificial Sequence
  chemically synthesized
ctttactttttattgatgtt

SEQ ID NO: 552565 - DNA, 20 bp, Artificial Sequence
  chemically synthesized
gaacggttaaaaagacagga

SEQ ID NO: 552566 - DNA, 20 bp, Artificial Sequence
  chemically synthesized
aggaattgttttggagaagg

SEQ ID NO: 552567 - DNA, 20 bp, Artificial Sequence
  chemically synthesized
ggtagtggcacttatgaagg

SEQ ID NO: 552568 - DNA, 20 bp, Artificial Sequence
  chemically synthesized
ttataatccttaaactaaac

SEQ ID NO: 552569 - DNA, 20 bp, Artificial Sequence
  chemically synthesized
catctatgtgcttccattca

SEQ ID NO: 552570 - DNA, 20 bp, Artificial Sequence
  chemically synthesized
gatattacatcaccacttcg

SEQ ID NO: 552571 - DNA, 20 bp, Artificial Sequence
  chemically synthesized
aatgtgagatctgcctagtt

SEQ ID NO: 552572 - DNA, 20 bp, Artificial Sequence
  chemically synthesized
tctgatgctgtttgcagtga

SEQ ID NO: 552573 - DNA, 20 bp, Artificial Sequence
  chemically synthesized
tacaatggctcttaagcttc

SEQ ID NO: 552574 - DNA, 20 bp, Artificial Sequence
  chemically synthesized
aaggggaagacattcagtac

SEQ ID NO: 552575 - DNA, 20 bp, Artificial Sequence
  chemically synthesized
tcagcgtaaatatcaccttt

SEQ ID NO: 552576 - DNA, 20 bp, Artificial Sequence
  chemically synthesized
aagttagttggcatatgcca

SEQ ID NO: 552577 - DNA, 20 bp, Artificial Sequence
  chemically synthesized
ctatattttgttgttgcaag

SEQ ID NO: 552578 - DNA, 20 bp, Artificial Sequence
  chemically synthesized
taattaaaaaaatcttcatt

SEQ ID NO: 552579 - DNA, 20 bp, Artificial Sequence
  chemically synthesized
taactttgaattgcaagtat

SEQ ID NO: 552580 - DNA, 20 bp, Artificial Sequence
  chemically synthesized
aaaaaaagagcatctagggc

SEQ ID NO: 552581 - DNA, 20 bp, Artificial Sequence
  chemically synthesized
atgctacaataaagatgtaa

SEQ ID NO: 552582 - DNA, 20 bp, Artificial Sequence
  chemically synthesized
caatatttgtttagtttcac

SEQ ID NO: 552583 - DNA, 20 bp, Artificial Sequence
  chemically synthesized
tttaagtgtttgtttgacaa

SEQ ID NO: 552584 - DNA, 20 bp, Artificial Sequence
  chemically synthesized
cttccttgaaacaccaccta

SEQ ID NO: 552585 - DNA, 20 bp, Artificial Sequence
  chemically synthesized
tattatgaattcacctcaac

SEQ ID NO: 552586 - DNA, 20 bp, Artificial Sequence
  chemically synthesized
gtaactataatagataatcc

SEQ ID NO: 552587 - DNA, 20 bp, Artificial Sequence
  chemically synthesized
aacttggatgtttaccattt

SEQ ID NO: 552588 - DNA, 20 bp, Artificial Sequence
  chemically synthesized
ttcaagaatgatttcctgaa

SEQ ID NO: 552589 - DNA, 20 bp, Artificial Sequence
  chemically synthesized
aatgatttcctgaaaaagaa

SEQ ID NO: 552590 - DNA, 20 bp, Artificial Sequence
  chemically synthesized
ttcaaagtcagccattttct

SEQ ID NO: 552591 - DNA, 20 bp, Artificial Sequence
  chemically synthesized
tttaaataattgctcattct

SEQ ID NO: 552592 - DNA, 20 bp, Artificial Sequence
  chemically synthesized
gtggacttgttcagtaagca

SEQ ID NO: 552593 - DNA, 20 bp, Artificial Sequence
  chemically synthesized
catgacatgaataaaaaaca

SEQ ID NO: 552594 - DNA, 20 bp, Artificial Sequence
  chemically synthesized
agtagttccatttaccaagg

SEQ ID NO: 552595 - DNA, 20 bp, Artificial Sequence
  chemically synthesized
attaaatgaaggtgaggaag

SEQ ID NO: 552596 - DNA, 20 bp, Artificial Sequence
  chemically synthesized
tttaaaaacactttttagtg

SEQ ID NO: 552597 - DNA, 20 bp, Artificial Sequence
  chemically synthesized
taagtgtaatatgattttga

SEQ ID NO: 552598 - DNA, 20 bp, Artificial Sequence
  chemically synthesized
tatttttttggttataaaat

SEQ ID NO: 552599 - DNA, 20 bp, Artificial Sequence
  chemically synthesized
ggaactaaagtcaagcacag

SEQ ID NO: 552600 - DNA, 20 bp, Artificial Sequence
  chemically synthesized
atacatgcatgctatacaag

SEQ ID NO: 552601 - DNA, 20 bp, Artificial Sequence
  chemically synthesized
catggtcacaaaataagctg

SEQ ID NO: 552602 - DNA, 20 bp, Artificial Sequence
  chemically synthesized
tgtatttttaagctaggagg

SEQ ID NO: 552603 - DNA, 20 bp, Artificial Sequence
  chemically synthesized
acccctccttcatccttaaa

SEQ ID NO: 552604 - DNA, 20 bp, Artificial Sequence
  chemically synthesized
ggtgggaaatacatatatgt

SEQ ID NO: 552605 - DNA, 20 bp, Artificial Sequence
  chemically synthesized
aattatgagacacaacaaaa

SEQ ID NO: 552606 - DNA, 20 bp, Artificial Sequence
  chemically synthesized
ctacgattatctcaatagat

SEQ ID NO: 552607 - DNA, 20 bp, Artificial Sequence
  chemically synthesized
ctggccagggcaatcaggca

SEQ ID NO: 552608 - DNA, 20 bp, Artificial Sequence
  chemically synthesized
ccagggcaatcaggcaagag

SEQ ID NO: 552609 - DNA, 20 bp, Artificial Sequence
  chemically synthesized
aaagctacatataaataaaa

SEQ ID NO: 552610 - DNA, 20 bp, Artificial Sequence
  chemically synthesized
ggaaagatgaagacggagac

SEQ ID NO: 552611 - DNA, 20 bp, Artificial Sequence
  chemically synthesized
ttagggtaacatatatcgaa

SEQ ID NO: 552612 - DNA, 20 bp, Artificial Sequence
  chemically synthesized
atataaaagtagaaacatgg

SEQ ID NO: 552613 - DNA, 20 bp, Artificial Sequence
  chemically synthesized
aattgtttcagtatataaaa

SEQ ID NO: 552614 - DNA, 20 bp, Artificial Sequence
  chemically synthesized
cattatctcaagcaaattta

SEQ ID NO: 552615 - DNA, 20 bp, Artificial Sequence
  chemically synthesized
tactcctaagattgatgaaa

SEQ ID NO: 552616 - DNA, 20 bp, Artificial Sequence
  chemically synthesized
tagttttgaggttccaacac

SEQ ID NO: 552617 - DNA, 20 bp, Artificial Sequence
  chemically synthesized
tgaatatcatgttttataaa

SEQ ID NO: 552618 - DNA, 20 bp, Artificial Sequence
  chemically synthesized
gctctcaaatcaaatttgga

SEQ ID NO: 552619 - DNA, 20 bp, Artificial Sequence
  chemically synthesized
ttttttatgtacaattgaat

SEQ ID NO: 552620 - DNA, 20 bp, Artificial Sequence
  chemically synthesized
tacaatgtggtccactgtct

SEQ ID NO: 552621 - DNA, 20 bp, Artificial Sequence
  chemically synthesized
aaatgagaagatatatagat

SEQ ID NO: 552622 - DNA, 20 bp, Artificial Sequence
  chemically synthesized
gatatatagatgaagaaaaa

SEQ ID NO: 552623 - DNA, 20 bp, Artificial Sequence
  chemically synthesized
tatagatgaagaaaaaaaag

SEQ ID NO: 552624 - DNA, 20 bp, Artificial Sequence
  chemically synthesized
caaaaccaaaaatatatact

SEQ ID NO: 552625 - DNA, 20 bp, Artificial Sequence
  chemically synthesized
agcaacaatgggagatgagg

SEQ ID NO: 552626 - DNA, 20 bp, Artificial Sequence
  chemically synthesized
aatggactaaaaaaagagaa

SEQ ID NO: 552627 - DNA, 20 bp, Artificial Sequence
  chemically synthesized
tgtgcttcctgtttccctat

SEQ ID NO: 552628 - DNA, 20 bp, Artificial Sequence
  chemically synthesized
tacatgtgatgatctggata

SEQ ID NO: 552629 - DNA, 20 bp, Artificial Sequence
  chemically synthesized
atttaagggcttctcaattc

SEQ ID NO: 552630 - DNA, 20 bp, Artificial Sequence
  chemically synthesized
aagataaaaatcaaatattt

SEQ ID NO: 552631 - DNA, 20 bp, Artificial Sequence
  chemically synthesized
tcacagagcatacttactag

SEQ ID NO: 552632 - DNA, 20 bp, Artificial Sequence
  chemically synthesized
ttagaactgagctacaagtg

SEQ ID NO: 552633 - DNA, 20 bp, Artificial Sequence
  chemically synthesized
ctcaactgtctcttcttatt

SEQ ID NO: 552634 - DNA, 20 bp, Artificial Sequence
  chemically synthesized
cattgccatccaagtaacag

SEQ ID NO: 552635 - DNA, 20 bp, Artificial Sequence
  chemically synthesized
ctggttctgataggacataa

SEQ ID NO: 552636 - DNA, 20 bp, Artificial Sequence
  chemically synthesized
attggtttggggtgagttag

SEQ ID NO: 552637 - DNA, 20 bp, Artificial Sequence
  chemically synthesized
accctttacctcttggtgag

SEQ ID NO: 552638 - DNA, 20 bp, Artificial Sequence
  chemically synthesized
aaacttgagattcacatgca

SEQ ID NO: 552639 - DNA, 20 bp, Artificial Sequence
  chemically synthesized
atcttttaaacaaacggtgc

SEQ ID NO: 552640 - DNA, 20 bp, Artificial Sequence
  chemically synthesized
gctaagaccatgaaaatgag

SEQ ID NO: 552641 - DNA, 20 bp, Artificial Sequence
  chemically synthesized
agaggctaagaccatgaaaa

SEQ ID NO: 552642 - DNA, 20 bp, Artificial Sequence
  chemically synthesized
gctgataagtaaaaagaaga

SEQ ID NO: 552643 - DNA, 20 bp, Artificial Sequence
  chemically synthesized
actctctctagctctgtgtg

SEQ ID NO: 552644 - DNA, 20 bp, Artificial Sequence
  chemically synthesized
cttaagagcatatagcaaat

SEQ ID NO: 552645 - DNA, 20 bp, Artificial Sequence
  chemically synthesized
tataaacatgaacattttgg

SEQ ID NO: 552646 - DNA, 20 bp, Artificial Sequence
  chemically synthesized
tagattgatttagttttaat

SEQ ID NO: 552647 - DNA, 20 bp, Artificial Sequence
  chemically synthesized
tatattaaacttaataaata

SEQ ID NO: 552648 - DNA, 20 bp, Artificial Sequence
  chemically synthesized
cagttatttcagcttcatta

SEQ ID NO: 552649 - DNA, 20 bp, Artificial Sequence
  chemically synthesized
attacccttggcaatagatt

SEQ ID NO: 552650 - DNA, 20 bp, Artificial Sequence
  chemically synthesized
ttgaaactttttaaataatt

SEQ ID NO: 552651 - DNA, 20 bp, Artificial Sequence
  chemically synthesized
tcaactcacaaatattcact

SEQ ID NO: 552652 - DNA, 20 bp, Artificial Sequence
  chemically synthesized
tgtagaaacatacaaaacat

SEQ ID NO: 552653 - DNA, 20 bp, Artificial Sequence
  chemically synthesized
taaaggacatatgaaaacaa

SEQ ID NO: 552654 - DNA, 20 bp, Artificial Sequence
  chemically synthesized
gtggttgaagtatttacacc

SEQ ID NO: 552655 - DNA, 20 bp, Artificial Sequence
  chemically synthesized
ccacagaaataagcaaacac

SEQ ID NO: 552656 - DNA, 20 bp, Artificial Sequence
  chemically synthesized
tattttaaccaccagctcag

SEQ ID NO: 552657 - DNA, 20 bp, Artificial Sequence
  chemically synthesized
aagccttgttctaaacaaat

SEQ ID NO: 552658 - DNA, 20 bp, Artificial Sequence
  chemically synthesized
cactgttttatctagatagc

SEQ ID NO: 552659 - DNA, 20 bp, Artificial Sequence
  chemically synthesized
ctaaaattacacaaatggac

SEQ ID NO: 552660 - DNA, 20 bp, Artificial Sequence
  chemically synthesized
tgtctcttgtcatacggttg

SEQ ID NO: 552661 - DNA, 20 bp, Artificial Sequence
  chemically synthesized
agttacatatcagaattcat

SEQ ID NO: 552662 - DNA, 20 bp, Artificial Sequence
  chemically synthesized
gaagaaatgatagttacata

SEQ ID NO: 552663 - DNA, 20 bp, Artificial Sequence
  chemically synthesized
ctggatctcataggtaaaat

SEQ ID NO: 552664 - DNA, 20 bp, Artificial Sequence
  chemically synthesized
aagtcaacagctgattggat

SEQ ID NO: 552665 - DNA, 20 bp, Artificial Sequence
  chemically synthesized
cacaagagaaagcattacta

SEQ ID NO: 552666 - DNA, 20 bp, Artificial Sequence
  chemically synthesized
tatatggaatacctttcaca

SEQ ID NO: 552667 - DNA, 20 bp, Artificial Sequence
  chemically synthesized
ttatgaaactgctataattt

SEQ ID NO: 552668 - DNA, 20 bp, Artificial Sequence
  chemically synthesized
tttcataaaaggtaaaatcc

SEQ ID NO: 552669 - DNA, 20 bp, Artificial Sequence
  chemically synthesized
cactgtaggatgtagttaaa

SEQ ID NO: 552670 - DNA, 20 bp, Artificial Sequence
  chemically synthesized
ggatgtagttaaagaagaaa

SEQ ID NO: 552671 - DNA, 20 bp, Artificial Sequence
  chemically synthesized
attccagttttatcatgata

SEQ ID NO: 552672 - DNA, 20 bp, Artificial Sequence
  chemically synthesized
ttgtcaattattactaaatt

SEQ ID NO: 552673 - DNA, 20 bp, Artificial Sequence
  chemically synthesized
ttattactaaattttagaaa

SEQ ID NO: 552674 - DNA, 20 bp, Artificial Sequence
  chemically synthesized
cagtctggaagactcaaaaa

SEQ ID NO: 552675 - DNA, 20 bp, Artificial Sequence
  chemically synthesized
atgtttcaaatgtataataa

SEQ ID NO: 552676 - DNA, 20 bp, Artificial Sequence
  chemically synthesized
taaaaaatttagctgatcct

SEQ ID NO: 552677 - DNA, 20 bp, Artificial Sequence
  chemically synthesized
cactttggcttatttgatgt

SEQ ID NO: 552678 - DNA, 20 bp, Artificial Sequence
  chemically synthesized
acactattcagcaaatgctg

SEQ ID NO: 552679 - DNA, 20 bp, Artificial Sequence
  chemically synthesized
ttgctgaatagtgttattgt

SEQ ID NO: 552680 - DNA, 20 bp, Artificial Sequence
  chemically synthesized
tcaagcagtctgacaagttt

SEQ ID NO: 552681 - DNA, 20 bp, Artificial Sequence
  chemically synthesized
ttttatttaaaattatagaa

SEQ ID NO: 552682 - DNA, 20 bp, Artificial Sequence
  chemically synthesized
atacgtgttggtgaggattt

SEQ ID NO: 552683 - DNA, 20 bp, Artificial Sequence
  chemically synthesized
taattctatttttaatagtt

SEQ ID NO: 552684 - DNA, 20 bp, Artificial Sequence
  chemically synthesized
ggtttctcaaactattaaaa

SEQ ID NO: 552685 - DNA, 20 bp, Artificial Sequence
  chemically synthesized
ttgtggatgtatggatgaat

SEQ ID NO: 552686 - DNA, 20 bp, Artificial Sequence
  chemically synthesized
atatgctatgtgaaataagg

SEQ ID NO: 552687 - DNA, 20 bp, Artificial Sequence
  chemically synthesized
tgaacttatagaagtaggga

SEQ ID NO: 552688 - DNA, 20 bp, Artificial Sequence
  chemically synthesized
gtgttgtatatcttaaatat

SEQ ID NO: 552689 - DNA, 20 bp, Artificial Sequence
  chemically synthesized
aatttttatggaggtattat

SEQ ID NO: 552690 - DNA, 20 bp, Artificial Sequence
  chemically synthesized
ttttaataatcccatttcat

SEQ ID NO: 552691 - DNA, 20 bp, Artificial Sequence
  chemically synthesized
aagattaattaaattttgag

SEQ ID NO: 552692 - DNA, 20 bp, Artificial Sequence
  chemically synthesized
taaaatagaagctgaaaaaa

SEQ ID NO: 552693 - DNA, 20 bp, Artificial Sequence
  chemically synthesized
acatatttaagaaatgtgtt

SEQ ID NO: 552694 - DNA, 20 bp, Artificial Sequence
  chemically synthesized
gccaaaacagcaaacatatt

SEQ ID NO: 552695 - DNA, 20 bp, Artificial Sequence
  chemically synthesized
agaaataagatactaagaga

SEQ ID NO: 552696 - DNA, 20 bp, Artificial Sequence
  chemically synthesized
cagcaagaaataagatacta

SEQ ID NO: 552697 - DNA, 20 bp, Artificial Sequence
  chemically synthesized
ggataggcacagagtatcag

SEQ ID NO: 552698 - DNA, 20 bp, Artificial Sequence
  chemically synthesized
gttgttggttgataggtctg

SEQ ID NO: 552699 - DNA, 20 bp, Artificial Sequence
  chemically synthesized
tgcggaagtgattccacgta

SEQ ID NO: 552700 - DNA, 20 bp, Artificial Sequence
  chemically synthesized
tatcagataaccacaacttc

SEQ ID NO: 552701 - DNA, 20 bp, Artificial Sequence
  chemically synthesized
atatatttcataataggtac

SEQ ID NO: 552702 - DNA, 20 bp, Artificial Sequence
  chemically synthesized
taattacatttaaaataaat

SEQ ID NO: 552703 - DNA, 20 bp, Artificial Sequence
  chemically synthesized
ttactctcaggaaaaaaaaa

SEQ ID NO: 552704 - DNA, 20 bp, Artificial Sequence
  chemically synthesized
tatagttgaaaaccaaaatg

SEQ ID NO: 552705 - DNA, 20 bp, Artificial Sequence
  chemically synthesized
ttgaaaaccaaaatgagaga

SEQ ID NO: 552706 - DNA, 20 bp, Artificial Sequence
  chemically synthesized
gcaaagtcctacaagtacca

SEQ ID NO: 552707 - DNA, 20 bp, Artificial Sequence
  chemically synthesized
ctttcctcactaggccttcc

SEQ ID NO: 552708 - DNA, 20 bp, Artificial Sequence
  chemically synthesized
tcagttctctaaattatgtg

SEQ ID NO: 552709 - DNA, 20 bp, Artificial Sequence
  chemically synthesized
gaatcttaaaatgaaatatg

SEQ ID NO: 552710 - DNA, 20 bp, Artificial Sequence
  chemically synthesized
agaacagggagaggtaaagg

SEQ ID NO: 552711 - DNA, 20 bp, Artificial Sequence
  chemically synthesized
tctaccaattgtcagaatgg

SEQ ID NO: 552712 - DNA, 20 bp, Artificial Sequence
  chemically synthesized
tgtaaaacatctaccaattg

SEQ ID NO: 552713 - DNA, 20 bp, Artificial Sequence
  chemically synthesized
tttagaaatttaacataaag

SEQ ID NO: 552714 - DNA, 20 bp, Artificial Sequence
  chemically synthesized
acagtttagaaatttaacat

SEQ ID NO: 552715 - DNA, 20 bp, Artificial Sequence
  chemically synthesized
ctgtctctagtggatacagt

SEQ ID NO: 552716 - DNA, 20 bp, Artificial Sequence
  chemically synthesized
gacaatgaatactaatcaaa

SEQ ID NO: 552717 - DNA, 20 bp, Artificial Sequence
  chemically synthesized
atgaatactaatcaaaagag

SEQ ID NO: 552718 - DNA, 20 bp, Artificial Sequence
  chemically synthesized
tggttgtggtcacgccttag

SEQ ID NO: 552719 - DNA, 20 bp, Artificial Sequence
  chemically synthesized
cttagcaagaaaccccttta

SEQ ID NO: 552720 - DNA, 20 bp, Artificial Sequence
  chemically synthesized
atcaaataccacagccacac

SEQ ID NO: 552721 - DNA, 20 bp, Artificial Sequence
  chemically synthesized
aaagccatcattggcaaagg

SEQ ID NO: 552722 - DNA, 20 bp, Artificial Sequence
  chemically synthesized
atatgttcttcattaaaaac

SEQ ID NO: 552723 - DNA, 20 bp, Artificial Sequence
  chemically synthesized
taatatagtcatcttggtga

SEQ ID NO: 552724 - DNA, 20 bp, Artificial Sequence
  chemically synthesized
cttccccgcctccataactg

SEQ ID NO: 552725 - DNA, 20 bp, Artificial Sequence
  chemically synthesized
aacagggtggcttataaaga

SEQ ID NO: 552726 - DNA, 20 bp, Artificial Sequence
  chemically synthesized
gttaattggtctctttgcta

SEQ ID NO: 552727 - DNA, 20 bp, Artificial Sequence
  chemically synthesized
tattttgcatgaagccaaag

SEQ ID NO: 552728 - DNA, 20 bp, Artificial Sequence
  chemically synthesized
aaaggcagaatatgctagaa

SEQ ID NO: 552729 - DNA, 20 bp, Artificial Sequence
  chemically synthesized
accctgcccactccaaacag

SEQ ID NO: 552730 - DNA, 20 bp, Artificial Sequence
  chemically synthesized
ggtggctctctacataatgc

SEQ ID NO: 552731 - DNA, 20 bp, Artificial Sequence
  chemically synthesized
taagttttttccctttgttg

SEQ ID NO: 552732 - DNA, 20 bp, Artificial Sequence
  chemically synthesized
agacaggtaatttataaaca

SEQ ID NO: 552733 - DNA, 20 bp, Artificial Sequence
  chemically synthesized
taatactatgaaatatgtgt

SEQ ID NO: 552734 - DNA, 20 bp, Artificial Sequence
  chemically synthesized
acttattaaaattatgtttt

SEQ ID NO: 552735 - DNA, 20 bp, Artificial Sequence
  chemically synthesized
attctttgctatgttacttt

SEQ ID NO: 552736 - DNA, 20 bp, Artificial Sequence
  chemically synthesized
tttcttaaaagtaacatagc

SEQ ID NO: 552737 - DNA, 20 bp, Artificial Sequence
  chemically synthesized
ctgatttataacctcaccaa

SEQ ID NO: 552738 - DNA, 20 bp, Artificial Sequence
  chemically synthesized
tgtaaattttacctatcaac

SEQ ID NO: 552739 - DNA, 20 bp, Artificial Sequence
  chemically synthesized
aagatatgctcacggaatta

SEQ ID NO: 552740 - DNA, 20 bp, Artificial Sequence
  chemically synthesized
gcaaaagaaatataaatgcc

SEQ ID NO: 552741 - DNA, 20 bp, Artificial Sequence
  chemically synthesized
agaacaaatagcttaccgca

SEQ ID NO: 552742 - DNA, 20 bp, Artificial Sequence
  chemically synthesized
gcaacactactaataccact

SEQ ID NO: 552743 - DNA, 20 bp, Artificial Sequence
  chemically synthesized
gctgtgacgctaatactact

SEQ ID NO: 552744 - DNA, 20 bp, Artificial Sequence
  chemically synthesized
gtgtggaggcaggggatata

SEQ ID NO: 552745 - DNA, 20 bp, Artificial Sequence
  chemically synthesized
tccatagaatgcacaacacc

SEQ ID NO: 552746 - DNA, 20 bp, Artificial Sequence
  chemically synthesized
ttatatatttgtccaaatcc

SEQ ID NO: 552747 - DNA, 20 bp, Artificial Sequence
  chemically synthesized
cacaattatagcatcattac

SEQ ID NO: 552748 - DNA, 20 bp, Artificial Sequence
  chemically synthesized
tctacatagtttttgctttc

SEQ ID NO: 552749 - DNA, 20 bp, Artificial Sequence
  chemically synthesized
aagatgttattcattgctaa

SEQ ID NO: 552750 - DNA, 20 bp, Artificial Sequence
  chemically synthesized
aaaataagcttagtttcagt

SEQ ID NO: 552751 - DNA, 20 bp, Artificial Sequence
  chemically synthesized
gtaagtctcttcggtggaaa

SEQ ID NO: 552752 - DNA, 20 bp, Artificial Sequence
  chemically synthesized
gtaataggaatatgggatgg

SEQ ID NO: 552753 - DNA, 20 bp, Artificial Sequence
  chemically synthesized
tgagaacttacttgctatca

SEQ ID NO: 552754 - DNA, 20 bp, Artificial Sequence
  chemically synthesized
tcacatggcggcagcaagga

SEQ ID NO: 552755 - DNA, 20 bp, Artificial Sequence
  chemically synthesized
gttcattctcacactgctat

SEQ ID NO: 552756 - DNA, 20 bp, Artificial Sequence
  chemically synthesized
ggtatttctttatagcagtg

SEQ ID NO: 552757 - DNA, 20 bp, Artificial Sequence
  chemically synthesized
tagatttctaattgttggag

SEQ ID NO: 552758 - DNA, 20 bp, Artificial Sequence
  chemically synthesized
acagattctctctccaacaa

SEQ ID NO: 552759 - DNA, 20 bp, Artificial Sequence
  chemically synthesized
aatggaacagaacagagccc

SEQ ID NO: 552760 - DNA, 20 bp, Artificial Sequence
  chemically synthesized
tatctgatctttgacaaacc

SEQ ID NO: 552761 - DNA, 20 bp, Artificial Sequence
  chemically synthesized
ggaaaactggctagccatat

SEQ ID NO: 552762 - DNA, 20 bp, Artificial Sequence
  chemically synthesized
ctaaaaccataaaaacccta

SEQ ID NO: 552763 - DNA, 20 bp, Artificial Sequence
  chemically synthesized
taaagagcttctgcacagca

SEQ ID NO: 552764 - DNA, 20 bp, Artificial Sequence
  chemically synthesized
aacaggcaacctacaaaatg

SEQ ID NO: 552765 - DNA, 20 bp, Artificial Sequence
  chemically synthesized
atctgacaaagggctaatat

SEQ ID NO: 552766 - DNA, 20 bp, Artificial Sequence
  chemically synthesized
aatgaactcaaacaaattta

SEQ ID NO: 552767 - DNA, 20 bp, Artificial Sequence
  chemically synthesized
gctcatcatcactggccatc

SEQ ID NO: 552768 - DNA, 20 bp, Artificial Sequence
  chemically synthesized
gagataccatctcacaccag

SEQ ID NO: 552769 - DNA, 20 bp, Artificial Sequence
  chemically synthesized
acaggtgctggagaggatgt

SEQ ID NO: 552770 - DNA, 20 bp, Artificial Sequence
  chemically synthesized
gattcctcagggatctagaa

SEQ ID NO: 552771 - DNA, 20 bp, Artificial Sequence
  chemically synthesized
ccaacaatgatagactggat

SEQ ID NO: 552772 - DNA, 20 bp, Artificial Sequence
  chemically synthesized
ttgtccttgcaatggtttgc

SEQ ID NO: 552773 - DNA, 20 bp, Artificial Sequence
  chemically synthesized
tataacttcaaaaaaaaaaa

SEQ ID NO: 552774 - DNA, 20 bp, Artificial Sequence
  chemically synthesized
taacatagaatgaaatgata

SEQ ID NO: 552775 - DNA, 20 bp, Artificial Sequence
  chemically synthesized
gactgaaggttttttataac

SEQ ID NO: 552776 - DNA, 20 bp, Artificial Sequence
  chemically synthesized
gtaaacttgaaaaatataaa

SEQ ID NO: 552777 - DNA, 20 bp, Artificial Sequence
  chemically synthesized
tgatccccaaggcctagttc

SEQ ID NO: 552778 - DNA, 20 bp, Artificial Sequence
  chemically synthesized
ttacagctaaaaagtgccag

SEQ ID NO: 552779 - DNA, 20 bp, Artificial Sequence
  chemically synthesized
taaagaagacaactgcatag

SEQ ID NO: 552780 - DNA, 20 bp, Artificial Sequence
  chemically synthesized
tgcttgaatacttactatga

SEQ ID NO: 552781 - DNA, 20 bp, Artificial Sequence
  chemically synthesized
tttccagtttataacaagga

SEQ ID NO: 552782 - DNA, 20 bp, Artificial Sequence
  chemically synthesized
taagtaggagatttccactg

SEQ ID NO: 552783 - DNA, 20 bp, Artificial Sequence
  chemically synthesized
tattgctgtgatgtagccac

SEQ ID NO: 552784 - DNA, 20 bp, Artificial Sequence
  chemically synthesized
tgttggaaagtgagtctgga

SEQ ID NO: 552785 - DNA, 20 bp, Artificial Sequence
  chemically synthesized
atataattttacatacttta

SEQ ID NO: 552786 - DNA, 20 bp, Artificial Sequence
  chemically synthesized
gccaaaaataaaagaggaga

SEQ ID NO: 552787 - DNA, 20 bp, Artificial Sequence
  chemically synthesized
actcgagacagatttagcta

SEQ ID NO: 552788 - DNA, 20 bp, Artificial Sequence
  chemically synthesized
gagcaaatttaggtgtaata

SEQ ID NO: 552789 - DNA, 20 bp, Artificial Sequence
  chemically synthesized
aaatttgctctccttcatgc

SEQ ID NO: 552790 - DNA, 20 bp, Artificial Sequence
  chemically synthesized
ggtagaaatagggccagcca

SEQ ID NO: 552791 - DNA, 20 bp, Artificial Sequence
  chemically synthesized
gtaagtctattaggtggaag

SEQ ID NO: 552792 - DNA, 20 bp, Artificial Sequence
  chemically synthesized
atttcactcacgagtcatcc

SEQ ID NO: 552793 - DNA, 20 bp, Artificial Sequence
  chemically synthesized
ctacttgggaggctgaggca

SEQ ID NO: 552794 - DNA, 20 bp, Artificial Sequence
  chemically synthesized
tgacagagcgagactccatc

SEQ ID NO: 552795 - DNA, 20 bp, Artificial Sequence
  chemically synthesized
ctcagaaaaaatataaatat

SEQ ID NO: 552796 - DNA, 20 bp, Artificial Sequence
  chemically synthesized
taaatatatagaaataaaga

SEQ ID NO: 552797 - DNA, 20 bp, Artificial Sequence
  chemically synthesized
gcagcgcctctattgttagg

SEQ ID NO: 552798 - DNA, 20 bp, Artificial Sequence
  chemically synthesized
agggtagaaagcagtcacag

SEQ ID NO: 552799 - DNA, 20 bp, Artificial Sequence
  chemically synthesized
cagaaattcaataaaaataa

SEQ ID NO: 552800 - DNA, 20 bp, Artificial Sequence
  chemically synthesized
tttgaaaaactggtgtctgt

SEQ ID NO: 552801 - DNA, 20 bp, Artificial Sequence
  chemically synthesized
tctggcatagagacttccaa

SEQ ID NO: 552802 - DNA, 20 bp, Artificial Sequence
  chemically synthesized
gcccaactttggcattttcc

SEQ ID NO: 552803 - DNA, 20 bp, Artificial Sequence
  chemically synthesized
tcccaagaaagattgcattc

SEQ ID NO: 552804 - DNA, 20 bp, Artificial Sequence
  chemically synthesized
aaaattatttgttttaaaag

SEQ ID NO: 552805 - DNA, 20 bp, Artificial Sequence
  chemically synthesized
tttaaaacaaataatttttc

SEQ ID NO: 552806 - DNA, 20 bp, Artificial Sequence
  chemically synthesized
gttagacgattaattgattc

SEQ ID NO: 552807 - DNA, 20 bp, Artificial Sequence
  chemically synthesized
tacagaaaggaaaaaaagaa

SEQ ID NO: 552808 - DNA, 20 bp, Artificial Sequence
  chemically synthesized
accctttacagaaaggaaaa

SEQ ID NO: 552809 - DNA, 20 bp, Artificial Sequence
  chemically synthesized
cctaagtatgctcacccttt

SEQ ID NO: 552810 - DNA, 20 bp, Artificial Sequence
  chemically synthesized
agttattaacttcaattgat

SEQ ID NO: 552811 - DNA, 20 bp, Artificial Sequence
  chemically synthesized
atatgtgttgctaatattaa

SEQ ID NO: 552812 - DNA, 20 bp, Artificial Sequence
  chemically synthesized
caaagctgactggggaatat

SEQ ID NO: 552813 - DNA, 20 bp, Artificial Sequence
  chemically synthesized
agtcccttaatattcagtga

SEQ ID NO: 552814 - DNA, 20 bp, Artificial Sequence
  chemically synthesized
gagatagtaaactttttatt

SEQ ID NO: 552815 - DNA, 20 bp, Artificial Sequence
  chemically synthesized
aatgcaagatgtactttagt

SEQ ID NO: 552816 - DNA, 20 bp, Artificial Sequence
  chemically synthesized
ttaattcatacaccttttca

SEQ ID NO: 552817 - DNA, 20 bp, Artificial Sequence
  chemically synthesized
tcttaataatattgatgttt

SEQ ID NO: 552818 - DNA, 20 bp, Artificial Sequence
  chemically synthesized
tattaagaagatattccaat

SEQ ID NO: 552819 - DNA, 20 bp, Artificial Sequence
  chemically synthesized
catttttaagtacggtttat

SEQ ID NO: 552820 - DNA, 20 bp, Artificial Sequence
  chemically synthesized
ctcttatcaagagattctgc

SEQ ID NO: 552821 - DNA, 20 bp, Artificial Sequence
  chemically synthesized
aatggttgctaattttctgg

SEQ ID NO: 552822 - DNA, 20 bp, Artificial Sequence
  chemically synthesized
aaagaagcgaacttctctta

SEQ ID NO: 552823 - DNA, 20 bp, Artificial Sequence
  chemically synthesized
taaaatttggattacaatat

SEQ ID NO: 552824 - DNA, 20 bp, Artificial Sequence
  chemically synthesized
tcttagcagatacagtcaat

SEQ ID NO: 552825 - DNA, 20 bp, Artificial Sequence
  chemically synthesized
tgaaacaatactcaattttt

SEQ ID NO: 552826 - DNA, 20 bp, Artificial Sequence
  chemically synthesized
actttctgtggcttgcaaat

SEQ ID NO: 552827 - DNA, 20 bp, Artificial Sequence
  chemically synthesized
tgattctaaatttgcaagcc

SEQ ID NO: 552828 - DNA, 20 bp, Artificial Sequence
  chemically synthesized
acattacagctataaaaatt

SEQ ID NO: 552829 - DNA, 20 bp, Artificial Sequence
  chemically synthesized
tttatgttgtttcatgcacc

SEQ ID NO: 552830 - DNA, 20 bp, Artificial Sequence
  chemically synthesized
agctaaagggattttgaaaa

SEQ ID NO: 552831 - DNA, 20 bp, Artificial Sequence
  chemically synthesized
aaaatgagattttagtaaat

SEQ ID NO: 552832 - DNA, 20 bp, Artificial Sequence
  chemically synthesized
atgaacacagcagcaaaaaa

SEQ ID NO: 552833 - DNA, 20 bp, Artificial Sequence
  chemically synthesized
attttcttgaaatatgcttt

SEQ ID NO: 552834 - DNA, 20 bp, Artificial Sequence
  chemically synthesized
aatttcttgaaagcatattt

SEQ ID NO: 552835 - DNA, 20 bp, Artificial Sequence
  chemically synthesized
ccatggctagcataataaaa

SEQ ID NO: 552836 - DNA, 20 bp, Artificial Sequence
  chemically synthesized
ggctagcataataaaaacag

SEQ ID NO: 552837 - DNA, 20 bp, Artificial Sequence
  chemically synthesized
ggagatacaaaacagatggg

SEQ ID NO: 552838 - DNA, 20 bp, Artificial Sequence
  chemically synthesized
acaaaacagatgggcaagaa

SEQ ID NO: 552839 - DNA, 20 bp, Artificial Sequence
  chemically synthesized
tgggcaagaaaaagaatttt

SEQ ID NO: 552840 - DNA, 20 bp, Artificial Sequence
  chemically synthesized
aatgtgaagggaaatagtaa

SEQ ID NO: 552841 - DNA, 20 bp, Artificial Sequence
  chemically synthesized
taagatgaaaaatgttaata

SEQ ID NO: 552842 - DNA, 20 bp, Artificial Sequence
  chemically synthesized
gcaagtttttttttttagca

SEQ ID NO: 552843 - DNA, 20 bp, Artificial Sequence
  chemically synthesized
aaatgtcatacaggttctat

SEQ ID NO: 552844 - DNA, 20 bp, Artificial Sequence
  chemically synthesized
gaacctgtatgacatttatt

SEQ ID NO: 552845 - DNA, 20 bp, Artificial Sequence
  chemically synthesized
atgacatttatttaagaaac

SEQ ID NO: 552846 - DNA, 20 bp, Artificial Sequence
  chemically synthesized
taaataacatagttgagtcc

SEQ ID NO: 552847 - DNA, 20 bp, Artificial Sequence
  chemically synthesized
agatcaaaaatacagtattc

SEQ ID NO: 552848 - DNA, 20 bp, Artificial Sequence
  chemically synthesized
tcagtgttcacagtgacttt

SEQ ID NO: 552849 - DNA, 20 bp, Artificial Sequence
  chemically synthesized
atactgaagcattcctccca

SEQ ID NO: 552850 - DNA, 20 bp, Artificial Sequence
  chemically synthesized
aatgttatgagcagaggctc

SEQ ID NO: 552851 - DNA, 20 bp, Artificial Sequence
  chemically synthesized
attcaataagatgtttttaa

SEQ ID NO: 552852 - DNA, 20 bp, Artificial Sequence
  chemically synthesized
aaggctgtgaagtaccttag

SEQ ID NO: 552853 - DNA, 20 bp, Artificial Sequence
  chemically synthesized
taagaaggctgtgaagtacc

SEQ ID NO: 552854 - DNA, 20 bp, Artificial Sequence
  chemically synthesized
cttaagcttaggaacactag

SEQ ID NO: 552855 - DNA, 20 bp, Artificial Sequence
  chemically synthesized
atttaaagcagcaaaatcac

SEQ ID NO: 552856 - DNA, 20 bp, Artificial Sequence
  chemically synthesized
ttaccgtatgagacctgaag

SEQ ID NO: 552857 - DNA, 20 bp, Artificial Sequence
  chemically synthesized
agttttgagaactcccaaac

SEQ ID NO: 552858 - DNA, 20 bp, Artificial Sequence
  chemically synthesized
catttggttatggtgtttgt

SEQ ID NO: 552859 - DNA, 20 bp, Artificial Sequence
  chemically synthesized
gatcattcaaaagggcaatt

SEQ ID NO: 552860 - DNA, 20 bp, Artificial Sequence
  chemically synthesized
tacagttcttcagttggtaa

SEQ ID NO: 552861 - DNA, 20 bp, Artificial Sequence
  chemically synthesized
ccctttgcaagctccacttt

SEQ ID NO: 552862 - DNA, 20 bp, Artificial Sequence
  chemically synthesized
gacagctcacaaatatgtga

SEQ ID NO: 552863 - DNA, 20 bp, Artificial Sequence
  chemically synthesized
tgtcattaaaggaagctaga

SEQ ID NO: 552864 - DNA, 20 bp, Artificial Sequence
  chemically synthesized
gtgtgtgtgtgtgtgtaatg

SEQ ID NO: 552865 - DNA, 20 bp, Artificial Sequence
  chemically synthesized
cgacttgggaagctgaggca

SEQ ID NO: 552866 - DNA, 20 bp, Artificial Sequence
  chemically synthesized
ttggttttagtccagaactc

SEQ ID NO: 552867 - DNA, 20 bp, Artificial Sequence
  chemically synthesized
tggattctcccctagagtct

SEQ ID NO: 552868 - DNA, 20 bp, Artificial Sequence
  chemically synthesized
ttcattctggagactctagg

SEQ ID NO: 552869 - DNA, 20 bp, Artificial Sequence
  chemically synthesized
aactccgtatcaaaaaaaag

SEQ ID NO: 552870 - DNA, 20 bp, Artificial Sequence
  chemically synthesized
ctacttgggaggctgaggca

SEQ ID NO: 552871 - DNA, 20 bp, Artificial Sequence
  chemically synthesized
gttcaaactctgtacattcc

SEQ ID NO: 552872 - DNA, 20 bp, Artificial Sequence
  chemically synthesized
agttgcctaagtcttggtgt

SEQ ID NO: 552873 - DNA, 20 bp, Artificial Sequence
  chemically synthesized
agataaagactgaagtgaac

SEQ ID NO: 552874 - DNA, 20 bp, Artificial Sequence
  chemically synthesized
atcatgagtgtaactgcttt

SEQ ID NO: 552875 - DNA, 20 bp, Artificial Sequence
  chemically synthesized
ataaaatacatgactcttgt

SEQ ID NO: 552876 - DNA, 20 bp, Artificial Sequence
  chemically synthesized
aacatttgataaaaatctct

SEQ ID NO: 552877 - DNA, 20 bp, Artificial Sequence
  chemically synthesized
aaaactaccctttcctatat

SEQ ID NO: 552878 - DNA, 20 bp, Artificial Sequence
  chemically synthesized
tcctttaaacccaatataat

SEQ ID NO: 552879 - DNA, 20 bp, Artificial Sequence
  chemically synthesized
gtatttggatacacataggc

SEQ ID NO: 552880 - DNA, 20 bp, Artificial Sequence
  chemically synthesized
aattgcttttacacctttgc

SEQ ID NO: 552881 - DNA, 20 bp, Artificial Sequence
  chemically synthesized
aatgtaataaaatacagaac

SEQ ID NO: 552882 - DNA, 20 bp, Artificial Sequence
  chemically synthesized
aatgtgatattggtggtgag

SEQ ID NO: 552883 - DNA, 20 bp, Artificial Sequence
  chemically synthesized
aaatctatagatcgatttgg

SEQ ID NO: 552884 - DNA, 20 bp, Artificial Sequence
  chemically synthesized
aaaattacaaaatgctgata

SEQ ID NO: 552885 - DNA, 20 bp, Artificial Sequence
  chemically synthesized
attaaaaacacaaaaagaaa

SEQ ID NO: 552886 - DNA, 20 bp, Artificial Sequence
  chemically synthesized
atttagaattaaaaacacaa

SEQ ID NO: 552887 - DNA, 20 bp, Artificial Sequence
  chemically synthesized
taaaatttctttttaaaaat

SEQ ID NO: 552888 - DNA, 20 bp, Artificial Sequence
  chemically synthesized
ttttaattctaaatttttaa

SEQ ID NO: 552889 - DNA, 20 bp, Artificial Sequence
  chemically synthesized
aaatttttaaaaagaaattt

SEQ ID NO: 552890 - DNA, 20 bp, Artificial Sequence
  chemically synthesized
attcaacatcacttgtcaga

SEQ ID NO: 552891 - DNA, 20 bp, Artificial Sequence
  chemically synthesized
aatctcacttacacaattaa

SEQ ID NO: 552892 - DNA, 20 bp, Artificial Sequence
  chemically synthesized
gagattatattgctcatttg

SEQ ID NO: 552893 - DNA, 20 bp, Artificial Sequence
  chemically synthesized
taaaattcttagttgatatt

SEQ ID NO: 552894 - DNA, 20 bp, Artificial Sequence
  chemically synthesized
tatatttctgcaatatcaac

SEQ ID NO: 552895 - DNA, 20 bp, Artificial Sequence
  chemically synthesized
tctaaaatgtaagcatagaa

SEQ ID NO: 552896 - DNA, 20 bp, Artificial Sequence
  chemically synthesized
ttattttctaaaatgtaagc

SEQ ID NO: 552897 - DNA, 20 bp, Artificial Sequence
  chemically synthesized
tctttttctatgcttacatt

SEQ ID NO: 552898 - DNA, 20 bp, Artificial Sequence
  chemically synthesized
ctataaaatgaataattgta

SEQ ID NO: 552899 - DNA, 20 bp, Artificial Sequence
  chemically synthesized
aggttttacccccctctttt

SEQ ID NO: 552900 - DNA, 20 bp, Artificial Sequence
  chemically synthesized
taatagagcccactgtctca

SEQ ID NO: 552901 - DNA, 20 bp, Artificial Sequence
  chemically synthesized
aagggaaaatgttcccttct

SEQ ID NO: 552902 - DNA, 20 bp, Artificial Sequence
  chemically synthesized
cataaaacataaagaatatt

SEQ ID NO: 552903 - DNA, 20 bp, Artificial Sequence
  chemically synthesized
gcccaagaaacataaaacat

SEQ ID NO: 552904 - DNA, 20 bp, Artificial Sequence
  chemically synthesized
cttaatcagcacagtaagcc

SEQ ID NO: 552905 - DNA, 20 bp, Artificial Sequence
  chemically synthesized
atatatatgatttgatgagt

SEQ ID NO: 552906 - DNA, 20 bp, Artificial Sequence
  chemically synthesized
agttaagaataattgggtcc

SEQ ID NO: 552907 - DNA, 20 bp, Artificial Sequence
  chemically synthesized
actttagggtggctgaggct

SEQ ID NO: 552908 - DNA, 20 bp, Artificial Sequence
  chemically synthesized
tggtgaaaccctgtctctac

SEQ ID NO: 552909 - DNA, 20 bp, Artificial Sequence
  chemically synthesized
tcttactgagtattttcccc

SEQ ID NO: 552910 - DNA, 20 bp, Artificial Sequence
  chemically synthesized
ataacatgagcatgttaaga

SEQ ID NO: 552911 - DNA, 20 bp, Artificial Sequence
  chemically synthesized
tagcaacattgcaagcaaaa

SEQ ID NO: 552912 - DNA, 20 bp, Artificial Sequence
  chemically synthesized
aaaataataaactgggtggc

SEQ ID NO: 552913 - DNA, 20 bp, Artificial Sequence
  chemically synthesized
ttatagaagcccaaatggat

SEQ ID NO: 552914 - DNA, 20 bp, Artificial Sequence
  chemically synthesized
aatgatagttatttcatagt

SEQ ID NO: 552915 - DNA, 20 bp, Artificial Sequence
  chemically synthesized
gagtcataagtataatgtat

SEQ ID NO: 552916 - DNA, 20 bp, Artificial Sequence
  chemically synthesized
tatgaaaatgcactagagag

SEQ ID NO: 552917 - DNA, 20 bp, Artificial Sequence
  chemically synthesized
aatacacgataagatcttta

SEQ ID NO: 552918 - DNA, 20 bp, Artificial Sequence
  chemically synthesized
catagacagatgtaaatcta

SEQ ID NO: 552919 - DNA, 20 bp, Artificial Sequence
  chemically synthesized
aatctagcagaatgcaaata

SEQ ID NO: 552920 - DNA, 20 bp, Artificial Sequence
  chemically synthesized
caacttgtcagattttgata

SEQ ID NO: 552921 - DNA, 20 bp, Artificial Sequence
  chemically synthesized
ccatggaaatggaaaaaatg

SEQ ID NO: 552922 - DNA, 20 bp, Artificial Sequence
  chemically synthesized
tctttgttaacgcttaattc

SEQ ID NO: 552923 - DNA, 20 bp, Artificial Sequence
  chemically synthesized
ctacaaagaaatgttttgtg

SEQ ID NO: 552924 - DNA, 20 bp, Artificial Sequence
  chemically synthesized
caaacagcagcacatgctac

SEQ ID NO: 552925 - DNA, 20 bp, Artificial Sequence
  chemically synthesized
acttagctgataaagtagtg

SEQ ID NO: 552926 - DNA, 20 bp, Artificial Sequence
  chemically synthesized
ttgagatgacaacaaaggat

SEQ ID NO: 552927 - DNA, 20 bp, Artificial Sequence
  chemically synthesized
accagaagtaaattttatct

SEQ ID NO: 552928 - DNA, 20 bp, Artificial Sequence
  chemically synthesized
attgcatctgatggatgagc

SEQ ID NO: 552929 - DNA, 20 bp, Artificial Sequence
  chemically synthesized
gagatatggtgacaatagca

SEQ ID NO: 552930 - DNA, 20 bp, Artificial Sequence
  chemically synthesized
atgaatgttattaatggcat

SEQ ID NO: 552931 - DNA, 20 bp, Artificial Sequence
  chemically synthesized
aacatttatgtctcattatt

SEQ ID NO: 552932 - DNA, 20 bp, Artificial Sequence
  chemically synthesized
tactctttgacccatgggct

SEQ ID NO: 552933 - DNA, 20 bp, Artificial Sequence
  chemically synthesized
ccggggttgagaccttgtgc

SEQ ID NO: 552934 - DNA, 20 bp, Artificial Sequence
  chemically synthesized
tctgaaaatcctagggccct

SEQ ID NO: 552935 - DNA, 20 bp, Artificial Sequence
  chemically synthesized
tcttaagggccctaggattt

SEQ ID NO: 552936 - DNA, 20 bp, Artificial Sequence
  chemically synthesized
agctgcattagactctagca

SEQ ID NO: 552937 - DNA, 20 bp, Artificial Sequence
  chemically synthesized
gccatctaggattttcatag

SEQ ID NO: 552938 - DNA, 20 bp, Artificial Sequence
  chemically synthesized
tgagaggtaaggaagctgca

SEQ ID NO: 552939 - DNA, 20 bp, Artificial Sequence
  chemically synthesized
ttccttacctctcagccttc

SEQ ID NO: 552940 - DNA, 20 bp, Artificial Sequence
  chemically synthesized
ccccatgcacacatgaatga

SEQ ID NO: 552941 - DNA, 20 bp, Artificial Sequence
  chemically synthesized
catttcaatattggtttgtc

SEQ ID NO: 552942 - DNA, 20 bp, Artificial Sequence
  chemically synthesized
caatattggtttgtctcaga

SEQ ID NO: 552943 - DNA, 20 bp, Artificial Sequence
  chemically synthesized
agagtacaaaagccacactg

SEQ ID NO: 552944 - DNA, 20 bp, Artificial Sequence
  chemically synthesized
ccagtgtcagcttgttgagg

SEQ ID NO: 552945 - DNA, 20 bp, Artificial Sequence
  chemically synthesized
tgaaagcatagaaagattaa

SEQ ID NO: 552946 - DNA, 20 bp, Artificial Sequence
  chemically synthesized
cacttagtaacactgaaagc

SEQ ID NO: 552947 - DNA, 20 bp, Artificial Sequence
  chemically synthesized
gtgaagatatgacagtgagt

SEQ ID NO: 552948 - DNA, 20 bp, Artificial Sequence
  chemically synthesized
aaatatgatagttgaattca

SEQ ID NO: 552949 - DNA, 20 bp, Artificial Sequence
  chemically synthesized
ggtgatgagattatcatctc

SEQ ID NO: 552950 - DNA, 20 bp, Artificial Sequence
  chemically synthesized
atgtttgaggccactttcag

SEQ ID NO: 552951 - DNA, 20 bp, Artificial Sequence
  chemically synthesized
taaggataatgttgatgaag

SEQ ID NO: 552952 - DNA, 20 bp, Artificial Sequence
  chemically synthesized
cataactggcaaccaacagg

SEQ ID NO: 552953 - DNA, 20 bp, Artificial Sequence
  chemically synthesized
ctttacctactcatcctcag

SEQ ID NO: 552954 - DNA, 20 bp, Artificial Sequence
  chemically synthesized
gactacttccaactacaaat

SEQ ID NO: 552955 - DNA, 20 bp, Artificial Sequence
  chemically synthesized
ctgtagaaaactgagatctt

SEQ ID NO: 552956 - DNA, 20 bp, Artificial Sequence
  chemically synthesized
ataaccccatagacacagct

SEQ ID NO: 552957 - DNA, 20 bp, Artificial Sequence
  chemically synthesized
tgaaagcccagcaaagaaaa

SEQ ID NO: 552958 - DNA, 20 bp, Artificial Sequence
  chemically synthesized
atctcatatgaaagcccagc

SEQ ID NO: 552959 - DNA, 20 bp, Artificial Sequence
  chemically synthesized
atttcatatatttgccaact

SEQ ID NO: 552960 - DNA, 20 bp, Artificial Sequence
  chemically synthesized
gcatgaatgcagtgggaagg

SEQ ID NO: 552961 - DNA, 20 bp, Artificial Sequence
  chemically synthesized
aataaagaagatagaaagtg

SEQ ID NO: 552962 - DNA, 20 bp, Artificial Sequence
  chemically synthesized
atcattaaagaataaagaag

SEQ ID NO: 552963 - DNA, 20 bp, Artificial Sequence
  chemically synthesized
gcattcgattacaaatcatt

SEQ ID NO: 552964 - DNA, 20 bp, Artificial Sequence
  chemically synthesized
aatgcttccattttttcaga

SEQ ID NO: 552965 - DNA, 20 bp, Artificial Sequence
  chemically synthesized
ttcagaagagaataaaaggc

SEQ ID NO: 552966 - DNA, 20 bp, Artificial Sequence
  chemically synthesized
tatgcattggtttgggagtt

SEQ ID NO: 552967 - DNA, 20 bp, Artificial Sequence
  chemically synthesized
tcctcaaatatacttccctg

SEQ ID NO: 552968 - DNA, 20 bp, Artificial Sequence
  chemically synthesized
agcaaagaagtgagtgagac

SEQ ID NO: 552969 - DNA, 20 bp, Artificial Sequence
  chemically synthesized
agtaccacttgagaccacta

SEQ ID NO: 552970 - DNA, 20 bp, Artificial Sequence
  chemically synthesized
gatttgtctcacctgagaag

SEQ ID NO: 552971 - DNA, 20 bp, Artificial Sequence
  chemically synthesized
aggatggaagccagcatcag

SEQ ID NO: 552972 - DNA, 20 bp, Artificial Sequence
  chemically synthesized
caaaagtgtgtgggagaata

SEQ ID NO: 552973 - DNA, 20 bp, Artificial Sequence
  chemically synthesized
atgcaggtcaaaagtgtgtg

SEQ ID NO: 552974 - DNA, 20 bp, Artificial Sequence
  chemically synthesized
atctttaatataacaaagat

SEQ ID NO: 552975 - DNA, 20 bp, Artificial Sequence
  chemically synthesized
aaaatctgtaactgtatatt

SEQ ID NO: 552976 - DNA, 20 bp, Artificial Sequence
  chemically synthesized
gaggataaattttattatat

SEQ ID NO: 552977 - DNA, 20 bp, Artificial Sequence
  chemically synthesized
tacattatacttttaattta

SEQ ID NO: 552978 - DNA, 20 bp, Artificial Sequence
  chemically synthesized
taaaagacacatcaagcctg

SEQ ID NO: 552979 - DNA, 20 bp, Artificial Sequence
  chemically synthesized
ggactgtatataatgtcaat

SEQ ID NO: 552980 - DNA, 20 bp, Artificial Sequence
  chemically synthesized
ataatgtcaatagagaataa

SEQ ID NO: 552981 - DNA, 20 bp, Artificial Sequence
  chemically synthesized
ggcatgtggcttcctgttac

SEQ ID NO: 552982 - DNA, 20 bp, Artificial Sequence
  chemically synthesized
taatgcatagctttgtgata

SEQ ID NO: 552983 - DNA, 20 bp, Artificial Sequence
  chemically synthesized
ttttttccactgaattttca

SEQ ID NO: 552984 - DNA, 20 bp, Artificial Sequence
  chemically synthesized
tttgtcttgtttcatcacta

SEQ ID NO: 552985 - DNA, 20 bp, Artificial Sequence
  chemically synthesized
agcaaagggtaaaaaaaaaa

SEQ ID NO: 552986 - DNA, 20 bp, Artificial Sequence
  chemically synthesized
ggtaaaaaaaaaaaaagaat

SEQ ID NO: 552987 - DNA, 20 bp, Artificial Sequence
  chemically synthesized
tgaatcatgcacccctgtgc

SEQ ID NO: 552988 - DNA, 20 bp, Artificial Sequence
  chemically synthesized
accaagtaaatatatgtgaa

SEQ ID NO: 552989 - DNA, 20 bp, Artificial Sequence
  chemically synthesized
gaggggggatggcagagcta

SEQ ID NO: 552990 - DNA, 20 bp, Artificial Sequence
  chemically synthesized
agaaatttaggatacaaata

SEQ ID NO: 552991 - DNA, 20 bp, Artificial Sequence
  chemically synthesized
atactcaatagtacttccac

SEQ ID NO: 552992 - DNA, 20 bp, Artificial Sequence
  chemically synthesized
agaagcattccacagatgcc

SEQ ID NO: 552993 - DNA, 20 bp, Artificial Sequence
  chemically synthesized
tggaatgcttctccaatgaa

SEQ ID NO: 552994 - DNA, 20 bp, Artificial Sequence
  chemically synthesized
gcttctccaatgaacaagaa

SEQ ID NO: 552995 - DNA, 20 bp, Artificial Sequence
  chemically synthesized
ctccaatgaacaagaaagag

SEQ ID NO: 552996 - DNA, 20 bp, Artificial Sequence
  chemically synthesized
accttggaataggttgctaa

SEQ ID NO: 552997 - DNA, 20 bp, Artificial Sequence
  chemically synthesized
tttagagactgaacttatta

SEQ ID NO: 552998 - DNA, 20 bp, Artificial Sequence
  chemically synthesized
ataagttcagtctctaaatg

SEQ ID NO: 552999 - DNA, 20 bp, Artificial Sequence
  chemically synthesized
catgaataagagttccgtat

SEQ ID NO: 553000 - DNA, 20 bp, Artificial Sequence
  chemically synthesized
ccgttttggaaaaaaaagat

SEQ ID NO: 553001 - DNA, 20 bp, Artificial Sequence
  chemically synthesized
tcatggaaggagtgaaatgc

SEQ ID NO: 553002 - DNA, 20 bp, Artificial Sequence
  chemically synthesized
aactaaattttatctcacta

SEQ ID NO: 553003 - DNA, 20 bp, Artificial Sequence
  chemically synthesized
tatgttgttcttcatccact

SEQ ID NO: 553004 - DNA, 20 bp, Artificial Sequence
  chemically synthesized
gaatgggaacatccaagtaa

SEQ ID NO: 553005 - DNA, 20 bp, Artificial Sequence
  chemically synthesized
agtaataagaataaatgtga

SEQ ID NO: 553006 - DNA, 20 bp, Artificial Sequence
  chemically synthesized
gttttcctttgttttttgag

SEQ ID NO: 553007 - DNA, 20 bp, Artificial Sequence
  chemically synthesized
ctactcgggaggctgaggca

SEQ ID NO: 553008 - DNA, 20 bp, Artificial Sequence
  chemically synthesized
taaagaccctacatggttta

SEQ ID NO: 553009 - DNA, 20 bp, Artificial Sequence
  chemically synthesized
tctggccttactactaactg

SEQ ID NO: 553010 - DNA, 20 bp, Artificial Sequence
  chemically synthesized
tactaactggaagaaactta

SEQ ID NO: 553011 - DNA, 20 bp, Artificial Sequence
  chemically synthesized
atgaggaaagtgtgacttat

SEQ ID NO: 553012 - DNA, 20 bp, Artificial Sequence
  chemically synthesized
ttcaaaacccggagaccatt

SEQ ID NO: 553013 - DNA, 20 bp, Artificial Sequence
  chemically synthesized
cagatatcttttataggaac

SEQ ID NO: 553014 - DNA, 20 bp, Artificial Sequence
  chemically synthesized
aaaaccaaaattgtaaatca

SEQ ID NO: 553015 - DNA, 20 bp, Artificial Sequence
  chemically synthesized
atagaaaaatgagcatgaga

SEQ ID NO: 553016 - DNA, 20 bp, Artificial Sequence
  chemically synthesized
acattttaaaaatcaagttg

SEQ ID NO: 553017 - DNA, 20 bp, Artificial Sequence
  chemically synthesized
gtaatttccctttgtagatt

SEQ ID NO: 553018 - DNA, 20 bp, Artificial Sequence
  chemically synthesized
gttctcaaattaattagtca

SEQ ID NO: 553019 - DNA, 20 bp, Artificial Sequence
  chemically synthesized
tcactagaaaaaaatggaaa

SEQ ID NO: 553020 - DNA, 20 bp, Artificial Sequence
  chemically synthesized
gagatactatagtataacag

SEQ ID NO: 553021 - DNA, 20 bp, Artificial Sequence
  chemically synthesized
agaagtagaattattaggtc

SEQ ID NO: 553022 - DNA, 20 bp, Artificial Sequence
  chemically synthesized
gttctgttatgtgccaagaa

SEQ ID NO: 553023 - DNA, 20 bp, Artificial Sequence
  chemically synthesized
gcatatgtgcagtaaatttg

SEQ ID NO: 553024 - DNA, 20 bp, Artificial Sequence
  chemically synthesized
aaattatgggaccacaacta

SEQ ID NO: 553025 - DNA, 20 bp, Artificial Sequence
  chemically synthesized
aaattagatagatctcacaa

SEQ ID NO: 553026 - DNA, 20 bp, Artificial Sequence
  chemically synthesized
agaatgttgagatttaggag

SEQ ID NO: 553027 - DNA, 20 bp, Artificial Sequence
  chemically synthesized
agtaattactcaaggcaaga

SEQ ID NO: 553028 - DNA, 20 bp, Artificial Sequence
  chemically synthesized
accccagtaattactcaagg

SEQ ID NO: 553029 - DNA, 20 bp, Artificial Sequence
  chemically synthesized
tgttttaaaaatcaaggagg

SEQ ID NO: 553030 - DNA, 20 bp, Artificial Sequence
  chemically synthesized
tagatatataggctaaaggc

SEQ ID NO: 553031 - DNA, 20 bp, Artificial Sequence
  chemically synthesized
tatatgtcagaagaagggag

SEQ ID NO: 553032 - DNA, 20 bp, Artificial Sequence
  chemically synthesized
tttttcgataattaaattct

SEQ ID NO: 553033 - DNA, 20 bp, Artificial Sequence
  chemically synthesized
tctcaagcagtacattttct

SEQ ID NO: 553034 - DNA, 20 bp, Artificial Sequence
  chemically synthesized
tagaaaatgtactgcttgag

SEQ ID NO: 553035 - DNA, 20 bp, Artificial Sequence
  chemically synthesized
tttctgaagaatcgaatcat

SEQ ID NO: 553036 - DNA, 20 bp, Artificial Sequence
  chemically synthesized
tttctggatgattcgattct

SEQ ID NO: 553037 - DNA, 20 bp, Artificial Sequence
  chemically synthesized
aggtaaacaagatattttct

SEQ ID NO: 553038 - DNA, 20 bp, Artificial Sequence
  chemically synthesized
gccaaataaacctgtaacaa

SEQ ID NO: 553039 - DNA, 20 bp, Artificial Sequence
  chemically synthesized
ctgaaaggataacatctcag

SEQ ID NO: 553040 - DNA, 20 bp, Artificial Sequence
  chemically synthesized
tgtataaagttaaattaatc

SEQ ID NO: 553041 - DNA, 20 bp, Artificial Sequence
  chemically synthesized
gcaaaatgataactgaacag

SEQ ID NO: 553042 - DNA, 20 bp, Artificial Sequence
  chemically synthesized
aagagcaaaatgataactga

SEQ ID NO: 553043 - DNA, 20 bp, Artificial Sequence
  chemically synthesized
cgtggtttatgtggatgaga

SEQ ID NO: 553044 - DNA, 20 bp, Artificial Sequence
  chemically synthesized
tctagcacagagcctggcag

SEQ ID NO: 553045 - DNA, 20 bp, Artificial Sequence
  chemically synthesized
tgttggatgaatgaaaagca

SEQ ID NO: 553046 - DNA, 20 bp, Artificial Sequence
  chemically synthesized
tcctgtctggatgacctaat

SEQ ID NO: 553047 - DNA, 20 bp, Artificial Sequence
  chemically synthesized
ttcttttatacatgctataa

SEQ ID NO: 553048 - DNA, 20 bp, Artificial Sequence
  chemically synthesized
ttctacttatagcatgtata

SEQ ID NO: 553049 - DNA, 20 bp, Artificial Sequence
  chemically synthesized
tggtgcttatcaaatttcca

SEQ ID NO: 553050 - DNA, 20 bp, Artificial Sequence
  chemically synthesized
taggctgtaaccccaaagct

SEQ ID NO: 553051 - DNA, 20 bp, Artificial Sequence
  chemically synthesized
aatgtgacatctgaataaaa

SEQ ID NO: 553052 - DNA, 20 bp, Artificial Sequence
  chemically synthesized
tgttggaaagcaaatttttt

SEQ ID NO: 553053 - DNA, 20 bp, Artificial Sequence
  chemically synthesized
agtctataaatttctcaagg

SEQ ID NO: 553054 - DNA, 20 bp, Artificial Sequence
  chemically synthesized
tatggtttattttctgacct

SEQ ID NO: 553055 - DNA, 20 bp, Artificial Sequence
  chemically synthesized
tttgttatatgttagggtca

SEQ ID NO: 553056 - DNA, 20 bp, Artificial Sequence
  chemically synthesized
cacatcacatttgaattgtt

SEQ ID NO: 553057 - DNA, 20 bp, Artificial Sequence
  chemically synthesized
gcttttttgttattttaata

SEQ ID NO: 553058 - DNA, 20 bp, Artificial Sequence
  chemically synthesized
ctatttattactggtcttta

SEQ ID NO: 553059 - DNA, 20 bp, Artificial Sequence
  chemically synthesized
ctttttcctgattccaaggg

SEQ ID NO: 553060 - DNA, 20 bp, Artificial Sequence
  chemically synthesized
cttacccttggaatcaggaa

SEQ ID NO: 553061 - DNA, 20 bp, Artificial Sequence
  chemically synthesized
ttggcttgcctttcgctact

SEQ ID NO: 553062 - DNA, 20 bp, Artificial Sequence
  chemically synthesized
tagcgaaaggcaagccaact

SEQ ID NO: 553063 - DNA, 20 bp, Artificial Sequence
  chemically synthesized
ggttaaaaaacaatactttc

SEQ ID NO: 553064 - DNA, 20 bp, Artificial Sequence
  chemically synthesized
atacaagtaaagttttacag

SEQ ID NO: 553065 - DNA, 20 bp, Artificial Sequence
  chemically synthesized
caacatacaagtaaagtttt

SEQ ID NO: 553066 - DNA, 20 bp, Artificial Sequence
  chemically synthesized
ggaaaggcaaaagaggcaat

SEQ ID NO: 553067 - DNA, 20 bp, Artificial Sequence
  chemically synthesized
ccatattcctaagccaacag

SEQ ID NO: 553068 - DNA, 20 bp, Artificial Sequence
  chemically synthesized
acacaaggcttaagggtctg

SEQ ID NO: 553069 - DNA, 20 bp, Artificial Sequence
  chemically synthesized
acatcctcatggaaatacaa

SEQ ID NO: 553070 - DNA, 20 bp, Artificial Sequence
  chemically synthesized
atttccagcgctaccagtga

SEQ ID NO: 553071 - DNA, 20 bp, Artificial Sequence
  chemically synthesized
agcagaaattatatctttcc

SEQ ID NO: 553072 - DNA, 20 bp, Artificial Sequence
  chemically synthesized
tgtaatatttggtggtaaat

SEQ ID NO: 553073 - DNA, 20 bp, Artificial Sequence
  chemically synthesized
agaatccctcagctttatgc

SEQ ID NO: 553074 - DNA, 20 bp, Artificial Sequence
  chemically synthesized
ggattttttttcatgtcata

SEQ ID NO: 553075 - DNA, 20 bp, Artificial Sequence
  chemically synthesized
ttgataagacatgctaaatt

SEQ ID NO: 553076 - DNA, 20 bp, Artificial Sequence
  chemically synthesized
agagaagagggtagctgcaa

SEQ ID NO: 553077 - DNA, 20 bp, Artificial Sequence
  chemically synthesized
tgtatgatttcagtagactt

SEQ ID NO: 553078 - DNA, 20 bp, Artificial Sequence
  chemically synthesized
gaaaagcagcaataaaaata

SEQ ID NO: 553079 - DNA, 20 bp, Artificial Sequence
  chemically synthesized
ataacagttctataccataa

SEQ ID NO: 553080 - DNA, 20 bp, Artificial Sequence
  chemically synthesized
tcacctcatctctagactat

SEQ ID NO: 553081 - DNA, 20 bp, Artificial Sequence
  chemically synthesized
attttatataatctcatgtg

SEQ ID NO: 553082 - DNA, 20 bp, Artificial Sequence
  chemically synthesized
gtttctgaattgtttcattt

SEQ ID NO: 553083 - DNA, 20 bp, Artificial Sequence
  chemically synthesized
tattcttgaaatgaaacaat

SEQ ID NO: 553084 - DNA, 20 bp, Artificial Sequence
  chemically synthesized
gtggagtagtagagaccctc

SEQ ID NO: 553085 - DNA, 20 bp, Artificial Sequence
  chemically synthesized
aaaaaaagaacatgttttta

SEQ ID NO: 553086 - DNA, 20 bp, Artificial Sequence
  chemically synthesized
tgtctgagataatttttaac

SEQ ID NO: 553087 - DNA, 20 bp, Artificial Sequence
  chemically synthesized
ttcttcaatttccatttagt

SEQ ID NO: 553088 - DNA, 20 bp, Artificial Sequence
  chemically synthesized
attcctaaagtgttcagtgc

SEQ ID NO: 553089 - DNA, 20 bp, Artificial Sequence
  chemically synthesized
ttccagttaatgttgtgagc

SEQ ID NO: 553090 - DNA, 20 bp, Artificial Sequence
  chemically synthesized
tctgctcacaacattaactg

SEQ ID NO: 553091 - DNA, 20 bp, Artificial Sequence
  chemically synthesized
aatacttgaaggaaaaaagt

SEQ ID NO: 553092 - DNA, 20 bp, Artificial Sequence
  chemically synthesized
tactagaaaagtgaaaagtt

SEQ ID NO: 553093 - DNA, 20 bp, Artificial Sequence
  chemically synthesized
tttgaggggcatggaaagta

SEQ ID NO: 553094 - DNA, 20 bp, Artificial Sequence
  chemically synthesized
aaaaactgtggtgaggtcaa

SEQ ID NO: 553095 - DNA, 20 bp, Artificial Sequence
  chemically synthesized
gatgcccatatggtgaaaat

SEQ ID NO: 553096 - DNA, 20 bp, Artificial Sequence
  chemically synthesized
catacttttcagataacatt

SEQ ID NO: 553097 - DNA, 20 bp, Artificial Sequence
  chemically synthesized
cctgaagaaggtgagatggt

SEQ ID NO: 553098 - DNA, 20 bp, Artificial Sequence
  chemically synthesized
aattgtcagttactcccagt

SEQ ID NO: 553099 - DNA, 20 bp, Artificial Sequence
  chemically synthesized
ttaaaactggaaatattttt

SEQ ID NO: 553100 - DNA, 20 bp, Artificial Sequence
  chemically synthesized
aaagtcagaactgtttaaaa

SEQ ID NO: 553101 - DNA, 20 bp, Artificial Sequence
  chemically synthesized
ttcttaaaagatggattata

SEQ ID NO: 553102 - DNA, 20 bp, Artificial Sequence
  chemically synthesized
caggggaagacactatcggt

SEQ ID NO: 553103 - DNA, 20 bp, Artificial Sequence
  chemically synthesized
tgcctctcaggtgttgctct

SEQ ID NO: 553104 - DNA, 20 bp, Artificial Sequence
  chemically synthesized
ttgacagtcttatcacaaaa

SEQ ID NO: 553105 - DNA, 20 bp, Artificial Sequence
  chemically synthesized
aaaagagataaataattgtt

SEQ ID NO: 553106 - DNA, 20 bp, Artificial Sequence
  chemically synthesized
ttttagaatataaatgcctt

SEQ ID NO: 553107 - DNA, 20 bp, Artificial Sequence
  chemically synthesized
gagaaaacaatctgagtttg

SEQ ID NO: 553108 - DNA, 20 bp, Artificial Sequence
  chemically synthesized
attttaatatatttttaaat

SEQ ID NO: 553109 - DNA, 20 bp, Artificial Sequence
  chemically synthesized
aaggaagaaaaaacgatgaa

SEQ ID NO: 553110 - DNA, 20 bp, Artificial Sequence
  chemically synthesized
gtcttctgaagtgctttaag

SEQ ID NO: 553111 - DNA, 20 bp, Artificial Sequence
  chemically synthesized
aggctgaccctgttttagag

SEQ ID NO: 553112 - DNA, 20 bp, Artificial Sequence
  chemically synthesized
taggcttgcttcatttgcgg

SEQ ID NO: 553113 - DNA, 20 bp, Artificial Sequence
  chemically synthesized
agtacgctatcttcattgaa

SEQ ID NO: 553114 - DNA, 20 bp, Artificial Sequence
  chemically synthesized
agggttattttgtggttggt

SEQ ID NO: 553115 - DNA, 20 bp, Artificial Sequence
  chemically synthesized
tttgggaagctcaaagactg

SEQ ID NO: 553116 - DNA, 20 bp, Artificial Sequence
  chemically synthesized
agatgtatcattttagcagc

SEQ ID NO: 553117 - DNA, 20 bp, Artificial Sequence
  chemically synthesized
ttgctgctaaaatgatacat

SEQ ID NO: 553118 - DNA, 20 bp, Artificial Sequence
  chemically synthesized
taattcatatatacagcagg

SEQ ID NO: 553119 - DNA, 20 bp, Artificial Sequence
  chemically synthesized
cagaagttagcaattatttt

SEQ ID NO: 553120 - DNA, 20 bp, Artificial Sequence
  chemically synthesized
ttttcaattacgtattcctc

SEQ ID NO: 553121 - DNA, 20 bp, Artificial Sequence
  chemically synthesized
tgaaaaccatggactaacat

SEQ ID NO: 553122 - DNA, 20 bp, Artificial Sequence
  chemically synthesized
actgggatattacaattact

SEQ ID NO: 553123 - DNA, 20 bp, Artificial Sequence
  chemically synthesized
ttattaactgtctatgtaat

SEQ ID NO: 553124 - DNA, 20 bp, Artificial Sequence
  chemically synthesized
taaaacagatgttaaataat

SEQ ID NO: 553125 - DNA, 20 bp, Artificial Sequence
  chemically synthesized
acagcatgtgaagataggtt

SEQ ID NO: 553126 - DNA, 20 bp, Artificial Sequence
  chemically synthesized
gctccaaaaataaagttttt

SEQ ID NO: 553127 - DNA, 20 bp, Artificial Sequence
  chemically synthesized
taatccactgattgtagggg

SEQ ID NO: 553128 - DNA, 20 bp, Artificial Sequence
  chemically synthesized
ggaaagaaatattgcaaaac

SEQ ID NO: 553129 - DNA, 20 bp, Artificial Sequence
  chemically synthesized
ttctaaaaatcgtacgcagg

SEQ ID NO: 553130 - DNA, 20 bp, Artificial Sequence
  chemically synthesized
aaaaatcgtacgcaggcaag

SEQ ID NO: 553131 - DNA, 20 bp, Artificial Sequence
  chemically synthesized
tatctgaaacaagctgatac

SEQ ID NO: 553132 - DNA, 20 bp, Artificial Sequence
  chemically synthesized
aattaagagcagtaatcaag

SEQ ID NO: 553133 - DNA, 20 bp, Artificial Sequence
  chemically synthesized
atatattttcttcatataat

SEQ ID NO: 553134 - DNA, 20 bp, Artificial Sequence
  chemically synthesized
tcagtcattctgcattatat

SEQ ID NO: 553135 - DNA, 20 bp, Artificial Sequence
  chemically synthesized
gactgaataaatgtcaaaag

SEQ ID NO: 553136 - DNA, 20 bp, Artificial Sequence
  chemically synthesized
caaaagctagaaattgatga

SEQ ID NO: 553137 - DNA, 20 bp, Artificial Sequence
  chemically synthesized
acagccaaactccttataaa

SEQ ID NO: 553138 - DNA, 20 bp, Artificial Sequence
  chemically synthesized
agtgagagaaatgagaatgt

SEQ ID NO: 553139 - DNA, 20 bp, Artificial Sequence
  chemically synthesized
tattcagacagtgagagaaa

SEQ ID NO: 553140 - DNA, 20 bp, Artificial Sequence
  chemically synthesized
attggcatattcagacagtg

SEQ ID NO: 553141 - DNA, 20 bp, Artificial Sequence
  chemically synthesized
ccccctgtcatcatctacct

SEQ ID NO: 553142 - DNA, 20 bp, Artificial Sequence
  chemically synthesized
gaaatcagtgttagaagatt

SEQ ID NO: 553143 - DNA, 20 bp, Artificial Sequence
  chemically synthesized
ctcaggaaaacacttctggg

SEQ ID NO: 553144 - DNA, 20 bp, Artificial Sequence
  chemically synthesized
ctgcaaacagtgttgctttt

SEQ ID NO: 553145 - DNA, 20 bp, Artificial Sequence
  chemically synthesized
tcaggaagatgacagaatca

SEQ ID NO: 553146 - DNA, 20 bp, Artificial Sequence
  chemically synthesized
agaatgctttcaggaagatg

SEQ ID NO: 553147 - DNA, 20 bp, Artificial Sequence
  chemically synthesized
gttcccagcagtcggcagta

SEQ ID NO: 553148 - DNA, 20 bp, Artificial Sequence
  chemically synthesized
ttactgccgactgctgggaa

SEQ ID NO: 553149 - DNA, 20 bp, Artificial Sequence
  chemically synthesized
agctgcataataaatgactg

SEQ ID NO: 553150 - DNA, 20 bp, Artificial Sequence
  chemically synthesized
atccactgttttttaggcag

SEQ ID NO: 553151 - DNA, 20 bp, Artificial Sequence
  chemically synthesized
tgcatgctatattttacaac

SEQ ID NO: 553152 - DNA, 20 bp, Artificial Sequence
  chemically synthesized
cacaagaggcaaattccatt

SEQ ID NO: 553153 - DNA, 20 bp, Artificial Sequence
  chemically synthesized
tttcaaataagaggatattt

SEQ ID NO: 553154 - DNA, 20 bp, Artificial Sequence
  chemically synthesized
tgagtgatttcttcacaaag

SEQ ID NO: 553155 - DNA, 20 bp, Artificial Sequence
  chemically synthesized
aatctaatttcttactttgt

SEQ ID NO: 553156 - DNA, 20 bp, Artificial Sequence
  chemically synthesized
tcgtgaatcagtatttgtta

SEQ ID NO: 553157 - DNA, 20 bp, Artificial Sequence
  chemically synthesized
caggcaaacttggaagtttt

SEQ ID NO: 553158 - DNA, 20 bp, Artificial Sequence
  chemically synthesized
tatggtttgaaattataaca

SEQ ID NO: 553159 - DNA, 20 bp, Artificial Sequence
  chemically synthesized
agaaagtttaagtgttttca

SEQ ID NO: 553160 - DNA, 20 bp, Artificial Sequence
  chemically synthesized
ccccttaggaaaacactatt

SEQ ID NO: 553161 - DNA, 20 bp, Artificial Sequence
  chemically synthesized
tatacaaaaatcaaatggaa

SEQ ID NO: 553162 - DNA, 20 bp, Artificial Sequence
  chemically synthesized
ttagatataatttataaatg

SEQ ID NO: 553163 - DNA, 20 bp, Artificial Sequence
  chemically synthesized
aatgatatgtatattatttt

SEQ ID NO: 553164 - DNA, 20 bp, Artificial Sequence
  chemically synthesized
agcatatctattttagagat

SEQ ID NO: 553165 - DNA, 20 bp, Artificial Sequence
  chemically synthesized
ctggagaggctagtagaagc

SEQ ID NO: 553166 - DNA, 20 bp, Artificial Sequence
  chemically synthesized
ggaaggagtccagcatttta

SEQ ID NO: 553167 - DNA, 20 bp, Artificial Sequence
  chemically synthesized
cagacttatgaatagatgaa

SEQ ID NO: 553168 - DNA, 20 bp, Artificial Sequence
  chemically synthesized
taccaagggcagagggaggg

SEQ ID NO: 553169 - DNA, 20 bp, Artificial Sequence
  chemically synthesized
gtgaaataagccaggcatag

SEQ ID NO: 553170 - DNA, 20 bp, Artificial Sequence
  chemically synthesized
acatcaacagataaattaat

SEQ ID NO: 553171 - DNA, 20 bp, Artificial Sequence
  chemically synthesized
aaaaaaataacaagttttgg

SEQ ID NO: 553172 - DNA, 20 bp, Artificial Sequence
  chemically synthesized
tccttgatgattagcgcttt

SEQ ID NO: 553173 - DNA, 20 bp, Artificial Sequence
  chemically synthesized
gaagagacaactgtggaatg

SEQ ID NO: 553174 - DNA, 20 bp, Artificial Sequence
  chemically synthesized
atcattgccaagaccaattt

SEQ ID NO: 553175 - DNA, 20 bp, Artificial Sequence
  chemically synthesized
ctgaaactacaaaattccta

SEQ ID NO: 553176 - DNA, 20 bp, Artificial Sequence
  chemically synthesized
aagtcagctaaaaattgatt

SEQ ID NO: 553177 - DNA, 20 bp, Artificial Sequence
  chemically synthesized
aaactggatatacacatgct

SEQ ID NO: 553178 - DNA, 20 bp, Artificial Sequence
  chemically synthesized
tttcaaacaccatttattaa

SEQ ID NO: 553179 - DNA, 20 bp, Artificial Sequence
  chemically synthesized
cagacatatagaccaatgca

SEQ ID NO: 553180 - DNA, 20 bp, Artificial Sequence
  chemically synthesized
caaatgaaacaacaaaagaa

SEQ ID NO: 553181 - DNA, 20 bp, Artificial Sequence
  chemically synthesized
aaaattcaaatgaaacaaca

SEQ ID NO: 553182 - DNA, 20 bp, Artificial Sequence
  chemically synthesized
ccaccgtgcgtggcctgatt

SEQ ID NO: 553183 - DNA, 20 bp, Artificial Sequence
  chemically synthesized
accccgtctctactaaaaat

SEQ ID NO: 553184 - DNA, 20 bp, Artificial Sequence
  chemically synthesized
ctactcgggaggctgaggca

SEQ ID NO: 553185 - DNA, 20 bp, Artificial Sequence
  chemically synthesized
ttcatttacagtatcatcag

SEQ ID NO: 553186 - DNA, 20 bp, Artificial Sequence
  chemically synthesized
catttatctgttaatggcac

SEQ ID NO: 553187 - DNA, 20 bp, Artificial Sequence
  chemically synthesized
ttaagtgaaataagccaggc

SEQ ID NO: 553188 - DNA, 20 bp, Artificial Sequence
  chemically synthesized
tacaaaagtacagttagata

SEQ ID NO: 553189 - DNA, 20 bp, Artificial Sequence
  chemically synthesized
ccctactatgctctcaaaca

SEQ ID NO: 553190 - DNA, 20 bp, Artificial Sequence
  chemically synthesized
atttggaatgttcccattac

SEQ ID NO: 553191 - DNA, 20 bp, Artificial Sequence
  chemically synthesized
aatcaactgatttcattttt

SEQ ID NO: 553192 - DNA, 20 bp, Artificial Sequence
  chemically synthesized
actgatttcatttttagaga

SEQ ID NO: 553193 - DNA, 20 bp, Artificial Sequence
  chemically synthesized
atcattagggctttctacat

SEQ ID NO: 553194 - DNA, 20 bp, Artificial Sequence
  chemically synthesized
tagatgccacgattctatat

SEQ ID NO: 553195 - DNA, 20 bp, Artificial Sequence
  chemically synthesized
tcagagcaattaggcaagag

SEQ ID NO: 553196 - DNA, 20 bp, Artificial Sequence
  chemically synthesized
ctagtcagagcaattaggca

SEQ ID NO: 553197 - DNA, 20 bp, Artificial Sequence
  chemically synthesized
aaactgtcaacaaaataagt

SEQ ID NO: 553198 - DNA, 20 bp, Artificial Sequence
  chemically synthesized
acatgaccatcttaatagat

SEQ ID NO: 553199 - DNA, 20 bp, Artificial Sequence
  chemically synthesized
tgtgtgccaagtatggaatg

SEQ ID NO: 553200 - DNA, 20 bp, Artificial Sequence
  chemically synthesized
gttacctccttaagtgtcac

SEQ ID NO: 553201 - DNA, 20 bp, Artificial Sequence
  chemically synthesized
attaatatacttgtcattat

SEQ ID NO: 553202 - DNA, 20 bp, Artificial Sequence
  chemically synthesized
tacttgtcattattaaaaca

SEQ ID NO: 553203 - DNA, 20 bp, Artificial Sequence
  chemically synthesized
ctataatccagaaagacagt

SEQ ID NO: 553204 - DNA, 20 bp, Artificial Sequence
  chemically synthesized
gtaatacatgcatatgagta

SEQ ID NO: 553205 - DNA, 20 bp, Artificial Sequence
  chemically synthesized
aacaacaactaaattaaaat

SEQ ID NO: 553206 - DNA, 20 bp, Artificial Sequence
  chemically synthesized
gatatgttgtgaaaatgcag

SEQ ID NO: 553207 - DNA, 20 bp, Artificial Sequence
  chemically synthesized
aaatgttacagtgttggtgt

SEQ ID NO: 553208 - DNA, 20 bp, Artificial Sequence
  chemically synthesized
caagtaagaactcagtacct

SEQ ID NO: 553209 - DNA, 20 bp, Artificial Sequence
  chemically synthesized
tcagtacctgaaaacaatga

SEQ ID NO: 553210 - DNA, 20 bp, Artificial Sequence
  chemically synthesized
agagctaatgtgtctaaaag

SEQ ID NO: 553211 - DNA, 20 bp, Artificial Sequence
  chemically synthesized
taaaagaaaaacaaaaagat

SEQ ID NO: 553212 - DNA, 20 bp, Artificial Sequence
  chemically synthesized
ggatttttaaaactcagatt

SEQ ID NO: 553213 - DNA, 20 bp, Artificial Sequence
  chemically synthesized
tttctttacccaaggatttt

SEQ ID NO: 553214 - DNA, 20 bp, Artificial Sequence
  chemically synthesized
aaaggaaaaaaatgcaagac

SEQ ID NO: 553215 - DNA, 20 bp, Artificial Sequence
  chemically synthesized
ttccttcataattttcaaaa

SEQ ID NO: 553216 - DNA, 20 bp, Artificial Sequence
  chemically synthesized
cacaattatcaggaacaccc

SEQ ID NO: 553217 - DNA, 20 bp, Artificial Sequence
  chemically synthesized
aattaattattaataatgga

SEQ ID NO: 553218 - DNA, 20 bp, Artificial Sequence
  chemically synthesized
aattgattcaaatgttacaa

SEQ ID NO: 553219 - DNA, 20 bp, Artificial Sequence
  chemically synthesized
ataaactttgggaaaaggtg

SEQ ID NO: 553220 - DNA, 20 bp, Artificial Sequence
  chemically synthesized
aattatgtcttgtggcattt

SEQ ID NO: 553221 - DNA, 20 bp, Artificial Sequence
  chemically synthesized
aataaatctaaaaaagcaac

SEQ ID NO: 553222 - DNA, 20 bp, Artificial Sequence
  chemically synthesized
aggaggaaactacaccacac

SEQ ID NO: 553223 - DNA, 20 bp, Artificial Sequence
  chemically synthesized
gacatatagatatatgaaat

SEQ ID NO: 553224 - DNA, 20 bp, Artificial Sequence
  chemically synthesized
gatatcacgccaaaaggatg

SEQ ID NO: 553225 - DNA, 20 bp, Artificial Sequence
  chemically synthesized
cacacatacacacacacaca

SEQ ID NO: 553226 - DNA, 20 bp, Artificial Sequence
  chemically synthesized
tttataaaaacccctaaaaa

SEQ ID NO: 553227 - DNA, 20 bp, Artificial Sequence
  chemically synthesized
agttgtttataaaaacccct

SEQ ID NO: 553228 - DNA, 20 bp, Artificial Sequence
  chemically synthesized
tataaaaaaaagttgtttat

SEQ ID NO: 553229 - DNA, 20 bp, Artificial Sequence
  chemically synthesized
attgtacaaaaaagttataa

SEQ ID NO: 553230 - DNA, 20 bp, Artificial Sequence
  chemically synthesized
tgtacaattgcatagacgtg

SEQ ID NO: 553231 - DNA, 20 bp, Artificial Sequence
  chemically synthesized
gtaaaacctgccattgttaa

SEQ ID NO: 553232 - DNA, 20 bp, Artificial Sequence
  chemically synthesized
ctttgttgtatgaatattat

SEQ ID NO: 553233 - DNA, 20 bp, Artificial Sequence
  chemically synthesized
catgcgggaatcaggagttg

SEQ ID NO: 553234 - DNA, 20 bp, Artificial Sequence
  chemically synthesized
acttcctacattgtgtcctg

SEQ ID NO: 553235 - DNA, 20 bp, Artificial Sequence
  chemically synthesized
aataattaaaattagccatg

SEQ ID NO: 553236 - DNA, 20 bp, Artificial Sequence
  chemically synthesized
atatctcttgaaataaatat

SEQ ID NO: 553237 - DNA, 20 bp, Artificial Sequence
  chemically synthesized
tttttggctttctgtgccat

SEQ ID NO: 553238 - DNA, 20 bp, Artificial Sequence
  chemically synthesized
ttacggttaacaaaatcagt

SEQ ID NO: 553239 - DNA, 20 bp, Artificial Sequence
  chemically synthesized
tgtagtccacctagtagcta

SEQ ID NO: 553240 - DNA, 20 bp, Artificial Sequence
  chemically synthesized
agtagctagaaaacatatta

SEQ ID NO: 553241 - DNA, 20 bp, Artificial Sequence
  chemically synthesized
aaacatcaacgaaaagggga

SEQ ID NO: 553242 - DNA, 20 bp, Artificial Sequence
  chemically synthesized
gatggcagttcaaaatataa

SEQ ID NO: 553243 - DNA, 20 bp, Artificial Sequence
  chemically synthesized
ctatttaaagatttgccagg

SEQ ID NO: 553244 - DNA, 20 bp, Artificial Sequence
  chemically synthesized
tcttttttctggatctaatg

SEQ ID NO: 553245 - DNA, 20 bp, Artificial Sequence
  chemically synthesized
ccttcaggcacaaggtgaca

SEQ ID NO: 553246 - DNA, 20 bp, Artificial Sequence
  chemically synthesized
ttgcagttagcgccaacttg

SEQ ID NO: 553247 - DNA, 20 bp, Artificial Sequence
  chemically synthesized
tctcaattccaatcgctgtg

SEQ ID NO: 553248 - DNA, 20 bp, Artificial Sequence
  chemically synthesized
gtttccagaagccaaagaat

SEQ ID NO: 553249 - DNA, 20 bp, Artificial Sequence
  chemically synthesized
ttaaacacaggagtcgtaat

SEQ ID NO: 553250 - DNA, 20 bp, Artificial Sequence
  chemically synthesized
gtaagaagcatctttcaccg

SEQ ID NO: 553251 - DNA, 20 bp, Artificial Sequence
  chemically synthesized
aacccataaataggcatttt

SEQ ID NO: 553252 - DNA, 20 bp, Artificial Sequence
  chemically synthesized
taggcattttaaaaacctct

SEQ ID NO: 553253 - DNA, 20 bp, Artificial Sequence
  chemically synthesized
tgactcagtctccttatctg

SEQ ID NO: 553254 - DNA, 20 bp, Artificial Sequence
  chemically synthesized
tgaagtcatcccagaagaat

SEQ ID NO: 553255 - DNA, 20 bp, Artificial Sequence
  chemically synthesized
agagatatcagaaagggaaa

SEQ ID NO: 553256 - DNA, 20 bp, Artificial Sequence
  chemically synthesized
ctggaaaaaaaaaaaaaaaa

SEQ ID NO: 553257 - DNA, 20 bp, Artificial Sequence
  chemically synthesized
aaaaaaaaaaaacagaaaca

SEQ ID NO: 553258 - DNA, 20 bp, Artificial Sequence
  chemically synthesized
gttcacgcattaaactggat

SEQ ID NO: 553259 - DNA, 20 bp, Artificial Sequence
  chemically synthesized
attaagtttgagttgtcctt

SEQ ID NO: 553260 - DNA, 20 bp, Artificial Sequence
  chemically synthesized
atgaaattggaggcatttga

SEQ ID NO: 553261 - DNA, 20 bp, Artificial Sequence
  chemically synthesized
tgctatagttaaaacagttt

SEQ ID NO: 553262 - DNA, 20 bp, Artificial Sequence
  chemically synthesized
agatgtcccattgctatagt

SEQ ID NO: 553263 - DNA, 20 bp, Artificial Sequence
  chemically synthesized
tatagcaatgggacatctcc

SEQ ID NO: 553264 - DNA, 20 bp, Artificial Sequence
  chemically synthesized
tcagtggctccaagaagact

SEQ ID NO: 553265 - DNA, 20 bp, Artificial Sequence
  chemically synthesized
cgacaccaatagaaaccttt

SEQ ID NO: 553266 - DNA, 20 bp, Artificial Sequence
  chemically synthesized
actcactcaaggttagggtt

SEQ ID NO: 553267 - DNA, 20 bp, Artificial Sequence
  chemically synthesized
aagagaaggagagagggaag

SEQ ID NO: 553268 - DNA, 20 bp, Artificial Sequence
  chemically synthesized
acataaagatacttttttaa

SEQ ID NO: 553269 - DNA, 20 bp, Artificial Sequence
  chemically synthesized
tgtaactttggtctagtttt

SEQ ID NO: 553270 - DNA, 20 bp, Artificial Sequence
  chemically synthesized
tcctaaagatctcaagtttt

SEQ ID NO: 553271 - DNA, 20 bp, Artificial Sequence
  chemically synthesized
ttttcactttagaaaaagtt

SEQ ID NO: 553272 - DNA, 20 bp, Artificial Sequence
  chemically synthesized
aaggactagttctacgctga

SEQ ID NO: 553273 - DNA, 20 bp, Artificial Sequence
  chemically synthesized
gtgttccaataaagctttat

SEQ ID NO: 553274 - DNA, 20 bp, Artificial Sequence
  chemically synthesized
ttaccaacccaacagctttg

SEQ ID NO: 553275 - DNA, 20 bp, Artificial Sequence
  chemically synthesized
aagataagctcttaatgcag

SEQ ID NO: 553276 - DNA, 20 bp, Artificial Sequence
  chemically synthesized
aaagctctgccattctatag

SEQ ID NO: 553277 - DNA, 20 bp, Artificial Sequence
  chemically synthesized
atgaagagcataagtttttt

SEQ ID NO: 553278 - DNA, 20 bp, Artificial Sequence
  chemically synthesized
cagaggaaaagccgttttta

SEQ ID NO: 553279 - DNA, 20 bp, Artificial Sequence
  chemically synthesized
ggacagctgtttgagtaact

SEQ ID NO: 553280 - DNA, 20 bp, Artificial Sequence
  chemically synthesized
gagttactcaaacagctgtc

SEQ ID NO: 553281 - DNA, 20 bp, Artificial Sequence
  chemically synthesized
gttctcattgttgtgttaca

SEQ ID NO: 553282 - DNA, 20 bp, Artificial Sequence
  chemically synthesized
catggatggtagtgttagaa

SEQ ID NO: 553283 - DNA, 20 bp, Artificial Sequence
  chemically synthesized
agataattcaaccaggcaag

SEQ ID NO: 553284 - DNA, 20 bp, Artificial Sequence
  chemically synthesized
tttttctattttatttattt

SEQ ID NO: 553285 - DNA, 20 bp, Artificial Sequence
  chemically synthesized
tttttaaataaataaaatag

SEQ ID NO: 553286 - DNA, 20 bp, Artificial Sequence
  chemically synthesized
cctctgatatggataaccat

SEQ ID NO: 553287 - DNA, 20 bp, Artificial Sequence
  chemically synthesized
tatgccatttttcaaaatta

SEQ ID NO: 553288 - DNA, 20 bp, Artificial Sequence
  chemically synthesized
tagttggaaagaaagcatcc

SEQ ID NO: 553289 - DNA, 20 bp, Artificial Sequence
  chemically synthesized
cctgagttagctgaaagtag

SEQ ID NO: 553290 - DNA, 20 bp, Artificial Sequence
  chemically synthesized
acaaaacaattaaatacaca

SEQ ID NO: 553291 - DNA, 20 bp, Artificial Sequence
  chemically synthesized
aaattcacattcttaaaaaa

SEQ ID NO: 553292 - DNA, 20 bp, Artificial Sequence
  chemically synthesized
aaaataaattcacattctta

SEQ ID NO: 553293 - DNA, 20 bp, Artificial Sequence
  chemically synthesized
acactgaacaaaaagatagg

SEQ ID NO: 553294 - DNA, 20 bp, Artificial Sequence
  chemically synthesized
gcctagagaaacaaaaggga

SEQ ID NO: 553295 - DNA, 20 bp, Artificial Sequence
  chemically synthesized
tttggtttattgccctcaca

SEQ ID NO: 553296 - DNA, 20 bp, Artificial Sequence
  chemically synthesized
ccagaaacgaacagtagcag

SEQ ID NO: 553297 - DNA, 20 bp, Artificial Sequence
  chemically synthesized
tgcgtattttacccccatac

SEQ ID NO: 553298 - DNA, 20 bp, Artificial Sequence
  chemically synthesized
ttcctcaccttaataaaagc

SEQ ID NO: 553299 - DNA, 20 bp, Artificial Sequence
  chemically synthesized
aatggaaaattacatttata

SEQ ID NO: 553300 - DNA, 20 bp, Artificial Sequence
  chemically synthesized
acttgctcataaataacaaa

SEQ ID NO: 553301 - DNA, 20 bp, Artificial Sequence
  chemically synthesized
atcattacccttggagaaaa

SEQ ID NO: 553302 - DNA, 20 bp, Artificial Sequence
  chemically synthesized
acaaatattatactacagta

SEQ ID NO: 553303 - DNA, 20 bp, Artificial Sequence
  chemically synthesized
gtgagaccctgtctctattt

SEQ ID NO: 553304 - DNA, 20 bp, Artificial Sequence
  chemically synthesized
ctgtctctatttaaaaacaa

SEQ ID NO: 553305 - DNA, 20 bp, Artificial Sequence
  chemically synthesized
atttaaaaacaaaaaaacaa

SEQ ID NO: 553306 - DNA, 20 bp, Artificial Sequence
  chemically synthesized
aaaaagtcaattgaaaaagg

SEQ ID NO: 553307 - DNA, 20 bp, Artificial Sequence
  chemically synthesized
ttgtatttttggttaaatgt

SEQ ID NO: 553308 - DNA, 20 bp, Artificial Sequence
  chemically synthesized
taatgaaatatgaatattct

SEQ ID NO: 553309 - DNA, 20 bp, Artificial Sequence
  chemically synthesized
aatgtcttctttataaaacc

SEQ ID NO: 553310 - DNA, 20 bp, Artificial Sequence
  chemically synthesized
tgtttgtaatgtcttcttta

SEQ ID NO: 553311 - DNA, 20 bp, Artificial Sequence
  chemically synthesized
tagatggaagtgacaatgtg

SEQ ID NO: 553312 - DNA, 20 bp, Artificial Sequence
  chemically synthesized
tgcacattgtcacttccatc

SEQ ID NO: 553313 - DNA, 20 bp, Artificial Sequence
  chemically synthesized
ttcaccagataatggtagtt

SEQ ID NO: 553314 - DNA, 20 bp, Artificial Sequence
  chemically synthesized
ttggcttctttgctttaatg

SEQ ID NO: 553315 - DNA, 20 bp, Artificial Sequence
  chemically synthesized
tattacattctaggtagtat

SEQ ID NO: 553316 - DNA, 20 bp, Artificial Sequence
  chemically synthesized
tgaaaatatggagaaaagaa

SEQ ID NO: 553317 - DNA, 20 bp, Artificial Sequence
  chemically synthesized
agagaaaaaaagcaatgcat

SEQ ID NO: 553318 - DNA, 20 bp, Artificial Sequence
  chemically synthesized
tcagaatatattgtaaaagt

SEQ ID NO: 553319 - DNA, 20 bp, Artificial Sequence
  chemically synthesized
agatttttaaaatgcctttt

SEQ ID NO: 553320 - DNA, 20 bp, Artificial Sequence
  chemically synthesized
tttaaaaaccacaaaagttt

SEQ ID NO: 553321 - DNA, 20 bp, Artificial Sequence
  chemically synthesized
gcagagtgaacaagagctgg

SEQ ID NO: 553322 - DNA, 20 bp, Artificial Sequence
  chemically synthesized
ggggaagtgccacacacttt

SEQ ID NO: 553323 - DNA, 20 bp, Artificial Sequence
  chemically synthesized
atcacgagaacagcatgggg

SEQ ID NO: 553324 - DNA, 20 bp, Artificial Sequence
  chemically synthesized
atcacaagcccctcatcacc

SEQ ID NO: 553325 - DNA, 20 bp, Artificial Sequence
  chemically synthesized
agcccctcatcaccaaaaac

SEQ ID NO: 553326 - DNA, 20 bp, Artificial Sequence
  chemically synthesized
gatgtcagtgtggatgtggt

SEQ ID NO: 553327 - DNA, 20 bp, Artificial Sequence
  chemically synthesized
aaactaggacaaccactatg

SEQ ID NO: 553328 - DNA, 20 bp, Artificial Sequence
  chemically synthesized
aaacaccacctgggttccct

SEQ ID NO: 553329 - DNA, 20 bp, Artificial Sequence
  chemically synthesized
accaaatagctaataatcca

SEQ ID NO: 553330 - DNA, 20 bp, Artificial Sequence
  chemically synthesized
taatttgtttagattcagac

SEQ ID NO: 553331 - DNA, 20 bp, Artificial Sequence
  chemically synthesized
agaagtactagtaactggct

SEQ ID NO: 553332 - DNA, 20 bp, Artificial Sequence
  chemically synthesized
aacaacaacaacaacaacaa

SEQ ID NO: 553333 - DNA, 20 bp, Artificial Sequence
  chemically synthesized
tgcatgattaagttccaaaa

SEQ ID NO: 553334 - DNA, 20 bp, Artificial Sequence
  chemically synthesized
ttgctctttttcataagtag

SEQ ID NO: 553335 - DNA, 20 bp, Artificial Sequence
  chemically synthesized
aggggatggagaatcttgag

SEQ ID NO: 553336 - DNA, 20 bp, Artificial Sequence
  chemically synthesized
acctatatggtaatctggca

SEQ ID NO: 553337 - DNA, 20 bp, Artificial Sequence
  chemically synthesized
tcaaattgggggacattcta

SEQ ID NO: 553338 - DNA, 20 bp, Artificial Sequence
  chemically synthesized
gaacaatttcaaacttatgg

SEQ ID NO: 553339 - DNA, 20 bp, Artificial Sequence
  chemically synthesized
ataaaatataaaatgcttca

SEQ ID NO: 553340 - DNA, 20 bp, Artificial Sequence
  chemically synthesized
gtagttctttatagcagtgt

SEQ ID NO: 553341 - DNA, 20 bp, Artificial Sequence
  chemically synthesized
ttgcaaagtctgtaaattct

SEQ ID NO: 553342 - DNA, 20 bp, Artificial Sequence
  chemically synthesized
aaatgacaacacactacatg

SEQ ID NO: 553343 - DNA, 20 bp, Artificial Sequence
  chemically synthesized
cttttccttctcaaaaaaat

SEQ ID NO: 553344 - DNA, 20 bp, Artificial Sequence
  chemically synthesized
gatctccaaatttttcgcca

SEQ ID NO: 553345 - DNA, 20 bp, Artificial Sequence
  chemically synthesized
ccaagtatttgtggccttca

SEQ ID NO: 553346 - DNA, 20 bp, Artificial Sequence
  chemically synthesized
gtctagccagacacagcagg

SEQ ID NO: 553347 - DNA, 20 bp, Artificial Sequence
  chemically synthesized
aggcataaatgatcaaaggt

SEQ ID NO: 553348 - DNA, 20 bp, Artificial Sequence
  chemically synthesized
ggccaagagaagggaaggtg

SEQ ID NO: 553349 - DNA, 20 bp, Artificial Sequence
  chemically synthesized
gcagctctatctggcccaca

SEQ ID NO: 553350 - DNA, 20 bp, Artificial Sequence
  chemically synthesized
tggggctaagtcatccaaaa

SEQ ID NO: 553351 - DNA, 20 bp, Artificial Sequence
  chemically synthesized
gatgagactatgtgagatct

SEQ ID NO: 553352 - DNA, 20 bp, Artificial Sequence
  chemically synthesized
tagttctttaagcctccatc

SEQ ID NO: 553353 - DNA, 20 bp, Artificial Sequence
  chemically synthesized
gtgttagggattaggagaaa

SEQ ID NO: 553354 - DNA, 20 bp, Artificial Sequence
  chemically synthesized
ttgaaatacatcttggggaa

SEQ ID NO: 553355 - DNA, 20 bp, Artificial Sequence
  chemically synthesized
gtatttcaaattggtcaaga

SEQ ID NO: 553356 - DNA, 20 bp, Artificial Sequence
  chemically synthesized
gatagaagtagaggagatag

SEQ ID NO: 553357 - DNA, 20 bp, Artificial Sequence
  chemically synthesized
attcatttttccctcttaaa

SEQ ID NO: 553358 - DNA, 20 bp, Artificial Sequence
  chemically synthesized
actggtaagattgtcatcat

SEQ ID NO: 553359 - DNA, 20 bp, Artificial Sequence
  chemically synthesized
tcttaccagtgctaaaagaa

SEQ ID NO: 553360 - DNA, 20 bp, Artificial Sequence
  chemically synthesized
tgttaacttttctttcttca

SEQ ID NO: 553361 - DNA, 20 bp, Artificial Sequence
  chemically synthesized
tgtatttttctttcacctac

SEQ ID NO: 553362 - DNA, 20 bp, Artificial Sequence
  chemically synthesized
agttcttaaatttaaagttt

SEQ ID NO: 553363 - DNA, 20 bp, Artificial Sequence
  chemically synthesized
gtgaggaggtgggccaaatg

SEQ ID NO: 553364 - DNA, 20 bp, Artificial Sequence
  chemically synthesized
aatgcacccatcaggttaac

SEQ ID NO: 553365 - DNA, 20 bp, Artificial Sequence
  chemically synthesized
taagaaaagattttcgtgaa

SEQ ID NO: 553366 - DNA, 20 bp, Artificial Sequence
  chemically synthesized
aaattcaagtcctaaatgtg

SEQ ID NO: 553367 - DNA, 20 bp, Artificial Sequence
  chemically synthesized
gatctctaacgatgcttccg

SEQ ID NO: 553368 - DNA, 20 bp, Artificial Sequence
  chemically synthesized
tagtcaagacaattttgagg

SEQ ID NO: 553369 - DNA, 20 bp, Artificial Sequence
  chemically synthesized
caagcattttcataaaatca

SEQ ID NO: 553370 - DNA, 20 bp, Artificial Sequence
  chemically synthesized
ggaaaaaaaagagtaacaag

SEQ ID NO: 553371 - DNA, 20 bp, Artificial Sequence
  chemically synthesized
ttgaatcaggtgatgtatat

SEQ ID NO: 553372 - DNA, 20 bp, Artificial Sequence
  chemically synthesized
agaaatcacagtaagaatta

SEQ ID NO: 553373 - DNA, 20 bp, Artificial Sequence
  chemically synthesized
tttctcaaactggacaatgg

SEQ ID NO: 553374 - DNA, 20 bp, Artificial Sequence
  chemically synthesized
tctccacatggaagcagaaa

SEQ ID NO: 553375 - DNA, 20 bp, Artificial Sequence
  chemically synthesized
aagcaaaacaaaacaaagaa

SEQ ID NO: 553376 - DNA, 20 bp, Artificial Sequence
  chemically synthesized
atgaaaaaaatgaagcaaaa

SEQ ID NO: 553377 - DNA, 20 bp, Artificial Sequence
  chemically synthesized
gtagaatgaaaaaaatgaag

SEQ ID NO: 553378 - DNA, 20 bp, Artificial Sequence
  chemically synthesized
tttttccctcttcattaaaa

SEQ ID NO: 553379 - DNA, 20 bp, Artificial Sequence
  chemically synthesized
gcagccatggtgttcctttt

SEQ ID NO: 553380 - DNA, 20 bp, Artificial Sequence
  chemically synthesized
ccatcttgaggtccatgtct

SEQ ID NO: 553381 - DNA, 20 bp, Artificial Sequence
  chemically synthesized
ctgttttcactggaaaccac

SEQ ID NO: 553382 - DNA, 20 bp, Artificial Sequence
  chemically synthesized
ctgttttggtggtttccagt

SEQ ID NO: 553383 - DNA, 20 bp, Artificial Sequence
  chemically synthesized
aacaaagatatctttgccaa

SEQ ID NO: 553384 - DNA, 20 bp, Artificial Sequence
  chemically synthesized
gatgaaatgtaactaggtct

SEQ ID NO: 553385 - DNA, 20 bp, Artificial Sequence
  chemically synthesized
catgcatatgtatgcacatg

SEQ ID NO: 553386 - DNA, 20 bp, Artificial Sequence
  chemically synthesized
acacacacatgagaataata

SEQ ID NO: 553387 - DNA, 20 bp, Artificial Sequence
  chemically synthesized
ggtatggctgggagaagcca

SEQ ID NO: 553388 - DNA, 20 bp, Artificial Sequence
  chemically synthesized
atttgaaatcagagccccac

SEQ ID NO: 553389 - DNA, 20 bp, Artificial Sequence
  chemically synthesized
tatctcagagcttcaggagg

SEQ ID NO: 553390 - DNA, 20 bp, Artificial Sequence
  chemically synthesized
gagaattcagactcaaatca

SEQ ID NO: 553391 - DNA, 20 bp, Artificial Sequence
  chemically synthesized
gactatgactgcatttatta

SEQ ID NO: 553392 - DNA, 20 bp, Artificial Sequence
  chemically synthesized
atttgaattttcttatattt

SEQ ID NO: 553393 - DNA, 20 bp, Artificial Sequence
  chemically synthesized
cccctacgttaatactgcat

SEQ ID NO: 553394 - DNA, 20 bp, Artificial Sequence
  chemically synthesized
aaaaaataaaaaaataaaaa

SEQ ID NO: 553395 - DNA, 20 bp, Artificial Sequence
  chemically synthesized
tggtaataattgacagctgt

SEQ ID NO: 553396 - DNA, 20 bp, Artificial Sequence
  chemically synthesized
acatacaaatttacactcaa

SEQ ID NO: 553397 - DNA, 20 bp, Artificial Sequence
  chemically synthesized
ttcccttaactcaacctgct

SEQ ID NO: 553398 - DNA, 20 bp, Artificial Sequence
  chemically synthesized
taaatgtatgatactgttaa

SEQ ID NO: 553399 - DNA, 20 bp, Artificial Sequence
  chemically synthesized
aatttgtctttcatttaaaa

SEQ ID NO: 553400 - DNA, 20 bp, Artificial Sequence
  chemically synthesized
ctgcaagcaagatgaacttt

SEQ ID NO: 553401 - DNA, 20 bp, Artificial Sequence
  chemically synthesized
tattttaggtcagccttaag

SEQ ID NO: 553402 - DNA, 20 bp, Artificial Sequence
  chemically synthesized
ttcttagcactgtccccctt

SEQ ID NO: 553403 - DNA, 20 bp, Artificial Sequence
  chemically synthesized
taaaatgtaaatgtcttata

SEQ ID NO: 553404 - DNA, 20 bp, Artificial Sequence
  chemically synthesized
ttctagtgatatctgcattt

SEQ ID NO: 553405 - DNA, 20 bp, Artificial Sequence
  chemically synthesized
tttagaacctcagatgtgct

SEQ ID NO: 553406 - DNA, 20 bp, Artificial Sequence
  chemically synthesized
catctgatcaggaatttgtg

SEQ ID NO: 553407 - DNA, 20 bp, Artificial Sequence
  chemically synthesized
ctggaaataagacagactaa

SEQ ID NO: 553408 - DNA, 20 bp, Artificial Sequence
  chemically synthesized
ggtcatcatcagccaaaagg

SEQ ID NO: 553409 - DNA, 20 bp, Artificial Sequence
  chemically synthesized
ggactagagttcttcacctc

SEQ ID NO: 553410 - DNA, 20 bp, Artificial Sequence
  chemically synthesized
atctcaataaaggtcttata

SEQ ID NO: 553411 - DNA, 20 bp, Artificial Sequence
  chemically synthesized
acaaaagatattaccccagt

SEQ ID NO: 553412 - DNA, 20 bp, Artificial Sequence
  chemically synthesized
gcttatttttggactctttt

SEQ ID NO: 553413 - DNA, 20 bp, Artificial Sequence
  chemically synthesized
aaaataatgtaagaaatgag

SEQ ID NO: 553414 - DNA, 20 bp, Artificial Sequence
  chemically synthesized
gatacctgaaaatcaacccc

SEQ ID NO: 553415 - DNA, 20 bp, Artificial Sequence
  chemically synthesized
aaaaacccatcaagtaacag

SEQ ID NO: 553416 - DNA, 20 bp, Artificial Sequence
  chemically synthesized
tcaagtctgaagtaaacttt

SEQ ID NO: 553417 - DNA, 20 bp, Artificial Sequence
  chemically synthesized
aaaaaggattccaaggacag

SEQ ID NO: 553418 - DNA, 20 bp, Artificial Sequence
  chemically synthesized
aattgtggaaagcttaacat

SEQ ID NO: 553419 - DNA, 20 bp, Artificial Sequence
  chemically synthesized
atgaactcctatttaatcct

SEQ ID NO: 553420 - DNA, 20 bp, Artificial Sequence
  chemically synthesized
ttattattacgtagagccag

SEQ ID NO: 553421 - DNA, 20 bp, Artificial Sequence
  chemically synthesized
ctttttaaagaatcctttct

SEQ ID NO: 553422 - DNA, 20 bp, Artificial Sequence
  chemically synthesized
agcaacctagtgcacccagg

SEQ ID NO: 553423 - DNA, 20 bp, Artificial Sequence
  chemically synthesized
gaactgggaaatgatcattg

SEQ ID NO: 553424 - DNA, 20 bp, Artificial Sequence
  chemically synthesized
tcatttcccagttcccaaat

SEQ ID NO: 553425 - DNA, 20 bp, Artificial Sequence
  chemically synthesized
ctgttcacctgcttatagga

SEQ ID NO: 553426 - DNA, 20 bp, Artificial Sequence
  chemically synthesized
ctcactggtccaccagtctg

SEQ ID NO: 553427 - DNA, 20 bp, Artificial Sequence
  chemically synthesized
ttcccccatctctcagactg

SEQ ID NO: 553428 - DNA, 20 bp, Artificial Sequence
  chemically synthesized
tcatttggtgacatgggccc

SEQ ID NO: 553429 - DNA, 20 bp, Artificial Sequence
  chemically synthesized
ctatcacaaaaacagcatgg

SEQ ID NO: 553430 - DNA, 20 bp, Artificial Sequence
  chemically synthesized
ctcatgagagttactatcac

SEQ ID NO: 553431 - DNA, 20 bp, Artificial Sequence
  chemically synthesized
tgcaggagaactgccctttt

SEQ ID NO: 553432 - DNA, 20 bp, Artificial Sequence
  chemically synthesized
ttcctctccactccaacttt

SEQ ID NO: 553433 - DNA, 20 bp, Artificial Sequence
  chemically synthesized
gagatttttaagtaaaaaga

SEQ ID NO: 553434 - DNA, 20 bp, Artificial Sequence
  chemically synthesized
attcccagggctggtaacta

SEQ ID NO: 553435 - DNA, 20 bp, Artificial Sequence
  chemically synthesized
aggaatttaaaggaaaaaga

SEQ ID NO: 553436 - DNA, 20 bp, Artificial Sequence
  chemically synthesized
ctaaggacacacaatggggc

SEQ ID NO: 553437 - DNA, 20 bp, Artificial Sequence
  chemically synthesized
cttatgggaggcactatggg

SEQ ID NO: 553438 - DNA, 20 bp, Artificial Sequence
  chemically synthesized
catacagtgcctgtgatttg

SEQ ID NO: 553439 - DNA, 20 bp, Artificial Sequence
  chemically synthesized
agaattttgaaaagcaagca

SEQ ID NO: 553440 - DNA, 20 bp, Artificial Sequence
  chemically synthesized
acctccctacaaccccctag

SEQ ID NO: 553441 - DNA, 20 bp, Artificial Sequence
  chemically synthesized
aatttgccatttcctgttga

SEQ ID NO: 553442 - DNA, 20 bp, Artificial Sequence
  chemically synthesized
acaggacagggcagatcaaa

SEQ ID NO: 553443 - DNA, 20 bp, Artificial Sequence
  chemically synthesized
ctccacagagttcccttcct

SEQ ID NO: 553444 - DNA, 20 bp, Artificial Sequence
  chemically synthesized
gtttgttctctaaaagaaca

SEQ ID NO: 553445 - DNA, 20 bp, Artificial Sequence
  chemically synthesized
tcagtgaagaccatggtaga

SEQ ID NO: 553446 - DNA, 20 bp, Artificial Sequence
  chemically synthesized
gccaaaaataaagctatcat

SEQ ID NO: 553447 - DNA, 20 bp, Artificial Sequence
  chemically synthesized
ctactcaggaaatgtttgct

SEQ ID NO: 553448 - DNA, 20 bp, Artificial Sequence
  chemically synthesized
tggtaataactgataaaaag

SEQ ID NO: 553449 - DNA, 20 bp, Artificial Sequence
  chemically synthesized
agtatgccacttcaggatga

SEQ ID NO: 553450 - DNA, 20 bp, Artificial Sequence
  chemically synthesized
gagctaaacagattatttta

SEQ ID NO: 553451 - DNA, 20 bp, Artificial Sequence
  chemically synthesized
accaatgacaaagctagaaa

SEQ ID NO: 553452 - DNA, 20 bp, Artificial Sequence
  chemically synthesized
tcctagcagatcttgaggaa

SEQ ID NO: 553453 - DNA, 20 bp, Artificial Sequence
  chemically synthesized
aaataagggggggaaaaaac

SEQ ID NO: 553454 - DNA, 20 bp, Artificial Sequence
  chemically synthesized
aaagcaaaataaggggggga

SEQ ID NO: 553455 - DNA, 20 bp, Artificial Sequence
  chemically synthesized
tcatttgaaaatctgagcaa

SEQ ID NO: 553456 - DNA, 20 bp, Artificial Sequence
  chemically synthesized
cctcaatgacttatataagt

SEQ ID NO: 553457 - DNA, 20 bp, Artificial Sequence
  chemically synthesized
taaataaaacttgtatttaa

SEQ ID NO: 553458 - DNA, 20 bp, Artificial Sequence
  chemically synthesized
tgtataaatttaaaaataaa

SEQ ID NO: 553459 - DNA, 20 bp, Artificial Sequence
  chemically synthesized
tttcccgcaagattagtcct

SEQ ID NO: 553460 - DNA, 20 bp, Artificial Sequence
  chemically synthesized
aaaaataattattgggtatt

SEQ ID NO: 553461 - DNA, 20 bp, Artificial Sequence
  chemically synthesized
ttgactcaatgttggatggc

SEQ ID NO: 553462 - DNA, 20 bp, Artificial Sequence
  chemically synthesized
agctaaagcttattttaaaa

SEQ ID NO: 553463 - DNA, 20 bp, Artificial Sequence
  chemically synthesized
gagtgtgataaattaggtgg

SEQ ID NO: 553464 - DNA, 20 bp, Artificial Sequence
  chemically synthesized
ttatcaggctagcagaaatg

SEQ ID NO: 553465 - DNA, 20 bp, Artificial Sequence
  chemically synthesized
ccatttctgctagcctgata

SEQ ID NO: 553466 - DNA, 20 bp, Artificial Sequence
  chemically synthesized
taaaaaacgtaaaagctcat

SEQ ID NO: 553467 - DNA, 20 bp, Artificial Sequence
  chemically synthesized
agacctaatcgaacattcct

SEQ ID NO: 553468 - DNA, 20 bp, Artificial Sequence
  chemically synthesized
gcaagactgatctgtagggg

SEQ ID NO: 553469 - DNA, 20 bp, Artificial Sequence
  chemically synthesized
gttagggaagcttttcttct

SEQ ID NO: 553470 - DNA, 20 bp, Artificial Sequence
  chemically synthesized
aacaaacaaacaaacaaaca

SEQ ID NO: 553471 - DNA, 20 bp, Artificial Sequence
  chemically synthesized
gttaacttttttagttgtaa

SEQ ID NO: 553472 - DNA, 20 bp, Artificial Sequence
  chemically synthesized
ttgagatgatttttatacct

SEQ ID NO: 553473 - DNA, 20 bp, Artificial Sequence
  chemically synthesized
caaatagtttaacctcctta

SEQ ID NO: 553474 - DNA, 20 bp, Artificial Sequence
  chemically synthesized
agtaaatgtgctcagtataa

SEQ ID NO: 553475 - DNA, 20 bp, Artificial Sequence
  chemically synthesized
taatgctcttgttggtgacc

SEQ ID NO: 553476 - DNA, 20 bp, Artificial Sequence
  chemically synthesized
ataccatccattaatggaga

SEQ ID NO: 553477 - DNA, 20 bp, Artificial Sequence
  chemically synthesized
tactctagtacaagacttct

SEQ ID NO: 553478 - DNA, 20 bp, Artificial Sequence
  chemically synthesized
gaaatttagtcattcttttt

SEQ ID NO: 553479 - DNA, 20 bp, Artificial Sequence
  chemically synthesized
ttcttagagatactgtgtgc

SEQ ID NO: 553480 - DNA, 20 bp, Artificial Sequence
  chemically synthesized
gttaatccaaaagatactat

SEQ ID NO: 553481 - DNA, 20 bp, Artificial Sequence
  chemically synthesized
tttggattaaccttaggaaa

SEQ ID NO: 553482 - DNA, 20 bp, Artificial Sequence
  chemically synthesized
gaaaaaaaaccatctgttct

SEQ ID NO: 553483 - DNA, 20 bp, Artificial Sequence
  chemically synthesized
tttaaattgtcaagaggaaa

SEQ ID NO: 553484 - DNA, 20 bp, Artificial Sequence
  chemically synthesized
agattaacagattaactctc

SEQ ID NO: 553485 - DNA, 20 bp, Artificial Sequence
  chemically synthesized
ttgatctgcagtgaagattt

SEQ ID NO: 553486 - DNA, 20 bp, Artificial Sequence
  chemically synthesized
ggatagcaactattacaagg

SEQ ID NO: 553487 - DNA, 20 bp, Artificial Sequence
  chemically synthesized
tggtcagagatgaatcattt

SEQ ID NO: 553488 - DNA, 20 bp, Artificial Sequence
  chemically synthesized
aaagccacttagtccacaaa

SEQ ID NO: 553489 - DNA, 20 bp, Artificial Sequence
  chemically synthesized
aaactaagtgcaaagccttc

SEQ ID NO: 553490 - DNA, 20 bp, Artificial Sequence
  chemically synthesized
cgcttcccacttcctaaaca

SEQ ID NO: 553491 - DNA, 20 bp, Artificial Sequence
  chemically synthesized
accaccaccttctcttttat

SEQ ID NO: 553492 - DNA, 20 bp, Artificial Sequence
  chemically synthesized
ttgtgtttgtcatattactt

SEQ ID NO: 553493 - DNA, 20 bp, Artificial Sequence
  chemically synthesized
aaataagagtttagtctaag

SEQ ID NO: 553494 - DNA, 20 bp, Artificial Sequence
  chemically synthesized
atacaattactgctattaaa

SEQ ID NO: 553495 - DNA, 20 bp, Artificial Sequence
  chemically synthesized
gaagttttaattttgaggaa

SEQ ID NO: 553496 - DNA, 20 bp, Artificial Sequence
  chemically synthesized
tttgttttcttcctcaaaat

SEQ ID NO: 553497 - DNA, 20 bp, Artificial Sequence
  chemically synthesized
taaaaatattttctaacaac

SEQ ID NO: 553498 - DNA, 20 bp, Artificial Sequence
  chemically synthesized
gctacacgtaagctaatgag

SEQ ID NO: 553499 - DNA, 20 bp, Artificial Sequence
  chemically synthesized
gaaggctatgctttcctttt

SEQ ID NO: 553500 - DNA, 20 bp, Artificial Sequence
  chemically synthesized
tctaaactagatcctttttt

SEQ ID NO: 553501 - DNA, 20 bp, Artificial Sequence
  chemically synthesized
agcaaacaaagtgcctattt

SEQ ID NO: 553502 - DNA, 20 bp, Artificial Sequence
  chemically synthesized
tctcagagtttataatgcta

SEQ ID NO: 553503 - DNA, 20 bp, Artificial Sequence
  chemically synthesized
ccaaactcagcatcatactt

SEQ ID NO: 553504 - DNA, 20 bp, Artificial Sequence
  chemically synthesized
atgtctcccaggaatacagc

SEQ ID NO: 553505 - DNA, 20 bp, Artificial Sequence
  chemically synthesized
ttcacctggtggaggaacca

SEQ ID NO: 553506 - DNA, 20 bp, Artificial Sequence
  chemically synthesized
ctcatcaagaaaagaaaaaa

SEQ ID NO: 553507 - DNA, 20 bp, Artificial Sequence
  chemically synthesized
aaggggaattaatatgtcca

SEQ ID NO: 553508 - DNA, 20 bp, Artificial Sequence
  chemically synthesized
gaattaatatgtccataaaa

SEQ ID NO: 553509 - DNA, 20 bp, Artificial Sequence
  chemically synthesized
aatatgtccataaaacaaaa

SEQ ID NO: 553510 - DNA, 20 bp, Artificial Sequence
  chemically synthesized
taaaacaaaacaaaacaaaa

SEQ ID NO: 553511 - DNA, 20 bp, Artificial Sequence
  chemically synthesized
tgatcagagtaacgggactg

SEQ ID NO: 553512 - DNA, 20 bp, Artificial Sequence
  chemically synthesized
ggtgtaaagtgaattaaaag

SEQ ID NO: 553513 - DNA, 20 bp, Artificial Sequence
  chemically synthesized
tcacagggggaaaaaaaaaa

SEQ ID NO: 553514 - DNA, 20 bp, Artificial Sequence
  chemically synthesized
gagactttgccaaggtacta

SEQ ID NO: 553515 - DNA, 20 bp, Artificial Sequence
  chemically synthesized
gatttaggacaggatgattt

SEQ ID NO: 553516 - DNA, 20 bp, Artificial Sequence
  chemically synthesized
cacaacactctccttaatta

SEQ ID NO: 553517 - DNA, 20 bp, Artificial Sequence
  chemically synthesized
accacactttatggtatttt

SEQ ID NO: 553518 - DNA, 20 bp, Artificial Sequence
  chemically synthesized
caactcctgatgctctaaat

SEQ ID NO: 553519 - DNA, 20 bp, Artificial Sequence
  chemically synthesized
agggacaggtttattttaga

SEQ ID NO: 553520 - DNA, 20 bp, Artificial Sequence
  chemically synthesized
aggctgtgcaaaataaacgt

SEQ ID NO: 553521 - DNA, 20 bp, Artificial Sequence
  chemically synthesized
tacaaccatgcacacagaat

SEQ ID NO: 553522 - DNA, 20 bp, Artificial Sequence
  chemically synthesized
acatgatctgcagtattgta

SEQ ID NO: 553523 - DNA, 20 bp, Artificial Sequence
  chemically synthesized
tcctgtacctgataaagagc

SEQ ID NO: 553524 - DNA, 20 bp, Artificial Sequence
  chemically synthesized
cggtgcctctcctacagtac

SEQ ID NO: 553525 - DNA, 20 bp, Artificial Sequence
  chemically synthesized
aacatatggaaggagggaag

SEQ ID NO: 553526 - DNA, 20 bp, Artificial Sequence
  chemically synthesized
tggaaaatttccagtctttt

SEQ ID NO: 553527 - DNA, 20 bp, Artificial Sequence
  chemically synthesized
ttttgaaaataattgcttca

SEQ ID NO: 553528 - DNA, 20 bp, Artificial Sequence
  chemically synthesized
ttttctgaagcaattatttt

SEQ ID NO: 553529 - DNA, 20 bp, Artificial Sequence
  chemically synthesized
tgtgaacaagaactttcaat

SEQ ID NO: 553530 - DNA, 20 bp, Artificial Sequence
  chemically synthesized
tgaatcgtatcagtcaatta

SEQ ID NO: 553531 - DNA, 20 bp, Artificial Sequence
  chemically synthesized
gaaacctctaaaagtttttg

SEQ ID NO: 553532 - DNA, 20 bp, Artificial Sequence
  chemically synthesized
tgtttacaaagaggttttac

SEQ ID NO: 553533 - DNA, 20 bp, Artificial Sequence
  chemically synthesized
gttattagaaaataaagtaa

SEQ ID NO: 553534 - DNA, 20 bp, Artificial Sequence
  chemically synthesized
gatagtcttaaaatatcatg

SEQ ID NO: 553535 - DNA, 20 bp, Artificial Sequence
  chemically synthesized
gaagattcacaaagcagcta

SEQ ID NO: 553536 - DNA, 20 bp, Artificial Sequence
  chemically synthesized
gaagcaagttctaagatgct

SEQ ID NO: 553537 - DNA, 20 bp, Artificial Sequence
  chemically synthesized
aacttcccaagaatcagtta

SEQ ID NO: 553538 - DNA, 20 bp, Artificial Sequence
  chemically synthesized
tacctcctccttcctggaac

SEQ ID NO: 553539 - DNA, 20 bp, Artificial Sequence
  chemically synthesized
gctactagatgacaagaaaa

SEQ ID NO: 553540 - DNA, 20 bp, Artificial Sequence
  chemically synthesized
tagatgacaagaaaagaaaa

SEQ ID NO: 553541 - DNA, 20 bp, Artificial Sequence
  chemically synthesized
cagaatcaacagggcatcat

SEQ ID NO: 553542 - DNA, 20 bp, Artificial Sequence
  chemically synthesized
aacaatcctatagggttgaa

SEQ ID NO: 553543 - DNA, 20 bp, Artificial Sequence
  chemically synthesized
tatctaataatataaaaaat

SEQ ID NO: 553544 - DNA, 20 bp, Artificial Sequence
  chemically synthesized
acaaaataaaaacaagaccc

SEQ ID NO: 553545 - DNA, 20 bp, Artificial Sequence
  chemically synthesized
tcagtattcaaaaacaaaat

SEQ ID NO: 553546 - DNA, 20 bp, Artificial Sequence
  chemically synthesized
ggagtaatatttcagtattc

SEQ ID NO: 553547 - DNA, 20 bp, Artificial Sequence
  chemically synthesized
atgactgttgctcctttgca

SEQ ID NO: 553548 - DNA, 20 bp, Artificial Sequence
  chemically synthesized
gccatcagagaaatgcaaat

SEQ ID NO: 553549 - DNA, 20 bp, Artificial Sequence
  chemically synthesized
agtaaactatcgcaaggaca

SEQ ID NO: 553550 - DNA, 20 bp, Artificial Sequence
  chemically synthesized
cacattgtgcacatgtaccc

SEQ ID NO: 553551 - DNA, 20 bp, Artificial Sequence
  chemically synthesized
cctagaaacagcacaagata

SEQ ID NO: 553552 - DNA, 20 bp, Artificial Sequence
  chemically synthesized
ctctctgccccacatctttt

SEQ ID NO: 553553 - DNA, 20 bp, Artificial Sequence
  chemically synthesized
aaagtacaataatcaaaatt

SEQ ID NO: 553554 - DNA, 20 bp, Artificial Sequence
  chemically synthesized
tttatgcagttagaaaaata

SEQ ID NO: 553555 - DNA, 20 bp, Artificial Sequence
  chemically synthesized
cgtggtaaaaaaaaaaaaca

SEQ ID NO: 553556 - DNA, 20 bp, Artificial Sequence
  chemically synthesized
tttagtacgtggtaaaaaaa

SEQ ID NO: 553557 - DNA, 20 bp, Artificial Sequence
  chemically synthesized
ccaatggaagactgaataaa

SEQ ID NO: 553558 - DNA, 20 bp, Artificial Sequence
  chemically synthesized
agcaaactaatgcaggaaca

SEQ ID NO: 553559 - DNA, 20 bp, Artificial Sequence
  chemically synthesized
tttaactcccacttataagt

SEQ ID NO: 553560 - DNA, 20 bp, Artificial Sequence
  chemically synthesized
cacatgggcagatagagggg

SEQ ID NO: 553561 - DNA, 20 bp, Artificial Sequence
  chemically synthesized
tagtttgccattgtcattta

SEQ ID NO: 553562 - DNA, 20 bp, Artificial Sequence
  chemically synthesized
cgagagccattcacataatt

SEQ ID NO: 553563 - DNA, 20 bp, Artificial Sequence
  chemically synthesized
tagaatgttctactctttca

SEQ ID NO: 553564 - DNA, 20 bp, Artificial Sequence
  chemically synthesized
atccatcatgttggctcttt

SEQ ID NO: 553565 - DNA, 20 bp, Artificial Sequence
  chemically synthesized
aacaaagccaacaaacaaaa

SEQ ID NO: 553566 - DNA, 20 bp, Artificial Sequence
  chemically synthesized
agcaaaacaaagccaacaaa

SEQ ID NO: 553567 - DNA, 20 bp, Artificial Sequence
  chemically synthesized
tgccaaaacaacagcaaaag

SEQ ID NO: 553568 - DNA, 20 bp, Artificial Sequence
  chemically synthesized
ggggaaaatggagttattgc

SEQ ID NO: 553569 - DNA, 20 bp, Artificial Sequence
  chemically synthesized
atttcaattgtgaggtttgt

SEQ ID NO: 553570 - DNA, 20 bp, Artificial Sequence
  chemically synthesized
ttttcgatacgcatttggtt

SEQ ID NO: 553571 - DNA, 20 bp, Artificial Sequence
  chemically synthesized
ctatatagagttgacccttg

SEQ ID NO: 553572 - DNA, 20 bp, Artificial Sequence
  chemically synthesized
gcctagtcatcctgaagagc

SEQ ID NO: 553573 - DNA, 20 bp, Artificial Sequence
  chemically synthesized
aatgtttggagtgtcgacca

SEQ ID NO: 553574 - DNA, 20 bp, Artificial Sequence
  chemically synthesized
tcgaccaaaaaacatcagag

SEQ ID NO: 553575 - DNA, 20 bp, Artificial Sequence
  chemically synthesized
agagggaaacttttattggt

SEQ ID NO: 553576 - DNA, 20 bp, Artificial Sequence
  chemically synthesized
agatagaggccaggattctg

SEQ ID NO: 553577 - DNA, 20 bp, Artificial Sequence
  chemically synthesized
taaccatatggttcacttgt

SEQ ID NO: 553578 - DNA, 20 bp, Artificial Sequence
  chemically synthesized
tgacctgtactaagtaaaat

SEQ ID NO: 553579 - DNA, 20 bp, Artificial Sequence
  chemically synthesized
cagaaaaaggtaaatttatg

SEQ ID NO: 553580 - DNA, 20 bp, Artificial Sequence
  chemically synthesized
tcacactatctgatggtttt

SEQ ID NO: 553581 - DNA, 20 bp, Artificial Sequence
  chemically synthesized
tgcagagaaactcccgtttt

SEQ ID NO: 553582 - DNA, 20 bp, Artificial Sequence
  chemically synthesized
tatgtctttatcagcagcgt

SEQ ID NO: 553583 - DNA, 20 bp, Artificial Sequence
  chemically synthesized
tttgctgaatttaaatttat

SEQ ID NO: 553584 - DNA, 20 bp, Artificial Sequence
  chemically synthesized
tgtgtacagactgtaattca

SEQ ID NO: 553585 - DNA, 20 bp, Artificial Sequence
  chemically synthesized
acagtctgtacacaaagatt

SEQ ID NO: 553586 - DNA, 20 bp, Artificial Sequence
  chemically synthesized
tgagtgataaaaagactcta

SEQ ID NO: 553587 - DNA, 20 bp, Artificial Sequence
  chemically synthesized
aaagactctataaaactata

SEQ ID NO: 553588 - DNA, 20 bp, Artificial Sequence
  chemically synthesized
caaaacctgcatgtaacaaa

SEQ ID NO: 553589 - DNA, 20 bp, Artificial Sequence
  chemically synthesized
tttcctcagtaactcaaagg

SEQ ID NO: 553590 - DNA, 20 bp, Artificial Sequence
  chemically synthesized
cacactaagagcaagatgtg

SEQ ID NO: 553591 - DNA, 20 bp, Artificial Sequence
  chemically synthesized
tatcagagctataagatata

SEQ ID NO: 553592 - DNA, 20 bp, Artificial Sequence
  chemically synthesized
tcttatctgtaacataaagt

SEQ ID NO: 553593 - DNA, 20 bp, Artificial Sequence
  chemically synthesized
caaaaaggaaaaaaaagaaa

SEQ ID NO: 553594 - DNA, 20 bp, Artificial Sequence
  chemically synthesized
ataattaaaacacgtaacat

SEQ ID NO: 553595 - DNA, 20 bp, Artificial Sequence
  chemically synthesized
gaacaacacattgacataat

SEQ ID NO: 553596 - DNA, 20 bp, Artificial Sequence
  chemically synthesized
caaggatcatccataaatgc

SEQ ID NO: 553597 - DNA, 20 bp, Artificial Sequence
  chemically synthesized
aaaagtcaatgtcatgaaag

SEQ ID NO: 553598 - DNA, 20 bp, Artificial Sequence
  chemically synthesized
caaaatgctgggagactgtt

SEQ ID NO: 553599 - DNA, 20 bp, Artificial Sequence
  chemically synthesized
ggtacagagacatgacagac

SEQ ID NO: 553600 - DNA, 20 bp, Artificial Sequence
  chemically synthesized
accttgactagatgctggaa

SEQ ID NO: 553601 - DNA, 20 bp, Artificial Sequence
  chemically synthesized
tgcttgaaatgtttccaaaa

SEQ ID NO: 553602 - DNA, 20 bp, Artificial Sequence
  chemically synthesized
gttaggtttgtatttttaga

SEQ ID NO: 553603 - DNA, 20 bp, Artificial Sequence
  chemically synthesized
aaggcaaaattacaggaaca

SEQ ID NO: 553604 - DNA, 20 bp, Artificial Sequence
  chemically synthesized
actttagaaggatgaagatg

SEQ ID NO: 553605 - DNA, 20 bp, Artificial Sequence
  chemically synthesized
cttagcagtaagtgtataaa

SEQ ID NO: 553606 - DNA, 20 bp, Artificial Sequence
  chemically synthesized
atcttcaaaattctggtgaa

SEQ ID NO: 553607 - DNA, 20 bp, Artificial Sequence
  chemically synthesized
ccatcctgaaagtaactcct

SEQ ID NO: 553608 - DNA, 20 bp, Artificial Sequence
  chemically synthesized
acagttgcttttatctataa

SEQ ID NO: 553609 - DNA, 20 bp, Artificial Sequence
  chemically synthesized
actaagtacaacaggaggca

SEQ ID NO: 553610 - DNA, 20 bp, Artificial Sequence
  chemically synthesized
cataataattaaaaatattt

SEQ ID NO: 553611 - DNA, 20 bp, Artificial Sequence
  chemically synthesized
atatatggcctgtcattgac

SEQ ID NO: 553612 - DNA, 20 bp, Artificial Sequence
  chemically synthesized
caagtatcacttttaggtgg

SEQ ID NO: 553613 - DNA, 20 bp, Artificial Sequence
  chemically synthesized
ctgtttagtctatcttcaga

SEQ ID NO: 553614 - DNA, 20 bp, Artificial Sequence
  chemically synthesized
ataaataaacacccctcccc

SEQ ID NO: 553615 - DNA, 20 bp, Artificial Sequence
  chemically synthesized
acctctcctttttcagatga

SEQ ID NO: 553616 - DNA, 20 bp, Artificial Sequence
  chemically synthesized
tgtatctcttaaactcgttg

SEQ ID NO: 553617 - DNA, 20 bp, Artificial Sequence
  chemically synthesized
gttagtggggagggatatga

SEQ ID NO: 553618 - DNA, 20 bp, Artificial Sequence
  chemically synthesized
tcaacctgattgcaaattgc

SEQ ID NO: 553619 - DNA, 20 bp, Artificial Sequence
  chemically synthesized
attgttaccattgctactaa

SEQ ID NO: 553620 - DNA, 20 bp, Artificial Sequence
  chemically synthesized
atatgggaaatgcttttctc

SEQ ID NO: 553621 - DNA, 20 bp, Artificial Sequence
  chemically synthesized
ggcaatggaaagcaatcaaa

SEQ ID NO: 553622 - DNA, 20 bp, Artificial Sequence
  chemically synthesized
aattataaatgttcaaagaa

SEQ ID NO: 553623 - DNA, 20 bp, Artificial Sequence
  chemically synthesized
gatttccccccagtctcata

SEQ ID NO: 553624 - DNA, 20 bp, Artificial Sequence
  chemically synthesized
gacgaagttagaccccttct

SEQ ID NO: 553625 - DNA, 20 bp, Artificial Sequence
  chemically synthesized
agttagaccccttctgaaaa

SEQ ID NO: 553626 - DNA, 20 bp, Artificial Sequence
  chemically synthesized
gaccccttctgaaaacaaaa

SEQ ID NO: 553627 - DNA, 20 bp, Artificial Sequence
  chemically synthesized
atgagtcagtactcgggcga

SEQ ID NO: 553628 - DNA, 20 bp, Artificial Sequence
  chemically synthesized
gacagagggagactccatct

SEQ ID NO: 553629 - DNA, 20 bp, Artificial Sequence
  chemically synthesized
agggagactccatctcaaaa

SEQ ID NO: 553630 - DNA, 20 bp, Artificial Sequence
  chemically synthesized
gactccatctcaaaacaaaa

SEQ ID NO: 553631 - DNA, 20 bp, Artificial Sequence
  chemically synthesized
tcaaaacaaaacaaaacaaa

SEQ ID NO: 553632 - DNA, 20 bp, Artificial Sequence
  chemically synthesized
gattttttaaaatccaatta

SEQ ID NO: 553633 - DNA, 20 bp, Artificial Sequence
  chemically synthesized
attgagaaaccctacataag

SEQ ID NO: 553634 - DNA, 20 bp, Artificial Sequence
  chemically synthesized
aaacagctcttagcacttga

SEQ ID NO: 553635 - DNA, 20 bp, Artificial Sequence
  chemically synthesized
tcttagcacttgaaaaaacc

SEQ ID NO: 553636 - DNA, 20 bp, Artificial Sequence
  chemically synthesized
cacttgaaaaaaccaaaaac

SEQ ID NO: 553637 - DNA, 20 bp, Artificial Sequence
  chemically synthesized
agcacagctgtccttttttt

SEQ ID NO: 553638 - DNA, 20 bp, Artificial Sequence
  chemically synthesized
ctcagcactgtcttctttcc

SEQ ID NO: 553639 - DNA, 20 bp, Artificial Sequence
  chemically synthesized
ctactgaagagctaatatga

SEQ ID NO: 553640 - DNA, 20 bp, Artificial Sequence
  chemically synthesized
catattttagaaattaatta

SEQ ID NO: 553641 - DNA, 20 bp, Artificial Sequence
  chemically synthesized
aagaagaaaattgcaacagt

SEQ ID NO: 553642 - DNA, 20 bp, Artificial Sequence
  chemically synthesized
agttatatgtctcttaatgc

SEQ ID NO: 553643 - DNA, 20 bp, Artificial Sequence
  chemically synthesized
cagagcaagactccgtctca

SEQ ID NO: 553644 - DNA, 20 bp, Artificial Sequence
  chemically synthesized
ggggatataagtctcctgcc

SEQ ID NO: 553645 - DNA, 20 bp, Artificial Sequence
  chemically synthesized
taaaattttatatctgagaa

SEQ ID NO: 553646 - DNA, 20 bp, Artificial Sequence
  chemically synthesized
tgccatcttaggtatcctgt

SEQ ID NO: 553647 - DNA, 20 bp, Artificial Sequence
  chemically synthesized
tatttttgtttcaccaacct

SEQ ID NO: 553648 - DNA, 20 bp, Artificial Sequence
  chemically synthesized
ttctctcgttctgaggatga

SEQ ID NO: 553649 - DNA, 20 bp, Artificial Sequence
  chemically synthesized
gcttataagcatttcaaggg

SEQ ID NO: 553650 - DNA, 20 bp, Artificial Sequence
  chemically synthesized
gttcttctgcttaaaaactg

SEQ ID NO: 553651 - DNA, 20 bp, Artificial Sequence
  chemically synthesized
cgcattgggttcttctgctt

SEQ ID NO: 553652 - DNA, 20 bp, Artificial Sequence
  chemically synthesized
ttacattgactgtgtctgaa

SEQ ID NO: 553653 - DNA, 20 bp, Artificial Sequence
  chemically synthesized
aggatccgtgtcctgtcttt

SEQ ID NO: 553654 - DNA, 20 bp, Artificial Sequence
  chemically synthesized
tattatgaagaatcaaagca

SEQ ID NO: 553655 - DNA, 20 bp, Artificial Sequence
  chemically synthesized
aaagttcaaaacaatcttaa

SEQ ID NO: 553656 - DNA, 20 bp, Artificial Sequence
  chemically synthesized
ataatgaatttggaaaagtt

SEQ ID NO: 553657 - DNA, 20 bp, Artificial Sequence
  chemically synthesized
tttaccaagtttcaattcct

SEQ ID NO: 553658 - DNA, 20 bp, Artificial Sequence
  chemically synthesized
caaataaaagcaatctatat

SEQ ID NO: 553659 - DNA, 20 bp, Artificial Sequence
  chemically synthesized
attttctatatttgcatata

SEQ ID NO: 553660 - DNA, 20 bp, Artificial Sequence
  chemically synthesized
aagacattttctacaaaatg

SEQ ID NO: 553661 - DNA, 20 bp, Artificial Sequence
  chemically synthesized
cgtaataaaataagaagcca

SEQ ID NO: 553662 - DNA, 20 bp, Artificial Sequence
  chemically synthesized
attcacatgtcatctgcaaa

SEQ ID NO: 553663 - DNA, 20 bp, Artificial Sequence
  chemically synthesized
acctgaatacaaactcttat

SEQ ID NO: 553664 - DNA, 20 bp, Artificial Sequence
  chemically synthesized
tctacaacaaaggtaaaagg

SEQ ID NO: 553665 - DNA, 20 bp, Artificial Sequence
  chemically synthesized
aggttttctgaaaagagttg

SEQ ID NO: 553666 - DNA, 20 bp, Artificial Sequence
  chemically synthesized
ttgttttgcaactcttttca

SEQ ID NO: 553667 - DNA, 20 bp, Artificial Sequence
  chemically synthesized
tatctcccttgtgtgcaatc

SEQ ID NO: 553668 - DNA, 20 bp, Artificial Sequence
  chemically synthesized
aacttcataaaatcttatta

SEQ ID NO: 553669 - DNA, 20 bp, Artificial Sequence
  chemically synthesized
aatcttattaaaaaacaaaa

SEQ ID NO: 553670 - DNA, 20 bp, Artificial Sequence
  chemically synthesized
attgataggccaaacaaaat

SEQ ID NO: 553671 - DNA, 20 bp, Artificial Sequence
  chemically synthesized
ctctcagattagaaaacaaa

SEQ ID NO: 553672 - DNA, 20 bp, Artificial Sequence
  chemically synthesized
tgtagattgctctcagatta

SEQ ID NO: 553673 - DNA, 20 bp, Artificial Sequence
  chemically synthesized
tgtgacagagcccgggaaat

SEQ ID NO: 553674 - DNA, 20 bp, Artificial Sequence
  chemically synthesized
ggctcaagagatccactgca

SEQ ID NO: 553675 - DNA, 20 bp, Artificial Sequence
  chemically synthesized
atcacaaatgactcaaagag

SEQ ID NO: 553676 - DNA, 20 bp, Artificial Sequence
  chemically synthesized
ttagagtcgaggcataaaaa

SEQ ID NO: 553677 - DNA, 20 bp, Artificial Sequence
  chemically synthesized
atctctttaaaaatttctgc

SEQ ID NO: 553678 - DNA, 20 bp, Artificial Sequence
  chemically synthesized
aataagcgagcctcaggtct

SEQ ID NO: 553679 - DNA, 20 bp, Artificial Sequence
  chemically synthesized
ttctaattaaatattaagaa

SEQ ID NO: 553680 - DNA, 20 bp, Artificial Sequence
  chemically synthesized
tttttctcttttaaaaaaag

SEQ ID NO: 553681 - DNA, 20 bp, Artificial Sequence
  chemically synthesized
tctttagagtatttcagagc

SEQ ID NO: 553682 - DNA, 20 bp, Artificial Sequence
  chemically synthesized
ttgagtatgtgccctctgag

SEQ ID NO: 553683 - DNA, 20 bp, Artificial Sequence
  chemically synthesized
aacaaaaaagaaaataattg

SEQ ID NO: 553684 - DNA, 20 bp, Artificial Sequence
  chemically synthesized
tgtgatggaaatgaacagag

SEQ ID NO: 553685 - DNA, 20 bp, Artificial Sequence
  chemically synthesized
tactgtgcagtgtgctctgc

SEQ ID NO: 553686 - DNA, 20 bp, Artificial Sequence
  chemically synthesized
atatatctttaaagctacat

SEQ ID NO: 553687 - DNA, 20 bp, Artificial Sequence
  chemically synthesized
tgtacctccatgagaaatca

SEQ ID NO: 553688 - DNA, 20 bp, Artificial Sequence
  chemically synthesized
ttactgactttacagaacag

SEQ ID NO: 553689 - DNA, 20 bp, Artificial Sequence
  chemically synthesized
tgctaatgacaacagtagga

SEQ ID NO: 553690 - DNA, 20 bp, Artificial Sequence
  chemically synthesized
atgcaatatacccacaacat

SEQ ID NO: 553691 - DNA, 20 bp, Artificial Sequence
  chemically synthesized
tacatcggcctacagttggg

SEQ ID NO: 553692 - DNA, 20 bp, Artificial Sequence
  chemically synthesized
cttttttttttttttaaagg

SEQ ID NO: 553693 - DNA, 20 bp, Artificial Sequence
  chemically synthesized
cttggggtgggggactctgc

SEQ ID NO: 553694 - DNA, 20 bp, Artificial Sequence
  chemically synthesized
aatggaaccaataattacta

SEQ ID NO: 553695 - DNA, 20 bp, Artificial Sequence
  chemically synthesized
tctttagcatctgactgaga

SEQ ID NO: 553696 - DNA, 20 bp, Artificial Sequence
  chemically synthesized
caacttgtaagagcagaaat

SEQ ID NO: 553697 - DNA, 20 bp, Artificial Sequence
  chemically synthesized
ttgtctgcggtacaggcaaa

SEQ ID NO: 553698 - DNA, 20 bp, Artificial Sequence
  chemically synthesized
taggagggtgccatatatag

SEQ ID NO: 553699 - DNA, 20 bp, Artificial Sequence
  chemically synthesized
taagttgaaatgacagacaa

SEQ ID NO: 553700 - DNA, 20 bp, Artificial Sequence
  chemically synthesized
cccagaaatagaccagatgg

SEQ ID NO: 553701 - DNA, 20 bp, Artificial Sequence
  chemically synthesized
aggtgaagaaaaagaggcaa

SEQ ID NO: 553702 - DNA, 20 bp, Artificial Sequence
  chemically synthesized
cattcatgcattcatctcat

SEQ ID NO: 553703 - DNA, 20 bp, Artificial Sequence
  chemically synthesized
ggtatccccaatgcttagta

SEQ ID NO: 553704 - DNA, 20 bp, Artificial Sequence
  chemically synthesized
ataagagagagggcggagtt

SEQ ID NO: 553705 - DNA, 20 bp, Artificial Sequence
  chemically synthesized
aatgaattcgtaaactttcc

SEQ ID NO: 553706 - DNA, 20 bp, Artificial Sequence
  chemically synthesized
cgatgtgggagtgacaggag

SEQ ID NO: 553707 - DNA, 20 bp, Artificial Sequence
  chemically synthesized
aattccttaacttgggtttt

SEQ ID NO: 553708 - DNA, 20 bp, Artificial Sequence
  chemically synthesized
agcagattgtgcaaggtttt

SEQ ID NO: 553709 - DNA, 20 bp, Artificial Sequence
  chemically synthesized
cccgcctctactaaaattac

SEQ ID NO: 553710 - DNA, 20 bp, Artificial Sequence
  chemically synthesized
agcgagactctgtctcaaaa

SEQ ID NO: 553711 - DNA, 20 bp, Artificial Sequence
  chemically synthesized
gactctgtctcaaaaaaaaa

SEQ ID NO: 553712 - DNA, 20 bp, Artificial Sequence
  chemically synthesized
aacaaacaaacaaacaaaca

SEQ ID NO: 553713 - DNA, 20 bp, Artificial Sequence
  chemically synthesized
aaaaaaaaaaaaaaaaaaaa

SEQ ID NO: 553714 - DNA, 20 bp, Artificial Sequence
  chemically synthesized
tacattttgtaaaaagaaaa

SEQ ID NO: 553715 - DNA, 20 bp, Artificial Sequence
  chemically synthesized
gacaggaatgattctaaaaa

SEQ ID NO: 553716 - DNA, 20 bp, Artificial Sequence
  chemically synthesized
gaatgattctaaaaataaaa

SEQ ID NO: 553717 - DNA, 20 bp, Artificial Sequence
  chemically synthesized
tcaggtcagctgaaaagagg

SEQ ID NO: 553718 - DNA, 20 bp, Artificial Sequence
  chemically synthesized
accaccacaaaaatagccta

SEQ ID NO: 553719 - DNA, 20 bp, Artificial Sequence
  chemically synthesized
agtcggtccatgatctgtat

SEQ ID NO: 553720 - DNA, 20 bp, Artificial Sequence
  chemically synthesized
tgaatttcaactaggggaaa

SEQ ID NO: 553721 - DNA, 20 bp, Artificial Sequence
  chemically synthesized
cagctttattcataatagtc

SEQ ID NO: 553722 - DNA, 20 bp, Artificial Sequence
  chemically synthesized
caacaatgtgaactgatctg

SEQ ID NO: 553723 - DNA, 20 bp, Artificial Sequence
  chemically synthesized
tgggtaaaagaagccaggca

SEQ ID NO: 553724 - DNA, 20 bp, Artificial Sequence
  chemically synthesized
atatcaacttctagaacagg

SEQ ID NO: 553725 - DNA, 20 bp, Artificial Sequence
  chemically synthesized
tataacatttcgatcaccta

SEQ ID NO: 553726 - DNA, 20 bp, Artificial Sequence
  chemically synthesized
ggtaaattttaagagtcttt

SEQ ID NO: 553727 - DNA, 20 bp, Artificial Sequence
  chemically synthesized
gcaaaatatgaagattgttg

SEQ ID NO: 553728 - DNA, 20 bp, Artificial Sequence
  chemically synthesized
tctgatgtttgctcaagtct

SEQ ID NO: 553729 - DNA, 20 bp, Artificial Sequence
  chemically synthesized
catttattagccaatgggta

SEQ ID NO: 553730 - DNA, 20 bp, Artificial Sequence
  chemically synthesized
aatggaagatagaaagatag

SEQ ID NO: 553731 - DNA, 20 bp, Artificial Sequence
  chemically synthesized
actactatagtcaactacac

SEQ ID NO: 553732 - DNA, 20 bp, Artificial Sequence
  chemically synthesized
tacaagatgtttggctggca

SEQ ID NO: 553733 - DNA, 20 bp, Artificial Sequence
  chemically synthesized
ggattggactttggtgcgtg

SEQ ID NO: 553734 - DNA, 20 bp, Artificial Sequence
  chemically synthesized
actttcttcacagaattgga

SEQ ID NO: 553735 - DNA, 20 bp, Artificial Sequence
  chemically synthesized
agtaaactatcgcaagaaca

SEQ ID NO: 553736 - DNA, 20 bp, Artificial Sequence
  chemically synthesized
cacaatgtgcacatgtaccc

SEQ ID NO: 553737 - DNA, 20 bp, Artificial Sequence
  chemically synthesized
cagagtaaaagtgaaagtca

SEQ ID NO: 553738 - DNA, 20 bp, Artificial Sequence
  chemically synthesized
ttccaaagatattacagaaa

SEQ ID NO: 553739 - DNA, 20 bp, Artificial Sequence
  chemically synthesized
ctgaactgaggtctagaatt

SEQ ID NO: 553740 - DNA, 20 bp, Artificial Sequence
  chemically synthesized
aagccattggaaagatagac

SEQ ID NO: 553741 - DNA, 20 bp, Artificial Sequence
  chemically synthesized
tccaaattttcccaagaagc

SEQ ID NO: 553742 - DNA, 20 bp, Artificial Sequence
  chemically synthesized
ctcttaaaatctcaactcgt

SEQ ID NO: 553743 - DNA, 20 bp, Artificial Sequence
  chemically synthesized
atttatcaccaatgactttg

SEQ ID NO: 553744 - DNA, 20 bp, Artificial Sequence
  chemically synthesized
ggtgaaaccccgtctctatt

SEQ ID NO: 553745 - DNA, 20 bp, Artificial Sequence
  chemically synthesized
ccagggcagctaacaatgag

SEQ ID NO: 553746 - DNA, 20 bp, Artificial Sequence
  chemically synthesized
agatacacagttctccccca

SEQ ID NO: 553747 - DNA, 20 bp, Artificial Sequence
  chemically synthesized
aggatcagggctctaactcc

SEQ ID NO: 553748 - DNA, 20 bp, Artificial Sequence
  chemically synthesized
cccaaaaccttcattatata

SEQ ID NO: 553749 - DNA, 20 bp, Artificial Sequence
  chemically synthesized
gaatgtcttttaagcagtta

SEQ ID NO: 553750 - DNA, 20 bp, Artificial Sequence
  chemically synthesized
tccagcctgggcaacaagag

SEQ ID NO: 553751 - DNA, 20 bp, Artificial Sequence
  chemically synthesized
tttacccaaaagaaaattaa

SEQ ID NO: 553752 - DNA, 20 bp, Artificial Sequence
  chemically synthesized
ctttttaaaatgagttaaca

SEQ ID NO: 553753 - DNA, 20 bp, Artificial Sequence
  chemically synthesized
ttacccatgttgtgactgag

SEQ ID NO: 553754 - DNA, 20 bp, Artificial Sequence
  chemically synthesized
ccttagcttttttggattgc

SEQ ID NO: 553755 - DNA, 20 bp, Artificial Sequence
  chemically synthesized
aaaattaagttaagactttt

SEQ ID NO: 553756 - DNA, 20 bp, Artificial Sequence
  chemically synthesized
tcaacatatgatctttctcc

SEQ ID NO: 553757 - DNA, 20 bp, Artificial Sequence
  chemically synthesized
gcgtatcattcaacaatttc

SEQ ID NO: 553758 - DNA, 20 bp, Artificial Sequence
  chemically synthesized
cagttgttactgggttttcc

SEQ ID NO: 553759 - DNA, 20 bp, Artificial Sequence
  chemically synthesized
taatcgctggaaagttttgg

SEQ ID NO: 553760 - DNA, 20 bp, Artificial Sequence
  chemically synthesized
caggtttctaagatattggg

SEQ ID NO: 553761 - DNA, 20 bp, Artificial Sequence
  chemically synthesized
tgtcaagcaacacacacata

SEQ ID NO: 553762 - DNA, 20 bp, Artificial Sequence
  chemically synthesized
tggttatgtgagtgtcaaag

SEQ ID NO: 553763 - DNA, 20 bp, Artificial Sequence
  chemically synthesized
gagatggacggtaaagtggt

SEQ ID NO: 553764 - DNA, 20 bp, Artificial Sequence
  chemically synthesized
agggtggggtttggtggatg

SEQ ID NO: 553765 - DNA, 20 bp, Artificial Sequence
  chemically synthesized
taagggggattctagctaaa

SEQ ID NO: 553766 - DNA, 20 bp, Artificial Sequence
  chemically synthesized
atatcttctcaagcattggc

SEQ ID NO: 553767 - DNA, 20 bp, Artificial Sequence
  chemically synthesized
ttgacagctaatttaacgtt

SEQ ID NO: 553768 - DNA, 20 bp, Artificial Sequence
  chemically synthesized
taagataaggattggaattt

SEQ ID NO: 553769 - DNA, 20 bp, Artificial Sequence
  chemically synthesized
ttaactctaaagagttaatg

SEQ ID NO: 553770 - DNA, 20 bp, Artificial Sequence
  chemically synthesized
atatgattagttgaagttac

SEQ ID NO: 553771 - DNA, 20 bp, Artificial Sequence
  chemically synthesized
aagaatcttaatttgactgt

SEQ ID NO: 553772 - DNA, 20 bp, Artificial Sequence
  chemically synthesized
agcaaactgaccttcttgca

SEQ ID NO: 553773 - DNA, 20 bp, Artificial Sequence
  chemically synthesized
ctctcaaacagcaacatcaa

SEQ ID NO: 553774 - DNA, 20 bp, Artificial Sequence
  chemically synthesized
ttaacacataacagtgaaaa

SEQ ID NO: 553775 - DNA, 20 bp, Artificial Sequence
  chemically synthesized
aagactcttctttatcacct

SEQ ID NO: 553776 - DNA, 20 bp, Artificial Sequence
  chemically synthesized
attctcctcagaatcctgga

SEQ ID NO: 553777 - DNA, 20 bp, Artificial Sequence
  chemically synthesized
ttccctgtagagccaaagag

SEQ ID NO: 553778 - DNA, 20 bp, Artificial Sequence
  chemically synthesized
tgtatgtttctatgggagca

SEQ ID NO: 553779 - DNA, 20 bp, Artificial Sequence
  chemically synthesized
attccctagtcagctaggag

SEQ ID NO: 553780 - DNA, 20 bp, Artificial Sequence
  chemically synthesized
ccttgacaaacatctgactg

SEQ ID NO: 553781 - DNA, 20 bp, Artificial Sequence
  chemically synthesized
tttctgggttcctgtcttat

SEQ ID NO: 553782 - DNA, 20 bp, Artificial Sequence
  chemically synthesized
tagactgacagatggtgaat

SEQ ID NO: 553783 - DNA, 20 bp, Artificial Sequence
  chemically synthesized
ctattgcgctacaggaaaaa

SEQ ID NO: 553784 - DNA, 20 bp, Artificial Sequence
  chemically synthesized
atatttacagaagcaaacat

SEQ ID NO: 553785 - DNA, 20 bp, Artificial Sequence
  chemically synthesized
agagtactattgtacaatgg

SEQ ID NO: 553786 - DNA, 20 bp, Artificial Sequence
  chemically synthesized
aaaaactactgggtagagaa

SEQ ID NO: 553787 - DNA, 20 bp, Artificial Sequence
  chemically synthesized
acctattcctagggctgttg

SEQ ID NO: 553788 - DNA, 20 bp, Artificial Sequence
  chemically synthesized
tatttctcattaatcctttc

SEQ ID NO: 553789 - DNA, 20 bp, Artificial Sequence
  chemically synthesized
catataactccctttttctt

SEQ ID NO: 553790 - DNA, 20 bp, Artificial Sequence
  chemically synthesized
ggcaattctaccttgttaag

SEQ ID NO: 553791 - DNA, 20 bp, Artificial Sequence
  chemically synthesized
cctcatcatgtcaattacct

SEQ ID NO: 553792 - DNA, 20 bp, Artificial Sequence
  chemically synthesized
tcatgtcaattacctcaaaa

SEQ ID NO: 553793 - DNA, 20 bp, Artificial Sequence
  chemically synthesized
cacccaccaaattcctattc

SEQ ID NO: 553794 - DNA, 20 bp, Artificial Sequence
  chemically synthesized
tgcatttgattggcaatggg

SEQ ID NO: 553795 - DNA, 20 bp, Artificial Sequence
  chemically synthesized
gaacagcctggataacatgg

SEQ ID NO: 553796 - DNA, 20 bp, Artificial Sequence
  chemically synthesized
gagttgtttggagagtggaa

SEQ ID NO: 553797 - DNA, 20 bp, Artificial Sequence
  chemically synthesized
gaaataaaattgggaagtaa

SEQ ID NO: 553798 - DNA, 20 bp, Artificial Sequence
  chemically synthesized
cttcccaattttatttcccc

SEQ ID NO: 553799 - DNA, 20 bp, Artificial Sequence
  chemically synthesized
tatggagtacttagaatgtt

SEQ ID NO: 553800 - DNA, 20 bp, Artificial Sequence
  chemically synthesized
aaaaaaatcaatgcctcaca

SEQ ID NO: 553801 - DNA, 20 bp, Artificial Sequence
  chemically synthesized
ttttttgagtaatgtgaaaa

SEQ ID NO: 553802 - DNA, 20 bp, Artificial Sequence
  chemically synthesized
tcttcttttttgagtaatgt

SEQ ID NO: 553803 - DNA, 20 bp, Artificial Sequence
  chemically synthesized
cacattactcaaaaaagaag

SEQ ID NO: 553804 - DNA, 20 bp, Artificial Sequence
  chemically synthesized
cacccagcagatatttaaaa

SEQ ID NO: 553805 - DNA, 20 bp, Artificial Sequence
  chemically synthesized
acacaaatgttttgagaaga

SEQ ID NO: 553806 - DNA, 20 bp, Artificial Sequence
  chemically synthesized
agcagactgttttatcttct

SEQ ID NO: 553807 - DNA, 20 bp, Artificial Sequence
  chemically synthesized
atatcagttattataaaaat

SEQ ID NO: 553808 - DNA, 20 bp, Artificial Sequence
  chemically synthesized
ccattaagatatttgtggta

SEQ ID NO: 553809 - DNA, 20 bp, Artificial Sequence
  chemically synthesized
agaataaagtcagtgtggtc

SEQ ID NO: 553810 - DNA, 20 bp, Artificial Sequence
  chemically synthesized
aattttagaaggtgaagtgc

SEQ ID NO: 553811 - DNA, 20 bp, Artificial Sequence
  chemically synthesized
atcttacttttattgaacat

SEQ ID NO: 553812 - DNA, 20 bp, Artificial Sequence
  chemically synthesized
ttcaataaaagtaagatcat

SEQ ID NO: 553813 - DNA, 20 bp, Artificial Sequence
  chemically synthesized
aggctaaaaatatcaaggag

SEQ ID NO: 553814 - DNA, 20 bp, Artificial Sequence
  chemically synthesized
ttggcaatttgttatcttag

SEQ ID NO: 553815 - DNA, 20 bp, Artificial Sequence
  chemically synthesized
cagtttaataatccgcctta

SEQ ID NO: 553816 - DNA, 20 bp, Artificial Sequence
  chemically synthesized
agagtgattttgctcgggag

SEQ ID NO: 553817 - DNA, 20 bp, Artificial Sequence
  chemically synthesized
tgaaatattgagggaatttt

SEQ ID NO: 553818 - DNA, 20 bp, Artificial Sequence
  chemically synthesized
gggtgtggttagttgcaccc

SEQ ID NO: 553819 - DNA, 20 bp, Artificial Sequence
  chemically synthesized
gcacacaaatgataagaaag

SEQ ID NO: 553820 - DNA, 20 bp, Artificial Sequence
  chemically synthesized
agccaaagcctaatccagag

SEQ ID NO: 553821 - DNA, 20 bp, Artificial Sequence
  chemically synthesized
catgaccttagcttcatctg

SEQ ID NO: 553822 - DNA, 20 bp, Artificial Sequence
  chemically synthesized
tgcctgtgctgtataaatgg

SEQ ID NO: 553823 - DNA, 20 bp, Artificial Sequence
  chemically synthesized
gatgttgtgtaagcgggcat

SEQ ID NO: 553824 - DNA, 20 bp, Artificial Sequence
  chemically synthesized
tgcaacagcattatgtctta

SEQ ID NO: 553825 - DNA, 20 bp, Artificial Sequence
  chemically synthesized
aacataacttatatgtacta

SEQ ID NO: 553826 - DNA, 20 bp, Artificial Sequence
  chemically synthesized
acttatatgtactagaaaac

SEQ ID NO: 553827 - DNA, 20 bp, Artificial Sequence
  chemically synthesized
aaaggagaggaggtagcaat

SEQ ID NO: 553828 - DNA, 20 bp, Artificial Sequence
  chemically synthesized
ttcgggaacaagaaacataa

SEQ ID NO: 553829 - DNA, 20 bp, Artificial Sequence
  chemically synthesized
gaaaaggcagagaaagtatc

SEQ ID NO: 553830 - DNA, 20 bp, Artificial Sequence
  chemically synthesized
aatcagggtctgcctggtca

SEQ ID NO: 553831 - DNA, 20 bp, Artificial Sequence
  chemically synthesized
attgatacatcttccaaatc

SEQ ID NO: 553832 - DNA, 20 bp, Artificial Sequence
  chemically synthesized
aaatcaaaaaccttagtata

SEQ ID NO: 553833 - DNA, 20 bp, Artificial Sequence
  chemically synthesized
gctgtagagatgaggagggc

SEQ ID NO: 553834 - DNA, 20 bp, Artificial Sequence
  chemically synthesized
aatgaacaattttgttgctg

SEQ ID NO: 553835 - DNA, 20 bp, Artificial Sequence
  chemically synthesized
gatttctatgctttgtcttc

SEQ ID NO: 553836 - DNA, 20 bp, Artificial Sequence
  chemically synthesized
cctgaacttgactcaactgg

SEQ ID NO: 553837 - DNA, 20 bp, Artificial Sequence
  chemically synthesized
tctgtgatgtgtagtatgtt

SEQ ID NO: 553838 - DNA, 20 bp, Artificial Sequence
  chemically synthesized
agagcaagactctgtctcaa

SEQ ID NO: 553839 - DNA, 20 bp, Artificial Sequence
  chemically synthesized
tgtctcaaaaaaacaaaaaa

SEQ ID NO: 553840 - DNA, 20 bp, Artificial Sequence
  chemically synthesized
aaaaaaaacccaccaccaac

SEQ ID NO: 553841 - DNA, 20 bp, Artificial Sequence
  chemically synthesized
agaccaagaaagtaaaatat

SEQ ID NO: 553842 - DNA, 20 bp, Artificial Sequence
  chemically synthesized
ccgtagagggtacagacttt

SEQ ID NO: 553843 - DNA, 20 bp, Artificial Sequence
  chemically synthesized
cacacagagtaaaggcatct

SEQ ID NO: 553844 - DNA, 20 bp, Artificial Sequence
  chemically synthesized
ctacaatttggcagctcttt

SEQ ID NO: 553845 - DNA, 20 bp, Artificial Sequence
  chemically synthesized
attactcttagcatgattta

SEQ ID NO: 553846 - DNA, 20 bp, Artificial Sequence
  chemically synthesized
gtagcattatttcccaaatc

SEQ ID NO: 553847 - DNA, 20 bp, Artificial Sequence
  chemically synthesized
gattaaatatggttatttct

SEQ ID NO: 553848 - DNA, 20 bp, Artificial Sequence
  chemically synthesized
gctttactctagccaggggt

SEQ ID NO: 553849 - DNA, 20 bp, Artificial Sequence
  chemically synthesized
actctagccaggggttaaaa

SEQ ID NO: 553850 - DNA, 20 bp, Artificial Sequence
  chemically synthesized
cttaatatattgctcagtgt

SEQ ID NO: 553851 - DNA, 20 bp, Artificial Sequence
  chemically synthesized
cagcaatttgcaagagagtt

SEQ ID NO: 553852 - DNA, 20 bp, Artificial Sequence
  chemically synthesized
tcttaggaaaagtggtcttt

SEQ ID NO: 553853 - DNA, 20 bp, Artificial Sequence
  chemically synthesized
ccacttttcctaagaattcc

SEQ ID NO: 553854 - DNA, 20 bp, Artificial Sequence
  chemically synthesized
acgctataacttaagaaaag

SEQ ID NO: 553855 - DNA, 20 bp, Artificial Sequence
  chemically synthesized
ggaaaaccagtaccccttga

SEQ ID NO: 553856 - DNA, 20 bp, Artificial Sequence
  chemically synthesized
tgacagtatcacaaatgcaa

SEQ ID NO: 553857 - DNA, 20 bp, Artificial Sequence
  chemically synthesized
aacagaacgagaccctgttt

SEQ ID NO: 553858 - DNA, 20 bp, Artificial Sequence
  chemically synthesized
atgctgtcaaaaaaaaaaaa

SEQ ID NO: 553859 - DNA, 20 bp, Artificial Sequence
  chemically synthesized
aataggttagcttggtgatt

SEQ ID NO: 553860 - DNA, 20 bp, Artificial Sequence
  chemically synthesized
taaaaatgctaatagaaatc

SEQ ID NO: 553861 - DNA, 20 bp, Artificial Sequence
  chemically synthesized
ttttaaaatgtacattctga

SEQ ID NO: 553862 - DNA, 20 bp, Artificial Sequence
  chemically synthesized
ttttctcagaatgtacattt

SEQ ID NO: 553863 - DNA, 20 bp, Artificial Sequence
  chemically synthesized
ccctcagcccaaagtaaaag

SEQ ID NO: 553864 - DNA, 20 bp, Artificial Sequence
  chemically synthesized
tgaaaccccatctttactaa

SEQ ID NO: 553865 - DNA, 20 bp, Artificial Sequence
  chemically synthesized
gtcacagacaaatgctgaaa

SEQ ID NO: 553866 - DNA, 20 bp, Artificial Sequence
  chemically synthesized
ttttgattaaaaaatagata

SEQ ID NO: 553867 - DNA, 20 bp, Artificial Sequence
  chemically synthesized
agtggaaaaggaatgaaaaa

SEQ ID NO: 553868 - DNA, 20 bp, Artificial Sequence
  chemically synthesized
acacaataggattagaaggt

SEQ ID NO: 553869 - DNA, 20 bp, Artificial Sequence
  chemically synthesized
aaaaatataaactaataagt

SEQ ID NO: 553870 - DNA, 20 bp, Artificial Sequence
  chemically synthesized
gaccagcctagccaacatgg

SEQ ID NO: 553871 - DNA, 20 bp, Artificial Sequence
  chemically synthesized
cagagtgagaatctgtctca

SEQ ID NO: 553872 - DNA, 20 bp, Artificial Sequence
  chemically synthesized
agtaacttactattcatagg

SEQ ID NO: 553873 - DNA, 20 bp, Artificial Sequence
  chemically synthesized
gaacagtgaaagtactaaca

SEQ ID NO: 553874 - DNA, 20 bp, Artificial Sequence
  chemically synthesized
ttgctggcacatcccatgtg

SEQ ID NO: 553875 - DNA, 20 bp, Artificial Sequence
  chemically synthesized
caacgaatgtttgattgtta

SEQ ID NO: 553876 - DNA, 20 bp, Artificial Sequence
  chemically synthesized
tttagatgtggtgataaact

SEQ ID NO: 553877 - DNA, 20 bp, Artificial Sequence
  chemically synthesized
gacccctgattgtacaagag

SEQ ID NO: 553878 - DNA, 20 bp, Artificial Sequence
  chemically synthesized
gactgtttataccacaggtg

SEQ ID NO: 553879 - DNA, 20 bp, Artificial Sequence
  chemically synthesized
acagtccacaattataagcc

SEQ ID NO: 553880 - DNA, 20 bp, Artificial Sequence
  chemically synthesized
aataaaaaacatgaaaaagg

SEQ ID NO: 553881 - DNA, 20 bp, Artificial Sequence
  chemically synthesized
aaacctgaaaaatgtaaata

SEQ ID NO: 553882 - DNA, 20 bp, Artificial Sequence
  chemically synthesized
aaatgattaaatgtcttcta

SEQ ID NO: 553883 - DNA, 20 bp, Artificial Sequence
  chemically synthesized
ataattagaaaaatgtttaa

SEQ ID NO: 553884 - DNA, 20 bp, Artificial Sequence
  chemically synthesized
gtgaatggacatattgatag

SEQ ID NO: 553885 - DNA, 20 bp, Artificial Sequence
  chemically synthesized
tttatgtatttttttaatat

SEQ ID NO: 553886 - DNA, 20 bp, Artificial Sequence
  chemically synthesized
tttatattaaaaaaatacat

SEQ ID NO: 553887 - DNA, 20 bp, Artificial Sequence
  chemically synthesized
gacagagcaagaccctgtcc

SEQ ID NO: 553888 - DNA, 20 bp, Artificial Sequence
  chemically synthesized
agcaagaccctgtcccaaaa

SEQ ID NO: 553889 - DNA, 20 bp, Artificial Sequence
  chemically synthesized
ccctgtcccaaaacaaaacc

SEQ ID NO: 553890 - DNA, 20 bp, Artificial Sequence
  chemically synthesized
cagaatattccttgtagatc

SEQ ID NO: 553891 - DNA, 20 bp, Artificial Sequence
  chemically synthesized
gagcatacaaataagggttt

SEQ ID NO: 553892 - DNA, 20 bp, Artificial Sequence
  chemically synthesized
attcaagttatgaggggaaa

SEQ ID NO: 553893 - DNA, 20 bp, Artificial Sequence
  chemically synthesized
gtcaggctcttacataaaca

SEQ ID NO: 553894 - DNA, 20 bp, Artificial Sequence
  chemically synthesized
tttttcttcccacgaagata

SEQ ID NO: 553895 - DNA, 20 bp, Artificial Sequence
  chemically synthesized
tttggtgcctaaaatgatgg

SEQ ID NO: 553896 - DNA, 20 bp, Artificial Sequence
  chemically synthesized
tttaggaatcaatcaacttc

SEQ ID NO: 553897 - DNA, 20 bp, Artificial Sequence
  chemically synthesized
ctttttatcagaggttcctt

SEQ ID NO: 553898 - DNA, 20 bp, Artificial Sequence
  chemically synthesized
agttgtttgagtctcgtggc

SEQ ID NO: 553899 - DNA, 20 bp, Artificial Sequence
  chemically synthesized
tgagtctcgtggctaaaaca

SEQ ID NO: 553900 - DNA, 20 bp, Artificial Sequence
  chemically synthesized
catttacaatgagtagtcaa

SEQ ID NO: 553901 - DNA, 20 bp, Artificial Sequence
  chemically synthesized
gtcaagaaaacaggaaaaaa

SEQ ID NO: 553902 - DNA, 20 bp, Artificial Sequence
  chemically synthesized
tagcgtactgcgtttaaaga

SEQ ID NO: 553903 - DNA, 20 bp, Artificial Sequence
  chemically synthesized
agctcctgccacaaaaagaa

SEQ ID NO: 553904 - DNA, 20 bp, Artificial Sequence
  chemically synthesized
aagcctgtcatgcaatccct

SEQ ID NO: 553905 - DNA, 20 bp, Artificial Sequence
  chemically synthesized
gggcgcagagccctaaaatt

SEQ ID NO: 553906 - DNA, 20 bp, Artificial Sequence
  chemically synthesized
gaaagacccttcctagagag

SEQ ID NO: 553907 - DNA, 20 bp, Artificial Sequence
  chemically synthesized
tatgtttaaaaaaaataagt

SEQ ID NO: 553908 - DNA, 20 bp, Artificial Sequence
  chemically synthesized
gagttgtctctatggaaaag

SEQ ID NO: 553909 - DNA, 20 bp, Artificial Sequence
  chemically synthesized
ggcttggtcatggggtgtcc

SEQ ID NO: 553910 - DNA, 20 bp, Artificial Sequence
  chemically synthesized
catcttctataggtctgcag

SEQ ID NO: 553911 - DNA, 20 bp, Artificial Sequence
  chemically synthesized
gattaaaaaaaaataatttc

SEQ ID NO: 553912 - DNA, 20 bp, Artificial Sequence
  chemically synthesized
tttaatccatcagtcctcgg

SEQ ID NO: 553913 - DNA, 20 bp, Artificial Sequence
  chemically synthesized
aagcaatgcaaaagaactag

SEQ ID NO: 553914 - DNA, 20 bp, Artificial Sequence
  chemically synthesized
taaagggtgtgactaattct

SEQ ID NO: 553915 - DNA, 20 bp, Artificial Sequence
  chemically synthesized
aatgcttggcaacgtagcca

SEQ ID NO: 553916 - DNA, 20 bp, Artificial Sequence
  chemically synthesized
cttactctgtgcctgccttc

SEQ ID NO: 553917 - DNA, 20 bp, Artificial Sequence
  chemically synthesized
ggaatatgcagacgatatag

SEQ ID NO: 553918 - DNA, 20 bp, Artificial Sequence
  chemically synthesized
tgcagaaaagagacaattac

SEQ ID NO: 553919 - DNA, 20 bp, Artificial Sequence
  chemically synthesized
tcagcttcataaataatcct

SEQ ID NO: 553920 - DNA, 20 bp, Artificial Sequence
  chemically synthesized
aattgcttttttagtttctt

SEQ ID NO: 553921 - DNA, 20 bp, Artificial Sequence
  chemically synthesized
tccaaacagttgccttttta

SEQ ID NO: 553922 - DNA, 20 bp, Artificial Sequence
  chemically synthesized
tgtccactacttcccaggga

SEQ ID NO: 553923 - DNA, 20 bp, Artificial Sequence
  chemically synthesized
gttaaaccttgaaaagcaaa

SEQ ID NO: 553924 - DNA, 20 bp, Artificial Sequence
  chemically synthesized
atggatttttttcatgatgt

SEQ ID NO: 553925 - DNA, 20 bp, Artificial Sequence
  chemically synthesized
agggggcaagctgaggcggt

SEQ ID NO: 553926 - DNA, 20 bp, Artificial Sequence
  chemically synthesized
gactgggcagttggggcttt

SEQ ID NO: 553927 - DNA, 20 bp, Artificial Sequence
  chemically synthesized
tttcttttattttttaaaaa

SEQ ID NO: 553928 - DNA, 20 bp, Artificial Sequence
  chemically synthesized
aaaacgggtgtgcttccacc

SEQ ID NO: 553929 - DNA, 20 bp, Artificial Sequence
  chemically synthesized
tgctatagcattagataaag

SEQ ID NO: 553930 - DNA, 20 bp, Artificial Sequence
  chemically synthesized
aagtgtaaaacaaacaaaca

SEQ ID NO: 553931 - DNA, 20 bp, Artificial Sequence
  chemically synthesized
gagcaggtaatttaaaagtg

SEQ ID NO: 553932 - DNA, 20 bp, Artificial Sequence
  chemically synthesized
cttttctcagtgtccaatta

SEQ ID NO: 553933 - DNA, 20 bp, Artificial Sequence
  chemically synthesized
atctgactgcaattgaacaa

SEQ ID NO: 553934 - DNA, 20 bp, Artificial Sequence
  chemically synthesized
ttcatgtccgtggttcatat

SEQ ID NO: 553935 - DNA, 20 bp, Artificial Sequence
  chemically synthesized
ttgtctatgagtatactaga

SEQ ID NO: 553936 - DNA, 20 bp, Artificial Sequence
  chemically synthesized
ccagtacattttcccgtagc

SEQ ID NO: 553937 - DNA, 20 bp, Artificial Sequence
  chemically synthesized
gcaggctaggagaaaaaaaa

SEQ ID NO: 553938 - DNA, 20 bp, Artificial Sequence
  chemically synthesized
taaagtgatgcaggttatac

SEQ ID NO: 553939 - DNA, 20 bp, Artificial Sequence
  chemically synthesized
tttgagaaatcttattaaaa

SEQ ID NO: 553940 - DNA, 20 bp, Artificial Sequence
  chemically synthesized
gtgccaaataagcggaattt

SEQ ID NO: 553941 - DNA, 20 bp, Artificial Sequence
  chemically synthesized
cgattagactcacagcaggt

SEQ ID NO: 553942 - DNA, 20 bp, Artificial Sequence
  chemically synthesized
tgagtatttatggatttgaa

SEQ ID NO: 553943 - DNA, 20 bp, Artificial Sequence
  chemically synthesized
tgtgagtgtcaggtagaaag

SEQ ID NO: 553944 - DNA, 20 bp, Artificial Sequence
  chemically synthesized
tttaatcatatgttcataaa

SEQ ID NO: 553945 - DNA, 20 bp, Artificial Sequence
  chemically synthesized
tatttatgaacatatgatta

SEQ ID NO: 553946 - DNA, 20 bp, Artificial Sequence
  chemically synthesized
ttcaagaaaagtgacaggac

SEQ ID NO: 553947 - DNA, 20 bp, Artificial Sequence
  chemically synthesized
atctcaggaaaaaaaaaaag

SEQ ID NO: 553948 - DNA, 20 bp, Artificial Sequence
  chemically synthesized
ttttccctcacacgacaatc

SEQ ID NO: 553949 - DNA, 20 bp, Artificial Sequence
  chemically synthesized
ctgtattttcctttcatctt

SEQ ID NO: 553950 - DNA, 20 bp, Artificial Sequence
  chemically synthesized
tagtctagatagagcacata

SEQ ID NO: 553951 - DNA, 20 bp, Artificial Sequence
  chemically synthesized
attttttctttatggttggt

SEQ ID NO: 553952 - DNA, 20 bp, Artificial Sequence
  chemically synthesized
ccttgggatcccacttaaaa

SEQ ID NO: 553953 - DNA, 20 bp, Artificial Sequence
  chemically synthesized
agagaatatgcacttcaatt

SEQ ID NO: 553954 - DNA, 20 bp, Artificial Sequence
  chemically synthesized
cacacacacacacacacaca

SEQ ID NO: 553955 - DNA, 20 bp, Artificial Sequence
  chemically synthesized
acacagctgtatattaacat

SEQ ID NO: 553956 - DNA, 20 bp, Artificial Sequence
  chemically synthesized
gtataactcttaaaaattaa

SEQ ID NO: 553957 - DNA, 20 bp, Artificial Sequence
  chemically synthesized
ctaaggaaatataaatagca

SEQ ID NO: 553958 - DNA, 20 bp, Artificial Sequence
  chemically synthesized
ccgtctcaaaacaaaaaaca

SEQ ID NO: 553959 - DNA, 20 bp, Artificial Sequence
  chemically synthesized
tgagactccgtctcaaaaca

SEQ ID NO: 553960 - DNA, 20 bp, Artificial Sequence
  chemically synthesized
gacagagtgagactccgtct

SEQ ID NO: 553961 - DNA, 20 bp, Artificial Sequence
  chemically synthesized
aaactggtacaaccacattg

SEQ ID NO: 553962 - DNA, 20 bp, Artificial Sequence
  chemically synthesized
tccacagtgtatacatattt

SEQ ID NO: 553963 - DNA, 20 bp, Artificial Sequence
  chemically synthesized
accaaattatacccaccttt

SEQ ID NO: 553964 - DNA, 20 bp, Artificial Sequence
  chemically synthesized
ggcttatgtcgaggggcact

SEQ ID NO: 553965 - DNA, 20 bp, Artificial Sequence
  chemically synthesized
gacctggcctgaggtggaga

SEQ ID NO: 553966 - DNA, 20 bp, Artificial Sequence
  chemically synthesized
ggttcatgacctgcagtttg

SEQ ID NO: 553967 - DNA, 20 bp, Artificial Sequence
  chemically synthesized
ggagtggggaaaatgggtta

SEQ ID NO: 553968 - DNA, 20 bp, Artificial Sequence
  chemically synthesized
tgattgaaagaaaagtttca

SEQ ID NO: 553969 - DNA, 20 bp, Artificial Sequence
  chemically synthesized
ctggcagagaagacaccccc

SEQ ID NO: 553970 - DNA, 20 bp, Artificial Sequence
  chemically synthesized
tatcaccatgccatttggaa

SEQ ID NO: 553971 - DNA, 20 bp, Artificial Sequence
  chemically synthesized
tattgtcacattgcaggagg

SEQ ID NO: 553972 - DNA, 20 bp, Artificial Sequence
  chemically synthesized
ctgcacgttgcctgtctgaa

SEQ ID NO: 553973 - DNA, 20 bp, Artificial Sequence
  chemically synthesized
cctgtctgaacaaaacactt

SEQ ID NO: 553974 - DNA, 20 bp, Artificial Sequence
  chemically synthesized
gctgtataacagaccaaccc

SEQ ID NO: 553975 - DNA, 20 bp, Artificial Sequence
  chemically synthesized
attttataaggggtatttag

SEQ ID NO: 553976 - DNA, 20 bp, Artificial Sequence
  chemically synthesized
ctgattaattccgaaaatat

SEQ ID NO: 553977 - DNA, 20 bp, Artificial Sequence
  chemically synthesized
agctcaatccattctcagaa

SEQ ID NO: 553978 - DNA, 20 bp, Artificial Sequence
  chemically synthesized
tcacagtagtaatgaatggg

SEQ ID NO: 553979 - DNA, 20 bp, Artificial Sequence
  chemically synthesized
gatgtcatataaggagatta

SEQ ID NO: 553980 - DNA, 20 bp, Artificial Sequence
  chemically synthesized
ttgccagtggaaaactcaga

SEQ ID NO: 553981 - DNA, 20 bp, Artificial Sequence
  chemically synthesized
catgaaaagagttgccagtg

SEQ ID NO: 553982 - DNA, 20 bp, Artificial Sequence
  chemically synthesized
attagacctagtctctgaac

SEQ ID NO: 553983 - DNA, 20 bp, Artificial Sequence
  chemically synthesized
ctcgtttgttcaccaaacta

SEQ ID NO: 553984 - DNA, 20 bp, Artificial Sequence
  chemically synthesized
ttttagtcataaagcaaaaa

SEQ ID NO: 553985 - DNA, 20 bp, Artificial Sequence
  chemically synthesized
aggtttagggtacaatatta

SEQ ID NO: 553986 - DNA, 20 bp, Artificial Sequence
  chemically synthesized
atcaaatgtaatgacgtgtg

SEQ ID NO: 553987 - DNA, 20 bp, Artificial Sequence
  chemically synthesized
gtaaatccagtatgttttgg

SEQ ID NO: 553988 - DNA, 20 bp, Artificial Sequence
  chemically synthesized
ttctctgaaaactgttttac

SEQ ID NO: 553989 - DNA, 20 bp, Artificial Sequence
  chemically synthesized
aacgtaagtagagcttctct

SEQ ID NO: 553990 - DNA, 20 bp, Artificial Sequence
  chemically synthesized
catttagaggagagataggg

SEQ ID NO: 553991 - DNA, 20 bp, Artificial Sequence
  chemically synthesized
taacctgaaaatatattttt

SEQ ID NO: 553992 - DNA, 20 bp, Artificial Sequence
  chemically synthesized
tgaggaccaaatcgtcagta

SEQ ID NO: 553993 - DNA, 20 bp, Artificial Sequence
  chemically synthesized
aaacgttatgttgagaatca

SEQ ID NO: 553994 - DNA, 20 bp, Artificial Sequence
  chemically synthesized
taacatttctaaatgggacc

SEQ ID NO: 553995 - DNA, 20 bp, Artificial Sequence
  chemically synthesized
tgaatactgtactgaaagtg

SEQ ID NO: 553996 - DNA, 20 bp, Artificial Sequence
  chemically synthesized
tagaccgagattttcgatat

SEQ ID NO: 553997 - DNA, 20 bp, Artificial Sequence
  chemically synthesized
gcctaaatatggtaagcttt

SEQ ID NO: 553998 - DNA, 20 bp, Artificial Sequence
  chemically synthesized
tgagataacagggaagtggg

SEQ ID NO: 553999 - DNA, 20 bp, Artificial Sequence
  chemically synthesized
tccttacaagatccaaattg

SEQ ID NO: 554000 - DNA, 20 bp, Artificial Sequence
  chemically synthesized
aatgatcaaaaatcttatta

SEQ ID NO: 554001 - DNA, 20 bp, Artificial Sequence
  chemically synthesized
caaaaatcttattaaaaaac

SEQ ID NO: 554002 - DNA, 20 bp, Artificial Sequence
  chemically synthesized
ctttggaaaataaatttagg

SEQ ID NO: 554003 - DNA, 20 bp, Artificial Sequence
  chemically synthesized
ccgatctgagaagcaggtga

SEQ ID NO: 554004 - DNA, 20 bp, Artificial Sequence
  chemically synthesized
agctgtgctttcctgaaggc

SEQ ID NO: 554005 - DNA, 20 bp, Artificial Sequence
  chemically synthesized
caagatgagccagtgacagg

SEQ ID NO: 554006 - DNA, 20 bp, Artificial Sequence
  chemically synthesized
acttgttccatgataactct

SEQ ID NO: 554007 - DNA, 20 bp, Artificial Sequence
  chemically synthesized
tgtctcaaaaaaaagaaaga

SEQ ID NO: 554008 - DNA, 20 bp, Artificial Sequence
  chemically synthesized
acctgtctctactaaaaata

SEQ ID NO: 554009 - DNA, 20 bp, Artificial Sequence
  chemically synthesized
tcctaggctgtggtttgtac

SEQ ID NO: 554010 - DNA, 20 bp, Artificial Sequence
  chemically synthesized
gccatcaatattagttactt

SEQ ID NO: 554011 - DNA, 20 bp, Artificial Sequence
  chemically synthesized
acaacgcaagagaggaaaag

SEQ ID NO: 554012 - DNA, 20 bp, Artificial Sequence
  chemically synthesized
tattaaaagctctgacagga

SEQ ID NO: 554013 - DNA, 20 bp, Artificial Sequence
  chemically synthesized
gcacaatgaggagattcaat

SEQ ID NO: 554014 - DNA, 20 bp, Artificial Sequence
  chemically synthesized
atgaatcttttctggtgcct

SEQ ID NO: 554015 - DNA, 20 bp, Artificial Sequence
  chemically synthesized
ttctttagagaggagcaaac

SEQ ID NO: 554016 - DNA, 20 bp, Artificial Sequence
  chemically synthesized
taatactagttatatataca

SEQ ID NO: 554017 - DNA, 20 bp, Artificial Sequence
  chemically synthesized
taagtgttatgttaagcaaa

SEQ ID NO: 554018 - DNA, 20 bp, Artificial Sequence
  chemically synthesized
tatttgcttaacataacact

SEQ ID NO: 554019 - DNA, 20 bp, Artificial Sequence
  chemically synthesized
tttagtttagtaaagtctac

SEQ ID NO: 554020 - DNA, 20 bp, Artificial Sequence
  chemically synthesized
agtgtcttgtggacattcca

SEQ ID NO: 554021 - DNA, 20 bp, Artificial Sequence
  chemically synthesized
aaaaaactgtgtgggctaat

SEQ ID NO: 554022 - DNA, 20 bp, Artificial Sequence
  chemically synthesized
gtaattcagattaaaaaaaa

SEQ ID NO: 554023 - DNA, 20 bp, Artificial Sequence
  chemically synthesized
gatatccatattatgaaaaa

SEQ ID NO: 554024 - DNA, 20 bp, Artificial Sequence
  chemically synthesized
agttaagaactatcaatcaa

SEQ ID NO: 554025 - DNA, 20 bp, Artificial Sequence
  chemically synthesized
tacaaactagaatatgtaaa

SEQ ID NO: 554026 - DNA, 20 bp, Artificial Sequence
  chemically synthesized
aaactggtacaaccactttg

SEQ ID NO: 554027 - DNA, 20 bp, Artificial Sequence
  chemically synthesized
ttgtacacacgtgtgtgcca

SEQ ID NO: 554028 - DNA, 20 bp, Artificial Sequence
  chemically synthesized
atagagttcaaataaacagg

SEQ ID NO: 554029 - DNA, 20 bp, Artificial Sequence
  chemically synthesized
tcgccatctaggacagtaaa

SEQ ID NO: 554030 - DNA, 20 bp, Artificial Sequence
  chemically synthesized
attcaatcaacttatttttt

SEQ ID NO: 554031 - DNA, 20 bp, Artificial Sequence
  chemically synthesized
tattttttgaaaacgccctc

SEQ ID NO: 554032 - DNA, 20 bp, Artificial Sequence
  chemically synthesized
ctgtttagacagcgttaggg

SEQ ID NO: 554033 - DNA, 20 bp, Artificial Sequence
  chemically synthesized
aagtgtagagtatggctacg

SEQ ID NO: 554034 - DNA, 20 bp, Artificial Sequence
  chemically synthesized
gccctgaacaaccttgtctt

SEQ ID NO: 554035 - DNA, 20 bp, Artificial Sequence
  chemically synthesized
ctatcagttaatcgactaag

SEQ ID NO: 554036 - DNA, 20 bp, Artificial Sequence
  chemically synthesized
gttggtaaacaacacaaagg

SEQ ID NO: 554037 - DNA, 20 bp, Artificial Sequence
  chemically synthesized
aacatggctaaactggtcta

SEQ ID NO: 554038 - DNA, 20 bp, Artificial Sequence
  chemically synthesized
gggaatggatctccttctcc

SEQ ID NO: 554039 - DNA, 20 bp, Artificial Sequence
  chemically synthesized
gtgaaagtgctacaataaat

SEQ ID NO: 554040 - DNA, 20 bp, Artificial Sequence
  chemically synthesized
cttgaggactcatagttgtg

SEQ ID NO: 554041 - DNA, 20 bp, Artificial Sequence
  chemically synthesized
ccattagctttttgaaaata

SEQ ID NO: 554042 - DNA, 20 bp, Artificial Sequence
  chemically synthesized
actattttctaggcatcttt

SEQ ID NO: 554043 - DNA, 20 bp, Artificial Sequence
  chemically synthesized
gaaactggagaagagcccct

SEQ ID NO: 554044 - DNA, 20 bp, Artificial Sequence
  chemically synthesized
ttacatagatttttataagg

SEQ ID NO: 554045 - DNA, 20 bp, Artificial Sequence
  chemically synthesized
gattaatggctgactactat

SEQ ID NO: 554046 - DNA, 20 bp, Artificial Sequence
  chemically synthesized
caacaaagtgatggcagaca

SEQ ID NO: 554047 - DNA, 20 bp, Artificial Sequence
  chemically synthesized
ttatgcattttagtactgag

SEQ ID NO: 554048 - DNA, 20 bp, Artificial Sequence
  chemically synthesized
tattttccatgaattaaatt

SEQ ID NO: 554049 - DNA, 20 bp, Artificial Sequence
  chemically synthesized
aatttagctagtatactagg

SEQ ID NO: 554050 - DNA, 20 bp, Artificial Sequence
  chemically synthesized
tcccaaaaaaagaaaaagaa

SEQ ID NO: 554051 - DNA, 20 bp, Artificial Sequence
  chemically synthesized
ctttttctttttttgggaaa

SEQ ID NO: 554052 - DNA, 20 bp, Artificial Sequence
  chemically synthesized
ttttgggaaacaaaacacaa

SEQ ID NO: 554053 - DNA, 20 bp, Artificial Sequence
  chemically synthesized
taaatgacatttgcagaagt

SEQ ID NO: 554054 - DNA, 20 bp, Artificial Sequence
  chemically synthesized
gcaaatgtcatttacaaaat

SEQ ID NO: 554055 - DNA, 20 bp, Artificial Sequence
  chemically synthesized
attttgacttaaaaggaatt

SEQ ID NO: 554056 - DNA, 20 bp, Artificial Sequence
  chemically synthesized
atctccctaacagtacacat

SEQ ID NO: 554057 - DNA, 20 bp, Artificial Sequence
  chemically synthesized
taaaaactaactgcaaagag

SEQ ID NO: 554058 - DNA, 20 bp, Artificial Sequence
  chemically synthesized
tgtcattggtgcagccaaca

SEQ ID NO: 554059 - DNA, 20 bp, Artificial Sequence
  chemically synthesized
tattttatcagcagatttta

SEQ ID NO: 554060 - DNA, 20 bp, Artificial Sequence
  chemically synthesized
aataataaatgttcactgtg

SEQ ID NO: 554061 - DNA, 20 bp, Artificial Sequence
  chemically synthesized
attatttttgttatgacacg

SEQ ID NO: 554062 - DNA, 20 bp, Artificial Sequence
  chemically synthesized
tgctcccatacttgtagcaa

SEQ ID NO: 554063 - DNA, 20 bp, Artificial Sequence
  chemically synthesized
caaacaaaaaaagaacaaaa

SEQ ID NO: 554064 - DNA, 20 bp, Artificial Sequence
  chemically synthesized
aaaaacaaacaaaaaaagaa

SEQ ID NO: 554065 - DNA, 20 bp, Artificial Sequence
  chemically synthesized
acaacaacaaacaaacaaaa

SEQ ID NO: 554066 - DNA, 20 bp, Artificial Sequence
  chemically synthesized
ctttctcctgcataaggctg

SEQ ID NO: 554067 - DNA, 20 bp, Artificial Sequence
  chemically synthesized
tctggtggccacagcagcaa

SEQ ID NO: 554068 - DNA, 20 bp, Artificial Sequence
  chemically synthesized
ctagagccctacttaatact

SEQ ID NO: 554069 - DNA, 20 bp, Artificial Sequence
  chemically synthesized
caaaaagatccacagtacaa

SEQ ID NO: 554070 - DNA, 20 bp, Artificial Sequence
  chemically synthesized
tgcacctgtacttcaaaaag

SEQ ID NO: 554071 - DNA, 20 bp, Artificial Sequence
  chemically synthesized
ggaagggcgcaaagagaaag

SEQ ID NO: 554072 - DNA, 20 bp, Artificial Sequence
  chemically synthesized
agggctggaggaggtgagga

SEQ ID NO: 554073 - DNA, 20 bp, Artificial Sequence
  chemically synthesized
tttgattctccttacctaag

SEQ ID NO: 554074 - DNA, 20 bp, Artificial Sequence
  chemically synthesized
caaatgctaaaatgaaagca

SEQ ID NO: 554075 - DNA, 20 bp, Artificial Sequence
  chemically synthesized
attaatacatttgccttttg

SEQ ID NO: 554076 - DNA, 20 bp, Artificial Sequence
  chemically synthesized
tttgcttccagcaacaacag

SEQ ID NO: 554077 - DNA, 20 bp, Artificial Sequence
  chemically synthesized
tctacaatatataccaagat

SEQ ID NO: 554078 - DNA, 20 bp, Artificial Sequence
  chemically synthesized
catgtactgcaatggaacac

SEQ ID NO: 554079 - DNA, 20 bp, Artificial Sequence
  chemically synthesized
attataacaaagcaccagca

SEQ ID NO: 554080 - DNA, 20 bp, Artificial Sequence
  chemically synthesized
tactttacattgtgaacatt

SEQ ID NO: 554081 - DNA, 20 bp, Artificial Sequence
  chemically synthesized
acatgaaacttggaaattgg

SEQ ID NO: 554082 - DNA, 20 bp, Artificial Sequence
  chemically synthesized
ctggatttttttttaaattt

SEQ ID NO: 554083 - DNA, 20 bp, Artificial Sequence
  chemically synthesized
gggaaatttaatttgggata

SEQ ID NO: 554084 - DNA, 20 bp, Artificial Sequence
  chemically synthesized
tttcctaaatatgtgtatta

SEQ ID NO: 554085 - DNA, 20 bp, Artificial Sequence
  chemically synthesized
tttcttcactccactcttta

SEQ ID NO: 554086 - DNA, 20 bp, Artificial Sequence
  chemically synthesized
aaactatagaattaattcag

SEQ ID NO: 554087 - DNA, 20 bp, Artificial Sequence
  chemically synthesized
gtggaacacttctttaaaat

SEQ ID NO: 554088 - DNA, 20 bp, Artificial Sequence
  chemically synthesized
aattaacatggagggatgga

SEQ ID NO: 554089 - DNA, 20 bp, Artificial Sequence
  chemically synthesized
attttttccagttcacaagt

SEQ ID NO: 554090 - DNA, 20 bp, Artificial Sequence
  chemically synthesized
ccttgataataaagcacctt

SEQ ID NO: 554091 - DNA, 20 bp, Artificial Sequence
  chemically synthesized
atgatgtttctccctaccaa

SEQ ID NO: 554092 - DNA, 20 bp, Artificial Sequence
  chemically synthesized
tccctaccaaaaaaacccca

SEQ ID NO: 554093 - DNA, 20 bp, Artificial Sequence
  chemically synthesized
aatatttaacagagaaaggc

SEQ ID NO: 554094 - DNA, 20 bp, Artificial Sequence
  chemically synthesized
tgtggaaaaattgtcttcca

SEQ ID NO: 554095 - DNA, 20 bp, Artificial Sequence
  chemically synthesized
accttaaaatcctcttctat

SEQ ID NO: 554096 - DNA, 20 bp, Artificial Sequence
  chemically synthesized
ctgttgtgagaatatcttag

SEQ ID NO: 554097 - DNA, 20 bp, Artificial Sequence
  chemically synthesized
ccttcagtagctcctattac

SEQ ID NO: 554098 - DNA, 20 bp, Artificial Sequence
  chemically synthesized
tcacttaaagatgctttctt

SEQ ID NO: 554099 - DNA, 20 bp, Artificial Sequence
  chemically synthesized
cagtgcttaatcatcaaaat

SEQ ID NO: 554100 - DNA, 20 bp, Artificial Sequence
  chemically synthesized
ttcaagagttaaacaagaaa

SEQ ID NO: 554101 - DNA, 20 bp, Artificial Sequence
  chemically synthesized
ttcttagacttgtgatttcc

SEQ ID NO: 554102 - DNA, 20 bp, Artificial Sequence
  chemically synthesized
aataatcacacatgcgtttc

SEQ ID NO: 554103 - DNA, 20 bp, Artificial Sequence
  chemically synthesized
atgtttctgtgtaaattttt

SEQ ID NO: 554104 - DNA, 20 bp, Artificial Sequence
  chemically synthesized
aattgacagattataaaatg

SEQ ID NO: 554105 - DNA, 20 bp, Artificial Sequence
  chemically synthesized
tctgtcaattacaaaaatag

SEQ ID NO: 554106 - DNA, 20 bp, Artificial Sequence
  chemically synthesized
tgatataagtaagagcgaga

SEQ ID NO: 554107 - DNA, 20 bp, Artificial Sequence
  chemically synthesized
gagatttttcttaatcttca

SEQ ID NO: 554108 - DNA, 20 bp, Artificial Sequence
  chemically synthesized
ataagccattatttatcttc

SEQ ID NO: 554109 - DNA, 20 bp, Artificial Sequence
  chemically synthesized
aaacagcatggtactggtac

SEQ ID NO: 554110 - DNA, 20 bp, Artificial Sequence
  chemically synthesized
tactacaaggctacagtaac

SEQ ID NO: 554111 - DNA, 20 bp, Artificial Sequence
  chemically synthesized
ctttgattccacatgaaatt

SEQ ID NO: 554112 - DNA, 20 bp, Artificial Sequence
  chemically synthesized
cttcttcacagaattaaaaa

SEQ ID NO: 554113 - DNA, 20 bp, Artificial Sequence
  chemically synthesized
tgatctttgataaacctgac

SEQ ID NO: 554114 - DNA, 20 bp, Artificial Sequence
  chemically synthesized
tattcagtaaacggtgctgg

SEQ ID NO: 554115 - DNA, 20 bp, Artificial Sequence
  chemically synthesized
aaactctctagccatatgca

SEQ ID NO: 554116 - DNA, 20 bp, Artificial Sequence
  chemically synthesized
atggattaaagacttaaatg

SEQ ID NO: 554117 - DNA, 20 bp, Artificial Sequence
  chemically synthesized
aatgtaaaaccccaaatcct

SEQ ID NO: 554118 - DNA, 20 bp, Artificial Sequence
  chemically synthesized
atgggcaaagacttcatgac

SEQ ID NO: 554119 - DNA, 20 bp, Artificial Sequence
  chemically synthesized
ataggcaacctacagaatgg

SEQ ID NO: 554120 - DNA, 20 bp, Artificial Sequence
  chemically synthesized
atcatcagagaaatgcaaat

SEQ ID NO: 554121 - DNA, 20 bp, Artificial Sequence
  chemically synthesized
aaattagttcaaccattgtg

SEQ ID NO: 554122 - DNA, 20 bp, Artificial Sequence
  chemically synthesized
agcaaactaacacaggaaca

SEQ ID NO: 554123 - DNA, 20 bp, Artificial Sequence
  chemically synthesized
taaaaaaaaaaaacacacca

SEQ ID NO: 554124 - DNA, 20 bp, Artificial Sequence
  chemically synthesized
ctttttttcttctaaaaaaa

SEQ ID NO: 554125 - DNA, 20 bp, Artificial Sequence
  chemically synthesized
tctacctccctgcaggctga

SEQ ID NO: 554126 - DNA, 20 bp, Artificial Sequence
  chemically synthesized
aacaaaaaacaaaatgaaac

SEQ ID NO: 554127 - DNA, 20 bp, Artificial Sequence
  chemically synthesized
ttgggcaataaaggggaaca

SEQ ID NO: 554128 - DNA, 20 bp, Artificial Sequence
  chemically synthesized
gctgccatcttgggcatcac

SEQ ID NO: 554129 - DNA, 20 bp, Artificial Sequence
  chemically synthesized
caaatggccagttttcaatc

SEQ ID NO: 554130 - DNA, 20 bp, Artificial Sequence
  chemically synthesized
actttctaatgtttttgatt

SEQ ID NO: 554131 - DNA, 20 bp, Artificial Sequence
  chemically synthesized
tatgcaatacatccctgtaa

SEQ ID NO: 554132 - DNA, 20 bp, Artificial Sequence
  chemically synthesized
ccccatctctaccaaagata

SEQ ID NO: 554133 - DNA, 20 bp, Artificial Sequence
  chemically synthesized
acttattatccaataaagaa

SEQ ID NO: 554134 - DNA, 20 bp, Artificial Sequence
  chemically synthesized
tatgagacacactgtttaca

SEQ ID NO: 554135 - DNA, 20 bp, Artificial Sequence
  chemically synthesized
aaatagtgaccaaaaggaaa

SEQ ID NO: 554136 - DNA, 20 bp, Artificial Sequence
  chemically synthesized
accaaaaggaaagaaaacaa

SEQ ID NO: 554137 - DNA, 20 bp, Artificial Sequence
  chemically synthesized
atgtggataagctgagaaag

SEQ ID NO: 554138 - DNA, 20 bp, Artificial Sequence
  chemically synthesized
caggagttaatggtatcaca

SEQ ID NO: 554139 - DNA, 20 bp, Artificial Sequence
  chemically synthesized
taaaccgttgtacaagatag

SEQ ID NO: 554140 - DNA, 20 bp, Artificial Sequence
  chemically synthesized
caggaaaaatgttaacacgg

SEQ ID NO: 554141 - DNA, 20 bp, Artificial Sequence
  chemically synthesized
aaatgcccctttctcagtgg

SEQ ID NO: 554142 - DNA, 20 bp, Artificial Sequence
  chemically synthesized
tcagggttattaagttattt

SEQ ID NO: 554143 - DNA, 20 bp, Artificial Sequence
  chemically synthesized
atctctatgagtgttttcct

SEQ ID NO: 554144 - DNA, 20 bp, Artificial Sequence
  chemically synthesized
ctgagtgttcaggtttttag

SEQ ID NO: 554145 - DNA, 20 bp, Artificial Sequence
  chemically synthesized
tacataatcacgtgttagaa

SEQ ID NO: 554146 - DNA, 20 bp, Artificial Sequence
  chemically synthesized
cctgtccacaatgctcagtg

SEQ ID NO: 554147 - DNA, 20 bp, Artificial Sequence
  chemically synthesized
taaagctctattgaccacta

SEQ ID NO: 554148 - DNA, 20 bp, Artificial Sequence
  chemically synthesized
cctcatgaatgatatttagg

SEQ ID NO: 554149 - DNA, 20 bp, Artificial Sequence
  chemically synthesized
gatgtatgaatggtacatac

SEQ ID NO: 554150 - DNA, 20 bp, Artificial Sequence
  chemically synthesized
ttgctgactcatttcacctt

SEQ ID NO: 554151 - DNA, 20 bp, Artificial Sequence
  chemically synthesized
gtgtctcataggttcatgaa

SEQ ID NO: 554152 - DNA, 20 bp, Artificial Sequence
  chemically synthesized
acatctcccaacaagatcta

SEQ ID NO: 554153 - DNA, 20 bp, Artificial Sequence
  chemically synthesized
cccaacaagatctataaaac

SEQ ID NO: 554154 - DNA, 20 bp, Artificial Sequence
  chemically synthesized
attattgatgatataatcat

SEQ ID NO: 554155 - DNA, 20 bp, Artificial Sequence
  chemically synthesized
aaccatcaaatggcagagga

SEQ ID NO: 554156 - DNA, 20 bp, Artificial Sequence
  chemically synthesized
tggagtatgatatcaacata

SEQ ID NO: 554157 - DNA, 20 bp, Artificial Sequence
  chemically synthesized
gaaggaagaaatcaaccaac

SEQ ID NO: 554158 - DNA, 20 bp, Artificial Sequence
  chemically synthesized
gttaggggaacactggtact

SEQ ID NO: 554159 - DNA, 20 bp, Artificial Sequence
  chemically synthesized
ctgcttagcaaaatgcgata

SEQ ID NO: 554160 - DNA, 20 bp, Artificial Sequence
  chemically synthesized
aagcagcagaaagttgtgag

SEQ ID NO: 554161 - DNA, 20 bp, Artificial Sequence
  chemically synthesized
ggtattacagaaaagtagca

SEQ ID NO: 554162 - DNA, 20 bp, Artificial Sequence
  chemically synthesized
gagctggaaaagatccaggg

SEQ ID NO: 554163 - DNA, 20 bp, Artificial Sequence
  chemically synthesized
taaattctttgaaattcagt

SEQ ID NO: 554164 - DNA, 20 bp, Artificial Sequence
  chemically synthesized
aaatgtactaggttacctga

SEQ ID NO: 554165 - DNA, 20 bp, Artificial Sequence
  chemically synthesized
atgagtttgacagtaggcca

SEQ ID NO: 554166 - DNA, 20 bp, Artificial Sequence
  chemically synthesized
ccccaagggagagggaatat

SEQ ID NO: 554167 - DNA, 20 bp, Artificial Sequence
  chemically synthesized
agaaaaagttacaaagcatt

SEQ ID NO: 554168 - DNA, 20 bp, Artificial Sequence
  chemically synthesized
ttaccacagatgcccagctg

SEQ ID NO: 554169 - DNA, 20 bp, Artificial Sequence
  chemically synthesized
tgcagctgggcatctgtggt

SEQ ID NO: 554170 - DNA, 20 bp, Artificial Sequence
  chemically synthesized
atgttaaactgtaatatagg

SEQ ID NO: 554171 - DNA, 20 bp, Artificial Sequence
  chemically synthesized
taatgtaaattcttacttta

SEQ ID NO: 554172 - DNA, 20 bp, Artificial Sequence
  chemically synthesized
cagttgtcctgtccaaactt

SEQ ID NO: 554173 - DNA, 20 bp, Artificial Sequence
  chemically synthesized
gggcacagatctatgaataa

SEQ ID NO: 554174 - DNA, 20 bp, Artificial Sequence
  chemically synthesized
cttgaattctccagtgatcc

SEQ ID NO: 554175 - DNA, 20 bp, Artificial Sequence
  chemically synthesized
tatttaattcattagtcact

SEQ ID NO: 554176 - DNA, 20 bp, Artificial Sequence
  chemically synthesized
aaattaaattcataaaatat

SEQ ID NO: 554177 - DNA, 20 bp, Artificial Sequence
  chemically synthesized
ttgatggacagtgaaagaat

SEQ ID NO: 554178 - DNA, 20 bp, Artificial Sequence
  chemically synthesized
tggcaggcggaaaaaaatgg

SEQ ID NO: 554179 - DNA, 20 bp, Artificial Sequence
  chemically synthesized
gactggcacaaatgtttcca

SEQ ID NO: 554180 - DNA, 20 bp, Artificial Sequence
  chemically synthesized
acatgtagtattcattcacc

SEQ ID NO: 554181 - DNA, 20 bp, Artificial Sequence
  chemically synthesized
tgacggaagaagaaatgtga

SEQ ID NO: 554182 - DNA, 20 bp, Artificial Sequence
  chemically synthesized
aaaatccgccccctctgtca

SEQ ID NO: 554183 - DNA, 20 bp, Artificial Sequence
  chemically synthesized
ttcctgaggaagcttggata

SEQ ID NO: 554184 - DNA, 20 bp, Artificial Sequence
  chemically synthesized
aagataaatgcgaagaaaaa

SEQ ID NO: 554185 - DNA, 20 bp, Artificial Sequence
  chemically synthesized
ctctttaaaccaataaagat

SEQ ID NO: 554186 - DNA, 20 bp, Artificial Sequence
  chemically synthesized
aatacacagtgaagtcataa

SEQ ID NO: 554187 - DNA, 20 bp, Artificial Sequence
  chemically synthesized
aacttaagcctgaaaaaaaa

SEQ ID NO: 554188 - DNA, 20 bp, Artificial Sequence
  chemically synthesized
ttttgtcttaaagaaagaaa

SEQ ID NO: 554189 - DNA, 20 bp, Artificial Sequence
  chemically synthesized
ttcttaaagctccagtgtct

SEQ ID NO: 554190 - DNA, 20 bp, Artificial Sequence
  chemically synthesized
gaccattatttcctcctatg

SEQ ID NO: 554191 - DNA, 20 bp, Artificial Sequence
  chemically synthesized
cgcagtgtattgagatgtaa

SEQ ID NO: 554192 - DNA, 20 bp, Artificial Sequence
  chemically synthesized
gatccctctattactctata

SEQ ID NO: 554193 - DNA, 20 bp, Artificial Sequence
  chemically synthesized
aatgacatatctccaaggta

SEQ ID NO: 554194 - DNA, 20 bp, Artificial Sequence
  chemically synthesized
tggaaagtcagagactactt

SEQ ID NO: 554195 - DNA, 20 bp, Artificial Sequence
  chemically synthesized
gagtaaataagatctgattt

SEQ ID NO: 554196 - DNA, 20 bp, Artificial Sequence
  chemically synthesized
tccagcctgggcgacaagag

SEQ ID NO: 554197 - DNA, 20 bp, Artificial Sequence
  chemically synthesized
caagagcaaaactccaactg

SEQ ID NO: 554198 - DNA, 20 bp, Artificial Sequence
  chemically synthesized
ctagaatgataaaaaaaaaa

SEQ ID NO: 554199 - DNA, 20 bp, Artificial Sequence
  chemically synthesized
taaactgtgaatcaaagggg

SEQ ID NO: 554200 - DNA, 20 bp, Artificial Sequence
  chemically synthesized
acacatgcatttatttattg

SEQ ID NO: 554201 - DNA, 20 bp, Artificial Sequence
  chemically synthesized
tggcctgtgcttgtgatttt

SEQ ID NO: 554202 - DNA, 20 bp, Artificial Sequence
  chemically synthesized
attctgttcatcatgcattt

SEQ ID NO: 554203 - DNA, 20 bp, Artificial Sequence
  chemically synthesized
caatcactggaggtaaaata

SEQ ID NO: 554204 - DNA, 20 bp, Artificial Sequence
  chemically synthesized
atatgacattctggaaaaga

SEQ ID NO: 554205 - DNA, 20 bp, Artificial Sequence
  chemically synthesized
agcattcatcttagagaaat

SEQ ID NO: 554206 - DNA, 20 bp, Artificial Sequence
  chemically synthesized
tggccttacttagaacagtg

SEQ ID NO: 554207 - DNA, 20 bp, Artificial Sequence
  chemically synthesized
ttaaaggctatgaatgtttt

SEQ ID NO: 554208 - DNA, 20 bp, Artificial Sequence
  chemically synthesized
taatttatgtaaaatgtttt

SEQ ID NO: 554209 - DNA, 20 bp, Artificial Sequence
  chemically synthesized
cctcttcccctgatagactg

SEQ ID NO: 554210 - DNA, 20 bp, Artificial Sequence
  chemically synthesized
acaatactgtgtagtgcact

SEQ ID NO: 554211 - DNA, 20 bp, Artificial Sequence
  chemically synthesized
cacacaaaagcaaagggaca

SEQ ID NO: 554212 - DNA, 20 bp, Artificial Sequence
  chemically synthesized
aaaagatgagtacagtggag

SEQ ID NO: 554213 - DNA, 20 bp, Artificial Sequence
  chemically synthesized
gaagttgtgtataaaaagag

SEQ ID NO: 554214 - DNA, 20 bp, Artificial Sequence
  chemically synthesized
tgattatgactttaggaaat

SEQ ID NO: 554215 - DNA, 20 bp, Artificial Sequence
  chemically synthesized
ggcctttcatttaaatgaca

SEQ ID NO: 554216 - DNA, 20 bp, Artificial Sequence
  chemically synthesized
aagttaaatttaacactttt

SEQ ID NO: 554217 - DNA, 20 bp, Artificial Sequence
  chemically synthesized
atcaaaagtaaagattcaat

SEQ ID NO: 554218 - DNA, 20 bp, Artificial Sequence
  chemically synthesized
aggtgactgagttgcagaga

SEQ ID NO: 554219 - DNA, 20 bp, Artificial Sequence
  chemically synthesized
ctgcttctaaccgacttata

SEQ ID NO: 554220 - DNA, 20 bp, Artificial Sequence
  chemically synthesized
accgacttatagaaaacttc

SEQ ID NO: 554221 - DNA, 20 bp, Artificial Sequence
  chemically synthesized
tagggagcaactcagatatt

SEQ ID NO: 554222 - DNA, 20 bp, Artificial Sequence
  chemically synthesized
tgtaattcgggtgatctgga

SEQ ID NO: 554223 - DNA, 20 bp, Artificial Sequence
  chemically synthesized
tgtctccatttcacagaaga

SEQ ID NO: 554224 - DNA, 20 bp, Artificial Sequence
  chemically synthesized
ttacgcggttctcagagtaa

SEQ ID NO: 554225 - DNA, 20 bp, Artificial Sequence
  chemically synthesized
actaatatagtatataatga

SEQ ID NO: 554226 - DNA, 20 bp, Artificial Sequence
  chemically synthesized
taaatatttttagaaataaa

SEQ ID NO: 554227 - DNA, 20 bp, Artificial Sequence
  chemically synthesized
gaataactgaagatgcagtt

SEQ ID NO: 554228 - DNA, 20 bp, Artificial Sequence
  chemically synthesized
tctgcctatttctatctcat

SEQ ID NO: 554229 - DNA, 20 bp, Artificial Sequence
  chemically synthesized
attaaaacattagtgctctc

SEQ ID NO: 554230 - DNA, 20 bp, Artificial Sequence
  chemically synthesized
tcattcctatatttattaac

SEQ ID NO: 554231 - DNA, 20 bp, Artificial Sequence
  chemically synthesized
ggtcatgataagtttgattt

SEQ ID NO: 554232 - DNA, 20 bp, Artificial Sequence
  chemically synthesized
actggggaaacggcagtaaa

SEQ ID NO: 554233 - DNA, 20 bp, Artificial Sequence
  chemically synthesized
acataaactgttcctggttt

SEQ ID NO: 554234 - DNA, 20 bp, Artificial Sequence
  chemically synthesized
ctggttgtgttctgaaaatg

SEQ ID NO: 554235 - DNA, 20 bp, Artificial Sequence
  chemically synthesized
aatggaaaacatccaaatgg

SEQ ID NO: 554236 - DNA, 20 bp, Artificial Sequence
  chemically synthesized
ccaaaatagtgcccatgtta

SEQ ID NO: 554237 - DNA, 20 bp, Artificial Sequence
  chemically synthesized
gacagaacaagactccatct

SEQ ID NO: 554238 - DNA, 20 bp, Artificial Sequence
  chemically synthesized
cacaaaaaaaaaaaaaaaaa

SEQ ID NO: 554239 - DNA, 20 bp, Artificial Sequence
  chemically synthesized
gaaattcccatagcagaaac

SEQ ID NO: 554240 - DNA, 20 bp, Artificial Sequence
  chemically synthesized
aaactgcatctcaaaaaaat

SEQ ID NO: 554241 - DNA, 20 bp, Artificial Sequence
  chemically synthesized
tactacctttgtaatggaaa

SEQ ID NO: 554242 - DNA, 20 bp, Artificial Sequence
  chemically synthesized
atggtacagtcgactttgat

SEQ ID NO: 554243 - DNA, 20 bp, Artificial Sequence
  chemically synthesized
tattgagccgttctaatgtg

SEQ ID NO: 554244 - DNA, 20 bp, Artificial Sequence
  chemically synthesized
gatcaaacagttaatatttg

SEQ ID NO: 554245 - DNA, 20 bp, Artificial Sequence
  chemically synthesized
tctctcaacacctctgggct

SEQ ID NO: 554246 - DNA, 20 bp, Artificial Sequence
  chemically synthesized
tcgactgcaacccacagaag

SEQ ID NO: 554247 - DNA, 20 bp, Artificial Sequence
  chemically synthesized
gcgcacgccagatcacagtg

SEQ ID NO: 554248 - DNA, 20 bp, Artificial Sequence
  chemically synthesized
tctaacaaattaaccaccgc

SEQ ID NO: 554249 - DNA, 20 bp, Artificial Sequence
  chemically synthesized
aaaaggcttccacagtcacc

SEQ ID NO: 554250 - DNA, 20 bp, Artificial Sequence
  chemically synthesized
gtactgattaataagattgg

SEQ ID NO: 554251 - DNA, 20 bp, Artificial Sequence
  chemically synthesized
ttttttcaagggacagttat

SEQ ID NO: 554252 - DNA, 20 bp, Artificial Sequence
  chemically synthesized
attttccaagccaggttctt

SEQ ID NO: 554253 - DNA, 20 bp, Artificial Sequence
  chemically synthesized
tggaacttgtaaaatattaa

SEQ ID NO: 554254 - DNA, 20 bp, Artificial Sequence
  chemically synthesized
aattaggagtagcagtgtat

SEQ ID NO: 554255 - DNA, 20 bp, Artificial Sequence
  chemically synthesized
tatgaccttagaggaatatt

SEQ ID NO: 554256 - DNA, 20 bp, Artificial Sequence
  chemically synthesized
tatgagctgcttttttccct

SEQ ID NO: 554257 - DNA, 20 bp, Artificial Sequence
  chemically synthesized
taagggaaaaaagcagctca

SEQ ID NO: 554258 - DNA, 20 bp, Artificial Sequence
  chemically synthesized
cttttaaaccatgcgcagat

SEQ ID NO: 554259 - DNA, 20 bp, Artificial Sequence
  chemically synthesized
tgagattgcactctgtctca

SEQ ID NO: 554260 - DNA, 20 bp, Artificial Sequence
  chemically synthesized
aattcccatgtcttacccat

SEQ ID NO: 554261 - DNA, 20 bp, Artificial Sequence
  chemically synthesized
atctattatcgatgtatgac

SEQ ID NO: 554262 - DNA, 20 bp, Artificial Sequence
  chemically synthesized
aaaattacagtgcgatgctt

SEQ ID NO: 554263 - DNA, 20 bp, Artificial Sequence
  chemically synthesized
gtatggctttttaaatacca

SEQ ID NO: 554264 - DNA, 20 bp, Artificial Sequence
  chemically synthesized
taaattaacattaatcagag

SEQ ID NO: 554265 - DNA, 20 bp, Artificial Sequence
  chemically synthesized
tttctcttagtattaattat

SEQ ID NO: 554266 - DNA, 20 bp, Artificial Sequence
  chemically synthesized
aaacataattaataaaatag

SEQ ID NO: 554267 - DNA, 20 bp, Artificial Sequence
  chemically synthesized
atgcttatcacagcactgtt

SEQ ID NO: 554268 - DNA, 20 bp, Artificial Sequence
  chemically synthesized
tgaactgataggcagaaatt

SEQ ID NO: 554269 - DNA, 20 bp, Artificial Sequence
  chemically synthesized
agtatatgggctgctgaagc

SEQ ID NO: 554270 - DNA, 20 bp, Artificial Sequence
  chemically synthesized
ttaataagaataacagttga

SEQ ID NO: 554271 - DNA, 20 bp, Artificial Sequence
  chemically synthesized
tctatataatgaggaacaat

SEQ ID NO: 554272 - DNA, 20 bp, Artificial Sequence
  chemically synthesized
tatatacggtaagtgaatat

SEQ ID NO: 554273 - DNA, 20 bp, Artificial Sequence
  chemically synthesized
gtgtttggccttggattgat

SEQ ID NO: 554274 - DNA, 20 bp, Artificial Sequence
  chemically synthesized
ccaatgagttgactgtaaaa

SEQ ID NO: 554275 - DNA, 20 bp, Artificial Sequence
  chemically synthesized
atacaaatctttactttcac

SEQ ID NO: 554276 - DNA, 20 bp, Artificial Sequence
  chemically synthesized
tgcttctttaaaaatttgtc

SEQ ID NO: 554277 - DNA, 20 bp, Artificial Sequence
  chemically synthesized
gccagcctggccaacatggt

SEQ ID NO: 554278 - DNA, 20 bp, Artificial Sequence
  chemically synthesized
aaatagggtgggtagtaaga

SEQ ID NO: 554279 - DNA, 20 bp, Artificial Sequence
  chemically synthesized
taataatttccaagtccact

SEQ ID NO: 554280 - DNA, 20 bp, Artificial Sequence
  chemically synthesized
acctttagggggcatgcagt

SEQ ID NO: 554281 - DNA, 20 bp, Artificial Sequence
  chemically synthesized
actgtgtcaatatattatag

SEQ ID NO: 554282 - DNA, 20 bp, Artificial Sequence
  chemically synthesized
actctacctgctaagcccac

SEQ ID NO: 554283 - DNA, 20 bp, Artificial Sequence
  chemically synthesized
ccaaatgctaatcttgtctg

SEQ ID NO: 554284 - DNA, 20 bp, Artificial Sequence
  chemically synthesized
atcatcttatttaattccca

SEQ ID NO: 554285 - DNA, 20 bp, Artificial Sequence
  chemically synthesized
ccccccgacttcattgacat

SEQ ID NO: 554286 - DNA, 20 bp, Artificial Sequence
  chemically synthesized
ggcatgagaggttaaaaaaa

SEQ ID NO: 554287 - DNA, 20 bp, Artificial Sequence
  chemically synthesized
attatagagaaaggttgtgg

SEQ ID NO: 554288 - DNA, 20 bp, Artificial Sequence
  chemically synthesized
agttgtgcattcaatccaca

SEQ ID NO: 554289 - DNA, 20 bp, Artificial Sequence
  chemically synthesized
gaaacaaatttatgaatgag

SEQ ID NO: 554290 - DNA, 20 bp, Artificial Sequence
  chemically synthesized
tcaatataccgtggtatata

SEQ ID NO: 554291 - DNA, 20 bp, Artificial Sequence
  chemically synthesized
aatattgaaagagataggca

SEQ ID NO: 554292 - DNA, 20 bp, Artificial Sequence
  chemically synthesized
ttgggaagatcagtatagtg

SEQ ID NO: 554293 - DNA, 20 bp, Artificial Sequence
  chemically synthesized
agaactatcccagatgggca

SEQ ID NO: 554294 - DNA, 20 bp, Artificial Sequence
  chemically synthesized
atccctgacacaagcttttg

SEQ ID NO: 554295 - DNA, 20 bp, Artificial Sequence
  chemically synthesized
aagtaaaaaaaagaaaagaa

SEQ ID NO: 554296 - DNA, 20 bp, Artificial Sequence
  chemically synthesized
taatactagatttaaaaatg

SEQ ID NO: 554297 - DNA, 20 bp, Artificial Sequence
  chemically synthesized
aaatgtaaaacggcaattta

SEQ ID NO: 554298 - DNA, 20 bp, Artificial Sequence
  chemically synthesized
tgattatttaaaaactagag

SEQ ID NO: 554299 - DNA, 20 bp, Artificial Sequence
  chemically synthesized
aatcttaaatatgattattt

SEQ ID NO: 554300 - DNA, 20 bp, Artificial Sequence
  chemically synthesized
agtggaagcccttgagaatc

SEQ ID NO: 554301 - DNA, 20 bp, Artificial Sequence
  chemically synthesized
tcctaaacttctagtgaaga

SEQ ID NO: 554302 - DNA, 20 bp, Artificial Sequence
  chemically synthesized
caaactgagaaccagaaaat

SEQ ID NO: 554303 - DNA, 20 bp, Artificial Sequence
  chemically synthesized
acttacacaaatgagcctat

SEQ ID NO: 554304 - DNA, 20 bp, Artificial Sequence
  chemically synthesized
acaaatgagcctattaaaac

SEQ ID NO: 554305 - DNA, 20 bp, Artificial Sequence
  chemically synthesized
aaactgaaaaacttcaggac

SEQ ID NO: 554306 - DNA, 20 bp, Artificial Sequence
  chemically synthesized
cacagaaactgtacaaactg

SEQ ID NO: 554307 - DNA, 20 bp, Artificial Sequence
  chemically synthesized
ccgcagagctatacctatca

SEQ ID NO: 554308 - DNA, 20 bp, Artificial Sequence
  chemically synthesized
tgataggtatagctctgcgg

SEQ ID NO: 554309 - DNA, 20 bp, Artificial Sequence
  chemically synthesized
cctaagtgccctaatgtcag

SEQ ID NO: 554310 - DNA, 20 bp, Artificial Sequence
  chemically synthesized
aactggaaggcaagagagaa

SEQ ID NO: 554311 - DNA, 20 bp, Artificial Sequence
  chemically synthesized
tgaggcagttgcataagcaa

SEQ ID NO: 554312 - DNA, 20 bp, Artificial Sequence
  chemically synthesized
cataagtctgtagatgtaat

SEQ ID NO: 554313 - DNA, 20 bp, Artificial Sequence
  chemically synthesized
caaatcatgagatacattag

SEQ ID NO: 554314 - DNA, 20 bp, Artificial Sequence
  chemically synthesized
agatgtgtgagaaccagaat

SEQ ID NO: 554315 - DNA, 20 bp, Artificial Sequence
  chemically synthesized
ttttcacttcaactctaaac

SEQ ID NO: 554316 - DNA, 20 bp, Artificial Sequence
  chemically synthesized
ctatgtaaagccacatttgg

SEQ ID NO: 554317 - DNA, 20 bp, Artificial Sequence
  chemically synthesized
atgtggctttacatagtgca

SEQ ID NO: 554318 - DNA, 20 bp, Artificial Sequence
  chemically synthesized
atagtgcagaaaactacagg

SEQ ID NO: 554319 - DNA, 20 bp, Artificial Sequence
  chemically synthesized
agattataaagcaaaatccc

SEQ ID NO: 554320 - DNA, 20 bp, Artificial Sequence
  chemically synthesized
aaggattctttttctttctt

SEQ ID NO: 554321 - DNA, 20 bp, Artificial Sequence
  chemically synthesized
gaaaaaataaaaataaataa

SEQ ID NO: 554322 - DNA, 20 bp, Artificial Sequence
  chemically synthesized
tgggtaagcttttgatgggc

SEQ ID NO: 554323 - DNA, 20 bp, Artificial Sequence
  chemically synthesized
acatgataataaaattcaag

SEQ ID NO: 554324 - DNA, 20 bp, Artificial Sequence
  chemically synthesized
ttaccattaccttcaatggc

SEQ ID NO: 554325 - DNA, 20 bp, Artificial Sequence
  chemically synthesized
tttgccattgaaggtaatgg

SEQ ID NO: 554326 - DNA, 20 bp, Artificial Sequence
  chemically synthesized
ctccatgctttcattcatcc

SEQ ID NO: 554327 - DNA, 20 bp, Artificial Sequence
  chemically synthesized
gaggataagctgccagaaac

SEQ ID NO: 554328 - DNA, 20 bp, Artificial Sequence
  chemically synthesized
atccctaccatagctggggc

SEQ ID NO: 554329 - DNA, 20 bp, Artificial Sequence
  chemically synthesized
aaaaaaaaataacacaaaca

SEQ ID NO: 554330 - DNA, 20 bp, Artificial Sequence
  chemically synthesized
atacagtaaggaaaagacaa

SEQ ID NO: 554331 - DNA, 20 bp, Artificial Sequence
  chemically synthesized
tgattttgtgttgtttagat

SEQ ID NO: 554332 - DNA, 20 bp, Artificial Sequence
  chemically synthesized
ctcatgtgacaggtcacagt

SEQ ID NO: 554333 - DNA, 20 bp, Artificial Sequence
  chemically synthesized
atccacaaaaataaaaaatc

SEQ ID NO: 554334 - DNA, 20 bp, Artificial Sequence
  chemically synthesized
gttagggccaggttagatcg

SEQ ID NO: 554335 - DNA, 20 bp, Artificial Sequence
  chemically synthesized
tgtaatatataatgaagaaa

SEQ ID NO: 554336 - DNA, 20 bp, Artificial Sequence
  chemically synthesized
ggtgaaaccccgtctctagt

SEQ ID NO: 554337 - DNA, 20 bp, Artificial Sequence
  chemically synthesized
cagagtgagacaccgtctca

SEQ ID NO: 554338 - DNA, 20 bp, Artificial Sequence
  chemically synthesized
gagacaccgtctcaaaaaac

SEQ ID NO: 554339 - DNA, 20 bp, Artificial Sequence
  chemically synthesized
ccgtctcaaaaaacaaaaac

SEQ ID NO: 554340 - DNA, 20 bp, Artificial Sequence
  chemically synthesized
tcaagttaatatttgtttta

SEQ ID NO: 554341 - DNA, 20 bp, Artificial Sequence
  chemically synthesized
atttaaaagattctgttttt

SEQ ID NO: 554342 - DNA, 20 bp, Artificial Sequence
  chemically synthesized
tcataactacatataagaac

SEQ ID NO: 554343 - DNA, 20 bp, Artificial Sequence
  chemically synthesized
actcttggctgtaagtgaca

SEQ ID NO: 554344 - DNA, 20 bp, Artificial Sequence
  chemically synthesized
ttaaacagaaagatttagtt

SEQ ID NO: 554345 - DNA, 20 bp, Artificial Sequence
  chemically synthesized
atagcagacaattattgatg

SEQ ID NO: 554346 - DNA, 20 bp, Artificial Sequence
  chemically synthesized
tagtgactgtcaatgagttt

SEQ ID NO: 554347 - DNA, 20 bp, Artificial Sequence
  chemically synthesized
cacttccgggaatctatggt

SEQ ID NO: 554348 - DNA, 20 bp, Artificial Sequence
  chemically synthesized
cagtgagatccacaagggtt

SEQ ID NO: 554349 - DNA, 20 bp, Artificial Sequence
  chemically synthesized
aaaaaaaaaaaaaaaaaaaa

SEQ ID NO: 554350 - DNA, 20 bp, Artificial Sequence
  chemically synthesized
gataaaagaaaaaaaagaaa

SEQ ID NO: 554351 - DNA, 20 bp, Artificial Sequence
  chemically synthesized
agtgttgcagggacagtcat

SEQ ID NO: 554352 - DNA, 20 bp, Artificial Sequence
  chemically synthesized
ttgactcaatatcgactttt

SEQ ID NO: 554353 - DNA, 20 bp, Artificial Sequence
  chemically synthesized
atagttcacagctttgatag

SEQ ID NO: 554354 - DNA, 20 bp, Artificial Sequence
  chemically synthesized
cacacaacgtcggaaagatt

SEQ ID NO: 554355 - DNA, 20 bp, Artificial Sequence
  chemically synthesized
ctgttgagaagtgtacagaa

SEQ ID NO: 554356 - DNA, 20 bp, Artificial Sequence
  chemically synthesized
aggcaaatgtgaataccatt

SEQ ID NO: 554357 - DNA, 20 bp, Artificial Sequence
  chemically synthesized
acttctgccttagggcagga

SEQ ID NO: 554358 - DNA, 20 bp, Artificial Sequence
  chemically synthesized
acagacttaaacataaaatg

SEQ ID NO: 554359 - DNA, 20 bp, Artificial Sequence
  chemically synthesized
atgtaaaactataagacata

SEQ ID NO: 554360 - DNA, 20 bp, Artificial Sequence
  chemically synthesized
gaagatgaaaagatgagaga

SEQ ID NO: 554361 - DNA, 20 bp, Artificial Sequence
  chemically synthesized
agatgagagagaaaacattt

SEQ ID NO: 554362 - DNA, 20 bp, Artificial Sequence
  chemically synthesized
tctgatacagaaagaactct

SEQ ID NO: 554363 - DNA, 20 bp, Artificial Sequence
  chemically synthesized
ctctcaaaaccgaactataa

SEQ ID NO: 554364 - DNA, 20 bp, Artificial Sequence
  chemically synthesized
tcggaaaagtttggcagttt

SEQ ID NO: 554365 - DNA, 20 bp, Artificial Sequence
  chemically synthesized
ggtagttgaatgtttagttt

SEQ ID NO: 554366 - DNA, 20 bp, Artificial Sequence
  chemically synthesized
agcatttatctcagggaaat

SEQ ID NO: 554367 - DNA, 20 bp, Artificial Sequence
  chemically synthesized
ataaaaacttatgttcacac

SEQ ID NO: 554368 - DNA, 20 bp, Artificial Sequence
  chemically synthesized
tagctttattcacaatagtc

SEQ ID NO: 554369 - DNA, 20 bp, Artificial Sequence
  chemically synthesized
ataacaaaattaaagaaatg

SEQ ID NO: 554370 - DNA, 20 bp, Artificial Sequence
  chemically synthesized
ttcctctaatggtacacctg

SEQ ID NO: 554371 - DNA, 20 bp, Artificial Sequence
  chemically synthesized
gccttctgaatttttaataa

SEQ ID NO: 554372 - DNA, 20 bp, Artificial Sequence
  chemically synthesized
aattttttggtaataagaaa

SEQ ID NO: 554373 - DNA, 20 bp, Artificial Sequence
  chemically synthesized
ctaagaattattttttatta

SEQ ID NO: 554374 - DNA, 20 bp, Artificial Sequence
  chemically synthesized
agcactcagcaaatagcagg

SEQ ID NO: 554375 - DNA, 20 bp, Artificial Sequence
  chemically synthesized
tccttgtatgtccaaacaaa

SEQ ID NO: 554376 - DNA, 20 bp, Artificial Sequence
  chemically synthesized
cttttgccagtttaatttcg

SEQ ID NO: 554377 - DNA, 20 bp, Artificial Sequence
  chemically synthesized
gacagaacagtgtttaactt

SEQ ID NO: 554378 - DNA, 20 bp, Artificial Sequence
  chemically synthesized
attcaacaacccttcatgct

SEQ ID NO: 554379 - DNA, 20 bp, Artificial Sequence
  chemically synthesized
caatatcatactgaatgggc

SEQ ID NO: 554380 - DNA, 20 bp, Artificial Sequence
  chemically synthesized
aaactggaagcattccctct

SEQ ID NO: 554381 - DNA, 20 bp, Artificial Sequence
  chemically synthesized
atgacatgattgtatatcta

SEQ ID NO: 554382 - DNA, 20 bp, Artificial Sequence
  chemically synthesized
actttcttcacagaattgga

SEQ ID NO: 554383 - DNA, 20 bp, Artificial Sequence
  chemically synthesized
tactacaaggctacaggaag

SEQ ID NO: 554384 - DNA, 20 bp, Artificial Sequence
  chemically synthesized
aaacagcatggtactggtac

SEQ ID NO: 554385 - DNA, 20 bp, Artificial Sequence
  chemically synthesized
tgatctttgacaaacctgag

SEQ ID NO: 554386 - DNA, 20 bp, Artificial Sequence
  chemically synthesized
tatttaataaatggtgctgg

SEQ ID NO: 554387 - DNA, 20 bp, Artificial Sequence
  chemically synthesized
aaagacttaaatgttagacc

SEQ ID NO: 554388 - DNA, 20 bp, Artificial Sequence
  chemically synthesized
aatgttagacctaaaaccac

SEQ ID NO: 554389 - DNA, 20 bp, Artificial Sequence
  chemically synthesized
aaaccacaaaaactctagaa

SEQ ID NO: 554390 - DNA, 20 bp, Artificial Sequence
  chemically synthesized
ctcaaacaaatgtacaagaa

SEQ ID NO: 554391 - DNA, 20 bp, Artificial Sequence
  chemically synthesized
gccatcagagaaatgcaaat

SEQ ID NO: 554392 - DNA, 20 bp, Artificial Sequence
  chemically synthesized
cacattgtgcacatgtaccc

SEQ ID NO: 554393 - DNA, 20 bp, Artificial Sequence
  chemically synthesized
accttgagcagtaggatata

SEQ ID NO: 554394 - DNA, 20 bp, Artificial Sequence
  chemically synthesized
cgccaaggtctgacttttca

SEQ ID NO: 554395 - DNA, 20 bp, Artificial Sequence
  chemically synthesized
attgagagttgtgctgggaa

SEQ ID NO: 554396 - DNA, 20 bp, Artificial Sequence
  chemically synthesized
acgagatcatgtgcttggca

SEQ ID NO: 554397 - DNA, 20 bp, Artificial Sequence
  chemically synthesized
ctttcttttcaaattgtggt

SEQ ID NO: 554398 - DNA, 20 bp, Artificial Sequence
  chemically synthesized
attttccttccttcctctaa

SEQ ID NO: 554399 - DNA, 20 bp, Artificial Sequence
  chemically synthesized
agtttgagcttctgaataac

SEQ ID NO: 554400 - DNA, 20 bp, Artificial Sequence
  chemically synthesized
atgaggaaacagacaaggta

SEQ ID NO: 554401 - DNA, 20 bp, Artificial Sequence
  chemically synthesized
ccctcactaggaaagctgct

SEQ ID NO: 554402 - DNA, 20 bp, Artificial Sequence
  chemically synthesized
gctctctctgctgtaatcat

SEQ ID NO: 554403 - DNA, 20 bp, Artificial Sequence
  chemically synthesized
tctgatgccagtgcatgggg

SEQ ID NO: 554404 - DNA, 20 bp, Artificial Sequence
  chemically synthesized
tagagtacaggtatcaaaat

SEQ ID NO: 554405 - DNA, 20 bp, Artificial Sequence
  chemically synthesized
aaaacactttggcctaggct

SEQ ID NO: 554406 - DNA, 20 bp, Artificial Sequence
  chemically synthesized
gttcttccacatttctgcta

SEQ ID NO: 554407 - DNA, 20 bp, Artificial Sequence
  chemically synthesized
actcccactcctgcccgcca

SEQ ID NO: 554408 - DNA, 20 bp, Artificial Sequence
  chemically synthesized
ctttacctacccaaatctta

SEQ ID NO: 554409 - DNA, 20 bp, Artificial Sequence
  chemically synthesized
aacaggctttgtgtgagcaa

SEQ ID NO: 554410 - DNA, 20 bp, Artificial Sequence
  chemically synthesized
cggagttttgggtccacgga

SEQ ID NO: 554411 - DNA, 20 bp, Artificial Sequence
  chemically synthesized
atgcgttttatccgtggacc

SEQ ID NO: 554412 - DNA, 20 bp, Artificial Sequence
  chemically synthesized
agcctgtgctctcaagaact

SEQ ID NO: 554413 - DNA, 20 bp, Artificial Sequence
  chemically synthesized
tcttcaactcacacctgacc

SEQ ID NO: 554414 - DNA, 20 bp, Artificial Sequence
  chemically synthesized
acagtagttccaaatagcca

SEQ ID NO: 554415 - DNA, 20 bp, Artificial Sequence
  chemically synthesized
ggctctttttcatcaaataa

SEQ ID NO: 554416 - DNA, 20 bp, Artificial Sequence
  chemically synthesized
ggccaggcttctaaacctct

SEQ ID NO: 554417 - DNA, 20 bp, Artificial Sequence
  chemically synthesized
tgcaccccttaccatcccat

SEQ ID NO: 554418 - DNA, 20 bp, Artificial Sequence
  chemically synthesized
ggcaccacagggttgatagg

SEQ ID NO: 554419 - DNA, 20 bp, Artificial Sequence
  chemically synthesized
tatctcggcataattctcat

SEQ ID NO: 554420 - DNA, 20 bp, Artificial Sequence
  chemically synthesized
ccaaaccccaatcccttcta

SEQ ID NO: 554421 - DNA, 20 bp, Artificial Sequence
  chemically synthesized
tctaaccatgcctaggagga

SEQ ID NO: 554422 - DNA, 20 bp, Artificial Sequence
  chemically synthesized
taatggttttgttaggatgg

SEQ ID NO: 554423 - DNA, 20 bp, Artificial Sequence
  chemically synthesized
acctggttttgccatcctaa

SEQ ID NO: 554424 - DNA, 20 bp, Artificial Sequence
  chemically synthesized
acgcagacatgagggctagg

SEQ ID NO: 554425 - DNA, 20 bp, Artificial Sequence
  chemically synthesized
cagtgaactaatggtctttt

SEQ ID NO: 554426 - DNA, 20 bp, Artificial Sequence
  chemically synthesized
ccaacttagactgcacccca

SEQ ID NO: 554427 - DNA, 20 bp, Artificial Sequence
  chemically synthesized
aaacggaataagagaaggag

SEQ ID NO: 554428 - DNA, 20 bp, Artificial Sequence
  chemically synthesized
atacggttttgtatgaattg

SEQ ID NO: 554429 - DNA, 20 bp, Artificial Sequence
  chemically synthesized
gtttagtttttcaattcata

SEQ ID NO: 554430 - DNA, 20 bp, Artificial Sequence
  chemically synthesized
tcttatattaataagaaaaa

SEQ ID NO: 554431 - DNA, 20 bp, Artificial Sequence
  chemically synthesized
aaaaggcaacatttgagcag

SEQ ID NO: 554432 - DNA, 20 bp, Artificial Sequence
  chemically synthesized
tgctcaaatgttgccttttc

SEQ ID NO: 554433 - DNA, 20 bp, Artificial Sequence
  chemically synthesized
cttttgggcgccagcaggaa

SEQ ID NO: 554434 - DNA, 20 bp, Artificial Sequence
  chemically synthesized
tgttatgttatcaattcttg

SEQ ID NO: 554435 - DNA, 20 bp, Artificial Sequence
  chemically synthesized
cagctgtcatttctttcctc

SEQ ID NO: 554436 - DNA, 20 bp, Artificial Sequence
  chemically synthesized
aagcaatagcaaagcagaga

SEQ ID NO: 554437 - DNA, 20 bp, Artificial Sequence
  chemically synthesized
cagagaagatcctattacag

SEQ ID NO: 554438 - DNA, 20 bp, Artificial Sequence
  chemically synthesized
gcgtaggatgtctgtattag

SEQ ID NO: 554439 - DNA, 20 bp, Artificial Sequence
  chemically synthesized
tgagaagaaaaagcggctga

SEQ ID NO: 554440 - DNA, 20 bp, Artificial Sequence
  chemically synthesized
tcctgaaacaaatatgtttc

SEQ ID NO: 554441 - DNA, 20 bp, Artificial Sequence
  chemically synthesized
ttcacattgcatgcctgtat

SEQ ID NO: 554442 - DNA, 20 bp, Artificial Sequence
  chemically synthesized
atgttcagagaaatgcaaat

SEQ ID NO: 554443 - DNA, 20 bp, Artificial Sequence
  chemically synthesized
agcaaactatcacaaggaca

SEQ ID NO: 554444 - DNA, 20 bp, Artificial Sequence
  chemically synthesized
cctcctccctcccctcaccc

SEQ ID NO: 554445 - DNA, 20 bp, Artificial Sequence
  chemically synthesized
tcagcctcacacagacatag

SEQ ID NO: 554446 - DNA, 20 bp, Artificial Sequence
  chemically synthesized
aaggcattttctgaaaaaca

SEQ ID NO: 554447 - DNA, 20 bp, Artificial Sequence
  chemically synthesized
aaaggggaaggcattttctg

SEQ ID NO: 554448 - DNA, 20 bp, Artificial Sequence
  chemically synthesized
aatgaatgaacacatgaagt

SEQ ID NO: 554449 - DNA, 20 bp, Artificial Sequence
  chemically synthesized
tctagaatgaagcctattaa

SEQ ID NO: 554450 - DNA, 20 bp, Artificial Sequence
  chemically synthesized
ccgcgtctctactaaaaata

SEQ ID NO: 554451 - DNA, 20 bp, Artificial Sequence
  chemically synthesized
gaccagcctggccaacatgg

SEQ ID NO: 554452 - DNA, 20 bp, Artificial Sequence
  chemically synthesized
ctcaaaaaaaaaaaaaaccg

SEQ ID NO: 554453 - DNA, 20 bp, Artificial Sequence
  chemically synthesized
gattccatctcaaaaaaaaa

SEQ ID NO: 554454 - DNA, 20 bp, Artificial Sequence
  chemically synthesized
taataaagcagcaaacaaga

SEQ ID NO: 554455 - DNA, 20 bp, Artificial Sequence
  chemically synthesized
cagagtgagactccgtctca

SEQ ID NO: 554456 - DNA, 20 bp, Artificial Sequence
  chemically synthesized
tgagactccgtctcaaaaaa

SEQ ID NO: 554457 - DNA, 20 bp, Artificial Sequence
  chemically synthesized
ctccgtctcaaaaaacaaaa

SEQ ID NO: 554458 - DNA, 20 bp, Artificial Sequence
  chemically synthesized
tctcaaaaaacaaaacaaaa

SEQ ID NO: 554459 - DNA, 20 bp, Artificial Sequence
  chemically synthesized
aacaaaacaaaacaaaacca

SEQ ID NO: 554460 - DNA, 20 bp, Artificial Sequence
  chemically synthesized
ggatcaaaatgaaatagtca

SEQ ID NO: 554461 - DNA, 20 bp, Artificial Sequence
  chemically synthesized
gaagtgtagaaatgattttt

SEQ ID NO: 554462 - DNA, 20 bp, Artificial Sequence
  chemically synthesized
ctaaactaaacagatggtag

SEQ ID NO: 554463 - DNA, 20 bp, Artificial Sequence
  chemically synthesized
tggaacttaaaatggaaaaa

SEQ ID NO: 554464 - DNA, 20 bp, Artificial Sequence
  chemically synthesized
catttcaaactgaacatgtc

SEQ ID NO: 554465 - DNA, 20 bp, Artificial Sequence
  chemically synthesized
caacaagttgatcaaacaaa

SEQ ID NO: 554466 - DNA, 20 bp, Artificial Sequence
  chemically synthesized
cacctgagctgatgtacctg

SEQ ID NO: 554467 - DNA, 20 bp, Artificial Sequence
  chemically synthesized
agagagtgaggctccatctc

SEQ ID NO: 554468 - DNA, 20 bp, Artificial Sequence
  chemically synthesized
gaggctccatctcaaaaaca

SEQ ID NO: 554469 - DNA, 20 bp, Artificial Sequence
  chemically synthesized
aaaaacaaaaagcaagcaaa

SEQ ID NO: 554470 - DNA, 20 bp, Artificial Sequence
  chemically synthesized
atgaaaacattactaaacca

SEQ ID NO: 554471 - DNA, 20 bp, Artificial Sequence
  chemically synthesized
ttctgagtctttgaaataat

SEQ ID NO: 554472 - DNA, 20 bp, Artificial Sequence
  chemically synthesized
tgctttccatattaaaattt

SEQ ID NO: 554473 - DNA, 20 bp, Artificial Sequence
  chemically synthesized
gaaagcaggtcattctttta

SEQ ID NO: 554474 - DNA, 20 bp, Artificial Sequence
  chemically synthesized
actccatctcaaaaaaaaaa

SEQ ID NO: 554475 - DNA, 20 bp, Artificial Sequence
  chemically synthesized
aaaaaaaaaaaacaaaaaaa

SEQ ID NO: 554476 - DNA, 20 bp, Artificial Sequence
  chemically synthesized
atatttttaaggtagtttag

SEQ ID NO: 554477 - DNA, 20 bp, Artificial Sequence
  chemically synthesized
aactaccttaaaaatatttt

SEQ ID NO: 554478 - DNA, 20 bp, Artificial Sequence
  chemically synthesized
tagtaatgaaactaaagctg

SEQ ID NO: 554479 - DNA, 20 bp, Artificial Sequence
  chemically synthesized
cgattcctcaaaggaaaaac

SEQ ID NO: 554480 - DNA, 20 bp, Artificial Sequence
  chemically synthesized
ggaaagcgattcctcaaagg

SEQ ID NO: 554481 - DNA, 20 bp, Artificial Sequence
  chemically synthesized
agaaatgaacgaagtaattt

SEQ ID NO: 554482 - DNA, 20 bp, Artificial Sequence
  chemically synthesized
tctggctaattcaagtcagg

SEQ ID NO: 554483 - DNA, 20 bp, Artificial Sequence
  chemically synthesized
tagctacttcaatacctgtt

SEQ ID NO: 554484 - DNA, 20 bp, Artificial Sequence
  chemically synthesized
atcttaatattggagataaa

SEQ ID NO: 554485 - DNA, 20 bp, Artificial Sequence
  chemically synthesized
ttagaattgcaatggcagca

SEQ ID NO: 554486 - DNA, 20 bp, Artificial Sequence
  chemically synthesized
gccaataaaatgggaatatg

SEQ ID NO: 554487 - DNA, 20 bp, Artificial Sequence
  chemically synthesized
ccttgtagctgatgttaatg

SEQ ID NO: 554488 - DNA, 20 bp, Artificial Sequence
  chemically synthesized
aaaaaaaaaaaaaaaaaaaa

SEQ ID NO: 554489 - DNA, 20 bp, Artificial Sequence
  chemically synthesized
taatcagttagtgaaaggag

SEQ ID NO: 554490 - DNA, 20 bp, Artificial Sequence
  chemically synthesized
atttctaaggaaaatcattc

SEQ ID NO: 554491 - DNA, 20 bp, Artificial Sequence
  chemically synthesized
tccagggtgctgaaaattta

SEQ ID NO: 554492 - DNA, 20 bp, Artificial Sequence
  chemically synthesized
ggctgtactgtcactcactc

SEQ ID NO: 554493 - DNA, 20 bp, Artificial Sequence
  chemically synthesized
agatttagagtgtgtcttat

SEQ ID NO: 554494 - DNA, 20 bp, Artificial Sequence
  chemically synthesized
tctagtgctcttagctatga

SEQ ID NO: 554495 - DNA, 20 bp, Artificial Sequence
  chemically synthesized
tttgtctactgagatgaaat

SEQ ID NO: 554496 - DNA, 20 bp, Artificial Sequence
  chemically synthesized
caacttgctatctttgttca

SEQ ID NO: 554497 - DNA, 20 bp, Artificial Sequence
  chemically synthesized
accccccaacctgtgcctat

SEQ ID NO: 554498 - DNA, 20 bp, Artificial Sequence
  chemically synthesized
ctcttgaagggtgccttttc

SEQ ID NO: 554499 - DNA, 20 bp, Artificial Sequence
  chemically synthesized
aaaaggcacccttcaagagg

SEQ ID NO: 554500 - DNA, 20 bp, Artificial Sequence
  chemically synthesized
tgactcttatatctaaaaat

SEQ ID NO: 554501 - DNA, 20 bp, Artificial Sequence
  chemically synthesized
acagaatttagtgaccaaat

SEQ ID NO: 554502 - DNA, 20 bp, Artificial Sequence
  chemically synthesized
aagaaagtaaatgcaaggtg

SEQ ID NO: 554503 - DNA, 20 bp, Artificial Sequence
  chemically synthesized
catgtctccctaaatatata

SEQ ID NO: 554504 - DNA, 20 bp, Artificial Sequence
  chemically synthesized
tttcgacttagcaggacaat

SEQ ID NO: 554505 - DNA, 20 bp, Artificial Sequence
  chemically synthesized
gcaggacaatgaaaacaatc

SEQ ID NO: 554506 - DNA, 20 bp, Artificial Sequence
  chemically synthesized
atatggaaactaagggccaa

SEQ ID NO: 554507 - DNA, 20 bp, Artificial Sequence
  chemically synthesized
tctaaggtttcctgttgctt

SEQ ID NO: 554508 - DNA, 20 bp, Artificial Sequence
  chemically synthesized
tttaattggataagaaatag

SEQ ID NO: 554509 - DNA, 20 bp, Artificial Sequence
  chemically synthesized
aaaccaaaccttggagaggt

SEQ ID NO: 554510 - DNA, 20 bp, Artificial Sequence
  chemically synthesized
ttgggtttcgtacaacttat

SEQ ID NO: 554511 - DNA, 20 bp, Artificial Sequence
  chemically synthesized
tttttaatagcaggggagct

SEQ ID NO: 554512 - DNA, 20 bp, Artificial Sequence
  chemically synthesized
ttagctcccctgctattaaa

SEQ ID NO: 554513 - DNA, 20 bp, Artificial Sequence
  chemically synthesized
gcagggagggactggaataa

SEQ ID NO: 554514 - DNA, 20 bp, Artificial Sequence
  chemically synthesized
gacaattatggtatggtttg

SEQ ID NO: 554515 - DNA, 20 bp, Artificial Sequence
  chemically synthesized
caactagttagtgaagcagc

SEQ ID NO: 554516 - DNA, 20 bp, Artificial Sequence
  chemically synthesized
ggcttcagtatcctaaagta

SEQ ID NO: 554517 - DNA, 20 bp, Artificial Sequence
  chemically synthesized
agatcagaaaatgtatagga

SEQ ID NO: 554518 - DNA, 20 bp, Artificial Sequence
  chemically synthesized
ctcctagtacaattggaaaa

SEQ ID NO: 554519 - DNA, 20 bp, Artificial Sequence
  chemically synthesized
cccattagtttcatttgctt

SEQ ID NO: 554520 - DNA, 20 bp, Artificial Sequence
  chemically synthesized
ttacaagagaggcaagatta

SEQ ID NO: 554521 - DNA, 20 bp, Artificial Sequence
  chemically synthesized
tctaattttatgtatgtgaa

SEQ ID NO: 554522 - DNA, 20 bp, Artificial Sequence
  chemically synthesized
agaaatctatttgtagggtt

SEQ ID NO: 554523 - DNA, 20 bp, Artificial Sequence
  chemically synthesized
tgtgtgaatgaatttggaag

SEQ ID NO: 554524 - DNA, 20 bp, Artificial Sequence
  chemically synthesized
gcaaatgaaggctgtggcta

SEQ ID NO: 554525 - DNA, 20 bp, Artificial Sequence
  chemically synthesized
gcccacacaaatgaaatcta

SEQ ID NO: 554526 - DNA, 20 bp, Artificial Sequence
  chemically synthesized
gcatttagatggacaagtca

SEQ ID NO: 554527 - DNA, 20 bp, Artificial Sequence
  chemically synthesized
tctccattttccttactatt

SEQ ID NO: 554528 - DNA, 20 bp, Artificial Sequence
  chemically synthesized
gctttcaacgatattaaagc

SEQ ID NO: 554529 - DNA, 20 bp, Artificial Sequence
  chemically synthesized
tattaagtcttttctaggta

SEQ ID NO: 554530 - DNA, 20 bp, Artificial Sequence
  chemically synthesized
aaaattaggatccatgttga

SEQ ID NO: 554531 - DNA, 20 bp, Artificial Sequence
  chemically synthesized
ctcatctgtaaaatggaatt

SEQ ID NO: 554532 - DNA, 20 bp, Artificial Sequence
  chemically synthesized
tattaaattatgaaacagga

SEQ ID NO: 554533 - DNA, 20 bp, Artificial Sequence
  chemically synthesized
atgctctagttcccttcctg

SEQ ID NO: 554534 - DNA, 20 bp, Artificial Sequence
  chemically synthesized
gtaaccaatggggcagtttt

SEQ ID NO: 554535 - DNA, 20 bp, Artificial Sequence
  chemically synthesized
ctacaaacatttgtggtttt

SEQ ID NO: 554536 - DNA, 20 bp, Artificial Sequence
  chemically synthesized
ggagaaagaggcttaataga

SEQ ID NO: 554537 - DNA, 20 bp, Artificial Sequence
  chemically synthesized
aaaaacaaaacaaaacaaaa

SEQ ID NO: 554538 - DNA, 20 bp, Artificial Sequence
  chemically synthesized
ccagtaaaaacaaaacaaaa

SEQ ID NO: 554539 - DNA, 20 bp, Artificial Sequence
  chemically synthesized
ataaaccagtaaaaacaaaa

SEQ ID NO: 554540 - DNA, 20 bp, Artificial Sequence
  chemically synthesized
gtaagataaaccagtaaaaa

SEQ ID NO: 554541 - DNA, 20 bp, Artificial Sequence
  chemically synthesized
aagtagtaagataaaccagt

SEQ ID NO: 554542 - DNA, 20 bp, Artificial Sequence
  chemically synthesized
cacgttgtgcacatgtaccc

SEQ ID NO: 554543 - DNA, 20 bp, Artificial Sequence
  chemically synthesized
cctccccactcccccaaccc

SEQ ID NO: 554544 - DNA, 20 bp, Artificial Sequence
  chemically synthesized
agcaaactatcacaaggacc

SEQ ID NO: 554545 - DNA, 20 bp, Artificial Sequence
  chemically synthesized
tttccccactggaaagcaga

SEQ ID NO: 554546 - DNA, 20 bp, Artificial Sequence
  chemically synthesized
gtcttctacataggaacaaa

SEQ ID NO: 554547 - DNA, 20 bp, Artificial Sequence
  chemically synthesized
gattctccccattaagtaaa

SEQ ID NO: 554548 - DNA, 20 bp, Artificial Sequence
  chemically synthesized
cttcaaaccatctggcacca

SEQ ID NO: 554549 - DNA, 20 bp, Artificial Sequence
  chemically synthesized
gaccagcctggccaacatgg

SEQ ID NO: 554550 - DNA, 20 bp, Artificial Sequence
  chemically synthesized
tataagagaaagggagaggg

SEQ ID NO: 554551 - DNA, 20 bp, Artificial Sequence
  chemically synthesized
tgaaaaaaaaaaaaaaaaaa

SEQ ID NO: 554552 - DNA, 20 bp, Artificial Sequence
  chemically synthesized
atgcagtattaccagggcag

SEQ ID NO: 554553 - DNA, 20 bp, Artificial Sequence
  chemically synthesized
caaaacacaacacaggctaa

SEQ ID NO: 554554 - DNA, 20 bp, Artificial Sequence
  chemically synthesized
acattatgaaaatatgcaca

SEQ ID NO: 554555 - DNA, 20 bp, Artificial Sequence
  chemically synthesized
ggtgttaataataatattta

SEQ ID NO: 554556 - DNA, 20 bp, Artificial Sequence
  chemically synthesized
gacagtgagactctaactca

SEQ ID NO: 554557 - DNA, 20 bp, Artificial Sequence
  chemically synthesized
ggtaaaagagtaattctctg

SEQ ID NO: 554558 - DNA, 20 bp, Artificial Sequence
  chemically synthesized
actttgtggcgctttatatg

SEQ ID NO: 554559 - DNA, 20 bp, Artificial Sequence
  chemically synthesized
tcactctgtggttagcacca

SEQ ID NO: 554560 - DNA, 20 bp, Artificial Sequence
  chemically synthesized
aaagcctacaatattaaggt

SEQ ID NO: 554561 - DNA, 20 bp, Artificial Sequence
  chemically synthesized
taataaaataaagaaataaa

SEQ ID NO: 554562 - DNA, 20 bp, Artificial Sequence
  chemically synthesized
ctgtctctactgaatacaaa

SEQ ID NO: 554563 - DNA, 20 bp, Artificial Sequence
  chemically synthesized
tggcttgtcgcttttatctt

SEQ ID NO: 554564 - DNA, 20 bp, Artificial Sequence
  chemically synthesized
cccatatgtttcgagctttt

SEQ ID NO: 554565 - DNA, 20 bp, Artificial Sequence
  chemically synthesized
gcgtaattaatagcatttgg

SEQ ID NO: 554566 - DNA, 20 bp, Artificial Sequence
  chemically synthesized
atattataaaagaaaatatg

SEQ ID NO: 554567 - DNA, 20 bp, Artificial Sequence
  chemically synthesized
ggatttctacaatccttggg

SEQ ID NO: 554568 - DNA, 20 bp, Artificial Sequence
  chemically synthesized
attcttgtcttttgctggta

SEQ ID NO: 554569 - DNA, 20 bp, Artificial Sequence
  chemically synthesized
atccaaacttccaaatggaa

SEQ ID NO: 554570 - DNA, 20 bp, Artificial Sequence
  chemically synthesized
ttattaatcatatacaagat

SEQ ID NO: 554571 - DNA, 20 bp, Artificial Sequence
  chemically synthesized
cttcatcttatgaaaaaggc

SEQ ID NO: 554572 - DNA, 20 bp, Artificial Sequence
  chemically synthesized
aatccactatttccctcagc

SEQ ID NO: 554573 - DNA, 20 bp, Artificial Sequence
  chemically synthesized
aacaggatataagaatccag

SEQ ID NO: 554574 - DNA, 20 bp, Artificial Sequence
  chemically synthesized
tacgtatttcttaagatata

SEQ ID NO: 554575 - DNA, 20 bp, Artificial Sequence
  chemically synthesized
gttatagcattccaacggac

SEQ ID NO: 554576 - DNA, 20 bp, Artificial Sequence
  chemically synthesized
agccttcagaattgtgagaa

SEQ ID NO: 554577 - DNA, 20 bp, Artificial Sequence
  chemically synthesized
actccatgcgcaccaatagc

SEQ ID NO: 554578 - DNA, 20 bp, Artificial Sequence
  chemically synthesized
agactctctggaaaaaaaca

SEQ ID NO: 554579 - DNA, 20 bp, Artificial Sequence
  chemically synthesized
cagagtgagactctctggaa

SEQ ID NO: 554580 - DNA, 20 bp, Artificial Sequence
  chemically synthesized
gtaggtcatggtcaaagttt

SEQ ID NO: 554581 - DNA, 20 bp, Artificial Sequence
  chemically synthesized
ttatagaacagcagtatagg

SEQ ID NO: 554582 - DNA, 20 bp, Artificial Sequence
  chemically synthesized
gcagtcaaaaagaagataaa

SEQ ID NO: 554583 - DNA, 20 bp, Artificial Sequence
  chemically synthesized
gcctgttggcaaaaaaatat

SEQ ID NO: 554584 - DNA, 20 bp, Artificial Sequence
  chemically synthesized
tatttttacccaactttcta

SEQ ID NO: 554585 - DNA, 20 bp, Artificial Sequence
  chemically synthesized
agcataaagaaattaagcaa

SEQ ID NO: 554586 - DNA, 20 bp, Artificial Sequence
  chemically synthesized
gcaatttaatccatcttact

SEQ ID NO: 554587 - DNA, 20 bp, Artificial Sequence
  chemically synthesized
agtaggaagttgatgcaaag

SEQ ID NO: 554588 - DNA, 20 bp, Artificial Sequence
  chemically synthesized
ttgctataagggtgattaaa

SEQ ID NO: 554589 - DNA, 20 bp, Artificial Sequence
  chemically synthesized
gcatgtctttctcacttctt

SEQ ID NO: 554590 - DNA, 20 bp, Artificial Sequence
  chemically synthesized
ccgctgccactcctcatgtt

SEQ ID NO: 554591 - DNA, 20 bp, Artificial Sequence
  chemically synthesized
ccattctgacagtgcagtgg

SEQ ID NO: 554592 - DNA, 20 bp, Artificial Sequence
  chemically synthesized
accttgtttttctctttgtg

SEQ ID NO: 554593 - DNA, 20 bp, Artificial Sequence
  chemically synthesized
gtcttgttttccacaaagag

SEQ ID NO: 554594 - DNA, 20 bp, Artificial Sequence
  chemically synthesized
ccgtctctactaaaaataca

SEQ ID NO: 554595 - DNA, 20 bp, Artificial Sequence
  chemically synthesized
ttaaacatagagtaggaagt

SEQ ID NO: 554596 - DNA, 20 bp, Artificial Sequence
  chemically synthesized
gtttaactcgtttaacatat

SEQ ID NO: 554597 - DNA, 20 bp, Artificial Sequence
  chemically synthesized
gatgggactctagaagtgtt

SEQ ID NO: 554598 - DNA, 20 bp, Artificial Sequence
  chemically synthesized
taatttgtatcttaaaaggg

SEQ ID NO: 554599 - DNA, 20 bp, Artificial Sequence
  chemically synthesized
cacatgaattctactaaaat

SEQ ID NO: 554600 - DNA, 20 bp, Artificial Sequence
  chemically synthesized
gtggaaaatggaaggcagat

SEQ ID NO: 554601 - DNA, 20 bp, Artificial Sequence
  chemically synthesized
aatccagtcaccagtgcaaa

SEQ ID NO: 554602 - DNA, 20 bp, Artificial Sequence
  chemically synthesized
catcgcatttaacttggttt

SEQ ID NO: 554603 - DNA, 20 bp, Artificial Sequence
  chemically synthesized
gagctcgacaaaccttggta

SEQ ID NO: 554604 - DNA, 20 bp, Artificial Sequence
  chemically synthesized
ttcctggtgttcacgggttt

SEQ ID NO: 554605 - DNA, 20 bp, Artificial Sequence
  chemically synthesized
gttagttgcatggtcttcaa

SEQ ID NO: 554606 - DNA, 20 bp, Artificial Sequence
  chemically synthesized
tgcatggtcttcaaaaaaac

SEQ ID NO: 554607 - DNA, 20 bp, Artificial Sequence
  chemically synthesized
ccctctgctggcagaggctc

SEQ ID NO: 554608 - DNA, 20 bp, Artificial Sequence
  chemically synthesized
ccggcagtgaacccagaaga

SEQ ID NO: 554609 - DNA, 20 bp, Artificial Sequence
  chemically synthesized
gaaaatggtgtggataagca

SEQ ID NO: 554610 - DNA, 20 bp, Artificial Sequence
  chemically synthesized
acaagctttgtccagaaacc

SEQ ID NO: 554611 - DNA, 20 bp, Artificial Sequence
  chemically synthesized
gttagtttgcactttacgta

SEQ ID NO: 554612 - DNA, 20 bp, Artificial Sequence
  chemically synthesized
tctagtgctgtaaaggaaaa

SEQ ID NO: 554613 - DNA, 20 bp, Artificial Sequence
  chemically synthesized
tcctctatcaaaaggatgca

SEQ ID NO: 554614 - DNA, 20 bp, Artificial Sequence
  chemically synthesized
tgcccacagtcaacacagtg

SEQ ID NO: 554615 - DNA, 20 bp, Artificial Sequence
  chemically synthesized
tttcaggaatgaataaggag

SEQ ID NO: 554616 - DNA, 20 bp, Artificial Sequence
  chemically synthesized
ataggtatccaacatagaga

SEQ ID NO: 554617 - DNA, 20 bp, Artificial Sequence
  chemically synthesized
agtggaatcaggcaagaagt

SEQ ID NO: 554618 - DNA, 20 bp, Artificial Sequence
  chemically synthesized
cctggtgattcttatgacca

SEQ ID NO: 554619 - DNA, 20 bp, Artificial Sequence
  chemically synthesized
gcaggaacaattagtctgtt

SEQ ID NO: 554620 - DNA, 20 bp, Artificial Sequence
  chemically synthesized
ttgaatgaatattttacatt

SEQ ID NO: 554621 - DNA, 20 bp, Artificial Sequence
  chemically synthesized
gccaaataaggtaaaaaggt

SEQ ID NO: 554622 - DNA, 20 bp, Artificial Sequence
  chemically synthesized
aagtaatatctaagcaaatg

SEQ ID NO: 554623 - DNA, 20 bp, Artificial Sequence
  chemically synthesized
cagacctggttttcttccta

SEQ ID NO: 554624 - DNA, 20 bp, Artificial Sequence
  chemically synthesized
atggaatggttttctaggaa

SEQ ID NO: 554625 - DNA, 20 bp, Artificial Sequence
  chemically synthesized
aattaagtacataaaacctg

SEQ ID NO: 554626 - DNA, 20 bp, Artificial Sequence
  chemically synthesized
cctacttgcaattaagtaca

SEQ ID NO: 554627 - DNA, 20 bp, Artificial Sequence
  chemically synthesized
cctcaccaccaccacactgc

SEQ ID NO: 554628 - DNA, 20 bp, Artificial Sequence
  chemically synthesized
agcagacaccacagtattct

SEQ ID NO: 554629 - DNA, 20 bp, Artificial Sequence
  chemically synthesized
gctttctgctgcaggttgta

SEQ ID NO: 554630 - DNA, 20 bp, Artificial Sequence
  chemically synthesized
gatgcaaatggaattaacat

SEQ ID NO: 554631 - DNA, 20 bp, Artificial Sequence
  chemically synthesized
aatttggatacattagctaa

SEQ ID NO: 554632 - DNA, 20 bp, Artificial Sequence
  chemically synthesized
cgtctctactaaaaataaaa

SEQ ID NO: 554633 - DNA, 20 bp, Artificial Sequence
  chemically synthesized
cagaatgagtgtatgatagg

SEQ ID NO: 554634 - DNA, 20 bp, Artificial Sequence
  chemically synthesized
gtatgataggaaaaaccaga

SEQ ID NO: 554635 - DNA, 20 bp, Artificial Sequence
  chemically synthesized
ggagccagatgtacaagtga

SEQ ID NO: 554636 - DNA, 20 bp, Artificial Sequence
  chemically synthesized
aatctcaacttaaaaaaaaa

SEQ ID NO: 554637 - DNA, 20 bp, Artificial Sequence
  chemically synthesized
tgtttagttctctagacgag

SEQ ID NO: 554638 - DNA, 20 bp, Artificial Sequence
  chemically synthesized
atggacacatttggggaaaa

SEQ ID NO: 554639 - DNA, 20 bp, Artificial Sequence
  chemically synthesized
atcctgtctctactgaaata

SEQ ID NO: 554640 - DNA, 20 bp, Artificial Sequence
  chemically synthesized
gaccagcctgaccaacatgg

SEQ ID NO: 554641 - DNA, 20 bp, Artificial Sequence
  chemically synthesized
atgaactgcagttctaataa

SEQ ID NO: 554642 - DNA, 20 bp, Artificial Sequence
  chemically synthesized
ggactttctgtgctgaagtg

SEQ ID NO: 554643 - DNA, 20 bp, Artificial Sequence
  chemically synthesized
caaatcataaaaataaataa

SEQ ID NO: 554644 - DNA, 20 bp, Artificial Sequence
  chemically synthesized
gggtgtgggacaagggctga

SEQ ID NO: 554645 - DNA, 20 bp, Artificial Sequence
  chemically synthesized
agcgaattaaagcagaaaca

SEQ ID NO: 554646 - DNA, 20 bp, Artificial Sequence
  chemically synthesized
tcaatggtggattggataaa

SEQ ID NO: 554647 - DNA, 20 bp, Artificial Sequence
  chemically synthesized
tttttttcttggagttttgg

SEQ ID NO: 554648 - DNA, 20 bp, Artificial Sequence
  chemically synthesized
caacacttaaatagttttgc

SEQ ID NO: 554649 - DNA, 20 bp, Artificial Sequence
  chemically synthesized
gaggagaaaaattaggggaa

SEQ ID NO: 554650 - DNA, 20 bp, Artificial Sequence
  chemically synthesized
aactaagttaaaatgttact

SEQ ID NO: 554651 - DNA, 20 bp, Artificial Sequence
  chemically synthesized
gtcttgaatagatgaatgca

SEQ ID NO: 554652 - DNA, 20 bp, Artificial Sequence
  chemically synthesized
gtcccaggcttcaggccatt

SEQ ID NO: 554653 - DNA, 20 bp, Artificial Sequence
  chemically synthesized
gcctgaatcattcacagact

SEQ ID NO: 554654 - DNA, 20 bp, Artificial Sequence
  chemically synthesized
cattgattgtctgaataaag

SEQ ID NO: 554655 - DNA, 20 bp, Artificial Sequence
  chemically synthesized
gcagtgggaaaggcaatgaa

SEQ ID NO: 554656 - DNA, 20 bp, Artificial Sequence
  chemically synthesized
agaataagggaaaaggacaa

SEQ ID NO: 554657 - DNA, 20 bp, Artificial Sequence
  chemically synthesized
taggaacacattccattttt

SEQ ID NO: 554658 - DNA, 20 bp, Artificial Sequence
  chemically synthesized
tagcaaaaatagttcccgat

SEQ ID NO: 554659 - DNA, 20 bp, Artificial Sequence
  chemically synthesized
aaaaaatagagaattccctt

SEQ ID NO: 554660 - DNA, 20 bp, Artificial Sequence
  chemically synthesized
caattagttgtacaaacatt

SEQ ID NO: 554661 - DNA, 20 bp, Artificial Sequence
  chemically synthesized
taggaaaaaaaggatgtaaa

SEQ ID NO: 554662 - DNA, 20 bp, Artificial Sequence
  chemically synthesized
aaaggacaattaagttccag

SEQ ID NO: 554663 - DNA, 20 bp, Artificial Sequence
  chemically synthesized
ttctgtgacctaaccttttc

SEQ ID NO: 554664 - DNA, 20 bp, Artificial Sequence
  chemically synthesized
tcctttacttttagctttta

SEQ ID NO: 554665 - DNA, 20 bp, Artificial Sequence
  chemically synthesized
atactgcagtaagatgtagg

SEQ ID NO: 554666 - DNA, 20 bp, Artificial Sequence
  chemically synthesized
tattgagaaatacacagggt

SEQ ID NO: 554667 - DNA, 20 bp, Artificial Sequence
  chemically synthesized
gtatttctcaataacattcc

SEQ ID NO: 554668 - DNA, 20 bp, Artificial Sequence
  chemically synthesized
agaaaaggctattagctgat

SEQ ID NO: 554669 - DNA, 20 bp, Artificial Sequence
  chemically synthesized
aacacaactgctttacttac

SEQ ID NO: 554670 - DNA, 20 bp, Artificial Sequence
  chemically synthesized
tatatttttgcacctctctg

SEQ ID NO: 554671 - DNA, 20 bp, Artificial Sequence
  chemically synthesized
tcttatccatgctagatttt

SEQ ID NO: 554672 - DNA, 20 bp, Artificial Sequence
  chemically synthesized
attaagtataatgccatccc

SEQ ID NO: 554673 - DNA, 20 bp, Artificial Sequence
  chemically synthesized
aattcacctggaaggcttat

SEQ ID NO: 554674 - DNA, 20 bp, Artificial Sequence
  chemically synthesized
tttgagaaccactaatgtag

SEQ ID NO: 554675 - DNA, 20 bp, Artificial Sequence
  chemically synthesized
tgattagtacaggatcatta

SEQ ID NO: 554676 - DNA, 20 bp, Artificial Sequence
  chemically synthesized
ataagaattgcttgttggaa

SEQ ID NO: 554677 - DNA, 20 bp, Artificial Sequence
  chemically synthesized
tttgtgtggcttcattttaa

SEQ ID NO: 554678 - DNA, 20 bp, Artificial Sequence
  chemically synthesized
tctcatcctttctcagtgtt

SEQ ID NO: 554679 - DNA, 20 bp, Artificial Sequence
  chemically synthesized
tggtccaaggacatactaaa

SEQ ID NO: 554680 - DNA, 20 bp, Artificial Sequence
  chemically synthesized
agaagcttaggaaaccttta

SEQ ID NO: 554681 - DNA, 20 bp, Artificial Sequence
  chemically synthesized
ccatgagttcctacagtcaa

SEQ ID NO: 554682 - DNA, 20 bp, Artificial Sequence
  chemically synthesized
acaaatagcacaaaagctgc

SEQ ID NO: 554683 - DNA, 20 bp, Artificial Sequence
  chemically synthesized
aaaaaaaaaaagcaatactt

SEQ ID NO: 554684 - DNA, 20 bp, Artificial Sequence
  chemically synthesized
agcatgggaatagcagttcg

SEQ ID NO: 554685 - DNA, 20 bp, Artificial Sequence
  chemically synthesized
actgatattacagacagcta

SEQ ID NO: 554686 - DNA, 20 bp, Artificial Sequence
  chemically synthesized
cctcatctctactaaaaata

SEQ ID NO: 554687 - DNA, 20 bp, Artificial Sequence
  chemically synthesized
gtcaatctttaaatcgtgat

SEQ ID NO: 554688 - DNA, 20 bp, Artificial Sequence
  chemically synthesized
tgactcggttatatgcaaac

SEQ ID NO: 554689 - DNA, 20 bp, Artificial Sequence
  chemically synthesized
ggatttatcagctttctgct

SEQ ID NO: 554690 - DNA, 20 bp, Artificial Sequence
  chemically synthesized
acatttgacagaatttagtt

SEQ ID NO: 554691 - DNA, 20 bp, Artificial Sequence
  chemically synthesized
aaacttggttataagtacag

SEQ ID NO: 554692 - DNA, 20 bp, Artificial Sequence
  chemically synthesized
agccattctttacaatgagt

SEQ ID NO: 554693 - DNA, 20 bp, Artificial Sequence
  chemically synthesized
ttatttgcatttaaggtatc

SEQ ID NO: 554694 - DNA, 20 bp, Artificial Sequence
  chemically synthesized
ttagcattgattaaaaaaaa

SEQ ID NO: 554695 - DNA, 20 bp, Artificial Sequence
  chemically synthesized
gaaagtaataaatgtccaaa

SEQ ID NO: 554696 - DNA, 20 bp, Artificial Sequence
  chemically synthesized
ccttatttatacttaagatg

SEQ ID NO: 554697 - DNA, 20 bp, Artificial Sequence
  chemically synthesized
tatttttcttattaaaaagt

SEQ ID NO: 554698 - DNA, 20 bp, Artificial Sequence
  chemically synthesized
gcctctgaggaaactgggtt

SEQ ID NO: 554699 - DNA, 20 bp, Artificial Sequence
  chemically synthesized
aaggacaccatgttataccc

SEQ ID NO: 554700 - DNA, 20 bp, Artificial Sequence
  chemically synthesized
tcagctaatatgttggattc

SEQ ID NO: 554701 - DNA, 20 bp, Artificial Sequence
  chemically synthesized
atttattacgcaaacctacg

SEQ ID NO: 554702 - DNA, 20 bp, Artificial Sequence
  chemically synthesized
ctcttactgcttggattctc

SEQ ID NO: 554703 - DNA, 20 bp, Artificial Sequence
  chemically synthesized
tctcatgaaaactgctagag

SEQ ID NO: 554704 - DNA, 20 bp, Artificial Sequence
  chemically synthesized
ggggaggtgccagttctcat

SEQ ID NO: 554705 - DNA, 20 bp, Artificial Sequence
  chemically synthesized
aattggaagatgagaatatt

SEQ ID NO: 554706 - DNA, 20 bp, Artificial Sequence
  chemically synthesized
aaataaaaaggaaacgaaat

SEQ ID NO: 554707 - DNA, 20 bp, Artificial Sequence
  chemically synthesized
tggatagcttgtgaaacaac

SEQ ID NO: 554708 - DNA, 20 bp, Artificial Sequence
  chemically synthesized
aattctaattttatacatga

SEQ ID NO: 554709 - DNA, 20 bp, Artificial Sequence
  chemically synthesized
aacttgcagaggtttgtttt

SEQ ID NO: 554710 - DNA, 20 bp, Artificial Sequence
  chemically synthesized
tggcaaggtttgtttgtttt

SEQ ID NO: 554711 - DNA, 20 bp, Artificial Sequence
  chemically synthesized
cctgcccagatcaagcaagt

SEQ ID NO: 554712 - DNA, 20 bp, Artificial Sequence
  chemically synthesized
tgtctggttcactatgttga

SEQ ID NO: 554713 - DNA, 20 bp, Artificial Sequence
  chemically synthesized
tgtgtagttcttagataata

SEQ ID NO: 554714 - DNA, 20 bp, Artificial Sequence
  chemically synthesized
tgtttttaatgaccactttt

SEQ ID NO: 554715 - DNA, 20 bp, Artificial Sequence
  chemically synthesized
agttttaaaaagtggtcatt

SEQ ID NO: 554716 - DNA, 20 bp, Artificial Sequence
  chemically synthesized
tatgtgaattatatattaat

SEQ ID NO: 554717 - DNA, 20 bp, Artificial Sequence
  chemically synthesized
atatttactatccaccccta

SEQ ID NO: 554718 - DNA, 20 bp, Artificial Sequence
  chemically synthesized
tttctaacctttctattatg

SEQ ID NO: 554719 - DNA, 20 bp, Artificial Sequence
  chemically synthesized
tttgcataatagaaaggtta

SEQ ID NO: 554720 - DNA, 20 bp, Artificial Sequence
  chemically synthesized
tttgaatccccttcatcctc

SEQ ID NO: 554721 - DNA, 20 bp, Artificial Sequence
  chemically synthesized
ttgcaattaattatgagtac

SEQ ID NO: 554722 - DNA, 20 bp, Artificial Sequence
  chemically synthesized
aaaaaagttattatttctat

SEQ ID NO: 554723 - DNA, 20 bp, Artificial Sequence
  chemically synthesized
agacaactgctaaagatgaa

SEQ ID NO: 554724 - DNA, 20 bp, Artificial Sequence
  chemically synthesized
tgggtggtaaaagctgctac

SEQ ID NO: 554725 - DNA, 20 bp, Artificial Sequence
  chemically synthesized
tactgcttccaaactagaaa

SEQ ID NO: 554726 - DNA, 20 bp, Artificial Sequence
  chemically synthesized
agtttggaagcagtaagtga

SEQ ID NO: 554727 - DNA, 20 bp, Artificial Sequence
  chemically synthesized
agatgtttaagtgattcaaa

SEQ ID NO: 554728 - DNA, 20 bp, Artificial Sequence
  chemically synthesized
caatttaattttatatgaag

SEQ ID NO: 554729 - DNA, 20 bp, Artificial Sequence
  chemically synthesized
ttcctacttcacagaggaaa

SEQ ID NO: 554730 - DNA, 20 bp, Artificial Sequence
  chemically synthesized
gcaatgaatagtcactgaat

SEQ ID NO: 554731 - DNA, 20 bp, Artificial Sequence
  chemically synthesized
gtgttgcatgtaagcatggg

SEQ ID NO: 554732 - DNA, 20 bp, Artificial Sequence
  chemically synthesized
atagtgctactcagtgtttg

SEQ ID NO: 554733 - DNA, 20 bp, Artificial Sequence
  chemically synthesized
tttgttaaccaagactcttg

SEQ ID NO: 554734 - DNA, 20 bp, Artificial Sequence
  chemically synthesized
gctgagaaatgcaggagctg

SEQ ID NO: 554735 - DNA, 20 bp, Artificial Sequence
  chemically synthesized
aaccaccaggggtacaaagg

SEQ ID NO: 554736 - DNA, 20 bp, Artificial Sequence
  chemically synthesized
tcccaccacaccttctctct

SEQ ID NO: 554737 - DNA, 20 bp, Artificial Sequence
  chemically synthesized
aagtctcctgaaaaaaaaaa

SEQ ID NO: 554738 - DNA, 20 bp, Artificial Sequence
  chemically synthesized
gctatttcatagctctccaa

SEQ ID NO: 554739 - DNA, 20 bp, Artificial Sequence
  chemically synthesized
tgccttcaggctatcacaat

SEQ ID NO: 554740 - DNA, 20 bp, Artificial Sequence
  chemically synthesized
aagtttacaagaattgccct

SEQ ID NO: 554741 - DNA, 20 bp, Artificial Sequence
  chemically synthesized
agtcaaaaaaaagatcttgg

SEQ ID NO: 554742 - DNA, 20 bp, Artificial Sequence
  chemically synthesized
aaagatgtggattctttatg

SEQ ID NO: 554743 - DNA, 20 bp, Artificial Sequence
  chemically synthesized
agaatccacatctttttata

SEQ ID NO: 554744 - DNA, 20 bp, Artificial Sequence
  chemically synthesized
agtgaaaccctgtctctact

SEQ ID NO: 554745 - DNA, 20 bp, Artificial Sequence
  chemically synthesized
tccagcctgggcaacaagag

SEQ ID NO: 554746 - DNA, 20 bp, Artificial Sequence
  chemically synthesized
caagagcaaaactctgtctc

SEQ ID NO: 554747 - DNA, 20 bp, Artificial Sequence
  chemically synthesized
ctgtctcaaaaacaagaaca

SEQ ID NO: 554748 - DNA, 20 bp, Artificial Sequence
  chemically synthesized
ttcaacttgttcttaaaaat

SEQ ID NO: 554749 - DNA, 20 bp, Artificial Sequence
  chemically synthesized
ctcctacaactcaatagcaa

SEQ ID NO: 554750 - DNA, 20 bp, Artificial Sequence
  chemically synthesized
ctcaaaaggaacaaaaaaga

SEQ ID NO: 554751 - DNA, 20 bp, Artificial Sequence
  chemically synthesized
gaccagcctggccaacatgg

SEQ ID NO: 554752 - DNA, 20 bp, Artificial Sequence
  chemically synthesized
ccagaactcttctcatcttg

SEQ ID NO: 554753 - DNA, 20 bp, Artificial Sequence
  chemically synthesized
ttatctcccctttatagaca

SEQ ID NO: 554754 - DNA, 20 bp, Artificial Sequence
  chemically synthesized
aaaaaaaaaaaaaaaaaaaa

SEQ ID NO: 554755 - DNA, 20 bp, Artificial Sequence
  chemically synthesized
aagctttccaatgacacaat

SEQ ID NO: 554756 - DNA, 20 bp, Artificial Sequence
  chemically synthesized
actctatctcaaaaaaaaag

SEQ ID NO: 554757 - DNA, 20 bp, Artificial Sequence
  chemically synthesized
tccagccggggcgacaagag

SEQ ID NO: 554758 - DNA, 20 bp, Artificial Sequence
  chemically synthesized
gcccaaaaacttgttaaatg

SEQ ID NO: 554759 - DNA, 20 bp, Artificial Sequence
  chemically synthesized
caagaaatgattgcaagccc

SEQ ID NO: 554760 - DNA, 20 bp, Artificial Sequence
  chemically synthesized
tctccctcccctaaatagct

SEQ ID NO: 554761 - DNA, 20 bp, Artificial Sequence
  chemically synthesized
aaaaaaaaaaaagaaaaaga

SEQ ID NO: 554762 - DNA, 20 bp, Artificial Sequence
  chemically synthesized
aggagtttgagaccagcctg

SEQ ID NO: 554763 - DNA, 20 bp, Artificial Sequence
  chemically synthesized
ctaggcataaagtggatata

SEQ ID NO: 554764 - DNA, 20 bp, Artificial Sequence
  chemically synthesized
tggcttggcatatactggtg

SEQ ID NO: 554765 - DNA, 20 bp, Artificial Sequence
  chemically synthesized
aaaaatccctggtagagacc

SEQ ID NO: 554766 - DNA, 20 bp, Artificial Sequence
  chemically synthesized
ataggaccggggatctcttc

SEQ ID NO: 554767 - DNA, 20 bp, Artificial Sequence
  chemically synthesized
ccaccacaatcttgatccca

SEQ ID NO: 554768 - DNA, 20 bp, Artificial Sequence
  chemically synthesized
atgtagaatgaagatgtcca

SEQ ID NO: 554769 - DNA, 20 bp, Artificial Sequence
  chemically synthesized
gatttaattactactcactt

SEQ ID NO: 554770 - DNA, 20 bp, Artificial Sequence
  chemically synthesized
tttgtttattcatttattcc

SEQ ID NO: 554771 - DNA, 20 bp, Artificial Sequence
  chemically synthesized
cttaatttgctttaataagt

SEQ ID NO: 554772 - DNA, 20 bp, Artificial Sequence
  chemically synthesized
gagtgccttccccctagaac

SEQ ID NO: 554773 - DNA, 20 bp, Artificial Sequence
  chemically synthesized
agagggctaaaaaggattgc

SEQ ID NO: 554774 - DNA, 20 bp, Artificial Sequence
  chemically synthesized
aagaccattttagaaaggct

SEQ ID NO: 554775 - DNA, 20 bp, Artificial Sequence
  chemically synthesized
aaagtcaaacgaaaggaaca

SEQ ID NO: 554776 - DNA, 20 bp, Artificial Sequence
  chemically synthesized
tttcagtaggaaaaagagtt

SEQ ID NO: 554777 - DNA, 20 bp, Artificial Sequence
  chemically synthesized
ttgcaaagtcgtttctccta

SEQ ID NO: 554778 - DNA, 20 bp, Artificial Sequence
  chemically synthesized
atattgggtttgtgaaagtc

SEQ ID NO: 554779 - DNA, 20 bp, Artificial Sequence
  chemically synthesized
gctagaaacatgtgaagacc

SEQ ID NO: 554780 - DNA, 20 bp, Artificial Sequence
  chemically synthesized
atttacttttttcctactct

SEQ ID NO: 554781 - DNA, 20 bp, Artificial Sequence
  chemically synthesized
agtttatcattggttctaaa

SEQ ID NO: 554782 - DNA, 20 bp, Artificial Sequence
  chemically synthesized
tataatgatgcataatcccg

SEQ ID NO: 554783 - DNA, 20 bp, Artificial Sequence
  chemically synthesized
atttttcccaaaatggtgca

SEQ ID NO: 554784 - DNA, 20 bp, Artificial Sequence
  chemically synthesized
tattttttgcatttaccaat

SEQ ID NO: 554785 - DNA, 20 bp, Artificial Sequence
  chemically synthesized
taaagaattactgtacatgc

SEQ ID NO: 554786 - DNA, 20 bp, Artificial Sequence
  chemically synthesized
aattactgtacatgcaaaaa

SEQ ID NO: 554787 - DNA, 20 bp, Artificial Sequence
  chemically synthesized
agagggagtatttacaccac

SEQ ID NO: 554788 - DNA, 20 bp, Artificial Sequence
  chemically synthesized
ggatgaatcctggtgtgtat

SEQ ID NO: 554789 - DNA, 20 bp, Artificial Sequence
  chemically synthesized
ggtgaaaccccatctctact

SEQ ID NO: 554790 - DNA, 20 bp, Artificial Sequence
  chemically synthesized
tggaaaaagataaagcctgc

SEQ ID NO: 554791 - DNA, 20 bp, Artificial Sequence
  chemically synthesized
aagaaaaagcatcttcatat

SEQ ID NO: 554792 - DNA, 20 bp, Artificial Sequence
  chemically synthesized
ttgatgtgagatttaaaaaa

SEQ ID NO: 554793 - DNA, 20 bp, Artificial Sequence
  chemically synthesized
cggaagatgcttttaaatag

SEQ ID NO: 554794 - DNA, 20 bp, Artificial Sequence
  chemically synthesized
aactgttcccataataccca

SEQ ID NO: 554795 - DNA, 20 bp, Artificial Sequence
  chemically synthesized
gttactctcctaccgttcag

SEQ ID NO: 554796 - DNA, 20 bp, Artificial Sequence
  chemically synthesized
ctaaataataatattcccag

SEQ ID NO: 554797 - DNA, 20 bp, Artificial Sequence
  chemically synthesized
gtgaacatttaatttatttc

SEQ ID NO: 554798 - DNA, 20 bp, Artificial Sequence
  chemically synthesized
gggtaataaaagattattca

SEQ ID NO: 554799 - DNA, 20 bp, Artificial Sequence
  chemically synthesized
taccatccttcctactattt

SEQ ID NO: 554800 - DNA, 20 bp, Artificial Sequence
  chemically synthesized
ggaaatgagttgatggcatt

SEQ ID NO: 554801 - DNA, 20 bp, Artificial Sequence
  chemically synthesized
ttggaaccaaacaaacgatt

SEQ ID NO: 554802 - DNA, 20 bp, Artificial Sequence
  chemically synthesized
tcagctctccaaattccaac

SEQ ID NO: 554803 - DNA, 20 bp, Artificial Sequence
  chemically synthesized
taagtcgaggtaggggcttt

SEQ ID NO: 554804 - DNA, 20 bp, Artificial Sequence
  chemically synthesized
agcaaactaacacaggaaca

SEQ ID NO: 554805 - DNA, 20 bp, Artificial Sequence
  chemically synthesized
tcaatgatagactggataaa

SEQ ID NO: 554806 - DNA, 20 bp, Artificial Sequence
  chemically synthesized
gtgattagagaaatgcaaat

SEQ ID NO: 554807 - DNA, 20 bp, Artificial Sequence
  chemically synthesized
acttaaacaaatttacaaga

SEQ ID NO: 554808 - DNA, 20 bp, Artificial Sequence
  chemically synthesized
atgggcaaagacttcacgac

SEQ ID NO: 554809 - DNA, 20 bp, Artificial Sequence
  chemically synthesized
aaaccataaaaaccctagaa

SEQ ID NO: 554810 - DNA, 20 bp, Artificial Sequence
  chemically synthesized
aacataaaacctaaaaccat

SEQ ID NO: 554811 - DNA, 20 bp, Artificial Sequence
  chemically synthesized
caagacttaaacataaaacc

SEQ ID NO: 554812 - DNA, 20 bp, Artificial Sequence
  chemically synthesized
attaactcaagacttaaaca

SEQ ID NO: 554813 - DNA, 20 bp, Artificial Sequence
  chemically synthesized
aaaccggctagccatctaca

SEQ ID NO: 554814 - DNA, 20 bp, Artificial Sequence
  chemically synthesized
tgatctttgacaaacctgac

SEQ ID NO: 554815 - DNA, 20 bp, Artificial Sequence
  chemically synthesized
aaacagtatggtattggtac

SEQ ID NO: 554816 - DNA, 20 bp, Artificial Sequence
  chemically synthesized
tactacaaggcttcagtaac

SEQ ID NO: 554817 - DNA, 20 bp, Artificial Sequence
  chemically synthesized
gactttcttcacataattag

SEQ ID NO: 554818 - DNA, 20 bp, Artificial Sequence
  chemically synthesized
ctgacatgattgtatattta

SEQ ID NO: 554819 - DNA, 20 bp, Artificial Sequence
  chemically synthesized
ccttgcctgattgtcctggc

SEQ ID NO: 554820 - DNA, 20 bp, Artificial Sequence
  chemically synthesized
aagctggaagcactcccttt

SEQ ID NO: 554821 - DNA, 20 bp, Artificial Sequence
  chemically synthesized
attcaacaccccttcatgct

SEQ ID NO: 554822 - DNA, 20 bp, Artificial Sequence
  chemically synthesized
acttaaacagaaccaatgac

SEQ ID NO: 554823 - DNA, 20 bp, Artificial Sequence
  chemically synthesized
ggccagcatcatcctgatac

SEQ ID NO: 554824 - DNA, 20 bp, Artificial Sequence
  chemically synthesized
ctattttgttaatcttttca

SEQ ID NO: 554825 - DNA, 20 bp, Artificial Sequence
  chemically synthesized
tcaggattaagaaactcact

SEQ ID NO: 554826 - DNA, 20 bp, Artificial Sequence
  chemically synthesized
acactcctcagcaaatgcaa

SEQ ID NO: 554827 - DNA, 20 bp, Artificial Sequence
  chemically synthesized
attgaccacataattggaag

SEQ ID NO: 554828 - DNA, 20 bp, Artificial Sequence
  chemically synthesized
gttgcaatcctagtctcaga

SEQ ID NO: 554829 - DNA, 20 bp, Artificial Sequence
  chemically synthesized
aaactggtaccagccatggt

SEQ ID NO: 554830 - DNA, 20 bp, Artificial Sequence
  chemically synthesized
aagcactaaatatggaaagg

SEQ ID NO: 554831 - DNA, 20 bp, Artificial Sequence
  chemically synthesized
gggagaatggaaccaagttg

SEQ ID NO: 554832 - DNA, 20 bp, Artificial Sequence
  chemically synthesized
actcctctccagcaagggaa

SEQ ID NO: 554833 - DNA, 20 bp, Artificial Sequence
  chemically synthesized
acaaaaagcctgaaaattcc

SEQ ID NO: 554834 - DNA, 20 bp, Artificial Sequence
  chemically synthesized
ataaatccacgaagatgagg

SEQ ID NO: 554835 - DNA, 20 bp, Artificial Sequence
  chemically synthesized
aacaaaaaggacgtccacac

SEQ ID NO: 554836 - DNA, 20 bp, Artificial Sequence
  chemically synthesized
cccagtcaggggcttataga

SEQ ID NO: 554837 - DNA, 20 bp, Artificial Sequence
  chemically synthesized
ctttgtttacactgtgaggg

SEQ ID NO: 554838 - DNA, 20 bp, Artificial Sequence
  chemically synthesized
aggtgacgctgggatatgaa

SEQ ID NO: 554839 - DNA, 20 bp, Artificial Sequence
  chemically synthesized
tgcatgctttgtaaactaga

SEQ ID NO: 554840 - DNA, 20 bp, Artificial Sequence
  chemically synthesized
taagcctttgatggagaaga

SEQ ID NO: 554841 - DNA, 20 bp, Artificial Sequence
  chemically synthesized
tgtagttctttaacaatgca

SEQ ID NO: 554842 - DNA, 20 bp, Artificial Sequence
  chemically synthesized
gggcgatcctaaaaatcatt

SEQ ID NO: 554843 - DNA, 20 bp, Artificial Sequence
  chemically synthesized
ttatatatgagttatgtaag

SEQ ID NO: 554844 - DNA, 20 bp, Artificial Sequence
  chemically synthesized
caaaattaatacaataagaa

SEQ ID NO: 554845 - DNA, 20 bp, Artificial Sequence
  chemically synthesized
ttctttgacaaatttctcaa

SEQ ID NO: 554846 - DNA, 20 bp, Artificial Sequence
  chemically synthesized
ggatttgccagttttcttct

SEQ ID NO: 554847 - DNA, 20 bp, Artificial Sequence
  chemically synthesized
cacatctaaagttttaagaa

SEQ ID NO: 554848 - DNA, 20 bp, Artificial Sequence
  chemically synthesized
aatgccaaaaaaggtttaat

SEQ ID NO: 554849 - DNA, 20 bp, Artificial Sequence
  chemically synthesized
cattgtaggaactttaaaga

SEQ ID NO: 554850 - DNA, 20 bp, Artificial Sequence
  chemically synthesized
agagttatttacagtgtatg

SEQ ID NO: 554851 - DNA, 20 bp, Artificial Sequence
  chemically synthesized
aaagagaaaccatggtttat

SEQ ID NO: 554852 - DNA, 20 bp, Artificial Sequence
  chemically synthesized
aaaccatggtttattaaaac

SEQ ID NO: 554853 - DNA, 20 bp, Artificial Sequence
  chemically synthesized
atggtttattaaaacaaaaa

SEQ ID NO: 554854 - DNA, 20 bp, Artificial Sequence
  chemically synthesized
aaaacaaaaacaaaacatta

SEQ ID NO: 554855 - DNA, 20 bp, Artificial Sequence
  chemically synthesized
ctcaaaaaaaaaaaaaaaaa

SEQ ID NO: 554856 - DNA, 20 bp, Artificial Sequence
  chemically synthesized
tttaaaagtaaagaagcatt

SEQ ID NO: 554857 - DNA, 20 bp, Artificial Sequence
  chemically synthesized
caaacatagcttccatagga

SEQ ID NO: 554858 - DNA, 20 bp, Artificial Sequence
  chemically synthesized
ctgaaataaattttagttaa

SEQ ID NO: 554859 - DNA, 20 bp, Artificial Sequence
  chemically synthesized
cattctgatcccaatgatag

SEQ ID NO: 554860 - DNA, 20 bp, Artificial Sequence
  chemically synthesized
attttccataccctgattgg

SEQ ID NO: 554861 - DNA, 20 bp, Artificial Sequence
  chemically synthesized
aaatactaggtaatacattt

SEQ ID NO: 554862 - DNA, 20 bp, Artificial Sequence
  chemically synthesized
gttaaccttgctgtgtactg

SEQ ID NO: 554863 - DNA, 20 bp, Artificial Sequence
  chemically synthesized
aaatgttagacatggggtca

SEQ ID NO: 554864 - DNA, 20 bp, Artificial Sequence
  chemically synthesized
acattggttaaaagaggaga

SEQ ID NO: 554865 - DNA, 20 bp, Artificial Sequence
  chemically synthesized
gggacagaagtagggaaatg

SEQ ID NO: 554866 - DNA, 20 bp, Artificial Sequence
  chemically synthesized
agtatcagaatacagaaaaa

SEQ ID NO: 554867 - DNA, 20 bp, Artificial Sequence
  chemically synthesized
agttatatgaaatgaaatat

SEQ ID NO: 554868 - DNA, 20 bp, Artificial Sequence
  chemically synthesized
taaaaaaaaagaatgtggcc

SEQ ID NO: 554869 - DNA, 20 bp, Artificial Sequence
  chemically synthesized
tcacttaagctattgaggag

SEQ ID NO: 554870 - DNA, 20 bp, Artificial Sequence
  chemically synthesized
caggccttcaagagggaatt

SEQ ID NO: 554871 - DNA, 20 bp, Artificial Sequence
  chemically synthesized
aagtttcaaggtatatattg

SEQ ID NO: 554872 - DNA, 20 bp, Artificial Sequence
  chemically synthesized
ttcctacatccataatagct

SEQ ID NO: 554873 - DNA, 20 bp, Artificial Sequence
  chemically synthesized
tttatccaggggatcaagag

SEQ ID NO: 554874 - DNA, 20 bp, Artificial Sequence
  chemically synthesized
attaacactagaagcagagt

SEQ ID NO: 554875 - DNA, 20 bp, Artificial Sequence
  chemically synthesized
gccctgttctttcactgggg

SEQ ID NO: 554876 - DNA, 20 bp, Artificial Sequence
  chemically synthesized
ggaaacttaattgtatgaaa

SEQ ID NO: 554877 - DNA, 20 bp, Artificial Sequence
  chemically synthesized
tggaaatacaaagttgaatg

SEQ ID NO: 554878 - DNA, 20 bp, Artificial Sequence
  chemically synthesized
tcctgtgccactcccttggt

SEQ ID NO: 554879 - DNA, 20 bp, Artificial Sequence
  chemically synthesized
ttggagacatttccagattg

SEQ ID NO: 554880 - DNA, 20 bp, Artificial Sequence
  chemically synthesized
atcgaaagtctctcatcctg

SEQ ID NO: 554881 - DNA, 20 bp, Artificial Sequence
  chemically synthesized
ggatgagagactttcgatgt

SEQ ID NO: 554882 - DNA, 20 bp, Artificial Sequence
  chemically synthesized
ggaaaattggacagtctcag

SEQ ID NO: 554883 - DNA, 20 bp, Artificial Sequence
  chemically synthesized
ttaaaggtctcatcaaactt

SEQ ID NO: 554884 - DNA, 20 bp, Artificial Sequence
  chemically synthesized
acttaaaaacttaaggcact

SEQ ID NO: 554885 - DNA, 20 bp, Artificial Sequence
  chemically synthesized
tgatgatataattccattgt

SEQ ID NO: 554886 - DNA, 20 bp, Artificial Sequence
  chemically synthesized
tcagattaaatacaaaagga

SEQ ID NO: 554887 - DNA, 20 bp, Artificial Sequence
  chemically synthesized
aataattcttatcatgtggg

SEQ ID NO: 554888 - DNA, 20 bp, Artificial Sequence
  chemically synthesized
ggtctttgtagcatggagct

SEQ ID NO: 554889 - DNA, 20 bp, Artificial Sequence
  chemically synthesized
acagataaaattatctttgt

SEQ ID NO: 554890 - DNA, 20 bp, Artificial Sequence
  chemically synthesized
attatctggtagattgcact

SEQ ID NO: 554891 - DNA, 20 bp, Artificial Sequence
  chemically synthesized
aagctgaaagtgagtgataa

SEQ ID NO: 554892 - DNA, 20 bp, Artificial Sequence
  chemically synthesized
gagtaaaagcccgtgctttt

SEQ ID NO: 554893 - DNA, 20 bp, Artificial Sequence
  chemically synthesized
ttccatcagattttattctg

SEQ ID NO: 554894 - DNA, 20 bp, Artificial Sequence
  chemically synthesized
tgtaaaatgtgggcatttgc

SEQ ID NO: 554895 - DNA, 20 bp, Artificial Sequence
  chemically synthesized
catcgttattatcgatgctt

SEQ ID NO: 554896 - DNA, 20 bp, Artificial Sequence
  chemically synthesized
aggccaagttgatttagatg

SEQ ID NO: 554897 - DNA, 20 bp, Artificial Sequence
  chemically synthesized
agaatgatgacgtaggatgg

SEQ ID NO: 554898 - DNA, 20 bp, Artificial Sequence
  chemically synthesized
tataattagatttttaaaaa

SEQ ID NO: 554899 - DNA, 20 bp, Artificial Sequence
  chemically synthesized
aatctaattatagtcaatga

SEQ ID NO: 554900 - DNA, 20 bp, Artificial Sequence
  chemically synthesized
ttatttttctggaagtcttt

SEQ ID NO: 554901 - DNA, 20 bp, Artificial Sequence
  chemically synthesized
gaccttgagagatcactggt

SEQ ID NO: 554902 - DNA, 20 bp, Artificial Sequence
  chemically synthesized
tagaaatgaatggattatta

SEQ ID NO: 554903 - DNA, 20 bp, Artificial Sequence
  chemically synthesized
cttgctatttctacaacact

SEQ ID NO: 554904 - DNA, 20 bp, Artificial Sequence
  chemically synthesized
tgtgagtgagtaaaccatgc

SEQ ID NO: 554905 - DNA, 20 bp, Artificial Sequence
  chemically synthesized
gtctcaaaaaaacaaacaaa

SEQ ID NO: 554906 - DNA, 20 bp, Artificial Sequence
  chemically synthesized
agagtgagaccctgtctcaa

SEQ ID NO: 554907 - DNA, 20 bp, Artificial Sequence
  chemically synthesized
agtgaaactacgtttctacc

SEQ ID NO: 554908 - DNA, 20 bp, Artificial Sequence
  chemically synthesized
tgctcttccttttgtccccc

SEQ ID NO: 554909 - DNA, 20 bp, Artificial Sequence
  chemically synthesized
gtaaaagtgctttgtcaagg

SEQ ID NO: 554910 - DNA, 20 bp, Artificial Sequence
  chemically synthesized
atgtcctgacaaatactctt

SEQ ID NO: 554911 - DNA, 20 bp, Artificial Sequence
  chemically synthesized
ctgaaaactagctttatcat

SEQ ID NO: 554912 - DNA, 20 bp, Artificial Sequence
  chemically synthesized
aaactaagtctaagtcttct

SEQ ID NO: 554913 - DNA, 20 bp, Artificial Sequence
  chemically synthesized
tctaggcatttgagtcttct

SEQ ID NO: 554914 - DNA, 20 bp, Artificial Sequence
  chemically synthesized
ccccgtctctactaaaaata

SEQ ID NO: 554915 - DNA, 20 bp, Artificial Sequence
  chemically synthesized
gttgttccctatcacctctg

SEQ ID NO: 554916 - DNA, 20 bp, Artificial Sequence
  chemically synthesized
attttctctttctgtaaaaa

SEQ ID NO: 554917 - DNA, 20 bp, Artificial Sequence
  chemically synthesized
ttctgtaaaaagaaaacaca

SEQ ID NO: 554918 - DNA, 20 bp, Artificial Sequence
  chemically synthesized
gatttttttaattgaaagat

SEQ ID NO: 554919 - DNA, 20 bp, Artificial Sequence
  chemically synthesized
atttctaaggagaactgcaa

SEQ ID NO: 554920 - DNA, 20 bp, Artificial Sequence
  chemically synthesized
cccactatgatttgctcctt

SEQ ID NO: 554921 - DNA, 20 bp, Artificial Sequence
  chemically synthesized
cactttagtgactgctcaag

SEQ ID NO: 554922 - DNA, 20 bp, Artificial Sequence
  chemically synthesized
ttctggtccagatatatttt

SEQ ID NO: 554923 - DNA, 20 bp, Artificial Sequence
  chemically synthesized
cagaataacacccactaatt

SEQ ID NO: 554924 - DNA, 20 bp, Artificial Sequence
  chemically synthesized
atctgaaatggtatacaaag

SEQ ID NO: 554925 - DNA, 20 bp, Artificial Sequence
  chemically synthesized
tctataaatcaggatgttta

SEQ ID NO: 554926 - DNA, 20 bp, Artificial Sequence
  chemically synthesized
attctggaaacatggcaaag

SEQ ID NO: 554927 - DNA, 20 bp, Artificial Sequence
  chemically synthesized
gggctaccacatacatgtga

SEQ ID NO: 554928 - DNA, 20 bp, Artificial Sequence
  chemically synthesized
tttaagaaaaattcttgaca

SEQ ID NO: 554929 - DNA, 20 bp, Artificial Sequence
  chemically synthesized
agcaaactaacagaggaacc

SEQ ID NO: 554930 - DNA, 20 bp, Artificial Sequence
  chemically synthesized
ataagtgggagataaacaat

SEQ ID NO: 554931 - DNA, 20 bp, Artificial Sequence
  chemically synthesized
tgtaaagtataataataaaa

SEQ ID NO: 554932 - DNA, 20 bp, Artificial Sequence
  chemically synthesized
tgcttaattagaaataaaca

SEQ ID NO: 554933 - DNA, 20 bp, Artificial Sequence
  chemically synthesized
cagtcagaataatctgtgta

SEQ ID NO: 554934 - DNA, 20 bp, Artificial Sequence
  chemically synthesized
gataacaatagtagacagtc

SEQ ID NO: 554935 - DNA, 20 bp, Artificial Sequence
  chemically synthesized
tgctgcaatctacaaaactc

SEQ ID NO: 554936 - DNA, 20 bp, Artificial Sequence
  chemically synthesized
ctttttgttgctgcaatcta

SEQ ID NO: 554937 - DNA, 20 bp, Artificial Sequence
  chemically synthesized
gcaaagggtttcagactttt

SEQ ID NO: 554938 - DNA, 20 bp, Artificial Sequence
  chemically synthesized
agggcagaggaactaatgta

SEQ ID NO: 554939 - DNA, 20 bp, Artificial Sequence
  chemically synthesized
taccactcttaacaagcaac

SEQ ID NO: 554940 - DNA, 20 bp, Artificial Sequence
  chemically synthesized
tctgactttgaataaacagc

SEQ ID NO: 554941 - DNA, 20 bp, Artificial Sequence
  chemically synthesized
ttattcaaagtcagaacatt

SEQ ID NO: 554942 - DNA, 20 bp, Artificial Sequence
  chemically synthesized
acaaattactaccaaataat

SEQ ID NO: 554943 - DNA, 20 bp, Artificial Sequence
  chemically synthesized
gtatcttttattctcatttc

SEQ ID NO: 554944 - DNA, 20 bp, Artificial Sequence
  chemically synthesized
gatagaaatgtaaataaaaa

SEQ ID NO: 554945 - DNA, 20 bp, Artificial Sequence
  chemically synthesized
accaaaataggagacaagtg

SEQ ID NO: 554946 - DNA, 20 bp, Artificial Sequence
  chemically synthesized
ttaaacatcacacaaaaaga

SEQ ID NO: 554947 - DNA, 20 bp, Artificial Sequence
  chemically synthesized
atttcaatttttatttaaac

SEQ ID NO: 554948 - DNA, 20 bp, Artificial Sequence
  chemically synthesized
cacacgcctgatatttgttt

SEQ ID NO: 554949 - DNA, 20 bp, Artificial Sequence
  chemically synthesized
tagctcttcccagattgttt

SEQ ID NO: 554950 - DNA, 20 bp, Artificial Sequence
  chemically synthesized
aagtagacagaatgctataa

SEQ ID NO: 554951 - DNA, 20 bp, Artificial Sequence
  chemically synthesized
ctacttacttttgagagcca

SEQ ID NO: 554952 - DNA, 20 bp, Artificial Sequence
  chemically synthesized
attggatgcagtgactaatg

SEQ ID NO: 554953 - DNA, 20 bp, Artificial Sequence
  chemically synthesized
agtactagcatgagtcacat

SEQ ID NO: 554954 - DNA, 20 bp, Artificial Sequence
  chemically synthesized
ataaaataaatcatcatcca

SEQ ID NO: 554955 - DNA, 20 bp, Artificial Sequence
  chemically synthesized
atagcatcatttatgattga

SEQ ID NO: 554956 - DNA, 20 bp, Artificial Sequence
  chemically synthesized
atcatttatgattgataaaa

SEQ ID NO: 554957 - DNA, 20 bp, Artificial Sequence
  chemically synthesized
agggaattgcttgagaaatg

SEQ ID NO: 554958 - DNA, 20 bp, Artificial Sequence
  chemically synthesized
atacaagtttcattacattt

SEQ ID NO: 554959 - DNA, 20 bp, Artificial Sequence
  chemically synthesized
tcatcccagttactaaatga

SEQ ID NO: 554960 - DNA, 20 bp, Artificial Sequence
  chemically synthesized
ctaaatgagaaaacaggtta

SEQ ID NO: 554961 - DNA, 20 bp, Artificial Sequence
  chemically synthesized
atacattttttgaatttttc

SEQ ID NO: 554962 - DNA, 20 bp, Artificial Sequence
  chemically synthesized
gaaaaatgtgataggaggac

SEQ ID NO: 554963 - DNA, 20 bp, Artificial Sequence
  chemically synthesized
ggaggacaaaaactgaagcg

SEQ ID NO: 554964 - DNA, 20 bp, Artificial Sequence
  chemically synthesized
aaggcagccagagaatgaat

SEQ ID NO: 554965 - DNA, 20 bp, Artificial Sequence
  chemically synthesized
tgtaaggaacattgtgagct

SEQ ID NO: 554966 - DNA, 20 bp, Artificial Sequence
  chemically synthesized
atgtattagaaatgtgactt

SEQ ID NO: 554967 - DNA, 20 bp, Artificial Sequence
  chemically synthesized
aatcttgatttctacatatg

SEQ ID NO: 554968 - DNA, 20 bp, Artificial Sequence
  chemically synthesized
aaatcaagattgcaaaggta

SEQ ID NO: 554969 - DNA, 20 bp, Artificial Sequence
  chemically synthesized
aaggtataaaacagctgctg

SEQ ID NO: 554970 - DNA, 20 bp, Artificial Sequence
  chemically synthesized
agagatcaaaaacatttggt

SEQ ID NO: 554971 - DNA, 20 bp, Artificial Sequence
  chemically synthesized
agcctttttgttcagagatc

SEQ ID NO: 554972 - DNA, 20 bp, Artificial Sequence
  chemically synthesized
ttgcagagtttatttgagca

SEQ ID NO: 554973 - DNA, 20 bp, Artificial Sequence
  chemically synthesized
ttttgctcaaataaactctg

SEQ ID NO: 554974 - DNA, 20 bp, Artificial Sequence
  chemically synthesized
cacaatttgtaaggtttagg

SEQ ID NO: 554975 - DNA, 20 bp, Artificial Sequence
  chemically synthesized
gcctagtttgaaatccttaa

SEQ ID NO: 554976 - DNA, 20 bp, Artificial Sequence
  chemically synthesized
tttcactttgacttccttta

SEQ ID NO: 554977 - DNA, 20 bp, Artificial Sequence
  chemically synthesized
aagaaccacaatactgccat

SEQ ID NO: 554978 - DNA, 20 bp, Artificial Sequence
  chemically synthesized
tggaaaagactagagaaccc

SEQ ID NO: 554979 - DNA, 20 bp, Artificial Sequence
  chemically synthesized
ctcttcaacaaatggtgcgg

SEQ ID NO: 554980 - DNA, 20 bp, Artificial Sequence
  chemically synthesized
ggtggggtctacctttgaga

SEQ ID NO: 554981 - DNA, 20 bp, Artificial Sequence
  chemically synthesized
cttcatatatatttcttatg

SEQ ID NO: 554982 - DNA, 20 bp, Artificial Sequence
  chemically synthesized
ggatatggaattttagaatg

SEQ ID NO: 554983 - DNA, 20 bp, Artificial Sequence
  chemically synthesized
taagttccatcaaacaaaac

SEQ ID NO: 554984 - DNA, 20 bp, Artificial Sequence
  chemically synthesized
ataatttaagttccatcaaa

SEQ ID NO: 554985 - DNA, 20 bp, Artificial Sequence
  chemically synthesized
atcagttctattttaattaa

SEQ ID NO: 554986 - DNA, 20 bp, Artificial Sequence
  chemically synthesized
acggaggatgcaaccatgaa

SEQ ID NO: 554987 - DNA, 20 bp, Artificial Sequence
  chemically synthesized
agaagaaaaataaatggaag

SEQ ID NO: 554988 - DNA, 20 bp, Artificial Sequence
  chemically synthesized
gctcttatatttcaaaaaaa

SEQ ID NO: 554989 - DNA, 20 bp, Artificial Sequence
  chemically synthesized
acataggcctatataaaagc

SEQ ID NO: 554990 - DNA, 20 bp, Artificial Sequence
  chemically synthesized
ttgctgtcattaatcaggta

SEQ ID NO: 554991 - DNA, 20 bp, Artificial Sequence
  chemically synthesized
agccagggtgcaaacttgtg

SEQ ID NO: 554992 - DNA, 20 bp, Artificial Sequence
  chemically synthesized
gggtgcaaacttgtgaaaaa

SEQ ID NO: 554993 - DNA, 20 bp, Artificial Sequence
  chemically synthesized
caaacttgtgaaaaacaaaa

SEQ ID NO: 554994 - DNA, 20 bp, Artificial Sequence
  chemically synthesized
ttgtgaaaaacaaaacaaaa

SEQ ID NO: 554995 - DNA, 20 bp, Artificial Sequence
  chemically synthesized
cctagcaatctacttctcat

SEQ ID NO: 554996 - DNA, 20 bp, Artificial Sequence
  chemically synthesized
gcaagtggaagatacaagat

SEQ ID NO: 554997 - DNA, 20 bp, Artificial Sequence
  chemically synthesized
aaaaggatagagatagtaag

SEQ ID NO: 554998 - DNA, 20 bp, Artificial Sequence
  chemically synthesized
gttcctccacggaactattg

SEQ ID NO: 554999 - DNA, 20 bp, Artificial Sequence
  chemically synthesized
tgcttcctctcagattttgt

SEQ ID NO: 555000 - DNA, 20 bp, Artificial Sequence
  chemically synthesized
cacattacaattatataata

SEQ ID NO: 555001 - DNA, 20 bp, Artificial Sequence
  chemically synthesized
gcataccagaggacagtctt

SEQ ID NO: 555002 - DNA, 20 bp, Artificial Sequence
  chemically synthesized
atgcatgtctcctatgttta

SEQ ID NO: 555003 - DNA, 20 bp, Artificial Sequence
  chemically synthesized
atgtttatcacaacctggat

SEQ ID NO: 555004 - DNA, 20 bp, Artificial Sequence
  chemically synthesized
atgtgtattaaatgggaaat

SEQ ID NO: 555005 - DNA, 20 bp, Artificial Sequence
  chemically synthesized
ctgttgcatagcaatcctga

SEQ ID NO: 555006 - DNA, 20 bp, Artificial Sequence
  chemically synthesized
ttgagagagagagagaaaaa

SEQ ID NO: 555007 - DNA, 20 bp, Artificial Sequence
  chemically synthesized
catcttaagaggctgtggct

SEQ ID NO: 555008 - DNA, 20 bp, Artificial Sequence
  chemically synthesized
ggcaaaaggaaaaaagaaag

SEQ ID NO: 555009 - DNA, 20 bp, Artificial Sequence
  chemically synthesized
atgttaatgtagtaaacata

SEQ ID NO: 555010 - DNA, 20 bp, Artificial Sequence
  chemically synthesized
tcttacatttcccaaagtgc

SEQ ID NO: 555011 - DNA, 20 bp, Artificial Sequence
  chemically synthesized
agttctgtctttaattttcc

SEQ ID NO: 555012 - DNA, 20 bp, Artificial Sequence
  chemically synthesized
agtctcagtgctctcatctg

SEQ ID NO: 555013 - DNA, 20 bp, Artificial Sequence
  chemically synthesized
gccatcagagaaatgcaaat

SEQ ID NO: 555014 - DNA, 20 bp, Artificial Sequence
  chemically synthesized
ctcaaacaaatgtacaagaa

SEQ ID NO: 555015 - DNA, 20 bp, Artificial Sequence
  chemically synthesized
atgggcaaggacttcatgtc

SEQ ID NO: 555016 - DNA, 20 bp, Artificial Sequence
  chemically synthesized
aaaccataaaaaccctagaa

SEQ ID NO: 555017 - DNA, 20 bp, Artificial Sequence
  chemically synthesized
aacgttagacctaaaaccat

SEQ ID NO: 555018 - DNA, 20 bp, Artificial Sequence
  chemically synthesized
aaagacttaaacgttagacc

SEQ ID NO: 555019 - DNA, 20 bp, Artificial Sequence
  chemically synthesized
tatttaataaatggtgctgg

SEQ ID NO: 555020 - DNA, 20 bp, Artificial Sequence
  chemically synthesized
tgatctttaacaaacctgag

SEQ ID NO: 555021 - DNA, 20 bp, Artificial Sequence
  chemically synthesized
aaacaacatggtactggtac

SEQ ID NO: 555022 - DNA, 20 bp, Artificial Sequence
  chemically synthesized
tactacaaggctacagtaac

SEQ ID NO: 555023 - DNA, 20 bp, Artificial Sequence
  chemically synthesized
cctttcttcacagaattgga

SEQ ID NO: 555024 - DNA, 20 bp, Artificial Sequence
  chemically synthesized
acgacatgattgtatatcta

SEQ ID NO: 555025 - DNA, 20 bp, Artificial Sequence
  chemically synthesized
tagttaagtcagaagtgaaa

SEQ ID NO: 555026 - DNA, 20 bp, Artificial Sequence
  chemically synthesized
aaaggtagttgttacataac

SEQ ID NO: 555027 - DNA, 20 bp, Artificial Sequence
  chemically synthesized
gtagtagcattattaatagg

SEQ ID NO: 555028 - DNA, 20 bp, Artificial Sequence
  chemically synthesized
atgcatccaatacaacaaga

SEQ ID NO: 555029 - DNA, 20 bp, Artificial Sequence
  chemically synthesized
aacaggatctcccctactcc

SEQ ID NO: 555030 - DNA, 20 bp, Artificial Sequence
  chemically synthesized
gaatttgaaaaagcccttca

SEQ ID NO: 555031 - DNA, 20 bp, Artificial Sequence
  chemically synthesized
ctcctttctcagcttccaga

SEQ ID NO: 555032 - DNA, 20 bp, Artificial Sequence
  chemically synthesized
cttattagccacataatgat

SEQ ID NO: 555033 - DNA, 20 bp, Artificial Sequence
  chemically synthesized
cttctttatttttcttctag

SEQ ID NO: 555034 - DNA, 20 bp, Artificial Sequence
  chemically synthesized
taaaataggactcagcaaat

SEQ ID NO: 555035 - DNA, 20 bp, Artificial Sequence
  chemically synthesized
ttaactattttgcttcgcta

SEQ ID NO: 555036 - DNA, 20 bp, Artificial Sequence
  chemically synthesized
ttaaatcattaacacctttt

SEQ ID NO: 555037 - DNA, 20 bp, Artificial Sequence
  chemically synthesized
gttaatgatttaaataaaaa

SEQ ID NO: 555038 - DNA, 20 bp, Artificial Sequence
  chemically synthesized
gatttaaataaaaataaaac

SEQ ID NO: 555039 - DNA, 20 bp, Artificial Sequence
  chemically synthesized
gtctattatggattgggaat

SEQ ID NO: 555040 - DNA, 20 bp, Artificial Sequence
  chemically synthesized
aagcgcaaaaaaaaaaaaaa

SEQ ID NO: 555041 - DNA, 20 bp, Artificial Sequence
  chemically synthesized
cttcctatggattcttctcg

SEQ ID NO: 555042 - DNA, 20 bp, Artificial Sequence
  chemically synthesized
acatatagaataagaaggga

SEQ ID NO: 555043 - DNA, 20 bp, Artificial Sequence
  chemically synthesized
caacgcaatgcagtggacct

SEQ ID NO: 555044 - DNA, 20 bp, Artificial Sequence
  chemically synthesized
gagtccacaggctttgcttt

SEQ ID NO: 555045 - DNA, 20 bp, Artificial Sequence
  chemically synthesized
ccattcttaagattaccttt

SEQ ID NO: 555046 - DNA, 20 bp, Artificial Sequence
  chemically synthesized
ctggatgagaagaaactagg

SEQ ID NO: 555047 - DNA, 20 bp, Artificial Sequence
  chemically synthesized
tcatctcatctaatctttgc

SEQ ID NO: 555048 - DNA, 20 bp, Artificial Sequence
  chemically synthesized
agatatgaggccgttcaaaa

SEQ ID NO: 555049 - DNA, 20 bp, Artificial Sequence
  chemically synthesized
agtcccagccatacaggaac

SEQ ID NO: 555050 - DNA, 20 bp, Artificial Sequence
  chemically synthesized
ggccaaataaattagaatga

SEQ ID NO: 555051 - DNA, 20 bp, Artificial Sequence
  chemically synthesized
ttaattctggtgttgaaaga

SEQ ID NO: 555052 - DNA, 20 bp, Artificial Sequence
  chemically synthesized
tagatgcagtattaaaaaaa

SEQ ID NO: 555053 - DNA, 20 bp, Artificial Sequence
  chemically synthesized
tgcacataaaatataatata

SEQ ID NO: 555054 - DNA, 20 bp, Artificial Sequence
  chemically synthesized
caggaatcagtctgtttgaa

SEQ ID NO: 555055 - DNA, 20 bp, Artificial Sequence
  chemically synthesized
acccctcatcatggctctgc

SEQ ID NO: 555056 - DNA, 20 bp, Artificial Sequence
  chemically synthesized
gcatttacaaccctaataat

SEQ ID NO: 555057 - DNA, 20 bp, Artificial Sequence
  chemically synthesized
tatcccccactttaccccct

SEQ ID NO: 555058 - DNA, 20 bp, Artificial Sequence
  chemically synthesized
aaaatactcccacgcaacca

SEQ ID NO: 555059 - DNA, 20 bp, Artificial Sequence
  chemically synthesized
cagcatagagatattaacct

SEQ ID NO: 555060 - DNA, 20 bp, Artificial Sequence
  chemically synthesized
ctagaaccttctttaacatt

SEQ ID NO: 555061 - DNA, 20 bp, Artificial Sequence
  chemically synthesized
agggtgaacagtgatgggga

SEQ ID NO: 555062 - DNA, 20 bp, Artificial Sequence
  chemically synthesized
actcactcactatcacatgg

SEQ ID NO: 555063 - DNA, 20 bp, Artificial Sequence
  chemically synthesized
tgaatgggaagagcccctta

SEQ ID NO: 555064 - DNA, 20 bp, Artificial Sequence
  chemically synthesized
tccagcctgggcgacaagag

SEQ ID NO: 555065 - DNA, 20 bp, Artificial Sequence
  chemically synthesized
cctgtctctactaaaaataa

SEQ ID NO: 555066 - DNA, 20 bp, Artificial Sequence
  chemically synthesized
ctgccttagaagggtggatc

SEQ ID NO: 555067 - DNA, 20 bp, Artificial Sequence
  chemically synthesized
gaatatttttctgctaaatt

SEQ ID NO: 555068 - DNA, 20 bp, Artificial Sequence
  chemically synthesized
gaaaataaaaagacttgctg

SEQ ID NO: 555069 - DNA, 20 bp, Artificial Sequence
  chemically synthesized
taaaaggaagagaactctga

SEQ ID NO: 555070 - DNA, 20 bp, Artificial Sequence
  chemically synthesized
tttctgccagcccacaaaag

SEQ ID NO: 555071 - DNA, 20 bp, Artificial Sequence
  chemically synthesized
acttttactaaaaatactct

SEQ ID NO: 555072 - DNA, 20 bp, Artificial Sequence
  chemically synthesized
gtgaaatttgaagcagtggg

SEQ ID NO: 555073 - DNA, 20 bp, Artificial Sequence
  chemically synthesized
gaatcacccagagggctcat

SEQ ID NO: 555074 - DNA, 20 bp, Artificial Sequence
  chemically synthesized
gaatgatggatcttctcctc

SEQ ID NO: 555075 - DNA, 20 bp, Artificial Sequence
  chemically synthesized
aattaagaatgtgcttaaaa

SEQ ID NO: 555076 - DNA, 20 bp, Artificial Sequence
  chemically synthesized
agaattttcttggctgtagg

SEQ ID NO: 555077 - DNA, 20 bp, Artificial Sequence
  chemically synthesized
agaggagatgaatcagcagc

SEQ ID NO: 555078 - DNA, 20 bp, Artificial Sequence
  chemically synthesized
aataaataaataaaagaaga

SEQ ID NO: 555079 - DNA, 20 bp, Artificial Sequence
  chemically synthesized
acttttctagcaatcacact

SEQ ID NO: 555080 - DNA, 20 bp, Artificial Sequence
  chemically synthesized
tggatgaatgcttgctcctg

SEQ ID NO: 555081 - DNA, 20 bp, Artificial Sequence
  chemically synthesized
tatgattatctatcaatact

SEQ ID NO: 555082 - DNA, 20 bp, Artificial Sequence
  chemically synthesized
ttaatgatcatcttggatct

SEQ ID NO: 555083 - DNA, 20 bp, Artificial Sequence
  chemically synthesized
catatgttcgatcacctttt

SEQ ID NO: 555084 - DNA, 20 bp, Artificial Sequence
  chemically synthesized
ccgtacatttaatgatattt

SEQ ID NO: 555085 - DNA, 20 bp, Artificial Sequence
  chemically synthesized
cagattttctcttccgcatt

SEQ ID NO: 555086 - DNA, 20 bp, Artificial Sequence
  chemically synthesized
ccaaaaagtcaaagctgatg

SEQ ID NO: 555087 - DNA, 20 bp, Artificial Sequence
  chemically synthesized
attagactagctatgaaaag

SEQ ID NO: 555088 - DNA, 20 bp, Artificial Sequence
  chemically synthesized
agatagaagagaatgaggat

SEQ ID NO: 555089 - DNA, 20 bp, Artificial Sequence
  chemically synthesized
agttggacaggttggaaatt

SEQ ID NO: 555090 - DNA, 20 bp, Artificial Sequence
  chemically synthesized
tcacaagtatacacatttgg

SEQ ID NO: 555091 - DNA, 20 bp, Artificial Sequence
  chemically synthesized
tggcttcgaggacagatttc

SEQ ID NO: 555092 - DNA, 20 bp, Artificial Sequence
  chemically synthesized
tctgtcctcgaagccaagtc

SEQ ID NO: 555093 - DNA, 20 bp, Artificial Sequence
  chemically synthesized
acctgctactttagcctttc

SEQ ID NO: 555094 - DNA, 20 bp, Artificial Sequence
  chemically synthesized
gtgacaaagaaccatgttaa

SEQ ID NO: 555095 - DNA, 20 bp, Artificial Sequence
  chemically synthesized
ttctttagaaataaaataaa

SEQ ID NO: 555096 - DNA, 20 bp, Artificial Sequence
  chemically synthesized
taacatgatgtcctattaat

SEQ ID NO: 555097 - DNA, 20 bp, Artificial Sequence
  chemically synthesized
cacacgtgcaagccaggttt

SEQ ID NO: 555098 - DNA, 20 bp, Artificial Sequence
  chemically synthesized
ttatttttatttttaatttt

SEQ ID NO: 555099 - DNA, 20 bp, Artificial Sequence
  chemically synthesized
aaaattaaaaataaaaataa

SEQ ID NO: 555100 - DNA, 20 bp, Artificial Sequence
  chemically synthesized
ataacaaaatgcccttcaaa

SEQ ID NO: 555101 - DNA, 20 bp, Artificial Sequence
  chemically synthesized
catttctaactgtatctaga

SEQ ID NO: 555102 - DNA, 20 bp, Artificial Sequence
  chemically synthesized
tctagagaaaacagggacat

SEQ ID NO: 555103 - DNA, 20 bp, Artificial Sequence
  chemically synthesized
agaaaacagggacatcaaaa

SEQ ID NO: 555104 - DNA, 20 bp, Artificial Sequence
  chemically synthesized
cacaatgtgcacatgtaccc

SEQ ID NO: 555105 - DNA, 20 bp, Artificial Sequence
  chemically synthesized
agtaaactatcgcaagaaca

SEQ ID NO: 555106 - DNA, 20 bp, Artificial Sequence
  chemically synthesized
gccatcagagaaatgcaaat

SEQ ID NO: 555107 - DNA, 20 bp, Artificial Sequence
  chemically synthesized
agaagacatttatgcagcca

SEQ ID NO: 555108 - DNA, 20 bp, Artificial Sequence
  chemically synthesized
ctcaaacaaatttacaagaa

SEQ ID NO: 555109 - DNA, 20 bp, Artificial Sequence
  chemically synthesized
ttttgttgccattgcttttg

SEQ ID NO: 555110 - DNA, 20 bp, Artificial Sequence
  chemically synthesized
ttaaaggagctgatggagct

SEQ ID NO: 555111 - DNA, 20 bp, Artificial Sequence
  chemically synthesized
tggagaatggaaccaagttg

SEQ ID NO: 555112 - DNA, 20 bp, Artificial Sequence
  chemically synthesized
gaagatctaccaagcaaatg

SEQ ID NO: 555113 - DNA, 20 bp, Artificial Sequence
  chemically synthesized
gttgcaatcctagtctctga

SEQ ID NO: 555114 - DNA, 20 bp, Artificial Sequence
  chemically synthesized
ctgaaggaaatagagacaca

SEQ ID NO: 555115 - DNA, 20 bp, Artificial Sequence
  chemically synthesized
caattttgttgatcctttca

SEQ ID NO: 555116 - DNA, 20 bp, Artificial Sequence
  chemically synthesized
atccttgatgaacattgatg

SEQ ID NO: 555117 - DNA, 20 bp, Artificial Sequence
  chemically synthesized
atataaacagagccaaagac

SEQ ID NO: 555118 - DNA, 20 bp, Artificial Sequence
  chemically synthesized
attcaacaacccttcatgct

SEQ ID NO: 555119 - DNA, 20 bp, Artificial Sequence
  chemically synthesized
caatatcatactgaatgggc

SEQ ID NO: 555120 - DNA, 20 bp, Artificial Sequence
  chemically synthesized
aaactggaagcattcccttt

SEQ ID NO: 555121 - DNA, 20 bp, Artificial Sequence
  chemically synthesized
acgacatgattgtttatcta

SEQ ID NO: 555122 - DNA, 20 bp, Artificial Sequence
  chemically synthesized
actttcttcacagaattgga

SEQ ID NO: 555123 - DNA, 20 bp, Artificial Sequence
  chemically synthesized
tactacaaggctacagtaac

SEQ ID NO: 555124 - DNA, 20 bp, Artificial Sequence
  chemically synthesized
aaacagcatggtactggtac

SEQ ID NO: 555125 - DNA, 20 bp, Artificial Sequence
  chemically synthesized
tgatctttgacaaacctgag

SEQ ID NO: 555126 - DNA, 20 bp, Artificial Sequence
  chemically synthesized
tatttaataaatggtgctgg

SEQ ID NO: 555127 - DNA, 20 bp, Artificial Sequence
  chemically synthesized
aaagatttaaacgttagacc

SEQ ID NO: 555128 - DNA, 20 bp, Artificial Sequence
  chemically synthesized
aacgttagacctaaaaccat

SEQ ID NO: 555129 - DNA, 20 bp, Artificial Sequence
  chemically synthesized
aaaccataaaaaccctagaa

SEQ ID NO: 555130 - DNA, 20 bp, Artificial Sequence
  chemically synthesized
gtgggcaaggacttcatgtc

SEQ ID NO: 555131 - DNA, 20 bp, Artificial Sequence
  chemically synthesized
ttggagggggaaaaggtggc

SEQ ID NO: 555132 - DNA, 20 bp, Artificial Sequence
  chemically synthesized
gatatcattcttttataaca

SEQ ID NO: 555133 - DNA, 20 bp, Artificial Sequence
  chemically synthesized
tagaaaatcagctaaaaggg

SEQ ID NO: 555134 - DNA, 20 bp, Artificial Sequence
  chemically synthesized
agggtaaaactgtttgcaca

SEQ ID NO: 555135 - DNA, 20 bp, Artificial Sequence
  chemically synthesized
tagattcttttgatcaggta

SEQ ID NO: 555136 - DNA, 20 bp, Artificial Sequence
  chemically synthesized
ctgaaattaatgagataatt

SEQ ID NO: 555137 - DNA, 20 bp, Artificial Sequence
  chemically synthesized
tgtttaaactggggaggtga

SEQ ID NO: 555138 - DNA, 20 bp, Artificial Sequence
  chemically synthesized
ttcattgcttctaagtttat

SEQ ID NO: 555139 - DNA, 20 bp, Artificial Sequence
  chemically synthesized
caaacagaatagagtggact

SEQ ID NO: 555140 - DNA, 20 bp, Artificial Sequence
  chemically synthesized
ttaacctttcaccaaactta

SEQ ID NO: 555141 - DNA, 20 bp, Artificial Sequence
  chemically synthesized
agaaagtgggggagcaagtg

SEQ ID NO: 555142 - DNA, 20 bp, Artificial Sequence
  chemically synthesized
tctaaatgttactttttctt

SEQ ID NO: 555143 - DNA, 20 bp, Artificial Sequence
  chemically synthesized
attatcagtatatacgtaat

SEQ ID NO: 555144 - DNA, 20 bp, Artificial Sequence
  chemically synthesized
atagggtaatgcaaatattc

SEQ ID NO: 555145 - DNA, 20 bp, Artificial Sequence
  chemically synthesized
tacaatgtccagcatggggc

SEQ ID NO: 555146 - DNA, 20 bp, Artificial Sequence
  chemically synthesized
ctgacatgacatcacaaatg

SEQ ID NO: 555147 - DNA, 20 bp, Artificial Sequence
  chemically synthesized
aatccaaatgttccaaattc

SEQ ID NO: 555148 - DNA, 20 bp, Artificial Sequence
  chemically synthesized
aggttgaacatccctgatcc

SEQ ID NO: 555149 - DNA, 20 bp, Artificial Sequence
  chemically synthesized
tttatgaaacaatgtctttt

SEQ ID NO: 555150 - DNA, 20 bp, Artificial Sequence
  chemically synthesized
tgtgcaagttgtacaccgag

SEQ ID NO: 555151 - DNA, 20 bp, Artificial Sequence
  chemically synthesized
aatgagagttagcacatagg

SEQ ID NO: 555152 - DNA, 20 bp, Artificial Sequence
  chemically synthesized
gcaaatagtctttagcatca

SEQ ID NO: 555153 - DNA, 20 bp, Artificial Sequence
  chemically synthesized
gattcaagccaaatatgtct

SEQ ID NO: 555154 - DNA, 20 bp, Artificial Sequence
  chemically synthesized
gttccttgtacttcctcttt

SEQ ID NO: 555155 - DNA, 20 bp, Artificial Sequence
  chemically synthesized
ctgcatccaggctggatatc

SEQ ID NO: 555156 - DNA, 20 bp, Artificial Sequence
  chemically synthesized
aaacaaacactggattgctg

SEQ ID NO: 555157 - DNA, 20 bp, Artificial Sequence
  chemically synthesized
atcgatattctaaaataagt

SEQ ID NO: 555158 - DNA, 20 bp, Artificial Sequence
  chemically synthesized
gtgagattttgaaggaaaag

SEQ ID NO: 555159 - DNA, 20 bp, Artificial Sequence
  chemically synthesized
aaggagttcttataatacca

SEQ ID NO: 555160 - DNA, 20 bp, Artificial Sequence
  chemically synthesized
ttgaaaaagatcttaatttc

SEQ ID NO: 555161 - DNA, 20 bp, Artificial Sequence
  chemically synthesized
aggaatatcatttggtgata

SEQ ID NO: 555162 - DNA, 20 bp, Artificial Sequence
  chemically synthesized
gactcttggttcagttattg

SEQ ID NO: 555163 - DNA, 20 bp, Artificial Sequence
  chemically synthesized
agcaaactatcacaaggaca

SEQ ID NO: 555164 - DNA, 20 bp, Artificial Sequence
  chemically synthesized
ttgtgctggcattgggaaca

SEQ ID NO: 555165 - DNA, 20 bp, Artificial Sequence
  chemically synthesized
gagaggattagtcacatctt

SEQ ID NO: 555166 - DNA, 20 bp, Artificial Sequence
  chemically synthesized
aataaaaaataaattaaaaa

SEQ ID NO: 555167 - DNA, 20 bp, Artificial Sequence
  chemically synthesized
aagaatttagataagaagag

SEQ ID NO: 555168 - DNA, 20 bp, Artificial Sequence
  chemically synthesized
aaaggaaaatttttacctct

SEQ ID NO: 555169 - DNA, 20 bp, Artificial Sequence
  chemically synthesized
aagcaggtttcgggttctca

SEQ ID NO: 555170 - DNA, 20 bp, Artificial Sequence
  chemically synthesized
tctgacatagcccaaactgt

SEQ ID NO: 555171 - DNA, 20 bp, Artificial Sequence
  chemically synthesized
agtattctagggaaaggatg

SEQ ID NO: 555172 - DNA, 20 bp, Artificial Sequence
  chemically synthesized
ttcccgagtcttctaacgac

SEQ ID NO: 555173 - DNA, 20 bp, Artificial Sequence
  chemically synthesized
gtttcagttccttaagggga

SEQ ID NO: 555174 - DNA, 20 bp, Artificial Sequence
  chemically synthesized
ataattaagaattaggctct

SEQ ID NO: 555175 - DNA, 20 bp, Artificial Sequence
  chemically synthesized
actctcttagtctggttagc

SEQ ID NO: 555176 - DNA, 20 bp, Artificial Sequence
  chemically synthesized
ctgaaaatgactcatttatt

SEQ ID NO: 555177 - DNA, 20 bp, Artificial Sequence
  chemically synthesized
ttataccaacagatttaaag

SEQ ID NO: 555178 - DNA, 20 bp, Artificial Sequence
  chemically synthesized
taactgattttttttaaaaa

SEQ ID NO: 555179 - DNA, 20 bp, Artificial Sequence
  chemically synthesized
aaaatatgccagttaaatgt

SEQ ID NO: 555180 - DNA, 20 bp, Artificial Sequence
  chemically synthesized
attgaaattgtgtgaaatta

SEQ ID NO: 555181 - DNA, 20 bp, Artificial Sequence
  chemically synthesized
gatcatctttaatttacacc

SEQ ID NO: 555182 - DNA, 20 bp, Artificial Sequence
  chemically synthesized
caatcttttctaaagccaca

SEQ ID NO: 555183 - DNA, 20 bp, Artificial Sequence
  chemically synthesized
atactttatgccttctttca

SEQ ID NO: 555184 - DNA, 20 bp, Artificial Sequence
  chemically synthesized
taggatattcagagaaacgt

SEQ ID NO: 555185 - DNA, 20 bp, Artificial Sequence
  chemically synthesized
atatttctcctaagttaagc

SEQ ID NO: 555186 - DNA, 20 bp, Artificial Sequence
  chemically synthesized
ctaaatgaaaattgcaaaca

SEQ ID NO: 555187 - DNA, 20 bp, Artificial Sequence
  chemically synthesized
tgtcaaacattcatgatgac

SEQ ID NO: 555188 - DNA, 20 bp, Artificial Sequence
  chemically synthesized
atctgaactactcagcaggt

SEQ ID NO: 555189 - DNA, 20 bp, Artificial Sequence
  chemically synthesized
tgcttagatgactcaaaaca

SEQ ID NO: 555190 - DNA, 20 bp, Artificial Sequence
  chemically synthesized
gagttattgcttagatgact

SEQ ID NO: 555191 - DNA, 20 bp, Artificial Sequence
  chemically synthesized
acatccaaggaagtcatgaa

SEQ ID NO: 555192 - DNA, 20 bp, Artificial Sequence
  chemically synthesized
ttaccctcaatatgtgccca

SEQ ID NO: 555193 - DNA, 20 bp, Artificial Sequence
  chemically synthesized
taaacccaaagcacatcttt

SEQ ID NO: 555194 - DNA, 20 bp, Artificial Sequence
  chemically synthesized
taattccaaccacatacata

SEQ ID NO: 555195 - DNA, 20 bp, Artificial Sequence
  chemically synthesized
gggtgagaccctgtctccag

SEQ ID NO: 555196 - DNA, 20 bp, Artificial Sequence
  chemically synthesized
cttcatctctaataaaaata

SEQ ID NO: 555197 - DNA, 20 bp, Artificial Sequence
  chemically synthesized
cggcccttgaatcacaactt

SEQ ID NO: 555198 - DNA, 20 bp, Artificial Sequence
  chemically synthesized
gaatcttctgaatgcctttt

SEQ ID NO: 555199 - DNA, 20 bp, Artificial Sequence
  chemically synthesized
ccattgcttttaatggtaaa

SEQ ID NO: 555200 - DNA, 20 bp, Artificial Sequence
  chemically synthesized
gggattatttgttctctgtc

SEQ ID NO: 555201 - DNA, 20 bp, Artificial Sequence
  chemically synthesized
gatttttatatgtacatatt

SEQ ID NO: 555202 - DNA, 20 bp, Artificial Sequence
  chemically synthesized
gtcaaatttctcagcagtaa

SEQ ID NO: 555203 - DNA, 20 bp, Artificial Sequence
  chemically synthesized
aattggaatcattaaagatt

SEQ ID NO: 555204 - DNA, 20 bp, Artificial Sequence
  chemically synthesized
gcctggctgggcagaaatac

SEQ ID NO: 555205 - DNA, 20 bp, Artificial Sequence
  chemically synthesized
acttaaatttttcaaggggg

SEQ ID NO: 555206 - DNA, 20 bp, Artificial Sequence
  chemically synthesized
tcaaagaaatgttgaattaa

SEQ ID NO: 555207 - DNA, 20 bp, Artificial Sequence
  chemically synthesized
cgttcgttccaaaaatatta

SEQ ID NO: 555208 - DNA, 20 bp, Artificial Sequence
  chemically synthesized
atgaatcatttgatgacatt

SEQ ID NO: 555209 - DNA, 20 bp, Artificial Sequence
  chemically synthesized
cacgacaacatattccttgt

SEQ ID NO: 555210 - DNA, 20 bp, Artificial Sequence
  chemically synthesized
agatttaaggatgaaaatga

SEQ ID NO: 555211 - DNA, 20 bp, Artificial Sequence
  chemically synthesized
aaatacagattggaaaaaaa

SEQ ID NO: 555212 - DNA, 20 bp, Artificial Sequence
  chemically synthesized
ctgggatttcaaaattctaa

SEQ ID NO: 555213 - DNA, 20 bp, Artificial Sequence
  chemically synthesized
tcatgaacctcttacttgct

SEQ ID NO: 555214 - DNA, 20 bp, Artificial Sequence
  chemically synthesized
ctcaggcaggatatctaaca

SEQ ID NO: 555215 - DNA, 20 bp, Artificial Sequence
  chemically synthesized
tgaaatcccaggccccactt

SEQ ID NO: 555216 - DNA, 20 bp, Artificial Sequence
  chemically synthesized
ttcaccaatatgtgcacact

SEQ ID NO: 555217 - DNA, 20 bp, Artificial Sequence
  chemically synthesized
agtagaacttttcactcccc

SEQ ID NO: 555218 - DNA, 20 bp, Artificial Sequence
  chemically synthesized
caagttggatgctaattata

SEQ ID NO: 555219 - DNA, 20 bp, Artificial Sequence
  chemically synthesized
gggctgaaactgaaaaagca

SEQ ID NO: 555220 - DNA, 20 bp, Artificial Sequence
  chemically synthesized
gctcagcccatgtttctttg

SEQ ID NO: 555221 - DNA, 20 bp, Artificial Sequence
  chemically synthesized
ctttgtaaaacacaacatat

SEQ ID NO: 555222 - DNA, 20 bp, Artificial Sequence
  chemically synthesized
tcaatccaaccacctcataa

SEQ ID NO: 555223 - DNA, 20 bp, Artificial Sequence
  chemically synthesized
aaggacgataagataatata

SEQ ID NO: 555224 - DNA, 20 bp, Artificial Sequence
  chemically synthesized
tgatgatatctttcaaaaat

SEQ ID NO: 555225 - DNA, 20 bp, Artificial Sequence
  chemically synthesized
tatccagatagctggaaaaa

SEQ ID NO: 555226 - DNA, 20 bp, Artificial Sequence
  chemically synthesized
aaaattcaaacaacccagta

SEQ ID NO: 555227 - DNA, 20 bp, Artificial Sequence
  chemically synthesized
acagaagacaaagtcaaaag

SEQ ID NO: 555228 - DNA, 20 bp, Artificial Sequence
  chemically synthesized
gacgttttctaaacaagaca

SEQ ID NO: 555229 - DNA, 20 bp, Artificial Sequence
  chemically synthesized
tgagttttgtgtcttgttta

SEQ ID NO: 555230 - DNA, 20 bp, Artificial Sequence
  chemically synthesized
agaatttttgtttttacatt

SEQ ID NO: 555231 - DNA, 20 bp, Artificial Sequence
  chemically synthesized
tgcattaaagttttaaatgt

SEQ ID NO: 555232 - DNA, 20 bp, Artificial Sequence
  chemically synthesized
actctttgcaattcctctta

SEQ ID NO: 555233 - DNA, 20 bp, Artificial Sequence
  chemically synthesized
tgctggcaccatttattgaa

SEQ ID NO: 555234 - DNA, 20 bp, Artificial Sequence
  chemically synthesized
atttgccatataatgtttcc

SEQ ID NO: 555235 - DNA, 20 bp, Artificial Sequence
  chemically synthesized
agccaccatgcccggcctcc

SEQ ID NO: 555236 - DNA, 20 bp, Artificial Sequence
  chemically synthesized
caaatagtatagtattagca

SEQ ID NO: 555237 - DNA, 20 bp, Artificial Sequence
  chemically synthesized
aacagacaccaatattaagg

SEQ ID NO: 555238 - DNA, 20 bp, Artificial Sequence
  chemically synthesized
taaggcaaaacaatgaaagt

SEQ ID NO: 555239 - DNA, 20 bp, Artificial Sequence
  chemically synthesized
tgtaaagatgcatatatata

SEQ ID NO: 555240 - DNA, 20 bp, Artificial Sequence
  chemically synthesized
agtggaaaataagtaaaatt

SEQ ID NO: 555241 - DNA, 20 bp, Artificial Sequence
  chemically synthesized
atttgttattttactgttga

SEQ ID NO: 555242 - DNA, 20 bp, Artificial Sequence
  chemically synthesized
gtgtaatttcaaaaaacaaa

SEQ ID NO: 555243 - DNA, 20 bp, Artificial Sequence
  chemically synthesized
aaactaaaagtgtaatttca

SEQ ID NO: 555244 - DNA, 20 bp, Artificial Sequence
  chemically synthesized
atgtgaacatacaattatct

SEQ ID NO: 555245 - DNA, 20 bp, Artificial Sequence
  chemically synthesized
gttgtgagaaataatacaga

SEQ ID NO: 555246 - DNA, 20 bp, Artificial Sequence
  chemically synthesized
tgaccccgtctccctgaagg

SEQ ID NO: 555247 - DNA, 20 bp, Artificial Sequence
  chemically synthesized
tccacagaattatgctgagt

SEQ ID NO: 555248 - DNA, 20 bp, Artificial Sequence
  chemically synthesized
caccattattcattatagcc

SEQ ID NO: 555249 - DNA, 20 bp, Artificial Sequence
  chemically synthesized
aactgtttatcaattttctg

SEQ ID NO: 555250 - DNA, 20 bp, Artificial Sequence
  chemically synthesized
tacacatctatcagaatggc

SEQ ID NO: 555251 - DNA, 20 bp, Artificial Sequence
  chemically synthesized
aggtgcatgaaaagattatc

SEQ ID NO: 555252 - DNA, 20 bp, Artificial Sequence
  chemically synthesized
gaactctcaaaactgcaagg

SEQ ID NO: 555253 - DNA, 20 bp, Artificial Sequence
  chemically synthesized
tagaatatataaagaactct

SEQ ID NO: 555254 - DNA, 20 bp, Artificial Sequence
  chemically synthesized
agttggactgcatcaagatt

SEQ ID NO: 555255 - DNA, 20 bp, Artificial Sequence
  chemically synthesized
atggacttaaatgtaaaaca

SEQ ID NO: 555256 - DNA, 20 bp, Artificial Sequence
  chemically synthesized
atagatcatggacttaaatg

SEQ ID NO: 555257 - DNA, 20 bp, Artificial Sequence
  chemically synthesized
acctaaatctcacaccttgt

SEQ ID NO: 555258 - DNA, 20 bp, Artificial Sequence
  chemically synthesized
tgaaacagaatagagaaccc

SEQ ID NO: 555259 - DNA, 20 bp, Artificial Sequence
  chemically synthesized
gtcacaggccacagaataac

SEQ ID NO: 555260 - DNA, 20 bp, Artificial Sequence
  chemically synthesized
aaatgctgatgaaaggcatt

SEQ ID NO: 555261 - DNA, 20 bp, Artificial Sequence
  chemically synthesized
aagatgtgaaaagtgaaatt

SEQ ID NO: 555262 - DNA, 20 bp, Artificial Sequence
  chemically synthesized
gaaaatatcaaatattctac

SEQ ID NO: 555263 - DNA, 20 bp, Artificial Sequence
  chemically synthesized
gacactacaataaagcaagg

SEQ ID NO: 555264 - DNA, 20 bp, Artificial Sequence
  chemically synthesized
cttaataaagggtatctaca

SEQ ID NO: 555265 - DNA, 20 bp, Artificial Sequence
  chemically synthesized
attcatgataaaaactatga

SEQ ID NO: 555266 - DNA, 20 bp, Artificial Sequence
  chemically synthesized
acccagcatccattcatgat

SEQ ID NO: 555267 - DNA, 20 bp, Artificial Sequence
  chemically synthesized
aaataaatgagcctagagac

SEQ ID NO: 555268 - DNA, 20 bp, Artificial Sequence
  chemically synthesized
agaactaaataaaatgaaaa

SEQ ID NO: 555269 - DNA, 20 bp, Artificial Sequence
  chemically synthesized
gaaagacaaaagaaaaacct

SEQ ID NO: 555270 - DNA, 20 bp, Artificial Sequence
  chemically synthesized
caataagagaaagacaaaag

SEQ ID NO: 555271 - DNA, 20 bp, Artificial Sequence
  chemically synthesized
agagaagaatgagaaataaa

SEQ ID NO: 555272 - DNA, 20 bp, Artificial Sequence
  chemically synthesized
aatgcctggaaagaccacta

SEQ ID NO: 555273 - DNA, 20 bp, Artificial Sequence
  chemically synthesized
atttaccataagtttgaagt

SEQ ID NO: 555274 - DNA, 20 bp, Artificial Sequence
  chemically synthesized
agagacattctcagattaag

SEQ ID NO: 555275 - DNA, 20 bp, Artificial Sequence
  chemically synthesized
ctttccctttaattccttag

SEQ ID NO: 555276 - DNA, 20 bp, Artificial Sequence
  chemically synthesized
tatatacacatatatatata

SEQ ID NO: 555277 - DNA, 20 bp, Artificial Sequence
  chemically synthesized
aaatataaaatgaatatgtg

SEQ ID NO: 555278 - DNA, 20 bp, Artificial Sequence
  chemically synthesized
agctgtgtgtcaggcactta

SEQ ID NO: 555279 - DNA, 20 bp, Artificial Sequence
  chemically synthesized
cactgatacaacactattaa

SEQ ID NO: 555280 - DNA, 20 bp, Artificial Sequence
  chemically synthesized
cagaaaaatgacatgagtgg

SEQ ID NO: 555281 - DNA, 20 bp, Artificial Sequence
  chemically synthesized
atctctctggtattcttccc

SEQ ID NO: 555282 - DNA, 20 bp, Artificial Sequence
  chemically synthesized
atgcttttttactaaacaga

SEQ ID NO: 555283 - DNA, 20 bp, Artificial Sequence
  chemically synthesized
gtatccatagaaatatatgg

SEQ ID NO: 555284 - DNA, 20 bp, Artificial Sequence
  chemically synthesized
attgttgagaaacttaagag

SEQ ID NO: 555285 - DNA, 20 bp, Artificial Sequence
  chemically synthesized
tgtgtgtgtgtgtgtgtata

SEQ ID NO: 555286 - DNA, 20 bp, Artificial Sequence
  chemically synthesized
ctcggtggtgaaataaaatg

SEQ ID NO: 555287 - DNA, 20 bp, Artificial Sequence
  chemically synthesized
ttagacctgtatctctaaaa

SEQ ID NO: 555288 - DNA, 20 bp, Artificial Sequence
  chemically synthesized
agagaaaaaaatctgggagg

SEQ ID NO: 555289 - DNA, 20 bp, Artificial Sequence
  chemically synthesized
aaactgaaagatctacttag

SEQ ID NO: 555290 - DNA, 20 bp, Artificial Sequence
  chemically synthesized
gaaattttagtaagattaca

SEQ ID NO: 555291 - DNA, 20 bp, Artificial Sequence
  chemically synthesized
atattgtgaagattaaatga

SEQ ID NO: 555292 - DNA, 20 bp, Artificial Sequence
  chemically synthesized
aaaaaaaaaaaaacaaaaaa

SEQ ID NO: 555293 - DNA, 20 bp, Artificial Sequence
  chemically synthesized
actctgcctcaaaaaaaaaa

SEQ ID NO: 555294 - DNA, 20 bp, Artificial Sequence
  chemically synthesized
ttcattctcaagagacaaaa

SEQ ID NO: 555295 - DNA, 20 bp, Artificial Sequence
  chemically synthesized
ctagttttgttatacatcta

SEQ ID NO: 555296 - DNA, 20 bp, Artificial Sequence
  chemically synthesized
ttagttttgtagatgtataa

SEQ ID NO: 555297 - DNA, 20 bp, Artificial Sequence
  chemically synthesized
tatatggtacagtaccaaag

SEQ ID NO: 555298 - DNA, 20 bp, Artificial Sequence
  chemically synthesized
catgttgcagtgggtccatt

SEQ ID NO: 555299 - DNA, 20 bp, Artificial Sequence
  chemically synthesized
tttgaaatggtttaagacca

SEQ ID NO: 555300 - DNA, 20 bp, Artificial Sequence
  chemically synthesized
gaatgatattaaaaccgcta

SEQ ID NO: 555301 - DNA, 20 bp, Artificial Sequence
  chemically synthesized
tagaaaattttgaatgatat

SEQ ID NO: 555302 - DNA, 20 bp, Artificial Sequence
  chemically synthesized
gatattctgatcacttaatt

SEQ ID NO: 555303 - DNA, 20 bp, Artificial Sequence
  chemically synthesized
agctttcaaatacttttttt

SEQ ID NO: 555304 - DNA, 20 bp, Artificial Sequence
  chemically synthesized
aacctcatatatttttactt

SEQ ID NO: 555305 - DNA, 20 bp, Artificial Sequence
  chemically synthesized
agagtgagactctgtcaaaa

SEQ ID NO: 555306 - DNA, 20 bp, Artificial Sequence
  chemically synthesized
ggtgaaaccctgtctctact

SEQ ID NO: 555307 - DNA, 20 bp, Artificial Sequence
  chemically synthesized
aaggcgggtaatactttaca

SEQ ID NO: 555308 - DNA, 20 bp, Artificial Sequence
  chemically synthesized
taatatcactacttgacttg

SEQ ID NO: 555309 - DNA, 20 bp, Artificial Sequence
  chemically synthesized
tacttgacttgtaaaacaaa

SEQ ID NO: 555310 - DNA, 20 bp, Artificial Sequence
  chemically synthesized
attcattggcatcatggagc

SEQ ID NO: 555311 - DNA, 20 bp, Artificial Sequence
  chemically synthesized
ttatattgaaaaaaatcacc

SEQ ID NO: 555312 - DNA, 20 bp, Artificial Sequence
  chemically synthesized
gtttaatatttccaggattt

SEQ ID NO: 555313 - DNA, 20 bp, Artificial Sequence
  chemically synthesized
tggaaaatgcatgtgaacct

SEQ ID NO: 555314 - DNA, 20 bp, Artificial Sequence
  chemically synthesized
tttaggagtatccaaataac

SEQ ID NO: 555315 - DNA, 20 bp, Artificial Sequence
  chemically synthesized
ttcacagctgataaaggctc

SEQ ID NO: 555316 - DNA, 20 bp, Artificial Sequence
  chemically synthesized
gtttttttccttaatacaga

SEQ ID NO: 555317 - DNA, 20 bp, Artificial Sequence
  chemically synthesized
gttttatctgtattaaggaa

SEQ ID NO: 555318 - DNA, 20 bp, Artificial Sequence
  chemically synthesized
gccttaagtgataattccca

SEQ ID NO: 555319 - DNA, 20 bp, Artificial Sequence
  chemically synthesized
atcacttaaggctaaaagca

SEQ ID NO: 555320 - DNA, 20 bp, Artificial Sequence
  chemically synthesized
caaaatgagctgattttaag

SEQ ID NO: 555321 - DNA, 20 bp, Artificial Sequence
  chemically synthesized
tttccataaacttactggcc

SEQ ID NO: 555322 - DNA, 20 bp, Artificial Sequence
  chemically synthesized
catttcaaacttctgacttc

SEQ ID NO: 555323 - DNA, 20 bp, Artificial Sequence
  chemically synthesized
ctgcctaccacagggggaaa

SEQ ID NO: 555324 - DNA, 20 bp, Artificial Sequence
  chemically synthesized
cgcctcaaaactcagtagct

SEQ ID NO: 555325 - DNA, 20 bp, Artificial Sequence
  chemically synthesized
agtccattaccaaaccgcct

SEQ ID NO: 555326 - DNA, 20 bp, Artificial Sequence
  chemically synthesized
acttttgccaggtaaactat

SEQ ID NO: 555327 - DNA, 20 bp, Artificial Sequence
  chemically synthesized
tgccaggtaaactattaaaa

SEQ ID NO: 555328 - DNA, 20 bp, Artificial Sequence
  chemically synthesized
tgcagtatactaagctgcgt

SEQ ID NO: 555329 - DNA, 20 bp, Artificial Sequence
  chemically synthesized
ggtgaaaattaaaatagaaa

SEQ ID NO: 555330 - DNA, 20 bp, Artificial Sequence
  chemically synthesized
tttaatgtcaaatacacttt

SEQ ID NO: 555331 - DNA, 20 bp, Artificial Sequence
  chemically synthesized
acactttaaaaacctagttt

SEQ ID NO: 555332 - DNA, 20 bp, Artificial Sequence
  chemically synthesized
caagacattccagtgggata

SEQ ID NO: 555333 - DNA, 20 bp, Artificial Sequence
  chemically synthesized
ctaggtttgtcaatatagaa

SEQ ID NO: 555334 - DNA, 20 bp, Artificial Sequence
  chemically synthesized
aacaatataaccagagaata

SEQ ID NO: 555335 - DNA, 20 bp, Artificial Sequence
  chemically synthesized
caaaataaacttgcccttga

SEQ ID NO: 555336 - DNA, 20 bp, Artificial Sequence
  chemically synthesized
ttattttgcttcatctatgt

SEQ ID NO: 555337 - DNA, 20 bp, Artificial Sequence
  chemically synthesized
atgattagccattttaatat

SEQ ID NO: 555338 - DNA, 20 bp, Artificial Sequence
  chemically synthesized
cacattgtgcacatgtaccc

SEQ ID NO: 555339 - DNA, 20 bp, Artificial Sequence
  chemically synthesized
tacaggatgaacacgccccc

SEQ ID NO: 555340 - DNA, 20 bp, Artificial Sequence
  chemically synthesized
ctattactattcgtatccta

SEQ ID NO: 555341 - DNA, 20 bp, Artificial Sequence
  chemically synthesized
tttagtcaccctaagaaaca

SEQ ID NO: 555342 - DNA, 20 bp, Artificial Sequence
  chemically synthesized
caaaagcccaaccaaataga

SEQ ID NO: 555343 - DNA, 20 bp, Artificial Sequence
  chemically synthesized
cctatggagacaggtcaggt

SEQ ID NO: 555344 - DNA, 20 bp, Artificial Sequence
  chemically synthesized
cacgttgtgcatatggaccc

SEQ ID NO: 555345 - DNA, 20 bp, Artificial Sequence
  chemically synthesized
agcaaactatggcaaggaca

SEQ ID NO: 555346 - DNA, 20 bp, Artificial Sequence
  chemically synthesized
gacttattttcctttaaaaa

SEQ ID NO: 555347 - DNA, 20 bp, Artificial Sequence
  chemically synthesized
taagaagcttctggcaaaaa

SEQ ID NO: 555348 - DNA, 20 bp, Artificial Sequence
  chemically synthesized
gcaaaaacaatttaggccag

SEQ ID NO: 555349 - DNA, 20 bp, Artificial Sequence
  chemically synthesized
ttaaaataccattaaaaagc

SEQ ID NO: 555350 - DNA, 20 bp, Artificial Sequence
  chemically synthesized
aaaaacaaacaaaccaaaaa

SEQ ID NO: 555351 - DNA, 20 bp, Artificial Sequence
  chemically synthesized
ccattaaaaaacaaacaaac

SEQ ID NO: 555352 - DNA, 20 bp, Artificial Sequence
  chemically synthesized
ccaaaccctgagaaccatta

SEQ ID NO: 555353 - DNA, 20 bp, Artificial Sequence
  chemically synthesized
accctatctgtaactgaatg

SEQ ID NO: 555354 - DNA, 20 bp, Artificial Sequence
  chemically synthesized
cctataactgtttctttcta

SEQ ID NO: 555355 - DNA, 20 bp, Artificial Sequence
  chemically synthesized
ttctacgtttttaattaata

SEQ ID NO: 555356 - DNA, 20 bp, Artificial Sequence
  chemically synthesized
aagaaagttttctattaatt

SEQ ID NO: 555357 - DNA, 20 bp, Artificial Sequence
  chemically synthesized
gtaggcatttttctcacatt

SEQ ID NO: 555358 - DNA, 20 bp, Artificial Sequence
  chemically synthesized
ctctcagggaacaagacatc

SEQ ID NO: 555359 - DNA, 20 bp, Artificial Sequence
  chemically synthesized
acaactgatttttttaaata

SEQ ID NO: 555360 - DNA, 20 bp, Artificial Sequence
  chemically synthesized
tccacaatgtatgggtatat

SEQ ID NO: 555361 - DNA, 20 bp, Artificial Sequence
  chemically synthesized
cccaattagaagcttaaggg

SEQ ID NO: 555362 - DNA, 20 bp, Artificial Sequence
  chemically synthesized
agctccactggaatctcctg

SEQ ID NO: 555363 - DNA, 20 bp, Artificial Sequence
  chemically synthesized
ataaaatatggaaatttttt

SEQ ID NO: 555364 - DNA, 20 bp, Artificial Sequence
  chemically synthesized
ccaagttgaaaaaaaaaaaa

SEQ ID NO: 555365 - DNA, 20 bp, Artificial Sequence
  chemically synthesized
tttacttgcatgacaatggt

SEQ ID NO: 555366 - DNA, 20 bp, Artificial Sequence
  chemically synthesized
ttgcttacattgagactaag

SEQ ID NO: 555367 - DNA, 20 bp, Artificial Sequence
  chemically synthesized
tagtaccggctatatttgcc

SEQ ID NO: 555368 - DNA, 20 bp, Artificial Sequence
  chemically synthesized
acctcataaatttatataaa

SEQ ID NO: 555369 - DNA, 20 bp, Artificial Sequence
  chemically synthesized
attagattatcaacactttg

SEQ ID NO: 555370 - DNA, 20 bp, Artificial Sequence
  chemically synthesized
catggggtacactagtctag

SEQ ID NO: 555371 - DNA, 20 bp, Artificial Sequence
  chemically synthesized
cttgctcttaatcttccatt

SEQ ID NO: 555372 - DNA, 20 bp, Artificial Sequence
  chemically synthesized
caagcctattttaaaagcgc

SEQ ID NO: 555373 - DNA, 20 bp, Artificial Sequence
  chemically synthesized
actgagttgcgctgtaagag

SEQ ID NO: 555374 - DNA, 20 bp, Artificial Sequence
  chemically synthesized
tgtatataacccaatatacc

SEQ ID NO: 555375 - DNA, 20 bp, Artificial Sequence
  chemically synthesized
aattgttggcttgtaacaat

SEQ ID NO: 555376 - DNA, 20 bp, Artificial Sequence
  chemically synthesized
aaaaaaatcagaaatacaat

SEQ ID NO: 555377 - DNA, 20 bp, Artificial Sequence
  chemically synthesized
tacttaacagtatgtctagt

SEQ ID NO: 555378 - DNA, 20 bp, Artificial Sequence
  chemically synthesized
atgggcatttacaaatgagt

SEQ ID NO: 555379 - DNA, 20 bp, Artificial Sequence
  chemically synthesized
atagtaatgagcaggattaa

SEQ ID NO: 555380 - DNA, 20 bp, Artificial Sequence
  chemically synthesized
tgaatatcaggctgtgctca

SEQ ID NO: 555381 - DNA, 20 bp, Artificial Sequence
  chemically synthesized
tcttccaactggatactaga

SEQ ID NO: 555382 - DNA, 20 bp, Artificial Sequence
  chemically synthesized
cccacagaacaccaataaaa

SEQ ID NO: 555383 - DNA, 20 bp, Artificial Sequence
  chemically synthesized
aaactctcaggaaatcttgt

SEQ ID NO: 555384 - DNA, 20 bp, Artificial Sequence
  chemically synthesized
aaaaaatagctaacttctga

SEQ ID NO: 555385 - DNA, 20 bp, Artificial Sequence
  chemically synthesized
gctaacttctgataaaaccc

SEQ ID NO: 555386 - DNA, 20 bp, Artificial Sequence
  chemically synthesized
cattgttaaagtgaaaaaaa

SEQ ID NO: 555387 - DNA, 20 bp, Artificial Sequence
  chemically synthesized
attatcaacatttcataaga

SEQ ID NO: 555388 - DNA, 20 bp, Artificial Sequence
  chemically synthesized
gtttttagtatactgtatta

SEQ ID NO: 555389 - DNA, 20 bp, Artificial Sequence
  chemically synthesized
gttttgtaatacagtatact

SEQ ID NO: 555390 - DNA, 20 bp, Artificial Sequence
  chemically synthesized
gataaacacattaaataatt

SEQ ID NO: 555391 - DNA, 20 bp, Artificial Sequence
  chemically synthesized
ttaatgtgtttatcgtatta

SEQ ID NO: 555392 - DNA, 20 bp, Artificial Sequence
  chemically synthesized
caaattatgtgagcttatgt

SEQ ID NO: 555393 - DNA, 20 bp, Artificial Sequence
  chemically synthesized
aatttgaagctatagaattt

SEQ ID NO: 555394 - DNA, 20 bp, Artificial Sequence
  chemically synthesized
tagcaagaactctaaaaagg

SEQ ID NO: 555395 - DNA, 20 bp, Artificial Sequence
  chemically synthesized
gaactctaaaaaggaaaaac

SEQ ID NO: 555396 - DNA, 20 bp, Artificial Sequence
  chemically synthesized
ctaaaaaggaaaaacaaaaa

SEQ ID NO: 555397 - DNA, 20 bp, Artificial Sequence
  chemically synthesized
agttgcaatcttcaaaaaaa

SEQ ID NO: 555398 - DNA, 20 bp, Artificial Sequence
  chemically synthesized
ttaatttaacatgaaaggat

SEQ ID NO: 555399 - DNA, 20 bp, Artificial Sequence
  chemically synthesized
taaaatcacctaagaaacaa

SEQ ID NO: 555400 - DNA, 20 bp, Artificial Sequence
  chemically synthesized
caattctatcaattaaagat

SEQ ID NO: 555401 - DNA, 20 bp, Artificial Sequence
  chemically synthesized
caattgcctggagagcttgt

SEQ ID NO: 555402 - DNA, 20 bp, Artificial Sequence
  chemically synthesized
tgttttacatctattttatc

SEQ ID NO: 555403 - DNA, 20 bp, Artificial Sequence
  chemically synthesized
agttttggataaaatagatg

SEQ ID NO: 555404 - DNA, 20 bp, Artificial Sequence
  chemically synthesized
tttcctgcatagtatttttt

SEQ ID NO: 555405 - DNA, 20 bp, Artificial Sequence
  chemically synthesized
ggaaataataatggtgctat

SEQ ID NO: 555406 - DNA, 20 bp, Artificial Sequence
  chemically synthesized
aattagaaaaccaggaattg

SEQ ID NO: 555407 - DNA, 20 bp, Artificial Sequence
  chemically synthesized
ttgtcttgcacagtgaatta

SEQ ID NO: 555408 - DNA, 20 bp, Artificial Sequence
  chemically synthesized
tatcatgtctggggctgaac

SEQ ID NO: 555409 - DNA, 20 bp, Artificial Sequence
  chemically synthesized
tgtttgccaaagtaatgaaa

SEQ ID NO: 555410 - DNA, 20 bp, Artificial Sequence
  chemically synthesized
tctctctcaattaaaaaaaa

SEQ ID NO: 555411 - DNA, 20 bp, Artificial Sequence
  chemically synthesized
tgctttactgaacagagatc

SEQ ID NO: 555412 - DNA, 20 bp, Artificial Sequence
  chemically synthesized
cttatttaacaactatagaa

SEQ ID NO: 555413 - DNA, 20 bp, Artificial Sequence
  chemically synthesized
aacaactatagaataaaact

SEQ ID NO: 555414 - DNA, 20 bp, Artificial Sequence
  chemically synthesized
actagttaggtttaagaaaa

SEQ ID NO: 555415 - DNA, 20 bp, Artificial Sequence
  chemically synthesized
gtttaacatgaaaggactgt

SEQ ID NO: 555416 - DNA, 20 bp, Artificial Sequence
  chemically synthesized
tcttcaattttgtattttgt

SEQ ID NO: 555417 - DNA, 20 bp, Artificial Sequence
  chemically synthesized
ccaaaataaatagattttat

SEQ ID NO: 555418 - DNA, 20 bp, Artificial Sequence
  chemically synthesized
gcttgtggaattgcattaaa

SEQ ID NO: 555419 - DNA, 20 bp, Artificial Sequence
  chemically synthesized
caaaaaaaaaaaaaaaaaaa

SEQ ID NO: 555420 - DNA, 20 bp, Artificial Sequence
  chemically synthesized
tccttggtcaaacccaaaca

SEQ ID NO: 555421 - DNA, 20 bp, Artificial Sequence
  chemically synthesized
cagaaaaaaagaaaaaaaaa

SEQ ID NO: 555422 - DNA, 20 bp, Artificial Sequence
  chemically synthesized
catacacaggtgtctcaaca

SEQ ID NO: 555423 - DNA, 20 bp, Artificial Sequence
  chemically synthesized
tagtatgctgttaatatatt

SEQ ID NO: 555424 - DNA, 20 bp, Artificial Sequence
  chemically synthesized
taagaatttatgtttttatg

SEQ ID NO: 555425 - DNA, 20 bp, Artificial Sequence
  chemically synthesized
tcagtatcattgtttttcat

SEQ ID NO: 555426 - DNA, 20 bp, Artificial Sequence
  chemically synthesized
catttgaagatttttatagg

SEQ ID NO: 555427 - DNA, 20 bp, Artificial Sequence
  chemically synthesized
acaaaacaagaacaaataaa

SEQ ID NO: 555428 - DNA, 20 bp, Artificial Sequence
  chemically synthesized
gccagtgaattgacctcaaa

SEQ ID NO: 555429 - DNA, 20 bp, Artificial Sequence
  chemically synthesized
aggtgtttaaaaaaaaaaaa

SEQ ID NO: 555430 - DNA, 20 bp, Artificial Sequence
  chemically synthesized
cttctaatacatctgctagc

SEQ ID NO: 555431 - DNA, 20 bp, Artificial Sequence
  chemically synthesized
cattgtattcccaaattgaa

SEQ ID NO: 555432 - DNA, 20 bp, Artificial Sequence
  chemically synthesized
catcttattatagcagtagc

SEQ ID NO: 555433 - DNA, 20 bp, Artificial Sequence
  chemically synthesized
tttgtttatagcccattaga

SEQ ID NO: 555434 - DNA, 20 bp, Artificial Sequence
  chemically synthesized
tgtctatcaagcaaaagaaa

SEQ ID NO: 555435 - DNA, 20 bp, Artificial Sequence
  chemically synthesized
caaaccagaacagtctgctt

SEQ ID NO: 555436 - DNA, 20 bp, Artificial Sequence
  chemically synthesized
caaaatgctaagctcaagtt

SEQ ID NO: 555437 - DNA, 20 bp, Artificial Sequence
  chemically synthesized
tacctatgtttccagagtgg

SEQ ID NO: 555438 - DNA, 20 bp, Artificial Sequence
  chemically synthesized
gggaacctgtagatatgact

SEQ ID NO: 555439 - DNA, 20 bp, Artificial Sequence
  chemically synthesized
attctatttagcctccaatg

SEQ ID NO: 555440 - DNA, 20 bp, Artificial Sequence
  chemically synthesized
gcccatggagatagccattt

SEQ ID NO: 555441 - DNA, 20 bp, Artificial Sequence
  chemically synthesized
gaccatagaatcacagagtt

SEQ ID NO: 555442 - DNA, 20 bp, Artificial Sequence
  chemically synthesized
aatcatttatgtcaaaagat

SEQ ID NO: 555443 - DNA, 20 bp, Artificial Sequence
  chemically synthesized
atatactcaattaagcaatt

SEQ ID NO: 555444 - DNA, 20 bp, Artificial Sequence
  chemically synthesized
agtaaatgacagttgccata

SEQ ID NO: 555445 - DNA, 20 bp, Artificial Sequence
  chemically synthesized
tatctgcatcaattgttaaa

SEQ ID NO: 555446 - DNA, 20 bp, Artificial Sequence
  chemically synthesized
tgccataagctgttcttagc

SEQ ID NO: 555447 - DNA, 20 bp, Artificial Sequence
  chemically synthesized
tttctgatgtttctttttca

SEQ ID NO: 555448 - DNA, 20 bp, Artificial Sequence
  chemically synthesized
ctaaatcatttccattaaac

SEQ ID NO: 555449 - DNA, 20 bp, Artificial Sequence
  chemically synthesized
atttccattaaacaaaaaca

SEQ ID NO: 555450 - DNA, 20 bp, Artificial Sequence
  chemically synthesized
ggacacagccaagccatacc

SEQ ID NO: 555451 - DNA, 20 bp, Artificial Sequence
  chemically synthesized
gaagtaggaagagcccctta

SEQ ID NO: 555452 - DNA, 20 bp, Artificial Sequence
  chemically synthesized
cgttgtgtgttattgtaacc

SEQ ID NO: 555453 - DNA, 20 bp, Artificial Sequence
  chemically synthesized
tcttcatgggatcactgcac

SEQ ID NO: 555454 - DNA, 20 bp, Artificial Sequence
  chemically synthesized
agtattctgaaactattata

SEQ ID NO: 555455 - DNA, 20 bp, Artificial Sequence
  chemically synthesized
tctgaaactattatataaaa

SEQ ID NO: 555456 - DNA, 20 bp, Artificial Sequence
  chemically synthesized
gactgcaatttaaaatggaa

SEQ ID NO: 555457 - DNA, 20 bp, Artificial Sequence
  chemically synthesized
gaattttgtccccatgaaaa

SEQ ID NO: 555458 - DNA, 20 bp, Artificial Sequence
  chemically synthesized
gatttatataccagagttct

SEQ ID NO: 555459 - DNA, 20 bp, Artificial Sequence
  chemically synthesized
catcttctcttagggttact

SEQ ID NO: 555460 - DNA, 20 bp, Artificial Sequence
  chemically synthesized
aaaaatagatgtcagctgaa

SEQ ID NO: 555461 - DNA, 20 bp, Artificial Sequence
  chemically synthesized
caattattcaaaaggcatgc

SEQ ID NO: 555462 - DNA, 20 bp, Artificial Sequence
  chemically synthesized
aaagctatagtactcaaaac

SEQ ID NO: 555463 - DNA, 20 bp, Artificial Sequence
  chemically synthesized
gtttacaaagctatagtact

SEQ ID NO: 555464 - DNA, 20 bp, Artificial Sequence
  chemically synthesized
tcatttgttggcacaatcat

SEQ ID NO: 555465 - DNA, 20 bp, Artificial Sequence
  chemically synthesized
cctggaaattcatgaaggat

SEQ ID NO: 555466 - DNA, 20 bp, Artificial Sequence
  chemically synthesized
aaattcatgaaggattaaaa

SEQ ID NO: 555467 - DNA, 20 bp, Artificial Sequence
  chemically synthesized
cacttctgtactaaattttg

SEQ ID NO: 555468 - DNA, 20 bp, Artificial Sequence
  chemically synthesized
ggcagtgaaccattaaaaaa

SEQ ID NO: 555469 - DNA, 20 bp, Artificial Sequence
  chemically synthesized
attttcaatatgcatttagg

SEQ ID NO: 555470 - DNA, 20 bp, Artificial Sequence
  chemically synthesized
atctaggctgctggtctcag

SEQ ID NO: 555471 - DNA, 20 bp, Artificial Sequence
  chemically synthesized
gatctcttaaggcctaggct

SEQ ID NO: 555472 - DNA, 20 bp, Artificial Sequence
  chemically synthesized
caaaaatggaacaccaccag

SEQ ID NO: 555473 - DNA, 20 bp, Artificial Sequence
  chemically synthesized
agtaaaagaagagtgtgctt

SEQ ID NO: 555474 - DNA, 20 bp, Artificial Sequence
  chemically synthesized
atgtcagcatttgagctcca

SEQ ID NO: 555475 - DNA, 20 bp, Artificial Sequence
  chemically synthesized
aagaaaaaagttcaaataag

SEQ ID NO: 555476 - DNA, 20 bp, Artificial Sequence
  chemically synthesized
caaataagtaaaacgacaac

SEQ ID NO: 555477 - DNA, 20 bp, Artificial Sequence
  chemically synthesized
atacacattccaaatcaaat

SEQ ID NO: 555478 - DNA, 20 bp, Artificial Sequence
  chemically synthesized
cattccaaatcaaatcaaaa

SEQ ID NO: 555479 - DNA, 20 bp, Artificial Sequence
  chemically synthesized
tcatgtttttccctttgcat

SEQ ID NO: 555480 - DNA, 20 bp, Artificial Sequence
  chemically synthesized
gacagtttttatgcaaaggg

SEQ ID NO: 555481 - DNA, 20 bp, Artificial Sequence
  chemically synthesized
agcttttccttttgtatctt

SEQ ID NO: 555482 - DNA, 20 bp, Artificial Sequence
  chemically synthesized
agagctgaaagggccataag

SEQ ID NO: 555483 - DNA, 20 bp, Artificial Sequence
  chemically synthesized
cttcttcagctaacagactc

SEQ ID NO: 555484 - DNA, 20 bp, Artificial Sequence
  chemically synthesized
gagtttcagtttgggatgat

SEQ ID NO: 555485 - DNA, 20 bp, Artificial Sequence
  chemically synthesized
gagagatgaactaaactgag

SEQ ID NO: 555486 - DNA, 20 bp, Artificial Sequence
  chemically synthesized
ctttaaacttttttctacaa

SEQ ID NO: 555487 - DNA, 20 bp, Artificial Sequence
  chemically synthesized
agaaaaaagtttaaagtttt

SEQ ID NO: 555488 - DNA, 20 bp, Artificial Sequence
  chemically synthesized
caccagtatactgatgtttt

SEQ ID NO: 555489 - DNA, 20 bp, Artificial Sequence
  chemically synthesized
cagctttaattaaatggcat

SEQ ID NO: 555490 - DNA, 20 bp, Artificial Sequence
  chemically synthesized
caaatagaatatgggagaag

SEQ ID NO: 555491 - DNA, 20 bp, Artificial Sequence
  chemically synthesized
atggagaggtccacatgaag

SEQ ID NO: 555492 - DNA, 20 bp, Artificial Sequence
  chemically synthesized
gcaaactgtagattcatgaa

SEQ ID NO: 555493 - DNA, 20 bp, Artificial Sequence
  chemically synthesized
tgctacataacaagccagcc

SEQ ID NO: 555494 - DNA, 20 bp, Artificial Sequence
  chemically synthesized
gttgattctcttttggagtg

SEQ ID NO: 555495 - DNA, 20 bp, Artificial Sequence
  chemically synthesized
cctctactcattgcactttt

SEQ ID NO: 555496 - DNA, 20 bp, Artificial Sequence
  chemically synthesized
aatatttgtaaagctactgc

SEQ ID NO: 555497 - DNA, 20 bp, Artificial Sequence
  chemically synthesized
ttttattttaatataattta

SEQ ID NO: 555498 - DNA, 20 bp, Artificial Sequence
  chemically synthesized
gcctttcataattctgataa

SEQ ID NO: 555499 - DNA, 20 bp, Artificial Sequence
  chemically synthesized
tgggagcagactttctagac

SEQ ID NO: 555500 - DNA, 20 bp, Artificial Sequence
  chemically synthesized
taccatggggcagtggcaat

SEQ ID NO: 555501 - DNA, 20 bp, Artificial Sequence
  chemically synthesized
actgccccatggtatgcatt

SEQ ID NO: 555502 - DNA, 20 bp, Artificial Sequence
  chemically synthesized
aagactttaaagagcttttc

SEQ ID NO: 555503 - DNA, 20 bp, Artificial Sequence
  chemically synthesized
aaaaaaggaatctcaagaca

SEQ ID NO: 555504 - DNA, 20 bp, Artificial Sequence
  chemically synthesized
tccatttaaattaagcttcc

SEQ ID NO: 555505 - DNA, 20 bp, Artificial Sequence
  chemically synthesized
atgcgcccgccccggcctcc

SEQ ID NO: 555506 - DNA, 20 bp, Artificial Sequence
  chemically synthesized
tggaaatacctctaagaact

SEQ ID NO: 555507 - DNA, 20 bp, Artificial Sequence
  chemically synthesized
ggtgaaataacataggaaca

SEQ ID NO: 555508 - DNA, 20 bp, Artificial Sequence
  chemically synthesized
atctgaaaatccaaaatcca

SEQ ID NO: 555509 - DNA, 20 bp, Artificial Sequence
  chemically synthesized
ctggttgagtatcccttatc

SEQ ID NO: 555510 - DNA, 20 bp, Artificial Sequence
  chemically synthesized
tcgtatatttagtacagagg

SEQ ID NO: 555511 - DNA, 20 bp, Artificial Sequence
  chemically synthesized
tttctaatttgatccttagt

SEQ ID NO: 555512 - DNA, 20 bp, Artificial Sequence
  chemically synthesized
cacaaaagctctgcgaggaa

SEQ ID NO: 555513 - DNA, 20 bp, Artificial Sequence
  chemically synthesized
gttaattgtattaaaacctt

SEQ ID NO: 555514 - DNA, 20 bp, Artificial Sequence
  chemically synthesized
cgtaaacatgttaattgtat

SEQ ID NO: 555515 - DNA, 20 bp, Artificial Sequence
  chemically synthesized
gttaccatggtaacatggtc

SEQ ID NO: 555516 - DNA, 20 bp, Artificial Sequence
  chemically synthesized
tattctcatattgatactat

SEQ ID NO: 555517 - DNA, 20 bp, Artificial Sequence
  chemically synthesized
ataatgtatccaagatcatg

SEQ ID NO: 555518 - DNA, 20 bp, Artificial Sequence
  chemically synthesized
gtaagtgaaaaatcagaggt

SEQ ID NO: 555519 - DNA, 20 bp, Artificial Sequence
  chemically synthesized
ctgctcacctccacctccca

SEQ ID NO: 555520 - DNA, 20 bp, Artificial Sequence
  chemically synthesized
aagtggtgaggttgaacaaa

SEQ ID NO: 555521 - DNA, 20 bp, Artificial Sequence
  chemically synthesized
cactaccagaatgatctttt

SEQ ID NO: 555522 - DNA, 20 bp, Artificial Sequence
  chemically synthesized
agagctggacagggtctagc

SEQ ID NO: 555523 - DNA, 20 bp, Artificial Sequence
  chemically synthesized
gtaagtttcaatattgttcg

SEQ ID NO: 555524 - DNA, 20 bp, Artificial Sequence
  chemically synthesized
ccccaagaaaggtgcttttc

SEQ ID NO: 555525 - DNA, 20 bp, Artificial Sequence
  chemically synthesized
gaaagattaaaaaatacata

SEQ ID NO: 555526 - DNA, 20 bp, Artificial Sequence
  chemically synthesized
aaaaattgtcttctgatgaa

SEQ ID NO: 555527 - DNA, 20 bp, Artificial Sequence
  chemically synthesized
ggattgagaggagacgtagg

SEQ ID NO: 555528 - DNA, 20 bp, Artificial Sequence
  chemically synthesized
catggttcaaagtactacca

SEQ ID NO: 555529 - DNA, 20 bp, Artificial Sequence
  chemically synthesized
aatcggattatttctctatc

SEQ ID NO: 555530 - DNA, 20 bp, Artificial Sequence
  chemically synthesized
cagatttatcctttaaataa

SEQ ID NO: 555531 - DNA, 20 bp, Artificial Sequence
  chemically synthesized
gctggagtctccatatatag

SEQ ID NO: 555532 - DNA, 20 bp, Artificial Sequence
  chemically synthesized
acggattgacagtcttagag

SEQ ID NO: 555533 - DNA, 20 bp, Artificial Sequence
  chemically synthesized
agtgaatgaagagagagggt

SEQ ID NO: 555534 - DNA, 20 bp, Artificial Sequence
  chemically synthesized
aagactcggagatgtcatgg

SEQ ID NO: 555535 - DNA, 20 bp, Artificial Sequence
  chemically synthesized
ctaagattccaaaattattt

SEQ ID NO: 555536 - DNA, 20 bp, Artificial Sequence
  chemically synthesized
aaaactcccatagagcctct

SEQ ID NO: 555537 - DNA, 20 bp, Artificial Sequence
  chemically synthesized
atttattctcaaaatccaga

SEQ ID NO: 555538 - DNA, 20 bp, Artificial Sequence
  chemically synthesized
gtttggttaagccactggac

SEQ ID NO: 555539 - DNA, 20 bp, Artificial Sequence
  chemically synthesized
attttatgtcagggatttaa

SEQ ID NO: 555540 - DNA, 20 bp, Artificial Sequence
  chemically synthesized
gacaaagtgagacttcatct

SEQ ID NO: 555541 - DNA, 20 bp, Artificial Sequence
  chemically synthesized
catacatcgaagagtgagca

SEQ ID NO: 555542 - DNA, 20 bp, Artificial Sequence
  chemically synthesized
caactatcatatcaaaaaag

SEQ ID NO: 555543 - DNA, 20 bp, Artificial Sequence
  chemically synthesized
gatatttttaaactattatg

SEQ ID NO: 555544 - DNA, 20 bp, Artificial Sequence
  chemically synthesized
aagttattatatcaagtcag

SEQ ID NO: 555545 - DNA, 20 bp, Artificial Sequence
  chemically synthesized
gaaaaaccaactatacataa

SEQ ID NO: 555546 - DNA, 20 bp, Artificial Sequence
  chemically synthesized
tcaccaagacttcatttaaa

SEQ ID NO: 555547 - DNA, 20 bp, Artificial Sequence
  chemically synthesized
gttccatatgcataaacagt

SEQ ID NO: 555548 - DNA, 20 bp, Artificial Sequence
  chemically synthesized
aaataatttttgtttctagg

SEQ ID NO: 555549 - DNA, 20 bp, Artificial Sequence
  chemically synthesized
aaaatgccagattaacattt

SEQ ID NO: 555550 - DNA, 20 bp, Artificial Sequence
  chemically synthesized
attcagttagcaacgctaaa

SEQ ID NO: 555551 - DNA, 20 bp, Artificial Sequence
  chemically synthesized
accaggaaaacatttgcata

SEQ ID NO: 555552 - DNA, 20 bp, Artificial Sequence
  chemically synthesized
aaagtacatgctctgaccag

SEQ ID NO: 555553 - DNA, 20 bp, Artificial Sequence
  chemically synthesized
tgtaactgacaagccaggga

SEQ ID NO: 555554 - DNA, 20 bp, Artificial Sequence
  chemically synthesized
agctttcaaaattgaccaac

SEQ ID NO: 555555 - DNA, 20 bp, Artificial Sequence
  chemically synthesized
ttgagacaaacctttatagt

SEQ ID NO: 555556 - DNA, 20 bp, Artificial Sequence
  chemically synthesized
tttgatgctgctctgaggca

SEQ ID NO: 555557 - DNA, 20 bp, Artificial Sequence
  chemically synthesized
atgaaaaagagtagagtttt

SEQ ID NO: 555558 - DNA, 20 bp, Artificial Sequence
  chemically synthesized
actcagatctgcctagtttt

SEQ ID NO: 555559 - DNA, 20 bp, Artificial Sequence
  chemically synthesized
gttatacattacagttactc

SEQ ID NO: 555560 - DNA, 20 bp, Artificial Sequence
  chemically synthesized
gaaacaaactctttcatgac

SEQ ID NO: 555561 - DNA, 20 bp, Artificial Sequence
  chemically synthesized
tgtgattgtcaataattatg

SEQ ID NO: 555562 - DNA, 20 bp, Artificial Sequence
  chemically synthesized
tggaagactgtgtgctcagc

SEQ ID NO: 555563 - DNA, 20 bp, Artificial Sequence
  chemically synthesized
cttgcattgatagtttgcct

SEQ ID NO: 555564 - DNA, 20 bp, Artificial Sequence
  chemically synthesized
cgagagaaatgttgaagccg

SEQ ID NO: 555565 - DNA, 20 bp, Artificial Sequence
  chemically synthesized
ccatatggttccggaaaatt

SEQ ID NO: 555566 - DNA, 20 bp, Artificial Sequence
  chemically synthesized
aaaaaagatatgttcagaaa

SEQ ID NO: 555567 - DNA, 20 bp, Artificial Sequence
  chemically synthesized
aaagctggaatagctgatta

SEQ ID NO: 555568 - DNA, 20 bp, Artificial Sequence
  chemically synthesized
agtgctcttatgaatagaat

SEQ ID NO: 555569 - DNA, 20 bp, Artificial Sequence
  chemically synthesized
gcatatattggaaggcttgt

SEQ ID NO: 555570 - DNA, 20 bp, Artificial Sequence
  chemically synthesized
aaaaagaaaatgggtatgct

SEQ ID NO: 555571 - DNA, 20 bp, Artificial Sequence
  chemically synthesized
agtaaattgcattttgattt

SEQ ID NO: 555572 - DNA, 20 bp, Artificial Sequence
  chemically synthesized
gattagtagtccattcctag

SEQ ID NO: 555573 - DNA, 20 bp, Artificial Sequence
  chemically synthesized
agatgttgcccaaaaacaga

SEQ ID NO: 555574 - DNA, 20 bp, Artificial Sequence
  chemically synthesized
tttctaggtagatgttgccc

SEQ ID NO: 555575 - DNA, 20 bp, Artificial Sequence
  chemically synthesized
gaataactctgaatatgttt

SEQ ID NO: 555576 - DNA, 20 bp, Artificial Sequence
  chemically synthesized
acctcttttgatggaaagag

SEQ ID NO: 555577 - DNA, 20 bp, Artificial Sequence
  chemically synthesized
aactaattttcataaaaata

SEQ ID NO: 555578 - DNA, 20 bp, Artificial Sequence
  chemically synthesized
atatctgtcttcagagttac

SEQ ID NO: 555579 - DNA, 20 bp, Artificial Sequence
  chemically synthesized
gacctcaagagagaggggat

SEQ ID NO: 555580 - DNA, 20 bp, Artificial Sequence
  chemically synthesized
gtattgctgattagttctca

SEQ ID NO: 555581 - DNA, 20 bp, Artificial Sequence
  chemically synthesized
aattcgcaaatctctatttt

SEQ ID NO: 555582 - DNA, 20 bp, Artificial Sequence
  chemically synthesized
ccataattatacactttccc

SEQ ID NO: 555583 - DNA, 20 bp, Artificial Sequence
  chemically synthesized
gggtaatgcaaagtaaagta

SEQ ID NO: 555584 - DNA, 20 bp, Artificial Sequence
  chemically synthesized
ggatttgtttaaaatagtat

SEQ ID NO: 555585 - DNA, 20 bp, Artificial Sequence
  chemically synthesized
tcatccacaataacttagag

SEQ ID NO: 555586 - DNA, 20 bp, Artificial Sequence
  chemically synthesized
taacttagagaaaaacagaa

SEQ ID NO: 555587 - DNA, 20 bp, Artificial Sequence
  chemically synthesized
gtgtttgccatttgatatta

SEQ ID NO: 555588 - DNA, 20 bp, Artificial Sequence
  chemically synthesized
tttaaaagaaagaagtggct

SEQ ID NO: 555589 - DNA, 20 bp, Artificial Sequence
  chemically synthesized
tgaacagacactttttaaaa

SEQ ID NO: 555590 - DNA, 20 bp, Artificial Sequence
  chemically synthesized
atcattggagaaatgcaaat

SEQ ID NO: 555591 - DNA, 20 bp, Artificial Sequence
  chemically synthesized
tatgttatttcagtcattgt

SEQ ID NO: 555592 - DNA, 20 bp, Artificial Sequence
  chemically synthesized
agcaaactaatgcaggaaca

SEQ ID NO: 555593 - DNA, 20 bp, Artificial Sequence
  chemically synthesized
ggatcctgtcaaaggagctt

SEQ ID NO: 555594 - DNA, 20 bp, Artificial Sequence
  chemically synthesized
taattcatataataataaca

SEQ ID NO: 555595 - DNA, 20 bp, Artificial Sequence
  chemically synthesized
gtgaaataaatacattttaa

SEQ ID NO: 555596 - DNA, 20 bp, Artificial Sequence
  chemically synthesized
tacaagtagcttgagctaat

SEQ ID NO: 555597 - DNA, 20 bp, Artificial Sequence
  chemically synthesized
ttcataagtcagaggattct

SEQ ID NO: 555598 - DNA, 20 bp, Artificial Sequence
  chemically synthesized
cgataaggtatacagcttct

SEQ ID NO: 555599 - DNA, 20 bp, Artificial Sequence
  chemically synthesized
gccataggctcttgttctta

SEQ ID NO: 555600 - DNA, 20 bp, Artificial Sequence
  chemically synthesized
aaaatattatctttgttata

SEQ ID NO: 555601 - DNA, 20 bp, Artificial Sequence
  chemically synthesized
atatctgtacatttgcaaag

SEQ ID NO: 555602 - DNA, 20 bp, Artificial Sequence
  chemically synthesized
atcaagtaccaaaagtgcct

SEQ ID NO: 555603 - DNA, 20 bp, Artificial Sequence
  chemically synthesized
agttctactcatgttctgtc

SEQ ID NO: 555604 - DNA, 20 bp, Artificial Sequence
  chemically synthesized
tgtctaaaagtttttcattg

SEQ ID NO: 555605 - DNA, 20 bp, Artificial Sequence
  chemically synthesized
taaaataatgttttacaatg

SEQ ID NO: 555606 - DNA, 20 bp, Artificial Sequence
  chemically synthesized
gaagagattagctaatttag

SEQ ID NO: 555607 - DNA, 20 bp, Artificial Sequence
  chemically synthesized
cattgatagtctcgtgatct

SEQ ID NO: 555608 - DNA, 20 bp, Artificial Sequence
  chemically synthesized
gcattgggtctgagaagttt

SEQ ID NO: 555609 - DNA, 20 bp, Artificial Sequence
  chemically synthesized
ttcatatacgaacctgaatt

SEQ ID NO: 555610 - DNA, 20 bp, Artificial Sequence
  chemically synthesized
ttcctcgttgtcattcttgt

SEQ ID NO: 555611 - DNA, 20 bp, Artificial Sequence
  chemically synthesized
tagagtttggactagaaggg

SEQ ID NO: 555612 - DNA, 20 bp, Artificial Sequence
  chemically synthesized
tagatagggacatgtaattt

SEQ ID NO: 555613 - DNA, 20 bp, Artificial Sequence
  chemically synthesized
gaagagaaatatgcagatgg

SEQ ID NO: 555614 - DNA, 20 bp, Artificial Sequence
  chemically synthesized
gttgtaaccactggggacag

SEQ ID NO: 555615 - DNA, 20 bp, Artificial Sequence
  chemically synthesized
cttctttcctgcaaaatgat

SEQ ID NO: 555616 - DNA, 20 bp, Artificial Sequence
  chemically synthesized
atagattctgttctccttta

SEQ ID NO: 555617 - DNA, 20 bp, Artificial Sequence
  chemically synthesized
agtatacattcacattttat

SEQ ID NO: 555618 - DNA, 20 bp, Artificial Sequence
  chemically synthesized
ttggctaagctagaatttgg

SEQ ID NO: 555619 - DNA, 20 bp, Artificial Sequence
  chemically synthesized
aaattatggatatcatgttg

SEQ ID NO: 555620 - DNA, 20 bp, Artificial Sequence
  chemically synthesized
gctgtcatgattttccaaaa

SEQ ID NO: 555621 - DNA, 20 bp, Artificial Sequence
  chemically synthesized
aactgatagagcaaaataag

SEQ ID NO: 555622 - DNA, 20 bp, Artificial Sequence
  chemically synthesized
actttatttctttgggctca

SEQ ID NO: 555623 - DNA, 20 bp, Artificial Sequence
  chemically synthesized
aaattgttgaattaaatttc

SEQ ID NO: 555624 - DNA, 20 bp, Artificial Sequence
  chemically synthesized
aactataaaatatagtttat

SEQ ID NO: 555625 - DNA, 20 bp, Artificial Sequence
  chemically synthesized
gaaataccatttttccctac

SEQ ID NO: 555626 - DNA, 20 bp, Artificial Sequence
  chemically synthesized
gtttgtgataggcacttttt

SEQ ID NO: 555627 - DNA, 20 bp, Artificial Sequence
  chemically synthesized
tatatttttaaagtagctct

SEQ ID NO: 555628 - DNA, 20 bp, Artificial Sequence
  chemically synthesized
ttgagcacatatttcactaa

SEQ ID NO: 555629 - DNA, 20 bp, Artificial Sequence
  chemically synthesized
aatattatgccttttctcag

SEQ ID NO: 555630 - DNA, 20 bp, Artificial Sequence
  chemically synthesized
ttttcaaaagcaaactttgg

SEQ ID NO: 555631 - DNA, 20 bp, Artificial Sequence
  chemically synthesized
tataggtgatgctgcaatgt

SEQ ID NO: 555632 - DNA, 20 bp, Artificial Sequence
  chemically synthesized
gtctgtgactttcctaagct

SEQ ID NO: 555633 - DNA, 20 bp, Artificial Sequence
  chemically synthesized
taggttgctgctggtaacag

SEQ ID NO: 555634 - DNA, 20 bp, Artificial Sequence
  chemically synthesized
ttgaggatttttttcccaca

SEQ ID NO: 555635 - DNA, 20 bp, Artificial Sequence
  chemically synthesized
gcatttgtttcagggaaaag

SEQ ID NO: 555636 - DNA, 20 bp, Artificial Sequence
  chemically synthesized
ccttctaaaagtttgaccat

SEQ ID NO: 555637 - DNA, 20 bp, Artificial Sequence
  chemically synthesized
tacagtggaactagttctgc

SEQ ID NO: 555638 - DNA, 20 bp, Artificial Sequence
  chemically synthesized
caaaaccccatttggaaaaa

SEQ ID NO: 555639 - DNA, 20 bp, Artificial Sequence
  chemically synthesized
agaaggagattattgttgct

SEQ ID NO: 555640 - DNA, 20 bp, Artificial Sequence
  chemically synthesized
aaccactgcctacaccaacc

SEQ ID NO: 555641 - DNA, 20 bp, Artificial Sequence
  chemically synthesized
ttcaaaagaaacatgaaaca

SEQ ID NO: 555642 - DNA, 20 bp, Artificial Sequence
  chemically synthesized
gcctaccagtccaacttgtt

SEQ ID NO: 555643 - DNA, 20 bp, Artificial Sequence
  chemically synthesized
acttatataacacatttcaa

SEQ ID NO: 555644 - DNA, 20 bp, Artificial Sequence
  chemically synthesized
aacaaaacatatctcactat

SEQ ID NO: 555645 - DNA, 20 bp, Artificial Sequence
  chemically synthesized
catctaatttgtcccagcat

SEQ ID NO: 555646 - DNA, 20 bp, Artificial Sequence
  chemically synthesized
tttttaaaatgtgtaaacga

SEQ ID NO: 555647 - DNA, 20 bp, Artificial Sequence
  chemically synthesized
cagacggaatgaccacagca

SEQ ID NO: 555648 - DNA, 20 bp, Artificial Sequence
  chemically synthesized
aggtgtttatcttttcaata

SEQ ID NO: 555649 - DNA, 20 bp, Artificial Sequence
  chemically synthesized
gatttttttaaatgaaaaaa

SEQ ID NO: 555650 - DNA, 20 bp, Artificial Sequence
  chemically synthesized
ctgtgtttcagaaatgccac

SEQ ID NO: 555651 - DNA, 20 bp, Artificial Sequence
  chemically synthesized
attggaaagattagatttca

SEQ ID NO: 555652 - DNA, 20 bp, Artificial Sequence
  chemically synthesized
tgaataaagccaaaggatcc

SEQ ID NO: 555653 - DNA, 20 bp, Artificial Sequence
  chemically synthesized
tgattatattcatttattaa

SEQ ID NO: 555654 - DNA, 20 bp, Artificial Sequence
  chemically synthesized
cattctcagaaagacttctt

SEQ ID NO: 555655 - DNA, 20 bp, Artificial Sequence
  chemically synthesized
gttcaattaaaccaaataag

SEQ ID NO: 555656 - DNA, 20 bp, Artificial Sequence
  chemically synthesized
taatattaaatttatgaaca

SEQ ID NO: 555657 - DNA, 20 bp, Artificial Sequence
  chemically synthesized
ggaaaaacaatagtattatc

SEQ ID NO: 555658 - DNA, 20 bp, Artificial Sequence
  chemically synthesized
aatactattgtttttcctgg

SEQ ID NO: 555659 - DNA, 20 bp, Artificial Sequence
  chemically synthesized
tatgtatcagttttcccagg

SEQ ID NO: 555660 - DNA, 20 bp, Artificial Sequence
  chemically synthesized
atagtgagataccatttcta

SEQ ID NO: 555661 - DNA, 20 bp, Artificial Sequence
  chemically synthesized
taacagtctgctgaggatca

SEQ ID NO: 555662 - DNA, 20 bp, Artificial Sequence
  chemically synthesized
agtaaaaacaaatgaaaaag

SEQ ID NO: 555663 - DNA, 20 bp, Artificial Sequence
  chemically synthesized
tctcaaatttttctgaaagt

SEQ ID NO: 555664 - DNA, 20 bp, Artificial Sequence
  chemically synthesized
ttgtctaacttaattgtctc

SEQ ID NO: 555665 - DNA, 20 bp, Artificial Sequence
  chemically synthesized
ttagacaattacactacact

SEQ ID NO: 555666 - DNA, 20 bp, Artificial Sequence
  chemically synthesized
aacagaggagccagataaga

SEQ ID NO: 555667 - DNA, 20 bp, Artificial Sequence
  chemically synthesized
aaacatgtcactcctccatt

SEQ ID NO: 555668 - DNA, 20 bp, Artificial Sequence
  chemically synthesized
cagtgtggaagaacaaagag

SEQ ID NO: 555669 - DNA, 20 bp, Artificial Sequence
  chemically synthesized
tgttggtcaactctgctaat

SEQ ID NO: 555670 - DNA, 20 bp, Artificial Sequence
  chemically synthesized
ccccagcaccaccactttat

SEQ ID NO: 555671 - DNA, 20 bp, Artificial Sequence
  chemically synthesized
aaggaaagtagaataattac

SEQ ID NO: 555672 - DNA, 20 bp, Artificial Sequence
  chemically synthesized
ttcattgcaacaagaaaaga

SEQ ID NO: 555673 - DNA, 20 bp, Artificial Sequence
  chemically synthesized
tcaaggttgtcaaagacgga

SEQ ID NO: 555674 - DNA, 20 bp, Artificial Sequence
  chemically synthesized
aaattaatagttgatcatct

SEQ ID NO: 555675 - DNA, 20 bp, Artificial Sequence
  chemically synthesized
taattttgatcattaaaata

SEQ ID NO: 555676 - DNA, 20 bp, Artificial Sequence
  chemically synthesized
tctgtaaggactacgataag

SEQ ID NO: 555677 - DNA, 20 bp, Artificial Sequence
  chemically synthesized
ttatttaacattcaacagtt

SEQ ID NO: 555678 - DNA, 20 bp, Artificial Sequence
  chemically synthesized
tgtgagaaatgatgtaatca

SEQ ID NO: 555679 - DNA, 20 bp, Artificial Sequence
  chemically synthesized
atggtatttgtgttggtctc

SEQ ID NO: 555680 - DNA, 20 bp, Artificial Sequence
  chemically synthesized
atcaaactaatacaggaaca

SEQ ID NO: 555681 - DNA, 20 bp, Artificial Sequence
  chemically synthesized
atctagagcaggactatcag

SEQ ID NO: 555682 - DNA, 20 bp, Artificial Sequence
  chemically synthesized
taccataagtttgggaaggg

SEQ ID NO: 555683 - DNA, 20 bp, Artificial Sequence
  chemically synthesized
agcagcaggatctacatgtc

SEQ ID NO: 555684 - DNA, 20 bp, Artificial Sequence
  chemically synthesized
gaagaatccagagaccttga

SEQ ID NO: 555685 - DNA, 20 bp, Artificial Sequence
  chemically synthesized
cttgataaaacaatttttta

SEQ ID NO: 555686 - DNA, 20 bp, Artificial Sequence
  chemically synthesized
ctttttcatagggctccaat

SEQ ID NO: 555687 - DNA, 20 bp, Artificial Sequence
  chemically synthesized
tgagctagacattagagagt

SEQ ID NO: 555688 - DNA, 20 bp, Artificial Sequence
  chemically synthesized
gtaaaagtcaccactggggc

SEQ ID NO: 555689 - DNA, 20 bp, Artificial Sequence
  chemically synthesized
gcaaagggagtcatcattca

SEQ ID NO: 555690 - DNA, 20 bp, Artificial Sequence
  chemically synthesized
ttggctcagacttctatttt

SEQ ID NO: 555691 - DNA, 20 bp, Artificial Sequence
  chemically synthesized
ctccagtttagctggattgg

SEQ ID NO: 555692 - DNA, 20 bp, Artificial Sequence
  chemically synthesized
ggtatgaattacattatttc

SEQ ID NO: 555693 - DNA, 20 bp, Artificial Sequence
  chemically synthesized
ccaactagagatttcataaa

SEQ ID NO: 555694 - DNA, 20 bp, Artificial Sequence
  chemically synthesized
tagtttttttctcttgtgat

SEQ ID NO: 555695 - DNA, 20 bp, Artificial Sequence
  chemically synthesized
ttgtttttatcacaagagaa

SEQ ID NO: 555696 - DNA, 20 bp, Artificial Sequence
  chemically synthesized
tataacaacatttgaacgaa

SEQ ID NO: 555697 - DNA, 20 bp, Artificial Sequence
  chemically synthesized
agtgatgagatagcaagttt

SEQ ID NO: 555698 - DNA, 20 bp, Artificial Sequence
  chemically synthesized
caggttgatatgcttcgaga

SEQ ID NO: 555699 - DNA, 20 bp, Artificial Sequence
  chemically synthesized
tccaaagctgaaaagaccag

SEQ ID NO: 555700 - DNA, 20 bp, Artificial Sequence
  chemically synthesized
gagcacaattttcttgtgta

SEQ ID NO: 555701 - DNA, 20 bp, Artificial Sequence
  chemically synthesized
taacgcaaaagaacaaatat

SEQ ID NO: 555702 - DNA, 20 bp, Artificial Sequence
  chemically synthesized
aatgtaatttctcagttaac

SEQ ID NO: 555703 - DNA, 20 bp, Artificial Sequence
  chemically synthesized
gagcatagttgctgctatta

SEQ ID NO: 555704 - DNA, 20 bp, Artificial Sequence
  chemically synthesized
attaatagcatgaacatcca

SEQ ID NO: 555705 - DNA, 20 bp, Artificial Sequence
  chemically synthesized
tttcaaatgaattcctttta

SEQ ID NO: 555706 - DNA, 20 bp, Artificial Sequence
  chemically synthesized
aaagctcaggaatacaaaat

SEQ ID NO: 555707 - DNA, 20 bp, Artificial Sequence
  chemically synthesized
ttgaagtgtaattgatatac

SEQ ID NO: 555708 - DNA, 20 bp, Artificial Sequence
  chemically synthesized
caataaagctgttaaaatta

SEQ ID NO: 555709 - DNA, 20 bp, Artificial Sequence
  chemically synthesized
cagaaggtgccaatgaatct

SEQ ID NO: 555710 - DNA, 20 bp, Artificial Sequence
  chemically synthesized
tttttaatcctacatcctca

SEQ ID NO: 555711 - DNA, 20 bp, Artificial Sequence
  chemically synthesized
gaggatgtaggattaaaaag

SEQ ID NO: 555712 - DNA, 20 bp, Artificial Sequence
  chemically synthesized
atattaccgtaggagaaagg

SEQ ID NO: 555713 - DNA, 20 bp, Artificial Sequence
  chemically synthesized
tagtgtgaatgacacttggg

SEQ ID NO: 555714 - DNA, 20 bp, Artificial Sequence
  chemically synthesized
agcattttatattcttcata

SEQ ID NO: 555715 - DNA, 20 bp, Artificial Sequence
  chemically synthesized
gcatttctagacaatgtcca

SEQ ID NO: 555716 - DNA, 20 bp, Artificial Sequence
  chemically synthesized
ttacttgtaggtgaatatca

SEQ ID NO: 555717 - DNA, 20 bp, Artificial Sequence
  chemically synthesized
actgcagaacaatggacaag

SEQ ID NO: 555718 - DNA, 20 bp, Artificial Sequence
  chemically synthesized
ccatcctagtttacagatga

SEQ ID NO: 555719 - DNA, 20 bp, Artificial Sequence
  chemically synthesized
agcaattgctcggaaaattg

SEQ ID NO: 555720 - DNA, 20 bp, Artificial Sequence
  chemically synthesized
ttctggtttctgggctttgg

SEQ ID NO: 555721 - DNA, 20 bp, Artificial Sequence
  chemically synthesized
ttctgccatcatcgttccac

SEQ ID NO: 555722 - DNA, 20 bp, Artificial Sequence
  chemically synthesized
aaagttaaaaaaaaaaaaaa

SEQ ID NO: 555723 - DNA, 20 bp, Artificial Sequence
  chemically synthesized
aacctcatttctcctctgtg

SEQ ID NO: 555724 - DNA, 20 bp, Artificial Sequence
  chemically synthesized
taactgagctttgaagaata

SEQ ID NO: 555725 - DNA, 20 bp, Artificial Sequence
  chemically synthesized
tcttccctccttgtgtgaat

SEQ ID NO: 555726 - DNA, 20 bp, Artificial Sequence
  chemically synthesized
gtgtgaattaaaacgaccta

SEQ ID NO: 555727 - DNA, 20 bp, Artificial Sequence
  chemically synthesized
ggggtctgaaaaggagctga

SEQ ID NO: 555728 - DNA, 20 bp, Artificial Sequence
  chemically synthesized
gcctggaagtgaccagtaga

SEQ ID NO: 555729 - DNA, 20 bp, Artificial Sequence
  chemically synthesized
agatgttacctgtagttcag

SEQ ID NO: 555730 - DNA, 20 bp, Artificial Sequence
  chemically synthesized
aaaaatggagactatgtttc

SEQ ID NO: 555731 - DNA, 20 bp, Artificial Sequence
  chemically synthesized
tgtttctaaaactgtgttca

SEQ ID NO: 555732 - DNA, 20 bp, Artificial Sequence
  chemically synthesized
attgtatcaatacattcata

SEQ ID NO: 555733 - DNA, 20 bp, Artificial Sequence
  chemically synthesized
taaaaatacatatgtacaca

SEQ ID NO: 555734 - DNA, 20 bp, Artificial Sequence
  chemically synthesized
aacatgaagctaccatatga

SEQ ID NO: 555735 - DNA, 20 bp, Artificial Sequence
  chemically synthesized
taaaatggtgaaacaacttt

SEQ ID NO: 555736 - DNA, 20 bp, Artificial Sequence
  chemically synthesized
attgtttaaaaaatgcaaat

SEQ ID NO: 555737 - DNA, 20 bp, Artificial Sequence
  chemically synthesized
tacttgtatcaagaatatat

SEQ ID NO: 555738 - DNA, 20 bp, Artificial Sequence
  chemically synthesized
aatttggactttaacaaaat

SEQ ID NO: 555739 - DNA, 20 bp, Artificial Sequence
  chemically synthesized
gcttttggtgtcatatctaa

SEQ ID NO: 555740 - DNA, 20 bp, Artificial Sequence
  chemically synthesized
attaataagaactaaaactt

SEQ ID NO: 555741 - DNA, 20 bp, Artificial Sequence
  chemically synthesized
ctaaatatattaataagaac

SEQ ID NO: 555742 - DNA, 20 bp, Artificial Sequence
  chemically synthesized
agtttattttacaaaagttt

SEQ ID NO: 555743 - DNA, 20 bp, Artificial Sequence
  chemically synthesized
aaattaaaaataaaatgttt

SEQ ID NO: 555744 - DNA, 20 bp, Artificial Sequence
  chemically synthesized
aggttgtgtcataaagtctc

SEQ ID NO: 555745 - DNA, 20 bp, Artificial Sequence
  chemically synthesized
gatgttgatcaaaaggggtt

SEQ ID NO: 555746 - DNA, 20 bp, Artificial Sequence
  chemically synthesized
tggtagctcctcaaaaaact

SEQ ID NO: 555747 - DNA, 20 bp, Artificial Sequence
  chemically synthesized
aacagtatggtagctcctca

SEQ ID NO: 555748 - DNA, 20 bp, Artificial Sequence
  chemically synthesized
aataatctgattaaaatggg

SEQ ID NO: 555749 - DNA, 20 bp, Artificial Sequence
  chemically synthesized
agcttaaatgtatcataaaa

SEQ ID NO: 555750 - DNA, 20 bp, Artificial Sequence
  chemically synthesized
ggagttaactttccaatttc

SEQ ID NO: 555751 - DNA, 20 bp, Artificial Sequence
  chemically synthesized
tgcaagggatgtagaatagt

SEQ ID NO: 555752 - DNA, 20 bp, Artificial Sequence
  chemically synthesized
caatggcatcaaaaaatgtt

SEQ ID NO: 555753 - DNA, 20 bp, Artificial Sequence
  chemically synthesized
aatttgcgtagctgggtaga

SEQ ID NO: 555754 - DNA, 20 bp, Artificial Sequence
  chemically synthesized
tgctacagttgcaagacaag

SEQ ID NO: 555755 - DNA, 20 bp, Artificial Sequence
  chemically synthesized
ataaaggcactgaccacggg

SEQ ID NO: 555756 - DNA, 20 bp, Artificial Sequence
  chemically synthesized
gggggacactattcaatcca

SEQ ID NO: 555757 - DNA, 20 bp, Artificial Sequence
  chemically synthesized
gaccatcctggctaacacgg

SEQ ID NO: 555758 - DNA, 20 bp, Artificial Sequence
  chemically synthesized
aaaattcatgtgacaaagta

SEQ ID NO: 555759 - DNA, 20 bp, Artificial Sequence
  chemically synthesized
accagacaaagatatcacaa

SEQ ID NO: 555760 - DNA, 20 bp, Artificial Sequence
  chemically synthesized
caagaaattgaattggtatt

SEQ ID NO: 555761 - DNA, 20 bp, Artificial Sequence
  chemically synthesized
ttctttcctaaccaatcagc

SEQ ID NO: 555762 - DNA, 20 bp, Artificial Sequence
  chemically synthesized
aatataatagaaaaaatcaa

SEQ ID NO: 555763 - DNA, 20 bp, Artificial Sequence
  chemically synthesized
gaaataaaaatacaatatac

SEQ ID NO: 555764 - DNA, 20 bp, Artificial Sequence
  chemically synthesized
attaaggaaatacagaaagc

SEQ ID NO: 555765 - DNA, 20 bp, Artificial Sequence
  chemically synthesized
agataaacataggtctggag

SEQ ID NO: 555766 - DNA, 20 bp, Artificial Sequence
  chemically synthesized
cttgcaaccataatagctgt

SEQ ID NO: 555767 - DNA, 20 bp, Artificial Sequence
  chemically synthesized
tgacgggaaaggccaactta

SEQ ID NO: 555768 - DNA, 20 bp, Artificial Sequence
  chemically synthesized
agtgaaaccctgtctctact

SEQ ID NO: 555769 - DNA, 20 bp, Artificial Sequence
  chemically synthesized
gtttcctaaagaatgccttc

SEQ ID NO: 555770 - DNA, 20 bp, Artificial Sequence
  chemically synthesized
tgatttggctatataatatt

SEQ ID NO: 555771 - DNA, 20 bp, Artificial Sequence
  chemically synthesized
actcttagctcagccaagca

SEQ ID NO: 555772 - DNA, 20 bp, Artificial Sequence
  chemically synthesized
aaaaaggggatttctctttc

SEQ ID NO: 555773 - DNA, 20 bp, Artificial Sequence
  chemically synthesized
tgacaggggaaaaaataaat

SEQ ID NO: 555774 - DNA, 20 bp, Artificial Sequence
  chemically synthesized
tgacactggaaaagaaagtt

SEQ ID NO: 555775 - DNA, 20 bp, Artificial Sequence
  chemically synthesized
aatagtatgccattggcacc

SEQ ID NO: 555776 - DNA, 20 bp, Artificial Sequence
  chemically synthesized
tagaaagacagatgttaggc

SEQ ID NO: 555777 - DNA, 20 bp, Artificial Sequence
  chemically synthesized
cccttaattttttctaaaac

SEQ ID NO: 555778 - DNA, 20 bp, Artificial Sequence
  chemically synthesized
ctttcacccttaattttttc

SEQ ID NO: 555779 - DNA, 20 bp, Artificial Sequence
  chemically synthesized
agaaaaaattaagggtgaaa

SEQ ID NO: 555780 - DNA, 20 bp, Artificial Sequence
  chemically synthesized
ggagagtcttgatttggtga

SEQ ID NO: 555781 - DNA, 20 bp, Artificial Sequence
  chemically synthesized
acctattcacagaacagaaa

SEQ ID NO: 555782 - DNA, 20 bp, Artificial Sequence
  chemically synthesized
cctgtctctactaaaaatac

SEQ ID NO: 555783 - DNA, 20 bp, Artificial Sequence
  chemically synthesized
ttgctggtctgacatttaga

SEQ ID NO: 555784 - DNA, 20 bp, Artificial Sequence
  chemically synthesized
tatattctttgatgaaaaaa

SEQ ID NO: 555785 - DNA, 20 bp, Artificial Sequence
  chemically synthesized
acgtggctaaaacaaagcaa

SEQ ID NO: 555786 - DNA, 20 bp, Artificial Sequence
  chemically synthesized
cttccaattgtctacgtggc

SEQ ID NO: 555787 - DNA, 20 bp, Artificial Sequence
  chemically synthesized
tattcttagtttgcagagaa

SEQ ID NO: 555788 - DNA, 20 bp, Artificial Sequence
  chemically synthesized
ttggtttatttcatcctttc

SEQ ID NO: 555789 - DNA, 20 bp, Artificial Sequence
  chemically synthesized
aaaaacgctttggaatggtc

SEQ ID NO: 555790 - DNA, 20 bp, Artificial Sequence
  chemically synthesized
aacttttgaaattaaaaaaa

SEQ ID NO: 555791 - DNA, 20 bp, Artificial Sequence
  chemically synthesized
gatgttttaatcacctaaaa

SEQ ID NO: 555792 - DNA, 20 bp, Artificial Sequence
  chemically synthesized
ctggttttattttaggtgat

SEQ ID NO: 555793 - DNA, 20 bp, Artificial Sequence
  chemically synthesized
aaacaaaacaattgcattgt

SEQ ID NO: 555794 - DNA, 20 bp, Artificial Sequence
  chemically synthesized
ggaaatatgaaagtagaaaa

SEQ ID NO: 555795 - DNA, 20 bp, Artificial Sequence
  chemically synthesized
cagaaggaaatatgaaagta

SEQ ID NO: 555796 - DNA, 20 bp, Artificial Sequence
  chemically synthesized
catctatgctcatccattga

SEQ ID NO: 555797 - DNA, 20 bp, Artificial Sequence
  chemically synthesized
aacatcctcatcatataaac

SEQ ID NO: 555798 - DNA, 20 bp, Artificial Sequence
  chemically synthesized
ataatttccaggcctggcca

SEQ ID NO: 555799 - DNA, 20 bp, Artificial Sequence
  chemically synthesized
gatcagattgggcacttgat

SEQ ID NO: 555800 - DNA, 20 bp, Artificial Sequence
  chemically synthesized
gcactatgcatgctgcttga

SEQ ID NO: 555801 - DNA, 20 bp, Artificial Sequence
  chemically synthesized
atcttaaagatggtgcaaca

SEQ ID NO: 555802 - DNA, 20 bp, Artificial Sequence
  chemically synthesized
ttcaagaacccatctctaca

SEQ ID NO: 555803 - DNA, 20 bp, Artificial Sequence
  chemically synthesized
ccaaataaatcacttgctct

SEQ ID NO: 555804 - DNA, 20 bp, Artificial Sequence
  chemically synthesized
tccagcctgggttacaagag

SEQ ID NO: 555805 - DNA, 20 bp, Artificial Sequence
  chemically synthesized
tctgtattatttttatttca

SEQ ID NO: 555806 - DNA, 20 bp, Artificial Sequence
  chemically synthesized
tatgaaataaaaataataca

SEQ ID NO: 555807 - DNA, 20 bp, Artificial Sequence
  chemically synthesized
ataatacagaaaacaagtaa

SEQ ID NO: 555808 - DNA, 20 bp, Artificial Sequence
  chemically synthesized
ttggggtagaatttacattc

SEQ ID NO: 555809 - DNA, 20 bp, Artificial Sequence
  chemically synthesized
attctaccccaattaaagat

SEQ ID NO: 555810 - DNA, 20 bp, Artificial Sequence
  chemically synthesized
gatcactgcactccctctta

SEQ ID NO: 555811 - DNA, 20 bp, Artificial Sequence
  chemically synthesized
atgtatatggcacaggaata

SEQ ID NO: 555812 - DNA, 20 bp, Artificial Sequence
  chemically synthesized
ctccagcctgggtgacagag

SEQ ID NO: 555813 - DNA, 20 bp, Artificial Sequence
  chemically synthesized
tcaggactagaaagacccca

SEQ ID NO: 555814 - DNA, 20 bp, Artificial Sequence
  chemically synthesized
aatatagtccccagaataat

SEQ ID NO: 555815 - DNA, 20 bp, Artificial Sequence
  chemically synthesized
aacagaaataaacctgataa

SEQ ID NO: 555816 - DNA, 20 bp, Artificial Sequence
  chemically synthesized
tgggtgtttgctatgtattg

SEQ ID NO: 555817 - DNA, 20 bp, Artificial Sequence
  chemically synthesized
aacaacaacaatgagacaca

SEQ ID NO: 555818 - DNA, 20 bp, Artificial Sequence
  chemically synthesized
agagcttgctatgtttatgt

SEQ ID NO: 555819 - DNA, 20 bp, Artificial Sequence
  chemically synthesized
ctacagttcatttcaatagg

SEQ ID NO: 555820 - DNA, 20 bp, Artificial Sequence
  chemically synthesized
gccattatgataagaacttg

SEQ ID NO: 555821 - DNA, 20 bp, Artificial Sequence
  chemically synthesized
aacctcccagtgaataggtc

SEQ ID NO: 555822 - DNA, 20 bp, Artificial Sequence
  chemically synthesized
ggttgtgaggaacacacaca

SEQ ID NO: 555823 - DNA, 20 bp, Artificial Sequence
  chemically synthesized
tacaacgtaaaaagaataaa

SEQ ID NO: 555824 - DNA, 20 bp, Artificial Sequence
  chemically synthesized
catggaaaagaaagattttc

SEQ ID NO: 555825 - DNA, 20 bp, Artificial Sequence
  chemically synthesized
caagttttccatatttggga

SEQ ID NO: 555826 - DNA, 20 bp, Artificial Sequence
  chemically synthesized
gaagttttttcccaaatatg

SEQ ID NO: 555827 - DNA, 20 bp, Artificial Sequence
  chemically synthesized
caaagagaggtctattgtgg

SEQ ID NO: 555828 - DNA, 20 bp, Artificial Sequence
  chemically synthesized
ctaaagccagggagatgagt

SEQ ID NO: 555829 - DNA, 20 bp, Artificial Sequence
  chemically synthesized
ttgttcgtgattctaaaaga

SEQ ID NO: 555830 - DNA, 20 bp, Artificial Sequence
  chemically synthesized
agagccatgcaatggagaag

SEQ ID NO: 555831 - DNA, 20 bp, Artificial Sequence
  chemically synthesized
atttccaaagcccatagaac

SEQ ID NO: 555832 - DNA, 20 bp, Artificial Sequence
  chemically synthesized
ataacactttgttaagattt

SEQ ID NO: 555833 - DNA, 20 bp, Artificial Sequence
  chemically synthesized
agtaaacaaacaaacaaaca

SEQ ID NO: 555834 - DNA, 20 bp, Artificial Sequence
  chemically synthesized
taaagtaaaaagtaaaaatt

SEQ ID NO: 555835 - DNA, 20 bp, Artificial Sequence
  chemically synthesized
tgagtccattttcaaattat

SEQ ID NO: 555836 - DNA, 20 bp, Artificial Sequence
  chemically synthesized
atcaaccacattcatttgta

SEQ ID NO: 555837 - DNA, 20 bp, Artificial Sequence
  chemically synthesized
ggtcaaataattcagtaagc

SEQ ID NO: 555838 - DNA, 20 bp, Artificial Sequence
  chemically synthesized
gagggccagtcattggagtc

SEQ ID NO: 555839 - DNA, 20 bp, Artificial Sequence
  chemically synthesized
acctacaagatccagacaca

SEQ ID NO: 555840 - DNA, 20 bp, Artificial Sequence
  chemically synthesized
caattctgttgatcttttca

SEQ ID NO: 555841 - DNA, 20 bp, Artificial Sequence
  chemically synthesized
ggaactggtatcattccttc

SEQ ID NO: 555842 - DNA, 20 bp, Artificial Sequence
  chemically synthesized
atataaacagaaccaacgac

SEQ ID NO: 555843 - DNA, 20 bp, Artificial Sequence
  chemically synthesized
attcaacagcccttcatgct

SEQ ID NO: 555844 - DNA, 20 bp, Artificial Sequence
  chemically synthesized
ccaatatcatactgaatggg

SEQ ID NO: 555845 - DNA, 20 bp, Artificial Sequence
  chemically synthesized
aaactggaagcattcccttt

SEQ ID NO: 555846 - DNA, 20 bp, Artificial Sequence
  chemically synthesized
acgacatgattgtatattta

SEQ ID NO: 555847 - DNA, 20 bp, Artificial Sequence
  chemically synthesized
actttcttcacagaattgga

SEQ ID NO: 555848 - DNA, 20 bp, Artificial Sequence
  chemically synthesized
tactacaaggctacggtaac

SEQ ID NO: 555849 - DNA, 20 bp, Artificial Sequence
  chemically synthesized
aaacagcatggtactggtac

SEQ ID NO: 555850 - DNA, 20 bp, Artificial Sequence
  chemically synthesized
tgatctttgacaaacctgac

SEQ ID NO: 555851 - DNA, 20 bp, Artificial Sequence
  chemically synthesized
tatttaataaatggtgctgg

SEQ ID NO: 555852 - DNA, 20 bp, Artificial Sequence
  chemically synthesized
tgaagacttaatgttagacc

SEQ ID NO: 555853 - DNA, 20 bp, Artificial Sequence
  chemically synthesized
aatgttagacctaaaaccat

SEQ ID NO: 555854 - DNA, 20 bp, Artificial Sequence
  chemically synthesized
aaaccataaaaaccctagaa

SEQ ID NO: 555855 - DNA, 20 bp, Artificial Sequence
  chemically synthesized
atgggcaaggacttcatgtc

SEQ ID NO: 555856 - DNA, 20 bp, Artificial Sequence
  chemically synthesized
aaagcaatggcaacaaaagc

SEQ ID NO: 555857 - DNA, 20 bp, Artificial Sequence
  chemically synthesized
actcaaacaaacttacaaga

SEQ ID NO: 555858 - DNA, 20 bp, Artificial Sequence
  chemically synthesized
gccatcagagaaacgcaaat

SEQ ID NO: 555859 - DNA, 20 bp, Artificial Sequence
  chemically synthesized
agcaaactatcacaaggaca

SEQ ID NO: 555860 - DNA, 20 bp, Artificial Sequence
  chemically synthesized
tggatactccgaggcttaca

SEQ ID NO: 555861 - DNA, 20 bp, Artificial Sequence
  chemically synthesized
ataatacatacatgaatgat

SEQ ID NO: 555862 - DNA, 20 bp, Artificial Sequence
  chemically synthesized
acccaaagtatactactaca

SEQ ID NO: 555863 - DNA, 20 bp, Artificial Sequence
  chemically synthesized
atactactacacaaaaccat

SEQ ID NO: 555864 - DNA, 20 bp, Artificial Sequence
  chemically synthesized
gtggattaacgacaacaaca

SEQ ID NO: 555865 - DNA, 20 bp, Artificial Sequence
  chemically synthesized
atagacagaaaaattcataa

SEQ ID NO: 555866 - DNA, 20 bp, Artificial Sequence
  chemically synthesized
acaagtctcaacaaatttaa

SEQ ID NO: 555867 - DNA, 20 bp, Artificial Sequence
  chemically synthesized
gtcttgagacaaacagaaat

SEQ ID NO: 555868 - DNA, 20 bp, Artificial Sequence
  chemically synthesized
gaaatgaaaacacaacatag

SEQ ID NO: 555869 - DNA, 20 bp, Artificial Sequence
  chemically synthesized
aacaatagaaaaaaagtcaa

SEQ ID NO: 555870 - DNA, 20 bp, Artificial Sequence
  chemically synthesized
caattgtgtttagcttttca

SEQ ID NO: 555871 - DNA, 20 bp, Artificial Sequence
  chemically synthesized
cttagaaatacataatctac

SEQ ID NO: 555872 - DNA, 20 bp, Artificial Sequence
  chemically synthesized
atctttctcaaactcttttg

SEQ ID NO: 555873 - DNA, 20 bp, Artificial Sequence
  chemically synthesized
gcaaagacactacaaggaaa

SEQ ID NO: 555874 - DNA, 20 bp, Artificial Sequence
  chemically synthesized
catataacagaatgaagtac

SEQ ID NO: 555875 - DNA, 20 bp, Artificial Sequence
  chemically synthesized
attcaacatccttttatgag

SEQ ID NO: 555876 - DNA, 20 bp, Artificial Sequence
  chemically synthesized
gctaacatcatgcacaacag

SEQ ID NO: 555877 - DNA, 20 bp, Artificial Sequence
  chemically synthesized
caaatcctaaggactccact

SEQ ID NO: 555878 - DNA, 20 bp, Artificial Sequence
  chemically synthesized
tattacaaagctataataat

SEQ ID NO: 555879 - DNA, 20 bp, Artificial Sequence
  chemically synthesized
aaacagcatggcaagtacat

SEQ ID NO: 555880 - DNA, 20 bp, Artificial Sequence
  chemically synthesized
tcttcaataaatggtattgg

SEQ ID NO: 555881 - DNA, 20 bp, Artificial Sequence
  chemically synthesized
ctgaatgttcacatacagaa

SEQ ID NO: 555882 - DNA, 20 bp, Artificial Sequence
  chemically synthesized
taaatgtaatacctgaaact

SEQ ID NO: 555883 - DNA, 20 bp, Artificial Sequence
  chemically synthesized
tacctgaaactaaaaactac

SEQ ID NO: 555884 - DNA, 20 bp, Artificial Sequence
  chemically synthesized
ctcaagctactcaataacaa

SEQ ID NO: 555885 - DNA, 20 bp, Artificial Sequence
  chemically synthesized
tatttgtgggatctaaaaat

SEQ ID NO: 555886 - DNA, 20 bp, Artificial Sequence
  chemically synthesized
ttcacattacatgcctatat

SEQ ID NO: 555887 - DNA, 20 bp, Artificial Sequence
  chemically synthesized
aaaaataaaaaaaaaatttt

SEQ ID NO: 555888 - DNA, 20 bp, Artificial Sequence
  chemically synthesized
ccataatatagttgtcgact

SEQ ID NO: 555889 - DNA, 20 bp, Artificial Sequence
  chemically synthesized
tagttattaatatattcacc

SEQ ID NO: 555890 - DNA, 20 bp, Artificial Sequence
  chemically synthesized
gattccttcatataatacac

SEQ ID NO: 555891 - DNA, 20 bp, Artificial Sequence
  chemically synthesized
aaaaacaggaaaaagtaata

SEQ ID NO: 555892 - DNA, 20 bp, Artificial Sequence
  chemically synthesized
ttgacaaaatgaaatacatt

SEQ ID NO: 555893 - DNA, 20 bp, Artificial Sequence
  chemically synthesized
acccaggagactgacagatc

SEQ ID NO: 555894 - DNA, 20 bp, Artificial Sequence
  chemically synthesized
aattaaacatagctagtcta

SEQ ID NO: 555895 - DNA, 20 bp, Artificial Sequence
  chemically synthesized
agtagactgttctccgaggc

SEQ ID NO: 555896 - DNA, 20 bp, Artificial Sequence
  chemically synthesized
gcatgatcaagaatgaagct

SEQ ID NO: 555897 - DNA, 20 bp, Artificial Sequence
  chemically synthesized
gatactttattctctatttg

SEQ ID NO: 555898 - DNA, 20 bp, Artificial Sequence
  chemically synthesized
atgtaacagatcaaaaagct

SEQ ID NO: 555899 - DNA, 20 bp, Artificial Sequence
  chemically synthesized
tttcacaaactgttagagct

SEQ ID NO: 555900 - DNA, 20 bp, Artificial Sequence
  chemically synthesized
gggctgggtgagttcttcac

SEQ ID NO: 555901 - DNA, 20 bp, Artificial Sequence
  chemically synthesized
acacaggtatacccattcat

SEQ ID NO: 555902 - DNA, 20 bp, Artificial Sequence
  chemically synthesized
aaaaaaaaaattctctcaca

SEQ ID NO: 555903 - DNA, 20 bp, Artificial Sequence
  chemically synthesized
aaagtggtgttagtgattca

SEQ ID NO: 555904 - DNA, 20 bp, Artificial Sequence
  chemically synthesized
acttatacgagtggaaatgg

SEQ ID NO: 555905 - DNA, 20 bp, Artificial Sequence
  chemically synthesized
atacacattgtgactttgag

SEQ ID NO: 555906 - DNA, 20 bp, Artificial Sequence
  chemically synthesized
tcattctcctgttttggtaa

SEQ ID NO: 555907 - DNA, 20 bp, Artificial Sequence
  chemically synthesized
acttccctatgttttattac

SEQ ID NO: 555908 - DNA, 20 bp, Artificial Sequence
  chemically synthesized
attatcctccaaccagtggt

SEQ ID NO: 555909 - DNA, 20 bp, Artificial Sequence
  chemically synthesized
gcattcacctatttaattaa

SEQ ID NO: 555910 - DNA, 20 bp, Artificial Sequence
  chemically synthesized
ttaaaatgaataattttttt

SEQ ID NO: 555911 - DNA, 20 bp, Artificial Sequence
  chemically synthesized
ccagcatgcaatgcacacaa

SEQ ID NO: 555912 - DNA, 20 bp, Artificial Sequence
  chemically synthesized
acttttacttgatgagtgca

SEQ ID NO: 555913 - DNA, 20 bp, Artificial Sequence
  chemically synthesized
gaaaacggaaattaaccccg

SEQ ID NO: 555914 - DNA, 20 bp, Artificial Sequence
  chemically synthesized
ttaagaaataaaaataaatg

SEQ ID NO: 555915 - DNA, 20 bp, Artificial Sequence
  chemically synthesized
aaccatgtttattttaagaa

SEQ ID NO: 555916 - DNA, 20 bp, Artificial Sequence
  chemically synthesized
tattttaagaagaaaacaac

SEQ ID NO: 555917 - DNA, 20 bp, Artificial Sequence
  chemically synthesized
gtaatttcagtggcaaaagc

SEQ ID NO: 555918 - DNA, 20 bp, Artificial Sequence
  chemically synthesized
caggtactgaagggatatct

SEQ ID NO: 555919 - DNA, 20 bp, Artificial Sequence
  chemically synthesized
ccagagagaatatgtaaagt

SEQ ID NO: 555920 - DNA, 20 bp, Artificial Sequence
  chemically synthesized
tcaagagacaattcttagct

SEQ ID NO: 555921 - DNA, 20 bp, Artificial Sequence
  chemically synthesized
tgaatcaagagggctgcttt

SEQ ID NO: 555922 - DNA, 20 bp, Artificial Sequence
  chemically synthesized
ttgcactccccatccttctt

SEQ ID NO: 555923 - DNA, 20 bp, Artificial Sequence
  chemically synthesized
cactgctttcaggatagtat

SEQ ID NO: 555924 - DNA, 20 bp, Artificial Sequence
  chemically synthesized
gtgaaagggaattatcagga

SEQ ID NO: 555925 - DNA, 20 bp, Artificial Sequence
  chemically synthesized
aaagccccattttcactctt

SEQ ID NO: 555926 - DNA, 20 bp, Artificial Sequence
  chemically synthesized
ttagactaaaatgctggtag

SEQ ID NO: 555927 - DNA, 20 bp, Artificial Sequence
  chemically synthesized
aataatccccattcaagtaa

SEQ ID NO: 555928 - DNA, 20 bp, Artificial Sequence
  chemically synthesized
gcttgggtttatgggaaaca

SEQ ID NO: 555929 - DNA, 20 bp, Artificial Sequence
  chemically synthesized
tgattttccaggaggtaaat

SEQ ID NO: 555930 - DNA, 20 bp, Artificial Sequence
  chemically synthesized
gaacagtgctttgtaaactg

SEQ ID NO: 555931 - DNA, 20 bp, Artificial Sequence
  chemically synthesized
aagggaagatcctatccttt

SEQ ID NO: 555932 - DNA, 20 bp, Artificial Sequence
  chemically synthesized
tcctatccttttaaaacata

SEQ ID NO: 555933 - DNA, 20 bp, Artificial Sequence
  chemically synthesized
atgcatcactaattaaaagg

SEQ ID NO: 555934 - DNA, 20 bp, Artificial Sequence
  chemically synthesized
acaccgtctaatctgggctt

SEQ ID NO: 555935 - DNA, 20 bp, Artificial Sequence
  chemically synthesized
ggagggcaaaaaagatgcag

SEQ ID NO: 555936 - DNA, 20 bp, Artificial Sequence
  chemically synthesized
tgggaaatgaacagggttat

SEQ ID NO: 555937 - DNA, 20 bp, Artificial Sequence
  chemically synthesized
gttaaaaaaaaaaaaaaaag

SEQ ID NO: 555938 - DNA, 20 bp, Artificial Sequence
  chemically synthesized
tgctaaaagttagaattttg

SEQ ID NO: 555939 - DNA, 20 bp, Artificial Sequence
  chemically synthesized
tgcttttctatcatttccac

SEQ ID NO: 555940 - DNA, 20 bp, Artificial Sequence
  chemically synthesized
aaatggaccgtggaatatag

SEQ ID NO: 555941 - DNA, 20 bp, Artificial Sequence
  chemically synthesized
caactgcttgccagccaaga

SEQ ID NO: 555942 - DNA, 20 bp, Artificial Sequence
  chemically synthesized
gaattagcatagttgtgttc

SEQ ID NO: 555943 - DNA, 20 bp, Artificial Sequence
  chemically synthesized
aaaaataaaaagatttaaaa

SEQ ID NO: 555944 - DNA, 20 bp, Artificial Sequence
  chemically synthesized
ctatttactttgaacattaa

SEQ ID NO: 555945 - DNA, 20 bp, Artificial Sequence
  chemically synthesized
ttcatttttaagttaaaaaa

SEQ ID NO: 555946 - DNA, 20 bp, Artificial Sequence
  chemically synthesized
aacttttcatttttaagtta

SEQ ID NO: 555947 - DNA, 20 bp, Artificial Sequence
  chemically synthesized
gagggaggggagtgggttaa

SEQ ID NO: 555948 - DNA, 20 bp, Artificial Sequence
  chemically synthesized
aaagttgaaattaaaaaaaa

SEQ ID NO: 555949 - DNA, 20 bp, Artificial Sequence
  chemically synthesized
gagagaaggatataggattt

SEQ ID NO: 555950 - DNA, 20 bp, Artificial Sequence
  chemically synthesized
ctaaagcatgtctgtggtat

SEQ ID NO: 555951 - DNA, 20 bp, Artificial Sequence
  chemically synthesized
ctaattttgtaaaaaacaga

SEQ ID NO: 555952 - DNA, 20 bp, Artificial Sequence
  chemically synthesized
cataggatcctaattttgta

SEQ ID NO: 555953 - DNA, 20 bp, Artificial Sequence
  chemically synthesized
ttttataatactaatactat

SEQ ID NO: 555954 - DNA, 20 bp, Artificial Sequence
  chemically synthesized
cttcatccccaaaacccttt

SEQ ID NO: 555955 - DNA, 20 bp, Artificial Sequence
  chemically synthesized
catctgggttacttcatccc

SEQ ID NO: 555956 - DNA, 20 bp, Artificial Sequence
  chemically synthesized
ttatctgtcacagaacaata

SEQ ID NO: 555957 - DNA, 20 bp, Artificial Sequence
  chemically synthesized
gtatatggtggtggttgggg

SEQ ID NO: 555958 - DNA, 20 bp, Artificial Sequence
  chemically synthesized
aattcatctcagatggtaca

SEQ ID NO: 555959 - DNA, 20 bp, Artificial Sequence
  chemically synthesized
aaatttagttgttggctatg

SEQ ID NO: 555960 - DNA, 20 bp, Artificial Sequence
  chemically synthesized
atgaaaagggcacaatttta

SEQ ID NO: 555961 - DNA, 20 bp, Artificial Sequence
  chemically synthesized
tagtaatatttagatccact

SEQ ID NO: 555962 - DNA, 20 bp, Artificial Sequence
  chemically synthesized
ttagcttccaaaatcaatct

SEQ ID NO: 555963 - DNA, 20 bp, Artificial Sequence
  chemically synthesized
aatcaatctgaaaacatgct

SEQ ID NO: 555964 - DNA, 20 bp, Artificial Sequence
  chemically synthesized
gggagggggtacataaaaga

SEQ ID NO: 555965 - DNA, 20 bp, Artificial Sequence
  chemically synthesized
ctgggaaggtcttgccaatt

SEQ ID NO: 555966 - DNA, 20 bp, Artificial Sequence
  chemically synthesized
gaaatccaataggcaaaaaa

SEQ ID NO: 555967 - DNA, 20 bp, Artificial Sequence
  chemically synthesized
acaatacacagtttagaatg

SEQ ID NO: 555968 - DNA, 20 bp, Artificial Sequence
  chemically synthesized
tcatagaagagaggattaca

SEQ ID NO: 555969 - DNA, 20 bp, Artificial Sequence
  chemically synthesized
gtaatattttggttccacta

SEQ ID NO: 555970 - DNA, 20 bp, Artificial Sequence
  chemically synthesized
gtagatcagaggctggatct

SEQ ID NO: 555971 - DNA, 20 bp, Artificial Sequence
  chemically synthesized
tagattaagaacagtaccta

SEQ ID NO: 555972 - DNA, 20 bp, Artificial Sequence
  chemically synthesized
tgaatataaagttgattttg

SEQ ID NO: 555973 - DNA, 20 bp, Artificial Sequence
  chemically synthesized
tgttacataatttctatgtc

SEQ ID NO: 555974 - DNA, 20 bp, Artificial Sequence
  chemically synthesized
caacaagctatatggccatt

SEQ ID NO: 555975 - DNA, 20 bp, Artificial Sequence
  chemically synthesized
gagttctctgtaccctctca

SEQ ID NO: 555976 - DNA, 20 bp, Artificial Sequence
  chemically synthesized
agaaaaagaaagttttatta

SEQ ID NO: 555977 - DNA, 20 bp, Artificial Sequence
  chemically synthesized
tttggattagggttttttaa

SEQ ID NO: 555978 - DNA, 20 bp, Artificial Sequence
  chemically synthesized
aattaccctaaagaggttaa

SEQ ID NO: 555979 - DNA, 20 bp, Artificial Sequence
  chemically synthesized
tcgaatggtgtttatttttt

SEQ ID NO: 555980 - DNA, 20 bp, Artificial Sequence
  chemically synthesized
tccagcctgggcaacaagag

SEQ ID NO: 555981 - DNA, 20 bp, Artificial Sequence
  chemically synthesized
agagcaaaactccatctcaa

SEQ ID NO: 555982 - DNA, 20 bp, Artificial Sequence
  chemically synthesized
aaaactccatctcaacaaaa

SEQ ID NO: 555983 - DNA, 20 bp, Artificial Sequence
  chemically synthesized
tccatctcaacaaaacaaaa

SEQ ID NO: 555984 - DNA, 20 bp, Artificial Sequence
  chemically synthesized
ctcaacaaaacaaaacaaaa

SEQ ID NO: 555985 - DNA, 20 bp, Artificial Sequence
  chemically synthesized
caaaacaaaacaaaacaaaa

SEQ ID NO: 555986 - DNA, 20 bp, Artificial Sequence
  chemically synthesized
caaaacaaaacaaaacaaac

SEQ ID NO: 555987 - DNA, 20 bp, Artificial Sequence
  chemically synthesized
caaaacaaaacaaacaaaaa

SEQ ID NO: 555988 - DNA, 20 bp, Artificial Sequence
  chemically synthesized
atgttagccttttatctttc

SEQ ID NO: 555989 - DNA, 20 bp, Artificial Sequence
  chemically synthesized
agcttggtattttggtaact

SEQ ID NO: 555990 - DNA, 20 bp, Artificial Sequence
  chemically synthesized
agacacataacctgctgtcc

SEQ ID NO: 555991 - DNA, 20 bp, Artificial Sequence
  chemically synthesized
aaaagtgtgccatgaagtga

SEQ ID NO: 555992 - DNA, 20 bp, Artificial Sequence
  chemically synthesized
gcacagaataagaatgaggg

SEQ ID NO: 555993 - DNA, 20 bp, Artificial Sequence
  chemically synthesized
gggccacagctggctctcag

SEQ ID NO: 555994 - DNA, 20 bp, Artificial Sequence
  chemically synthesized
tcattcagagaatcttgatg

SEQ ID NO: 555995 - DNA, 20 bp, Artificial Sequence
  chemically synthesized
tctcaacctccagaaccgtg

SEQ ID NO: 555996 - DNA, 20 bp, Artificial Sequence
  chemically synthesized
acagttaattttctcatctg

SEQ ID NO: 555997 - DNA, 20 bp, Artificial Sequence
  chemically synthesized
acaggagcttttttctcata

SEQ ID NO: 555998 - DNA, 20 bp, Artificial Sequence
  chemically synthesized
aactatattacttcagtggc

SEQ ID NO: 555999 - DNA, 20 bp, Artificial Sequence
  chemically synthesized
tgaaagaaacaagaacccac

SEQ ID NO: 556000 - DNA, 20 bp, Artificial Sequence
  chemically synthesized
tcttgtttctttcaagaaac

SEQ ID NO: 556001 - DNA, 20 bp, Artificial Sequence
  chemically synthesized
caacatgggatcatgtttca

SEQ ID NO: 556002 - DNA, 20 bp, Artificial Sequence
  chemically synthesized
atgtttcagaaaactcaggg

SEQ ID NO: 556003 - DNA, 20 bp, Artificial Sequence
  chemically synthesized
tgaatagttacctgttactg

SEQ ID NO: 556004 - DNA, 20 bp, Artificial Sequence
  chemically synthesized
tctgttgtacttgtcttaag

SEQ ID NO: 556005 - DNA, 20 bp, Artificial Sequence
  chemically synthesized
atggcatcatgcattttaga

SEQ ID NO: 556006 - DNA, 20 bp, Artificial Sequence
  chemically synthesized
ctttatcacaaaaaaggaag

SEQ ID NO: 556007 - DNA, 20 bp, Artificial Sequence
  chemically synthesized
tgaaaattaaacataataaa

SEQ ID NO: 556008 - DNA, 20 bp, Artificial Sequence
  chemically synthesized
taattttcaaggtggatgaa

SEQ ID NO: 556009 - DNA, 20 bp, Artificial Sequence
  chemically synthesized
aaaagaaacataatgaagac

SEQ ID NO: 556010 - DNA, 20 bp, Artificial Sequence
  chemically synthesized
gaagacaaaaacaattagta

SEQ ID NO: 556011 - DNA, 20 bp, Artificial Sequence
  chemically synthesized
taaattaagaggattaatat

SEQ ID NO: 556012 - DNA, 20 bp, Artificial Sequence
  chemically synthesized
aaatacatttatgaaaaatg

SEQ ID NO: 556013 - DNA, 20 bp, Artificial Sequence
  chemically synthesized
taacacaacgtataggaaga

SEQ ID NO: 556014 - DNA, 20 bp, Artificial Sequence
  chemically synthesized
tatataaaaactgatatata

SEQ ID NO: 556015 - DNA, 20 bp, Artificial Sequence
  chemically synthesized
agtaattgtaacttgtatat

SEQ ID NO: 556016 - DNA, 20 bp, Artificial Sequence
  chemically synthesized
actgtgagttttcagatgat

SEQ ID NO: 556017 - DNA, 20 bp, Artificial Sequence
  chemically synthesized
tatctaggttttcatcatct

SEQ ID NO: 556018 - DNA, 20 bp, Artificial Sequence
  chemically synthesized
atctgtcacacatcctttag

SEQ ID NO: 556019 - DNA, 20 bp, Artificial Sequence
  chemically synthesized
gagattttaaagaaatggtt

SEQ ID NO: 556020 - DNA, 20 bp, Artificial Sequence
  chemically synthesized
tttgacattgattgcatata

SEQ ID NO: 556021 - DNA, 20 bp, Artificial Sequence
  chemically synthesized
cattccactaagccctcatt

SEQ ID NO: 556022 - DNA, 20 bp, Artificial Sequence
  chemically synthesized
agtattacaaaatgttgaga

SEQ ID NO: 556023 - DNA, 20 bp, Artificial Sequence
  chemically synthesized
atgggttgacaaagctgcta

SEQ ID NO: 556024 - DNA, 20 bp, Artificial Sequence
  chemically synthesized
tcttctgtatgagaataaaa

SEQ ID NO: 556025 - DNA, 20 bp, Artificial Sequence
  chemically synthesized
caaaataaacgactccctct

SEQ ID NO: 556026 - DNA, 20 bp, Artificial Sequence
  chemically synthesized
ctactcccattttagagaca

SEQ ID NO: 556027 - DNA, 20 bp, Artificial Sequence
  chemically synthesized
gtgaagaggatttggaaaga

SEQ ID NO: 556028 - DNA, 20 bp, Artificial Sequence
  chemically synthesized
acggtaatagtttcatatag

SEQ ID NO: 556029 - DNA, 20 bp, Artificial Sequence
  chemically synthesized
tttatttctgtccttttcct

SEQ ID NO: 556030 - DNA, 20 bp, Artificial Sequence
  chemically synthesized
acaataaagagttaaacttt

SEQ ID NO: 556031 - DNA, 20 bp, Artificial Sequence
  chemically synthesized
catgtctttaggaagtgaat

SEQ ID NO: 556032 - DNA, 20 bp, Artificial Sequence
  chemically synthesized
aaggtcattaacaaaagcaa

SEQ ID NO: 556033 - DNA, 20 bp, Artificial Sequence
  chemically synthesized
aatccccattttatagacga

SEQ ID NO: 556034 - DNA, 20 bp, Artificial Sequence
  chemically synthesized
ctttgtagtgcaggaaggag

SEQ ID NO: 556035 - DNA, 20 bp, Artificial Sequence
  chemically synthesized
gatgcatgacaagtttcaat

SEQ ID NO: 556036 - DNA, 20 bp, Artificial Sequence
  chemically synthesized
tgtgtgtcccatgcttgtta

SEQ ID NO: 556037 - DNA, 20 bp, Artificial Sequence
  chemically synthesized
ttaccgctgcccaaaatttg

SEQ ID NO: 556038 - DNA, 20 bp, Artificial Sequence
  chemically synthesized
agtacaattgtgagaccagc

SEQ ID NO: 556039 - DNA, 20 bp, Artificial Sequence
  chemically synthesized
ttactgtataagggtttata

SEQ ID NO: 556040 - DNA, 20 bp, Artificial Sequence
  chemically synthesized
aattaaggtatatttatttt

SEQ ID NO: 556041 - DNA, 20 bp, Artificial Sequence
  chemically synthesized
catctgactagctctggttc

SEQ ID NO: 556042 - DNA, 20 bp, Artificial Sequence
  chemically synthesized
aaaaaatgagaaaatataga

SEQ ID NO: 556043 - DNA, 20 bp, Artificial Sequence
  chemically synthesized
tgatcaaaatttggcctttc

SEQ ID NO: 556044 - DNA, 20 bp, Artificial Sequence
  chemically synthesized
ggtaatagtaaaataatgca

SEQ ID NO: 556045 - DNA, 20 bp, Artificial Sequence
  chemically synthesized
agtttcacattctaacactg

SEQ ID NO: 556046 - DNA, 20 bp, Artificial Sequence
  chemically synthesized
aatatgttcaatagaatttt

SEQ ID NO: 556047 - DNA, 20 bp, Artificial Sequence
  chemically synthesized
caaacagtgaataatgtatc

SEQ ID NO: 556048 - DNA, 20 bp, Artificial Sequence
  chemically synthesized
caagcatgtcaacttagact

SEQ ID NO: 556049 - DNA, 20 bp, Artificial Sequence
  chemically synthesized
tatgcatttctaaaatattt

SEQ ID NO: 556050 - DNA, 20 bp, Artificial Sequence
  chemically synthesized
ttttttcattaagatattat

SEQ ID NO: 556051 - DNA, 20 bp, Artificial Sequence
  chemically synthesized
tttgagaagttctggaatta

SEQ ID NO: 556052 - DNA, 20 bp, Artificial Sequence
  chemically synthesized
ttcgagccacccacagatga

SEQ ID NO: 556053 - DNA, 20 bp, Artificial Sequence
  chemically synthesized
cacaaataacttaaagcgaa

SEQ ID NO: 556054 - DNA, 20 bp, Artificial Sequence
  chemically synthesized
ttctatcattctagaggaaa

SEQ ID NO: 556055 - DNA, 20 bp, Artificial Sequence
  chemically synthesized
gtcagctactgggctttact

SEQ ID NO: 556056 - DNA, 20 bp, Artificial Sequence
  chemically synthesized
cacctaaataatactcaaat

SEQ ID NO: 556057 - DNA, 20 bp, Artificial Sequence
  chemically synthesized
gattacagcatcctcaccag

SEQ ID NO: 556058 - DNA, 20 bp, Artificial Sequence
  chemically synthesized
ccaaatagagtggccaaatc

SEQ ID NO: 556059 - DNA, 20 bp, Artificial Sequence
  chemically synthesized
agaaaaaaaatatatatata

SEQ ID NO: 556060 - DNA, 20 bp, Artificial Sequence
  chemically synthesized
atgtctttgctattaagaaa

SEQ ID NO: 556061 - DNA, 20 bp, Artificial Sequence
  chemically synthesized
aatacctggcctctgttggt

SEQ ID NO: 556062 - DNA, 20 bp, Artificial Sequence
  chemically synthesized
ataattcctgttctcaaaga

SEQ ID NO: 556063 - DNA, 20 bp, Artificial Sequence
  chemically synthesized
ttttctttatttaaattata

SEQ ID NO: 556064 - DNA, 20 bp, Artificial Sequence
  chemically synthesized
gtatgaggagcagtggtgtt

SEQ ID NO: 556065 - DNA, 20 bp, Artificial Sequence
  chemically synthesized
ctttctgtcttccgtcatct

SEQ ID NO: 556066 - DNA, 20 bp, Artificial Sequence
  chemically synthesized
tgtagagcccagtgaaaaat

SEQ ID NO: 556067 - DNA, 20 bp, Artificial Sequence
  chemically synthesized
tgcagtttagtaaatgtttc

SEQ ID NO: 556068 - DNA, 20 bp, Artificial Sequence
  chemically synthesized
agctagtacacatagacaaa

SEQ ID NO: 556069 - DNA, 20 bp, Artificial Sequence
  chemically synthesized
gaacaataaaagttttaaat

SEQ ID NO: 556070 - DNA, 20 bp, Artificial Sequence
  chemically synthesized
attgactgatagtttttatt

SEQ ID NO: 556071 - DNA, 20 bp, Artificial Sequence
  chemically synthesized
gttgtccttgtgataaaatt

SEQ ID NO: 556072 - DNA, 20 bp, Artificial Sequence
  chemically synthesized
gaagcagcgaacttgcagaa

SEQ ID NO: 556073 - DNA, 20 bp, Artificial Sequence
  chemically synthesized
aaccgtttggaggttcctca

SEQ ID NO: 556074 - DNA, 20 bp, Artificial Sequence
  chemically synthesized
tatttgtgggatttaaaatt

SEQ ID NO: 556075 - DNA, 20 bp, Artificial Sequence
  chemically synthesized
tacacattgcatgcctgtat

SEQ ID NO: 556076 - DNA, 20 bp, Artificial Sequence
  chemically synthesized
atacacctgctaggtactca

SEQ ID NO: 556077 - DNA, 20 bp, Artificial Sequence
  chemically synthesized
aaaacttaaaaatataaaaa

SEQ ID NO: 556078 - DNA, 20 bp, Artificial Sequence
  chemically synthesized
ttattagctattcaaactta

SEQ ID NO: 556079 - DNA, 20 bp, Artificial Sequence
  chemically synthesized
ttgatattttggggagttaa

SEQ ID NO: 556080 - DNA, 20 bp, Artificial Sequence
  chemically synthesized
tacctaatgcattgggggct

SEQ ID NO: 556081 - DNA, 20 bp, Artificial Sequence
  chemically synthesized
cagaacttaaagtaaaatta

SEQ ID NO: 556082 - DNA, 20 bp, Artificial Sequence
  chemically synthesized
agtaatctcaaaaaaaaaaa

SEQ ID NO: 556083 - DNA, 20 bp, Artificial Sequence
  chemically synthesized
ttgatttacttgtcatttac

SEQ ID NO: 556084 - DNA, 20 bp, Artificial Sequence
  chemically synthesized
gcgaatctgatgcacatgat

SEQ ID NO: 556085 - DNA, 20 bp, Artificial Sequence
  chemically synthesized
gaatagctgtaatctcaagg

SEQ ID NO: 556086 - DNA, 20 bp, Artificial Sequence
  chemically synthesized
ggatctggataaagtaaact

SEQ ID NO: 556087 - DNA, 20 bp, Artificial Sequence
  chemically synthesized
tagtggtctggatagaggat

SEQ ID NO: 556088 - DNA, 20 bp, Artificial Sequence
  chemically synthesized
agtggagtagccagaacaca

SEQ ID NO: 556089 - DNA, 20 bp, Artificial Sequence
  chemically synthesized
gtcctcaaaagcaattataa

SEQ ID NO: 556090 - DNA, 20 bp, Artificial Sequence
  chemically synthesized
cttaaacaattcaacaagtc

SEQ ID NO: 556091 - DNA, 20 bp, Artificial Sequence
  chemically synthesized
aacatcagagaaatgcaaat

SEQ ID NO: 556092 - DNA, 20 bp, Artificial Sequence
  chemically synthesized
tgaagatttctcaaaggact

SEQ ID NO: 556093 - DNA, 20 bp, Artificial Sequence
  chemically synthesized
tactgggcatatagcccaaa

SEQ ID NO: 556094 - DNA, 20 bp, Artificial Sequence
  chemically synthesized
taaaacaaattgctttacta

SEQ ID NO: 556095 - DNA, 20 bp, Artificial Sequence
  chemically synthesized
agggagggaaacaagggttg

SEQ ID NO: 556096 - DNA, 20 bp, Artificial Sequence
  chemically synthesized
gagtgcagttcatgacatct

SEQ ID NO: 556097 - DNA, 20 bp, Artificial Sequence
  chemically synthesized
tgaaatattgagcaaattac

SEQ ID NO: 556098 - DNA, 20 bp, Artificial Sequence
  chemically synthesized
tgcaataaagtgaaacccaa

SEQ ID NO: 556099 - DNA, 20 bp, Artificial Sequence
  chemically synthesized
ttcaggacaaggagtagctt

SEQ ID NO: 556100 - DNA, 20 bp, Artificial Sequence
  chemically synthesized
ttgattaaatgtcctgtcat

SEQ ID NO: 556101 - DNA, 20 bp, Artificial Sequence
  chemically synthesized
tgtcctgtcatgaaaacatg

SEQ ID NO: 556102 - DNA, 20 bp, Artificial Sequence
  chemically synthesized
aattcaaccccattgcttgt

SEQ ID NO: 556103 - DNA, 20 bp, Artificial Sequence
  chemically synthesized
gtaggaatgtaagaatttaa

SEQ ID NO: 556104 - DNA, 20 bp, Artificial Sequence
  chemically synthesized
aaaataaaagtcaaagctaa

SEQ ID NO: 556105 - DNA, 20 bp, Artificial Sequence
  chemically synthesized
attcaaccttttcacgtttt

SEQ ID NO: 556106 - DNA, 20 bp, Artificial Sequence
  chemically synthesized
taatatcttcaaaatgtttt

SEQ ID NO: 556107 - DNA, 20 bp, Artificial Sequence
  chemically synthesized
tattcatttaagtactgaaa

SEQ ID NO: 556108 - DNA, 20 bp, Artificial Sequence
  chemically synthesized
tcctgtttcacacttatttg

SEQ ID NO: 556109 - DNA, 20 bp, Artificial Sequence
  chemically synthesized
gtaagagcaaatttctataa

SEQ ID NO: 556110 - DNA, 20 bp, Artificial Sequence
  chemically synthesized
atgattctgcttctctgtca

SEQ ID NO: 556111 - DNA, 20 bp, Artificial Sequence
  chemically synthesized
ataatgagaaacctgcctaa

SEQ ID NO: 556112 - DNA, 20 bp, Artificial Sequence
  chemically synthesized
ttttgctcaccttatacaaa

SEQ ID NO: 556113 - DNA, 20 bp, Artificial Sequence
  chemically synthesized
gcatgaggctaggcagagac

SEQ ID NO: 556114 - DNA, 20 bp, Artificial Sequence
  chemically synthesized
attctgtctactatcttaca

SEQ ID NO: 556115 - DNA, 20 bp, Artificial Sequence
  chemically synthesized
gaaggcttcaatccaaacta

SEQ ID NO: 556116 - DNA, 20 bp, Artificial Sequence
  chemically synthesized
ctaatacacacaagtaataa

SEQ ID NO: 556117 - DNA, 20 bp, Artificial Sequence
  chemically synthesized
gtagttacgatgtaaaagag

SEQ ID NO: 556118 - DNA, 20 bp, Artificial Sequence
  chemically synthesized
cacattgtgcacatgtaccc

SEQ ID NO: 556119 - DNA, 20 bp, Artificial Sequence
  chemically synthesized
agtaaactattgcaagaaca

SEQ ID NO: 556120 - DNA, 20 bp, Artificial Sequence
  chemically synthesized
gccatcagagaaatgcaaat

SEQ ID NO: 556121 - DNA, 20 bp, Artificial Sequence
  chemically synthesized
ctccaacaaatttacaagaa

SEQ ID NO: 556122 - DNA, 20 bp, Artificial Sequence
  chemically synthesized
atgggcaaggacttcatgtc

SEQ ID NO: 556123 - DNA, 20 bp, Artificial Sequence
  chemically synthesized
aaaccataaaaaccctagaa

SEQ ID NO: 556124 - DNA, 20 bp, Artificial Sequence
  chemically synthesized
aacgttagacctaaaaccat

SEQ ID NO: 556125 - DNA, 20 bp, Artificial Sequence
  chemically synthesized
aaagacttaaacgttagacc

SEQ ID NO: 556126 - DNA, 20 bp, Artificial Sequence
  chemically synthesized
tatttaataaatggtgctgg

SEQ ID NO: 556127 - DNA, 20 bp, Artificial Sequence
  chemically synthesized
tgatctttgacaaacctgag

SEQ ID NO: 556128 - DNA, 20 bp, Artificial Sequence
  chemically synthesized
aaacagcatggtactggtac

SEQ ID NO: 556129 - DNA, 20 bp, Artificial Sequence
  chemically synthesized
tagtacaaggctacagtaac

SEQ ID NO: 556130 - DNA, 20 bp, Artificial Sequence
  chemically synthesized
actatagaagcattcccttt

SEQ ID NO: 556131 - DNA, 20 bp, Artificial Sequence
  chemically synthesized
acgacatgattgtatatcta

SEQ ID NO: 556132 - DNA, 20 bp, Artificial Sequence
  chemically synthesized
actttcttcacagaattgga

SEQ ID NO: 556133 - DNA, 20 bp, Artificial Sequence
  chemically synthesized
tgattttaaaaagcagaagg

SEQ ID NO: 556134 - DNA, 20 bp, Artificial Sequence
  chemically synthesized
gaaatacaaattcatatggc

SEQ ID NO: 556135 - DNA, 20 bp, Artificial Sequence
  chemically synthesized
tgattacagacttaatggct

SEQ ID NO: 556136 - DNA, 20 bp, Artificial Sequence
  chemically synthesized
aggaggcaaaaaagcaaaca

SEQ ID NO: 556137 - DNA, 20 bp, Artificial Sequence
  chemically synthesized
tattgccttctgggatgcag

SEQ ID NO: 556138 - DNA, 20 bp, Artificial Sequence
  chemically synthesized
aatcttttcacttccataca

SEQ ID NO: 556139 - DNA, 20 bp, Artificial Sequence
  chemically synthesized
gcgaggcagcccctcaatcc

SEQ ID NO: 556140 - DNA, 20 bp, Artificial Sequence
  chemically synthesized
caatacccactctagctttt

SEQ ID NO: 556141 - DNA, 20 bp, Artificial Sequence
  chemically synthesized
atgttcatcattgtgctgta

SEQ ID NO: 556142 - DNA, 20 bp, Artificial Sequence
  chemically synthesized
caattctcttatttgcaaag

SEQ ID NO: 556143 - DNA, 20 bp, Artificial Sequence
  chemically synthesized
gccacttcacatagtatcaa

SEQ ID NO: 556144 - DNA, 20 bp, Artificial Sequence
  chemically synthesized
acagactattaaataaagat

SEQ ID NO: 556145 - DNA, 20 bp, Artificial Sequence
  chemically synthesized
ttagcggtctaactacaaaa

SEQ ID NO: 556146 - DNA, 20 bp, Artificial Sequence
  chemically synthesized
tatttttagcggtctaacta

SEQ ID NO: 556147 - DNA, 20 bp, Artificial Sequence
  chemically synthesized
tataagtatattatagatat

SEQ ID NO: 556148 - DNA, 20 bp, Artificial Sequence
  chemically synthesized
gtaacactaatctcataagt

SEQ ID NO: 556149 - DNA, 20 bp, Artificial Sequence
  chemically synthesized
tttttggtagataaccacag

SEQ ID NO: 556150 - DNA, 20 bp, Artificial Sequence
  chemically synthesized
gatctttaacgacctagtta

SEQ ID NO: 556151 - DNA, 20 bp, Artificial Sequence
  chemically synthesized
aaattactttatggagatgc

SEQ ID NO: 556152 - DNA, 20 bp, Artificial Sequence
  chemically synthesized
ttaggacatgtttggcaaat

SEQ ID NO: 556153 - DNA, 20 bp, Artificial Sequence
  chemically synthesized
ctctctgagtttctcccttt

SEQ ID NO: 556154 - DNA, 20 bp, Artificial Sequence
  chemically synthesized
tttctccctttcaaaacaag

SEQ ID NO: 556155 - DNA, 20 bp, Artificial Sequence
  chemically synthesized
tataaggtaaaaaaaaaaag

SEQ ID NO: 556156 - DNA, 20 bp, Artificial Sequence
  chemically synthesized
taaccaatacataattatat

SEQ ID NO: 556157 - DNA, 20 bp, Artificial Sequence
  chemically synthesized
tatataataaatattgcaac

SEQ ID NO: 556158 - DNA, 20 bp, Artificial Sequence
  chemically synthesized
catacacattttggagggac

SEQ ID NO: 556159 - DNA, 20 bp, Artificial Sequence
  chemically synthesized
tttctagaatgctcttaatc

SEQ ID NO: 556160 - DNA, 20 bp, Artificial Sequence
  chemically synthesized
aaactctccaaagtgtaggt

SEQ ID NO: 556161 - DNA, 20 bp, Artificial Sequence
  chemically synthesized
tttgtggccactgactttcg

SEQ ID NO: 556162 - DNA, 20 bp, Artificial Sequence
  chemically synthesized
cgcttttttggaagctctta

SEQ ID NO: 556163 - DNA, 20 bp, Artificial Sequence
  chemically synthesized
gaaaaatgatagacacttga

SEQ ID NO: 556164 - DNA, 20 bp, Artificial Sequence
  chemically synthesized
gtcaaaataacagtcatcct

SEQ ID NO: 556165 - DNA, 20 bp, Artificial Sequence
  chemically synthesized
tttattatttactaagatct

SEQ ID NO: 556166 - DNA, 20 bp, Artificial Sequence
  chemically synthesized
tattacagtttgttcaactg

SEQ ID NO: 556167 - DNA, 20 bp, Artificial Sequence
  chemically synthesized
tttgtttaaagtcaggcatc

SEQ ID NO: 556168 - DNA, 20 bp, Artificial Sequence
  chemically synthesized
tgctatttctacaaatacaa

SEQ ID NO: 556169 - DNA, 20 bp, Artificial Sequence
  chemically synthesized
tagtgttacgtaagtaatta

SEQ ID NO: 556170 - DNA, 20 bp, Artificial Sequence
  chemically synthesized
tgaaaaggtcaaataagctg

SEQ ID NO: 556171 - DNA, 20 bp, Artificial Sequence
  chemically synthesized
atttccaaaattgtcctaca

SEQ ID NO: 556172 - DNA, 20 bp, Artificial Sequence
  chemically synthesized
tcttagcaaagttttaaata

SEQ ID NO: 556173 - DNA, 20 bp, Artificial Sequence
  chemically synthesized
agttaacaatgttttatatt

SEQ ID NO: 556174 - DNA, 20 bp, Artificial Sequence
  chemically synthesized
tattttccattttaacggca

SEQ ID NO: 556175 - DNA, 20 bp, Artificial Sequence
  chemically synthesized
aggcaacattggtaaggaag

SEQ ID NO: 556176 - DNA, 20 bp, Artificial Sequence
  chemically synthesized
aggaagaaaaacttgatctt

SEQ ID NO: 556177 - DNA, 20 bp, Artificial Sequence
  chemically synthesized
tagcaatgataatcaaacaa

SEQ ID NO: 556178 - DNA, 20 bp, Artificial Sequence
  chemically synthesized
gaaagtatacactgagcaat

SEQ ID NO: 556179 - DNA, 20 bp, Artificial Sequence
  chemically synthesized
gtcttaataattcagaatat

SEQ ID NO: 556180 - DNA, 20 bp, Artificial Sequence
  chemically synthesized
tcaaggaaataaaatggaga

SEQ ID NO: 556181 - DNA, 20 bp, Artificial Sequence
  chemically synthesized
aaacagaactaagaagacag

SEQ ID NO: 556182 - DNA, 20 bp, Artificial Sequence
  chemically synthesized
cacatcatatttagctaagt

SEQ ID NO: 556183 - DNA, 20 bp, Artificial Sequence
  chemically synthesized
gaaaattggtaacttagtta

SEQ ID NO: 556184 - DNA, 20 bp, Artificial Sequence
  chemically synthesized
aagaaacacacctattcagt

SEQ ID NO: 556185 - DNA, 20 bp, Artificial Sequence
  chemically synthesized
tgtcagctcctgtttgtaag

SEQ ID NO: 556186 - DNA, 20 bp, Artificial Sequence
  chemically synthesized
tggcgacagagactccatct

SEQ ID NO: 556187 - DNA, 20 bp, Artificial Sequence
  chemically synthesized
cagagactccatctcaaaac

SEQ ID NO: 556188 - DNA, 20 bp, Artificial Sequence
  chemically synthesized
ctccatctcaaaacaaaaac

SEQ ID NO: 556189 - DNA, 20 bp, Artificial Sequence
  chemically synthesized
ctcaaaacaaaaacaaaaac

SEQ ID NO: 556190 - DNA, 20 bp, Artificial Sequence
  chemically synthesized
aaaaacaaaaacaaaaacaa

SEQ ID NO: 556191 - DNA, 20 bp, Artificial Sequence
  chemically synthesized
caaaaacaaaaacaacaaaa

SEQ ID NO: 556192 - DNA, 20 bp, Artificial Sequence
  chemically synthesized
cagggtcagtgcagcacctc

SEQ ID NO: 556193 - DNA, 20 bp, Artificial Sequence
  chemically synthesized
taaatttactgcatcgatgc

SEQ ID NO: 556194 - DNA, 20 bp, Artificial Sequence
  chemically synthesized
gactttcattcatcattgac

SEQ ID NO: 556195 - DNA, 20 bp, Artificial Sequence
  chemically synthesized
gtcatattccaaatactaag

SEQ ID NO: 556196 - DNA, 20 bp, Artificial Sequence
  chemically synthesized
agtgcgagactccatctcaa

SEQ ID NO: 556197 - DNA, 20 bp, Artificial Sequence
  chemically synthesized
gagactccatctcaaaaaaa

SEQ ID NO: 556198 - DNA, 20 bp, Artificial Sequence
  chemically synthesized
ccatctcaaaaaaacaaaac

SEQ ID NO: 556199 - DNA, 20 bp, Artificial Sequence
  chemically synthesized
caaaaaaacaaaacaaaaac

SEQ ID NO: 556200 - DNA, 20 bp, Artificial Sequence
  chemically synthesized
aaacaaaacaaaaacaaaaa

SEQ ID NO: 556201 - DNA, 20 bp, Artificial Sequence
  chemically synthesized
aaacaaaaacaaaaacaaaa

SEQ ID NO: 556202 - DNA, 20 bp, Artificial Sequence
  chemically synthesized
aaacaaaaacaaaacaaaac

SEQ ID NO: 556203 - DNA, 20 bp, Artificial Sequence
  chemically synthesized
ccagtacatactggaattaa

SEQ ID NO: 556204 - DNA, 20 bp, Artificial Sequence
  chemically synthesized
ttctaaaaaagaataaaata

SEQ ID NO: 556205 - DNA, 20 bp, Artificial Sequence
  chemically synthesized
ttccaacctgggcaatggaa

SEQ ID NO: 556206 - DNA, 20 bp, Artificial Sequence
  chemically synthesized
cccgtcctcattttcattta

SEQ ID NO: 556207 - DNA, 20 bp, Artificial Sequence
  chemically synthesized
cctgttgctttttttttttc

SEQ ID NO: 556208 - DNA, 20 bp, Artificial Sequence
  chemically synthesized
tcaattcatttatgaaattt

SEQ ID NO: 556209 - DNA, 20 bp, Artificial Sequence
  chemically synthesized
tttatgaaatttaaaaacat

SEQ ID NO: 556210 - DNA, 20 bp, Artificial Sequence
  chemically synthesized
tagagtgtatcctctataag

SEQ ID NO: 556211 - DNA, 20 bp, Artificial Sequence
  chemically synthesized
ttgttgaacgaaggaatgaa

SEQ ID NO: 556212 - DNA, 20 bp, Artificial Sequence
  chemically synthesized
taactttcagaaaattaaaa

SEQ ID NO: 556213 - DNA, 20 bp, Artificial Sequence
  chemically synthesized
cagattctacgtatttctat

SEQ ID NO: 556214 - DNA, 20 bp, Artificial Sequence
  chemically synthesized
aatcccactggtattttatg

SEQ ID NO: 556215 - DNA, 20 bp, Artificial Sequence
  chemically synthesized
tctgtcaaaatcttatcaag

SEQ ID NO: 556216 - DNA, 20 bp, Artificial Sequence
  chemically synthesized
attgttgatcgatgaaagag

SEQ ID NO: 556217 - DNA, 20 bp, Artificial Sequence
  chemically synthesized
tttctccatccaaattataa

SEQ ID NO: 556218 - DNA, 20 bp, Artificial Sequence
  chemically synthesized
ctgggtttgtgacaacagaa

SEQ ID NO: 556219 - DNA, 20 bp, Artificial Sequence
  chemically synthesized
tatttaaactaaaagcaata

SEQ ID NO: 556220 - DNA, 20 bp, Artificial Sequence
  chemically synthesized
acttaaaaattatgattttt

SEQ ID NO: 556221 - DNA, 20 bp, Artificial Sequence
  chemically synthesized
taaatatacactatacccac

SEQ ID NO: 556222 - DNA, 20 bp, Artificial Sequence
  chemically synthesized
tttagtaatcactctcaaag

SEQ ID NO: 556223 - DNA, 20 bp, Artificial Sequence
  chemically synthesized
tgatagattatgtcaaaaaa

SEQ ID NO: 556224 - DNA, 20 bp, Artificial Sequence
  chemically synthesized
tttttaaatggctgtattct

SEQ ID NO: 556225 - DNA, 20 bp, Artificial Sequence
  chemically synthesized
agctttagactttgaactca

SEQ ID NO: 556226 - DNA, 20 bp, Artificial Sequence
  chemically synthesized
cacaaatttgtaaactttct

SEQ ID NO: 556227 - DNA, 20 bp, Artificial Sequence
  chemically synthesized
acatgagctagaagggagca

SEQ ID NO: 556228 - DNA, 20 bp, Artificial Sequence
  chemically synthesized
ttagcacaaaggcattggaa

SEQ ID NO: 556229 - DNA, 20 bp, Artificial Sequence
  chemically synthesized
gcttttcactgaggtggaaa

SEQ ID NO: 556230 - DNA, 20 bp, Artificial Sequence
  chemically synthesized
gttggaattacctagctaga

SEQ ID NO: 556231 - DNA, 20 bp, Artificial Sequence
  chemically synthesized
tgagatattcctgaagaagg

SEQ ID NO: 556232 - DNA, 20 bp, Artificial Sequence
  chemically synthesized
ctgttggggctttcttcagg

SEQ ID NO: 556233 - DNA, 20 bp, Artificial Sequence
  chemically synthesized
cacacaatatcagagaagtt

SEQ ID NO: 556234 - DNA, 20 bp, Artificial Sequence
  chemically synthesized
aaagggctttataaactgaa

SEQ ID NO: 556235 - DNA, 20 bp, Artificial Sequence
  chemically synthesized
aaagttgggattgctttatt

SEQ ID NO: 556236 - DNA, 20 bp, Artificial Sequence
  chemically synthesized
atcgtctttaaatataggtc

SEQ ID NO: 556237 - DNA, 20 bp, Artificial Sequence
  chemically synthesized
gaacccagacaatgtaactt

SEQ ID NO: 556238 - DNA, 20 bp, Artificial Sequence
  chemically synthesized
tactttttttaaagcagaag

SEQ ID NO: 556239 - DNA, 20 bp, Artificial Sequence
  chemically synthesized
attaaagtactaccttttga

SEQ ID NO: 556240 - DNA, 20 bp, Artificial Sequence
  chemically synthesized
ttgaaagctgttacaagtga

SEQ ID NO: 556241 - DNA, 20 bp, Artificial Sequence
  chemically synthesized
aaaaatgcactatttgtatt

SEQ ID NO: 556242 - DNA, 20 bp, Artificial Sequence
  chemically synthesized
acttaaaaagagaaaagtaa

SEQ ID NO: 556243 - DNA, 20 bp, Artificial Sequence
  chemically synthesized
tatgttgggctgcgtagtgc

SEQ ID NO: 556244 - DNA, 20 bp, Artificial Sequence
  chemically synthesized
ggaaaatcttcattttaaag

SEQ ID NO: 556245 - DNA, 20 bp, Artificial Sequence
  chemically synthesized
tcttcttttttcctttttgc

SEQ ID NO: 556246 - DNA, 20 bp, Artificial Sequence
  chemically synthesized
atacatttaacaatttttta

SEQ ID NO: 556247 - DNA, 20 bp, Artificial Sequence
  chemically synthesized
tacattgtggaagtggtaaa

SEQ ID NO: 556248 - DNA, 20 bp, Artificial Sequence
  chemically synthesized
ttatttccctggcaaggtct

SEQ ID NO: 556249 - DNA, 20 bp, Artificial Sequence
  chemically synthesized
tattttttttttattcaaga

SEQ ID NO: 556250 - DNA, 20 bp, Artificial Sequence
  chemically synthesized
tattcaagaaaaaacaaagg

SEQ ID NO: 556251 - DNA, 20 bp, Artificial Sequence
  chemically synthesized
taaactggccagcagtgaag

SEQ ID NO: 556252 - DNA, 20 bp, Artificial Sequence
  chemically synthesized
agtatttcatgtctaaatag

SEQ ID NO: 556253 - DNA, 20 bp, Artificial Sequence
  chemically synthesized
cttactagccaggcgtttat

SEQ ID NO: 556254 - DNA, 20 bp, Artificial Sequence
  chemically synthesized
aattagttccttcattcata

SEQ ID NO: 556255 - DNA, 20 bp, Artificial Sequence
  chemically synthesized
tttttattctctctgacaat

SEQ ID NO: 556256 - DNA, 20 bp, Artificial Sequence
  chemically synthesized
agtcagatagctttgagaaa

SEQ ID NO: 556257 - DNA, 20 bp, Artificial Sequence
  chemically synthesized
gaagaatggaggctagaaca

SEQ ID NO: 556258 - DNA, 20 bp, Artificial Sequence
  chemically synthesized
gctaaaatcacctaactagt

SEQ ID NO: 556259 - DNA, 20 bp, Artificial Sequence
  chemically synthesized
gttttcatagttacacaggt

SEQ ID NO: 556260 - DNA, 20 bp, Artificial Sequence
  chemically synthesized
gttttcacctgtgtaactat

SEQ ID NO: 556261 - DNA, 20 bp, Artificial Sequence
  chemically synthesized
atacgctttctatacttctt

SEQ ID NO: 556262 - DNA, 20 bp, Artificial Sequence
  chemically synthesized
cttcttattctggtcctccc

SEQ ID NO: 556263 - DNA, 20 bp, Artificial Sequence
  chemically synthesized
tgataactagatttaagtaa

SEQ ID NO: 556264 - DNA, 20 bp, Artificial Sequence
  chemically synthesized
tagacactttcaaaatcctc

SEQ ID NO: 556265 - DNA, 20 bp, Artificial Sequence
  chemically synthesized
gggtctcaaggaatatactt

SEQ ID NO: 556266 - DNA, 20 bp, Artificial Sequence
  chemically synthesized
ttagagccatttctgttcag

SEQ ID NO: 556267 - DNA, 20 bp, Artificial Sequence
  chemically synthesized
tccagaggcaagtcttttta

SEQ ID NO: 556268 - DNA, 20 bp, Artificial Sequence
  chemically synthesized
aaaaaaaaatttcaggactt

SEQ ID NO: 556269 - DNA, 20 bp, Artificial Sequence
  chemically synthesized
aacaggttgctcagactgta

SEQ ID NO: 556270 - DNA, 20 bp, Artificial Sequence
  chemically synthesized
atggattcaggcactcttag

SEQ ID NO: 556271 - DNA, 20 bp, Artificial Sequence
  chemically synthesized
ttgagcaaaaaacaaacaaa

SEQ ID NO: 556272 - DNA, 20 bp, Artificial Sequence
  chemically synthesized
tggcataaggtgattgagca

SEQ ID NO: 556273 - DNA, 20 bp, Artificial Sequence
  chemically synthesized
tgtctgcttaactatggagg

SEQ ID NO: 556274 - DNA, 20 bp, Artificial Sequence
  chemically synthesized
aaaggagctactaaatcttt

SEQ ID NO: 556275 - DNA, 20 bp, Artificial Sequence
  chemically synthesized
aggagacctgtgaattacag

SEQ ID NO: 556276 - DNA, 20 bp, Artificial Sequence
  chemically synthesized
ggcacttagatgatgccaac

SEQ ID NO: 556277 - DNA, 20 bp, Artificial Sequence
  chemically synthesized
acctgttaaacacttgtacg

SEQ ID NO: 556278 - DNA, 20 bp, Artificial Sequence
  chemically synthesized
tgaagggtggtcatcaattg

SEQ ID NO: 556279 - DNA, 20 bp, Artificial Sequence
  chemically synthesized
ccaaaattctgagcacctta

SEQ ID NO: 556280 - DNA, 20 bp, Artificial Sequence
  chemically synthesized
tagagacaagactctgcagt

SEQ ID NO: 556281 - DNA, 20 bp, Artificial Sequence
  chemically synthesized
gatttagactgaattctgta

SEQ ID NO: 556282 - DNA, 20 bp, Artificial Sequence
  chemically synthesized
attatttttctgcttaaggt

SEQ ID NO: 556283 - DNA, 20 bp, Artificial Sequence
  chemically synthesized
attcattatataacaacttt

SEQ ID NO: 556284 - DNA, 20 bp, Artificial Sequence
  chemically synthesized
ttgcacctcattctaattgt

SEQ ID NO: 556285 - DNA, 20 bp, Artificial Sequence
  chemically synthesized
accactctggtgtggatagg

SEQ ID NO: 556286 - DNA, 20 bp, Artificial Sequence
  chemically synthesized
taattaataaggaattcacc

SEQ ID NO: 556287 - DNA, 20 bp, Artificial Sequence
  chemically synthesized
tacacagccaacaagcatct

SEQ ID NO: 556288 - DNA, 20 bp, Artificial Sequence
  chemically synthesized
gggaaatgcaaatgaagaac

SEQ ID NO: 556289 - DNA, 20 bp, Artificial Sequence
  chemically synthesized
gaaaaggtgtagccactatg

SEQ ID NO: 556290 - DNA, 20 bp, Artificial Sequence
  chemically synthesized
aaaaccgtatggaagttcct

SEQ ID NO: 556291 - DNA, 20 bp, Artificial Sequence
  chemically synthesized
tctgtatatccaaaagaatt

SEQ ID NO: 556292 - DNA, 20 bp, Artificial Sequence
  chemically synthesized
gagtttcggatttgagagat

SEQ ID NO: 556293 - DNA, 20 bp, Artificial Sequence
  chemically synthesized
acactactggtttgtacaca

SEQ ID NO: 556294 - DNA, 20 bp, Artificial Sequence
  chemically synthesized
taaaaaatgtggttgaaaaa

SEQ ID NO: 556295 - DNA, 20 bp, Artificial Sequence
  chemically synthesized
taatttaaaaaatgtggttg

SEQ ID NO: 556296 - DNA, 20 bp, Artificial Sequence
  chemically synthesized
agcaaactaacacaggaaca

SEQ ID NO: 556297 - DNA, 20 bp, Artificial Sequence
  chemically synthesized
gtcattagagaaatgcaaat

SEQ ID NO: 556298 - DNA, 20 bp, Artificial Sequence
  chemically synthesized
tttaatcaaatttacaagaa

SEQ ID NO: 556299 - DNA, 20 bp, Artificial Sequence
  chemically synthesized
tcatattacttctatgtatt

SEQ ID NO: 556300 - DNA, 20 bp, Artificial Sequence
  chemically synthesized
tcaaatatacccaaggagtg

SEQ ID NO: 556301 - DNA, 20 bp, Artificial Sequence
  chemically synthesized
tgtttactgacccagaacgt

SEQ ID NO: 556302 - DNA, 20 bp, Artificial Sequence
  chemically synthesized
tgttatgaattgcaggtatg

SEQ ID NO: 556303 - DNA, 20 bp, Artificial Sequence
  chemically synthesized
tggttttctacaagttaaat

SEQ ID NO: 556304 - DNA, 20 bp, Artificial Sequence
  chemically synthesized
atgtttttatttaacttgta

SEQ ID NO: 556305 - DNA, 20 bp, Artificial Sequence
  chemically synthesized
agagatcaaaatcaagggga

SEQ ID NO: 556306 - DNA, 20 bp, Artificial Sequence
  chemically synthesized
gtatgaaaggtaatcataaa

SEQ ID NO: 556307 - DNA, 20 bp, Artificial Sequence
  chemically synthesized
gttatttcaatagcataatt

SEQ ID NO: 556308 - DNA, 20 bp, Artificial Sequence
  chemically synthesized
acaataggaagtatgtgcat

SEQ ID NO: 556309 - DNA, 20 bp, Artificial Sequence
  chemically synthesized
ttgaaagcatgtattttatg

SEQ ID NO: 556310 - DNA, 20 bp, Artificial Sequence
  chemically synthesized
caaaataggctttaaaaatc

SEQ ID NO: 556311 - DNA, 20 bp, Artificial Sequence
  chemically synthesized
gatagagtggccaaatggat

SEQ ID NO: 556312 - DNA, 20 bp, Artificial Sequence
  chemically synthesized
aaggatctacaaaacaatta

SEQ ID NO: 556313 - DNA, 20 bp, Artificial Sequence
  chemically synthesized
catatagaacaaaggatcta

SEQ ID NO: 556314 - DNA, 20 bp, Artificial Sequence
  chemically synthesized
aatcaaagtatactactgag

SEQ ID NO: 556315 - DNA, 20 bp, Artificial Sequence
  chemically synthesized
aaacctatagtagcaaaagc

SEQ ID NO: 556316 - DNA, 20 bp, Artificial Sequence
  chemically synthesized
cgtaagatgtaaagaaaagc

SEQ ID NO: 556317 - DNA, 20 bp, Artificial Sequence
  chemically synthesized
gttaagttattaccagctta

SEQ ID NO: 556318 - DNA, 20 bp, Artificial Sequence
  chemically synthesized
aacttaactttgattgcata

SEQ ID NO: 556319 - DNA, 20 bp, Artificial Sequence
  chemically synthesized
tctatattaatccattattt

SEQ ID NO: 556320 - DNA, 20 bp, Artificial Sequence
  chemically synthesized
ctagggtttatcaaactaca

SEQ ID NO: 556321 - DNA, 20 bp, Artificial Sequence
  chemically synthesized
aatgaagaattttaccaatt

SEQ ID NO: 556322 - DNA, 20 bp, Artificial Sequence
  chemically synthesized
aattaggtgacttgaacaga

SEQ ID NO: 556323 - DNA, 20 bp, Artificial Sequence
  chemically synthesized
tgagtaagtaaattatttat

SEQ ID NO: 556324 - DNA, 20 bp, Artificial Sequence
  chemically synthesized
ttataaaaacgtaagctatc

SEQ ID NO: 556325 - DNA, 20 bp, Artificial Sequence
  chemically synthesized
acctatattttcatggcact

SEQ ID NO: 556326 - DNA, 20 bp, Artificial Sequence
  chemically synthesized
ttgggaagggatttatctgg

SEQ ID NO: 556327 - DNA, 20 bp, Artificial Sequence
  chemically synthesized
aaaaggttgaatagtttgcc

SEQ ID NO: 556328 - DNA, 20 bp, Artificial Sequence
  chemically synthesized
tggtaggatagggatggggg

SEQ ID NO: 556329 - DNA, 20 bp, Artificial Sequence
  chemically synthesized
ataatctaaataagaaatgg

SEQ ID NO: 556330 - DNA, 20 bp, Artificial Sequence
  chemically synthesized
ctaatggtagaacatatttt

SEQ ID NO: 556331 - DNA, 20 bp, Artificial Sequence
  chemically synthesized
agattatcaaagacacgaca

SEQ ID NO: 556332 - DNA, 20 bp, Artificial Sequence
  chemically synthesized
ccaccccatcctgtgcctat

SEQ ID NO: 556333 - DNA, 20 bp, Artificial Sequence
  chemically synthesized
aaaaggcaacattcgagcag

SEQ ID NO: 556334 - DNA, 20 bp, Artificial Sequence
  chemically synthesized
gaaaagggatggtccccagc

SEQ ID NO: 556335 - DNA, 20 bp, Artificial Sequence
  chemically synthesized
tgataaacccatcatacgtt

SEQ ID NO: 556336 - DNA, 20 bp, Artificial Sequence
  chemically synthesized
gttgaaaacatcataaattg

SEQ ID NO: 556337 - DNA, 20 bp, Artificial Sequence
  chemically synthesized
tgaaaaacccatcataagtt

SEQ ID NO: 556338 - DNA, 20 bp, Artificial Sequence
  chemically synthesized
taagccgaaccattgtaaat

SEQ ID NO: 556339 - DNA, 20 bp, Artificial Sequence
  chemically synthesized
tcaagatatagaattgtcgg

SEQ ID NO: 556340 - DNA, 20 bp, Artificial Sequence
  chemically synthesized
acagttggactggtttagac

SEQ ID NO: 556341 - DNA, 20 bp, Artificial Sequence
  chemically synthesized
atgaacaatgaaaatgattt

SEQ ID NO: 556342 - DNA, 20 bp, Artificial Sequence
  chemically synthesized
gtcctctaggtttaatttta

SEQ ID NO: 556343 - DNA, 20 bp, Artificial Sequence
  chemically synthesized
cttgtacactgcaaatccat

SEQ ID NO: 556344 - DNA, 20 bp, Artificial Sequence
  chemically synthesized
caagatgagctgagagacag

SEQ ID NO: 556345 - DNA, 20 bp, Artificial Sequence
  chemically synthesized
cattcagatagcatcttcta

SEQ ID NO: 556346 - DNA, 20 bp, Artificial Sequence
  chemically synthesized
gatgctatctgaatgaatga

SEQ ID NO: 556347 - DNA, 20 bp, Artificial Sequence
  chemically synthesized
aggaataaagaaagtgccag

SEQ ID NO: 556348 - DNA, 20 bp, Artificial Sequence
  chemically synthesized
agtgaccacagagatcactg

SEQ ID NO: 556349 - DNA, 20 bp, Artificial Sequence
  chemically synthesized
tacagaaccctagcaaaggg

SEQ ID NO: 556350 - DNA, 20 bp, Artificial Sequence
  chemically synthesized
tcaccatgtgatgcaattta

SEQ ID NO: 556351 - DNA, 20 bp, Artificial Sequence
  chemically synthesized
cttcagtaatccattgactt

SEQ ID NO: 556352 - DNA, 20 bp, Artificial Sequence
  chemically synthesized
aagtgaccaactggtttcaa

SEQ ID NO: 556353 - DNA, 20 bp, Artificial Sequence
  chemically synthesized
tttgagtctcaaaatcaagg

SEQ ID NO: 556354 - DNA, 20 bp, Artificial Sequence
  chemically synthesized
aaagacaaaacttctagaac

SEQ ID NO: 556355 - DNA, 20 bp, Artificial Sequence
  chemically synthesized
atttatgctcacaaaaaaga

SEQ ID NO: 556356 - DNA, 20 bp, Artificial Sequence
  chemically synthesized
ttatatgaaaggcagtaaag

SEQ ID NO: 556357 - DNA, 20 bp, Artificial Sequence
  chemically synthesized
aagttgggctagggtctatg

SEQ ID NO: 556358 - DNA, 20 bp, Artificial Sequence
  chemically synthesized
gagactgggtaatttatgaa

SEQ ID NO: 556359 - DNA, 20 bp, Artificial Sequence
  chemically synthesized
atgcagaatggtgaatcaat

SEQ ID NO: 556360 - DNA, 20 bp, Artificial Sequence
  chemically synthesized
ggggaaacgccagacactta

SEQ ID NO: 556361 - DNA, 20 bp, Artificial Sequence
  chemically synthesized
gatttgggtggggacacagc

SEQ ID NO: 556362 - DNA, 20 bp, Artificial Sequence
  chemically synthesized
aatctcatgtcatcacattt

SEQ ID NO: 556363 - DNA, 20 bp, Artificial Sequence
  chemically synthesized
cgcctatgagcctgaaaatc

SEQ ID NO: 556364 - DNA, 20 bp, Artificial Sequence
  chemically synthesized
gcaggggcagggccctcatg

SEQ ID NO: 556365 - DNA, 20 bp, Artificial Sequence
  chemically synthesized
caagcccagaggcctaaaag

SEQ ID NO: 556366 - DNA, 20 bp, Artificial Sequence
  chemically synthesized
ctaacaatgtgatagaaaag

SEQ ID NO: 556367 - DNA, 20 bp, Artificial Sequence
  chemically synthesized
tttgatgctctgcttccctt

SEQ ID NO: 556368 - DNA, 20 bp, Artificial Sequence
  chemically synthesized
atcaccatcggcattttggt

SEQ ID NO: 556369 - DNA, 20 bp, Artificial Sequence
  chemically synthesized
agggaaatgccagatgctta

SEQ ID NO: 556370 - DNA, 20 bp, Artificial Sequence
  chemically synthesized
ttgaagtataattgagaaat

SEQ ID NO: 556371 - DNA, 20 bp, Artificial Sequence
  chemically synthesized
caatatgtgcaatggcttta

SEQ ID NO: 556372 - DNA, 20 bp, Artificial Sequence
  chemically synthesized
aaaataagcactttcataag

SEQ ID NO: 556373 - DNA, 20 bp, Artificial Sequence
  chemically synthesized
aagcactttcataagcaaaa

SEQ ID NO: 556374 - DNA, 20 bp, Artificial Sequence
  chemically synthesized
atagtcttgatttgcctaga

SEQ ID NO: 556375 - DNA, 20 bp, Artificial Sequence
  chemically synthesized
aaaatcttgggggtcattct

SEQ ID NO: 556376 - DNA, 20 bp, Artificial Sequence
  chemically synthesized
tggatagctaagtggtgcta

SEQ ID NO: 556377 - DNA, 20 bp, Artificial Sequence
  chemically synthesized
ttgttgtctttgggtcccct

SEQ ID NO: 556378 - DNA, 20 bp, Artificial Sequence
  chemically synthesized
atccctaggaagcaagaatg

SEQ ID NO: 556379 - DNA, 20 bp, Artificial Sequence
  chemically synthesized
gttgaaggttgctcactcac

SEQ ID NO: 556380 - DNA, 20 bp, Artificial Sequence
  chemically synthesized
agagttaaccagcgttatga

SEQ ID NO: 556381 - DNA, 20 bp, Artificial Sequence
  chemically synthesized
cagttacctcagtggccttg

SEQ ID NO: 556382 - DNA, 20 bp, Artificial Sequence
  chemically synthesized
ttcagccagagtaatccctc

SEQ ID NO: 556383 - DNA, 20 bp, Artificial Sequence
  chemically synthesized
ttcagccatactgatatttt

SEQ ID NO: 556384 - DNA, 20 bp, Artificial Sequence
  chemically synthesized
cctagactcctagaaagtaa

SEQ ID NO: 556385 - DNA, 20 bp, Artificial Sequence
  chemically synthesized
attttttgatgctgagatag

SEQ ID NO: 556386 - DNA, 20 bp, Artificial Sequence
  chemically synthesized
tatataaaaggactcgagcc

SEQ ID NO: 556387 - DNA, 20 bp, Artificial Sequence
  chemically synthesized
tctattgactagtatttatc

SEQ ID NO: 556388 - DNA, 20 bp, Artificial Sequence
  chemically synthesized
aacaaagatcttctggcttg

SEQ ID NO: 556389 - DNA, 20 bp, Artificial Sequence
  chemically synthesized
ctttttacagaaaaaattgg

SEQ ID NO: 556390 - DNA, 20 bp, Artificial Sequence
  chemically synthesized
aaaattggcaaaacttcgac

SEQ ID NO: 556391 - DNA, 20 bp, Artificial Sequence
  chemically synthesized
ttagtgaaccctagagtgaa

SEQ ID NO: 556392 - DNA, 20 bp, Artificial Sequence
  chemically synthesized
ataaatctgaagcattatag

SEQ ID NO: 556393 - DNA, 20 bp, Artificial Sequence
  chemically synthesized
caccacagccaccgaacaaa

SEQ ID NO: 556394 - DNA, 20 bp, Artificial Sequence
  chemically synthesized
taaaagatttagatgtcatg

SEQ ID NO: 556395 - DNA, 20 bp, Artificial Sequence
  chemically synthesized
cctagagagaatggttatcc

SEQ ID NO: 556396 - DNA, 20 bp, Artificial Sequence
  chemically synthesized
taagtctgatgtaaatcagg

SEQ ID NO: 556397 - DNA, 20 bp, Artificial Sequence
  chemically synthesized
cccaccagctgaaagacaag

SEQ ID NO: 556398 - DNA, 20 bp, Artificial Sequence
  chemically synthesized
gtcagttgtattggaaaaaa

SEQ ID NO: 556399 - DNA, 20 bp, Artificial Sequence
  chemically synthesized
cttactaagttcagcatgat

SEQ ID NO: 556400 - DNA, 20 bp, Artificial Sequence
  chemically synthesized
cattcacttcagtatgacaa

SEQ ID NO: 556401 - DNA, 20 bp, Artificial Sequence
  chemically synthesized
tatgagagacaatattgaaa

SEQ ID NO: 556402 - DNA, 20 bp, Artificial Sequence
  chemically synthesized
atatatatagtttcctatat

SEQ ID NO: 556403 - DNA, 20 bp, Artificial Sequence
  chemically synthesized
cataattgttctccaatatt

SEQ ID NO: 556404 - DNA, 20 bp, Artificial Sequence
  chemically synthesized
aataattatcacaccttcaa

SEQ ID NO: 556405 - DNA, 20 bp, Artificial Sequence
  chemically synthesized
aagcactttggaaataagag

SEQ ID NO: 556406 - DNA, 20 bp, Artificial Sequence
  chemically synthesized
cacaacagaaaaatagtatg

SEQ ID NO: 556407 - DNA, 20 bp, Artificial Sequence
  chemically synthesized
gagtccccatggtctggcaa

SEQ ID NO: 556408 - DNA, 20 bp, Artificial Sequence
  chemically synthesized
gaacttaggttaggtagttg

SEQ ID NO: 556409 - DNA, 20 bp, Artificial Sequence
  chemically synthesized
taaaatcgacaattgaagta

SEQ ID NO: 556410 - DNA, 20 bp, Artificial Sequence
  chemically synthesized
ggtaaagttatattcaattt

SEQ ID NO: 556411 - DNA, 20 bp, Artificial Sequence
  chemically synthesized
catgtattcctaatatttcc

SEQ ID NO: 556412 - DNA, 20 bp, Artificial Sequence
  chemically synthesized
tggaaatggtaaccatgcaa

SEQ ID NO: 556413 - DNA, 20 bp, Artificial Sequence
  chemically synthesized
agttacaggctctaaacctt

SEQ ID NO: 556414 - DNA, 20 bp, Artificial Sequence
  chemically synthesized
aggtttagagcctgtaacta

SEQ ID NO: 556415 - DNA, 20 bp, Artificial Sequence
  chemically synthesized
taacagatgatttctctgct

SEQ ID NO: 556416 - DNA, 20 bp, Artificial Sequence
  chemically synthesized
agcaaactatcgcaaggaca

SEQ ID NO: 556417 - DNA, 20 bp, Artificial Sequence
  chemically synthesized
cacattgtgcacatgtaccc

SEQ ID NO: 556418 - DNA, 20 bp, Artificial Sequence
  chemically synthesized
agcaaaaataaataaataaa

SEQ ID NO: 556419 - DNA, 20 bp, Artificial Sequence
  chemically synthesized
ctatcaggagaacagcacag

SEQ ID NO: 556420 - DNA, 20 bp, Artificial Sequence
  chemically synthesized
tgcagggaaactgctcttta

SEQ ID NO: 556421 - DNA, 20 bp, Artificial Sequence
  chemically synthesized
gtatttcttcatagcagtat

SEQ ID NO: 556422 - DNA, 20 bp, Artificial Sequence
  chemically synthesized
taccagtgtttaatcaacta

SEQ ID NO: 556423 - DNA, 20 bp, Artificial Sequence
  chemically synthesized
gtgaaaccccgtctctacta

SEQ ID NO: 556424 - DNA, 20 bp, Artificial Sequence
  chemically synthesized
aaaaaaaaaaaaaaaaaaaa

SEQ ID NO: 556425 - DNA, 20 bp, Artificial Sequence
  chemically synthesized
gtgtataaatacggtgacaa

SEQ ID NO: 556426 - DNA, 20 bp, Artificial Sequence
  chemically synthesized
cttccacccgccctctcttg

SEQ ID NO: 556427 - DNA, 20 bp, Artificial Sequence
  chemically synthesized
caccccaaaacttaacagtt

SEQ ID NO: 556428 - DNA, 20 bp, Artificial Sequence
  chemically synthesized
attgttgcatagaagcaccc

SEQ ID NO: 556429 - DNA, 20 bp, Artificial Sequence
  chemically synthesized
aacatactggaaaaaaaaag

SEQ ID NO: 556430 - DNA, 20 bp, Artificial Sequence
  chemically synthesized
tgttgatttgtcctgataat

SEQ ID NO: 556431 - DNA, 20 bp, Artificial Sequence
  chemically synthesized
gtagtttggtttagtgttca

SEQ ID NO: 556432 - DNA, 20 bp, Artificial Sequence
  chemically synthesized
ttggtttagtgttcataaaa

SEQ ID NO: 556433 - DNA, 20 bp, Artificial Sequence
  chemically synthesized
ttttctacttcttaagtaga

SEQ ID NO: 556434 - DNA, 20 bp, Artificial Sequence
  chemically synthesized
tggagcaaccccgtctttac

SEQ ID NO: 556435 - DNA, 20 bp, Artificial Sequence
  chemically synthesized
aaaaagaaagaaagaaaaga

SEQ ID NO: 556436 - DNA, 20 bp, Artificial Sequence
  chemically synthesized
gatagtgtaaagcacagcca

SEQ ID NO: 556437 - DNA, 20 bp, Artificial Sequence
  chemically synthesized
tgtaaagcacagccacaaaa

SEQ ID NO: 556438 - DNA, 20 bp, Artificial Sequence
  chemically synthesized
cacaaatgttgaatgaaaaa

SEQ ID NO: 556439 - DNA, 20 bp, Artificial Sequence
  chemically synthesized
tgtctgttaagagaacatca

SEQ ID NO: 556440 - DNA, 20 bp, Artificial Sequence
  chemically synthesized
aataaaagtctctcctttca

SEQ ID NO: 556441 - DNA, 20 bp, Artificial Sequence
  chemically synthesized
ttatatatgttgctggaagt

SEQ ID NO: 556442 - DNA, 20 bp, Artificial Sequence
  chemically synthesized
tacacatggtaggaaggctc

SEQ ID NO: 556443 - DNA, 20 bp, Artificial Sequence
  chemically synthesized
ttcagagtttaacaaactta

SEQ ID NO: 556444 - DNA, 20 bp, Artificial Sequence
  chemically synthesized
gaacctaccagagacagcca

SEQ ID NO: 556445 - DNA, 20 bp, Artificial Sequence
  chemically synthesized
aaccaaaaattacagctcat

SEQ ID NO: 556446 - DNA, 20 bp, Artificial Sequence
  chemically synthesized
gtcccagattgacaaaaaaa

SEQ ID NO: 556447 - DNA, 20 bp, Artificial Sequence
  chemically synthesized
aaagcagacaaggcaaaaaa

SEQ ID NO: 556448 - DNA, 20 bp, Artificial Sequence
  chemically synthesized
gacaaggcaaaaaaaaaaac

SEQ ID NO: 556449 - DNA, 20 bp, Artificial Sequence
  chemically synthesized
caaaaaaaaaaacaaaaaca

SEQ ID NO: 556450 - DNA, 20 bp, Artificial Sequence
  chemically synthesized
ttccataattaggcagaact

SEQ ID NO: 556451 - DNA, 20 bp, Artificial Sequence
  chemically synthesized
ctctcaggggaaagaggcca

SEQ ID NO: 556452 - DNA, 20 bp, Artificial Sequence
  chemically synthesized
atagactgaaaatatgcagt

SEQ ID NO: 556453 - DNA, 20 bp, Artificial Sequence
  chemically synthesized
tatgcagtgaaaacaaaagt

SEQ ID NO: 556454 - DNA, 20 bp, Artificial Sequence
  chemically synthesized
aagaattgccttcggcctca

SEQ ID NO: 556455 - DNA, 20 bp, Artificial Sequence
  chemically synthesized
atttatcaattgctccatac

SEQ ID NO: 556456 - DNA, 20 bp, Artificial Sequence
  chemically synthesized
agtagagtgcaaacattagt

SEQ ID NO: 556457 - DNA, 20 bp, Artificial Sequence
  chemically synthesized
ttagtgaaaacaaaccaaca

SEQ ID NO: 556458 - DNA, 20 bp, Artificial Sequence
  chemically synthesized
tctctgatctcagggtgttt

SEQ ID NO: 556459 - DNA, 20 bp, Artificial Sequence
  chemically synthesized
cacagaaattggcaaacact

SEQ ID NO: 556460 - DNA, 20 bp, Artificial Sequence
  chemically synthesized
taagaaagctgcttgactag

SEQ ID NO: 556461 - DNA, 20 bp, Artificial Sequence
  chemically synthesized
ataggaatttacagtgatac

SEQ ID NO: 556462 - DNA, 20 bp, Artificial Sequence
  chemically synthesized
tgtgccagttactaagctta

SEQ ID NO: 556463 - DNA, 20 bp, Artificial Sequence
  chemically synthesized
gcgcttgaatggccccttct

SEQ ID NO: 556464 - DNA, 20 bp, Artificial Sequence
  chemically synthesized
aagggcatttcagacagaag

SEQ ID NO: 556465 - DNA, 20 bp, Artificial Sequence
  chemically synthesized
gggactattacattctcttc

SEQ ID NO: 556466 - DNA, 20 bp, Artificial Sequence
  chemically synthesized
ctgataaagcctccacaatg

SEQ ID NO: 556467 - DNA, 20 bp, Artificial Sequence
  chemically synthesized
agcactagactggatataaa

SEQ ID NO: 556468 - DNA, 20 bp, Artificial Sequence
  chemically synthesized
ataaaatgattgcacgcctg

SEQ ID NO: 556469 - DNA, 20 bp, Artificial Sequence
  chemically synthesized
gaccagcctgggcaacatgg

SEQ ID NO: 556470 - DNA, 20 bp, Artificial Sequence
  chemically synthesized
ggtgggcataagttaaaaag

SEQ ID NO: 556471 - DNA, 20 bp, Artificial Sequence
  chemically synthesized
agttaaaaagcaaaacacag

SEQ ID NO: 556472 - DNA, 20 bp, Artificial Sequence
  chemically synthesized
aaaacacagaaaaacaaaca

SEQ ID NO: 556473 - DNA, 20 bp, Artificial Sequence
  chemically synthesized
cccggccatgggtggatctt

SEQ ID NO: 556474 - DNA, 20 bp, Artificial Sequence
  chemically synthesized
ttacatcatgcattctggat

SEQ ID NO: 556475 - DNA, 20 bp, Artificial Sequence
  chemically synthesized
taatgcctctgattagtcag

SEQ ID NO: 556476 - DNA, 20 bp, Artificial Sequence
  chemically synthesized
aataggagacaatgaacatg

SEQ ID NO: 556477 - DNA, 20 bp, Artificial Sequence
  chemically synthesized
gacaatgaacatgaaaaact

SEQ ID NO: 556478 - DNA, 20 bp, Artificial Sequence
  chemically synthesized
ttatgcgctgctcaatgaag

SEQ ID NO: 556479 - DNA, 20 bp, Artificial Sequence
  chemically synthesized
catgttattttctaggtaac

SEQ ID NO: 556480 - DNA, 20 bp, Artificial Sequence
  chemically synthesized
tttttgtgaacagccaaatc

SEQ ID NO: 556481 - DNA, 20 bp, Artificial Sequence
  chemically synthesized
tttttgatttggctgttcac

SEQ ID NO: 556482 - DNA, 20 bp, Artificial Sequence
  chemically synthesized
aagtgaaaagcaaaatgaag

SEQ ID NO: 556483 - DNA, 20 bp, Artificial Sequence
  chemically synthesized
tgactacatctccataattt

SEQ ID NO: 556484 - DNA, 20 bp, Artificial Sequence
  chemically synthesized
gagtttggagctcttgtgcg

SEQ ID NO: 556485 - DNA, 20 bp, Artificial Sequence
  chemically synthesized
cactggtgctcctagcttta

SEQ ID NO: 556486 - DNA, 20 bp, Artificial Sequence
  chemically synthesized
actagacaggtcactgaaac

SEQ ID NO: 556487 - DNA, 20 bp, Artificial Sequence
  chemically synthesized
cttctcagaccacagtggaa

SEQ ID NO: 556488 - DNA, 20 bp, Artificial Sequence
  chemically synthesized
tcaactccaaaaggaaccct

SEQ ID NO: 556489 - DNA, 20 bp, Artificial Sequence
  chemically synthesized
ttaatagtgacacaatttat

SEQ ID NO: 556490 - DNA, 20 bp, Artificial Sequence
  chemically synthesized
caaaacctctgagatacagc

SEQ ID NO: 556491 - DNA, 20 bp, Artificial Sequence
  chemically synthesized
ctaaagcctaggtgaaagag

SEQ ID NO: 556492 - DNA, 20 bp, Artificial Sequence
  chemically synthesized
agtcagtatcaccctaatac

SEQ ID NO: 556493 - DNA, 20 bp, Artificial Sequence
  chemically synthesized
agtaaagtaactcaggaacg

SEQ ID NO: 556494 - DNA, 20 bp, Artificial Sequence
  chemically synthesized
tagaactcatccatgtaacc

SEQ ID NO: 556495 - DNA, 20 bp, Artificial Sequence
  chemically synthesized
ccaaaaaccacctatacccc

SEQ ID NO: 556496 - DNA, 20 bp, Artificial Sequence
  chemically synthesized
ttttccttgtcttaatgata

SEQ ID NO: 556497 - DNA, 20 bp, Artificial Sequence
  chemically synthesized
tctcaaactcaaatagagtt

SEQ ID NO: 556498 - DNA, 20 bp, Artificial Sequence
  chemically synthesized
caagagcgaaactccgtctc

SEQ ID NO: 556499 - DNA, 20 bp, Artificial Sequence
  chemically synthesized
tcatatctaagaaaaatgaa

SEQ ID NO: 556500 - DNA, 20 bp, Artificial Sequence
  chemically synthesized
acccattcacaaaatattag

SEQ ID NO: 556501 - DNA, 20 bp, Artificial Sequence
  chemically synthesized
atggtcccagctggatgtta

SEQ ID NO: 556502 - DNA, 20 bp, Artificial Sequence
  chemically synthesized
accttattgcagcaagagcg

SEQ ID NO: 556503 - DNA, 20 bp, Artificial Sequence
  chemically synthesized
cccatctctactaaaaatac

SEQ ID NO: 556504 - DNA, 20 bp, Artificial Sequence
  chemically synthesized
gaaataaatataattacact

SEQ ID NO: 556505 - DNA, 20 bp, Artificial Sequence
  chemically synthesized
atcaacatcttaacattttt

SEQ ID NO: 556506 - DNA, 20 bp, Artificial Sequence
  chemically synthesized
acaaactcattgggagaaaa

SEQ ID NO: 556507 - DNA, 20 bp, Artificial Sequence
  chemically synthesized
ttcatctagttaattaacaa

SEQ ID NO: 556508 - DNA, 20 bp, Artificial Sequence
  chemically synthesized
aataattcaagagcagtaag

SEQ ID NO: 556509 - DNA, 20 bp, Artificial Sequence
  chemically synthesized
ctcatttttaacttaagttg

SEQ ID NO: 556510 - DNA, 20 bp, Artificial Sequence
  chemically synthesized
tttagcagtttaaaagcagc

SEQ ID NO: 556511 - DNA, 20 bp, Artificial Sequence
  chemically synthesized
attaatgtaatatattatac

SEQ ID NO: 556512 - DNA, 20 bp, Artificial Sequence
  chemically synthesized
ttccaaatgcacctccccca

SEQ ID NO: 556513 - DNA, 20 bp, Artificial Sequence
  chemically synthesized
atgcacctcccccaaaaaac

SEQ ID NO: 556514 - DNA, 20 bp, Artificial Sequence
  chemically synthesized
gtattgctgggtgtcatgtt

SEQ ID NO: 556515 - DNA, 20 bp, Artificial Sequence
  chemically synthesized
gaaaaaaaaaaaggaaggaa

SEQ ID NO: 556516 - DNA, 20 bp, Artificial Sequence
  chemically synthesized
tccttctctttcacaaccct

SEQ ID NO: 556517 - DNA, 20 bp, Artificial Sequence
  chemically synthesized
atttttgctttcattatgta

SEQ ID NO: 556518 - DNA, 20 bp, Artificial Sequence
  chemically synthesized
agtctcttgtaagctgtaag

SEQ ID NO: 556519 - DNA, 20 bp, Artificial Sequence
  chemically synthesized
cctcatgtttaaaactgctt

SEQ ID NO: 556520 - DNA, 20 bp, Artificial Sequence
  chemically synthesized
atgaacctcgtcctcatgtt

SEQ ID NO: 556521 - DNA, 20 bp, Artificial Sequence
  chemically synthesized
ccattgattagctatttttt

SEQ ID NO: 556522 - DNA, 20 bp, Artificial Sequence
  chemically synthesized
agggcagcatttgtacaagg

SEQ ID NO: 556523 - DNA, 20 bp, Artificial Sequence
  chemically synthesized
attattgagattattgtagc

SEQ ID NO: 556524 - DNA, 20 bp, Artificial Sequence
  chemically synthesized
atactaaacacagaattttg

SEQ ID NO: 556525 - DNA, 20 bp, Artificial Sequence
  chemically synthesized
taattatttgatatttattt

SEQ ID NO: 556526 - DNA, 20 bp, Artificial Sequence
  chemically synthesized
gtcttactgccccttgccaa

SEQ ID NO: 556527 - DNA, 20 bp, Artificial Sequence
  chemically synthesized
cctatttggaattcagtaag

SEQ ID NO: 556528 - DNA, 20 bp, Artificial Sequence
  chemically synthesized
cttgaataccgcatttgcaa

SEQ ID NO: 556529 - DNA, 20 bp, Artificial Sequence
  chemically synthesized
agctatgatgaagctaatca

SEQ ID NO: 556530 - DNA, 20 bp, Artificial Sequence
  chemically synthesized
tgatattatcacatatgctg

SEQ ID NO: 556531 - DNA, 20 bp, Artificial Sequence
  chemically synthesized
aactcctttgcttcctcctt

SEQ ID NO: 556532 - DNA, 20 bp, Artificial Sequence
  chemically synthesized
gataattctttaggaatggt

SEQ ID NO: 556533 - DNA, 20 bp, Artificial Sequence
  chemically synthesized
cacatagtaagtgctaaaca

SEQ ID NO: 556534 - DNA, 20 bp, Artificial Sequence
  chemically synthesized
ttgattacaacaatgtctca

SEQ ID NO: 556535 - DNA, 20 bp, Artificial Sequence
  chemically synthesized
atgctaaatcatataaatgc

SEQ ID NO: 556536 - DNA, 20 bp, Artificial Sequence
  chemically synthesized
cttctactggaattacaaat

SEQ ID NO: 556537 - DNA, 20 bp, Artificial Sequence
  chemically synthesized
catatttcctatacaaatct

SEQ ID NO: 556538 - DNA, 20 bp, Artificial Sequence
  chemically synthesized
ctaaaaacttctatgagtat

SEQ ID NO: 556539 - DNA, 20 bp, Artificial Sequence
  chemically synthesized
ttttaatgtataaatactat

SEQ ID NO: 556540 - DNA, 20 bp, Artificial Sequence
  chemically synthesized
ttttcatagtatttatacat

SEQ ID NO: 556541 - DNA, 20 bp, Artificial Sequence
  chemically synthesized
tatctgcagagccaataagg

SEQ ID NO: 556542 - DNA, 20 bp, Artificial Sequence
  chemically synthesized
tggcctctaaatgttcaagg

SEQ ID NO: 556543 - DNA, 20 bp, Artificial Sequence
  chemically synthesized
tagtggtctggacagaagat

SEQ ID NO: 556544 - DNA, 20 bp, Artificial Sequence
  chemically synthesized
gatgttgtgttagcaggcat

SEQ ID NO: 556545 - DNA, 20 bp, Artificial Sequence
  chemically synthesized
agttgctacttatagatgag

SEQ ID NO: 556546 - DNA, 20 bp, Artificial Sequence
  chemically synthesized
aggagtagattctgtctcat

SEQ ID NO: 556547 - DNA, 20 bp, Artificial Sequence
  chemically synthesized
actatgccaatttcttagaa

SEQ ID NO: 556548 - DNA, 20 bp, Artificial Sequence
  chemically synthesized
gcacatgtaccccttaaatc

SEQ ID NO: 556549 - DNA, 20 bp, Artificial Sequence
  chemically synthesized
taaggaaggggcaagagttg

SEQ ID NO: 556550 - DNA, 20 bp, Artificial Sequence
  chemically synthesized
taaatgaattagtaggaaca

SEQ ID NO: 556551 - DNA, 20 bp, Artificial Sequence
  chemically synthesized
aatgcctattatcaaaaact

SEQ ID NO: 556552 - DNA, 20 bp, Artificial Sequence
  chemically synthesized
cagtcagaatgcctattatc

SEQ ID NO: 556553 - DNA, 20 bp, Artificial Sequence
  chemically synthesized
atcattagagaaatgcaaat

SEQ ID NO: 556554 - DNA, 20 bp, Artificial Sequence
  chemically synthesized
tctatagggaacttaacaag

SEQ ID NO: 556555 - DNA, 20 bp, Artificial Sequence
  chemically synthesized
gtccttaaaagcaaatgtaa

SEQ ID NO: 556556 - DNA, 20 bp, Artificial Sequence
  chemically synthesized
aaactagaagaatcgcagaa

SEQ ID NO: 556557 - DNA, 20 bp, Artificial Sequence
  chemically synthesized
aaagagaatgggacttctac

SEQ ID NO: 556558 - DNA, 20 bp, Artificial Sequence
  chemically synthesized
taaaaaacagtctgaagagt

SEQ ID NO: 556559 - DNA, 20 bp, Artificial Sequence
  chemically synthesized
ctaaaattcatatgaatcta

SEQ ID NO: 556560 - DNA, 20 bp, Artificial Sequence
  chemically synthesized
tcatttttcacagaattata

SEQ ID NO: 556561 - DNA, 20 bp, Artificial Sequence
  chemically synthesized
gatctctacagggctaacta

SEQ ID NO: 556562 - DNA, 20 bp, Artificial Sequence
  chemically synthesized
gtatacaatagtgtatgcct

SEQ ID NO: 556563 - DNA, 20 bp, Artificial Sequence
  chemically synthesized
acttcaaatccttatacaag

SEQ ID NO: 556564 - DNA, 20 bp, Artificial Sequence
  chemically synthesized
ttgactcatgtctccaacct

SEQ ID NO: 556565 - DNA, 20 bp, Artificial Sequence
  chemically synthesized
agactgaaacaagaacatgt

SEQ ID NO: 556566 - DNA, 20 bp, Artificial Sequence
  chemically synthesized
taaaccgagaacattggata

SEQ ID NO: 556567 - DNA, 20 bp, Artificial Sequence
  chemically synthesized
agcaactataacaaggtgag

SEQ ID NO: 556568 - DNA, 20 bp, Artificial Sequence
  chemically synthesized
aatgtgacatagaaaagcta

SEQ ID NO: 556569 - DNA, 20 bp, Artificial Sequence
  chemically synthesized
tattaacaagctacagttgc

SEQ ID NO: 556570 - DNA, 20 bp, Artificial Sequence
  chemically synthesized
gcagcatctgtgaaattaga

SEQ ID NO: 556571 - DNA, 20 bp, Artificial Sequence
  chemically synthesized
agagctattacaaggctatg

SEQ ID NO: 556572 - DNA, 20 bp, Artificial Sequence
  chemically synthesized
gaataaggcatggaggaaaa

SEQ ID NO: 556573 - DNA, 20 bp, Artificial Sequence
  chemically synthesized
gcttagagttactccatttc

SEQ ID NO: 556574 - DNA, 20 bp, Artificial Sequence
  chemically synthesized
gatgaaaagaggtagaaaaa

SEQ ID NO: 556575 - DNA, 20 bp, Artificial Sequence
  chemically synthesized
agaaattgagtacaagaaag

SEQ ID NO: 556576 - DNA, 20 bp, Artificial Sequence
  chemically synthesized
ataagtgccattcccttatt

SEQ ID NO: 556577 - DNA, 20 bp, Artificial Sequence
  chemically synthesized
tatatttagaagatcaattg

SEQ ID NO: 556578 - DNA, 20 bp, Artificial Sequence
  chemically synthesized
cagatcagcttatttgatta

SEQ ID NO: 556579 - DNA, 20 bp, Artificial Sequence
  chemically synthesized
atcaatgatagattagatag

SEQ ID NO: 556580 - DNA, 20 bp, Artificial Sequence
  chemically synthesized
tatgtaaactaagaaagcca

SEQ ID NO: 556581 - DNA, 20 bp, Artificial Sequence
  chemically synthesized
ctaagaaagccaaaaaacaa

SEQ ID NO: 556582 - DNA, 20 bp, Artificial Sequence
  chemically synthesized
tgacaattacaatattatag

SEQ ID NO: 556583 - DNA, 20 bp, Artificial Sequence
  chemically synthesized
atatgtgatttctgggacaa

SEQ ID NO: 556584 - DNA, 20 bp, Artificial Sequence
  chemically synthesized
aaatgaaggctgatggatgg

SEQ ID NO: 556585 - DNA, 20 bp, Artificial Sequence
  chemically synthesized
caaagggagacttaaaaaaa

SEQ ID NO: 556586 - DNA, 20 bp, Artificial Sequence
  chemically synthesized
tttggcaaatgaaatattac

SEQ ID NO: 556587 - DNA, 20 bp, Artificial Sequence
  chemically synthesized
actagatatgtaacagcgaa

SEQ ID NO: 556588 - DNA, 20 bp, Artificial Sequence
  chemically synthesized
acaaactttttgtgtcctca

SEQ ID NO: 556589 - DNA, 20 bp, Artificial Sequence
  chemically synthesized
gatcacatcactcctctgct

SEQ ID NO: 556590 - DNA, 20 bp, Artificial Sequence
  chemically synthesized
tttggatggaaggactttgt

SEQ ID NO: 556591 - DNA, 20 bp, Artificial Sequence
  chemically synthesized
aacctgaagccattattttg

SEQ ID NO: 556592 - DNA, 20 bp, Artificial Sequence
  chemically synthesized
caaatggcccatgaagcctc

SEQ ID NO: 556593 - DNA, 20 bp, Artificial Sequence
  chemically synthesized
tccacaatgtaaacatatat

SEQ ID NO: 556594 - DNA, 20 bp, Artificial Sequence
  chemically synthesized
ggcaaaaccccgtctgtact

SEQ ID NO: 556595 - DNA, 20 bp, Artificial Sequence
  chemically synthesized
gacgagcctggccaacatgg

SEQ ID NO: 556596 - DNA, 20 bp, Artificial Sequence
  chemically synthesized
aggttagcaaacattttcta

SEQ ID NO: 556597 - DNA, 20 bp, Artificial Sequence
  chemically synthesized
attactgtgagtaaagggtt

SEQ ID NO: 556598 - DNA, 20 bp, Artificial Sequence
  chemically synthesized
ttctagctcccttctcccta

SEQ ID NO: 556599 - DNA, 20 bp, Artificial Sequence
  chemically synthesized
tgaactataaatacctaatg

SEQ ID NO: 556600 - DNA, 20 bp, Artificial Sequence
  chemically synthesized
agtcttataattgattattg

SEQ ID NO: 556601 - DNA, 20 bp, Artificial Sequence
  chemically synthesized
ctatgacacgctatcattta

SEQ ID NO: 556602 - DNA, 20 bp, Artificial Sequence
  chemically synthesized
aatgatagcgtgtcatagtc

SEQ ID NO: 556603 - DNA, 20 bp, Artificial Sequence
  chemically synthesized
actctaatcaatggtatctt

SEQ ID NO: 556604 - DNA, 20 bp, Artificial Sequence
  chemically synthesized
attaccattttttcagatta

SEQ ID NO: 556605 - DNA, 20 bp, Artificial Sequence
  chemically synthesized
gagccgtaggattcatcaaa

SEQ ID NO: 556606 - DNA, 20 bp, Artificial Sequence
  chemically synthesized
catagtgaccaggcatgctg

SEQ ID NO: 556607 - DNA, 20 bp, Artificial Sequence
  chemically synthesized
tagaagttgctttttaaaga

SEQ ID NO: 556608 - DNA, 20 bp, Artificial Sequence
  chemically synthesized
acagaacctaatagtaaaaa

SEQ ID NO: 556609 - DNA, 20 bp, Artificial Sequence
  chemically synthesized
ttggtacagaacctaatagt

SEQ ID NO: 556610 - DNA, 20 bp, Artificial Sequence
  chemically synthesized
ccaaaatcatagtcattatc

SEQ ID NO: 556611 - DNA, 20 bp, Artificial Sequence
  chemically synthesized
aaactcgtatttttttaaaa

SEQ ID NO: 556612 - DNA, 20 bp, Artificial Sequence
  chemically synthesized
aaaatctgtccaacaaactt

SEQ ID NO: 556613 - DNA, 20 bp, Artificial Sequence
  chemically synthesized
acacgttcctgtgcttcact

SEQ ID NO: 556614 - DNA, 20 bp, Artificial Sequence
  chemically synthesized
tttggtaagcattaagaagg

SEQ ID NO: 556615 - DNA, 20 bp, Artificial Sequence
  chemically synthesized
aagctgtttaatgttcaaat

SEQ ID NO: 556616 - DNA, 20 bp, Artificial Sequence
  chemically synthesized
gcacaaataatatagttaat

SEQ ID NO: 556617 - DNA, 20 bp, Artificial Sequence
  chemically synthesized
ggggaaaatgatgtgaatag

SEQ ID NO: 556618 - DNA, 20 bp, Artificial Sequence
  chemically synthesized
aggatatatgaagtattact

SEQ ID NO: 556619 - DNA, 20 bp, Artificial Sequence
  chemically synthesized
ttaaagatgcatgtctctaa

SEQ ID NO: 556620 - DNA, 20 bp, Artificial Sequence
  chemically synthesized
atagatacttctcctaatgc

SEQ ID NO: 556621 - DNA, 20 bp, Artificial Sequence
  chemically synthesized
agacaaatatatatatttgt

SEQ ID NO: 556622 - DNA, 20 bp, Artificial Sequence
  chemically synthesized
ctctatcaggtgctgtgagg

SEQ ID NO: 556623 - DNA, 20 bp, Artificial Sequence
  chemically synthesized
tttgtaattatgatacctct

SEQ ID NO: 556624 - DNA, 20 bp, Artificial Sequence
  chemically synthesized
caaatattgattctcagaat

SEQ ID NO: 556625 - DNA, 20 bp, Artificial Sequence
  chemically synthesized
cacttgcaatttgcaatact

SEQ ID NO: 556626 - DNA, 20 bp, Artificial Sequence
  chemically synthesized
agggaggtaacttgcaagtt

SEQ ID NO: 556627 - DNA, 20 bp, Artificial Sequence
  chemically synthesized
ttttttttatgtactctaaa

SEQ ID NO: 556628 - DNA, 20 bp, Artificial Sequence
  chemically synthesized
ctttagagtacataaaaaaa

SEQ ID NO: 556629 - DNA, 20 bp, Artificial Sequence
  chemically synthesized
gtagtgaaggactgctaagt

SEQ ID NO: 556630 - DNA, 20 bp, Artificial Sequence
  chemically synthesized
ggtattctaactgcaaagaa

SEQ ID NO: 556631 - DNA, 20 bp, Artificial Sequence
  chemically synthesized
ttatttttccttgtgaaaat

SEQ ID NO: 556632 - DNA, 20 bp, Artificial Sequence
  chemically synthesized
aggttataacctgaaaacat

SEQ ID NO: 556633 - DNA, 20 bp, Artificial Sequence
  chemically synthesized
tagtcttaaggttataacct

SEQ ID NO: 556634 - DNA, 20 bp, Artificial Sequence
  chemically synthesized
actagaatctgtctgttgta

SEQ ID NO: 556635 - DNA, 20 bp, Artificial Sequence
  chemically synthesized
ctgttgtagaaaacattcat

SEQ ID NO: 556636 - DNA, 20 bp, Artificial Sequence
  chemically synthesized
tcattaaaacctttatcata

SEQ ID NO: 556637 - DNA, 20 bp, Artificial Sequence
  chemically synthesized
tatagtttacaacttgaagt

SEQ ID NO: 556638 - DNA, 20 bp, Artificial Sequence
  chemically synthesized
cccaaaagagaacattggca

SEQ ID NO: 556639 - DNA, 20 bp, Artificial Sequence
  chemically synthesized
ggaaggctacccaggaaact

SEQ ID NO: 556640 - DNA, 20 bp, Artificial Sequence
  chemically synthesized
actaattaactcattttcta

SEQ ID NO: 556641 - DNA, 20 bp, Artificial Sequence
  chemically synthesized
aaatgataacaacagttcca

SEQ ID NO: 556642 - DNA, 20 bp, Artificial Sequence
  chemically synthesized
ttcctgtttacaggagacta

SEQ ID NO: 556643 - DNA, 20 bp, Artificial Sequence
  chemically synthesized
gcccgcacccaggcgctcat

SEQ ID NO: 556644 - DNA, 20 bp, Artificial Sequence
  chemically synthesized
tggacttaaattcaattttt

SEQ ID NO: 556645 - DNA, 20 bp, Artificial Sequence
  chemically synthesized
aattatgatagagtggctaa

SEQ ID NO: 556646 - DNA, 20 bp, Artificial Sequence
  chemically synthesized
ttaaataaaaaggaataata

SEQ ID NO: 556647 - DNA, 20 bp, Artificial Sequence
  chemically synthesized
taacaatttgttggacatga

SEQ ID NO: 556648 - DNA, 20 bp, Artificial Sequence
  chemically synthesized
cagcagcaagttggtaccag

SEQ ID NO: 556649 - DNA, 20 bp, Artificial Sequence
  chemically synthesized
gatcagcctgggcaatatag

SEQ ID NO: 556650 - DNA, 20 bp, Artificial Sequence
  chemically synthesized
tgggactctgttagataagg

SEQ ID NO: 556651 - DNA, 20 bp, Artificial Sequence
  chemically synthesized
tgttttttctactcaactcc

SEQ ID NO: 556652 - DNA, 20 bp, Artificial Sequence
  chemically synthesized
ggtttttggagttgagtaga

SEQ ID NO: 556653 - DNA, 20 bp, Artificial Sequence
  chemically synthesized
aggcaacctaaactcaggag

SEQ ID NO: 556654 - DNA, 20 bp, Artificial Sequence
  chemically synthesized
tatcagtggaatgtgtcctg

SEQ ID NO: 556655 - DNA, 20 bp, Artificial Sequence
  chemically synthesized
tgatattttcatatccaata

SEQ ID NO: 556656 - DNA, 20 bp, Artificial Sequence
  chemically synthesized
gaacttcaatggcctcttcc

SEQ ID NO: 556657 - DNA, 20 bp, Artificial Sequence
  chemically synthesized
tgccactactgggggctctg

SEQ ID NO: 556658 - DNA, 20 bp, Artificial Sequence
  chemically synthesized
agtaagtcttattttataga

SEQ ID NO: 556659 - DNA, 20 bp, Artificial Sequence
  chemically synthesized
atataatcaatatatgtaaa

SEQ ID NO: 556660 - DNA, 20 bp, Artificial Sequence
  chemically synthesized
ttattctctttttccttaac

SEQ ID NO: 556661 - DNA, 20 bp, Artificial Sequence
  chemically synthesized
tgttaatagccaatgctggc

SEQ ID NO: 556662 - DNA, 20 bp, Artificial Sequence
  chemically synthesized
tatacgcacacacaaaattg

SEQ ID NO: 556663 - DNA, 20 bp, Artificial Sequence
  chemically synthesized
attacccaaaatataaaaaa

SEQ ID NO: 556664 - DNA, 20 bp, Artificial Sequence
  chemically synthesized
tttttagttctttccaaaga

SEQ ID NO: 556665 - DNA, 20 bp, Artificial Sequence
  chemically synthesized
ttttctctttggaaagaact

SEQ ID NO: 556666 - DNA, 20 bp, Artificial Sequence
  chemically synthesized
gggaagcatcagcataaacc

SEQ ID NO: 556667 - DNA, 20 bp, Artificial Sequence
  chemically synthesized
tcagaatgcatcatcttcag

SEQ ID NO: 556668 - DNA, 20 bp, Artificial Sequence
  chemically synthesized
gtatttagcaaacagaacat

SEQ ID NO: 556669 - DNA, 20 bp, Artificial Sequence
  chemically synthesized
tatagtcaagagtagctcct

SEQ ID NO: 556670 - DNA, 20 bp, Artificial Sequence
  chemically synthesized
ctaatataagccccttttgg

SEQ ID NO: 556671 - DNA, 20 bp, Artificial Sequence
  chemically synthesized
aagggtattttaggaacctg

SEQ ID NO: 556672 - DNA, 20 bp, Artificial Sequence
  chemically synthesized
ttggagataaagtatatata

SEQ ID NO: 556673 - DNA, 20 bp, Artificial Sequence
  chemically synthesized
ttcagcttgtgattcttcat

SEQ ID NO: 556674 - DNA, 20 bp, Artificial Sequence
  chemically synthesized
gacttggtgacactgagaac

SEQ ID NO: 556675 - DNA, 20 bp, Artificial Sequence
  chemically synthesized
acttgctgccctctggactc

SEQ ID NO: 556676 - DNA, 20 bp, Artificial Sequence
  chemically synthesized
gttcctaagtttttcaatgg

SEQ ID NO: 556677 - DNA, 20 bp, Artificial Sequence
  chemically synthesized
ggaaaccagttttcccattg

SEQ ID NO: 556678 - DNA, 20 bp, Artificial Sequence
  chemically synthesized
ttcttagagcatttactcta

SEQ ID NO: 556679 - DNA, 20 bp, Artificial Sequence
  chemically synthesized
cagacaagaaagactgtgtt

SEQ ID NO: 556680 - DNA, 20 bp, Artificial Sequence
  chemically synthesized
cataatgtcaaatccacact

SEQ ID NO: 556681 - DNA, 20 bp, Artificial Sequence
  chemically synthesized
agtgattcttgaggggagga

SEQ ID NO: 556682 - DNA, 20 bp, Artificial Sequence
  chemically synthesized
gaaagcattcattaaaggtt

SEQ ID NO: 556683 - DNA, 20 bp, Artificial Sequence
  chemically synthesized
agagtgaagtaccaagcaga

SEQ ID NO: 556684 - DNA, 20 bp, Artificial Sequence
  chemically synthesized
gtgctcagagtttgactaga

SEQ ID NO: 556685 - DNA, 20 bp, Artificial Sequence
  chemically synthesized
ttaacacaaggtaaaaaaaa

SEQ ID NO: 556686 - DNA, 20 bp, Artificial Sequence
  chemically synthesized
taaaaaaaagggcatgtgct

SEQ ID NO: 556687 - DNA, 20 bp, Artificial Sequence
  chemically synthesized
tatcctatatcttaaatcag

SEQ ID NO: 556688 - DNA, 20 bp, Artificial Sequence
  chemically synthesized
aagctagacaaagagggata

SEQ ID NO: 556689 - DNA, 20 bp, Artificial Sequence
  chemically synthesized
gagctgcttttttcctggca

SEQ ID NO: 556690 - DNA, 20 bp, Artificial Sequence
  chemically synthesized
tccctctcccctcagtgatt

SEQ ID NO: 556691 - DNA, 20 bp, Artificial Sequence
  chemically synthesized
aatgcaggttttcattattt

SEQ ID NO: 556692 - DNA, 20 bp, Artificial Sequence
  chemically synthesized
cggaatggttttcaaataat

SEQ ID NO: 556693 - DNA, 20 bp, Artificial Sequence
  chemically synthesized
ggggcaagactgggtgcgta

SEQ ID NO: 556694 - DNA, 20 bp, Artificial Sequence
  chemically synthesized
tagacatcatttcactagca

SEQ ID NO: 556695 - DNA, 20 bp, Artificial Sequence
  chemically synthesized
ccctttgctctcagttccag

SEQ ID NO: 556696 - DNA, 20 bp, Artificial Sequence
  chemically synthesized
tatttactgtccagtattgt

SEQ ID NO: 556697 - DNA, 20 bp, Artificial Sequence
  chemically synthesized
aaagtcaattaaataaaaga

SEQ ID NO: 556698 - DNA, 20 bp, Artificial Sequence
  chemically synthesized
ttttggcaaataaggagacg

SEQ ID NO: 556699 - DNA, 20 bp, Artificial Sequence
  chemically synthesized
ctgtctttattcattgactt

SEQ ID NO: 556700 - DNA, 20 bp, Artificial Sequence
  chemically synthesized
actctacttggggtacggaa

SEQ ID NO: 556701 - DNA, 20 bp, Artificial Sequence
  chemically synthesized
gaagtcatttaaagaagaga

SEQ ID NO: 556702 - DNA, 20 bp, Artificial Sequence
  chemically synthesized
gaatatgtattaagcacaat

SEQ ID NO: 556703 - DNA, 20 bp, Artificial Sequence
  chemically synthesized
ccaaggataaagggttcttg

SEQ ID NO: 556704 - DNA, 20 bp, Artificial Sequence
  chemically synthesized
ctaatacctttttggaattt

SEQ ID NO: 556705 - DNA, 20 bp, Artificial Sequence
  chemically synthesized
ttcaatgcgcatcctaaaat

SEQ ID NO: 556706 - DNA, 20 bp, Artificial Sequence
  chemically synthesized
actcacaaactatagctcac

SEQ ID NO: 556707 - DNA, 20 bp, Artificial Sequence
  chemically synthesized
gtgatgacgttggggttgaa

SEQ ID NO: 556708 - DNA, 20 bp, Artificial Sequence
  chemically synthesized
aggaggcattgagagttaga

SEQ ID NO: 556709 - DNA, 20 bp, Artificial Sequence
  chemically synthesized
cactcccatctctacaaaaa

SEQ ID NO: 556710 - DNA, 20 bp, Artificial Sequence
  chemically synthesized
ctctacaaaaaaaaaacaaa

SEQ ID NO: 556711 - DNA, 20 bp, Artificial Sequence
  chemically synthesized
aaaaaaaaacaaaaaaaaca

SEQ ID NO: 556712 - DNA, 20 bp, Artificial Sequence
  chemically synthesized
aaaacaaaaaaaacaaaaaa

SEQ ID NO: 556713 - DNA, 20 bp, Artificial Sequence
  chemically synthesized
aaaaaaaacaaaaaacaaaa

SEQ ID NO: 556714 - DNA, 20 bp, Artificial Sequence
  chemically synthesized
aaacaaaaaacaaaacaaaa

SEQ ID NO: 556715 - DNA, 20 bp, Artificial Sequence
  chemically synthesized
aacaaaacaaaacaaaacaa

SEQ ID NO: 556716 - DNA, 20 bp, Artificial Sequence
  chemically synthesized
ttcttcagaatatcaagagt

SEQ ID NO: 556717 - DNA, 20 bp, Artificial Sequence
  chemically synthesized
tgacttattttaaaagtatc

SEQ ID NO: 556718 - DNA, 20 bp, Artificial Sequence
  chemically synthesized
tagttatggatgtgaactca

SEQ ID NO: 556719 - DNA, 20 bp, Artificial Sequence
  chemically synthesized
gatgttgttagttgaagctg

SEQ ID NO: 556720 - DNA, 20 bp, Artificial Sequence
  chemically synthesized
tcatattttcctaaaatctc

SEQ ID NO: 556721 - DNA, 20 bp, Artificial Sequence
  chemically synthesized
tcccttccttgtaatagagg

SEQ ID NO: 556722 - DNA, 20 bp, Artificial Sequence
  chemically synthesized
aggtaaaacaattcctgaca

SEQ ID NO: 556723 - DNA, 20 bp, Artificial Sequence
  chemically synthesized
accttcaccaaaagtttgtt

SEQ ID NO: 556724 - DNA, 20 bp, Artificial Sequence
  chemically synthesized
aaagagccataggcaaaatc

SEQ ID NO: 556725 - DNA, 20 bp, Artificial Sequence
  chemically synthesized
gcagaaggcaaaggagaagc

SEQ ID NO: 556726 - DNA, 20 bp, Artificial Sequence
  chemically synthesized
ctcaggggaactcacattta

SEQ ID NO: 556727 - DNA, 20 bp, Artificial Sequence
  chemically synthesized
gtaaaaaattatttaataag

SEQ ID NO: 556728 - DNA, 20 bp, Artificial Sequence
  chemically synthesized
cattaagtgatattgccaaa

SEQ ID NO: 556729 - DNA, 20 bp, Artificial Sequence
  chemically synthesized
ttttgtgctcttctgcactt

SEQ ID NO: 556730 - DNA, 20 bp, Artificial Sequence
  chemically synthesized
aatataaatgtaaattaatt

SEQ ID NO: 556731 - DNA, 20 bp, Artificial Sequence
  chemically synthesized
aataatccttttatgtatta

SEQ ID NO: 556732 - DNA, 20 bp, Artificial Sequence
  chemically synthesized
acatgttccctgtggtgaaa

SEQ ID NO: 556733 - DNA, 20 bp, Artificial Sequence
  chemically synthesized
acttttgcttatcttaatat

SEQ ID NO: 556734 - DNA, 20 bp, Artificial Sequence
  chemically synthesized
catcttaatatgtttatttc

SEQ ID NO: 556735 - DNA, 20 bp, Artificial Sequence
  chemically synthesized
ttaagatggatttcataaca

SEQ ID NO: 556736 - DNA, 20 bp, Artificial Sequence
  chemically synthesized
ttaaagccactaatcaaaat

SEQ ID NO: 556737 - DNA, 20 bp, Artificial Sequence
  chemically synthesized
aaaaaaggaaaaatctactg

SEQ ID NO: 556738 - DNA, 20 bp, Artificial Sequence
  chemically synthesized
gtaatcaatgaaatgcaaag

SEQ ID NO: 556739 - DNA, 20 bp, Artificial Sequence
  chemically synthesized
aggtctttgtcaaagttctg

SEQ ID NO: 556740 - DNA, 20 bp, Artificial Sequence
  chemically synthesized
taagcttttctgttaaaaag

SEQ ID NO: 556741 - DNA, 20 bp, Artificial Sequence
  chemically synthesized
ctctgtaataacacttagct

SEQ ID NO: 556742 - DNA, 20 bp, Artificial Sequence
  chemically synthesized
ctaagtgttattacagagtc

SEQ ID NO: 556743 - DNA, 20 bp, Artificial Sequence
  chemically synthesized
gttaactgattagtcatttg

SEQ ID NO: 556744 - DNA, 20 bp, Artificial Sequence
  chemically synthesized
ttgactctccacatcataca

SEQ ID NO: 556745 - DNA, 20 bp, Artificial Sequence
  chemically synthesized
ttttttctatattttctttt

SEQ ID NO: 556746 - DNA, 20 bp, Artificial Sequence
  chemically synthesized
atcgtcaggtgattgcaaat

SEQ ID NO: 556747 - DNA, 20 bp, Artificial Sequence
  chemically synthesized
gaactgaaatgaccacactg

SEQ ID NO: 556748 - DNA, 20 bp, Artificial Sequence
  chemically synthesized
atttggctttggaatcacca

SEQ ID NO: 556749 - DNA, 20 bp, Artificial Sequence
  chemically synthesized
caatagaataccatacatag

SEQ ID NO: 556750 - DNA, 20 bp, Artificial Sequence
  chemically synthesized
gtttatagtaatttcaaagt

SEQ ID NO: 556751 - DNA, 20 bp, Artificial Sequence
  chemically synthesized
gaaattcagggatttttaaa

SEQ ID NO: 556752 - DNA, 20 bp, Artificial Sequence
  chemically synthesized
cttcagtttagaaaatttga

SEQ ID NO: 556753 - DNA, 20 bp, Artificial Sequence
  chemically synthesized
ccattaaagtaaatattatg

SEQ ID NO: 556754 - DNA, 20 bp, Artificial Sequence
  chemically synthesized
gtaaaatatgcatacaaaat

SEQ ID NO: 556755 - DNA, 20 bp, Artificial Sequence
  chemically synthesized
aaattagtataattattgtg

SEQ ID NO: 556756 - DNA, 20 bp, Artificial Sequence
  chemically synthesized
aaaacagtatggaagatcca

SEQ ID NO: 556757 - DNA, 20 bp, Artificial Sequence
  chemically synthesized
atttatttctatttaacata

SEQ ID NO: 556758 - DNA, 20 bp, Artificial Sequence
  chemically synthesized
agagtagaatatgaagtcag

SEQ ID NO: 556759 - DNA, 20 bp, Artificial Sequence
  chemically synthesized
tttccttccctcttccctcc

SEQ ID NO: 556760 - DNA, 20 bp, Artificial Sequence
  chemically synthesized
aatatgaatattttgaaaat

SEQ ID NO: 556761 - DNA, 20 bp, Artificial Sequence
  chemically synthesized
aacaagccaaagaaaaaggc

SEQ ID NO: 556762 - DNA, 20 bp, Artificial Sequence
  chemically synthesized
ctttttgacactcttaagat

SEQ ID NO: 556763 - DNA, 20 bp, Artificial Sequence
  chemically synthesized
ctattgatttaacaaagatt

SEQ ID NO: 556764 - DNA, 20 bp, Artificial Sequence
  chemically synthesized
agactttagatatgaactac

SEQ ID NO: 556765 - DNA, 20 bp, Artificial Sequence
  chemically synthesized
tgtagttcatatctaaagtc

SEQ ID NO: 556766 - DNA, 20 bp, Artificial Sequence
  chemically synthesized
ccactatcaaattcagtttt

SEQ ID NO: 556767 - DNA, 20 bp, Artificial Sequence
  chemically synthesized
aatcaatgagtggcagtttt

SEQ ID NO: 556768 - DNA, 20 bp, Artificial Sequence
  chemically synthesized
cttttccttatcgacacata

SEQ ID NO: 556769 - DNA, 20 bp, Artificial Sequence
  chemically synthesized
gaggtggaacttttattacc

SEQ ID NO: 556770 - DNA, 20 bp, Artificial Sequence
  chemically synthesized
ttgttaaatgaacaatcata

SEQ ID NO: 556771 - DNA, 20 bp, Artificial Sequence
  chemically synthesized
aacaatcaatcattcgctaa

SEQ ID NO: 556772 - DNA, 20 bp, Artificial Sequence
  chemically synthesized
aaagagaaggtaaatctcct

SEQ ID NO: 556773 - DNA, 20 bp, Artificial Sequence
  chemically synthesized
cttatgttcttgtacacttt

SEQ ID NO: 556774 - DNA, 20 bp, Artificial Sequence
  chemically synthesized
tgacatcaagctaactaaca

SEQ ID NO: 556775 - DNA, 20 bp, Artificial Sequence
  chemically synthesized
caaagatatcttcccaggca

SEQ ID NO: 556776 - DNA, 20 bp, Artificial Sequence
  chemically synthesized
ttatatgccaccagatattt

SEQ ID NO: 556777 - DNA, 20 bp, Artificial Sequence
  chemically synthesized
cttcactgttatcagatact

SEQ ID NO: 556778 - DNA, 20 bp, Artificial Sequence
  chemically synthesized
gtaatgaagtggttatgcaa

SEQ ID NO: 556779 - DNA, 20 bp, Artificial Sequence
  chemically synthesized
ctctgcccttattaccacac

SEQ ID NO: 556780 - DNA, 20 bp, Artificial Sequence
  chemically synthesized
ttgtttgataaaaattcaag

SEQ ID NO: 556781 - DNA, 20 bp, Artificial Sequence
  chemically synthesized
tatggttcttgttgcttggg

SEQ ID NO: 556782 - DNA, 20 bp, Artificial Sequence
  chemically synthesized
cttaatagaatttaaaaaaa

SEQ ID NO: 556783 - DNA, 20 bp, Artificial Sequence
  chemically synthesized
ttcagggggggaaagaaagg

SEQ ID NO: 556784 - DNA, 20 bp, Artificial Sequence
  chemically synthesized
agtgagattgttgtttcaaa

SEQ ID NO: 556785 - DNA, 20 bp, Artificial Sequence
  chemically synthesized
gattgttgtttcaaaaaaaa

SEQ ID NO: 556786 - DNA, 20 bp, Artificial Sequence
  chemically synthesized
gaaagaaagaaagaaaaaag

SEQ ID NO: 556787 - DNA, 20 bp, Artificial Sequence
  chemically synthesized
cttaccacatttccaatgct

SEQ ID NO: 556788 - DNA, 20 bp, Artificial Sequence
  chemically synthesized
actatttgcttatgcatcta

SEQ ID NO: 556789 - DNA, 20 bp, Artificial Sequence
  chemically synthesized
tagacagaaaatattgaaat

SEQ ID NO: 556790 - DNA, 20 bp, Artificial Sequence
  chemically synthesized
ctagaaagcttgtttttctc

SEQ ID NO: 556791 - DNA, 20 bp, Artificial Sequence
  chemically synthesized
ttagagaatgagttttggag

SEQ ID NO: 556792 - DNA, 20 bp, Artificial Sequence
  chemically synthesized
tctccaaaactcattctcta

SEQ ID NO: 556793 - DNA, 20 bp, Artificial Sequence
  chemically synthesized
aaaactcattctctaaaaaa

SEQ ID NO: 556794 - DNA, 20 bp, Artificial Sequence
  chemically synthesized
tcattctctaaaaaacaaaa

SEQ ID NO: 556795 - DNA, 20 bp, Artificial Sequence
  chemically synthesized
ctctaaaaaacaaaacaaaa

SEQ ID NO: 556796 - DNA, 20 bp, Artificial Sequence
  chemically synthesized
aacaaaacaaaacaaaaata

SEQ ID NO: 556797 - DNA, 20 bp, Artificial Sequence
  chemically synthesized
actcttcccgatgttgtgtt

SEQ ID NO: 556798 - DNA, 20 bp, Artificial Sequence
  chemically synthesized
gcaacaatcctcgcagaata

SEQ ID NO: 556799 - DNA, 20 bp, Artificial Sequence
  chemically synthesized
ttttcagtttcttcaaatgt

SEQ ID NO: 556800 - DNA, 20 bp, Artificial Sequence
  chemically synthesized
acctattggcctgcaaagcc

SEQ ID NO: 556801 - DNA, 20 bp, Artificial Sequence
  chemically synthesized
cttcaatgtacgagaaataa

SEQ ID NO: 556802 - DNA, 20 bp, Artificial Sequence
  chemically synthesized
tactggctacaaagtgtccc

SEQ ID NO: 556803 - DNA, 20 bp, Artificial Sequence
  chemically synthesized
tccaaagcagtgaaagaaaa

SEQ ID NO: 556804 - DNA, 20 bp, Artificial Sequence
  chemically synthesized
atatatagtttatcatggac

SEQ ID NO: 556805 - DNA, 20 bp, Artificial Sequence
  chemically synthesized
tttagatacactgggttaaa

SEQ ID NO: 556806 - DNA, 20 bp, Artificial Sequence
  chemically synthesized
aatcaacttagaagatatac

SEQ ID NO: 556807 - DNA, 20 bp, Artificial Sequence
  chemically synthesized
aattgatgttatgttaataa

SEQ ID NO: 556808 - DNA, 20 bp, Artificial Sequence
  chemically synthesized
gacaagcagtgtgcttcaga

SEQ ID NO: 556809 - DNA, 20 bp, Artificial Sequence
  chemically synthesized
caaatattataaagatgccc

SEQ ID NO: 556810 - DNA, 20 bp, Artificial Sequence
  chemically synthesized
gtatgaactgaagctggaat

SEQ ID NO: 556811 - DNA, 20 bp, Artificial Sequence
  chemically synthesized
aaagtggtttcactcattta

SEQ ID NO: 556812 - DNA, 20 bp, Artificial Sequence
  chemically synthesized
gttatgactggaatgtggaa

SEQ ID NO: 556813 - DNA, 20 bp, Artificial Sequence
  chemically synthesized
aaactccatgtcatggcaca

SEQ ID NO: 556814 - DNA, 20 bp, Artificial Sequence
  chemically synthesized
ttatccctgtagaataagtt

SEQ ID NO: 556815 - DNA, 20 bp, Artificial Sequence
  chemically synthesized
cagagatggttcattattaa

SEQ ID NO: 556816 - DNA, 20 bp, Artificial Sequence
  chemically synthesized
tggttatctgtcatcttttt

SEQ ID NO: 556817 - DNA, 20 bp, Artificial Sequence
  chemically synthesized
gttatattctttgacttaaa

SEQ ID NO: 556818 - DNA, 20 bp, Artificial Sequence
  chemically synthesized
agaatgtgcttcaagtttca

SEQ ID NO: 556819 - DNA, 20 bp, Artificial Sequence
  chemically synthesized
ttttacctttattgagtata

SEQ ID NO: 556820 - DNA, 20 bp, Artificial Sequence
  chemically synthesized
ccatcgtttctaacagatgt

SEQ ID NO: 556821 - DNA, 20 bp, Artificial Sequence
  chemically synthesized
aacagatgtaaaaacaaaaa

SEQ ID NO: 556822 - DNA, 20 bp, Artificial Sequence
  chemically synthesized
ctgacttataagtagtacat

SEQ ID NO: 556823 - DNA, 20 bp, Artificial Sequence
  chemically synthesized
ttatttttaaattttagatc

SEQ ID NO: 556824 - DNA, 20 bp, Artificial Sequence
  chemically synthesized
cacaatgtgcacatgtaccc

SEQ ID NO: 556825 - DNA, 20 bp, Artificial Sequence
  chemically synthesized
agtaaactgtcgcaagaaca

SEQ ID NO: 556826 - DNA, 20 bp, Artificial Sequence
  chemically synthesized
gccatcagagaaatgcaaat

SEQ ID NO: 556827 - DNA, 20 bp, Artificial Sequence
  chemically synthesized
agaagacatttatgcagcca

SEQ ID NO: 556828 - DNA, 20 bp, Artificial Sequence
  chemically synthesized
ctccaacaaatttacaagaa

SEQ ID NO: 556829 - DNA, 20 bp, Artificial Sequence
  chemically synthesized
ggacttcatgtctaaaacac

SEQ ID NO: 556830 - DNA, 20 bp, Artificial Sequence
  chemically synthesized
atgggcaaggacttcatgtc

SEQ ID NO: 556831 - DNA, 20 bp, Artificial Sequence
  chemically synthesized
cctttcttcacagaattgga

SEQ ID NO: 556832 - DNA, 20 bp, Artificial Sequence
  chemically synthesized
tactacaaggctacagtaac

SEQ ID NO: 556833 - DNA, 20 bp, Artificial Sequence
  chemically synthesized
aaacagcatggtactggtac

SEQ ID NO: 556834 - DNA, 20 bp, Artificial Sequence
  chemically synthesized
tgatctttgacaaacctgag

SEQ ID NO: 556835 - DNA, 20 bp, Artificial Sequence
  chemically synthesized
aaagacttaaacgttagacc

SEQ ID NO: 556836 - DNA, 20 bp, Artificial Sequence
  chemically synthesized
aacgttagacctaaaaccat

SEQ ID NO: 556837 - DNA, 20 bp, Artificial Sequence
  chemically synthesized
atttaatggcatgtaaaggg

SEQ ID NO: 556838 - DNA, 20 bp, Artificial Sequence
  chemically synthesized
ttcctgaagaaatgatgcat

SEQ ID NO: 556839 - DNA, 20 bp, Artificial Sequence
  chemically synthesized
tttatgcatcatttcttcag

SEQ ID NO: 556840 - DNA, 20 bp, Artificial Sequence
  chemically synthesized
ctaaattggttggagaaggc

SEQ ID NO: 556841 - DNA, 20 bp, Artificial Sequence
  chemically synthesized
atattaaaacaaaataaaac

SEQ ID NO: 556842 - DNA, 20 bp, Artificial Sequence
  chemically synthesized
atatacatattaaaacaaaa

SEQ ID NO: 556843 - DNA, 20 bp, Artificial Sequence
  chemically synthesized
tggagcttggatatacatat

SEQ ID NO: 556844 - DNA, 20 bp, Artificial Sequence
  chemically synthesized
tacctcagatttactaagtc

SEQ ID NO: 556845 - DNA, 20 bp, Artificial Sequence
  chemically synthesized
tcaagtcaagtgtagtgcag

SEQ ID NO: 556846 - DNA, 20 bp, Artificial Sequence
  chemically synthesized
gggcttaaagtggttccccc

SEQ ID NO: 556847 - DNA, 20 bp, Artificial Sequence
  chemically synthesized
tggagggaaactccgctttt

SEQ ID NO: 556848 - DNA, 20 bp, Artificial Sequence
  chemically synthesized
tcagactgagtcttctaaaa

SEQ ID NO: 556849 - DNA, 20 bp, Artificial Sequence
  chemically synthesized
gtatgtttgggcaagagttt

SEQ ID NO: 556850 - DNA, 20 bp, Artificial Sequence
  chemically synthesized
tccacagtgtatgcatattt

SEQ ID NO: 556851 - DNA, 20 bp, Artificial Sequence
  chemically synthesized
gaactaattcattaaagaaa

SEQ ID NO: 556852 - DNA, 20 bp, Artificial Sequence
  chemically synthesized
ttaatgaattagttcattct

SEQ ID NO: 556853 - DNA, 20 bp, Artificial Sequence
  chemically synthesized
atcaggcagagattttaagg

SEQ ID NO: 556854 - DNA, 20 bp, Artificial Sequence
  chemically synthesized
ttctacacattacaaaagta

SEQ ID NO: 556855 - DNA, 20 bp, Artificial Sequence
  chemically synthesized
ataaaacactcaccaaatta

SEQ ID NO: 556856 - DNA, 20 bp, Artificial Sequence
  chemically synthesized
actgaaatgtgctgtaagta

SEQ ID NO: 556857 - DNA, 20 bp, Artificial Sequence
  chemically synthesized
aatcagttttttatttgaac

SEQ ID NO: 556858 - DNA, 20 bp, Artificial Sequence
  chemically synthesized
tccaagtttttgttcaaata

SEQ ID NO: 556859 - DNA, 20 bp, Artificial Sequence
  chemically synthesized
caaaaatattcgcaatatta

SEQ ID NO: 556860 - DNA, 20 bp, Artificial Sequence
  chemically synthesized
gacattcattatataaaaaa

SEQ ID NO: 556861 - DNA, 20 bp, Artificial Sequence
  chemically synthesized
cagcatgagaagctttgcat

SEQ ID NO: 556862 - DNA, 20 bp, Artificial Sequence
  chemically synthesized
ttactacaaagataggggct

SEQ ID NO: 556863 - DNA, 20 bp, Artificial Sequence
  chemically synthesized
atttgcaatactcctatact

SEQ ID NO: 556864 - DNA, 20 bp, Artificial Sequence
  chemically synthesized
tatatactcagatgaaatga

SEQ ID NO: 556865 - DNA, 20 bp, Artificial Sequence
  chemically synthesized
ttaaatgcaaggtgctaaaa

SEQ ID NO: 556866 - DNA, 20 bp, Artificial Sequence
  chemically synthesized
ttattttagcaccttgcatt

SEQ ID NO: 556867 - DNA, 20 bp, Artificial Sequence
  chemically synthesized
tgaaattgtggaaactttaa

SEQ ID NO: 556868 - DNA, 20 bp, Artificial Sequence
  chemically synthesized
aaaaggatgcctcaaagtca

SEQ ID NO: 556869 - DNA, 20 bp, Artificial Sequence
  chemically synthesized
atttatgttaaactgtttat

SEQ ID NO: 556870 - DNA, 20 bp, Artificial Sequence
  chemically synthesized
atcatagagtttcgaatctg

SEQ ID NO: 556871 - DNA, 20 bp, Artificial Sequence
  chemically synthesized
aaagagggaaaagcccctta

SEQ ID NO: 556872 - DNA, 20 bp, Artificial Sequence
  chemically synthesized
atattatcagccagatttag

SEQ ID NO: 556873 - DNA, 20 bp, Artificial Sequence
  chemically synthesized
tgtcttacattctggtgtct

SEQ ID NO: 556874 - DNA, 20 bp, Artificial Sequence
  chemically synthesized
tgtgtcctggaatcacatcc

SEQ ID NO: 556875 - DNA, 20 bp, Artificial Sequence
  chemically synthesized
gaaactaaggctactgtaac

SEQ ID NO: 556876 - DNA, 20 bp, Artificial Sequence
  chemically synthesized
aaacagcatggtactggtac

SEQ ID NO: 556877 - DNA, 20 bp, Artificial Sequence
  chemically synthesized
gatctttgacaaacctgaca

SEQ ID NO: 556878 - DNA, 20 bp, Artificial Sequence
  chemically synthesized
tatttaataaatggtgctgg

SEQ ID NO: 556879 - DNA, 20 bp, Artificial Sequence
  chemically synthesized
aaagacttacatgttagacc

SEQ ID NO: 556880 - DNA, 20 bp, Artificial Sequence
  chemically synthesized
acatgttagacctaaaacca

SEQ ID NO: 556881 - DNA, 20 bp, Artificial Sequence
  chemically synthesized
aaaaccataaaaccctagaa

SEQ ID NO: 556882 - DNA, 20 bp, Artificial Sequence
  chemically synthesized
atgggcaaggacttcatgat

SEQ ID NO: 556883 - DNA, 20 bp, Artificial Sequence
  chemically synthesized
cttaaacaaatttacaagaa

SEQ ID NO: 556884 - DNA, 20 bp, Artificial Sequence
  chemically synthesized
gtcatcagagaaatgcaaat

SEQ ID NO: 556885 - DNA, 20 bp, Artificial Sequence
  chemically synthesized
agcaaactatcacaaggaca

SEQ ID NO: 556886 - DNA, 20 bp, Artificial Sequence
  chemically synthesized
ataggtgggaattgaacaat

SEQ ID NO: 556887 - DNA, 20 bp, Artificial Sequence
  chemically synthesized
aaatgtgaaaaaaaaaaaaa

SEQ ID NO: 556888 - DNA, 20 bp, Artificial Sequence
  chemically synthesized
aaaaaaaaaaacaagaaaca

SEQ ID NO: 556889 - DNA, 20 bp, Artificial Sequence
  chemically synthesized
tcttaatgctgtaagtgaca

SEQ ID NO: 556890 - DNA, 20 bp, Artificial Sequence
  chemically synthesized
taggtgttagaaaaacgaaa

SEQ ID NO: 556891 - DNA, 20 bp, Artificial Sequence
  chemically synthesized
aatatggttttaggtgttag

SEQ ID NO: 556892 - DNA, 20 bp, Artificial Sequence
  chemically synthesized
tctttcgtttttctaacacc

SEQ ID NO: 556893 - DNA, 20 bp, Artificial Sequence
  chemically synthesized
ccaaggagtggggaggactt

SEQ ID NO: 556894 - DNA, 20 bp, Artificial Sequence
  chemically synthesized
agggaatcagaggcgaggaa

SEQ ID NO: 556895 - DNA, 20 bp, Artificial Sequence
  chemically synthesized
aaatactttccaaacagtga

SEQ ID NO: 556896 - DNA, 20 bp, Artificial Sequence
  chemically synthesized
atggcaagttccatgaatgt

SEQ ID NO: 556897 - DNA, 20 bp, Artificial Sequence
  chemically synthesized
ccattttgaactcgaataag

SEQ ID NO: 556898 - DNA, 20 bp, Artificial Sequence
  chemically synthesized
cagaggcaactcgcaatgtc

SEQ ID NO: 556899 - DNA, 20 bp, Artificial Sequence
  chemically synthesized
caagactcttatctcctttg

SEQ ID NO: 556900 - DNA, 20 bp, Artificial Sequence
  chemically synthesized
gaagcaaattggaaaggcga

SEQ ID NO: 556901 - DNA, 20 bp, Artificial Sequence
  chemically synthesized
gtaaattgatgagatacatc

SEQ ID NO: 556902 - DNA, 20 bp, Artificial Sequence
  chemically synthesized
ggtaaatatggcagatgagg

SEQ ID NO: 556903 - DNA, 20 bp, Artificial Sequence
  chemically synthesized
ttgttcctgtttccaggtga

SEQ ID NO: 556904 - DNA, 20 bp, Artificial Sequence
  chemically synthesized
ctcagaattatgagaaatcg

SEQ ID NO: 556905 - DNA, 20 bp, Artificial Sequence
  chemically synthesized
actaactatacaggattaaa

SEQ ID NO: 556906 - DNA, 20 bp, Artificial Sequence
  chemically synthesized
aatgtagaatatttatttca

SEQ ID NO: 556907 - DNA, 20 bp, Artificial Sequence
  chemically synthesized
taattagcaccaaattgtag

SEQ ID NO: 556908 - DNA, 20 bp, Artificial Sequence
  chemically synthesized
tccagaggaagattttgaaa

SEQ ID NO: 556909 - DNA, 20 bp, Artificial Sequence
  chemically synthesized
ggaagattttgaaaaaaaac

SEQ ID NO: 556910 - DNA, 20 bp, Artificial Sequence
  chemically synthesized
ttttgaaaaaaaacaaaaac

SEQ ID NO: 556911 - DNA, 20 bp, Artificial Sequence
  chemically synthesized
aaaaaaaacaaaaacaaaaa

SEQ ID NO: 556912 - DNA, 20 bp, Artificial Sequence
  chemically synthesized
aaacaaaaacaaaaacaaaa

SEQ ID NO: 556913 - DNA, 20 bp, Artificial Sequence
  chemically synthesized
aaaacaaaaacaaaacaaaa

SEQ ID NO: 556914 - DNA, 20 bp, Artificial Sequence
  chemically synthesized
aaaaacaaaacaaaacaaaa

SEQ ID NO: 556915 - DNA, 20 bp, Artificial Sequence
  chemically synthesized
caaaacaaaacaaaacaaaa

SEQ ID NO: 556916 - DNA, 20 bp, Artificial Sequence
  chemically synthesized
aaaacaaaacaaaacaaaac

SEQ ID NO: 556917 - DNA, 20 bp, Artificial Sequence
  chemically synthesized
aaaacaaaacaaaacaaaaa

SEQ ID NO: 556918 - DNA, 20 bp, Artificial Sequence
  chemically synthesized
aaacaaaacaaaaacaaaac

SEQ ID NO: 556919 - DNA, 20 bp, Artificial Sequence
  chemically synthesized
atcttctctaataattatct

SEQ ID NO: 556920 - DNA, 20 bp, Artificial Sequence
  chemically synthesized
acaaggaaagcaagagagca

SEQ ID NO: 556921 - DNA, 20 bp, Artificial Sequence
  chemically synthesized
atttagcttagcttacattt

SEQ ID NO: 556922 - DNA, 20 bp, Artificial Sequence
  chemically synthesized
ggagagaatgtggagaaaag

SEQ ID NO: 556923 - DNA, 20 bp, Artificial Sequence
  chemically synthesized
tcaacaaatgaatggataaa

SEQ ID NO: 556924 - DNA, 20 bp, Artificial Sequence
  chemically synthesized
gcaaaataagccaagcacag

SEQ ID NO: 556925 - DNA, 20 bp, Artificial Sequence
  chemically synthesized
tatttgcagaatctaaaaat

SEQ ID NO: 556926 - DNA, 20 bp, Artificial Sequence
  chemically synthesized
tatgcattgcatgcttgtgt

SEQ ID NO: 556927 - DNA, 20 bp, Artificial Sequence
  chemically synthesized
tgttatgtaacaaatcaccc

SEQ ID NO: 556928 - DNA, 20 bp, Artificial Sequence
  chemically synthesized
ctactgcatacctgtgttca

SEQ ID NO: 556929 - DNA, 20 bp, Artificial Sequence
  chemically synthesized
tccactttagaaagattaat

SEQ ID NO: 556930 - DNA, 20 bp, Artificial Sequence
  chemically synthesized
ctgtcactcactgattcacc

SEQ ID NO: 556931 - DNA, 20 bp, Artificial Sequence
  chemically synthesized
cttctctcaccacaaagttc

SEQ ID NO: 556932 - DNA, 20 bp, Artificial Sequence
  chemically synthesized
aggaaaccagagtactagaa

SEQ ID NO: 556933 - DNA, 20 bp, Artificial Sequence
  chemically synthesized
gaaaacccacagagacaaaa

SEQ ID NO: 556934 - DNA, 20 bp, Artificial Sequence
  chemically synthesized
gttataatattggcaaggga

SEQ ID NO: 556935 - DNA, 20 bp, Artificial Sequence
  chemically synthesized
ccagcgtctagtgaggaact

SEQ ID NO: 556936 - DNA, 20 bp, Artificial Sequence
  chemically synthesized
ctggaaaggggtatctttaa

SEQ ID NO: 556937 - DNA, 20 bp, Artificial Sequence
  chemically synthesized
catatagtttgggagcagac

SEQ ID NO: 556938 - DNA, 20 bp, Artificial Sequence
  chemically synthesized
aacaaataaaggccaacaca

SEQ ID NO: 556939 - DNA, 20 bp, Artificial Sequence
  chemically synthesized
atacacatcactgatgaaaa

SEQ ID NO: 556940 - DNA, 20 bp, Artificial Sequence
  chemically synthesized
ccaagaagtactgtcctatt

SEQ ID NO: 556941 - DNA, 20 bp, Artificial Sequence
  chemically synthesized
tcatcaaaagggtatttcaa

SEQ ID NO: 556942 - DNA, 20 bp, Artificial Sequence
  chemically synthesized
gcaagccaatcaaaagggag

SEQ ID NO: 556943 - DNA, 20 bp, Artificial Sequence
  chemically synthesized
agtttaaggagttggcatat

SEQ ID NO: 556944 - DNA, 20 bp, Artificial Sequence
  chemically synthesized
tgcagaaacaaaaggaaaga

SEQ ID NO: 556945 - DNA, 20 bp, Artificial Sequence
  chemically synthesized
agttaagctaattttcaact

SEQ ID NO: 556946 - DNA, 20 bp, Artificial Sequence
  chemically synthesized
tggatttttgttatattttt

SEQ ID NO: 556947 - DNA, 20 bp, Artificial Sequence
  chemically synthesized
aatcaggccaatagattgat

SEQ ID NO: 556948 - DNA, 20 bp, Artificial Sequence
  chemically synthesized
aagtgagaatgctggtgttt

SEQ ID NO: 556949 - DNA, 20 bp, Artificial Sequence
  chemically synthesized
tgctcaaaaaatgttagatt

SEQ ID NO: 556950 - DNA, 20 bp, Artificial Sequence
  chemically synthesized
acgcaaccaacattataaca

SEQ ID NO: 556951 - DNA, 20 bp, Artificial Sequence
  chemically synthesized
cctttcagattataggtctt

SEQ ID NO: 556952 - DNA, 20 bp, Artificial Sequence
  chemically synthesized
gatgtcatgaagcttccata

SEQ ID NO: 556953 - DNA, 20 bp, Artificial Sequence
  chemically synthesized
gagcagctcacagaactcag

SEQ ID NO: 556954 - DNA, 20 bp, Artificial Sequence
  chemically synthesized
ttacgatttgagagtagaga

SEQ ID NO: 556955 - DNA, 20 bp, Artificial Sequence
  chemically synthesized
attatgataggataacaggc

SEQ ID NO: 556956 - DNA, 20 bp, Artificial Sequence
  chemically synthesized
gtaattattaactacataaa

SEQ ID NO: 556957 - DNA, 20 bp, Artificial Sequence
  chemically synthesized
tttccaggaacttacataaa

SEQ ID NO: 556958 - DNA, 20 bp, Artificial Sequence
  chemically synthesized
gaccatcccagccaacatgg

SEQ ID NO: 556959 - DNA, 20 bp, Artificial Sequence
  chemically synthesized
gctaaaacgctattatataa

SEQ ID NO: 556960 - DNA, 20 bp, Artificial Sequence
  chemically synthesized
aattttataaatctgtgtgc

SEQ ID NO: 556961 - DNA, 20 bp, Artificial Sequence
  chemically synthesized
gcacacagatttataaaatt

SEQ ID NO: 556962 - DNA, 20 bp, Artificial Sequence
  chemically synthesized
agattctattatttggttga

SEQ ID NO: 556963 - DNA, 20 bp, Artificial Sequence
  chemically synthesized
ataaagaaaaaagcattttg

SEQ ID NO: 556964 - DNA, 20 bp, Artificial Sequence
  chemically synthesized
caaaatgacaacatatttat

SEQ ID NO: 556965 - DNA, 20 bp, Artificial Sequence
  chemically synthesized
tttacagttgtgtaatatag

SEQ ID NO: 556966 - DNA, 20 bp, Artificial Sequence
  chemically synthesized
aaggttctagaaagtaattt

SEQ ID NO: 556967 - DNA, 20 bp, Artificial Sequence
  chemically synthesized
atctagttctcaaaaagggc

SEQ ID NO: 556968 - DNA, 20 bp, Artificial Sequence
  chemically synthesized
aaaagggcaaaaaccaaagc

SEQ ID NO: 556969 - DNA, 20 bp, Artificial Sequence
  chemically synthesized
ggggatttattttcttttaa

SEQ ID NO: 556970 - DNA, 20 bp, Artificial Sequence
  chemically synthesized
cttgagcttcaccaaaaggt

SEQ ID NO: 556971 - DNA, 20 bp, Artificial Sequence
  chemically synthesized
tttttaactacccatttatt

SEQ ID NO: 556972 - DNA, 20 bp, Artificial Sequence
  chemically synthesized
ctccagcctgggcgacagag

SEQ ID NO: 556973 - DNA, 20 bp, Artificial Sequence
  chemically synthesized
ctctgtctcaaaaaaaaaaa

SEQ ID NO: 556974 - DNA, 20 bp, Artificial Sequence
  chemically synthesized
tatgaagagggataaatatt

SEQ ID NO: 556975 - DNA, 20 bp, Artificial Sequence
  chemically synthesized
atatttcattactgaagaga

SEQ ID NO: 556976 - DNA, 20 bp, Artificial Sequence
  chemically synthesized
ccattttcttttacttttaa

SEQ ID NO: 556977 - DNA, 20 bp, Artificial Sequence
  chemically synthesized
aaatttttatgatagaaaat

SEQ ID NO: 556978 - DNA, 20 bp, Artificial Sequence
  chemically synthesized
ttattctgttgcaggacaca

SEQ ID NO: 556979 - DNA, 20 bp, Artificial Sequence
  chemically synthesized
gtttctacctttaatgattg

SEQ ID NO: 556980 - DNA, 20 bp, Artificial Sequence
  chemically synthesized
aagtaccaattttatgacat

SEQ ID NO: 556981 - DNA, 20 bp, Artificial Sequence
  chemically synthesized
gaccagcctggccaacatgg

SEQ ID NO: 556982 - DNA, 20 bp, Artificial Sequence
  chemically synthesized
cccatctctactaaaaatac

SEQ ID NO: 556983 - DNA, 20 bp, Artificial Sequence
  chemically synthesized
cttaattacaatcttttttt

SEQ ID NO: 556984 - DNA, 20 bp, Artificial Sequence
  chemically synthesized
agtatgcaaggtggaaagat

SEQ ID NO: 556985 - DNA, 20 bp, Artificial Sequence
  chemically synthesized
atcattttttctagccacaa

SEQ ID NO: 556986 - DNA, 20 bp, Artificial Sequence
  chemically synthesized
aaagcaaacggtcaggttaa

SEQ ID NO: 556987 - DNA, 20 bp, Artificial Sequence
  chemically synthesized
aaacggtcaggttaaaaaaa

SEQ ID NO: 556988 - DNA, 20 bp, Artificial Sequence
  chemically synthesized
gtcaggttaaaaaaacaaaa

SEQ ID NO: 556989 - DNA, 20 bp, Artificial Sequence
  chemically synthesized
atcagctctgtgctcagata

SEQ ID NO: 556990 - DNA, 20 bp, Artificial Sequence
  chemically synthesized
tccaaataaagttagtgtct

SEQ ID NO: 556991 - DNA, 20 bp, Artificial Sequence
  chemically synthesized
tttgaatcccaaatacctag

SEQ ID NO: 556992 - DNA, 20 bp, Artificial Sequence
  chemically synthesized
atccaaaagagctgctttcc

SEQ ID NO: 556993 - DNA, 20 bp, Artificial Sequence
  chemically synthesized
aagagctgctttcctaaaac

SEQ ID NO: 556994 - DNA, 20 bp, Artificial Sequence
  chemically synthesized
acacccccagacaaatcagc

SEQ ID NO: 556995 - DNA, 20 bp, Artificial Sequence
  chemically synthesized
cccagacaaatcagctaaaa

SEQ ID NO: 556996 - DNA, 20 bp, Artificial Sequence
  chemically synthesized
tcacaacttcatataatttt

SEQ ID NO: 556997 - DNA, 20 bp, Artificial Sequence
  chemically synthesized
attaatttcaaatcaaagat

SEQ ID NO: 556998 - DNA, 20 bp, Artificial Sequence
  chemically synthesized
agaagaaataaagttgtgag

SEQ ID NO: 556999 - DNA, 20 bp, Artificial Sequence
  chemically synthesized
tatgaataacctaatgggca

SEQ ID NO: 557000 - DNA, 20 bp, Artificial Sequence
  chemically synthesized
ttatctgcttcctccaacca

SEQ ID NO: 557001 - DNA, 20 bp, Artificial Sequence
  chemically synthesized
tatactttaattaaacattt

SEQ ID NO: 557002 - DNA, 20 bp, Artificial Sequence
  chemically synthesized
ggctgctacttaaacaaaac

SEQ ID NO: 557003 - DNA, 20 bp, Artificial Sequence
  chemically synthesized
taaaatggctgctacttaaa

SEQ ID NO: 557004 - DNA, 20 bp, Artificial Sequence
  chemically synthesized
ggcttcagcttggtttaaaa

SEQ ID NO: 557005 - DNA, 20 bp, Artificial Sequence
  chemically synthesized
aggttgtgagtcataattcg

SEQ ID NO: 557006 - DNA, 20 bp, Artificial Sequence
  chemically synthesized
aaccttatttgaggaaagag

SEQ ID NO: 557007 - DNA, 20 bp, Artificial Sequence
  chemically synthesized
gttatatgcattttcataat

SEQ ID NO: 557008 - DNA, 20 bp, Artificial Sequence
  chemically synthesized
acatagttcccaaaagacaa

SEQ ID NO: 557009 - DNA, 20 bp, Artificial Sequence
  chemically synthesized
tgtacagtgtgttcaatttt

SEQ ID NO: 557010 - DNA, 20 bp, Artificial Sequence
  chemically synthesized
aaaaaatagctaatcattca

SEQ ID NO: 557011 - DNA, 20 bp, Artificial Sequence
  chemically synthesized
aacaggctcttatcatatag

SEQ ID NO: 557012 - DNA, 20 bp, Artificial Sequence
  chemically synthesized
actatgtccctacaaaaatt

SEQ ID NO: 557013 - DNA, 20 bp, Artificial Sequence
  chemically synthesized
tgttatattcgggataggtt

SEQ ID NO: 557014 - DNA, 20 bp, Artificial Sequence
  chemically synthesized
attagcaatcagttggcaga

SEQ ID NO: 557015 - DNA, 20 bp, Artificial Sequence
  chemically synthesized
ttgtcaatgattaaaattca

SEQ ID NO: 557016 - DNA, 20 bp, Artificial Sequence
  chemically synthesized
aatggtgctgttccacattc

SEQ ID NO: 557017 - DNA, 20 bp, Artificial Sequence
  chemically synthesized
tagaatcaattgtggaagaa

SEQ ID NO: 557018 - DNA, 20 bp, Artificial Sequence
  chemically synthesized
ctaaaatctgattacatttg

SEQ ID NO: 557019 - DNA, 20 bp, Artificial Sequence
  chemically synthesized
gcagacacgtttaaggaaaa

SEQ ID NO: 557020 - DNA, 20 bp, Artificial Sequence
  chemically synthesized
taggtcattaattacgcttt

SEQ ID NO: 557021 - DNA, 20 bp, Artificial Sequence
  chemically synthesized
cattataattgatataccaa

SEQ ID NO: 557022 - DNA, 20 bp, Artificial Sequence
  chemically synthesized
aaaagagctcttaaaaatag

SEQ ID NO: 557023 - DNA, 20 bp, Artificial Sequence
  chemically synthesized
actgttaaattttatttaga

SEQ ID NO: 557024 - DNA, 20 bp, Artificial Sequence
  chemically synthesized
ggaaaaaatatcagtttctg

SEQ ID NO: 557025 - DNA, 20 bp, Artificial Sequence
  chemically synthesized
tgtatcattcagtcaaatta

SEQ ID NO: 557026 - DNA, 20 bp, Artificial Sequence
  chemically synthesized
attaaccatatactaattta

SEQ ID NO: 557027 - DNA, 20 bp, Artificial Sequence
  chemically synthesized
ctttttacacgatatttgtg

SEQ ID NO: 557028 - DNA, 20 bp, Artificial Sequence
  chemically synthesized
ccagtgatttaattttttaa

SEQ ID NO: 557029 - DNA, 20 bp, Artificial Sequence
  chemically synthesized
aaacagcatcttttaaatat

SEQ ID NO: 557030 - DNA, 20 bp, Artificial Sequence
  chemically synthesized
tcgaggcttttgaaatttca

SEQ ID NO: 557031 - DNA, 20 bp, Artificial Sequence
  chemically synthesized
taaattcaaattgcagcttt

SEQ ID NO: 557032 - DNA, 20 bp, Artificial Sequence
  chemically synthesized
ttctatgttaaaggtgatca

SEQ ID NO: 557033 - DNA, 20 bp, Artificial Sequence
  chemically synthesized
agtaaagatgatgccctctg

SEQ ID NO: 557034 - DNA, 20 bp, Artificial Sequence
  chemically synthesized
aaagctgtctttacataaca

SEQ ID NO: 557035 - DNA, 20 bp, Artificial Sequence
  chemically synthesized
taaacctgatagaggagggc

SEQ ID NO: 557036 - DNA, 20 bp, Artificial Sequence
  chemically synthesized
gtcatttattttacttcaat

SEQ ID NO: 557037 - DNA, 20 bp, Artificial Sequence
  chemically synthesized
taagttgacccttcccgagg

SEQ ID NO: 557038 - DNA, 20 bp, Artificial Sequence
  chemically synthesized
gacccttcccgagggaaaac

SEQ ID NO: 557039 - DNA, 20 bp, Artificial Sequence
  chemically synthesized
ttcccgagggaaaaccaaaa

SEQ ID NO: 557040 - DNA, 20 bp, Artificial Sequence
  chemically synthesized
gcaacttttgagtagatgtg

SEQ ID NO: 557041 - DNA, 20 bp, Artificial Sequence
  chemically synthesized
gatgtggaaaacgatgaggg

SEQ ID NO: 557042 - DNA, 20 bp, Artificial Sequence
  chemically synthesized
aaatcttgggtttctgcaaa

SEQ ID NO: 557043 - DNA, 20 bp, Artificial Sequence
  chemically synthesized
cttagacacaattctaggat

SEQ ID NO: 557044 - DNA, 20 bp, Artificial Sequence
  chemically synthesized
tacatagataaaagtattta

SEQ ID NO: 557045 - DNA, 20 bp, Artificial Sequence
  chemically synthesized
ttgacaaattttgctgggga

SEQ ID NO: 557046 - DNA, 20 bp, Artificial Sequence
  chemically synthesized
gaaagaacgccctaagcaga

SEQ ID NO: 557047 - DNA, 20 bp, Artificial Sequence
  chemically synthesized
gagtgtagtaagaacgtcct

SEQ ID NO: 557048 - DNA, 20 bp, Artificial Sequence
  chemically synthesized
gaactgggattcaaatcaga

SEQ ID NO: 557049 - DNA, 20 bp, Artificial Sequence
  chemically synthesized
gtttgaatgtctgcgaaggg

SEQ ID NO: 557050 - DNA, 20 bp, Artificial Sequence
  chemically synthesized
acttctacactttcagctta

SEQ ID NO: 557051 - DNA, 20 bp, Artificial Sequence
  chemically synthesized
aaggagaggggcaagggttg

SEQ ID NO: 557052 - DNA, 20 bp, Artificial Sequence
  chemically synthesized
tgggtactcattataaaggt

SEQ ID NO: 557053 - DNA, 20 bp, Artificial Sequence
  chemically synthesized
agtgaattaatgcaggaaca

SEQ ID NO: 557054 - DNA, 20 bp, Artificial Sequence
  chemically synthesized
tggctattattaaaaagtca

SEQ ID NO: 557055 - DNA, 20 bp, Artificial Sequence
  chemically synthesized
tccagtaaaactttatttac

SEQ ID NO: 557056 - DNA, 20 bp, Artificial Sequence
  chemically synthesized
tgagtgtagctctgttccag

SEQ ID NO: 557057 - DNA, 20 bp, Artificial Sequence
  chemically synthesized
ttatttcacaggacaaatag

SEQ ID NO: 557058 - DNA, 20 bp, Artificial Sequence
  chemically synthesized
caaaataggaggtgaaatta

SEQ ID NO: 557059 - DNA, 20 bp, Artificial Sequence
  chemically synthesized
tggaaacatacatagtttga

SEQ ID NO: 557060 - DNA, 20 bp, Artificial Sequence
  chemically synthesized
ctcgcatcatgtagcctctg

SEQ ID NO: 557061 - DNA, 20 bp, Artificial Sequence
  chemically synthesized
taaagagatttgcaaaaatg

SEQ ID NO: 557062 - DNA, 20 bp, Artificial Sequence
  chemically synthesized
tgttgtagaagagatagttt

SEQ ID NO: 557063 - DNA, 20 bp, Artificial Sequence
  chemically synthesized
aaaaaaaaagcagaacaaaa

SEQ ID NO: 557064 - DNA, 20 bp, Artificial Sequence
  chemically synthesized
aaaaaaaaaaaaaagcagaa

SEQ ID NO: 557065 - DNA, 20 bp, Artificial Sequence
  chemically synthesized
gagactccatctcaaaaaat

SEQ ID NO: 557066 - DNA, 20 bp, Artificial Sequence
  chemically synthesized
gctggatattcaggagtgaa

SEQ ID NO: 557067 - DNA, 20 bp, Artificial Sequence
  chemically synthesized
ctaaagttagacatgatacc

SEQ ID NO: 557068 - DNA, 20 bp, Artificial Sequence
  chemically synthesized
aatgagattaataatgttta

SEQ ID NO: 557069 - DNA, 20 bp, Artificial Sequence
  chemically synthesized
aaatttgttgagagtcctgg

SEQ ID NO: 557070 - DNA, 20 bp, Artificial Sequence
  chemically synthesized
taacattgaaattgagccct

SEQ ID NO: 557071 - DNA, 20 bp, Artificial Sequence
  chemically synthesized
aagtggtctacttcaaggat

SEQ ID NO: 557072 - DNA, 20 bp, Artificial Sequence
  chemically synthesized
ccctttggattctagtattt

SEQ ID NO: 557073 - DNA, 20 bp, Artificial Sequence
  chemically synthesized
tcctattgatctgagaacca

SEQ ID NO: 557074 - DNA, 20 bp, Artificial Sequence
  chemically synthesized
aaatttctctgtatgtttac

SEQ ID NO: 557075 - DNA, 20 bp, Artificial Sequence
  chemically synthesized
ctcccagtggagaaaaaaaa

SEQ ID NO: 557076 - DNA, 20 bp, Artificial Sequence
  chemically synthesized
gggtatatatcccaaagaat

SEQ ID NO: 557077 - DNA, 20 bp, Artificial Sequence
  chemically synthesized
ggctactataaaaacaaacc

SEQ ID NO: 557078 - DNA, 20 bp, Artificial Sequence
  chemically synthesized
cctgttaggatggctactat

SEQ ID NO: 557079 - DNA, 20 bp, Artificial Sequence
  chemically synthesized
gtcatcagggaaatgcaaat

SEQ ID NO: 557080 - DNA, 20 bp, Artificial Sequence
  chemically synthesized
attcaaatgtaccaaatagc

SEQ ID NO: 557081 - DNA, 20 bp, Artificial Sequence
  chemically synthesized
aagtactaaacctgtactct

SEQ ID NO: 557082 - DNA, 20 bp, Artificial Sequence
  chemically synthesized
aatttaaaattttccaacaa

SEQ ID NO: 557083 - DNA, 20 bp, Artificial Sequence
  chemically synthesized
cttagaaagacataaattaa

SEQ ID NO: 557084 - DNA, 20 bp, Artificial Sequence
  chemically synthesized
aacattgtcaacaatttctg

SEQ ID NO: 557085 - DNA, 20 bp, Artificial Sequence
  chemically synthesized
tcttttctaaaataggtatt

SEQ ID NO: 557086 - DNA, 20 bp, Artificial Sequence
  chemically synthesized
aacttctaaatccattggtt

SEQ ID NO: 557087 - DNA, 20 bp, Artificial Sequence
  chemically synthesized
atagattctatgctaggtca

SEQ ID NO: 557088 - DNA, 20 bp, Artificial Sequence
  chemically synthesized
aaagagaaatgtattagagc

SEQ ID NO: 557089 - DNA, 20 bp, Artificial Sequence
  chemically synthesized
atctaaagaaatccaaaatc

SEQ ID NO: 557090 - DNA, 20 bp, Artificial Sequence
  chemically synthesized
agtcacagtcaaaacacagc

SEQ ID NO: 557091 - DNA, 20 bp, Artificial Sequence
  chemically synthesized
gacctgtaatgagtcacagt

SEQ ID NO: 557092 - DNA, 20 bp, Artificial Sequence
  chemically synthesized
cactaagaaaataaatagtt

SEQ ID NO: 557093 - DNA, 20 bp, Artificial Sequence
  chemically synthesized
tttaaagaagttaaaagaag

SEQ ID NO: 557094 - DNA, 20 bp, Artificial Sequence
  chemically synthesized
agctgacctgacttacaaga

SEQ ID NO: 557095 - DNA, 20 bp, Artificial Sequence
  chemically synthesized
accaagaattccgcataaaa

SEQ ID NO: 557096 - DNA, 20 bp, Artificial Sequence
  chemically synthesized
tgccaaccaagaattccgca

SEQ ID NO: 557097 - DNA, 20 bp, Artificial Sequence
  chemically synthesized
aagacaaatgggaaagtctt

SEQ ID NO: 557098 - DNA, 20 bp, Artificial Sequence
  chemically synthesized
acacgaagagatcaataccc

SEQ ID NO: 557099 - DNA, 20 bp, Artificial Sequence
  chemically synthesized
catgagtcatagctttgtgt

SEQ ID NO: 557100 - DNA, 20 bp, Artificial Sequence
  chemically synthesized
gtcagaggtaaaacagtata

SEQ ID NO: 557101 - DNA, 20 bp, Artificial Sequence
  chemically synthesized
tccaatctgaatgtcagagg

SEQ ID NO: 557102 - DNA, 20 bp, Artificial Sequence
  chemically synthesized
gttattaaaacttcaattta

SEQ ID NO: 557103 - DNA, 20 bp, Artificial Sequence
  chemically synthesized
atttcatctaggcaagttat

SEQ ID NO: 557104 - DNA, 20 bp, Artificial Sequence
  chemically synthesized
cacatataaagaacctttag

SEQ ID NO: 557105 - DNA, 20 bp, Artificial Sequence
  chemically synthesized
actccttgtgtctccttcat

SEQ ID NO: 557106 - DNA, 20 bp, Artificial Sequence
  chemically synthesized
ttttatttgaagcagaagtt

SEQ ID NO: 557107 - DNA, 20 bp, Artificial Sequence
  chemically synthesized
gtaaaatgggacacactgga

SEQ ID NO: 557108 - DNA, 20 bp, Artificial Sequence
  chemically synthesized
gtataaaggctaattagcaa

SEQ ID NO: 557109 - DNA, 20 bp, Artificial Sequence
  chemically synthesized
gattagagtctatccatgac

SEQ ID NO: 557110 - DNA, 20 bp, Artificial Sequence
  chemically synthesized
ggatagactctaatcattaa

SEQ ID NO: 557111 - DNA, 20 bp, Artificial Sequence
  chemically synthesized
gtcactcacatgtgggagct

SEQ ID NO: 557112 - DNA, 20 bp, Artificial Sequence
  chemically synthesized
ttaccacattaagcacaaga

SEQ ID NO: 557113 - DNA, 20 bp, Artificial Sequence
  chemically synthesized
aattaagtgggaaacatttg

SEQ ID NO: 557114 - DNA, 20 bp, Artificial Sequence
  chemically synthesized
ctgttcatagagtaaatgca

SEQ ID NO: 557115 - DNA, 20 bp, Artificial Sequence
  chemically synthesized
catctcaaagtcagtatatc

SEQ ID NO: 557116 - DNA, 20 bp, Artificial Sequence
  chemically synthesized
ctgtcactcattccagattc

SEQ ID NO: 557117 - DNA, 20 bp, Artificial Sequence
  chemically synthesized
cattcctaaacaaagggata

SEQ ID NO: 557118 - DNA, 20 bp, Artificial Sequence
  chemically synthesized
ccgtttccgcttctatcaac

SEQ ID NO: 557119 - DNA, 20 bp, Artificial Sequence
  chemically synthesized
tatattgtaatctaggagct

SEQ ID NO: 557120 - DNA, 20 bp, Artificial Sequence
  chemically synthesized
tcattttacaaacgattttt

SEQ ID NO: 557121 - DNA, 20 bp, Artificial Sequence
  chemically synthesized
ctatgacaacatataattag

SEQ ID NO: 557122 - DNA, 20 bp, Artificial Sequence
  chemically synthesized
tcctacctttgtttacaaaa

SEQ ID NO: 557123 - DNA, 20 bp, Artificial Sequence
  chemically synthesized
taaaaaaaaaaaaaaaaaaa

SEQ ID NO: 557124 - DNA, 20 bp, Artificial Sequence
  chemically synthesized
aatattggggataaatcagg

SEQ ID NO: 557125 - DNA, 20 bp, Artificial Sequence
  chemically synthesized
cattgaaaataaggtgatca

SEQ ID NO: 557126 - DNA, 20 bp, Artificial Sequence
  chemically synthesized
gcagccagttcccccaagca

SEQ ID NO: 557127 - DNA, 20 bp, Artificial Sequence
  chemically synthesized
agtaagcagaatagaacttt

SEQ ID NO: 557128 - DNA, 20 bp, Artificial Sequence
  chemically synthesized
gatgcaaatctaaagcatat

SEQ ID NO: 557129 - DNA, 20 bp, Artificial Sequence
  chemically synthesized
caattttacaatatttttcc

SEQ ID NO: 557130 - DNA, 20 bp, Artificial Sequence
  chemically synthesized
taagcatattactttttgca

SEQ ID NO: 557131 - DNA, 20 bp, Artificial Sequence
  chemically synthesized
aggaaaaaaaaaaaaaaaaa

SEQ ID NO: 557132 - DNA, 20 bp, Artificial Sequence
  chemically synthesized
acatcgctactaagaaaata

SEQ ID NO: 557133 - DNA, 20 bp, Artificial Sequence
  chemically synthesized
cctatttaattaaatatcat

SEQ ID NO: 557134 - DNA, 20 bp, Artificial Sequence
  chemically synthesized
aggatacttgaacacctttc

SEQ ID NO: 557135 - DNA, 20 bp, Artificial Sequence
  chemically synthesized
tgaaaaaataaaatatgaca

SEQ ID NO: 557136 - DNA, 20 bp, Artificial Sequence
  chemically synthesized
ttggtgatatggattgcatc

SEQ ID NO: 557137 - DNA, 20 bp, Artificial Sequence
  chemically synthesized
ggctatatgtaggatgaggc

SEQ ID NO: 557138 - DNA, 20 bp, Artificial Sequence
  chemically synthesized
tggaaatgtgataacatgat

SEQ ID NO: 557139 - DNA, 20 bp, Artificial Sequence
  chemically synthesized
agtgttataaaaaggggcaa

SEQ ID NO: 557140 - DNA, 20 bp, Artificial Sequence
  chemically synthesized
aaaacaagacaaaaaaaaaa

SEQ ID NO: 557141 - DNA, 20 bp, Artificial Sequence
  chemically synthesized
aaaaaaaaaaacaaagaaca

SEQ ID NO: 557142 - DNA, 20 bp, Artificial Sequence
  chemically synthesized
ttcagcttttgcaaaaaaaa

SEQ ID NO: 557143 - DNA, 20 bp, Artificial Sequence
  chemically synthesized
tttgcaaaagctgaagaaca

SEQ ID NO: 557144 - DNA, 20 bp, Artificial Sequence
  chemically synthesized
cagaaatagtggaaattatg

SEQ ID NO: 557145 - DNA, 20 bp, Artificial Sequence
  chemically synthesized
taccagagaatcctgatgga

SEQ ID NO: 557146 - DNA, 20 bp, Artificial Sequence
  chemically synthesized
gcaacgaaggcacagactga

SEQ ID NO: 557147 - DNA, 20 bp, Artificial Sequence
  chemically synthesized
gttataagtattgagctacg

SEQ ID NO: 557148 - DNA, 20 bp, Artificial Sequence
  chemically synthesized
ttaaaagttgtcaattattt

SEQ ID NO: 557149 - DNA, 20 bp, Artificial Sequence
  chemically synthesized
tgtaagaagccaaagttaaa

SEQ ID NO: 557150 - DNA, 20 bp, Artificial Sequence
  chemically synthesized
ttttgacataaatatagagg

SEQ ID NO: 557151 - DNA, 20 bp, Artificial Sequence
  chemically synthesized
ttaagatcatgtcagattag

SEQ ID NO: 557152 - DNA, 20 bp, Artificial Sequence
  chemically synthesized
tcaccacctgaagcaagtaa

SEQ ID NO: 557153 - DNA, 20 bp, Artificial Sequence
  chemically synthesized
tcccatcaggggaaaaaaaa

SEQ ID NO: 557154 - DNA, 20 bp, Artificial Sequence
  chemically synthesized
ctctaagaatttagggggag

SEQ ID NO: 557155 - DNA, 20 bp, Artificial Sequence
  chemically synthesized
tagaaaaattgaaacaattg

SEQ ID NO: 557156 - DNA, 20 bp, Artificial Sequence
  chemically synthesized
cattaaggtaacacttaaat

SEQ ID NO: 557157 - DNA, 20 bp, Artificial Sequence
  chemically synthesized
agcaataataattaagattt

SEQ ID NO: 557158 - DNA, 20 bp, Artificial Sequence
  chemically synthesized
agggtcttattgttgggctt

SEQ ID NO: 557159 - DNA, 20 bp, Artificial Sequence
  chemically synthesized
atttatgcttatcactactt

SEQ ID NO: 557160 - DNA, 20 bp, Artificial Sequence
  chemically synthesized
tacacgaaggaggtgcaaat

SEQ ID NO: 557161 - DNA, 20 bp, Artificial Sequence
  chemically synthesized
tttaatgatggcgtagccac

SEQ ID NO: 557162 - DNA, 20 bp, Artificial Sequence
  chemically synthesized
tatatggagccctgtagttg

SEQ ID NO: 557163 - DNA, 20 bp, Artificial Sequence
  chemically synthesized
ttaaaagctcagcttaaaaa

SEQ ID NO: 557164 - DNA, 20 bp, Artificial Sequence
  chemically synthesized
tctataatcaagaagatttt

SEQ ID NO: 557165 - DNA, 20 bp, Artificial Sequence
  chemically synthesized
agactattgttatgaacaat

SEQ ID NO: 557166 - DNA, 20 bp, Artificial Sequence
  chemically synthesized
tacaagtttaatggggaaaa

SEQ ID NO: 557167 - DNA, 20 bp, Artificial Sequence
  chemically synthesized
agaggtacaagtttaatggg

SEQ ID NO: 557168 - DNA, 20 bp, Artificial Sequence
  chemically synthesized
gtcatattcatagctatttt

SEQ ID NO: 557169 - DNA, 20 bp, Artificial Sequence
  chemically synthesized
gcaaagatctgtctttccta

SEQ ID NO: 557170 - DNA, 20 bp, Artificial Sequence
  chemically synthesized
tgctttctaaaatcttcttg

SEQ ID NO: 557171 - DNA, 20 bp, Artificial Sequence
  chemically synthesized
acttcaagtttaaaatagca

SEQ ID NO: 557172 - DNA, 20 bp, Artificial Sequence
  chemically synthesized
gcgacagatctaataggaat

SEQ ID NO: 557173 - DNA, 20 bp, Artificial Sequence
  chemically synthesized
gaaataattcagcaatcctc

SEQ ID NO: 557174 - DNA, 20 bp, Artificial Sequence
  chemically synthesized
cctgtaagataccaaaaagg

SEQ ID NO: 557175 - DNA, 20 bp, Artificial Sequence
  chemically synthesized
gctgacaagcttacaaaaat

SEQ ID NO: 557176 - DNA, 20 bp, Artificial Sequence
  chemically synthesized
ggttagtcacagtattaaaa

SEQ ID NO: 557177 - DNA, 20 bp, Artificial Sequence
  chemically synthesized
attttgcattagaagccaca

SEQ ID NO: 557178 - DNA, 20 bp, Artificial Sequence
  chemically synthesized
tattacaaccaagtacacac

SEQ ID NO: 557179 - DNA, 20 bp, Artificial Sequence
  chemically synthesized
cagaataatgtgcgtatgta

SEQ ID NO: 557180 - DNA, 20 bp, Artificial Sequence
  chemically synthesized
ggagctttacctcagtctca

SEQ ID NO: 557181 - DNA, 20 bp, Artificial Sequence
  chemically synthesized
acggtgcctcacaatgaata

SEQ ID NO: 557182 - DNA, 20 bp, Artificial Sequence
  chemically synthesized
ccatgatgtgaccaagagca

SEQ ID NO: 557183 - DNA, 20 bp, Artificial Sequence
  chemically synthesized
ttgcacgatgcagtttattc

SEQ ID NO: 557184 - DNA, 20 bp, Artificial Sequence
  chemically synthesized
aatgggaaaaaaattttgcc

SEQ ID NO: 557185 - DNA, 20 bp, Artificial Sequence
  chemically synthesized
tgaagcaaaagtgccaagat

SEQ ID NO: 557186 - DNA, 20 bp, Artificial Sequence
  chemically synthesized
tatttgggaaaccgaaataa

SEQ ID NO: 557187 - DNA, 20 bp, Artificial Sequence
  chemically synthesized
ctcttctttcacaaaattaa

SEQ ID NO: 557188 - DNA, 20 bp, Artificial Sequence
  chemically synthesized
gtaaatatttctcctggttg

SEQ ID NO: 557189 - DNA, 20 bp, Artificial Sequence
  chemically synthesized
ctttcttatgctttatcact

SEQ ID NO: 557190 - DNA, 20 bp, Artificial Sequence
  chemically synthesized
aagaaagaaaaataagggat

SEQ ID NO: 557191 - DNA, 20 bp, Artificial Sequence
  chemically synthesized
gtgttatcttttccagctca

SEQ ID NO: 557192 - DNA, 20 bp, Artificial Sequence
  chemically synthesized
tgaatgcttaatattggaat

SEQ ID NO: 557193 - DNA, 20 bp, Artificial Sequence
  chemically synthesized
gaaaccactaccttttctat

SEQ ID NO: 557194 - DNA, 20 bp, Artificial Sequence
  chemically synthesized
tttttttaaaagtctatttg

SEQ ID NO: 557195 - DNA, 20 bp, Artificial Sequence
  chemically synthesized
agtctatttgtaaaactttc

SEQ ID NO: 557196 - DNA, 20 bp, Artificial Sequence
  chemically synthesized
aaaactttccaaaactgcat

SEQ ID NO: 557197 - DNA, 20 bp, Artificial Sequence
  chemically synthesized
caaactagggagcaagataa

SEQ ID NO: 557198 - DNA, 20 bp, Artificial Sequence
  chemically synthesized
tgagaatgaccttaggataa

SEQ ID NO: 557199 - DNA, 20 bp, Artificial Sequence
  chemically synthesized
tgaagcacattaaaatctct

SEQ ID NO: 557200 - DNA, 20 bp, Artificial Sequence
  chemically synthesized
aaagcaactaggaaggataa

SEQ ID NO: 557201 - DNA, 20 bp, Artificial Sequence
  chemically synthesized
agcttagctccaatgcccag

SEQ ID NO: 557202 - DNA, 20 bp, Artificial Sequence
  chemically synthesized
taatattcagctgtaaagtc

SEQ ID NO: 557203 - DNA, 20 bp, Artificial Sequence
  chemically synthesized
caaattaacgcaggaacagg

SEQ ID NO: 557204 - DNA, 20 bp, Artificial Sequence
  chemically synthesized
gggagggtgcgcattggttg

SEQ ID NO: 557205 - DNA, 20 bp, Artificial Sequence
  chemically synthesized
agaataatgagaattccttc

SEQ ID NO: 557206 - DNA, 20 bp, Artificial Sequence
  chemically synthesized
aacaacccaagataccctta

SEQ ID NO: 557207 - DNA, 20 bp, Artificial Sequence
  chemically synthesized
gcatttcttggaagagaaag

SEQ ID NO: 557208 - DNA, 20 bp, Artificial Sequence
  chemically synthesized
agccctcagtttcagagggc

SEQ ID NO: 557209 - DNA, 20 bp, Artificial Sequence
  chemically synthesized
atcaaacaaagttctaacgc

SEQ ID NO: 557210 - DNA, 20 bp, Artificial Sequence
  chemically synthesized
ttggtggctcttgttttaaa

SEQ ID NO: 557211 - DNA, 20 bp, Artificial Sequence
  chemically synthesized
tttgtaacaacagttttctt

SEQ ID NO: 557212 - DNA, 20 bp, Artificial Sequence
  chemically synthesized
taacatttattttagcaaac

SEQ ID NO: 557213 - DNA, 20 bp, Artificial Sequence
  chemically synthesized
tgagaacttcaggacaaata

SEQ ID NO: 557214 - DNA, 20 bp, Artificial Sequence
  chemically synthesized
aaatctaagtaaatggagag

SEQ ID NO: 557215 - DNA, 20 bp, Artificial Sequence
  chemically synthesized
catttacttagatttgcaaa

SEQ ID NO: 557216 - DNA, 20 bp, Artificial Sequence
  chemically synthesized
taaccaggatcacttaataa

SEQ ID NO: 557217 - DNA, 20 bp, Artificial Sequence
  chemically synthesized
aacatattgcacgtaactca

SEQ ID NO: 557218 - DNA, 20 bp, Artificial Sequence
  chemically synthesized
tgcacattgtcttatttttg

SEQ ID NO: 557219 - DNA, 20 bp, Artificial Sequence
  chemically synthesized
gtatctaatgtcattggttc

SEQ ID NO: 557220 - DNA, 20 bp, Artificial Sequence
  chemically synthesized
ggactcaaacacatttggag

SEQ ID NO: 557221 - DNA, 20 bp, Artificial Sequence
  chemically synthesized
gaaaacacaagcagcttcat

SEQ ID NO: 557222 - DNA, 20 bp, Artificial Sequence
  chemically synthesized
gtgggtgggagttagggtag

SEQ ID NO: 557223 - DNA, 20 bp, Artificial Sequence
  chemically synthesized
cttaaagcacaacactttct

SEQ ID NO: 557224 - DNA, 20 bp, Artificial Sequence
  chemically synthesized
tacaagcttatttatcattg

SEQ ID NO: 557225 - DNA, 20 bp, Artificial Sequence
  chemically synthesized
atttgttgataaattgagca

SEQ ID NO: 557226 - DNA, 20 bp, Artificial Sequence
  chemically synthesized
gtaggagatgaaactttgat

SEQ ID NO: 557227 - DNA, 20 bp, Artificial Sequence
  chemically synthesized
atacaacagataatgagttg

SEQ ID NO: 557228 - DNA, 20 bp, Artificial Sequence
  chemically synthesized
agatgagaagaggtgatgat

SEQ ID NO: 557229 - DNA, 20 bp, Artificial Sequence
  chemically synthesized
gatatttgtaaaagagtggt

SEQ ID NO: 557230 - DNA, 20 bp, Artificial Sequence
  chemically synthesized
aagctaaattgataagaaag

SEQ ID NO: 557231 - DNA, 20 bp, Artificial Sequence
  chemically synthesized
gccaacatccacttcactcc

SEQ ID NO: 557232 - DNA, 20 bp, Artificial Sequence
  chemically synthesized
aggaatgaaaaaaaaaggga

SEQ ID NO: 557233 - DNA, 20 bp, Artificial Sequence
  chemically synthesized
tgttgctacctggcagtgct

SEQ ID NO: 557234 - DNA, 20 bp, Artificial Sequence
  chemically synthesized
tttaatttttatagactgtg

SEQ ID NO: 557235 - DNA, 20 bp, Artificial Sequence
  chemically synthesized
taaagtaaaaagaaaagaaa

SEQ ID NO: 557236 - DNA, 20 bp, Artificial Sequence
  chemically synthesized
gtaatcagaggaatataagt

SEQ ID NO: 557237 - DNA, 20 bp, Artificial Sequence
  chemically synthesized
aaaatggcacaaccacttta

SEQ ID NO: 557238 - DNA, 20 bp, Artificial Sequence
  chemically synthesized
cagagttactcaaactaaat

SEQ ID NO: 557239 - DNA, 20 bp, Artificial Sequence
  chemically synthesized
gcatcttattcataacagcc

SEQ ID NO: 557240 - DNA, 20 bp, Artificial Sequence
  chemically synthesized
attcataacagccaaaaact

SEQ ID NO: 557241 - DNA, 20 bp, Artificial Sequence
  chemically synthesized
tatacaaatttttaaaaaga

SEQ ID NO: 557242 - DNA, 20 bp, Artificial Sequence
  chemically synthesized
ttttacctcaattaagaaat

SEQ ID NO: 557243 - DNA, 20 bp, Artificial Sequence
  chemically synthesized
tatggacccttcttatgcaa

SEQ ID NO: 557244 - DNA, 20 bp, Artificial Sequence
  chemically synthesized
gcaaatcatcccagtgagta

SEQ ID NO: 557245 - DNA, 20 bp, Artificial Sequence
  chemically synthesized
ttcacatttctaaacaactt

SEQ ID NO: 557246 - DNA, 20 bp, Artificial Sequence
  chemically synthesized
atccactaaaagtgatagaa

SEQ ID NO: 557247 - DNA, 20 bp, Artificial Sequence
  chemically synthesized
ataaattgatataatcttac

SEQ ID NO: 557248 - DNA, 20 bp, Artificial Sequence
  chemically synthesized
tatatatggccatatctctg

SEQ ID NO: 557249 - DNA, 20 bp, Artificial Sequence
  chemically synthesized
atggtagacatgaatttatt

SEQ ID NO: 557250 - DNA, 20 bp, Artificial Sequence
  chemically synthesized
atgatgtcaacatgctccat

SEQ ID NO: 557251 - DNA, 20 bp, Artificial Sequence
  chemically synthesized
cctcatccttggccttaata

SEQ ID NO: 557252 - DNA, 20 bp, Artificial Sequence
  chemically synthesized
tgaagaagggtataaatcaa

SEQ ID NO: 557253 - DNA, 20 bp, Artificial Sequence
  chemically synthesized
gggtataaatcaataaaact

SEQ ID NO: 557254 - DNA, 20 bp, Artificial Sequence
  chemically synthesized
tttctggcatgatcttctgt

SEQ ID NO: 557255 - DNA, 20 bp, Artificial Sequence
  chemically synthesized
cgaatcatcttttttctacc

SEQ ID NO: 557256 - DNA, 20 bp, Artificial Sequence
  chemically synthesized
ttctaatatagcagctttac

SEQ ID NO: 557257 - DNA, 20 bp, Artificial Sequence
  chemically synthesized
ttcaccttcgtgtatcaaaa

SEQ ID NO: 557258 - DNA, 20 bp, Artificial Sequence
  chemically synthesized
tcttgtactcacatgatgaa

SEQ ID NO: 557259 - DNA, 20 bp, Artificial Sequence
  chemically synthesized
taacttgaattacataaata

SEQ ID NO: 557260 - DNA, 20 bp, Artificial Sequence
  chemically synthesized
catgtggcatccttctctat

SEQ ID NO: 557261 - DNA, 20 bp, Artificial Sequence
  chemically synthesized
tcagtatgacctgttactgc

SEQ ID NO: 557262 - DNA, 20 bp, Artificial Sequence
  chemically synthesized
tcataactgagagccagaaa

SEQ ID NO: 557263 - DNA, 20 bp, Artificial Sequence
  chemically synthesized
taactacttatccagatgga

SEQ ID NO: 557264 - DNA, 20 bp, Artificial Sequence
  chemically synthesized
tggatataaagaagctgaaa

SEQ ID NO: 557265 - DNA, 20 bp, Artificial Sequence
  chemically synthesized
gctaatgggacagaactcaa

SEQ ID NO: 557266 - DNA, 20 bp, Artificial Sequence
  chemically synthesized
caagaaaacatcaaaaggtg

SEQ ID NO: 557267 - DNA, 20 bp, Artificial Sequence
  chemically synthesized
actctgtctcagaaaaaaaa

SEQ ID NO: 557268 - DNA, 20 bp, Artificial Sequence
  chemically synthesized
gcgagactctgtctcagaaa

SEQ ID NO: 557269 - DNA, 20 bp, Artificial Sequence
  chemically synthesized
aaaaagtataagcaaaaatg

SEQ ID NO: 557270 - DNA, 20 bp, Artificial Sequence
  chemically synthesized
gcctttgtcctgaaatatta

SEQ ID NO: 557271 - DNA, 20 bp, Artificial Sequence
  chemically synthesized
aactaaaatgggcacagaac

SEQ ID NO: 557272 - DNA, 20 bp, Artificial Sequence
  chemically synthesized
aatcactactgaattgttta

SEQ ID NO: 557273 - DNA, 20 bp, Artificial Sequence
  chemically synthesized
ttatttggggtagaaacctt

SEQ ID NO: 557274 - DNA, 20 bp, Artificial Sequence
  chemically synthesized
cagtaaggtattgcgtatct

SEQ ID NO: 557275 - DNA, 20 bp, Artificial Sequence
  chemically synthesized
ctcattcatatgcacaatct

SEQ ID NO: 557276 - DNA, 20 bp, Artificial Sequence
  chemically synthesized
actatcaggaaaatgcaaat

SEQ ID NO: 557277 - DNA, 20 bp, Artificial Sequence
  chemically synthesized
ggacggtatggaggttcctc

SEQ ID NO: 557278 - DNA, 20 bp, Artificial Sequence
  chemically synthesized
cattataacatttcaggagt

SEQ ID NO: 557279 - DNA, 20 bp, Artificial Sequence
  chemically synthesized
aatttaatataataaaagga

SEQ ID NO: 557280 - DNA, 20 bp, Artificial Sequence
  chemically synthesized
tttttcttgcgcttgtaaat

SEQ ID NO: 557281 - DNA, 20 bp, Artificial Sequence
  chemically synthesized
ggcagccaagttgagtgggg

SEQ ID NO: 557282 - DNA, 20 bp, Artificial Sequence
  chemically synthesized
tgagtggggaaaaacaggag

SEQ ID NO: 557283 - DNA, 20 bp, Artificial Sequence
  chemically synthesized
aaacatgctaatacggggaa

SEQ ID NO: 557284 - DNA, 20 bp, Artificial Sequence
  chemically synthesized
agggaggggagcaagtgctg

SEQ ID NO: 557285 - DNA, 20 bp, Artificial Sequence
  chemically synthesized
cttaggggaacattcataga

SEQ ID NO: 557286 - DNA, 20 bp, Artificial Sequence
  chemically synthesized
acattaagcgctagtttatc

SEQ ID NO: 557287 - DNA, 20 bp, Artificial Sequence
  chemically synthesized
actactctactgttgtggat

SEQ ID NO: 557288 - DNA, 20 bp, Artificial Sequence
  chemically synthesized
aataagttaagcaacacatt

SEQ ID NO: 557289 - DNA, 20 bp, Artificial Sequence
  chemically synthesized
tgaggatgtactagcaatgt

SEQ ID NO: 557290 - DNA, 20 bp, Artificial Sequence
  chemically synthesized
catcctcagattaaatatac

SEQ ID NO: 557291 - DNA, 20 bp, Artificial Sequence
  chemically synthesized
ctattgtcttgaacattaat

SEQ ID NO: 557292 - DNA, 20 bp, Artificial Sequence
  chemically synthesized
aataatttatgagttttcct

SEQ ID NO: 557293 - DNA, 20 bp, Artificial Sequence
  chemically synthesized
aaacctgtattggttttcag

SEQ ID NO: 557294 - DNA, 20 bp, Artificial Sequence
  chemically synthesized
aaccatgtcttatcaactct

SEQ ID NO: 557295 - DNA, 20 bp, Artificial Sequence
  chemically synthesized
gcataatattgagattatat

SEQ ID NO: 557296 - DNA, 20 bp, Artificial Sequence
  chemically synthesized
tatcatatcgtttgtctcct

SEQ ID NO: 557297 - DNA, 20 bp, Artificial Sequence
  chemically synthesized
tacaggttggaacagagata

SEQ ID NO: 557298 - DNA, 20 bp, Artificial Sequence
  chemically synthesized
tgaggtcagagtgagaaaga

SEQ ID NO: 557299 - DNA, 20 bp, Artificial Sequence
  chemically synthesized
tttgacacatgagaggaata

SEQ ID NO: 557300 - DNA, 20 bp, Artificial Sequence
  chemically synthesized
aacataaaataaacaactaa

SEQ ID NO: 557301 - DNA, 20 bp, Artificial Sequence
  chemically synthesized
ataaagaatatgaagagact

SEQ ID NO: 557302 - DNA, 20 bp, Artificial Sequence
  chemically synthesized
tgaatttcagcaggaggaat

SEQ ID NO: 557303 - DNA, 20 bp, Artificial Sequence
  chemically synthesized
tttaagaaaaactagctaca

SEQ ID NO: 557304 - DNA, 20 bp, Artificial Sequence
  chemically synthesized
aagccagtttattctttaag

SEQ ID NO: 557305 - DNA, 20 bp, Artificial Sequence
  chemically synthesized
tgcctccatgagcaggccat

SEQ ID NO: 557306 - DNA, 20 bp, Artificial Sequence
  chemically synthesized
gaggagaggagtgagccaag

SEQ ID NO: 557307 - DNA, 20 bp, Artificial Sequence
  chemically synthesized
ccttccaataaattacccta

SEQ ID NO: 557308 - DNA, 20 bp, Artificial Sequence
  chemically synthesized
gtctcttacagattcacatg

SEQ ID NO: 557309 - DNA, 20 bp, Artificial Sequence
  chemically synthesized
gtaaatggaagcaaacagag

SEQ ID NO: 557310 - DNA, 20 bp, Artificial Sequence
  chemically synthesized
acagcatgataattttagct

SEQ ID NO: 557311 - DNA, 20 bp, Artificial Sequence
  chemically synthesized
gctgagggattgtatacacc

SEQ ID NO: 557312 - DNA, 20 bp, Artificial Sequence
  chemically synthesized
tatttttagcatggttagac

SEQ ID NO: 557313 - DNA, 20 bp, Artificial Sequence
  chemically synthesized
tgcaaacaaaattcagttga

SEQ ID NO: 557314 - DNA, 20 bp, Artificial Sequence
  chemically synthesized
ataaccctacgtatcatctg

SEQ ID NO: 557315 - DNA, 20 bp, Artificial Sequence
  chemically synthesized
tactcctgtataacttggaa

SEQ ID NO: 557316 - DNA, 20 bp, Artificial Sequence
  chemically synthesized
cataaattatccacaaaatg

SEQ ID NO: 557317 - DNA, 20 bp, Artificial Sequence
  chemically synthesized
gtggtggtgctcacaaaaaa

SEQ ID NO: 557318 - DNA, 20 bp, Artificial Sequence
  chemically synthesized
agtatgaatctttgaaatac

SEQ ID NO: 557319 - DNA, 20 bp, Artificial Sequence
  chemically synthesized
atgtaatggcaactgggaac

SEQ ID NO: 557320 - DNA, 20 bp, Artificial Sequence
  chemically synthesized
gcactgaattttcagtaatt

SEQ ID NO: 557321 - DNA, 20 bp, Artificial Sequence
  chemically synthesized
ttgcaggcatataaccggtc

SEQ ID NO: 557322 - DNA, 20 bp, Artificial Sequence
  chemically synthesized
tataaccggtccaaaacaat

SEQ ID NO: 557323 - DNA, 20 bp, Artificial Sequence
  chemically synthesized
ctggaagctctaaaaaaaca

SEQ ID NO: 557324 - DNA, 20 bp, Artificial Sequence
  chemically synthesized
aattactctggaagctctaa

SEQ ID NO: 557325 - DNA, 20 bp, Artificial Sequence
  chemically synthesized
tccaacttgtagctaagatt

SEQ ID NO: 557326 - DNA, 20 bp, Artificial Sequence
  chemically synthesized
tgaaaatactgagtaataat

SEQ ID NO: 557327 - DNA, 20 bp, Artificial Sequence
  chemically synthesized
actgtttgtcagcccatgac

SEQ ID NO: 557328 - DNA, 20 bp, Artificial Sequence
  chemically synthesized
tttcaagtatcctaacagtt

SEQ ID NO: 557329 - DNA, 20 bp, Artificial Sequence
  chemically synthesized
atcctaacagttaaaaacac

SEQ ID NO: 557330 - DNA, 20 bp, Artificial Sequence
  chemically synthesized
gctgatttgtaaacaaaaat

SEQ ID NO: 557331 - DNA, 20 bp, Artificial Sequence
  chemically synthesized
ctgtgaaatctttttatttg

SEQ ID NO: 557332 - DNA, 20 bp, Artificial Sequence
  chemically synthesized
gatgattatcagtacaaatt

SEQ ID NO: 557333 - DNA, 20 bp, Artificial Sequence
  chemically synthesized
attagccaaactcaaaaggc

SEQ ID NO: 557334 - DNA, 20 bp, Artificial Sequence
  chemically synthesized
taaacaccttcaatgccttc

SEQ ID NO: 557335 - DNA, 20 bp, Artificial Sequence
  chemically synthesized
tttgttaaaatgttcaaata

SEQ ID NO: 557336 - DNA, 20 bp, Artificial Sequence
  chemically synthesized
tggctcattcaaaggaggtt

SEQ ID NO: 557337 - DNA, 20 bp, Artificial Sequence
  chemically synthesized
tcactggtgttatgtgaaaa

SEQ ID NO: 557338 - DNA, 20 bp, Artificial Sequence
  chemically synthesized
taattgaaattaaataaagt

SEQ ID NO: 557339 - DNA, 20 bp, Artificial Sequence
  chemically synthesized
gtaggactgcatatgtttgt

SEQ ID NO: 557340 - DNA, 20 bp, Artificial Sequence
  chemically synthesized
gcatgtaaattatacctcaa

SEQ ID NO: 557341 - DNA, 20 bp, Artificial Sequence
  chemically synthesized
tcactaatattatatgaatc

SEQ ID NO: 557342 - DNA, 20 bp, Artificial Sequence
  chemically synthesized
gaatctaaaacagtggccgg

SEQ ID NO: 557343 - DNA, 20 bp, Artificial Sequence
  chemically synthesized
ctatcatccttattctaaaa

SEQ ID NO: 557344 - DNA, 20 bp, Artificial Sequence
  chemically synthesized
gaaaatatgctctgaaggag

SEQ ID NO: 557345 - DNA, 20 bp, Artificial Sequence
  chemically synthesized
acaggcactgtttttaattc

SEQ ID NO: 557346 - DNA, 20 bp, Artificial Sequence
  chemically synthesized
cattactttgttttggaatt

SEQ ID NO: 557347 - DNA, 20 bp, Artificial Sequence
  chemically synthesized
aaacaaagtaatgcataaac

SEQ ID NO: 557348 - DNA, 20 bp, Artificial Sequence
  chemically synthesized
ctagggtgctaaaattgctt

SEQ ID NO: 557349 - DNA, 20 bp, Artificial Sequence
  chemically synthesized
gctggaaaatacgggctcct

SEQ ID NO: 557350 - DNA, 20 bp, Artificial Sequence
  chemically synthesized
tgagaagaaactaacaaaaa

SEQ ID NO: 557351 - DNA, 20 bp, Artificial Sequence
  chemically synthesized
agtcttgagaagaaactaac

SEQ ID NO: 557352 - DNA, 20 bp, Artificial Sequence
  chemically synthesized
caaaatgatttagttaattt

SEQ ID NO: 557353 - DNA, 20 bp, Artificial Sequence
  chemically synthesized
ttgatttaagtgcaggaaca

SEQ ID NO: 557354 - DNA, 20 bp, Artificial Sequence
  chemically synthesized
tctgcccacactgaatcttt

SEQ ID NO: 557355 - DNA, 20 bp, Artificial Sequence
  chemically synthesized
aaaaacacagagtagttgga

SEQ ID NO: 557356 - DNA, 20 bp, Artificial Sequence
  chemically synthesized
tactaattatacacatatag

SEQ ID NO: 557357 - DNA, 20 bp, Artificial Sequence
  chemically synthesized
attttatttaattttgacaa

SEQ ID NO: 557358 - DNA, 20 bp, Artificial Sequence
  chemically synthesized
ccagaacatatgtctctgcc

SEQ ID NO: 557359 - DNA, 20 bp, Artificial Sequence
  chemically synthesized
attacccctactttacatct

SEQ ID NO: 557360 - DNA, 20 bp, Artificial Sequence
  chemically synthesized
atctattttaggaataaaac

SEQ ID NO: 557361 - DNA, 20 bp, Artificial Sequence
  chemically synthesized
tgattaatctattttaggaa

SEQ ID NO: 557362 - DNA, 20 bp, Artificial Sequence
  chemically synthesized
taaaagacatactgttatta

SEQ ID NO: 557363 - DNA, 20 bp, Artificial Sequence
  chemically synthesized
aaaaaccacatatctgtgga

SEQ ID NO: 557364 - DNA, 20 bp, Artificial Sequence
  chemically synthesized
aatggaagtataagatcaat

SEQ ID NO: 557365 - DNA, 20 bp, Artificial Sequence
  chemically synthesized
aactgggatcagagaacaac

SEQ ID NO: 557366 - DNA, 20 bp, Artificial Sequence
  chemically synthesized
aaaaaaaaagtgacaaagaa

SEQ ID NO: 557367 - DNA, 20 bp, Artificial Sequence
  chemically synthesized
ccaaatctttaatcattatg

SEQ ID NO: 557368 - DNA, 20 bp, Artificial Sequence
  chemically synthesized
gggtgcagtcttcagcaaag

SEQ ID NO: 557369 - DNA, 20 bp, Artificial Sequence
  chemically synthesized
tctaaaaataataataaatc

SEQ ID NO: 557370 - DNA, 20 bp, Artificial Sequence
  chemically synthesized
aaaacatttatttgcttgat

SEQ ID NO: 557371 - DNA, 20 bp, Artificial Sequence
  chemically synthesized
ctcttaatcaaaaggcccta

SEQ ID NO: 557372 - DNA, 20 bp, Artificial Sequence
  chemically synthesized
agtaaactatcgcaagaaca

SEQ ID NO: 557373 - DNA, 20 bp, Artificial Sequence
  chemically synthesized
cacattgtgcacatgtaccc

SEQ ID NO: 557374 - DNA, 20 bp, Artificial Sequence
  chemically synthesized
ccacagtctcttattcatac

SEQ ID NO: 557375 - DNA, 20 bp, Artificial Sequence
  chemically synthesized
tgaataagagactgtggtag

SEQ ID NO: 557376 - DNA, 20 bp, Artificial Sequence
  chemically synthesized
tgtggtagaaaaacattttt

SEQ ID NO: 557377 - DNA, 20 bp, Artificial Sequence
  chemically synthesized
cattacattagttaccagct

SEQ ID NO: 557378 - DNA, 20 bp, Artificial Sequence
  chemically synthesized
gataacgttgtgtgttacag

SEQ ID NO: 557379 - DNA, 20 bp, Artificial Sequence
  chemically synthesized
cctctttgccctatgcctca

SEQ ID NO: 557380 - DNA, 20 bp, Artificial Sequence
  chemically synthesized
gatagttccatgaacaacta

SEQ ID NO: 557381 - DNA, 20 bp, Artificial Sequence
  chemically synthesized
tcctgaattgccaacatgta

SEQ ID NO: 557382 - DNA, 20 bp, Artificial Sequence
  chemically synthesized
ctacgaataagatttttaga

SEQ ID NO: 557383 - DNA, 20 bp, Artificial Sequence
  chemically synthesized
gtgcatgaagggatctagag

SEQ ID NO: 557384 - DNA, 20 bp, Artificial Sequence
  chemically synthesized
cctgtgtgaggcaggaggga

SEQ ID NO: 557385 - DNA, 20 bp, Artificial Sequence
  chemically synthesized
gaagccaaacgagaaaagat

SEQ ID NO: 557386 - DNA, 20 bp, Artificial Sequence
  chemically synthesized
ctatgaagaaaaaatggtta

SEQ ID NO: 557387 - DNA, 20 bp, Artificial Sequence
  chemically synthesized
caatcagatttctattcttg

SEQ ID NO: 557388 - DNA, 20 bp, Artificial Sequence
  chemically synthesized
gaatgattgctgagttttct

SEQ ID NO: 557389 - DNA, 20 bp, Artificial Sequence
  chemically synthesized
tggcaagaatgatgttttca

SEQ ID NO: 557390 - DNA, 20 bp, Artificial Sequence
  chemically synthesized
ccagaataattgagtgagct

SEQ ID NO: 557391 - DNA, 20 bp, Artificial Sequence
  chemically synthesized
gaagaatgtttaactggaaa

SEQ ID NO: 557392 - DNA, 20 bp, Artificial Sequence
  chemically synthesized
ggaagcacttttaaaaatag

SEQ ID NO: 557393 - DNA, 20 bp, Artificial Sequence
  chemically synthesized
tgaaaagttctgatatttca

SEQ ID NO: 557394 - DNA, 20 bp, Artificial Sequence
  chemically synthesized
agagttgtattaaaaatgct

SEQ ID NO: 557395 - DNA, 20 bp, Artificial Sequence
  chemically synthesized
cctccttgcttatcaggtga

SEQ ID NO: 557396 - DNA, 20 bp, Artificial Sequence
  chemically synthesized
ttgggtcagagattaaagat

SEQ ID NO: 557397 - DNA, 20 bp, Artificial Sequence
  chemically synthesized
gtttttgggagtagggccaa

SEQ ID NO: 557398 - DNA, 20 bp, Artificial Sequence
  chemically synthesized
gttttcttggccctactccc

SEQ ID NO: 557399 - DNA, 20 bp, Artificial Sequence
  chemically synthesized
ccccattccagatctcactt

SEQ ID NO: 557400 - DNA, 20 bp, Artificial Sequence
  chemically synthesized
tactctccatctgcattttt

SEQ ID NO: 557401 - DNA, 20 bp, Artificial Sequence
  chemically synthesized
gttttgccaagttccacaaa

SEQ ID NO: 557402 - DNA, 20 bp, Artificial Sequence
  chemically synthesized
gttttttttgtggaacttgg

SEQ ID NO: 557403 - DNA, 20 bp, Artificial Sequence
  chemically synthesized
tcatgaaatcttaaagaaga

SEQ ID NO: 557404 - DNA, 20 bp, Artificial Sequence
  chemically synthesized
gggattgttctccattaggc

SEQ ID NO: 557405 - DNA, 20 bp, Artificial Sequence
  chemically synthesized
tattctaaaaatgctgatga

SEQ ID NO: 557406 - DNA, 20 bp, Artificial Sequence
  chemically synthesized
aacacagatgaaaagttttt

SEQ ID NO: 557407 - DNA, 20 bp, Artificial Sequence
  chemically synthesized
actgaagccctgatgttttt

SEQ ID NO: 557408 - DNA, 20 bp, Artificial Sequence
  chemically synthesized
ttgatgcttcaaaattattg

SEQ ID NO: 557409 - DNA, 20 bp, Artificial Sequence
  chemically synthesized
tgttgacctgaaatacattg

SEQ ID NO: 557410 - DNA, 20 bp, Artificial Sequence
  chemically synthesized
gataaagaagtcatgtgcaa

SEQ ID NO: 557411 - DNA, 20 bp, Artificial Sequence
  chemically synthesized
tgtgtcttcagatgaaagga

SEQ ID NO: 557412 - DNA, 20 bp, Artificial Sequence
  chemically synthesized
ttcagatcctactctttcta

SEQ ID NO: 557413 - DNA, 20 bp, Artificial Sequence
  chemically synthesized
cattagatgctggaacttgc

SEQ ID NO: 557414 - DNA, 20 bp, Artificial Sequence
  chemically synthesized
aaaaaatgatgatgtctttg

SEQ ID NO: 557415 - DNA, 20 bp, Artificial Sequence
  chemically synthesized
tgttccctttgacaaaaaga

SEQ ID NO: 557416 - DNA, 20 bp, Artificial Sequence
  chemically synthesized
tacaagataatctttgaatt

SEQ ID NO: 557417 - DNA, 20 bp, Artificial Sequence
  chemically synthesized
tgactaaaacatgaatacct

SEQ ID NO: 557418 - DNA, 20 bp, Artificial Sequence
  chemically synthesized
aaagtataatcacatttgac

SEQ ID NO: 557419 - DNA, 20 bp, Artificial Sequence
  chemically synthesized
aataattatcttatttgttc

SEQ ID NO: 557420 - DNA, 20 bp, Artificial Sequence
  chemically synthesized
ctacctccacttgcaggggt

SEQ ID NO: 557421 - DNA, 20 bp, Artificial Sequence
  chemically synthesized
aaatttttaaacatgcacta

SEQ ID NO: 557422 - DNA, 20 bp, Artificial Sequence
  chemically synthesized
tgttgtggtttgtgatgaac

SEQ ID NO: 557423 - DNA, 20 bp, Artificial Sequence
  chemically synthesized
tttgtgatgaacaaaaacat

SEQ ID NO: 557424 - DNA, 20 bp, Artificial Sequence
  chemically synthesized
cattgatgaacgtaaatatg

SEQ ID NO: 557425 - DNA, 20 bp, Artificial Sequence
  chemically synthesized
aagttcaaatccaggcaaac

SEQ ID NO: 557426 - DNA, 20 bp, Artificial Sequence
  chemically synthesized
taaacaatgctcatttttta

SEQ ID NO: 557427 - DNA, 20 bp, Artificial Sequence
  chemically synthesized
aatatggctagtagaaaatt

SEQ ID NO: 557428 - DNA, 20 bp, Artificial Sequence
  chemically synthesized
ctccttttatccttaagggt

SEQ ID NO: 557429 - DNA, 20 bp, Artificial Sequence
  chemically synthesized
tttatattgtatttagaaag

SEQ ID NO: 557430 - DNA, 20 bp, Artificial Sequence
  chemically synthesized
aaccagttcaatggaactta

SEQ ID NO: 557431 - DNA, 20 bp, Artificial Sequence
  chemically synthesized
tctgactctagcagatttta

SEQ ID NO: 557432 - DNA, 20 bp, Artificial Sequence
  chemically synthesized
tccagcctgggcgacaagag

SEQ ID NO: 557433 - DNA, 20 bp, Artificial Sequence
  chemically synthesized
agttattatacagtaattga

SEQ ID NO: 557434 - DNA, 20 bp, Artificial Sequence
  chemically synthesized
tgtatgtctcactctgtcaa

SEQ ID NO: 557435 - DNA, 20 bp, Artificial Sequence
  chemically synthesized
gtcaataaaactgcacttac

SEQ ID NO: 557436 - DNA, 20 bp, Artificial Sequence
  chemically synthesized
atggaatactacacagccat

SEQ ID NO: 557437 - DNA, 20 bp, Artificial Sequence
  chemically synthesized
aaattataaaaagaaaaaaa

SEQ ID NO: 557438 - DNA, 20 bp, Artificial Sequence
  chemically synthesized
ggtgaagccctgtctctact

SEQ ID NO: 557439 - DNA, 20 bp, Artificial Sequence
  chemically synthesized
tagctaaataagtataataa

SEQ ID NO: 557440 - DNA, 20 bp, Artificial Sequence
  chemically synthesized
ttgcatttattgaagaagaa

SEQ ID NO: 557441 - DNA, 20 bp, Artificial Sequence
  chemically synthesized
agaggcatttaatgttaaaa

SEQ ID NO: 557442 - DNA, 20 bp, Artificial Sequence
  chemically synthesized
ctctgggttgagagtactat

SEQ ID NO: 557443 - DNA, 20 bp, Artificial Sequence
  chemically synthesized
aagtgtggcacagtaggaat

SEQ ID NO: 557444 - DNA, 20 bp, Artificial Sequence
  chemically synthesized
acaagtgagaaagtgaatag

SEQ ID NO: 557445 - DNA, 20 bp, Artificial Sequence
  chemically synthesized
gctgccacttagaagcatat

SEQ ID NO: 557446 - DNA, 20 bp, Artificial Sequence
  chemically synthesized
agcattaaattagcatgttg

SEQ ID NO: 557447 - DNA, 20 bp, Artificial Sequence
  chemically synthesized
tgttactaaaccctgaagac

SEQ ID NO: 557448 - DNA, 20 bp, Artificial Sequence
  chemically synthesized
cctgagatttaatatgctgc

SEQ ID NO: 557449 - DNA, 20 bp, Artificial Sequence
  chemically synthesized
ccaaaacaaaatattattca

SEQ ID NO: 557450 - DNA, 20 bp, Artificial Sequence
  chemically synthesized
ggtttgatgcagggaaaaat

SEQ ID NO: 557451 - DNA, 20 bp, Artificial Sequence
  chemically synthesized
aaagaaatgactgttcaaat

SEQ ID NO: 557452 - DNA, 20 bp, Artificial Sequence
  chemically synthesized
cttttaatttctataagatc

SEQ ID NO: 557453 - DNA, 20 bp, Artificial Sequence
  chemically synthesized
ctcgagtataatcagcacta

SEQ ID NO: 557454 - DNA, 20 bp, Artificial Sequence
  chemically synthesized
tataatgctatattatcaaa

SEQ ID NO: 557455 - DNA, 20 bp, Artificial Sequence
  chemically synthesized
ttcctgggcttcagtatgtt

SEQ ID NO: 557456 - DNA, 20 bp, Artificial Sequence
  chemically synthesized
taggtagaggtcaaacttca

SEQ ID NO: 557457 - DNA, 20 bp, Artificial Sequence
  chemically synthesized
tgaggtagaaatattgaaat

SEQ ID NO: 557458 - DNA, 20 bp, Artificial Sequence
  chemically synthesized
agaagatcacagtaagttct

SEQ ID NO: 557459 - DNA, 20 bp, Artificial Sequence
  chemically synthesized
tttacttagcaaaacaaatt

SEQ ID NO: 557460 - DNA, 20 bp, Artificial Sequence
  chemically synthesized
tcatgactaagtttacttag

SEQ ID NO: 557461 - DNA, 20 bp, Artificial Sequence
  chemically synthesized
tgagaatggagttaaaaaat

SEQ ID NO: 557462 - DNA, 20 bp, Artificial Sequence
  chemically synthesized
actgctatctccttatcatc

SEQ ID NO: 557463 - DNA, 20 bp, Artificial Sequence
  chemically synthesized
ccttggtaaagtcacttgac

SEQ ID NO: 557464 - DNA, 20 bp, Artificial Sequence
  chemically synthesized
aaagcacaacagtgctacta

SEQ ID NO: 557465 - DNA, 20 bp, Artificial Sequence
  chemically synthesized
aagctgcactcaaattaatc

SEQ ID NO: 557466 - DNA, 20 bp, Artificial Sequence
  chemically synthesized
ttctactggttcacgtcatt

SEQ ID NO: 557467 - DNA, 20 bp, Artificial Sequence
  chemically synthesized
ttgaatttgtgggagatgag

SEQ ID NO: 557468 - DNA, 20 bp, Artificial Sequence
  chemically synthesized
acacagataatattggcgtt

SEQ ID NO: 557469 - DNA, 20 bp, Artificial Sequence
  chemically synthesized
ctttgcatgaggtgagtggg

SEQ ID NO: 557470 - DNA, 20 bp, Artificial Sequence
  chemically synthesized
cttacttgaaataaggtatc

SEQ ID NO: 557471 - DNA, 20 bp, Artificial Sequence
  chemically synthesized
caagctgcctcattccagta

SEQ ID NO: 557472 - DNA, 20 bp, Artificial Sequence
  chemically synthesized
tccctggcaaggaatttgga

SEQ ID NO: 557473 - DNA, 20 bp, Artificial Sequence
  chemically synthesized
aaactgcttgcactatttaa

SEQ ID NO: 557474 - DNA, 20 bp, Artificial Sequence
  chemically synthesized
tatatttttcactgagaaat

SEQ ID NO: 557475 - DNA, 20 bp, Artificial Sequence
  chemically synthesized
ttgagattatttttcctgta

SEQ ID NO: 557476 - DNA, 20 bp, Artificial Sequence
  chemically synthesized
cattaaaataattatggctc

SEQ ID NO: 557477 - DNA, 20 bp, Artificial Sequence
  chemically synthesized
taattatggctctaaaactg

SEQ ID NO: 557478 - DNA, 20 bp, Artificial Sequence
  chemically synthesized
tttttaaatcaaatatgcct

SEQ ID NO: 557479 - DNA, 20 bp, Artificial Sequence
  chemically synthesized
agtaaggacacaagaattac

SEQ ID NO: 557480 - DNA, 20 bp, Artificial Sequence
  chemically synthesized
agcagaaatacaggcttcta

SEQ ID NO: 557481 - DNA, 20 bp, Artificial Sequence
  chemically synthesized
ctcctctactagagtgttag

SEQ ID NO: 557482 - DNA, 20 bp, Artificial Sequence
  chemically synthesized
tgaattcatgtcccaacgaa

SEQ ID NO: 557483 - DNA, 20 bp, Artificial Sequence
  chemically synthesized
tctcttttccttgtaactct

SEQ ID NO: 557484 - DNA, 20 bp, Artificial Sequence
  chemically synthesized
aaagctagagtaatttttta

SEQ ID NO: 557485 - DNA, 20 bp, Artificial Sequence
  chemically synthesized
ctgatctcctgcttagattt

SEQ ID NO: 557486 - DNA, 20 bp, Artificial Sequence
  chemically synthesized
attttccccatctttacacc

SEQ ID NO: 557487 - DNA, 20 bp, Artificial Sequence
  chemically synthesized
tgtaagaacgtatttaacaa

SEQ ID NO: 557488 - DNA, 20 bp, Artificial Sequence
  chemically synthesized
gaggaaaagaggtcctagat

SEQ ID NO: 557489 - DNA, 20 bp, Artificial Sequence
  chemically synthesized
actgtcaactctgttctgct

SEQ ID NO: 557490 - DNA, 20 bp, Artificial Sequence
  chemically synthesized
tagtatttttgtttaatcat

SEQ ID NO: 557491 - DNA, 20 bp, Artificial Sequence
  chemically synthesized
atctctaaaatcacatttgt

SEQ ID NO: 557492 - DNA, 20 bp, Artificial Sequence
  chemically synthesized
tatttctaatgatagattct

SEQ ID NO: 557493 - DNA, 20 bp, Artificial Sequence
  chemically synthesized
ttattaaagatataatacac

SEQ ID NO: 557494 - DNA, 20 bp, Artificial Sequence
  chemically synthesized
gtggaaaatctcggtaccaa

SEQ ID NO: 557495 - DNA, 20 bp, Artificial Sequence
  chemically synthesized
atcctcatataataatagta

SEQ ID NO: 557496 - DNA, 20 bp, Artificial Sequence
  chemically synthesized
gtgaaacaaaagtccatcag

SEQ ID NO: 557497 - DNA, 20 bp, Artificial Sequence
  chemically synthesized
gagaagatcagtaacttatc

SEQ ID NO: 557498 - DNA, 20 bp, Artificial Sequence
  chemically synthesized
tggttctcattttcatctga

SEQ ID NO: 557499 - DNA, 20 bp, Artificial Sequence
  chemically synthesized
ggggggatatttattccagg

SEQ ID NO: 557500 - DNA, 20 bp, Artificial Sequence
  chemically synthesized
tgatgtgtaagttgtgtcta

SEQ ID NO: 557501 - DNA, 20 bp, Artificial Sequence
  chemically synthesized
ctctgggttgtttcttcatt

SEQ ID NO: 557502 - DNA, 20 bp, Artificial Sequence
  chemically synthesized
tccagaccagagaatgattt

SEQ ID NO: 557503 - DNA, 20 bp, Artificial Sequence
  chemically synthesized
cttatgtctactgtactagg

SEQ ID NO: 557504 - DNA, 20 bp, Artificial Sequence
  chemically synthesized
attcagaaccaaggtgcaga

SEQ ID NO: 557505 - DNA, 20 bp, Artificial Sequence
  chemically synthesized
cctaaatggaaaccaatgaa

SEQ ID NO: 557506 - DNA, 20 bp, Artificial Sequence
  chemically synthesized
cccctttctacttgaagaca

SEQ ID NO: 557507 - DNA, 20 bp, Artificial Sequence
  chemically synthesized
acagtattccccaaattctt

SEQ ID NO: 557508 - DNA, 20 bp, Artificial Sequence
  chemically synthesized
actgaggaagtatcagtaaa

SEQ ID NO: 557509 - DNA, 20 bp, Artificial Sequence
  chemically synthesized
gtgatgtacaggaaagaaac

SEQ ID NO: 557510 - DNA, 20 bp, Artificial Sequence
  chemically synthesized
tataataataatgagagtta

SEQ ID NO: 557511 - DNA, 20 bp, Artificial Sequence
  chemically synthesized
agtaatagcctaaatagaaa

SEQ ID NO: 557512 - DNA, 20 bp, Artificial Sequence
  chemically synthesized
gaagggggaagagcccttta

SEQ ID NO: 557513 - DNA, 20 bp, Artificial Sequence
  chemically synthesized
tatcaggagaacagcatggg

SEQ ID NO: 557514 - DNA, 20 bp, Artificial Sequence
  chemically synthesized
ttcatattgaatgcttgtgt

SEQ ID NO: 557515 - DNA, 20 bp, Artificial Sequence
  chemically synthesized
accatgtactcacaaagata

SEQ ID NO: 557516 - DNA, 20 bp, Artificial Sequence
  chemically synthesized
ataaaaaacccattgaaaga

SEQ ID NO: 557517 - DNA, 20 bp, Artificial Sequence
  chemically synthesized
atatacactgaaatatctat

SEQ ID NO: 557518 - DNA, 20 bp, Artificial Sequence
  chemically synthesized
tgttaacagcctattaaaaa

SEQ ID NO: 557519 - DNA, 20 bp, Artificial Sequence
  chemically synthesized
aaataatagcatttctactt

SEQ ID NO: 557520 - DNA, 20 bp, Artificial Sequence
  chemically synthesized
gggatctgtccccatgaccc

SEQ ID NO: 557521 - DNA, 20 bp, Artificial Sequence
  chemically synthesized
tcactacactgaggacaata

SEQ ID NO: 557522 - DNA, 20 bp, Artificial Sequence
  chemically synthesized
aaaaaaaaaccagatctcat

SEQ ID NO: 557523 - DNA, 20 bp, Artificial Sequence
  chemically synthesized
gatgcccacacactttaaaa

SEQ ID NO: 557524 - DNA, 20 bp, Artificial Sequence
  chemically synthesized
catcaccttctgccatgagc

SEQ ID NO: 557525 - DNA, 20 bp, Artificial Sequence
  chemically synthesized
acatttaaaaaaaaaaaaaa

SEQ ID NO: 557526 - DNA, 20 bp, Artificial Sequence
  chemically synthesized
gccacacatttaaaaaaaaa

SEQ ID NO: 557527 - DNA, 20 bp, Artificial Sequence
  chemically synthesized
aataggaataaaatcggcag

SEQ ID NO: 557528 - DNA, 20 bp, Artificial Sequence
  chemically synthesized
ttcaatttaaattaaaaagg

SEQ ID NO: 557529 - DNA, 20 bp, Artificial Sequence
  chemically synthesized
attattctgtctttaggatt

SEQ ID NO: 557530 - DNA, 20 bp, Artificial Sequence
  chemically synthesized
catacctacatttatggcct

SEQ ID NO: 557531 - DNA, 20 bp, Artificial Sequence
  chemically synthesized
aacttttaatgcaaaaagaa

SEQ ID NO: 557532 - DNA, 20 bp, Artificial Sequence
  chemically synthesized
acgtttccaaagagaaagtt

SEQ ID NO: 557533 - DNA, 20 bp, Artificial Sequence
  chemically synthesized
ttttcttcttaagcattatt

SEQ ID NO: 557534 - DNA, 20 bp, Artificial Sequence
  chemically synthesized
ttgtagatttaatgtgaaac

SEQ ID NO: 557535 - DNA, 20 bp, Artificial Sequence
  chemically synthesized
ctcttttgtcatagtatgta

SEQ ID NO: 557536 - DNA, 20 bp, Artificial Sequence
  chemically synthesized
tttttaggcttcatatgcca

SEQ ID NO: 557537 - DNA, 20 bp, Artificial Sequence
  chemically synthesized
gttcagtcaaacactattgt

SEQ ID NO: 557538 - DNA, 20 bp, Artificial Sequence
  chemically synthesized
atacacaggtgtgtaaatat

SEQ ID NO: 557539 - DNA, 20 bp, Artificial Sequence
  chemically synthesized
gtgtgtaaatattaaaacat

SEQ ID NO: 557540 - DNA, 20 bp, Artificial Sequence
  chemically synthesized
tagcaaacattatctgtaat

SEQ ID NO: 557541 - DNA, 20 bp, Artificial Sequence
  chemically synthesized
taggcagtttcacatatcat

SEQ ID NO: 557542 - DNA, 20 bp, Artificial Sequence
  chemically synthesized
tctggtagttcatcagttta

SEQ ID NO: 557543 - DNA, 20 bp, Artificial Sequence
  chemically synthesized
cacacttttgctgactatat

SEQ ID NO: 557544 - DNA, 20 bp, Artificial Sequence
  chemically synthesized
ctgtgcattgaaataataat

SEQ ID NO: 557545 - DNA, 20 bp, Artificial Sequence
  chemically synthesized
tattttaaaaatgaggaaga

SEQ ID NO: 557546 - DNA, 20 bp, Artificial Sequence
  chemically synthesized
gaggcctccagatgaaaaaa

SEQ ID NO: 557547 - DNA, 20 bp, Artificial Sequence
  chemically synthesized
accaggtatccatccataaa

SEQ ID NO: 557548 - DNA, 20 bp, Artificial Sequence
  chemically synthesized
tggatacctggtacctgcaa

SEQ ID NO: 557549 - DNA, 20 bp, Artificial Sequence
  chemically synthesized
atttgtaatacgtccgttaa

SEQ ID NO: 557550 - DNA, 20 bp, Artificial Sequence
  chemically synthesized
accccttaccaacaatggaa

SEQ ID NO: 557551 - DNA, 20 bp, Artificial Sequence
  chemically synthesized
tagaggaggtaaagagctat

SEQ ID NO: 557552 - DNA, 20 bp, Artificial Sequence
  chemically synthesized
aaaaaaaatcttccttcctg

SEQ ID NO: 557553 - DNA, 20 bp, Artificial Sequence
  chemically synthesized
ataccaaaatacgtttatta

SEQ ID NO: 557554 - DNA, 20 bp, Artificial Sequence
  chemically synthesized
aagacaattatgcattttaa

SEQ ID NO: 557555 - DNA, 20 bp, Artificial Sequence
  chemically synthesized
ctatttgatataggcagaaa

SEQ ID NO: 557556 - DNA, 20 bp, Artificial Sequence
  chemically synthesized
tatcaaatagtataggggtc

SEQ ID NO: 557557 - DNA, 20 bp, Artificial Sequence
  chemically synthesized
tatagacttaataactccct

SEQ ID NO: 557558 - DNA, 20 bp, Artificial Sequence
  chemically synthesized
gaagcattttgaactggatg

SEQ ID NO: 557559 - DNA, 20 bp, Artificial Sequence
  chemically synthesized
ggctttttgatcctatcttt

SEQ ID NO: 557560 - DNA, 20 bp, Artificial Sequence
  chemically synthesized
tttttatttcagttaactta

SEQ ID NO: 557561 - DNA, 20 bp, Artificial Sequence
  chemically synthesized
ttttctaagttaactgaaat

SEQ ID NO: 557562 - DNA, 20 bp, Artificial Sequence
  chemically synthesized
atcgattgagcccaggagtt

SEQ ID NO: 557563 - DNA, 20 bp, Artificial Sequence
  chemically synthesized
atgtttaaataaataattta

SEQ ID NO: 557564 - DNA, 20 bp, Artificial Sequence
  chemically synthesized
tagatggtctgcccaactaa

SEQ ID NO: 557565 - DNA, 20 bp, Artificial Sequence
  chemically synthesized
tatcctttatggtactatat

SEQ ID NO: 557566 - DNA, 20 bp, Artificial Sequence
  chemically synthesized
gcactgaggaacaactccac

SEQ ID NO: 557567 - DNA, 20 bp, Artificial Sequence
  chemically synthesized
aaacatcactgctccagaat

SEQ ID NO: 557568 - DNA, 20 bp, Artificial Sequence
  chemically synthesized
ttttcaattgtgcaagtttc

SEQ ID NO: 557569 - DNA, 20 bp, Artificial Sequence
  chemically synthesized
tggcttgagagtgggcgaga

SEQ ID NO: 557570 - DNA, 20 bp, Artificial Sequence
  chemically synthesized
cacgttgtgcacatgtaccc

SEQ ID NO: 557571 - DNA, 20 bp, Artificial Sequence
  chemically synthesized
agcaaactattgcaaggaca

SEQ ID NO: 557572 - DNA, 20 bp, Artificial Sequence
  chemically synthesized
aaaatctagttattctgtgc

SEQ ID NO: 557573 - DNA, 20 bp, Artificial Sequence
  chemically synthesized
gttaagaacgaactttggaa

SEQ ID NO: 557574 - DNA, 20 bp, Artificial Sequence
  chemically synthesized
tggtgaaaatgctgctgttt

SEQ ID NO: 557575 - DNA, 20 bp, Artificial Sequence
  chemically synthesized
ctgctgtttaaaaactacaa

SEQ ID NO: 557576 - DNA, 20 bp, Artificial Sequence
  chemically synthesized
ctgtgataatatctttaatt

SEQ ID NO: 557577 - DNA, 20 bp, Artificial Sequence
  chemically synthesized
gcataaattaagaatatttt

SEQ ID NO: 557578 - DNA, 20 bp, Artificial Sequence
  chemically synthesized
tcactatacattacatatat

SEQ ID NO: 557579 - DNA, 20 bp, Artificial Sequence
  chemically synthesized
tcccaatcaattttggaaca

SEQ ID NO: 557580 - DNA, 20 bp, Artificial Sequence
  chemically synthesized
aagatactcatatgatcaca

SEQ ID NO: 557581 - DNA, 20 bp, Artificial Sequence
  chemically synthesized
atagtgacaaaaacaaaata

SEQ ID NO: 557582 - DNA, 20 bp, Artificial Sequence
  chemically synthesized
ttaattatttttatagtgac

SEQ ID NO: 557583 - DNA, 20 bp, Artificial Sequence
  chemically synthesized
aaaaagccaaaattgaaata

SEQ ID NO: 557584 - DNA, 20 bp, Artificial Sequence
  chemically synthesized
acaaagctaagagttttttt

SEQ ID NO: 557585 - DNA, 20 bp, Artificial Sequence
  chemically synthesized
ttttattgatttgtttttaa

SEQ ID NO: 557586 - DNA, 20 bp, Artificial Sequence
  chemically synthesized
aggagattgaatcagtagtc

SEQ ID NO: 557587 - DNA, 20 bp, Artificial Sequence
  chemically synthesized
gcaaaaatggttcaatttat

SEQ ID NO: 557588 - DNA, 20 bp, Artificial Sequence
  chemically synthesized
agtttcaacactttcatgat

SEQ ID NO: 557589 - DNA, 20 bp, Artificial Sequence
  chemically synthesized
cgaaattaccgcaacataat

SEQ ID NO: 557590 - DNA, 20 bp, Artificial Sequence
  chemically synthesized
cataataaaaaccgtatatg

SEQ ID NO: 557591 - DNA, 20 bp, Artificial Sequence
  chemically synthesized
tttctatacgctagcaacat

SEQ ID NO: 557592 - DNA, 20 bp, Artificial Sequence
  chemically synthesized
acataaaaacaggaaattta

SEQ ID NO: 557593 - DNA, 20 bp, Artificial Sequence
  chemically synthesized
cacaaacgactccaaatagc

SEQ ID NO: 557594 - DNA, 20 bp, Artificial Sequence
  chemically synthesized
tcttcaaccaatggtgctgg

SEQ ID NO: 557595 - DNA, 20 bp, Artificial Sequence
  chemically synthesized
aaactatgaaactcatagaa

SEQ ID NO: 557596 - DNA, 20 bp, Artificial Sequence
  chemically synthesized
acgctaaaaggacagccaac

SEQ ID NO: 557597 - DNA, 20 bp, Artificial Sequence
  chemically synthesized
aaaaggacagccaacaaaaa

SEQ ID NO: 557598 - DNA, 20 bp, Artificial Sequence
  chemically synthesized
aaaattgtgcagcttttgtg

SEQ ID NO: 557599 - DNA, 20 bp, Artificial Sequence
  chemically synthesized
gtggatttcattaaaaaaat

SEQ ID NO: 557600 - DNA, 20 bp, Artificial Sequence
  chemically synthesized
aacaagtgcttcattaagaa

SEQ ID NO: 557601 - DNA, 20 bp, Artificial Sequence
  chemically synthesized
gagctcagcatgcacaggga

SEQ ID NO: 557602 - DNA, 20 bp, Artificial Sequence
  chemically synthesized
tgtaaaattctttaaaaaac

SEQ ID NO: 557603 - DNA, 20 bp, Artificial Sequence
  chemically synthesized
ctgttttgtaaaattcttta

SEQ ID NO: 557604 - DNA, 20 bp, Artificial Sequence
  chemically synthesized
tagttttttaaagaatttta

SEQ ID NO: 557605 - DNA, 20 bp, Artificial Sequence
  chemically synthesized
ttctggtaagagacctagaa

SEQ ID NO: 557606 - DNA, 20 bp, Artificial Sequence
  chemically synthesized
ctcaatttgtcaattttttg

SEQ ID NO: 557607 - DNA, 20 bp, Artificial Sequence
  chemically synthesized
caaatactccaagctttgat

SEQ ID NO: 557608 - DNA, 20 bp, Artificial Sequence
  chemically synthesized
ggaaggagataatttgtgac

SEQ ID NO: 557609 - DNA, 20 bp, Artificial Sequence
  chemically synthesized
ctggaaaatgggaacgataa

SEQ ID NO: 557610 - DNA, 20 bp, Artificial Sequence
  chemically synthesized
ggcacatagtaagccttcaa

SEQ ID NO: 557611 - DNA, 20 bp, Artificial Sequence
  chemically synthesized
agcaggccattcatcgttct

SEQ ID NO: 557612 - DNA, 20 bp, Artificial Sequence
  chemically synthesized
gcaaatacaacagtcccaac

SEQ ID NO: 557613 - DNA, 20 bp, Artificial Sequence
  chemically synthesized
ctagctcatcattttagtga

SEQ ID NO: 557614 - DNA, 20 bp, Artificial Sequence
  chemically synthesized
ctagaaaggaaacgcatagg

SEQ ID NO: 557615 - DNA, 20 bp, Artificial Sequence
  chemically synthesized
acatattttccaggagattt

SEQ ID NO: 557616 - DNA, 20 bp, Artificial Sequence
  chemically synthesized
taaacacaattagaatggaa

SEQ ID NO: 557617 - DNA, 20 bp, Artificial Sequence
  chemically synthesized
tctatatatgttatatatat

SEQ ID NO: 557618 - DNA, 20 bp, Artificial Sequence
  chemically synthesized
caaaagtaacacatgctcat

SEQ ID NO: 557619 - DNA, 20 bp, Artificial Sequence
  chemically synthesized
tttagaataaatggaagttt

SEQ ID NO: 557620 - DNA, 20 bp, Artificial Sequence
  chemically synthesized
atatggcaagctgcttgttt

SEQ ID NO: 557621 - DNA, 20 bp, Artificial Sequence
  chemically synthesized
actgagcgtgttaacctatt

SEQ ID NO: 557622 - DNA, 20 bp, Artificial Sequence
  chemically synthesized
acacagagaggatctatgtg

SEQ ID NO: 557623 - DNA, 20 bp, Artificial Sequence
  chemically synthesized
caaaagccagtccaaacaag

SEQ ID NO: 557624 - DNA, 20 bp, Artificial Sequence
  chemically synthesized
actgattattgaaaggaaaa

SEQ ID NO: 557625 - DNA, 20 bp, Artificial Sequence
  chemically synthesized
tgtcagaattaattttttta

SEQ ID NO: 557626 - DNA, 20 bp, Artificial Sequence
  chemically synthesized
actttgtagtgactcactat

SEQ ID NO: 557627 - DNA, 20 bp, Artificial Sequence
  chemically synthesized
gtgtgtgtgttagacatact

SEQ ID NO: 557628 - DNA, 20 bp, Artificial Sequence
  chemically synthesized
taagcagcagttgaggggga

SEQ ID NO: 557629 - DNA, 20 bp, Artificial Sequence
  chemically synthesized
tatacaaagatcgcggatat

SEQ ID NO: 557630 - DNA, 20 bp, Artificial Sequence
  chemically synthesized
tgagaataaatcgaatgagt

SEQ ID NO: 557631 - DNA, 20 bp, Artificial Sequence
  chemically synthesized
ccttaattatgtttaatcta

SEQ ID NO: 557632 - DNA, 20 bp, Artificial Sequence
  chemically synthesized
agatcattaatcctagccac

SEQ ID NO: 557633 - DNA, 20 bp, Artificial Sequence
  chemically synthesized
tcttaaaggattttatttac

SEQ ID NO: 557634 - DNA, 20 bp, Artificial Sequence
  chemically synthesized
cctgtgggaaaatttgggta

SEQ ID NO: 557635 - DNA, 20 bp, Artificial Sequence
  chemically synthesized
atagcactgacaaggagaaa

SEQ ID NO: 557636 - DNA, 20 bp, Artificial Sequence
  chemically synthesized
ttgaaactagttcaagtcta

SEQ ID NO: 557637 - DNA, 20 bp, Artificial Sequence
  chemically synthesized
gacattgtctttacttgaca

SEQ ID NO: 557638 - DNA, 20 bp, Artificial Sequence
  chemically synthesized
gctcaattttattaccattt

SEQ ID NO: 557639 - DNA, 20 bp, Artificial Sequence
  chemically synthesized
taaatattttaatcttgaat

SEQ ID NO: 557640 - DNA, 20 bp, Artificial Sequence
  chemically synthesized
gtactgtgaaatttgttatt

SEQ ID NO: 557641 - DNA, 20 bp, Artificial Sequence
  chemically synthesized
aaaggattttgaacctgggg

SEQ ID NO: 557642 - DNA, 20 bp, Artificial Sequence
  chemically synthesized
agcatctaatgcaggtgttg

SEQ ID NO: 557643 - DNA, 20 bp, Artificial Sequence
  chemically synthesized
gagatctagagccctgttgc

SEQ ID NO: 557644 - DNA, 20 bp, Artificial Sequence
  chemically synthesized
tacaagtaaaaacggaagac

SEQ ID NO: 557645 - DNA, 20 bp, Artificial Sequence
  chemically synthesized
acttaatgatacctacaagt

SEQ ID NO: 557646 - DNA, 20 bp, Artificial Sequence
  chemically synthesized
gctaacatttttcggatgca

SEQ ID NO: 557647 - DNA, 20 bp, Artificial Sequence
  chemically synthesized
atattaaaactcagactttc

SEQ ID NO: 557648 - DNA, 20 bp, Artificial Sequence
  chemically synthesized
tctctcatccatttttatat

SEQ ID NO: 557649 - DNA, 20 bp, Artificial Sequence
  chemically synthesized
attaacatgctcttctcact

SEQ ID NO: 557650 - DNA, 20 bp, Artificial Sequence
  chemically synthesized
tgataatctgtcagaaagat

SEQ ID NO: 557651 - DNA, 20 bp, Artificial Sequence
  chemically synthesized
agcaaattaacataagaaca

SEQ ID NO: 557652 - DNA, 20 bp, Artificial Sequence
  chemically synthesized
tactgagtagatatccaaaa

SEQ ID NO: 557653 - DNA, 20 bp, Artificial Sequence
  chemically synthesized
atcatcagagaaatgcaaat

SEQ ID NO: 557654 - DNA, 20 bp, Artificial Sequence
  chemically synthesized
aattgaacaaacaaaaatca

SEQ ID NO: 557655 - DNA, 20 bp, Artificial Sequence
  chemically synthesized
cagacaaacaccaaatggga

SEQ ID NO: 557656 - DNA, 20 bp, Artificial Sequence
  chemically synthesized
cagaatagagaacacataaa

SEQ ID NO: 557657 - DNA, 20 bp, Artificial Sequence
  chemically synthesized
taacttttaagtgatttgaa

SEQ ID NO: 557658 - DNA, 20 bp, Artificial Sequence
  chemically synthesized
aaacccttacataacataga

SEQ ID NO: 557659 - DNA, 20 bp, Artificial Sequence
  chemically synthesized
ctatgttatagaaaagcatt

SEQ ID NO: 557660 - DNA, 20 bp, Artificial Sequence
  chemically synthesized
atgggaagacttggataagc

SEQ ID NO: 557661 - DNA, 20 bp, Artificial Sequence
  chemically synthesized
ggacattataccacgatgga

SEQ ID NO: 557662 - DNA, 20 bp, Artificial Sequence
  chemically synthesized
gagccccagatgcccatatg

SEQ ID NO: 557663 - DNA, 20 bp, Artificial Sequence
  chemically synthesized
atatgggcatctggggctca

SEQ ID NO: 557664 - DNA, 20 bp, Artificial Sequence
  chemically synthesized
agtgaagtaactcaggaatg

SEQ ID NO: 557665 - DNA, 20 bp, Artificial Sequence
  chemically synthesized
tccttgcgatagtttgctga

SEQ ID NO: 557666 - DNA, 20 bp, Artificial Sequence
  chemically synthesized
agcaaactatcgcaaggaca

SEQ ID NO: 557667 - DNA, 20 bp, Artificial Sequence
  chemically synthesized
cacgttgtgcacatgtaccc

SEQ ID NO: 557668 - DNA, 20 bp, Artificial Sequence
  chemically synthesized
ttacagaaaaataaaataat

SEQ ID NO: 557669 - DNA, 20 bp, Artificial Sequence
  chemically synthesized
catttgctaggagtaaaaaa

SEQ ID NO: 557670 - DNA, 20 bp, Artificial Sequence
  chemically synthesized
gtgccacgatatgtaatatt

SEQ ID NO: 557671 - DNA, 20 bp, Artificial Sequence
  chemically synthesized
taatgtttctacattatttt

SEQ ID NO: 557672 - DNA, 20 bp, Artificial Sequence
  chemically synthesized
atgctttacaaaagaggttc

SEQ ID NO: 557673 - DNA, 20 bp, Artificial Sequence
  chemically synthesized
atgacaaagcattaagaaaa

SEQ ID NO: 557674 - DNA, 20 bp, Artificial Sequence
  chemically synthesized
ctgctaaattcgtatgttgc

SEQ ID NO: 557675 - DNA, 20 bp, Artificial Sequence
  chemically synthesized
gtcactttcaccgagggact

SEQ ID NO: 557676 - DNA, 20 bp, Artificial Sequence
  chemically synthesized
tacataccatgtatgtttag

SEQ ID NO: 557677 - DNA, 20 bp, Artificial Sequence
  chemically synthesized
aacagtttaaattattcttt

SEQ ID NO: 557678 - DNA, 20 bp, Artificial Sequence
  chemically synthesized
aatttaaactgttaaatatt

SEQ ID NO: 557679 - DNA, 20 bp, Artificial Sequence
  chemically synthesized
aaaaaaataatcaaccatat

SEQ ID NO: 557680 - DNA, 20 bp, Artificial Sequence
  chemically synthesized
tgcgtaaagtttgctaggaa

SEQ ID NO: 557681 - DNA, 20 bp, Artificial Sequence
  chemically synthesized
agttacggaagtggaagggg

SEQ ID NO: 557682 - DNA, 20 bp, Artificial Sequence
  chemically synthesized
agtctttgaaaatttagtcc

SEQ ID NO: 557683 - DNA, 20 bp, Artificial Sequence
  chemically synthesized
tgtattctctctgccatcct

SEQ ID NO: 557684 - DNA, 20 bp, Artificial Sequence
  chemically synthesized
tgagggcattggaaggcaaa

SEQ ID NO: 557685 - DNA, 20 bp, Artificial Sequence
  chemically synthesized
tgcagatacttattttttga

SEQ ID NO: 557686 - DNA, 20 bp, Artificial Sequence
  chemically synthesized
aaacattcatttttttccat

SEQ ID NO: 557687 - DNA, 20 bp, Artificial Sequence
  chemically synthesized
gagattaaatgtagaatctc

SEQ ID NO: 557688 - DNA, 20 bp, Artificial Sequence
  chemically synthesized
gatccatttgcataaaattc

SEQ ID NO: 557689 - DNA, 20 bp, Artificial Sequence
  chemically synthesized
ctttaaccagcacttagatt

SEQ ID NO: 557690 - DNA, 20 bp, Artificial Sequence
  chemically synthesized
taggtgtatttcaactaaaa

SEQ ID NO: 557691 - DNA, 20 bp, Artificial Sequence
  chemically synthesized
agaatataagaggaatgttc

SEQ ID NO: 557692 - DNA, 20 bp, Artificial Sequence
  chemically synthesized
cttgctgtgccccttcacag

SEQ ID NO: 557693 - DNA, 20 bp, Artificial Sequence
  chemically synthesized
ttcactttgactggcttatc

SEQ ID NO: 557694 - DNA, 20 bp, Artificial Sequence
  chemically synthesized
ataaaatctaaacaatttat

SEQ ID NO: 557695 - DNA, 20 bp, Artificial Sequence
  chemically synthesized
gtaaacttgtagagaaatga

SEQ ID NO: 557696 - DNA, 20 bp, Artificial Sequence
  chemically synthesized
acattctctcacaggagaca

SEQ ID NO: 557697 - DNA, 20 bp, Artificial Sequence
  chemically synthesized
agtgacctgacatgatgaat

SEQ ID NO: 557698 - DNA, 20 bp, Artificial Sequence
  chemically synthesized
ggccactattctgagttttg

SEQ ID NO: 557699 - DNA, 20 bp, Artificial Sequence
  chemically synthesized
taaagttgtaaaatgttttt

SEQ ID NO: 557700 - DNA, 20 bp, Artificial Sequence
  chemically synthesized
atcttagctaactgcatatt

SEQ ID NO: 557701 - DNA, 20 bp, Artificial Sequence
  chemically synthesized
ctatttatatgcattatttt

SEQ ID NO: 557702 - DNA, 20 bp, Artificial Sequence
  chemically synthesized
ttcatggctgggaccacccc

SEQ ID NO: 557703 - DNA, 20 bp, Artificial Sequence
  chemically synthesized
taaagtacagctgcagagta

SEQ ID NO: 557704 - DNA, 20 bp, Artificial Sequence
  chemically synthesized
gatcatacttttgatgccta

SEQ ID NO: 557705 - DNA, 20 bp, Artificial Sequence
  chemically synthesized
gttctctgggaaacagactc

SEQ ID NO: 557706 - DNA, 20 bp, Artificial Sequence
  chemically synthesized
acagagtgagatcctgtctc

SEQ ID NO: 557707 - DNA, 20 bp, Artificial Sequence
  chemically synthesized
tttgctcagaaagggagcaa

SEQ ID NO: 557708 - DNA, 20 bp, Artificial Sequence
  chemically synthesized
atgctttaacatcctttgta

SEQ ID NO: 557709 - DNA, 20 bp, Artificial Sequence
  chemically synthesized
gtagaaaaatctagttgtag

SEQ ID NO: 557710 - DNA, 20 bp, Artificial Sequence
  chemically synthesized
atcaagagcaggtataaatt

SEQ ID NO: 557711 - DNA, 20 bp, Artificial Sequence
  chemically synthesized
accatcctggctaacacggt

SEQ ID NO: 557712 - DNA, 20 bp, Artificial Sequence
  chemically synthesized
aaaataacagggaagtgcca

SEQ ID NO: 557713 - DNA, 20 bp, Artificial Sequence
  chemically synthesized
cactactggattctttgaac

SEQ ID NO: 557714 - DNA, 20 bp, Artificial Sequence
  chemically synthesized
attctttgaaccaaaacctt

SEQ ID NO: 557715 - DNA, 20 bp, Artificial Sequence
  chemically synthesized
catcgagaagtgagggatgt

SEQ ID NO: 557716 - DNA, 20 bp, Artificial Sequence
  chemically synthesized
cttttattaaaccatcaagt

SEQ ID NO: 557717 - DNA, 20 bp, Artificial Sequence
  chemically synthesized
actaaaataattatttggga

SEQ ID NO: 557718 - DNA, 20 bp, Artificial Sequence
  chemically synthesized
tgtggatcccttgagagaag

SEQ ID NO: 557719 - DNA, 20 bp, Artificial Sequence
  chemically synthesized
agaaatatatgaagaaaaaa

SEQ ID NO: 557720 - DNA, 20 bp, Artificial Sequence
  chemically synthesized
tgtaatagctaagttatcaa

SEQ ID NO: 557721 - DNA, 20 bp, Artificial Sequence
  chemically synthesized
tcagcaaaaatatagtaggg

SEQ ID NO: 557722 - DNA, 20 bp, Artificial Sequence
  chemically synthesized
atccacttcaagaaagaaaa

SEQ ID NO: 557723 - DNA, 20 bp, Artificial Sequence
  chemically synthesized
tcagcatccacttcaagaaa

SEQ ID NO: 557724 - DNA, 20 bp, Artificial Sequence
  chemically synthesized
catagcagtagcaaaaagat

SEQ ID NO: 557725 - DNA, 20 bp, Artificial Sequence
  chemically synthesized
gtgatccagcctttgacgca

SEQ ID NO: 557726 - DNA, 20 bp, Artificial Sequence
  chemically synthesized
gaccaatctactaggcagga

SEQ ID NO: 557727 - DNA, 20 bp, Artificial Sequence
  chemically synthesized
cgaagaaaaagaaaaagtac

SEQ ID NO: 557728 - DNA, 20 bp, Artificial Sequence
  chemically synthesized
gtcatatatattattgacta

SEQ ID NO: 557729 - DNA, 20 bp, Artificial Sequence
  chemically synthesized
tcgtttcaattcttaacatc

SEQ ID NO: 557730 - DNA, 20 bp, Artificial Sequence
  chemically synthesized
agctacaagctgaagagaga

SEQ ID NO: 557731 - DNA, 20 bp, Artificial Sequence
  chemically synthesized
atctatgactacaggaggaa

SEQ ID NO: 557732 - DNA, 20 bp, Artificial Sequence
  chemically synthesized
catatgttaaattgggctac

SEQ ID NO: 557733 - DNA, 20 bp, Artificial Sequence
  chemically synthesized
tcgtcaactgtaaaatgggg

SEQ ID NO: 557734 - DNA, 20 bp, Artificial Sequence
  chemically synthesized
gtgtgtgtgtgtgtgtgtgt

SEQ ID NO: 557735 - DNA, 20 bp, Artificial Sequence
  chemically synthesized
cgtattgaatggatctccag

SEQ ID NO: 557736 - DNA, 20 bp, Artificial Sequence
  chemically synthesized
agcaaacttatatggaaaca

SEQ ID NO: 557737 - DNA, 20 bp, Artificial Sequence
  chemically synthesized
gagttagaataccttcagag

SEQ ID NO: 557738 - DNA, 20 bp, Artificial Sequence
  chemically synthesized
ggtgtttcttctacctacat

SEQ ID NO: 557739 - DNA, 20 bp, Artificial Sequence
  chemically synthesized
tgatcatcgctctctaattc

SEQ ID NO: 557740 - DNA, 20 bp, Artificial Sequence
  chemically synthesized
ggattgtcccagcagaaaaa

SEQ ID NO: 557741 - DNA, 20 bp, Artificial Sequence
  chemically synthesized
agaagagaagacacctttgg

SEQ ID NO: 557742 - DNA, 20 bp, Artificial Sequence
  chemically synthesized
cagtttgattataaaagata

SEQ ID NO: 557743 - DNA, 20 bp, Artificial Sequence
  chemically synthesized
gccatcagattttccaggtt

SEQ ID NO: 557744 - DNA, 20 bp, Artificial Sequence
  chemically synthesized
tgattattaactgtaacttt

SEQ ID NO: 557745 - DNA, 20 bp, Artificial Sequence
  chemically synthesized
cagttaataatcatgttact

SEQ ID NO: 557746 - DNA, 20 bp, Artificial Sequence
  chemically synthesized
ttggtgtacatggttttcaa

SEQ ID NO: 557747 - DNA, 20 bp, Artificial Sequence
  chemically synthesized
ataatgaatcatgttttctt

SEQ ID NO: 557748 - DNA, 20 bp, Artificial Sequence
  chemically synthesized
tgaacatttttgaggaagta

SEQ ID NO: 557749 - DNA, 20 bp, Artificial Sequence
  chemically synthesized
tggacaattcttgtaacaaa

SEQ ID NO: 557750 - DNA, 20 bp, Artificial Sequence
  chemically synthesized
taattatataaaatcactat

SEQ ID NO: 557751 - DNA, 20 bp, Artificial Sequence
  chemically synthesized
agtgtaaggtcacttagtgt

SEQ ID NO: 557752 - DNA, 20 bp, Artificial Sequence
  chemically synthesized
tgagcaagactattgaatac

SEQ ID NO: 557753 - DNA, 20 bp, Artificial Sequence
  chemically synthesized
tgttgtaaacactttcttaa

SEQ ID NO: 557754 - DNA, 20 bp, Artificial Sequence
  chemically synthesized
atatgttaattattttgtcg

SEQ ID NO: 557755 - DNA, 20 bp, Artificial Sequence
  chemically synthesized
accataaattattaaagtca

SEQ ID NO: 557756 - DNA, 20 bp, Artificial Sequence
  chemically synthesized
ttcctctatttcagtgggat

SEQ ID NO: 557757 - DNA, 20 bp, Artificial Sequence
  chemically synthesized
aaattttttatgactgtcaa

SEQ ID NO: 557758 - DNA, 20 bp, Artificial Sequence
  chemically synthesized
tactgattgttaacaggtta

SEQ ID NO: 557759 - DNA, 20 bp, Artificial Sequence
  chemically synthesized
aactatgtataagttgttct

SEQ ID NO: 557760 - DNA, 20 bp, Artificial Sequence
  chemically synthesized
gaattagtggcaataataaa

SEQ ID NO: 557761 - DNA, 20 bp, Artificial Sequence
  chemically synthesized
ttatgaacacacaatattgt

SEQ ID NO: 557762 - DNA, 20 bp, Artificial Sequence
  chemically synthesized
ttgtgagatatctcaataca

SEQ ID NO: 557763 - DNA, 20 bp, Artificial Sequence
  chemically synthesized
agtgtaggacctccttatag

SEQ ID NO: 557764 - DNA, 20 bp, Artificial Sequence
  chemically synthesized
gtctgtaagtcatgtattca

SEQ ID NO: 557765 - DNA, 20 bp, Artificial Sequence
  chemically synthesized
cctgccacacctactctctc

SEQ ID NO: 557766 - DNA, 20 bp, Artificial Sequence
  chemically synthesized
acaggagagcatggggctag

SEQ ID NO: 557767 - DNA, 20 bp, Artificial Sequence
  chemically synthesized
ctgaaaataattttatcaat

SEQ ID NO: 557768 - DNA, 20 bp, Artificial Sequence
  chemically synthesized
tcctttcacattaattttac

SEQ ID NO: 557769 - DNA, 20 bp, Artificial Sequence
  chemically synthesized
acttaaagtataataaaaaa

SEQ ID NO: 557770 - DNA, 20 bp, Artificial Sequence
  chemically synthesized
catgttgtgcacatgaaccc

SEQ ID NO: 557771 - DNA, 20 bp, Artificial Sequence
  chemically synthesized
agatatcatgcctgactctt

SEQ ID NO: 557772 - DNA, 20 bp, Artificial Sequence
  chemically synthesized
taagaattatattaccaaca

SEQ ID NO: 557773 - DNA, 20 bp, Artificial Sequence
  chemically synthesized
ttcccagaacttaaaattta

SEQ ID NO: 557774 - DNA, 20 bp, Artificial Sequence
  chemically synthesized
tacctaatgcatgcggggct

SEQ ID NO: 557775 - DNA, 20 bp, Artificial Sequence
  chemically synthesized
gcaaactaacacaggaatgg

SEQ ID NO: 557776 - DNA, 20 bp, Artificial Sequence
  chemically synthesized
agaaaacattttctgaactg

SEQ ID NO: 557777 - DNA, 20 bp, Artificial Sequence
  chemically synthesized
ttagctgagatttactggaa

SEQ ID NO: 557778 - DNA, 20 bp, Artificial Sequence
  chemically synthesized
tcttccagtaaatctcagct

SEQ ID NO: 557779 - DNA, 20 bp, Artificial Sequence
  chemically synthesized
catcagtatagtacctggtg

SEQ ID NO: 557780 - DNA, 20 bp, Artificial Sequence
  chemically synthesized
tttcaaacaaggtagtttat

SEQ ID NO: 557781 - DNA, 20 bp, Artificial Sequence
  chemically synthesized
gaagtcagggctccacattg

SEQ ID NO: 557782 - DNA, 20 bp, Artificial Sequence
  chemically synthesized
cacttcaatcagaatgctca

SEQ ID NO: 557783 - DNA, 20 bp, Artificial Sequence
  chemically synthesized
gattttgatttaaacttcat

SEQ ID NO: 557784 - DNA, 20 bp, Artificial Sequence
  chemically synthesized
tttgtttcatctcttcattt

SEQ ID NO: 557785 - DNA, 20 bp, Artificial Sequence
  chemically synthesized
gccatcagagacatgcaaat

SEQ ID NO: 557786 - DNA, 20 bp, Artificial Sequence
  chemically synthesized
agaagacatttatgcagcca

SEQ ID NO: 557787 - DNA, 20 bp, Artificial Sequence
  chemically synthesized
agtaaactatcgcaaggaca

SEQ ID NO: 557788 - DNA, 20 bp, Artificial Sequence
  chemically synthesized
cacactgtgcacatgtaccc

SEQ ID NO: 557789 - DNA, 20 bp, Artificial Sequence
  chemically synthesized
tgctattaaagataagtttt

SEQ ID NO: 557790 - DNA, 20 bp, Artificial Sequence
  chemically synthesized
taaggcccttgtgtagtttt

SEQ ID NO: 557791 - DNA, 20 bp, Artificial Sequence
  chemically synthesized
tgaaaacacgtgttaataca

SEQ ID NO: 557792 - DNA, 20 bp, Artificial Sequence
  chemically synthesized
attgtggaggaagaagcgat

SEQ ID NO: 557793 - DNA, 20 bp, Artificial Sequence
  chemically synthesized
tttgaaaaagcgtaaatcta

SEQ ID NO: 557794 - DNA, 20 bp, Artificial Sequence
  chemically synthesized
tttgtcttcagctgcaatga

SEQ ID NO: 557795 - DNA, 20 bp, Artificial Sequence
  chemically synthesized
tcaggaaagaggaggcgaag

SEQ ID NO: 557796 - DNA, 20 bp, Artificial Sequence
  chemically synthesized
aaaggcgggctttgaacaaa

SEQ ID NO: 557797 - DNA, 20 bp, Artificial Sequence
  chemically synthesized
gcgaagggagatgtgaagct

SEQ ID NO: 557798 - DNA, 20 bp, Artificial Sequence
  chemically synthesized
ccaaatctaggtgaaaagaa

SEQ ID NO: 557799 - DNA, 20 bp, Artificial Sequence
  chemically synthesized
ccaccactgcttctccatat

SEQ ID NO: 557800 - DNA, 20 bp, Artificial Sequence
  chemically synthesized
ctcatagagccatagagtag

SEQ ID NO: 557801 - DNA, 20 bp, Artificial Sequence
  chemically synthesized
ttcatattgaattgtaaatt

SEQ ID NO: 557802 - DNA, 20 bp, Artificial Sequence
  chemically synthesized
cccatcttctgatgaataag

SEQ ID NO: 557803 - DNA, 20 bp, Artificial Sequence
  chemically synthesized
acttatcactgagaatttat

SEQ ID NO: 557804 - DNA, 20 bp, Artificial Sequence
  chemically synthesized
gatgactctataacttagct

SEQ ID NO: 557805 - DNA, 20 bp, Artificial Sequence
  chemically synthesized
gtgtgccttattttttaaag

SEQ ID NO: 557806 - DNA, 20 bp, Artificial Sequence
  chemically synthesized
cgtggtctgataaatatttt

SEQ ID NO: 557807 - DNA, 20 bp, Artificial Sequence
  chemically synthesized
agtcattgctgtccaatgat

SEQ ID NO: 557808 - DNA, 20 bp, Artificial Sequence
  chemically synthesized
cctagcttagaaataaaagt

SEQ ID NO: 557809 - DNA, 20 bp, Artificial Sequence
  chemically synthesized
caaagtattttaaaataaaa

SEQ ID NO: 557810 - DNA, 20 bp, Artificial Sequence
  chemically synthesized
aggtcttctggtgtggccat

SEQ ID NO: 557811 - DNA, 20 bp, Artificial Sequence
  chemically synthesized
aggagctcttttccatagca

SEQ ID NO: 557812 - DNA, 20 bp, Artificial Sequence
  chemically synthesized
ttgaaaaattcagcaactat

SEQ ID NO: 557813 - DNA, 20 bp, Artificial Sequence
  chemically synthesized
cctgtctccctgctccagta

SEQ ID NO: 557814 - DNA, 20 bp, Artificial Sequence
  chemically synthesized
tccagtaaaaaacatccaca

SEQ ID NO: 557815 - DNA, 20 bp, Artificial Sequence
  chemically synthesized
ccctgcacattcaaatagag

SEQ ID NO: 557816 - DNA, 20 bp, Artificial Sequence
  chemically synthesized
cattaaatgatttaaatttt

SEQ ID NO: 557817 - DNA, 20 bp, Artificial Sequence
  chemically synthesized
aaactgtaagaattaatgtg

SEQ ID NO: 557818 - DNA, 20 bp, Artificial Sequence
  chemically synthesized
gtatgtgaaataactcaaat

SEQ ID NO: 557819 - DNA, 20 bp, Artificial Sequence
  chemically synthesized
gatagaggtagactttcttc

SEQ ID NO: 557820 - DNA, 20 bp, Artificial Sequence
  chemically synthesized
atcatattaatgatttaaac

SEQ ID NO: 557821 - DNA, 20 bp, Artificial Sequence
  chemically synthesized
tttcatcattaaattaagat

SEQ ID NO: 557822 - DNA, 20 bp, Artificial Sequence
  chemically synthesized
ttcatcttaatttaatgatg

SEQ ID NO: 557823 - DNA, 20 bp, Artificial Sequence
  chemically synthesized
catcctagtgtttcatattg

SEQ ID NO: 557824 - DNA, 20 bp, Artificial Sequence
  chemically synthesized
atgactgggattagatggag

SEQ ID NO: 557825 - DNA, 20 bp, Artificial Sequence
  chemically synthesized
aatgtttcttaggacccagg

SEQ ID NO: 557826 - DNA, 20 bp, Artificial Sequence
  chemically synthesized
attaaaggcctgaatagaag

SEQ ID NO: 557827 - DNA, 20 bp, Artificial Sequence
  chemically synthesized
accccctgtcccaaacttta

SEQ ID NO: 557828 - DNA, 20 bp, Artificial Sequence
  chemically synthesized
aaagcgttaagaatctaaaa

SEQ ID NO: 557829 - DNA, 20 bp, Artificial Sequence
  chemically synthesized
tcactaaagcgttaagaatc

SEQ ID NO: 557830 - DNA, 20 bp, Artificial Sequence
  chemically synthesized
gccattttcatggaaccaag

SEQ ID NO: 557831 - DNA, 20 bp, Artificial Sequence
  chemically synthesized
tagctataggtatatgatta

SEQ ID NO: 557832 - DNA, 20 bp, Artificial Sequence
  chemically synthesized
aaaaaacctcacgttattta

SEQ ID NO: 557833 - DNA, 20 bp, Artificial Sequence
  chemically synthesized
ccttgtgttcttaactaata

SEQ ID NO: 557834 - DNA, 20 bp, Artificial Sequence
  chemically synthesized
gtgtagagagagagcattcc

SEQ ID NO: 557835 - DNA, 20 bp, Artificial Sequence
  chemically synthesized
ctcctttttggcatttaaca

SEQ ID NO: 557836 - DNA, 20 bp, Artificial Sequence
  chemically synthesized
attcacatccatgaggtaaa

SEQ ID NO: 557837 - DNA, 20 bp, Artificial Sequence
  chemically synthesized
gaattaaacatttaaagtgg

SEQ ID NO: 557838 - DNA, 20 bp, Artificial Sequence
  chemically synthesized
ttcctgtgacaatgcaagtg

SEQ ID NO: 557839 - DNA, 20 bp, Artificial Sequence
  chemically synthesized
tgacaatgcaagtgaaaaac

SEQ ID NO: 557840 - DNA, 20 bp, Artificial Sequence
  chemically synthesized
ctgttgcatgataacagagt

SEQ ID NO: 557841 - DNA, 20 bp, Artificial Sequence
  chemically synthesized
aactcctttattttaaatgc

SEQ ID NO: 557842 - DNA, 20 bp, Artificial Sequence
  chemically synthesized
tagggtaaatttctgtcttt

SEQ ID NO: 557843 - DNA, 20 bp, Artificial Sequence
  chemically synthesized
ctagcctctgctcaatgggc

SEQ ID NO: 557844 - DNA, 20 bp, Artificial Sequence
  chemically synthesized
taatttattgccatagataa

SEQ ID NO: 557845 - DNA, 20 bp, Artificial Sequence
  chemically synthesized
cttaccattaccatgatgtc

SEQ ID NO: 557846 - DNA, 20 bp, Artificial Sequence
  chemically synthesized
tgggctttagcttttagaaa

SEQ ID NO: 557847 - DNA, 20 bp, Artificial Sequence
  chemically synthesized
cagctagttaacagcagagt

SEQ ID NO: 557848 - DNA, 20 bp, Artificial Sequence
  chemically synthesized
accttgtttttaatatttct

SEQ ID NO: 557849 - DNA, 20 bp, Artificial Sequence
  chemically synthesized
tatctgttttcagaaatatt

SEQ ID NO: 557850 - DNA, 20 bp, Artificial Sequence
  chemically synthesized
ctgcctttcctaaatccaaa

SEQ ID NO: 557851 - DNA, 20 bp, Artificial Sequence
  chemically synthesized
aataaccacattctcagaaa

SEQ ID NO: 557852 - DNA, 20 bp, Artificial Sequence
  chemically synthesized
caatcataaccagagacatg

SEQ ID NO: 557853 - DNA, 20 bp, Artificial Sequence
  chemically synthesized
ttcactggaagcatgcatca

SEQ ID NO: 557854 - DNA, 20 bp, Artificial Sequence
  chemically synthesized
caagtatgagctccatattg

SEQ ID NO: 557855 - DNA, 20 bp, Artificial Sequence
  chemically synthesized
aagtccttcatgatagaatc

SEQ ID NO: 557856 - DNA, 20 bp, Artificial Sequence
  chemically synthesized
caacttctgtgatttataga

SEQ ID NO: 557857 - DNA, 20 bp, Artificial Sequence
  chemically synthesized
cgagaattgactgcaccttt

SEQ ID NO: 557858 - DNA, 20 bp, Artificial Sequence
  chemically synthesized
tcatccagtcccatgtcttt

SEQ ID NO: 557859 - DNA, 20 bp, Artificial Sequence
  chemically synthesized
agatattctccaatttgggc

SEQ ID NO: 557860 - DNA, 20 bp, Artificial Sequence
  chemically synthesized
atcctcaaatggctttagct

SEQ ID NO: 557861 - DNA, 20 bp, Artificial Sequence
  chemically synthesized
actttccttaaaggaggatt

SEQ ID NO: 557862 - DNA, 20 bp, Artificial Sequence
  chemically synthesized
attacataaacagactttac

SEQ ID NO: 557863 - DNA, 20 bp, Artificial Sequence
  chemically synthesized
aattctaacactcttctttt

SEQ ID NO: 557864 - DNA, 20 bp, Artificial Sequence
  chemically synthesized
gaagtatgtgggagctcaca

SEQ ID NO: 557865 - DNA, 20 bp, Artificial Sequence
  chemically synthesized
catttgtgttgtcagggaag

SEQ ID NO: 557866 - DNA, 20 bp, Artificial Sequence
  chemically synthesized
agccacatttgtgaagactt

SEQ ID NO: 557867 - DNA, 20 bp, Artificial Sequence
  chemically synthesized
cgaagaggttggaaggggtt

SEQ ID NO: 557868 - DNA, 20 bp, Artificial Sequence
  chemically synthesized
gacattaagtagcttctttt

SEQ ID NO: 557869 - DNA, 20 bp, Artificial Sequence
  chemically synthesized
cttacgtgaacttgaggtaa

SEQ ID NO: 557870 - DNA, 20 bp, Artificial Sequence
  chemically synthesized
gcatgggcttgtaagttgca

SEQ ID NO: 557871 - DNA, 20 bp, Artificial Sequence
  chemically synthesized
gatctgttctatagctttcc

SEQ ID NO: 557872 - DNA, 20 bp, Artificial Sequence
  chemically synthesized
tttgatgcaggatcaaatgt

SEQ ID NO: 557873 - DNA, 20 bp, Artificial Sequence
  chemically synthesized
gggaggcgatggtttgggga

SEQ ID NO: 557874 - DNA, 20 bp, Artificial Sequence
  chemically synthesized
ccctgtctctactaaaaatg

SEQ ID NO: 557875 - DNA, 20 bp, Artificial Sequence
  chemically synthesized
ttgtatgctaatcctagtcc

SEQ ID NO: 557876 - DNA, 20 bp, Artificial Sequence
  chemically synthesized
tcctaaaaccaagattaggc

SEQ ID NO: 557877 - DNA, 20 bp, Artificial Sequence
  chemically synthesized
acattaaattttcagaagga

SEQ ID NO: 557878 - DNA, 20 bp, Artificial Sequence
  chemically synthesized
gctggccttgatcatgctgt

SEQ ID NO: 557879 - DNA, 20 bp, Artificial Sequence
  chemically synthesized
ttgagactcttctgaatcca

SEQ ID NO: 557880 - DNA, 20 bp, Artificial Sequence
  chemically synthesized
gttaggagtggaagaagtaa

SEQ ID NO: 557881 - DNA, 20 bp, Artificial Sequence
  chemically synthesized
ctctttgtcaagtaaacata

SEQ ID NO: 557882 - DNA, 20 bp, Artificial Sequence
  chemically synthesized
tatatatgcacacatatttt

SEQ ID NO: 557883 - DNA, 20 bp, Artificial Sequence
  chemically synthesized
atacacttctgcattctgaa

SEQ ID NO: 557884 - DNA, 20 bp, Artificial Sequence
  chemically synthesized
cctgggtcacagagcaaatg

SEQ ID NO: 557885 - DNA, 20 bp, Artificial Sequence
  chemically synthesized
tgctttagctacgctatagg

SEQ ID NO: 557886 - DNA, 20 bp, Artificial Sequence
  chemically synthesized
gctggccttgatcgtgcttt

SEQ ID NO: 557887 - DNA, 20 bp, Artificial Sequence
  chemically synthesized
tcttatctagacaaatgagg

SEQ ID NO: 557888 - DNA, 20 bp, Artificial Sequence
  chemically synthesized
tccttaaataacaacaattt

SEQ ID NO: 557889 - DNA, 20 bp, Artificial Sequence
  chemically synthesized
tcaccccttaatcggttttc

SEQ ID NO: 557890 - DNA, 20 bp, Artificial Sequence
  chemically synthesized
tgttttctttttgtgtttta

SEQ ID NO: 557891 - DNA, 20 bp, Artificial Sequence
  chemically synthesized
ggttttctaaaacacaaaaa

SEQ ID NO: 557892 - DNA, 20 bp, Artificial Sequence
  chemically synthesized
gaatacaggaaggggaatac

SEQ ID NO: 557893 - DNA, 20 bp, Artificial Sequence
  chemically synthesized
tatatatatatgcatgctca

SEQ ID NO: 557894 - DNA, 20 bp, Artificial Sequence
  chemically synthesized
tgatctgggacccacacttt

SEQ ID NO: 557895 - DNA, 20 bp, Artificial Sequence
  chemically synthesized
tttttattttattttctatc

SEQ ID NO: 557896 - DNA, 20 bp, Artificial Sequence
  chemically synthesized
atggaatctattcaatttaa

SEQ ID NO: 557897 - DNA, 20 bp, Artificial Sequence
  chemically synthesized
ggaagaggaaatcaaagctt

SEQ ID NO: 557898 - DNA, 20 bp, Artificial Sequence
  chemically synthesized
aagaccggtaagacgggcag

SEQ ID NO: 557899 - DNA, 20 bp, Artificial Sequence
  chemically synthesized
agagaaatctaaaaaaaaaa

SEQ ID NO: 557900 - DNA, 20 bp, Artificial Sequence
  chemically synthesized
ggatactaatgggcataaag

SEQ ID NO: 557901 - DNA, 20 bp, Artificial Sequence
  chemically synthesized
tttacaatctagcaaatgga

SEQ ID NO: 557902 - DNA, 20 bp, Artificial Sequence
  chemically synthesized
gcatgcatgattgtagttta

SEQ ID NO: 557903 - DNA, 20 bp, Artificial Sequence
  chemically synthesized
gaggcaaaagttgatttggt

SEQ ID NO: 557904 - DNA, 20 bp, Artificial Sequence
  chemically synthesized
tatcctccagccatgagatt

SEQ ID NO: 557905 - DNA, 20 bp, Artificial Sequence
  chemically synthesized
ggttacatatttcaaaggaa

SEQ ID NO: 557906 - DNA, 20 bp, Artificial Sequence
  chemically synthesized
aattcatatgtttaattttc

SEQ ID NO: 557907 - DNA, 20 bp, Artificial Sequence
  chemically synthesized
aatatcccccaaagggtccc

SEQ ID NO: 557908 - DNA, 20 bp, Artificial Sequence
  chemically synthesized
taaagtaggatgatagtata

SEQ ID NO: 557909 - DNA, 20 bp, Artificial Sequence
  chemically synthesized
cttctccctccttcttgcct

SEQ ID NO: 557910 - DNA, 20 bp, Artificial Sequence
  chemically synthesized
cagctggatattaaagaggt

SEQ ID NO: 557911 - DNA, 20 bp, Artificial Sequence
  chemically synthesized
tacatgcattaatttcactg

SEQ ID NO: 557912 - DNA, 20 bp, Artificial Sequence
  chemically synthesized
taaaattatatgattaaaaa

SEQ ID NO: 557913 - DNA, 20 bp, Artificial Sequence
  chemically synthesized
gtcaacaaagaactgttcaa

SEQ ID NO: 557914 - DNA, 20 bp, Artificial Sequence
  chemically synthesized
ttattttgaaaaagtcacca

SEQ ID NO: 557915 - DNA, 20 bp, Artificial Sequence
  chemically synthesized
ttcaaaataactacatcatt

SEQ ID NO: 557916 - DNA, 20 bp, Artificial Sequence
  chemically synthesized
caaaactattgagttgcctg

SEQ ID NO: 557917 - DNA, 20 bp, Artificial Sequence
  chemically synthesized
ggaaaatatgtttaagaaag

SEQ ID NO: 557918 - DNA, 20 bp, Artificial Sequence
  chemically synthesized
tgaaataggaactcagggtt

SEQ ID NO: 557919 - DNA, 20 bp, Artificial Sequence
  chemically synthesized
aatctgatgaagcaaagctg

SEQ ID NO: 557920 - DNA, 20 bp, Artificial Sequence
  chemically synthesized
aaaagtacattttatgatga

SEQ ID NO: 557921 - DNA, 20 bp, Artificial Sequence
  chemically synthesized
ttgtactcatgaaacttttg

SEQ ID NO: 557922 - DNA, 20 bp, Artificial Sequence
  chemically synthesized
ttgcatcctaaaagccaaag

SEQ ID NO: 557923 - DNA, 20 bp, Artificial Sequence
  chemically synthesized
agaaaattggtaattctaca

SEQ ID NO: 557924 - DNA, 20 bp, Artificial Sequence
  chemically synthesized
gtgtaacactcaaactttct

SEQ ID NO: 557925 - DNA, 20 bp, Artificial Sequence
  chemically synthesized
cagtgtcaatagaaaataat

SEQ ID NO: 557926 - DNA, 20 bp, Artificial Sequence
  chemically synthesized
atttcacatatatatatata

SEQ ID NO: 557927 - DNA, 20 bp, Artificial Sequence
  chemically synthesized
atcacataactcctctggtt

SEQ ID NO: 557928 - DNA, 20 bp, Artificial Sequence
  chemically synthesized
tcctgtaattcagcacctag

SEQ ID NO: 557929 - DNA, 20 bp, Artificial Sequence
  chemically synthesized
ttttatccttaagataacaa

SEQ ID NO: 557930 - DNA, 20 bp, Artificial Sequence
  chemically synthesized
ctaacattcttgtcgcattg

SEQ ID NO: 557931 - DNA, 20 bp, Artificial Sequence
  chemically synthesized
atggtcattagtgatgaaga

SEQ ID NO: 557932 - DNA, 20 bp, Artificial Sequence
  chemically synthesized
gtgatgaagaaaaaaccctt

SEQ ID NO: 557933 - DNA, 20 bp, Artificial Sequence
  chemically synthesized
acctagaggagaatgtcgtg

SEQ ID NO: 557934 - DNA, 20 bp, Artificial Sequence
  chemically synthesized
tgcctaatctaaatttaggt

SEQ ID NO: 557935 - DNA, 20 bp, Artificial Sequence
  chemically synthesized
agatgccttgaattcatgaa

SEQ ID NO: 557936 - DNA, 20 bp, Artificial Sequence
  chemically synthesized
tgaatgcaatcagtcagcag

SEQ ID NO: 557937 - DNA, 20 bp, Artificial Sequence
  chemically synthesized
aaaaactgacgttctatttt

SEQ ID NO: 557938 - DNA, 20 bp, Artificial Sequence
  chemically synthesized
caaaagtgtgtggtgtcctc

SEQ ID NO: 557939 - DNA, 20 bp, Artificial Sequence
  chemically synthesized
gtgatcaatgagatgggaag

SEQ ID NO: 557940 - DNA, 20 bp, Artificial Sequence
  chemically synthesized
agaggtggattgacaaagga

SEQ ID NO: 557941 - DNA, 20 bp, Artificial Sequence
  chemically synthesized
cccttccagttaatcagagc

SEQ ID NO: 557942 - DNA, 20 bp, Artificial Sequence
  chemically synthesized
cttctcacacttagaaagag

SEQ ID NO: 557943 - DNA, 20 bp, Artificial Sequence
  chemically synthesized
gctttgttcactgacacatt

SEQ ID NO: 557944 - DNA, 20 bp, Artificial Sequence
  chemically synthesized
tatcttttttttagaattgt

SEQ ID NO: 557945 - DNA, 20 bp, Artificial Sequence
  chemically synthesized
ctgatcattcagcaactctt

SEQ ID NO: 557946 - DNA, 20 bp, Artificial Sequence
  chemically synthesized
cagagatgaaaggatttgcc

SEQ ID NO: 557947 - DNA, 20 bp, Artificial Sequence
  chemically synthesized
tatactctaccaagatgcca

SEQ ID NO: 557948 - DNA, 20 bp, Artificial Sequence
  chemically synthesized
taatttaaaaagctgtacat

SEQ ID NO: 557949 - DNA, 20 bp, Artificial Sequence
  chemically synthesized
atcggttacagcagtaataa

SEQ ID NO: 557950 - DNA, 20 bp, Artificial Sequence
  chemically synthesized
tatggaaatgattcccttct

SEQ ID NO: 557951 - DNA, 20 bp, Artificial Sequence
  chemically synthesized
tcaaaaaaatgtgatccaca

SEQ ID NO: 557952 - DNA, 20 bp, Artificial Sequence
  chemically synthesized
tgcacaaatcaaaataaata

SEQ ID NO: 557953 - DNA, 20 bp, Artificial Sequence
  chemically synthesized
attaattggaattggcatta

SEQ ID NO: 557954 - DNA, 20 bp, Artificial Sequence
  chemically synthesized
taaatagcagaacattttaa

SEQ ID NO: 557955 - DNA, 20 bp, Artificial Sequence
  chemically synthesized
atgaaaaatattactaaaat

SEQ ID NO: 557956 - DNA, 20 bp, Artificial Sequence
  chemically synthesized
atcatgccccctgggcaaag

SEQ ID NO: 557957 - DNA, 20 bp, Artificial Sequence
  chemically synthesized
aaggcatatgttcctttatg

SEQ ID NO: 557958 - DNA, 20 bp, Artificial Sequence
  chemically synthesized
aacaagcaacagagattaaa

SEQ ID NO: 557959 - DNA, 20 bp, Artificial Sequence
  chemically synthesized
gcaacagagattaaacaaaa

SEQ ID NO: 557960 - DNA, 20 bp, Artificial Sequence
  chemically synthesized
agagattaaacaaaacaaaa

SEQ ID NO: 557961 - DNA, 20 bp, Artificial Sequence
  chemically synthesized
ttaaacaaaacaaaacaaaa

SEQ ID NO: 557962 - DNA, 20 bp, Artificial Sequence
  chemically synthesized
caaaacaaaacaaaacaaaa

SEQ ID NO: 557963 - DNA, 20 bp, Artificial Sequence
  chemically synthesized
caaaacaaaacaaaacaaaa

SEQ ID NO: 557964 - DNA, 20 bp, Artificial Sequence
  chemically synthesized
caaaacaaaacaaaacaaaa

SEQ ID NO: 557965 - DNA, 20 bp, Artificial Sequence
  chemically synthesized
caaaacaaaacaaaacaaaa

SEQ ID NO: 557966 - DNA, 20 bp, Artificial Sequence
  chemically synthesized
ttgttctgccttgtccttca

SEQ ID NO: 557967 - DNA, 20 bp, Artificial Sequence
  chemically synthesized
accatgagatgattaatttt

SEQ ID NO: 557968 - DNA, 20 bp, Artificial Sequence
  chemically synthesized
cacattgtgcacatgtgccc

SEQ ID NO: 557969 - DNA, 20 bp, Artificial Sequence
  chemically synthesized
cattatcagcacagataaca

SEQ ID NO: 557970 - DNA, 20 bp, Artificial Sequence
  chemically synthesized
tatagaaacctagggatgga

SEQ ID NO: 557971 - DNA, 20 bp, Artificial Sequence
  chemically synthesized
tggaaaaaactctaatagaa

SEQ ID NO: 557972 - DNA, 20 bp, Artificial Sequence
  chemically synthesized
ccaaaattaaagttgaaaaa

SEQ ID NO: 557973 - DNA, 20 bp, Artificial Sequence
  chemically synthesized
ttctccaaaaacctgaaatc

SEQ ID NO: 557974 - DNA, 20 bp, Artificial Sequence
  chemically synthesized
cgaggcactcttgtttctcc

SEQ ID NO: 557975 - DNA, 20 bp, Artificial Sequence
  chemically synthesized
actttttttggaaaccaaaa

SEQ ID NO: 557976 - DNA, 20 bp, Artificial Sequence
  chemically synthesized
acatgttcacatcatcataa

SEQ ID NO: 557977 - DNA, 20 bp, Artificial Sequence
  chemically synthesized
atcagtgagttttaataact

SEQ ID NO: 557978 - DNA, 20 bp, Artificial Sequence
  chemically synthesized
gcaagtatgttttgagttat

SEQ ID NO: 557979 - DNA, 20 bp, Artificial Sequence
  chemically synthesized
cacagtaaaagagcatgtgc

SEQ ID NO: 557980 - DNA, 20 bp, Artificial Sequence
  chemically synthesized
atagactcacaaggagttgc

SEQ ID NO: 557981 - DNA, 20 bp, Artificial Sequence
  chemically synthesized
atttcacaataaaaaaatct

SEQ ID NO: 557982 - DNA, 20 bp, Artificial Sequence
  chemically synthesized
aaaaaatcttaaaacattct

SEQ ID NO: 557983 - DNA, 20 bp, Artificial Sequence
  chemically synthesized
gtttcttgtataaaaataaa

SEQ ID NO: 557984 - DNA, 20 bp, Artificial Sequence
  chemically synthesized
ttatttttatacaagaaacg

SEQ ID NO: 557985 - DNA, 20 bp, Artificial Sequence
  chemically synthesized
aagtaggatgtaaacaagac

SEQ ID NO: 557986 - DNA, 20 bp, Artificial Sequence
  chemically synthesized
tcttaagctatgacagaatt

SEQ ID NO: 557987 - DNA, 20 bp, Artificial Sequence
  chemically synthesized
gatgccacaacacacatcta

SEQ ID NO: 557988 - DNA, 20 bp, Artificial Sequence
  chemically synthesized
gtatgtctttatcacagcat

SEQ ID NO: 557989 - DNA, 20 bp, Artificial Sequence
  chemically synthesized
gcaagagcagaaacccctga

SEQ ID NO: 557990 - DNA, 20 bp, Artificial Sequence
  chemically synthesized
tttttaactataaacttctc

SEQ ID NO: 557991 - DNA, 20 bp, Artificial Sequence
  chemically synthesized
tttttgagaagtttatagtt

SEQ ID NO: 557992 - DNA, 20 bp, Artificial Sequence
  chemically synthesized
gggcttaacaatgaggtgac

SEQ ID NO: 557993 - DNA, 20 bp, Artificial Sequence
  chemically synthesized
ctactaaaaatacaaaaaaa

SEQ ID NO: 557994 - DNA, 20 bp, Artificial Sequence
  chemically synthesized
gacagagcgagactccgtct

SEQ ID NO: 557995 - DNA, 20 bp, Artificial Sequence
  chemically synthesized
gcgagactccgtctcaaaac

SEQ ID NO: 557996 - DNA, 20 bp, Artificial Sequence
  chemically synthesized
ctccgtctcaaaacaaaaac

SEQ ID NO: 557997 - DNA, 20 bp, Artificial Sequence
  chemically synthesized
ctcaaaacaaaaacaaaaac

SEQ ID NO: 557998 - DNA, 20 bp, Artificial Sequence
  chemically synthesized
acaaaaacaaaaacaaaaac

SEQ ID NO: 557999 - DNA, 20 bp, Artificial Sequence
  chemically synthesized
acaaaaacaaaaacaaaaac

SEQ ID NO: 558000 - DNA, 20 bp, Artificial Sequence
  chemically synthesized
acaaaaacaaaaacaaaaac

SEQ ID NO: 558001 - DNA, 20 bp, Artificial Sequence
  chemically synthesized
aacaaaaacaaaaacaaaaa

SEQ ID NO: 558002 - DNA, 20 bp, Artificial Sequence
  chemically synthesized
cctttgctctctgtgcctcc

SEQ ID NO: 558003 - DNA, 20 bp, Artificial Sequence
  chemically synthesized
tcataattgcagactcagac

SEQ ID NO: 558004 - DNA, 20 bp, Artificial Sequence
  chemically synthesized
agacactctgcaaattgtat

SEQ ID NO: 558005 - DNA, 20 bp, Artificial Sequence
  chemically synthesized
gaaactttaaagccctttgt

SEQ ID NO: 558006 - DNA, 20 bp, Artificial Sequence
  chemically synthesized
ggggactcagcaagtgcaag

SEQ ID NO: 558007 - DNA, 20 bp, Artificial Sequence
  chemically synthesized
aacacaggacattataattt

SEQ ID NO: 558008 - DNA, 20 bp, Artificial Sequence
  chemically synthesized
tacctgaaggatgatgataa

SEQ ID NO: 558009 - DNA, 20 bp, Artificial Sequence
  chemically synthesized
gtgggtgctgaggacagaac

SEQ ID NO: 558010 - DNA, 20 bp, Artificial Sequence
  chemically synthesized
gtaaagattaacatgaggag

SEQ ID NO: 558011 - DNA, 20 bp, Artificial Sequence
  chemically synthesized
aatagtttaaatttttctac

SEQ ID NO: 558012 - DNA, 20 bp, Artificial Sequence
  chemically synthesized
tctttgagaaaattaaaaat

SEQ ID NO: 558013 - DNA, 20 bp, Artificial Sequence
  chemically synthesized
gaaagtatataatcataaat

SEQ ID NO: 558014 - DNA, 20 bp, Artificial Sequence
  chemically synthesized
aatcataaatgaaaaccaaa

SEQ ID NO: 558015 - DNA, 20 bp, Artificial Sequence
  chemically synthesized
caaacaaaaccctcactggc

SEQ ID NO: 558016 - DNA, 20 bp, Artificial Sequence
  chemically synthesized
gtgttattattcacagtaac

SEQ ID NO: 558017 - DNA, 20 bp, Artificial Sequence
  chemically synthesized
gcatttgaagtctcttggaa

SEQ ID NO: 558018 - DNA, 20 bp, Artificial Sequence
  chemically synthesized
ggagcatgctgtgctgaact

SEQ ID NO: 558019 - DNA, 20 bp, Artificial Sequence
  chemically synthesized
atcaaaacatggcagcccta

SEQ ID NO: 558020 - DNA, 20 bp, Artificial Sequence
  chemically synthesized
gatacatagtatcatacaat

SEQ ID NO: 558021 - DNA, 20 bp, Artificial Sequence
  chemically synthesized
ttttgttaccataagttaat

SEQ ID NO: 558022 - DNA, 20 bp, Artificial Sequence
  chemically synthesized
tacatctaatctatgaattt

SEQ ID NO: 558023 - DNA, 20 bp, Artificial Sequence
  chemically synthesized
gttatatgacttacggtatg

SEQ ID NO: 558024 - DNA, 20 bp, Artificial Sequence
  chemically synthesized
aaaggcaagaacaatgacca

SEQ ID NO: 558025 - DNA, 20 bp, Artificial Sequence
  chemically synthesized
ctgccaatgacatatatcat

SEQ ID NO: 558026 - DNA, 20 bp, Artificial Sequence
  chemically synthesized
acatacatacatatgtatat

SEQ ID NO: 558027 - DNA, 20 bp, Artificial Sequence
  chemically synthesized
tcttatcagtatgctaatat

SEQ ID NO: 558028 - DNA, 20 bp, Artificial Sequence
  chemically synthesized
gatattatgttagtaataag

SEQ ID NO: 558029 - DNA, 20 bp, Artificial Sequence
  chemically synthesized
tttaagaccctactaactaa

SEQ ID NO: 558030 - DNA, 20 bp, Artificial Sequence
  chemically synthesized
ctggtaaaacaaaacaaaac

SEQ ID NO: 558031 - DNA, 20 bp, Artificial Sequence
  chemically synthesized
gatattctggtaaaacaaaa

SEQ ID NO: 558032 - DNA, 20 bp, Artificial Sequence
  chemically synthesized
ggggagatattctggtaaaa

SEQ ID NO: 558033 - DNA, 20 bp, Artificial Sequence
  chemically synthesized
tcaaaggggagatattctgg

SEQ ID NO: 558034 - DNA, 20 bp, Artificial Sequence
  chemically synthesized
ttagccttggctcgtcacga

SEQ ID NO: 558035 - DNA, 20 bp, Artificial Sequence
  chemically synthesized
gaaaatgaaacaatactcat

SEQ ID NO: 558036 - DNA, 20 bp, Artificial Sequence
  chemically synthesized
ttatctcatagagtagactt

SEQ ID NO: 558037 - DNA, 20 bp, Artificial Sequence
  chemically synthesized
ttgtgctgattttacagatg

SEQ ID NO: 558038 - DNA, 20 bp, Artificial Sequence
  chemically synthesized
ttcccttaccagtgtttctt

SEQ ID NO: 558039 - DNA, 20 bp, Artificial Sequence
  chemically synthesized
aacgtggaaagttatgagga

SEQ ID NO: 558040 - DNA, 20 bp, Artificial Sequence
  chemically synthesized
actgacagcacctggcacat

SEQ ID NO: 558041 - DNA, 20 bp, Artificial Sequence
  chemically synthesized
taaactaaaaataaattctt

SEQ ID NO: 558042 - DNA, 20 bp, Artificial Sequence
  chemically synthesized
tagtttgagagcatgagaag

SEQ ID NO: 558043 - DNA, 20 bp, Artificial Sequence
  chemically synthesized
ctctagttatatacttgttt

SEQ ID NO: 558044 - DNA, 20 bp, Artificial Sequence
  chemically synthesized
acaatagccaataaaaaaca

SEQ ID NO: 558045 - DNA, 20 bp, Artificial Sequence
  chemically synthesized
taaaactacaatagccaata

SEQ ID NO: 558046 - DNA, 20 bp, Artificial Sequence
  chemically synthesized
ataaaatagatgaggataag

SEQ ID NO: 558047 - DNA, 20 bp, Artificial Sequence
  chemically synthesized
tatgtggtatgcatcctgaa

SEQ ID NO: 558048 - DNA, 20 bp, Artificial Sequence
  chemically synthesized
aacatttgttttaagatcat

SEQ ID NO: 558049 - DNA, 20 bp, Artificial Sequence
  chemically synthesized
aacagtagtttttatgatct

SEQ ID NO: 558050 - DNA, 20 bp, Artificial Sequence
  chemically synthesized
aagattttgcccaaaatatt

SEQ ID NO: 558051 - DNA, 20 bp, Artificial Sequence
  chemically synthesized
taaacataggaaagaattag

SEQ ID NO: 558052 - DNA, 20 bp, Artificial Sequence
  chemically synthesized
tggaccctttaaaatttaag

SEQ ID NO: 558053 - DNA, 20 bp, Artificial Sequence
  chemically synthesized
tcctttactccatagaatac

SEQ ID NO: 558054 - DNA, 20 bp, Artificial Sequence
  chemically synthesized
tatttcagttgagaacaagg

SEQ ID NO: 558055 - DNA, 20 bp, Artificial Sequence
  chemically synthesized
agtcttggttgtgaagttcc

SEQ ID NO: 558056 - DNA, 20 bp, Artificial Sequence
  chemically synthesized
ctacaattaaatctaaataa

SEQ ID NO: 558057 - DNA, 20 bp, Artificial Sequence
  chemically synthesized
cccacacattccagatgtga

SEQ ID NO: 558058 - DNA, 20 bp, Artificial Sequence
  chemically synthesized
acacagacagcatttaaatt

SEQ ID NO: 558059 - DNA, 20 bp, Artificial Sequence
  chemically synthesized
cataactgttttccctttat

SEQ ID NO: 558060 - DNA, 20 bp, Artificial Sequence
  chemically synthesized
atgctgtgttttaataaagg

SEQ ID NO: 558061 - DNA, 20 bp, Artificial Sequence
  chemically synthesized
ttctaaactcttactgaaag

SEQ ID NO: 558062 - DNA, 20 bp, Artificial Sequence
  chemically synthesized
ttacaaagaaattttcatcc

SEQ ID NO: 558063 - DNA, 20 bp, Artificial Sequence
  chemically synthesized
gcagtagtatttttctcaga

SEQ ID NO: 558064 - DNA, 20 bp, Artificial Sequence
  chemically synthesized
aactgagaaggctgctttca

SEQ ID NO: 558065 - DNA, 20 bp, Artificial Sequence
  chemically synthesized
agtaccatgaaactttatca

SEQ ID NO: 558066 - DNA, 20 bp, Artificial Sequence
  chemically synthesized
cccctagcaggagtctctta

SEQ ID NO: 558067 - DNA, 20 bp, Artificial Sequence
  chemically synthesized
ggggaaattaaaaaaaaaaa

SEQ ID NO: 558068 - DNA, 20 bp, Artificial Sequence
  chemically synthesized
cctaccttaataaggtgtgc

SEQ ID NO: 558069 - DNA, 20 bp, Artificial Sequence
  chemically synthesized
actgtcctggccaacatggt

SEQ ID NO: 558070 - DNA, 20 bp, Artificial Sequence
  chemically synthesized
caatacttagaaagtttgtt

SEQ ID NO: 558071 - DNA, 20 bp, Artificial Sequence
  chemically synthesized
acagcgtaattaagcacaca

SEQ ID NO: 558072 - DNA, 20 bp, Artificial Sequence
  chemically synthesized
gtaattaagcacacacaaaa

SEQ ID NO: 558073 - DNA, 20 bp, Artificial Sequence
  chemically synthesized
tagagagtcgggaagaagat

SEQ ID NO: 558074 - DNA, 20 bp, Artificial Sequence
  chemically synthesized
gttcatatttttatgcatca

SEQ ID NO: 558075 - DNA, 20 bp, Artificial Sequence
  chemically synthesized
aaatagcaagaccccatctc

SEQ ID NO: 558076 - DNA, 20 bp, Artificial Sequence
  chemically synthesized
gtgtgtagcaaatatcagtg

SEQ ID NO: 558077 - DNA, 20 bp, Artificial Sequence
  chemically synthesized
cggttgggtagatactgagg

SEQ ID NO: 558078 - DNA, 20 bp, Artificial Sequence
  chemically synthesized
ctcccatcaactcttcaaca

SEQ ID NO: 558079 - DNA, 20 bp, Artificial Sequence
  chemically synthesized
ttaatgaagcattgaggaca

SEQ ID NO: 558080 - DNA, 20 bp, Artificial Sequence
  chemically synthesized
ggtggttgtgatgtcaaacc

SEQ ID NO: 558081 - DNA, 20 bp, Artificial Sequence
  chemically synthesized
agatcacggtattttcaggg

SEQ ID NO: 558082 - DNA, 20 bp, Artificial Sequence
  chemically synthesized
aacacgcaaacaaaaaaaaa

SEQ ID NO: 558083 - DNA, 20 bp, Artificial Sequence
  chemically synthesized
accctgtcttcaaaaaagca

SEQ ID NO: 558084 - DNA, 20 bp, Artificial Sequence
  chemically synthesized
gaccagcctggccaacgtgg

SEQ ID NO: 558085 - DNA, 20 bp, Artificial Sequence
  chemically synthesized
caacaaaggttgactccatt

SEQ ID NO: 558086 - DNA, 20 bp, Artificial Sequence
  chemically synthesized
attctacaaaactacatcaa

SEQ ID NO: 558087 - DNA, 20 bp, Artificial Sequence
  chemically synthesized
ccattgcaataacaattcta

SEQ ID NO: 558088 - DNA, 20 bp, Artificial Sequence
  chemically synthesized
tcttatgttgttcattaaca

SEQ ID NO: 558089 - DNA, 20 bp, Artificial Sequence
  chemically synthesized
gtcctttggtgactgaaaag

SEQ ID NO: 558090 - DNA, 20 bp, Artificial Sequence
  chemically synthesized
ttgcatataggaagcaagaa

SEQ ID NO: 558091 - DNA, 20 bp, Artificial Sequence
  chemically synthesized
caaaccctatgaggctataa

SEQ ID NO: 558092 - DNA, 20 bp, Artificial Sequence
  chemically synthesized
ggcagattccctgagagaac

SEQ ID NO: 558093 - DNA, 20 bp, Artificial Sequence
  chemically synthesized
tttaagggctgaagatatca

SEQ ID NO: 558094 - DNA, 20 bp, Artificial Sequence
  chemically synthesized
tgagaggcttcaaaaagaaa

SEQ ID NO: 558095 - DNA, 20 bp, Artificial Sequence
  chemically synthesized
tacctaatgcatgtggggct

SEQ ID NO: 558096 - DNA, 20 bp, Artificial Sequence
  chemically synthesized
aataataaaaaagaaagaag

SEQ ID NO: 558097 - DNA, 20 bp, Artificial Sequence
  chemically synthesized
attatctgggaaggcagtac

SEQ ID NO: 558098 - DNA, 20 bp, Artificial Sequence
  chemically synthesized
tccagcctgggcaacaagag

SEQ ID NO: 558099 - DNA, 20 bp, Artificial Sequence
  chemically synthesized
gatttcaaacctaacaattc

SEQ ID NO: 558100 - DNA, 20 bp, Artificial Sequence
  chemically synthesized
taaaccaggaagctttcagt

SEQ ID NO: 558101 - DNA, 20 bp, Artificial Sequence
  chemically synthesized
tccccaaatgagtttactta

SEQ ID NO: 558102 - DNA, 20 bp, Artificial Sequence
  chemically synthesized
tacatagctatgcacaatat

SEQ ID NO: 558103 - DNA, 20 bp, Artificial Sequence
  chemically synthesized
atcactatcagcattttggt

SEQ ID NO: 558104 - DNA, 20 bp, Artificial Sequence
  chemically synthesized
ctgacaatgcagtagaaaag

SEQ ID NO: 558105 - DNA, 20 bp, Artificial Sequence
  chemically synthesized
ctcatgtccctttcacattt

SEQ ID NO: 558106 - DNA, 20 bp, Artificial Sequence
  chemically synthesized
aaagggggaagagaccctta

SEQ ID NO: 558107 - DNA, 20 bp, Artificial Sequence
  chemically synthesized
gcagttctttctagcggtat

SEQ ID NO: 558108 - DNA, 20 bp, Artificial Sequence
  chemically synthesized
tctgcccagactgccatata

SEQ ID NO: 558109 - DNA, 20 bp, Artificial Sequence
  chemically synthesized
actctgtctctataagaaaa

SEQ ID NO: 558110 - DNA, 20 bp, Artificial Sequence
  chemically synthesized
aaatatatataaataaaaaa

SEQ ID NO: 558111 - DNA, 20 bp, Artificial Sequence
  chemically synthesized
atataggcacaaggataacc

SEQ ID NO: 558112 - DNA, 20 bp, Artificial Sequence
  chemically synthesized
cattccttggcagtacttaa

SEQ ID NO: 558113 - DNA, 20 bp, Artificial Sequence
  chemically synthesized
aaaaaactgggaaggaaaaa

SEQ ID NO: 558114 - DNA, 20 bp, Artificial Sequence
  chemically synthesized
gctgcttctgtgatacaaag

SEQ ID NO: 558115 - DNA, 20 bp, Artificial Sequence
  chemically synthesized
tgctcaactttattatttaa

SEQ ID NO: 558116 - DNA, 20 bp, Artificial Sequence
  chemically synthesized
ttacttacaacgtgcagagt

SEQ ID NO: 558117 - DNA, 20 bp, Artificial Sequence
  chemically synthesized
agacttatctcctttaatcc

SEQ ID NO: 558118 - DNA, 20 bp, Artificial Sequence
  chemically synthesized
taatgggaggaaggtaaaag

SEQ ID NO: 558119 - DNA, 20 bp, Artificial Sequence
  chemically synthesized
aatgtacatttaacacattt

SEQ ID NO: 558120 - DNA, 20 bp, Artificial Sequence
  chemically synthesized
cattttcattaaaaagaaaa

SEQ ID NO: 558121 - DNA, 20 bp, Artificial Sequence
  chemically synthesized
aatttttttaaagagattat

SEQ ID NO: 558122 - DNA, 20 bp, Artificial Sequence
  chemically synthesized
agttataaaaaaaaaaaaaa

SEQ ID NO: 558123 - DNA, 20 bp, Artificial Sequence
  chemically synthesized
aaaaaaaaaaaaaccaacaa

SEQ ID NO: 558124 - DNA, 20 bp, Artificial Sequence
  chemically synthesized
aaaaactaaattccctcaga

SEQ ID NO: 558125 - DNA, 20 bp, Artificial Sequence
  chemically synthesized
aagtatgggagcaactttaa

SEQ ID NO: 558126 - DNA, 20 bp, Artificial Sequence
  chemically synthesized
tgcatgagaaaacatcaagg

SEQ ID NO: 558127 - DNA, 20 bp, Artificial Sequence
  chemically synthesized
actggcatattcatgcatga

SEQ ID NO: 558128 - DNA, 20 bp, Artificial Sequence
  chemically synthesized
gcctcatttattgttattgt

SEQ ID NO: 558129 - DNA, 20 bp, Artificial Sequence
  chemically synthesized
agataatgacaataaagaaa

SEQ ID NO: 558130 - DNA, 20 bp, Artificial Sequence
  chemically synthesized
tggtgatatctacatctcta

SEQ ID NO: 558131 - DNA, 20 bp, Artificial Sequence
  chemically synthesized
tattgatatgaaaagatctg

SEQ ID NO: 558132 - DNA, 20 bp, Artificial Sequence
  chemically synthesized
tgttaatacggctgacacag

SEQ ID NO: 558133 - DNA, 20 bp, Artificial Sequence
  chemically synthesized
tattgtatatttctcctctc

SEQ ID NO: 558134 - DNA, 20 bp, Artificial Sequence
  chemically synthesized
ctgagatgttagtgctaagg

SEQ ID NO: 558135 - DNA, 20 bp, Artificial Sequence
  chemically synthesized
atgctttgttccagctataa

SEQ ID NO: 558136 - DNA, 20 bp, Artificial Sequence
  chemically synthesized
ttatcaaatgtatgaatgat

SEQ ID NO: 558137 - DNA, 20 bp, Artificial Sequence
  chemically synthesized
aattcctcttaatgtcatag

SEQ ID NO: 558138 - DNA, 20 bp, Artificial Sequence
  chemically synthesized
taacttcctaaattaaggct

SEQ ID NO: 558139 - DNA, 20 bp, Artificial Sequence
  chemically synthesized
agaaataagaaaagcgacaa

SEQ ID NO: 558140 - DNA, 20 bp, Artificial Sequence
  chemically synthesized
taataaacattactcttttt

SEQ ID NO: 558141 - DNA, 20 bp, Artificial Sequence
  chemically synthesized
gtttgcactgagaaatgaga

SEQ ID NO: 558142 - DNA, 20 bp, Artificial Sequence
  chemically synthesized
aattgagcagttaatgtcct

SEQ ID NO: 558143 - DNA, 20 bp, Artificial Sequence
  chemically synthesized
acacctctatgatttttcag

SEQ ID NO: 558144 - DNA, 20 bp, Artificial Sequence
  chemically synthesized
attttcttaattgctttact

SEQ ID NO: 558145 - DNA, 20 bp, Artificial Sequence
  chemically synthesized
atgtctttaatatttcactt

SEQ ID NO: 558146 - DNA, 20 bp, Artificial Sequence
  chemically synthesized
gtacctcattgtaggtttcc

SEQ ID NO: 558147 - DNA, 20 bp, Artificial Sequence
  chemically synthesized
gatgtgtcattgtgatccaa

SEQ ID NO: 558148 - DNA, 20 bp, Artificial Sequence
  chemically synthesized
aatagttgcaacagagtata

SEQ ID NO: 558149 - DNA, 20 bp, Artificial Sequence
  chemically synthesized
ccctttacgtttacattaca

SEQ ID NO: 558150 - DNA, 20 bp, Artificial Sequence
  chemically synthesized
acacttgctaacccctacta

SEQ ID NO: 558151 - DNA, 20 bp, Artificial Sequence
  chemically synthesized
tttggaagctatggtaaatt

SEQ ID NO: 558152 - DNA, 20 bp, Artificial Sequence
  chemically synthesized
atggtaaattaaaaacagaa

SEQ ID NO: 558153 - DNA, 20 bp, Artificial Sequence
  chemically synthesized
tttcacgagcatatatgaat

SEQ ID NO: 558154 - DNA, 20 bp, Artificial Sequence
  chemically synthesized
tctgtcttacaagaggattg

SEQ ID NO: 558155 - DNA, 20 bp, Artificial Sequence
  chemically synthesized
cccgtcttacaagaggattg

SEQ ID NO: 558156 - DNA, 20 bp, Artificial Sequence
  chemically synthesized
tagtaatgcctgagtgtcac

SEQ ID NO: 558157 - DNA, 20 bp, Artificial Sequence
  chemically synthesized
taggatacaaactgagaaag

SEQ ID NO: 558158 - DNA, 20 bp, Artificial Sequence
  chemically synthesized
aaagcccttctgggcagaga

SEQ ID NO: 558159 - DNA, 20 bp, Artificial Sequence
  chemically synthesized
gtgatatagacttggccaca

SEQ ID NO: 558160 - DNA, 20 bp, Artificial Sequence
  chemically synthesized
gatgtaaaatagtggaatga

SEQ ID NO: 558161 - DNA, 20 bp, Artificial Sequence
  chemically synthesized
tttataattcactttctctg

SEQ ID NO: 558162 - DNA, 20 bp, Artificial Sequence
  chemically synthesized
aatataagaaatgcagaaag

SEQ ID NO: 558163 - DNA, 20 bp, Artificial Sequence
  chemically synthesized
ggaagggctaagaatatgta

SEQ ID NO: 558164 - DNA, 20 bp, Artificial Sequence
  chemically synthesized
aatattttatggctagtgtc

SEQ ID NO: 558165 - DNA, 20 bp, Artificial Sequence
  chemically synthesized
gttttcgttactaaaggaag

SEQ ID NO: 558166 - DNA, 20 bp, Artificial Sequence
  chemically synthesized
gtttttcttcctttagtaac

SEQ ID NO: 558167 - DNA, 20 bp, Artificial Sequence
  chemically synthesized
attcatgtgacagtttgtgc

SEQ ID NO: 558168 - DNA, 20 bp, Artificial Sequence
  chemically synthesized
tgcaggaaaattgcccttta

SEQ ID NO: 558169 - DNA, 20 bp, Artificial Sequence
  chemically synthesized
ggagactaagtgcttaatat

SEQ ID NO: 558170 - DNA, 20 bp, Artificial Sequence
  chemically synthesized
ctaacttgctttccgcagaa

SEQ ID NO: 558171 - DNA, 20 bp, Artificial Sequence
  chemically synthesized
tctgcaatcccactcctatc

SEQ ID NO: 558172 - DNA, 20 bp, Artificial Sequence
  chemically synthesized
aaaggttttactttgagcac

SEQ ID NO: 558173 - DNA, 20 bp, Artificial Sequence
  chemically synthesized
gcaggttttagtgctcaaag

SEQ ID NO: 558174 - DNA, 20 bp, Artificial Sequence
  chemically synthesized
gaagcaggaagagcccctta

SEQ ID NO: 558175 - DNA, 20 bp, Artificial Sequence
  chemically synthesized
gagtgaaagcagattcaaac

SEQ ID NO: 558176 - DNA, 20 bp, Artificial Sequence
  chemically synthesized
ccagcacactgctcactctc

SEQ ID NO: 558177 - DNA, 20 bp, Artificial Sequence
  chemically synthesized
tctaaggactatggcttaca

SEQ ID NO: 558178 - DNA, 20 bp, Artificial Sequence
  chemically synthesized
tcagcttgctaagataactt

SEQ ID NO: 558179 - DNA, 20 bp, Artificial Sequence
  chemically synthesized
atattctgggttgttcataa

SEQ ID NO: 558180 - DNA, 20 bp, Artificial Sequence
  chemically synthesized
atatagtatattttccatgt

SEQ ID NO: 558181 - DNA, 20 bp, Artificial Sequence
  chemically synthesized
aataaatgaatgaagcaaat

SEQ ID NO: 558182 - DNA, 20 bp, Artificial Sequence
  chemically synthesized
gaaaacatcagtaaacagaa

SEQ ID NO: 558183 - DNA, 20 bp, Artificial Sequence
  chemically synthesized
acagggcaaaacttaaaggg

SEQ ID NO: 558184 - DNA, 20 bp, Artificial Sequence
  chemically synthesized
ccatagcaaaagatacaggg

SEQ ID NO: 558185 - DNA, 20 bp, Artificial Sequence
  chemically synthesized
agaggatcattttgcagaaa

SEQ ID NO: 558186 - DNA, 20 bp, Artificial Sequence
  chemically synthesized
aacccaattcaataattaaa

SEQ ID NO: 558187 - DNA, 20 bp, Artificial Sequence
  chemically synthesized
tttaaataatgcttctgata

SEQ ID NO: 558188 - DNA, 20 bp, Artificial Sequence
  chemically synthesized
cattgtaaatatcgatatct

SEQ ID NO: 558189 - DNA, 20 bp, Artificial Sequence
  chemically synthesized
aggacttacagtaacagaaa

SEQ ID NO: 558190 - DNA, 20 bp, Artificial Sequence
  chemically synthesized
tactgtaagtcctaaatgta

SEQ ID NO: 558191 - DNA, 20 bp, Artificial Sequence
  chemically synthesized
attattaacgtgcaattgac

SEQ ID NO: 558192 - DNA, 20 bp, Artificial Sequence
  chemically synthesized
agtacatgatgattgcttac

SEQ ID NO: 558193 - DNA, 20 bp, Artificial Sequence
  chemically synthesized
ctttattttgtactcttcct

SEQ ID NO: 558194 - DNA, 20 bp, Artificial Sequence
  chemically synthesized
gatctagaaataaattccct

SEQ ID NO: 558195 - DNA, 20 bp, Artificial Sequence
  chemically synthesized
ggtaatgattcgaaatttct

SEQ ID NO: 558196 - DNA, 20 bp, Artificial Sequence
  chemically synthesized
gcttaattctaaagtgaagg

SEQ ID NO: 558197 - DNA, 20 bp, Artificial Sequence
  chemically synthesized
tttgtagatattttaacaca

SEQ ID NO: 558198 - DNA, 20 bp, Artificial Sequence
  chemically synthesized
gtcttgaaaatcctttgttc

SEQ ID NO: 558199 - DNA, 20 bp, Artificial Sequence
  chemically synthesized
gagagggcaatttagtctac

SEQ ID NO: 558200 - DNA, 20 bp, Artificial Sequence
  chemically synthesized
ctacaaaaacttttatttaa

SEQ ID NO: 558201 - DNA, 20 bp, Artificial Sequence
  chemically synthesized
ttcttttctttttcccaaac

SEQ ID NO: 558202 - DNA, 20 bp, Artificial Sequence
  chemically synthesized
gaagaaaacaacaataataa

SEQ ID NO: 558203 - DNA, 20 bp, Artificial Sequence
  chemically synthesized
cgagtgtgagattaatggaa

SEQ ID NO: 558204 - DNA, 20 bp, Artificial Sequence
  chemically synthesized
gagtagaatatatgcatcta

SEQ ID NO: 558205 - DNA, 20 bp, Artificial Sequence
  chemically synthesized
caggtgaaatatataaagca

SEQ ID NO: 558206 - DNA, 20 bp, Artificial Sequence
  chemically synthesized
gtacatgttcaaatcaaatg

SEQ ID NO: 558207 - DNA, 20 bp, Artificial Sequence
  chemically synthesized
aacagcaatctagcattcaa

SEQ ID NO: 558208 - DNA, 20 bp, Artificial Sequence
  chemically synthesized
acaaataaatcaaactacag

SEQ ID NO: 558209 - DNA, 20 bp, Artificial Sequence
  chemically synthesized
ctgaacttctttattttaaa

SEQ ID NO: 558210 - DNA, 20 bp, Artificial Sequence
  chemically synthesized
aataatctgaagcactttca

SEQ ID NO: 558211 - DNA, 20 bp, Artificial Sequence
  chemically synthesized
gtcacaggtgacacagctgg

SEQ ID NO: 558212 - DNA, 20 bp, Artificial Sequence
  chemically synthesized
catacatatgtatctctttt

SEQ ID NO: 558213 - DNA, 20 bp, Artificial Sequence
  chemically synthesized
taaagcctccaagaaacaaa

SEQ ID NO: 558214 - DNA, 20 bp, Artificial Sequence
  chemically synthesized
cgttgtcttctgtaaaaata

SEQ ID NO: 558215 - DNA, 20 bp, Artificial Sequence
  chemically synthesized
cctaacctaattttttaaac

SEQ ID NO: 558216 - DNA, 20 bp, Artificial Sequence
  chemically synthesized
aattcctggagaaaagatgg

SEQ ID NO: 558217 - DNA, 20 bp, Artificial Sequence
  chemically synthesized
gaaaagatgggaaaacggca

SEQ ID NO: 558218 - DNA, 20 bp, Artificial Sequence
  chemically synthesized
tctaaatccattatatattt

SEQ ID NO: 558219 - DNA, 20 bp, Artificial Sequence
  chemically synthesized
gtcaggaagcctggaagact

SEQ ID NO: 558220 - DNA, 20 bp, Artificial Sequence
  chemically synthesized
taagtttaactatagaccaa

SEQ ID NO: 558221 - DNA, 20 bp, Artificial Sequence
  chemically synthesized
gtttacaagtgagagtccag

SEQ ID NO: 558222 - DNA, 20 bp, Artificial Sequence
  chemically synthesized
tactttgaagtaattgtgat

SEQ ID NO: 558223 - DNA, 20 bp, Artificial Sequence
  chemically synthesized
tgacaataaatcttaaatcc

SEQ ID NO: 558224 - DNA, 20 bp, Artificial Sequence
  chemically synthesized
aaataggattattgtgcaga

SEQ ID NO: 558225 - DNA, 20 bp, Artificial Sequence
  chemically synthesized
agaccaagcaaagcaaattt

SEQ ID NO: 558226 - DNA, 20 bp, Artificial Sequence
  chemically synthesized
cagcaaactacaaaaaaaaa

SEQ ID NO: 558227 - DNA, 20 bp, Artificial Sequence
  chemically synthesized
ttttataaatacaaagtttg

SEQ ID NO: 558228 - DNA, 20 bp, Artificial Sequence
  chemically synthesized
gacagagactatttgggcca

SEQ ID NO: 558229 - DNA, 20 bp, Artificial Sequence
  chemically synthesized
cagccccatttcacattgga

SEQ ID NO: 558230 - DNA, 20 bp, Artificial Sequence
  chemically synthesized
gtataataaaaaaaatgtaa

SEQ ID NO: 558231 - DNA, 20 bp, Artificial Sequence
  chemically synthesized
caacaaagatgtatttggct

SEQ ID NO: 558232 - DNA, 20 bp, Artificial Sequence
  chemically synthesized
ctgctttcaccactagactg

SEQ ID NO: 558233 - DNA, 20 bp, Artificial Sequence
  chemically synthesized
acaggcggtatagcattgca

SEQ ID NO: 558234 - DNA, 20 bp, Artificial Sequence
  chemically synthesized
caagtcccatgtatacacta

SEQ ID NO: 558235 - DNA, 20 bp, Artificial Sequence
  chemically synthesized
cggatgtaaaacaaaactat

SEQ ID NO: 558236 - DNA, 20 bp, Artificial Sequence
  chemically synthesized
tctttaacacggatgtaaaa

SEQ ID NO: 558237 - DNA, 20 bp, Artificial Sequence
  chemically synthesized
aaacatctttaacacggatg

SEQ ID NO: 558238 - DNA, 20 bp, Artificial Sequence
  chemically synthesized
gagaatgttgaagagccagt

SEQ ID NO: 558239 - DNA, 20 bp, Artificial Sequence
  chemically synthesized
atcaggtatcataagtgcta

SEQ ID NO: 558240 - DNA, 20 bp, Artificial Sequence
  chemically synthesized
acacatcctcctatatactt

SEQ ID NO: 558241 - DNA, 20 bp, Artificial Sequence
  chemically synthesized
gtttagggaataatgacaag

SEQ ID NO: 558242 - DNA, 20 bp, Artificial Sequence
  chemically synthesized
catgcatcaaaaatattcag

SEQ ID NO: 558243 - DNA, 20 bp, Artificial Sequence
  chemically synthesized
attgatggaaacattacagt

SEQ ID NO: 558244 - DNA, 20 bp, Artificial Sequence
  chemically synthesized
cataaagatccagaaatgag

SEQ ID NO: 558245 - DNA, 20 bp, Artificial Sequence
  chemically synthesized
taaactcataatacactaat

SEQ ID NO: 558246 - DNA, 20 bp, Artificial Sequence
  chemically synthesized
aacaatattttgaacattaa

SEQ ID NO: 558247 - DNA, 20 bp, Artificial Sequence
  chemically synthesized
ataccagctctgtgttactc

SEQ ID NO: 558248 - DNA, 20 bp, Artificial Sequence
  chemically synthesized
ccaataaccttaactacata

SEQ ID NO: 558249 - DNA, 20 bp, Artificial Sequence
  chemically synthesized
tcaactgttgatataatttt

SEQ ID NO: 558250 - DNA, 20 bp, Artificial Sequence
  chemically synthesized
acatagatacattcaattgt

SEQ ID NO: 558251 - DNA, 20 bp, Artificial Sequence
  chemically synthesized
tacatgaagttaaagcacag

SEQ ID NO: 558252 - DNA, 20 bp, Artificial Sequence
  chemically synthesized
tactcggcagtgaatagagg

SEQ ID NO: 558253 - DNA, 20 bp, Artificial Sequence
  chemically synthesized
attagtgcttcctcactttc

SEQ ID NO: 558254 - DNA, 20 bp, Artificial Sequence
  chemically synthesized
caactcactgggacacaaaa

SEQ ID NO: 558255 - DNA, 20 bp, Artificial Sequence
  chemically synthesized
agactgctttctaattgaaa

SEQ ID NO: 558256 - DNA, 20 bp, Artificial Sequence
  chemically synthesized
aatagagtgcagagcatcca

SEQ ID NO: 558257 - DNA, 20 bp, Artificial Sequence
  chemically synthesized
tgagtatttccctgtgtctt

SEQ ID NO: 558258 - DNA, 20 bp, Artificial Sequence
  chemically synthesized
gaggttctaccttgaagaaa

SEQ ID NO: 558259 - DNA, 20 bp, Artificial Sequence
  chemically synthesized
caacataaaccttaaatagt

SEQ ID NO: 558260 - DNA, 20 bp, Artificial Sequence
  chemically synthesized
atatactctcgggatcatga

SEQ ID NO: 558261 - DNA, 20 bp, Artificial Sequence
  chemically synthesized
catctcaaaaaaaaaaaaaa

SEQ ID NO: 558262 - DNA, 20 bp, Artificial Sequence
  chemically synthesized
aaaaaaaaaaaaaaaaaaac

SEQ ID NO: 558263 - DNA, 20 bp, Artificial Sequence
  chemically synthesized
aaaaaaacaaaaacaaaaga

SEQ ID NO: 558264 - DNA, 20 bp, Artificial Sequence
  chemically synthesized
ataccgaaagtaatagcatt

SEQ ID NO: 558265 - DNA, 20 bp, Artificial Sequence
  chemically synthesized
tacccattgcctgcctgtgt

SEQ ID NO: 558266 - DNA, 20 bp, Artificial Sequence
  chemically synthesized
ccccaaatcccaaagctcat

SEQ ID NO: 558267 - DNA, 20 bp, Artificial Sequence
  chemically synthesized
cgactctcttagtaattttc

SEQ ID NO: 558268 - DNA, 20 bp, Artificial Sequence
  chemically synthesized
tttagatttttcagtagaat

SEQ ID NO: 558269 - DNA, 20 bp, Artificial Sequence
  chemically synthesized
ataatttaagaaaaattatc

SEQ ID NO: 558270 - DNA, 20 bp, Artificial Sequence
  chemically synthesized
aattatccaaaacttagaag

SEQ ID NO: 558271 - DNA, 20 bp, Artificial Sequence
  chemically synthesized
agggtgtgaggagtttgtta

SEQ ID NO: 558272 - DNA, 20 bp, Artificial Sequence
  chemically synthesized
gaagttcaatgcaaatttta

SEQ ID NO: 558273 - DNA, 20 bp, Artificial Sequence
  chemically synthesized
ttggagagctggtaggaaga

SEQ ID NO: 558274 - DNA, 20 bp, Artificial Sequence
  chemically synthesized
tctccaattactgtattaaa

SEQ ID NO: 558275 - DNA, 20 bp, Artificial Sequence
  chemically synthesized
aaaatctaagccaccaaaga

SEQ ID NO: 558276 - DNA, 20 bp, Artificial Sequence
  chemically synthesized
aggaaaaacactattgattg

SEQ ID NO: 558277 - DNA, 20 bp, Artificial Sequence
  chemically synthesized
tgctgatggaagagaaaagg

SEQ ID NO: 558278 - DNA, 20 bp, Artificial Sequence
  chemically synthesized
tttggccaccagggagtgtt

SEQ ID NO: 558279 - DNA, 20 bp, Artificial Sequence
  chemically synthesized
aactaactcatttcaaaggt

SEQ ID NO: 558280 - DNA, 20 bp, Artificial Sequence
  chemically synthesized
agtacccaacagcactcagt

SEQ ID NO: 558281 - DNA, 20 bp, Artificial Sequence
  chemically synthesized
gcacctatagtttctacctc

SEQ ID NO: 558282 - DNA, 20 bp, Artificial Sequence
  chemically synthesized
acagttggtgtgctgattta

SEQ ID NO: 558283 - DNA, 20 bp, Artificial Sequence
  chemically synthesized
gaataaataatgcttattat

SEQ ID NO: 558284 - DNA, 20 bp, Artificial Sequence
  chemically synthesized
ctcaaagtttactagttata

SEQ ID NO: 558285 - DNA, 20 bp, Artificial Sequence
  chemically synthesized
tgattgttacatgtgacatg

SEQ ID NO: 558286 - DNA, 20 bp, Artificial Sequence
  chemically synthesized
gtaacatcagttacatatgt

SEQ ID NO: 558287 - DNA, 20 bp, Artificial Sequence
  chemically synthesized
ttttatttaatcaactataa

SEQ ID NO: 558288 - DNA, 20 bp, Artificial Sequence
  chemically synthesized
gtcactgaaactggggaaag

SEQ ID NO: 558289 - DNA, 20 bp, Artificial Sequence
  chemically synthesized
aaatagtctcacccttaaag

SEQ ID NO: 558290 - DNA, 20 bp, Artificial Sequence
  chemically synthesized
tgagctcttgatatagttct

SEQ ID NO: 558291 - DNA, 20 bp, Artificial Sequence
  chemically synthesized
gtcaaaaggtacaaatccct

SEQ ID NO: 558292 - DNA, 20 bp, Artificial Sequence
  chemically synthesized
agagagctgagaatgatacg

SEQ ID NO: 558293 - DNA, 20 bp, Artificial Sequence
  chemically synthesized
cactgctttattttcaagca

SEQ ID NO: 558294 - DNA, 20 bp, Artificial Sequence
  chemically synthesized
ttacggtttgaactttaaag

SEQ ID NO: 558295 - DNA, 20 bp, Artificial Sequence
  chemically synthesized
tcaaaccgtaattataatgt

SEQ ID NO: 558296 - DNA, 20 bp, Artificial Sequence
  chemically synthesized
tgcaactgtggtttataggc

SEQ ID NO: 558297 - DNA, 20 bp, Artificial Sequence
  chemically synthesized
gggccagacaggtaggttag

SEQ ID NO: 558298 - DNA, 20 bp, Artificial Sequence
  chemically synthesized
ggtcatctcttctgtttcta

SEQ ID NO: 558299 - DNA, 20 bp, Artificial Sequence
  chemically synthesized
atacagttattatggaaatt

SEQ ID NO: 558300 - DNA, 20 bp, Artificial Sequence
  chemically synthesized
ccaaaagtttcaacattgag

SEQ ID NO: 558301 - DNA, 20 bp, Artificial Sequence
  chemically synthesized
agcactgtcctgaaacttaa

SEQ ID NO: 558302 - DNA, 20 bp, Artificial Sequence
  chemically synthesized
aagacatggttccctacagg

SEQ ID NO: 558303 - DNA, 20 bp, Artificial Sequence
  chemically synthesized
gaagttagaaatgttaagcc

SEQ ID NO: 558304 - DNA, 20 bp, Artificial Sequence
  chemically synthesized
gtcatattcttggtaatttt

SEQ ID NO: 558305 - DNA, 20 bp, Artificial Sequence
  chemically synthesized
aaaattaagaagccagttca

SEQ ID NO: 558306 - DNA, 20 bp, Artificial Sequence
  chemically synthesized
gaactggcttcttaattttc

SEQ ID NO: 558307 - DNA, 20 bp, Artificial Sequence
  chemically synthesized
tgcagaaccgtaagtcaaaa

SEQ ID NO: 558308 - DNA, 20 bp, Artificial Sequence
  chemically synthesized
cacacacacacagtcgcaat

SEQ ID NO: 558309 - DNA, 20 bp, Artificial Sequence
  chemically synthesized
atttaaaaaatgaaattaac

SEQ ID NO: 558310 - DNA, 20 bp, Artificial Sequence
  chemically synthesized
aaaaatgaaattaaccaaaa

SEQ ID NO: 558311 - DNA, 20 bp, Artificial Sequence
  chemically synthesized
ttgaaaagtgatggtgtcag

SEQ ID NO: 558312 - DNA, 20 bp, Artificial Sequence
  chemically synthesized
aacatcaacacatttattca

SEQ ID NO: 558313 - DNA, 20 bp, Artificial Sequence
  chemically synthesized
gggagattacctttatctta

SEQ ID NO: 558314 - DNA, 20 bp, Artificial Sequence
  chemically synthesized
acatgagtcctctgaggccc

SEQ ID NO: 558315 - DNA, 20 bp, Artificial Sequence
  chemically synthesized
caaggttccacagaaaaaag

SEQ ID NO: 558316 - DNA, 20 bp, Artificial Sequence
  chemically synthesized
aaatcggaatggaaaagact

SEQ ID NO: 558317 - DNA, 20 bp, Artificial Sequence
  chemically synthesized
tcaaaaggacaagaatcctt

SEQ ID NO: 558318 - DNA, 20 bp, Artificial Sequence
  chemically synthesized
aagaatccttcaaaacaagg

SEQ ID NO: 558319 - DNA, 20 bp, Artificial Sequence
  chemically synthesized
tcaaaacaaggaaaaactcc

SEQ ID NO: 558320 - DNA, 20 bp, Artificial Sequence
  chemically synthesized
aggttctcactctgcattat

SEQ ID NO: 558321 - DNA, 20 bp, Artificial Sequence
  chemically synthesized
aagggtggagttccatcttt

SEQ ID NO: 558322 - DNA, 20 bp, Artificial Sequence
  chemically synthesized
cataacattccatacatcct

SEQ ID NO: 558323 - DNA, 20 bp, Artificial Sequence
  chemically synthesized
ggtttcaatgtttttccctc

SEQ ID NO: 558324 - DNA, 20 bp, Artificial Sequence
  chemically synthesized
tcaacatcagttttggaggg

SEQ ID NO: 558325 - DNA, 20 bp, Artificial Sequence
  chemically synthesized
ggtactttgttacagcagca

SEQ ID NO: 558326 - DNA, 20 bp, Artificial Sequence
  chemically synthesized
tgctgaaacaactgtaactt

SEQ ID NO: 558327 - DNA, 20 bp, Artificial Sequence
  chemically synthesized
caataagaacaaattaccaa

SEQ ID NO: 558328 - DNA, 20 bp, Artificial Sequence
  chemically synthesized
caatttctatttgacaaggg

SEQ ID NO: 558329 - DNA, 20 bp, Artificial Sequence
  chemically synthesized
ggatacctagtctgacttgg

SEQ ID NO: 558330 - DNA, 20 bp, Artificial Sequence
  chemically synthesized
gcaggaaaaataacagctgg

SEQ ID NO: 558331 - DNA, 20 bp, Artificial Sequence
  chemically synthesized
ttgtccttgcttttcatagc

SEQ ID NO: 558332 - DNA, 20 bp, Artificial Sequence
  chemically synthesized
atggaaaagataataaacat

SEQ ID NO: 558333 - DNA, 20 bp, Artificial Sequence
  chemically synthesized
agtaagaagggatgtgaaaa

SEQ ID NO: 558334 - DNA, 20 bp, Artificial Sequence
  chemically synthesized
ccaaatagaaaaaatcaaaa

SEQ ID NO: 558335 - DNA, 20 bp, Artificial Sequence
  chemically synthesized
aaattccaaatagaaaaaat

SEQ ID NO: 558336 - DNA, 20 bp, Artificial Sequence
  chemically synthesized
ttggaaagaagcaagaacaa

SEQ ID NO: 558337 - DNA, 20 bp, Artificial Sequence
  chemically synthesized
ccaggatagctttgtgacca

SEQ ID NO: 558338 - DNA, 20 bp, Artificial Sequence
  chemically synthesized
agctggtgaaatcacaatgt

SEQ ID NO: 558339 - DNA, 20 bp, Artificial Sequence
  chemically synthesized
gtgtatcctaataaaaatac

SEQ ID NO: 558340 - DNA, 20 bp, Artificial Sequence
  chemically synthesized
aagcaaggcgagaagaatga

SEQ ID NO: 558341 - DNA, 20 bp, Artificial Sequence
  chemically synthesized
ggtcccaccatcaaatgttg

SEQ ID NO: 558342 - DNA, 20 bp, Artificial Sequence
  chemically synthesized
tgctgtaaagaaatgtaata

SEQ ID NO: 558343 - DNA, 20 bp, Artificial Sequence
  chemically synthesized
taacataggttatggagcag

SEQ ID NO: 558344 - DNA, 20 bp, Artificial Sequence
  chemically synthesized
taacattgcaaaagatacca

SEQ ID NO: 558345 - DNA, 20 bp, Artificial Sequence
  chemically synthesized
caagactatattttttccct

SEQ ID NO: 558346 - DNA, 20 bp, Artificial Sequence
  chemically synthesized
cattcagcagcattatttca

SEQ ID NO: 558347 - DNA, 20 bp, Artificial Sequence
  chemically synthesized
ttctatcatagcccatgttt

SEQ ID NO: 558348 - DNA, 20 bp, Artificial Sequence
  chemically synthesized
gactaggaaaaaataagttt

SEQ ID NO: 558349 - DNA, 20 bp, Artificial Sequence
  chemically synthesized
tggtgttcagcttttccttt

SEQ ID NO: 558350 - DNA, 20 bp, Artificial Sequence
  chemically synthesized
aaaccaacctggaaatttca

SEQ ID NO: 558351 - DNA, 20 bp, Artificial Sequence
  chemically synthesized
tctaaacatccacactgcag

SEQ ID NO: 558352 - DNA, 20 bp, Artificial Sequence
  chemically synthesized
tacaaagttttatcatccac

SEQ ID NO: 558353 - DNA, 20 bp, Artificial Sequence
  chemically synthesized
gtcactgttttggtggatga

SEQ ID NO: 558354 - DNA, 20 bp, Artificial Sequence
  chemically synthesized
gaaactgatgaacattttat

SEQ ID NO: 558355 - DNA, 20 bp, Artificial Sequence
  chemically synthesized
ctccaacttgaaaacaagtc

SEQ ID NO: 558356 - DNA, 20 bp, Artificial Sequence
  chemically synthesized
agcctcctttactccaactt

SEQ ID NO: 558357 - DNA, 20 bp, Artificial Sequence
  chemically synthesized
tgtctgatgttcaatgtgtt

SEQ ID NO: 558358 - DNA, 20 bp, Artificial Sequence
  chemically synthesized
tgatcagttcatgtatgcaa

SEQ ID NO: 558359 - DNA, 20 bp, Artificial Sequence
  chemically synthesized
ctttttccccactactgagg

SEQ ID NO: 558360 - DNA, 20 bp, Artificial Sequence
  chemically synthesized
atttgacaatagagattata

SEQ ID NO: 558361 - DNA, 20 bp, Artificial Sequence
  chemically synthesized
tcaagaacaagaaacatgaa

SEQ ID NO: 558362 - DNA, 20 bp, Artificial Sequence
  chemically synthesized
aaaactacaccaagttacat

SEQ ID NO: 558363 - DNA, 20 bp, Artificial Sequence
  chemically synthesized
agtggtttctatatctaccc

SEQ ID NO: 558364 - DNA, 20 bp, Artificial Sequence
  chemically synthesized
ttaaacacagaaaatatttt

SEQ ID NO: 558365 - DNA, 20 bp, Artificial Sequence
  chemically synthesized
gattaagacagatgagggca

SEQ ID NO: 558366 - DNA, 20 bp, Artificial Sequence
  chemically synthesized
ttctgaaatagtccagaggc

SEQ ID NO: 558367 - DNA, 20 bp, Artificial Sequence
  chemically synthesized
cactacaaaattgtctttag

SEQ ID NO: 558368 - DNA, 20 bp, Artificial Sequence
  chemically synthesized
tacacactgccccaaagcca

SEQ ID NO: 558369 - DNA, 20 bp, Artificial Sequence
  chemically synthesized
gaagataaatacaatttcga

SEQ ID NO: 558370 - DNA, 20 bp, Artificial Sequence
  chemically synthesized
aaatatctttatatcataat

SEQ ID NO: 558371 - DNA, 20 bp, Artificial Sequence
  chemically synthesized
agaaaaatagatggattatg

SEQ ID NO: 558372 - DNA, 20 bp, Artificial Sequence
  chemically synthesized
tttcaatattattcttgatc

SEQ ID NO: 558373 - DNA, 20 bp, Artificial Sequence
  chemically synthesized
atacatatagttattacaaa

SEQ ID NO: 558374 - DNA, 20 bp, Artificial Sequence
  chemically synthesized
taagaatcaactggggcatt

SEQ ID NO: 558375 - DNA, 20 bp, Artificial Sequence
  chemically synthesized
ttcaatgtacagtcaaggtg

SEQ ID NO: 558376 - DNA, 20 bp, Artificial Sequence
  chemically synthesized
caagcaagcatttgtgagca

SEQ ID NO: 558377 - DNA, 20 bp, Artificial Sequence
  chemically synthesized
agtaggcagatgtagcaatt

SEQ ID NO: 558378 - DNA, 20 bp, Artificial Sequence
  chemically synthesized
tattcccattttccattgga

SEQ ID NO: 558379 - DNA, 20 bp, Artificial Sequence
  chemically synthesized
agttaataaaaataagggga

SEQ ID NO: 558380 - DNA, 20 bp, Artificial Sequence
  chemically synthesized
gcttaacctttaaaatcttg

SEQ ID NO: 558381 - DNA, 20 bp, Artificial Sequence
  chemically synthesized
taaattattagtaaacatgc

SEQ ID NO: 558382 - DNA, 20 bp, Artificial Sequence
  chemically synthesized
agttcaagtgattgggtagg

SEQ ID NO: 558383 - DNA, 20 bp, Artificial Sequence
  chemically synthesized
tttacattctcccaagagaa

SEQ ID NO: 558384 - DNA, 20 bp, Artificial Sequence
  chemically synthesized
catgcaactgctaaaccttt

SEQ ID NO: 558385 - DNA, 20 bp, Artificial Sequence
  chemically synthesized
aattggtaaatctaactttg

SEQ ID NO: 558386 - DNA, 20 bp, Artificial Sequence
  chemically synthesized
ttcttcttactgccaagaaa

SEQ ID NO: 558387 - DNA, 20 bp, Artificial Sequence
  chemically synthesized
ctattgaatttgaatttttt

SEQ ID NO: 558388 - DNA, 20 bp, Artificial Sequence
  chemically synthesized
agtgaagtaattcaggaatg

SEQ ID NO: 558389 - DNA, 20 bp, Artificial Sequence
  chemically synthesized
aaattagtacaacctacatg

SEQ ID NO: 558390 - DNA, 20 bp, Artificial Sequence
  chemically synthesized
gattttgttgtgaatgtgat

SEQ ID NO: 558391 - DNA, 20 bp, Artificial Sequence
  chemically synthesized
cattcacaacaaaatctatt

SEQ ID NO: 558392 - DNA, 20 bp, Artificial Sequence
  chemically synthesized
aaatgaaaatgcaaatttct

SEQ ID NO: 558393 - DNA, 20 bp, Artificial Sequence
  chemically synthesized
ccatcacccagaccaagaaa

SEQ ID NO: 558394 - DNA, 20 bp, Artificial Sequence
  chemically synthesized
gcatagtaatagccccaaac

SEQ ID NO: 558395 - DNA, 20 bp, Artificial Sequence
  chemically synthesized
atggtccaggccatgcaaat

SEQ ID NO: 558396 - DNA, 20 bp, Artificial Sequence
  chemically synthesized
cttaacgttactatgatgca

SEQ ID NO: 558397 - DNA, 20 bp, Artificial Sequence
  chemically synthesized
actaaaaactgacatgagaa

SEQ ID NO: 558398 - DNA, 20 bp, Artificial Sequence
  chemically synthesized
aaataaaatcccaggtgact

SEQ ID NO: 558399 - DNA, 20 bp, Artificial Sequence
  chemically synthesized
ctccattttaattttttagg

SEQ ID NO: 558400 - DNA, 20 bp, Artificial Sequence
  chemically synthesized
attgaatatattgaaagcag

SEQ ID NO: 558401 - DNA, 20 bp, Artificial Sequence
  chemically synthesized
catttaacaagtttacctat

SEQ ID NO: 558402 - DNA, 20 bp, Artificial Sequence
  chemically synthesized
cagagttgagtagttgtaac

SEQ ID NO: 558403 - DNA, 20 bp, Artificial Sequence
  chemically synthesized
gggattcaatactactttac

SEQ ID NO: 558404 - DNA, 20 bp, Artificial Sequence
  chemically synthesized
tggaaatcattgactaaaat

SEQ ID NO: 558405 - DNA, 20 bp, Artificial Sequence
  chemically synthesized
ccactgtcgtggcctttctt

SEQ ID NO: 558406 - DNA, 20 bp, Artificial Sequence
  chemically synthesized
cccaccatgtatactgtact

SEQ ID NO: 558407 - DNA, 20 bp, Artificial Sequence
  chemically synthesized
acaagcttccacagctttgt

SEQ ID NO: 558408 - DNA, 20 bp, Artificial Sequence
  chemically synthesized
accaggaattcaaaggtgca

SEQ ID NO: 558409 - DNA, 20 bp, Artificial Sequence
  chemically synthesized
attttgtgtcttttattaat

SEQ ID NO: 558410 - DNA, 20 bp, Artificial Sequence
  chemically synthesized
ttaaggtgagtgttttaaac

SEQ ID NO: 558411 - DNA, 20 bp, Artificial Sequence
  chemically synthesized
ttatcaatattgttttggtt

SEQ ID NO: 558412 - DNA, 20 bp, Artificial Sequence
  chemically synthesized
agaagtcaatagcattattt

SEQ ID NO: 558413 - DNA, 20 bp, Artificial Sequence
  chemically synthesized
catcttaagtggaataactc

SEQ ID NO: 558414 - DNA, 20 bp, Artificial Sequence
  chemically synthesized
atttgcatgatgggtacaca

SEQ ID NO: 558415 - DNA, 20 bp, Artificial Sequence
  chemically synthesized
cactctattttggcttaggg

SEQ ID NO: 558416 - DNA, 20 bp, Artificial Sequence
  chemically synthesized
cctttctcttcattcaaaca

SEQ ID NO: 558417 - DNA, 20 bp, Artificial Sequence
  chemically synthesized
tatatgctatgcactctaat

SEQ ID NO: 558418 - DNA, 20 bp, Artificial Sequence
  chemically synthesized
tttattcattttgcaaatga

SEQ ID NO: 558419 - DNA, 20 bp, Artificial Sequence
  chemically synthesized
cttaaaaaaaacaagaaaca

SEQ ID NO: 558420 - DNA, 20 bp, Artificial Sequence
  chemically synthesized
tgattcaaatgacacttaaa

SEQ ID NO: 558421 - DNA, 20 bp, Artificial Sequence
  chemically synthesized
tgggaataagtatacaccca

SEQ ID NO: 558422 - DNA, 20 bp, Artificial Sequence
  chemically synthesized
acaaaacaaaacaaaacaaa

SEQ ID NO: 558423 - DNA, 20 bp, Artificial Sequence
  chemically synthesized
aataacaaaacaaaacaaaa

SEQ ID NO: 558424 - DNA, 20 bp, Artificial Sequence
  chemically synthesized
tcaaaaataacaaaacaaaa

SEQ ID NO: 558425 - DNA, 20 bp, Artificial Sequence
  chemically synthesized
ccgtctcaaaaataacaaaa

SEQ ID NO: 558426 - DNA, 20 bp, Artificial Sequence
  chemically synthesized
agactccgtctcaaaaataa

SEQ ID NO: 558427 - DNA, 20 bp, Artificial Sequence
  chemically synthesized
gtgagccaccgcgcccggcc

SEQ ID NO: 558428 - DNA, 20 bp, Artificial Sequence
  chemically synthesized
ttgaaattaagaacaagtag

SEQ ID NO: 558429 - DNA, 20 bp, Artificial Sequence
  chemically synthesized
tacaaagcactgttaggcaa

SEQ ID NO: 558430 - DNA, 20 bp, Artificial Sequence
  chemically synthesized
gagcacttactatgggctca

SEQ ID NO: 558431 - DNA, 20 bp, Artificial Sequence
  chemically synthesized
gctattgtaattgggcaaac

SEQ ID NO: 558432 - DNA, 20 bp, Artificial Sequence
  chemically synthesized
atgaaaaagccattttattt

SEQ ID NO: 558433 - DNA, 20 bp, Artificial Sequence
  chemically synthesized
cacacttacaaatacataaa

SEQ ID NO: 558434 - DNA, 20 bp, Artificial Sequence
  chemically synthesized
attataactaccttcacagg

SEQ ID NO: 558435 - DNA, 20 bp, Artificial Sequence
  chemically synthesized
tgttcactaatatggtaaat

SEQ ID NO: 558436 - DNA, 20 bp, Artificial Sequence
  chemically synthesized
tgagattggtttcaataaag

SEQ ID NO: 558437 - DNA, 20 bp, Artificial Sequence
  chemically synthesized
ttcaactagaaatagcaagg

SEQ ID NO: 558438 - DNA, 20 bp, Artificial Sequence
  chemically synthesized
tattttatattctatcttat

SEQ ID NO: 558439 - DNA, 20 bp, Artificial Sequence
  chemically synthesized
cgagggaaatgttcttggca

SEQ ID NO: 558440 - DNA, 20 bp, Artificial Sequence
  chemically synthesized
acttctgcataaatgaactc

SEQ ID NO: 558441 - DNA, 20 bp, Artificial Sequence
  chemically synthesized
ttcacaatacaataaattaa

SEQ ID NO: 558442 - DNA, 20 bp, Artificial Sequence
  chemically synthesized
tcgcagttgtagggttaatg

SEQ ID NO: 558443 - DNA, 20 bp, Artificial Sequence
  chemically synthesized
agccatggtatgggtcacag

SEQ ID NO: 558444 - DNA, 20 bp, Artificial Sequence
  chemically synthesized
ttttcctgacccaacataac

SEQ ID NO: 558445 - DNA, 20 bp, Artificial Sequence
  chemically synthesized
aacgttcatttgcacgtggt

SEQ ID NO: 558446 - DNA, 20 bp, Artificial Sequence
  chemically synthesized
ggaaggaaaagatatgtgat

SEQ ID NO: 558447 - DNA, 20 bp, Artificial Sequence
  chemically synthesized
tccagctttcacttatccca

SEQ ID NO: 558448 - DNA, 20 bp, Artificial Sequence
  chemically synthesized
gttagaaaaagttgaaaaaa

SEQ ID NO: 558449 - DNA, 20 bp, Artificial Sequence
  chemically synthesized
gatgaataaatactccaaat

SEQ ID NO: 558450 - DNA, 20 bp, Artificial Sequence
  chemically synthesized
tagttaaaaaacactaaaac

SEQ ID NO: 558451 - DNA, 20 bp, Artificial Sequence
  chemically synthesized
ttttcatagttaaaaaacac

SEQ ID NO: 558452 - DNA, 20 bp, Artificial Sequence
  chemically synthesized
tgacaatattttcatagtta

SEQ ID NO: 558453 - DNA, 20 bp, Artificial Sequence
  chemically synthesized
agttacaaaatgacagtgaa

SEQ ID NO: 558454 - DNA, 20 bp, Artificial Sequence
  chemically synthesized
ggcaaagaaagtccccttta

SEQ ID NO: 558455 - DNA, 20 bp, Artificial Sequence
  chemically synthesized
tatgtctttatcagcagcat

SEQ ID NO: 558456 - DNA, 20 bp, Artificial Sequence
  chemically synthesized
agatagtatatttgcaatac

SEQ ID NO: 558457 - DNA, 20 bp, Artificial Sequence
  chemically synthesized
tatatttgatcattttaatt

SEQ ID NO: 558458 - DNA, 20 bp, Artificial Sequence
  chemically synthesized
cctgcaaagcctaggatccg

SEQ ID NO: 558459 - DNA, 20 bp, Artificial Sequence
  chemically synthesized
ataacaaggcgaatcatgcc

SEQ ID NO: 558460 - DNA, 20 bp, Artificial Sequence
  chemically synthesized
attccaaaatttagcagctt

SEQ ID NO: 558461 - DNA, 20 bp, Artificial Sequence
  chemically synthesized
tcatcatcataaatttttac

SEQ ID NO: 558462 - DNA, 20 bp, Artificial Sequence
  chemically synthesized
ctcattttcttcagttctaa

SEQ ID NO: 558463 - DNA, 20 bp, Artificial Sequence
  chemically synthesized
caaataatagatgttaaaaa

SEQ ID NO: 558464 - DNA, 20 bp, Artificial Sequence
  chemically synthesized
acagagtagtttcattgctc

SEQ ID NO: 558465 - DNA, 20 bp, Artificial Sequence
  chemically synthesized
atttatacaattaagaattt

SEQ ID NO: 558466 - DNA, 20 bp, Artificial Sequence
  chemically synthesized
agacaaggcatagaccttaa

SEQ ID NO: 558467 - DNA, 20 bp, Artificial Sequence
  chemically synthesized
aaaagcagaaatattgggaa

SEQ ID NO: 558468 - DNA, 20 bp, Artificial Sequence
  chemically synthesized
tggaagacagaaaccaacat

SEQ ID NO: 558469 - DNA, 20 bp, Artificial Sequence
  chemically synthesized
ggaaatccttgattgtctct

SEQ ID NO: 558470 - DNA, 20 bp, Artificial Sequence
  chemically synthesized
atggtattttgttatagcaa

SEQ ID NO: 558471 - DNA, 20 bp, Artificial Sequence
  chemically synthesized
tgagagcctacctgcaatac

SEQ ID NO: 558472 - DNA, 20 bp, Artificial Sequence
  chemically synthesized
attgccccttttaagggatt

SEQ ID NO: 558473 - DNA, 20 bp, Artificial Sequence
  chemically synthesized
ctcgggaatatatggccttc

SEQ ID NO: 558474 - DNA, 20 bp, Artificial Sequence
  chemically synthesized
tttgtttttcaggatcccag

SEQ ID NO: 558475 - DNA, 20 bp, Artificial Sequence
  chemically synthesized
caagtttttctgggatcctg

SEQ ID NO: 558476 - DNA, 20 bp, Artificial Sequence
  chemically synthesized
aaagattacgctaagggaat

SEQ ID NO: 558477 - DNA, 20 bp, Artificial Sequence
  chemically synthesized
ctccaatagaaatgacaatc

SEQ ID NO: 558478 - DNA, 20 bp, Artificial Sequence
  chemically synthesized
tggtgcttgcattcgtgaaa

SEQ ID NO: 558479 - DNA, 20 bp, Artificial Sequence
  chemically synthesized
ctggagacaaactcagtatt

SEQ ID NO: 558480 - DNA, 20 bp, Artificial Sequence
  chemically synthesized
acagacttgacactgaacca

SEQ ID NO: 558481 - DNA, 20 bp, Artificial Sequence
  chemically synthesized
gttatgctggtacctattat

SEQ ID NO: 558482 - DNA, 20 bp, Artificial Sequence
  chemically synthesized
cttttccaaataagaaaagg

SEQ ID NO: 558483 - DNA, 20 bp, Artificial Sequence
  chemically synthesized
aaaaatgcttctgtgtgttc

SEQ ID NO: 558484 - DNA, 20 bp, Artificial Sequence
  chemically synthesized
ctttcttttcagtaccacaa

SEQ ID NO: 558485 - DNA, 20 bp, Artificial Sequence
  chemically synthesized
aagaaaagaaagaaaaaaag

SEQ ID NO: 558486 - DNA, 20 bp, Artificial Sequence
  chemically synthesized
taaactggtaaagcaagtat

SEQ ID NO: 558487 - DNA, 20 bp, Artificial Sequence
  chemically synthesized
agactccttattttcaaaga

SEQ ID NO: 558488 - DNA, 20 bp, Artificial Sequence
  chemically synthesized
cacaatgtgcacatgtaccc

SEQ ID NO: 558489 - DNA, 20 bp, Artificial Sequence
  chemically synthesized
agtaaactatcgcaagaaca

SEQ ID NO: 558490 - DNA, 20 bp, Artificial Sequence
  chemically synthesized
gccatcagagtaatgcaaat

SEQ ID NO: 558491 - DNA, 20 bp, Artificial Sequence
  chemically synthesized
agaagacatttatgcagcca

SEQ ID NO: 558492 - DNA, 20 bp, Artificial Sequence
  chemically synthesized
ctcaaacaaatttacaagaa

SEQ ID NO: 558493 - DNA, 20 bp, Artificial Sequence
  chemically synthesized
atgggcaaggacttcatgtc

SEQ ID NO: 558494 - DNA, 20 bp, Artificial Sequence
  chemically synthesized
aaaccataaaaaccctagaa

SEQ ID NO: 558495 - DNA, 20 bp, Artificial Sequence
  chemically synthesized
aacattagacctaaaaccat

SEQ ID NO: 558496 - DNA, 20 bp, Artificial Sequence
  chemically synthesized
aaagatttaaacattagacc

SEQ ID NO: 558497 - DNA, 20 bp, Artificial Sequence
  chemically synthesized
tgatctttgacaaacctgag

SEQ ID NO: 558498 - DNA, 20 bp, Artificial Sequence
  chemically synthesized
aaacagcatggtactggtac

SEQ ID NO: 558499 - DNA, 20 bp, Artificial Sequence
  chemically synthesized
tactacaaggctacagtaac

SEQ ID NO: 558500 - DNA, 20 bp, Artificial Sequence
  chemically synthesized
cctttcttcacagaattgga

SEQ ID NO: 558501 - DNA, 20 bp, Artificial Sequence
  chemically synthesized
acgacatgattgtttatcta

SEQ ID NO: 558502 - DNA, 20 bp, Artificial Sequence
  chemically synthesized
aaactggaagcattcccttt

SEQ ID NO: 558503 - DNA, 20 bp, Artificial Sequence
  chemically synthesized
caatatcatactgaatgggc

SEQ ID NO: 558504 - DNA, 20 bp, Artificial Sequence
  chemically synthesized
attcaacaacccttcatgct

SEQ ID NO: 558505 - DNA, 20 bp, Artificial Sequence
  chemically synthesized
atataaacagagccaaagac

SEQ ID NO: 558506 - DNA, 20 bp, Artificial Sequence
  chemically synthesized
atttgactctgaagtacgtg

SEQ ID NO: 558507 - DNA, 20 bp, Artificial Sequence
  chemically synthesized
tcagttgttgaaccaagttt

SEQ ID NO: 558508 - DNA, 20 bp, Artificial Sequence
  chemically synthesized
taatttccttggaagtttgt

SEQ ID NO: 558509 - DNA, 20 bp, Artificial Sequence
  chemically synthesized
tccttggaagtttgtcaaaa

SEQ ID NO: 558510 - DNA, 20 bp, Artificial Sequence
  chemically synthesized
tggtagttgctgcagatgtg

SEQ ID NO: 558511 - DNA, 20 bp, Artificial Sequence
  chemically synthesized
gaggactcgtcactgtgcat

SEQ ID NO: 558512 - DNA, 20 bp, Artificial Sequence
  chemically synthesized
gattctgagggctagaaata

SEQ ID NO: 558513 - DNA, 20 bp, Artificial Sequence
  chemically synthesized
gtataacctctttctcttca

SEQ ID NO: 558514 - DNA, 20 bp, Artificial Sequence
  chemically synthesized
aaggcattgttaacattagt

SEQ ID NO: 558515 - DNA, 20 bp, Artificial Sequence
  chemically synthesized
cttatacaactgttgttaaa

SEQ ID NO: 558516 - DNA, 20 bp, Artificial Sequence
  chemically synthesized
tatggcactattccaaaaaa

SEQ ID NO: 558517 - DNA, 20 bp, Artificial Sequence
  chemically synthesized
taaaatcctgataattctag

SEQ ID NO: 558518 - DNA, 20 bp, Artificial Sequence
  chemically synthesized
agaattctcctaggctggaa

SEQ ID NO: 558519 - DNA, 20 bp, Artificial Sequence
  chemically synthesized
tttaaatgtgaacacaacag

SEQ ID NO: 558520 - DNA, 20 bp, Artificial Sequence
  chemically synthesized
tgaaataaaattgatgaaaa

SEQ ID NO: 558521 - DNA, 20 bp, Artificial Sequence
  chemically synthesized
gtaactgaaataaaattgat

SEQ ID NO: 558522 - DNA, 20 bp, Artificial Sequence
  chemically synthesized
actataaagctatatgttta

SEQ ID NO: 558523 - DNA, 20 bp, Artificial Sequence
  chemically synthesized
tgagaaaattgaggttcagc

SEQ ID NO: 558524 - DNA, 20 bp, Artificial Sequence
  chemically synthesized
taagtactccctttttgcag

SEQ ID NO: 558525 - DNA, 20 bp, Artificial Sequence
  chemically synthesized
aacttccttcattttctgat

SEQ ID NO: 558526 - DNA, 20 bp, Artificial Sequence
  chemically synthesized
cctccattgagaagattcta

SEQ ID NO: 558527 - DNA, 20 bp, Artificial Sequence
  chemically synthesized
cccactgagatatatgcaat

SEQ ID NO: 558528 - DNA, 20 bp, Artificial Sequence
  chemically synthesized
tggcatatatttaaatgttg

SEQ ID NO: 558529 - DNA, 20 bp, Artificial Sequence
  chemically synthesized
tacgataagcaggagaaaaa

SEQ ID NO: 558530 - DNA, 20 bp, Artificial Sequence
  chemically synthesized
agctcttgtttcctctgaca

SEQ ID NO: 558531 - DNA, 20 bp, Artificial Sequence
  chemically synthesized
gtttccgtcatgtccagagt

SEQ ID NO: 558532 - DNA, 20 bp, Artificial Sequence
  chemically synthesized
tgatagtgttcatcagtgct

SEQ ID NO: 558533 - DNA, 20 bp, Artificial Sequence
  chemically synthesized
ataaccctgaaaaggagcac

SEQ ID NO: 558534 - DNA, 20 bp, Artificial Sequence
  chemically synthesized
aatgcattaaaagtacctca

SEQ ID NO: 558535 - DNA, 20 bp, Artificial Sequence
  chemically synthesized
gtactttagggaacctccct

SEQ ID NO: 558536 - DNA, 20 bp, Artificial Sequence
  chemically synthesized
taaagtacattgttttcagc

SEQ ID NO: 558537 - DNA, 20 bp, Artificial Sequence
  chemically synthesized
acataatcattgtttttgct

SEQ ID NO: 558538 - DNA, 20 bp, Artificial Sequence
  chemically synthesized
tcttgaaataaataaataag

SEQ ID NO: 558539 - DNA, 20 bp, Artificial Sequence
  chemically synthesized
gattttatctaagtgcaacg

SEQ ID NO: 558540 - DNA, 20 bp, Artificial Sequence
  chemically synthesized
ctacaatgacttgtacaacg

SEQ ID NO: 558541 - DNA, 20 bp, Artificial Sequence
  chemically synthesized
agtaattctgatcctgtctc

SEQ ID NO: 558542 - DNA, 20 bp, Artificial Sequence
  chemically synthesized
attcaacggtaaatggttta

SEQ ID NO: 558543 - DNA, 20 bp, Artificial Sequence
  chemically synthesized
atggagtcagagaagtgagg

SEQ ID NO: 558544 - DNA, 20 bp, Artificial Sequence
  chemically synthesized
gatatctcaaagatggtaga

SEQ ID NO: 558545 - DNA, 20 bp, Artificial Sequence
  chemically synthesized
gattatgaggtcaggagttc

SEQ ID NO: 558546 - DNA, 20 bp, Artificial Sequence
  chemically synthesized
tttcctctatgtttaaaaat

SEQ ID NO: 558547 - DNA, 20 bp, Artificial Sequence
  chemically synthesized
acagagcaagactctgtctc

SEQ ID NO: 558548 - DNA, 20 bp, Artificial Sequence
  chemically synthesized
tatatgctacacttcttata

SEQ ID NO: 558549 - DNA, 20 bp, Artificial Sequence
  chemically synthesized
atgtgatcattttccttttc

SEQ ID NO: 558550 - DNA, 20 bp, Artificial Sequence
  chemically synthesized
acatcaccaccatctatctc

SEQ ID NO: 558551 - DNA, 20 bp, Artificial Sequence
  chemically synthesized
actgaccaagaatggagaaa

SEQ ID NO: 558552 - DNA, 20 bp, Artificial Sequence
  chemically synthesized
ggtatatacccaaaataatt

SEQ ID NO: 558553 - DNA, 20 bp, Artificial Sequence
  chemically synthesized
tgagtgtgattatattccaa

SEQ ID NO: 558554 - DNA, 20 bp, Artificial Sequence
  chemically synthesized
tattctcggcctacatatga

SEQ ID NO: 558555 - DNA, 20 bp, Artificial Sequence
  chemically synthesized
acttctttatatgctatata

SEQ ID NO: 558556 - DNA, 20 bp, Artificial Sequence
  chemically synthesized
ttcacgtactatgtatgact

SEQ ID NO: 558557 - DNA, 20 bp, Artificial Sequence
  chemically synthesized
gttacaatcctagtctctga

SEQ ID NO: 558558 - DNA, 20 bp, Artificial Sequence
  chemically synthesized
aaattaaaaaaaataaaaaa

SEQ ID NO: 558559 - DNA, 20 bp, Artificial Sequence
  chemically synthesized
aatcactaaacatggaaagg

SEQ ID NO: 558560 - DNA, 20 bp, Artificial Sequence
  chemically synthesized
aaaggacgcaaacaaatgga

SEQ ID NO: 558561 - DNA, 20 bp, Artificial Sequence
  chemically synthesized
tactacaaggctacagtaag

SEQ ID NO: 558562 - DNA, 20 bp, Artificial Sequence
  chemically synthesized
aaacagactggtactggtag

SEQ ID NO: 558563 - DNA, 20 bp, Artificial Sequence
  chemically synthesized
tgatctttgacaaacctgac

SEQ ID NO: 558564 - DNA, 20 bp, Artificial Sequence
  chemically synthesized
tatttaataaatggtgttgg

SEQ ID NO: 558565 - DNA, 20 bp, Artificial Sequence
  chemically synthesized
aaactggctagtcatatgca

SEQ ID NO: 558566 - DNA, 20 bp, Artificial Sequence
  chemically synthesized
atgcattaaagacttaaacc

SEQ ID NO: 558567 - DNA, 20 bp, Artificial Sequence
  chemically synthesized
aaagacttaaacctaaaacc

SEQ ID NO: 558568 - DNA, 20 bp, Artificial Sequence
  chemically synthesized
aacctaaaaccgaaaaccat

SEQ ID NO: 558569 - DNA, 20 bp, Artificial Sequence
  chemically synthesized
aaaccatcaaaaccctagaa

SEQ ID NO: 558570 - DNA, 20 bp, Artificial Sequence
  chemically synthesized
acggggaaagactgcatgac

SEQ ID NO: 558571 - DNA, 20 bp, Artificial Sequence
  chemically synthesized
aacaaatttacaagaaaaaa

SEQ ID NO: 558572 - DNA, 20 bp, Artificial Sequence
  chemically synthesized
ggatatgaacagacacttct

SEQ ID NO: 558573 - DNA, 20 bp, Artificial Sequence
  chemically synthesized
gtcattagaggaatgcaaat

SEQ ID NO: 558574 - DNA, 20 bp, Artificial Sequence
  chemically synthesized
agcaaactaacacaggaaca

SEQ ID NO: 558575 - DNA, 20 bp, Artificial Sequence
  chemically synthesized
atcctacctatggctatgtt

SEQ ID NO: 558576 - DNA, 20 bp, Artificial Sequence
  chemically synthesized
ccaagcagaagctacactgg

SEQ ID NO: 558577 - DNA, 20 bp, Artificial Sequence
  chemically synthesized
catgcagatagcaaatttct

SEQ ID NO: 558578 - DNA, 20 bp, Artificial Sequence
  chemically synthesized
cagagtattagtattttttc

SEQ ID NO: 558579 - DNA, 20 bp, Artificial Sequence
  chemically synthesized
attaatgttagatgccacaa

SEQ ID NO: 558580 - DNA, 20 bp, Artificial Sequence
  chemically synthesized
ggtcaaacaaagcagccaag

SEQ ID NO: 558581 - DNA, 20 bp, Artificial Sequence
  chemically synthesized
agaatgaaaagggagggcat

SEQ ID NO: 558582 - DNA, 20 bp, Artificial Sequence
  chemically synthesized
ttcttataatgtcctcagat

SEQ ID NO: 558583 - DNA, 20 bp, Artificial Sequence
  chemically synthesized
caacccacagaagaatttcc

SEQ ID NO: 558584 - DNA, 20 bp, Artificial Sequence
  chemically synthesized
ataaaaagattgatagcaaa

SEQ ID NO: 558585 - DNA, 20 bp, Artificial Sequence
  chemically synthesized
cacacattaagaaagtcaat

SEQ ID NO: 558586 - DNA, 20 bp, Artificial Sequence
  chemically synthesized
tctacttttataaaattcta

SEQ ID NO: 558587 - DNA, 20 bp, Artificial Sequence
  chemically synthesized
ggcaggagagagtgattacc

SEQ ID NO: 558588 - DNA, 20 bp, Artificial Sequence
  chemically synthesized
tcactggtatttgcatatgt

SEQ ID NO: 558589 - DNA, 20 bp, Artificial Sequence
  chemically synthesized
taggtatacaagttttactt

SEQ ID NO: 558590 - DNA, 20 bp, Artificial Sequence
  chemically synthesized
agacatatattgtttttaag

SEQ ID NO: 558591 - DNA, 20 bp, Artificial Sequence
  chemically synthesized
tgttgagaagttaaaatgta

SEQ ID NO: 558592 - DNA, 20 bp, Artificial Sequence
  chemically synthesized
tttaatacattcacaaagta

SEQ ID NO: 558593 - DNA, 20 bp, Artificial Sequence
  chemically synthesized
ccatctaattatagacacat

SEQ ID NO: 558594 - DNA, 20 bp, Artificial Sequence
  chemically synthesized
agcaaaccaaaaagagaata

SEQ ID NO: 558595 - DNA, 20 bp, Artificial Sequence
  chemically synthesized
tacaaatttcttcaatgtag

SEQ ID NO: 558596 - DNA, 20 bp, Artificial Sequence
  chemically synthesized
accatatctttgtggataca

SEQ ID NO: 558597 - DNA, 20 bp, Artificial Sequence
  chemically synthesized
ctgaagatgcaatagaaaag

SEQ ID NO: 558598 - DNA, 20 bp, Artificial Sequence
  chemically synthesized
atgatgggaggggctgccat

SEQ ID NO: 558599 - DNA, 20 bp, Artificial Sequence
  chemically synthesized
aatggcacgtcttcacattt

SEQ ID NO: 558600 - DNA, 20 bp, Artificial Sequence
  chemically synthesized
aaagggggaaaagcccctta

SEQ ID NO: 558601 - DNA, 20 bp, Artificial Sequence
  chemically synthesized
atggctggggaggcctcagg

SEQ ID NO: 558602 - DNA, 20 bp, Artificial Sequence
  chemically synthesized
atttacagaattatttaatg

SEQ ID NO: 558603 - DNA, 20 bp, Artificial Sequence
  chemically synthesized
tttgcatttggtggtgtatg

SEQ ID NO: 558604 - DNA, 20 bp, Artificial Sequence
  chemically synthesized
cagtttgcactgagaccagt

SEQ ID NO: 558605 - DNA, 20 bp, Artificial Sequence
  chemically synthesized
gttgtttccttattaagaag

SEQ ID NO: 558606 - DNA, 20 bp, Artificial Sequence
  chemically synthesized
tattaagaagcaaaacaaag

SEQ ID NO: 558607 - DNA, 20 bp, Artificial Sequence
  chemically synthesized
gaagcaaaacaaagtaaaac

SEQ ID NO: 558608 - DNA, 20 bp, Artificial Sequence
  chemically synthesized
aatttgtcttcatttctagt

SEQ ID NO: 558609 - DNA, 20 bp, Artificial Sequence
  chemically synthesized
attggtagtgaatttctaac

SEQ ID NO: 558610 - DNA, 20 bp, Artificial Sequence
  chemically synthesized
ttctcaaagtattgatttaa

SEQ ID NO: 558611 - DNA, 20 bp, Artificial Sequence
  chemically synthesized
actgttatgaatcacactta

SEQ ID NO: 558612 - DNA, 20 bp, Artificial Sequence
  chemically synthesized
aagtagctacaaccacatgc

SEQ ID NO: 558613 - DNA, 20 bp, Artificial Sequence
  chemically synthesized
ggagaaagtctgggaaggca

SEQ ID NO: 558614 - DNA, 20 bp, Artificial Sequence
  chemically synthesized
aaggcagtctcccaatagat

SEQ ID NO: 558615 - DNA, 20 bp, Artificial Sequence
  chemically synthesized
catggaagtatgccaaaata

SEQ ID NO: 558616 - DNA, 20 bp, Artificial Sequence
  chemically synthesized
gcaggaatgaaagtttattt

SEQ ID NO: 558617 - DNA, 20 bp, Artificial Sequence
  chemically synthesized
agattctaaataaatacttt

SEQ ID NO: 558618 - DNA, 20 bp, Artificial Sequence
  chemically synthesized
tgagaaaaacaaaacaaaat

SEQ ID NO: 558619 - DNA, 20 bp, Artificial Sequence
  chemically synthesized
gcttgagatagtgagaaaaa

SEQ ID NO: 558620 - DNA, 20 bp, Artificial Sequence
  chemically synthesized
cagcagcttgagatagtgag

SEQ ID NO: 558621 - DNA, 20 bp, Artificial Sequence
  chemically synthesized
tctcttggcaaaatttgttt

SEQ ID NO: 558622 - DNA, 20 bp, Artificial Sequence
  chemically synthesized
atacccagctgtctgctgct

SEQ ID NO: 558623 - DNA, 20 bp, Artificial Sequence
  chemically synthesized
ccaacacattgaattagaaa

SEQ ID NO: 558624 - DNA, 20 bp, Artificial Sequence
  chemically synthesized
tattaattaaacatttttga

SEQ ID NO: 558625 - DNA, 20 bp, Artificial Sequence
  chemically synthesized
gtgggtgtataacactacta

SEQ ID NO: 558626 - DNA, 20 bp, Artificial Sequence
  chemically synthesized
tgatgattccaaaattcctt

SEQ ID NO: 558627 - DNA, 20 bp, Artificial Sequence
  chemically synthesized
aaaattatagcatagtactt

SEQ ID NO: 558628 - DNA, 20 bp, Artificial Sequence
  chemically synthesized
ggaaactacaaagaatattt

SEQ ID NO: 558629 - DNA, 20 bp, Artificial Sequence
  chemically synthesized
tttcaggcagaaatctctca

SEQ ID NO: 558630 - DNA, 20 bp, Artificial Sequence
  chemically synthesized
aaatatcagtgttctcaagg

SEQ ID NO: 558631 - DNA, 20 bp, Artificial Sequence
  chemically synthesized
gagactatccacggataaac

SEQ ID NO: 558632 - DNA, 20 bp, Artificial Sequence
  chemically synthesized
atctccaattccctaattag

SEQ ID NO: 558633 - DNA, 20 bp, Artificial Sequence
  chemically synthesized
cttaagacaattatttattc

SEQ ID NO: 558634 - DNA, 20 bp, Artificial Sequence
  chemically synthesized
aattcactgactaaccacta

SEQ ID NO: 558635 - DNA, 20 bp, Artificial Sequence
  chemically synthesized
ttagtcagtgaattagtaag

SEQ ID NO: 558636 - DNA, 20 bp, Artificial Sequence
  chemically synthesized
taggtacctagggaaatgat

SEQ ID NO: 558637 - DNA, 20 bp, Artificial Sequence
  chemically synthesized
tcttcttagggctccttaaa

SEQ ID NO: 558638 - DNA, 20 bp, Artificial Sequence
  chemically synthesized
ttagggctccttaaataaaa

SEQ ID NO: 558639 - DNA, 20 bp, Artificial Sequence
  chemically synthesized
gctccttaaataaaacaaaa

SEQ ID NO: 558640 - DNA, 20 bp, Artificial Sequence
  chemically synthesized
ttaaataaaacaaaacaaaa

SEQ ID NO: 558641 - DNA, 20 bp, Artificial Sequence
  chemically synthesized
taaaacaaaacaaaacaaaa

SEQ ID NO: 558642 - DNA, 20 bp, Artificial Sequence
  chemically synthesized
tatttcacatgtgctctgct

SEQ ID NO: 558643 - DNA, 20 bp, Artificial Sequence
  chemically synthesized
taaagataactcactcagta

SEQ ID NO: 558644 - DNA, 20 bp, Artificial Sequence
  chemically synthesized
aagcctatttctttctcctg

SEQ ID NO: 558645 - DNA, 20 bp, Artificial Sequence
  chemically synthesized
taaaagacattactgtaaaa

SEQ ID NO: 558646 - DNA, 20 bp, Artificial Sequence
  chemically synthesized
tattttacagtaatgtcttt

SEQ ID NO: 558647 - DNA, 20 bp, Artificial Sequence
  chemically synthesized
aagggaaatttgtgaaatga

SEQ ID NO: 558648 - DNA, 20 bp, Artificial Sequence
  chemically synthesized
agttcacttagaggttagtt

SEQ ID NO: 558649 - DNA, 20 bp, Artificial Sequence
  chemically synthesized
aattcagaagaaattatatt

SEQ ID NO: 558650 - DNA, 20 bp, Artificial Sequence
  chemically synthesized
tgacttattgaaactcttta

SEQ ID NO: 558651 - DNA, 20 bp, Artificial Sequence
  chemically synthesized
taaagctttgcctctggtag

SEQ ID NO: 558652 - DNA, 20 bp, Artificial Sequence
  chemically synthesized
aaaccatcataaacttcgag

SEQ ID NO: 558653 - DNA, 20 bp, Artificial Sequence
  chemically synthesized
cacaagatactcaaatggag

SEQ ID NO: 558654 - DNA, 20 bp, Artificial Sequence
  chemically synthesized
gttcttataaactgacacac

SEQ ID NO: 558655 - DNA, 20 bp, Artificial Sequence
  chemically synthesized
tcaaagaagatcttgagggt

SEQ ID NO: 558656 - DNA, 20 bp, Artificial Sequence
  chemically synthesized
aaagcactgtcaccagaacc

SEQ ID NO: 558657 - DNA, 20 bp, Artificial Sequence
  chemically synthesized
ctcttttagcaagatgaagt

SEQ ID NO: 558658 - DNA, 20 bp, Artificial Sequence
  chemically synthesized
gaccaaatcgatatcaggac

SEQ ID NO: 558659 - DNA, 20 bp, Artificial Sequence
  chemically synthesized
atgtcttcaaaaaatgaaag

SEQ ID NO: 558660 - DNA, 20 bp, Artificial Sequence
  chemically synthesized
atgaaagaaaaaccacatac

SEQ ID NO: 558661 - DNA, 20 bp, Artificial Sequence
  chemically synthesized
ccaaaacctatgggatacag

SEQ ID NO: 558662 - DNA, 20 bp, Artificial Sequence
  chemically synthesized
gtgcttctatcaaaaaagaa

SEQ ID NO: 558663 - DNA, 20 bp, Artificial Sequence
  chemically synthesized
ataaatgactttgtaataaa

SEQ ID NO: 558664 - DNA, 20 bp, Artificial Sequence
  chemically synthesized
gaaaacatacaaaaagtcaa

SEQ ID NO: 558665 - DNA, 20 bp, Artificial Sequence
  chemically synthesized
gattaaaccataaagaaatc

SEQ ID NO: 558666 - DNA, 20 bp, Artificial Sequence
  chemically synthesized
ctcaaacaaacgtacaagaa

SEQ ID NO: 558667 - DNA, 20 bp, Artificial Sequence
  chemically synthesized
agaagacatttatgcagcca

SEQ ID NO: 558668 - DNA, 20 bp, Artificial Sequence
  chemically synthesized
ctccaggatatctgtctggg

SEQ ID NO: 558669 - DNA, 20 bp, Artificial Sequence
  chemically synthesized
aaccagaatatataaggagt

SEQ ID NO: 558670 - DNA, 20 bp, Artificial Sequence
  chemically synthesized
atcatcacagaaatacaaag

SEQ ID NO: 558671 - DNA, 20 bp, Artificial Sequence
  chemically synthesized
ggatattctctcaccccaat

SEQ ID NO: 558672 - DNA, 20 bp, Artificial Sequence
  chemically synthesized
ttggaggttcctcagaaact

SEQ ID NO: 558673 - DNA, 20 bp, Artificial Sequence
  chemically synthesized
tatttgtggcaggtaaaaat

SEQ ID NO: 558674 - DNA, 20 bp, Artificial Sequence
  chemically synthesized
cacaacagggtgactatagt

SEQ ID NO: 558675 - DNA, 20 bp, Artificial Sequence
  chemically synthesized
aaatacaattttactgtttg

SEQ ID NO: 558676 - DNA, 20 bp, Artificial Sequence
  chemically synthesized
tgatacttgcatgcctatat

SEQ ID NO: 558677 - DNA, 20 bp, Artificial Sequence
  chemically synthesized
gattcctttcttccagtcag

SEQ ID NO: 558678 - DNA, 20 bp, Artificial Sequence
  chemically synthesized
gaattaggaagtaaggggta

SEQ ID NO: 558679 - DNA, 20 bp, Artificial Sequence
  chemically synthesized
atgaaagaaacgaaaggaga

SEQ ID NO: 558680 - DNA, 20 bp, Artificial Sequence
  chemically synthesized
taaagctacaccttctttat

SEQ ID NO: 558681 - DNA, 20 bp, Artificial Sequence
  chemically synthesized
gcagcatccacatcaagaaa

SEQ ID NO: 558682 - DNA, 20 bp, Artificial Sequence
  chemically synthesized
caagaaggaaatactgattt

SEQ ID NO: 558683 - DNA, 20 bp, Artificial Sequence
  chemically synthesized
tatacctataggaaacatgt

SEQ ID NO: 558684 - DNA, 20 bp, Artificial Sequence
  chemically synthesized
ttacccacccgaaaatcaat

SEQ ID NO: 558685 - DNA, 20 bp, Artificial Sequence
  chemically synthesized
ctctattaaatgtcataagg

SEQ ID NO: 558686 - DNA, 20 bp, Artificial Sequence
  chemically synthesized
cttcattattttataaggga

SEQ ID NO: 558687 - DNA, 20 bp, Artificial Sequence
  chemically synthesized
tataaaataatgaagcaggg

SEQ ID NO: 558688 - DNA, 20 bp, Artificial Sequence
  chemically synthesized
actaaggcattttctagctg

SEQ ID NO: 558689 - DNA, 20 bp, Artificial Sequence
  chemically synthesized
atactttggtgactggtcat

SEQ ID NO: 558690 - DNA, 20 bp, Artificial Sequence
  chemically synthesized
caccctagaacttgctgact

SEQ ID NO: 558691 - DNA, 20 bp, Artificial Sequence
  chemically synthesized
taacccaaattggcttacta

SEQ ID NO: 558692 - DNA, 20 bp, Artificial Sequence
  chemically synthesized
atggacatgttgtgtttaaa

SEQ ID NO: 558693 - DNA, 20 bp, Artificial Sequence
  chemically synthesized
atacatggtttttttcaccc

SEQ ID NO: 558694 - DNA, 20 bp, Artificial Sequence
  chemically synthesized
ctctgctgttttagggtgaa

SEQ ID NO: 558695 - DNA, 20 bp, Artificial Sequence
  chemically synthesized
tagcagaaaggccagaattc

SEQ ID NO: 558696 - DNA, 20 bp, Artificial Sequence
  chemically synthesized
tgtgcttataagcaattact

SEQ ID NO: 558697 - DNA, 20 bp, Artificial Sequence
  chemically synthesized
agagaaactctatcctttgt

SEQ ID NO: 558698 - DNA, 20 bp, Artificial Sequence
  chemically synthesized
gcgttatttctactttagtg

SEQ ID NO: 558699 - DNA, 20 bp, Artificial Sequence
  chemically synthesized
ggtggcctagaatgcttgga

SEQ ID NO: 558700 - DNA, 20 bp, Artificial Sequence
  chemically synthesized
aacaaaacaaaacaaaacaa

SEQ ID NO: 558701 - DNA, 20 bp, Artificial Sequence
  chemically synthesized
ccgtctcaaacaaaacaaaa

SEQ ID NO: 558702 - DNA, 20 bp, Artificial Sequence
  chemically synthesized
aggctccgtctcaaacaaaa

SEQ ID NO: 558703 - DNA, 20 bp, Artificial Sequence
  chemically synthesized
gagcaaggctccgtctcaaa

SEQ ID NO: 558704 - DNA, 20 bp, Artificial Sequence
  chemically synthesized
tcctgagcatataacacaaa

SEQ ID NO: 558705 - DNA, 20 bp, Artificial Sequence
  chemically synthesized
tgatctgatgtgcctgctcc

SEQ ID NO: 558706 - DNA, 20 bp, Artificial Sequence
  chemically synthesized
ttgtctttttctagaaatcc

SEQ ID NO: 558707 - DNA, 20 bp, Artificial Sequence
  chemically synthesized
caggcaggtcagagggagta

SEQ ID NO: 558708 - DNA, 20 bp, Artificial Sequence
  chemically synthesized
aataaattctacagttccct

SEQ ID NO: 558709 - DNA, 20 bp, Artificial Sequence
  chemically synthesized
attctgtaatataaaaattt

SEQ ID NO: 558710 - DNA, 20 bp, Artificial Sequence
  chemically synthesized
gtggatcgctccctacatct

SEQ ID NO: 558711 - DNA, 20 bp, Artificial Sequence
  chemically synthesized
atatgtcctgaaagtcaagc

SEQ ID NO: 558712 - DNA, 20 bp, Artificial Sequence
  chemically synthesized
aagagccgaaaagattcttt

SEQ ID NO: 558713 - DNA, 20 bp, Artificial Sequence
  chemically synthesized
aacaggtgtaccatagttct

SEQ ID NO: 558714 - DNA, 20 bp, Artificial Sequence
  chemically synthesized
tatattgcaggaaaaaactc

SEQ ID NO: 558715 - DNA, 20 bp, Artificial Sequence
  chemically synthesized
gatcagtctatattgcagga

SEQ ID NO: 558716 - DNA, 20 bp, Artificial Sequence
  chemically synthesized
acaagaaggatgggtaatat

SEQ ID NO: 558717 - DNA, 20 bp, Artificial Sequence
  chemically synthesized
gcaaatatattccacaacag

SEQ ID NO: 558718 - DNA, 20 bp, Artificial Sequence
  chemically synthesized
ctgcattcctatacaaaaag

SEQ ID NO: 558719 - DNA, 20 bp, Artificial Sequence
  chemically synthesized
actcaatgttttcttagatt

SEQ ID NO: 558720 - DNA, 20 bp, Artificial Sequence
  chemically synthesized
ttagtaagttttcaatctaa

SEQ ID NO: 558721 - DNA, 20 bp, Artificial Sequence
  chemically synthesized
gttgctgtaaataagctagt

SEQ ID NO: 558722 - DNA, 20 bp, Artificial Sequence
  chemically synthesized
ataagctagtcaaaacccac

SEQ ID NO: 558723 - DNA, 20 bp, Artificial Sequence
  chemically synthesized
attgctgactccttttccca

SEQ ID NO: 558724 - DNA, 20 bp, Artificial Sequence
  chemically synthesized
ctgatagaaatgtgggttag

SEQ ID NO: 558725 - DNA, 20 bp, Artificial Sequence
  chemically synthesized
tccgttaaatagaatataaa

SEQ ID NO: 558726 - DNA, 20 bp, Artificial Sequence
  chemically synthesized
ttattctcaataaatttgct

SEQ ID NO: 558727 - DNA, 20 bp, Artificial Sequence
  chemically synthesized
ctactacaataaaacctact

SEQ ID NO: 558728 - DNA, 20 bp, Artificial Sequence
  chemically synthesized
atcctttcttactactacaa

SEQ ID NO: 558729 - DNA, 20 bp, Artificial Sequence
  chemically synthesized
aacattttctagaagttaga

SEQ ID NO: 558730 - DNA, 20 bp, Artificial Sequence
  chemically synthesized
gaagtgggaaggaagtttag

SEQ ID NO: 558731 - DNA, 20 bp, Artificial Sequence
  chemically synthesized
gcattgctctggagagattt

SEQ ID NO: 558732 - DNA, 20 bp, Artificial Sequence
  chemically synthesized
atccacccgcctcagcctcc

SEQ ID NO: 558733 - DNA, 20 bp, Artificial Sequence
  chemically synthesized
tccagatgacgggctctgaa

SEQ ID NO: 558734 - DNA, 20 bp, Artificial Sequence
  chemically synthesized
aacaggaaagaagttaacaa

SEQ ID NO: 558735 - DNA, 20 bp, Artificial Sequence
  chemically synthesized
atgccttgaaattttatttt

SEQ ID NO: 558736 - DNA, 20 bp, Artificial Sequence
  chemically synthesized
ttatctggaggaatgcaggt

SEQ ID NO: 558737 - DNA, 20 bp, Artificial Sequence
  chemically synthesized
acaacagcatgttggaagtg

SEQ ID NO: 558738 - DNA, 20 bp, Artificial Sequence
  chemically synthesized
aagaaaagtttcatattgat

SEQ ID NO: 558739 - DNA, 20 bp, Artificial Sequence
  chemically synthesized
aagtttcatattgataaaaa

SEQ ID NO: 558740 - DNA, 20 bp, Artificial Sequence
  chemically synthesized
gataaaaacaaaactcataa

SEQ ID NO: 558741 - DNA, 20 bp, Artificial Sequence
  chemically synthesized
agctgtaagcacccatggag

SEQ ID NO: 558742 - DNA, 20 bp, Artificial Sequence
  chemically synthesized
aacatgctgtacagcattgc

SEQ ID NO: 558743 - DNA, 20 bp, Artificial Sequence
  chemically synthesized
acagcatgttactaacgcgg

SEQ ID NO: 558744 - DNA, 20 bp, Artificial Sequence
  chemically synthesized
aaaggagaaaagcaaaaagc

SEQ ID NO: 558745 - DNA, 20 bp, Artificial Sequence
  chemically synthesized
tttctgtatgtgtctccttt

SEQ ID NO: 558746 - DNA, 20 bp, Artificial Sequence
  chemically synthesized
cactttacattaaatggaag

SEQ ID NO: 558747 - DNA, 20 bp, Artificial Sequence
  chemically synthesized
tataggtacaaaaatatatt

SEQ ID NO: 558748 - DNA, 20 bp, Artificial Sequence
  chemically synthesized
gtaaaattttattactgagg

SEQ ID NO: 558749 - DNA, 20 bp, Artificial Sequence
  chemically synthesized
tgttagtccttcagagaaat

SEQ ID NO: 558750 - DNA, 20 bp, Artificial Sequence
  chemically synthesized
tgtggctaggtctgtatgat

SEQ ID NO: 558751 - DNA, 20 bp, Artificial Sequence
  chemically synthesized
tagaagatagtattactagt

SEQ ID NO: 558752 - DNA, 20 bp, Artificial Sequence
  chemically synthesized
actcaagaaatatttgttga

SEQ ID NO: 558753 - DNA, 20 bp, Artificial Sequence
  chemically synthesized
agtggttaagtgctgaggag

SEQ ID NO: 558754 - DNA, 20 bp, Artificial Sequence
  chemically synthesized
tttccttcagatctttactt

SEQ ID NO: 558755 - DNA, 20 bp, Artificial Sequence
  chemically synthesized
tccccctttctgcttctgtt

SEQ ID NO: 558756 - DNA, 20 bp, Artificial Sequence
  chemically synthesized
ttgccattaactatagtgta

SEQ ID NO: 558757 - DNA, 20 bp, Artificial Sequence
  chemically synthesized
ggtctggaaagggaatatag

SEQ ID NO: 558758 - DNA, 20 bp, Artificial Sequence
  chemically synthesized
tcttcgatttctgttatccc

SEQ ID NO: 558759 - DNA, 20 bp, Artificial Sequence
  chemically synthesized
gggattatatacaccttcca

SEQ ID NO: 558760 - DNA, 20 bp, Artificial Sequence
  chemically synthesized
cacaaggaaaaataaagaga

SEQ ID NO: 558761 - DNA, 20 bp, Artificial Sequence
  chemically synthesized
tttttccaggaaaaaaaaga

SEQ ID NO: 558762 - DNA, 20 bp, Artificial Sequence
  chemically synthesized
actaggaaatcaagttggat

SEQ ID NO: 558763 - DNA, 20 bp, Artificial Sequence
  chemically synthesized
gactttgtatctttaacttt

SEQ ID NO: 558764 - DNA, 20 bp, Artificial Sequence
  chemically synthesized
agaacaaaaagaacaacaaa

SEQ ID NO: 558765 - DNA, 20 bp, Artificial Sequence
  chemically synthesized
ccatcagcactaagtaaatt

SEQ ID NO: 558766 - DNA, 20 bp, Artificial Sequence
  chemically synthesized
gagaaaagtacttacttcta

SEQ ID NO: 558767 - DNA, 20 bp, Artificial Sequence
  chemically synthesized
gctttggaatttttcctcca

SEQ ID NO: 558768 - DNA, 20 bp, Artificial Sequence
  chemically synthesized
aaagcaatacaacaatccaa

SEQ ID NO: 558769 - DNA, 20 bp, Artificial Sequence
  chemically synthesized
caacaatccaagaaaacctc

SEQ ID NO: 558770 - DNA, 20 bp, Artificial Sequence
  chemically synthesized
atgacagtaaactattttgg

SEQ ID NO: 558771 - DNA, 20 bp, Artificial Sequence
  chemically synthesized
taaactattttggtaaaaca

SEQ ID NO: 558772 - DNA, 20 bp, Artificial Sequence
  chemically synthesized
tcagaagtattagttatata

SEQ ID NO: 558773 - DNA, 20 bp, Artificial Sequence
  chemically synthesized
ttgcttttctgtcccctgtg

SEQ ID NO: 558774 - DNA, 20 bp, Artificial Sequence
  chemically synthesized
attaaacatcctgatggaaa

SEQ ID NO: 558775 - DNA, 20 bp, Artificial Sequence
  chemically synthesized
ctccaaagcaaaaaagagaa

SEQ ID NO: 558776 - DNA, 20 bp, Artificial Sequence
  chemically synthesized
ccatttctagttcagtaact

SEQ ID NO: 558777 - DNA, 20 bp, Artificial Sequence
  chemically synthesized
aaagaaactaaagcccaaaa

SEQ ID NO: 558778 - DNA, 20 bp, Artificial Sequence
  chemically synthesized
gcccaaaataaaacaacaat

SEQ ID NO: 558779 - DNA, 20 bp, Artificial Sequence
  chemically synthesized
caacaattaaaaccaagcta

SEQ ID NO: 558780 - DNA, 20 bp, Artificial Sequence
  chemically synthesized
tcttctatttatttaaggta

SEQ ID NO: 558781 - DNA, 20 bp, Artificial Sequence
  chemically synthesized
ggcaaatattctaaagctaa

SEQ ID NO: 558782 - DNA, 20 bp, Artificial Sequence
  chemically synthesized
aattgcatatttatatctta

SEQ ID NO: 558783 - DNA, 20 bp, Artificial Sequence
  chemically synthesized
atttccacgtaaagtatcct

SEQ ID NO: 558784 - DNA, 20 bp, Artificial Sequence
  chemically synthesized
ctgatttaatttcaacgtta

SEQ ID NO: 558785 - DNA, 20 bp, Artificial Sequence
  chemically synthesized
acagggaacccacatataat

SEQ ID NO: 558786 - DNA, 20 bp, Artificial Sequence
  chemically synthesized
aggtttgtatatactgaatc

SEQ ID NO: 558787 - DNA, 20 bp, Artificial Sequence
  chemically synthesized
taagcgctggtactaaaaga

SEQ ID NO: 558788 - DNA, 20 bp, Artificial Sequence
  chemically synthesized
tagatacagtggtggaggaa

SEQ ID NO: 558789 - DNA, 20 bp, Artificial Sequence
  chemically synthesized
gtatagtgtttatagactta

SEQ ID NO: 558790 - DNA, 20 bp, Artificial Sequence
  chemically synthesized
ctcaaggcatttctgatacc

SEQ ID NO: 558791 - DNA, 20 bp, Artificial Sequence
  chemically synthesized
ttctaagaaaaaaggattag

SEQ ID NO: 558792 - DNA, 20 bp, Artificial Sequence
  chemically synthesized
aactttttttggaagctccg

SEQ ID NO: 558793 - DNA, 20 bp, Artificial Sequence
  chemically synthesized
ggtttattgtccccatgtga

SEQ ID NO: 558794 - DNA, 20 bp, Artificial Sequence
  chemically synthesized
gtaattatatatcacacata

SEQ ID NO: 558795 - DNA, 20 bp, Artificial Sequence
  chemically synthesized
caaccgtttgtgaataaaag

SEQ ID NO: 558796 - DNA, 20 bp, Artificial Sequence
  chemically synthesized
gaaagcagaaacttccatat

SEQ ID NO: 558797 - DNA, 20 bp, Artificial Sequence
  chemically synthesized
ctttacacgatggggattat

SEQ ID NO: 558798 - DNA, 20 bp, Artificial Sequence
  chemically synthesized
gatttgtataaaatataaaa

SEQ ID NO: 558799 - DNA, 20 bp, Artificial Sequence
  chemically synthesized
ataaccaaataaatgtgttg

SEQ ID NO: 558800 - DNA, 20 bp, Artificial Sequence
  chemically synthesized
gagttagaactttggtctcg

SEQ ID NO: 558801 - DNA, 20 bp, Artificial Sequence
  chemically synthesized
aaacttaagcatgtgtctat

SEQ ID NO: 558802 - DNA, 20 bp, Artificial Sequence
  chemically synthesized
agaagccagtgtgatccttt

SEQ ID NO: 558803 - DNA, 20 bp, Artificial Sequence
  chemically synthesized
gaaggccaaagtggctgaag

SEQ ID NO: 558804 - DNA, 20 bp, Artificial Sequence
  chemically synthesized
acgtattttgggaaaaaaaa

SEQ ID NO: 558805 - DNA, 20 bp, Artificial Sequence
  chemically synthesized
cacactattctaagtgctta

SEQ ID NO: 558806 - DNA, 20 bp, Artificial Sequence
  chemically synthesized
tgtttctcaagagcaatgca

SEQ ID NO: 558807 - DNA, 20 bp, Artificial Sequence
  chemically synthesized
gggtaaccaagagggtgatg

SEQ ID NO: 558808 - DNA, 20 bp, Artificial Sequence
  chemically synthesized
catcatttcagttgtctcat

SEQ ID NO: 558809 - DNA, 20 bp, Artificial Sequence
  chemically synthesized
aagaccccatcgcacacagt

SEQ ID NO: 558810 - DNA, 20 bp, Artificial Sequence
  chemically synthesized
aagagtgtttcatcctccaa

SEQ ID NO: 558811 - DNA, 20 bp, Artificial Sequence
  chemically synthesized
aatatttaactctctccaga

SEQ ID NO: 558812 - DNA, 20 bp, Artificial Sequence
  chemically synthesized
gagaaaaccttttggtaatt

SEQ ID NO: 558813 - DNA, 20 bp, Artificial Sequence
  chemically synthesized
ggaaatctgcatttaatagc

SEQ ID NO: 558814 - DNA, 20 bp, Artificial Sequence
  chemically synthesized
ttcactgaaaagactgagct

SEQ ID NO: 558815 - DNA, 20 bp, Artificial Sequence
  chemically synthesized
gatactgcaacaccgatttc

SEQ ID NO: 558816 - DNA, 20 bp, Artificial Sequence
  chemically synthesized
taacttgctgttggtggttt

SEQ ID NO: 558817 - DNA, 20 bp, Artificial Sequence
  chemically synthesized
atatgtatacataaaaaata

SEQ ID NO: 558818 - DNA, 20 bp, Artificial Sequence
  chemically synthesized
atacataaaaaatataaaac

SEQ ID NO: 558819 - DNA, 20 bp, Artificial Sequence
  chemically synthesized
gcaagaggagtctctgaagg

SEQ ID NO: 558820 - DNA, 20 bp, Artificial Sequence
  chemically synthesized
aactgggctgaaaatggatt

SEQ ID NO: 558821 - DNA, 20 bp, Artificial Sequence
  chemically synthesized
cctcacgatggtaagtctag

SEQ ID NO: 558822 - DNA, 20 bp, Artificial Sequence
  chemically synthesized
aaatcgtctttttcttagga

SEQ ID NO: 558823 - DNA, 20 bp, Artificial Sequence
  chemically synthesized
aaagttgcctgtgttaggaa

SEQ ID NO: 558824 - DNA, 20 bp, Artificial Sequence
  chemically synthesized
cttagcaagagactagcaac

SEQ ID NO: 558825 - DNA, 20 bp, Artificial Sequence
  chemically synthesized
taggtcagagaaattaaaaa

SEQ ID NO: 558826 - DNA, 20 bp, Artificial Sequence
  chemically synthesized
aatcctaggtcagagaaatt

SEQ ID NO: 558827 - DNA, 20 bp, Artificial Sequence
  chemically synthesized
tttggcccagatatacacaa

SEQ ID NO: 558828 - DNA, 20 bp, Artificial Sequence
  chemically synthesized
accaaccaatgtaatgcgtg

SEQ ID NO: 558829 - DNA, 20 bp, Artificial Sequence
  chemically synthesized
tttacacctgtaagtttttg

SEQ ID NO: 558830 - DNA, 20 bp, Artificial Sequence
  chemically synthesized
aacaaaaacctttgttttcc

SEQ ID NO: 558831 - DNA, 20 bp, Artificial Sequence
  chemically synthesized
cttactctgttcctgataac

SEQ ID NO: 558832 - DNA, 20 bp, Artificial Sequence
  chemically synthesized
aacaaattaataaataaatg

SEQ ID NO: 558833 - DNA, 20 bp, Artificial Sequence
  chemically synthesized
caactcccttgattaaacaa

SEQ ID NO: 558834 - DNA, 20 bp, Artificial Sequence
  chemically synthesized
aaagtgatgaggacatgcat

SEQ ID NO: 558835 - DNA, 20 bp, Artificial Sequence
  chemically synthesized
agaagaatcagaaaatagat

SEQ ID NO: 558836 - DNA, 20 bp, Artificial Sequence
  chemically synthesized
atgaaagtaatgaagactga

SEQ ID NO: 558837 - DNA, 20 bp, Artificial Sequence
  chemically synthesized
ggagctggtaccattccctc

SEQ ID NO: 558838 - DNA, 20 bp, Artificial Sequence
  chemically synthesized
ggccagcagcatcctgatac

SEQ ID NO: 558839 - DNA, 20 bp, Artificial Sequence
  chemically synthesized
taaacagaaccaatgaccaa

SEQ ID NO: 558840 - DNA, 20 bp, Artificial Sequence
  chemically synthesized
attcaacaccctttcatgtt

SEQ ID NO: 558841 - DNA, 20 bp, Artificial Sequence
  chemically synthesized
aagctagaagcattcccttt

SEQ ID NO: 558842 - DNA, 20 bp, Artificial Sequence
  chemically synthesized
atgacatgattgtatattta

SEQ ID NO: 558843 - DNA, 20 bp, Artificial Sequence
  chemically synthesized
aaaccccatcgtctcagccc

SEQ ID NO: 558844 - DNA, 20 bp, Artificial Sequence
  chemically synthesized
gagaggacccaaacaaatgg

SEQ ID NO: 558845 - DNA, 20 bp, Artificial Sequence
  chemically synthesized
tactataatgctacagtaac

SEQ ID NO: 558846 - DNA, 20 bp, Artificial Sequence
  chemically synthesized
aaaacagattatactgatag

SEQ ID NO: 558847 - DNA, 20 bp, Artificial Sequence
  chemically synthesized
tgatctttgacaaacctgac

SEQ ID NO: 558848 - DNA, 20 bp, Artificial Sequence
  chemically synthesized
tatttaataaatggtgtcgg

SEQ ID NO: 558849 - DNA, 20 bp, Artificial Sequence
  chemically synthesized
aaactggctggccatatgca

SEQ ID NO: 558850 - DNA, 20 bp, Artificial Sequence
  chemically synthesized
aacctaagacctgaaaccat

SEQ ID NO: 558851 - DNA, 20 bp, Artificial Sequence
  chemically synthesized
aaaccataaaaactctagaa

SEQ ID NO: 558852 - DNA, 20 bp, Artificial Sequence
  chemically synthesized
atgggcaaagacttcatgac

SEQ ID NO: 558853 - DNA, 20 bp, Artificial Sequence
  chemically synthesized
aggcaacctacagaatgaga

SEQ ID NO: 558854 - DNA, 20 bp, Artificial Sequence
  chemically synthesized
gcggccaacaaacataagaa

SEQ ID NO: 558855 - DNA, 20 bp, Artificial Sequence
  chemically synthesized
gtcattagagaaatgcaagt

SEQ ID NO: 558856 - DNA, 20 bp, Artificial Sequence
  chemically synthesized
agcaaactaacacaggaaca

SEQ ID NO: 558857 - DNA, 20 bp, Artificial Sequence
  chemically synthesized
gataatgggagttgaacaat

SEQ ID NO: 558858 - DNA, 20 bp, Artificial Sequence
  chemically synthesized
attcttcagaacattaaact

SEQ ID NO: 558859 - DNA, 20 bp, Artificial Sequence
  chemically synthesized
gtacagatcagctgactaga

SEQ ID NO: 558860 - DNA, 20 bp, Artificial Sequence
  chemically synthesized
gtcatgcgaatctataatga

SEQ ID NO: 558861 - DNA, 20 bp, Artificial Sequence
  chemically synthesized
gtatgatctaaacttaaagt

SEQ ID NO: 558862 - DNA, 20 bp, Artificial Sequence
  chemically synthesized
atttacacagctcagaatct

SEQ ID NO: 558863 - DNA, 20 bp, Artificial Sequence
  chemically synthesized
cagatgaatgaaaatgtatt

SEQ ID NO: 558864 - DNA, 20 bp, Artificial Sequence
  chemically synthesized
acataatgcaccatttgttt

SEQ ID NO: 558865 - DNA, 20 bp, Artificial Sequence
  chemically synthesized
tggaggaaaacattttgttt

SEQ ID NO: 558866 - DNA, 20 bp, Artificial Sequence
  chemically synthesized
aagtcttttaaatcatggag

SEQ ID NO: 558867 - DNA, 20 bp, Artificial Sequence
  chemically synthesized
aatagactattatcttgacc

SEQ ID NO: 558868 - DNA, 20 bp, Artificial Sequence
  chemically synthesized
gtattggtccagggtgatta

SEQ ID NO: 558869 - DNA, 20 bp, Artificial Sequence
  chemically synthesized
aaccccaaacaataaagcat

SEQ ID NO: 558870 - DNA, 20 bp, Artificial Sequence
  chemically synthesized
caaacaataaagcataaaaa

SEQ ID NO: 558871 - DNA, 20 bp, Artificial Sequence
  chemically synthesized
aaaacagtgacaacgcagat

SEQ ID NO: 558872 - DNA, 20 bp, Artificial Sequence
  chemically synthesized
gtcatgccattatatgtatc

SEQ ID NO: 558873 - DNA, 20 bp, Artificial Sequence
  chemically synthesized
agtgacttgactaaaacaga

SEQ ID NO: 558874 - DNA, 20 bp, Artificial Sequence
  chemically synthesized
tttctacccagtgacttgac

SEQ ID NO: 558875 - DNA, 20 bp, Artificial Sequence
  chemically synthesized
ccccctttgtttaaaaagaa

SEQ ID NO: 558876 - DNA, 20 bp, Artificial Sequence
  chemically synthesized
aacaatcatggcctgctttg

SEQ ID NO: 558877 - DNA, 20 bp, Artificial Sequence
  chemically synthesized
tttgttggataaattaatga

SEQ ID NO: 558878 - DNA, 20 bp, Artificial Sequence
  chemically synthesized
tatatactagatatgtaaac

SEQ ID NO: 558879 - DNA, 20 bp, Artificial Sequence
  chemically synthesized
atgaagagaatacttccttg

SEQ ID NO: 558880 - DNA, 20 bp, Artificial Sequence
  chemically synthesized
atttaaaagcaaatacaatt

SEQ ID NO: 558881 - DNA, 20 bp, Artificial Sequence
  chemically synthesized
gaacttaaaacatggctagt

SEQ ID NO: 558882 - DNA, 20 bp, Artificial Sequence
  chemically synthesized
tattgaggctactgagaact

SEQ ID NO: 558883 - DNA, 20 bp, Artificial Sequence
  chemically synthesized
gacagagactgagtagaata

SEQ ID NO: 558884 - DNA, 20 bp, Artificial Sequence
  chemically synthesized
tgttctattttaaataatgt

SEQ ID NO: 558885 - DNA, 20 bp, Artificial Sequence
  chemically synthesized
tgtctaaattacctttgtga

SEQ ID NO: 558886 - DNA, 20 bp, Artificial Sequence
  chemically synthesized
aaactaaaatgtcacaaggt

SEQ ID NO: 558887 - DNA, 20 bp, Artificial Sequence
  chemically synthesized
gatttaggctgtgtctacct

SEQ ID NO: 558888 - DNA, 20 bp, Artificial Sequence
  chemically synthesized
actctgaagataattaattt

SEQ ID NO: 558889 - DNA, 20 bp, Artificial Sequence
  chemically synthesized
actcagttcaaagtgaaaca

SEQ ID NO: 558890 - DNA, 20 bp, Artificial Sequence
  chemically synthesized
atcattccacatatatactt

SEQ ID NO: 558891 - DNA, 20 bp, Artificial Sequence
  chemically synthesized
ttcacaaaatttacatatgg

SEQ ID NO: 558892 - DNA, 20 bp, Artificial Sequence
  chemically synthesized
taaataattattcatcagat

SEQ ID NO: 558893 - DNA, 20 bp, Artificial Sequence
  chemically synthesized
caaaacaacaacaacaacaa

SEQ ID NO: 558894 - DNA, 20 bp, Artificial Sequence
  chemically synthesized
atcactatgcatcaaaatat

SEQ ID NO: 558895 - DNA, 20 bp, Artificial Sequence
  chemically synthesized
taagttgtctattgttattt

SEQ ID NO: 558896 - DNA, 20 bp, Artificial Sequence
  chemically synthesized
gatggaagatttgtaataat

SEQ ID NO: 558897 - DNA, 20 bp, Artificial Sequence
  chemically synthesized
attaatattaattggttatt

SEQ ID NO: 558898 - DNA, 20 bp, Artificial Sequence
  chemically synthesized
taccatgactggctaatttt

SEQ ID NO: 558899 - DNA, 20 bp, Artificial Sequence
  chemically synthesized
caagaccctgtctcaaaaat

SEQ ID NO: 558900 - DNA, 20 bp, Artificial Sequence
  chemically synthesized
cttgaagatagttgaaacaa

SEQ ID NO: 558901 - DNA, 20 bp, Artificial Sequence
  chemically synthesized
cacatgagaaatgtcctcgt

SEQ ID NO: 558902 - DNA, 20 bp, Artificial Sequence
  chemically synthesized
ctcatgtgttccaaccaaat

SEQ ID NO: 558903 - DNA, 20 bp, Artificial Sequence
  chemically synthesized
tgactgtgtaataaagattt

SEQ ID NO: 558904 - DNA, 20 bp, Artificial Sequence
  chemically synthesized
atgagaaataaacggtacaa

SEQ ID NO: 558905 - DNA, 20 bp, Artificial Sequence
  chemically synthesized
tagtatgtgatactacaagt

SEQ ID NO: 558906 - DNA, 20 bp, Artificial Sequence
  chemically synthesized
ccatcaatatgacaaggaat

SEQ ID NO: 558907 - DNA, 20 bp, Artificial Sequence
  chemically synthesized
gctgcgttaatggtgattta

SEQ ID NO: 558908 - DNA, 20 bp, Artificial Sequence
  chemically synthesized
gctgcgttaatggtgattta

SEQ ID NO: 558909 - DNA, 20 bp, Artificial Sequence
  chemically synthesized
atagacaaaaaatacaaata

SEQ ID NO: 558910 - DNA, 20 bp, Artificial Sequence
  chemically synthesized
aaacaagaatagaggtggtt

SEQ ID NO: 558911 - DNA, 20 bp, Artificial Sequence
  chemically synthesized
aacaatttcacatcatcacc

SEQ ID NO: 558912 - DNA, 20 bp, Artificial Sequence
  chemically synthesized
taatgtgccaggccaaagag

SEQ ID NO: 558913 - DNA, 20 bp, Artificial Sequence
  chemically synthesized
aataaaaagcaggcagttaa

SEQ ID NO: 558914 - DNA, 20 bp, Artificial Sequence
  chemically synthesized
atatggtaatagtcactgaa

SEQ ID NO: 558915 - DNA, 20 bp, Artificial Sequence
  chemically synthesized
ctaaggtgtcattaaattca

SEQ ID NO: 558916 - DNA, 20 bp, Artificial Sequence
  chemically synthesized
aatttacaagttttaactct

SEQ ID NO: 558917 - DNA, 20 bp, Artificial Sequence
  chemically synthesized
tcaatatgagtttttagagt

SEQ ID NO: 558918 - DNA, 20 bp, Artificial Sequence
  chemically synthesized
ataaattttttttcacttct

SEQ ID NO: 558919 - DNA, 20 bp, Artificial Sequence
  chemically synthesized
gtaaacaatgcatcaagatc

SEQ ID NO: 558920 - DNA, 20 bp, Artificial Sequence
  chemically synthesized
ttggaatccaaaaattaatt

SEQ ID NO: 558921 - DNA, 20 bp, Artificial Sequence
  chemically synthesized
ttatgagttctttatatcac

SEQ ID NO: 558922 - DNA, 20 bp, Artificial Sequence
  chemically synthesized
tttatatcaccaaaacaaac

SEQ ID NO: 558923 - DNA, 20 bp, Artificial Sequence
  chemically synthesized
ttttgtcacatgtgaggagc

SEQ ID NO: 558924 - DNA, 20 bp, Artificial Sequence
  chemically synthesized
gaatgaggaagagaaagcat

SEQ ID NO: 558925 - DNA, 20 bp, Artificial Sequence
  chemically synthesized
ataacaacattacaaaaaaa

SEQ ID NO: 558926 - DNA, 20 bp, Artificial Sequence
  chemically synthesized
aaaggccattttaatacctc

SEQ ID NO: 558927 - DNA, 20 bp, Artificial Sequence
  chemically synthesized
aaaggacaattcttgcatta

SEQ ID NO: 558928 - DNA, 20 bp, Artificial Sequence
  chemically synthesized
tcttttccttatggaccatt

SEQ ID NO: 558929 - DNA, 20 bp, Artificial Sequence
  chemically synthesized
gcccatgcactgatatccag

SEQ ID NO: 558930 - DNA, 20 bp, Artificial Sequence
  chemically synthesized
aatagctattttaacgcatg

SEQ ID NO: 558931 - DNA, 20 bp, Artificial Sequence
  chemically synthesized
aatagctatttaggaatttt

SEQ ID NO: 558932 - DNA, 20 bp, Artificial Sequence
  chemically synthesized
gttataacataattttgctt

SEQ ID NO: 558933 - DNA, 20 bp, Artificial Sequence
  chemically synthesized
atgtgaatttgtattattca

SEQ ID NO: 558934 - DNA, 20 bp, Artificial Sequence
  chemically synthesized
attttgtgaaaatcaaagtg

SEQ ID NO: 558935 - DNA, 20 bp, Artificial Sequence
  chemically synthesized
ctcctaagtgccagacaaca

SEQ ID NO: 558936 - DNA, 20 bp, Artificial Sequence
  chemically synthesized
ccaattcagtgtattcaaaa

SEQ ID NO: 558937 - DNA, 20 bp, Artificial Sequence
  chemically synthesized
aaaggaagaaaccaatgtaa

SEQ ID NO: 558938 - DNA, 20 bp, Artificial Sequence
  chemically synthesized
tcatcaaagaaaatcatcaa

SEQ ID NO: 558939 - DNA, 20 bp, Artificial Sequence
  chemically synthesized
ctctgtgttaattcaataag

SEQ ID NO: 558940 - DNA, 20 bp, Artificial Sequence
  chemically synthesized
tcagtaacattatatgatag

SEQ ID NO: 558941 - DNA, 20 bp, Artificial Sequence
  chemically synthesized
atatattaataaacataaga

SEQ ID NO: 558942 - DNA, 20 bp, Artificial Sequence
  chemically synthesized
ctttggactagagatattcg

SEQ ID NO: 558943 - DNA, 20 bp, Artificial Sequence
  chemically synthesized
taaagcaaataatccaaata

SEQ ID NO: 558944 - DNA, 20 bp, Artificial Sequence
  chemically synthesized
attctcttagtgcttagaat

SEQ ID NO: 558945 - DNA, 20 bp, Artificial Sequence
  chemically synthesized
actgctgtgtcctcaacacc

SEQ ID NO: 558946 - DNA, 20 bp, Artificial Sequence
  chemically synthesized
catgagaaagattcattgaa

SEQ ID NO: 558947 - DNA, 20 bp, Artificial Sequence
  chemically synthesized
atctatttttaagtgaaatc

SEQ ID NO: 558948 - DNA, 20 bp, Artificial Sequence
  chemically synthesized
atccagcctcgtgacttgat

SEQ ID NO: 558949 - DNA, 20 bp, Artificial Sequence
  chemically synthesized
atcaagtcacgaggctggat

SEQ ID NO: 558950 - DNA, 20 bp, Artificial Sequence
  chemically synthesized
ggtagcaggtaaactggatg

SEQ ID NO: 558951 - DNA, 20 bp, Artificial Sequence
  chemically synthesized
gtgtatgaaagtgtctatta

SEQ ID NO: 558952 - DNA, 20 bp, Artificial Sequence
  chemically synthesized
gacggtagaataatattttc

SEQ ID NO: 558953 - DNA, 20 bp, Artificial Sequence
  chemically synthesized
tctggcttctatcattgctc

SEQ ID NO: 558954 - DNA, 20 bp, Artificial Sequence
  chemically synthesized
tgataatagcttaggatttt

SEQ ID NO: 558955 - DNA, 20 bp, Artificial Sequence
  chemically synthesized
acataatatagaggtgaaaa

SEQ ID NO: 558956 - DNA, 20 bp, Artificial Sequence
  chemically synthesized
attttgtcctaaaaggtctt

SEQ ID NO: 558957 - DNA, 20 bp, Artificial Sequence
  chemically synthesized
ccatagcccagctgtgtatt

SEQ ID NO: 558958 - DNA, 20 bp, Artificial Sequence
  chemically synthesized
acaactagacactagaacaa

SEQ ID NO: 558959 - DNA, 20 bp, Artificial Sequence
  chemically synthesized
tatgatcatcaacaatctag

SEQ ID NO: 558960 - DNA, 20 bp, Artificial Sequence
  chemically synthesized
aacttgaactcactgctttc

SEQ ID NO: 558961 - DNA, 20 bp, Artificial Sequence
  chemically synthesized
tgatcaaactagatgcatgt

SEQ ID NO: 558962 - DNA, 20 bp, Artificial Sequence
  chemically synthesized
agcctggctaattttatata

SEQ ID NO: 558963 - DNA, 20 bp, Artificial Sequence
  chemically synthesized
taacatgtgtatgttatata

SEQ ID NO: 558964 - DNA, 20 bp, Artificial Sequence
  chemically synthesized
taacatgtgtatgttatata

SEQ ID NO: 558965 - DNA, 20 bp, Artificial Sequence
  chemically synthesized
atgttatatataaaacatta

SEQ ID NO: 558966 - DNA, 20 bp, Artificial Sequence
  chemically synthesized
ataggcataacatgtatata

SEQ ID NO: 558967 - DNA, 20 bp, Artificial Sequence
  chemically synthesized
atacataagtatagggaata

SEQ ID NO: 558968 - DNA, 20 bp, Artificial Sequence
  chemically synthesized
tatgctatgtaaagggagat

SEQ ID NO: 558969 - DNA, 20 bp, Artificial Sequence
  chemically synthesized
atttggtcagtgccaccaag

SEQ ID NO: 558970 - DNA, 20 bp, Artificial Sequence
  chemically synthesized
taaatgttcttatttacaga

SEQ ID NO: 558971 - DNA, 20 bp, Artificial Sequence
  chemically synthesized
acagctagtttcacctgaac

SEQ ID NO: 558972 - DNA, 20 bp, Artificial Sequence
  chemically synthesized
gcacattttcaaataccagg

SEQ ID NO: 558973 - DNA, 20 bp, Artificial Sequence
  chemically synthesized
tcaaccaacgtggaaaaaat

SEQ ID NO: 558974 - DNA, 20 bp, Artificial Sequence
  chemically synthesized
aagtgaaaacgaagatttga

SEQ ID NO: 558975 - DNA, 20 bp, Artificial Sequence
  chemically synthesized
aataggccattatataaagt

SEQ ID NO: 558976 - DNA, 20 bp, Artificial Sequence
  chemically synthesized
atatacagaaaggagacgaa

SEQ ID NO: 558977 - DNA, 20 bp, Artificial Sequence
  chemically synthesized
agcctacagtttatatctag

SEQ ID NO: 558978 - DNA, 20 bp, Artificial Sequence
  chemically synthesized
gaccaattgtcaatgcattt

SEQ ID NO: 558979 - DNA, 20 bp, Artificial Sequence
  chemically synthesized
aattttggatctttaatata

SEQ ID NO: 558980 - DNA, 20 bp, Artificial Sequence
  chemically synthesized
ttagggtattagatttaaca

SEQ ID NO: 558981 - DNA, 20 bp, Artificial Sequence
  chemically synthesized
atagaagaaagtactcctca

SEQ ID NO: 558982 - DNA, 20 bp, Artificial Sequence
  chemically synthesized
gaacaaaaatgtacctgtca

SEQ ID NO: 558983 - DNA, 20 bp, Artificial Sequence
  chemically synthesized
attactgaaatgttaccagc

SEQ ID NO: 558984 - DNA, 20 bp, Artificial Sequence
  chemically synthesized
agaaattaacagataacagg

SEQ ID NO: 558985 - DNA, 20 bp, Artificial Sequence
  chemically synthesized
cagaatgtacattagaagtt

SEQ ID NO: 558986 - DNA, 20 bp, Artificial Sequence
  chemically synthesized
ccgatcaatttcctattgag

SEQ ID NO: 558987 - DNA, 20 bp, Artificial Sequence
  chemically synthesized
atttacttaattagaatatc

SEQ ID NO: 558988 - DNA, 20 bp, Artificial Sequence
  chemically synthesized
agtgtaaaataataacagaa

SEQ ID NO: 558989 - DNA, 20 bp, Artificial Sequence
  chemically synthesized
agtcaattacaattttacca

SEQ ID NO: 558990 - DNA, 20 bp, Artificial Sequence
  chemically synthesized
ttaaatcactttacatagtc

SEQ ID NO: 558991 - DNA, 20 bp, Artificial Sequence
  chemically synthesized
cttaatacaatacatttact

SEQ ID NO: 558992 - DNA, 20 bp, Artificial Sequence
  chemically synthesized
aaaatctggtattgacattc

SEQ ID NO: 558993 - DNA, 20 bp, Artificial Sequence
  chemically synthesized
ttagccttggggctcatcaa

SEQ ID NO: 558994 - DNA, 20 bp, Artificial Sequence
  chemically synthesized
actcttatgtaggcatttct

SEQ ID NO: 558995 - DNA, 20 bp, Artificial Sequence
  chemically synthesized
accaaatcatgctctaaatg

SEQ ID NO: 558996 - DNA, 20 bp, Artificial Sequence
  chemically synthesized
caattaactatttgaaaaaa

SEQ ID NO: 558997 - DNA, 20 bp, Artificial Sequence
  chemically synthesized
gctcgaattaaacctgtgaa

SEQ ID NO: 558998 - DNA, 20 bp, Artificial Sequence
  chemically synthesized
gaaggtttgaaaattcaaca

SEQ ID NO: 558999 - DNA, 20 bp, Artificial Sequence
  chemically synthesized
tctacatgcaaataagagaa

SEQ ID NO: 559000 - DNA, 20 bp, Artificial Sequence
  chemically synthesized
tatacaaaaaaaaagtttca

SEQ ID NO: 559001 - DNA, 20 bp, Artificial Sequence
  chemically synthesized
tagattcttttatttatttt

SEQ ID NO: 559002 - DNA, 20 bp, Artificial Sequence
  chemically synthesized
atcagctactttatattgaa

SEQ ID NO: 559003 - DNA, 20 bp, Artificial Sequence
  chemically synthesized
ttttaccctatatattaaaa

SEQ ID NO: 559004 - DNA, 20 bp, Artificial Sequence
  chemically synthesized
aaaacagcagctgttacaga

SEQ ID NO: 559005 - DNA, 20 bp, Artificial Sequence
  chemically synthesized
aaagcgagaggaaataaaga

SEQ ID NO: 559006 - DNA, 20 bp, Artificial Sequence
  chemically synthesized
tcattgtcttcattctgatc

SEQ ID NO: 559007 - DNA, 20 bp, Artificial Sequence
  chemically synthesized
ttaacaatgtacagcttttt

SEQ ID NO: 559008 - DNA, 20 bp, Artificial Sequence
  chemically synthesized
acacacacaaaaatccaatt

SEQ ID NO: 559009 - DNA, 20 bp, Artificial Sequence
  chemically synthesized
tttagtgtagttctagaaat

SEQ ID NO: 559010 - DNA, 20 bp, Artificial Sequence
  chemically synthesized
atattagaccagcatttatt

SEQ ID NO: 559011 - DNA, 20 bp, Artificial Sequence
  chemically synthesized
acattctgagttgaaagaaa

SEQ ID NO: 559012 - DNA, 20 bp, Artificial Sequence
  chemically synthesized
tttctttcaactcagaatgt

SEQ ID NO: 559013 - DNA, 20 bp, Artificial Sequence
  chemically synthesized
aggtacactgatgacataag

SEQ ID NO: 559014 - DNA, 20 bp, Artificial Sequence
  chemically synthesized
cattttctagggctgaggac

SEQ ID NO: 559015 - DNA, 20 bp, Artificial Sequence
  chemically synthesized
acaaaaacaacaaaaaatta

SEQ ID NO: 559016 - DNA, 20 bp, Artificial Sequence
  chemically synthesized
ctaactaaacaactatttgg

SEQ ID NO: 559017 - DNA, 20 bp, Artificial Sequence
  chemically synthesized
gaaataaatgttatactacc

SEQ ID NO: 559018 - DNA, 20 bp, Artificial Sequence
  chemically synthesized
ttgtatttcaaaacccttca

SEQ ID NO: 559019 - DNA, 20 bp, Artificial Sequence
  chemically synthesized
gtacttttccagttgtattt

SEQ ID NO: 559020 - DNA, 20 bp, Artificial Sequence
  chemically synthesized
aattgtcatcttatccttag

SEQ ID NO: 559021 - DNA, 20 bp, Artificial Sequence
  chemically synthesized
gctgtgctaaaaatgtcatt

SEQ ID NO: 559022 - DNA, 20 bp, Artificial Sequence
  chemically synthesized
actgataatgaccagtctaa

SEQ ID NO: 559023 - DNA, 20 bp, Artificial Sequence
  chemically synthesized
aaatctcttgactttctaaa

SEQ ID NO: 559024 - DNA, 20 bp, Artificial Sequence
  chemically synthesized
tatgctgtatttctttccat

SEQ ID NO: 559025 - DNA, 20 bp, Artificial Sequence
  chemically synthesized
ttttatatgggatagctctt

SEQ ID NO: 559026 - DNA, 20 bp, Artificial Sequence
  chemically synthesized
atctgattttctttcagagc

SEQ ID NO: 559027 - DNA, 20 bp, Artificial Sequence
  chemically synthesized
gctaaaacattttacttttg

SEQ ID NO: 559028 - DNA, 20 bp, Artificial Sequence
  chemically synthesized
aatacggataagtgtagaag

SEQ ID NO: 559029 - DNA, 20 bp, Artificial Sequence
  chemically synthesized
gcaaatgatcattaggattt

SEQ ID NO: 559030 - DNA, 20 bp, Artificial Sequence
  chemically synthesized
tagagaagaagcagttggaa

SEQ ID NO: 559031 - DNA, 20 bp, Artificial Sequence
  chemically synthesized
ttctctcagtcattcaggcg

SEQ ID NO: 559032 - DNA, 20 bp, Artificial Sequence
  chemically synthesized
catcgttcctggtccttaca

SEQ ID NO: 559033 - DNA, 20 bp, Artificial Sequence
  chemically synthesized
tgatcagcttactatgtttc

SEQ ID NO: 559034 - DNA, 20 bp, Artificial Sequence
  chemically synthesized
taagcatgtattttatcctt

SEQ ID NO: 559035 - DNA, 20 bp, Artificial Sequence
  chemically synthesized
agttacataatcctgaagaa

SEQ ID NO: 559036 - DNA, 20 bp, Artificial Sequence
  chemically synthesized
ataattcctgattaaaaaaa

SEQ ID NO: 559037 - DNA, 20 bp, Artificial Sequence
  chemically synthesized
gagctttgggagagactacc

SEQ ID NO: 559038 - DNA, 20 bp, Artificial Sequence
  chemically synthesized
cactttgaaactacacaaaa

SEQ ID NO: 559039 - DNA, 20 bp, Artificial Sequence
  chemically synthesized
atgaggactgcaattttttt

SEQ ID NO: 559040 - DNA, 20 bp, Artificial Sequence
  chemically synthesized
atattctagttgccatagta

SEQ ID NO: 559041 - DNA, 20 bp, Artificial Sequence
  chemically synthesized
agttgccatagtaaaaaaca

SEQ ID NO: 559042 - DNA, 20 bp, Artificial Sequence
  chemically synthesized
tttacattttatattctctt

SEQ ID NO: 559043 - DNA, 20 bp, Artificial Sequence
  chemically synthesized
aattcaccacaagttataaa

SEQ ID NO: 559044 - DNA, 20 bp, Artificial Sequence
  chemically synthesized
atactactctattttccagt

SEQ ID NO: 559045 - DNA, 20 bp, Artificial Sequence
  chemically synthesized
aattaatatataggtagttc

SEQ ID NO: 559046 - DNA, 20 bp, Artificial Sequence
  chemically synthesized
tatcttgccaataacatagc

SEQ ID NO: 559047 - DNA, 20 bp, Artificial Sequence
  chemically synthesized
gcattaggctatgcccattc

SEQ ID NO: 559048 - DNA, 20 bp, Artificial Sequence
  chemically synthesized
gctatgcccattctaaaaca

SEQ ID NO: 559049 - DNA, 20 bp, Artificial Sequence
  chemically synthesized
attcttgagtcaccaaattt

SEQ ID NO: 559050 - DNA, 20 bp, Artificial Sequence
  chemically synthesized
cagaattatgataaattgtc

SEQ ID NO: 559051 - DNA, 20 bp, Artificial Sequence
  chemically synthesized
ttgattattttctatataac

SEQ ID NO: 559052 - DNA, 20 bp, Artificial Sequence
  chemically synthesized
agtaaaaaattaaaagtgtc

SEQ ID NO: 559053 - DNA, 20 bp, Artificial Sequence
  chemically synthesized
tgaaacattaaaaaatcaag

SEQ ID NO: 559054 - DNA, 20 bp, Artificial Sequence
  chemically synthesized
ataaaattcagctttaatgc

SEQ ID NO: 559055 - DNA, 20 bp, Artificial Sequence
  chemically synthesized
accaaggaaagcttacattt

SEQ ID NO: 559056 - DNA, 20 bp, Artificial Sequence
  chemically synthesized
ccactatattcaaatcacac

SEQ ID NO: 559057 - DNA, 20 bp, Artificial Sequence
  chemically synthesized
tgtagaggaaaagaacttac

SEQ ID NO: 559058 - DNA, 20 bp, Artificial Sequence
  chemically synthesized
aatttcatgcttacacattt

SEQ ID NO: 559059 - DNA, 20 bp, Artificial Sequence
  chemically synthesized
taggaaatgaattaaaagag

SEQ ID NO: 559060 - DNA, 20 bp, Artificial Sequence
  chemically synthesized
tgggggagacagacaaaagt

SEQ ID NO: 559061 - DNA, 20 bp, Artificial Sequence
  chemically synthesized
gaatggaagaaataaaactg

SEQ ID NO: 559062 - DNA, 20 bp, Artificial Sequence
  chemically synthesized
ggaagggggaatggaagaaa

SEQ ID NO: 559063 - DNA, 20 bp, Artificial Sequence
  chemically synthesized
ctaacacatagtagaccaac

SEQ ID NO: 559064 - DNA, 20 bp, Artificial Sequence
  chemically synthesized
tggtgagcagtgtcatttga

SEQ ID NO: 559065 - DNA, 20 bp, Artificial Sequence
  chemically synthesized
aaaattttctataaaaacat

SEQ ID NO: 559066 - DNA, 20 bp, Artificial Sequence
  chemically synthesized
tttttagtaaaattttctat

SEQ ID NO: 559067 - DNA, 20 bp, Artificial Sequence
  chemically synthesized
aaaaaaaaaaaaaaaaaaaa

SEQ ID NO: 559068 - DNA, 20 bp, Artificial Sequence
  chemically synthesized
tatgcacttgggtgaattgt

SEQ ID NO: 559069 - DNA, 20 bp, Artificial Sequence
  chemically synthesized
agagtagagggcatggaaga

SEQ ID NO: 559070 - DNA, 20 bp, Artificial Sequence
  chemically synthesized
tcttccatgccctctactct

SEQ ID NO: 559071 - DNA, 20 bp, Artificial Sequence
  chemically synthesized
gccactatactccgatgccc

SEQ ID NO: 559072 - DNA, 20 bp, Artificial Sequence
  chemically synthesized
gcaattctgatcctctccat

SEQ ID NO: 559073 - DNA, 20 bp, Artificial Sequence
  chemically synthesized
tgatttcacatagattacga

SEQ ID NO: 559074 - DNA, 20 bp, Artificial Sequence
  chemically synthesized
cgaatctggggggttgagac

SEQ ID NO: 559075 - DNA, 20 bp, Artificial Sequence
  chemically synthesized
tcaaattatgtaatatatgt

SEQ ID NO: 559076 - DNA, 20 bp, Artificial Sequence
  chemically synthesized
ttacaatctttagattaaaa

SEQ ID NO: 559077 - DNA, 20 bp, Artificial Sequence
  chemically synthesized
tgagatcaaaggctaccccc

SEQ ID NO: 559078 - DNA, 20 bp, Artificial Sequence
  chemically synthesized
gttgattacaataagaaatt

SEQ ID NO: 559079 - DNA, 20 bp, Artificial Sequence
  chemically synthesized
tagactaacaatttttaaaa

SEQ ID NO: 559080 - DNA, 20 bp, Artificial Sequence
  chemically synthesized
tagaaggtaatctcaccaga

SEQ ID NO: 559081 - DNA, 20 bp, Artificial Sequence
  chemically synthesized
ctaagtattcatttctgttt

SEQ ID NO: 559082 - DNA, 20 bp, Artificial Sequence
  chemically synthesized
tctattatcacgatgaaatg

SEQ ID NO: 559083 - DNA, 20 bp, Artificial Sequence
  chemically synthesized
ttgcctttactaatttagag

SEQ ID NO: 559084 - DNA, 20 bp, Artificial Sequence
  chemically synthesized
attcatgcagaatgtgaaat

SEQ ID NO: 559085 - DNA, 20 bp, Artificial Sequence
  chemically synthesized
ccattgatatctttagaagt

SEQ ID NO: 559086 - DNA, 20 bp, Artificial Sequence
  chemically synthesized
taagtaacaatacattcttt

SEQ ID NO: 559087 - DNA, 20 bp, Artificial Sequence
  chemically synthesized
tgtcacatttcacttatttt

SEQ ID NO: 559088 - DNA, 20 bp, Artificial Sequence
  chemically synthesized
tagaaataatctgaaatgaa

SEQ ID NO: 559089 - DNA, 20 bp, Artificial Sequence
  chemically synthesized
taatgaaatgatcacgccat

SEQ ID NO: 559090 - DNA, 20 bp, Artificial Sequence
  chemically synthesized
cacaaccagtaaagaggtaa

SEQ ID NO: 559091 - DNA, 20 bp, Artificial Sequence
  chemically synthesized
ctgaaggccaaaaaaataaa

SEQ ID NO: 559092 - DNA, 20 bp, Artificial Sequence
  chemically synthesized
ttggcattcattttcctttt

SEQ ID NO: 559093 - DNA, 20 bp, Artificial Sequence
  chemically synthesized
gcagaaaatacaaagggaga

SEQ ID NO: 559094 - DNA, 20 bp, Artificial Sequence
  chemically synthesized
agataaaaccacaacttcca

SEQ ID NO: 559095 - DNA, 20 bp, Artificial Sequence
  chemically synthesized
agttgcaacaacatagttgg

SEQ ID NO: 559096 - DNA, 20 bp, Artificial Sequence
  chemically synthesized
aattcattccaggctatccc

SEQ ID NO: 559097 - DNA, 20 bp, Artificial Sequence
  chemically synthesized
attacgatatacctttaatg

SEQ ID NO: 559098 - DNA, 20 bp, Artificial Sequence
  chemically synthesized
ttagttgtttactatttaaa

SEQ ID NO: 559099 - DNA, 20 bp, Artificial Sequence
  chemically synthesized
aaatttatcaaacattgcag

SEQ ID NO: 559100 - DNA, 20 bp, Artificial Sequence
  chemically synthesized
tgggttctttcttttagtct

SEQ ID NO: 559101 - DNA, 20 bp, Artificial Sequence
  chemically synthesized
gtttacatgtagttaaaaat

SEQ ID NO: 559102 - DNA, 20 bp, Artificial Sequence
  chemically synthesized
taaggacgtcttaataagag

SEQ ID NO: 559103 - DNA, 20 bp, Artificial Sequence
  chemically synthesized
ttctatatgaaaataccact

SEQ ID NO: 559104 - DNA, 20 bp, Artificial Sequence
  chemically synthesized
accaacgtctccttcttgcc

SEQ ID NO: 559105 - DNA, 20 bp, Artificial Sequence
  chemically synthesized
acagaggtaggagaggcctt

SEQ ID NO: 559106 - DNA, 20 bp, Artificial Sequence
  chemically synthesized
ttaatacatagttataggtt

SEQ ID NO: 559107 - DNA, 20 bp, Artificial Sequence
  chemically synthesized
actatgtattaatgaatcat

SEQ ID NO: 559108 - DNA, 20 bp, Artificial Sequence
  chemically synthesized
tttggcatctgttgaagctt

SEQ ID NO: 559109 - DNA, 20 bp, Artificial Sequence
  chemically synthesized
taataatgcttttaaatgca

SEQ ID NO: 559110 - DNA, 20 bp, Artificial Sequence
  chemically synthesized
aaatacataggattttaaat

SEQ ID NO: 559111 - DNA, 20 bp, Artificial Sequence
  chemically synthesized
ttaattaacatattaggaaa

SEQ ID NO: 559112 - DNA, 20 bp, Artificial Sequence
  chemically synthesized
gttgctcacattttaactga

SEQ ID NO: 559113 - DNA, 20 bp, Artificial Sequence
  chemically synthesized
tatctttatttgtattcaat

SEQ ID NO: 559114 - DNA, 20 bp, Artificial Sequence
  chemically synthesized
tctgtgaacttggattgggg

SEQ ID NO: 559115 - DNA, 20 bp, Artificial Sequence
  chemically synthesized
atttcctaagaggtgattta

SEQ ID NO: 559116 - DNA, 20 bp, Artificial Sequence
  chemically synthesized
agaggtgatttataaaacat

SEQ ID NO: 559117 - DNA, 20 bp, Artificial Sequence
  chemically synthesized
ttaatcacagaaagccaaag

SEQ ID NO: 559118 - DNA, 20 bp, Artificial Sequence
  chemically synthesized
tccgatgccaaaggcaaaac

SEQ ID NO: 559119 - DNA, 20 bp, Artificial Sequence
  chemically synthesized
tgtttatccgatgccaaagg

SEQ ID NO: 559120 - DNA, 20 bp, Artificial Sequence
  chemically synthesized
taaaaatttttatgcaagac

SEQ ID NO: 559121 - DNA, 20 bp, Artificial Sequence
  chemically synthesized
tttattgaaaaaatgtgaca

SEQ ID NO: 559122 - DNA, 20 bp, Artificial Sequence
  chemically synthesized
ttatgtcacattttttcaat

SEQ ID NO: 559123 - DNA, 20 bp, Artificial Sequence
  chemically synthesized
tgttactaggctctgtggga

SEQ ID NO: 559124 - DNA, 20 bp, Artificial Sequence
  chemically synthesized
tagagaagtccccatccttc

SEQ ID NO: 559125 - DNA, 20 bp, Artificial Sequence
  chemically synthesized
ttaaaggcaatggaattttc

SEQ ID NO: 559126 - DNA, 20 bp, Artificial Sequence
  chemically synthesized
gcaacattatcccctaagtt

SEQ ID NO: 559127 - DNA, 20 bp, Artificial Sequence
  chemically synthesized
agttccacaaaattataaat

SEQ ID NO: 559128 - DNA, 20 bp, Artificial Sequence
  chemically synthesized
cacaatattttttcctaacc

SEQ ID NO: 559129 - DNA, 20 bp, Artificial Sequence
  chemically synthesized
cttaagtcatatctttgatt

SEQ ID NO: 559130 - DNA, 20 bp, Artificial Sequence
  chemically synthesized
agaggaaagcttaaatgcaa

SEQ ID NO: 559131 - DNA, 20 bp, Artificial Sequence
  chemically synthesized
atcacattactacatgactg

SEQ ID NO: 559132 - DNA, 20 bp, Artificial Sequence
  chemically synthesized
aatcatgtcataggtcaagt

SEQ ID NO: 559133 - DNA, 20 bp, Artificial Sequence
  chemically synthesized
gatattttcccctctatcat

SEQ ID NO: 559134 - DNA, 20 bp, Artificial Sequence
  chemically synthesized
ctgatacagtagcaagatgg

SEQ ID NO: 559135 - DNA, 20 bp, Artificial Sequence
  chemically synthesized
aaaatctgtggaaggtactg

SEQ ID NO: 559136 - DNA, 20 bp, Artificial Sequence
  chemically synthesized
gagaatttaaaaaaaaaaaa

SEQ ID NO: 559137 - DNA, 20 bp, Artificial Sequence
  chemically synthesized
tttgatgtgcaaccaatgtt

SEQ ID NO: 559138 - DNA, 20 bp, Artificial Sequence
  chemically synthesized
tttaatgactatcactcaat

SEQ ID NO: 559139 - DNA, 20 bp, Artificial Sequence
  chemically synthesized
cttcctgaggttaaatatta

SEQ ID NO: 559140 - DNA, 20 bp, Artificial Sequence
  chemically synthesized
ttgtttccaaaataaacgtg

SEQ ID NO: 559141 - DNA, 20 bp, Artificial Sequence
  chemically synthesized
catactaagactactgttaa

SEQ ID NO: 559142 - DNA, 20 bp, Artificial Sequence
  chemically synthesized
gagttggaatctttgatgct

SEQ ID NO: 559143 - DNA, 20 bp, Artificial Sequence
  chemically synthesized
ttagcatatgaattgatcac

SEQ ID NO: 559144 - DNA, 20 bp, Artificial Sequence
  chemically synthesized
cctcattaaaataataaaat

SEQ ID NO: 559145 - DNA, 20 bp, Artificial Sequence
  chemically synthesized
tgataatttggtatagtgga

SEQ ID NO: 559146 - DNA, 20 bp, Artificial Sequence
  chemically synthesized
atacaagtcctggtacatag

SEQ ID NO: 559147 - DNA, 20 bp, Artificial Sequence
  chemically synthesized
gacttgtatttgttcatcta

SEQ ID NO: 559148 - DNA, 20 bp, Artificial Sequence
  chemically synthesized
gtgattatttatgtttgtta

SEQ ID NO: 559149 - DNA, 20 bp, Artificial Sequence
  chemically synthesized
taggattgatccatattttt

SEQ ID NO: 559150 - DNA, 20 bp, Artificial Sequence
  chemically synthesized
gaagggacagctgcaggtaa

SEQ ID NO: 559151 - DNA, 20 bp, Artificial Sequence
  chemically synthesized
tatttaattctgagcaggaa

SEQ ID NO: 559152 - DNA, 20 bp, Artificial Sequence
  chemically synthesized
ttttctggctgcttttgtgc

SEQ ID NO: 559153 - DNA, 20 bp, Artificial Sequence
  chemically synthesized
ttttttccaaccatttacat

SEQ ID NO: 559154 - DNA, 20 bp, Artificial Sequence
  chemically synthesized
aaattaaaaaaaaacagatt

SEQ ID NO: 559155 - DNA, 20 bp, Artificial Sequence
  chemically synthesized
ttgtcaacaagaaattaaaa

SEQ ID NO: 559156 - DNA, 20 bp, Artificial Sequence
  chemically synthesized
acctcaatgacaaatgcaac

SEQ ID NO: 559157 - DNA, 20 bp, Artificial Sequence
  chemically synthesized
aactactaaaaatcctagaa

SEQ ID NO: 559158 - DNA, 20 bp, Artificial Sequence
  chemically synthesized
atttccctttttgtaaacaa

SEQ ID NO: 559159 - DNA, 20 bp, Artificial Sequence
  chemically synthesized
gccacagaaacatcctcttt

SEQ ID NO: 559160 - DNA, 20 bp, Artificial Sequence
  chemically synthesized
aatcacatataagaacataa

SEQ ID NO: 559161 - DNA, 20 bp, Artificial Sequence
  chemically synthesized
aaaggaaggggaaggttgcc

SEQ ID NO: 559162 - DNA, 20 bp, Artificial Sequence
  chemically synthesized
ttttaaagggcacagcatta

SEQ ID NO: 559163 - DNA, 20 bp, Artificial Sequence
  chemically synthesized
ggtgaaactccaactctacc

SEQ ID NO: 559164 - DNA, 20 bp, Artificial Sequence
  chemically synthesized
tgagaattttggtggtactg

SEQ ID NO: 559165 - DNA, 20 bp, Artificial Sequence
  chemically synthesized
caattttttttttttctcat

SEQ ID NO: 559166 - DNA, 20 bp, Artificial Sequence
  chemically synthesized
tctcagcttcgtaatgtaag

SEQ ID NO: 559167 - DNA, 20 bp, Artificial Sequence
  chemically synthesized
attatataacacggctagtt

SEQ ID NO: 559168 - DNA, 20 bp, Artificial Sequence
  chemically synthesized
taacacggctagttaaaaac

SEQ ID NO: 559169 - DNA, 20 bp, Artificial Sequence
  chemically synthesized
ctagttaaaaaccaaaaccc

SEQ ID NO: 559170 - DNA, 20 bp, Artificial Sequence
  chemically synthesized
ggagaatcagaagtcacctt

SEQ ID NO: 559171 - DNA, 20 bp, Artificial Sequence
  chemically synthesized
tagtttttcctgtgatatga

SEQ ID NO: 559172 - DNA, 20 bp, Artificial Sequence
  chemically synthesized
tagttttctcatatcacagg

SEQ ID NO: 559173 - DNA, 20 bp, Artificial Sequence
  chemically synthesized
ttgatacttcatgcccccta

SEQ ID NO: 559174 - DNA, 20 bp, Artificial Sequence
  chemically synthesized
ctcagtgaatgtatttattt

SEQ ID NO: 559175 - DNA, 20 bp, Artificial Sequence
  chemically synthesized
gccaagcataattgaagaaa

SEQ ID NO: 559176 - DNA, 20 bp, Artificial Sequence
  chemically synthesized
ctctgtgactggttcaaacc

SEQ ID NO: 559177 - DNA, 20 bp, Artificial Sequence
  chemically synthesized
aatagagaatctgaaaatct

SEQ ID NO: 559178 - DNA, 20 bp, Artificial Sequence
  chemically synthesized
gcgccaagcttcctaaaaga

SEQ ID NO: 559179 - DNA, 20 bp, Artificial Sequence
  chemically synthesized
tgagaagcctaaataaattg

SEQ ID NO: 559180 - DNA, 20 bp, Artificial Sequence
  chemically synthesized
ataattaagatactttaaga

SEQ ID NO: 559181 - DNA, 20 bp, Artificial Sequence
  chemically synthesized
aagataaatgtcacattttt

SEQ ID NO: 559182 - DNA, 20 bp, Artificial Sequence
  chemically synthesized
taggaaaaaaaaaaagctta

SEQ ID NO: 559183 - DNA, 20 bp, Artificial Sequence
  chemically synthesized
aagatacagtatatacaggt

SEQ ID NO: 559184 - DNA, 20 bp, Artificial Sequence
  chemically synthesized
catttattctgaaagagaag

SEQ ID NO: 559185 - DNA, 20 bp, Artificial Sequence
  chemically synthesized
gtataaatgagacccaaact

SEQ ID NO: 559186 - DNA, 20 bp, Artificial Sequence
  chemically synthesized
aaattttcaataccttatgt

SEQ ID NO: 559187 - DNA, 20 bp, Artificial Sequence
  chemically synthesized
tctagttaatttggtaactt

SEQ ID NO: 559188 - DNA, 20 bp, Artificial Sequence
  chemically synthesized
cacagtggcaaattttgagg

SEQ ID NO: 559189 - DNA, 20 bp, Artificial Sequence
  chemically synthesized
tgtgcttttcaggaccatga

SEQ ID NO: 559190 - DNA, 20 bp, Artificial Sequence
  chemically synthesized
aggttattttgaacatacgt

SEQ ID NO: 559191 - DNA, 20 bp, Artificial Sequence
  chemically synthesized
tgaagttgcctggggaaagg

SEQ ID NO: 559192 - DNA, 20 bp, Artificial Sequence
  chemically synthesized
atttttataaaatattattt

SEQ ID NO: 559193 - DNA, 20 bp, Artificial Sequence
  chemically synthesized
tctgaatattaagagtgaat

SEQ ID NO: 559194 - DNA, 20 bp, Artificial Sequence
  chemically synthesized
gatataagtcaaactgaaga

SEQ ID NO: 559195 - DNA, 20 bp, Artificial Sequence
  chemically synthesized
gataaaactcatttctcact

SEQ ID NO: 559196 - DNA, 20 bp, Artificial Sequence
  chemically synthesized
aaagtgtctcacatctgctc

SEQ ID NO: 559197 - DNA, 20 bp, Artificial Sequence
  chemically synthesized
atattcattcccattaatag

SEQ ID NO: 559198 - DNA, 20 bp, Artificial Sequence
  chemically synthesized
aaaacacataccaaagaaaa

SEQ ID NO: 559199 - DNA, 20 bp, Artificial Sequence
  chemically synthesized
ggttttttttaaaaaaaggt

SEQ ID NO: 559200 - DNA, 20 bp, Artificial Sequence
  chemically synthesized
tgttttcacctttttttaaa

SEQ ID NO: 559201 - DNA, 20 bp, Artificial Sequence
  chemically synthesized
cctttagggatggttcaata

SEQ ID NO: 559202 - DNA, 20 bp, Artificial Sequence
  chemically synthesized
tttactaccttacaggtaaa

SEQ ID NO: 559203 - DNA, 20 bp, Artificial Sequence
  chemically synthesized
tcaattgtaatggaattggt

SEQ ID NO: 559204 - DNA, 20 bp, Artificial Sequence
  chemically synthesized
agaatctatctataagcaag

SEQ ID NO: 559205 - DNA, 20 bp, Artificial Sequence
  chemically synthesized
gagaggtgtgcgtacattta

SEQ ID NO: 559206 - DNA, 20 bp, Artificial Sequence
  chemically synthesized
tccagctaaatacattttta

SEQ ID NO: 559207 - DNA, 20 bp, Artificial Sequence
  chemically synthesized
tcgcatacacacacaaagta

SEQ ID NO: 559208 - DNA, 20 bp, Artificial Sequence
  chemically synthesized
cttcgtgaaacaatgactac

SEQ ID NO: 559209 - DNA, 20 bp, Artificial Sequence
  chemically synthesized
atagtatcacagaatacagc

SEQ ID NO: 559210 - DNA, 20 bp, Artificial Sequence
  chemically synthesized
aaataaaaagcccacacaca

SEQ ID NO: 559211 - DNA, 20 bp, Artificial Sequence
  chemically synthesized
actgagaaactcccctttac

SEQ ID NO: 559212 - DNA, 20 bp, Artificial Sequence
  chemically synthesized
aatttaaaatttataattac

SEQ ID NO: 559213 - DNA, 20 bp, Artificial Sequence
  chemically synthesized
aggatggcaacaaacttgtt

SEQ ID NO: 559214 - DNA, 20 bp, Artificial Sequence
  chemically synthesized
ttagagggtttttaaaatat

SEQ ID NO: 559215 - DNA, 20 bp, Artificial Sequence
  chemically synthesized
tagtcttgtttttatatttt

SEQ ID NO: 559216 - DNA, 20 bp, Artificial Sequence
  chemically synthesized
aaagagcaggatggtagtat

SEQ ID NO: 559217 - DNA, 20 bp, Artificial Sequence
  chemically synthesized
cacttatctcacagcatata

SEQ ID NO: 559218 - DNA, 20 bp, Artificial Sequence
  chemically synthesized
ttcaaaatggactcaagact

SEQ ID NO: 559219 - DNA, 20 bp, Artificial Sequence
  chemically synthesized
aacctataaaatgatttgaa

SEQ ID NO: 559220 - DNA, 20 bp, Artificial Sequence
  chemically synthesized
caaagcacaggcaacaagag

SEQ ID NO: 559221 - DNA, 20 bp, Artificial Sequence
  chemically synthesized
cctaaaaagcttctgctcag

SEQ ID NO: 559222 - DNA, 20 bp, Artificial Sequence
  chemically synthesized
gagctatctgatggaccagg

SEQ ID NO: 559223 - DNA, 20 bp, Artificial Sequence
  chemically synthesized
acaagttctaagtttaaaca

SEQ ID NO: 559224 - DNA, 20 bp, Artificial Sequence
  chemically synthesized
ttctaagtttaaacataaaa

SEQ ID NO: 559225 - DNA, 20 bp, Artificial Sequence
  chemically synthesized
aactaaatatatatatatca

SEQ ID NO: 559226 - DNA, 20 bp, Artificial Sequence
  chemically synthesized
actgggaagtcagtggtggc

SEQ ID NO: 559227 - DNA, 20 bp, Artificial Sequence
  chemically synthesized
attttcttaaaagtgctgat

SEQ ID NO: 559228 - DNA, 20 bp, Artificial Sequence
  chemically synthesized
agcacacacatacggtttca

SEQ ID NO: 559229 - DNA, 20 bp, Artificial Sequence
  chemically synthesized
acaaagacatatatttctag

SEQ ID NO: 559230 - DNA, 20 bp, Artificial Sequence
  chemically synthesized
aatttttgttctaattccat

SEQ ID NO: 559231 - DNA, 20 bp, Artificial Sequence
  chemically synthesized
caaagcatcgtaaacaatga

SEQ ID NO: 559232 - DNA, 20 bp, Artificial Sequence
  chemically synthesized
tccaacagtaaatatgagct

SEQ ID NO: 559233 - DNA, 20 bp, Artificial Sequence
  chemically synthesized
tctactccataatatcaatg

SEQ ID NO: 559234 - DNA, 20 bp, Artificial Sequence
  chemically synthesized
acacagaatgttattaaagg

SEQ ID NO: 559235 - DNA, 20 bp, Artificial Sequence
  chemically synthesized
agtgggaagtcacataaaat

SEQ ID NO: 559236 - DNA, 20 bp, Artificial Sequence
  chemically synthesized
ccaactgagatgattcctct

SEQ ID NO: 559237 - DNA, 20 bp, Artificial Sequence
  chemically synthesized
tataattattatggttatct

SEQ ID NO: 559238 - DNA, 20 bp, Artificial Sequence
  chemically synthesized
ctgaagatatacagaaaaat

SEQ ID NO: 559239 - DNA, 20 bp, Artificial Sequence
  chemically synthesized
tttccattcatccaacacag

SEQ ID NO: 559240 - DNA, 20 bp, Artificial Sequence
  chemically synthesized
tatttagtataacattaaga

SEQ ID NO: 559241 - DNA, 20 bp, Artificial Sequence
  chemically synthesized
tatctttaaaatgtagagag

SEQ ID NO: 559242 - DNA, 20 bp, Artificial Sequence
  chemically synthesized
tggatttgaggacattattt

SEQ ID NO: 559243 - DNA, 20 bp, Artificial Sequence
  chemically synthesized
actggagtataatgcccaac

SEQ ID NO: 559244 - DNA, 20 bp, Artificial Sequence
  chemically synthesized
tttgagtgtgacttcaaaga

SEQ ID NO: 559245 - DNA, 20 bp, Artificial Sequence
  chemically synthesized
ttgtgaattttagataacta

SEQ ID NO: 559246 - DNA, 20 bp, Artificial Sequence
  chemically synthesized
tcgctctggaaactgctaag

SEQ ID NO: 559247 - DNA, 20 bp, Artificial Sequence
  chemically synthesized
aaatagttagaattctgcct

SEQ ID NO: 559248 - DNA, 20 bp, Artificial Sequence
  chemically synthesized
atagggagtgaggtggtaac

SEQ ID NO: 559249 - DNA, 20 bp, Artificial Sequence
  chemically synthesized
gacagagcgagattccatct

SEQ ID NO: 559250 - DNA, 20 bp, Artificial Sequence
  chemically synthesized
gaccatcctgaccaacatgg

SEQ ID NO: 559251 - DNA, 20 bp, Artificial Sequence
  chemically synthesized
aggtgagctttctcaacacg

SEQ ID NO: 559252 - DNA, 20 bp, Artificial Sequence
  chemically synthesized
aaatggctatcataaataac

SEQ ID NO: 559253 - DNA, 20 bp, Artificial Sequence
  chemically synthesized
gcattagtcccttcttgagt

SEQ ID NO: 559254 - DNA, 20 bp, Artificial Sequence
  chemically synthesized
cacattcctgtttccatatg

SEQ ID NO: 559255 - DNA, 20 bp, Artificial Sequence
  chemically synthesized
caaaattgaagtaactaaag

SEQ ID NO: 559256 - DNA, 20 bp, Artificial Sequence
  chemically synthesized
cgcaaggatataggagttgt

SEQ ID NO: 559257 - DNA, 20 bp, Artificial Sequence
  chemically synthesized
atcggatcaaatattagcaa

SEQ ID NO: 559258 - DNA, 20 bp, Artificial Sequence
  chemically synthesized
tctgctttcctctaacgctt

SEQ ID NO: 559259 - DNA, 20 bp, Artificial Sequence
  chemically synthesized
gaagataaacttgattttaa

SEQ ID NO: 559260 - DNA, 20 bp, Artificial Sequence
  chemically synthesized
aaaaaacctgtttaaagcaa

SEQ ID NO: 559261 - DNA, 20 bp, Artificial Sequence
  chemically synthesized
ggagaggtggctctttttca

SEQ ID NO: 559262 - DNA, 20 bp, Artificial Sequence
  chemically synthesized
aatgagaatttctcagataa

SEQ ID NO: 559263 - DNA, 20 bp, Artificial Sequence
  chemically synthesized
tcacatctgatctttttgac

SEQ ID NO: 559264 - DNA, 20 bp, Artificial Sequence
  chemically synthesized
atgtcatttcctcgtaagca

SEQ ID NO: 559265 - DNA, 20 bp, Artificial Sequence
  chemically synthesized
cttggaggctaaggggatgg

SEQ ID NO: 559266 - DNA, 20 bp, Artificial Sequence
  chemically synthesized
agagtggtcaaagaagagca

SEQ ID NO: 559267 - DNA, 20 bp, Artificial Sequence
  chemically synthesized
caaagaagagcaaaaaacaa

SEQ ID NO: 559268 - DNA, 20 bp, Artificial Sequence
  chemically synthesized
aaatatatgcaatgtaatag

SEQ ID NO: 559269 - DNA, 20 bp, Artificial Sequence
  chemically synthesized
gtataatttaaaaaaatttt

SEQ ID NO: 559270 - DNA, 20 bp, Artificial Sequence
  chemically synthesized
taaaaaaattttaaaaacag

SEQ ID NO: 559271 - DNA, 20 bp, Artificial Sequence
  chemically synthesized
attcttattctctgaccctc

SEQ ID NO: 559272 - DNA, 20 bp, Artificial Sequence
  chemically synthesized
tatttccattaaatagttag

SEQ ID NO: 559273 - DNA, 20 bp, Artificial Sequence
  chemically synthesized
ttagtggtggcgacctttct

SEQ ID NO: 559274 - DNA, 20 bp, Artificial Sequence
  chemically synthesized
attctactatgggtaagctg

SEQ ID NO: 559275 - DNA, 20 bp, Artificial Sequence
  chemically synthesized
aagaaaataaaattgtggaa

SEQ ID NO: 559276 - DNA, 20 bp, Artificial Sequence
  chemically synthesized
atggatagtaagcatttgaa

SEQ ID NO: 559277 - DNA, 20 bp, Artificial Sequence
  chemically synthesized
atatattcaaagtaggaaaa

SEQ ID NO: 559278 - DNA, 20 bp, Artificial Sequence
  chemically synthesized
atgaggtaaagcaagatttt

SEQ ID NO: 559279 - DNA, 20 bp, Artificial Sequence
  chemically synthesized
ccacatatcacacgtactta

SEQ ID NO: 559280 - DNA, 20 bp, Artificial Sequence
  chemically synthesized
tgcatatttctgataaaagt

SEQ ID NO: 559281 - DNA, 20 bp, Artificial Sequence
  chemically synthesized
agaaatatgttgatatacca

SEQ ID NO: 559282 - DNA, 20 bp, Artificial Sequence
  chemically synthesized
acattcttcacagaaataga

SEQ ID NO: 559283 - DNA, 20 bp, Artificial Sequence
  chemically synthesized
ttggatatccaaatgcagaa

SEQ ID NO: 559284 - DNA, 20 bp, Artificial Sequence
  chemically synthesized
aaattatgaaactaccacaa

SEQ ID NO: 559285 - DNA, 20 bp, Artificial Sequence
  chemically synthesized
gctcaaacaactctatagga

SEQ ID NO: 559286 - DNA, 20 bp, Artificial Sequence
  chemically synthesized
atcataacagaatagtaaat

SEQ ID NO: 559287 - DNA, 20 bp, Artificial Sequence
  chemically synthesized
aactcaaatggttttattta

SEQ ID NO: 559288 - DNA, 20 bp, Artificial Sequence
  chemically synthesized
gttattgcttgttttataaa

SEQ ID NO: 559289 - DNA, 20 bp, Artificial Sequence
  chemically synthesized
aaactagtacaaccactatg

SEQ ID NO: 559290 - DNA, 20 bp, Artificial Sequence
  chemically synthesized
tacagttttttgaggaatct

SEQ ID NO: 559291 - DNA, 20 bp, Artificial Sequence
  chemically synthesized
acaagttttgagattcctca

SEQ ID NO: 559292 - DNA, 20 bp, Artificial Sequence
  chemically synthesized
ttttgtgaacagtgccgcaa

SEQ ID NO: 559293 - DNA, 20 bp, Artificial Sequence
  chemically synthesized
agcaacctaaatgtccatta

SEQ ID NO: 559294 - DNA, 20 bp, Artificial Sequence
  chemically synthesized
atgacatgattgtatatcta

SEQ ID NO: 559295 - DNA, 20 bp, Artificial Sequence
  chemically synthesized
aaaccggaagcattcccttt

SEQ ID NO: 559296 - DNA, 20 bp, Artificial Sequence
  chemically synthesized
caatatcatactgaatgggc

SEQ ID NO: 559297 - DNA, 20 bp, Artificial Sequence
  chemically synthesized
atctaaacagagccaaagac

SEQ ID NO: 559298 - DNA, 20 bp, Artificial Sequence
  chemically synthesized
aatcctcaataaaatacttg

SEQ ID NO: 559299 - DNA, 20 bp, Artificial Sequence
  chemically synthesized
tccttgtacctctgcagcca

SEQ ID NO: 559300 - DNA, 20 bp, Artificial Sequence
  chemically synthesized
gccatcagagaaatgcaaat

SEQ ID NO: 559301 - DNA, 20 bp, Artificial Sequence
  chemically synthesized
agcaaactatctcaaggaca

SEQ ID NO: 559302 - DNA, 20 bp, Artificial Sequence
  chemically synthesized
cacaatgtgcacatgtaccc

SEQ ID NO: 559303 - DNA, 20 bp, Artificial Sequence
  chemically synthesized
tctctattcaatagggtttt

SEQ ID NO: 559304 - DNA, 20 bp, Artificial Sequence
  chemically synthesized
ttgtacctcaaagttgtttt

SEQ ID NO: 559305 - DNA, 20 bp, Artificial Sequence
  chemically synthesized
gtgtttaaaagggaatattt

SEQ ID NO: 559306 - DNA, 20 bp, Artificial Sequence
  chemically synthesized
attcacatggtataatcctt

SEQ ID NO: 559307 - DNA, 20 bp, Artificial Sequence
  chemically synthesized
ttgcccaactttgaagctct

SEQ ID NO: 559308 - DNA, 20 bp, Artificial Sequence
  chemically synthesized
gataaacgctgaaagaaaaa

SEQ ID NO: 559309 - DNA, 20 bp, Artificial Sequence
  chemically synthesized
aaattattaaaattaatggc

SEQ ID NO: 559310 - DNA, 20 bp, Artificial Sequence
  chemically synthesized
agagatttgggttcaaatat

SEQ ID NO: 559311 - DNA, 20 bp, Artificial Sequence
  chemically synthesized
cttttgatttcattaaggaa

SEQ ID NO: 559312 - DNA, 20 bp, Artificial Sequence
  chemically synthesized
gagatcagaattctttggga

SEQ ID NO: 559313 - DNA, 20 bp, Artificial Sequence
  chemically synthesized
ttgatgcacattttgtaggg

SEQ ID NO: 559314 - DNA, 20 bp, Artificial Sequence
  chemically synthesized
gttcttacatatcaaagatt

SEQ ID NO: 559315 - DNA, 20 bp, Artificial Sequence
  chemically synthesized
tgctataggattttaggtgc

SEQ ID NO: 559316 - DNA, 20 bp, Artificial Sequence
  chemically synthesized
agatatggaaatatatctta

SEQ ID NO: 559317 - DNA, 20 bp, Artificial Sequence
  chemically synthesized
aacagaataaagcaaatggg

SEQ ID NO: 559318 - DNA, 20 bp, Artificial Sequence
  chemically synthesized
tactacaaggctacagtaac

SEQ ID NO: 559319 - DNA, 20 bp, Artificial Sequence
  chemically synthesized
cctttcttcagagaattgga

SEQ ID NO: 559320 - DNA, 20 bp, Artificial Sequence
  chemically synthesized
atgacatgattgtatatcta

SEQ ID NO: 559321 - DNA, 20 bp, Artificial Sequence
  chemically synthesized
aaactggaagcattcccttt

SEQ ID NO: 559322 - DNA, 20 bp, Artificial Sequence
  chemically synthesized
caatatcatactgaatgggc

SEQ ID NO: 559323 - DNA, 20 bp, Artificial Sequence
  chemically synthesized
tattacaaggctacagtaac

SEQ ID NO: 559324 - DNA, 20 bp, Artificial Sequence
  chemically synthesized
aaacagcatggtactggtac

SEQ ID NO: 559325 - DNA, 20 bp, Artificial Sequence
  chemically synthesized
tgatctttgacaaacctcac

SEQ ID NO: 559326 - DNA, 20 bp, Artificial Sequence
  chemically synthesized
tatttaataaatggtgctgg

SEQ ID NO: 559327 - DNA, 20 bp, Artificial Sequence
  chemically synthesized
aaagacttacatgttagact

SEQ ID NO: 559328 - DNA, 20 bp, Artificial Sequence
  chemically synthesized
catgttagacttaaaaccat

SEQ ID NO: 559329 - DNA, 20 bp, Artificial Sequence
  chemically synthesized
aaaccataaaaaccctagaa

SEQ ID NO: 559330 - DNA, 20 bp, Artificial Sequence
  chemically synthesized
acgggcaaggacttcatgac

SEQ ID NO: 559331 - DNA, 20 bp, Artificial Sequence
  chemically synthesized
gccatcagagaaatgcaaat

SEQ ID NO: 559332 - DNA, 20 bp, Artificial Sequence
  chemically synthesized
agcaaactatcgcaaggaca

SEQ ID NO: 559333 - DNA, 20 bp, Artificial Sequence
  chemically synthesized
cacgttgtgcacatgtaccc

SEQ ID NO: 559334 - DNA, 20 bp, Artificial Sequence
  chemically synthesized
aaaagattcaaattaactag

SEQ ID NO: 559335 - DNA, 20 bp, Artificial Sequence
  chemically synthesized
tacctgagaactctgttcta

SEQ ID NO: 559336 - DNA, 20 bp, Artificial Sequence
  chemically synthesized
cacttactgccatattaaaa

SEQ ID NO: 559337 - DNA, 20 bp, Artificial Sequence
  chemically synthesized
acaagccatctgaaagctct

SEQ ID NO: 559338 - DNA, 20 bp, Artificial Sequence
  chemically synthesized
ttattgtagtatttttttag

SEQ ID NO: 559339 - DNA, 20 bp, Artificial Sequence
  chemically synthesized
aagcaaaatattttgctatt

SEQ ID NO: 559340 - DNA, 20 bp, Artificial Sequence
  chemically synthesized
gaatccatttctaaataaga

SEQ ID NO: 559341 - DNA, 20 bp, Artificial Sequence
  chemically synthesized
tttttaatcaaacattcctt

SEQ ID NO: 559342 - DNA, 20 bp, Artificial Sequence
  chemically synthesized
tgtataaatattttatatca

SEQ ID NO: 559343 - DNA, 20 bp, Artificial Sequence
  chemically synthesized
tttactcttgttgcccagtg

SEQ ID NO: 559344 - DNA, 20 bp, Artificial Sequence
  chemically synthesized
cctggactttttaagcctat

SEQ ID NO: 559345 - DNA, 20 bp, Artificial Sequence
  chemically synthesized
cccaaattcattttaaagtg

SEQ ID NO: 559346 - DNA, 20 bp, Artificial Sequence
  chemically synthesized
tattttaattctcattctag

SEQ ID NO: 559347 - DNA, 20 bp, Artificial Sequence
  chemically synthesized
gcttcattcaaacgaaaata

SEQ ID NO: 559348 - DNA, 20 bp, Artificial Sequence
  chemically synthesized
ttgtaactaacacattttta

SEQ ID NO: 559349 - DNA, 20 bp, Artificial Sequence
  chemically synthesized
tgagccaccacacccggcca

SEQ ID NO: 559350 - DNA, 20 bp, Artificial Sequence
  chemically synthesized
aactatactaaaagctagag

SEQ ID NO: 559351 - DNA, 20 bp, Artificial Sequence
  chemically synthesized
aaatagtcaaatcagtgaat

SEQ ID NO: 559352 - DNA, 20 bp, Artificial Sequence
  chemically synthesized
tgaatcaaaacaaccccatg

SEQ ID NO: 559353 - DNA, 20 bp, Artificial Sequence
  chemically synthesized
caacattttgttgaagtaat

SEQ ID NO: 559354 - DNA, 20 bp, Artificial Sequence
  chemically synthesized
ggagaaaaataaatagcaaa

SEQ ID NO: 559355 - DNA, 20 bp, Artificial Sequence
  chemically synthesized
ttcagaatcagctccttgtc

SEQ ID NO: 559356 - DNA, 20 bp, Artificial Sequence
  chemically synthesized
tataaaaaccaagatcatct

SEQ ID NO: 559357 - DNA, 20 bp, Artificial Sequence
  chemically synthesized
taatattctatatataatat

SEQ ID NO: 559358 - DNA, 20 bp, Artificial Sequence
  chemically synthesized
ataacacagctttgcccaag

SEQ ID NO: 559359 - DNA, 20 bp, Artificial Sequence
  chemically synthesized
tattttttccggtttcagcg

SEQ ID NO: 559360 - DNA, 20 bp, Artificial Sequence
  chemically synthesized
cccgtaacatattcatatat

SEQ ID NO: 559361 - DNA, 20 bp, Artificial Sequence
  chemically synthesized
taaggagaaattttaatgag

SEQ ID NO: 559362 - DNA, 20 bp, Artificial Sequence
  chemically synthesized
aaattttaatgagaaaaaca

SEQ ID NO: 559363 - DNA, 20 bp, Artificial Sequence
  chemically synthesized
cattctgacacttttaatac

SEQ ID NO: 559364 - DNA, 20 bp, Artificial Sequence
  chemically synthesized
cattgtgacaggtggttgga

SEQ ID NO: 559365 - DNA, 20 bp, Artificial Sequence
  chemically synthesized
tccttcctctggctaaaggc

SEQ ID NO: 559366 - DNA, 20 bp, Artificial Sequence
  chemically synthesized
aaagacatgaaataacattt

SEQ ID NO: 559367 - DNA, 20 bp, Artificial Sequence
  chemically synthesized
atgacaaaaatataaaaata

SEQ ID NO: 559368 - DNA, 20 bp, Artificial Sequence
  chemically synthesized
tcctagtaatggttaccaag

SEQ ID NO: 559369 - DNA, 20 bp, Artificial Sequence
  chemically synthesized
acttagttttaattttcatt

SEQ ID NO: 559370 - DNA, 20 bp, Artificial Sequence
  chemically synthesized
acccagttttcaatgaaaat

SEQ ID NO: 559371 - DNA, 20 bp, Artificial Sequence
  chemically synthesized
agcaaaactcattaaactct

SEQ ID NO: 559372 - DNA, 20 bp, Artificial Sequence
  chemically synthesized
agatgactttacattgccag

SEQ ID NO: 559373 - DNA, 20 bp, Artificial Sequence
  chemically synthesized
gtctaagaaactctggaaga

SEQ ID NO: 559374 - DNA, 20 bp, Artificial Sequence
  chemically synthesized
aaaactctgcatgtgaaata

SEQ ID NO: 559375 - DNA, 20 bp, Artificial Sequence
  chemically synthesized
tcatttaataatattttaca

SEQ ID NO: 559376 - DNA, 20 bp, Artificial Sequence
  chemically synthesized
atcattgtgatgtagacatg

SEQ ID NO: 559377 - DNA, 20 bp, Artificial Sequence
  chemically synthesized
tttactcagaagaaaatatt

SEQ ID NO: 559378 - DNA, 20 bp, Artificial Sequence
  chemically synthesized
ttagtagtaaatgaactaac

SEQ ID NO: 559379 - DNA, 20 bp, Artificial Sequence
  chemically synthesized
ccaagacactttctataaaa

SEQ ID NO: 559380 - DNA, 20 bp, Artificial Sequence
  chemically synthesized
gagtcctgcaagagatgtgc

SEQ ID NO: 559381 - DNA, 20 bp, Artificial Sequence
  chemically synthesized
gaagttgagactctgggaaa

SEQ ID NO: 559382 - DNA, 20 bp, Artificial Sequence
  chemically synthesized
agggcttacaaaagagctgg

SEQ ID NO: 559383 - DNA, 20 bp, Artificial Sequence
  chemically synthesized
tccaccatacccacttatac

SEQ ID NO: 559384 - DNA, 20 bp, Artificial Sequence
  chemically synthesized
ttcagaagaccgattctttc

SEQ ID NO: 559385 - DNA, 20 bp, Artificial Sequence
  chemically synthesized
agaaggaaaatatgctctat

SEQ ID NO: 559386 - DNA, 20 bp, Artificial Sequence
  chemically synthesized
ttttccttcttaaagatggg

SEQ ID NO: 559387 - DNA, 20 bp, Artificial Sequence
  chemically synthesized
tgtatgttggtagacggata

SEQ ID NO: 559388 - DNA, 20 bp, Artificial Sequence
  chemically synthesized
tgaatataaataatccacgt

SEQ ID NO: 559389 - DNA, 20 bp, Artificial Sequence
  chemically synthesized
tcctaactctattctttttg

SEQ ID NO: 559390 - DNA, 20 bp, Artificial Sequence
  chemically synthesized
aaaataggatgaactaattt

SEQ ID NO: 559391 - DNA, 20 bp, Artificial Sequence
  chemically synthesized
acaagaaagactaagtaaat

SEQ ID NO: 559392 - DNA, 20 bp, Artificial Sequence
  chemically synthesized
attaacaaatatgccacagg

SEQ ID NO: 559393 - DNA, 20 bp, Artificial Sequence
  chemically synthesized
ttcaaacctagtgacattaa

SEQ ID NO: 559394 - DNA, 20 bp, Artificial Sequence
  chemically synthesized
aggtttgaacacacctggga

SEQ ID NO: 559395 - DNA, 20 bp, Artificial Sequence
  chemically synthesized
ccaggaaagaatataaatgt

SEQ ID NO: 559396 - DNA, 20 bp, Artificial Sequence
  chemically synthesized
ttcagtaacctgctaaaacc

SEQ ID NO: 559397 - DNA, 20 bp, Artificial Sequence
  chemically synthesized
gaagaacttcagtaacctgc

SEQ ID NO: 559398 - DNA, 20 bp, Artificial Sequence
  chemically synthesized
acttggaggacaaaatatta

SEQ ID NO: 559399 - DNA, 20 bp, Artificial Sequence
  chemically synthesized
ctggtaggagttcttttcta

SEQ ID NO: 559400 - DNA, 20 bp, Artificial Sequence
  chemically synthesized
agggaactatggctgtgaag

SEQ ID NO: 559401 - DNA, 20 bp, Artificial Sequence
  chemically synthesized
tctatgaagtagcttgcaaa

SEQ ID NO: 559402 - DNA, 20 bp, Artificial Sequence
  chemically synthesized
ttttaccactctcaactttt

SEQ ID NO: 559403 - DNA, 20 bp, Artificial Sequence
  chemically synthesized
ttttaaaaagttgagagtgg

SEQ ID NO: 559404 - DNA, 20 bp, Artificial Sequence
  chemically synthesized
aaggaaaaccattaaggccg

SEQ ID NO: 559405 - DNA, 20 bp, Artificial Sequence
  chemically synthesized
gagggagttaatacataaag

SEQ ID NO: 559406 - DNA, 20 bp, Artificial Sequence
  chemically synthesized
taataggcatacagacgaac

SEQ ID NO: 559407 - DNA, 20 bp, Artificial Sequence
  chemically synthesized
tacttttccgaaatattata

SEQ ID NO: 559408 - DNA, 20 bp, Artificial Sequence
  chemically synthesized
atgtattttaaaatattatt

SEQ ID NO: 559409 - DNA, 20 bp, Artificial Sequence
  chemically synthesized
cctaggttgaatgctctgca

SEQ ID NO: 559410 - DNA, 20 bp, Artificial Sequence
  chemically synthesized
gccgatcctgacattttggg

SEQ ID NO: 559411 - DNA, 20 bp, Artificial Sequence
  chemically synthesized
cctgattttaaacgaatctt

SEQ ID NO: 559412 - DNA, 20 bp, Artificial Sequence
  chemically synthesized
tgcagagtcctaaacaacct

SEQ ID NO: 559413 - DNA, 20 bp, Artificial Sequence
  chemically synthesized
tactacagtgctacagtaac

SEQ ID NO: 559414 - DNA, 20 bp, Artificial Sequence
  chemically synthesized
aaacaacacagtactggtac

SEQ ID NO: 559415 - DNA, 20 bp, Artificial Sequence
  chemically synthesized
gctaaccgtatacagaagaa

SEQ ID NO: 559416 - DNA, 20 bp, Artificial Sequence
  chemically synthesized
aaagacttaaaatgtcaaag

SEQ ID NO: 559417 - DNA, 20 bp, Artificial Sequence
  chemically synthesized
aaatgtcaaagcaaaacttt

SEQ ID NO: 559418 - DNA, 20 bp, Artificial Sequence
  chemically synthesized
aacttaaacaaatttatttt

SEQ ID NO: 559419 - DNA, 20 bp, Artificial Sequence
  chemically synthesized
accattagagaagtgcacat

SEQ ID NO: 559420 - DNA, 20 bp, Artificial Sequence
  chemically synthesized
gatgctgttgggatggcaga

SEQ ID NO: 559421 - DNA, 20 bp, Artificial Sequence
  chemically synthesized
gaaagcagtttggcagagct

SEQ ID NO: 559422 - DNA, 20 bp, Artificial Sequence
  chemically synthesized
atatacccagaacataaaag

SEQ ID NO: 559423 - DNA, 20 bp, Artificial Sequence
  chemically synthesized
attcctgaaatttctcatac

SEQ ID NO: 559424 - DNA, 20 bp, Artificial Sequence
  chemically synthesized
atggcattaacagaggtgga

SEQ ID NO: 559425 - DNA, 20 bp, Artificial Sequence
  chemically synthesized
gacaaaaatgaaacaggaag

SEQ ID NO: 559426 - DNA, 20 bp, Artificial Sequence
  chemically synthesized
aaatcaactgagagggaagt

SEQ ID NO: 559427 - DNA, 20 bp, Artificial Sequence
  chemically synthesized
tctcagttgatttgtctaat

SEQ ID NO: 559428 - DNA, 20 bp, Artificial Sequence
  chemically synthesized
attcaagagcagaaataaat

SEQ ID NO: 559429 - DNA, 20 bp, Artificial Sequence
  chemically synthesized
gtagaagagacggaagggct

SEQ ID NO: 559430 - DNA, 20 bp, Artificial Sequence
  chemically synthesized
gtgataataaaaataaaaat

SEQ ID NO: 559431 - DNA, 20 bp, Artificial Sequence
  chemically synthesized
aacaagctagaatcaatagt

SEQ ID NO: 559432 - DNA, 20 bp, Artificial Sequence
  chemically synthesized
catacctgggaaaatacctt

SEQ ID NO: 559433 - DNA, 20 bp, Artificial Sequence
  chemically synthesized
ggagtaaaatataacagttc

SEQ ID NO: 559434 - DNA, 20 bp, Artificial Sequence
  chemically synthesized
tgtgtctttatgtatttctt

SEQ ID NO: 559435 - DNA, 20 bp, Artificial Sequence
  chemically synthesized
ctccagactgggtgaaagag

SEQ ID NO: 559436 - DNA, 20 bp, Artificial Sequence
  chemically synthesized
caaaaaaaaaaaaaaaaaaa

SEQ ID NO: 559437 - DNA, 20 bp, Artificial Sequence
  chemically synthesized
aaagcaagaaagaaggaaaa

SEQ ID NO: 559438 - DNA, 20 bp, Artificial Sequence
  chemically synthesized
gcagtaaagcaagaaagaag

SEQ ID NO: 559439 - DNA, 20 bp, Artificial Sequence
  chemically synthesized
ttgatctaaaatactagatt

SEQ ID NO: 559440 - DNA, 20 bp, Artificial Sequence
  chemically synthesized
ttcatcatacttattgcatc

SEQ ID NO: 559441 - DNA, 20 bp, Artificial Sequence
  chemically synthesized
cttattgcatctaaaacctt

SEQ ID NO: 559442 - DNA, 20 bp, Artificial Sequence
  chemically synthesized
ggagataaatatacactgat

SEQ ID NO: 559443 - DNA, 20 bp, Artificial Sequence
  chemically synthesized
ataaacctattcatcatctc

SEQ ID NO: 559444 - DNA, 20 bp, Artificial Sequence
  chemically synthesized
taattcatgctgacactatg

SEQ ID NO: 559445 - DNA, 20 bp, Artificial Sequence
  chemically synthesized
atcatcagggctatgtaaat

SEQ ID NO: 559446 - DNA, 20 bp, Artificial Sequence
  chemically synthesized
ttttctttattctcctcttt

SEQ ID NO: 559447 - DNA, 20 bp, Artificial Sequence
  chemically synthesized
aatgtacagactgtgttacc

SEQ ID NO: 559448 - DNA, 20 bp, Artificial Sequence
  chemically synthesized
ttgaaagaaatgatttaaaa

SEQ ID NO: 559449 - DNA, 20 bp, Artificial Sequence
  chemically synthesized
gttattgaagttataaaaaa

SEQ ID NO: 559450 - DNA, 20 bp, Artificial Sequence
  chemically synthesized
agctaaacacagattccaca

SEQ ID NO: 559451 - DNA, 20 bp, Artificial Sequence
  chemically synthesized
gcttagcaaaaggactgacg

SEQ ID NO: 559452 - DNA, 20 bp, Artificial Sequence
  chemically synthesized
ttatagacagatattgtcta

SEQ ID NO: 559453 - DNA, 20 bp, Artificial Sequence
  chemically synthesized
ccccgtttttaaggaaagct

SEQ ID NO: 559454 - DNA, 20 bp, Artificial Sequence
  chemically synthesized
ccatgttttaagctttcctt

SEQ ID NO: 559455 - DNA, 20 bp, Artificial Sequence
  chemically synthesized
ccttttcatatattaaaaat

SEQ ID NO: 559456 - DNA, 20 bp, Artificial Sequence
  chemically synthesized
ttctgtagaatgggaatatg

SEQ ID NO: 559457 - DNA, 20 bp, Artificial Sequence
  chemically synthesized
gactccatctcaaaaaaaga

SEQ ID NO: 559458 - DNA, 20 bp, Artificial Sequence
  chemically synthesized
atctcaaaaaaagaaaaaac

SEQ ID NO: 559459 - DNA, 20 bp, Artificial Sequence
  chemically synthesized
aaaaaagaaaaaacaaaaac

SEQ ID NO: 559460 - DNA, 20 bp, Artificial Sequence
  chemically synthesized
aaacattaggtaggtgatat

SEQ ID NO: 559461 - DNA, 20 bp, Artificial Sequence
  chemically synthesized
atagaaaataaccacaaaat

SEQ ID NO: 559462 - DNA, 20 bp, Artificial Sequence
  chemically synthesized
aaatcaagagaatcatggcc

SEQ ID NO: 559463 - DNA, 20 bp, Artificial Sequence
  chemically synthesized
agaattttttaaattgattt

SEQ ID NO: 559464 - DNA, 20 bp, Artificial Sequence
  chemically synthesized
tgaaagatacaatgttaaat

SEQ ID NO: 559465 - DNA, 20 bp, Artificial Sequence
  chemically synthesized
ttagtttttacggctttcat

SEQ ID NO: 559466 - DNA, 20 bp, Artificial Sequence
  chemically synthesized
gtggttttcatgaaagccgt

SEQ ID NO: 559467 - DNA, 20 bp, Artificial Sequence
  chemically synthesized
ttttatattttgctcacaaa

SEQ ID NO: 559468 - DNA, 20 bp, Artificial Sequence
  chemically synthesized
aggatgaggaaacgtaagtt

SEQ ID NO: 559469 - DNA, 20 bp, Artificial Sequence
  chemically synthesized
gggagaaatgttcccgtgtc

SEQ ID NO: 559470 - DNA, 20 bp, Artificial Sequence
  chemically synthesized
tattcaaaagtttatgcttt

SEQ ID NO: 559471 - DNA, 20 bp, Artificial Sequence
  chemically synthesized
gaaatgtcagggtttatacc

SEQ ID NO: 559472 - DNA, 20 bp, Artificial Sequence
  chemically synthesized
attgcaatcctttattaaca

SEQ ID NO: 559473 - DNA, 20 bp, Artificial Sequence
  chemically synthesized
gaccagcctggacaacatgg

SEQ ID NO: 559474 - DNA, 20 bp, Artificial Sequence
  chemically synthesized
actgatattcaaatagaaat

SEQ ID NO: 559475 - DNA, 20 bp, Artificial Sequence
  chemically synthesized
aaaaggaacgccttgagtag

SEQ ID NO: 559476 - DNA, 20 bp, Artificial Sequence
  chemically synthesized
tcctagaatgtgcaagacat

SEQ ID NO: 559477 - DNA, 20 bp, Artificial Sequence
  chemically synthesized
tttgctaaccttcataactt

SEQ ID NO: 559478 - DNA, 20 bp, Artificial Sequence
  chemically synthesized
atgtactcagtaagtgaata

SEQ ID NO: 559479 - DNA, 20 bp, Artificial Sequence
  chemically synthesized
aatggattatttgtcaagaa

SEQ ID NO: 559480 - DNA, 20 bp, Artificial Sequence
  chemically synthesized
cattcttaggagatagtatg

SEQ ID NO: 559481 - DNA, 20 bp, Artificial Sequence
  chemically synthesized
gtgatttttcaaatcaaaac

SEQ ID NO: 559482 - DNA, 20 bp, Artificial Sequence
  chemically synthesized
catggtgtgatttttcaaat

SEQ ID NO: 559483 - DNA, 20 bp, Artificial Sequence
  chemically synthesized
attatagcatgtgatttcac

SEQ ID NO: 559484 - DNA, 20 bp, Artificial Sequence
  chemically synthesized
agcaaattttaattgggatt

SEQ ID NO: 559485 - DNA, 20 bp, Artificial Sequence
  chemically synthesized
agtgttgcggactgagaact

SEQ ID NO: 559486 - DNA, 20 bp, Artificial Sequence
  chemically synthesized
tccttgacgtcccctaactc

SEQ ID NO: 559487 - DNA, 20 bp, Artificial Sequence
  chemically synthesized
aactctaaaaccagaagagg

SEQ ID NO: 559488 - DNA, 20 bp, Artificial Sequence
  chemically synthesized
tcagtgtcataggcatgcca

SEQ ID NO: 559489 - DNA, 20 bp, Artificial Sequence
  chemically synthesized
tttcatttttttaaaacaag

SEQ ID NO: 559490 - DNA, 20 bp, Artificial Sequence
  chemically synthesized
ttggaagattttcatttttt

SEQ ID NO: 559491 - DNA, 20 bp, Artificial Sequence
  chemically synthesized
ataaatatcttgagttgcaa

SEQ ID NO: 559492 - DNA, 20 bp, Artificial Sequence
  chemically synthesized
tcaccacgtatcaaggatag

SEQ ID NO: 559493 - DNA, 20 bp, Artificial Sequence
  chemically synthesized
atttagaaaagatggggaaa

SEQ ID NO: 559494 - DNA, 20 bp, Artificial Sequence
  chemically synthesized
acagtttcagtgatgtgctg

SEQ ID NO: 559495 - DNA, 20 bp, Artificial Sequence
  chemically synthesized
taattttcaaaaggaaatta

SEQ ID NO: 559496 - DNA, 20 bp, Artificial Sequence
  chemically synthesized
cgtacatatattacatattc

SEQ ID NO: 559497 - DNA, 20 bp, Artificial Sequence
  chemically synthesized
attattgaaagtctccaaag

SEQ ID NO: 559498 - DNA, 20 bp, Artificial Sequence
  chemically synthesized
agcatatccatttaataact

SEQ ID NO: 559499 - DNA, 20 bp, Artificial Sequence
  chemically synthesized
aaatagaagacaaatccaaa

SEQ ID NO: 559500 - DNA, 20 bp, Artificial Sequence
  chemically synthesized
aatttaaacttaaaaccact

SEQ ID NO: 559501 - DNA, 20 bp, Artificial Sequence
  chemically synthesized
aatgaagtagaatttaaact

SEQ ID NO: 559502 - DNA, 20 bp, Artificial Sequence
  chemically synthesized
aaattttgccatttcattat

SEQ ID NO: 559503 - DNA, 20 bp, Artificial Sequence
  chemically synthesized
ctacaatcaaaagtcattaa

SEQ ID NO: 559504 - DNA, 20 bp, Artificial Sequence
  chemically synthesized
cataaatttataatagcaaa

SEQ ID NO: 559505 - DNA, 20 bp, Artificial Sequence
  chemically synthesized
cttaagtaagacatctcgta

SEQ ID NO: 559506 - DNA, 20 bp, Artificial Sequence
  chemically synthesized
aggacaccatcaagtaattg

SEQ ID NO: 559507 - DNA, 20 bp, Artificial Sequence
  chemically synthesized
aaaacagactcaaaatagaa

SEQ ID NO: 559508 - DNA, 20 bp, Artificial Sequence
  chemically synthesized
aacccaatcgataatgaaaa

SEQ ID NO: 559509 - DNA, 20 bp, Artificial Sequence
  chemically synthesized
gtactgaaatggccatttca

SEQ ID NO: 559510 - DNA, 20 bp, Artificial Sequence
  chemically synthesized
ggtgaaagacaaagccctaa

SEQ ID NO: 559511 - DNA, 20 bp, Artificial Sequence
  chemically synthesized
atccacacacatatgagtga

SEQ ID NO: 559512 - DNA, 20 bp, Artificial Sequence
  chemically synthesized
atttctatcaccttttaaag

SEQ ID NO: 559513 - DNA, 20 bp, Artificial Sequence
  chemically synthesized
tttgaaggaaagtacaaata

SEQ ID NO: 559514 - DNA, 20 bp, Artificial Sequence
  chemically synthesized
tttaattcatagctgatctg

SEQ ID NO: 559515 - DNA, 20 bp, Artificial Sequence
  chemically synthesized
aatcctgatggcaacaatac

SEQ ID NO: 559516 - DNA, 20 bp, Artificial Sequence
  chemically synthesized
aaataaacaaataaacaaac

SEQ ID NO: 559517 - DNA, 20 bp, Artificial Sequence
  chemically synthesized
ctgtttaaaccagggcttgt

SEQ ID NO: 559518 - DNA, 20 bp, Artificial Sequence
  chemically synthesized
atcattttatttacaggatc

SEQ ID NO: 559519 - DNA, 20 bp, Artificial Sequence
  chemically synthesized
tttatttacaggatctaaaa

SEQ ID NO: 559520 - DNA, 20 bp, Artificial Sequence
  chemically synthesized
ggtatggccaagaaggaatc

SEQ ID NO: 559521 - DNA, 20 bp, Artificial Sequence
  chemically synthesized
caactgctgttcccttttgt

SEQ ID NO: 559522 - DNA, 20 bp, Artificial Sequence
  chemically synthesized
gaattaatcacaaaaaagaa

SEQ ID NO: 559523 - DNA, 20 bp, Artificial Sequence
  chemically synthesized
tgtgtgtttatattttttca

SEQ ID NO: 559524 - DNA, 20 bp, Artificial Sequence
  chemically synthesized
ctcttcattccttcctaagg

SEQ ID NO: 559525 - DNA, 20 bp, Artificial Sequence
  chemically synthesized
ttcagtgttgtaggaaaaaa

SEQ ID NO: 559526 - DNA, 20 bp, Artificial Sequence
  chemically synthesized
gcaaagggaagaacaaaagg

SEQ ID NO: 559527 - DNA, 20 bp, Artificial Sequence
  chemically synthesized
caaaaggcaaaactgatcac

SEQ ID NO: 559528 - DNA, 20 bp, Artificial Sequence
  chemically synthesized
taaatattatatgaaatagt

SEQ ID NO: 559529 - DNA, 20 bp, Artificial Sequence
  chemically synthesized
tatgaggcaacaataacgcg

SEQ ID NO: 559530 - DNA, 20 bp, Artificial Sequence
  chemically synthesized
gaaaagtttgttattaatac

SEQ ID NO: 559531 - DNA, 20 bp, Artificial Sequence
  chemically synthesized
gctttctgacaatgtttaaa

SEQ ID NO: 559532 - DNA, 20 bp, Artificial Sequence
  chemically synthesized
tggcactgtacatgtctcaa

SEQ ID NO: 559533 - DNA, 20 bp, Artificial Sequence
  chemically synthesized
caggtacctctttacttttg

SEQ ID NO: 559534 - DNA, 20 bp, Artificial Sequence
  chemically synthesized
aaatactgtgccaaggggca

SEQ ID NO: 559535 - DNA, 20 bp, Artificial Sequence
  chemically synthesized
ttactaaagacaattgtagt

SEQ ID NO: 559536 - DNA, 20 bp, Artificial Sequence
  chemically synthesized
ttatgtctagttgacagatt

SEQ ID NO: 559537 - DNA, 20 bp, Artificial Sequence
  chemically synthesized
taagaacatggataccagtg

SEQ ID NO: 559538 - DNA, 20 bp, Artificial Sequence
  chemically synthesized
gaaagtttcgttcgagaatt

SEQ ID NO: 559539 - DNA, 20 bp, Artificial Sequence
  chemically synthesized
aatcatgtctgaatccagac

SEQ ID NO: 559540 - DNA, 20 bp, Artificial Sequence
  chemically synthesized
catcaacattacccaaacca

SEQ ID NO: 559541 - DNA, 20 bp, Artificial Sequence
  chemically synthesized
gcgtgtggatgaaaaaaaaa

SEQ ID NO: 559542 - DNA, 20 bp, Artificial Sequence
  chemically synthesized
gaagttaagcattctataga

SEQ ID NO: 559543 - DNA, 20 bp, Artificial Sequence
  chemically synthesized
agtcaaaatgcaatttgtgt

SEQ ID NO: 559544 - DNA, 20 bp, Artificial Sequence
  chemically synthesized
aatgtccaatatagaggtaa

SEQ ID NO: 559545 - DNA, 20 bp, Artificial Sequence
  chemically synthesized
tacctctatattggacatta

SEQ ID NO: 559546 - DNA, 20 bp, Artificial Sequence
  chemically synthesized
accaagaatatatgaagtct

SEQ ID NO: 559547 - DNA, 20 bp, Artificial Sequence
  chemically synthesized
gtttctatacaaatcctcat

SEQ ID NO: 559548 - DNA, 20 bp, Artificial Sequence
  chemically synthesized
actcaaacttgttaaaaatg

SEQ ID NO: 559549 - DNA, 20 bp, Artificial Sequence
  chemically synthesized
gagtaaaaattaaaaaaaaa

SEQ ID NO: 559550 - DNA, 20 bp, Artificial Sequence
  chemically synthesized
ctttatactaaaaccctttg

SEQ ID NO: 559551 - DNA, 20 bp, Artificial Sequence
  chemically synthesized
tatatggtaaaactttatac

SEQ ID NO: 559552 - DNA, 20 bp, Artificial Sequence
  chemically synthesized
gatcagcaatcactatatgg

SEQ ID NO: 559553 - DNA, 20 bp, Artificial Sequence
  chemically synthesized
tgataaacaacctctgactt

SEQ ID NO: 559554 - DNA, 20 bp, Artificial Sequence
  chemically synthesized
cctgggttcttttatgtcaa

SEQ ID NO: 559555 - DNA, 20 bp, Artificial Sequence
  chemically synthesized
tcaggggaaaaataagttat

SEQ ID NO: 559556 - DNA, 20 bp, Artificial Sequence
  chemically synthesized
acagcacttccattttcagg

SEQ ID NO: 559557 - DNA, 20 bp, Artificial Sequence
  chemically synthesized
actgtcttgagtagcaggct

SEQ ID NO: 559558 - DNA, 20 bp, Artificial Sequence
  chemically synthesized
tttgtagctagaccaattat

SEQ ID NO: 559559 - DNA, 20 bp, Artificial Sequence
  chemically synthesized
gtctcaaatttttaaaattt

SEQ ID NO: 559560 - DNA, 20 bp, Artificial Sequence
  chemically synthesized
acttctctctctgcttatca

SEQ ID NO: 559561 - DNA, 20 bp, Artificial Sequence
  chemically synthesized
ttggggaggtcacccctgag

SEQ ID NO: 559562 - DNA, 20 bp, Artificial Sequence
  chemically synthesized
ttttattctaaatggacaag

SEQ ID NO: 559563 - DNA, 20 bp, Artificial Sequence
  chemically synthesized
ttttcttgtccatttagaat

SEQ ID NO: 559564 - DNA, 20 bp, Artificial Sequence
  chemically synthesized
taaaaactgtgatactctaa

SEQ ID NO: 559565 - DNA, 20 bp, Artificial Sequence
  chemically synthesized
gtggtaggatgctattttag

SEQ ID NO: 559566 - DNA, 20 bp, Artificial Sequence
  chemically synthesized
gcaatagcatatttatcaac

SEQ ID NO: 559567 - DNA, 20 bp, Artificial Sequence
  chemically synthesized
ataatcatttctagagtatt

SEQ ID NO: 559568 - DNA, 20 bp, Artificial Sequence
  chemically synthesized
gtataaatattatgtgtgta

SEQ ID NO: 559569 - DNA, 20 bp, Artificial Sequence
  chemically synthesized
tagcagaaagtaactcacat

SEQ ID NO: 559570 - DNA, 20 bp, Artificial Sequence
  chemically synthesized
tggagccagatacttgagtt

SEQ ID NO: 559571 - DNA, 20 bp, Artificial Sequence
  chemically synthesized
gtatgatgatataaacatga

SEQ ID NO: 559572 - DNA, 20 bp, Artificial Sequence
  chemically synthesized
aaaaaaaaagaaaaactaag

SEQ ID NO: 559573 - DNA, 20 bp, Artificial Sequence
  chemically synthesized
gaaggtaaaaaaaaaaaaag

SEQ ID NO: 559574 - DNA, 20 bp, Artificial Sequence
  chemically synthesized
cttgagagagattttgaata

SEQ ID NO: 559575 - DNA, 20 bp, Artificial Sequence
  chemically synthesized
gccttgaagggaggtttgga

SEQ ID NO: 559576 - DNA, 20 bp, Artificial Sequence
  chemically synthesized
tttctggcatagaccttcca

SEQ ID NO: 559577 - DNA, 20 bp, Artificial Sequence
  chemically synthesized
ccttccacaaaacaaacaaa

SEQ ID NO: 559578 - DNA, 20 bp, Artificial Sequence
  chemically synthesized
atgcttttctgtgaatggag

SEQ ID NO: 559579 - DNA, 20 bp, Artificial Sequence
  chemically synthesized
tcttagaatatttaaaatag

SEQ ID NO: 559580 - DNA, 20 bp, Artificial Sequence
  chemically synthesized
actctcataaattaaaaaga

SEQ ID NO: 559581 - DNA, 20 bp, Artificial Sequence
  chemically synthesized
aagaaaaaacgaaaagtgca

SEQ ID NO: 559582 - DNA, 20 bp, Artificial Sequence
  chemically synthesized
atatttccctcaacaagtat

SEQ ID NO: 559583 - DNA, 20 bp, Artificial Sequence
  chemically synthesized
ccttttagatagtaagatgg

SEQ ID NO: 559584 - DNA, 20 bp, Artificial Sequence
  chemically synthesized
ctttaaagaccaaacatctt

SEQ ID NO: 559585 - DNA, 20 bp, Artificial Sequence
  chemically synthesized
tgcaacttgcattttacacg

SEQ ID NO: 559586 - DNA, 20 bp, Artificial Sequence
  chemically synthesized
agagtctgtctgtggttata

SEQ ID NO: 559587 - DNA, 20 bp, Artificial Sequence
  chemically synthesized
ttaaagcctcacgcattttt

SEQ ID NO: 559588 - DNA, 20 bp, Artificial Sequence
  chemically synthesized
cctcacgcatttttgaaaac

SEQ ID NO: 559589 - DNA, 20 bp, Artificial Sequence
  chemically synthesized
actcattaaccagaaaaatg

SEQ ID NO: 559590 - DNA, 20 bp, Artificial Sequence
  chemically synthesized
aaccagaaaaatgcaaaact

SEQ ID NO: 559591 - DNA, 20 bp, Artificial Sequence
  chemically synthesized
gcattatatattaatactat

SEQ ID NO: 559592 - DNA, 20 bp, Artificial Sequence
  chemically synthesized
ccatgaacacttcattttac

SEQ ID NO: 559593 - DNA, 20 bp, Artificial Sequence
  chemically synthesized
tgaacctataataaacttaa

SEQ ID NO: 559594 - DNA, 20 bp, Artificial Sequence
  chemically synthesized
attcagccaagacttctagt

SEQ ID NO: 559595 - DNA, 20 bp, Artificial Sequence
  chemically synthesized
atcctggaaattttgaaggc

SEQ ID NO: 559596 - DNA, 20 bp, Artificial Sequence
  chemically synthesized
gcatattaaatctaacatgt

SEQ ID NO: 559597 - DNA, 20 bp, Artificial Sequence
  chemically synthesized
ttgttaaaaaaaaaaaaaaa

SEQ ID NO: 559598 - DNA, 20 bp, Artificial Sequence
  chemically synthesized
aacaacttacagattacatt

SEQ ID NO: 559599 - DNA, 20 bp, Artificial Sequence
  chemically synthesized
ggatattgacagtggtcagg

SEQ ID NO: 559600 - DNA, 20 bp, Artificial Sequence
  chemically synthesized
gattgcttatattttctcgg

SEQ ID NO: 559601 - DNA, 20 bp, Artificial Sequence
  chemically synthesized
tgtttttccatctttctgca

SEQ ID NO: 559602 - DNA, 20 bp, Artificial Sequence
  chemically synthesized
agttttttgcagaaagatgg

SEQ ID NO: 559603 - DNA, 20 bp, Artificial Sequence
  chemically synthesized
aacctacatatatagaatta

SEQ ID NO: 559604 - DNA, 20 bp, Artificial Sequence
  chemically synthesized
ctgtacatgtttgttagata

SEQ ID NO: 559605 - DNA, 20 bp, Artificial Sequence
  chemically synthesized
aatgtatattgtcaaataaa

SEQ ID NO: 559606 - DNA, 20 bp, Artificial Sequence
  chemically synthesized
tagggtggctattatcagaa

SEQ ID NO: 559607 - DNA, 20 bp, Artificial Sequence
  chemically synthesized
ctaaaattcaatagcaaaaa

SEQ ID NO: 559608 - DNA, 20 bp, Artificial Sequence
  chemically synthesized
gatcttaggagctcttatca

SEQ ID NO: 559609 - DNA, 20 bp, Artificial Sequence
  chemically synthesized
ctcataacagaaatatatct

SEQ ID NO: 559610 - DNA, 20 bp, Artificial Sequence
  chemically synthesized
aaaataacgattttatgata

SEQ ID NO: 559611 - DNA, 20 bp, Artificial Sequence
  chemically synthesized
atcatcaaataaatgcaaac

SEQ ID NO: 559612 - DNA, 20 bp, Artificial Sequence
  chemically synthesized
aacagcatggaggttcctca

SEQ ID NO: 559613 - DNA, 20 bp, Artificial Sequence
  chemically synthesized
caattgtccaggtagaaaaa

SEQ ID NO: 559614 - DNA, 20 bp, Artificial Sequence
  chemically synthesized
ataggaatatgcagcaaact

SEQ ID NO: 559615 - DNA, 20 bp, Artificial Sequence
  chemically synthesized
ctgccagaaaatgaagtgga

SEQ ID NO: 559616 - DNA, 20 bp, Artificial Sequence
  chemically synthesized
gctttaatttcgcctcttca

SEQ ID NO: 559617 - DNA, 20 bp, Artificial Sequence
  chemically synthesized
aatgagagtgacaggagcag

SEQ ID NO: 559618 - DNA, 20 bp, Artificial Sequence
  chemically synthesized
caccagatgccaatgtctgc

SEQ ID NO: 559619 - DNA, 20 bp, Artificial Sequence
  chemically synthesized
gaagaagaagacgatgcggt

SEQ ID NO: 559620 - DNA, 20 bp, Artificial Sequence
  chemically synthesized
attgtactcctgtaaaatgt

SEQ ID NO: 559621 - DNA, 20 bp, Artificial Sequence
  chemically synthesized
tataaaaccaacaatattac

SEQ ID NO: 559622 - DNA, 20 bp, Artificial Sequence
  chemically synthesized
tcagccaaaaaaaaaaagta

SEQ ID NO: 559623 - DNA, 20 bp, Artificial Sequence
  chemically synthesized
caatttatgtagagcaaggg

SEQ ID NO: 559624 - DNA, 20 bp, Artificial Sequence
  chemically synthesized
ttaagaacattcaacaaaca

SEQ ID NO: 559625 - DNA, 20 bp, Artificial Sequence
  chemically synthesized
ctttcacactggccttccag

SEQ ID NO: 559626 - DNA, 20 bp, Artificial Sequence
  chemically synthesized
gcatttgaaaccagggaaag

SEQ ID NO: 559627 - DNA, 20 bp, Artificial Sequence
  chemically synthesized
agaatagctgaatttcaaaa

SEQ ID NO: 559628 - DNA, 20 bp, Artificial Sequence
  chemically synthesized
actgaatcttaattgttatt

SEQ ID NO: 559629 - DNA, 20 bp, Artificial Sequence
  chemically synthesized
attgtttgagcccaggaatt

SEQ ID NO: 559630 - DNA, 20 bp, Artificial Sequence
  chemically synthesized
ttatacatttatgttctgaa

SEQ ID NO: 559631 - DNA, 20 bp, Artificial Sequence
  chemically synthesized
aattaattgtgctttaaagc

SEQ ID NO: 559632 - DNA, 20 bp, Artificial Sequence
  chemically synthesized
ccattgtcatgcagcaggaa

SEQ ID NO: 559633 - DNA, 20 bp, Artificial Sequence
  chemically synthesized
ttgagtaaatgaggaactga

SEQ ID NO: 559634 - DNA, 20 bp, Artificial Sequence
  chemically synthesized
ccaacccagctgtgacaatc

SEQ ID NO: 559635 - DNA, 20 bp, Artificial Sequence
  chemically synthesized
agcaaaatccaccccagctg

SEQ ID NO: 559636 - DNA, 20 bp, Artificial Sequence
  chemically synthesized
gcaggccattcctccttcag

SEQ ID NO: 559637 - DNA, 20 bp, Artificial Sequence
  chemically synthesized
ttatgtctaaacacaggccc

SEQ ID NO: 559638 - DNA, 20 bp, Artificial Sequence
  chemically synthesized
tgttctcgagagtaacatca

SEQ ID NO: 559639 - DNA, 20 bp, Artificial Sequence
  chemically synthesized
tctagagaaattttaagtta

SEQ ID NO: 559640 - DNA, 20 bp, Artificial Sequence
  chemically synthesized
aaatgtgtccttacagtaca

SEQ ID NO: 559641 - DNA, 20 bp, Artificial Sequence
  chemically synthesized
atcatactttttagaagtgg

SEQ ID NO: 559642 - DNA, 20 bp, Artificial Sequence
  chemically synthesized
attttcaatgtaaatttaag

SEQ ID NO: 559643 - DNA, 20 bp, Artificial Sequence
  chemically synthesized
aaaaaaaaaaaaaaaaaaca

SEQ ID NO: 559644 - DNA, 20 bp, Artificial Sequence
  chemically synthesized
tctcaaaaaaaaaaaaaaaa

SEQ ID NO: 559645 - DNA, 20 bp, Artificial Sequence
  chemically synthesized
ggcgaaaccctgtctctact

SEQ ID NO: 559646 - DNA, 20 bp, Artificial Sequence
  chemically synthesized
ggtgagaccgaggcagatat

SEQ ID NO: 559647 - DNA, 20 bp, Artificial Sequence
  chemically synthesized
tctcatcttgggaatgtttt

SEQ ID NO: 559648 - DNA, 20 bp, Artificial Sequence
  chemically synthesized
tatgattccacttgtgtttt

SEQ ID NO: 559649 - DNA, 20 bp, Artificial Sequence
  chemically synthesized
acaataaaaacttaataaga

SEQ ID NO: 559650 - DNA, 20 bp, Artificial Sequence
  chemically synthesized
ggactgataataataacaat

SEQ ID NO: 559651 - DNA, 20 bp, Artificial Sequence
  chemically synthesized
cagtcccatcaccactagat

SEQ ID NO: 559652 - DNA, 20 bp, Artificial Sequence
  chemically synthesized
ctagattaaaactcagattg

SEQ ID NO: 559653 - DNA, 20 bp, Artificial Sequence
  chemically synthesized
ttaataaaatattatggttg

SEQ ID NO: 559654 - DNA, 20 bp, Artificial Sequence
  chemically synthesized
ctagaagctaaaaatgccaa

SEQ ID NO: 559655 - DNA, 20 bp, Artificial Sequence
  chemically synthesized
agactctgtcgcaaagcctc

SEQ ID NO: 559656 - DNA, 20 bp, Artificial Sequence
  chemically synthesized
accaaagcactaagcaaacc

SEQ ID NO: 559657 - DNA, 20 bp, Artificial Sequence
  chemically synthesized
ggtttgtaaaaggtaagcac

SEQ ID NO: 559658 - DNA, 20 bp, Artificial Sequence
  chemically synthesized
aaaacgttatggtatgatgg

SEQ ID NO: 559659 - DNA, 20 bp, Artificial Sequence
  chemically synthesized
aatgctgggaaggaaatgtc

SEQ ID NO: 559660 - DNA, 20 bp, Artificial Sequence
  chemically synthesized
aataaccactcaagctaaag

SEQ ID NO: 559661 - DNA, 20 bp, Artificial Sequence
  chemically synthesized
acattctctttcaaagtctc

SEQ ID NO: 559662 - DNA, 20 bp, Artificial Sequence
  chemically synthesized
ctcctactttttataagtag

SEQ ID NO: 559663 - DNA, 20 bp, Artificial Sequence
  chemically synthesized
gtttttagtttaataatttt

SEQ ID NO: 559664 - DNA, 20 bp, Artificial Sequence
  chemically synthesized
gttttgaaaattattaaact

SEQ ID NO: 559665 - DNA, 20 bp, Artificial Sequence
  chemically synthesized
gaaaatagaaaattcattct

SEQ ID NO: 559666 - DNA, 20 bp, Artificial Sequence
  chemically synthesized
attcattctaaaaacactga

SEQ ID NO: 559667 - DNA, 20 bp, Artificial Sequence
  chemically synthesized
ttacagtgtatcgttaggga

SEQ ID NO: 559668 - DNA, 20 bp, Artificial Sequence
  chemically synthesized
agagaactttgtaaagccta

SEQ ID NO: 559669 - DNA, 20 bp, Artificial Sequence
  chemically synthesized
tcaagtacagttaatttcac

SEQ ID NO: 559670 - DNA, 20 bp, Artificial Sequence
  chemically synthesized
gaacaatgtcaaatatatct

SEQ ID NO: 559671 - DNA, 20 bp, Artificial Sequence
  chemically synthesized
ttcagtaaaattagatgcac

SEQ ID NO: 559672 - DNA, 20 bp, Artificial Sequence
  chemically synthesized
tcaggaaagtaaactctaca

SEQ ID NO: 559673 - DNA, 20 bp, Artificial Sequence
  chemically synthesized
aatattgatatatggaatag

SEQ ID NO: 559674 - DNA, 20 bp, Artificial Sequence
  chemically synthesized
taaattttataaattctcca

SEQ ID NO: 559675 - DNA, 20 bp, Artificial Sequence
  chemically synthesized
ctcatgacaaaaatggaaaa

SEQ ID NO: 559676 - DNA, 20 bp, Artificial Sequence
  chemically synthesized
cataggatactatgaaacta

SEQ ID NO: 559677 - DNA, 20 bp, Artificial Sequence
  chemically synthesized
aacttaaaaaagtaaagtaa

SEQ ID NO: 559678 - DNA, 20 bp, Artificial Sequence
  chemically synthesized
acatgggcaaatgctcacac

SEQ ID NO: 559679 - DNA, 20 bp, Artificial Sequence
  chemically synthesized
tgtcaaataattattttttc

SEQ ID NO: 559680 - DNA, 20 bp, Artificial Sequence
  chemically synthesized
aaacataatttacaggagtg

SEQ ID NO: 559681 - DNA, 20 bp, Artificial Sequence
  chemically synthesized
gaaacaatcacaaacattgt

SEQ ID NO: 559682 - DNA, 20 bp, Artificial Sequence
  chemically synthesized
ccccaaagttacaccaaaat

SEQ ID NO: 559683 - DNA, 20 bp, Artificial Sequence
  chemically synthesized
tgtgcaagaataagagtgga

SEQ ID NO: 559684 - DNA, 20 bp, Artificial Sequence
  chemically synthesized
gaatcattatgccaagcatt

SEQ ID NO: 559685 - DNA, 20 bp, Artificial Sequence
  chemically synthesized
ctttttatttctgaagacat

SEQ ID NO: 559686 - DNA, 20 bp, Artificial Sequence
  chemically synthesized
aaagaagcaaaggtggggaa

SEQ ID NO: 559687 - DNA, 20 bp, Artificial Sequence
  chemically synthesized
gtattgattttgattattag

SEQ ID NO: 559688 - DNA, 20 bp, Artificial Sequence
  chemically synthesized
tagatcatacaattgttttc

SEQ ID NO: 559689 - DNA, 20 bp, Artificial Sequence
  chemically synthesized
catatatacatgctgttttt

SEQ ID NO: 559690 - DNA, 20 bp, Artificial Sequence
  chemically synthesized
gtctgtgaatatttgaatgt

SEQ ID NO: 559691 - DNA, 20 bp, Artificial Sequence
  chemically synthesized
cgcattggtggcaaagtgtc

SEQ ID NO: 559692 - DNA, 20 bp, Artificial Sequence
  chemically synthesized
tgagtttgctgacaatttag

SEQ ID NO: 559693 - DNA, 20 bp, Artificial Sequence
  chemically synthesized
ttttctgtttcctgacctta

SEQ ID NO: 559694 - DNA, 20 bp, Artificial Sequence
  chemically synthesized
tttataaggtcaggaaacag

SEQ ID NO: 559695 - DNA, 20 bp, Artificial Sequence
  chemically synthesized
cagataagggcaggaaacag

SEQ ID NO: 559696 - DNA, 20 bp, Artificial Sequence
  chemically synthesized
ttaatcccaattgcaattga

SEQ ID NO: 559697 - DNA, 20 bp, Artificial Sequence
  chemically synthesized
acatatacacatacatactt

SEQ ID NO: 559698 - DNA, 20 bp, Artificial Sequence
  chemically synthesized
caaaaagatagagaacacag

SEQ ID NO: 559699 - DNA, 20 bp, Artificial Sequence
  chemically synthesized
aacatattatttatgtaaat

SEQ ID NO: 559700 - DNA, 20 bp, Artificial Sequence
  chemically synthesized
agtgaagtaactcaggaatg

SEQ ID NO: 559701 - DNA, 20 bp, Artificial Sequence
  chemically synthesized
atgatcagggaaatgcaaat

SEQ ID NO: 559702 - DNA, 20 bp, Artificial Sequence
  chemically synthesized
aacccaaaagcaaatgtaat

SEQ ID NO: 559703 - DNA, 20 bp, Artificial Sequence
  chemically synthesized
ttctagaagataacattgga

SEQ ID NO: 559704 - DNA, 20 bp, Artificial Sequence
  chemically synthesized
cctcatctctcacattatac

SEQ ID NO: 559705 - DNA, 20 bp, Artificial Sequence
  chemically synthesized
tgatcttcaacaaagcaaac

SEQ ID NO: 559706 - DNA, 20 bp, Artificial Sequence
  chemically synthesized
tactataaggccatagtcac

SEQ ID NO: 559707 - DNA, 20 bp, Artificial Sequence
  chemically synthesized
catagatgacacaaacaaat

SEQ ID NO: 559708 - DNA, 20 bp, Artificial Sequence
  chemically synthesized
agtcgaaagacctctccaag

SEQ ID NO: 559709 - DNA, 20 bp, Artificial Sequence
  chemically synthesized
aaataacaacaacaacaaca

SEQ ID NO: 559710 - DNA, 20 bp, Artificial Sequence
  chemically synthesized
actatatgatcatttacctt

SEQ ID NO: 559711 - DNA, 20 bp, Artificial Sequence
  chemically synthesized
ttctggtctttctgtttaat

SEQ ID NO: 559712 - DNA, 20 bp, Artificial Sequence
  chemically synthesized
tcatattggtaaactataat

SEQ ID NO: 559713 - DNA, 20 bp, Artificial Sequence
  chemically synthesized
agtttcaaatgaatttaata

SEQ ID NO: 559714 - DNA, 20 bp, Artificial Sequence
  chemically synthesized
tgttgaatatatttcactaa

SEQ ID NO: 559715 - DNA, 20 bp, Artificial Sequence
  chemically synthesized
gtttttaaacaaaaggtgca

SEQ ID NO: 559716 - DNA, 20 bp, Artificial Sequence
  chemically synthesized
gttttctgcaccttttgttt

SEQ ID NO: 559717 - DNA, 20 bp, Artificial Sequence
  chemically synthesized
ctggtgtgtctttatatata

SEQ ID NO: 559718 - DNA, 20 bp, Artificial Sequence
  chemically synthesized
tcttaatattgacagcattt

SEQ ID NO: 559719 - DNA, 20 bp, Artificial Sequence
  chemically synthesized
agaatttgttttataagtca

SEQ ID NO: 559720 - DNA, 20 bp, Artificial Sequence
  chemically synthesized
cattggagttttatgactta

SEQ ID NO: 559721 - DNA, 20 bp, Artificial Sequence
  chemically synthesized
gggaaaattcagcaaaagaa

SEQ ID NO: 559722 - DNA, 20 bp, Artificial Sequence
  chemically synthesized
tttacaatgcatacatagat

SEQ ID NO: 559723 - DNA, 20 bp, Artificial Sequence
  chemically synthesized
caaaatatatagaaacctca

SEQ ID NO: 559724 - DNA, 20 bp, Artificial Sequence
  chemically synthesized
ctcaaaaaactcaacagcaa

SEQ ID NO: 559725 - DNA, 20 bp, Artificial Sequence
  chemically synthesized
tctaaacatcagaaaaatgt

SEQ ID NO: 559726 - DNA, 20 bp, Artificial Sequence
  chemically synthesized
cctgacctcaagaatcatgg

SEQ ID NO: 559727 - DNA, 20 bp, Artificial Sequence
  chemically synthesized
agattatgtgtctactggaa

SEQ ID NO: 559728 - DNA, 20 bp, Artificial Sequence
  chemically synthesized
aggatgctgagactgggaat

SEQ ID NO: 559729 - DNA, 20 bp, Artificial Sequence
  chemically synthesized
tacccttagttgtatttttt

SEQ ID NO: 559730 - DNA, 20 bp, Artificial Sequence
  chemically synthesized
ttttgaaactttagaacagt

SEQ ID NO: 559731 - DNA, 20 bp, Artificial Sequence
  chemically synthesized
tgtcactttctccatttttg

SEQ ID NO: 559732 - DNA, 20 bp, Artificial Sequence
  chemically synthesized
aaaatacttttctagagact

SEQ ID NO: 559733 - DNA, 20 bp, Artificial Sequence
  chemically synthesized
acaacattattcataatagc

SEQ ID NO: 559734 - DNA, 20 bp, Artificial Sequence
  chemically synthesized
ttaaacttgctttttcacac

SEQ ID NO: 559735 - DNA, 20 bp, Artificial Sequence
  chemically synthesized
ctacaaacgatgattgttta

SEQ ID NO: 559736 - DNA, 20 bp, Artificial Sequence
  chemically synthesized
ttattttcctgtacaggtag

SEQ ID NO: 559737 - DNA, 20 bp, Artificial Sequence
  chemically synthesized
aggaaaataaaccccttagc

SEQ ID NO: 559738 - DNA, 20 bp, Artificial Sequence
  chemically synthesized
aacatgtgtttgtttactac

SEQ ID NO: 559739 - DNA, 20 bp, Artificial Sequence
  chemically synthesized
tatgcatgtatatagtgaat

SEQ ID NO: 559740 - DNA, 20 bp, Artificial Sequence
  chemically synthesized
tctgaaaagaatttttgtct

SEQ ID NO: 559741 - DNA, 20 bp, Artificial Sequence
  chemically synthesized
cttttattttcttctatatt

SEQ ID NO: 559742 - DNA, 20 bp, Artificial Sequence
  chemically synthesized
aaggagaagctattcccata

SEQ ID NO: 559743 - DNA, 20 bp, Artificial Sequence
  chemically synthesized
aattttgtgactttgagaaa

SEQ ID NO: 559744 - DNA, 20 bp, Artificial Sequence
  chemically synthesized
ggagaagtaatgagaccata

SEQ ID NO: 559745 - DNA, 20 bp, Artificial Sequence
  chemically synthesized
tgaaagtgtaatcagtattt

SEQ ID NO: 559746 - DNA, 20 bp, Artificial Sequence
  chemically synthesized
actttcttcacagaattgga

SEQ ID NO: 559747 - DNA, 20 bp, Artificial Sequence
  chemically synthesized
tactacaaggctacagtaac

SEQ ID NO: 559748 - DNA, 20 bp, Artificial Sequence
  chemically synthesized
aaacagcatggtactggtac

SEQ ID NO: 559749 - DNA, 20 bp, Artificial Sequence
  chemically synthesized
tgatctttgacaaacctgac

SEQ ID NO: 559750 - DNA, 20 bp, Artificial Sequence
  chemically synthesized
tatttaataaatggtgctgg

SEQ ID NO: 559751 - DNA, 20 bp, Artificial Sequence
  chemically synthesized
aaagatttaaacgttagacc

SEQ ID NO: 559752 - DNA, 20 bp, Artificial Sequence
  chemically synthesized
aacgttagacctaaaaccat

SEQ ID NO: 559753 - DNA, 20 bp, Artificial Sequence
  chemically synthesized
aaaccataaaaaccctagaa

SEQ ID NO: 559754 - DNA, 20 bp, Artificial Sequence
  chemically synthesized
atgggcaaggacttcatgtc

SEQ ID NO: 559755 - DNA, 20 bp, Artificial Sequence
  chemically synthesized
ctcaaaaaaatttacaagaa

SEQ ID NO: 559756 - DNA, 20 bp, Artificial Sequence
  chemically synthesized
ttcactggaaacaagaacat

SEQ ID NO: 559757 - DNA, 20 bp, Artificial Sequence
  chemically synthesized
acacttttaaaaagggcagt

SEQ ID NO: 559758 - DNA, 20 bp, Artificial Sequence
  chemically synthesized
atgccacttattctcattaa

SEQ ID NO: 559759 - DNA, 20 bp, Artificial Sequence
  chemically synthesized
cgtctttaatcttcacccac

SEQ ID NO: 559760 - DNA, 20 bp, Artificial Sequence
  chemically synthesized
ttatagccaagtgtgctctg

SEQ ID NO: 559761 - DNA, 20 bp, Artificial Sequence
  chemically synthesized
aaaggggactttgaaactaa

SEQ ID NO: 559762 - DNA, 20 bp, Artificial Sequence
  chemically synthesized
tctctaacccccacaatatt

SEQ ID NO: 559763 - DNA, 20 bp, Artificial Sequence
  chemically synthesized
aaatatgcgctctaatgtta

SEQ ID NO: 559764 - DNA, 20 bp, Artificial Sequence
  chemically synthesized
taaaacttctccaaataaaa

SEQ ID NO: 559765 - DNA, 20 bp, Artificial Sequence
  chemically synthesized
tccagacaatatttaatata

SEQ ID NO: 559766 - DNA, 20 bp, Artificial Sequence
  chemically synthesized
tgggagaatgagtaacaggg

SEQ ID NO: 559767 - DNA, 20 bp, Artificial Sequence
  chemically synthesized
aatgcccactctaatattcc

SEQ ID NO: 559768 - DNA, 20 bp, Artificial Sequence
  chemically synthesized
agcaaactaacacaagaaca

SEQ ID NO: 559769 - DNA, 20 bp, Artificial Sequence
  chemically synthesized
ttcaaagctattttgaagag

SEQ ID NO: 559770 - DNA, 20 bp, Artificial Sequence
  chemically synthesized
aaactgattagaggatggac

SEQ ID NO: 559771 - DNA, 20 bp, Artificial Sequence
  chemically synthesized
acatagctcatagtaacaat

SEQ ID NO: 559772 - DNA, 20 bp, Artificial Sequence
  chemically synthesized
gattatgccttcaagtgtaa

SEQ ID NO: 559773 - DNA, 20 bp, Artificial Sequence
  chemically synthesized
agatacataaggaaaatatt

SEQ ID NO: 559774 - DNA, 20 bp, Artificial Sequence
  chemically synthesized
agcagatgacaactactgct

SEQ ID NO: 559775 - DNA, 20 bp, Artificial Sequence
  chemically synthesized
atgtaaataaaatattaaat

SEQ ID NO: 559776 - DNA, 20 bp, Artificial Sequence
  chemically synthesized
tattaaataaaaacttaaat

SEQ ID NO: 559777 - DNA, 20 bp, Artificial Sequence
  chemically synthesized
atgatatgtaaaatgtatct

SEQ ID NO: 559778 - DNA, 20 bp, Artificial Sequence
  chemically synthesized
tggattttttttcctctttt

SEQ ID NO: 559779 - DNA, 20 bp, Artificial Sequence
  chemically synthesized
tgtccatggatgcgaggaag

SEQ ID NO: 559780 - DNA, 20 bp, Artificial Sequence
  chemically synthesized
ggtattactacagatgattt

SEQ ID NO: 559781 - DNA, 20 bp, Artificial Sequence
  chemically synthesized
ctgtagtaataccaaaccca

SEQ ID NO: 559782 - DNA, 20 bp, Artificial Sequence
  chemically synthesized
cttttatattctgtcattaa

SEQ ID NO: 559783 - DNA, 20 bp, Artificial Sequence
  chemically synthesized
tgtaggtacatgagggaaca

SEQ ID NO: 559784 - DNA, 20 bp, Artificial Sequence
  chemically synthesized
gggaggcatgtgcaagttag

SEQ ID NO: 559785 - DNA, 20 bp, Artificial Sequence
  chemically synthesized
ctcctcaaaatctaacgatc

SEQ ID NO: 559786 - DNA, 20 bp, Artificial Sequence
  chemically synthesized
gtttgaaaaaagtattatga

SEQ ID NO: 559787 - DNA, 20 bp, Artificial Sequence
  chemically synthesized
atgttaattttgttaaatga

SEQ ID NO: 559788 - DNA, 20 bp, Artificial Sequence
  chemically synthesized
aatgatcaacaatgactcat

SEQ ID NO: 559789 - DNA, 20 bp, Artificial Sequence
  chemically synthesized
agtcattgttgatcattaca

SEQ ID NO: 559790 - DNA, 20 bp, Artificial Sequence
  chemically synthesized
ttgcaacattttttgggggg

SEQ ID NO: 559791 - DNA, 20 bp, Artificial Sequence
  chemically synthesized
atcctcatttcatggatgag

SEQ ID NO: 559792 - DNA, 20 bp, Artificial Sequence
  chemically synthesized
gaaatgaaaaagaatattca

SEQ ID NO: 559793 - DNA, 20 bp, Artificial Sequence
  chemically synthesized
aaaggatccctggttattga

SEQ ID NO: 559794 - DNA, 20 bp, Artificial Sequence
  chemically synthesized
gattgaagttataaagaaac

SEQ ID NO: 559795 - DNA, 20 bp, Artificial Sequence
  chemically synthesized
agaaacgaaaacatttcaaa

SEQ ID NO: 559796 - DNA, 20 bp, Artificial Sequence
  chemically synthesized
gattttctaagaaagtccat

SEQ ID NO: 559797 - DNA, 20 bp, Artificial Sequence
  chemically synthesized
ataattctatggaatacata

SEQ ID NO: 559798 - DNA, 20 bp, Artificial Sequence
  chemically synthesized
atgctcagatgattgatact

SEQ ID NO: 559799 - DNA, 20 bp, Artificial Sequence
  chemically synthesized
aaatagctaacacaaaatta

SEQ ID NO: 559800 - DNA, 20 bp, Artificial Sequence
  chemically synthesized
gaagccagggtagaataaca

SEQ ID NO: 559801 - DNA, 20 bp, Artificial Sequence
  chemically synthesized
aaatgtaatatagagatatt

SEQ ID NO: 559802 - DNA, 20 bp, Artificial Sequence
  chemically synthesized
attttatgatgtttgaaaat

SEQ ID NO: 559803 - DNA, 20 bp, Artificial Sequence
  chemically synthesized
tgttgtgggaaatgagtggc

SEQ ID NO: 559804 - DNA, 20 bp, Artificial Sequence
  chemically synthesized
gaaaaatgtgcctgtcaatt

SEQ ID NO: 559805 - DNA, 20 bp, Artificial Sequence
  chemically synthesized
aaaactctcatgatcactgg

SEQ ID NO: 559806 - DNA, 20 bp, Artificial Sequence
  chemically synthesized
agtctggctcatctcaaagc

SEQ ID NO: 559807 - DNA, 20 bp, Artificial Sequence
  chemically synthesized
tattagactaaagaacatct

SEQ ID NO: 559808 - DNA, 20 bp, Artificial Sequence
  chemically synthesized
agactcttaattaacacaca

SEQ ID NO: 559809 - DNA, 20 bp, Artificial Sequence
  chemically synthesized
ccatatcaaaacatttattt

SEQ ID NO: 559810 - DNA, 20 bp, Artificial Sequence
  chemically synthesized
ttaccaaaagatgaccatat

SEQ ID NO: 559811 - DNA, 20 bp, Artificial Sequence
  chemically synthesized
gtaatttcagtattaatatg

SEQ ID NO: 559812 - DNA, 20 bp, Artificial Sequence
  chemically synthesized
attagacgtaatcctttttg

SEQ ID NO: 559813 - DNA, 20 bp, Artificial Sequence
  chemically synthesized
acgtctaatcctaaatagat

SEQ ID NO: 559814 - DNA, 20 bp, Artificial Sequence
  chemically synthesized
attttagccctaggttgtcc

SEQ ID NO: 559815 - DNA, 20 bp, Artificial Sequence
  chemically synthesized
ctgttcaaattaaaatctta

SEQ ID NO: 559816 - DNA, 20 bp, Artificial Sequence
  chemically synthesized
agaactggaacatccataag

SEQ ID NO: 559817 - DNA, 20 bp, Artificial Sequence
  chemically synthesized
gccaaattccttgcctgctt

SEQ ID NO: 559818 - DNA, 20 bp, Artificial Sequence
  chemically synthesized
aagagttgtatgcagaattt

SEQ ID NO: 559819 - DNA, 20 bp, Artificial Sequence
  chemically synthesized
aagtatcttccaattgatca

SEQ ID NO: 559820 - DNA, 20 bp, Artificial Sequence
  chemically synthesized
aaaacttgtatgtgacactg

SEQ ID NO: 559821 - DNA, 20 bp, Artificial Sequence
  chemically synthesized
aacatcacttaagtaatgca

SEQ ID NO: 559822 - DNA, 20 bp, Artificial Sequence
  chemically synthesized
tctgatgtaccatttcaggt

SEQ ID NO: 559823 - DNA, 20 bp, Artificial Sequence
  chemically synthesized
caatttgttccttgaacgac

SEQ ID NO: 559824 - DNA, 20 bp, Artificial Sequence
  chemically synthesized
gatttttaatttttggtaag

SEQ ID NO: 559825 - DNA, 20 bp, Artificial Sequence
  chemically synthesized
gactgtatttggttaaaaat

SEQ ID NO: 559826 - DNA, 20 bp, Artificial Sequence
  chemically synthesized
aaaaagctgacatgcacaac

SEQ ID NO: 559827 - DNA, 20 bp, Artificial Sequence
  chemically synthesized
tattcttgaaaaagaaagac

SEQ ID NO: 559828 - DNA, 20 bp, Artificial Sequence
  chemically synthesized
aaatgtcatatatattatta

SEQ ID NO: 559829 - DNA, 20 bp, Artificial Sequence
  chemically synthesized
ttacaaaacaggaatgacgg

SEQ ID NO: 559830 - DNA, 20 bp, Artificial Sequence
  chemically synthesized
catataattttagtgtttgg

SEQ ID NO: 559831 - DNA, 20 bp, Artificial Sequence
  chemically synthesized
taacagtcatgttatatgtg

SEQ ID NO: 559832 - DNA, 20 bp, Artificial Sequence
  chemically synthesized
aataaggttaacagaaattt

SEQ ID NO: 559833 - DNA, 20 bp, Artificial Sequence
  chemically synthesized
gcattaaaaaaagaataata

SEQ ID NO: 559834 - DNA, 20 bp, Artificial Sequence
  chemically synthesized
agaaaaagctgagaagttca

SEQ ID NO: 559835 - DNA, 20 bp, Artificial Sequence
  chemically synthesized
ttctcaacacttttgccatc

SEQ ID NO: 559836 - DNA, 20 bp, Artificial Sequence
  chemically synthesized
gaagacaagattgagtttca

SEQ ID NO: 559837 - DNA, 20 bp, Artificial Sequence
  chemically synthesized
ctataacaatgtgtatgtcc

SEQ ID NO: 559838 - DNA, 20 bp, Artificial Sequence
  chemically synthesized
actctgtctcaaagagaaac

SEQ ID NO: 559839 - DNA, 20 bp, Artificial Sequence
  chemically synthesized
tctttaaaataaatttttaa

SEQ ID NO: 559840 - DNA, 20 bp, Artificial Sequence
  chemically synthesized
tctgacttcaaggcttgata

SEQ ID NO: 559841 - DNA, 20 bp, Artificial Sequence
  chemically synthesized
tggaattaaataattgtaat

SEQ ID NO: 559842 - DNA, 20 bp, Artificial Sequence
  chemically synthesized
tggaacacagcattatggtt

SEQ ID NO: 559843 - DNA, 20 bp, Artificial Sequence
  chemically synthesized
ttatatccatgtgtatccaa

SEQ ID NO: 559844 - DNA, 20 bp, Artificial Sequence
  chemically synthesized
acagactctagagtaaaatg

SEQ ID NO: 559845 - DNA, 20 bp, Artificial Sequence
  chemically synthesized
tagagtaaaatgtaaaacta

SEQ ID NO: 559846 - DNA, 20 bp, Artificial Sequence
  chemically synthesized
tcctagcagatagcagtgga

SEQ ID NO: 559847 - DNA, 20 bp, Artificial Sequence
  chemically synthesized
tccctttggtggtgtatcta

SEQ ID NO: 559848 - DNA, 20 bp, Artificial Sequence
  chemically synthesized
cgaaatacacaaagaactct

SEQ ID NO: 559849 - DNA, 20 bp, Artificial Sequence
  chemically synthesized
aactcttaaaactcagtaac

SEQ ID NO: 559850 - DNA, 20 bp, Artificial Sequence
  chemically synthesized
agtaacaaaaacaaacaaac

SEQ ID NO: 559851 - DNA, 20 bp, Artificial Sequence
  chemically synthesized
ccaaaatccaagaacactga

SEQ ID NO: 559852 - DNA, 20 bp, Artificial Sequence
  chemically synthesized
atatgatagtctggaaaagg

SEQ ID NO: 559853 - DNA, 20 bp, Artificial Sequence
  chemically synthesized
aggtaaaactatgtaaacta

SEQ ID NO: 559854 - DNA, 20 bp, Artificial Sequence
  chemically synthesized
gtaatatataaaatactaat

SEQ ID NO: 559855 - DNA, 20 bp, Artificial Sequence
  chemically synthesized
gagataggtatttaagaaaa

SEQ ID NO: 559856 - DNA, 20 bp, Artificial Sequence
  chemically synthesized
tgctctgaagggcaacaaat

SEQ ID NO: 559857 - DNA, 20 bp, Artificial Sequence
  chemically synthesized
gagtttcttaactaattaga

SEQ ID NO: 559858 - DNA, 20 bp, Artificial Sequence
  chemically synthesized
atccctttccaattagcagg

SEQ ID NO: 559859 - DNA, 20 bp, Artificial Sequence
  chemically synthesized
ggacagataacttagatcac

SEQ ID NO: 559860 - DNA, 20 bp, Artificial Sequence
  chemically synthesized
gagaataaatgtaagtagtg

SEQ ID NO: 559861 - DNA, 20 bp, Artificial Sequence
  chemically synthesized
cagaatttgaactttatcca

SEQ ID NO: 559862 - DNA, 20 bp, Artificial Sequence
  chemically synthesized
tactttttatatcatttcac

SEQ ID NO: 559863 - DNA, 20 bp, Artificial Sequence
  chemically synthesized
ttaatattactaacagagaa

SEQ ID NO: 559864 - DNA, 20 bp, Artificial Sequence
  chemically synthesized
acaaccaccacaactacaac

SEQ ID NO: 559865 - DNA, 20 bp, Artificial Sequence
  chemically synthesized
gagaggtttgtgaaaatttt

SEQ ID NO: 559866 - DNA, 20 bp, Artificial Sequence
  chemically synthesized
gtataccattttatacaaga

SEQ ID NO: 559867 - DNA, 20 bp, Artificial Sequence
  chemically synthesized
cagggttctaatattgaatc

SEQ ID NO: 559868 - DNA, 20 bp, Artificial Sequence
  chemically synthesized
atgagacagtgaagagccca

SEQ ID NO: 559869 - DNA, 20 bp, Artificial Sequence
  chemically synthesized
ctagctccccattttactat

SEQ ID NO: 559870 - DNA, 20 bp, Artificial Sequence
  chemically synthesized
actactgatccaacctacct

SEQ ID NO: 559871 - DNA, 20 bp, Artificial Sequence
  chemically synthesized
taaaaagcacagaaaagcac

SEQ ID NO: 559872 - DNA, 20 bp, Artificial Sequence
  chemically synthesized
cacagaaaagcacaaaaacc

SEQ ID NO: 559873 - DNA, 20 bp, Artificial Sequence
  chemically synthesized
acaggtctatcttgcaaagt

SEQ ID NO: 559874 - DNA, 20 bp, Artificial Sequence
  chemically synthesized
ttgcaaagtaaaaactggtt

SEQ ID NO: 559875 - DNA, 20 bp, Artificial Sequence
  chemically synthesized
agtaaaaactggttcaaaac

SEQ ID NO: 559876 - DNA, 20 bp, Artificial Sequence
  chemically synthesized
aactggttcaaaacaaaaac

SEQ ID NO: 559877 - DNA, 20 bp, Artificial Sequence
  chemically synthesized
attctcttactcagtcccat

SEQ ID NO: 559878 - DNA, 20 bp, Artificial Sequence
  chemically synthesized
ggtgacctctgaagttggag

SEQ ID NO: 559879 - DNA, 20 bp, Artificial Sequence
  chemically synthesized
tgtttttggcctaaacaaag

SEQ ID NO: 559880 - DNA, 20 bp, Artificial Sequence
  chemically synthesized
tgttttcctttgtttaggcc

SEQ ID NO: 559881 - DNA, 20 bp, Artificial Sequence
  chemically synthesized
agtcctgttggctctaacct

SEQ ID NO: 559882 - DNA, 20 bp, Artificial Sequence
  chemically synthesized
agctttatataaagtggcca

SEQ ID NO: 559883 - DNA, 20 bp, Artificial Sequence
  chemically synthesized
accatatacaatccatgagt

SEQ ID NO: 559884 - DNA, 20 bp, Artificial Sequence
  chemically synthesized
gaagatcagagccatgaaat

SEQ ID NO: 559885 - DNA, 20 bp, Artificial Sequence
  chemically synthesized
cagatgatacccttggtctt

SEQ ID NO: 559886 - DNA, 20 bp, Artificial Sequence
  chemically synthesized
ttacaacattcagtactgat

SEQ ID NO: 559887 - DNA, 20 bp, Artificial Sequence
  chemically synthesized
tatgataaacagctctatag

SEQ ID NO: 559888 - DNA, 20 bp, Artificial Sequence
  chemically synthesized
atatgttaatagcataattt

SEQ ID NO: 559889 - DNA, 20 bp, Artificial Sequence
  chemically synthesized
aaattcctcaataagttgat

SEQ ID NO: 559890 - DNA, 20 bp, Artificial Sequence
  chemically synthesized
gttactcttcagtcaaaggg

SEQ ID NO: 559891 - DNA, 20 bp, Artificial Sequence
  chemically synthesized
gtgttaggcatggggacacc

SEQ ID NO: 559892 - DNA, 20 bp, Artificial Sequence
  chemically synthesized
aggcatggggacaccaaaaa

SEQ ID NO: 559893 - DNA, 20 bp, Artificial Sequence
  chemically synthesized
aaaaacaaaacacacacaca

SEQ ID NO: 559894 - DNA, 20 bp, Artificial Sequence
  chemically synthesized
acttccttacaacatccaat

SEQ ID NO: 559895 - DNA, 20 bp, Artificial Sequence
  chemically synthesized
ctctgccaaagcgaacatat

SEQ ID NO: 559896 - DNA, 20 bp, Artificial Sequence
  chemically synthesized
gttctctctattcccatcac

SEQ ID NO: 559897 - DNA, 20 bp, Artificial Sequence
  chemically synthesized
tctttagctcatctctttct

SEQ ID NO: 559898 - DNA, 20 bp, Artificial Sequence
  chemically synthesized
gaagaatatcaatattaaag

SEQ ID NO: 559899 - DNA, 20 bp, Artificial Sequence
  chemically synthesized
gaggacacgttctaaaagat

SEQ ID NO: 559900 - DNA, 20 bp, Artificial Sequence
  chemically synthesized
gcactaacaacatattttaa

SEQ ID NO: 559901 - DNA, 20 bp, Artificial Sequence
  chemically synthesized
cccgtctctactaaaaatac

SEQ ID NO: 559902 - DNA, 20 bp, Artificial Sequence
  chemically synthesized
tggaaaccaattttaccctc

SEQ ID NO: 559903 - DNA, 20 bp, Artificial Sequence
  chemically synthesized
cattttgttaattatatgaa

SEQ ID NO: 559904 - DNA, 20 bp, Artificial Sequence
  chemically synthesized
aggggactcacaaggtatca

SEQ ID NO: 559905 - DNA, 20 bp, Artificial Sequence
  chemically synthesized
aggtatcagaaaaccagtta

SEQ ID NO: 559906 - DNA, 20 bp, Artificial Sequence
  chemically synthesized
tttcaagaaatgggaaatat

SEQ ID NO: 559907 - DNA, 20 bp, Artificial Sequence
  chemically synthesized
tttttcaacttcaacaatta

SEQ ID NO: 559908 - DNA, 20 bp, Artificial Sequence
  chemically synthesized
aacactttatattaaattaa

SEQ ID NO: 559909 - DNA, 20 bp, Artificial Sequence
  chemically synthesized
tctgacatgcaagcacttct

SEQ ID NO: 559910 - DNA, 20 bp, Artificial Sequence
  chemically synthesized
atggacagatcaagtttcct

SEQ ID NO: 559911 - DNA, 20 bp, Artificial Sequence
  chemically synthesized
cacaccaaaatgtagtggct

SEQ ID NO: 559912 - DNA, 20 bp, Artificial Sequence
  chemically synthesized
acattgcaattcaattgact

SEQ ID NO: 559913 - DNA, 20 bp, Artificial Sequence
  chemically synthesized
gtttatatgattcaaagtcc

SEQ ID NO: 559914 - DNA, 20 bp, Artificial Sequence
  chemically synthesized
atggaacacaaagcccttag

SEQ ID NO: 559915 - DNA, 20 bp, Artificial Sequence
  chemically synthesized
tatttatcatcataatgtct

SEQ ID NO: 559916 - DNA, 20 bp, Artificial Sequence
  chemically synthesized
taagtctctacaggaactat

SEQ ID NO: 559917 - DNA, 20 bp, Artificial Sequence
  chemically synthesized
tactctactatctctcacca

SEQ ID NO: 559918 - DNA, 20 bp, Artificial Sequence
  chemically synthesized
ttttgttacagcaaaccaac

SEQ ID NO: 559919 - DNA, 20 bp, Artificial Sequence
  chemically synthesized
actttgaaatatacggtagt

SEQ ID NO: 559920 - DNA, 20 bp, Artificial Sequence
  chemically synthesized
gattatgttaccttcattcg

SEQ ID NO: 559921 - DNA, 20 bp, Artificial Sequence
  chemically synthesized
gactcttccataaatatttt

SEQ ID NO: 559922 - DNA, 20 bp, Artificial Sequence
  chemically synthesized
ttgcacactgtaggggctca

SEQ ID NO: 559923 - DNA, 20 bp, Artificial Sequence
  chemically synthesized
gaaggcctcaaaagcagcct

SEQ ID NO: 559924 - DNA, 20 bp, Artificial Sequence
  chemically synthesized
caaggtaggtcatagaaacc

SEQ ID NO: 559925 - DNA, 20 bp, Artificial Sequence
  chemically synthesized
tctttatcaactctaagcat

SEQ ID NO: 559926 - DNA, 20 bp, Artificial Sequence
  chemically synthesized
gaagacccaatgacccaaag

SEQ ID NO: 559927 - DNA, 20 bp, Artificial Sequence
  chemically synthesized
ttgaaggctcccatgtcacc

SEQ ID NO: 559928 - DNA, 20 bp, Artificial Sequence
  chemically synthesized
aaattatttactttcaaact

SEQ ID NO: 559929 - DNA, 20 bp, Artificial Sequence
  chemically synthesized
caaaattgtatgtttccttt

SEQ ID NO: 559930 - DNA, 20 bp, Artificial Sequence
  chemically synthesized
tctttttaagaggataatca

SEQ ID NO: 559931 - DNA, 20 bp, Artificial Sequence
  chemically synthesized
ttttaaaaatctgtacatca

SEQ ID NO: 559932 - DNA, 20 bp, Artificial Sequence
  chemically synthesized
aataggttattttccttaga

SEQ ID NO: 559933 - DNA, 20 bp, Artificial Sequence
  chemically synthesized
aacatctctgatttccttgc

SEQ ID NO: 559934 - DNA, 20 bp, Artificial Sequence
  chemically synthesized
cactggcagaatattggaga

SEQ ID NO: 559935 - DNA, 20 bp, Artificial Sequence
  chemically synthesized
attgaaaatgtcactgaacc

SEQ ID NO: 559936 - DNA, 20 bp, Artificial Sequence
  chemically synthesized
ctagtagcagtgaaatacat

SEQ ID NO: 559937 - DNA, 20 bp, Artificial Sequence
  chemically synthesized
tgcaactcagttaccttctt

SEQ ID NO: 559938 - DNA, 20 bp, Artificial Sequence
  chemically synthesized
ccttctttaaaaccctcaag

SEQ ID NO: 559939 - DNA, 20 bp, Artificial Sequence
  chemically synthesized
ccccactttaacaactcaca

SEQ ID NO: 559940 - DNA, 20 bp, Artificial Sequence
  chemically synthesized
tctattcttcaagtatatct

SEQ ID NO: 559941 - DNA, 20 bp, Artificial Sequence
  chemically synthesized
tcatcagaaacccctgaaat

SEQ ID NO: 559942 - DNA, 20 bp, Artificial Sequence
  chemically synthesized
tttaaaataaattcaaaggc

SEQ ID NO: 559943 - DNA, 20 bp, Artificial Sequence
  chemically synthesized
caattttgaattgtcaatag

SEQ ID NO: 559944 - DNA, 20 bp, Artificial Sequence
  chemically synthesized
cttagcatgtagaatttcat

SEQ ID NO: 559945 - DNA, 20 bp, Artificial Sequence
  chemically synthesized
agttttgttcctattaatgt

SEQ ID NO: 559946 - DNA, 20 bp, Artificial Sequence
  chemically synthesized
agttttaacattaataggaa

SEQ ID NO: 559947 - DNA, 20 bp, Artificial Sequence
  chemically synthesized
taaaatgtcttctcacttcg

SEQ ID NO: 559948 - DNA, 20 bp, Artificial Sequence
  chemically synthesized
agtagagagaggttgatcaa

SEQ ID NO: 559949 - DNA, 20 bp, Artificial Sequence
  chemically synthesized
cctttcaactttccttctgg

SEQ ID NO: 559950 - DNA, 20 bp, Artificial Sequence
  chemically synthesized
gaaatcctatttaaccaaaa

SEQ ID NO: 559951 - DNA, 20 bp, Artificial Sequence
  chemically synthesized
gaaagataaaaattagggat

SEQ ID NO: 559952 - DNA, 20 bp, Artificial Sequence
  chemically synthesized
tatcaaactggtcctgaagt

SEQ ID NO: 559953 - DNA, 20 bp, Artificial Sequence
  chemically synthesized
taaaagcttcatctacatga

SEQ ID NO: 559954 - DNA, 20 bp, Artificial Sequence
  chemically synthesized
tcatgcctccctaaaatgtg

SEQ ID NO: 559955 - DNA, 20 bp, Artificial Sequence
  chemically synthesized
tcagtttttgtatcttgggt

SEQ ID NO: 559956 - DNA, 20 bp, Artificial Sequence
  chemically synthesized
gaggttttgacccaagatac

SEQ ID NO: 559957 - DNA, 20 bp, Artificial Sequence
  chemically synthesized
tgtgcttaaaattacacata

SEQ ID NO: 559958 - DNA, 20 bp, Artificial Sequence
  chemically synthesized
catttttggcattaatagct

SEQ ID NO: 559959 - DNA, 20 bp, Artificial Sequence
  chemically synthesized
gttgattgcagtgaagagaa

SEQ ID NO: 559960 - DNA, 20 bp, Artificial Sequence
  chemically synthesized
tattgcttctctgcacaaag

SEQ ID NO: 559961 - DNA, 20 bp, Artificial Sequence
  chemically synthesized
ttctctcaaagatatttaaa

SEQ ID NO: 559962 - DNA, 20 bp, Artificial Sequence
  chemically synthesized
gttataaagccaaggagtgt

SEQ ID NO: 559963 - DNA, 20 bp, Artificial Sequence
  chemically synthesized
gagtgtgaaaacacgtgggc

SEQ ID NO: 559964 - DNA, 20 bp, Artificial Sequence
  chemically synthesized
tattttcgttatgcagataa

SEQ ID NO: 559965 - DNA, 20 bp, Artificial Sequence
  chemically synthesized
attttatatttctgtgtaag

SEQ ID NO: 559966 - DNA, 20 bp, Artificial Sequence
  chemically synthesized
aaatcaatgaacttgggaag

SEQ ID NO: 559967 - DNA, 20 bp, Artificial Sequence
  chemically synthesized
aatgaaagtttggcatttta

SEQ ID NO: 559968 - DNA, 20 bp, Artificial Sequence
  chemically synthesized
aggtcacaggctttcaaaaa

SEQ ID NO: 559969 - DNA, 20 bp, Artificial Sequence
  chemically synthesized
ataatccaagatagcgtagt

SEQ ID NO: 559970 - DNA, 20 bp, Artificial Sequence
  chemically synthesized
ttggcaaagagtgacaataa

SEQ ID NO: 559971 - DNA, 20 bp, Artificial Sequence
  chemically synthesized
atcagtcattaagaagacac

SEQ ID NO: 559972 - DNA, 20 bp, Artificial Sequence
  chemically synthesized
acaattggaataacaagaat

SEQ ID NO: 559973 - DNA, 20 bp, Artificial Sequence
  chemically synthesized
gtgtatcataaaatttattt

SEQ ID NO: 559974 - DNA, 20 bp, Artificial Sequence
  chemically synthesized
aaaataaattttatgataca

SEQ ID NO: 559975 - DNA, 20 bp, Artificial Sequence
  chemically synthesized
ttactctctggccctttaga

SEQ ID NO: 559976 - DNA, 20 bp, Artificial Sequence
  chemically synthesized
ggggaaagcctgtatgcgaa

SEQ ID NO: 559977 - DNA, 20 bp, Artificial Sequence
  chemically synthesized
ggaagtgaacttttcttcct

SEQ ID NO: 559978 - DNA, 20 bp, Artificial Sequence
  chemically synthesized
taatggattgctatggtatg

SEQ ID NO: 559979 - DNA, 20 bp, Artificial Sequence
  chemically synthesized
gtgaataggaaaattagcat

SEQ ID NO: 559980 - DNA, 20 bp, Artificial Sequence
  chemically synthesized
gcatcactatgaactttagt

SEQ ID NO: 559981 - DNA, 20 bp, Artificial Sequence
  chemically synthesized
tatgtaagtgctagctgact

SEQ ID NO: 559982 - DNA, 20 bp, Artificial Sequence
  chemically synthesized
ttgaagaacgtttacattta

SEQ ID NO: 559983 - DNA, 20 bp, Artificial Sequence
  chemically synthesized
gagggagctagctatccaga

SEQ ID NO: 559984 - DNA, 20 bp, Artificial Sequence
  chemically synthesized
aattggctaagcaggtagta

SEQ ID NO: 559985 - DNA, 20 bp, Artificial Sequence
  chemically synthesized
ttttgtgcgagtcttgtcag

SEQ ID NO: 559986 - DNA, 20 bp, Artificial Sequence
  chemically synthesized
tttttctgacaagactcgca

SEQ ID NO: 559987 - DNA, 20 bp, Artificial Sequence
  chemically synthesized
agcctttttaacacttctat

SEQ ID NO: 559988 - DNA, 20 bp, Artificial Sequence
  chemically synthesized
caaaaaaaaaaaaaaaaaaa

SEQ ID NO: 559989 - DNA, 20 bp, Artificial Sequence
  chemically synthesized
taaagagaatcttaggcaga

SEQ ID NO: 559990 - DNA, 20 bp, Artificial Sequence
  chemically synthesized
cagttgatttatactctggt

SEQ ID NO: 559991 - DNA, 20 bp, Artificial Sequence
  chemically synthesized
gggcaggggaataatctaat

SEQ ID NO: 559992 - DNA, 20 bp, Artificial Sequence
  chemically synthesized
cttgctgccttcactctagt

SEQ ID NO: 559993 - DNA, 20 bp, Artificial Sequence
  chemically synthesized
gagttatacgatctaaactc

SEQ ID NO: 559994 - DNA, 20 bp, Artificial Sequence
  chemically synthesized
agggaagatatactctgaaa

SEQ ID NO: 559995 - DNA, 20 bp, Artificial Sequence
  chemically synthesized
atagttcaggtcttctgatt

SEQ ID NO: 559996 - DNA, 20 bp, Artificial Sequence
  chemically synthesized
agtaccattttcttcactca

SEQ ID NO: 559997 - DNA, 20 bp, Artificial Sequence
  chemically synthesized
tcgctcggttaaggtggggc

SEQ ID NO: 559998 - DNA, 20 bp, Artificial Sequence
  chemically synthesized
tgaaattccttctcctggct

SEQ ID NO: 559999 - DNA, 20 bp, Artificial Sequence
  chemically synthesized
cactacccacccaaatccta

SEQ ID NO: 560000 - DNA, 20 bp, Artificial Sequence
  chemically synthesized
attcacattactatattctt

SEQ ID NO: 560001 - DNA, 20 bp, Artificial Sequence
  chemically synthesized
attggcacagcccatagaaa

SEQ ID NO: 560002 - DNA, 20 bp, Artificial Sequence
  chemically synthesized
ctgaagttataatcaatatc

SEQ ID NO: 560003 - DNA, 20 bp, Artificial Sequence
  chemically synthesized
agttttgtgagactcatgcc

SEQ ID NO: 560004 - DNA, 20 bp, Artificial Sequence
  chemically synthesized
tgttttaggcatgagtctca

SEQ ID NO: 560005 - DNA, 20 bp, Artificial Sequence
  chemically synthesized
aaaagaaaatcaaacaaaca

SEQ ID NO: 560006 - DNA, 20 bp, Artificial Sequence
  chemically synthesized
gtctgcttaccctggaggga

SEQ ID NO: 560007 - DNA, 20 bp, Artificial Sequence
  chemically synthesized
tattaagatggcattcactt

SEQ ID NO: 560008 - DNA, 20 bp, Artificial Sequence
  chemically synthesized
gtaaggaactcagcctaggg

SEQ ID NO: 560009 - DNA, 20 bp, Artificial Sequence
  chemically synthesized
ttagggtatccttatttacc

SEQ ID NO: 560010 - DNA, 20 bp, Artificial Sequence
  chemically synthesized
ttgctacaatggaatctaag

SEQ ID NO: 560011 - DNA, 20 bp, Artificial Sequence
  chemically synthesized
taaaatttctcattgcccgt

SEQ ID NO: 560012 - DNA, 20 bp, Artificial Sequence
  chemically synthesized
agtggcatgaaggcatacaa

SEQ ID NO: 560013 - DNA, 20 bp, Artificial Sequence
  chemically synthesized
aaatccagatacctccaaaa

SEQ ID NO: 560014 - DNA, 20 bp, Artificial Sequence
  chemically synthesized
gtaaattctgttttgaagag

SEQ ID NO: 560015 - DNA, 20 bp, Artificial Sequence
  chemically synthesized
taccttcctgttttcctctt

SEQ ID NO: 560016 - DNA, 20 bp, Artificial Sequence
  chemically synthesized
attccagtattctcacttta

SEQ ID NO: 560017 - DNA, 20 bp, Artificial Sequence
  chemically synthesized
tgcgctcataagctagtaat

SEQ ID NO: 560018 - DNA, 20 bp, Artificial Sequence
  chemically synthesized
tgggaggcaggtgaggatgg

SEQ ID NO: 560019 - DNA, 20 bp, Artificial Sequence
  chemically synthesized
taggaataaggcagaaggaa

SEQ ID NO: 560020 - DNA, 20 bp, Artificial Sequence
  chemically synthesized
ggaagaggacatcatttaaa

SEQ ID NO: 560021 - DNA, 20 bp, Artificial Sequence
  chemically synthesized
tagtgggcttcagatgatac

SEQ ID NO: 560022 - DNA, 20 bp, Artificial Sequence
  chemically synthesized
gatttgaactgaggtagcta

SEQ ID NO: 560023 - DNA, 20 bp, Artificial Sequence
  chemically synthesized
aggcacatacaaaaattgcc

SEQ ID NO: 560024 - DNA, 20 bp, Artificial Sequence
  chemically synthesized
accactagccactctttcct

SEQ ID NO: 560025 - DNA, 20 bp, Artificial Sequence
  chemically synthesized
tgagtttggctgtgttccac

SEQ ID NO: 560026 - DNA, 20 bp, Artificial Sequence
  chemically synthesized
ttgattattttcaaccattt

SEQ ID NO: 560027 - DNA, 20 bp, Artificial Sequence
  chemically synthesized
tttcaaccatttgaaaacgt

SEQ ID NO: 560028 - DNA, 20 bp, Artificial Sequence
  chemically synthesized
tttctaaacatatgctgctt

SEQ ID NO: 560029 - DNA, 20 bp, Artificial Sequence
  chemically synthesized
gaaaaaaaagacatttaatg

SEQ ID NO: 560030 - DNA, 20 bp, Artificial Sequence
  chemically synthesized
tagtttcttctttcacccca

SEQ ID NO: 560031 - DNA, 20 bp, Artificial Sequence
  chemically synthesized
aaaaattatgaagtacattt

SEQ ID NO: 560032 - DNA, 20 bp, Artificial Sequence
  chemically synthesized
tctggaaatattgctgaagt

SEQ ID NO: 560033 - DNA, 20 bp, Artificial Sequence
  chemically synthesized
tgaagtgaaaacaccaccaa

SEQ ID NO: 560034 - DNA, 20 bp, Artificial Sequence
  chemically synthesized
ttatctgcaaatgaagtgga

SEQ ID NO: 560035 - DNA, 20 bp, Artificial Sequence
  chemically synthesized
tgaaccaaacttaagtcaga

SEQ ID NO: 560036 - DNA, 20 bp, Artificial Sequence
  chemically synthesized
tgaatgttattcaaatgcta

SEQ ID NO: 560037 - DNA, 20 bp, Artificial Sequence
  chemically synthesized
tatggagatcctagagaaga

SEQ ID NO: 560038 - DNA, 20 bp, Artificial Sequence
  chemically synthesized
attttctttttgactagaaa

SEQ ID NO: 560039 - DNA, 20 bp, Artificial Sequence
  chemically synthesized
aatgctcttggaatcctact

SEQ ID NO: 560040 - DNA, 20 bp, Artificial Sequence
  chemically synthesized
tgaatattttttaaccatga

SEQ ID NO: 560041 - DNA, 20 bp, Artificial Sequence
  chemically synthesized
aattatcttgggatcctact

SEQ ID NO: 560042 - DNA, 20 bp, Artificial Sequence
  chemically synthesized
ccttcgggatggagaaataa

SEQ ID NO: 560043 - DNA, 20 bp, Artificial Sequence
  chemically synthesized
aacaaattaataatcactct

SEQ ID NO: 560044 - DNA, 20 bp, Artificial Sequence
  chemically synthesized
tacttcatacaatcagaata

SEQ ID NO: 560045 - DNA, 20 bp, Artificial Sequence
  chemically synthesized
tgattaagacttcctcttgt

SEQ ID NO: 560046 - DNA, 20 bp, Artificial Sequence
  chemically synthesized
ctctgctttcattcagaact

SEQ ID NO: 560047 - DNA, 20 bp, Artificial Sequence
  chemically synthesized
atataacttgattcgtcatc

SEQ ID NO: 560048 - DNA, 20 bp, Artificial Sequence
  chemically synthesized
catagtcaatcaaagaattc

SEQ ID NO: 560049 - DNA, 20 bp, Artificial Sequence
  chemically synthesized
attttctctttaaatgttat

SEQ ID NO: 560050 - DNA, 20 bp, Artificial Sequence
  chemically synthesized
caaatattttaatgtcattg

SEQ ID NO: 560051 - DNA, 20 bp, Artificial Sequence
  chemically synthesized
atttaaaacaaacagtttgg

SEQ ID NO: 560052 - DNA, 20 bp, Artificial Sequence
  chemically synthesized
ataaatagaaatgatagatt

SEQ ID NO: 560053 - DNA, 20 bp, Artificial Sequence
  chemically synthesized
actcaatgcattagaatgag

SEQ ID NO: 560054 - DNA, 20 bp, Artificial Sequence
  chemically synthesized
aatgtttaatatggcagagt

SEQ ID NO: 560055 - DNA, 20 bp, Artificial Sequence
  chemically synthesized
agacagtggaagcagagctt

SEQ ID NO: 560056 - DNA, 20 bp, Artificial Sequence
  chemically synthesized
ttgtgggcccagtgcaaact

SEQ ID NO: 560057 - DNA, 20 bp, Artificial Sequence
  chemically synthesized
atattatatcatttaattct

SEQ ID NO: 560058 - DNA, 20 bp, Artificial Sequence
  chemically synthesized
gttattttgataggcctggg

SEQ ID NO: 560059 - DNA, 20 bp, Artificial Sequence
  chemically synthesized
atgatatagagagttgggca

SEQ ID NO: 560060 - DNA, 20 bp, Artificial Sequence
  chemically synthesized
caatctttagaaaatttttt

SEQ ID NO: 560061 - DNA, 20 bp, Artificial Sequence
  chemically synthesized
tcaatgttaagcaaattgct

SEQ ID NO: 560062 - DNA, 20 bp, Artificial Sequence
  chemically synthesized
gttagaaggatctctaatta

SEQ ID NO: 560063 - DNA, 20 bp, Artificial Sequence
  chemically synthesized
attgaccccacagaaataga

SEQ ID NO: 560064 - DNA, 20 bp, Artificial Sequence
  chemically synthesized
acccctatgcacacaagcta

SEQ ID NO: 560065 - DNA, 20 bp, Artificial Sequence
  chemically synthesized
gggaagcattgtcctgatac

SEQ ID NO: 560066 - DNA, 20 bp, Artificial Sequence
  chemically synthesized
gacacacaacaaccaaaaaa

SEQ ID NO: 560067 - DNA, 20 bp, Artificial Sequence
  chemically synthesized
cataaacagaacaaaaaatc

SEQ ID NO: 560068 - DNA, 20 bp, Artificial Sequence
  chemically synthesized
aagccagaagcattgtgctt

SEQ ID NO: 560069 - DNA, 20 bp, Artificial Sequence
  chemically synthesized
ttaattcaatgctattccca

SEQ ID NO: 560070 - DNA, 20 bp, Artificial Sequence
  chemically synthesized
tactacaaggatatagtaac

SEQ ID NO: 560071 - DNA, 20 bp, Artificial Sequence
  chemically synthesized
aaccaaaacagcatggtaca

SEQ ID NO: 560072 - DNA, 20 bp, Artificial Sequence
  chemically synthesized
tgttcttcaatgaaatcaac

SEQ ID NO: 560073 - DNA, 20 bp, Artificial Sequence
  chemically synthesized
gtggattaaagacttaaatc

SEQ ID NO: 560074 - DNA, 20 bp, Artificial Sequence
  chemically synthesized
aatctaaaaccaacaactat

SEQ ID NO: 560075 - DNA, 20 bp, Artificial Sequence
  chemically synthesized
gacttcataacaaagacacc

SEQ ID NO: 560076 - DNA, 20 bp, Artificial Sequence
  chemically synthesized
acaccaaaaacaattgaaac

SEQ ID NO: 560077 - DNA, 20 bp, Artificial Sequence
  chemically synthesized
ttgaaacaaaaacaaaaatt

SEQ ID NO: 560078 - DNA, 20 bp, Artificial Sequence
  chemically synthesized
aggaacttaaatttacaagc

SEQ ID NO: 560079 - DNA, 20 bp, Artificial Sequence
  chemically synthesized
cagaaaaagacatacataca

SEQ ID NO: 560080 - DNA, 20 bp, Artificial Sequence
  chemically synthesized
atcattagagaagtgcagat

SEQ ID NO: 560081 - DNA, 20 bp, Artificial Sequence
  chemically synthesized
ttggtgatttcccaaacaac

SEQ ID NO: 560082 - DNA, 20 bp, Artificial Sequence
  chemically synthesized
tattgtgaataatgcttcaa

SEQ ID NO: 560083 - DNA, 20 bp, Artificial Sequence
  chemically synthesized
aagaggagggtgaggattaa

SEQ ID NO: 560084 - DNA, 20 bp, Artificial Sequence
  chemically synthesized
cagcctaacatctcaaataa

SEQ ID NO: 560085 - DNA, 20 bp, Artificial Sequence
  chemically synthesized
ctgaaggagataaagacatg

SEQ ID NO: 560086 - DNA, 20 bp, Artificial Sequence
  chemically synthesized
aagacatgaaaaaccctcca

SEQ ID NO: 560087 - DNA, 20 bp, Artificial Sequence
  chemically synthesized
ttttatttttatttttttcc

SEQ ID NO: 560088 - DNA, 20 bp, Artificial Sequence
  chemically synthesized
acctctatgcacataaacta

SEQ ID NO: 560089 - DNA, 20 bp, Artificial Sequence
  chemically synthesized
ggtcagcatcaccctgatgc

SEQ ID NO: 560090 - DNA, 20 bp, Artificial Sequence
  chemically synthesized
acataaacagaactaaagac

SEQ ID NO: 560091 - DNA, 20 bp, Artificial Sequence
  chemically synthesized
aagctagaagcattccccct

SEQ ID NO: 560092 - DNA, 20 bp, Artificial Sequence
  chemically synthesized
atgacatgaacctatatcca

SEQ ID NO: 560093 - DNA, 20 bp, Artificial Sequence
  chemically synthesized
ctgatcttcgacaaacctga

SEQ ID NO: 560094 - DNA, 20 bp, Artificial Sequence
  chemically synthesized
atggattaaagacttaaatg

SEQ ID NO: 560095 - DNA, 20 bp, Artificial Sequence
  chemically synthesized
aatgcaaaaccccaaacaat

SEQ ID NO: 560096 - DNA, 20 bp, Artificial Sequence
  chemically synthesized
aaacaataaaaaccttagaa

SEQ ID NO: 560097 - DNA, 20 bp, Artificial Sequence
  chemically synthesized
aaagcaactgcaacaaaagc

SEQ ID NO: 560098 - DNA, 20 bp, Artificial Sequence
  chemically synthesized
attgtcagatggatagatgg

SEQ ID NO: 560099 - DNA, 20 bp, Artificial Sequence
  chemically synthesized
cttaaacaaatttacaagaa

SEQ ID NO: 560100 - DNA, 20 bp, Artificial Sequence
  chemically synthesized
aagaagacatacatgtgacc

SEQ ID NO: 560101 - DNA, 20 bp, Artificial Sequence
  chemically synthesized
tgacctaaaacgatatgaaa

SEQ ID NO: 560102 - DNA, 20 bp, Artificial Sequence
  chemically synthesized
atcatgagagaaatgcacat

SEQ ID NO: 560103 - DNA, 20 bp, Artificial Sequence
  chemically synthesized
tctcaaagacttagaggcag

SEQ ID NO: 560104 - DNA, 20 bp, Artificial Sequence
  chemically synthesized
tttgaataagataatcaatt

SEQ ID NO: 560105 - DNA, 20 bp, Artificial Sequence
  chemically synthesized
atcttattcaaaagatctag

SEQ ID NO: 560106 - DNA, 20 bp, Artificial Sequence
  chemically synthesized
agtgaccttgttgaggcaga

SEQ ID NO: 560107 - DNA, 20 bp, Artificial Sequence
  chemically synthesized
tgcaattcctccatgcccat

SEQ ID NO: 560108 - DNA, 20 bp, Artificial Sequence
  chemically synthesized
ggaattgcacttctgcagtt

SEQ ID NO: 560109 - DNA, 20 bp, Artificial Sequence
  chemically synthesized
aataattgatagccatgctt

SEQ ID NO: 560110 - DNA, 20 bp, Artificial Sequence
  chemically synthesized
aattaagaaggtttattctg

SEQ ID NO: 560111 - DNA, 20 bp, Artificial Sequence
  chemically synthesized
cagacaatgcatttacaagg

SEQ ID NO: 560112 - DNA, 20 bp, Artificial Sequence
  chemically synthesized
tcaacttcaaatttttctaa

SEQ ID NO: 560113 - DNA, 20 bp, Artificial Sequence
  chemically synthesized
ctttaacctgaggaattacc

SEQ ID NO: 560114 - DNA, 20 bp, Artificial Sequence
  chemically synthesized
actcctatcaaatagtaata

SEQ ID NO: 560115 - DNA, 20 bp, Artificial Sequence
  chemically synthesized
caagcacctgatgggagatt

SEQ ID NO: 560116 - DNA, 20 bp, Artificial Sequence
  chemically synthesized
tttattctactaaaaatcca

SEQ ID NO: 560117 - DNA, 20 bp, Artificial Sequence
  chemically synthesized
actaaaaatccacaaaacta

SEQ ID NO: 560118 - DNA, 20 bp, Artificial Sequence
  chemically synthesized
agcaaactaatgcgggaaca

SEQ ID NO: 560119 - DNA, 20 bp, Artificial Sequence
  chemically synthesized
aaacaagctaacaaccacga

SEQ ID NO: 560120 - DNA, 20 bp, Artificial Sequence
  chemically synthesized
aaagaataaaaatgaatgta

SEQ ID NO: 560121 - DNA, 20 bp, Artificial Sequence
  chemically synthesized
tcagggccaaggcaattaga

SEQ ID NO: 560122 - DNA, 20 bp, Artificial Sequence
  chemically synthesized
taccctggattgacttcttt

SEQ ID NO: 560123 - DNA, 20 bp, Artificial Sequence
  chemically synthesized
gcagttgcatggcaagagat

SEQ ID NO: 560124 - DNA, 20 bp, Artificial Sequence
  chemically synthesized
agcaaagttctcataatggt

SEQ ID NO: 560125 - DNA, 20 bp, Artificial Sequence
  chemically synthesized
ttctaccttcctgtgagctc

SEQ ID NO: 560126 - DNA, 20 bp, Artificial Sequence
  chemically synthesized
tttttggaaaggcaatgaga

SEQ ID NO: 560127 - DNA, 20 bp, Artificial Sequence
  chemically synthesized
aactgaaacataagcttaag

SEQ ID NO: 560128 - DNA, 20 bp, Artificial Sequence
  chemically synthesized
aactcaagcttagtgttctg

SEQ ID NO: 560129 - DNA, 20 bp, Artificial Sequence
  chemically synthesized
tcataaagaaccatgcaaat

SEQ ID NO: 560130 - DNA, 20 bp, Artificial Sequence
  chemically synthesized
acatttcagggagcattgtg

SEQ ID NO: 560131 - DNA, 20 bp, Artificial Sequence
  chemically synthesized
gaagccatgggcagatcaca

SEQ ID NO: 560132 - DNA, 20 bp, Artificial Sequence
  chemically synthesized
gaggaatcataatatagtac

SEQ ID NO: 560133 - DNA, 20 bp, Artificial Sequence
  chemically synthesized
ttgctaaagtatgtttaatg

SEQ ID NO: 560134 - DNA, 20 bp, Artificial Sequence
  chemically synthesized
ccacacaatcattacataat

SEQ ID NO: 560135 - DNA, 20 bp, Artificial Sequence
  chemically synthesized
tatcagatgtcaggtctcaa

SEQ ID NO: 560136 - DNA, 20 bp, Artificial Sequence
  chemically synthesized
atctttaaaaattattataa

SEQ ID NO: 560137 - DNA, 20 bp, Artificial Sequence
  chemically synthesized
acatacgggctgtagattat

SEQ ID NO: 560138 - DNA, 20 bp, Artificial Sequence
  chemically synthesized
gataattaactacactaata

SEQ ID NO: 560139 - DNA, 20 bp, Artificial Sequence
  chemically synthesized
agtttcatttttctcaagag

SEQ ID NO: 560140 - DNA, 20 bp, Artificial Sequence
  chemically synthesized
tgccctgtgtttagttaaat

SEQ ID NO: 560141 - DNA, 20 bp, Artificial Sequence
  chemically synthesized
tatttaactaaacacagggc

SEQ ID NO: 560142 - DNA, 20 bp, Artificial Sequence
  chemically synthesized
gtgttgggataatttagtcc

SEQ ID NO: 560143 - DNA, 20 bp, Artificial Sequence
  chemically synthesized
ttcttttctagatccgcttt

SEQ ID NO: 560144 - DNA, 20 bp, Artificial Sequence
  chemically synthesized
gatccgcttttaaaacctgt

SEQ ID NO: 560145 - DNA, 20 bp, Artificial Sequence
  chemically synthesized
ggtaatattgcttcaaaagg

SEQ ID NO: 560146 - DNA, 20 bp, Artificial Sequence
  chemically synthesized
attcctgacggaattcaaac

SEQ ID NO: 560147 - DNA, 20 bp, Artificial Sequence
  chemically synthesized
ccaaataatgaaccgaatgt

SEQ ID NO: 560148 - DNA, 20 bp, Artificial Sequence
  chemically synthesized
ttatttgagtaattattttt

SEQ ID NO: 560149 - DNA, 20 bp, Artificial Sequence
  chemically synthesized
gttactgagtcaagtaaaag

SEQ ID NO: 560150 - DNA, 20 bp, Artificial Sequence
  chemically synthesized
acactgaattcaaatcaaaa

SEQ ID NO: 560151 - DNA, 20 bp, Artificial Sequence
  chemically synthesized
tccaactcaaaacaaaaaag

SEQ ID NO: 560152 - DNA, 20 bp, Artificial Sequence
  chemically synthesized
gacagagttagactccaact

SEQ ID NO: 560153 - DNA, 20 bp, Artificial Sequence
  chemically synthesized
aattaaacaaaatgaatatg

SEQ ID NO: 560154 - DNA, 20 bp, Artificial Sequence
  chemically synthesized
atattcacttaaatttaatg

SEQ ID NO: 560155 - DNA, 20 bp, Artificial Sequence
  chemically synthesized
ttaaagaagaggattgcaat

SEQ ID NO: 560156 - DNA, 20 bp, Artificial Sequence
  chemically synthesized
ttcttcatgtggcttaataa

SEQ ID NO: 560157 - DNA, 20 bp, Artificial Sequence
  chemically synthesized
tttttatatgtctgtatgac

SEQ ID NO: 560158 - DNA, 20 bp, Artificial Sequence
  chemically synthesized
aactacacataatataggtg

SEQ ID NO: 560159 - DNA, 20 bp, Artificial Sequence
  chemically synthesized
tccctgatgccaaatcagtt

SEQ ID NO: 560160 - DNA, 20 bp, Artificial Sequence
  chemically synthesized
gatctattattttttataat

SEQ ID NO: 560161 - DNA, 20 bp, Artificial Sequence
  chemically synthesized
tctatacctagacatgtagt

SEQ ID NO: 560162 - DNA, 20 bp, Artificial Sequence
  chemically synthesized
atatgtcacaatctgagacc

SEQ ID NO: 560163 - DNA, 20 bp, Artificial Sequence
  chemically synthesized
tgatagtttaagccaattaa

SEQ ID NO: 560164 - DNA, 20 bp, Artificial Sequence
  chemically synthesized
atcaaatgacaagacctata

SEQ ID NO: 560165 - DNA, 20 bp, Artificial Sequence
  chemically synthesized
agagaaaatcgagatcaaga

SEQ ID NO: 560166 - DNA, 20 bp, Artificial Sequence
  chemically synthesized
gctccccatcagctgcaggc

SEQ ID NO: 560167 - DNA, 20 bp, Artificial Sequence
  chemically synthesized
aaagtaacctgtatatgttt

SEQ ID NO: 560168 - DNA, 20 bp, Artificial Sequence
  chemically synthesized
tcatttgatatgaactttta

SEQ ID NO: 560169 - DNA, 20 bp, Artificial Sequence
  chemically synthesized
caagatttaaaaaaaaaaaa

SEQ ID NO: 560170 - DNA, 20 bp, Artificial Sequence
  chemically synthesized
tgccaaagaaatctcattct

SEQ ID NO: 560171 - DNA, 20 bp, Artificial Sequence
  chemically synthesized
ctttaatttttttttgcttg

SEQ ID NO: 560172 - DNA, 20 bp, Artificial Sequence
  chemically synthesized
tttcaaagttgtactcttga

SEQ ID NO: 560173 - DNA, 20 bp, Artificial Sequence
  chemically synthesized
ttatcaagagtacaactttg

SEQ ID NO: 560174 - DNA, 20 bp, Artificial Sequence
  chemically synthesized
ttttctgaattaaagtggga

SEQ ID NO: 560175 - DNA, 20 bp, Artificial Sequence
  chemically synthesized
ctagctttcaatggtcttat

SEQ ID NO: 560176 - DNA, 20 bp, Artificial Sequence
  chemically synthesized
tgaaatgttatcaagtcttc

SEQ ID NO: 560177 - DNA, 20 bp, Artificial Sequence
  chemically synthesized
attattcatgccatttttaa

SEQ ID NO: 560178 - DNA, 20 bp, Artificial Sequence
  chemically synthesized
tttctaaactactctagtga

SEQ ID NO: 560179 - DNA, 20 bp, Artificial Sequence
  chemically synthesized
aaaactaacaatctctgagt

SEQ ID NO: 560180 - DNA, 20 bp, Artificial Sequence
  chemically synthesized
ctatcaatgatttttggaag

SEQ ID NO: 560181 - DNA, 20 bp, Artificial Sequence
  chemically synthesized
tccagcctgggtgacaggag

SEQ ID NO: 560182 - DNA, 20 bp, Artificial Sequence
  chemically synthesized
gatatttatgaagaaaaact

SEQ ID NO: 560183 - DNA, 20 bp, Artificial Sequence
  chemically synthesized
taacattgatatttatgaag

SEQ ID NO: 560184 - DNA, 20 bp, Artificial Sequence
  chemically synthesized
cagtatatataggttttttc

SEQ ID NO: 560185 - DNA, 20 bp, Artificial Sequence
  chemically synthesized
aaatgcaagtatgttttaga

SEQ ID NO: 560186 - DNA, 20 bp, Artificial Sequence
  chemically synthesized
tttgtgactcatacagtgaa

SEQ ID NO: 560187 - DNA, 20 bp, Artificial Sequence
  chemically synthesized
tgttcactgtatgagtcaca

SEQ ID NO: 560188 - DNA, 20 bp, Artificial Sequence
  chemically synthesized
aaaatcctcaggtggatgcc

SEQ ID NO: 560189 - DNA, 20 bp, Artificial Sequence
  chemically synthesized
gcctaaaactgcaggtagta

SEQ ID NO: 560190 - DNA, 20 bp, Artificial Sequence
  chemically synthesized
tgggaaccttttcacataaa

SEQ ID NO: 560191 - DNA, 20 bp, Artificial Sequence
  chemically synthesized
gcagttcaaatatgccaaag

SEQ ID NO: 560192 - DNA, 20 bp, Artificial Sequence
  chemically synthesized
actttggggccatgactaag

SEQ ID NO: 560193 - DNA, 20 bp, Artificial Sequence
  chemically synthesized
caagatttcattatgctact

SEQ ID NO: 560194 - DNA, 20 bp, Artificial Sequence
  chemically synthesized
gtaattgaagccaaggagag

SEQ ID NO: 560195 - DNA, 20 bp, Artificial Sequence
  chemically synthesized
aagaggaaatttggacacag

SEQ ID NO: 560196 - DNA, 20 bp, Artificial Sequence
  chemically synthesized
aaacattctacacataaatg

SEQ ID NO: 560197 - DNA, 20 bp, Artificial Sequence
  chemically synthesized
ctttatgaaagagggaggca

SEQ ID NO: 560198 - DNA, 20 bp, Artificial Sequence
  chemically synthesized
tttatcaacaactatgcagt

SEQ ID NO: 560199 - DNA, 20 bp, Artificial Sequence
  chemically synthesized
gttgaaatggaaatcacatc

SEQ ID NO: 560200 - DNA, 20 bp, Artificial Sequence
  chemically synthesized
tcacatcaaaaaccattgaa

SEQ ID NO: 560201 - DNA, 20 bp, Artificial Sequence
  chemically synthesized
gttcagtttgtagaaatgtg

SEQ ID NO: 560202 - DNA, 20 bp, Artificial Sequence
  chemically synthesized
agtaagaattatacttttga

SEQ ID NO: 560203 - DNA, 20 bp, Artificial Sequence
  chemically synthesized
aaatctagtcaaacttctgc

SEQ ID NO: 560204 - DNA, 20 bp, Artificial Sequence
  chemically synthesized
ttaatgttataatttgattc

SEQ ID NO: 560205 - DNA, 20 bp, Artificial Sequence
  chemically synthesized
actctgtatttgtttaatca

SEQ ID NO: 560206 - DNA, 20 bp, Artificial Sequence
  chemically synthesized
agctcagagtctgcgaggta

SEQ ID NO: 560207 - DNA, 20 bp, Artificial Sequence
  chemically synthesized
aatgtcttgcacaaatatcc

SEQ ID NO: 560208 - DNA, 20 bp, Artificial Sequence
  chemically synthesized
tatctctatttcactggtga

SEQ ID NO: 560209 - DNA, 20 bp, Artificial Sequence
  chemically synthesized
aaaaattttcaattcttgta

SEQ ID NO: 560210 - DNA, 20 bp, Artificial Sequence
  chemically synthesized
aatgaagagcctgtgctaga

SEQ ID NO: 560211 - DNA, 20 bp, Artificial Sequence
  chemically synthesized
ctgctctggttactatgtag

SEQ ID NO: 560212 - DNA, 20 bp, Artificial Sequence
  chemically synthesized
caaatgattcgagctgactc

SEQ ID NO: 560213 - DNA, 20 bp, Artificial Sequence
  chemically synthesized
cactttcatggacgtaaagg

SEQ ID NO: 560214 - DNA, 20 bp, Artificial Sequence
  chemically synthesized
gaaaggcttttttagcatta

SEQ ID NO: 560215 - DNA, 20 bp, Artificial Sequence
  chemically synthesized
aatttggcatccggtagtga

SEQ ID NO: 560216 - DNA, 20 bp, Artificial Sequence
  chemically synthesized
aataattggaaagggagaaa

SEQ ID NO: 560217 - DNA, 20 bp, Artificial Sequence
  chemically synthesized
aaagaaaactgtcattactc

SEQ ID NO: 560218 - DNA, 20 bp, Artificial Sequence
  chemically synthesized
attcataacagcaaaaatat

SEQ ID NO: 560219 - DNA, 20 bp, Artificial Sequence
  chemically synthesized
agtttaagagcctttacttt

SEQ ID NO: 560220 - DNA, 20 bp, Artificial Sequence
  chemically synthesized
agcctttactttaaaaacta

SEQ ID NO: 560221 - DNA, 20 bp, Artificial Sequence
  chemically synthesized
gagaatagatgaaatccaat

SEQ ID NO: 560222 - DNA, 20 bp, Artificial Sequence
  chemically synthesized
gcttttactgaccaactgac

SEQ ID NO: 560223 - DNA, 20 bp, Artificial Sequence
  chemically synthesized
ctttagggaaacttgcaacc

SEQ ID NO: 560224 - DNA, 20 bp, Artificial Sequence
  chemically synthesized
aaaaaaatattaccatatat

SEQ ID NO: 560225 - DNA, 20 bp, Artificial Sequence
  chemically synthesized
tgtcataatgctatagtaat

SEQ ID NO: 560226 - DNA, 20 bp, Artificial Sequence
  chemically synthesized
aggacaggcaagtagagaaa

SEQ ID NO: 560227 - DNA, 20 bp, Artificial Sequence
  chemically synthesized
gtggattgtaatacgaaagg

SEQ ID NO: 560228 - DNA, 20 bp, Artificial Sequence
  chemically synthesized
ttttgtcctcagtttaaaaa

SEQ ID NO: 560229 - DNA, 20 bp, Artificial Sequence
  chemically synthesized
aaatatagaaaatccagtag

SEQ ID NO: 560230 - DNA, 20 bp, Artificial Sequence
  chemically synthesized
tatgaatttatacaactttg

SEQ ID NO: 560231 - DNA, 20 bp, Artificial Sequence
  chemically synthesized
ccagtgaaaaaagccagtta

SEQ ID NO: 560232 - DNA, 20 bp, Artificial Sequence
  chemically synthesized
taaattataaagtcagaata

SEQ ID NO: 560233 - DNA, 20 bp, Artificial Sequence
  chemically synthesized
ttgatacaatgtgcagttga

SEQ ID NO: 560234 - DNA, 20 bp, Artificial Sequence
  chemically synthesized
atgcacatatcaaagctgat

SEQ ID NO: 560235 - DNA, 20 bp, Artificial Sequence
  chemically synthesized
ggcacatgattcagttatta

SEQ ID NO: 560236 - DNA, 20 bp, Artificial Sequence
  chemically synthesized
cccgttgctgattagtaaac

SEQ ID NO: 560237 - DNA, 20 bp, Artificial Sequence
  chemically synthesized
ggcattacatacaaagcatg

SEQ ID NO: 560238 - DNA, 20 bp, Artificial Sequence
  chemically synthesized
gtgaattaaatgcatttaaa

SEQ ID NO: 560239 - DNA, 20 bp, Artificial Sequence
  chemically synthesized
gatactcatgttacacaagt

SEQ ID NO: 560240 - DNA, 20 bp, Artificial Sequence
  chemically synthesized
tcaaaattactttcataaga

SEQ ID NO: 560241 - DNA, 20 bp, Artificial Sequence
  chemically synthesized
actcagtatgtcacctcttt

SEQ ID NO: 560242 - DNA, 20 bp, Artificial Sequence
  chemically synthesized
gagtggccaatttcatggag

SEQ ID NO: 560243 - DNA, 20 bp, Artificial Sequence
  chemically synthesized
gataatttcatctatgtata

SEQ ID NO: 560244 - DNA, 20 bp, Artificial Sequence
  chemically synthesized
tctgatattatgacattttg

SEQ ID NO: 560245 - DNA, 20 bp, Artificial Sequence
  chemically synthesized
taaacatgagttttctgact

SEQ ID NO: 560246 - DNA, 20 bp, Artificial Sequence
  chemically synthesized
catcctattgttttaagtca

SEQ ID NO: 560247 - DNA, 20 bp, Artificial Sequence
  chemically synthesized
gatactagaaaggaatatat

SEQ ID NO: 560248 - DNA, 20 bp, Artificial Sequence
  chemically synthesized
cgaatgtagcttagttctta

SEQ ID NO: 560249 - DNA, 20 bp, Artificial Sequence
  chemically synthesized
ttttcaagaaggaaaacctg

SEQ ID NO: 560250 - DNA, 20 bp, Artificial Sequence
  chemically synthesized
agtattctattttcaagaag

SEQ ID NO: 560251 - DNA, 20 bp, Artificial Sequence
  chemically synthesized
caaagaaaaagcaaaaccat

SEQ ID NO: 560252 - DNA, 20 bp, Artificial Sequence
  chemically synthesized
aatgtcttccaaagaaaaag

SEQ ID NO: 560253 - DNA, 20 bp, Artificial Sequence
  chemically synthesized
atcaagagagcgtggtttat

SEQ ID NO: 560254 - DNA, 20 bp, Artificial Sequence
  chemically synthesized
ctcctcccttccgagcccat

SEQ ID NO: 560255 - DNA, 20 bp, Artificial Sequence
  chemically synthesized
aggagcccagcgggcacaag

SEQ ID NO: 560256 - DNA, 20 bp, Artificial Sequence
  chemically synthesized
gatttagatcttagcttaaa

SEQ ID NO: 560257 - DNA, 20 bp, Artificial Sequence
  chemically synthesized
agagatgtggtaatgacctc

SEQ ID NO: 560258 - DNA, 20 bp, Artificial Sequence
  chemically synthesized
ttctttggaaaaggtttgaa

SEQ ID NO: 560259 - DNA, 20 bp, Artificial Sequence
  chemically synthesized
gctatccttaacttattcct

SEQ ID NO: 560260 - DNA, 20 bp, Artificial Sequence
  chemically synthesized
gtatttggatcccctaaaag

SEQ ID NO: 560261 - DNA, 20 bp, Artificial Sequence
  chemically synthesized
ttaaaagattgataaagtat

SEQ ID NO: 560262 - DNA, 20 bp, Artificial Sequence
  chemically synthesized
ggtgaaaatgaaagcaagta

SEQ ID NO: 560263 - DNA, 20 bp, Artificial Sequence
  chemically synthesized
tgtgtggttaaggcatcttg

SEQ ID NO: 560264 - DNA, 20 bp, Artificial Sequence
  chemically synthesized
aatatcattttaatttcctt

SEQ ID NO: 560265 - DNA, 20 bp, Artificial Sequence
  chemically synthesized
actcccattttttattaacc

SEQ ID NO: 560266 - DNA, 20 bp, Artificial Sequence
  chemically synthesized
cttctccattaccataaaaa

SEQ ID NO: 560267 - DNA, 20 bp, Artificial Sequence
  chemically synthesized
tcctcttcactgaaaaaaaa

SEQ ID NO: 560268 - DNA, 20 bp, Artificial Sequence
  chemically synthesized
tgtagtttgagcggaaggga

SEQ ID NO: 560269 - DNA, 20 bp, Artificial Sequence
  chemically synthesized
cagatgtcagtccgatttat

SEQ ID NO: 560270 - DNA, 20 bp, Artificial Sequence
  chemically synthesized
gtaccatgtgggggtttggg

SEQ ID NO: 560271 - DNA, 20 bp, Artificial Sequence
  chemically synthesized
gtctcaactgaaccctagga

SEQ ID NO: 560272 - DNA, 20 bp, Artificial Sequence
  chemically synthesized
cctattaagtgaggctgtca

SEQ ID NO: 560273 - DNA, 20 bp, Artificial Sequence
  chemically synthesized
acagtatttccaatcttttt

SEQ ID NO: 560274 - DNA, 20 bp, Artificial Sequence
  chemically synthesized
aaacgtgctgtccctacttg

SEQ ID NO: 560275 - DNA, 20 bp, Artificial Sequence
  chemically synthesized
ccagagcttataatggttaa

SEQ ID NO: 560276 - DNA, 20 bp, Artificial Sequence
  chemically synthesized
gtcctgtcttatataactca

SEQ ID NO: 560277 - DNA, 20 bp, Artificial Sequence
  chemically synthesized
aaaagaattgactaaattca

SEQ ID NO: 560278 - DNA, 20 bp, Artificial Sequence
  chemically synthesized
agcaatttacatgtaaaaat

SEQ ID NO: 560279 - DNA, 20 bp, Artificial Sequence
  chemically synthesized
ttttacttaagaagtgtaag

SEQ ID NO: 560280 - DNA, 20 bp, Artificial Sequence
  chemically synthesized
aagaatgccatttccaatta

SEQ ID NO: 560281 - DNA, 20 bp, Artificial Sequence
  chemically synthesized
ctgtaagacaaaagctatgg

SEQ ID NO: 560282 - DNA, 20 bp, Artificial Sequence
  chemically synthesized
tctggaagcttttaataaag

SEQ ID NO: 560283 - DNA, 20 bp, Artificial Sequence
  chemically synthesized
attattcacagaggtataac

SEQ ID NO: 560284 - DNA, 20 bp, Artificial Sequence
  chemically synthesized
ggtttttctaagccactttt

SEQ ID NO: 560285 - DNA, 20 bp, Artificial Sequence
  chemically synthesized
ggttttcaaaagtggcttag

SEQ ID NO: 560286 - DNA, 20 bp, Artificial Sequence
  chemically synthesized
aatcgaaaggcagtataata

SEQ ID NO: 560287 - DNA, 20 bp, Artificial Sequence
  chemically synthesized
aaggcagtataatagaaaac

SEQ ID NO: 560288 - DNA, 20 bp, Artificial Sequence
  chemically synthesized
ggccaaaagaaatagacaag

SEQ ID NO: 560289 - DNA, 20 bp, Artificial Sequence
  chemically synthesized
gaggagtagttaaaaaaaaa

SEQ ID NO: 560290 - DNA, 20 bp, Artificial Sequence
  chemically synthesized
cacacacacacacacacaca

SEQ ID NO: 560291 - DNA, 20 bp, Artificial Sequence
  chemically synthesized
gaattgactttttttcaaat

SEQ ID NO: 560292 - DNA, 20 bp, Artificial Sequence
  chemically synthesized
ttaattgtctactttatttt

SEQ ID NO: 560293 - DNA, 20 bp, Artificial Sequence
  chemically synthesized
ataggatgaaatagattgac

SEQ ID NO: 560294 - DNA, 20 bp, Artificial Sequence
  chemically synthesized
gcatgactatgaggagacag

SEQ ID NO: 560295 - DNA, 20 bp, Artificial Sequence
  chemically synthesized
agcctcagcttcctaatttg

SEQ ID NO: 560296 - DNA, 20 bp, Artificial Sequence
  chemically synthesized
aatttgtaaaactaagataa

SEQ ID NO: 560297 - DNA, 20 bp, Artificial Sequence
  chemically synthesized
gttaagaagattgaataagg

SEQ ID NO: 560298 - DNA, 20 bp, Artificial Sequence
  chemically synthesized
attgttttccaggcaaaatg

SEQ ID NO: 560299 - DNA, 20 bp, Artificial Sequence
  chemically synthesized
actgttttgcattttgcctg

SEQ ID NO: 560300 - DNA, 20 bp, Artificial Sequence
  chemically synthesized
aggtcattgcagtttagttt

SEQ ID NO: 560301 - DNA, 20 bp, Artificial Sequence
  chemically synthesized
tgtgatttttgaaaagtcat

SEQ ID NO: 560302 - DNA, 20 bp, Artificial Sequence
  chemically synthesized
ctgtatatttctccagacct

SEQ ID NO: 560303 - DNA, 20 bp, Artificial Sequence
  chemically synthesized
tacagaattaaaatcagatt

SEQ ID NO: 560304 - DNA, 20 bp, Artificial Sequence
  chemically synthesized
cttcttgcaccacagtggaa

SEQ ID NO: 560305 - DNA, 20 bp, Artificial Sequence
  chemically synthesized
aatgaaatcaaggaagaaat

SEQ ID NO: 560306 - DNA, 20 bp, Artificial Sequence
  chemically synthesized
tattgtacttcaatgaacta

SEQ ID NO: 560307 - DNA, 20 bp, Artificial Sequence
  chemically synthesized
attttgtttatcttttcaaa

SEQ ID NO: 560308 - DNA, 20 bp, Artificial Sequence
  chemically synthesized
ctagctagattaaccaagaa

SEQ ID NO: 560309 - DNA, 20 bp, Artificial Sequence
  chemically synthesized
tctgcatatattgcaccaca

SEQ ID NO: 560310 - DNA, 20 bp, Artificial Sequence
  chemically synthesized
ttcaccacataaaaagaatt

SEQ ID NO: 560311 - DNA, 20 bp, Artificial Sequence
  chemically synthesized
cataaaaagaattaaaaaca

SEQ ID NO: 560312 - DNA, 20 bp, Artificial Sequence
  chemically synthesized
atgataggattttacatcta

SEQ ID NO: 560313 - DNA, 20 bp, Artificial Sequence
  chemically synthesized
ggtgtctacaaggagaacta

SEQ ID NO: 560314 - DNA, 20 bp, Artificial Sequence
  chemically synthesized
tagatgacacaaacaaatgg

SEQ ID NO: 560315 - DNA, 20 bp, Artificial Sequence
  chemically synthesized
tactaaaaggctacagtaac

SEQ ID NO: 560316 - DNA, 20 bp, Artificial Sequence
  chemically synthesized
aaacagtatggtactggtat

SEQ ID NO: 560317 - DNA, 20 bp, Artificial Sequence
  chemically synthesized
ccaaattaagaacccagata

SEQ ID NO: 560318 - DNA, 20 bp, Artificial Sequence
  chemically synthesized
aaaatataaaaatcctaaaa

SEQ ID NO: 560319 - DNA, 20 bp, Artificial Sequence
  chemically synthesized
atcctaaaagaaaacctagg

SEQ ID NO: 560320 - DNA, 20 bp, Artificial Sequence
  chemically synthesized
gaatttatgactaagtactc

SEQ ID NO: 560321 - DNA, 20 bp, Artificial Sequence
  chemically synthesized
tttaaaatcttctgaacagc

SEQ ID NO: 560322 - DNA, 20 bp, Artificial Sequence
  chemically synthesized
cagcaaaaacaaacaaacaa

SEQ ID NO: 560323 - DNA, 20 bp, Artificial Sequence
  chemically synthesized
aacaaacaaacaaaaaaaca

SEQ ID NO: 560324 - DNA, 20 bp, Artificial Sequence
  chemically synthesized
aacagacaacttatagaatg

SEQ ID NO: 560325 - DNA, 20 bp, Artificial Sequence
  chemically synthesized
tccgaactatacatctaaca

SEQ ID NO: 560326 - DNA, 20 bp, Artificial Sequence
  chemically synthesized
atcatcagagaaatgcaaat

SEQ ID NO: 560327 - DNA, 20 bp, Artificial Sequence
  chemically synthesized
aatttttaaatgacattgaa

SEQ ID NO: 560328 - DNA, 20 bp, Artificial Sequence
  chemically synthesized
ttcactttgcatgcctgtat

SEQ ID NO: 560329 - DNA, 20 bp, Artificial Sequence
  chemically synthesized
tatttgtgggatctaaaaat

SEQ ID NO: 560330 - DNA, 20 bp, Artificial Sequence
  chemically synthesized
aagttaatataaacattatg

SEQ ID NO: 560331 - DNA, 20 bp, Artificial Sequence
  chemically synthesized
tggagatttctcaaagaact

SEQ ID NO: 560332 - DNA, 20 bp, Artificial Sequence
  chemically synthesized
gtactgggtatatactcaac

SEQ ID NO: 560333 - DNA, 20 bp, Artificial Sequence
  chemically synthesized
tgcaccccctcaatctattt

SEQ ID NO: 560334 - DNA, 20 bp, Artificial Sequence
  chemically synthesized
attaaatatcctcagtgtgc

SEQ ID NO: 560335 - DNA, 20 bp, Artificial Sequence
  chemically synthesized
atgtagataaactaattata

SEQ ID NO: 560336 - DNA, 20 bp, Artificial Sequence
  chemically synthesized
gaaagtttgataatttcaat

SEQ ID NO: 560337 - DNA, 20 bp, Artificial Sequence
  chemically synthesized
gatggagacgatttggataa

SEQ ID NO: 560338 - DNA, 20 bp, Artificial Sequence
  chemically synthesized
ataatcagaacatgtgttct

SEQ ID NO: 560339 - DNA, 20 bp, Artificial Sequence
  chemically synthesized
aattattgactaagcactct

SEQ ID NO: 560340 - DNA, 20 bp, Artificial Sequence
  chemically synthesized
aagcattctggatatcaaat

SEQ ID NO: 560341 - DNA, 20 bp, Artificial Sequence
  chemically synthesized
agcagagaaacaggaggccg

SEQ ID NO: 560342 - DNA, 20 bp, Artificial Sequence
  chemically synthesized
tagaaatagcagcaatttag

SEQ ID NO: 560343 - DNA, 20 bp, Artificial Sequence
  chemically synthesized
ctaaatctctcaaaagaatg

SEQ ID NO: 560344 - DNA, 20 bp, Artificial Sequence
  chemically synthesized
gttagtcttgccacacttca

SEQ ID NO: 560345 - DNA, 20 bp, Artificial Sequence
  chemically synthesized
atgaagtgtggcaagactaa

SEQ ID NO: 560346 - DNA, 20 bp, Artificial Sequence
  chemically synthesized
tggccttactctctgagcca

SEQ ID NO: 560347 - DNA, 20 bp, Artificial Sequence
  chemically synthesized
gatataatgtgaatgaaatg

SEQ ID NO: 560348 - DNA, 20 bp, Artificial Sequence
  chemically synthesized
ttcacattatatctttcaga

SEQ ID NO: 560349 - DNA, 20 bp, Artificial Sequence
  chemically synthesized
atatctttcagaaaaaacta

SEQ ID NO: 560350 - DNA, 20 bp, Artificial Sequence
  chemically synthesized
gtcttgggttagattcctcc

SEQ ID NO: 560351 - DNA, 20 bp, Artificial Sequence
  chemically synthesized
gtctgctatgccatcaggaa

SEQ ID NO: 560352 - DNA, 20 bp, Artificial Sequence
  chemically synthesized
ggctggccccatttgtcatt

SEQ ID NO: 560353 - DNA, 20 bp, Artificial Sequence
  chemically synthesized
tgaagctcattaaacttaaa

SEQ ID NO: 560354 - DNA, 20 bp, Artificial Sequence
  chemically synthesized
ctattcaaagccataaatcc

SEQ ID NO: 560355 - DNA, 20 bp, Artificial Sequence
  chemically synthesized
gcaggagcctatttcaacaa

SEQ ID NO: 560356 - DNA, 20 bp, Artificial Sequence
  chemically synthesized
agctatgctgtattttttaa

SEQ ID NO: 560357 - DNA, 20 bp, Artificial Sequence
  chemically synthesized
tccaccatgcaccaccatgt

SEQ ID NO: 560358 - DNA, 20 bp, Artificial Sequence
  chemically synthesized
gccattgcaacaaagattgc

SEQ ID NO: 560359 - DNA, 20 bp, Artificial Sequence
  chemically synthesized
catggttgatgggagagaat

SEQ ID NO: 560360 - DNA, 20 bp, Artificial Sequence
  chemically synthesized
tggacctgatcttgaagacc

SEQ ID NO: 560361 - DNA, 20 bp, Artificial Sequence
  chemically synthesized
gagttgaatgactggctaac

SEQ ID NO: 560362 - DNA, 20 bp, Artificial Sequence
  chemically synthesized
ttctgattctggagatccat

SEQ ID NO: 560363 - DNA, 20 bp, Artificial Sequence
  chemically synthesized
tattactgaacatcacaatg

SEQ ID NO: 560364 - DNA, 20 bp, Artificial Sequence
  chemically synthesized
gttcacaaatcctgatttct

SEQ ID NO: 560365 - DNA, 20 bp, Artificial Sequence
  chemically synthesized
cacattctgtggtcaaaaaa

SEQ ID NO: 560366 - DNA, 20 bp, Artificial Sequence
  chemically synthesized
caaggggtgacccccagcta

SEQ ID NO: 560367 - DNA, 20 bp, Artificial Sequence
  chemically synthesized
agctataaaactagtaatat

SEQ ID NO: 560368 - DNA, 20 bp, Artificial Sequence
  chemically synthesized
gacgtccaaacttaatgggt

SEQ ID NO: 560369 - DNA, 20 bp, Artificial Sequence
  chemically synthesized
aaagttgtgtaattaatagg

SEQ ID NO: 560370 - DNA, 20 bp, Artificial Sequence
  chemically synthesized
cacaactttatgttgaggat

SEQ ID NO: 560371 - DNA, 20 bp, Artificial Sequence
  chemically synthesized
atcatgtttaaagcattttt

SEQ ID NO: 560372 - DNA, 20 bp, Artificial Sequence
  chemically synthesized
ccaaaaaattaaatctgtta

SEQ ID NO: 560373 - DNA, 20 bp, Artificial Sequence
  chemically synthesized
tcattaatttttcgtgaatc

SEQ ID NO: 560374 - DNA, 20 bp, Artificial Sequence
  chemically synthesized
ataataacataagatgttaa

SEQ ID NO: 560375 - DNA, 20 bp, Artificial Sequence
  chemically synthesized
ccagcctggccagcactttt

SEQ ID NO: 560376 - DNA, 20 bp, Artificial Sequence
  chemically synthesized
cattacttctgtggtctttc

SEQ ID NO: 560377 - DNA, 20 bp, Artificial Sequence
  chemically synthesized
gtatagtgactttcttatta

SEQ ID NO: 560378 - DNA, 20 bp, Artificial Sequence
  chemically synthesized
tccaatgcagaaaaaactcc

SEQ ID NO: 560379 - DNA, 20 bp, Artificial Sequence
  chemically synthesized
agacaaatctccaatgcaga

SEQ ID NO: 560380 - DNA, 20 bp, Artificial Sequence
  chemically synthesized
tttgagcaaaaatccaaagc

SEQ ID NO: 560381 - DNA, 20 bp, Artificial Sequence
  chemically synthesized
ccacggtctcgctctaaaca

SEQ ID NO: 560382 - DNA, 20 bp, Artificial Sequence
  chemically synthesized
gggcaagtagtactacatta

SEQ ID NO: 560383 - DNA, 20 bp, Artificial Sequence
  chemically synthesized
tgatagtgttaaccaataaa

SEQ ID NO: 560384 - DNA, 20 bp, Artificial Sequence
  chemically synthesized
tttgaccttagtgggaaata

SEQ ID NO: 560385 - DNA, 20 bp, Artificial Sequence
  chemically synthesized
agacagcattgtattagcat

SEQ ID NO: 560386 - DNA, 20 bp, Artificial Sequence
  chemically synthesized
ccttatcccttgccacatac

SEQ ID NO: 560387 - DNA, 20 bp, Artificial Sequence
  chemically synthesized
aaaccaatttgaaatggatt

SEQ ID NO: 560388 - DNA, 20 bp, Artificial Sequence
  chemically synthesized
aaaaacttaaatttaagact

SEQ ID NO: 560389 - DNA, 20 bp, Artificial Sequence
  chemically synthesized
aaactctcaatctattagta

SEQ ID NO: 560390 - DNA, 20 bp, Artificial Sequence
  chemically synthesized
ttcaaccaactccatagcaa

SEQ ID NO: 560391 - DNA, 20 bp, Artificial Sequence
  chemically synthesized
atcatctgggaaatgcaaat

SEQ ID NO: 560392 - DNA, 20 bp, Artificial Sequence
  chemically synthesized
aaattatttcaactattgtt

SEQ ID NO: 560393 - DNA, 20 bp, Artificial Sequence
  chemically synthesized
tggtgattccacaaagacct

SEQ ID NO: 560394 - DNA, 20 bp, Artificial Sequence
  chemically synthesized
agcaaaataacgcagaaaca

SEQ ID NO: 560395 - DNA, 20 bp, Artificial Sequence
  chemically synthesized
acacaagtttacccatgtaa

SEQ ID NO: 560396 - DNA, 20 bp, Artificial Sequence
  chemically synthesized
ttgttagcatggctactatc

SEQ ID NO: 560397 - DNA, 20 bp, Artificial Sequence
  chemically synthesized
aaattactaattaaaaaaaa

SEQ ID NO: 560398 - DNA, 20 bp, Artificial Sequence
  chemically synthesized
caatcagtacaggcatcatg

SEQ ID NO: 560399 - DNA, 20 bp, Artificial Sequence
  chemically synthesized
gctccttgaaatatgaacaa

SEQ ID NO: 560400 - DNA, 20 bp, Artificial Sequence
  chemically synthesized
gaaataagccagtaaagaaa

SEQ ID NO: 560401 - DNA, 20 bp, Artificial Sequence
  chemically synthesized
taaattagtataagtgtatt

SEQ ID NO: 560402 - DNA, 20 bp, Artificial Sequence
  chemically synthesized
atatccatttaagtggaagc

SEQ ID NO: 560403 - DNA, 20 bp, Artificial Sequence
  chemically synthesized
agaaaaaaaaaaaaagaaga

SEQ ID NO: 560404 - DNA, 20 bp, Artificial Sequence
  chemically synthesized
ctgtatcccacttataaaga

SEQ ID NO: 560405 - DNA, 20 bp, Artificial Sequence
  chemically synthesized
acttgctagaagtgcaaatt

SEQ ID NO: 560406 - DNA, 20 bp, Artificial Sequence
  chemically synthesized
attaacctcagaacaagttt

SEQ ID NO: 560407 - DNA, 20 bp, Artificial Sequence
  chemically synthesized
ggtgtgatactaataagcac

SEQ ID NO: 560408 - DNA, 20 bp, Artificial Sequence
  chemically synthesized
aaaagaaatattttctcaat

SEQ ID NO: 560409 - DNA, 20 bp, Artificial Sequence
  chemically synthesized
ggtaagaatattatttattt

SEQ ID NO: 560410 - DNA, 20 bp, Artificial Sequence
  chemically synthesized
gatctattagttactactgc

SEQ ID NO: 560411 - DNA, 20 bp, Artificial Sequence
  chemically synthesized
tattacagtactgatatgtg

SEQ ID NO: 560412 - DNA, 20 bp, Artificial Sequence
  chemically synthesized
acttccttgctaatcaccca

SEQ ID NO: 560413 - DNA, 20 bp, Artificial Sequence
  chemically synthesized
tggcttcatatagttcaatt

SEQ ID NO: 560414 - DNA, 20 bp, Artificial Sequence
  chemically synthesized
tgagaatagagaggggctag

SEQ ID NO: 560415 - DNA, 20 bp, Artificial Sequence
  chemically synthesized
gtcatcccacccccggacat

SEQ ID NO: 560416 - DNA, 20 bp, Artificial Sequence
  chemically synthesized
cagagtgaaacgccgtttca

SEQ ID NO: 560417 - DNA, 20 bp, Artificial Sequence
  chemically synthesized
aaatacaggctgaaattaat

SEQ ID NO: 560418 - DNA, 20 bp, Artificial Sequence
  chemically synthesized
aatgtataaacatatattat

SEQ ID NO: 560419 - DNA, 20 bp, Artificial Sequence
  chemically synthesized
gcataaatggatagacttta

SEQ ID NO: 560420 - DNA, 20 bp, Artificial Sequence
  chemically synthesized
aaaacctagaggactacaat

SEQ ID NO: 560421 - DNA, 20 bp, Artificial Sequence
  chemically synthesized
tacatgatttaagtcagaaa

SEQ ID NO: 560422 - DNA, 20 bp, Artificial Sequence
  chemically synthesized
aatggcgtgcatttaaaagt

SEQ ID NO: 560423 - DNA, 20 bp, Artificial Sequence
  chemically synthesized
ctccagcctgggtgaaagaa

SEQ ID NO: 560424 - DNA, 20 bp, Artificial Sequence
  chemically synthesized
aaaaaaatagataaaaataa

SEQ ID NO: 560425 - DNA, 20 bp, Artificial Sequence
  chemically synthesized
aagaattgttaagctaaaac

SEQ ID NO: 560426 - DNA, 20 bp, Artificial Sequence
  chemically synthesized
catataaagaattgttaagc

SEQ ID NO: 560427 - DNA, 20 bp, Artificial Sequence
  chemically synthesized
aagaaatccaagataggtta

SEQ ID NO: 560428 - DNA, 20 bp, Artificial Sequence
  chemically synthesized
gcccaggtattggttctgta

SEQ ID NO: 560429 - DNA, 20 bp, Artificial Sequence
  chemically synthesized
aaacaaaggcttacttgggt

SEQ ID NO: 560430 - DNA, 20 bp, Artificial Sequence
  chemically synthesized
ttataaatattaaaaaaata

SEQ ID NO: 560431 - DNA, 20 bp, Artificial Sequence
  chemically synthesized
aataattttattattttcac

SEQ ID NO: 560432 - DNA, 20 bp, Artificial Sequence
  chemically synthesized
aattatactttttgttattt

SEQ ID NO: 560433 - DNA, 20 bp, Artificial Sequence
  chemically synthesized
aaaaaaaaaaaaaaaaaaat

SEQ ID NO: 560434 - DNA, 20 bp, Artificial Sequence
  chemically synthesized
ttaaaataagcccggcacag

SEQ ID NO: 560435 - DNA, 20 bp, Artificial Sequence
  chemically synthesized
atttttgtcaaccctttcaa

SEQ ID NO: 560436 - DNA, 20 bp, Artificial Sequence
  chemically synthesized
aaaatgatacaaaagatcaa

SEQ ID NO: 560437 - DNA, 20 bp, Artificial Sequence
  chemically synthesized
aaaaggaaacgcaatgtaac

SEQ ID NO: 560438 - DNA, 20 bp, Artificial Sequence
  chemically synthesized
agagttagagagatagaccc

SEQ ID NO: 560439 - DNA, 20 bp, Artificial Sequence
  chemically synthesized
gacaaaataggtttcaagac

SEQ ID NO: 560440 - DNA, 20 bp, Artificial Sequence
  chemically synthesized
agagaatgaagagaaggcca

SEQ ID NO: 560441 - DNA, 20 bp, Artificial Sequence
  chemically synthesized
cataaacaaataagcaaaga

SEQ ID NO: 560442 - DNA, 20 bp, Artificial Sequence
  chemically synthesized
tgagtcatcatctgaagtaa

SEQ ID NO: 560443 - DNA, 20 bp, Artificial Sequence
  chemically synthesized
tggcagcacaattttcagtg

SEQ ID NO: 560444 - DNA, 20 bp, Artificial Sequence
  chemically synthesized
gaagcatcaagaccatccaa

SEQ ID NO: 560445 - DNA, 20 bp, Artificial Sequence
  chemically synthesized
aaaattgctaccctgaagtg

SEQ ID NO: 560446 - DNA, 20 bp, Artificial Sequence
  chemically synthesized
aagaattcacccactatcat

SEQ ID NO: 560447 - DNA, 20 bp, Artificial Sequence
  chemically synthesized
acctatgagcccgtaaaatc

SEQ ID NO: 560448 - DNA, 20 bp, Artificial Sequence
  chemically synthesized
gcagggtagtcattaaatct

SEQ ID NO: 560449 - DNA, 20 bp, Artificial Sequence
  chemically synthesized
atatccatgttgcaaatttt

SEQ ID NO: 560450 - DNA, 20 bp, Artificial Sequence
  chemically synthesized
tatacatgtataaatatgta

SEQ ID NO: 560451 - DNA, 20 bp, Artificial Sequence
  chemically synthesized
ctctttctgtgatacaaccc

SEQ ID NO: 560452 - DNA, 20 bp, Artificial Sequence
  chemically synthesized
tgaatgttgcttttctatat

SEQ ID NO: 560453 - DNA, 20 bp, Artificial Sequence
  chemically synthesized
attgccatgcaacaacaaca

SEQ ID NO: 560454 - DNA, 20 bp, Artificial Sequence
  chemically synthesized
ggtaaaggtgatgagatagt

SEQ ID NO: 560455 - DNA, 20 bp, Artificial Sequence
  chemically synthesized
ttatacagtttttatccccc

SEQ ID NO: 560456 - DNA, 20 bp, Artificial Sequence
  chemically synthesized
cacattagttttagggggat

SEQ ID NO: 560457 - DNA, 20 bp, Artificial Sequence
  chemically synthesized
agtgcatgtttaattttgtg

SEQ ID NO: 560458 - DNA, 20 bp, Artificial Sequence
  chemically synthesized
tttctcatagaattcagtat

SEQ ID NO: 560459 - DNA, 20 bp, Artificial Sequence
  chemically synthesized
acaaaaatggatcaggattt

SEQ ID NO: 560460 - DNA, 20 bp, Artificial Sequence
  chemically synthesized
aacacatttattttcatttt

SEQ ID NO: 560461 - DNA, 20 bp, Artificial Sequence
  chemically synthesized
aaattcccaatcagaaatat

SEQ ID NO: 560462 - DNA, 20 bp, Artificial Sequence
  chemically synthesized
gagactggataatttataaa

SEQ ID NO: 560463 - DNA, 20 bp, Artificial Sequence
  chemically synthesized
aaaaggggaaaggcccctta

SEQ ID NO: 560464 - DNA, 20 bp, Artificial Sequence
  chemically synthesized
aatgagagagccgtatcttc

SEQ ID NO: 560465 - DNA, 20 bp, Artificial Sequence
  chemically synthesized
cttaacattactggaagaag

SEQ ID NO: 560466 - DNA, 20 bp, Artificial Sequence
  chemically synthesized
cctcctgctgatataaacca

SEQ ID NO: 560467 - DNA, 20 bp, Artificial Sequence
  chemically synthesized
taggacatgcaggcagaaac

SEQ ID NO: 560468 - DNA, 20 bp, Artificial Sequence
  chemically synthesized
aagaagacaactggcacagg

SEQ ID NO: 560469 - DNA, 20 bp, Artificial Sequence
  chemically synthesized
ggaggtaaggaattcggaag

SEQ ID NO: 560470 - DNA, 20 bp, Artificial Sequence
  chemically synthesized
ctcctcttaaggggttctaa

SEQ ID NO: 560471 - DNA, 20 bp, Artificial Sequence
  chemically synthesized
tcctttcataatgtagtgtt

SEQ ID NO: 560472 - DNA, 20 bp, Artificial Sequence
  chemically synthesized
tgtttatatgatttaaatga

SEQ ID NO: 560473 - DNA, 20 bp, Artificial Sequence
  chemically synthesized
gtgccgatactggtcaatta

SEQ ID NO: 560474 - DNA, 20 bp, Artificial Sequence
  chemically synthesized
aaggctggagaaaaaaagta

SEQ ID NO: 560475 - DNA, 20 bp, Artificial Sequence
  chemically synthesized
atgacactattgctgtttta

SEQ ID NO: 560476 - DNA, 20 bp, Artificial Sequence
  chemically synthesized
ttctctactttatagttttg

SEQ ID NO: 560477 - DNA, 20 bp, Artificial Sequence
  chemically synthesized
ataaaccatcaacaattatg

SEQ ID NO: 560478 - DNA, 20 bp, Artificial Sequence
  chemically synthesized
aaggaaaaaaaaataggaac

SEQ ID NO: 560479 - DNA, 20 bp, Artificial Sequence
  chemically synthesized
cttagccatttagttatttt

SEQ ID NO: 560480 - DNA, 20 bp, Artificial Sequence
  chemically synthesized
gtaggtgagagataggtcaa

SEQ ID NO: 560481 - DNA, 20 bp, Artificial Sequence
  chemically synthesized
cattacattttaatctcttc

SEQ ID NO: 560482 - DNA, 20 bp, Artificial Sequence
  chemically synthesized
tattaatggaatacattatc

SEQ ID NO: 560483 - DNA, 20 bp, Artificial Sequence
  chemically synthesized
tttccattgtaagtaatggg

SEQ ID NO: 560484 - DNA, 20 bp, Artificial Sequence
  chemically synthesized
tcccattacttacaatggaa

SEQ ID NO: 560485 - DNA, 20 bp, Artificial Sequence
  chemically synthesized
aagttgatataacaaaagtt

SEQ ID NO: 560486 - DNA, 20 bp, Artificial Sequence
  chemically synthesized
aatttatttgaagcattaag

SEQ ID NO: 560487 - DNA, 20 bp, Artificial Sequence
  chemically synthesized
gggtattgtcattattttta

SEQ ID NO: 560488 - DNA, 20 bp, Artificial Sequence
  chemically synthesized
agattttgtgagaggaaaca

SEQ ID NO: 560489 - DNA, 20 bp, Artificial Sequence
  chemically synthesized
actatgtatgtgttcgtgca

SEQ ID NO: 560490 - DNA, 20 bp, Artificial Sequence
  chemically synthesized
acatgtacgtgtctcatttt

SEQ ID NO: 560491 - DNA, 20 bp, Artificial Sequence
  chemically synthesized
ctagctggtatagcttttgc

SEQ ID NO: 560492 - DNA, 20 bp, Artificial Sequence
  chemically synthesized
cttacactccccattttcaa

SEQ ID NO: 560493 - DNA, 20 bp, Artificial Sequence
  chemically synthesized
taaagaggtggttggatttt

SEQ ID NO: 560494 - DNA, 20 bp, Artificial Sequence
  chemically synthesized
agtgtgaaattatggagggg

SEQ ID NO: 560495 - DNA, 20 bp, Artificial Sequence
  chemically synthesized
acacacctaacaatataaat

SEQ ID NO: 560496 - DNA, 20 bp, Artificial Sequence
  chemically synthesized
gtattttaataagaatttcc

SEQ ID NO: 560497 - DNA, 20 bp, Artificial Sequence
  chemically synthesized
tatatatggaaatcctcttg

SEQ ID NO: 560498 - DNA, 20 bp, Artificial Sequence
  chemically synthesized
tgacattttaatgtttggag

SEQ ID NO: 560499 - DNA, 20 bp, Artificial Sequence
  chemically synthesized
gacagaattttggcaaatct

SEQ ID NO: 560500 - DNA, 20 bp, Artificial Sequence
  chemically synthesized
gctcttttagttacaaaagt

SEQ ID NO: 560501 - DNA, 20 bp, Artificial Sequence
  chemically synthesized
tcaaaataatcacaagcttc

SEQ ID NO: 560502 - DNA, 20 bp, Artificial Sequence
  chemically synthesized
acttgttagtcttcttaatt

SEQ ID NO: 560503 - DNA, 20 bp, Artificial Sequence
  chemically synthesized
cctcagggtagctagcatgg

SEQ ID NO: 560504 - DNA, 20 bp, Artificial Sequence
  chemically synthesized
aactgcaaacaaataaaact

SEQ ID NO: 560505 - DNA, 20 bp, Artificial Sequence
  chemically synthesized
agtttaaaactgcaaacaaa

SEQ ID NO: 560506 - DNA, 20 bp, Artificial Sequence
  chemically synthesized
atctaaatgggccacaagtt

SEQ ID NO: 560507 - DNA, 20 bp, Artificial Sequence
  chemically synthesized
aatttgtatttgcagaatcc

SEQ ID NO: 560508 - DNA, 20 bp, Artificial Sequence
  chemically synthesized
tcaatggttgctctccaaaa

SEQ ID NO: 560509 - DNA, 20 bp, Artificial Sequence
  chemically synthesized
taaaacgttaatttacaaaa

SEQ ID NO: 560510 - DNA, 20 bp, Artificial Sequence
  chemically synthesized
taaactaaaacgttaattta

SEQ ID NO: 560511 - DNA, 20 bp, Artificial Sequence
  chemically synthesized
ttcatactcatgaggtaaac

SEQ ID NO: 560512 - DNA, 20 bp, Artificial Sequence
  chemically synthesized
atgcatgaggaagttaaaat

SEQ ID NO: 560513 - DNA, 20 bp, Artificial Sequence
  chemically synthesized
accagtaaaggcatcagtaa

SEQ ID NO: 560514 - DNA, 20 bp, Artificial Sequence
  chemically synthesized
ggagtacactcctcccaaag

SEQ ID NO: 560515 - DNA, 20 bp, Artificial Sequence
  chemically synthesized
actgctttttgattccttta

SEQ ID NO: 560516 - DNA, 20 bp, Artificial Sequence
  chemically synthesized
tgcacataggacttcacttc

SEQ ID NO: 560517 - DNA, 20 bp, Artificial Sequence
  chemically synthesized
tcttggggcaatttatgctt

SEQ ID NO: 560518 - DNA, 20 bp, Artificial Sequence
  chemically synthesized
attttgtctgaggatgtgca

SEQ ID NO: 560519 - DNA, 20 bp, Artificial Sequence
  chemically synthesized
tctgaggatgtgcataaaac

SEQ ID NO: 560520 - DNA, 20 bp, Artificial Sequence
  chemically synthesized
ggattctgacttacaatttg

SEQ ID NO: 560521 - DNA, 20 bp, Artificial Sequence
  chemically synthesized
aaacttttttctgcagtttg

SEQ ID NO: 560522 - DNA, 20 bp, Artificial Sequence
  chemically synthesized
gaataaaagacattttaaaa

SEQ ID NO: 560523 - DNA, 20 bp, Artificial Sequence
  chemically synthesized
atgtaaaattctgtgatgat

SEQ ID NO: 560524 - DNA, 20 bp, Artificial Sequence
  chemically synthesized
taaatagatctataaagaac

SEQ ID NO: 560525 - DNA, 20 bp, Artificial Sequence
  chemically synthesized
ttgggggaaaaaaaaaaaac

SEQ ID NO: 560526 - DNA, 20 bp, Artificial Sequence
  chemically synthesized
tcaattttgggggaaaaaaa

SEQ ID NO: 560527 - DNA, 20 bp, Artificial Sequence
  chemically synthesized
ccactgcactccggcctggg

SEQ ID NO: 560528 - DNA, 20 bp, Artificial Sequence
  chemically synthesized
ttttctagacattgctggac

SEQ ID NO: 560529 - DNA, 20 bp, Artificial Sequence
  chemically synthesized
catctcagttaccccatcta

SEQ ID NO: 560530 - DNA, 20 bp, Artificial Sequence
  chemically synthesized
aatccattttatcagtgata

SEQ ID NO: 560531 - DNA, 20 bp, Artificial Sequence
  chemically synthesized
tacgactgttaacctggatc

SEQ ID NO: 560532 - DNA, 20 bp, Artificial Sequence
  chemically synthesized
atttatgcattcaagaccaa

SEQ ID NO: 560533 - DNA, 20 bp, Artificial Sequence
  chemically synthesized
tttacgtgttatatctgtga

SEQ ID NO: 560534 - DNA, 20 bp, Artificial Sequence
  chemically synthesized
taactggtggttctgggact

SEQ ID NO: 560535 - DNA, 20 bp, Artificial Sequence
  chemically synthesized
aaaccaggttgtttggattc

SEQ ID NO: 560536 - DNA, 20 bp, Artificial Sequence
  chemically synthesized
agagcaatactcaatctcaa

SEQ ID NO: 560537 - DNA, 20 bp, Artificial Sequence
  chemically synthesized
ttcacactgcatgtctgtat

SEQ ID NO: 560538 - DNA, 20 bp, Artificial Sequence
  chemically synthesized
actacgtagccacaaaaatt

SEQ ID NO: 560539 - DNA, 20 bp, Artificial Sequence
  chemically synthesized
cataattttaacagtttttt

SEQ ID NO: 560540 - DNA, 20 bp, Artificial Sequence
  chemically synthesized
tttttctgtttatgttttta

SEQ ID NO: 560541 - DNA, 20 bp, Artificial Sequence
  chemically synthesized
ggctatagaatgagattttt

SEQ ID NO: 560542 - DNA, 20 bp, Artificial Sequence
  chemically synthesized
aaacaaaaggttctagagcc

SEQ ID NO: 560543 - DNA, 20 bp, Artificial Sequence
  chemically synthesized
agcaagctaacgcaaggaca

SEQ ID NO: 560544 - DNA, 20 bp, Artificial Sequence
  chemically synthesized
catgaaatactatgcagcca

SEQ ID NO: 560545 - DNA, 20 bp, Artificial Sequence
  chemically synthesized
gccatcagagaaatgcaaat

SEQ ID NO: 560546 - DNA, 20 bp, Artificial Sequence
  chemically synthesized
gtcaaacaaatttacaagaa

SEQ ID NO: 560547 - DNA, 20 bp, Artificial Sequence
  chemically synthesized
atgggtaaggacttcatgtc

SEQ ID NO: 560548 - DNA, 20 bp, Artificial Sequence
  chemically synthesized
aaaaccataaaaacctagaa

SEQ ID NO: 560549 - DNA, 20 bp, Artificial Sequence
  chemically synthesized
aatgttagacctaaaaccat

SEQ ID NO: 560550 - DNA, 20 bp, Artificial Sequence
  chemically synthesized
aaagacttaaatgttagacc

SEQ ID NO: 560551 - DNA, 20 bp, Artificial Sequence
  chemically synthesized
tatttaataaatggtgctgg

SEQ ID NO: 560552 - DNA, 20 bp, Artificial Sequence
  chemically synthesized
tgatctttgacaaacctgag

SEQ ID NO: 560553 - DNA, 20 bp, Artificial Sequence
  chemically synthesized
tactacaaggctacagtaac

SEQ ID NO: 560554 - DNA, 20 bp, Artificial Sequence
  chemically synthesized
actttctacacggaattgga

SEQ ID NO: 560555 - DNA, 20 bp, Artificial Sequence
  chemically synthesized
atgacatgattgtatatcta

SEQ ID NO: 560556 - DNA, 20 bp, Artificial Sequence
  chemically synthesized
aaactggaagcattcccttt

SEQ ID NO: 560557 - DNA, 20 bp, Artificial Sequence
  chemically synthesized
cactatcatattgaatgggc

SEQ ID NO: 560558 - DNA, 20 bp, Artificial Sequence
  chemically synthesized
aattcaacaaccttcatgct

SEQ ID NO: 560559 - DNA, 20 bp, Artificial Sequence
  chemically synthesized
ataccaaagcctggcagaga

SEQ ID NO: 560560 - DNA, 20 bp, Artificial Sequence
  chemically synthesized
aaattcaaactaccatcaga

SEQ ID NO: 560561 - DNA, 20 bp, Artificial Sequence
  chemically synthesized
tctggattaagaaactcact

SEQ ID NO: 560562 - DNA, 20 bp, Artificial Sequence
  chemically synthesized
gttgcaatcctagtgtctga

SEQ ID NO: 560563 - DNA, 20 bp, Artificial Sequence
  chemically synthesized
gcaacccctgcctttttttg

SEQ ID NO: 560564 - DNA, 20 bp, Artificial Sequence
  chemically synthesized
agcgtcccaggggatgatcg

SEQ ID NO: 560565 - DNA, 20 bp, Artificial Sequence
  chemically synthesized
gtaggtttcgtggcactaac

SEQ ID NO: 560566 - DNA, 20 bp, Artificial Sequence
  chemically synthesized
tataaaatcagatgtctctc

SEQ ID NO: 560567 - DNA, 20 bp, Artificial Sequence
  chemically synthesized
aaaactctactctgtctctc

SEQ ID NO: 560568 - DNA, 20 bp, Artificial Sequence
  chemically synthesized
atctaaaggtatgtgacttg

SEQ ID NO: 560569 - DNA, 20 bp, Artificial Sequence
  chemically synthesized
tggttaaaacatattttata

SEQ ID NO: 560570 - DNA, 20 bp, Artificial Sequence
  chemically synthesized
ttttcaaggtattgattggt

SEQ ID NO: 560571 - DNA, 20 bp, Artificial Sequence
  chemically synthesized
aattagagaaattagaggaa

SEQ ID NO: 560572 - DNA, 20 bp, Artificial Sequence
  chemically synthesized
attttcataagcatcaataa

SEQ ID NO: 560573 - DNA, 20 bp, Artificial Sequence
  chemically synthesized
ttttcaaatacgtctcatgg

SEQ ID NO: 560574 - DNA, 20 bp, Artificial Sequence
  chemically synthesized
ttttgatttttttggtatgt

SEQ ID NO: 560575 - DNA, 20 bp, Artificial Sequence
  chemically synthesized
tttttacataccaaaaaaat

SEQ ID NO: 560576 - DNA, 20 bp, Artificial Sequence
  chemically synthesized
acaaaatacacatatctcgt

SEQ ID NO: 560577 - DNA, 20 bp, Artificial Sequence
  chemically synthesized
tgagaaaaaaagcaaaattc

SEQ ID NO: 560578 - DNA, 20 bp, Artificial Sequence
  chemically synthesized
taaacatggatgtgttccaa

SEQ ID NO: 560579 - DNA, 20 bp, Artificial Sequence
  chemically synthesized
ctcaaagaaatcatgctgca

SEQ ID NO: 560580 - DNA, 20 bp, Artificial Sequence
  chemically synthesized
gtaccaagagtgtgaaatta

SEQ ID NO: 560581 - DNA, 20 bp, Artificial Sequence
  chemically synthesized
tattctgggttgcactaaat

SEQ ID NO: 560582 - DNA, 20 bp, Artificial Sequence
  chemically synthesized
ctcatattttcaagtaaaaa

SEQ ID NO: 560583 - DNA, 20 bp, Artificial Sequence
  chemically synthesized
cctaaagtcataaacagaga

SEQ ID NO: 560584 - DNA, 20 bp, Artificial Sequence
  chemically synthesized
tgtttaaaaatattataagt

SEQ ID NO: 560585 - DNA, 20 bp, Artificial Sequence
  chemically synthesized
aattatttccaaaagcagaa

SEQ ID NO: 560586 - DNA, 20 bp, Artificial Sequence
  chemically synthesized
agcagcacatcaagagcacc

SEQ ID NO: 560587 - DNA, 20 bp, Artificial Sequence
  chemically synthesized
tatattacatcaaattatct

SEQ ID NO: 560588 - DNA, 20 bp, Artificial Sequence
  chemically synthesized
taatcatacccgaaacctgt

SEQ ID NO: 560589 - DNA, 20 bp, Artificial Sequence
  chemically synthesized
acccgaaacctgtcaaaact

SEQ ID NO: 560590 - DNA, 20 bp, Artificial Sequence
  chemically synthesized
agataatcaatactatgttt

SEQ ID NO: 560591 - DNA, 20 bp, Artificial Sequence
  chemically synthesized
gtaatataaagcctatatat

SEQ ID NO: 560592 - DNA, 20 bp, Artificial Sequence
  chemically synthesized
tgaaagtacggcagctcttc

SEQ ID NO: 560593 - DNA, 20 bp, Artificial Sequence
  chemically synthesized
aaaattatgcaaattgagta

SEQ ID NO: 560594 - DNA, 20 bp, Artificial Sequence
  chemically synthesized
ctttgaggtctgttggatgc

SEQ ID NO: 560595 - DNA, 20 bp, Artificial Sequence
  chemically synthesized
aagatggtcaattacatgct

SEQ ID NO: 560596 - DNA, 20 bp, Artificial Sequence
  chemically synthesized
ctatttttcaatgtgaagac

SEQ ID NO: 560597 - DNA, 20 bp, Artificial Sequence
  chemically synthesized
tcaatgtgaagacaaaaact

SEQ ID NO: 560598 - DNA, 20 bp, Artificial Sequence
  chemically synthesized
ggcaattgaacaaataataa

SEQ ID NO: 560599 - DNA, 20 bp, Artificial Sequence
  chemically synthesized
aatgatgatatagccatata

SEQ ID NO: 560600 - DNA, 20 bp, Artificial Sequence
  chemically synthesized
ggtgattgtgcatgggctta

SEQ ID NO: 560601 - DNA, 20 bp, Artificial Sequence
  chemically synthesized
aatcacatcactcttctgct

SEQ ID NO: 560602 - DNA, 20 bp, Artificial Sequence
  chemically synthesized
tgtctgccagatggtcttgt

SEQ ID NO: 560603 - DNA, 20 bp, Artificial Sequence
  chemically synthesized
tctcaaaaaaaaaaaaaaaa

SEQ ID NO: 560604 - DNA, 20 bp, Artificial Sequence
  chemically synthesized
acacctgatgttgttgatta

SEQ ID NO: 560605 - DNA, 20 bp, Artificial Sequence
  chemically synthesized
tgaaaccttactgacacagg

SEQ ID NO: 560606 - DNA, 20 bp, Artificial Sequence
  chemically synthesized
caattcaaatttaccctatg

SEQ ID NO: 560607 - DNA, 20 bp, Artificial Sequence
  chemically synthesized
aaaatcaaagcagatgctag

SEQ ID NO: 560608 - DNA, 20 bp, Artificial Sequence
  chemically synthesized
agatgctagaaaaacaggaa

SEQ ID NO: 560609 - DNA, 20 bp, Artificial Sequence
  chemically synthesized
cattgtggctagcatactgt

SEQ ID NO: 560610 - DNA, 20 bp, Artificial Sequence
  chemically synthesized
ttcccccaaaagattaccgg

SEQ ID NO: 560611 - DNA, 20 bp, Artificial Sequence
  chemically synthesized
atatatactgaggacttcaa

SEQ ID NO: 560612 - DNA, 20 bp, Artificial Sequence
  chemically synthesized
tacctaatgcatgcagggct

SEQ ID NO: 560613 - DNA, 20 bp, Artificial Sequence
  chemically synthesized
agcaaactaacccaggaaca

SEQ ID NO: 560614 - DNA, 20 bp, Artificial Sequence
  chemically synthesized
taatctgtctccaaaaaaaa

SEQ ID NO: 560615 - DNA, 20 bp, Artificial Sequence
  chemically synthesized
gttttgaattccttgcctca

SEQ ID NO: 560616 - DNA, 20 bp, Artificial Sequence
  chemically synthesized
gttttgtgaggcaaggaatt

SEQ ID NO: 560617 - DNA, 20 bp, Artificial Sequence
  chemically synthesized
gtcctaatacatttcctcca

SEQ ID NO: 560618 - DNA, 20 bp, Artificial Sequence
  chemically synthesized
aaactggaaaaaaaaaaaaa

SEQ ID NO: 560619 - DNA, 20 bp, Artificial Sequence
  chemically synthesized
accattatctgacttgagta

SEQ ID NO: 560620 - DNA, 20 bp, Artificial Sequence
  chemically synthesized
gaccagcctggccaacatag

SEQ ID NO: 560621 - DNA, 20 bp, Artificial Sequence
  chemically synthesized
tgtaagaatgtaatcactat

SEQ ID NO: 560622 - DNA, 20 bp, Artificial Sequence
  chemically synthesized
caacagactattccatttag

SEQ ID NO: 560623 - DNA, 20 bp, Artificial Sequence
  chemically synthesized
cttgagaaacaagccctgtc

SEQ ID NO: 560624 - DNA, 20 bp, Artificial Sequence
  chemically synthesized
acattgctgtagaaggtgct

SEQ ID NO: 560625 - DNA, 20 bp, Artificial Sequence
  chemically synthesized
aattccagcagcaagtgttt

SEQ ID NO: 560626 - DNA, 20 bp, Artificial Sequence
  chemically synthesized
tatcaggcggcattttgttt

SEQ ID NO: 560627 - DNA, 20 bp, Artificial Sequence
  chemically synthesized
tttaacatgatttgatttta

SEQ ID NO: 560628 - DNA, 20 bp, Artificial Sequence
  chemically synthesized
tatgccatcttgctctctga

SEQ ID NO: 560629 - DNA, 20 bp, Artificial Sequence
  chemically synthesized
tagttaaatactaatgggat

SEQ ID NO: 560630 - DNA, 20 bp, Artificial Sequence
  chemically synthesized
gatttttaagtataagtgtg

SEQ ID NO: 560631 - DNA, 20 bp, Artificial Sequence
  chemically synthesized
acagcacacaagtatacttc

SEQ ID NO: 560632 - DNA, 20 bp, Artificial Sequence
  chemically synthesized
cagatagatagatcgatcaa

SEQ ID NO: 560633 - DNA, 20 bp, Artificial Sequence
  chemically synthesized
ctttaggaaggattgccaaa

SEQ ID NO: 560634 - DNA, 20 bp, Artificial Sequence
  chemically synthesized
gaaacacatgacttgttatt

SEQ ID NO: 560635 - DNA, 20 bp, Artificial Sequence
  chemically synthesized
gaatgctacctaaattatca

SEQ ID NO: 560636 - DNA, 20 bp, Artificial Sequence
  chemically synthesized
cactactgccatagcaggaa

SEQ ID NO: 560637 - DNA, 20 bp, Artificial Sequence
  chemically synthesized
gatgctttgggttaggtcat

SEQ ID NO: 560638 - DNA, 20 bp, Artificial Sequence
  chemically synthesized
attggaataagaagtttgtt

SEQ ID NO: 560639 - DNA, 20 bp, Artificial Sequence
  chemically synthesized
accctatataaatgttattt

SEQ ID NO: 560640 - DNA, 20 bp, Artificial Sequence
  chemically synthesized
tgttattttaaaacaaaaga

SEQ ID NO: 560641 - DNA, 20 bp, Artificial Sequence
  chemically synthesized
cattaaaatgtaaaagtcaa

SEQ ID NO: 560642 - DNA, 20 bp, Artificial Sequence
  chemically synthesized
ttggtttattgtttctctga

SEQ ID NO: 560643 - DNA, 20 bp, Artificial Sequence
  chemically synthesized
atgaagataaatatatgtca

SEQ ID NO: 560644 - DNA, 20 bp, Artificial Sequence
  chemically synthesized
taaaaaaaatgcagtggata

SEQ ID NO: 560645 - DNA, 20 bp, Artificial Sequence
  chemically synthesized
tttatattattaaatcatgg

SEQ ID NO: 560646 - DNA, 20 bp, Artificial Sequence
  chemically synthesized
ctggcagccatctatcataa

SEQ ID NO: 560647 - DNA, 20 bp, Artificial Sequence
  chemically synthesized
tacacatacacacacataca

SEQ ID NO: 560648 - DNA, 20 bp, Artificial Sequence
  chemically synthesized
taatggaaaactcttctcaa

SEQ ID NO: 560649 - DNA, 20 bp, Artificial Sequence
  chemically synthesized
tgatgtttggtacaataatg

SEQ ID NO: 560650 - DNA, 20 bp, Artificial Sequence
  chemically synthesized
tgatacttggtacatgatta

SEQ ID NO: 560651 - DNA, 20 bp, Artificial Sequence
  chemically synthesized
cctctttaaaccaagaaaga

SEQ ID NO: 560652 - DNA, 20 bp, Artificial Sequence
  chemically synthesized
ttcttttttttctgtacttc

SEQ ID NO: 560653 - DNA, 20 bp, Artificial Sequence
  chemically synthesized
agaggttaacatttgaagcc

SEQ ID NO: 560654 - DNA, 20 bp, Artificial Sequence
  chemically synthesized
aagaaaccccaggtctaact

SEQ ID NO: 560655 - DNA, 20 bp, Artificial Sequence
  chemically synthesized
agtagaataataaagtaaca

SEQ ID NO: 560656 - DNA, 20 bp, Artificial Sequence
  chemically synthesized
ttagaagggcacatcctgat

SEQ ID NO: 560657 - DNA, 20 bp, Artificial Sequence
  chemically synthesized
ctcctcaaaaagagcaagta

SEQ ID NO: 560658 - DNA, 20 bp, Artificial Sequence
  chemically synthesized
gtatcccacttggcttgcac

SEQ ID NO: 560659 - DNA, 20 bp, Artificial Sequence
  chemically synthesized
acttctccttaaatccataa

SEQ ID NO: 560660 - DNA, 20 bp, Artificial Sequence
  chemically synthesized
ttgctataaatcagaatctt

SEQ ID NO: 560661 - DNA, 20 bp, Artificial Sequence
  chemically synthesized
gtgtgcataagtgtgtttat

SEQ ID NO: 560662 - DNA, 20 bp, Artificial Sequence
  chemically synthesized
gattcagagcccagaaattg

SEQ ID NO: 560663 - DNA, 20 bp, Artificial Sequence
  chemically synthesized
aatttttaactctgtcaact

SEQ ID NO: 560664 - DNA, 20 bp, Artificial Sequence
  chemically synthesized
ataacaatcatcacagttta

SEQ ID NO: 560665 - DNA, 20 bp, Artificial Sequence
  chemically synthesized
aatgttagcccgtgtcttta

SEQ ID NO: 560666 - DNA, 20 bp, Artificial Sequence
  chemically synthesized
tagcccgtgtctttaaaaaa

SEQ ID NO: 560667 - DNA, 20 bp, Artificial Sequence
  chemically synthesized
aaaaatcacaatttaataga

SEQ ID NO: 560668 - DNA, 20 bp, Artificial Sequence
  chemically synthesized
tttttaaatgtcaataaatg

SEQ ID NO: 560669 - DNA, 20 bp, Artificial Sequence
  chemically synthesized
aaacatgtaatttaaaaatg

SEQ ID NO: 560670 - DNA, 20 bp, Artificial Sequence
  chemically synthesized
ttaaaacatgcaaaaataaa

SEQ ID NO: 560671 - DNA, 20 bp, Artificial Sequence
  chemically synthesized
gtcagtgaaattacatattt

SEQ ID NO: 560672 - DNA, 20 bp, Artificial Sequence
  chemically synthesized
acacaaataatttatttttt

SEQ ID NO: 560673 - DNA, 20 bp, Artificial Sequence
  chemically synthesized
attcagtctttaaaaagaag

SEQ ID NO: 560674 - DNA, 20 bp, Artificial Sequence
  chemically synthesized
gtgatacataaaacatttgt

SEQ ID NO: 560675 - DNA, 20 bp, Artificial Sequence
  chemically synthesized
atcatctgctttgtgataca

SEQ ID NO: 560676 - DNA, 20 bp, Artificial Sequence
  chemically synthesized
cctccttacaactttggcaa

SEQ ID NO: 560677 - DNA, 20 bp, Artificial Sequence
  chemically synthesized
taaatataaaaatttaaaca

SEQ ID NO: 560678 - DNA, 20 bp, Artificial Sequence
  chemically synthesized
aaaacaaatgtactgaaaga

SEQ ID NO: 560679 - DNA, 20 bp, Artificial Sequence
  chemically synthesized
aattataccatatcatgaag

SEQ ID NO: 560680 - DNA, 20 bp, Artificial Sequence
  chemically synthesized
gtaaataaaatagaaactag

SEQ ID NO: 560681 - DNA, 20 bp, Artificial Sequence
  chemically synthesized
cttttcacaaaaaaaaaaac

SEQ ID NO: 560682 - DNA, 20 bp, Artificial Sequence
  chemically synthesized
gtctatcttttcacaaaaaa

SEQ ID NO: 560683 - DNA, 20 bp, Artificial Sequence
  chemically synthesized
tcattcacttaacaaggaca

SEQ ID NO: 560684 - DNA, 20 bp, Artificial Sequence
  chemically synthesized
ttatgaactaaatgtaattc

SEQ ID NO: 560685 - DNA, 20 bp, Artificial Sequence
  chemically synthesized
gtgtttttcgctttgccaat

SEQ ID NO: 560686 - DNA, 20 bp, Artificial Sequence
  chemically synthesized
aagttttaattggcaaagcg

SEQ ID NO: 560687 - DNA, 20 bp, Artificial Sequence
  chemically synthesized
ttggcaaagcgaaaaacact

SEQ ID NO: 560688 - DNA, 20 bp, Artificial Sequence
  chemically synthesized
tactgtgaaaagggaatgaa

SEQ ID NO: 560689 - DNA, 20 bp, Artificial Sequence
  chemically synthesized
cctaaatttttgtactctta

SEQ ID NO: 560690 - DNA, 20 bp, Artificial Sequence
  chemically synthesized
aaaaacgtcaggcctttgaa

SEQ ID NO: 560691 - DNA, 20 bp, Artificial Sequence
  chemically synthesized
cagtcttatttgtgttggac

SEQ ID NO: 560692 - DNA, 20 bp, Artificial Sequence
  chemically synthesized
ttatgctttaatttattgag

SEQ ID NO: 560693 - DNA, 20 bp, Artificial Sequence
  chemically synthesized
atattacttcaaaaattagt

SEQ ID NO: 560694 - DNA, 20 bp, Artificial Sequence
  chemically synthesized
agtcaaagttgttttgaaca

SEQ ID NO: 560695 - DNA, 20 bp, Artificial Sequence
  chemically synthesized
tagcctgagggttttctgtt

SEQ ID NO: 560696 - DNA, 20 bp, Artificial Sequence
  chemically synthesized
caaaaagattagataaagag

SEQ ID NO: 560697 - DNA, 20 bp, Artificial Sequence
  chemically synthesized
gtaagagaaggaagatgacg

SEQ ID NO: 560698 - DNA, 20 bp, Artificial Sequence
  chemically synthesized
ttatattgcaggacctgctt

SEQ ID NO: 560699 - DNA, 20 bp, Artificial Sequence
  chemically synthesized
gtcgtttttccctaatgagt

SEQ ID NO: 560700 - DNA, 20 bp, Artificial Sequence
  chemically synthesized
ggagtttttactcattaggg

SEQ ID NO: 560701 - DNA, 20 bp, Artificial Sequence
  chemically synthesized
gccatatgaataactggggg

SEQ ID NO: 560702 - DNA, 20 bp, Artificial Sequence
  chemically synthesized
tttacactcggaagaaaatc

SEQ ID NO: 560703 - DNA, 20 bp, Artificial Sequence
  chemically synthesized
cttgaagagttcatatcaaa

SEQ ID NO: 560704 - DNA, 20 bp, Artificial Sequence
  chemically synthesized
gacaaaatgaactatgaaat

SEQ ID NO: 560705 - DNA, 20 bp, Artificial Sequence
  chemically synthesized
agcaaactatcgcaaggaca

SEQ ID NO: 560706 - DNA, 20 bp, Artificial Sequence
  chemically synthesized
atattgaggcaatatgtctc

SEQ ID NO: 560707 - DNA, 20 bp, Artificial Sequence
  chemically synthesized
gtgaaatgttatagcacata

SEQ ID NO: 560708 - DNA, 20 bp, Artificial Sequence
  chemically synthesized
cacagatatatactctattt

SEQ ID NO: 560709 - DNA, 20 bp, Artificial Sequence
  chemically synthesized
agtgatcaccataggattaa

SEQ ID NO: 560710 - DNA, 20 bp, Artificial Sequence
  chemically synthesized
ttattaaactttccctcttt

SEQ ID NO: 560711 - DNA, 20 bp, Artificial Sequence
  chemically synthesized
gaaatgatgtaagacatagt

SEQ ID NO: 560712 - DNA, 20 bp, Artificial Sequence
  chemically synthesized
aatgctgataaatcaataag

SEQ ID NO: 560713 - DNA, 20 bp, Artificial Sequence
  chemically synthesized
taagatttttaagagcttat

SEQ ID NO: 560714 - DNA, 20 bp, Artificial Sequence
  chemically synthesized
acaatgggattacttcacaa

SEQ ID NO: 560715 - DNA, 20 bp, Artificial Sequence
  chemically synthesized
taagggggtaaactcttagt

SEQ ID NO: 560716 - DNA, 20 bp, Artificial Sequence
  chemically synthesized
ttcagccggggcaacagagc

SEQ ID NO: 560717 - DNA, 20 bp, Artificial Sequence
  chemically synthesized
tgacaaccatgattgaaaat

SEQ ID NO: 560718 - DNA, 20 bp, Artificial Sequence
  chemically synthesized
aaaatattaaaatattttct

SEQ ID NO: 560719 - DNA, 20 bp, Artificial Sequence
  chemically synthesized
aagatctgtacaagcttacc

SEQ ID NO: 560720 - DNA, 20 bp, Artificial Sequence
  chemically synthesized
gaatcaaaagagataataag

SEQ ID NO: 560721 - DNA, 20 bp, Artificial Sequence
  chemically synthesized
ctcaaaacttgggagcttat

SEQ ID NO: 560722 - DNA, 20 bp, Artificial Sequence
  chemically synthesized
tgccatatagcaaatcaact

SEQ ID NO: 560723 - DNA, 20 bp, Artificial Sequence
  chemically synthesized
gatttgtaaaagaaaaataa

SEQ ID NO: 560724 - DNA, 20 bp, Artificial Sequence
  chemically synthesized
tatctttattttagagatga

SEQ ID NO: 560725 - DNA, 20 bp, Artificial Sequence
  chemically synthesized
catagctaagatattaagat

SEQ ID NO: 560726 - DNA, 20 bp, Artificial Sequence
  chemically synthesized
gaatagaataattcagagga

SEQ ID NO: 560727 - DNA, 20 bp, Artificial Sequence
  chemically synthesized
tgatttagtgtaagtaactt

SEQ ID NO: 560728 - DNA, 20 bp, Artificial Sequence
  chemically synthesized
ttacactaaatcattttttt

SEQ ID NO: 560729 - DNA, 20 bp, Artificial Sequence
  chemically synthesized
gcgttattgtgttatagtcc

SEQ ID NO: 560730 - DNA, 20 bp, Artificial Sequence
  chemically synthesized
acaccaagaaactgtaatct

SEQ ID NO: 560731 - DNA, 20 bp, Artificial Sequence
  chemically synthesized
tggttaaattcctagaaaca

SEQ ID NO: 560732 - DNA, 20 bp, Artificial Sequence
  chemically synthesized
atgcttcacgaactctttga

SEQ ID NO: 560733 - DNA, 20 bp, Artificial Sequence
  chemically synthesized
gccagaaaaagacatcccaa

SEQ ID NO: 560734 - DNA, 20 bp, Artificial Sequence
  chemically synthesized
tgttcatttcattagatgct

SEQ ID NO: 560735 - DNA, 20 bp, Artificial Sequence
  chemically synthesized
acacaatttcactatttaaa

SEQ ID NO: 560736 - DNA, 20 bp, Artificial Sequence
  chemically synthesized
atgacataatcttatgaata

SEQ ID NO: 560737 - DNA, 20 bp, Artificial Sequence
  chemically synthesized
agaaaaccctagaatccatt

SEQ ID NO: 560738 - DNA, 20 bp, Artificial Sequence
  chemically synthesized
attcacaagagcaccaaaaa

SEQ ID NO: 560739 - DNA, 20 bp, Artificial Sequence
  chemically synthesized
gaggtcaaagagtatgtact

SEQ ID NO: 560740 - DNA, 20 bp, Artificial Sequence
  chemically synthesized
agagtatgtactgaaaacta

SEQ ID NO: 560741 - DNA, 20 bp, Artificial Sequence
  chemically synthesized
catttttcacagaaacagag

SEQ ID NO: 560742 - DNA, 20 bp, Artificial Sequence
  chemically synthesized
tcttcaacaaatggtgttgg

SEQ ID NO: 560743 - DNA, 20 bp, Artificial Sequence
  chemically synthesized
acggataaaatatgtaaatg

SEQ ID NO: 560744 - DNA, 20 bp, Artificial Sequence
  chemically synthesized
aaatgtaaaacctcaatcca

SEQ ID NO: 560745 - DNA, 20 bp, Artificial Sequence
  chemically synthesized
aatccataaaactcctagaa

SEQ ID NO: 560746 - DNA, 20 bp, Artificial Sequence
  chemically synthesized
aaaatagaattaagactaca

SEQ ID NO: 560747 - DNA, 20 bp, Artificial Sequence
  chemically synthesized
caactcattggcaaaaaaaa

SEQ ID NO: 560748 - DNA, 20 bp, Artificial Sequence
  chemically synthesized
ttggcaaaaaaaaaaaaact

SEQ ID NO: 560749 - DNA, 20 bp, Artificial Sequence
  chemically synthesized
atagttgctcctcaaaaatt

SEQ ID NO: 560750 - DNA, 20 bp, Artificial Sequence
  chemically synthesized
aagacttctgagtagaattt

SEQ ID NO: 560751 - DNA, 20 bp, Artificial Sequence
  chemically synthesized
accaatttatagagttgagc

SEQ ID NO: 560752 - DNA, 20 bp, Artificial Sequence
  chemically synthesized
cttctcataaaagtgctaat

SEQ ID NO: 560753 - DNA, 20 bp, Artificial Sequence
  chemically synthesized
ataagcacattgtaagttct

SEQ ID NO: 560754 - DNA, 20 bp, Artificial Sequence
  chemically synthesized
agttctttagttcagatgtt

SEQ ID NO: 560755 - DNA, 20 bp, Artificial Sequence
  chemically synthesized
tagttgatggccacagggac

SEQ ID NO: 560756 - DNA, 20 bp, Artificial Sequence
  chemically synthesized
gacagggcaagactcggtct

SEQ ID NO: 560757 - DNA, 20 bp, Artificial Sequence
  chemically synthesized
ggcaaaatgctgtttctact

SEQ ID NO: 560758 - DNA, 20 bp, Artificial Sequence
  chemically synthesized
accctcattgtaacacttaa

SEQ ID NO: 560759 - DNA, 20 bp, Artificial Sequence
  chemically synthesized
ctaacactcctattcactct

SEQ ID NO: 560760 - DNA, 20 bp, Artificial Sequence
  chemically synthesized
aaattattcagtgaatttag

SEQ ID NO: 560761 - DNA, 20 bp, Artificial Sequence
  chemically synthesized
ttaggtatcttcctttctct

SEQ ID NO: 560762 - DNA, 20 bp, Artificial Sequence
  chemically synthesized
cacctcaagattaatatgtt

SEQ ID NO: 560763 - DNA, 20 bp, Artificial Sequence
  chemically synthesized
gaccaaccgaaccaacatgg

SEQ ID NO: 560764 - DNA, 20 bp, Artificial Sequence
  chemically synthesized
taccatttattaaatgagtt

SEQ ID NO: 560765 - DNA, 20 bp, Artificial Sequence
  chemically synthesized
gcaagtgacacataaacatg

SEQ ID NO: 560766 - DNA, 20 bp, Artificial Sequence
  chemically synthesized
acaaattaagttggccaatt

SEQ ID NO: 560767 - DNA, 20 bp, Artificial Sequence
  chemically synthesized
gtgggtgactgtcccctatg

SEQ ID NO: 560768 - DNA, 20 bp, Artificial Sequence
  chemically synthesized
tttgaatggcttattttaaa

SEQ ID NO: 560769 - DNA, 20 bp, Artificial Sequence
  chemically synthesized
ctaccagaataggcattgga

SEQ ID NO: 560770 - DNA, 20 bp, Artificial Sequence
  chemically synthesized
agtgataatgagagggggaa

SEQ ID NO: 560771 - DNA, 20 bp, Artificial Sequence
  chemically synthesized
ctagaggatgtgatttttat

SEQ ID NO: 560772 - DNA, 20 bp, Artificial Sequence
  chemically synthesized
catacaatattgaaagggtg

SEQ ID NO: 560773 - DNA, 20 bp, Artificial Sequence
  chemically synthesized
acttttcgaagttacatata

SEQ ID NO: 560774 - DNA, 20 bp, Artificial Sequence
  chemically synthesized
aaaggctgctaatggttata

SEQ ID NO: 560775 - DNA, 20 bp, Artificial Sequence
  chemically synthesized
gaatcacatgagggaatcaa

SEQ ID NO: 560776 - DNA, 20 bp, Artificial Sequence
  chemically synthesized
agggaatcaataaaacttgg

SEQ ID NO: 560777 - DNA, 20 bp, Artificial Sequence
  chemically synthesized
agtggatagagaggaggggg

SEQ ID NO: 560778 - DNA, 20 bp, Artificial Sequence
  chemically synthesized
gactactttccaacatggta

SEQ ID NO: 560779 - DNA, 20 bp, Artificial Sequence
  chemically synthesized
atggtactcttcaatccggc

SEQ ID NO: 560780 - DNA, 20 bp, Artificial Sequence
  chemically synthesized
tctctaaatccaaagtaaat

SEQ ID NO: 560781 - DNA, 20 bp, Artificial Sequence
  chemically synthesized
ttgtgcctgagaaagcatag

SEQ ID NO: 560782 - DNA, 20 bp, Artificial Sequence
  chemically synthesized
atttcaaataaacaataaag

SEQ ID NO: 560783 - DNA, 20 bp, Artificial Sequence
  chemically synthesized
attgtttatttgaaatagtt

SEQ ID NO: 560784 - DNA, 20 bp, Artificial Sequence
  chemically synthesized
taaagtattttttaatgatt

SEQ ID NO: 560785 - DNA, 20 bp, Artificial Sequence
  chemically synthesized
attgactacaatattcattt

SEQ ID NO: 560786 - DNA, 20 bp, Artificial Sequence
  chemically synthesized
gtaatacctaaaaatgcata

SEQ ID NO: 560787 - DNA, 20 bp, Artificial Sequence
  chemically synthesized
ctaaaaatgcatataaaaca

SEQ ID NO: 560788 - DNA, 20 bp, Artificial Sequence
  chemically synthesized
tcaatgctcacttgttgagg

SEQ ID NO: 560789 - DNA, 20 bp, Artificial Sequence
  chemically synthesized
tttattttccttgttcatat

SEQ ID NO: 560790 - DNA, 20 bp, Artificial Sequence
  chemically synthesized
aacatgctaagcatatgaag

SEQ ID NO: 560791 - DNA, 20 bp, Artificial Sequence
  chemically synthesized
tccagaacgtatacatattt

SEQ ID NO: 560792 - DNA, 20 bp, Artificial Sequence
  chemically synthesized
tttatattcattaatgatta

SEQ ID NO: 560793 - DNA, 20 bp, Artificial Sequence
  chemically synthesized
tgaatcacctggggatcttt

SEQ ID NO: 560794 - DNA, 20 bp, Artificial Sequence
  chemically synthesized
ctacattttgaataagggcc

SEQ ID NO: 560795 - DNA, 20 bp, Artificial Sequence
  chemically synthesized
tgaataaatgaataaaacaa

SEQ ID NO: 560796 - DNA, 20 bp, Artificial Sequence
  chemically synthesized
atatcatttgaataaatgaa

SEQ ID NO: 560797 - DNA, 20 bp, Artificial Sequence
  chemically synthesized
acaattggtcaaatattttg

SEQ ID NO: 560798 - DNA, 20 bp, Artificial Sequence
  chemically synthesized
ttcatttttagtatattaaa

SEQ ID NO: 560799 - DNA, 20 bp, Artificial Sequence
  chemically synthesized
taaataaaaccatgatgtga

SEQ ID NO: 560800 - DNA, 20 bp, Artificial Sequence
  chemically synthesized
tgtaataaatttcatttaca

SEQ ID NO: 560801 - DNA, 20 bp, Artificial Sequence
  chemically synthesized
ttctgagattatgtggaatt

SEQ ID NO: 560802 - DNA, 20 bp, Artificial Sequence
  chemically synthesized
cttagagagagtagagtagt

SEQ ID NO: 560803 - DNA, 20 bp, Artificial Sequence
  chemically synthesized
aaactggtagattgtacata

SEQ ID NO: 560804 - DNA, 20 bp, Artificial Sequence
  chemically synthesized
ggatcatcaacagcaaacta

SEQ ID NO: 560805 - DNA, 20 bp, Artificial Sequence
  chemically synthesized
tacagaatggattgctggag

SEQ ID NO: 560806 - DNA, 20 bp, Artificial Sequence
  chemically synthesized
caactgtgtacgggggaaat

SEQ ID NO: 560807 - DNA, 20 bp, Artificial Sequence
  chemically synthesized
aaagattaataaactgacaa

SEQ ID NO: 560808 - DNA, 20 bp, Artificial Sequence
  chemically synthesized
tggacttctgactccccccg

SEQ ID NO: 560809 - DNA, 20 bp, Artificial Sequence
  chemically synthesized
agcccaaatccaatgtttag

SEQ ID NO: 560810 - DNA, 20 bp, Artificial Sequence
  chemically synthesized
gctgtttctatcattaacac

SEQ ID NO: 560811 - DNA, 20 bp, Artificial Sequence
  chemically synthesized
gatgaaagcagtgccttcaa

SEQ ID NO: 560812 - DNA, 20 bp, Artificial Sequence
  chemically synthesized
aatgcatagcatgtgtaatt

SEQ ID NO: 560813 - DNA, 20 bp, Artificial Sequence
  chemically synthesized
tcacagtttttgttgtttaa

SEQ ID NO: 560814 - DNA, 20 bp, Artificial Sequence
  chemically synthesized
taagagttttattaaacaac

SEQ ID NO: 560815 - DNA, 20 bp, Artificial Sequence
  chemically synthesized
agccagaatgctcaaaatat

SEQ ID NO: 560816 - DNA, 20 bp, Artificial Sequence
  chemically synthesized
ggcctatatgttggcacaac

SEQ ID NO: 560817 - DNA, 20 bp, Artificial Sequence
  chemically synthesized
atatttatccaggagaaaca

SEQ ID NO: 560818 - DNA, 20 bp, Artificial Sequence
  chemically synthesized
tgcttatggtgtaactagca

SEQ ID NO: 560819 - DNA, 20 bp, Artificial Sequence
  chemically synthesized
ccatcatcttgttacaagta

SEQ ID NO: 560820 - DNA, 20 bp, Artificial Sequence
  chemically synthesized
gccatcagagaaatgcaaat

SEQ ID NO: 560821 - DNA, 20 bp, Artificial Sequence
  chemically synthesized
ctgagacatttattcagcca

SEQ ID NO: 560822 - DNA, 20 bp, Artificial Sequence
  chemically synthesized
agcaaactatcacaaggaca

SEQ ID NO: 560823 - DNA, 20 bp, Artificial Sequence
  chemically synthesized
cacgttgtgcacatgtaccc

SEQ ID NO: 560824 - DNA, 20 bp, Artificial Sequence
  chemically synthesized
gagagtgagactccatctca

SEQ ID NO: 560825 - DNA, 20 bp, Artificial Sequence
  chemically synthesized
aacaaaaaattaaaaaagaa

SEQ ID NO: 560826 - DNA, 20 bp, Artificial Sequence
  chemically synthesized
ttttagaagactgatacact

SEQ ID NO: 560827 - DNA, 20 bp, Artificial Sequence
  chemically synthesized
gaagtaatgatagtgattgt

SEQ ID NO: 560828 - DNA, 20 bp, Artificial Sequence
  chemically synthesized
tccattctgatttaatttcc

SEQ ID NO: 560829 - DNA, 20 bp, Artificial Sequence
  chemically synthesized
caactgaaacacgtcttatt

SEQ ID NO: 560830 - DNA, 20 bp, Artificial Sequence
  chemically synthesized
cggcagaaatttgatttttg

SEQ ID NO: 560831 - DNA, 20 bp, Artificial Sequence
  chemically synthesized
gcatgggagactacagatag

SEQ ID NO: 560832 - DNA, 20 bp, Artificial Sequence
  chemically synthesized
ttaggtcaaaagcaaagcac

SEQ ID NO: 560833 - DNA, 20 bp, Artificial Sequence
  chemically synthesized
catatttttttcaaaaaaaa

SEQ ID NO: 560834 - DNA, 20 bp, Artificial Sequence
  chemically synthesized
atatgactcattttatagat

SEQ ID NO: 560835 - DNA, 20 bp, Artificial Sequence
  chemically synthesized
aaatggagccattctaatta

SEQ ID NO: 560836 - DNA, 20 bp, Artificial Sequence
  chemically synthesized
ctgatgtgactctctcagca

SEQ ID NO: 560837 - DNA, 20 bp, Artificial Sequence
  chemically synthesized
ataaggggttcagtgttgag

SEQ ID NO: 560838 - DNA, 20 bp, Artificial Sequence
  chemically synthesized
aaaactttggattagttcag

SEQ ID NO: 560839 - DNA, 20 bp, Artificial Sequence
  chemically synthesized
ttttcagttagagtactact

SEQ ID NO: 560840 - DNA, 20 bp, Artificial Sequence
  chemically synthesized
ttttcagtagtactctaact

SEQ ID NO: 560841 - DNA, 20 bp, Artificial Sequence
  chemically synthesized
tgaaaaagagagtaagcatc

SEQ ID NO: 560842 - DNA, 20 bp, Artificial Sequence
  chemically synthesized
taaatgatgttaagaatgcg

SEQ ID NO: 560843 - DNA, 20 bp, Artificial Sequence
  chemically synthesized
cggtatttgagatgcaaaaa

SEQ ID NO: 560844 - DNA, 20 bp, Artificial Sequence
  chemically synthesized
gccttcggtatttgagatgc

SEQ ID NO: 560845 - DNA, 20 bp, Artificial Sequence
  chemically synthesized
tattttttatataagaatat

SEQ ID NO: 560846 - DNA, 20 bp, Artificial Sequence
  chemically synthesized
tactacttctcagtcattgg

SEQ ID NO: 560847 - DNA, 20 bp, Artificial Sequence
  chemically synthesized
gtatataattgatacttgat

SEQ ID NO: 560848 - DNA, 20 bp, Artificial Sequence
  chemically synthesized
gtggtgaatttaaatgaaaa

SEQ ID NO: 560849 - DNA, 20 bp, Artificial Sequence
  chemically synthesized
ttggaaatgtgatcaataag

SEQ ID NO: 560850 - DNA, 20 bp, Artificial Sequence
  chemically synthesized
tgaaaatactcaagacacag

SEQ ID NO: 560851 - DNA, 20 bp, Artificial Sequence
  chemically synthesized
ccaaagtttagaacaatgaa

SEQ ID NO: 560852 - DNA, 20 bp, Artificial Sequence
  chemically synthesized
aaaatagcaccgtgctttac

SEQ ID NO: 560853 - DNA, 20 bp, Artificial Sequence
  chemically synthesized
tgaattccttgtcatctcac

SEQ ID NO: 560854 - DNA, 20 bp, Artificial Sequence
  chemically synthesized
aagggattcaataaagaaac

SEQ ID NO: 560855 - DNA, 20 bp, Artificial Sequence
  chemically synthesized
ctcagtggctggatgagggt

SEQ ID NO: 560856 - DNA, 20 bp, Artificial Sequence
  chemically synthesized
taggaaagctttccctcaga

SEQ ID NO: 560857 - DNA, 20 bp, Artificial Sequence
  chemically synthesized
aacggttgaactcttggggc

SEQ ID NO: 560858 - DNA, 20 bp, Artificial Sequence
  chemically synthesized
catacatgcttattgtagtg

SEQ ID NO: 560859 - DNA, 20 bp, Artificial Sequence
  chemically synthesized
tgcttattgtagtggaaaac

SEQ ID NO: 560860 - DNA, 20 bp, Artificial Sequence
  chemically synthesized
ttttaaacttgaaatttgct

SEQ ID NO: 560861 - DNA, 20 bp, Artificial Sequence
  chemically synthesized
ctgaaatagtgagcaaaaat

SEQ ID NO: 560862 - DNA, 20 bp, Artificial Sequence
  chemically synthesized
gaaagaccattaaacagtaa

SEQ ID NO: 560863 - DNA, 20 bp, Artificial Sequence
  chemically synthesized
acaataatattaaggtgata

SEQ ID NO: 560864 - DNA, 20 bp, Artificial Sequence
  chemically synthesized
acaaattttagaattatcta

SEQ ID NO: 560865 - DNA, 20 bp, Artificial Sequence
  chemically synthesized
tacattagcctatactttgg

SEQ ID NO: 560866 - DNA, 20 bp, Artificial Sequence
  chemically synthesized
taacacaaagcctgttctat

SEQ ID NO: 560867 - DNA, 20 bp, Artificial Sequence
  chemically synthesized
cttgtgcggtttacttctaa

SEQ ID NO: 560868 - DNA, 20 bp, Artificial Sequence
  chemically synthesized
atagcatcatgtgtatacct

SEQ ID NO: 560869 - DNA, 20 bp, Artificial Sequence
  chemically synthesized
acaagttgaaagatctaata

SEQ ID NO: 560870 - DNA, 20 bp, Artificial Sequence
  chemically synthesized
gtataactatatagagagaa

SEQ ID NO: 560871 - DNA, 20 bp, Artificial Sequence
  chemically synthesized
ggcagagtgagacttcatct

SEQ ID NO: 560872 - DNA, 20 bp, Artificial Sequence
  chemically synthesized
tcacttgtttgtggaaactg

SEQ ID NO: 560873 - DNA, 20 bp, Artificial Sequence
  chemically synthesized
tagaagaaatttctaaccag

SEQ ID NO: 560874 - DNA, 20 bp, Artificial Sequence
  chemically synthesized
tgcagcctgaccatgtggta

SEQ ID NO: 560875 - DNA, 20 bp, Artificial Sequence
  chemically synthesized
gtcactcaatgccagcccat

SEQ ID NO: 560876 - DNA, 20 bp, Artificial Sequence
  chemically synthesized
ttacaggccctgtgcaagtc

SEQ ID NO: 560877 - DNA, 20 bp, Artificial Sequence
  chemically synthesized
tttatattaataataaaatg

SEQ ID NO: 560878 - DNA, 20 bp, Artificial Sequence
  chemically synthesized
ttaatataaatatgtcacat

SEQ ID NO: 560879 - DNA, 20 bp, Artificial Sequence
  chemically synthesized
tagcaaataattttgtcagc

SEQ ID NO: 560880 - DNA, 20 bp, Artificial Sequence
  chemically synthesized
tatttaatttactttaatat

SEQ ID NO: 560881 - DNA, 20 bp, Artificial Sequence
  chemically synthesized
aataaagaattgtggtagac

SEQ ID NO: 560882 - DNA, 20 bp, Artificial Sequence
  chemically synthesized
tttggatgtgagctaagtaa

SEQ ID NO: 560883 - DNA, 20 bp, Artificial Sequence
  chemically synthesized
ctcataatgtatgcatagat

SEQ ID NO: 560884 - DNA, 20 bp, Artificial Sequence
  chemically synthesized
caaacggccaacagggaaat

SEQ ID NO: 560885 - DNA, 20 bp, Artificial Sequence
  chemically synthesized
agattatgagtagatatttg

SEQ ID NO: 560886 - DNA, 20 bp, Artificial Sequence
  chemically synthesized
aagcttctggaaagcaaaag

SEQ ID NO: 560887 - DNA, 20 bp, Artificial Sequence
  chemically synthesized
cacatcaaaatttcaggcaa

SEQ ID NO: 560888 - DNA, 20 bp, Artificial Sequence
  chemically synthesized
aaatcataagactcctagaa

SEQ ID NO: 560889 - DNA, 20 bp, Artificial Sequence
  chemically synthesized
aaagagtattgtaatgccat

SEQ ID NO: 560890 - DNA, 20 bp, Artificial Sequence
  chemically synthesized
acagaaataaaagagcatta

SEQ ID NO: 560891 - DNA, 20 bp, Artificial Sequence
  chemically synthesized
aaataatcaaaaatagaaca

SEQ ID NO: 560892 - DNA, 20 bp, Artificial Sequence
  chemically synthesized
gcacacccccctatatactt

SEQ ID NO: 560893 - DNA, 20 bp, Artificial Sequence
  chemically synthesized
aatacgtacaaccaaaacta

SEQ ID NO: 560894 - DNA, 20 bp, Artificial Sequence
  chemically synthesized
aagtgaaaaatacgtacaac

SEQ ID NO: 560895 - DNA, 20 bp, Artificial Sequence
  chemically synthesized
actacattaacagaaagatg

SEQ ID NO: 560896 - DNA, 20 bp, Artificial Sequence
  chemically synthesized
tttaggtattcttaccatac

SEQ ID NO: 560897 - DNA, 20 bp, Artificial Sequence
  chemically synthesized
atagctaatcaactaaaaaa

SEQ ID NO: 560898 - DNA, 20 bp, Artificial Sequence
  chemically synthesized
ctgtaattcacccactttct

SEQ ID NO: 560899 - DNA, 20 bp, Artificial Sequence
  chemically synthesized
agtacatccagtaaaagaat

SEQ ID NO: 560900 - DNA, 20 bp, Artificial Sequence
  chemically synthesized
tccagtaaaagaataaaaac

SEQ ID NO: 560901 - DNA, 20 bp, Artificial Sequence
  chemically synthesized
atttacaattcagttaggaa

SEQ ID NO: 560902 - DNA, 20 bp, Artificial Sequence
  chemically synthesized
aatggaaaaaagagagctac

SEQ ID NO: 560903 - DNA, 20 bp, Artificial Sequence
  chemically synthesized
gttattgcagaaatggctaa

SEQ ID NO: 560904 - DNA, 20 bp, Artificial Sequence
  chemically synthesized
ttccatgccaatggaaacca

SEQ ID NO: 560905 - DNA, 20 bp, Artificial Sequence
  chemically synthesized
gacagaacagatttcaagac

SEQ ID NO: 560906 - DNA, 20 bp, Artificial Sequence
  chemically synthesized
caaaaattccttagaaagaa

SEQ ID NO: 560907 - DNA, 20 bp, Artificial Sequence
  chemically synthesized
taaaagtatatgagaatgtt

SEQ ID NO: 560908 - DNA, 20 bp, Artificial Sequence
  chemically synthesized
gtactaaaatatagtatttt

SEQ ID NO: 560909 - DNA, 20 bp, Artificial Sequence
  chemically synthesized
tgtcagtcataaataataaa

SEQ ID NO: 560910 - DNA, 20 bp, Artificial Sequence
  chemically synthesized
tttaccaaattagactgctg

SEQ ID NO: 560911 - DNA, 20 bp, Artificial Sequence
  chemically synthesized
ttactagaaaatgtaccaca

SEQ ID NO: 560912 - DNA, 20 bp, Artificial Sequence
  chemically synthesized
attacaaaaaaagttaaatt

SEQ ID NO: 560913 - DNA, 20 bp, Artificial Sequence
  chemically synthesized
tgctcttacactgcttgtac

SEQ ID NO: 560914 - DNA, 20 bp, Artificial Sequence
  chemically synthesized
tcaaaaatgtgattttcatg

SEQ ID NO: 560915 - DNA, 20 bp, Artificial Sequence
  chemically synthesized
aactgaaaatatccaaaatc

SEQ ID NO: 560916 - DNA, 20 bp, Artificial Sequence
  chemically synthesized
aatgttagctttccctataa

SEQ ID NO: 560917 - DNA, 20 bp, Artificial Sequence
  chemically synthesized
ttggcatatttctttttaac

SEQ ID NO: 560918 - DNA, 20 bp, Artificial Sequence
  chemically synthesized
tttttatactaagaaattca

SEQ ID NO: 560919 - DNA, 20 bp, Artificial Sequence
  chemically synthesized
tttgactttcctatcaaagt

SEQ ID NO: 560920 - DNA, 20 bp, Artificial Sequence
  chemically synthesized
caattttctaaatgtactag

SEQ ID NO: 560921 - DNA, 20 bp, Artificial Sequence
  chemically synthesized
cactgcagtttcccaaagcc

SEQ ID NO: 560922 - DNA, 20 bp, Artificial Sequence
  chemically synthesized
tggtgttacctgacatattt

SEQ ID NO: 560923 - DNA, 20 bp, Artificial Sequence
  chemically synthesized
gtaacaccaaagtaggacac

SEQ ID NO: 560924 - DNA, 20 bp, Artificial Sequence
  chemically synthesized
gagcctaccagtgggaaaat

SEQ ID NO: 560925 - DNA, 20 bp, Artificial Sequence
  chemically synthesized
gcgtgtttccgacgggctta

SEQ ID NO: 560926 - DNA, 20 bp, Artificial Sequence
  chemically synthesized
agggtcctgtctgttagaag

SEQ ID NO: 560927 - DNA, 20 bp, Artificial Sequence
  chemically synthesized
acagaaaggacatccacaca

SEQ ID NO: 560928 - DNA, 20 bp, Artificial Sequence
  chemically synthesized
catcaaagtccaaaagtaga

SEQ ID NO: 560929 - DNA, 20 bp, Artificial Sequence
  chemically synthesized
atggggaagaaacagagcag

SEQ ID NO: 560930 - DNA, 20 bp, Artificial Sequence
  chemically synthesized
aaaccaaaggcaaagaagtt

SEQ ID NO: 560931 - DNA, 20 bp, Artificial Sequence
  chemically synthesized
caaagaagttgaaaactttg

SEQ ID NO: 560932 - DNA, 20 bp, Artificial Sequence
  chemically synthesized
ttaaaggagctgatggagct

SEQ ID NO: 560933 - DNA, 20 bp, Artificial Sequence
  chemically synthesized
gggagaatggaaccaatttg

SEQ ID NO: 560934 - DNA, 20 bp, Artificial Sequence
  chemically synthesized
gaagatctaccaagcaaatg

SEQ ID NO: 560935 - DNA, 20 bp, Artificial Sequence
  chemically synthesized
gttgcaatcctagtctctga

SEQ ID NO: 560936 - DNA, 20 bp, Artificial Sequence
  chemically synthesized
tcagaattaagaatctcact

SEQ ID NO: 560937 - DNA, 20 bp, Artificial Sequence
  chemically synthesized
ctgaaggaaatagagacaca

SEQ ID NO: 560938 - DNA, 20 bp, Artificial Sequence
  chemically synthesized
ctattttgttgatcctttca

SEQ ID NO: 560939 - DNA, 20 bp, Artificial Sequence
  chemically synthesized
aatcctcaataaaatactgg

SEQ ID NO: 560940 - DNA, 20 bp, Artificial Sequence
  chemically synthesized
atataaacagagccaaagac

SEQ ID NO: 560941 - DNA, 20 bp, Artificial Sequence
  chemically synthesized
attcaacaacccttcatgct

SEQ ID NO: 560942 - DNA, 20 bp, Artificial Sequence
  chemically synthesized
caatatcatactgaatgggc

SEQ ID NO: 560943 - DNA, 20 bp, Artificial Sequence
  chemically synthesized
aaactggaagcattcccttt

SEQ ID NO: 560944 - DNA, 20 bp, Artificial Sequence
  chemically synthesized
atgacatgattgtatatcta

SEQ ID NO: 560945 - DNA, 20 bp, Artificial Sequence
  chemically synthesized
cctttcttcacagaattgga

SEQ ID NO: 560946 - DNA, 20 bp, Artificial Sequence
  chemically synthesized
tactacaaggctgcagtaac

SEQ ID NO: 560947 - DNA, 20 bp, Artificial Sequence
  chemically synthesized
aaacagcatggtactggtac

SEQ ID NO: 560948 - DNA, 20 bp, Artificial Sequence
  chemically synthesized
tgatctttgacaaacctgag

SEQ ID NO: 560949 - DNA, 20 bp, Artificial Sequence
  chemically synthesized
tatttaataaatggtgctag

SEQ ID NO: 560950 - DNA, 20 bp, Artificial Sequence
  chemically synthesized
aaatcaattcaacatggatt

SEQ ID NO: 560951 - DNA, 20 bp, Artificial Sequence
  chemically synthesized
aaaaacttaaacgttagacc

SEQ ID NO: 560952 - DNA, 20 bp, Artificial Sequence
  chemically synthesized
aacgttagacctaaaaccat

SEQ ID NO: 560953 - DNA, 20 bp, Artificial Sequence
  chemically synthesized
aaaccataaaaaccctggaa

SEQ ID NO: 560954 - DNA, 20 bp, Artificial Sequence
  chemically synthesized
atgggcaaggacttcatgtc

SEQ ID NO: 560955 - DNA, 20 bp, Artificial Sequence
  chemically synthesized
actcaaacaaatttacaaga

SEQ ID NO: 560956 - DNA, 20 bp, Artificial Sequence
  chemically synthesized
ggcatcagagaaatgcaaat

SEQ ID NO: 560957 - DNA, 20 bp, Artificial Sequence
  chemically synthesized
agtaaactatcgcaagaaca

SEQ ID NO: 560958 - DNA, 20 bp, Artificial Sequence
  chemically synthesized
agtataataataaaagaaaa

SEQ ID NO: 560959 - DNA, 20 bp, Artificial Sequence
  chemically synthesized
gaaacaattttcctgttaat

SEQ ID NO: 560960 - DNA, 20 bp, Artificial Sequence
  chemically synthesized
tatataattttttttttctt

SEQ ID NO: 560961 - DNA, 20 bp, Artificial Sequence
  chemically synthesized
tttctaataattaggtctta

SEQ ID NO: 560962 - DNA, 20 bp, Artificial Sequence
  chemically synthesized
tggtctaccagcattgtagt

SEQ ID NO: 560963 - DNA, 20 bp, Artificial Sequence
  chemically synthesized
aaaaagactccacaagtctt

SEQ ID NO: 560964 - DNA, 20 bp, Artificial Sequence
  chemically synthesized
gagagaagtttgtatcaacc

SEQ ID NO: 560965 - DNA, 20 bp, Artificial Sequence
  chemically synthesized
tcagctgcattcccattaga

SEQ ID NO: 560966 - DNA, 20 bp, Artificial Sequence
  chemically synthesized
gcattggaaacttggaaatt

SEQ ID NO: 560967 - DNA, 20 bp, Artificial Sequence
  chemically synthesized
aaagcattactaggagattc

SEQ ID NO: 560968 - DNA, 20 bp, Artificial Sequence
  chemically synthesized
gagctcaagtgaaatatggg

SEQ ID NO: 560969 - DNA, 20 bp, Artificial Sequence
  chemically synthesized
tggttgcgtaggcacaggaa

SEQ ID NO: 560970 - DNA, 20 bp, Artificial Sequence
  chemically synthesized
cttaggtaaagtccatcatc

SEQ ID NO: 560971 - DNA, 20 bp, Artificial Sequence
  chemically synthesized
taaagttaattgaatggagg

SEQ ID NO: 560972 - DNA, 20 bp, Artificial Sequence
  chemically synthesized
ggaggtaaaactaggagact

SEQ ID NO: 560973 - DNA, 20 bp, Artificial Sequence
  chemically synthesized
ttctgcctcatttattctat

SEQ ID NO: 560974 - DNA, 20 bp, Artificial Sequence
  chemically synthesized
cattataaccattataattg

SEQ ID NO: 560975 - DNA, 20 bp, Artificial Sequence
  chemically synthesized
ttataatggttataatggct

SEQ ID NO: 560976 - DNA, 20 bp, Artificial Sequence
  chemically synthesized
tggagctggactgcctgggt

SEQ ID NO: 560977 - DNA, 20 bp, Artificial Sequence
  chemically synthesized
aatttacccaaaatgaatac

SEQ ID NO: 560978 - DNA, 20 bp, Artificial Sequence
  chemically synthesized
aaatttctatgagtgcgctt

SEQ ID NO: 560979 - DNA, 20 bp, Artificial Sequence
  chemically synthesized
aaacagttcatgaaactgag

SEQ ID NO: 560980 - DNA, 20 bp, Artificial Sequence
  chemically synthesized
tctcttaagattccacaatg

SEQ ID NO: 560981 - DNA, 20 bp, Artificial Sequence
  chemically synthesized
agaataacctagaggtttgt

SEQ ID NO: 560982 - DNA, 20 bp, Artificial Sequence
  chemically synthesized
ttaatggcaaccacatccct

SEQ ID NO: 560983 - DNA, 20 bp, Artificial Sequence
  chemically synthesized
ttatggtatctatggaagag

SEQ ID NO: 560984 - DNA, 20 bp, Artificial Sequence
  chemically synthesized
aataacgcatgggaagtact

SEQ ID NO: 560985 - DNA, 20 bp, Artificial Sequence
  chemically synthesized
aatcaagttatttatgactc

SEQ ID NO: 560986 - DNA, 20 bp, Artificial Sequence
  chemically synthesized
taggtactccataatctcat

SEQ ID NO: 560987 - DNA, 20 bp, Artificial Sequence
  chemically synthesized
cctttttaaacacaaaatcc

SEQ ID NO: 560988 - DNA, 20 bp, Artificial Sequence
  chemically synthesized
catagtcctgtgaatatact

SEQ ID NO: 560989 - DNA, 20 bp, Artificial Sequence
  chemically synthesized
ttgccattgaaagtaatggc

SEQ ID NO: 560990 - DNA, 20 bp, Artificial Sequence
  chemically synthesized
gggcacgaagaatatttaat

SEQ ID NO: 560991 - DNA, 20 bp, Artificial Sequence
  chemically synthesized
tgaacacattccacagagtt

SEQ ID NO: 560992 - DNA, 20 bp, Artificial Sequence
  chemically synthesized
gttgctcttttgaatattat

SEQ ID NO: 560993 - DNA, 20 bp, Artificial Sequence
  chemically synthesized
attaagtactaaattccact

SEQ ID NO: 560994 - DNA, 20 bp, Artificial Sequence
  chemically synthesized
tgttaaatatgctaatgatt

SEQ ID NO: 560995 - DNA, 20 bp, Artificial Sequence
  chemically synthesized
ccaattacttttttcttgcc

SEQ ID NO: 560996 - DNA, 20 bp, Artificial Sequence
  chemically synthesized
acccccatacaaatgctcta

SEQ ID NO: 560997 - DNA, 20 bp, Artificial Sequence
  chemically synthesized
tgaaattatgactacctcga

SEQ ID NO: 560998 - DNA, 20 bp, Artificial Sequence
  chemically synthesized
tctcgaggtagtcataattt

SEQ ID NO: 560999 - DNA, 20 bp, Artificial Sequence
  chemically synthesized
gcagcttatcagtttaaaca

SEQ ID NO: 561000 - DNA, 20 bp, Artificial Sequence
  chemically synthesized
gtagattttcttgaaaaata

SEQ ID NO: 561001 - DNA, 20 bp, Artificial Sequence
  chemically synthesized
tgtcgattaaacattaaaaa

SEQ ID NO: 561002 - DNA, 20 bp, Artificial Sequence
  chemically synthesized
actttttagctctaacatat

SEQ ID NO: 561003 - DNA, 20 bp, Artificial Sequence
  chemically synthesized
gaattttctggaggccttgt

SEQ ID NO: 561004 - DNA, 20 bp, Artificial Sequence
  chemically synthesized
aagtaaataaataaacccag

SEQ ID NO: 561005 - DNA, 20 bp, Artificial Sequence
  chemically synthesized
tcatcagggaaggtggtggt

SEQ ID NO: 561006 - DNA, 20 bp, Artificial Sequence
  chemically synthesized
gaccagcctggccaacatgg

SEQ ID NO: 561007 - DNA, 20 bp, Artificial Sequence
  chemically synthesized
agaaaagaaaaagaaaaaag

SEQ ID NO: 561008 - DNA, 20 bp, Artificial Sequence
  chemically synthesized
taatcctgttatacagataa

SEQ ID NO: 561009 - DNA, 20 bp, Artificial Sequence
  chemically synthesized
aagtatatcaacatgcaaat

SEQ ID NO: 561010 - DNA, 20 bp, Artificial Sequence
  chemically synthesized
tagctactttgcctgaagca

SEQ ID NO: 561011 - DNA, 20 bp, Artificial Sequence
  chemically synthesized
actcagcagataggaaaaga

SEQ ID NO: 561012 - DNA, 20 bp, Artificial Sequence
  chemically synthesized
aggagcagagagcaggggaa

SEQ ID NO: 561013 - DNA, 20 bp, Artificial Sequence
  chemically synthesized
tgacacacaattaaaagcca

SEQ ID NO: 561014 - DNA, 20 bp, Artificial Sequence
  chemically synthesized
gagccatttccattggatga

SEQ ID NO: 561015 - DNA, 20 bp, Artificial Sequence
  chemically synthesized
atgttaatcataaactctat

SEQ ID NO: 561016 - DNA, 20 bp, Artificial Sequence
  chemically synthesized
ctagcatagcattagagtta

SEQ ID NO: 561017 - DNA, 20 bp, Artificial Sequence
  chemically synthesized
aaaattctgacaaaagggag

SEQ ID NO: 561018 - DNA, 20 bp, Artificial Sequence
  chemically synthesized
atgcacttctctgtggtttc

SEQ ID NO: 561019 - DNA, 20 bp, Artificial Sequence
  chemically synthesized
catgactttatcagcagtat

SEQ ID NO: 561020 - DNA, 20 bp, Artificial Sequence
  chemically synthesized
tttatgctctgtttcccttt

SEQ ID NO: 561021 - DNA, 20 bp, Artificial Sequence
  chemically synthesized
gggaccctgggcctagccca

SEQ ID NO: 561022 - DNA, 20 bp, Artificial Sequence
  chemically synthesized
agatttcagaggatgtatgg

SEQ ID NO: 561023 - DNA, 20 bp, Artificial Sequence
  chemically synthesized
tccaaataggagaaattgtc

SEQ ID NO: 561024 - DNA, 20 bp, Artificial Sequence
  chemically synthesized
tactcattccctcattaact

SEQ ID NO: 561025 - DNA, 20 bp, Artificial Sequence
  chemically synthesized
aatctcatatcctcacattt

SEQ ID NO: 561026 - DNA, 20 bp, Artificial Sequence
  chemically synthesized
tatctctttatcagcagcat

SEQ ID NO: 561027 - DNA, 20 bp, Artificial Sequence
  chemically synthesized
aggaaatctttatgagtatg

SEQ ID NO: 561028 - DNA, 20 bp, Artificial Sequence
  chemically synthesized
gataggctaaatcacggggt

SEQ ID NO: 561029 - DNA, 20 bp, Artificial Sequence
  chemically synthesized
tggtagcttactaattataa

SEQ ID NO: 561030 - DNA, 20 bp, Artificial Sequence
  chemically synthesized
atgttaaacttaaatatttt

SEQ ID NO: 561031 - DNA, 20 bp, Artificial Sequence
  chemically synthesized
atggtttatttctatttgag

SEQ ID NO: 561032 - DNA, 20 bp, Artificial Sequence
  chemically synthesized
gagaccatcacaaccagtct

SEQ ID NO: 561033 - DNA, 20 bp, Artificial Sequence
  chemically synthesized
agtcaggtcatgcattgaac

SEQ ID NO: 561034 - DNA, 20 bp, Artificial Sequence
  chemically synthesized
ttcaatgcatgacctgactg

SEQ ID NO: 561035 - DNA, 20 bp, Artificial Sequence
  chemically synthesized
attgtcttcagacaaggaaa

SEQ ID NO: 561036 - DNA, 20 bp, Artificial Sequence
  chemically synthesized
agacaaggaaaaaaaacaca

SEQ ID NO: 561037 - DNA, 20 bp, Artificial Sequence
  chemically synthesized
atgaaaacatcattgagtta

SEQ ID NO: 561038 - DNA, 20 bp, Artificial Sequence
  chemically synthesized
aattaagaactcaagaatat

SEQ ID NO: 561039 - DNA, 20 bp, Artificial Sequence
  chemically synthesized
agaaaatatagtgctaagga

SEQ ID NO: 561040 - DNA, 20 bp, Artificial Sequence
  chemically synthesized
tatcaaaaggcagagtaagt

SEQ ID NO: 561041 - DNA, 20 bp, Artificial Sequence
  chemically synthesized
aaaataaatgtattcaataa

SEQ ID NO: 561042 - DNA, 20 bp, Artificial Sequence
  chemically synthesized
tgaaatttatgattcaatca

SEQ ID NO: 561043 - DNA, 20 bp, Artificial Sequence
  chemically synthesized
ttagcgattttattgtcatc

SEQ ID NO: 561044 - DNA, 20 bp, Artificial Sequence
  chemically synthesized
ttgatgacaataaaatcgct

SEQ ID NO: 561045 - DNA, 20 bp, Artificial Sequence
  chemically synthesized
caatttgggaaacaaatgaa

SEQ ID NO: 561046 - DNA, 20 bp, Artificial Sequence
  chemically synthesized
acagttagaattaagtgatg

SEQ ID NO: 561047 - DNA, 20 bp, Artificial Sequence
  chemically synthesized
gagagccttgaaagttgggc

SEQ ID NO: 561048 - DNA, 20 bp, Artificial Sequence
  chemically synthesized
ttccgggaaactttcttgta

SEQ ID NO: 561049 - DNA, 20 bp, Artificial Sequence
  chemically synthesized
attatcaaagaaactagtaa

SEQ ID NO: 561050 - DNA, 20 bp, Artificial Sequence
  chemically synthesized
tgtcaggctttgctttgggg

SEQ ID NO: 561051 - DNA, 20 bp, Artificial Sequence
  chemically synthesized
attttatcaagtggatggaa

SEQ ID NO: 561052 - DNA, 20 bp, Artificial Sequence
  chemically synthesized
gctattattttcacctggag

SEQ ID NO: 561053 - DNA, 20 bp, Artificial Sequence
  chemically synthesized
accaaataggcgtccacaaa

SEQ ID NO: 561054 - DNA, 20 bp, Artificial Sequence
  chemically synthesized
agaagagggatgggcatagg

SEQ ID NO: 561055 - DNA, 20 bp, Artificial Sequence
  chemically synthesized
aaaatgagtattcccagttg

SEQ ID NO: 561056 - DNA, 20 bp, Artificial Sequence
  chemically synthesized
taacaaagacaggactcaag

SEQ ID NO: 561057 - DNA, 20 bp, Artificial Sequence
  chemically synthesized
aaattcagatatgcaaagtt

SEQ ID NO: 561058 - DNA, 20 bp, Artificial Sequence
  chemically synthesized
gccccccccccccccccaag

SEQ ID NO: 561059 - DNA, 20 bp, Artificial Sequence
  chemically synthesized
gtagtaaggtgtagatcaaa

SEQ ID NO: 561060 - DNA, 20 bp, Artificial Sequence
  chemically synthesized
agtgaaacccagtctctact

SEQ ID NO: 561061 - DNA, 20 bp, Artificial Sequence
  chemically synthesized
aaaagaaaaaaaaaatcaaa

SEQ ID NO: 561062 - DNA, 20 bp, Artificial Sequence
  chemically synthesized
aaaaaaatcaaaaaaaacaa

SEQ ID NO: 561063 - DNA, 20 bp, Artificial Sequence
  chemically synthesized
aatgaacagcttttttcaat

SEQ ID NO: 561064 - DNA, 20 bp, Artificial Sequence
  chemically synthesized
atttaatcactgctttaaac

SEQ ID NO: 561065 - DNA, 20 bp, Artificial Sequence
  chemically synthesized
ctgtagatagtgtcagagat

SEQ ID NO: 561066 - DNA, 20 bp, Artificial Sequence
  chemically synthesized
agaaaaaaagcagtagcgat

SEQ ID NO: 561067 - DNA, 20 bp, Artificial Sequence
  chemically synthesized
ctcatttactattactgaag

SEQ ID NO: 561068 - DNA, 20 bp, Artificial Sequence
  chemically synthesized
aagagtactgtgtgcaaata

SEQ ID NO: 561069 - DNA, 20 bp, Artificial Sequence
  chemically synthesized
gttaaaaaagaccccaaatt

SEQ ID NO: 561070 - DNA, 20 bp, Artificial Sequence
  chemically synthesized
accatttagttggaaaaaaa

SEQ ID NO: 561071 - DNA, 20 bp, Artificial Sequence
  chemically synthesized
actacattaaatttacacta

SEQ ID NO: 561072 - DNA, 20 bp, Artificial Sequence
  chemically synthesized
ttatgaatccaaacattttc

SEQ ID NO: 561073 - DNA, 20 bp, Artificial Sequence
  chemically synthesized
tatatatattttaccatgat

SEQ ID NO: 561074 - DNA, 20 bp, Artificial Sequence
  chemically synthesized
atggtaaaatatatataaca

SEQ ID NO: 561075 - DNA, 20 bp, Artificial Sequence
  chemically synthesized
ccaaaaattatcttccccca

SEQ ID NO: 561076 - DNA, 20 bp, Artificial Sequence
  chemically synthesized
gtgaactgctggagggaatg

SEQ ID NO: 561077 - DNA, 20 bp, Artificial Sequence
  chemically synthesized
aaaacaccaaaaaaaaaaaa

SEQ ID NO: 561078 - DNA, 20 bp, Artificial Sequence
  chemically synthesized
cattaggatgatgattattt

SEQ ID NO: 561079 - DNA, 20 bp, Artificial Sequence
  chemically synthesized
atcgtagaattcaacaacag

SEQ ID NO: 561080 - DNA, 20 bp, Artificial Sequence
  chemically synthesized
aattgaaatgcatcaacatt

SEQ ID NO: 561081 - DNA, 20 bp, Artificial Sequence
  chemically synthesized
gaaagcgtagacatttggaa

SEQ ID NO: 561082 - DNA, 20 bp, Artificial Sequence
  chemically synthesized
gcttcattaaaaaatcatta

SEQ ID NO: 561083 - DNA, 20 bp, Artificial Sequence
  chemically synthesized
tactacaaagctaccataat

SEQ ID NO: 561084 - DNA, 20 bp, Artificial Sequence
  chemically synthesized
agggtcatacgtcctgattt

SEQ ID NO: 561085 - DNA, 20 bp, Artificial Sequence
  chemically synthesized
agagttgtctatttctgcag

SEQ ID NO: 561086 - DNA, 20 bp, Artificial Sequence
  chemically synthesized
gttgaggtatccgagttact

SEQ ID NO: 561087 - DNA, 20 bp, Artificial Sequence
  chemically synthesized
gacttatacactgacaacta

SEQ ID NO: 561088 - DNA, 20 bp, Artificial Sequence
  chemically synthesized
attctagagatttccacaca

SEQ ID NO: 561089 - DNA, 20 bp, Artificial Sequence
  chemically synthesized
cattaatacataccattaaa

SEQ ID NO: 561090 - DNA, 20 bp, Artificial Sequence
  chemically synthesized
gaaccctggtgtaaaattta

SEQ ID NO: 561091 - DNA, 20 bp, Artificial Sequence
  chemically synthesized
atagcataggaaaattttgt

SEQ ID NO: 561092 - DNA, 20 bp, Artificial Sequence
  chemically synthesized
tttatgaattattcaggaaa

SEQ ID NO: 561093 - DNA, 20 bp, Artificial Sequence
  chemically synthesized
tgatcaaacactaagtggaa

SEQ ID NO: 561094 - DNA, 20 bp, Artificial Sequence
  chemically synthesized
taaggattataactagtcta

SEQ ID NO: 561095 - DNA, 20 bp, Artificial Sequence
  chemically synthesized
acataatggtgagattaaag

SEQ ID NO: 561096 - DNA, 20 bp, Artificial Sequence
  chemically synthesized
tctactatggcagacactaa

SEQ ID NO: 561097 - DNA, 20 bp, Artificial Sequence
  chemically synthesized
gtgtcaatatcgtaacaatg

SEQ ID NO: 561098 - DNA, 20 bp, Artificial Sequence
  chemically synthesized
ggaactatcagcttcataaa

SEQ ID NO: 561099 - DNA, 20 bp, Artificial Sequence
  chemically synthesized
cctcttcaatggctatatga

SEQ ID NO: 561100 - DNA, 20 bp, Artificial Sequence
  chemically synthesized
atggctatatgaaaaaacaa

SEQ ID NO: 561101 - DNA, 20 bp, Artificial Sequence
  chemically synthesized
tatgaaaaaacaaaaaaaca

SEQ ID NO: 561102 - DNA, 20 bp, Artificial Sequence
  chemically synthesized
acgagacttaccactatcaa

SEQ ID NO: 561103 - DNA, 20 bp, Artificial Sequence
  chemically synthesized
tgccaaaatagaaaggagct

SEQ ID NO: 561104 - DNA, 20 bp, Artificial Sequence
  chemically synthesized
atgtttactcaatttactaa

SEQ ID NO: 561105 - DNA, 20 bp, Artificial Sequence
  chemically synthesized
agtaaacattactatccagg

SEQ ID NO: 561106 - DNA, 20 bp, Artificial Sequence
  chemically synthesized
aggaaaaaccagaaaaaaaa

SEQ ID NO: 561107 - DNA, 20 bp, Artificial Sequence
  chemically synthesized
gactatgtgttcaatctttt

SEQ ID NO: 561108 - DNA, 20 bp, Artificial Sequence
  chemically synthesized
gtaagtgacttctgtaagat

SEQ ID NO: 561109 - DNA, 20 bp, Artificial Sequence
  chemically synthesized
ttctctgctggatgatcccc

SEQ ID NO: 561110 - DNA, 20 bp, Artificial Sequence
  chemically synthesized
tagtattgctattcggaata

SEQ ID NO: 561111 - DNA, 20 bp, Artificial Sequence
  chemically synthesized
ctcaaatacatttaggttag

SEQ ID NO: 561112 - DNA, 20 bp, Artificial Sequence
  chemically synthesized
aggaacttaaatgtttaatg

SEQ ID NO: 561113 - DNA, 20 bp, Artificial Sequence
  chemically synthesized
actgctatatctcctggtcc

SEQ ID NO: 561114 - DNA, 20 bp, Artificial Sequence
  chemically synthesized
tcctgtgatgactctctgga

SEQ ID NO: 561115 - DNA, 20 bp, Artificial Sequence
  chemically synthesized
aaggtgtaactactacagat

SEQ ID NO: 561116 - DNA, 20 bp, Artificial Sequence
  chemically synthesized
ttctaaagttttcagcaagt

SEQ ID NO: 561117 - DNA, 20 bp, Artificial Sequence
  chemically synthesized
catttatgttttcacttgct

SEQ ID NO: 561118 - DNA, 20 bp, Artificial Sequence
  chemically synthesized
taatgtataaacctcaaaga

SEQ ID NO: 561119 - DNA, 20 bp, Artificial Sequence
  chemically synthesized
cctaccagatgtgtgacctt

SEQ ID NO: 561120 - DNA, 20 bp, Artificial Sequence
  chemically synthesized
tcagaatatttttgtccctt

SEQ ID NO: 561121 - DNA, 20 bp, Artificial Sequence
  chemically synthesized
gaaccatccagctcagcgtg

SEQ ID NO: 561122 - DNA, 20 bp, Artificial Sequence
  chemically synthesized
gaaagaaaaataatagaaaa

SEQ ID NO: 561123 - DNA, 20 bp, Artificial Sequence
  chemically synthesized
tgttcagaaaatatagtatt

SEQ ID NO: 561124 - DNA, 20 bp, Artificial Sequence
  chemically synthesized
gatgccagatgtagatttta

SEQ ID NO: 561125 - DNA, 20 bp, Artificial Sequence
  chemically synthesized
aaatatatcattaccaatgg

SEQ ID NO: 561126 - DNA, 20 bp, Artificial Sequence
  chemically synthesized
agcctcatgtcatcacattt

SEQ ID NO: 561127 - DNA, 20 bp, Artificial Sequence
  chemically synthesized
tctctctgcctacaagcctg

SEQ ID NO: 561128 - DNA, 20 bp, Artificial Sequence
  chemically synthesized
ttagtagccaagacaatggg

SEQ ID NO: 561129 - DNA, 20 bp, Artificial Sequence
  chemically synthesized
ctgtccatgcggcagaaaag

SEQ ID NO: 561130 - DNA, 20 bp, Artificial Sequence
  chemically synthesized
gatgtgacttgactttttct

SEQ ID NO: 561131 - DNA, 20 bp, Artificial Sequence
  chemically synthesized
ataacagtgtgaaaacagac

SEQ ID NO: 561132 - DNA, 20 bp, Artificial Sequence
  chemically synthesized
ggtactctttataacagtgt

SEQ ID NO: 561133 - DNA, 20 bp, Artificial Sequence
  chemically synthesized
ttttgaggtgtcacaaatag

SEQ ID NO: 561134 - DNA, 20 bp, Artificial Sequence
  chemically synthesized
tttttctatttgtgacacct

SEQ ID NO: 561135 - DNA, 20 bp, Artificial Sequence
  chemically synthesized
tgttttactttttgtaacca

SEQ ID NO: 561136 - DNA, 20 bp, Artificial Sequence
  chemically synthesized
tgttttatggttacaaaaag

SEQ ID NO: 561137 - DNA, 20 bp, Artificial Sequence
  chemically synthesized
acaaaatagtatgaaataag

SEQ ID NO: 561138 - DNA, 20 bp, Artificial Sequence
  chemically synthesized
tatataggcctcacgcccta

SEQ ID NO: 561139 - DNA, 20 bp, Artificial Sequence
  chemically synthesized
tgcatactcttaattactgt

SEQ ID NO: 561140 - DNA, 20 bp, Artificial Sequence
  chemically synthesized
gtaattagattttctcaatt

SEQ ID NO: 561141 - DNA, 20 bp, Artificial Sequence
  chemically synthesized
cccaaccagaaaccaaactt

SEQ ID NO: 561142 - DNA, 20 bp, Artificial Sequence
  chemically synthesized
aatggcagttattactttgt

SEQ ID NO: 561143 - DNA, 20 bp, Artificial Sequence
  chemically synthesized
agcaagtatggaatttctca

SEQ ID NO: 561144 - DNA, 20 bp, Artificial Sequence
  chemically synthesized
aaaaataccgatttcttttg

SEQ ID NO: 561145 - DNA, 20 bp, Artificial Sequence
  chemically synthesized
ggtatttagacatgtaaatt

SEQ ID NO: 561146 - DNA, 20 bp, Artificial Sequence
  chemically synthesized
agctctttccttaagtatgc

SEQ ID NO: 561147 - DNA, 20 bp, Artificial Sequence
  chemically synthesized
caatcccagcaagaattcta

SEQ ID NO: 561148 - DNA, 20 bp, Artificial Sequence
  chemically synthesized
cgtagaggataatattccct

SEQ ID NO: 561149 - DNA, 20 bp, Artificial Sequence
  chemically synthesized
atcacaaaaggcacgaaggg

SEQ ID NO: 561150 - DNA, 20 bp, Artificial Sequence
  chemically synthesized
gctaagaaactgaacagaaa

SEQ ID NO: 561151 - DNA, 20 bp, Artificial Sequence
  chemically synthesized
ttcccaaaatcttaatggct

SEQ ID NO: 561152 - DNA, 20 bp, Artificial Sequence
  chemically synthesized
taacctactcagctgtaaga

SEQ ID NO: 561153 - DNA, 20 bp, Artificial Sequence
  chemically synthesized
gatgatttattaaacatttt

SEQ ID NO: 561154 - DNA, 20 bp, Artificial Sequence
  chemically synthesized
agcaaactatcgcaaggata

SEQ ID NO: 561155 - DNA, 20 bp, Artificial Sequence
  chemically synthesized
ataaaatttcaaactttatc

SEQ ID NO: 561156 - DNA, 20 bp, Artificial Sequence
  chemically synthesized
agaaggttctcagaaatatg

SEQ ID NO: 561157 - DNA, 20 bp, Artificial Sequence
  chemically synthesized
tcaaaaaatattaactatgc

SEQ ID NO: 561158 - DNA, 20 bp, Artificial Sequence
  chemically synthesized
agatcaaggaaaatattagg

SEQ ID NO: 561159 - DNA, 20 bp, Artificial Sequence
  chemically synthesized
gaaacatttgttgtacatta

SEQ ID NO: 561160 - DNA, 20 bp, Artificial Sequence
  chemically synthesized
ttgtactaaacagtattgaa

SEQ ID NO: 561161 - DNA, 20 bp, Artificial Sequence
  chemically synthesized
caaaatcaacgaaacatttg

SEQ ID NO: 561162 - DNA, 20 bp, Artificial Sequence
  chemically synthesized
tactttacctatctcagaga

SEQ ID NO: 561163 - DNA, 20 bp, Artificial Sequence
  chemically synthesized
acatggtaattttttagaat

SEQ ID NO: 561164 - DNA, 20 bp, Artificial Sequence
  chemically synthesized
aattttgaatacaatctaat

SEQ ID NO: 561165 - DNA, 20 bp, Artificial Sequence
  chemically synthesized
aaaaatcactagaatatcaa

SEQ ID NO: 561166 - DNA, 20 bp, Artificial Sequence
  chemically synthesized
agtatgtgataacataagca

SEQ ID NO: 561167 - DNA, 20 bp, Artificial Sequence
  chemically synthesized
gtgataacataagcacaaaa

SEQ ID NO: 561168 - DNA, 20 bp, Artificial Sequence
  chemically synthesized
cataagcacaaaacaaaaca

SEQ ID NO: 561169 - DNA, 20 bp, Artificial Sequence
  chemically synthesized
tccatattgtatgcctctat

SEQ ID NO: 561170 - DNA, 20 bp, Artificial Sequence
  chemically synthesized
attaaagagcagaaggctaa

SEQ ID NO: 561171 - DNA, 20 bp, Artificial Sequence
  chemically synthesized
acatctacttataaaactca

SEQ ID NO: 561172 - DNA, 20 bp, Artificial Sequence
  chemically synthesized
taagggaggacatctactta

SEQ ID NO: 561173 - DNA, 20 bp, Artificial Sequence
  chemically synthesized
tttgtacatttattagaatg

SEQ ID NO: 561174 - DNA, 20 bp, Artificial Sequence
  chemically synthesized
ctataaaagcattaaaaaaa

SEQ ID NO: 561175 - DNA, 20 bp, Artificial Sequence
  chemically synthesized
agagtaaaagacacattagc

SEQ ID NO: 561176 - DNA, 20 bp, Artificial Sequence
  chemically synthesized
ttaaattgttataacctaag

SEQ ID NO: 561177 - DNA, 20 bp, Artificial Sequence
  chemically synthesized
tgtctttctcttcagtcttt

SEQ ID NO: 561178 - DNA, 20 bp, Artificial Sequence
  chemically synthesized
tgggcatttgagtatttgga

SEQ ID NO: 561179 - DNA, 20 bp, Artificial Sequence
  chemically synthesized
gagacagccagaagtgggga

SEQ ID NO: 561180 - DNA, 20 bp, Artificial Sequence
  chemically synthesized
tgtgtattccaattattaat

SEQ ID NO: 561181 - DNA, 20 bp, Artificial Sequence
  chemically synthesized
gtctcttggaaaagtgattt

SEQ ID NO: 561182 - DNA, 20 bp, Artificial Sequence
  chemically synthesized
gcccaactgattctatacag

SEQ ID NO: 561183 - DNA, 20 bp, Artificial Sequence
  chemically synthesized
aaattagatggcaaaggcat

SEQ ID NO: 561184 - DNA, 20 bp, Artificial Sequence
  chemically synthesized
cttattctggctctagttta

SEQ ID NO: 561185 - DNA, 20 bp, Artificial Sequence
  chemically synthesized
aaaacttttccatttatttt

SEQ ID NO: 561186 - DNA, 20 bp, Artificial Sequence
  chemically synthesized
tgatggatgtgcatccaatt

SEQ ID NO: 561187 - DNA, 20 bp, Artificial Sequence
  chemically synthesized
tcctagagtttttgcagaaa

SEQ ID NO: 561188 - DNA, 20 bp, Artificial Sequence
  chemically synthesized
taatttcgttttatttctgc

SEQ ID NO: 561189 - DNA, 20 bp, Artificial Sequence
  chemically synthesized
attggttcccagactctcag

SEQ ID NO: 561190 - DNA, 20 bp, Artificial Sequence
  chemically synthesized
atgacgtaatgactacaaga

SEQ ID NO: 561191 - DNA, 20 bp, Artificial Sequence
  chemically synthesized
atatagtataaatcttttat

SEQ ID NO: 561192 - DNA, 20 bp, Artificial Sequence
  chemically synthesized
cagcagtattcctcagacca

SEQ ID NO: 561193 - DNA, 20 bp, Artificial Sequence
  chemically synthesized
taggtatgtatatgtatggg

SEQ ID NO: 561194 - DNA, 20 bp, Artificial Sequence
  chemically synthesized
tccctttatactcctgtagg

SEQ ID NO: 561195 - DNA, 20 bp, Artificial Sequence
  chemically synthesized
ctgctacttcaaggagtaag

SEQ ID NO: 561196 - DNA, 20 bp, Artificial Sequence
  chemically synthesized
tcaataattttccagtggcc

SEQ ID NO: 561197 - DNA, 20 bp, Artificial Sequence
  chemically synthesized
gcaaaaatcagattttaacc

SEQ ID NO: 561198 - DNA, 20 bp, Artificial Sequence
  chemically synthesized
ctaaaatacaaactgtttag

SEQ ID NO: 561199 - DNA, 20 bp, Artificial Sequence
  chemically synthesized
tgggatcagacttctaattt

SEQ ID NO: 561200 - DNA, 20 bp, Artificial Sequence
  chemically synthesized
ataactaagggctaataagg

SEQ ID NO: 561201 - DNA, 20 bp, Artificial Sequence
  chemically synthesized
tgtcacataagactggccat

SEQ ID NO: 561202 - DNA, 20 bp, Artificial Sequence
  chemically synthesized
tatccttcttttataaatgg

SEQ ID NO: 561203 - DNA, 20 bp, Artificial Sequence
  chemically synthesized
acaggatatttcctaaaagt

SEQ ID NO: 561204 - DNA, 20 bp, Artificial Sequence
  chemically synthesized
gatatccagttgaaaagtga

SEQ ID NO: 561205 - DNA, 20 bp, Artificial Sequence
  chemically synthesized
tttgaatacattaactaaga

SEQ ID NO: 561206 - DNA, 20 bp, Artificial Sequence
  chemically synthesized
aaattcaacagagaagcaat

SEQ ID NO: 561207 - DNA, 20 bp, Artificial Sequence
  chemically synthesized
actggtgggggctgggctct

SEQ ID NO: 561208 - DNA, 20 bp, Artificial Sequence
  chemically synthesized
cttggtgtcccagtcaccgg

SEQ ID NO: 561209 - DNA, 20 bp, Artificial Sequence
  chemically synthesized
agactcaagaggagactaga

SEQ ID NO: 561210 - DNA, 20 bp, Artificial Sequence
  chemically synthesized
acagaagaatctcagaacat

SEQ ID NO: 561211 - DNA, 20 bp, Artificial Sequence
  chemically synthesized
aaagacaaaaagagaattct

SEQ ID NO: 561212 - DNA, 20 bp, Artificial Sequence
  chemically synthesized
ttatattaaacttgctgaaa

SEQ ID NO: 561213 - DNA, 20 bp, Artificial Sequence
  chemically synthesized
agaatgacaactaccatcat

SEQ ID NO: 561214 - DNA, 20 bp, Artificial Sequence
  chemically synthesized
atgaaaacacataaaaatat

SEQ ID NO: 561215 - DNA, 20 bp, Artificial Sequence
  chemically synthesized
aaaaatgaagaaaaaatatt

SEQ ID NO: 561216 - DNA, 20 bp, Artificial Sequence
  chemically synthesized
aagcagcagctatgcttaca

SEQ ID NO: 561217 - DNA, 20 bp, Artificial Sequence
  chemically synthesized
cataaaacagactttcagtc

SEQ ID NO: 561218 - DNA, 20 bp, Artificial Sequence
  chemically synthesized
gactttcagtcaaaaacagt

SEQ ID NO: 561219 - DNA, 20 bp, Artificial Sequence
  chemically synthesized
aatcatatctaatatcttct

SEQ ID NO: 561220 - DNA, 20 bp, Artificial Sequence
  chemically synthesized
agaaactttggaacctgtac

SEQ ID NO: 561221 - DNA, 20 bp, Artificial Sequence
  chemically synthesized
atttgtttcaataatttttt

SEQ ID NO: 561222 - DNA, 20 bp, Artificial Sequence
  chemically synthesized
aaggagctagtcaaagaaaa

SEQ ID NO: 561223 - DNA, 20 bp, Artificial Sequence
  chemically synthesized
tgaaaatcctaaaaattgag

SEQ ID NO: 561224 - DNA, 20 bp, Artificial Sequence
  chemically synthesized
atattacatcaaacagaatg

SEQ ID NO: 561225 - DNA, 20 bp, Artificial Sequence
  chemically synthesized
atcaaacagaatgaaaaaca

SEQ ID NO: 561226 - DNA, 20 bp, Artificial Sequence
  chemically synthesized
atttaacatcccttcgagat

SEQ ID NO: 561227 - DNA, 20 bp, Artificial Sequence
  chemically synthesized
agctgaaaaatttctcccta

SEQ ID NO: 561228 - DNA, 20 bp, Artificial Sequence
  chemically synthesized
acagagcaagactccatctc

SEQ ID NO: 561229 - DNA, 20 bp, Artificial Sequence
  chemically synthesized
aagactccatctcaaaaaca

SEQ ID NO: 561230 - DNA, 20 bp, Artificial Sequence
  chemically synthesized
catctcaaaaacaaaaaacc

SEQ ID NO: 561231 - DNA, 20 bp, Artificial Sequence
  chemically synthesized
tataaaatacagaacactga

SEQ ID NO: 561232 - DNA, 20 bp, Artificial Sequence
  chemically synthesized
ttatgaatcacactacttga

SEQ ID NO: 561233 - DNA, 20 bp, Artificial Sequence
  chemically synthesized
aaacagcaaggtgttagaat

SEQ ID NO: 561234 - DNA, 20 bp, Artificial Sequence
  chemically synthesized
atgttcttggtgcttttgtc

SEQ ID NO: 561235 - DNA, 20 bp, Artificial Sequence
  chemically synthesized
aaggatttaaaggtaagacc

SEQ ID NO: 561236 - DNA, 20 bp, Artificial Sequence
  chemically synthesized
ctacatgaagcaaacatagg

SEQ ID NO: 561237 - DNA, 20 bp, Artificial Sequence
  chemically synthesized
acctcaaaagcgcaggcaac

SEQ ID NO: 561238 - DNA, 20 bp, Artificial Sequence
  chemically synthesized
agaaaatgaaagagcttctg

SEQ ID NO: 561239 - DNA, 20 bp, Artificial Sequence
  chemically synthesized
ggctattattaaaaagacaa

SEQ ID NO: 561240 - DNA, 20 bp, Artificial Sequence
  chemically synthesized
aagtcagtatagccactatt

SEQ ID NO: 561241 - DNA, 20 bp, Artificial Sequence
  chemically synthesized
agtatggagaagatttctca

SEQ ID NO: 561242 - DNA, 20 bp, Artificial Sequence
  chemically synthesized
cacatgtatgtacatatatg

SEQ ID NO: 561243 - DNA, 20 bp, Artificial Sequence
  chemically synthesized
atatagaaattatttaattg

SEQ ID NO: 561244 - DNA, 20 bp, Artificial Sequence
  chemically synthesized
gaacctgcaaatgaatatcc

SEQ ID NO: 561245 - DNA, 20 bp, Artificial Sequence
  chemically synthesized
gccctgtccccccatcccac

SEQ ID NO: 561246 - DNA, 20 bp, Artificial Sequence
  chemically synthesized
atatcacttataattatgta

SEQ ID NO: 561247 - DNA, 20 bp, Artificial Sequence
  chemically synthesized
gtatattttgctgatagttg

SEQ ID NO: 561248 - DNA, 20 bp, Artificial Sequence
  chemically synthesized
ttcaaatattatcactgact

SEQ ID NO: 561249 - DNA, 20 bp, Artificial Sequence
  chemically synthesized
tcacagaattttgccttggc

SEQ ID NO: 561250 - DNA, 20 bp, Artificial Sequence
  chemically synthesized
tgagactaaagaaatatatt

SEQ ID NO: 561251 - DNA, 20 bp, Artificial Sequence
  chemically synthesized
cattgtgatgatatgactag

SEQ ID NO: 561252 - DNA, 20 bp, Artificial Sequence
  chemically synthesized
acttagacaacagagacttg

SEQ ID NO: 561253 - DNA, 20 bp, Artificial Sequence
  chemically synthesized
tctcagttcagataccataa

SEQ ID NO: 561254 - DNA, 20 bp, Artificial Sequence
  chemically synthesized
gcaatcgcattagattttct

SEQ ID NO: 561255 - DNA, 20 bp, Artificial Sequence
  chemically synthesized
cagcagaggcggaaaaaagt

SEQ ID NO: 561256 - DNA, 20 bp, Artificial Sequence
  chemically synthesized
gaaagcattcactccaggag

SEQ ID NO: 561257 - DNA, 20 bp, Artificial Sequence
  chemically synthesized
ttcttggaaaagaaggctat

SEQ ID NO: 561258 - DNA, 20 bp, Artificial Sequence
  chemically synthesized
gaagtcaaaataaaggggat

SEQ ID NO: 561259 - DNA, 20 bp, Artificial Sequence
  chemically synthesized
ggatgttctctttaaaggaa

SEQ ID NO: 561260 - DNA, 20 bp, Artificial Sequence
  chemically synthesized
ttttaaaaggcaattccact

SEQ ID NO: 561261 - DNA, 20 bp, Artificial Sequence
  chemically synthesized
taaaactaaacctcaggcct

SEQ ID NO: 561262 - DNA, 20 bp, Artificial Sequence
  chemically synthesized
cacgttctgcacatgtatcc

SEQ ID NO: 561263 - DNA, 20 bp, Artificial Sequence
  chemically synthesized
cagggatgtggatgaagctg

SEQ ID NO: 561264 - DNA, 20 bp, Artificial Sequence
  chemically synthesized
gtcattagagaaatgaaaat

SEQ ID NO: 561265 - DNA, 20 bp, Artificial Sequence
  chemically synthesized
atagctcctgcacagcaaaa

SEQ ID NO: 561266 - DNA, 20 bp, Artificial Sequence
  chemically synthesized
aaaccataaaaaccctagaa

SEQ ID NO: 561267 - DNA, 20 bp, Artificial Sequence
  chemically synthesized
aatgtaatacctaaaaccat

SEQ ID NO: 561268 - DNA, 20 bp, Artificial Sequence
  chemically synthesized
aaagacttaaatgtaatacc

SEQ ID NO: 561269 - DNA, 20 bp, Artificial Sequence
  chemically synthesized
tatttaataaatgatgatgg

SEQ ID NO: 561270 - DNA, 20 bp, Artificial Sequence
  chemically synthesized
tgatctttgacaaacctgcc

SEQ ID NO: 561271 - DNA, 20 bp, Artificial Sequence
  chemically synthesized
cactacaaggctacagtaac

SEQ ID NO: 561272 - DNA, 20 bp, Artificial Sequence
  chemically synthesized
taaaaaagagcctgcattgc

SEQ ID NO: 561273 - DNA, 20 bp, Artificial Sequence
  chemically synthesized
ctttcttcacagaattagaa

SEQ ID NO: 561274 - DNA, 20 bp, Artificial Sequence
  chemically synthesized
gagaggacgcaaacaaatga

SEQ ID NO: 561275 - DNA, 20 bp, Artificial Sequence
  chemically synthesized
atgacatgattgtatattta

SEQ ID NO: 561276 - DNA, 20 bp, Artificial Sequence
  chemically synthesized
aagctggaagcactcccttt

SEQ ID NO: 561277 - DNA, 20 bp, Artificial Sequence
  chemically synthesized
acataaacagaaccaatgac

SEQ ID NO: 561278 - DNA, 20 bp, Artificial Sequence
  chemically synthesized
ggccaacatcatcctgatac

SEQ ID NO: 561279 - DNA, 20 bp, Artificial Sequence
  chemically synthesized
tattttgttaatcttttcaa

SEQ ID NO: 561280 - DNA, 20 bp, Artificial Sequence
  chemically synthesized
acgaaaaacccttaaaaaaa

SEQ ID NO: 561281 - DNA, 20 bp, Artificial Sequence
  chemically synthesized
ctgaaggagatagagacacg

SEQ ID NO: 561282 - DNA, 20 bp, Artificial Sequence
  chemically synthesized
actttgtttacactgtgagg

SEQ ID NO: 561283 - DNA, 20 bp, Artificial Sequence
  chemically synthesized
cccagtcagcggcttacaga

SEQ ID NO: 561284 - DNA, 20 bp, Artificial Sequence
  chemically synthesized
gcagaggggcctgtttgaag

SEQ ID NO: 561285 - DNA, 20 bp, Artificial Sequence
  chemically synthesized
gggcctgtttgaaggaaaac

SEQ ID NO: 561286 - DNA, 20 bp, Artificial Sequence
  chemically synthesized
ataaatccacaaagatgagg

SEQ ID NO: 561287 - DNA, 20 bp, Artificial Sequence
  chemically synthesized
cacaaaaagggtgaaaattc

SEQ ID NO: 561288 - DNA, 20 bp, Artificial Sequence
  chemically synthesized
ctcctcaccaaacaagagaa

SEQ ID NO: 561289 - DNA, 20 bp, Artificial Sequence
  chemically synthesized
actacaataaccagtttagg

SEQ ID NO: 561290 - DNA, 20 bp, Artificial Sequence
  chemically synthesized
taaatgacctgatggaactg

SEQ ID NO: 561291 - DNA, 20 bp, Artificial Sequence
  chemically synthesized
tatgggactatgtgaaaaga

SEQ ID NO: 561292 - DNA, 20 bp, Artificial Sequence
  chemically synthesized
agtttgattagtatacctgg

SEQ ID NO: 561293 - DNA, 20 bp, Artificial Sequence
  chemically synthesized
taaactaacaaagatttaaa

SEQ ID NO: 561294 - DNA, 20 bp, Artificial Sequence
  chemically synthesized
attgatcacataattagaag

SEQ ID NO: 561295 - DNA, 20 bp, Artificial Sequence
  chemically synthesized
tcaggattaagaaactcact

SEQ ID NO: 561296 - DNA, 20 bp, Artificial Sequence
  chemically synthesized
aaaaaaaaaaaaaaaaaaaa

SEQ ID NO: 561297 - DNA, 20 bp, Artificial Sequence
  chemically synthesized
ttttgttaatctcttcaaaa

SEQ ID NO: 561298 - DNA, 20 bp, Artificial Sequence
  chemically synthesized
cagatatgagattttattgg

SEQ ID NO: 561299 - DNA, 20 bp, Artificial Sequence
  chemically synthesized
cacaaaaaatttaaatgaat

SEQ ID NO: 561300 - DNA, 20 bp, Artificial Sequence
  chemically synthesized
gtgtgtgtcctatcctttca

SEQ ID NO: 561301 - DNA, 20 bp, Artificial Sequence
  chemically synthesized
tgaccatatgtgattcaata

SEQ ID NO: 561302 - DNA, 20 bp, Artificial Sequence
  chemically synthesized
tctacctcactgaactaaga

SEQ ID NO: 561303 - DNA, 20 bp, Artificial Sequence
  chemically synthesized
atagtttctcccttagagct

SEQ ID NO: 561304 - DNA, 20 bp, Artificial Sequence
  chemically synthesized
caatcaggcttctgcgtctg

SEQ ID NO: 561305 - DNA, 20 bp, Artificial Sequence
  chemically synthesized
tggatggtaggtcccatcaa

SEQ ID NO: 561306 - DNA, 20 bp, Artificial Sequence
  chemically synthesized
taaatcgatttcatcaattc

SEQ ID NO: 561307 - DNA, 20 bp, Artificial Sequence
  chemically synthesized
aaatctcttggtagcataag

SEQ ID NO: 561308 - DNA, 20 bp, Artificial Sequence
  chemically synthesized
taaatatatctacagtattg

SEQ ID NO: 561309 - DNA, 20 bp, Artificial Sequence
  chemically synthesized
tgtcatttctacacaaaata

SEQ ID NO: 561310 - DNA, 20 bp, Artificial Sequence
  chemically synthesized
agaaatgacaagtctcagat

SEQ ID NO: 561311 - DNA, 20 bp, Artificial Sequence
  chemically synthesized
ccagtcaaataggtctggcc

SEQ ID NO: 561312 - DNA, 20 bp, Artificial Sequence
  chemically synthesized
aaagaaagaaagaaagaaag

SEQ ID NO: 561313 - DNA, 20 bp, Artificial Sequence
  chemically synthesized
agaggtctgggttagacata

SEQ ID NO: 561314 - DNA, 20 bp, Artificial Sequence
  chemically synthesized
aaaattgcagttgctcagat

SEQ ID NO: 561315 - DNA, 20 bp, Artificial Sequence
  chemically synthesized
tcctaaatagataaatgaaa

SEQ ID NO: 561316 - DNA, 20 bp, Artificial Sequence
  chemically synthesized
taattaaactctaaatgtga

SEQ ID NO: 561317 - DNA, 20 bp, Artificial Sequence
  chemically synthesized
cttgaccgcttcagatttta

SEQ ID NO: 561318 - DNA, 20 bp, Artificial Sequence
  chemically synthesized
taatctgtctttcagcctca

SEQ ID NO: 561319 - DNA, 20 bp, Artificial Sequence
  chemically synthesized
ttcttagggaaggaaaaaag

SEQ ID NO: 561320 - DNA, 20 bp, Artificial Sequence
  chemically synthesized
tgaaacttctactcctacaa

SEQ ID NO: 561321 - DNA, 20 bp, Artificial Sequence
  chemically synthesized
attaatagattcaaatattc

SEQ ID NO: 561322 - DNA, 20 bp, Artificial Sequence
  chemically synthesized
tttaagagctcatgctatgc

SEQ ID NO: 561323 - DNA, 20 bp, Artificial Sequence
  chemically synthesized
ctcatgctatgcaaaaacaa

SEQ ID NO: 561324 - DNA, 20 bp, Artificial Sequence
  chemically synthesized
caaaaaaacaaaataacgaa

SEQ ID NO: 561325 - DNA, 20 bp, Artificial Sequence
  chemically synthesized
tagtttagctgttatttttc

SEQ ID NO: 561326 - DNA, 20 bp, Artificial Sequence
  chemically synthesized
gaccagcctggacaacatgg

SEQ ID NO: 561327 - DNA, 20 bp, Artificial Sequence
  chemically synthesized
gtatactatgccatagatga

SEQ ID NO: 561328 - DNA, 20 bp, Artificial Sequence
  chemically synthesized
tttcaaatgcataaaaattg

SEQ ID NO: 561329 - DNA, 20 bp, Artificial Sequence
  chemically synthesized
gagaggttacgtaatttacc

SEQ ID NO: 561330 - DNA, 20 bp, Artificial Sequence
  chemically synthesized
ctacaaaataataattgttt

SEQ ID NO: 561331 - DNA, 20 bp, Artificial Sequence
  chemically synthesized
tcaatttacagactcaagcc

SEQ ID NO: 561332 - DNA, 20 bp, Artificial Sequence
  chemically synthesized
aggaacttttgaccaatatg

SEQ ID NO: 561333 - DNA, 20 bp, Artificial Sequence
  chemically synthesized
aggtatttactccatagtat

SEQ ID NO: 561334 - DNA, 20 bp, Artificial Sequence
  chemically synthesized
actagaatcaggagcaaagg

SEQ ID NO: 561335 - DNA, 20 bp, Artificial Sequence
  chemically synthesized
cagatttctactttttgtgt

SEQ ID NO: 561336 - DNA, 20 bp, Artificial Sequence
  chemically synthesized
ggcagttaaaagttgtgtga

SEQ ID NO: 561337 - DNA, 20 bp, Artificial Sequence
  chemically synthesized
aagagtgggtcagggacaga

SEQ ID NO: 561338 - DNA, 20 bp, Artificial Sequence
  chemically synthesized
gaagtcttccacttgaaggg

SEQ ID NO: 561339 - DNA, 20 bp, Artificial Sequence
  chemically synthesized
tgcataaatgagcattgact

SEQ ID NO: 561340 - DNA, 20 bp, Artificial Sequence
  chemically synthesized
aaaaaaaaaaatcaaagtga

SEQ ID NO: 561341 - DNA, 20 bp, Artificial Sequence
  chemically synthesized
caattgtttctgttggtatt

SEQ ID NO: 561342 - DNA, 20 bp, Artificial Sequence
  chemically synthesized
aagctagagaagacagtgta

SEQ ID NO: 561343 - DNA, 20 bp, Artificial Sequence
  chemically synthesized
aaatttgaacatatacttta

SEQ ID NO: 561344 - DNA, 20 bp, Artificial Sequence
  chemically synthesized
aagtacaaaatatggtcaga

SEQ ID NO: 561345 - DNA, 20 bp, Artificial Sequence
  chemically synthesized
gcctacctaaaataaagaaa

SEQ ID NO: 561346 - DNA, 20 bp, Artificial Sequence
  chemically synthesized
atgcagtgacgcttcataga

SEQ ID NO: 561347 - DNA, 20 bp, Artificial Sequence
  chemically synthesized
gtaggtcaagaaggaattag

SEQ ID NO: 561348 - DNA, 20 bp, Artificial Sequence
  chemically synthesized
ggacaacaaagtattcaatc

SEQ ID NO: 561349 - DNA, 20 bp, Artificial Sequence
  chemically synthesized
caaaggtgagcctgtaaaca

SEQ ID NO: 561350 - DNA, 20 bp, Artificial Sequence
  chemically synthesized
ctggaaaaaaaaaaaaaaaa

SEQ ID NO: 561351 - DNA, 20 bp, Artificial Sequence
  chemically synthesized
ctcaaataaaattgctagcc

SEQ ID NO: 561352 - DNA, 20 bp, Artificial Sequence
  chemically synthesized
ttatttgagatggacagtag

SEQ ID NO: 561353 - DNA, 20 bp, Artificial Sequence
  chemically synthesized
cagtagaaaaacagtaatag

SEQ ID NO: 561354 - DNA, 20 bp, Artificial Sequence
  chemically synthesized
ggacttctcattgaacttgt

SEQ ID NO: 561355 - DNA, 20 bp, Artificial Sequence
  chemically synthesized
taaaaaaaaaaaaaaaaaag

SEQ ID NO: 561356 - DNA, 20 bp, Artificial Sequence
  chemically synthesized
tatatcacactgccctgttc

SEQ ID NO: 561357 - DNA, 20 bp, Artificial Sequence
  chemically synthesized
gtgattcaagggcataaatg

SEQ ID NO: 561358 - DNA, 20 bp, Artificial Sequence
  chemically synthesized
agttcttctgctggctttgt

SEQ ID NO: 561359 - DNA, 20 bp, Artificial Sequence
  chemically synthesized
ccattgtatgtaagatagaa

SEQ ID NO: 561360 - DNA, 20 bp, Artificial Sequence
  chemically synthesized
tggtctaacaattacatttc

SEQ ID NO: 561361 - DNA, 20 bp, Artificial Sequence
  chemically synthesized
aaaaagtaatcccgaccagt

SEQ ID NO: 561362 - DNA, 20 bp, Artificial Sequence
  chemically synthesized
ccaaattttttaaatgagtg

SEQ ID NO: 561363 - DNA, 20 bp, Artificial Sequence
  chemically synthesized
tcctttggtagtgattaaaa

SEQ ID NO: 561364 - DNA, 20 bp, Artificial Sequence
  chemically synthesized
cacgtcaagggtaaaaatta

SEQ ID NO: 561365 - DNA, 20 bp, Artificial Sequence
  chemically synthesized
caacctgttaaagaaagggg

SEQ ID NO: 561366 - DNA, 20 bp, Artificial Sequence
  chemically synthesized
gttgcaataataataataat

SEQ ID NO: 561367 - DNA, 20 bp, Artificial Sequence
  chemically synthesized
taaggctgactgcattttag

SEQ ID NO: 561368 - DNA, 20 bp, Artificial Sequence
  chemically synthesized
tagagacctaacattcattc

SEQ ID NO: 561369 - DNA, 20 bp, Artificial Sequence
  chemically synthesized
tttgccttgattaaggcaaa

SEQ ID NO: 561370 - DNA, 20 bp, Artificial Sequence
  chemically synthesized
tttgcattcctctattggct

SEQ ID NO: 561371 - DNA, 20 bp, Artificial Sequence
  chemically synthesized
caaatgatatagccactttg

SEQ ID NO: 561372 - DNA, 20 bp, Artificial Sequence
  chemically synthesized
aacagtctggcagtttctca

SEQ ID NO: 561373 - DNA, 20 bp, Artificial Sequence
  chemically synthesized
agcatttatctcaaggaaat

SEQ ID NO: 561374 - DNA, 20 bp, Artificial Sequence
  chemically synthesized
atgaaaacacatgtgtacac

SEQ ID NO: 561375 - DNA, 20 bp, Artificial Sequence
  chemically synthesized
gaccaagatgtcaacattca

SEQ ID NO: 561376 - DNA, 20 bp, Artificial Sequence
  chemically synthesized
ttcgatgtagtaacatctta

SEQ ID NO: 561377 - DNA, 20 bp, Artificial Sequence
  chemically synthesized
taataagagcatgtaaaagt

SEQ ID NO: 561378 - DNA, 20 bp, Artificial Sequence
  chemically synthesized
gagtcaggtccatggcaacc

SEQ ID NO: 561379 - DNA, 20 bp, Artificial Sequence
  chemically synthesized
tgtttataaccaaaataatt

SEQ ID NO: 561380 - DNA, 20 bp, Artificial Sequence
  chemically synthesized
atcatcagagaaatgcaaat

SEQ ID NO: 561381 - DNA, 20 bp, Artificial Sequence
  chemically synthesized
tgtaaattattgtagtcatg

SEQ ID NO: 561382 - DNA, 20 bp, Artificial Sequence
  chemically synthesized
gtttctcaaaaaattacaaa

SEQ ID NO: 561383 - DNA, 20 bp, Artificial Sequence
  chemically synthesized
atagataaattttattggaa

SEQ ID NO: 561384 - DNA, 20 bp, Artificial Sequence
  chemically synthesized
aatttatctatatccacagg

SEQ ID NO: 561385 - DNA, 20 bp, Artificial Sequence
  chemically synthesized
gggaggagggagaggatcag

SEQ ID NO: 561386 - DNA, 20 bp, Artificial Sequence
  chemically synthesized
agcaaactagtgcatgaaca

SEQ ID NO: 561387 - DNA, 20 bp, Artificial Sequence
  chemically synthesized
tggtgattcctcaaagaagt

SEQ ID NO: 561388 - DNA, 20 bp, Artificial Sequence
  chemically synthesized
aaaactaaaagaatcaaaaa

SEQ ID NO: 561389 - DNA, 20 bp, Artificial Sequence
  chemically synthesized
caaacaaaactaaaagaatc

SEQ ID NO: 561390 - DNA, 20 bp, Artificial Sequence
  chemically synthesized
gatgtatttgatcatacaaa

SEQ ID NO: 561391 - DNA, 20 bp, Artificial Sequence
  chemically synthesized
accatatagaaattaatgag

SEQ ID NO: 561392 - DNA, 20 bp, Artificial Sequence
  chemically synthesized
ttaaaattcaagaaggaaaa

SEQ ID NO: 561393 - DNA, 20 bp, Artificial Sequence
  chemically synthesized
ttttgtatttcattcaaaag

SEQ ID NO: 561394 - DNA, 20 bp, Artificial Sequence
  chemically synthesized
tccaaagcatatgaaaagaa

SEQ ID NO: 561395 - DNA, 20 bp, Artificial Sequence
  chemically synthesized
aaattagactgattacttca

SEQ ID NO: 561396 - DNA, 20 bp, Artificial Sequence
  chemically synthesized
aacaattttgcaaaattctg

SEQ ID NO: 561397 - DNA, 20 bp, Artificial Sequence
  chemically synthesized
taacaaagaaaacttagaat

SEQ ID NO: 561398 - DNA, 20 bp, Artificial Sequence
  chemically synthesized
cctatcccagtcataacaaa

SEQ ID NO: 561399 - DNA, 20 bp, Artificial Sequence
  chemically synthesized
agcttccacaaggtctgatt

SEQ ID NO: 561400 - DNA, 20 bp, Artificial Sequence
  chemically synthesized
aagaagacatgtacaagaga

SEQ ID NO: 561401 - DNA, 20 bp, Artificial Sequence
  chemically synthesized
agcttatgagaattcatggc

SEQ ID NO: 561402 - DNA, 20 bp, Artificial Sequence
  chemically synthesized
ctggaatgtgtattagaaaa

SEQ ID NO: 561403 - DNA, 20 bp, Artificial Sequence
  chemically synthesized
taactgaatggtaaaaatat

SEQ ID NO: 561404 - DNA, 20 bp, Artificial Sequence
  chemically synthesized
gattacatctgtctactaag

SEQ ID NO: 561405 - DNA, 20 bp, Artificial Sequence
  chemically synthesized
tctgtctactaagcaaaaca

SEQ ID NO: 561406 - DNA, 20 bp, Artificial Sequence
  chemically synthesized
gctttcctgttttgcacaat

SEQ ID NO: 561407 - DNA, 20 bp, Artificial Sequence
  chemically synthesized
tatcagatgttttcattgtg

SEQ ID NO: 561408 - DNA, 20 bp, Artificial Sequence
  chemically synthesized
gtagtttaacttatttctgc

SEQ ID NO: 561409 - DNA, 20 bp, Artificial Sequence
  chemically synthesized
aacttccgaagataacagtg

SEQ ID NO: 561410 - DNA, 20 bp, Artificial Sequence
  chemically synthesized
aaatgtaattttggaggata

SEQ ID NO: 561411 - DNA, 20 bp, Artificial Sequence
  chemically synthesized
gtctgtaagaattgcacata

SEQ ID NO: 561412 - DNA, 20 bp, Artificial Sequence
  chemically synthesized
ttgcttgttcgagacaggca

SEQ ID NO: 561413 - DNA, 20 bp, Artificial Sequence
  chemically synthesized
tgaaggaaagtgggataaaa

SEQ ID NO: 561414 - DNA, 20 bp, Artificial Sequence
  chemically synthesized
aagatttaagaatacttaag

SEQ ID NO: 561415 - DNA, 20 bp, Artificial Sequence
  chemically synthesized
ttcctgtcaataatctttca

SEQ ID NO: 561416 - DNA, 20 bp, Artificial Sequence
  chemically synthesized
agagaagggaaaatgatgaa

SEQ ID NO: 561417 - DNA, 20 bp, Artificial Sequence
  chemically synthesized
gcaaatgcttaaatgataca

SEQ ID NO: 561418 - DNA, 20 bp, Artificial Sequence
  chemically synthesized
actttctgcaacttccaagt

SEQ ID NO: 561419 - DNA, 20 bp, Artificial Sequence
  chemically synthesized
tcagagctacaggctctaat

SEQ ID NO: 561420 - DNA, 20 bp, Artificial Sequence
  chemically synthesized
ttaaagaatgactaaatatg

SEQ ID NO: 561421 - DNA, 20 bp, Artificial Sequence
  chemically synthesized
gaggcagtatataaacaaat

SEQ ID NO: 561422 - DNA, 20 bp, Artificial Sequence
  chemically synthesized
tttaatggcatgaaagacat

SEQ ID NO: 561423 - DNA, 20 bp, Artificial Sequence
  chemically synthesized
ttcaaccagattacctgtat

SEQ ID NO: 561424 - DNA, 20 bp, Artificial Sequence
  chemically synthesized
gaggattctaaaatgttctt

SEQ ID NO: 561425 - DNA, 20 bp, Artificial Sequence
  chemically synthesized
tagatttgaagttacttggt

SEQ ID NO: 561426 - DNA, 20 bp, Artificial Sequence
  chemically synthesized
ctgggatttgctttaccttc

SEQ ID NO: 561427 - DNA, 20 bp, Artificial Sequence
  chemically synthesized
cagcagggataacttcatgc

SEQ ID NO: 561428 - DNA, 20 bp, Artificial Sequence
  chemically synthesized
gaccatcctggccaacatgg

SEQ ID NO: 561429 - DNA, 20 bp, Artificial Sequence
  chemically synthesized
aacatatatgtatttctgtg

SEQ ID NO: 561430 - DNA, 20 bp, Artificial Sequence
  chemically synthesized
aagtatgagatatagaaacc

SEQ ID NO: 561431 - DNA, 20 bp, Artificial Sequence
  chemically synthesized
tgatccagacaaggagggag

SEQ ID NO: 561432 - DNA, 20 bp, Artificial Sequence
  chemically synthesized
aaggaaaaagcattccatat

SEQ ID NO: 561433 - DNA, 20 bp, Artificial Sequence
  chemically synthesized
ggtttgttaaaccaagagta

SEQ ID NO: 561434 - DNA, 20 bp, Artificial Sequence
  chemically synthesized
gtcctcatttcgcacagaaa

SEQ ID NO: 561435 - DNA, 20 bp, Artificial Sequence
  chemically synthesized
gggttagtgaagtaggagtg

SEQ ID NO: 561436 - DNA, 20 bp, Artificial Sequence
  chemically synthesized
aaactaaggagcggcactgg

SEQ ID NO: 561437 - DNA, 20 bp, Artificial Sequence
  chemically synthesized
agaaagttacagtcaataac

SEQ ID NO: 561438 - DNA, 20 bp, Artificial Sequence
  chemically synthesized
ttaaagaataataaaaaata

SEQ ID NO: 561439 - DNA, 20 bp, Artificial Sequence
  chemically synthesized
agcaaactaacacaagaaca

SEQ ID NO: 561440 - DNA, 20 bp, Artificial Sequence
  chemically synthesized
gtcattagaaaaatgcaaat

SEQ ID NO: 561441 - DNA, 20 bp, Artificial Sequence
  chemically synthesized
aatgagatgacaatgactaa

SEQ ID NO: 561442 - DNA, 20 bp, Artificial Sequence
  chemically synthesized
cataagtataaacaaaaatg

SEQ ID NO: 561443 - DNA, 20 bp, Artificial Sequence
  chemically synthesized
ggtgaaaccccatctctact

SEQ ID NO: 561444 - DNA, 20 bp, Artificial Sequence
  chemically synthesized
ctggcctatgcgttagagga

SEQ ID NO: 561445 - DNA, 20 bp, Artificial Sequence
  chemically synthesized
ttttggggccttttccctac

SEQ ID NO: 561446 - DNA, 20 bp, Artificial Sequence
  chemically synthesized
ttcatttaataatttcatta

SEQ ID NO: 561447 - DNA, 20 bp, Artificial Sequence
  chemically synthesized
aggaacttatgaagggaact

SEQ ID NO: 561448 - DNA, 20 bp, Artificial Sequence
  chemically synthesized
cacatgtgtatttactgtaa

SEQ ID NO: 561449 - DNA, 20 bp, Artificial Sequence
  chemically synthesized
atgtgtaacagctatcaggt

SEQ ID NO: 561450 - DNA, 20 bp, Artificial Sequence
  chemically synthesized
ttttggaaggagtaagtcag

SEQ ID NO: 561451 - DNA, 20 bp, Artificial Sequence
  chemically synthesized
atttctttcaattaaatttc

SEQ ID NO: 561452 - DNA, 20 bp, Artificial Sequence
  chemically synthesized
aatacatttcccagtttgcc

SEQ ID NO: 561453 - DNA, 20 bp, Artificial Sequence
  chemically synthesized
aatttcagtttctcattcta

SEQ ID NO: 561454 - DNA, 20 bp, Artificial Sequence
  chemically synthesized
aatttaaaaaaaaaatcaag

SEQ ID NO: 561455 - DNA, 20 bp, Artificial Sequence
  chemically synthesized
catgtaaatggaaaagatta

SEQ ID NO: 561456 - DNA, 20 bp, Artificial Sequence
  chemically synthesized
ccagatactaggctgtatta

SEQ ID NO: 561457 - DNA, 20 bp, Artificial Sequence
  chemically synthesized
atgcaagagaattgaagtgc

SEQ ID NO: 561458 - DNA, 20 bp, Artificial Sequence
  chemically synthesized
atgcaataatcaatttcagg

SEQ ID NO: 561459 - DNA, 20 bp, Artificial Sequence
  chemically synthesized
atttcaggtaaaacagatcc

SEQ ID NO: 561460 - DNA, 20 bp, Artificial Sequence
  chemically synthesized
cagatccaaaaacaaaatgg

SEQ ID NO: 561461 - DNA, 20 bp, Artificial Sequence
  chemically synthesized
cttggatatagtttattctt

SEQ ID NO: 561462 - DNA, 20 bp, Artificial Sequence
  chemically synthesized
cttcaatggttaatattaat

SEQ ID NO: 561463 - DNA, 20 bp, Artificial Sequence
  chemically synthesized
aggaaaatacatttgcaact

SEQ ID NO: 561464 - DNA, 20 bp, Artificial Sequence
  chemically synthesized
aaccagaaaaatcctggcaa

SEQ ID NO: 561465 - DNA, 20 bp, Artificial Sequence
  chemically synthesized
aagcatgcacacactcctcc

SEQ ID NO: 561466 - DNA, 20 bp, Artificial Sequence
  chemically synthesized
gtaaacaaacaaacaaacaa

SEQ ID NO: 561467 - DNA, 20 bp, Artificial Sequence
  chemically synthesized
aaccagagcatgtgtgccca

SEQ ID NO: 561468 - DNA, 20 bp, Artificial Sequence
  chemically synthesized
tgtgtgcccaaaaaacctcc

SEQ ID NO: 561469 - DNA, 20 bp, Artificial Sequence
  chemically synthesized
agtaaactaacacagaaaca

SEQ ID NO: 561470 - DNA, 20 bp, Artificial Sequence
  chemically synthesized
acaaactttgggatatcctg

SEQ ID NO: 561471 - DNA, 20 bp, Artificial Sequence
  chemically synthesized
agcaagaaaatgtcatttaa

SEQ ID NO: 561472 - DNA, 20 bp, Artificial Sequence
  chemically synthesized
tccagttaaatctaaaccaa

SEQ ID NO: 561473 - DNA, 20 bp, Artificial Sequence
  chemically synthesized
agaaaaatccgtttgttgca

SEQ ID NO: 561474 - DNA, 20 bp, Artificial Sequence
  chemically synthesized
agcttcatgaagtaaaatct

SEQ ID NO: 561475 - DNA, 20 bp, Artificial Sequence
  chemically synthesized
ctacttacattattgttctg

SEQ ID NO: 561476 - DNA, 20 bp, Artificial Sequence
  chemically synthesized
ctttttcttttggctgagaa

SEQ ID NO: 561477 - DNA, 20 bp, Artificial Sequence
  chemically synthesized
tagagtggttggtttatgct

SEQ ID NO: 561478 - DNA, 20 bp, Artificial Sequence
  chemically synthesized
acagaaacatcagcatgcat

SEQ ID NO: 561479 - DNA, 20 bp, Artificial Sequence
  chemically synthesized
aacattttctagtaagatag

SEQ ID NO: 561480 - DNA, 20 bp, Artificial Sequence
  chemically synthesized
tatcataatggtagaatttc

SEQ ID NO: 561481 - DNA, 20 bp, Artificial Sequence
  chemically synthesized
gaaatgaaaatgagagtaaa

SEQ ID NO: 561482 - DNA, 20 bp, Artificial Sequence
  chemically synthesized
ttatgtaggccagacagcac

SEQ ID NO: 561483 - DNA, 20 bp, Artificial Sequence
  chemically synthesized
agtccatttttaacagatga

SEQ ID NO: 561484 - DNA, 20 bp, Artificial Sequence
  chemically synthesized
atcttgttcctttgatttca

SEQ ID NO: 561485 - DNA, 20 bp, Artificial Sequence
  chemically synthesized
ccccatgtctactaaaaata

SEQ ID NO: 561486 - DNA, 20 bp, Artificial Sequence
  chemically synthesized
aaaaaaaaaatacatgaaag

SEQ ID NO: 561487 - DNA, 20 bp, Artificial Sequence
  chemically synthesized
ctgatttgagtaattatttt

SEQ ID NO: 561488 - DNA, 20 bp, Artificial Sequence
  chemically synthesized
ctacccatttgatataaaga

SEQ ID NO: 561489 - DNA, 20 bp, Artificial Sequence
  chemically synthesized
cagctatgtgagattaatac

SEQ ID NO: 561490 - DNA, 20 bp, Artificial Sequence
  chemically synthesized
atgtcagtcatacatacact

SEQ ID NO: 561491 - DNA, 20 bp, Artificial Sequence
  chemically synthesized
gcaagtaaaataatacaggc

SEQ ID NO: 561492 - DNA, 20 bp, Artificial Sequence
  chemically synthesized
ataagatagataccaagtag

SEQ ID NO: 561493 - DNA, 20 bp, Artificial Sequence
  chemically synthesized
agtcattctactagatgtca

SEQ ID NO: 561494 - DNA, 20 bp, Artificial Sequence
  chemically synthesized
cctcgaaggcctgacagggc

SEQ ID NO: 561495 - DNA, 20 bp, Artificial Sequence
  chemically synthesized
tttcacgattatcccctttt

SEQ ID NO: 561496 - DNA, 20 bp, Artificial Sequence
  chemically synthesized
ggttcgacatccttatcact

SEQ ID NO: 561497 - DNA, 20 bp, Artificial Sequence
  chemically synthesized
tcaccaaatcgttttctgct

SEQ ID NO: 561498 - DNA, 20 bp, Artificial Sequence
  chemically synthesized
ggattgtagggttttaagca

SEQ ID NO: 561499 - DNA, 20 bp, Artificial Sequence
  chemically synthesized
ggatcaacaaatactttcca

SEQ ID NO: 561500 - DNA, 20 bp, Artificial Sequence
  chemically synthesized
tcccttaaacttccacgatt

SEQ ID NO: 561501 - DNA, 20 bp, Artificial Sequence
  chemically synthesized
atgggaaaaagaacataaca

SEQ ID NO: 561502 - DNA, 20 bp, Artificial Sequence
  chemically synthesized
acacaagcaagcacctacat

SEQ ID NO: 561503 - DNA, 20 bp, Artificial Sequence
  chemically synthesized
tcaaagggagtctaggctac

SEQ ID NO: 561504 - DNA, 20 bp, Artificial Sequence
  chemically synthesized
tagtaacaggcttctcagca

SEQ ID NO: 561505 - DNA, 20 bp, Artificial Sequence
  chemically synthesized
agaggaccttaactagccag

SEQ ID NO: 561506 - DNA, 20 bp, Artificial Sequence
  chemically synthesized
agaaaaaccatctgaaggca

SEQ ID NO: 561507 - DNA, 20 bp, Artificial Sequence
  chemically synthesized
aagcaaagagaaaactaatt

SEQ ID NO: 561508 - DNA, 20 bp, Artificial Sequence
  chemically synthesized
cataaacaagaaagcaaaga

SEQ ID NO: 561509 - DNA, 20 bp, Artificial Sequence
  chemically synthesized
caggatggaagagaaagcca

SEQ ID NO: 561510 - DNA, 20 bp, Artificial Sequence
  chemically synthesized
agaaagccacaaaacaacca

SEQ ID NO: 561511 - DNA, 20 bp, Artificial Sequence
  chemically synthesized
taggaataagttcttaataa

SEQ ID NO: 561512 - DNA, 20 bp, Artificial Sequence
  chemically synthesized
aatgaaataaactctccaat

SEQ ID NO: 561513 - DNA, 20 bp, Artificial Sequence
  chemically synthesized
agtgacagaaaaaaaaaaaa

SEQ ID NO: 561514 - DNA, 20 bp, Artificial Sequence
  chemically synthesized
atgggccatatgttaggcca

SEQ ID NO: 561515 - DNA, 20 bp, Artificial Sequence
  chemically synthesized
gaggaattttgaaaattata

SEQ ID NO: 561516 - DNA, 20 bp, Artificial Sequence
  chemically synthesized
agttataaaatttcttgaaa

SEQ ID NO: 561517 - DNA, 20 bp, Artificial Sequence
  chemically synthesized
aaactgtaaacacagcatac

SEQ ID NO: 561518 - DNA, 20 bp, Artificial Sequence
  chemically synthesized
gattgtgtcatgaagacatg

SEQ ID NO: 561519 - DNA, 20 bp, Artificial Sequence
  chemically synthesized
ggccaatattagcctgacac

SEQ ID NO: 561520 - DNA, 20 bp, Artificial Sequence
  chemically synthesized
gaaaaccagacagatatcca

SEQ ID NO: 561521 - DNA, 20 bp, Artificial Sequence
  chemically synthesized
ccagacagatatccagaaaa

SEQ ID NO: 561522 - DNA, 20 bp, Artificial Sequence
  chemically synthesized
gtatgaacagaatgaaggac

SEQ ID NO: 561523 - DNA, 20 bp, Artificial Sequence
  chemically synthesized
attcaacatgccttcatgat

SEQ ID NO: 561524 - DNA, 20 bp, Artificial Sequence
  chemically synthesized
gccttcatgataaaaactct

SEQ ID NO: 561525 - DNA, 20 bp, Artificial Sequence
  chemically synthesized
taatttcatactgaatgggg

SEQ ID NO: 561526 - DNA, 20 bp, Artificial Sequence
  chemically synthesized
aatcaaatgatccttgttta

SEQ ID NO: 561527 - DNA, 20 bp, Artificial Sequence
  chemically synthesized
aaaatgcatgctaatggcat

SEQ ID NO: 561528 - DNA, 20 bp, Artificial Sequence
  chemically synthesized
ttttcaataaatggtgctga

SEQ ID NO: 561529 - DNA, 20 bp, Artificial Sequence
  chemically synthesized
ttgatcagagaaatgtaaat

SEQ ID NO: 561530 - DNA, 20 bp, Artificial Sequence
  chemically synthesized
aactgtttgaggttcttcaa

SEQ ID NO: 561531 - DNA, 20 bp, Artificial Sequence
  chemically synthesized
tgaggttcttcaaaaaaact

SEQ ID NO: 561532 - DNA, 20 bp, Artificial Sequence
  chemically synthesized
aagtgaaataagccaggcac

SEQ ID NO: 561533 - DNA, 20 bp, Artificial Sequence
  chemically synthesized
atgtatccataaatttaatc

SEQ ID NO: 561534 - DNA, 20 bp, Artificial Sequence
  chemically synthesized
cataatatacacataaatct

SEQ ID NO: 561535 - DNA, 20 bp, Artificial Sequence
  chemically synthesized
gtataccttcattcaatttg

SEQ ID NO: 561536 - DNA, 20 bp, Artificial Sequence
  chemically synthesized
ctcctggccaaaggagggaa

SEQ ID NO: 561537 - DNA, 20 bp, Artificial Sequence
  chemically synthesized
cctggattttttcttttcat

SEQ ID NO: 561538 - DNA, 20 bp, Artificial Sequence
  chemically synthesized
agaagtcttggagtacagaa

SEQ ID NO: 561539 - DNA, 20 bp, Artificial Sequence
  chemically synthesized
acaaagtctaggcaaaggtc

SEQ ID NO: 561540 - DNA, 20 bp, Artificial Sequence
  chemically synthesized
gtcttttataagtcttcttt

SEQ ID NO: 561541 - DNA, 20 bp, Artificial Sequence
  chemically synthesized
tatatgctttcaaagaaatt

SEQ ID NO: 561542 - DNA, 20 bp, Artificial Sequence
  chemically synthesized
aatatatgcttgtttcaacg

SEQ ID NO: 561543 - DNA, 20 bp, Artificial Sequence
  chemically synthesized
ccccgtctctactaaaaata

SEQ ID NO: 561544 - DNA, 20 bp, Artificial Sequence
  chemically synthesized
gtagcacatttcactaaaaa

SEQ ID NO: 561545 - DNA, 20 bp, Artificial Sequence
  chemically synthesized
tattcatactacagggagaa

SEQ ID NO: 561546 - DNA, 20 bp, Artificial Sequence
  chemically synthesized
tttgaccaaattctaggtgt

SEQ ID NO: 561547 - DNA, 20 bp, Artificial Sequence
  chemically synthesized
acagggatgccaaactaata

SEQ ID NO: 561548 - DNA, 20 bp, Artificial Sequence
  chemically synthesized
attattccctatacaattac

SEQ ID NO: 561549 - DNA, 20 bp, Artificial Sequence
  chemically synthesized
gaactattttgtgaagcaca

SEQ ID NO: 561550 - DNA, 20 bp, Artificial Sequence
  chemically synthesized
accacaacacgaaaggacct

SEQ ID NO: 561551 - DNA, 20 bp, Artificial Sequence
  chemically synthesized
gcaaataccacaaagaattg

SEQ ID NO: 561552 - DNA, 20 bp, Artificial Sequence
  chemically synthesized
gaattgcaaaactggggatt

SEQ ID NO: 561553 - DNA, 20 bp, Artificial Sequence
  chemically synthesized
cttttccaactcatatttaa

SEQ ID NO: 561554 - DNA, 20 bp, Artificial Sequence
  chemically synthesized
ttaggtgactcctttcaaga

SEQ ID NO: 561555 - DNA, 20 bp, Artificial Sequence
  chemically synthesized
tagtattctaactcaaaata

SEQ ID NO: 561556 - DNA, 20 bp, Artificial Sequence
  chemically synthesized
cactgataaaatatgctttg

SEQ ID NO: 561557 - DNA, 20 bp, Artificial Sequence
  chemically synthesized
tagcatagaaaatgctcaat

SEQ ID NO: 561558 - DNA, 20 bp, Artificial Sequence
  chemically synthesized
attttatctgctaaggtcca

SEQ ID NO: 561559 - DNA, 20 bp, Artificial Sequence
  chemically synthesized
tttatatctggagagattat

SEQ ID NO: 561560 - DNA, 20 bp, Artificial Sequence
  chemically synthesized
atccttaacatgttttgtaa

SEQ ID NO: 561561 - DNA, 20 bp, Artificial Sequence
  chemically synthesized
tttagaagttagttttatta

SEQ ID NO: 561562 - DNA, 20 bp, Artificial Sequence
  chemically synthesized
gtactgacctaacttaaaga

SEQ ID NO: 561563 - DNA, 20 bp, Artificial Sequence
  chemically synthesized
acagagtctcaacaacaaca

SEQ ID NO: 561564 - DNA, 20 bp, Artificial Sequence
  chemically synthesized
gtatctatgtgaatcaaaag

SEQ ID NO: 561565 - DNA, 20 bp, Artificial Sequence
  chemically synthesized
atgactttaattaatgaatg

SEQ ID NO: 561566 - DNA, 20 bp, Artificial Sequence
  chemically synthesized
atgggggtgactgtgaacat

SEQ ID NO: 561567 - DNA, 20 bp, Artificial Sequence
  chemically synthesized
agatgacgtaaaggctcaag

SEQ ID NO: 561568 - DNA, 20 bp, Artificial Sequence
  chemically synthesized
aagaagaaatatcattcaac

SEQ ID NO: 561569 - DNA, 20 bp, Artificial Sequence
  chemically synthesized
aaaatgggaagataaaagat

SEQ ID NO: 561570 - DNA, 20 bp, Artificial Sequence
  chemically synthesized
taggctattacaaaagctgt

SEQ ID NO: 561571 - DNA, 20 bp, Artificial Sequence
  chemically synthesized
aaaatatgaattaaaaaatg

SEQ ID NO: 561572 - DNA, 20 bp, Artificial Sequence
  chemically synthesized
ttaacatagtattgtttagg

SEQ ID NO: 561573 - DNA, 20 bp, Artificial Sequence
  chemically synthesized
ctggctgtctgctagtctgg

SEQ ID NO: 561574 - DNA, 20 bp, Artificial Sequence
  chemically synthesized
caccttgaaactcagtaggt

SEQ ID NO: 561575 - DNA, 20 bp, Artificial Sequence
  chemically synthesized
tctagcttgatatttctcat

SEQ ID NO: 561576 - DNA, 20 bp, Artificial Sequence
  chemically synthesized
aaaaatttctatgaaactga

SEQ ID NO: 561577 - DNA, 20 bp, Artificial Sequence
  chemically synthesized
aaattatagcttataatgaa

SEQ ID NO: 561578 - DNA, 20 bp, Artificial Sequence
  chemically synthesized
gtggtttattcagacatttc

SEQ ID NO: 561579 - DNA, 20 bp, Artificial Sequence
  chemically synthesized
aaaaatagttccctgtgaac

SEQ ID NO: 561580 - DNA, 20 bp, Artificial Sequence
  chemically synthesized
tatgtaataaagctcttggt

SEQ ID NO: 561581 - DNA, 20 bp, Artificial Sequence
  chemically synthesized
tccaatatgggaatttaagc

SEQ ID NO: 561582 - DNA, 20 bp, Artificial Sequence
  chemically synthesized
aggctcccactgagaagaac

SEQ ID NO: 561583 - DNA, 20 bp, Artificial Sequence
  chemically synthesized
gccaacagggccttgggtct

SEQ ID NO: 561584 - DNA, 20 bp, Artificial Sequence
  chemically synthesized
tcaacaaaaaaaatcccaat

SEQ ID NO: 561585 - DNA, 20 bp, Artificial Sequence
  chemically synthesized
actcatgaagatgagaatca

SEQ ID NO: 561586 - DNA, 20 bp, Artificial Sequence
  chemically synthesized
gaagatgagaatcaaaaaac

SEQ ID NO: 561587 - DNA, 20 bp, Artificial Sequence
  chemically synthesized
aatcaaaaaacaaaaacact

SEQ ID NO: 561588 - DNA, 20 bp, Artificial Sequence
  chemically synthesized
aaagaagttaagagccatga

SEQ ID NO: 561589 - DNA, 20 bp, Artificial Sequence
  chemically synthesized
aaatgacccaagggagctga

SEQ ID NO: 561590 - DNA, 20 bp, Artificial Sequence
  chemically synthesized
attcaacatcctttcatgtt

SEQ ID NO: 561591 - DNA, 20 bp, Artificial Sequence
  chemically synthesized
caatatcatactagatgggc

SEQ ID NO: 561592 - DNA, 20 bp, Artificial Sequence
  chemically synthesized
ttttcaagggtttgtcatac

SEQ ID NO: 561593 - DNA, 20 bp, Artificial Sequence
  chemically synthesized
ttttggtatgacaaaccctt

SEQ ID NO: 561594 - DNA, 20 bp, Artificial Sequence
  chemically synthesized
ctgtctcttctgtgtatcta

SEQ ID NO: 561595 - DNA, 20 bp, Artificial Sequence
  chemically synthesized
ttcacagaattagaaaaaaa

SEQ ID NO: 561596 - DNA, 20 bp, Artificial Sequence
  chemically synthesized
ttttggttctgtatgaattt

SEQ ID NO: 561597 - DNA, 20 bp, Artificial Sequence
  chemically synthesized
tgacttcagactatactacc

SEQ ID NO: 561598 - DNA, 20 bp, Artificial Sequence
  chemically synthesized
aaacatcatggtactggtag

SEQ ID NO: 561599 - DNA, 20 bp, Artificial Sequence
  chemically synthesized
tgatgtttgacaaacctgac

SEQ ID NO: 561600 - DNA, 20 bp, Artificial Sequence
  chemically synthesized
agactggctagccatattca

SEQ ID NO: 561601 - DNA, 20 bp, Artificial Sequence
  chemically synthesized
atggattaaagacttaaaca

SEQ ID NO: 561602 - DNA, 20 bp, Artificial Sequence
  chemically synthesized
acacaaaacccactaactat

SEQ ID NO: 561603 - DNA, 20 bp, Artificial Sequence
  chemically synthesized
aaagattttgatttcctgac

SEQ ID NO: 561604 - DNA, 20 bp, Artificial Sequence
  chemically synthesized
aaaacatcagtcaattgcaa

SEQ ID NO: 561605 - DNA, 20 bp, Artificial Sequence
  chemically synthesized
aaaaaaaaaaaaaaaaaaaa

SEQ ID NO: 561606 - DNA, 20 bp, Artificial Sequence
  chemically synthesized
aaaaaaaaaaaaaaaaacca

SEQ ID NO: 561607 - DNA, 20 bp, Artificial Sequence
  chemically synthesized
tgcaatctatttaccattaa

SEQ ID NO: 561608 - DNA, 20 bp, Artificial Sequence
  chemically synthesized
tagaccaagattaagagaaa

SEQ ID NO: 561609 - DNA, 20 bp, Artificial Sequence
  chemically synthesized
agttgaacagctggaagttg

SEQ ID NO: 561610 - DNA, 20 bp, Artificial Sequence
  chemically synthesized
aggagccatagagatcttta

SEQ ID NO: 561611 - DNA, 20 bp, Artificial Sequence
  chemically synthesized
agtgcctcatgcattcattt

SEQ ID NO: 561612 - DNA, 20 bp, Artificial Sequence
  chemically synthesized
aatagttactaaaaattagc

SEQ ID NO: 561613 - DNA, 20 bp, Artificial Sequence
  chemically synthesized
ctgaaaatgtacatttctaa

SEQ ID NO: 561614 - DNA, 20 bp, Artificial Sequence
  chemically synthesized
attttcactttaacaacaat

SEQ ID NO: 561615 - DNA, 20 bp, Artificial Sequence
  chemically synthesized
tgtatcaatagagaatatca

SEQ ID NO: 561616 - DNA, 20 bp, Artificial Sequence
  chemically synthesized
atgcatctcttttctttcct

SEQ ID NO: 561617 - DNA, 20 bp, Artificial Sequence
  chemically synthesized
caaacaagccaggcgagaga

SEQ ID NO: 561618 - DNA, 20 bp, Artificial Sequence
  chemically synthesized
agccctaagatgccatgcat

SEQ ID NO: 561619 - DNA, 20 bp, Artificial Sequence
  chemically synthesized
ggttttctattactatgtaa

SEQ ID NO: 561620 - DNA, 20 bp, Artificial Sequence
  chemically synthesized
tgttttgttacatagtaata

SEQ ID NO: 561621 - DNA, 20 bp, Artificial Sequence
  chemically synthesized
gataaactggtagagatagc

SEQ ID NO: 561622 - DNA, 20 bp, Artificial Sequence
  chemically synthesized
aaaattagtcaaagcaacca

SEQ ID NO: 561623 - DNA, 20 bp, Artificial Sequence
  chemically synthesized
gtcaatgtagtcacctcctt

SEQ ID NO: 561624 - DNA, 20 bp, Artificial Sequence
  chemically synthesized
ctggtcacagaagcagcaag

SEQ ID NO: 561625 - DNA, 20 bp, Artificial Sequence
  chemically synthesized
tacacagttaaaaaggaacc

SEQ ID NO: 561626 - DNA, 20 bp, Artificial Sequence
  chemically synthesized
tggttagaaatagaaataag

SEQ ID NO: 561627 - DNA, 20 bp, Artificial Sequence
  chemically synthesized
atttttttttaatcccctac

SEQ ID NO: 561628 - DNA, 20 bp, Artificial Sequence
  chemically synthesized
gtcaaaaagtgaatgtagct

SEQ ID NO: 561629 - DNA, 20 bp, Artificial Sequence
  chemically synthesized
caaagattcctgcgttcaat

SEQ ID NO: 561630 - DNA, 20 bp, Artificial Sequence
  chemically synthesized
taaacaaagaagtatcatta

SEQ ID NO: 561631 - DNA, 20 bp, Artificial Sequence
  chemically synthesized
gtcattaagtatactctttg

SEQ ID NO: 561632 - DNA, 20 bp, Artificial Sequence
  chemically synthesized
ggaatcttagtggatctgga

SEQ ID NO: 561633 - DNA, 20 bp, Artificial Sequence
  chemically synthesized
cttttgtggtctttgcttct

SEQ ID NO: 561634 - DNA, 20 bp, Artificial Sequence
  chemically synthesized
agtaaagctgctttgccaac

SEQ ID NO: 561635 - DNA, 20 bp, Artificial Sequence
  chemically synthesized
gcctcagtctggttctgcag

SEQ ID NO: 561636 - DNA, 20 bp, Artificial Sequence
  chemically synthesized
cctctccacatgggctttac

SEQ ID NO: 561637 - DNA, 20 bp, Artificial Sequence
  chemically synthesized
taatggattataatggtaat

SEQ ID NO: 561638 - DNA, 20 bp, Artificial Sequence
  chemically synthesized
attttcttgtagctatacta

SEQ ID NO: 561639 - DNA, 20 bp, Artificial Sequence
  chemically synthesized
ggagaaaccccatctctatt

SEQ ID NO: 561640 - DNA, 20 bp, Artificial Sequence
  chemically synthesized
ccaagactacgtctcaaaaa

SEQ ID NO: 561641 - DNA, 20 bp, Artificial Sequence
  chemically synthesized
tacgtctcaaaaaaaaaaca

SEQ ID NO: 561642 - DNA, 20 bp, Artificial Sequence
  chemically synthesized
caaaaaaaaaacaaaaaaca

SEQ ID NO: 561643 - DNA, 20 bp, Artificial Sequence
  chemically synthesized
aaacaaaaaacaaacaaaaa

SEQ ID NO: 561644 - DNA, 20 bp, Artificial Sequence
  chemically synthesized
atgcctctcacagccagaag

SEQ ID NO: 561645 - DNA, 20 bp, Artificial Sequence
  chemically synthesized
ctaccaaagtaaagcaaaac

SEQ ID NO: 561646 - DNA, 20 bp, Artificial Sequence
  chemically synthesized
attaacctaccaaagtaaag

SEQ ID NO: 561647 - DNA, 20 bp, Artificial Sequence
  chemically synthesized
aaatgtaactttctaatatg

SEQ ID NO: 561648 - DNA, 20 bp, Artificial Sequence
  chemically synthesized
ctaatatgcaaaacataaaa

SEQ ID NO: 561649 - DNA, 20 bp, Artificial Sequence
  chemically synthesized
attgagatgaatgtgttcaa

SEQ ID NO: 561650 - DNA, 20 bp, Artificial Sequence
  chemically synthesized
tttgccaattgcccatatcc

SEQ ID NO: 561651 - DNA, 20 bp, Artificial Sequence
  chemically synthesized
ccaggtatatggcagaatct

SEQ ID NO: 561652 - DNA, 20 bp, Artificial Sequence
  chemically synthesized
tccagcctgggcaacgacag

SEQ ID NO: 561653 - DNA, 20 bp, Artificial Sequence
  chemically synthesized
ctcaaaaaaaagaaaaagaa

SEQ ID NO: 561654 - DNA, 20 bp, Artificial Sequence
  chemically synthesized
ttctctttgaagctagttct

SEQ ID NO: 561655 - DNA, 20 bp, Artificial Sequence
  chemically synthesized
aaagcaatacttaaggcaac

SEQ ID NO: 561656 - DNA, 20 bp, Artificial Sequence
  chemically synthesized
ttctctaagcttttgaaaaa

SEQ ID NO: 561657 - DNA, 20 bp, Artificial Sequence
  chemically synthesized
gctgattctctaagcttttg

SEQ ID NO: 561658 - DNA, 20 bp, Artificial Sequence
  chemically synthesized
ctgacacatcatcccaaacc

SEQ ID NO: 561659 - DNA, 20 bp, Artificial Sequence
  chemically synthesized
attattttataaaagtagta

SEQ ID NO: 561660 - DNA, 20 bp, Artificial Sequence
  chemically synthesized
aactcagttgtattagagtc

SEQ ID NO: 561661 - DNA, 20 bp, Artificial Sequence
  chemically synthesized
cagaaagccctgcaggtaaa

SEQ ID NO: 561662 - DNA, 20 bp, Artificial Sequence
  chemically synthesized
aataagaaatgagagtaata

SEQ ID NO: 561663 - DNA, 20 bp, Artificial Sequence
  chemically synthesized
gatagagtacatcaaaacca

SEQ ID NO: 561664 - DNA, 20 bp, Artificial Sequence
  chemically synthesized
aggcaagggatagagtacat

SEQ ID NO: 561665 - DNA, 20 bp, Artificial Sequence
  chemically synthesized
attgtatgtattggtcaaga

SEQ ID NO: 561666 - DNA, 20 bp, Artificial Sequence
  chemically synthesized
gaacaagttgcaccaagtcc

SEQ ID NO: 561667 - DNA, 20 bp, Artificial Sequence
  chemically synthesized
atacagttaaatatgtacta

SEQ ID NO: 561668 - DNA, 20 bp, Artificial Sequence
  chemically synthesized
caattgtatataaatataaa

SEQ ID NO: 561669 - DNA, 20 bp, Artificial Sequence
  chemically synthesized
atttccctattggagaatta

SEQ ID NO: 561670 - DNA, 20 bp, Artificial Sequence
  chemically synthesized
cattttatgtgatgcatcag

SEQ ID NO: 561671 - DNA, 20 bp, Artificial Sequence
  chemically synthesized
gggaaaaaaaaaaaaaaaaa

SEQ ID NO: 561672 - DNA, 20 bp, Artificial Sequence
  chemically synthesized
ttggagagacaaggggtgag

SEQ ID NO: 561673 - DNA, 20 bp, Artificial Sequence
  chemically synthesized
caaatatatattagtcacaa

SEQ ID NO: 561674 - DNA, 20 bp, Artificial Sequence
  chemically synthesized
agataaaagtgtatcatata

SEQ ID NO: 561675 - DNA, 20 bp, Artificial Sequence
  chemically synthesized
catgaagtcagtattatttt

SEQ ID NO: 561676 - DNA, 20 bp, Artificial Sequence
  chemically synthesized
aggacacctaaattgtcaca

SEQ ID NO: 561677 - DNA, 20 bp, Artificial Sequence
  chemically synthesized
tatttagaacaacaaaaata

SEQ ID NO: 561678 - DNA, 20 bp, Artificial Sequence
  chemically synthesized
tcacatctaaataaatagca

SEQ ID NO: 561679 - DNA, 20 bp, Artificial Sequence
  chemically synthesized
atggattaaagacttacagg

SEQ ID NO: 561680 - DNA, 20 bp, Artificial Sequence
  chemically synthesized
ttacaggtaaaacctgaaac

SEQ ID NO: 561681 - DNA, 20 bp, Artificial Sequence
  chemically synthesized
tgaaactaaaactactagaa

SEQ ID NO: 561682 - DNA, 20 bp, Artificial Sequence
  chemically synthesized
aaaaaaaaaaaaaaaaaaaa

SEQ ID NO: 561683 - DNA, 20 bp, Artificial Sequence
  chemically synthesized
tacctaatgcacacaggact

SEQ ID NO: 561684 - DNA, 20 bp, Artificial Sequence
  chemically synthesized
ttagtcaggtaactgcaaat

SEQ ID NO: 561685 - DNA, 20 bp, Artificial Sequence
  chemically synthesized
aaataggtacagccattatg

SEQ ID NO: 561686 - DNA, 20 bp, Artificial Sequence
  chemically synthesized
gtgcctggacttgagaattt

SEQ ID NO: 561687 - DNA, 20 bp, Artificial Sequence
  chemically synthesized
cttgtcattcttcatcctcc

SEQ ID NO: 561688 - DNA, 20 bp, Artificial Sequence
  chemically synthesized
tgagatccaccccctgctcg

SEQ ID NO: 561689 - DNA, 20 bp, Artificial Sequence
  chemically synthesized
cctaactccaccgcctatcc

SEQ ID NO: 561690 - DNA, 20 bp, Artificial Sequence
  chemically synthesized
tcccctccagaaatttaaga

SEQ ID NO: 561691 - DNA, 20 bp, Artificial Sequence
  chemically synthesized
ttcttttggagttggatagg

SEQ ID NO: 561692 - DNA, 20 bp, Artificial Sequence
  chemically synthesized
catttcaatggcaactgctg

SEQ ID NO: 561693 - DNA, 20 bp, Artificial Sequence
  chemically synthesized
aacataaccccagatcatga

SEQ ID NO: 561694 - DNA, 20 bp, Artificial Sequence
  chemically synthesized
gcttcaattttatttatatt

SEQ ID NO: 561695 - DNA, 20 bp, Artificial Sequence
  chemically synthesized
atggttaatggaagaatatt

SEQ ID NO: 561696 - DNA, 20 bp, Artificial Sequence
  chemically synthesized
gttgaaatattttagctaaa

SEQ ID NO: 561697 - DNA, 20 bp, Artificial Sequence
  chemically synthesized
gtagcaggaataaatgttcg

SEQ ID NO: 561698 - DNA, 20 bp, Artificial Sequence
  chemically synthesized
ctgtgtatctacacataatg

SEQ ID NO: 561699 - DNA, 20 bp, Artificial Sequence
  chemically synthesized
ctattaaagggaaagaaaag

SEQ ID NO: 561700 - DNA, 20 bp, Artificial Sequence
  chemically synthesized
ggactctgttgagacaaaat

SEQ ID NO: 561701 - DNA, 20 bp, Artificial Sequence
  chemically synthesized
attgttagcaaagattaata

SEQ ID NO: 561702 - DNA, 20 bp, Artificial Sequence
  chemically synthesized
gccttctgtcagtcactaga

SEQ ID NO: 561703 - DNA, 20 bp, Artificial Sequence
  chemically synthesized
gctaatgtgtagccagggct

SEQ ID NO: 561704 - DNA, 20 bp, Artificial Sequence
  chemically synthesized
aaacaaaaaacgaaaacaaa

SEQ ID NO: 561705 - DNA, 20 bp, Artificial Sequence
  chemically synthesized
agaaacaaaaaacaaaaaac

SEQ ID NO: 561706 - DNA, 20 bp, Artificial Sequence
  chemically synthesized
tctcaaagaaacaaaaaaca

SEQ ID NO: 561707 - DNA, 20 bp, Artificial Sequence
  chemically synthesized
aactctgtctcaaagaaaca

SEQ ID NO: 561708 - DNA, 20 bp, Artificial Sequence
  chemically synthesized
atgatcgtgtaagcaaggct

SEQ ID NO: 561709 - DNA, 20 bp, Artificial Sequence
  chemically synthesized
aaaacaaaaatgtcacatta

SEQ ID NO: 561710 - DNA, 20 bp, Artificial Sequence
  chemically synthesized
tgtctgaccaaccgaataat

SEQ ID NO: 561711 - DNA, 20 bp, Artificial Sequence
  chemically synthesized
ctttgtcttatcaaagccat

SEQ ID NO: 561712 - DNA, 20 bp, Artificial Sequence
  chemically synthesized
ctccactacaatatttaaga

SEQ ID NO: 561713 - DNA, 20 bp, Artificial Sequence
  chemically synthesized
tttggtcaacggggtgttaa

SEQ ID NO: 561714 - DNA, 20 bp, Artificial Sequence
  chemically synthesized
gctatctagtgacaacctat

SEQ ID NO: 561715 - DNA, 20 bp, Artificial Sequence
  chemically synthesized
ccatgagaattaatgctatt

SEQ ID NO: 561716 - DNA, 20 bp, Artificial Sequence
  chemically synthesized
cagatgtattggtcagctct

SEQ ID NO: 561717 - DNA, 20 bp, Artificial Sequence
  chemically synthesized
ccctgtatgtaaacctctaa

SEQ ID NO: 561718 - DNA, 20 bp, Artificial Sequence
  chemically synthesized
ctggcaaccttcatccaacc

SEQ ID NO: 561719 - DNA, 20 bp, Artificial Sequence
  chemically synthesized
ctcccagattccgtagctcg

SEQ ID NO: 561720 - DNA, 20 bp, Artificial Sequence
  chemically synthesized
tgcatacacacacgtacaca

SEQ ID NO: 561721 - DNA, 20 bp, Artificial Sequence
  chemically synthesized
cggttgacatctgactctgt

SEQ ID NO: 561722 - DNA, 20 bp, Artificial Sequence
  chemically synthesized
gatccggtggcccgtgtaaa

SEQ ID NO: 561723 - DNA, 20 bp, Artificial Sequence
  chemically synthesized
cccttatcaaccttgacgcc

SEQ ID NO: 561724 - DNA, 20 bp, Artificial Sequence
  chemically synthesized
gatcttccacaagccagagc

SEQ ID NO: 561725 - DNA, 20 bp, Artificial Sequence
  chemically synthesized
ggtgcccaagaatgctctca

SEQ ID NO: 561726 - DNA, 20 bp, Artificial Sequence
  chemically synthesized
ctggattattcctctctgtt

SEQ ID NO: 561727 - DNA, 20 bp, Artificial Sequence
  chemically synthesized
tatgatgaaaggcgttaaag

SEQ ID NO: 561728 - DNA, 20 bp, Artificial Sequence
  chemically synthesized
tgtgactctttgctttattt

SEQ ID NO: 561729 - DNA, 20 bp, Artificial Sequence
  chemically synthesized
tatttttaaagcagtggtaa

SEQ ID NO: 561730 - DNA, 20 bp, Artificial Sequence
  chemically synthesized
acacttttcttaaacacagt

SEQ ID NO: 561731 - DNA, 20 bp, Artificial Sequence
  chemically synthesized
aaagcatacttcctcaatgt

SEQ ID NO: 561732 - DNA, 20 bp, Artificial Sequence
  chemically synthesized
tatttaataggcaaaataaa

SEQ ID NO: 561733 - DNA, 20 bp, Artificial Sequence
  chemically synthesized
cagtctacttattagaagtt

SEQ ID NO: 561734 - DNA, 20 bp, Artificial Sequence
  chemically synthesized
ccaaaattttaatgttttta

SEQ ID NO: 561735 - DNA, 20 bp, Artificial Sequence
  chemically synthesized
gattacctgtgatgttttct

SEQ ID NO: 561736 - DNA, 20 bp, Artificial Sequence
  chemically synthesized
attaggagagtctttcattt

SEQ ID NO: 561737 - DNA, 20 bp, Artificial Sequence
  chemically synthesized
ccaataagaaccctcctacc

SEQ ID NO: 561738 - DNA, 20 bp, Artificial Sequence
  chemically synthesized
attttttccattttgaagtt

SEQ ID NO: 561739 - DNA, 20 bp, Artificial Sequence
  chemically synthesized
tattcttggcttttggtgga

SEQ ID NO: 561740 - DNA, 20 bp, Artificial Sequence
  chemically synthesized
aagggagcatatctccttag

SEQ ID NO: 561741 - DNA, 20 bp, Artificial Sequence
  chemically synthesized
cagaatcccagtttgacttc

SEQ ID NO: 561742 - DNA, 20 bp, Artificial Sequence
  chemically synthesized
cttcctgcctctctaatatc

SEQ ID NO: 561743 - DNA, 20 bp, Artificial Sequence
  chemically synthesized
caaagcgcagtaatgttcac

SEQ ID NO: 561744 - DNA, 20 bp, Artificial Sequence
  chemically synthesized
cagcgaccaacggaagtgag

SEQ ID NO: 561745 - DNA, 20 bp, Artificial Sequence
  chemically synthesized
ttgcacagaatttttaattg

SEQ ID NO: 561746 - DNA, 20 bp, Artificial Sequence
  chemically synthesized
taagaatctggagttgtatg

SEQ ID NO: 561747 - DNA, 20 bp, Artificial Sequence
  chemically synthesized
ctatgatattatactaaatt

SEQ ID NO: 561748 - DNA, 20 bp, Artificial Sequence
  chemically synthesized
tttggaccacacagagttta

SEQ ID NO: 561749 - DNA, 20 bp, Artificial Sequence
  chemically synthesized
gcataaggaagacggaacca

SEQ ID NO: 561750 - DNA, 20 bp, Artificial Sequence
  chemically synthesized
aactttcttttttttatcaa

SEQ ID NO: 561751 - DNA, 20 bp, Artificial Sequence
  chemically synthesized
atcctaccacctcagcctcc

SEQ ID NO: 561752 - DNA, 20 bp, Artificial Sequence
  chemically synthesized
gtcacaccaaaaggaaagta

SEQ ID NO: 561753 - DNA, 20 bp, Artificial Sequence
  chemically synthesized
ggtatattttgaaagaaaag

SEQ ID NO: 561754 - DNA, 20 bp, Artificial Sequence
  chemically synthesized
ttcattcttttataaataat

SEQ ID NO: 561755 - DNA, 20 bp, Artificial Sequence
  chemically synthesized
aagttaaaatttgtgtttca

SEQ ID NO: 561756 - DNA, 20 bp, Artificial Sequence
  chemically synthesized
agcattataagcagctgttt

SEQ ID NO: 561757 - DNA, 20 bp, Artificial Sequence
  chemically synthesized
taaaaagggcacatgttgca

SEQ ID NO: 561758 - DNA, 20 bp, Artificial Sequence
  chemically synthesized
cactactaataatattatag

SEQ ID NO: 561759 - DNA, 20 bp, Artificial Sequence
  chemically synthesized
tataatttactaggaaacta

SEQ ID NO: 561760 - DNA, 20 bp, Artificial Sequence
  chemically synthesized
atatccatatacagtcataa

SEQ ID NO: 561761 - DNA, 20 bp, Artificial Sequence
  chemically synthesized
tatatggatattctatttac

SEQ ID NO: 561762 - DNA, 20 bp, Artificial Sequence
  chemically synthesized
agaaagacaccaaattttga

SEQ ID NO: 561763 - DNA, 20 bp, Artificial Sequence
  chemically synthesized
taggagaaagagaaaaaagg

SEQ ID NO: 561764 - DNA, 20 bp, Artificial Sequence
  chemically synthesized
gtaaaacatgattgatatag

SEQ ID NO: 561765 - DNA, 20 bp, Artificial Sequence
  chemically synthesized
cgtgggaaattttctaaatt

SEQ ID NO: 561766 - DNA, 20 bp, Artificial Sequence
  chemically synthesized
gaggcgaggtagaggaaggc

SEQ ID NO: 561767 - DNA, 20 bp, Artificial Sequence
  chemically synthesized
ttctcgtgttccagtcgcat

SEQ ID NO: 561768 - DNA, 20 bp, Artificial Sequence
  chemically synthesized
aatgggtgcattacatttgt

SEQ ID NO: 561769 - DNA, 20 bp, Artificial Sequence
  chemically synthesized
gacttaccctttattctgct

SEQ ID NO: 561770 - DNA, 20 bp, Artificial Sequence
  chemically synthesized
tcacttgaatcatacaccat

SEQ ID NO: 561771 - DNA, 20 bp, Artificial Sequence
  chemically synthesized
gtactttttacatatttatt

SEQ ID NO: 561772 - DNA, 20 bp, Artificial Sequence
  chemically synthesized
gctgcatctctaatcagtaa

SEQ ID NO: 561773 - DNA, 20 bp, Artificial Sequence
  chemically synthesized
gtgaaataacccctggacgg

SEQ ID NO: 561774 - DNA, 20 bp, Artificial Sequence
  chemically synthesized
aataactgtctgattgctca

SEQ ID NO: 561775 - DNA, 20 bp, Artificial Sequence
  chemically synthesized
aaatcatctcacctcttcat

SEQ ID NO: 561776 - DNA, 20 bp, Artificial Sequence
  chemically synthesized
tatcatccaaattccagaat

SEQ ID NO: 561777 - DNA, 20 bp, Artificial Sequence
  chemically synthesized
ataccaatattttttaaatc

SEQ ID NO: 561778 - DNA, 20 bp, Artificial Sequence
  chemically synthesized
aattcattgtttgattttct

SEQ ID NO: 561779 - DNA, 20 bp, Artificial Sequence
  chemically synthesized
aggagattatgagaaaagaa

SEQ ID NO: 561780 - DNA, 20 bp, Artificial Sequence
  chemically synthesized
tcaaatgtctacaatttcca

SEQ ID NO: 561781 - DNA, 20 bp, Artificial Sequence
  chemically synthesized
acctttacaacatttgaacg

SEQ ID NO: 561782 - DNA, 20 bp, Artificial Sequence
  chemically synthesized
agtgctaaaagtctggcagc

SEQ ID NO: 561783 - DNA, 20 bp, Artificial Sequence
  chemically synthesized
tatcctatttggaataaaaa

SEQ ID NO: 561784 - DNA, 20 bp, Artificial Sequence
  chemically synthesized
gccaatatcctatttggaat

SEQ ID NO: 561785 - DNA, 20 bp, Artificial Sequence
  chemically synthesized
gttgcagagtactatggcaa

SEQ ID NO: 561786 - DNA, 20 bp, Artificial Sequence
  chemically synthesized
ttttgtggacgcatttctac

SEQ ID NO: 561787 - DNA, 20 bp, Artificial Sequence
  chemically synthesized
tggccaaatatttgaaactc

SEQ ID NO: 561788 - DNA, 20 bp, Artificial Sequence
  chemically synthesized
gaaattaatgtaaaatattc

SEQ ID NO: 561789 - DNA, 20 bp, Artificial Sequence
  chemically synthesized
tttgtgcaaaggaataagac

SEQ ID NO: 561790 - DNA, 20 bp, Artificial Sequence
  chemically synthesized
tagacaggacacattgatca

SEQ ID NO: 561791 - DNA, 20 bp, Artificial Sequence
  chemically synthesized
cacacacacacgcggcacaa

SEQ ID NO: 561792 - DNA, 20 bp, Artificial Sequence
  chemically synthesized
gagtagctctcagctgtctg

SEQ ID NO: 561793 - DNA, 20 bp, Artificial Sequence
  chemically synthesized
aaattaaatgagtgaataca

SEQ ID NO: 561794 - DNA, 20 bp, Artificial Sequence
  chemically synthesized
atgagtgaatacataaaacg

SEQ ID NO: 561795 - DNA, 20 bp, Artificial Sequence
  chemically synthesized
aatacattatttttatttaa

SEQ ID NO: 561796 - DNA, 20 bp, Artificial Sequence
  chemically synthesized
tctaaacaattgtctgcatt

SEQ ID NO: 561797 - DNA, 20 bp, Artificial Sequence
  chemically synthesized
gtttgtaataggaaaagaat

SEQ ID NO: 561798 - DNA, 20 bp, Artificial Sequence
  chemically synthesized
atatatatgtagcaagacta

SEQ ID NO: 561799 - DNA, 20 bp, Artificial Sequence
  chemically synthesized
cagatttaaaaaacaaaaac

SEQ ID NO: 561800 - DNA, 20 bp, Artificial Sequence
  chemically synthesized
gcttttcagatttaaaaaac

SEQ ID NO: 561801 - DNA, 20 bp, Artificial Sequence
  chemically synthesized
ggaaatgcttttcagattta

SEQ ID NO: 561802 - DNA, 20 bp, Artificial Sequence
  chemically synthesized
agatgggatagcttattgtg

SEQ ID NO: 561803 - DNA, 20 bp, Artificial Sequence
  chemically synthesized
ataatagagcccttcggcag

SEQ ID NO: 561804 - DNA, 20 bp, Artificial Sequence
  chemically synthesized
taatcaaaatttatactaag

SEQ ID NO: 561805 - DNA, 20 bp, Artificial Sequence
  chemically synthesized
ggaagtaaggaaaaacgggg

SEQ ID NO: 561806 - DNA, 20 bp, Artificial Sequence
  chemically synthesized
gggaggcaggggaagtaagg

SEQ ID NO: 561807 - DNA, 20 bp, Artificial Sequence
  chemically synthesized
gattcagagtggaaagactt

SEQ ID NO: 561808 - DNA, 20 bp, Artificial Sequence
  chemically synthesized
taaaatccatctgcaacatc

SEQ ID NO: 561809 - DNA, 20 bp, Artificial Sequence
  chemically synthesized
tcaaagaaacgactgctaca

SEQ ID NO: 561810 - DNA, 20 bp, Artificial Sequence
  chemically synthesized
ttttaataacatttaaatat

SEQ ID NO: 561811 - DNA, 20 bp, Artificial Sequence
  chemically synthesized
atttaaatataaaaacaaac

SEQ ID NO: 561812 - DNA, 20 bp, Artificial Sequence
  chemically synthesized
cccattttttttttggatga

SEQ ID NO: 561813 - DNA, 20 bp, Artificial Sequence
  chemically synthesized
gttgaaacatatgtatctga

SEQ ID NO: 561814 - DNA, 20 bp, Artificial Sequence
  chemically synthesized
agtattcttattcatgtatt

SEQ ID NO: 561815 - DNA, 20 bp, Artificial Sequence
  chemically synthesized
gaatgaaaatataaatcata

SEQ ID NO: 561816 - DNA, 20 bp, Artificial Sequence
  chemically synthesized
atgggttttagtaaggtata

SEQ ID NO: 561817 - DNA, 20 bp, Artificial Sequence
  chemically synthesized
gatggttttatataccttac

SEQ ID NO: 561818 - DNA, 20 bp, Artificial Sequence
  chemically synthesized
atatgcttatgacaacagta

SEQ ID NO: 561819 - DNA, 20 bp, Artificial Sequence
  chemically synthesized
ttcacaaacataacatgtta

SEQ ID NO: 561820 - DNA, 20 bp, Artificial Sequence
  chemically synthesized
aaatttgagtgcattgaaga

SEQ ID NO: 561821 - DNA, 20 bp, Artificial Sequence
  chemically synthesized
aaatctaagtcctatttaat

SEQ ID NO: 561822 - DNA, 20 bp, Artificial Sequence
  chemically synthesized
tatttaatcaaaacttgctt

SEQ ID NO: 561823 - DNA, 20 bp, Artificial Sequence
  chemically synthesized
atggtgaaacctcatctctg

SEQ ID NO: 561824 - DNA, 20 bp, Artificial Sequence
  chemically synthesized
gcaacctgatcaaaaaagta

SEQ ID NO: 561825 - DNA, 20 bp, Artificial Sequence
  chemically synthesized
tagaatagactgaatactac

SEQ ID NO: 561826 - DNA, 20 bp, Artificial Sequence
  chemically synthesized
tttatttcaattgtcatttg

SEQ ID NO: 561827 - DNA, 20 bp, Artificial Sequence
  chemically synthesized
ctttaaggaaactaaatccc

SEQ ID NO: 561828 - DNA, 20 bp, Artificial Sequence
  chemically synthesized
tccttcttatcacacatggg

SEQ ID NO: 561829 - DNA, 20 bp, Artificial Sequence
  chemically synthesized
tatggatcaagcagtgaaga

SEQ ID NO: 561830 - DNA, 20 bp, Artificial Sequence
  chemically synthesized
ctgtttaattgcacatccaa

SEQ ID NO: 561831 - DNA, 20 bp, Artificial Sequence
  chemically synthesized
catttatttacactatcaag

SEQ ID NO: 561832 - DNA, 20 bp, Artificial Sequence
  chemically synthesized
tcccatctgtcaactggtta

SEQ ID NO: 561833 - DNA, 20 bp, Artificial Sequence
  chemically synthesized
ggaatattataacttgcaaa

SEQ ID NO: 561834 - DNA, 20 bp, Artificial Sequence
  chemically synthesized
ctttgccaatatgattggtg

SEQ ID NO: 561835 - DNA, 20 bp, Artificial Sequence
  chemically synthesized
atcaatttcctcataccata

SEQ ID NO: 561836 - DNA, 20 bp, Artificial Sequence
  chemically synthesized
gatatctgaaagaatacaca

SEQ ID NO: 561837 - DNA, 20 bp, Artificial Sequence
  chemically synthesized
atgtatactctctaagtaat

SEQ ID NO: 561838 - DNA, 20 bp, Artificial Sequence
  chemically synthesized
acttttgtaatttaataagg

SEQ ID NO: 561839 - DNA, 20 bp, Artificial Sequence
  chemically synthesized
cagaagtgagatcttaaaaa

SEQ ID NO: 561840 - DNA, 20 bp, Artificial Sequence
  chemically synthesized
tgagatcttaaaaaaaaaac

SEQ ID NO: 561841 - DNA, 20 bp, Artificial Sequence
  chemically synthesized
cttaaaaaaaaaacaaaaac

SEQ ID NO: 561842 - DNA, 20 bp, Artificial Sequence
  chemically synthesized
agtgattacataaaaaaatg

SEQ ID NO: 561843 - DNA, 20 bp, Artificial Sequence
  chemically synthesized
atataacaaatccatgtgat

SEQ ID NO: 561844 - DNA, 20 bp, Artificial Sequence
  chemically synthesized
ataaaaccagacaatccctg

SEQ ID NO: 561845 - DNA, 20 bp, Artificial Sequence
  chemically synthesized
tttatttttcattaaacaaa

SEQ ID NO: 561846 - DNA, 20 bp, Artificial Sequence
  chemically synthesized
tttaaatttatagatgcatt

SEQ ID NO: 561847 - DNA, 20 bp, Artificial Sequence
  chemically synthesized
aaaagattctattgatattg

SEQ ID NO: 561848 - DNA, 20 bp, Artificial Sequence
  chemically synthesized
attgatattgaaaaacaaac

SEQ ID NO: 561849 - DNA, 20 bp, Artificial Sequence
  chemically synthesized
atccactgaaggaactcagg

SEQ ID NO: 561850 - DNA, 20 bp, Artificial Sequence
  chemically synthesized
aggagaaaatcagtgtattt

SEQ ID NO: 561851 - DNA, 20 bp, Artificial Sequence
  chemically synthesized
atatgtgtaaatttttagca

SEQ ID NO: 561852 - DNA, 20 bp, Artificial Sequence
  chemically synthesized
gaatccctaaacattattac

SEQ ID NO: 561853 - DNA, 20 bp, Artificial Sequence
  chemically synthesized
aatgactaagtaggtttttc

SEQ ID NO: 561854 - DNA, 20 bp, Artificial Sequence
  chemically synthesized
aaaaaaacccagagtttttg

SEQ ID NO: 561855 - DNA, 20 bp, Artificial Sequence
  chemically synthesized
aaaaaaaaaaaaaaaaaaaa

SEQ ID NO: 561856 - DNA, 20 bp, Artificial Sequence
  chemically synthesized
actggcaatacttttaagtt

SEQ ID NO: 561857 - DNA, 20 bp, Artificial Sequence
  chemically synthesized
aatgtattaagtttgatagt

SEQ ID NO: 561858 - DNA, 20 bp, Artificial Sequence
  chemically synthesized
attaagtttgatagtaaaaa

SEQ ID NO: 561859 - DNA, 20 bp, Artificial Sequence
  chemically synthesized
atactcaatttaaagatata

SEQ ID NO: 561860 - DNA, 20 bp, Artificial Sequence
  chemically synthesized
gcctggcttattgcacttag

SEQ ID NO: 561861 - DNA, 20 bp, Artificial Sequence
  chemically synthesized
ccactgcacccagccaagtg

SEQ ID NO: 561862 - DNA, 20 bp, Artificial Sequence
  chemically synthesized
tagtgaaaccccgtctctac

SEQ ID NO: 561863 - DNA, 20 bp, Artificial Sequence
  chemically synthesized
gccattcatatatatatatt

SEQ ID NO: 561864 - DNA, 20 bp, Artificial Sequence
  chemically synthesized
caagtaaataagtactctgt

SEQ ID NO: 561865 - DNA, 20 bp, Artificial Sequence
  chemically synthesized
ggaaatcaacctaaataccc

SEQ ID NO: 561866 - DNA, 20 bp, Artificial Sequence
  chemically synthesized
tatttcatatttatatcata

SEQ ID NO: 561867 - DNA, 20 bp, Artificial Sequence
  chemically synthesized
tttcatgaaatgcgagacta

SEQ ID NO: 561868 - DNA, 20 bp, Artificial Sequence
  chemically synthesized
tacctacgtatccacatata

SEQ ID NO: 561869 - DNA, 20 bp, Artificial Sequence
  chemically synthesized
ttacctgatgaaacggattg

SEQ ID NO: 561870 - DNA, 20 bp, Artificial Sequence
  chemically synthesized
aggtaacctacttacagatg

SEQ ID NO: 561871 - DNA, 20 bp, Artificial Sequence
  chemically synthesized
gtactacaaacaaatataat

SEQ ID NO: 561872 - DNA, 20 bp, Artificial Sequence
  chemically synthesized
gttctgtttaaacacattcc

SEQ ID NO: 561873 - DNA, 20 bp, Artificial Sequence
  chemically synthesized
ccatattcttcttcaaatca

SEQ ID NO: 561874 - DNA, 20 bp, Artificial Sequence
  chemically synthesized
gccatagttactgaggatat

SEQ ID NO: 561875 - DNA, 20 bp, Artificial Sequence
  chemically synthesized
agcaaactaaaacaggaaca

SEQ ID NO: 561876 - DNA, 20 bp, Artificial Sequence
  chemically synthesized
aaccatcattctcagcaaac

SEQ ID NO: 561877 - DNA, 20 bp, Artificial Sequence
  chemically synthesized
tacagttgggaaaaaaatca

SEQ ID NO: 561878 - DNA, 20 bp, Artificial Sequence
  chemically synthesized
ttaaatactatactgaaagt

SEQ ID NO: 561879 - DNA, 20 bp, Artificial Sequence
  chemically synthesized
tctgtacttgaaagtagtca

SEQ ID NO: 561880 - DNA, 20 bp, Artificial Sequence
  chemically synthesized
gcttttgttatttatacaac

SEQ ID NO: 561881 - DNA, 20 bp, Artificial Sequence
  chemically synthesized
cccattcctcctaccctaag

SEQ ID NO: 561882 - DNA, 20 bp, Artificial Sequence
  chemically synthesized
gcaatacatacaatttcctc

SEQ ID NO: 561883 - DNA, 20 bp, Artificial Sequence
  chemically synthesized
ctctcactgaccttagccat

SEQ ID NO: 561884 - DNA, 20 bp, Artificial Sequence
  chemically synthesized
tcttcactcatggacatttt

SEQ ID NO: 561885 - DNA, 20 bp, Artificial Sequence
  chemically synthesized
aagaagtttctttttacgtg

SEQ ID NO: 561886 - DNA, 20 bp, Artificial Sequence
  chemically synthesized
gatgtagcctcctgagtact

SEQ ID NO: 561887 - DNA, 20 bp, Artificial Sequence
  chemically synthesized
tgattagagataactattga

SEQ ID NO: 561888 - DNA, 20 bp, Artificial Sequence
  chemically synthesized
ttttaaaaatacattcttat

SEQ ID NO: 561889 - DNA, 20 bp, Artificial Sequence
  chemically synthesized
ttgataagaatgtattttta

SEQ ID NO: 561890 - DNA, 20 bp, Artificial Sequence
  chemically synthesized
tagagactagagatattaag

SEQ ID NO: 561891 - DNA, 20 bp, Artificial Sequence
  chemically synthesized
gagacttaattacacaaagg

SEQ ID NO: 561892 - DNA, 20 bp, Artificial Sequence
  chemically synthesized
aatattggtagtcatcatca

SEQ ID NO: 561893 - DNA, 20 bp, Artificial Sequence
  chemically synthesized
caataggttgagagtttcag

SEQ ID NO: 561894 - DNA, 20 bp, Artificial Sequence
  chemically synthesized
agagtttcagtaaaactaat

SEQ ID NO: 561895 - DNA, 20 bp, Artificial Sequence
  chemically synthesized
tgccacttcacctggctaac

SEQ ID NO: 561896 - DNA, 20 bp, Artificial Sequence
  chemically synthesized
cagagaaataccgcatctct

SEQ ID NO: 561897 - DNA, 20 bp, Artificial Sequence
  chemically synthesized
taaattacaaagctcaataa

SEQ ID NO: 561898 - DNA, 20 bp, Artificial Sequence
  chemically synthesized
ataaatcgaaaaaaccaaca

SEQ ID NO: 561899 - DNA, 20 bp, Artificial Sequence
  chemically synthesized
atgcatgtgtgataaatcga

SEQ ID NO: 561900 - DNA, 20 bp, Artificial Sequence
  chemically synthesized
tatcacacatgcatgtatgc

SEQ ID NO: 561901 - DNA, 20 bp, Artificial Sequence
  chemically synthesized
tctaataaaacttcattttt

SEQ ID NO: 561902 - DNA, 20 bp, Artificial Sequence
  chemically synthesized
ataggtgtgagtgagtctaa

SEQ ID NO: 561903 - DNA, 20 bp, Artificial Sequence
  chemically synthesized
taagaatatgagaaaatcat

SEQ ID NO: 561904 - DNA, 20 bp, Artificial Sequence
  chemically synthesized
tacagaaaatgcaaggaaaa

SEQ ID NO: 561905 - DNA, 20 bp, Artificial Sequence
  chemically synthesized
taagaacagaatacatgtgc

SEQ ID NO: 561906 - DNA, 20 bp, Artificial Sequence
  chemically synthesized
taatatttcacacacacaaa

SEQ ID NO: 561907 - DNA, 20 bp, Artificial Sequence
  chemically synthesized
tccagcctgggcaacaagag

SEQ ID NO: 561908 - DNA, 20 bp, Artificial Sequence
  chemically synthesized
cataaagattattatggcac

SEQ ID NO: 561909 - DNA, 20 bp, Artificial Sequence
  chemically synthesized
agtcccaatttctggtggga

SEQ ID NO: 561910 - DNA, 20 bp, Artificial Sequence
  chemically synthesized
gagtctcctacacattatca

SEQ ID NO: 561911 - DNA, 20 bp, Artificial Sequence
  chemically synthesized
tattatatagatttctggag

SEQ ID NO: 561912 - DNA, 20 bp, Artificial Sequence
  chemically synthesized
accaatgtgtagcaaaatgc

SEQ ID NO: 561913 - DNA, 20 bp, Artificial Sequence
  chemically synthesized
taactggggttggtagtaac

SEQ ID NO: 561914 - DNA, 20 bp, Artificial Sequence
  chemically synthesized
ttatccaagtagtttaaaat

SEQ ID NO: 561915 - DNA, 20 bp, Artificial Sequence
  chemically synthesized
ccaaacgactgtattagatt

SEQ ID NO: 561916 - DNA, 20 bp, Artificial Sequence
  chemically synthesized
ctgtattagatttaaaacca

SEQ ID NO: 561917 - DNA, 20 bp, Artificial Sequence
  chemically synthesized
tgctcattgtagacattatg

SEQ ID NO: 561918 - DNA, 20 bp, Artificial Sequence
  chemically synthesized
ctaagaaacactaatgacca

SEQ ID NO: 561919 - DNA, 20 bp, Artificial Sequence
  chemically synthesized
catttatgaagaaaggaaat

SEQ ID NO: 561920 - DNA, 20 bp, Artificial Sequence
  chemically synthesized
cagatgacacaaacaaatag

SEQ ID NO: 561921 - DNA, 20 bp, Artificial Sequence
  chemically synthesized
ttattttgtgtctgtggtaa

SEQ ID NO: 561922 - DNA, 20 bp, Artificial Sequence
  chemically synthesized
ttcactgcgtatatgcacat

SEQ ID NO: 561923 - DNA, 20 bp, Artificial Sequence
  chemically synthesized
tataacatttaaataagagc

SEQ ID NO: 561924 - DNA, 20 bp, Artificial Sequence
  chemically synthesized
atttaaataagagcaaaaac

SEQ ID NO: 561925 - DNA, 20 bp, Artificial Sequence
  chemically synthesized
ataagagcaaaaacaaaaac

SEQ ID NO: 561926 - DNA, 20 bp, Artificial Sequence
  chemically synthesized
aaacagcatggtactggcac

SEQ ID NO: 561927 - DNA, 20 bp, Artificial Sequence
  chemically synthesized
aaactagaagaattgtagaa

SEQ ID NO: 561928 - DNA, 20 bp, Artificial Sequence
  chemically synthesized
atcctcaaaagcaattggag

SEQ ID NO: 561929 - DNA, 20 bp, Artificial Sequence
  chemically synthesized
tagaatttacaaggaactta

SEQ ID NO: 561930 - DNA, 20 bp, Artificial Sequence
  chemically synthesized
agcaaaatacaacgccatca

SEQ ID NO: 561931 - DNA, 20 bp, Artificial Sequence
  chemically synthesized
attgtcagagaaatgcaaat

SEQ ID NO: 561932 - DNA, 20 bp, Artificial Sequence
  chemically synthesized
cagtcagaaaggccattatt

SEQ ID NO: 561933 - DNA, 20 bp, Artificial Sequence
  chemically synthesized
aggccattattaaaaactca

SEQ ID NO: 561934 - DNA, 20 bp, Artificial Sequence
  chemically synthesized
gaatgcatgtgtctttatgt

SEQ ID NO: 561935 - DNA, 20 bp, Artificial Sequence
  chemically synthesized
catggaatactatgcagcca

SEQ ID NO: 561936 - DNA, 20 bp, Artificial Sequence
  chemically synthesized
gtactcatggacataaaggt

SEQ ID NO: 561937 - DNA, 20 bp, Artificial Sequence
  chemically synthesized
agggagggggataagggttg

SEQ ID NO: 561938 - DNA, 20 bp, Artificial Sequence
  chemically synthesized
gctccctcccataaggagtt

SEQ ID NO: 561939 - DNA, 20 bp, Artificial Sequence
  chemically synthesized
ctctgcaggttatcagaaaa

SEQ ID NO: 561940 - DNA, 20 bp, Artificial Sequence
  chemically synthesized
ttatcagaaaataaaacaaa

SEQ ID NO: 561941 - DNA, 20 bp, Artificial Sequence
  chemically synthesized
accgcaaactacaaaataac

SEQ ID NO: 561942 - DNA, 20 bp, Artificial Sequence
  chemically synthesized
cagagtgagactctgtctca

SEQ ID NO: 561943 - DNA, 20 bp, Artificial Sequence
  chemically synthesized
aaagatttattctaaaaatt

SEQ ID NO: 561944 - DNA, 20 bp, Artificial Sequence
  chemically synthesized
tttttagaataaatctttga

SEQ ID NO: 561945 - DNA, 20 bp, Artificial Sequence
  chemically synthesized
taaatgttaatttttttctt

SEQ ID NO: 561946 - DNA, 20 bp, Artificial Sequence
  chemically synthesized
agataatttgattaaaaatt

SEQ ID NO: 561947 - DNA, 20 bp, Artificial Sequence
  chemically synthesized
atatttggacaaaaagaaaa

SEQ ID NO: 561948 - DNA, 20 bp, Artificial Sequence
  chemically synthesized
atttttaaaatctgtacatt

SEQ ID NO: 561949 - DNA, 20 bp, Artificial Sequence
  chemically synthesized
aaaacccaaaatttaaaatg

SEQ ID NO: 561950 - DNA, 20 bp, Artificial Sequence
  chemically synthesized
aactatgtagaaatgatttt

SEQ ID NO: 561951 - DNA, 20 bp, Artificial Sequence
  chemically synthesized
ttgataatcatgttaaaagg

SEQ ID NO: 561952 - DNA, 20 bp, Artificial Sequence
  chemically synthesized
ttgccttttaacatgattat

SEQ ID NO: 561953 - DNA, 20 bp, Artificial Sequence
  chemically synthesized
gtagctattagagtgtttaa

SEQ ID NO: 561954 - DNA, 20 bp, Artificial Sequence
  chemically synthesized
gaggattaatagaaaatgtt

SEQ ID NO: 561955 - DNA, 20 bp, Artificial Sequence
  chemically synthesized
caaagctcattaagaaaaga

SEQ ID NO: 561956 - DNA, 20 bp, Artificial Sequence
  chemically synthesized
aatataactagaatgactac

SEQ ID NO: 561957 - DNA, 20 bp, Artificial Sequence
  chemically synthesized
atgaaaaatattgtctatct

SEQ ID NO: 561958 - DNA, 20 bp, Artificial Sequence
  chemically synthesized
ccctaatttaggagtagaaa

SEQ ID NO: 561959 - DNA, 20 bp, Artificial Sequence
  chemically synthesized
ccaaattggatttatttcag

SEQ ID NO: 561960 - DNA, 20 bp, Artificial Sequence
  chemically synthesized
atacagacgttcaaatctta

SEQ ID NO: 561961 - DNA, 20 bp, Artificial Sequence
  chemically synthesized
aaaaaaatagcatacacatt

SEQ ID NO: 561962 - DNA, 20 bp, Artificial Sequence
  chemically synthesized
tgaataaggaaaatacacat

SEQ ID NO: 561963 - DNA, 20 bp, Artificial Sequence
  chemically synthesized
tactttttctctcctgttac

SEQ ID NO: 561964 - DNA, 20 bp, Artificial Sequence
  chemically synthesized
ttttatagacagatatacag

SEQ ID NO: 561965 - DNA, 20 bp, Artificial Sequence
  chemically synthesized
aacaaaaccagcaagcaatt

SEQ ID NO: 561966 - DNA, 20 bp, Artificial Sequence
  chemically synthesized
tagaaaaaaatgtaatgtaa

SEQ ID NO: 561967 - DNA, 20 bp, Artificial Sequence
  chemically synthesized
tttttctagacattttataa

SEQ ID NO: 561968 - DNA, 20 bp, Artificial Sequence
  chemically synthesized
tagaacatcacgagagtctt

SEQ ID NO: 561969 - DNA, 20 bp, Artificial Sequence
  chemically synthesized
ggaaagggtgtttctaagat

SEQ ID NO: 561970 - DNA, 20 bp, Artificial Sequence
  chemically synthesized
agctaatcctagtatctcta

SEQ ID NO: 561971 - DNA, 20 bp, Artificial Sequence
  chemically synthesized
ctttctaaaacttgcttaag

SEQ ID NO: 561972 - DNA, 20 bp, Artificial Sequence
  chemically synthesized
ttgctcgtgtatgtgctttc

SEQ ID NO: 561973 - DNA, 20 bp, Artificial Sequence
  chemically synthesized
aaaaatagacatctttatca

SEQ ID NO: 561974 - DNA, 20 bp, Artificial Sequence
  chemically synthesized
cattatttagtcatctaatt

SEQ ID NO: 561975 - DNA, 20 bp, Artificial Sequence
  chemically synthesized
tttagtcatctaattaaaaa

SEQ ID NO: 561976 - DNA, 20 bp, Artificial Sequence
  chemically synthesized
tccaggaagatgttttagga

SEQ ID NO: 561977 - DNA, 20 bp, Artificial Sequence
  chemically synthesized
cttaggaatctgttttctcc

SEQ ID NO: 561978 - DNA, 20 bp, Artificial Sequence
  chemically synthesized
ttccctaaacttatctgtta

SEQ ID NO: 561979 - DNA, 20 bp, Artificial Sequence
  chemically synthesized
agagaaagtgtattaatagc

SEQ ID NO: 561980 - DNA, 20 bp, Artificial Sequence
  chemically synthesized
agagaatggattagacagtc

SEQ ID NO: 561981 - DNA, 20 bp, Artificial Sequence
  chemically synthesized
agaaagaaagaatgagcatg

SEQ ID NO: 561982 - DNA, 20 bp, Artificial Sequence
  chemically synthesized
ccttatcaactaaatattat

SEQ ID NO: 561983 - DNA, 20 bp, Artificial Sequence
  chemically synthesized
tttgatgttaaatgttgagg

SEQ ID NO: 561984 - DNA, 20 bp, Artificial Sequence
  chemically synthesized
ttacctcaacatttaacatc

SEQ ID NO: 561985 - DNA, 20 bp, Artificial Sequence
  chemically synthesized
caaataaaagtaaataatac

SEQ ID NO: 561986 - DNA, 20 bp, Artificial Sequence
  chemically synthesized
gaggtaaagtgtatgtgaag

SEQ ID NO: 561987 - DNA, 20 bp, Artificial Sequence
  chemically synthesized
catttgtgatccccactgaa

SEQ ID NO: 561988 - DNA, 20 bp, Artificial Sequence
  chemically synthesized
cagcaaatttgacaacaatc

SEQ ID NO: 561989 - DNA, 20 bp, Artificial Sequence
  chemically synthesized
tatgggattaagtagggtcc

SEQ ID NO: 561990 - DNA, 20 bp, Artificial Sequence
  chemically synthesized
tctaggatctattgagcact

SEQ ID NO: 561991 - DNA, 20 bp, Artificial Sequence
  chemically synthesized
gctgatacaagtaaagagct

SEQ ID NO: 561992 - DNA, 20 bp, Artificial Sequence
  chemically synthesized
acaaaattcaatggacaaaa

SEQ ID NO: 561993 - DNA, 20 bp, Artificial Sequence
  chemically synthesized
ccaactatttgccactttac

SEQ ID NO: 561994 - DNA, 20 bp, Artificial Sequence
  chemically synthesized
tcagctgacaagccatgggg

SEQ ID NO: 561995 - DNA, 20 bp, Artificial Sequence
  chemically synthesized
ggaaaatatcaatatttgaa

SEQ ID NO: 561996 - DNA, 20 bp, Artificial Sequence
  chemically synthesized
taagtgggctattgaacaaa

SEQ ID NO: 561997 - DNA, 20 bp, Artificial Sequence
  chemically synthesized
cattattcatataatccaag

SEQ ID NO: 561998 - DNA, 20 bp, Artificial Sequence
  chemically synthesized
aacttgaagatgtgctagta

SEQ ID NO: 561999 - DNA, 20 bp, Artificial Sequence
  chemically synthesized
cttactgagatccagattga

SEQ ID NO: 562000 - DNA, 20 bp, Artificial Sequence
  chemically synthesized
gagactgagtctcaaaaaaa

SEQ ID NO: 562001 - DNA, 20 bp, Artificial Sequence
  chemically synthesized
aaagtagataaattcactta

SEQ ID NO: 562002 - DNA, 20 bp, Artificial Sequence
  chemically synthesized
ctttgcctttattaagagta

SEQ ID NO: 562003 - DNA, 20 bp, Artificial Sequence
  chemically synthesized
atatacaagatgggtaagag

SEQ ID NO: 562004 - DNA, 20 bp, Artificial Sequence
  chemically synthesized
gacctgtaataaagtttaag

SEQ ID NO: 562005 - DNA, 20 bp, Artificial Sequence
  chemically synthesized
agaggttacaatgaatgtaa

SEQ ID NO: 562006 - DNA, 20 bp, Artificial Sequence
  chemically synthesized
atactaagacacttactagt

SEQ ID NO: 562007 - DNA, 20 bp, Artificial Sequence
  chemically synthesized
catggcccttgaaacactac

SEQ ID NO: 562008 - DNA, 20 bp, Artificial Sequence
  chemically synthesized
tacccctgaacttaaaagtt

SEQ ID NO: 562009 - DNA, 20 bp, Artificial Sequence
  chemically synthesized
gcaggtgggagctaaatgat

SEQ ID NO: 562010 - DNA, 20 bp, Artificial Sequence
  chemically synthesized
atcattagagaaatgcaaat

SEQ ID NO: 562011 - DNA, 20 bp, Artificial Sequence
  chemically synthesized
taaacaaatctatgagaaaa

SEQ ID NO: 562012 - DNA, 20 bp, Artificial Sequence
  chemically synthesized
aatataaaacctcaaactat

SEQ ID NO: 562013 - DNA, 20 bp, Artificial Sequence
  chemically synthesized
atagattaaagacttaaata

SEQ ID NO: 562014 - DNA, 20 bp, Artificial Sequence
  chemically synthesized
tgatcttcaacaaagctgac

SEQ ID NO: 562015 - DNA, 20 bp, Artificial Sequence
  chemically synthesized
agacacatggatcaatggaa

SEQ ID NO: 562016 - DNA, 20 bp, Artificial Sequence
  chemically synthesized
tactacagggctacagtggc

SEQ ID NO: 562017 - DNA, 20 bp, Artificial Sequence
  chemically synthesized
gagatgacagaaacaaatgg

SEQ ID NO: 562018 - DNA, 20 bp, Artificial Sequence
  chemically synthesized
ttcagcaaagtctcaggata

SEQ ID NO: 562019 - DNA, 20 bp, Artificial Sequence
  chemically synthesized
acaacatgatgctatatcta

SEQ ID NO: 562020 - DNA, 20 bp, Artificial Sequence
  chemically synthesized
aggaatgctgtgttcccatg

SEQ ID NO: 562021 - DNA, 20 bp, Artificial Sequence
  chemically synthesized
cccctgcccacaccccagtg

SEQ ID NO: 562022 - DNA, 20 bp, Artificial Sequence
  chemically synthesized
cactgattagctgaatattt

SEQ ID NO: 562023 - DNA, 20 bp, Artificial Sequence
  chemically synthesized
ataatttaaatgagacactg

SEQ ID NO: 562024 - DNA, 20 bp, Artificial Sequence
  chemically synthesized
cattatgatagagatacaag

SEQ ID NO: 562025 - DNA, 20 bp, Artificial Sequence
  chemically synthesized
cacccaaaagtattaaataa

SEQ ID NO: 562026 - DNA, 20 bp, Artificial Sequence
  chemically synthesized
aaaaataagcacttcagaaa

SEQ ID NO: 562027 - DNA, 20 bp, Artificial Sequence
  chemically synthesized
cagttcttgaattattttta

SEQ ID NO: 562028 - DNA, 20 bp, Artificial Sequence
  chemically synthesized
tattcttgccctttgctttt

SEQ ID NO: 562029 - DNA, 20 bp, Artificial Sequence
  chemically synthesized
tatttcacttaatttctcag

SEQ ID NO: 562030 - DNA, 20 bp, Artificial Sequence
  chemically synthesized
gactatcagttaccttaatg

SEQ ID NO: 562031 - DNA, 20 bp, Artificial Sequence
  chemically synthesized
ttacctttctggtagggagg

SEQ ID NO: 562032 - DNA, 20 bp, Artificial Sequence
  chemically synthesized
ccaacctgctatttaggaga

SEQ ID NO: 562033 - DNA, 20 bp, Artificial Sequence
  chemically synthesized
tttaacatgcagaactgctt

SEQ ID NO: 562034 - DNA, 20 bp, Artificial Sequence
  chemically synthesized
gtaacgtactcattaatttt

SEQ ID NO: 562035 - DNA, 20 bp, Artificial Sequence
  chemically synthesized
gtgttttacataaaacacaa

SEQ ID NO: 562036 - DNA, 20 bp, Artificial Sequence
  chemically synthesized
cggttttgttgtgttttatg

SEQ ID NO: 562037 - DNA, 20 bp, Artificial Sequence
  chemically synthesized
ccacagtggtgtgttttaca

SEQ ID NO: 562038 - DNA, 20 bp, Artificial Sequence
  chemically synthesized
gatgtagcccgatattgaag

SEQ ID NO: 562039 - DNA, 20 bp, Artificial Sequence
  chemically synthesized
tgcttagaattcaatgtcta

SEQ ID NO: 562040 - DNA, 20 bp, Artificial Sequence
  chemically synthesized
atggaaacaaacataaaaac

SEQ ID NO: 562041 - DNA, 20 bp, Artificial Sequence
  chemically synthesized
acctctatggaaacaaacat

SEQ ID NO: 562042 - DNA, 20 bp, Artificial Sequence
  chemically synthesized
ggcctgcacagacctgaaca

SEQ ID NO: 562043 - DNA, 20 bp, Artificial Sequence
  chemically synthesized
cacttaaggtgcatttctga

SEQ ID NO: 562044 - DNA, 20 bp, Artificial Sequence
  chemically synthesized
aatttaccctttgttccagt

SEQ ID NO: 562045 - DNA, 20 bp, Artificial Sequence
  chemically synthesized
tcattctctcattctccctt

SEQ ID NO: 562046 - DNA, 20 bp, Artificial Sequence
  chemically synthesized
aaaaggtcacatcatataga

SEQ ID NO: 562047 - DNA, 20 bp, Artificial Sequence
  chemically synthesized
ccaaaacgaaacaaaaacag

SEQ ID NO: 562048 - DNA, 20 bp, Artificial Sequence
  chemically synthesized
aagccataccaaaacgaaac

SEQ ID NO: 562049 - DNA, 20 bp, Artificial Sequence
  chemically synthesized
agccagaaaccaagccatac

SEQ ID NO: 562050 - DNA, 20 bp, Artificial Sequence
  chemically synthesized
ggtgaatcaaccataccata

SEQ ID NO: 562051 - DNA, 20 bp, Artificial Sequence
  chemically synthesized
taaaatatacaggtgattga

SEQ ID NO: 562052 - DNA, 20 bp, Artificial Sequence
  chemically synthesized
catttttcctttttaaaata

SEQ ID NO: 562053 - DNA, 20 bp, Artificial Sequence
  chemically synthesized
gcctggaaattacatagcag

SEQ ID NO: 562054 - DNA, 20 bp, Artificial Sequence
  chemically synthesized
taacgcaagtataatatgtg

SEQ ID NO: 562055 - DNA, 20 bp, Artificial Sequence
  chemically synthesized
cataggactacaaaatggca

SEQ ID NO: 562056 - DNA, 20 bp, Artificial Sequence
  chemically synthesized
ctctattcagatctttgcaa

SEQ ID NO: 562057 - DNA, 20 bp, Artificial Sequence
  chemically synthesized
aatcatattttcaaatcaaa

SEQ ID NO: 562058 - DNA, 20 bp, Artificial Sequence
  chemically synthesized
tacctatagaagcacgaata

SEQ ID NO: 562059 - DNA, 20 bp, Artificial Sequence
  chemically synthesized
ctgagcttggttctttgtag

SEQ ID NO: 562060 - DNA, 20 bp, Artificial Sequence
  chemically synthesized
ttgtaacatcatcgttttat

SEQ ID NO: 562061 - DNA, 20 bp, Artificial Sequence
  chemically synthesized
tgagacatattttgttttaa

SEQ ID NO: 562062 - DNA, 20 bp, Artificial Sequence
  chemically synthesized
ttgtagtttgagtttcataa

SEQ ID NO: 562063 - DNA, 20 bp, Artificial Sequence
  chemically synthesized
tttggattaatacaatcaat

SEQ ID NO: 562064 - DNA, 20 bp, Artificial Sequence
  chemically synthesized
tcatgcattcgcagtgatgc

SEQ ID NO: 562065 - DNA, 20 bp, Artificial Sequence
  chemically synthesized
gaaaattgttcttttggggg

SEQ ID NO: 562066 - DNA, 20 bp, Artificial Sequence
  chemically synthesized
acagagcaagactctgtctc

SEQ ID NO: 562067 - DNA, 20 bp, Artificial Sequence
  chemically synthesized
ctgtctcaaaaacaaaaaat

SEQ ID NO: 562068 - DNA, 20 bp, Artificial Sequence
  chemically synthesized
tcaaaaacaaaaaatcaaaa

SEQ ID NO: 562069 - DNA, 20 bp, Artificial Sequence
  chemically synthesized
ctcctaacaaatgaagaagt

SEQ ID NO: 562070 - DNA, 20 bp, Artificial Sequence
  chemically synthesized
gattatttcattatgagttg

SEQ ID NO: 562071 - DNA, 20 bp, Artificial Sequence
  chemically synthesized
ctcataatgaaataatcaat

SEQ ID NO: 562072 - DNA, 20 bp, Artificial Sequence
  chemically synthesized
atactttcggggatttgcct

SEQ ID NO: 562073 - DNA, 20 bp, Artificial Sequence
  chemically synthesized
aaactaacaaataaaaatct

SEQ ID NO: 562074 - DNA, 20 bp, Artificial Sequence
  chemically synthesized
aaatagtctttaactttctg

SEQ ID NO: 562075 - DNA, 20 bp, Artificial Sequence
  chemically synthesized
taaaaataaaattaataact

SEQ ID NO: 562076 - DNA, 20 bp, Artificial Sequence
  chemically synthesized
ctgttacctgcacttacaac

SEQ ID NO: 562077 - DNA, 20 bp, Artificial Sequence
  chemically synthesized
ctttataacagagaacagat

SEQ ID NO: 562078 - DNA, 20 bp, Artificial Sequence
  chemically synthesized
caatgatgcaaattggagta

SEQ ID NO: 562079 - DNA, 20 bp, Artificial Sequence
  chemically synthesized
atagatgagaattggatgat

SEQ ID NO: 562080 - DNA, 20 bp, Artificial Sequence
  chemically synthesized
aaaacaactggaaggtaact

SEQ ID NO: 562081 - DNA, 20 bp, Artificial Sequence
  chemically synthesized
cagttaccttccagttgttt

SEQ ID NO: 562082 - DNA, 20 bp, Artificial Sequence
  chemically synthesized
gaaatagctatttcatgttt

SEQ ID NO: 562083 - DNA, 20 bp, Artificial Sequence
  chemically synthesized
ctgaagcaattcgatcctct

SEQ ID NO: 562084 - DNA, 20 bp, Artificial Sequence
  chemically synthesized
catgtatacatacatataca

SEQ ID NO: 562085 - DNA, 20 bp, Artificial Sequence
  chemically synthesized
tcaaattgttctatttgtat

SEQ ID NO: 562086 - DNA, 20 bp, Artificial Sequence
  chemically synthesized
atataaattcatctcttgtt

SEQ ID NO: 562087 - DNA, 20 bp, Artificial Sequence
  chemically synthesized
tactattacctagctacaaa

SEQ ID NO: 562088 - DNA, 20 bp, Artificial Sequence
  chemically synthesized
atctaaacccttactcatgt

SEQ ID NO: 562089 - DNA, 20 bp, Artificial Sequence
  chemically synthesized
ttcacattgcatgtctgtat

SEQ ID NO: 562090 - DNA, 20 bp, Artificial Sequence
  chemically synthesized
aacctctgtctcaaaaagga

SEQ ID NO: 562091 - DNA, 20 bp, Artificial Sequence
  chemically synthesized
agcacaatcttgcacctaat

SEQ ID NO: 562092 - DNA, 20 bp, Artificial Sequence
  chemically synthesized
tgctgtattttttaatcaat

SEQ ID NO: 562093 - DNA, 20 bp, Artificial Sequence
  chemically synthesized
atataagtggcatgtgaaga

SEQ ID NO: 562094 - DNA, 20 bp, Artificial Sequence
  chemically synthesized
gggccgaaaatttcagggaa

SEQ ID NO: 562095 - DNA, 20 bp, Artificial Sequence
  chemically synthesized
tgtcaatttaaaagcatacc

SEQ ID NO: 562096 - DNA, 20 bp, Artificial Sequence
  chemically synthesized
gagcaagaccctatcttaaa

SEQ ID NO: 562097 - DNA, 20 bp, Artificial Sequence
  chemically synthesized
ggcaagccagggtaacatgg

SEQ ID NO: 562098 - DNA, 20 bp, Artificial Sequence
  chemically synthesized
aaattgttattgatgtcact

SEQ ID NO: 562099 - DNA, 20 bp, Artificial Sequence
  chemically synthesized
ttgatcaacattttttattt

SEQ ID NO: 562100 - DNA, 20 bp, Artificial Sequence
  chemically synthesized
caacattttttatttaaaaa

SEQ ID NO: 562101 - DNA, 20 bp, Artificial Sequence
  chemically synthesized
caggctccaaagcctatgct

SEQ ID NO: 562102 - DNA, 20 bp, Artificial Sequence
  chemically synthesized
ataataatccagaacaatga

SEQ ID NO: 562103 - DNA, 20 bp, Artificial Sequence
  chemically synthesized
tggagttactgaatttaaac

SEQ ID NO: 562104 - DNA, 20 bp, Artificial Sequence
  chemically synthesized
tgccactaaatcagaatcag

SEQ ID NO: 562105 - DNA, 20 bp, Artificial Sequence
  chemically synthesized
acgtaaagcttcacctgtca

SEQ ID NO: 562106 - DNA, 20 bp, Artificial Sequence
  chemically synthesized
tgagttttgggaccatattt

SEQ ID NO: 562107 - DNA, 20 bp, Artificial Sequence
  chemically synthesized
atggttttaaaatatggtcc

SEQ ID NO: 562108 - DNA, 20 bp, Artificial Sequence
  chemically synthesized
tgaccctgccatggagggca

SEQ ID NO: 562109 - DNA, 20 bp, Artificial Sequence
  chemically synthesized
caccctgatacttagcagtt

SEQ ID NO: 562110 - DNA, 20 bp, Artificial Sequence
  chemically synthesized
ctacatatttccaaacaact

SEQ ID NO: 562111 - DNA, 20 bp, Artificial Sequence
  chemically synthesized
gagttgtattttctcattaa

SEQ ID NO: 562112 - DNA, 20 bp, Artificial Sequence
  chemically synthesized
ctacaatatgaatggacctt

SEQ ID NO: 562113 - DNA, 20 bp, Artificial Sequence
  chemically synthesized
tagctctgtgaacatactga

SEQ ID NO: 562114 - DNA, 20 bp, Artificial Sequence
  chemically synthesized
ggttggttctaatactgaaa

SEQ ID NO: 562115 - DNA, 20 bp, Artificial Sequence
  chemically synthesized
gtttcttaccatctgcacaa

SEQ ID NO: 562116 - DNA, 20 bp, Artificial Sequence
  chemically synthesized
gtgaaatagttcttctgggt

SEQ ID NO: 562117 - DNA, 20 bp, Artificial Sequence
  chemically synthesized
ggatgttatagatggctctt

SEQ ID NO: 562118 - DNA, 20 bp, Artificial Sequence
  chemically synthesized
attaacagccaacccacagt

SEQ ID NO: 562119 - DNA, 20 bp, Artificial Sequence
  chemically synthesized
cagcatgtacatcaggaaaa

SEQ ID NO: 562120 - DNA, 20 bp, Artificial Sequence
  chemically synthesized
agaggcagcatgtacatcag

SEQ ID NO: 562121 - DNA, 20 bp, Artificial Sequence
  chemically synthesized
ataaatgtagtacctgtacc

SEQ ID NO: 562122 - DNA, 20 bp, Artificial Sequence
  chemically synthesized
tacatatatatataaaattc

SEQ ID NO: 562123 - DNA, 20 bp, Artificial Sequence
  chemically synthesized
ggtgttcagtcttacagggt

SEQ ID NO: 562124 - DNA, 20 bp, Artificial Sequence
  chemically synthesized
caggctaccgtgtttctttt

SEQ ID NO: 562125 - DNA, 20 bp, Artificial Sequence
  chemically synthesized
gaccagcctggccaacgtgg

SEQ ID NO: 562126 - DNA, 20 bp, Artificial Sequence
  chemically synthesized
agcagcttgcctagattgtg

SEQ ID NO: 562127 - DNA, 20 bp, Artificial Sequence
  chemically synthesized
aatacattttcacagccagg

SEQ ID NO: 562128 - DNA, 20 bp, Artificial Sequence
  chemically synthesized
tcaaatttcaaaatgccaag

SEQ ID NO: 562129 - DNA, 20 bp, Artificial Sequence
  chemically synthesized
ccaaggtatggaaacattga

SEQ ID NO: 562130 - DNA, 20 bp, Artificial Sequence
  chemically synthesized
tatagctgacctttactggg

SEQ ID NO: 562131 - DNA, 20 bp, Artificial Sequence
  chemically synthesized
gtaaaacctggataaacagg

SEQ ID NO: 562132 - DNA, 20 bp, Artificial Sequence
  chemically synthesized
tagcagtccgcccagttcat

SEQ ID NO: 562133 - DNA, 20 bp, Artificial Sequence
  chemically synthesized
tctttatgtgagattgtgtt

SEQ ID NO: 562134 - DNA, 20 bp, Artificial Sequence
  chemically synthesized
gatcaattcttaattttgta

SEQ ID NO: 562135 - DNA, 20 bp, Artificial Sequence
  chemically synthesized
aatttgtattacctagtatg

SEQ ID NO: 562136 - DNA, 20 bp, Artificial Sequence
  chemically synthesized
ccaatttggttgccatgaac

SEQ ID NO: 562137 - DNA, 20 bp, Artificial Sequence
  chemically synthesized
ataaaattataatcaaccta

SEQ ID NO: 562138 - DNA, 20 bp, Artificial Sequence
  chemically synthesized
gatgggatctcactggtaaa

SEQ ID NO: 562139 - DNA, 20 bp, Artificial Sequence
  chemically synthesized
agaaaacaaagaagagtcaa

SEQ ID NO: 562140 - DNA, 20 bp, Artificial Sequence
  chemically synthesized
aacagtcaaataaatgttgt

SEQ ID NO: 562141 - DNA, 20 bp, Artificial Sequence
  chemically synthesized
ggtgaaactccgtctctact

SEQ ID NO: 562142 - DNA, 20 bp, Artificial Sequence
  chemically synthesized
taacgatgttcatttgtgca

SEQ ID NO: 562143 - DNA, 20 bp, Artificial Sequence
  chemically synthesized
ccgtttgggggacgcgtcag

SEQ ID NO: 562144 - DNA, 20 bp, Artificial Sequence
  chemically synthesized
ggagtacatggagggacagg

SEQ ID NO: 562145 - DNA, 20 bp, Artificial Sequence
  chemically synthesized
aagaatattgaaaatgagac

SEQ ID NO: 562146 - DNA, 20 bp, Artificial Sequence
  chemically synthesized
tagtaaatagtatggtattt

SEQ ID NO: 562147 - DNA, 20 bp, Artificial Sequence
  chemically synthesized
aattaatatctcaataactc

SEQ ID NO: 562148 - DNA, 20 bp, Artificial Sequence
  chemically synthesized
aagcatcaactgcctttaat

SEQ ID NO: 562149 - DNA, 20 bp, Artificial Sequence
  chemically synthesized
atccatagtgcagatataat

SEQ ID NO: 562150 - DNA, 20 bp, Artificial Sequence
  chemically synthesized
taaaaaatatgtaacagcaa

SEQ ID NO: 562151 - DNA, 20 bp, Artificial Sequence
  chemically synthesized
catgagaaagaatattttta

SEQ ID NO: 562152 - DNA, 20 bp, Artificial Sequence
  chemically synthesized
ttttcccttcctcttcccac

SEQ ID NO: 562153 - DNA, 20 bp, Artificial Sequence
  chemically synthesized
ctgctccagacccagtaaac

SEQ ID NO: 562154 - DNA, 20 bp, Artificial Sequence
  chemically synthesized
taggagatagatagtgggta

SEQ ID NO: 562155 - DNA, 20 bp, Artificial Sequence
  chemically synthesized
aaccaaatcgacatcaggca

SEQ ID NO: 562156 - DNA, 20 bp, Artificial Sequence
  chemically synthesized
tccctaaagttaatattttg

SEQ ID NO: 562157 - DNA, 20 bp, Artificial Sequence
  chemically synthesized
aggaatgcttccagtttaaa

SEQ ID NO: 562158 - DNA, 20 bp, Artificial Sequence
  chemically synthesized
gaccagcctggccaacatga

SEQ ID NO: 562159 - DNA, 20 bp, Artificial Sequence
  chemically synthesized
ctttttatagatagggaaag

SEQ ID NO: 562160 - DNA, 20 bp, Artificial Sequence
  chemically synthesized
cccatagggcaactaattct

SEQ ID NO: 562161 - DNA, 20 bp, Artificial Sequence
  chemically synthesized
aaatattatcttgcattggg

SEQ ID NO: 562162 - DNA, 20 bp, Artificial Sequence
  chemically synthesized
ttatcatgtacaatgcactc

SEQ ID NO: 562163 - DNA, 20 bp, Artificial Sequence
  chemically synthesized
ccaagtttccatttacaagg

SEQ ID NO: 562164 - DNA, 20 bp, Artificial Sequence
  chemically synthesized
catttacaagggaaaacgat

SEQ ID NO: 562165 - DNA, 20 bp, Artificial Sequence
  chemically synthesized
ggagaaccttaacctatttc

SEQ ID NO: 562166 - DNA, 20 bp, Artificial Sequence
  chemically synthesized
gtttcagccagttgctgtgg

SEQ ID NO: 562167 - DNA, 20 bp, Artificial Sequence
  chemically synthesized
cttgccaagtagacagatgc

SEQ ID NO: 562168 - DNA, 20 bp, Artificial Sequence
  chemically synthesized
attgttgaaacctataaagg

SEQ ID NO: 562169 - DNA, 20 bp, Artificial Sequence
  chemically synthesized
ctgcactaagttagataaat

SEQ ID NO: 562170 - DNA, 20 bp, Artificial Sequence
  chemically synthesized
attacggccaattcaaattt

SEQ ID NO: 562171 - DNA, 20 bp, Artificial Sequence
  chemically synthesized
tcaaagcatccagaggtcta

SEQ ID NO: 562172 - DNA, 20 bp, Artificial Sequence
  chemically synthesized
gtagataagacaaattaact

SEQ ID NO: 562173 - DNA, 20 bp, Artificial Sequence
  chemically synthesized
ctacattgaagcaaacaatc

SEQ ID NO: 562174 - DNA, 20 bp, Artificial Sequence
  chemically synthesized
aaatgtctagtactactgtg

SEQ ID NO: 562175 - DNA, 20 bp, Artificial Sequence
  chemically synthesized
ctccatttgaattatccagg

SEQ ID NO: 562176 - DNA, 20 bp, Artificial Sequence
  chemically synthesized
taccaagtatagcagccaga

SEQ ID NO: 562177 - DNA, 20 bp, Artificial Sequence
  chemically synthesized
ttaaacttagatgaattatt

SEQ ID NO: 562178 - DNA, 20 bp, Artificial Sequence
  chemically synthesized
aaatgataaaaaatgattaa

SEQ ID NO: 562179 - DNA, 20 bp, Artificial Sequence
  chemically synthesized
attttacatatgtaaaaaaa

SEQ ID NO: 562180 - DNA, 20 bp, Artificial Sequence
  chemically synthesized
cgtcttaatgtcttcaatgg

SEQ ID NO: 562181 - DNA, 20 bp, Artificial Sequence
  chemically synthesized
tgtttgatttccatgagaac

SEQ ID NO: 562182 - DNA, 20 bp, Artificial Sequence
  chemically synthesized
gtggaacaaaatgtgtcaca

SEQ ID NO: 562183 - DNA, 20 bp, Artificial Sequence
  chemically synthesized
ttctttcaaagctgtagaaa

SEQ ID NO: 562184 - DNA, 20 bp, Artificial Sequence
  chemically synthesized
ctacagctttgaaagaagct

SEQ ID NO: 562185 - DNA, 20 bp, Artificial Sequence
  chemically synthesized
tcatttcaaacttatggtga

SEQ ID NO: 562186 - DNA, 20 bp, Artificial Sequence
  chemically synthesized
aaaatcaaaatgaaatgtga

SEQ ID NO: 562187 - DNA, 20 bp, Artificial Sequence
  chemically synthesized
tgaaatgtgacaaaacactg

SEQ ID NO: 562188 - DNA, 20 bp, Artificial Sequence
  chemically synthesized
attgaccaccgattcccaga

SEQ ID NO: 562189 - DNA, 20 bp, Artificial Sequence
  chemically synthesized
agacaaagcctttctctttt

SEQ ID NO: 562190 - DNA, 20 bp, Artificial Sequence
  chemically synthesized
tttgtcacttggacaacttg

SEQ ID NO: 562191 - DNA, 20 bp, Artificial Sequence
  chemically synthesized
ataactctgtatgaaaatga

SEQ ID NO: 562192 - DNA, 20 bp, Artificial Sequence
  chemically synthesized
tgcagttgcacaattaatac

SEQ ID NO: 562193 - DNA, 20 bp, Artificial Sequence
  chemically synthesized
aaaaggaaaacaagtacctc

SEQ ID NO: 562194 - DNA, 20 bp, Artificial Sequence
  chemically synthesized
cctaagtatttgattaaaag

SEQ ID NO: 562195 - DNA, 20 bp, Artificial Sequence
  chemically synthesized
tccaattataataataatta

SEQ ID NO: 562196 - DNA, 20 bp, Artificial Sequence
  chemically synthesized
gaagtagaagaaaactaaga

SEQ ID NO: 562197 - DNA, 20 bp, Artificial Sequence
  chemically synthesized
tatataattttgaagtagaa

SEQ ID NO: 562198 - DNA, 20 bp, Artificial Sequence
  chemically synthesized
cttagaaataacctgaaaag

SEQ ID NO: 562199 - DNA, 20 bp, Artificial Sequence
  chemically synthesized
tccttgatttttttctacat

SEQ ID NO: 562200 - DNA, 20 bp, Artificial Sequence
  chemically synthesized
ctttcatctcaatgtagaaa

SEQ ID NO: 562201 - DNA, 20 bp, Artificial Sequence
  chemically synthesized
tagaatttttggtggtgata

SEQ ID NO: 562202 - DNA, 20 bp, Artificial Sequence
  chemically synthesized
ctacataacacgatggccac

SEQ ID NO: 562203 - DNA, 20 bp, Artificial Sequence
  chemically synthesized
tgtggcatttttttaagtca

SEQ ID NO: 562204 - DNA, 20 bp, Artificial Sequence
  chemically synthesized
agactggagattttttcccc

SEQ ID NO: 562205 - DNA, 20 bp, Artificial Sequence
  chemically synthesized
caagctgtgaaatggcatat

SEQ ID NO: 562206 - DNA, 20 bp, Artificial Sequence
  chemically synthesized
ttcttttcttgaaactttgg

SEQ ID NO: 562207 - DNA, 20 bp, Artificial Sequence
  chemically synthesized
tgcatacttaacaatttgga

SEQ ID NO: 562208 - DNA, 20 bp, Artificial Sequence
  chemically synthesized
tgtagatctgtgatctgaca

SEQ ID NO: 562209 - DNA, 20 bp, Artificial Sequence
  chemically synthesized
ctgcttggattacaaatact

SEQ ID NO: 562210 - DNA, 20 bp, Artificial Sequence
  chemically synthesized
atgcatgctttcattaagaa

SEQ ID NO: 562211 - DNA, 20 bp, Artificial Sequence
  chemically synthesized
attcaggaattcttacctca

SEQ ID NO: 562212 - DNA, 20 bp, Artificial Sequence
  chemically synthesized
tctcaaaaaaaaaaaaaaaa

SEQ ID NO: 562213 - DNA, 20 bp, Artificial Sequence
  chemically synthesized
tttttggactgacacaatta

SEQ ID NO: 562214 - DNA, 20 bp, Artificial Sequence
  chemically synthesized
agcctacagtttttaaacca

SEQ ID NO: 562215 - DNA, 20 bp, Artificial Sequence
  chemically synthesized
aaagttaggttttttggttt

SEQ ID NO: 562216 - DNA, 20 bp, Artificial Sequence
  chemically synthesized
atctcaaaaaaaggaaaaaa

SEQ ID NO: 562217 - DNA, 20 bp, Artificial Sequence
  chemically synthesized
actaaaaatgccacctttta

SEQ ID NO: 562218 - DNA, 20 bp, Artificial Sequence
  chemically synthesized
cacacagacacatgcagaaa

SEQ ID NO: 562219 - DNA, 20 bp, Artificial Sequence
  chemically synthesized
cttgatgatccagtaccccc

SEQ ID NO: 562220 - DNA, 20 bp, Artificial Sequence
  chemically synthesized
aaataatatggagattcctc

SEQ ID NO: 562221 - DNA, 20 bp, Artificial Sequence
  chemically synthesized
agtagacaacattctgacca

SEQ ID NO: 562222 - DNA, 20 bp, Artificial Sequence
  chemically synthesized
acgaagtgagatcttgtctc

SEQ ID NO: 562223 - DNA, 20 bp, Artificial Sequence
  chemically synthesized
tcttgtctcaaaaaccaaac

SEQ ID NO: 562224 - DNA, 20 bp, Artificial Sequence
  chemically synthesized
atttaagttaaaaagaaaga

SEQ ID NO: 562225 - DNA, 20 bp, Artificial Sequence
  chemically synthesized
atgaagtctacattattatc

SEQ ID NO: 562226 - DNA, 20 bp, Artificial Sequence
  chemically synthesized
aatggtggtaaagctgagat

SEQ ID NO: 562227 - DNA, 20 bp, Artificial Sequence
  chemically synthesized
tcattttctttccaagtaat

SEQ ID NO: 562228 - DNA, 20 bp, Artificial Sequence
  chemically synthesized
gatgcctcagaaaacaatac

SEQ ID NO: 562229 - DNA, 20 bp, Artificial Sequence
  chemically synthesized
aaatggaatttgatgcctca

SEQ ID NO: 562230 - DNA, 20 bp, Artificial Sequence
  chemically synthesized
gaccagccgggccaacatgg

SEQ ID NO: 562231 - DNA, 20 bp, Artificial Sequence
  chemically synthesized
agactgtttcaaaaaaaaaa

SEQ ID NO: 562232 - DNA, 20 bp, Artificial Sequence
  chemically synthesized
atagggcacaatggagaaag

SEQ ID NO: 562233 - DNA, 20 bp, Artificial Sequence
  chemically synthesized
tctgttttatttcagtgaat

SEQ ID NO: 562234 - DNA, 20 bp, Artificial Sequence
  chemically synthesized
aaagttttcattcactgaaa

SEQ ID NO: 562235 - DNA, 20 bp, Artificial Sequence
  chemically synthesized
tatccaacatatgcatgtaa

SEQ ID NO: 562236 - DNA, 20 bp, Artificial Sequence
  chemically synthesized
tgccctcccactatttgcct

SEQ ID NO: 562237 - DNA, 20 bp, Artificial Sequence
  chemically synthesized
ccttgtcttgttacttctca

SEQ ID NO: 562238 - DNA, 20 bp, Artificial Sequence
  chemically synthesized
aaaagagatatcaacaagaa

SEQ ID NO: 562239 - DNA, 20 bp, Artificial Sequence
  chemically synthesized
aaacacattgcataggggaa

SEQ ID NO: 562240 - DNA, 20 bp, Artificial Sequence
  chemically synthesized
taaaatacacagaaaatgaa

SEQ ID NO: 562241 - DNA, 20 bp, Artificial Sequence
  chemically synthesized
atggtgggcaaagtctcttc

SEQ ID NO: 562242 - DNA, 20 bp, Artificial Sequence
  chemically synthesized
gatttatacatgcagaacca

SEQ ID NO: 562243 - DNA, 20 bp, Artificial Sequence
  chemically synthesized
acagagcgagactccatctc

SEQ ID NO: 562244 - DNA, 20 bp, Artificial Sequence
  chemically synthesized
cgagactccatctcaaaaac

SEQ ID NO: 562245 - DNA, 20 bp, Artificial Sequence
  chemically synthesized
tccatctcaaaaacaaaaac

SEQ ID NO: 562246 - DNA, 20 bp, Artificial Sequence
  chemically synthesized
tcaaaaacaaaaacaaaaac

SEQ ID NO: 562247 - DNA, 20 bp, Artificial Sequence
  chemically synthesized
caaaaacaaaaacaaaaaca

SEQ ID NO: 562248 - DNA, 20 bp, Artificial Sequence
  chemically synthesized
acaaaaacaaaaaacaaaaa

SEQ ID NO: 562249 - DNA, 20 bp, Artificial Sequence
  chemically synthesized
aaaaacaaaaaaaaaaccga

SEQ ID NO: 562250 - DNA, 20 bp, Artificial Sequence
  chemically synthesized
tactccaaagcagtaagaaa

SEQ ID NO: 562251 - DNA, 20 bp, Artificial Sequence
  chemically synthesized
gtataaaaacacccctatac

SEQ ID NO: 562252 - DNA, 20 bp, Artificial Sequence
  chemically synthesized
aactaaagtatgtttagtat

SEQ ID NO: 562253 - DNA, 20 bp, Artificial Sequence
  chemically synthesized
aatatttatttaactatatg

SEQ ID NO: 562254 - DNA, 20 bp, Artificial Sequence
  chemically synthesized
catttcttatagcctcattt

SEQ ID NO: 562255 - DNA, 20 bp, Artificial Sequence
  chemically synthesized
agtgactgtggtgatagttc

SEQ ID NO: 562256 - DNA, 20 bp, Artificial Sequence
  chemically synthesized
tcagtcttttgctaatactg

SEQ ID NO: 562257 - DNA, 20 bp, Artificial Sequence
  chemically synthesized
cagtgtctaataataataca

SEQ ID NO: 562258 - DNA, 20 bp, Artificial Sequence
  chemically synthesized
taacagaatataaaataaag

SEQ ID NO: 562259 - DNA, 20 bp, Artificial Sequence
  chemically synthesized
gaatataaaataaagaaaaa

SEQ ID NO: 562260 - DNA, 20 bp, Artificial Sequence
  chemically synthesized
cttcattatcttacttaatc

SEQ ID NO: 562261 - DNA, 20 bp, Artificial Sequence
  chemically synthesized
ttaatctaaaacagttccct

SEQ ID NO: 562262 - DNA, 20 bp, Artificial Sequence
  chemically synthesized
atagaaaattgtgaaagaac

SEQ ID NO: 562263 - DNA, 20 bp, Artificial Sequence
  chemically synthesized
ccctaggactaaactgaagg

SEQ ID NO: 562264 - DNA, 20 bp, Artificial Sequence
  chemically synthesized
gacctctgcaccaggtgtgc

SEQ ID NO: 562265 - DNA, 20 bp, Artificial Sequence
  chemically synthesized
aagaacttacccaggtaacc

SEQ ID NO: 562266 - DNA, 20 bp, Artificial Sequence
  chemically synthesized
agtaaagtaattcaggaatg

SEQ ID NO: 562267 - DNA, 20 bp, Artificial Sequence
  chemically synthesized
gtacttccctttcaaccaca

SEQ ID NO: 562268 - DNA, 20 bp, Artificial Sequence
  chemically synthesized
aaaccaataatttgaattaa

SEQ ID NO: 562269 - DNA, 20 bp, Artificial Sequence
  chemically synthesized
aatcacaatatcagctatca

SEQ ID NO: 562270 - DNA, 20 bp, Artificial Sequence
  chemically synthesized
aaactaaatcacatttactt

SEQ ID NO: 562271 - DNA, 20 bp, Artificial Sequence
  chemically synthesized
gaaaggcttcaaataatttt

SEQ ID NO: 562272 - DNA, 20 bp, Artificial Sequence
  chemically synthesized
ttccaataaaatgacaggaa

SEQ ID NO: 562273 - DNA, 20 bp, Artificial Sequence
  chemically synthesized
tgtaactctacaagcataaa

SEQ ID NO: 562274 - DNA, 20 bp, Artificial Sequence
  chemically synthesized
ctgatagaaatatattttta

SEQ ID NO: 562275 - DNA, 20 bp, Artificial Sequence
  chemically synthesized
attaaatataaattttcaat

SEQ ID NO: 562276 - DNA, 20 bp, Artificial Sequence
  chemically synthesized
attataaattaaaacttagg

SEQ ID NO: 562277 - DNA, 20 bp, Artificial Sequence
  chemically synthesized
ggaaacataaaattataaat

SEQ ID NO: 562278 - DNA, 20 bp, Artificial Sequence
  chemically synthesized
acacaagtaaaaataaccag

SEQ ID NO: 562279 - DNA, 20 bp, Artificial Sequence
  chemically synthesized
tttaatttacacattaactt

SEQ ID NO: 562280 - DNA, 20 bp, Artificial Sequence
  chemically synthesized
gaaatttcagtacctatgtt

SEQ ID NO: 562281 - DNA, 20 bp, Artificial Sequence
  chemically synthesized
gcaacaatagcaacaacagc

SEQ ID NO: 562282 - DNA, 20 bp, Artificial Sequence
  chemically synthesized
aatgggtgtgcaccatccat

SEQ ID NO: 562283 - DNA, 20 bp, Artificial Sequence
  chemically synthesized
gtttacctcaagagatcaca

SEQ ID NO: 562284 - DNA, 20 bp, Artificial Sequence
  chemically synthesized
caagataaaccaattcgagg

SEQ ID NO: 562285 - DNA, 20 bp, Artificial Sequence
  chemically synthesized
tgcattctggataaagacag

SEQ ID NO: 562286 - DNA, 20 bp, Artificial Sequence
  chemically synthesized
tgattaaagtacatttaata

SEQ ID NO: 562287 - DNA, 20 bp, Artificial Sequence
  chemically synthesized
gaacaaatgggaagaagaca

SEQ ID NO: 562288 - DNA, 20 bp, Artificial Sequence
  chemically synthesized
agagaaataattgtatttta

SEQ ID NO: 562289 - DNA, 20 bp, Artificial Sequence
  chemically synthesized
gacaatataaaaaaatgaac

SEQ ID NO: 562290 - DNA, 20 bp, Artificial Sequence
  chemically synthesized
ctatttagtggtgagaaaat

SEQ ID NO: 562291 - DNA, 20 bp, Artificial Sequence
  chemically synthesized
aacaagtggaatttgaaatg

SEQ ID NO: 562292 - DNA, 20 bp, Artificial Sequence
  chemically synthesized
aatatacaagatctttacaa

SEQ ID NO: 562293 - DNA, 20 bp, Artificial Sequence
  chemically synthesized
agatctttacaagaaaacta

SEQ ID NO: 562294 - DNA, 20 bp, Artificial Sequence
  chemically synthesized
gaaggagaagaacaaagttg

SEQ ID NO: 562295 - DNA, 20 bp, Artificial Sequence
  chemically synthesized
aaaataaatactccttccat

SEQ ID NO: 562296 - DNA, 20 bp, Artificial Sequence
  chemically synthesized
ctccttccataaaaacatac

SEQ ID NO: 562297 - DNA, 20 bp, Artificial Sequence
  chemically synthesized
atccttccttttgctcaagc

SEQ ID NO: 562298 - DNA, 20 bp, Artificial Sequence
  chemically synthesized
tggagattgagagagtggag

SEQ ID NO: 562299 - DNA, 20 bp, Artificial Sequence
  chemically synthesized
cctcacttaagaggcataca

SEQ ID NO: 562300 - DNA, 20 bp, Artificial Sequence
  chemically synthesized
atattctacttgcagagaga

SEQ ID NO: 562301 - DNA, 20 bp, Artificial Sequence
  chemically synthesized
gatctcttaactgttatatt

SEQ ID NO: 562302 - DNA, 20 bp, Artificial Sequence
  chemically synthesized
caaataagcaaagccctttt

SEQ ID NO: 562303 - DNA, 20 bp, Artificial Sequence
  chemically synthesized
ctatatatttttcttaagaa

SEQ ID NO: 562304 - DNA, 20 bp, Artificial Sequence
  chemically synthesized
attgtgttcaaaggttagaa

SEQ ID NO: 562305 - DNA, 20 bp, Artificial Sequence
  chemically synthesized
tatttttaagtcttataacc

SEQ ID NO: 562306 - DNA, 20 bp, Artificial Sequence
  chemically synthesized
ctgattgagcattcttcgtc

SEQ ID NO: 562307 - DNA, 20 bp, Artificial Sequence
  chemically synthesized
attttgtggggactatactc

SEQ ID NO: 562308 - DNA, 20 bp, Artificial Sequence
  chemically synthesized
gaattacctagaaaatgtgt

SEQ ID NO: 562309 - DNA, 20 bp, Artificial Sequence
  chemically synthesized
cacactccaaaacgatgcag

SEQ ID NO: 562310 - DNA, 20 bp, Artificial Sequence
  chemically synthesized
gtttgataccatgcacactc

SEQ ID NO: 562311 - DNA, 20 bp, Artificial Sequence
  chemically synthesized
gattgaagactgtgaagctc

SEQ ID NO: 562312 - DNA, 20 bp, Artificial Sequence
  chemically synthesized
gcatcaacaaataattaaaa

SEQ ID NO: 562313 - DNA, 20 bp, Artificial Sequence
  chemically synthesized
atgataatctcttggagagg

SEQ ID NO: 562314 - DNA, 20 bp, Artificial Sequence
  chemically synthesized
gattttattttgctttctag

SEQ ID NO: 562315 - DNA, 20 bp, Artificial Sequence
  chemically synthesized
agcatgatagttgctagcaa

SEQ ID NO: 562316 - DNA, 20 bp, Artificial Sequence
  chemically synthesized
ggacatgataacctagagac

SEQ ID NO: 562317 - DNA, 20 bp, Artificial Sequence
  chemically synthesized
taagtgatttgtctttcttt

SEQ ID NO: 562318 - DNA, 20 bp, Artificial Sequence
  chemically synthesized
ctttgcaaagattgtttcag

SEQ ID NO: 562319 - DNA, 20 bp, Artificial Sequence
  chemically synthesized
gtggtattttgaatttcgta

SEQ ID NO: 562320 - DNA, 20 bp, Artificial Sequence
  chemically synthesized
tgattatttgaatattaact

SEQ ID NO: 562321 - DNA, 20 bp, Artificial Sequence
  chemically synthesized
actaagtttacttcactcac

SEQ ID NO: 562322 - DNA, 20 bp, Artificial Sequence
  chemically synthesized
tgaatactgtactgaaagtg

SEQ ID NO: 562323 - DNA, 20 bp, Artificial Sequence
  chemically synthesized
cattcagaaagaatcaacta

SEQ ID NO: 562324 - DNA, 20 bp, Artificial Sequence
  chemically synthesized
ggacccaagaaaatggactc

SEQ ID NO: 562325 - DNA, 20 bp, Artificial Sequence
  chemically synthesized
aattcttcctattatcagat

SEQ ID NO: 562326 - DNA, 20 bp, Artificial Sequence
  chemically synthesized
ggagccattttagatctatg

SEQ ID NO: 562327 - DNA, 20 bp, Artificial Sequence
  chemically synthesized
atgatactgggacaaagtgg

SEQ ID NO: 562328 - DNA, 20 bp, Artificial Sequence
  chemically synthesized
tcccagtatcatcctttttt

SEQ ID NO: 562329 - DNA, 20 bp, Artificial Sequence
  chemically synthesized
ccttcttggcatcaaacagg

SEQ ID NO: 562330 - DNA, 20 bp, Artificial Sequence
  chemically synthesized
tttgatgccaagaaggtagc

SEQ ID NO: 562331 - DNA, 20 bp, Artificial Sequence
  chemically synthesized
ccagaggaaaatcacccttc

SEQ ID NO: 562332 - DNA, 20 bp, Artificial Sequence
  chemically synthesized
caagcacagagcatcatcag

SEQ ID NO: 562333 - DNA, 20 bp, Artificial Sequence
  chemically synthesized
agctatgaccaaaatgcact

SEQ ID NO: 562334 - DNA, 20 bp, Artificial Sequence
  chemically synthesized
atgttcttgcctacttgtaa

SEQ ID NO: 562335 - DNA, 20 bp, Artificial Sequence
  chemically synthesized
cactactctctaccttagga

SEQ ID NO: 562336 - DNA, 20 bp, Artificial Sequence
  chemically synthesized
tagtgattcctcaaagagct

SEQ ID NO: 562337 - DNA, 20 bp, Artificial Sequence
  chemically synthesized
agcaaaatgatgcaggaaca

SEQ ID NO: 562338 - DNA, 20 bp, Artificial Sequence
  chemically synthesized
aggcccaggaaaggcctggg

SEQ ID NO: 562339 - DNA, 20 bp, Artificial Sequence
  chemically synthesized
tagaaggtatataagctctg

SEQ ID NO: 562340 - DNA, 20 bp, Artificial Sequence
  chemically synthesized
aaattatccccagaccaact

SEQ ID NO: 562341 - DNA, 20 bp, Artificial Sequence
  chemically synthesized
ctgtaaccacttacagaaat

SEQ ID NO: 562342 - DNA, 20 bp, Artificial Sequence
  chemically synthesized
gcttttgtgaagacattaga

SEQ ID NO: 562343 - DNA, 20 bp, Artificial Sequence
  chemically synthesized
tactaaattcagtataggat

SEQ ID NO: 562344 - DNA, 20 bp, Artificial Sequence
  chemically synthesized
attatttttggtcatgtttt

SEQ ID NO: 562345 - DNA, 20 bp, Artificial Sequence
  chemically synthesized
ataaagggaagtacagtttt

SEQ ID NO: 562346 - DNA, 20 bp, Artificial Sequence
  chemically synthesized
tatttatctccacataaaca

SEQ ID NO: 562347 - DNA, 20 bp, Artificial Sequence
  chemically synthesized
gctaactgtagaaacagaag

SEQ ID NO: 562348 - DNA, 20 bp, Artificial Sequence
  chemically synthesized
actccatttatcaattaacc

SEQ ID NO: 562349 - DNA, 20 bp, Artificial Sequence
  chemically synthesized
cttttcttattcttttctgt

SEQ ID NO: 562350 - DNA, 20 bp, Artificial Sequence
  chemically synthesized
aagtttacaaagacagagga

SEQ ID NO: 562351 - DNA, 20 bp, Artificial Sequence
  chemically synthesized
aggatgcaaatattttggaa

SEQ ID NO: 562352 - DNA, 20 bp, Artificial Sequence
  chemically synthesized
ccttatgaatgcccatatct

SEQ ID NO: 562353 - DNA, 20 bp, Artificial Sequence
  chemically synthesized
tcttgtctgcttcagaattc

SEQ ID NO: 562354 - DNA, 20 bp, Artificial Sequence
  chemically synthesized
taaaaaaagttgaggattta

SEQ ID NO: 562355 - DNA, 20 bp, Artificial Sequence
  chemically synthesized
taaacagaaacatgtatttt

SEQ ID NO: 562356 - DNA, 20 bp, Artificial Sequence
  chemically synthesized
aaaattcatgataatggagc

SEQ ID NO: 562357 - DNA, 20 bp, Artificial Sequence
  chemically synthesized
agaaacaaaatatccactat

SEQ ID NO: 562358 - DNA, 20 bp, Artificial Sequence
  chemically synthesized
cattcatgatggaaacataa

SEQ ID NO: 562359 - DNA, 20 bp, Artificial Sequence
  chemically synthesized
gagcaagatattcttacctt

SEQ ID NO: 562360 - DNA, 20 bp, Artificial Sequence
  chemically synthesized
gtatggattgaagcctgcac

SEQ ID NO: 562361 - DNA, 20 bp, Artificial Sequence
  chemically synthesized
aaatgacactatgagagaaa

SEQ ID NO: 562362 - DNA, 20 bp, Artificial Sequence
  chemically synthesized
gaaagagaagatgttcaaaa

SEQ ID NO: 562363 - DNA, 20 bp, Artificial Sequence
  chemically synthesized
gaatgtaatactaaatgtaa

SEQ ID NO: 562364 - DNA, 20 bp, Artificial Sequence
  chemically synthesized
cctcagatttgtaatatctg

SEQ ID NO: 562365 - DNA, 20 bp, Artificial Sequence
  chemically synthesized
ctcagctgtcatttactccg

SEQ ID NO: 562366 - DNA, 20 bp, Artificial Sequence
  chemically synthesized
attagggagaaaaattatta

SEQ ID NO: 562367 - DNA, 20 bp, Artificial Sequence
  chemically synthesized
aaatagtcttttgcttggag

SEQ ID NO: 562368 - DNA, 20 bp, Artificial Sequence
  chemically synthesized
aaatctccgttgcttctctt

SEQ ID NO: 562369 - DNA, 20 bp, Artificial Sequence
  chemically synthesized
gttgacaagggtgaataaat

SEQ ID NO: 562370 - DNA, 20 bp, Artificial Sequence
  chemically synthesized
aaggaggctagaataggttt

SEQ ID NO: 562371 - DNA, 20 bp, Artificial Sequence
  chemically synthesized
agatgtctttgaaacatacc

SEQ ID NO: 562372 - DNA, 20 bp, Artificial Sequence
  chemically synthesized
gtaagcatcgaaggcagcac

SEQ ID NO: 562373 - DNA, 20 bp, Artificial Sequence
  chemically synthesized
acagattgagaagacataat

SEQ ID NO: 562374 - DNA, 20 bp, Artificial Sequence
  chemically synthesized
tgaacatattaacgcaaatg

SEQ ID NO: 562375 - DNA, 20 bp, Artificial Sequence
  chemically synthesized
attttttcgaagacaattat

SEQ ID NO: 562376 - DNA, 20 bp, Artificial Sequence
  chemically synthesized
aattatcagttcaacattat

SEQ ID NO: 562377 - DNA, 20 bp, Artificial Sequence
  chemically synthesized
agttcactgacctccttgca

SEQ ID NO: 562378 - DNA, 20 bp, Artificial Sequence
  chemically synthesized
tgtagtcacatagtctatag

SEQ ID NO: 562379 - DNA, 20 bp, Artificial Sequence
  chemically synthesized
agcatataatcattttgtaa

SEQ ID NO: 562380 - DNA, 20 bp, Artificial Sequence
  chemically synthesized
actgattttattttactaat

SEQ ID NO: 562381 - DNA, 20 bp, Artificial Sequence
  chemically synthesized
tctcttaggaaaatttactt

SEQ ID NO: 562382 - DNA, 20 bp, Artificial Sequence
  chemically synthesized
accactacttcataaattgc

SEQ ID NO: 562383 - DNA, 20 bp, Artificial Sequence
  chemically synthesized
tccccgtagagagaataaaa

SEQ ID NO: 562384 - DNA, 20 bp, Artificial Sequence
  chemically synthesized
tctcacattttagagtgcaa

SEQ ID NO: 562385 - DNA, 20 bp, Artificial Sequence
  chemically synthesized
caatgtaagtgaaagcattt

SEQ ID NO: 562386 - DNA, 20 bp, Artificial Sequence
  chemically synthesized
ttaaaaactgggggaaaaaa

SEQ ID NO: 562387 - DNA, 20 bp, Artificial Sequence
  chemically synthesized
tgggggaaaaaaaaaaacag

SEQ ID NO: 562388 - DNA, 20 bp, Artificial Sequence
  chemically synthesized
agccaccacattcggcctag

SEQ ID NO: 562389 - DNA, 20 bp, Artificial Sequence
  chemically synthesized
aaatctggtcttcgttaact

SEQ ID NO: 562390 - DNA, 20 bp, Artificial Sequence
  chemically synthesized
cggccttcttcgtacatctt

SEQ ID NO: 562391 - DNA, 20 bp, Artificial Sequence
  chemically synthesized
tgacacctactaggtggtag

SEQ ID NO: 562392 - DNA, 20 bp, Artificial Sequence
  chemically synthesized
ctctgctcttaattaacttt

SEQ ID NO: 562393 - DNA, 20 bp, Artificial Sequence
  chemically synthesized
agggagataagtgtgattgt

SEQ ID NO: 562394 - DNA, 20 bp, Artificial Sequence
  chemically synthesized
cattgagcacccattagaca

SEQ ID NO: 562395 - DNA, 20 bp, Artificial Sequence
  chemically synthesized
tgttaagtggtctcagttgg

SEQ ID NO: 562396 - DNA, 20 bp, Artificial Sequence
  chemically synthesized
gagaaagagaaaaaaataga

SEQ ID NO: 562397 - DNA, 20 bp, Artificial Sequence
  chemically synthesized
gtcttctcgatttgaaagat

SEQ ID NO: 562398 - DNA, 20 bp, Artificial Sequence
  chemically synthesized
ccattatttccattattact

SEQ ID NO: 562399 - DNA, 20 bp, Artificial Sequence
  chemically synthesized
taaaaaggacaaaaaaaaaa

SEQ ID NO: 562400 - DNA, 20 bp, Artificial Sequence
  chemically synthesized
ggagttcaagactccatctc

SEQ ID NO: 562401 - DNA, 20 bp, Artificial Sequence
  chemically synthesized
aaaacaaacaaacaaacaaa

SEQ ID NO: 562402 - DNA, 20 bp, Artificial Sequence
  chemically synthesized
agaggaaataatcgtggtaa

SEQ ID NO: 562403 - DNA, 20 bp, Artificial Sequence
  chemically synthesized
gaggaaggaccaagaaaagt

SEQ ID NO: 562404 - DNA, 20 bp, Artificial Sequence
  chemically synthesized
ttataggctaatgctctgta

SEQ ID NO: 562405 - DNA, 20 bp, Artificial Sequence
  chemically synthesized
aaagcttttaatacttcatt

SEQ ID NO: 562406 - DNA, 20 bp, Artificial Sequence
  chemically synthesized
accattcaaaatttaaacat

SEQ ID NO: 562407 - DNA, 20 bp, Artificial Sequence
  chemically synthesized
cacagacagaaatcaatgta

SEQ ID NO: 562408 - DNA, 20 bp, Artificial Sequence
  chemically synthesized
aataactcactgcatttcct

SEQ ID NO: 562409 - DNA, 20 bp, Artificial Sequence
  chemically synthesized
tgccaaatactgaaagcact

SEQ ID NO: 562410 - DNA, 20 bp, Artificial Sequence
  chemically synthesized
caaagtttcccgtcagtgct

SEQ ID NO: 562411 - DNA, 20 bp, Artificial Sequence
  chemically synthesized
attggcacctgattaactct

SEQ ID NO: 562412 - DNA, 20 bp, Artificial Sequence
  chemically synthesized
ttagtcaatcaagatataga

SEQ ID NO: 562413 - DNA, 20 bp, Artificial Sequence
  chemically synthesized
ctaaaaatacaaaaaaaaaa

SEQ ID NO: 562414 - DNA, 20 bp, Artificial Sequence
  chemically synthesized
aaatttggatttttattata

SEQ ID NO: 562415 - DNA, 20 bp, Artificial Sequence
  chemically synthesized
ttcgaaacagaaaattccct

SEQ ID NO: 562416 - DNA, 20 bp, Artificial Sequence
  chemically synthesized
taagggaattttctgtttcg

SEQ ID NO: 562417 - DNA, 20 bp, Artificial Sequence
  chemically synthesized
tacaatttatgaagatgaaa

SEQ ID NO: 562418 - DNA, 20 bp, Artificial Sequence
  chemically synthesized
ttcatgaattgtagcacact

SEQ ID NO: 562419 - DNA, 20 bp, Artificial Sequence
  chemically synthesized
cattttaatgttctctaatc

SEQ ID NO: 562420 - DNA, 20 bp, Artificial Sequence
  chemically synthesized
cagataggcaggttcaaagc

SEQ ID NO: 562421 - DNA, 20 bp, Artificial Sequence
  chemically synthesized
gaatacaatttcctcaactt

SEQ ID NO: 562422 - DNA, 20 bp, Artificial Sequence
  chemically synthesized
tctatgtgttccgccagttc

SEQ ID NO: 562423 - DNA, 20 bp, Artificial Sequence
  chemically synthesized
gcagaaacaaataaacaaac

SEQ ID NO: 562424 - DNA, 20 bp, Artificial Sequence
  chemically synthesized
aaaactcagccagtaagcgg

SEQ ID NO: 562425 - DNA, 20 bp, Artificial Sequence
  chemically synthesized
aagttatgtaaataaattga

SEQ ID NO: 562426 - DNA, 20 bp, Artificial Sequence
  chemically synthesized
agtacctattttacagatga

SEQ ID NO: 562427 - DNA, 20 bp, Artificial Sequence
  chemically synthesized
gccactgttccagaaaaaag

SEQ ID NO: 562428 - DNA, 20 bp, Artificial Sequence
  chemically synthesized
gcaaagtaaagaaaaataat

SEQ ID NO: 562429 - DNA, 20 bp, Artificial Sequence
  chemically synthesized
aatatctaagagaatatgaa

SEQ ID NO: 562430 - DNA, 20 bp, Artificial Sequence
  chemically synthesized
tgatgttttttatatcctgt

SEQ ID NO: 562431 - DNA, 20 bp, Artificial Sequence
  chemically synthesized
gatggttttcacaggatata

SEQ ID NO: 562432 - DNA, 20 bp, Artificial Sequence
  chemically synthesized
acctagctgaggagtcaaac

SEQ ID NO: 562433 - DNA, 20 bp, Artificial Sequence
  chemically synthesized
attgtgtttgaacaacattg

SEQ ID NO: 562434 - DNA, 20 bp, Artificial Sequence
  chemically synthesized
agtaatttgaaaatatgtac

SEQ ID NO: 562435 - DNA, 20 bp, Artificial Sequence
  chemically synthesized
tacacctcagaaaatgcaat

SEQ ID NO: 562436 - DNA, 20 bp, Artificial Sequence
  chemically synthesized
gaaactatacaggaaaaaaa

SEQ ID NO: 562437 - DNA, 20 bp, Artificial Sequence
  chemically synthesized
acaagggtaactgaacaaac

SEQ ID NO: 562438 - DNA, 20 bp, Artificial Sequence
  chemically synthesized
aaaaaaaatcattagcactg

SEQ ID NO: 562439 - DNA, 20 bp, Artificial Sequence
  chemically synthesized
atttaatttagtaaggtata

SEQ ID NO: 562440 - DNA, 20 bp, Artificial Sequence
  chemically synthesized
atttagtaaggtatacaaaa

SEQ ID NO: 562441 - DNA, 20 bp, Artificial Sequence
  chemically synthesized
tctgcaattagtaacttcta

SEQ ID NO: 562442 - DNA, 20 bp, Artificial Sequence
  chemically synthesized
attttgactgaaaagttttg

SEQ ID NO: 562443 - DNA, 20 bp, Artificial Sequence
  chemically synthesized
ggttcatttctcaagtttta

SEQ ID NO: 562444 - DNA, 20 bp, Artificial Sequence
  chemically synthesized
gcgaaaccccgtctctacta

SEQ ID NO: 562445 - DNA, 20 bp, Artificial Sequence
  chemically synthesized
tcaattttatagtaaatgaa

SEQ ID NO: 562446 - DNA, 20 bp, Artificial Sequence
  chemically synthesized
caccccaccaaacaaacaaa

SEQ ID NO: 562447 - DNA, 20 bp, Artificial Sequence
  chemically synthesized
aaaagtcatgaaaagctgaa

SEQ ID NO: 562448 - DNA, 20 bp, Artificial Sequence
  chemically synthesized
gaaaaagcagggtgatctat

SEQ ID NO: 562449 - DNA, 20 bp, Artificial Sequence
  chemically synthesized
gcccaggattctgcaccaat

SEQ ID NO: 562450 - DNA, 20 bp, Artificial Sequence
  chemically synthesized
acaggcatataaggcttgct

SEQ ID NO: 562451 - DNA, 20 bp, Artificial Sequence
  chemically synthesized
tgagacttgcaaaaaataaa

SEQ ID NO: 562452 - DNA, 20 bp, Artificial Sequence
  chemically synthesized
agattcatctagatactaaa

SEQ ID NO: 562453 - DNA, 20 bp, Artificial Sequence
  chemically synthesized
tagatactaaagaaaacatc

SEQ ID NO: 562454 - DNA, 20 bp, Artificial Sequence
  chemically synthesized
acactataatgatttattat

SEQ ID NO: 562455 - DNA, 20 bp, Artificial Sequence
  chemically synthesized
agtgatgtatgaaaaagagg

SEQ ID NO: 562456 - DNA, 20 bp, Artificial Sequence
  chemically synthesized
tggaccccaggatttaatgc

SEQ ID NO: 562457 - DNA, 20 bp, Artificial Sequence
  chemically synthesized
aaatatatatgtaaccagat

SEQ ID NO: 562458 - DNA, 20 bp, Artificial Sequence
  chemically synthesized
gataaaatgttcaggaaaga

SEQ ID NO: 562459 - DNA, 20 bp, Artificial Sequence
  chemically synthesized
agctaaaacaacaacacata

SEQ ID NO: 562460 - DNA, 20 bp, Artificial Sequence
  chemically synthesized
taaaaaacacaaacaacagc

SEQ ID NO: 562461 - DNA, 20 bp, Artificial Sequence
  chemically synthesized
agaaaaatgcagaaagaata

SEQ ID NO: 562462 - DNA, 20 bp, Artificial Sequence
  chemically synthesized
gtcaatgtacagtggtcaac

SEQ ID NO: 562463 - DNA, 20 bp, Artificial Sequence
  chemically synthesized
ttttttgcctactctttaag

SEQ ID NO: 562464 - DNA, 20 bp, Artificial Sequence
  chemically synthesized
agctatagagaaaataaata

SEQ ID NO: 562465 - DNA, 20 bp, Artificial Sequence
  chemically synthesized
agaaaacaaagaagttttga

SEQ ID NO: 562466 - DNA, 20 bp, Artificial Sequence
  chemically synthesized
taaagacagtttggttttgt

SEQ ID NO: 562467 - DNA, 20 bp, Artificial Sequence
  chemically synthesized
tgtctttacttttagattat

SEQ ID NO: 562468 - DNA, 20 bp, Artificial Sequence
  chemically synthesized
cacgttgtgcacatgtaccc

SEQ ID NO: 562469 - DNA, 20 bp, Artificial Sequence
  chemically synthesized
ccccagttaatctaaatctg

SEQ ID NO: 562470 - DNA, 20 bp, Artificial Sequence
  chemically synthesized
ccagaggggctgcaggatgg

SEQ ID NO: 562471 - DNA, 20 bp, Artificial Sequence
  chemically synthesized
gcttgaaatttaccttaaga

SEQ ID NO: 562472 - DNA, 20 bp, Artificial Sequence
  chemically synthesized
ggtaggcacctagagcaggt

SEQ ID NO: 562473 - DNA, 20 bp, Artificial Sequence
  chemically synthesized
ctatcaacatgtagaaataa

SEQ ID NO: 562474 - DNA, 20 bp, Artificial Sequence
  chemically synthesized
gattgagtaaaagaatgaac

SEQ ID NO: 562475 - DNA, 20 bp, Artificial Sequence
  chemically synthesized
ttctctttgacccaaatact

SEQ ID NO: 562476 - DNA, 20 bp, Artificial Sequence
  chemically synthesized
ttggacagtaccttagaaat

SEQ ID NO: 562477 - DNA, 20 bp, Artificial Sequence
  chemically synthesized
ttagaaataaaaacaaaaat

SEQ ID NO: 562478 - DNA, 20 bp, Artificial Sequence
  chemically synthesized
atcattatcattcaaatctt

SEQ ID NO: 562479 - DNA, 20 bp, Artificial Sequence
  chemically synthesized
ttaaatgtttaatctttttt

SEQ ID NO: 562480 - DNA, 20 bp, Artificial Sequence
  chemically synthesized
ttttaaaaacttagccaatg

SEQ ID NO: 562481 - DNA, 20 bp, Artificial Sequence
  chemically synthesized
aatgcaaaactgctttcctc

SEQ ID NO: 562482 - DNA, 20 bp, Artificial Sequence
  chemically synthesized
acaaatcagagatccctatt

SEQ ID NO: 562483 - DNA, 20 bp, Artificial Sequence
  chemically synthesized
aaaaggagagagagagaaag

SEQ ID NO: 562484 - DNA, 20 bp, Artificial Sequence
  chemically synthesized
tgattccaatcattggggat

SEQ ID NO: 562485 - DNA, 20 bp, Artificial Sequence
  chemically synthesized
agaaattaaaatagaaatat

SEQ ID NO: 562486 - DNA, 20 bp, Artificial Sequence
  chemically synthesized
atggtttcagtgctggaaaa

SEQ ID NO: 562487 - DNA, 20 bp, Artificial Sequence
  chemically synthesized
agcactgaaaccattccaaa

SEQ ID NO: 562488 - DNA, 20 bp, Artificial Sequence
  chemically synthesized
tggaaaagtgttaagccatc

SEQ ID NO: 562489 - DNA, 20 bp, Artificial Sequence
  chemically synthesized
gttctcagacccattttcaa

SEQ ID NO: 562490 - DNA, 20 bp, Artificial Sequence
  chemically synthesized
taaagtgtaagtggatttct

SEQ ID NO: 562491 - DNA, 20 bp, Artificial Sequence
  chemically synthesized
aaaagaaatgatatgcaaat

SEQ ID NO: 562492 - DNA, 20 bp, Artificial Sequence
  chemically synthesized
atttgcatatcatttctttt

SEQ ID NO: 562493 - DNA, 20 bp, Artificial Sequence
  chemically synthesized
aaataattacaatcattaag

SEQ ID NO: 562494 - DNA, 20 bp, Artificial Sequence
  chemically synthesized
gactggcctggccaacatgg

SEQ ID NO: 562495 - DNA, 20 bp, Artificial Sequence
  chemically synthesized
aatttcaccttatttgaatg

SEQ ID NO: 562496 - DNA, 20 bp, Artificial Sequence
  chemically synthesized
ctaggaaattttgctctaga

SEQ ID NO: 562497 - DNA, 20 bp, Artificial Sequence
  chemically synthesized
aaattttagattaaacaaag

SEQ ID NO: 562498 - DNA, 20 bp, Artificial Sequence
  chemically synthesized
ttaatatctcaaaaaggaat

SEQ ID NO: 562499 - DNA, 20 bp, Artificial Sequence
  chemically synthesized
tcattctcgtatatatttgg

SEQ ID NO: 562500 - DNA, 20 bp, Artificial Sequence
  chemically synthesized
tcagtgtttctcatatagtt

SEQ ID NO: 562501 - DNA, 20 bp, Artificial Sequence
  chemically synthesized
tttattcaactaactaataa

SEQ ID NO: 562502 - DNA, 20 bp, Artificial Sequence
  chemically synthesized
taacaaaacaggcaacaaat

SEQ ID NO: 562503 - DNA, 20 bp, Artificial Sequence
  chemically synthesized
caagattgctaagttagaaa

SEQ ID NO: 562504 - DNA, 20 bp, Artificial Sequence
  chemically synthesized
cattcaagcttgttaaactc

SEQ ID NO: 562505 - DNA, 20 bp, Artificial Sequence
  chemically synthesized
caaagtggtttgatgtatgt

SEQ ID NO: 562506 - DNA, 20 bp, Artificial Sequence
  chemically synthesized
aaaaaaagaaaagaaagaaa

SEQ ID NO: 562507 - DNA, 20 bp, Artificial Sequence
  chemically synthesized
ttatctgacttacattttag

SEQ ID NO: 562508 - DNA, 20 bp, Artificial Sequence
  chemically synthesized
ttgttataccatcactttca

SEQ ID NO: 562509 - DNA, 20 bp, Artificial Sequence
  chemically synthesized
cttataaacttcctttaaat

SEQ ID NO: 562510 - DNA, 20 bp, Artificial Sequence
  chemically synthesized
gattaattagtgtgacgaag

SEQ ID NO: 562511 - DNA, 20 bp, Artificial Sequence
  chemically synthesized
attgtgtcatcttcccccta

SEQ ID NO: 562512 - DNA, 20 bp, Artificial Sequence
  chemically synthesized
acacaatcgaatatgctttt

SEQ ID NO: 562513 - DNA, 20 bp, Artificial Sequence
  chemically synthesized
aaacattctggctgcatgtg

SEQ ID NO: 562514 - DNA, 20 bp, Artificial Sequence
  chemically synthesized
caggattgttgcagttcccc

SEQ ID NO: 562515 - DNA, 20 bp, Artificial Sequence
  chemically synthesized
gggaactgcaacaatcctgg

SEQ ID NO: 562516 - DNA, 20 bp, Artificial Sequence
  chemically synthesized
aaatcagtatatatgagatc

SEQ ID NO: 562517 - DNA, 20 bp, Artificial Sequence
  chemically synthesized
ataaagttgccctgagacag

SEQ ID NO: 562518 - DNA, 20 bp, Artificial Sequence
  chemically synthesized
tgatcggtccttcctattgg

SEQ ID NO: 562519 - DNA, 20 bp, Artificial Sequence
  chemically synthesized
taacaagtcggtaggagatt

SEQ ID NO: 562520 - DNA, 20 bp, Artificial Sequence
  chemically synthesized
aacccaaatttgtcagacta

SEQ ID NO: 562521 - DNA, 20 bp, Artificial Sequence
  chemically synthesized
actgctttgtttacaaatga

SEQ ID NO: 562522 - DNA, 20 bp, Artificial Sequence
  chemically synthesized
cacatagacagtcacataac

SEQ ID NO: 562523 - DNA, 20 bp, Artificial Sequence
  chemically synthesized
tccagcctgggcaaagagag

SEQ ID NO: 562524 - DNA, 20 bp, Artificial Sequence
  chemically synthesized
gaccagcctggcaaacatgg

SEQ ID NO: 562525 - DNA, 20 bp, Artificial Sequence
  chemically synthesized
tcaaaatcacattatcattt

SEQ ID NO: 562526 - DNA, 20 bp, Artificial Sequence
  chemically synthesized
ttaccatttaattcaaatta

SEQ ID NO: 562527 - DNA, 20 bp, Artificial Sequence
  chemically synthesized
ggagattctacgcatgcata

SEQ ID NO: 562528 - DNA, 20 bp, Artificial Sequence
  chemically synthesized
gtggaatattatatagtaat

SEQ ID NO: 562529 - DNA, 20 bp, Artificial Sequence
  chemically synthesized
acaaaaacaaaaaacaaaca

SEQ ID NO: 562530 - DNA, 20 bp, Artificial Sequence
  chemically synthesized
ttgtctcaaaaacaaaaaca

SEQ ID NO: 562531 - DNA, 20 bp, Artificial Sequence
  chemically synthesized
cgagactttgtctcaaaaac

SEQ ID NO: 562532 - DNA, 20 bp, Artificial Sequence
  chemically synthesized
acagagcgagactttgtctc

SEQ ID NO: 562533 - DNA, 20 bp, Artificial Sequence
  chemically synthesized
ctatgttgcccaggatagtc

SEQ ID NO: 562534 - DNA, 20 bp, Artificial Sequence
  chemically synthesized
aaaagaggacaaagatggta

SEQ ID NO: 562535 - DNA, 20 bp, Artificial Sequence
  chemically synthesized
acaagacgtatatctgatta

SEQ ID NO: 562536 - DNA, 20 bp, Artificial Sequence
  chemically synthesized
actgataaattgagcttcat

SEQ ID NO: 562537 - DNA, 20 bp, Artificial Sequence
  chemically synthesized
cagtacttttgagagagata

SEQ ID NO: 562538 - DNA, 20 bp, Artificial Sequence
  chemically synthesized
tctattctataacatacctt

SEQ ID NO: 562539 - DNA, 20 bp, Artificial Sequence
  chemically synthesized
atggtataaaaagactaact

SEQ ID NO: 562540 - DNA, 20 bp, Artificial Sequence
  chemically synthesized
agtctttttataccatcttt

SEQ ID NO: 562541 - DNA, 20 bp, Artificial Sequence
  chemically synthesized
aggccagatcagtttagcca

SEQ ID NO: 562542 - DNA, 20 bp, Artificial Sequence
  chemically synthesized
gctaaactgatctggcctgc

SEQ ID NO: 562543 - DNA, 20 bp, Artificial Sequence
  chemically synthesized
aaagttatgtatcacttgac

SEQ ID NO: 562544 - DNA, 20 bp, Artificial Sequence
  chemically synthesized
ttaaacaatttttttaacta

SEQ ID NO: 562545 - DNA, 20 bp, Artificial Sequence
  chemically synthesized
atcccgtaagatgttgaatg

SEQ ID NO: 562546 - DNA, 20 bp, Artificial Sequence
  chemically synthesized
acacctgcagtataacagat

SEQ ID NO: 562547 - DNA, 20 bp, Artificial Sequence
  chemically synthesized
tccttcctcctaaccactgc

SEQ ID NO: 562548 - DNA, 20 bp, Artificial Sequence
  chemically synthesized
tgatttgtagtaaacaggta

SEQ ID NO: 562549 - DNA, 20 bp, Artificial Sequence
  chemically synthesized
ttccaggtgtcccttttact

SEQ ID NO: 562550 - DNA, 20 bp, Artificial Sequence
  chemically synthesized
aaagatgattattcatcttg

SEQ ID NO: 562551 - DNA, 20 bp, Artificial Sequence
  chemically synthesized
aaataaatagataaataaat

SEQ ID NO: 562552 - DNA, 20 bp, Artificial Sequence
  chemically synthesized
cccatctctactaaaaatac

SEQ ID NO: 562553 - DNA, 20 bp, Artificial Sequence
  chemically synthesized
gcttcatatttagtattata

SEQ ID NO: 562554 - DNA, 20 bp, Artificial Sequence
  chemically synthesized
tctgtttcaaataagagttt

SEQ ID NO: 562555 - DNA, 20 bp, Artificial Sequence
  chemically synthesized
gtacagtaataataattttt

SEQ ID NO: 562556 - DNA, 20 bp, Artificial Sequence
  chemically synthesized
gaacaggaatcaaattataa

SEQ ID NO: 562557 - DNA, 20 bp, Artificial Sequence
  chemically synthesized
gagggtaaggctcgagttat

SEQ ID NO: 562558 - DNA, 20 bp, Artificial Sequence
  chemically synthesized
tctgtacatcagccggggag

SEQ ID NO: 562559 - DNA, 20 bp, Artificial Sequence
  chemically synthesized
gcaactttctaaaaggaaaa

SEQ ID NO: 562560 - DNA, 20 bp, Artificial Sequence
  chemically synthesized
ctctcttttgtttcatccaa

SEQ ID NO: 562561 - DNA, 20 bp, Artificial Sequence
  chemically synthesized
gaccagtctggccaacatgg

SEQ ID NO: 562562 - DNA, 20 bp, Artificial Sequence
  chemically synthesized
ggcaaaaccccatctctact

SEQ ID NO: 562563 - DNA, 20 bp, Artificial Sequence
  chemically synthesized
ttgcctcatcatctcttttg

SEQ ID NO: 562564 - DNA, 20 bp, Artificial Sequence
  chemically synthesized
attccaagtctatttacaag

SEQ ID NO: 562565 - DNA, 20 bp, Artificial Sequence
  chemically synthesized
aaggacatttttgtatcact

SEQ ID NO: 562566 - DNA, 20 bp, Artificial Sequence
  chemically synthesized
acaactgtgtgtttagacaa

SEQ ID NO: 562567 - DNA, 20 bp, Artificial Sequence
  chemically synthesized
gaaggatttgcctcaaatat

SEQ ID NO: 562568 - DNA, 20 bp, Artificial Sequence
  chemically synthesized
ccaaaggatttaaaaaaaaa

SEQ ID NO: 562569 - DNA, 20 bp, Artificial Sequence
  chemically synthesized
aaaaaaaaaaaaaaccacct

SEQ ID NO: 562570 - DNA, 20 bp, Artificial Sequence
  chemically synthesized
atcacttgaggtcaggagtt

SEQ ID NO: 562571 - DNA, 20 bp, Artificial Sequence
  chemically synthesized
ccactgcactccagcctgga

SEQ ID NO: 562572 - DNA, 20 bp, Artificial Sequence
  chemically synthesized
ttaatatcatgaaaacctgg

SEQ ID NO: 562573 - DNA, 20 bp, Artificial Sequence
  chemically synthesized
atcgttggtgttaatatcat

SEQ ID NO: 562574 - DNA, 20 bp, Artificial Sequence
  chemically synthesized
ttggatttctcccattgaga

SEQ ID NO: 562575 - DNA, 20 bp, Artificial Sequence
  chemically synthesized
gccccctaaagaatgaaatg

SEQ ID NO: 562576 - DNA, 20 bp, Artificial Sequence
  chemically synthesized
gaacatgtatgaaagagaca

SEQ ID NO: 562577 - DNA, 20 bp, Artificial Sequence
  chemically synthesized
tgttatccgtacacactctg

SEQ ID NO: 562578 - DNA, 20 bp, Artificial Sequence
  chemically synthesized
tacaatttcgagaaagaatt

SEQ ID NO: 562579 - DNA, 20 bp, Artificial Sequence
  chemically synthesized
ggtaataactgtatatctaa

SEQ ID NO: 562580 - DNA, 20 bp, Artificial Sequence
  chemically synthesized
gttatcactggatatggtag

SEQ ID NO: 562581 - DNA, 20 bp, Artificial Sequence
  chemically synthesized
aagactattattaagtacaa

SEQ ID NO: 562582 - DNA, 20 bp, Artificial Sequence
  chemically synthesized
attattttatgtaaactaat

SEQ ID NO: 562583 - DNA, 20 bp, Artificial Sequence
  chemically synthesized
tgaacttgttgaaggagatg

SEQ ID NO: 562584 - DNA, 20 bp, Artificial Sequence
  chemically synthesized
aaccagaattcatatacaca

SEQ ID NO: 562585 - DNA, 20 bp, Artificial Sequence
  chemically synthesized
gtttcctgagttccttcaag

SEQ ID NO: 562586 - DNA, 20 bp, Artificial Sequence
  chemically synthesized
cgaagtccatttcttagcag

SEQ ID NO: 562587 - DNA, 20 bp, Artificial Sequence
  chemically synthesized
ccataatacttagcccagag

SEQ ID NO: 562588 - DNA, 20 bp, Artificial Sequence
  chemically synthesized
ttatggttaaggaatccaag

SEQ ID NO: 562589 - DNA, 20 bp, Artificial Sequence
  chemically synthesized
caggcaatatttacttaaaa

SEQ ID NO: 562590 - DNA, 20 bp, Artificial Sequence
  chemically synthesized
cagagttcttgtttcataag

SEQ ID NO: 562591 - DNA, 20 bp, Artificial Sequence
  chemically synthesized
cttttttcaagcgggagaat

SEQ ID NO: 562592 - DNA, 20 bp, Artificial Sequence
  chemically synthesized
atgacttgaggccaggagtt

SEQ ID NO: 562593 - DNA, 20 bp, Artificial Sequence
  chemically synthesized
aattcatttaatggcgtaag

SEQ ID NO: 562594 - DNA, 20 bp, Artificial Sequence
  chemically synthesized
taagagtgaaactctgtttc

SEQ ID NO: 562595 - DNA, 20 bp, Artificial Sequence
  chemically synthesized
gaaactctgtttcaaaaacc

SEQ ID NO: 562596 - DNA, 20 bp, Artificial Sequence
  chemically synthesized
ttattaccatcaatgttttt

SEQ ID NO: 562597 - DNA, 20 bp, Artificial Sequence
  chemically synthesized
aattatgctgcccagttttc

SEQ ID NO: 562598 - DNA, 20 bp, Artificial Sequence
  chemically synthesized
ggacctcctgatttactgac

SEQ ID NO: 562599 - DNA, 20 bp, Artificial Sequence
  chemically synthesized
gaaagattatgtatatcagt

SEQ ID NO: 562600 - DNA, 20 bp, Artificial Sequence
  chemically synthesized
catattaaaccaccttgcac

SEQ ID NO: 562601 - DNA, 20 bp, Artificial Sequence
  chemically synthesized
gagagggacatgtttaattg

SEQ ID NO: 562602 - DNA, 20 bp, Artificial Sequence
  chemically synthesized
ggtgaaaccccgtctctact

SEQ ID NO: 562603 - DNA, 20 bp, Artificial Sequence
  chemically synthesized
tccatcctggacaacgagag

SEQ ID NO: 562604 - DNA, 20 bp, Artificial Sequence
  chemically synthesized
tcaataggtagacaagattg

SEQ ID NO: 562605 - DNA, 20 bp, Artificial Sequence
  chemically synthesized
aaaaaatatagtgttaaaag

SEQ ID NO: 562606 - DNA, 20 bp, Artificial Sequence
  chemically synthesized
aaatgacaatagcccttccc

SEQ ID NO: 562607 - DNA, 20 bp, Artificial Sequence
  chemically synthesized
cctttccccaaaccgatctt

SEQ ID NO: 562608 - DNA, 20 bp, Artificial Sequence
  chemically synthesized
gagactgatttgagtaatag

SEQ ID NO: 562609 - DNA, 20 bp, Artificial Sequence
  chemically synthesized
agctggtggctgtacatgta

SEQ ID NO: 562610 - DNA, 20 bp, Artificial Sequence
  chemically synthesized
taattcatttgctgttgcta

SEQ ID NO: 562611 - DNA, 20 bp, Artificial Sequence
  chemically synthesized
gtaagacaaagcttcaatgc

SEQ ID NO: 562612 - DNA, 20 bp, Artificial Sequence
  chemically synthesized
ttagtttatagcttatggtt

SEQ ID NO: 562613 - DNA, 20 bp, Artificial Sequence
  chemically synthesized
aggcaatgacaacccttccc

SEQ ID NO: 562614 - DNA, 20 bp, Artificial Sequence
  chemically synthesized
tccatcgagtgcagggtctg

SEQ ID NO: 562615 - DNA, 20 bp, Artificial Sequence
  chemically synthesized
ccacccaccaaattgtcctt

SEQ ID NO: 562616 - DNA, 20 bp, Artificial Sequence
  chemically synthesized
gagactgatttgagtaataa

SEQ ID NO: 562617 - DNA, 20 bp, Artificial Sequence
  chemically synthesized
ggatatgggactttaaattt

SEQ ID NO: 562618 - DNA, 20 bp, Artificial Sequence
  chemically synthesized
ttaaaactgagaaattcctg

SEQ ID NO: 562619 - DNA, 20 bp, Artificial Sequence
  chemically synthesized
ctgagaaattcctgaaaaac

SEQ ID NO: 562620 - DNA, 20 bp, Artificial Sequence
  chemically synthesized
aaaacaaaaacaaacaaaaa

SEQ ID NO: 562621 - DNA, 20 bp, Artificial Sequence
  chemically synthesized
aaatgaaagctttactaggt

SEQ ID NO: 562622 - DNA, 20 bp, Artificial Sequence
  chemically synthesized
gagactgatttgagtaataa

SEQ ID NO: 562623 - DNA, 20 bp, Artificial Sequence
  chemically synthesized
ccacccaccaagttatcctt

SEQ ID NO: 562624 - DNA, 20 bp, Artificial Sequence
  chemically synthesized
aaaattaggtctgagacagt

SEQ ID NO: 562625 - DNA, 20 bp, Artificial Sequence
  chemically synthesized
accttagggttaaagtgtta

SEQ ID NO: 562626 - DNA, 20 bp, Artificial Sequence
  chemically synthesized
tattcacataaacactgtag

SEQ ID NO: 562627 - DNA, 20 bp, Artificial Sequence
  chemically synthesized
gttcagtccccatttttatt

SEQ ID NO: 562628 - DNA, 20 bp, Artificial Sequence
  chemically synthesized
aatggtgtcctgttacaaaa

SEQ ID NO: 562629 - DNA, 20 bp, Artificial Sequence
  chemically synthesized
aaataagttatgttgactct

SEQ ID NO: 562630 - DNA, 20 bp, Artificial Sequence
  chemically synthesized
atgctcttggaatagaggga

SEQ ID NO: 562631 - DNA, 20 bp, Artificial Sequence
  chemically synthesized
ttatacaaatacagtccaaa

SEQ ID NO: 562632 - DNA, 20 bp, Artificial Sequence
  chemically synthesized
ttgtgacgttagaatagaag

SEQ ID NO: 562633 - DNA, 20 bp, Artificial Sequence
  chemically synthesized
ttacattttacagctggtat

SEQ ID NO: 562634 - DNA, 20 bp, Artificial Sequence
  chemically synthesized
gagccaccatgcccggccta

SEQ ID NO: 562635 - DNA, 20 bp, Artificial Sequence
  chemically synthesized
acatatgttctgagattatg

SEQ ID NO: 562636 - DNA, 20 bp, Artificial Sequence
  chemically synthesized
tttgccaaatatcaaaggtt

SEQ ID NO: 562637 - DNA, 20 bp, Artificial Sequence
  chemically synthesized
ccataagtcattcatttgac

SEQ ID NO: 562638 - DNA, 20 bp, Artificial Sequence
  chemically synthesized
taactccaaaatcttaaaag

SEQ ID NO: 562639 - DNA, 20 bp, Artificial Sequence
  chemically synthesized
aaaaaatcgtcttcaaaaga

SEQ ID NO: 562640 - DNA, 20 bp, Artificial Sequence
  chemically synthesized
agatacataaaattttattt

SEQ ID NO: 562641 - DNA, 20 bp, Artificial Sequence
  chemically synthesized
caccttgtggtcaaactaat

SEQ ID NO: 562642 - DNA, 20 bp, Artificial Sequence
  chemically synthesized
ttttagtttaagacagtctt

SEQ ID NO: 562643 - DNA, 20 bp, Artificial Sequence
  chemically synthesized
atgccttattatctttcacc

SEQ ID NO: 562644 - DNA, 20 bp, Artificial Sequence
  chemically synthesized
ttccctacacaccttgtatg

SEQ ID NO: 562645 - DNA, 20 bp, Artificial Sequence
  chemically synthesized
agcaactttgatttttagtg

SEQ ID NO: 562646 - DNA, 20 bp, Artificial Sequence
  chemically synthesized
acacacacacacacacacac

SEQ ID NO: 562647 - DNA, 20 bp, Artificial Sequence
  chemically synthesized
gaagtaatttctgatatccc

SEQ ID NO: 562648 - DNA, 20 bp, Artificial Sequence
  chemically synthesized
tttctgatatccccaaaact

SEQ ID NO: 562649 - DNA, 20 bp, Artificial Sequence
  chemically synthesized
aaccatcagataacacaatg

SEQ ID NO: 562650 - DNA, 20 bp, Artificial Sequence
  chemically synthesized
cacatgaaaccccaggaatt

SEQ ID NO: 562651 - DNA, 20 bp, Artificial Sequence
  chemically synthesized
aattcctggggtttcatgtg

SEQ ID NO: 562652 - DNA, 20 bp, Artificial Sequence
  chemically synthesized
ccgttttagggaaaaaaaaa

SEQ ID NO: 562653 - DNA, 20 bp, Artificial Sequence
  chemically synthesized
cagttttttttttttttccc

SEQ ID NO: 562654 - DNA, 20 bp, Artificial Sequence
  chemically synthesized
gtagcctgggactcattggg

SEQ ID NO: 562655 - DNA, 20 bp, Artificial Sequence
  chemically synthesized
aattcagtcggctgagaaga

SEQ ID NO: 562656 - DNA, 20 bp, Artificial Sequence
  chemically synthesized
gaagaaaaaactttttccaa

SEQ ID NO: 562657 - DNA, 20 bp, Artificial Sequence
  chemically synthesized
aaaacaagttccaagaagag

SEQ ID NO: 562658 - DNA, 20 bp, Artificial Sequence
  chemically synthesized
aggttaagctcttaaggaca

SEQ ID NO: 562659 - DNA, 20 bp, Artificial Sequence
  chemically synthesized
acccagcaaaatacacataa

SEQ ID NO: 562660 - DNA, 20 bp, Artificial Sequence
  chemically synthesized
actcaccaatccagacaccc

SEQ ID NO: 562661 - DNA, 20 bp, Artificial Sequence
  chemically synthesized
tttgctgatttgagtaataa

SEQ ID NO: 562662 - DNA, 20 bp, Artificial Sequence
  chemically synthesized
cgacccaccaagttatcctt

SEQ ID NO: 562663 - DNA, 20 bp, Artificial Sequence
  chemically synthesized
taattttgcagtggtggttt

SEQ ID NO: 562664 - DNA, 20 bp, Artificial Sequence
  chemically synthesized
ctccaacatttgagctacaa

SEQ ID NO: 562665 - DNA, 20 bp, Artificial Sequence
  chemically synthesized
gataggctttcagaattgta

SEQ ID NO: 562666 - DNA, 20 bp, Artificial Sequence
  chemically synthesized
tgaaaaatggaatatggcct

SEQ ID NO: 562667 - DNA, 20 bp, Artificial Sequence
  chemically synthesized
tacaccatacttgttcctag

SEQ ID NO: 562668 - DNA, 20 bp, Artificial Sequence
  chemically synthesized
tttcaaatggcacgcaatat

SEQ ID NO: 562669 - DNA, 20 bp, Artificial Sequence
  chemically synthesized
tgtttcattaatcaagaatt

SEQ ID NO: 562670 - DNA, 20 bp, Artificial Sequence
  chemically synthesized
aattcgcatagaaacaacca

SEQ ID NO: 562671 - DNA, 20 bp, Artificial Sequence
  chemically synthesized
gttttctaacttaatatttg

SEQ ID NO: 562672 - DNA, 20 bp, Artificial Sequence
  chemically synthesized
gttttgcaaatattaagtta

SEQ ID NO: 562673 - DNA, 20 bp, Artificial Sequence
  chemically synthesized
ttgatcttatgccatgatgt

SEQ ID NO: 562674 - DNA, 20 bp, Artificial Sequence
  chemically synthesized
atacttttttgtgataagtc

SEQ ID NO: 562675 - DNA, 20 bp, Artificial Sequence
  chemically synthesized
atatatataaacatatatat

SEQ ID NO: 562676 - DNA, 20 bp, Artificial Sequence
  chemically synthesized
gctaaaatatattggacaaa

SEQ ID NO: 562677 - DNA, 20 bp, Artificial Sequence
  chemically synthesized
tcacacagctatcacatggc

SEQ ID NO: 562678 - DNA, 20 bp, Artificial Sequence
  chemically synthesized
gcctcccagtaaaataaaga

SEQ ID NO: 562679 - DNA, 20 bp, Artificial Sequence
  chemically synthesized
tatttttataattctgatat

SEQ ID NO: 562680 - DNA, 20 bp, Artificial Sequence
  chemically synthesized
agtgagacaccatctcaaaa

SEQ ID NO: 562681 - DNA, 20 bp, Artificial Sequence
  chemically synthesized
tttaaaaaagttatgaatta

SEQ ID NO: 562682 - DNA, 20 bp, Artificial Sequence
  chemically synthesized
atatttaagtatgtatctat

SEQ ID NO: 562683 - DNA, 20 bp, Artificial Sequence
  chemically synthesized
caccatattcatgtctccat

SEQ ID NO: 562684 - DNA, 20 bp, Artificial Sequence
  chemically synthesized
aatggatcggacactataaa

SEQ ID NO: 562685 - DNA, 20 bp, Artificial Sequence
  chemically synthesized
caaaataataggagaatcag

SEQ ID NO: 562686 - DNA, 20 bp, Artificial Sequence
  chemically synthesized
ttctatgagagaatgttaaa

SEQ ID NO: 562687 - DNA, 20 bp, Artificial Sequence
  chemically synthesized
agctggaaataaaaagtaga

SEQ ID NO: 562688 - DNA, 20 bp, Artificial Sequence
  chemically synthesized
tcactgggggcttgaaggga

SEQ ID NO: 562689 - DNA, 20 bp, Artificial Sequence
  chemically synthesized
aaatgtaaagggtgaaccaa

SEQ ID NO: 562690 - DNA, 20 bp, Artificial Sequence
  chemically synthesized
aatggatcggacactataaa

SEQ ID NO: 562691 - DNA, 20 bp, Artificial Sequence
  chemically synthesized
attataaagcacaactttta

SEQ ID NO: 562692 - DNA, 20 bp, Artificial Sequence
  chemically synthesized
ctattttctttaggttttgc

SEQ ID NO: 562693 - DNA, 20 bp, Artificial Sequence
  chemically synthesized
tatttggtagtaagttttag

SEQ ID NO: 562694 - DNA, 20 bp, Artificial Sequence
  chemically synthesized
tgggacccctagaagccaaa

SEQ ID NO: 562695 - DNA, 20 bp, Artificial Sequence
  chemically synthesized
acagtaacaagacaaaaact

SEQ ID NO: 562696 - DNA, 20 bp, Artificial Sequence
  chemically synthesized
aaacaaaacagtaacaagac

SEQ ID NO: 562697 - DNA, 20 bp, Artificial Sequence
  chemically synthesized
gctggagtatgatgagaaaa

SEQ ID NO: 562698 - DNA, 20 bp, Artificial Sequence
  chemically synthesized
tagttgctggagtatgatga

SEQ ID NO: 562699 - DNA, 20 bp, Artificial Sequence
  chemically synthesized
cactcattcaaattttaatt

SEQ ID NO: 562700 - DNA, 20 bp, Artificial Sequence
  chemically synthesized
taaaatttgaatgagtgaac

SEQ ID NO: 562701 - DNA, 20 bp, Artificial Sequence
  chemically synthesized
cattgtgaaagacagtaagc

SEQ ID NO: 562702 - DNA, 20 bp, Artificial Sequence
  chemically synthesized
caaaacatgttacaattgag

SEQ ID NO: 562703 - DNA, 20 bp, Artificial Sequence
  chemically synthesized
ctgttttacaccgtttcaat

SEQ ID NO: 562704 - DNA, 20 bp, Artificial Sequence
  chemically synthesized
atgttttgattgaaacggtg

SEQ ID NO: 562705 - DNA, 20 bp, Artificial Sequence
  chemically synthesized
tatataatataatcaaatct

SEQ ID NO: 562706 - DNA, 20 bp, Artificial Sequence
  chemically synthesized
aagattgtactgcagaaaaa

SEQ ID NO: 562707 - DNA, 20 bp, Artificial Sequence
  chemically synthesized
tttttattactctttattac

SEQ ID NO: 562708 - DNA, 20 bp, Artificial Sequence
  chemically synthesized
aaatgtagtttattgatctt

SEQ ID NO: 562709 - DNA, 20 bp, Artificial Sequence
  chemically synthesized
tttgcttttgtttaaatatt

SEQ ID NO: 562710 - DNA, 20 bp, Artificial Sequence
  chemically synthesized
gtacaattcactcaacatat

SEQ ID NO: 562711 - DNA, 20 bp, Artificial Sequence
  chemically synthesized
aaattgttctgcttgtctga

SEQ ID NO: 562712 - DNA, 20 bp, Artificial Sequence
  chemically synthesized
ctcctttgaatataagaaga

SEQ ID NO: 562713 - DNA, 20 bp, Artificial Sequence
  chemically synthesized
atgcattttgagatggctta

SEQ ID NO: 562714 - DNA, 20 bp, Artificial Sequence
  chemically synthesized
tccagcctgggtgacaagag

SEQ ID NO: 562715 - DNA, 20 bp, Artificial Sequence
  chemically synthesized
tataattttgattctgctgg

SEQ ID NO: 562716 - DNA, 20 bp, Artificial Sequence
  chemically synthesized
gagaatgagctggatctgaa

SEQ ID NO: 562717 - DNA, 20 bp, Artificial Sequence
  chemically synthesized
tattttttaagaatcccttt

SEQ ID NO: 562718 - DNA, 20 bp, Artificial Sequence
  chemically synthesized
gtcttctaacgatgtgtgtc

SEQ ID NO: 562719 - DNA, 20 bp, Artificial Sequence
  chemically synthesized
catcccagtttagcggaaga

SEQ ID NO: 562720 - DNA, 20 bp, Artificial Sequence
  chemically synthesized
taatagctttttaaatatca

SEQ ID NO: 562721 - DNA, 20 bp, Artificial Sequence
  chemically synthesized
tgttcggtgtactctcgtgg

SEQ ID NO: 562722 - DNA, 20 bp, Artificial Sequence
  chemically synthesized
agttacttgctgagaaaggt

SEQ ID NO: 562723 - DNA, 20 bp, Artificial Sequence
  chemically synthesized
tatctatcagagatcagcaa

SEQ ID NO: 562724 - DNA, 20 bp, Artificial Sequence
  chemically synthesized
ttcatcttgcccattaaagg

SEQ ID NO: 562725 - DNA, 20 bp, Artificial Sequence
  chemically synthesized
tccatttgaagaaataatta

SEQ ID NO: 562726 - DNA, 20 bp, Artificial Sequence
  chemically synthesized
gtcgatttttcttggctgta

SEQ ID NO: 562727 - DNA, 20 bp, Artificial Sequence
  chemically synthesized
gatgtcaactagagaacaaa

SEQ ID NO: 562728 - DNA, 20 bp, Artificial Sequence
  chemically synthesized
actcagtatcagttctacag

SEQ ID NO: 562729 - DNA, 20 bp, Artificial Sequence
  chemically synthesized
tggtgtctaactttgcattg

SEQ ID NO: 562730 - DNA, 20 bp, Artificial Sequence
  chemically synthesized
gagggaaagccacccacagc

SEQ ID NO: 562731 - DNA, 20 bp, Artificial Sequence
  chemically synthesized
aaattttaaaagtataattt

SEQ ID NO: 562732 - DNA, 20 bp, Artificial Sequence
  chemically synthesized
tctagcctgggtgacaagag

SEQ ID NO: 562733 - DNA, 20 bp, Artificial Sequence
  chemically synthesized
aagagcaaaactccgtctca

SEQ ID NO: 562734 - DNA, 20 bp, Artificial Sequence
  chemically synthesized
aaactccgtctcaaaaaaca

SEQ ID NO: 562735 - DNA, 20 bp, Artificial Sequence
  chemically synthesized
aaaaacaaaaaacaaaaaat

SEQ ID NO: 562736 - DNA, 20 bp, Artificial Sequence
  chemically synthesized
atttaactaaattataattg

SEQ ID NO: 562737 - DNA, 20 bp, Artificial Sequence
  chemically synthesized
aatgcatttttatttatatg

SEQ ID NO: 562738 - DNA, 20 bp, Artificial Sequence
  chemically synthesized
cttaaatttagatctgatcc

SEQ ID NO: 562739 - DNA, 20 bp, Artificial Sequence
  chemically synthesized
aagaagaaaaaaaaagaaag

SEQ ID NO: 562740 - DNA, 20 bp, Artificial Sequence
  chemically synthesized
tcaaattctttctcctttga

SEQ ID NO: 562741 - DNA, 20 bp, Artificial Sequence
  chemically synthesized
aatcatttggaataaacatt

SEQ ID NO: 562742 - DNA, 20 bp, Artificial Sequence
  chemically synthesized
aacaacaaacctgaaataaa

SEQ ID NO: 562743 - DNA, 20 bp, Artificial Sequence
  chemically synthesized
taaaaaaaaaaaaaaacaaa

SEQ ID NO: 562744 - DNA, 20 bp, Artificial Sequence
  chemically synthesized
tggaatacttaaaaaaaaaa

SEQ ID NO: 562745 - DNA, 20 bp, Artificial Sequence
  chemically synthesized
ttttttaagtattccacttt

SEQ ID NO: 562746 - DNA, 20 bp, Artificial Sequence
  chemically synthesized
taacactgtcttttttaaaa

SEQ ID NO: 562747 - DNA, 20 bp, Artificial Sequence
  chemically synthesized
gaacgcttttcattggcaag

SEQ ID NO: 562748 - DNA, 20 bp, Artificial Sequence
  chemically synthesized
ctttacctaccgaaagctta

SEQ ID NO: 562749 - DNA, 20 bp, Artificial Sequence
  chemically synthesized
ttagaatttgtaaaatatga

SEQ ID NO: 562750 - DNA, 20 bp, Artificial Sequence
  chemically synthesized
aacacactacattattattt

SEQ ID NO: 562751 - DNA, 20 bp, Artificial Sequence
  chemically synthesized
ctttatctacccaaatccta

SEQ ID NO: 562752 - DNA, 20 bp, Artificial Sequence
  chemically synthesized
tttattctcaaagacaatgt

SEQ ID NO: 562753 - DNA, 20 bp, Artificial Sequence
  chemically synthesized
tagttccaattgcaacattt

SEQ ID NO: 562754 - DNA, 20 bp, Artificial Sequence
  chemically synthesized
cagaagtgaagccaaatact

SEQ ID NO: 562755 - DNA, 20 bp, Artificial Sequence
  chemically synthesized
ttaccttcaacaaagcatac

SEQ ID NO: 562756 - DNA, 20 bp, Artificial Sequence
  chemically synthesized
aagtctaagacctgaaacca

SEQ ID NO: 562757 - DNA, 20 bp, Artificial Sequence
  chemically synthesized
aaaccataaaactcctcaaa

SEQ ID NO: 562758 - DNA, 20 bp, Artificial Sequence
  chemically synthesized
ctcctcaaagaaaacctagg

SEQ ID NO: 562759 - DNA, 20 bp, Artificial Sequence
  chemically synthesized
aataaccatcaacgtaaaca

SEQ ID NO: 562760 - DNA, 20 bp, Artificial Sequence
  chemically synthesized
ctcaagcaaatcagcaagaa

SEQ ID NO: 562761 - DNA, 20 bp, Artificial Sequence
  chemically synthesized
atcatcaggggaatgcaaat

SEQ ID NO: 562762 - DNA, 20 bp, Artificial Sequence
  chemically synthesized
tggccattattaaaaagtca

SEQ ID NO: 562763 - DNA, 20 bp, Artificial Sequence
  chemically synthesized
tgtaaattaatacctctctg

SEQ ID NO: 562764 - DNA, 20 bp, Artificial Sequence
  chemically synthesized
gggggtgggaatgagggata

SEQ ID NO: 562765 - DNA, 20 bp, Artificial Sequence
  chemically synthesized
tacaattcatacacgtaagc

SEQ ID NO: 562766 - DNA, 20 bp, Artificial Sequence
  chemically synthesized
tactagtaatcatgtaaagc

SEQ ID NO: 562767 - DNA, 20 bp, Artificial Sequence
  chemically synthesized
ttgaagacagtggatgtgtt

SEQ ID NO: 562768 - DNA, 20 bp, Artificial Sequence
  chemically synthesized
gctgaagacataaccatatc

SEQ ID NO: 562769 - DNA, 20 bp, Artificial Sequence
  chemically synthesized
gccacttgcttctgtaaatg

SEQ ID NO: 562770 - DNA, 20 bp, Artificial Sequence
  chemically synthesized
tgacatctacctgactacca

SEQ ID NO: 562771 - DNA, 20 bp, Artificial Sequence
  chemically synthesized
ccccccccaacacacacaaa

SEQ ID NO: 562772 - DNA, 20 bp, Artificial Sequence
  chemically synthesized
aaaaaacagcaacaacaaca

SEQ ID NO: 562773 - DNA, 20 bp, Artificial Sequence
  chemically synthesized
tttccatggtaatgattatt

SEQ ID NO: 562774 - DNA, 20 bp, Artificial Sequence
  chemically synthesized
atatattgttttactaacaa

SEQ ID NO: 562775 - DNA, 20 bp, Artificial Sequence
  chemically synthesized
aacattagttttattgttag

SEQ ID NO: 562776 - DNA, 20 bp, Artificial Sequence
  chemically synthesized
atgtaaagtagaactgaaaa

SEQ ID NO: 562777 - DNA, 20 bp, Artificial Sequence
  chemically synthesized
cagagggatacttcgtctca

SEQ ID NO: 562778 - DNA, 20 bp, Artificial Sequence
  chemically synthesized
aacctaagtctgttcaattt

SEQ ID NO: 562779 - DNA, 20 bp, Artificial Sequence
  chemically synthesized
aaacagttatctctaatttt

SEQ ID NO: 562780 - DNA, 20 bp, Artificial Sequence
  chemically synthesized
gtcttaatctagaacagttt

SEQ ID NO: 562781 - DNA, 20 bp, Artificial Sequence
  chemically synthesized
ttataatgaagttcatccag

SEQ ID NO: 562782 - DNA, 20 bp, Artificial Sequence
  chemically synthesized
caagtgactgatcgttgtct

SEQ ID NO: 562783 - DNA, 20 bp, Artificial Sequence
  chemically synthesized
catctacctgtaaggggaaa

SEQ ID NO: 562784 - DNA, 20 bp, Artificial Sequence
  chemically synthesized
ttgtttgaaataatgagatt

SEQ ID NO: 562785 - DNA, 20 bp, Artificial Sequence
  chemically synthesized
tctactcactaatgattaat

SEQ ID NO: 562786 - DNA, 20 bp, Artificial Sequence
  chemically synthesized
aatcttgcacattgacaaat

SEQ ID NO: 562787 - DNA, 20 bp, Artificial Sequence
  chemically synthesized
acaaacaaagaaacaaacaa

SEQ ID NO: 562788 - DNA, 20 bp, Artificial Sequence
  chemically synthesized
agttttcattttgcacattt

SEQ ID NO: 562789 - DNA, 20 bp, Artificial Sequence
  chemically synthesized
tgttttcaaatgtgcaaaat

SEQ ID NO: 562790 - DNA, 20 bp, Artificial Sequence
  chemically synthesized
atgaaaactaaaagcatata

SEQ ID NO: 562791 - DNA, 20 bp, Artificial Sequence
  chemically synthesized
atatgatttttcaagatatc

SEQ ID NO: 562792 - DNA, 20 bp, Artificial Sequence
  chemically synthesized
agacacaaagatgaacaaat

SEQ ID NO: 562793 - DNA, 20 bp, Artificial Sequence
  chemically synthesized
cattaaaattaataatttta

SEQ ID NO: 562794 - DNA, 20 bp, Artificial Sequence
  chemically synthesized
tattaagtaatgaaggtgag

SEQ ID NO: 562795 - DNA, 20 bp, Artificial Sequence
  chemically synthesized
accaaatattatgctaaaaa

SEQ ID NO: 562796 - DNA, 20 bp, Artificial Sequence
  chemically synthesized
taatcaaattagagaataaa

SEQ ID NO: 562797 - DNA, 20 bp, Artificial Sequence
  chemically synthesized
gaaacttcgtctcaaaaaag

SEQ ID NO: 562798 - DNA, 20 bp, Artificial Sequence
  chemically synthesized
ggttgttggaattatgtcat

SEQ ID NO: 562799 - DNA, 20 bp, Artificial Sequence
  chemically synthesized
tgcagttgatcatgggtaac

SEQ ID NO: 562800 - DNA, 20 bp, Artificial Sequence
  chemically synthesized
aactctaaaatttttacatc

SEQ ID NO: 562801 - DNA, 20 bp, Artificial Sequence
  chemically synthesized
ccagattgaggatattagag

SEQ ID NO: 562802 - DNA, 20 bp, Artificial Sequence
  chemically synthesized
agaaatgtgtaggtaaaagt

SEQ ID NO: 562803 - DNA, 20 bp, Artificial Sequence
  chemically synthesized
agtgctcattattttgaaga

SEQ ID NO: 562804 - DNA, 20 bp, Artificial Sequence
  chemically synthesized
caaacaacaagagcgtaatg

SEQ ID NO: 562805 - DNA, 20 bp, Artificial Sequence
  chemically synthesized
gtaatgaaaaacgatagaag

SEQ ID NO: 562806 - DNA, 20 bp, Artificial Sequence
  chemically synthesized
aatgtagaagttattattat

SEQ ID NO: 562807 - DNA, 20 bp, Artificial Sequence
  chemically synthesized
tttcagttaggatgagcatt

SEQ ID NO: 562808 - DNA, 20 bp, Artificial Sequence
  chemically synthesized
ttatccccttgtctatggta

SEQ ID NO: 562809 - DNA, 20 bp, Artificial Sequence
  chemically synthesized
gccactgcgcccggccaaaa

SEQ ID NO: 562810 - DNA, 20 bp, Artificial Sequence
  chemically synthesized
gtattacttatacaatattt

SEQ ID NO: 562811 - DNA, 20 bp, Artificial Sequence
  chemically synthesized
catttttgaatcattgttta

SEQ ID NO: 562812 - DNA, 20 bp, Artificial Sequence
  chemically synthesized
agagtgaaacccagtctcaa

SEQ ID NO: 562813 - DNA, 20 bp, Artificial Sequence
  chemically synthesized
aaacccagtctcaaaaaaac

SEQ ID NO: 562814 - DNA, 20 bp, Artificial Sequence
  chemically synthesized
aaaaaaccaaaacaacgaca

SEQ ID NO: 562815 - DNA, 20 bp, Artificial Sequence
  chemically synthesized
gatcagcctgagtgataagg

SEQ ID NO: 562816 - DNA, 20 bp, Artificial Sequence
  chemically synthesized
gagcagtatgaatcctggca

SEQ ID NO: 562817 - DNA, 20 bp, Artificial Sequence
  chemically synthesized
ctttcggctacatagtcatt

SEQ ID NO: 562818 - DNA, 20 bp, Artificial Sequence
  chemically synthesized
ataaaatgagttactttttg

SEQ ID NO: 562819 - DNA, 20 bp, Artificial Sequence
  chemically synthesized
aaagcagtatttttagatat

SEQ ID NO: 562820 - DNA, 20 bp, Artificial Sequence
  chemically synthesized
gaacctgaaacttttatcat

SEQ ID NO: 562821 - DNA, 20 bp, Artificial Sequence
  chemically synthesized
ttgtctcatatactacggga

SEQ ID NO: 562822 - DNA, 20 bp, Artificial Sequence
  chemically synthesized
tgtgtgtgtatatatatata

SEQ ID NO: 562823 - DNA, 20 bp, Artificial Sequence
  chemically synthesized
ggcctaaaggttgagctttt

SEQ ID NO: 562824 - DNA, 20 bp, Artificial Sequence
  chemically synthesized
aattgtttcacatgcttaaa

SEQ ID NO: 562825 - DNA, 20 bp, Artificial Sequence
  chemically synthesized
accctattatgtgaagatta

SEQ ID NO: 562826 - DNA, 20 bp, Artificial Sequence
  chemically synthesized
attaaccaacataaaatatg

SEQ ID NO: 562827 - DNA, 20 bp, Artificial Sequence
  chemically synthesized
tttatgttggttaataagat

SEQ ID NO: 562828 - DNA, 20 bp, Artificial Sequence
  chemically synthesized
tgagatttgaggaaccagta

SEQ ID NO: 562829 - DNA, 20 bp, Artificial Sequence
  chemically synthesized
ctagtcatttcaaaaaacca

SEQ ID NO: 562830 - DNA, 20 bp, Artificial Sequence
  chemically synthesized
aaatatttctagtcatttca

SEQ ID NO: 562831 - DNA, 20 bp, Artificial Sequence
  chemically synthesized
acagagtgagactccgtctc

SEQ ID NO: 562832 - DNA, 20 bp, Artificial Sequence
  chemically synthesized
aacaaacaaacaaacaaaca

SEQ ID NO: 562833 - DNA, 20 bp, Artificial Sequence
  chemically synthesized
aaacaaacaaacaaaaaaca

SEQ ID NO: 562834 - DNA, 20 bp, Artificial Sequence
  chemically synthesized
ttagagctgcttgaagagat

SEQ ID NO: 562835 - DNA, 20 bp, Artificial Sequence
  chemically synthesized
tgtgttccgaatgctttctc

SEQ ID NO: 562836 - DNA, 20 bp, Artificial Sequence
  chemically synthesized
ctgatgtttttccagccagt

SEQ ID NO: 562837 - DNA, 20 bp, Artificial Sequence
  chemically synthesized
gctgagttttgactggctgg

SEQ ID NO: 562838 - DNA, 20 bp, Artificial Sequence
  chemically synthesized
atggtaaatatttcaatgtc

SEQ ID NO: 562839 - DNA, 20 bp, Artificial Sequence
  chemically synthesized
tccttcaccatgaggaatca

SEQ ID NO: 562840 - DNA, 20 bp, Artificial Sequence
  chemically synthesized
aaaacaaaagaaagtagaac

SEQ ID NO: 562841 - DNA, 20 bp, Artificial Sequence
  chemically synthesized
aggtagattctgtctcaaaa

SEQ ID NO: 562842 - DNA, 20 bp, Artificial Sequence
  chemically synthesized
ttggactgaaaaaaaaaaaa

SEQ ID NO: 562843 - DNA, 20 bp, Artificial Sequence
  chemically synthesized
tttttttttcagtccaatat

SEQ ID NO: 562844 - DNA, 20 bp, Artificial Sequence
  chemically synthesized
agtccaatattaaaacaaac

SEQ ID NO: 562845 - DNA, 20 bp, Artificial Sequence
  chemically synthesized
tatttattattcatttggaa

SEQ ID NO: 562846 - DNA, 20 bp, Artificial Sequence
  chemically synthesized
aaaaaaaaaaaaaaaaaaaa

SEQ ID NO: 562847 - DNA, 20 bp, Artificial Sequence
  chemically synthesized
aaaggctttatttttatgaa

SEQ ID NO: 562848 - DNA, 20 bp, Artificial Sequence
  chemically synthesized
ttatcagttgctttaatcat

SEQ ID NO: 562849 - DNA, 20 bp, Artificial Sequence
  chemically synthesized
taatcatgaaaacaaaaggg

SEQ ID NO: 562850 - DNA, 20 bp, Artificial Sequence
  chemically synthesized
taagatggagctgatcttta

SEQ ID NO: 562851 - DNA, 20 bp, Artificial Sequence
  chemically synthesized
tttccttgatatgtttaatc

SEQ ID NO: 562852 - DNA, 20 bp, Artificial Sequence
  chemically synthesized
tttgaaaactgaaactatga

SEQ ID NO: 562853 - DNA, 20 bp, Artificial Sequence
  chemically synthesized
ccttaccaaagccacagttt

SEQ ID NO: 562854 - DNA, 20 bp, Artificial Sequence
  chemically synthesized
ggctttggtaaggtaagttg

SEQ ID NO: 562855 - DNA, 20 bp, Artificial Sequence
  chemically synthesized
agtctccccttttgggccat

SEQ ID NO: 562856 - DNA, 20 bp, Artificial Sequence
  chemically synthesized
ttactaaaaatataatagac

SEQ ID NO: 562857 - DNA, 20 bp, Artificial Sequence
  chemically synthesized
attctcctgcctcagcctcc

SEQ ID NO: 562858 - DNA, 20 bp, Artificial Sequence
  chemically synthesized
gtcattaggtctcaaatacg

SEQ ID NO: 562859 - DNA, 20 bp, Artificial Sequence
  chemically synthesized
aggaaattgaaaaataagtt

SEQ ID NO: 562860 - DNA, 20 bp, Artificial Sequence
  chemically synthesized
tatatttataaagagattag

SEQ ID NO: 562861 - DNA, 20 bp, Artificial Sequence
  chemically synthesized
aaagtacaccgcattaaatt

SEQ ID NO: 562862 - DNA, 20 bp, Artificial Sequence
  chemically synthesized
ttagctcacccccctgaaaa

SEQ ID NO: 562863 - DNA, 20 bp, Artificial Sequence
  chemically synthesized
gctgtcttcctaaagataga

SEQ ID NO: 562864 - DNA, 20 bp, Artificial Sequence
  chemically synthesized
aggatattctataattaaaa

SEQ ID NO: 562865 - DNA, 20 bp, Artificial Sequence
  chemically synthesized
tatttccgtcttctttgatt

SEQ ID NO: 562866 - DNA, 20 bp, Artificial Sequence
  chemically synthesized
gatttttatattaacaatag

SEQ ID NO: 562867 - DNA, 20 bp, Artificial Sequence
  chemically synthesized
ctacattcataaactcatta

SEQ ID NO: 562868 - DNA, 20 bp, Artificial Sequence
  chemically synthesized
taggagaagaaaataactct

SEQ ID NO: 562869 - DNA, 20 bp, Artificial Sequence
  chemically synthesized
taaaaacgtccagtgctgct

SEQ ID NO: 562870 - DNA, 20 bp, Artificial Sequence
  chemically synthesized
aacacatttgaacttcctat

SEQ ID NO: 562871 - DNA, 20 bp, Artificial Sequence
  chemically synthesized
attccttttaattctttttt

SEQ ID NO: 562872 - DNA, 20 bp, Artificial Sequence
  chemically synthesized
ccttgaatcctgcttcttga

SEQ ID NO: 562873 - DNA, 20 bp, Artificial Sequence
  chemically synthesized
gtggattttcagattaaaaa

SEQ ID NO: 562874 - DNA, 20 bp, Artificial Sequence
  chemically synthesized
ttttaacaacttactctaaa

SEQ ID NO: 562875 - DNA, 20 bp, Artificial Sequence
  chemically synthesized
acaaggtttcaaacaaaaaa

SEQ ID NO: 562876 - DNA, 20 bp, Artificial Sequence
  chemically synthesized
gccaaatattttatattaaa

SEQ ID NO: 562877 - DNA, 20 bp, Artificial Sequence
  chemically synthesized
atgtcctagctcgagggcgg

SEQ ID NO: 562878 - DNA, 20 bp, Artificial Sequence
  chemically synthesized
ggaacctttataaatatcag

SEQ ID NO: 562879 - DNA, 20 bp, Artificial Sequence
  chemically synthesized
tccaacctgggcaacaagag

SEQ ID NO: 562880 - DNA, 20 bp, Artificial Sequence
  chemically synthesized
agctccaatctcctcacctg

SEQ ID NO: 562881 - DNA, 20 bp, Artificial Sequence
  chemically synthesized
tccggttagttggatgactg

SEQ ID NO: 562882 - DNA, 20 bp, Artificial Sequence
  chemically synthesized
ctgaagaacttctttaagaa

SEQ ID NO: 562883 - DNA, 20 bp, Artificial Sequence
  chemically synthesized
tgaaccctgaggatatgcat

SEQ ID NO: 562884 - DNA, 20 bp, Artificial Sequence
  chemically synthesized
taatgcgcaaccacaggcat

SEQ ID NO: 562885 - DNA, 20 bp, Artificial Sequence
  chemically synthesized
cacaatgtatcaccttaggt

SEQ ID NO: 562886 - DNA, 20 bp, Artificial Sequence
  chemically synthesized
taatctgacagcagttatgc

SEQ ID NO: 562887 - DNA, 20 bp, Artificial Sequence
  chemically synthesized
caaaataagcctttgaagtg

SEQ ID NO: 562888 - DNA, 20 bp, Artificial Sequence
  chemically synthesized
aaacatattactaaaaggaa

SEQ ID NO: 562889 - DNA, 20 bp, Artificial Sequence
  chemically synthesized
agacttcgaatgtacagatt

SEQ ID NO: 562890 - DNA, 20 bp, Artificial Sequence
  chemically synthesized
tttgaaggaaaatcaaacaa

SEQ ID NO: 562891 - DNA, 20 bp, Artificial Sequence
  chemically synthesized
tccagatgttcatgtttatg

SEQ ID NO: 562892 - DNA, 20 bp, Artificial Sequence
  chemically synthesized
ttaaatccagcagtagaagc

SEQ ID NO: 562893 - DNA, 20 bp, Artificial Sequence
  chemically synthesized
caaaagaatatttctggcaa

SEQ ID NO: 562894 - DNA, 20 bp, Artificial Sequence
  chemically synthesized
gagattatctgagaatttcc

SEQ ID NO: 562895 - DNA, 20 bp, Artificial Sequence
  chemically synthesized
ctacaacatacacatagatc

SEQ ID NO: 562896 - DNA, 20 bp, Artificial Sequence
  chemically synthesized
aataaattaattaattttta

SEQ ID NO: 562897 - DNA, 20 bp, Artificial Sequence
  chemically synthesized
tgctgccacatatatcttct

SEQ ID NO: 562898 - DNA, 20 bp, Artificial Sequence
  chemically synthesized
aatattcatgaaatagaaat

SEQ ID NO: 562899 - DNA, 20 bp, Artificial Sequence
  chemically synthesized
tggaatatttaactacgttg

SEQ ID NO: 562900 - DNA, 20 bp, Artificial Sequence
  chemically synthesized
taagtgaattaagcagcttc

SEQ ID NO: 562901 - DNA, 20 bp, Artificial Sequence
  chemically synthesized
atgtattattcttagtggtt

SEQ ID NO: 562902 - DNA, 20 bp, Artificial Sequence
  chemically synthesized
ctgccaaaagtagaatacag

SEQ ID NO: 562903 - DNA, 20 bp, Artificial Sequence
  chemically synthesized
aaaaaaaaaaaaaaaaaaaa

SEQ ID NO: 562904 - DNA, 20 bp, Artificial Sequence
  chemically synthesized
atatgacctaatcaccttct

SEQ ID NO: 562905 - DNA, 20 bp, Artificial Sequence
  chemically synthesized
tattttatatattcaagttt

SEQ ID NO: 562906 - DNA, 20 bp, Artificial Sequence
  chemically synthesized
ctctcccaagactattacaa

SEQ ID NO: 562907 - DNA, 20 bp, Artificial Sequence
  chemically synthesized
acggggtgtagcaagataaa

SEQ ID NO: 562908 - DNA, 20 bp, Artificial Sequence
  chemically synthesized
tcatattaaaagtttattaa

SEQ ID NO: 562909 - DNA, 20 bp, Artificial Sequence
  chemically synthesized
gcagcagcctccttcacaca

SEQ ID NO: 562910 - DNA, 20 bp, Artificial Sequence
  chemically synthesized
caagagtgaaattccgtctc

SEQ ID NO: 562911 - DNA, 20 bp, Artificial Sequence
  chemically synthesized
tgatactttcaatttatagc

SEQ ID NO: 562912 - DNA, 20 bp, Artificial Sequence
  chemically synthesized
aactgtacactgtcccttat

SEQ ID NO: 562913 - DNA, 20 bp, Artificial Sequence
  chemically synthesized
aaaacctagaaagcatgctg

SEQ ID NO: 562914 - DNA, 20 bp, Artificial Sequence
  chemically synthesized
aacatctttgtactatttag

SEQ ID NO: 562915 - DNA, 20 bp, Artificial Sequence
  chemically synthesized
ttcccatattttatagatga

SEQ ID NO: 562916 - DNA, 20 bp, Artificial Sequence
  chemically synthesized
ttggcaaaaataaacaaaca

SEQ ID NO: 562917 - DNA, 20 bp, Artificial Sequence
  chemically synthesized
ctcagcaaattttagtagcc

SEQ ID NO: 562918 - DNA, 20 bp, Artificial Sequence
  chemically synthesized
agtagtgtcatgcaatccat

SEQ ID NO: 562919 - DNA, 20 bp, Artificial Sequence
  chemically synthesized
ctaattgctctctagggtag

SEQ ID NO: 562920 - DNA, 20 bp, Artificial Sequence
  chemically synthesized
caaccaagcagtgaatccac

SEQ ID NO: 562921 - DNA, 20 bp, Artificial Sequence
  chemically synthesized
gaaattaatttactcgccat

SEQ ID NO: 562922 - DNA, 20 bp, Artificial Sequence
  chemically synthesized
ggtgaaaccctttctctact

SEQ ID NO: 562923 - DNA, 20 bp, Artificial Sequence
  chemically synthesized
caatttttactttgaataat

SEQ ID NO: 562924 - DNA, 20 bp, Artificial Sequence
  chemically synthesized
aattagtcaattacgcaatt

SEQ ID NO: 562925 - DNA, 20 bp, Artificial Sequence
  chemically synthesized
tcaaggttagatttacagag

SEQ ID NO: 562926 - DNA, 20 bp, Artificial Sequence
  chemically synthesized
atatatataaaaatttaaag

SEQ ID NO: 562927 - DNA, 20 bp, Artificial Sequence
  chemically synthesized
tggtactagaattacatttt

SEQ ID NO: 562928 - DNA, 20 bp, Artificial Sequence
  chemically synthesized
taataatataataatcatca

SEQ ID NO: 562929 - DNA, 20 bp, Artificial Sequence
  chemically synthesized
aataatataacacagtgtcc

SEQ ID NO: 562930 - DNA, 20 bp, Artificial Sequence
  chemically synthesized
gataataaccttggcaataa

SEQ ID NO: 562931 - DNA, 20 bp, Artificial Sequence
  chemically synthesized
accttggcaataaaaaaacc

SEQ ID NO: 562932 - DNA, 20 bp, Artificial Sequence
  chemically synthesized
aaagacattttttcttttat

SEQ ID NO: 562933 - DNA, 20 bp, Artificial Sequence
  chemically synthesized
taccagatgccacataaaag

SEQ ID NO: 562934 - DNA, 20 bp, Artificial Sequence
  chemically synthesized
attttcttgcttggtttaaa

SEQ ID NO: 562935 - DNA, 20 bp, Artificial Sequence
  chemically synthesized
aagaaaatgcaatctgatgc

SEQ ID NO: 562936 - DNA, 20 bp, Artificial Sequence
  chemically synthesized
aaagaggaatccatttaaca

SEQ ID NO: 562937 - DNA, 20 bp, Artificial Sequence
  chemically synthesized
gaaataagaggttgtctaat

SEQ ID NO: 562938 - DNA, 20 bp, Artificial Sequence
  chemically synthesized
aataattaaaaagaagaaag

SEQ ID NO: 562939 - DNA, 20 bp, Artificial Sequence
  chemically synthesized
ttaaaaagaagaaagaaaaa

SEQ ID NO: 562940 - DNA, 20 bp, Artificial Sequence
  chemically synthesized
atcacccttttgctctctgt

SEQ ID NO: 562941 - DNA, 20 bp, Artificial Sequence
  chemically synthesized
cttttatttcaataccactg

SEQ ID NO: 562942 - DNA, 20 bp, Artificial Sequence
  chemically synthesized
aatggtagttggaacttcag

SEQ ID NO: 562943 - DNA, 20 bp, Artificial Sequence
  chemically synthesized
gttagttatttcatatatga

SEQ ID NO: 562944 - DNA, 20 bp, Artificial Sequence
  chemically synthesized
tctagaggaaccagtcatgt

SEQ ID NO: 562945 - DNA, 20 bp, Artificial Sequence
  chemically synthesized
actgttaccactttctaata

SEQ ID NO: 562946 - DNA, 20 bp, Artificial Sequence
  chemically synthesized
tgtattgattagactattct

SEQ ID NO: 562947 - DNA, 20 bp, Artificial Sequence
  chemically synthesized
ctttctacagatgcaaatgg

SEQ ID NO: 562948 - DNA, 20 bp, Artificial Sequence
  chemically synthesized
ctcaaatacagaacttctaa

SEQ ID NO: 562949 - DNA, 20 bp, Artificial Sequence
  chemically synthesized
gttcaacttaaaattcaacc

SEQ ID NO: 562950 - DNA, 20 bp, Artificial Sequence
  chemically synthesized
gcattctctggcagatgcag

SEQ ID NO: 562951 - DNA, 20 bp, Artificial Sequence
  chemically synthesized
agaagcaattgcctttactg

SEQ ID NO: 562952 - DNA, 20 bp, Artificial Sequence
  chemically synthesized
tttagcacatctgctccatt

SEQ ID NO: 562953 - DNA, 20 bp, Artificial Sequence
  chemically synthesized
tgactgatagggaaaaagtc

SEQ ID NO: 562954 - DNA, 20 bp, Artificial Sequence
  chemically synthesized
taactctactttaaggcttt

SEQ ID NO: 562955 - DNA, 20 bp, Artificial Sequence
  chemically synthesized
tgaatttactttaatatcta

SEQ ID NO: 562956 - DNA, 20 bp, Artificial Sequence
  chemically synthesized
gattttaaaggtcattggac

SEQ ID NO: 562957 - DNA, 20 bp, Artificial Sequence
  chemically synthesized
tggatcaagatgacctgctg

SEQ ID NO: 562958 - DNA, 20 bp, Artificial Sequence
  chemically synthesized
tattataaaacttaatagct

SEQ ID NO: 562959 - DNA, 20 bp, Artificial Sequence
  chemically synthesized
tgctgagtaacaatttatta

SEQ ID NO: 562960 - DNA, 20 bp, Artificial Sequence
  chemically synthesized
aaagaacacagagacatttg

SEQ ID NO: 562961 - DNA, 20 bp, Artificial Sequence
  chemically synthesized
tttctctactgcacagaaac

SEQ ID NO: 562962 - DNA, 20 bp, Artificial Sequence
  chemically synthesized
tgaacaaaatatcaacattt

SEQ ID NO: 562963 - DNA, 20 bp, Artificial Sequence
  chemically synthesized
tccttatcactgcccttgtt

SEQ ID NO: 562964 - DNA, 20 bp, Artificial Sequence
  chemically synthesized
tacctcaataaagcagttta

SEQ ID NO: 562965 - DNA, 20 bp, Artificial Sequence
  chemically synthesized
gtgtgtgataattaaataac

SEQ ID NO: 562966 - DNA, 20 bp, Artificial Sequence
  chemically synthesized
ggaaaataaaaatagtgaga

SEQ ID NO: 562967 - DNA, 20 bp, Artificial Sequence
  chemically synthesized
tctagaagatacaatgagaa

SEQ ID NO: 562968 - DNA, 20 bp, Artificial Sequence
  chemically synthesized
aaaataccaaaatataaaaa

SEQ ID NO: 562969 - DNA, 20 bp, Artificial Sequence
  chemically synthesized
acttaaaaataccaaaatat

SEQ ID NO: 562970 - DNA, 20 bp, Artificial Sequence
  chemically synthesized
agcggctaagttcacgtatg

SEQ ID NO: 562971 - DNA, 20 bp, Artificial Sequence
  chemically synthesized
attgctattataattcacca

SEQ ID NO: 562972 - DNA, 20 bp, Artificial Sequence
  chemically synthesized
gacagaaggcaatacatttt

SEQ ID NO: 562973 - DNA, 20 bp, Artificial Sequence
  chemically synthesized
gaacaatacagaactaactt

SEQ ID NO: 562974 - DNA, 20 bp, Artificial Sequence
  chemically synthesized
cagagaaaaaatatgtggtc

SEQ ID NO: 562975 - DNA, 20 bp, Artificial Sequence
  chemically synthesized
acaagagtgaaactcggtct

SEQ ID NO: 562976 - DNA, 20 bp, Artificial Sequence
  chemically synthesized
tctcaaaacaaacaaacaaa

SEQ ID NO: 562977 - DNA, 20 bp, Artificial Sequence
  chemically synthesized
aaacaaacaaacaaacaaaa

SEQ ID NO: 562978 - DNA, 20 bp, Artificial Sequence
  chemically synthesized
aacaaacaaacaaaacaaaa

SEQ ID NO: 562979 - DNA, 20 bp, Artificial Sequence
  chemically synthesized
gtaacattaaggtagtaaat

SEQ ID NO: 562980 - DNA, 20 bp, Artificial Sequence
  chemically synthesized
tactgtagacgtaaaaaatt

SEQ ID NO: 562981 - DNA, 20 bp, Artificial Sequence
  chemically synthesized
gtaaaaaatttaaaacgtat

SEQ ID NO: 562982 - DNA, 20 bp, Artificial Sequence
  chemically synthesized
tctttctcttttaatagatg

SEQ ID NO: 562983 - DNA, 20 bp, Artificial Sequence
  chemically synthesized
ttgcactccagcctgggcag

SEQ ID NO: 562984 - DNA, 20 bp, Artificial Sequence
  chemically synthesized
ggtgatttttaatctagaaa

SEQ ID NO: 562985 - DNA, 20 bp, Artificial Sequence
  chemically synthesized
atttctagattaaaaatcac

SEQ ID NO: 562986 - DNA, 20 bp, Artificial Sequence
  chemically synthesized
gtttatgtagaaagcaacaa

SEQ ID NO: 562987 - DNA, 20 bp, Artificial Sequence
  chemically synthesized
cctacttagcaaaagaaagt

SEQ ID NO: 562988 - DNA, 20 bp, Artificial Sequence
  chemically synthesized
cttattccagaagtacaaga

SEQ ID NO: 562989 - DNA, 20 bp, Artificial Sequence
  chemically synthesized
tgggtcaactgaaggggaag

SEQ ID NO: 562990 - DNA, 20 bp, Artificial Sequence
  chemically synthesized
ctgagaggctcaaagatctg

SEQ ID NO: 562991 - DNA, 20 bp, Artificial Sequence
  chemically synthesized
tttaaaaaaagtgaaaataa

SEQ ID NO: 562992 - DNA, 20 bp, Artificial Sequence
  chemically synthesized
ggtaaggcctttatgttgtc

SEQ ID NO: 562993 - DNA, 20 bp, Artificial Sequence
  chemically synthesized
tttcatctctgagaatactc

SEQ ID NO: 562994 - DNA, 20 bp, Artificial Sequence
  chemically synthesized
ggaagatttattgggggaga

SEQ ID NO: 562995 - DNA, 20 bp, Artificial Sequence
  chemically synthesized
caagagagccagattaaaaa

SEQ ID NO: 562996 - DNA, 20 bp, Artificial Sequence
  chemically synthesized
gaaagaatgggtgtttcaag

SEQ ID NO: 562997 - DNA, 20 bp, Artificial Sequence
  chemically synthesized
gagacaatatgtttctccta

SEQ ID NO: 562998 - DNA, 20 bp, Artificial Sequence
  chemically synthesized
caaagaccccatttgcaaac

SEQ ID NO: 562999 - DNA, 20 bp, Artificial Sequence
  chemically synthesized
agtagttgagtagtggagtt

SEQ ID NO: 563000 - DNA, 20 bp, Artificial Sequence
  chemically synthesized
ccacagccagggtaacatgg

SEQ ID NO: 563001 - DNA, 20 bp, Artificial Sequence
  chemically synthesized
caaggaacaaagaacctggc

SEQ ID NO: 563002 - DNA, 20 bp, Artificial Sequence
  chemically synthesized
caaaaatgatagctaacatt

SEQ ID NO: 563003 - DNA, 20 bp, Artificial Sequence
  chemically synthesized
tcagactaacacaggaacag

SEQ ID NO: 563004 - DNA, 20 bp, Artificial Sequence
  chemically synthesized
ttcagtactgtacttaaagt

SEQ ID NO: 563005 - DNA, 20 bp, Artificial Sequence
  chemically synthesized
aacccttaaatacattccat

SEQ ID NO: 563006 - DNA, 20 bp, Artificial Sequence
  chemically synthesized
agtataacaaaatttaaaga

SEQ ID NO: 563007 - DNA, 20 bp, Artificial Sequence
  chemically synthesized
tatctcattaaatactaaag

SEQ ID NO: 563008 - DNA, 20 bp, Artificial Sequence
  chemically synthesized
ggtcaaatgctggtagagaa

SEQ ID NO: 563009 - DNA, 20 bp, Artificial Sequence
  chemically synthesized
gtatgagtgcctatttctta

SEQ ID NO: 563010 - DNA, 20 bp, Artificial Sequence
  chemically synthesized
aattcctccttcccatctca

SEQ ID NO: 563011 - DNA, 20 bp, Artificial Sequence
  chemically synthesized
gaactcatatcctcagattc

SEQ ID NO: 563012 - DNA, 20 bp, Artificial Sequence
  chemically synthesized
ttggataagagataggtaat

SEQ ID NO: 563013 - DNA, 20 bp, Artificial Sequence
  chemically synthesized
ttattttattggattttcta

SEQ ID NO: 563014 - DNA, 20 bp, Artificial Sequence
  chemically synthesized
agtgggagcaaatagaatca

SEQ ID NO: 563015 - DNA, 20 bp, Artificial Sequence
  chemically synthesized
gctatggctctcaaaatatc

SEQ ID NO: 563016 - DNA, 20 bp, Artificial Sequence
  chemically synthesized
gctaaaaaaaaaaacagcat

SEQ ID NO: 563017 - DNA, 20 bp, Artificial Sequence
  chemically synthesized
aatttgaaaatgctaaaaaa

SEQ ID NO: 563018 - DNA, 20 bp, Artificial Sequence
  chemically synthesized
ataacatttctattttctca

SEQ ID NO: 563019 - DNA, 20 bp, Artificial Sequence
  chemically synthesized
aattctgagcagatttctcc

SEQ ID NO: 563020 - DNA, 20 bp, Artificial Sequence
  chemically synthesized
ggttaaaagttcttcaaagt

SEQ ID NO: 563021 - DNA, 20 bp, Artificial Sequence
  chemically synthesized
taaaaacattctcaactcca

SEQ ID NO: 563022 - DNA, 20 bp, Artificial Sequence
  chemically synthesized
ctttctaagatattggctta

SEQ ID NO: 563023 - DNA, 20 bp, Artificial Sequence
  chemically synthesized
aatagtggacggaatatgca

SEQ ID NO: 563024 - DNA, 20 bp, Artificial Sequence
  chemically synthesized
gcttttcacttccttttgtg

SEQ ID NO: 563025 - DNA, 20 bp, Artificial Sequence
  chemically synthesized
tatatttattgcttagttta

SEQ ID NO: 563026 - DNA, 20 bp, Artificial Sequence
  chemically synthesized
aattatatttagcaagcaaa

SEQ ID NO: 563027 - DNA, 20 bp, Artificial Sequence
  chemically synthesized
gagtttattaggctgaggta

SEQ ID NO: 563028 - DNA, 20 bp, Artificial Sequence
  chemically synthesized
tgactctaataacgaatttg

SEQ ID NO: 563029 - DNA, 20 bp, Artificial Sequence
  chemically synthesized
ttcttgtttattggatgctc

SEQ ID NO: 563030 - DNA, 20 bp, Artificial Sequence
  chemically synthesized
ataaacaagaacatccatca

SEQ ID NO: 563031 - DNA, 20 bp, Artificial Sequence
  chemically synthesized
gtactgaaagcaactgcgga

SEQ ID NO: 563032 - DNA, 20 bp, Artificial Sequence
  chemically synthesized
aggtaataatagcacaaaaa

SEQ ID NO: 563033 - DNA, 20 bp, Artificial Sequence
  chemically synthesized
gcatcaagtaagaagaggaa

SEQ ID NO: 563034 - DNA, 20 bp, Artificial Sequence
  chemically synthesized
agtaagaagaggaagaaaac

SEQ ID NO: 563035 - DNA, 20 bp, Artificial Sequence
  chemically synthesized
aggacaagaagatggggcgt

SEQ ID NO: 563036 - DNA, 20 bp, Artificial Sequence
  chemically synthesized
cttctttgcttcctatacat

SEQ ID NO: 563037 - DNA, 20 bp, Artificial Sequence
  chemically synthesized
ttaatctgctattctgttgc

SEQ ID NO: 563038 - DNA, 20 bp, Artificial Sequence
  chemically synthesized
caatcactccattatatttt

SEQ ID NO: 563039 - DNA, 20 bp, Artificial Sequence
  chemically synthesized
agattaacaggattattctt

SEQ ID NO: 563040 - DNA, 20 bp, Artificial Sequence
  chemically synthesized
aataacccatactcctaaat

SEQ ID NO: 563041 - DNA, 20 bp, Artificial Sequence
  chemically synthesized
atttaatagaggaatgatct

SEQ ID NO: 563042 - DNA, 20 bp, Artificial Sequence
  chemically synthesized
atgcatttatgtctattttt

SEQ ID NO: 563043 - DNA, 20 bp, Artificial Sequence
  chemically synthesized
tatcaggtattggtattatt

SEQ ID NO: 563044 - DNA, 20 bp, Artificial Sequence
  chemically synthesized
atttctgctgaagaacattt

SEQ ID NO: 563045 - DNA, 20 bp, Artificial Sequence
  chemically synthesized
agaagaacaagtatataatg

SEQ ID NO: 563046 - DNA, 20 bp, Artificial Sequence
  chemically synthesized
tatattcaagcacaggggac

SEQ ID NO: 563047 - DNA, 20 bp, Artificial Sequence
  chemically synthesized
gctaataattcaaaggtcaa

SEQ ID NO: 563048 - DNA, 20 bp, Artificial Sequence
  chemically synthesized
attttctaggattcaatttc

SEQ ID NO: 563049 - DNA, 20 bp, Artificial Sequence
  chemically synthesized
tagaaaaatattgaattgtg

SEQ ID NO: 563050 - DNA, 20 bp, Artificial Sequence
  chemically synthesized
gaatcaatagaggcaaaaaa

SEQ ID NO: 563051 - DNA, 20 bp, Artificial Sequence
  chemically synthesized
tattacccaatgaacagaaa

SEQ ID NO: 563052 - DNA, 20 bp, Artificial Sequence
  chemically synthesized
caagtgtttgcttcaaagga

SEQ ID NO: 563053 - DNA, 20 bp, Artificial Sequence
  chemically synthesized
cataggtgctaacacgcagc

SEQ ID NO: 563054 - DNA, 20 bp, Artificial Sequence
  chemically synthesized
tagaactcatttgtgtaaca

SEQ ID NO: 563055 - DNA, 20 bp, Artificial Sequence
  chemically synthesized
agtttagattttgcataaat

SEQ ID NO: 563056 - DNA, 20 bp, Artificial Sequence
  chemically synthesized
tacaaataatgagaaatggg

SEQ ID NO: 563057 - DNA, 20 bp, Artificial Sequence
  chemically synthesized
ttgatccagcaccatttgtt

SEQ ID NO: 563058 - DNA, 20 bp, Artificial Sequence
  chemically synthesized
tatacaataagatctgattt

SEQ ID NO: 563059 - DNA, 20 bp, Artificial Sequence
  chemically synthesized
taacttccgcaatttgggga

SEQ ID NO: 563060 - DNA, 20 bp, Artificial Sequence
  chemically synthesized
tactactgtagcattaacat

SEQ ID NO: 563061 - DNA, 20 bp, Artificial Sequence
  chemically synthesized
tactgagaactctaatttac

SEQ ID NO: 563062 - DNA, 20 bp, Artificial Sequence
  chemically synthesized
agactgcaaccaaaggtgga

SEQ ID NO: 563063 - DNA, 20 bp, Artificial Sequence
  chemically synthesized
cctggttagaacatcagttc

SEQ ID NO: 563064 - DNA, 20 bp, Artificial Sequence
  chemically synthesized
tctttcaaaaatgagtaaat

SEQ ID NO: 563065 - DNA, 20 bp, Artificial Sequence
  chemically synthesized
gaagtatttcaccagtagct

SEQ ID NO: 563066 - DNA, 20 bp, Artificial Sequence
  chemically synthesized
taaaatcatgttaattagtc

SEQ ID NO: 563067 - DNA, 20 bp, Artificial Sequence
  chemically synthesized
aacttagtgattgaattata

SEQ ID NO: 563068 - DNA, 20 bp, Artificial Sequence
  chemically synthesized
atttagccaacttttaaatt

SEQ ID NO: 563069 - DNA, 20 bp, Artificial Sequence
  chemically synthesized
tcaagtcatagacttggaaa

SEQ ID NO: 563070 - DNA, 20 bp, Artificial Sequence
  chemically synthesized
aagtctatgacttgatgtac

SEQ ID NO: 563071 - DNA, 20 bp, Artificial Sequence
  chemically synthesized
tttacactgtatcgtacccc

SEQ ID NO: 563072 - DNA, 20 bp, Artificial Sequence
  chemically synthesized
cactcctgacaagtgatcct

SEQ ID NO: 563073 - DNA, 20 bp, Artificial Sequence
  chemically synthesized
cctatgaactcgagaagccg

SEQ ID NO: 563074 - DNA, 20 bp, Artificial Sequence
  chemically synthesized
cttaaataactcaaaagtgt

SEQ ID NO: 563075 - DNA, 20 bp, Artificial Sequence
  chemically synthesized
ttttgggtagatgccacatt

SEQ ID NO: 563076 - DNA, 20 bp, Artificial Sequence
  chemically synthesized
ttagagataatcacttaagt

SEQ ID NO: 563077 - DNA, 20 bp, Artificial Sequence
  chemically synthesized
aaattgtcaatggcattttg

SEQ ID NO: 563078 - DNA, 20 bp, Artificial Sequence
  chemically synthesized
atatattttgcaactcctcc

SEQ ID NO: 563079 - DNA, 20 bp, Artificial Sequence
  chemically synthesized
cacaactttcacaagaagtt

SEQ ID NO: 563080 - DNA, 20 bp, Artificial Sequence
  chemically synthesized
gaggccagttttctgattag

SEQ ID NO: 563081 - DNA, 20 bp, Artificial Sequence
  chemically synthesized
cttccctgttttactaatca

SEQ ID NO: 563082 - DNA, 20 bp, Artificial Sequence
  chemically synthesized
tttcatatgaatgttaactg

SEQ ID NO: 563083 - DNA, 20 bp, Artificial Sequence
  chemically synthesized
aagaggaacagggattcatg

SEQ ID NO: 563084 - DNA, 20 bp, Artificial Sequence
  chemically synthesized
aaacagaagtttccagatta

SEQ ID NO: 563085 - DNA, 20 bp, Artificial Sequence
  chemically synthesized
agagttaatgtaaaaaaaaa

SEQ ID NO: 563086 - DNA, 20 bp, Artificial Sequence
  chemically synthesized
tgcggcctgggctacaagag

SEQ ID NO: 563087 - DNA, 20 bp, Artificial Sequence
  chemically synthesized
gggacagtttagggcttggg

SEQ ID NO: 563088 - DNA, 20 bp, Artificial Sequence
  chemically synthesized
agtttagggcttggggaaaa

SEQ ID NO: 563089 - DNA, 20 bp, Artificial Sequence
  chemically synthesized
ccctgtctcaaaaaaataaa

SEQ ID NO: 563090 - DNA, 20 bp, Artificial Sequence
  chemically synthesized
ggttccaaactggaatttta

SEQ ID NO: 563091 - DNA, 20 bp, Artificial Sequence
  chemically synthesized
ttcctgaaaaagtgcattgt

SEQ ID NO: 563092 - DNA, 20 bp, Artificial Sequence
  chemically synthesized
tcaaaacatatcattatttt

SEQ ID NO: 563093 - DNA, 20 bp, Artificial Sequence
  chemically synthesized
aaatgtattattaaatacat

SEQ ID NO: 563094 - DNA, 20 bp, Artificial Sequence
  chemically synthesized
gtatttattaccactgggat

SEQ ID NO: 563095 - DNA, 20 bp, Artificial Sequence
  chemically synthesized
ctttcaaagcatgaacattt

SEQ ID NO: 563096 - DNA, 20 bp, Artificial Sequence
  chemically synthesized
tcaatttctaaattaggcat

SEQ ID NO: 563097 - DNA, 20 bp, Artificial Sequence
  chemically synthesized
aataaagccaatcagcatac

SEQ ID NO: 563098 - DNA, 20 bp, Artificial Sequence
  chemically synthesized
agagccaggtaagttcaacc

SEQ ID NO: 563099 - DNA, 20 bp, Artificial Sequence
  chemically synthesized
cctcaattccaatagaaaat

SEQ ID NO: 563100 - DNA, 20 bp, Artificial Sequence
  chemically synthesized
ttttttttttaagagccttt

SEQ ID NO: 563101 - DNA, 20 bp, Artificial Sequence
  chemically synthesized
ggtgacatcacttgagatcc

SEQ ID NO: 563102 - DNA, 20 bp, Artificial Sequence
  chemically synthesized
caccatttctgctaatttac

SEQ ID NO: 563103 - DNA, 20 bp, Artificial Sequence
  chemically synthesized
cttgataaccccaggccaga

SEQ ID NO: 563104 - DNA, 20 bp, Artificial Sequence
  chemically synthesized
tgcactgaccaagtgcttga

SEQ ID NO: 563105 - DNA, 20 bp, Artificial Sequence
  chemically synthesized
tgtgaaagtcattaaaaaaa

SEQ ID NO: 563106 - DNA, 20 bp, Artificial Sequence
  chemically synthesized
gaaaggggaaaaaaatatta

SEQ ID NO: 563107 - DNA, 20 bp, Artificial Sequence
  chemically synthesized
gggaaaaaaatattacaaaa

SEQ ID NO: 563108 - DNA, 20 bp, Artificial Sequence
  chemically synthesized
agaaaaaggaagagtagaaa

SEQ ID NO: 563109 - DNA, 20 bp, Artificial Sequence
  chemically synthesized
tcaaggaaaataagcctaca

SEQ ID NO: 563110 - DNA, 20 bp, Artificial Sequence
  chemically synthesized
aactcattcttaattttttc

SEQ ID NO: 563111 - DNA, 20 bp, Artificial Sequence
  chemically synthesized
cgttgcatacatttttgcag

SEQ ID NO: 563112 - DNA, 20 bp, Artificial Sequence
  chemically synthesized
aaaatattatttcctaattt

SEQ ID NO: 563113 - DNA, 20 bp, Artificial Sequence
  chemically synthesized
gagatttgttattctgattt

SEQ ID NO: 563114 - DNA, 20 bp, Artificial Sequence
  chemically synthesized
tttactcaacaaggaaaaaa

SEQ ID NO: 563115 - DNA, 20 bp, Artificial Sequence
  chemically synthesized
ccattgctaccactgtgctt

SEQ ID NO: 563116 - DNA, 20 bp, Artificial Sequence
  chemically synthesized
ataactgatgtacaaagaag

SEQ ID NO: 563117 - DNA, 20 bp, Artificial Sequence
  chemically synthesized
tctggctcccttttaactat

SEQ ID NO: 563118 - DNA, 20 bp, Artificial Sequence
  chemically synthesized
tgtagaataatttattccac

SEQ ID NO: 563119 - DNA, 20 bp, Artificial Sequence
  chemically synthesized
tgtacttttgtttacaaata

SEQ ID NO: 563120 - DNA, 20 bp, Artificial Sequence
  chemically synthesized
gtatcctcaggtattgctat

SEQ ID NO: 563121 - DNA, 20 bp, Artificial Sequence
  chemically synthesized
tacctctacaaaaagtcact

SEQ ID NO: 563122 - DNA, 20 bp, Artificial Sequence
  chemically synthesized
aaatgtattatactccaaag

SEQ ID NO: 563123 - DNA, 20 bp, Artificial Sequence
  chemically synthesized
tatggttattgtatctctac

SEQ ID NO: 563124 - DNA, 20 bp, Artificial Sequence
  chemically synthesized
ataatatattttacaatatt

SEQ ID NO: 563125 - DNA, 20 bp, Artificial Sequence
  chemically synthesized
tgagattttgagccctactc

SEQ ID NO: 563126 - DNA, 20 bp, Artificial Sequence
  chemically synthesized
ccattttagagattaaaaaa

SEQ ID NO: 563127 - DNA, 20 bp, Artificial Sequence
  chemically synthesized
acttcccattttagagatta

SEQ ID NO: 563128 - DNA, 20 bp, Artificial Sequence
  chemically synthesized
aagtttttgtgggggaggac

SEQ ID NO: 563129 - DNA, 20 bp, Artificial Sequence
  chemically synthesized
tagttttagtcctcccccac

SEQ ID NO: 563130 - DNA, 20 bp, Artificial Sequence
  chemically synthesized
acaattctaagttgatgtct

SEQ ID NO: 563131 - DNA, 20 bp, Artificial Sequence
  chemically synthesized
aaaaaagacttctttagtca

SEQ ID NO: 563132 - DNA, 20 bp, Artificial Sequence
  chemically synthesized
tccaggtcccacttccttaa

SEQ ID NO: 563133 - DNA, 20 bp, Artificial Sequence
  chemically synthesized
tttaattggcattattgtta

SEQ ID NO: 563134 - DNA, 20 bp, Artificial Sequence
  chemically synthesized
atcttttataattaaccttt

SEQ ID NO: 563135 - DNA, 20 bp, Artificial Sequence
  chemically synthesized
aaagtatagtttatgttggg

SEQ ID NO: 563136 - DNA, 20 bp, Artificial Sequence
  chemically synthesized
ctgtaagcaatgtaaatcat

SEQ ID NO: 563137 - DNA, 20 bp, Artificial Sequence
  chemically synthesized
aggccacagatccttaaaga

SEQ ID NO: 563138 - DNA, 20 bp, Artificial Sequence
  chemically synthesized
caacaacaaacagtattaga

SEQ ID NO: 563139 - DNA, 20 bp, Artificial Sequence
  chemically synthesized
accaattttctatatatgca

SEQ ID NO: 563140 - DNA, 20 bp, Artificial Sequence
  chemically synthesized
ttctcagaaacagttagata

SEQ ID NO: 563141 - DNA, 20 bp, Artificial Sequence
  chemically synthesized
catagatcatcacaactgca

SEQ ID NO: 563142 - DNA, 20 bp, Artificial Sequence
  chemically synthesized
gtgttaagctggtgaaacag

SEQ ID NO: 563143 - DNA, 20 bp, Artificial Sequence
  chemically synthesized
agagagagagatggttaaag

SEQ ID NO: 563144 - DNA, 20 bp, Artificial Sequence
  chemically synthesized
cctcagtaactcaggggaaa

SEQ ID NO: 563145 - DNA, 20 bp, Artificial Sequence
  chemically synthesized
taacaaggagccctgtcaaa

SEQ ID NO: 563146 - DNA, 20 bp, Artificial Sequence
  chemically synthesized
gaatgatctgaattcaaata

SEQ ID NO: 563147 - DNA, 20 bp, Artificial Sequence
  chemically synthesized
cttatgctatgagaacactt

SEQ ID NO: 563148 - DNA, 20 bp, Artificial Sequence
  chemically synthesized
ataataatatttcatctaca

SEQ ID NO: 563149 - DNA, 20 bp, Artificial Sequence
  chemically synthesized
cttataatttaagtttaaag

SEQ ID NO: 563150 - DNA, 20 bp, Artificial Sequence
  chemically synthesized
atatttagatatttaattag

SEQ ID NO: 563151 - DNA, 20 bp, Artificial Sequence
  chemically synthesized
ttagatgacacagggtttgt

SEQ ID NO: 563152 - DNA, 20 bp, Artificial Sequence
  chemically synthesized
gagcgagactctatctcaaa

SEQ ID NO: 563153 - DNA, 20 bp, Artificial Sequence
  chemically synthesized
agcttagacagtgagcaaaa

SEQ ID NO: 563154 - DNA, 20 bp, Artificial Sequence
  chemically synthesized
agaattgcatgcagttaaag

SEQ ID NO: 563155 - DNA, 20 bp, Artificial Sequence
  chemically synthesized
aatctgctcatagagtaaaa

SEQ ID NO: 563156 - DNA, 20 bp, Artificial Sequence
  chemically synthesized
aaacaatactcatttgactg

SEQ ID NO: 563157 - DNA, 20 bp, Artificial Sequence
  chemically synthesized
ttcccctctggcttaaattt

SEQ ID NO: 563158 - DNA, 20 bp, Artificial Sequence
  chemically synthesized
gaaatataccctaatggttc

SEQ ID NO: 563159 - DNA, 20 bp, Artificial Sequence
  chemically synthesized
ttttagaaatttttttcctg

SEQ ID NO: 563160 - DNA, 20 bp, Artificial Sequence
  chemically synthesized
gaccagcctggccaacatgg

SEQ ID NO: 563161 - DNA, 20 bp, Artificial Sequence
  chemically synthesized
agactctgtctcaaaaaaaa

SEQ ID NO: 563162 - DNA, 20 bp, Artificial Sequence
  chemically synthesized
ggaatcttgggtacttaaac

SEQ ID NO: 563163 - DNA, 20 bp, Artificial Sequence
  chemically synthesized
gaacaattgaaacgcgcatg

SEQ ID NO: 563164 - DNA, 20 bp, Artificial Sequence
  chemically synthesized
aaagactctcagataacttc

SEQ ID NO: 563165 - DNA, 20 bp, Artificial Sequence
  chemically synthesized
cttttggatattaattaatt

SEQ ID NO: 563166 - DNA, 20 bp, Artificial Sequence
  chemically synthesized
attaattcaaaacacattta

SEQ ID NO: 563167 - DNA, 20 bp, Artificial Sequence
  chemically synthesized
tcctagtacaaggaaatatt

SEQ ID NO: 563168 - DNA, 20 bp, Artificial Sequence
  chemically synthesized
attttttgccatagttttta

SEQ ID NO: 563169 - DNA, 20 bp, Artificial Sequence
  chemically synthesized
atacatataattggttttat

SEQ ID NO: 563170 - DNA, 20 bp, Artificial Sequence
  chemically synthesized
agcagagaattgaccagcca

SEQ ID NO: 563171 - DNA, 20 bp, Artificial Sequence
  chemically synthesized
tatgcacaggcattttatga

SEQ ID NO: 563172 - DNA, 20 bp, Artificial Sequence
  chemically synthesized
tcatgtaataatgaattttt

SEQ ID NO: 563173 - DNA, 20 bp, Artificial Sequence
  chemically synthesized
catggaattgaatggactct

SEQ ID NO: 563174 - DNA, 20 bp, Artificial Sequence
  chemically synthesized
aaatgagctcaatcccagat

SEQ ID NO: 563175 - DNA, 20 bp, Artificial Sequence
  chemically synthesized
ttgagactaagaaagaaaga

SEQ ID NO: 563176 - DNA, 20 bp, Artificial Sequence
  chemically synthesized
aacaaagtacacagataacc

SEQ ID NO: 563177 - DNA, 20 bp, Artificial Sequence
  chemically synthesized
acttcttggaatgttctccc

SEQ ID NO: 563178 - DNA, 20 bp, Artificial Sequence
  chemically synthesized
tgctgcccccgttgagtttc

SEQ ID NO: 563179 - DNA, 20 bp, Artificial Sequence
  chemically synthesized
tttgtaggtagaggcaagtt

SEQ ID NO: 563180 - DNA, 20 bp, Artificial Sequence
  chemically synthesized
gtttcaggttgtttatgacc

SEQ ID NO: 563181 - DNA, 20 bp, Artificial Sequence
  chemically synthesized
tgatgataccctagccttca

SEQ ID NO: 563182 - DNA, 20 bp, Artificial Sequence
  chemically synthesized
gtataactatagtacaatat

SEQ ID NO: 563183 - DNA, 20 bp, Artificial Sequence
  chemically synthesized
attgatgtttatgttcaccc

SEQ ID NO: 563184 - DNA, 20 bp, Artificial Sequence
  chemically synthesized
aaaatggtacaaccattcta

SEQ ID NO: 563185 - DNA, 20 bp, Artificial Sequence
  chemically synthesized
atggctaaaattaaaaaaag

SEQ ID NO: 563186 - DNA, 20 bp, Artificial Sequence
  chemically synthesized
tatcactcaaaactgagcac

SEQ ID NO: 563187 - DNA, 20 bp, Artificial Sequence
  chemically synthesized
tagaatatataaatatcact

SEQ ID NO: 563188 - DNA, 20 bp, Artificial Sequence
  chemically synthesized
aaagaaaaaggacatgggtt

SEQ ID NO: 563189 - DNA, 20 bp, Artificial Sequence
  chemically synthesized
gacatgggttaaaaacagta

SEQ ID NO: 563190 - DNA, 20 bp, Artificial Sequence
  chemically synthesized
gaaagccaaacaaaacaaaa

SEQ ID NO: 563191 - DNA, 20 bp, Artificial Sequence
  chemically synthesized
gctaggaaagccaaacaaaa

SEQ ID NO: 563192 - DNA, 20 bp, Artificial Sequence
  chemically synthesized
tggttgctaggaaagccaaa

SEQ ID NO: 563193 - DNA, 20 bp, Artificial Sequence
  chemically synthesized
gatgaaaatatattagagga

SEQ ID NO: 563194 - DNA, 20 bp, Artificial Sequence
  chemically synthesized
ttgcaccattcaatgataag

SEQ ID NO: 563195 - DNA, 20 bp, Artificial Sequence
  chemically synthesized
agaactttctcttcaccgca

SEQ ID NO: 563196 - DNA, 20 bp, Artificial Sequence
  chemically synthesized
ctacaacacggttgggaaaa

SEQ ID NO: 563197 - DNA, 20 bp, Artificial Sequence
  chemically synthesized
ctgatcttatcagtaaagcc

SEQ ID NO: 563198 - DNA, 20 bp, Artificial Sequence
  chemically synthesized
tcattatagcagtaagttat

SEQ ID NO: 563199 - DNA, 20 bp, Artificial Sequence
  chemically synthesized
tccagtaactaactagtata

SEQ ID NO: 563200 - DNA, 20 bp, Artificial Sequence
  chemically synthesized
aagatgaaaaagatcaaaaa

SEQ ID NO: 563201 - DNA, 20 bp, Artificial Sequence
  chemically synthesized
catattatattttcttagat

SEQ ID NO: 563202 - DNA, 20 bp, Artificial Sequence
  chemically synthesized
ttgaggatgctctttaaaaa

SEQ ID NO: 563203 - DNA, 20 bp, Artificial Sequence
  chemically synthesized
atgttgagttataagcaatt

SEQ ID NO: 563204 - DNA, 20 bp, Artificial Sequence
  chemically synthesized
aaaaatggtaaaaataccta

SEQ ID NO: 563205 - DNA, 20 bp, Artificial Sequence
  chemically synthesized
aatgaaatgagccttcagtg

SEQ ID NO: 563206 - DNA, 20 bp, Artificial Sequence
  chemically synthesized
ccacgcgctacataaaaata

SEQ ID NO: 563207 - DNA, 20 bp, Artificial Sequence
  chemically synthesized
cgctacataaaaatacaaaa

SEQ ID NO: 563208 - DNA, 20 bp, Artificial Sequence
  chemically synthesized
acttgccaatctctttcaca

SEQ ID NO: 563209 - DNA, 20 bp, Artificial Sequence
  chemically synthesized
agccttatgggtttcaggta

SEQ ID NO: 563210 - DNA, 20 bp, Artificial Sequence
  chemically synthesized
aaatggtatggagaaagatc

SEQ ID NO: 563211 - DNA, 20 bp, Artificial Sequence
  chemically synthesized
ttctttaaactgtggtcacc

SEQ ID NO: 563212 - DNA, 20 bp, Artificial Sequence
  chemically synthesized
tatcaaaataagtgactctc

SEQ ID NO: 563213 - DNA, 20 bp, Artificial Sequence
  chemically synthesized
ccattttcagacatttaaag

SEQ ID NO: 563214 - DNA, 20 bp, Artificial Sequence
  chemically synthesized
tggaagaagggagaacgctt

SEQ ID NO: 563215 - DNA, 20 bp, Artificial Sequence
  chemically synthesized
gaagggagaacgctttaaaa

SEQ ID NO: 563216 - DNA, 20 bp, Artificial Sequence
  chemically synthesized
gagaacgctttaaaacaaaa

SEQ ID NO: 563217 - DNA, 20 bp, Artificial Sequence
  chemically synthesized
acaaaagccaagaagagggt

SEQ ID NO: 563218 - DNA, 20 bp, Artificial Sequence
  chemically synthesized
tgtttatatttaataaatat

SEQ ID NO: 563219 - DNA, 20 bp, Artificial Sequence
  chemically synthesized
atatttattaaatataaaca

SEQ ID NO: 563220 - DNA, 20 bp, Artificial Sequence
  chemically synthesized
aaaattatcttaatcctctc

SEQ ID NO: 563221 - DNA, 20 bp, Artificial Sequence
  chemically synthesized
gtaatgatagtaagccctga

SEQ ID NO: 563222 - DNA, 20 bp, Artificial Sequence
  chemically synthesized
acctctacctcattcccatt

SEQ ID NO: 563223 - DNA, 20 bp, Artificial Sequence
  chemically synthesized
taagaaaatttatatgccct

SEQ ID NO: 563224 - DNA, 20 bp, Artificial Sequence
  chemically synthesized
ctataagtgacataaataga

SEQ ID NO: 563225 - DNA, 20 bp, Artificial Sequence
  chemically synthesized
gtcttcaccttttccctacg

SEQ ID NO: 563226 - DNA, 20 bp, Artificial Sequence
  chemically synthesized
atgcagtatactgatcttca

SEQ ID NO: 563227 - DNA, 20 bp, Artificial Sequence
  chemically synthesized
gaaacctggttgcatttaat

SEQ ID NO: 563228 - DNA, 20 bp, Artificial Sequence
  chemically synthesized
tagcaggactttgtgagaaa

SEQ ID NO: 563229 - DNA, 20 bp, Artificial Sequence
  chemically synthesized
tgcctctctctgaatccaat

SEQ ID NO: 563230 - DNA, 20 bp, Artificial Sequence
  chemically synthesized
tcaaaattttatctcaagag

SEQ ID NO: 563231 - DNA, 20 bp, Artificial Sequence
  chemically synthesized
gataataaaatagaattttg

SEQ ID NO: 563232 - DNA, 20 bp, Artificial Sequence
  chemically synthesized
attaaactacacaagtggtt

SEQ ID NO: 563233 - DNA, 20 bp, Artificial Sequence
  chemically synthesized
aagggtaactgttttggtta

SEQ ID NO: 563234 - DNA, 20 bp, Artificial Sequence
  chemically synthesized
acgttttgttgttttttaac

SEQ ID NO: 563235 - DNA, 20 bp, Artificial Sequence
  chemically synthesized
ctgttttggttaaaaaacaa

SEQ ID NO: 563236 - DNA, 20 bp, Artificial Sequence
  chemically synthesized
tgacaatgagtttggtaaga

SEQ ID NO: 563237 - DNA, 20 bp, Artificial Sequence
  chemically synthesized
gttacatatatcaaagaaat

SEQ ID NO: 563238 - DNA, 20 bp, Artificial Sequence
  chemically synthesized
tcattattacttttagattg

SEQ ID NO: 563239 - DNA, 20 bp, Artificial Sequence
  chemically synthesized
ccacaaagttttcccagtgg

SEQ ID NO: 563240 - DNA, 20 bp, Artificial Sequence
  chemically synthesized
ggcagaagttttgccactgg

SEQ ID NO: 563241 - DNA, 20 bp, Artificial Sequence
  chemically synthesized
tgtttagttctatcgcaaag

SEQ ID NO: 563242 - DNA, 20 bp, Artificial Sequence
  chemically synthesized
gaatatatatttttcattgg

SEQ ID NO: 563243 - DNA, 20 bp, Artificial Sequence
  chemically synthesized
tatatcaaggcagcgataaa

SEQ ID NO: 563244 - DNA, 20 bp, Artificial Sequence
  chemically synthesized
tttattgctccagtaggctt

SEQ ID NO: 563245 - DNA, 20 bp, Artificial Sequence
  chemically synthesized
ttcggagaaaaacgaatagg

SEQ ID NO: 563246 - DNA, 20 bp, Artificial Sequence
  chemically synthesized
ggaggcaattaccttcggag

SEQ ID NO: 563247 - DNA, 20 bp, Artificial Sequence
  chemically synthesized
ttttaaagccttctaaacac

SEQ ID NO: 563248 - DNA, 20 bp, Artificial Sequence
  chemically synthesized
agtattctttattttagcag

SEQ ID NO: 563249 - DNA, 20 bp, Artificial Sequence
  chemically synthesized
atttcagttgtgaattatgc

SEQ ID NO: 563250 - DNA, 20 bp, Artificial Sequence
  chemically synthesized
atttctctggtgccaattct

SEQ ID NO: 563251 - DNA, 20 bp, Artificial Sequence
  chemically synthesized
aactgtattcacttaataca

SEQ ID NO: 563252 - DNA, 20 bp, Artificial Sequence
  chemically synthesized
aggcgagcccaaaattgata

SEQ ID NO: 563253 - DNA, 20 bp, Artificial Sequence
  chemically synthesized
actttaacaaatggtacaat

SEQ ID NO: 563254 - DNA, 20 bp, Artificial Sequence
  chemically synthesized
atgttatgacaataatattc

SEQ ID NO: 563255 - DNA, 20 bp, Artificial Sequence
  chemically synthesized
ccagcaaaaggtgtatgaga

SEQ ID NO: 563256 - DNA, 20 bp, Artificial Sequence
  chemically synthesized
cataaggcctaattttaatt

SEQ ID NO: 563257 - DNA, 20 bp, Artificial Sequence
  chemically synthesized
gcatataagcaaaattttca

SEQ ID NO: 563258 - DNA, 20 bp, Artificial Sequence
  chemically synthesized
acttagagccaaatcagccc

SEQ ID NO: 563259 - DNA, 20 bp, Artificial Sequence
  chemically synthesized
aacaagggtttatgtttgta

SEQ ID NO: 563260 - DNA, 20 bp, Artificial Sequence
  chemically synthesized
ccatgcattagaatcaccgg

SEQ ID NO: 563261 - DNA, 20 bp, Artificial Sequence
  chemically synthesized
accctaaagtgtatgtttct

SEQ ID NO: 563262 - DNA, 20 bp, Artificial Sequence
  chemically synthesized
caataactacaattcagtat

SEQ ID NO: 563263 - DNA, 20 bp, Artificial Sequence
  chemically synthesized
ggtcactacaaataaagctg

SEQ ID NO: 563264 - DNA, 20 bp, Artificial Sequence
  chemically synthesized
atctagaggaatgaaaaatg

SEQ ID NO: 563265 - DNA, 20 bp, Artificial Sequence
  chemically synthesized
attggaggaatcaatgcggt

SEQ ID NO: 563266 - DNA, 20 bp, Artificial Sequence
  chemically synthesized
atgtgattgcacaaaaaaag

SEQ ID NO: 563267 - DNA, 20 bp, Artificial Sequence
  chemically synthesized
aaggaaaacagcagagtttc

SEQ ID NO: 563268 - DNA, 20 bp, Artificial Sequence
  chemically synthesized
atgaaaatttcttaaaaagc

SEQ ID NO: 563269 - DNA, 20 bp, Artificial Sequence
  chemically synthesized
tccccaaaagccattgcaac

SEQ ID NO: 563270 - DNA, 20 bp, Artificial Sequence
  chemically synthesized
tactgtaaaaaatcctagaa

SEQ ID NO: 563271 - DNA, 20 bp, Artificial Sequence
  chemically synthesized
tattcaatagatggtgctgg

SEQ ID NO: 563272 - DNA, 20 bp, Artificial Sequence
  chemically synthesized
aaacagcatggtactggtac

SEQ ID NO: 563273 - DNA, 20 bp, Artificial Sequence
  chemically synthesized
agagacaacacaaataaatg

SEQ ID NO: 563274 - DNA, 20 bp, Artificial Sequence
  chemically synthesized
gaactatacaaggagaacta

SEQ ID NO: 563275 - DNA, 20 bp, Artificial Sequence
  chemically synthesized
tgcaaattaacacaggaaca

SEQ ID NO: 563276 - DNA, 20 bp, Artificial Sequence
  chemically synthesized
ttctcacttataaatgggag

SEQ ID NO: 563277 - DNA, 20 bp, Artificial Sequence
  chemically synthesized
agggaagcgggtgtgagctg

SEQ ID NO: 563278 - DNA, 20 bp, Artificial Sequence
  chemically synthesized
agtttgaatgcaattcctat

SEQ ID NO: 563279 - DNA, 20 bp, Artificial Sequence
  chemically synthesized
agtaaatatatcaattcttc

SEQ ID NO: 563280 - DNA, 20 bp, Artificial Sequence
  chemically synthesized
tgaaatacttatgaatctaa

SEQ ID NO: 563281 - DNA, 20 bp, Artificial Sequence
  chemically synthesized
atttatgataaaagctctca

SEQ ID NO: 563282 - DNA, 20 bp, Artificial Sequence
  chemically synthesized
atatcaattgatggagggga

SEQ ID NO: 563283 - DNA, 20 bp, Artificial Sequence
  chemically synthesized
gtcaacaaattacagaccaa

SEQ ID NO: 563284 - DNA, 20 bp, Artificial Sequence
  chemically synthesized
aggaagaagtattttgataa

SEQ ID NO: 563285 - DNA, 20 bp, Artificial Sequence
  chemically synthesized
ttttttttaaaaaaagtctt

SEQ ID NO: 563286 - DNA, 20 bp, Artificial Sequence
  chemically synthesized
cgcatcatagtcaaatgtct

SEQ ID NO: 563287 - DNA, 20 bp, Artificial Sequence
  chemically synthesized
ataccaaattttgtaaaatg

SEQ ID NO: 563288 - DNA, 20 bp, Artificial Sequence
  chemically synthesized
acagtcgtaacaagaaggaa

SEQ ID NO: 563289 - DNA, 20 bp, Artificial Sequence
  chemically synthesized
aaattgttgagtaagctttt

SEQ ID NO: 563290 - DNA, 20 bp, Artificial Sequence
  chemically synthesized
ctatctatagagtcaagaaa

SEQ ID NO: 563291 - DNA, 20 bp, Artificial Sequence
  chemically synthesized
atttgcttaccaaatataag

SEQ ID NO: 563292 - DNA, 20 bp, Artificial Sequence
  chemically synthesized
taccaaatataagcaaaact

SEQ ID NO: 563293 - DNA, 20 bp, Artificial Sequence
  chemically synthesized
atccctgtacatttacctca

SEQ ID NO: 563294 - DNA, 20 bp, Artificial Sequence
  chemically synthesized
cccataagagatacaactat

SEQ ID NO: 563295 - DNA, 20 bp, Artificial Sequence
  chemically synthesized
gagacaagctttccagggca

SEQ ID NO: 563296 - DNA, 20 bp, Artificial Sequence
  chemically synthesized
ggagtaaagctgcatgctca

SEQ ID NO: 563297 - DNA, 20 bp, Artificial Sequence
  chemically synthesized
tgatggaaggcaagctccat

SEQ ID NO: 563298 - DNA, 20 bp, Artificial Sequence
  chemically synthesized
catagtgacaaattctcatt

SEQ ID NO: 563299 - DNA, 20 bp, Artificial Sequence
  chemically synthesized
agtgcatacggtgttatctt

SEQ ID NO: 563300 - DNA, 20 bp, Artificial Sequence
  chemically synthesized
tgcgtttgggagcagctttt

SEQ ID NO: 563301 - DNA, 20 bp, Artificial Sequence
  chemically synthesized
agaagaaaataataaagagt

SEQ ID NO: 563302 - DNA, 20 bp, Artificial Sequence
  chemically synthesized
gagtaaaaactaatcaaaat

SEQ ID NO: 563303 - DNA, 20 bp, Artificial Sequence
  chemically synthesized
actaatcaaaataaaaacag

SEQ ID NO: 563304 - DNA, 20 bp, Artificial Sequence
  chemically synthesized
ttaacaaagagctatttttt

SEQ ID NO: 563305 - DNA, 20 bp, Artificial Sequence
  chemically synthesized
ggaaatataactcataattt

SEQ ID NO: 563306 - DNA, 20 bp, Artificial Sequence
  chemically synthesized
ttccagaacatggaagggaa

SEQ ID NO: 563307 - DNA, 20 bp, Artificial Sequence
  chemically synthesized
tagcctgatacccaaaccag

SEQ ID NO: 563308 - DNA, 20 bp, Artificial Sequence
  chemically synthesized
agaaaaacagtacaaaagaa

SEQ ID NO: 563309 - DNA, 20 bp, Artificial Sequence
  chemically synthesized
acaaatgaaattcttagatc

SEQ ID NO: 563310 - DNA, 20 bp, Artificial Sequence
  chemically synthesized
acataccatatctatatgag

SEQ ID NO: 563311 - DNA, 20 bp, Artificial Sequence
  chemically synthesized
ggcaagaaaccttgaatagc

SEQ ID NO: 563312 - DNA, 20 bp, Artificial Sequence
  chemically synthesized
catgaagccccgtctgtact

SEQ ID NO: 563313 - DNA, 20 bp, Artificial Sequence
  chemically synthesized
aaacaaacaaacaaacaaac

SEQ ID NO: 563314 - DNA, 20 bp, Artificial Sequence
  chemically synthesized
agaaacttaaatgtaaaatg

SEQ ID NO: 563315 - DNA, 20 bp, Artificial Sequence
  chemically synthesized
ctgttaaaaatcaacaataa

SEQ ID NO: 563316 - DNA, 20 bp, Artificial Sequence
  chemically synthesized
aactctattttaaaaatggg

SEQ ID NO: 563317 - DNA, 20 bp, Artificial Sequence
  chemically synthesized
ccaaagaagatatacagatg

SEQ ID NO: 563318 - DNA, 20 bp, Artificial Sequence
  chemically synthesized
gtcatcaggaaattgcaaat

SEQ ID NO: 563319 - DNA, 20 bp, Artificial Sequence
  chemically synthesized
atcagtttaaggatttttta

SEQ ID NO: 563320 - DNA, 20 bp, Artificial Sequence
  chemically synthesized
ggtatttacccaaataagct

SEQ ID NO: 563321 - DNA, 20 bp, Artificial Sequence
  chemically synthesized
ctgaaaacttatgtccgcac

SEQ ID NO: 563322 - DNA, 20 bp, Artificial Sequence
  chemically synthesized
taaatttgtccaaacacaca

SEQ ID NO: 563323 - DNA, 20 bp, Artificial Sequence
  chemically synthesized
gatgttctatgatttacttc

SEQ ID NO: 563324 - DNA, 20 bp, Artificial Sequence
  chemically synthesized
ggcaatggatttagaatagc

SEQ ID NO: 563325 - DNA, 20 bp, Artificial Sequence
  chemically synthesized
caaaataataaatattttac

SEQ ID NO: 563326 - DNA, 20 bp, Artificial Sequence
  chemically synthesized
aattcatgtaacccaaaagt

SEQ ID NO: 563327 - DNA, 20 bp, Artificial Sequence
  chemically synthesized
gctcttagggaaattcgaat

SEQ ID NO: 563328 - DNA, 20 bp, Artificial Sequence
  chemically synthesized
taaaagtttggtgcattgta

SEQ ID NO: 563329 - DNA, 20 bp, Artificial Sequence
  chemically synthesized
aaatgaaaatttgctcataa

SEQ ID NO: 563330 - DNA, 20 bp, Artificial Sequence
  chemically synthesized
gcatacaaataaatataaga

SEQ ID NO: 563331 - DNA, 20 bp, Artificial Sequence
  chemically synthesized
taaaatatttagagtcttgt

SEQ ID NO: 563332 - DNA, 20 bp, Artificial Sequence
  chemically synthesized
attgtgttattgttaatact

SEQ ID NO: 563333 - DNA, 20 bp, Artificial Sequence
  chemically synthesized
actacacaagaaagagtaaa

SEQ ID NO: 563334 - DNA, 20 bp, Artificial Sequence
  chemically synthesized
ttatttttttactctgttct

SEQ ID NO: 563335 - DNA, 20 bp, Artificial Sequence
  chemically synthesized
cagaaaaaccttatcaggat

SEQ ID NO: 563336 - DNA, 20 bp, Artificial Sequence
  chemically synthesized
atgacacattaaaccttcag

SEQ ID NO: 563337 - DNA, 20 bp, Artificial Sequence
  chemically synthesized
ctctctctctctctctcttt

SEQ ID NO: 563338 - DNA, 20 bp, Artificial Sequence
  chemically synthesized
gcattctgtagtgaggtatt

SEQ ID NO: 563339 - DNA, 20 bp, Artificial Sequence
  chemically synthesized
gccttaaaaagaaatggaaa

SEQ ID NO: 563340 - DNA, 20 bp, Artificial Sequence
  chemically synthesized
ttttgagacataaaccaata

SEQ ID NO: 563341 - DNA, 20 bp, Artificial Sequence
  chemically synthesized
cacaatgtttaaacatttta

SEQ ID NO: 563342 - DNA, 20 bp, Artificial Sequence
  chemically synthesized
aaggtattacctcagaatat

SEQ ID NO: 563343 - DNA, 20 bp, Artificial Sequence
  chemically synthesized
ttggagaagggctacttcga

SEQ ID NO: 563344 - DNA, 20 bp, Artificial Sequence
  chemically synthesized
cttcgataaaacctcagtat

SEQ ID NO: 563345 - DNA, 20 bp, Artificial Sequence
  chemically synthesized
aaattgaaaccacagtgaga

SEQ ID NO: 563346 - DNA, 20 bp, Artificial Sequence
  chemically synthesized
gactatatacgaagaactta

SEQ ID NO: 563347 - DNA, 20 bp, Artificial Sequence
  chemically synthesized
aatatttgcatatcagttgc

SEQ ID NO: 563348 - DNA, 20 bp, Artificial Sequence
  chemically synthesized
aaattggacttcgttaaaat

SEQ ID NO: 563349 - DNA, 20 bp, Artificial Sequence
  chemically synthesized
tagcacaatccataaaaaag

SEQ ID NO: 563350 - DNA, 20 bp, Artificial Sequence
  chemically synthesized
taaaactacaaatattttag

SEQ ID NO: 563351 - DNA, 20 bp, Artificial Sequence
  chemically synthesized
caaatgtcaaatataaaaca

SEQ ID NO: 563352 - DNA, 20 bp, Artificial Sequence
  chemically synthesized
attatctcaaatgtcaaata

SEQ ID NO: 563353 - DNA, 20 bp, Artificial Sequence
  chemically synthesized
agcaagtagacatctaaagg

SEQ ID NO: 563354 - DNA, 20 bp, Artificial Sequence
  chemically synthesized
tcaaacaccactcacttaga

SEQ ID NO: 563355 - DNA, 20 bp, Artificial Sequence
  chemically synthesized
tattttagtagaaatggcat

SEQ ID NO: 563356 - DNA, 20 bp, Artificial Sequence
  chemically synthesized
ctcaatgcaaaacactgttg

SEQ ID NO: 563357 - DNA, 20 bp, Artificial Sequence
  chemically synthesized
aacacagtctaatctcaatg

SEQ ID NO: 563358 - DNA, 20 bp, Artificial Sequence
  chemically synthesized
tgtaagtatattagaaatat

SEQ ID NO: 563359 - DNA, 20 bp, Artificial Sequence
  chemically synthesized
tagaaaagaaagcagatttt

SEQ ID NO: 563360 - DNA, 20 bp, Artificial Sequence
  chemically synthesized
aggctaaagaaaagtaatta

SEQ ID NO: 563361 - DNA, 20 bp, Artificial Sequence
  chemically synthesized
tcattttacaacatgtatca

SEQ ID NO: 563362 - DNA, 20 bp, Artificial Sequence
  chemically synthesized
tgcagtattaacctgtatca

SEQ ID NO: 563363 - DNA, 20 bp, Artificial Sequence
  chemically synthesized
aaatgaattcttaagtatct

SEQ ID NO: 563364 - DNA, 20 bp, Artificial Sequence
  chemically synthesized
gtgctaagttttccagaatc

SEQ ID NO: 563365 - DNA, 20 bp, Artificial Sequence
  chemically synthesized
ctgatttgttttggattctg

SEQ ID NO: 563366 - DNA, 20 bp, Artificial Sequence
  chemically synthesized
acccttgagttctgagttta

SEQ ID NO: 563367 - DNA, 20 bp, Artificial Sequence
  chemically synthesized
tctagtgagtattttatact

SEQ ID NO: 563368 - DNA, 20 bp, Artificial Sequence
  chemically synthesized
attcaacatggatggttcaa

SEQ ID NO: 563369 - DNA, 20 bp, Artificial Sequence
  chemically synthesized
tgtttatgccttccattggc

SEQ ID NO: 563370 - DNA, 20 bp, Artificial Sequence
  chemically synthesized
agagaaggaaaaaatgaaag

SEQ ID NO: 563371 - DNA, 20 bp, Artificial Sequence
  chemically synthesized
tgggaatattctgtgtggga

SEQ ID NO: 563372 - DNA, 20 bp, Artificial Sequence
  chemically synthesized
acggattggagtgggagcag

SEQ ID NO: 563373 - DNA, 20 bp, Artificial Sequence
  chemically synthesized
tacacacacatgagtatagg

SEQ ID NO: 563374 - DNA, 20 bp, Artificial Sequence
  chemically synthesized
ggaactggtgcgtgctcaca

SEQ ID NO: 563375 - DNA, 20 bp, Artificial Sequence
  chemically synthesized
tgtgtaggactaacaaatta

SEQ ID NO: 563376 - DNA, 20 bp, Artificial Sequence
  chemically synthesized
ctaaatgattaaactgttgt

SEQ ID NO: 563377 - DNA, 20 bp, Artificial Sequence
  chemically synthesized
gaaacattttccaaagtttg

SEQ ID NO: 563378 - DNA, 20 bp, Artificial Sequence
  chemically synthesized
ctgtccgttatagtattaag

SEQ ID NO: 563379 - DNA, 20 bp, Artificial Sequence
  chemically synthesized
aaccacttttctctcctagc

SEQ ID NO: 563380 - DNA, 20 bp, Artificial Sequence
  chemically synthesized
tgttcatgcatccagcgagc

SEQ ID NO: 563381 - DNA, 20 bp, Artificial Sequence
  chemically synthesized
agggaaacggttgtacaata

SEQ ID NO: 563382 - DNA, 20 bp, Artificial Sequence
  chemically synthesized
tataaggtttccaaataata

SEQ ID NO: 563383 - DNA, 20 bp, Artificial Sequence
  chemically synthesized
acggatatattaaaaatata

SEQ ID NO: 563384 - DNA, 20 bp, Artificial Sequence
  chemically synthesized
gtattgaaaaatttagtaat

SEQ ID NO: 563385 - DNA, 20 bp, Artificial Sequence
  chemically synthesized
aacataaaattgtcccatga

SEQ ID NO: 563386 - DNA, 20 bp, Artificial Sequence
  chemically synthesized
gagggaggtcttcaaagttg

SEQ ID NO: 563387 - DNA, 20 bp, Artificial Sequence
  chemically synthesized
atactgggttgatggtttat

SEQ ID NO: 563388 - DNA, 20 bp, Artificial Sequence
  chemically synthesized
tattcacattttgcagataa

SEQ ID NO: 563389 - DNA, 20 bp, Artificial Sequence
  chemically synthesized
ctcggttatagctttggaca

SEQ ID NO: 563390 - DNA, 20 bp, Artificial Sequence
  chemically synthesized
agtcctgtgacgttaaaccc

SEQ ID NO: 563391 - DNA, 20 bp, Artificial Sequence
  chemically synthesized
agggcttccatcaatactga

SEQ ID NO: 563392 - DNA, 20 bp, Artificial Sequence
  chemically synthesized
ttcatttaaaaaataagctt

SEQ ID NO: 563393 - DNA, 20 bp, Artificial Sequence
  chemically synthesized
tgcaaactttttttcaagca

SEQ ID NO: 563394 - DNA, 20 bp, Artificial Sequence
  chemically synthesized
gttacgtgtataaagtgcag

SEQ ID NO: 563395 - DNA, 20 bp, Artificial Sequence
  chemically synthesized
aggggctttctcaaaaaaat

SEQ ID NO: 563396 - DNA, 20 bp, Artificial Sequence
  chemically synthesized
gaattaatataaccattatt

SEQ ID NO: 563397 - DNA, 20 bp, Artificial Sequence
  chemically synthesized
cacatagccaacaggaatac

SEQ ID NO: 563398 - DNA, 20 bp, Artificial Sequence
  chemically synthesized
ctcaaacaaataaatagcaa

SEQ ID NO: 563399 - DNA, 20 bp, Artificial Sequence
  chemically synthesized
aagaatcaacagagtgaaga

SEQ ID NO: 563400 - DNA, 20 bp, Artificial Sequence
  chemically synthesized
gacctcaaaagcacaggaaa

SEQ ID NO: 563401 - DNA, 20 bp, Artificial Sequence
  chemically synthesized
agacacatagaccaatggaa

SEQ ID NO: 563402 - DNA, 20 bp, Artificial Sequence
  chemically synthesized
aaaacagatggtgctggcat

SEQ ID NO: 563403 - DNA, 20 bp, Artificial Sequence
  chemically synthesized
tactacaaagctatggtaac

SEQ ID NO: 563404 - DNA, 20 bp, Artificial Sequence
  chemically synthesized
ataatgttgagcaaaaagaa

SEQ ID NO: 563405 - DNA, 20 bp, Artificial Sequence
  chemically synthesized
acagtcaatgcaatctttat

SEQ ID NO: 563406 - DNA, 20 bp, Artificial Sequence
  chemically synthesized
agtgaagtaactcaggaatg

SEQ ID NO: 563407 - DNA, 20 bp, Artificial Sequence
  chemically synthesized
actagtatacaaccgctatg

SEQ ID NO: 563408 - DNA, 20 bp, Artificial Sequence
  chemically synthesized
tggccataatcaaaaaatca

SEQ ID NO: 563409 - DNA, 20 bp, Artificial Sequence
  chemically synthesized
atgatcagggaaatgcaaat

SEQ ID NO: 563410 - DNA, 20 bp, Artificial Sequence
  chemically synthesized
aacccaaaagcaaatgcagt

SEQ ID NO: 563411 - DNA, 20 bp, Artificial Sequence
  chemically synthesized
attctagaagataacattgg

SEQ ID NO: 563412 - DNA, 20 bp, Artificial Sequence
  chemically synthesized
ctggtgtaaaaaattccacc

SEQ ID NO: 563413 - DNA, 20 bp, Artificial Sequence
  chemically synthesized
agtcaaaatggctattatta

SEQ ID NO: 563414 - DNA, 20 bp, Artificial Sequence
  chemically synthesized
aatgtggtatatatacacaa

SEQ ID NO: 563415 - DNA, 20 bp, Artificial Sequence
  chemically synthesized
atataattttaaaggattcc

SEQ ID NO: 563416 - DNA, 20 bp, Artificial Sequence
  chemically synthesized
agaccttgcctactcagtta

SEQ ID NO: 563417 - DNA, 20 bp, Artificial Sequence
  chemically synthesized
cttcccaaatgccatagaaa

SEQ ID NO: 563418 - DNA, 20 bp, Artificial Sequence
  chemically synthesized
ggagcaaaaatgtctatatt

SEQ ID NO: 563419 - DNA, 20 bp, Artificial Sequence
  chemically synthesized
cttattgaaatgcattagtt

SEQ ID NO: 563420 - DNA, 20 bp, Artificial Sequence
  chemically synthesized
aaacactcactctgaatagt

SEQ ID NO: 563421 - DNA, 20 bp, Artificial Sequence
  chemically synthesized
gtcaaaactgatgaaattaa

SEQ ID NO: 563422 - DNA, 20 bp, Artificial Sequence
  chemically synthesized
agtctagagaactggctggc

SEQ ID NO: 563423 - DNA, 20 bp, Artificial Sequence
  chemically synthesized
tttaaaaatgtggaatcatg

SEQ ID NO: 563424 - DNA, 20 bp, Artificial Sequence
  chemically synthesized
taatccattaagaacagaat

SEQ ID NO: 563425 - DNA, 20 bp, Artificial Sequence
  chemically synthesized
aatatgatctatgttgtacc

SEQ ID NO: 563426 - DNA, 20 bp, Artificial Sequence
  chemically synthesized
ttctgtaactaggaacacta

SEQ ID NO: 563427 - DNA, 20 bp, Artificial Sequence
  chemically synthesized
caaatgtaatgtacgtattt

SEQ ID NO: 563428 - DNA, 20 bp, Artificial Sequence
  chemically synthesized
aaaacaaacaaacaagcaaa

SEQ ID NO: 563429 - DNA, 20 bp, Artificial Sequence
  chemically synthesized
tccatctcaaaaaaacaaaa

SEQ ID NO: 563430 - DNA, 20 bp, Artificial Sequence
  chemically synthesized
gagattccatctcaaaaaaa

SEQ ID NO: 563431 - DNA, 20 bp, Artificial Sequence
  chemically synthesized
agagcgagattccatctcaa

SEQ ID NO: 563432 - DNA, 20 bp, Artificial Sequence
  chemically synthesized
tggtgaagccccgtctctac

SEQ ID NO: 563433 - DNA, 20 bp, Artificial Sequence
  chemically synthesized
ttaaggctttgtttaagtac

SEQ ID NO: 563434 - DNA, 20 bp, Artificial Sequence
  chemically synthesized
atcttatagttgttctacta

SEQ ID NO: 563435 - DNA, 20 bp, Artificial Sequence
  chemically synthesized
agtagttagtgcaaataact

SEQ ID NO: 563436 - DNA, 20 bp, Artificial Sequence
  chemically synthesized
cattattttatttttgtttt

SEQ ID NO: 563437 - DNA, 20 bp, Artificial Sequence
  chemically synthesized
ctatctgtgaaacttgtttt

SEQ ID NO: 563438 - DNA, 20 bp, Artificial Sequence
  chemically synthesized
ttctcacattttatttttag

SEQ ID NO: 563439 - DNA, 20 bp, Artificial Sequence
  chemically synthesized
tccagcctgggcaacaagag

SEQ ID NO: 563440 - DNA, 20 bp, Artificial Sequence
  chemically synthesized
gaaatgatgaagaaattatt

SEQ ID NO: 563441 - DNA, 20 bp, Artificial Sequence
  chemically synthesized
aaatccaacattataattca

SEQ ID NO: 563442 - DNA, 20 bp, Artificial Sequence
  chemically synthesized
aaaaaagaaccacaacaaca

SEQ ID NO: 563443 - DNA, 20 bp, Artificial Sequence
  chemically synthesized
tgtggaataattgtcttcca

SEQ ID NO: 563444 - DNA, 20 bp, Artificial Sequence
  chemically synthesized
tattagaagacacacatata

SEQ ID NO: 563445 - DNA, 20 bp, Artificial Sequence
  chemically synthesized
aagcattactttctatttgc

SEQ ID NO: 563446 - DNA, 20 bp, Artificial Sequence
  chemically synthesized
atagaagtaactattcatat

SEQ ID NO: 563447 - DNA, 20 bp, Artificial Sequence
  chemically synthesized
taaaatataaatataattat

SEQ ID NO: 563448 - DNA, 20 bp, Artificial Sequence
  chemically synthesized
atgatttgaaagcattgatg

SEQ ID NO: 563449 - DNA, 20 bp, Artificial Sequence
  chemically synthesized
taagttagtgcgtactataa

SEQ ID NO: 563450 - DNA, 20 bp, Artificial Sequence
  chemically synthesized
tccaatataccattatatta

SEQ ID NO: 563451 - DNA, 20 bp, Artificial Sequence
  chemically synthesized
tccccagagataccaactga

SEQ ID NO: 563452 - DNA, 20 bp, Artificial Sequence
  chemically synthesized
accatgcctcttgaacacga

SEQ ID NO: 563453 - DNA, 20 bp, Artificial Sequence
  chemically synthesized
agatgatttacaggaaagca

SEQ ID NO: 563454 - DNA, 20 bp, Artificial Sequence
  chemically synthesized
aagcataaaacaaacaaaaa

SEQ ID NO: 563455 - DNA, 20 bp, Artificial Sequence
  chemically synthesized
taaaacaaacaaaaataaaa

SEQ ID NO: 563456 - DNA, 20 bp, Artificial Sequence
  chemically synthesized
aaacaaaaataaaacaaaac

SEQ ID NO: 563457 - DNA, 20 bp, Artificial Sequence
  chemically synthesized
tcattaatggacatgacatt

SEQ ID NO: 563458 - DNA, 20 bp, Artificial Sequence
  chemically synthesized
atgttctacattctttgctt

SEQ ID NO: 563459 - DNA, 20 bp, Artificial Sequence
  chemically synthesized
taggtatttcctcataaggg

SEQ ID NO: 563460 - DNA, 20 bp, Artificial Sequence
  chemically synthesized
tgacaaaaataaaatcaaag

SEQ ID NO: 563461 - DNA, 20 bp, Artificial Sequence
  chemically synthesized
aatagtaatttattcatgta

SEQ ID NO: 563462 - DNA, 20 bp, Artificial Sequence
  chemically synthesized
atttgctctcaggtttatta

SEQ ID NO: 563463 - DNA, 20 bp, Artificial Sequence
  chemically synthesized
cttataatagtggggagata

SEQ ID NO: 563464 - DNA, 20 bp, Artificial Sequence
  chemically synthesized
cgaaagaaataaatcagaga

SEQ ID NO: 563465 - DNA, 20 bp, Artificial Sequence
  chemically synthesized
tataaaataataagagttat

SEQ ID NO: 563466 - DNA, 20 bp, Artificial Sequence
  chemically synthesized
agttattaaaacttgtttag

SEQ ID NO: 563467 - DNA, 20 bp, Artificial Sequence
  chemically synthesized
atgaaatcaaaacctttatc

SEQ ID NO: 563468 - DNA, 20 bp, Artificial Sequence
  chemically synthesized
aaaaatttaactcatgaaat

SEQ ID NO: 563469 - DNA, 20 bp, Artificial Sequence
  chemically synthesized
gatatttaccaactatcaag

SEQ ID NO: 563470 - DNA, 20 bp, Artificial Sequence
  chemically synthesized
caaataccacttgattattt

SEQ ID NO: 563471 - DNA, 20 bp, Artificial Sequence
  chemically synthesized
tctcaaaagaattccacatc

SEQ ID NO: 563472 - DNA, 20 bp, Artificial Sequence
  chemically synthesized
atcttatgcaatgctacaat

SEQ ID NO: 563473 - DNA, 20 bp, Artificial Sequence
  chemically synthesized
tgcaatgctacaataaaaac

SEQ ID NO: 563474 - DNA, 20 bp, Artificial Sequence
  chemically synthesized
aatcatatgcatgaagaaag

SEQ ID NO: 563475 - DNA, 20 bp, Artificial Sequence
  chemically synthesized
tattagggacaatttcatgt

SEQ ID NO: 563476 - DNA, 20 bp, Artificial Sequence
  chemically synthesized
aatcaactaccatattgaga

SEQ ID NO: 563477 - DNA, 20 bp, Artificial Sequence
  chemically synthesized
attttatttccaagtattaa

SEQ ID NO: 563478 - DNA, 20 bp, Artificial Sequence
  chemically synthesized
agttcttaaaatgtcatgca

SEQ ID NO: 563479 - DNA, 20 bp, Artificial Sequence
  chemically synthesized
atgacattttaagaactgta

SEQ ID NO: 563480 - DNA, 20 bp, Artificial Sequence
  chemically synthesized
gtgaaataaatgacattgtg

SEQ ID NO: 563481 - DNA, 20 bp, Artificial Sequence
  chemically synthesized
cgttgtttgtcttgtttcat

SEQ ID NO: 563482 - DNA, 20 bp, Artificial Sequence
  chemically synthesized
taaaaatattgctttgatgg

SEQ ID NO: 563483 - DNA, 20 bp, Artificial Sequence
  chemically synthesized
ttatgtagtacatactcaat

SEQ ID NO: 563484 - DNA, 20 bp, Artificial Sequence
  chemically synthesized
aatacctgctatgatatgga

SEQ ID NO: 563485 - DNA, 20 bp, Artificial Sequence
  chemically synthesized
tgcgtttaaaaaattgtgct

SEQ ID NO: 563486 - DNA, 20 bp, Artificial Sequence
  chemically synthesized
taaaaaaacatttactagga

SEQ ID NO: 563487 - DNA, 20 bp, Artificial Sequence
  chemically synthesized
aaaacaaagtctatttttaa

SEQ ID NO: 563488 - DNA, 20 bp, Artificial Sequence
  chemically synthesized
gtgaacgtaaaactcctcta

SEQ ID NO: 563489 - DNA, 20 bp, Artificial Sequence
  chemically synthesized
acttagtcctgctgtgaacg

SEQ ID NO: 563490 - DNA, 20 bp, Artificial Sequence
  chemically synthesized
catacagcttcccccaccat

SEQ ID NO: 563491 - DNA, 20 bp, Artificial Sequence
  chemically synthesized
aattcaaatgctccaaaatt

SEQ ID NO: 563492 - DNA, 20 bp, Artificial Sequence
  chemically synthesized
atgtggcattctagaaatgg

SEQ ID NO: 563493 - DNA, 20 bp, Artificial Sequence
  chemically synthesized
agcttaaaacatatccacac

SEQ ID NO: 563494 - DNA, 20 bp, Artificial Sequence
  chemically synthesized
ggtatttacccagataagct

SEQ ID NO: 563495 - DNA, 20 bp, Artificial Sequence
  chemically synthesized
aacaatttggcagtttctca

SEQ ID NO: 563496 - DNA, 20 bp, Artificial Sequence
  chemically synthesized
aaaagggtacagcctctttg

SEQ ID NO: 563497 - DNA, 20 bp, Artificial Sequence
  chemically synthesized
ctcttagaatggccaaaatc

SEQ ID NO: 563498 - DNA, 20 bp, Artificial Sequence
  chemically synthesized
atcttcaagtgatgtgttct

SEQ ID NO: 563499 - DNA, 20 bp, Artificial Sequence
  chemically synthesized
ttgtataaagtgatgagcaa

SEQ ID NO: 563500 - DNA, 20 bp, Artificial Sequence
  chemically synthesized
ggaaactagcatgatagctg

SEQ ID NO: 563501 - DNA, 20 bp, Artificial Sequence
  chemically synthesized
agacagtaatatagatacat

SEQ ID NO: 563502 - DNA, 20 bp, Artificial Sequence
  chemically synthesized
atgacacagtacaattaaca

SEQ ID NO: 563503 - DNA, 20 bp, Artificial Sequence
  chemically synthesized
ttgactttacaatgtcaaat

SEQ ID NO: 563504 - DNA, 20 bp, Artificial Sequence
  chemically synthesized
aaataacgggagattaaata

SEQ ID NO: 563505 - DNA, 20 bp, Artificial Sequence
  chemically synthesized
ccatgaaggcagaagcagcc

SEQ ID NO: 563506 - DNA, 20 bp, Artificial Sequence
  chemically synthesized
ataaaggcctaaaaaaggca

SEQ ID NO: 563507 - DNA, 20 bp, Artificial Sequence
  chemically synthesized
tcaacaataaaattaaaaga

SEQ ID NO: 563508 - DNA, 20 bp, Artificial Sequence
  chemically synthesized
ataaaaagaacaagtagtta

SEQ ID NO: 563509 - DNA, 20 bp, Artificial Sequence
  chemically synthesized
tatctaagaaagttttgaag

SEQ ID NO: 563510 - DNA, 20 bp, Artificial Sequence
  chemically synthesized
caccctaacttgtttttctt

SEQ ID NO: 563511 - DNA, 20 bp, Artificial Sequence
  chemically synthesized
tgtatatactaatctcgatg

SEQ ID NO: 563512 - DNA, 20 bp, Artificial Sequence
  chemically synthesized
aaattattcactattcacaa

SEQ ID NO: 563513 - DNA, 20 bp, Artificial Sequence
  chemically synthesized
gagaccgatgagtgaaaggg

SEQ ID NO: 563514 - DNA, 20 bp, Artificial Sequence
  chemically synthesized
tataaaagatacattgatca

SEQ ID NO: 563515 - DNA, 20 bp, Artificial Sequence
  chemically synthesized
aatatatatatatatatata

SEQ ID NO: 563516 - DNA, 20 bp, Artificial Sequence
  chemically synthesized
agaaagaaaattccatagct

SEQ ID NO: 563517 - DNA, 20 bp, Artificial Sequence
  chemically synthesized
attgcacaaatatacaagtt

SEQ ID NO: 563518 - DNA, 20 bp, Artificial Sequence
  chemically synthesized
ccttgccagataataattct

SEQ ID NO: 563519 - DNA, 20 bp, Artificial Sequence
  chemically synthesized
aataaaattttgaaaggaaa

SEQ ID NO: 563520 - DNA, 20 bp, Artificial Sequence
  chemically synthesized
taaacaagactttaggcggt

SEQ ID NO: 563521 - DNA, 20 bp, Artificial Sequence
  chemically synthesized
ttaccgcctaaagtcttgtt

SEQ ID NO: 563522 - DNA, 20 bp, Artificial Sequence
  chemically synthesized
ccaatcaatatatgtaaaaa

SEQ ID NO: 563523 - DNA, 20 bp, Artificial Sequence
  chemically synthesized
cttgaaatattactgacctc

SEQ ID NO: 563524 - DNA, 20 bp, Artificial Sequence
  chemically synthesized
aggatctaggcaaaattcag

SEQ ID NO: 563525 - DNA, 20 bp, Artificial Sequence
  chemically synthesized
ttttttgctacaattgaaaa

SEQ ID NO: 563526 - DNA, 20 bp, Artificial Sequence
  chemically synthesized
acgttccaggatatttaatg

SEQ ID NO: 563527 - DNA, 20 bp, Artificial Sequence
  chemically synthesized
atattaatagaattccacgt

SEQ ID NO: 563528 - DNA, 20 bp, Artificial Sequence
  chemically synthesized
accccattatgttctctata

SEQ ID NO: 563529 - DNA, 20 bp, Artificial Sequence
  chemically synthesized
aaaaatccaagactttcttc

SEQ ID NO: 563530 - DNA, 20 bp, Artificial Sequence
  chemically synthesized
aagggatgttggattttatt

SEQ ID NO: 563531 - DNA, 20 bp, Artificial Sequence
  chemically synthesized
atccaacatcccttcatgat

SEQ ID NO: 563532 - DNA, 20 bp, Artificial Sequence
  chemically synthesized
attcccactgagaactggaa

SEQ ID NO: 563533 - DNA, 20 bp, Artificial Sequence
  chemically synthesized
acttccagtactatgtttaa

SEQ ID NO: 563534 - DNA, 20 bp, Artificial Sequence
  chemically synthesized
acggtatgattctatactta

SEQ ID NO: 563535 - DNA, 20 bp, Artificial Sequence
  chemically synthesized
ataaaaatatatttttatag

SEQ ID NO: 563536 - DNA, 20 bp, Artificial Sequence
  chemically synthesized
gatctctgtaaggagtatta

SEQ ID NO: 563537 - DNA, 20 bp, Artificial Sequence
  chemically synthesized
attaaaatggctatactgca

SEQ ID NO: 563538 - DNA, 20 bp, Artificial Sequence
  chemically synthesized
tcattcctcacagaattaga

SEQ ID NO: 563539 - DNA, 20 bp, Artificial Sequence
  chemically synthesized
tagaccaatggaacagaata

SEQ ID NO: 563540 - DNA, 20 bp, Artificial Sequence
  chemically synthesized
cagccttcgacaaggctggc

SEQ ID NO: 563541 - DNA, 20 bp, Artificial Sequence
  chemically synthesized
aaagatattaatgtaagacc

SEQ ID NO: 563542 - DNA, 20 bp, Artificial Sequence
  chemically synthesized
aagcagcctgaccaacgtgg

SEQ ID NO: 563543 - DNA, 20 bp, Artificial Sequence
  chemically synthesized
atcatcagagaaatgaaaag

SEQ ID NO: 563544 - DNA, 20 bp, Artificial Sequence
  chemically synthesized
tggagatttctcacagaact

SEQ ID NO: 563545 - DNA, 20 bp, Artificial Sequence
  chemically synthesized
agcgaagtaatgcaagaaca

SEQ ID NO: 563546 - DNA, 20 bp, Artificial Sequence
  chemically synthesized
gagtacacatgcagatttgt

SEQ ID NO: 563547 - DNA, 20 bp, Artificial Sequence
  chemically synthesized
taaaagtgtcctactttaaa

SEQ ID NO: 563548 - DNA, 20 bp, Artificial Sequence
  chemically synthesized
tatttgtcccaagatctttg

SEQ ID NO: 563549 - DNA, 20 bp, Artificial Sequence
  chemically synthesized
aattttaaaagtatcaagat

SEQ ID NO: 563550 - DNA, 20 bp, Artificial Sequence
  chemically synthesized
aaaattattgtataagggtt

SEQ ID NO: 563551 - DNA, 20 bp, Artificial Sequence
  chemically synthesized
acaataaatagtcagatttt

SEQ ID NO: 563552 - DNA, 20 bp, Artificial Sequence
  chemically synthesized
taagctgaggcgttccctac

SEQ ID NO: 563553 - DNA, 20 bp, Artificial Sequence
  chemically synthesized
taagggaatagtatataaac

SEQ ID NO: 563554 - DNA, 20 bp, Artificial Sequence
  chemically synthesized
aagtatcataaactttttgg

SEQ ID NO: 563555 - DNA, 20 bp, Artificial Sequence
  chemically synthesized
taatgatccttaattttacc

SEQ ID NO: 563556 - DNA, 20 bp, Artificial Sequence
  chemically synthesized
tgtgatgaaacattagatat

SEQ ID NO: 563557 - DNA, 20 bp, Artificial Sequence
  chemically synthesized
gcgagactctgtctcaaaaa

SEQ ID NO: 563558 - DNA, 20 bp, Artificial Sequence
  chemically synthesized
aaaaaaaaaaccaaaaaaaa

SEQ ID NO: 563559 - DNA, 20 bp, Artificial Sequence
  chemically synthesized
aaaaaaaaaaccaaaaaaaa

SEQ ID NO: 563560 - DNA, 20 bp, Artificial Sequence
  chemically synthesized
gaccattcaatgatttaagt

SEQ ID NO: 563561 - DNA, 20 bp, Artificial Sequence
  chemically synthesized
acatcaaaatgaaaaaaaaa

SEQ ID NO: 563562 - DNA, 20 bp, Artificial Sequence
  chemically synthesized
aatcctaaaataatttaaaa

SEQ ID NO: 563563 - DNA, 20 bp, Artificial Sequence
  chemically synthesized
tgcacattgacatttaaaat

SEQ ID NO: 563564 - DNA, 20 bp, Artificial Sequence
  chemically synthesized
gcatacatataaacatttag

SEQ ID NO: 563565 - DNA, 20 bp, Artificial Sequence
  chemically synthesized
aacactaactgttgaatcat

SEQ ID NO: 563566 - DNA, 20 bp, Artificial Sequence
  chemically synthesized
ccagcatacataagagaata

SEQ ID NO: 563567 - DNA, 20 bp, Artificial Sequence
  chemically synthesized
tctttaatatctttgacaaa

SEQ ID NO: 563568 - DNA, 20 bp, Artificial Sequence
  chemically synthesized
aggagactgccctttgctta

SEQ ID NO: 563569 - DNA, 20 bp, Artificial Sequence
  chemically synthesized
agagtcacacatgggaaaga

SEQ ID NO: 563570 - DNA, 20 bp, Artificial Sequence
  chemically synthesized
gaaaaataattgctgacatt

SEQ ID NO: 563571 - DNA, 20 bp, Artificial Sequence
  chemically synthesized
atacatatcatttgcactca

SEQ ID NO: 563572 - DNA, 20 bp, Artificial Sequence
  chemically synthesized
tgattttaatgaacttcaaa

SEQ ID NO: 563573 - DNA, 20 bp, Artificial Sequence
  chemically synthesized
atggcatttaccgaatcaga

SEQ ID NO: 563574 - DNA, 20 bp, Artificial Sequence
  chemically synthesized
gaaaaagaccctatcagcac

SEQ ID NO: 563575 - DNA, 20 bp, Artificial Sequence
  chemically synthesized
cttcatgattcaactaaatt

SEQ ID NO: 563576 - DNA, 20 bp, Artificial Sequence
  chemically synthesized
cactcaatatttacatcttg

SEQ ID NO: 563577 - DNA, 20 bp, Artificial Sequence
  chemically synthesized
atagtgagaccctgtctaca

SEQ ID NO: 563578 - DNA, 20 bp, Artificial Sequence
  chemically synthesized
caagagtgagaacctgtctc

SEQ ID NO: 563579 - DNA, 20 bp, Artificial Sequence
  chemically synthesized
tcaaaaacaaacaagcaagc

SEQ ID NO: 563580 - DNA, 20 bp, Artificial Sequence
  chemically synthesized
agcgaattaacacagaaaca

SEQ ID NO: 563581 - DNA, 20 bp, Artificial Sequence
  chemically synthesized
aagtacttttcaagacctac

SEQ ID NO: 563582 - DNA, 20 bp, Artificial Sequence
  chemically synthesized
ttagaccgatcactgaggca

SEQ ID NO: 563583 - DNA, 20 bp, Artificial Sequence
  chemically synthesized
catctacatactactttacc

SEQ ID NO: 563584 - DNA, 20 bp, Artificial Sequence
  chemically synthesized
tcaataccaagaggacctct

SEQ ID NO: 563585 - DNA, 20 bp, Artificial Sequence
  chemically synthesized
atgtaattgcttaaaaaaaa

SEQ ID NO: 563586 - DNA, 20 bp, Artificial Sequence
  chemically synthesized
tcatagcagccttatagtac

SEQ ID NO: 563587 - DNA, 20 bp, Artificial Sequence
  chemically synthesized
ttgtggatacgtttctgtat

SEQ ID NO: 563588 - DNA, 20 bp, Artificial Sequence
  chemically synthesized
ttaatcattcttaaaaaaat

SEQ ID NO: 563589 - DNA, 20 bp, Artificial Sequence
  chemically synthesized
accattagtaaaatggaaat

SEQ ID NO: 563590 - DNA, 20 bp, Artificial Sequence
  chemically synthesized
aaaactacataaagagctct

SEQ ID NO: 563591 - DNA, 20 bp, Artificial Sequence
  chemically synthesized
tagatatcaagaactagtat

SEQ ID NO: 563592 - DNA, 20 bp, Artificial Sequence
  chemically synthesized
aagtgaacctcattaaaata

SEQ ID NO: 563593 - DNA, 20 bp, Artificial Sequence
  chemically synthesized
catcagaagaacttaaactg

SEQ ID NO: 563594 - DNA, 20 bp, Artificial Sequence
  chemically synthesized
ccataggcaaaaaacaaaca

SEQ ID NO: 563595 - DNA, 20 bp, Artificial Sequence
  chemically synthesized
taatccaacacccataggca

SEQ ID NO: 563596 - DNA, 20 bp, Artificial Sequence
  chemically synthesized
tactggattcctgcttcgtc

SEQ ID NO: 563597 - DNA, 20 bp, Artificial Sequence
  chemically synthesized
ggcacaggacctatactagc

SEQ ID NO: 563598 - DNA, 20 bp, Artificial Sequence
  chemically synthesized
taataagcctgtgtaagttc

SEQ ID NO: 563599 - DNA, 20 bp, Artificial Sequence
  chemically synthesized
tacattatgttcatggattg

SEQ ID NO: 563600 - DNA, 20 bp, Artificial Sequence
  chemically synthesized
actcttacatataaaactaa

SEQ ID NO: 563601 - DNA, 20 bp, Artificial Sequence
  chemically synthesized
gaaaatgaaactcttacata

SEQ ID NO: 563602 - DNA, 20 bp, Artificial Sequence
  chemically synthesized
tgagaaccaaaacaaacaaa

SEQ ID NO: 563603 - DNA, 20 bp, Artificial Sequence
  chemically synthesized
gtcgcctgcatactgagaac

SEQ ID NO: 563604 - DNA, 20 bp, Artificial Sequence
  chemically synthesized
cacgagaaatactctgaaaa

SEQ ID NO: 563605 - DNA, 20 bp, Artificial Sequence
  chemically synthesized
agaacaataaaacctagaaa

SEQ ID NO: 563606 - DNA, 20 bp, Artificial Sequence
  chemically synthesized
ctcatagtgaagaagaacaa

SEQ ID NO: 563607 - DNA, 20 bp, Artificial Sequence
  chemically synthesized
aatcacgtgttaaaacatat

SEQ ID NO: 563608 - DNA, 20 bp, Artificial Sequence
  chemically synthesized
aagttatctgaatcacgtgt

SEQ ID NO: 563609 - DNA, 20 bp, Artificial Sequence
  chemically synthesized
ttaaaagttgtgcacatttt

SEQ ID NO: 563610 - DNA, 20 bp, Artificial Sequence
  chemically synthesized
cctttgaaattaataacaaa

SEQ ID NO: 563611 - DNA, 20 bp, Artificial Sequence
  chemically synthesized
ggtctcaaagaaaaaaaaaa

SEQ ID NO: 563612 - DNA, 20 bp, Artificial Sequence
  chemically synthesized
ataaatactaaatatacaat

SEQ ID NO: 563613 - DNA, 20 bp, Artificial Sequence
  chemically synthesized
tctcaatttacagaaatata

SEQ ID NO: 563614 - DNA, 20 bp, Artificial Sequence
  chemically synthesized
attttattatttaattttat

SEQ ID NO: 563615 - DNA, 20 bp, Artificial Sequence
  chemically synthesized
gacagagaaagactgtctca

SEQ ID NO: 563616 - DNA, 20 bp, Artificial Sequence
  chemically synthesized
gactgtctcaaaaaacaaga

SEQ ID NO: 563617 - DNA, 20 bp, Artificial Sequence
  chemically synthesized
tctcaaaaaacaagacaaaa

SEQ ID NO: 563618 - DNA, 20 bp, Artificial Sequence
  chemically synthesized
tagacagtcttgatcttggc

SEQ ID NO: 563619 - DNA, 20 bp, Artificial Sequence
  chemically synthesized
ctgtctattaataagacatc

SEQ ID NO: 563620 - DNA, 20 bp, Artificial Sequence
  chemically synthesized
aaaaaacactaattgttgag

SEQ ID NO: 563621 - DNA, 20 bp, Artificial Sequence
  chemically synthesized
actgttatgtccttttgtta

SEQ ID NO: 563622 - DNA, 20 bp, Artificial Sequence
  chemically synthesized
ttgaattttgaattgagata

SEQ ID NO: 563623 - DNA, 20 bp, Artificial Sequence
  chemically synthesized
tttttaaaagtaagtaacaa

SEQ ID NO: 563624 - DNA, 20 bp, Artificial Sequence
  chemically synthesized
gaagtgtttaataaggtctt

SEQ ID NO: 563625 - DNA, 20 bp, Artificial Sequence
  chemically synthesized
ttttggttcacgtaaggacc

SEQ ID NO: 563626 - DNA, 20 bp, Artificial Sequence
  chemically synthesized
caaagtacatttttaaaaaa

SEQ ID NO: 563627 - DNA, 20 bp, Artificial Sequence
  chemically synthesized
aacatacatgtgaaggcatt

SEQ ID NO: 563628 - DNA, 20 bp, Artificial Sequence
  chemically synthesized
tatgtaaaattctagatata

SEQ ID NO: 563629 - DNA, 20 bp, Artificial Sequence
  chemically synthesized
aaaatgattcaaatacatgt

SEQ ID NO: 563630 - DNA, 20 bp, Artificial Sequence
  chemically synthesized
cgttaaaagtgccacttttg

SEQ ID NO: 563631 - DNA, 20 bp, Artificial Sequence
  chemically synthesized
cgaacaaacaattatcagtc

SEQ ID NO: 563632 - DNA, 20 bp, Artificial Sequence
  chemically synthesized
tccgcagtaattacgataaa

SEQ ID NO: 563633 - DNA, 20 bp, Artificial Sequence
  chemically synthesized
tttatgattcttaccttctc

SEQ ID NO: 563634 - DNA, 20 bp, Artificial Sequence
  chemically synthesized
ggtttagtttaaggattata

SEQ ID NO: 563635 - DNA, 20 bp, Artificial Sequence
  chemically synthesized
tgatttagttaaaaaatttc

SEQ ID NO: 563636 - DNA, 20 bp, Artificial Sequence
  chemically synthesized
cggccaacctgtacccaaca

SEQ ID NO: 563637 - DNA, 20 bp, Artificial Sequence
  chemically synthesized
tattgaccttaggatgaagt

SEQ ID NO: 563638 - DNA, 20 bp, Artificial Sequence
  chemically synthesized
tatgccacaagaataaaaaa

SEQ ID NO: 563639 - DNA, 20 bp, Artificial Sequence
  chemically synthesized
atgaagatttttttaattaa

SEQ ID NO: 563640 - DNA, 20 bp, Artificial Sequence
  chemically synthesized
agatgctctttttttccttt

SEQ ID NO: 563641 - DNA, 20 bp, Artificial Sequence
  chemically synthesized
attttcaaaggaaattgttt

SEQ ID NO: 563642 - DNA, 20 bp, Artificial Sequence
  chemically synthesized
tattttaaaaaattatgttt

SEQ ID NO: 563643 - DNA, 20 bp, Artificial Sequence
  chemically synthesized
atttacattcaatatatttt

SEQ ID NO: 563644 - DNA, 20 bp, Artificial Sequence
  chemically synthesized
taccaatttactcatttttc

SEQ ID NO: 563645 - DNA, 20 bp, Artificial Sequence
  chemically synthesized
aattatatcctggtatttga

SEQ ID NO: 563646 - DNA, 20 bp, Artificial Sequence
  chemically synthesized
gatttcctgaaaaagaaaaa

SEQ ID NO: 563647 - DNA, 20 bp, Artificial Sequence
  chemically synthesized
aacataacatgacatgaata

SEQ ID NO: 563648 - DNA, 20 bp, Artificial Sequence
  chemically synthesized
gacatgaataaaaaacaaaa

SEQ ID NO: 563649 - DNA, 20 bp, Artificial Sequence
  chemically synthesized
gaataaaaaacaaaagaaaa

SEQ ID NO: 563650 - DNA, 20 bp, Artificial Sequence
  chemically synthesized
agtaacaatagacactgttt

SEQ ID NO: 563651 - DNA, 20 bp, Artificial Sequence
  chemically synthesized
catgcatgctatacaagcca

SEQ ID NO: 563652 - DNA, 20 bp, Artificial Sequence
  chemically synthesized
gagaatatatccgttgtttg

SEQ ID NO: 563653 - DNA, 20 bp, Artificial Sequence
  chemically synthesized
acataaacagcaccaatgac

SEQ ID NO: 563654 - DNA, 20 bp, Artificial Sequence
  chemically synthesized
attcaacaccccttcatgct

SEQ ID NO: 563655 - DNA, 20 bp, Artificial Sequence
  chemically synthesized
ggtattgttggagtatatct

SEQ ID NO: 563656 - DNA, 20 bp, Artificial Sequence
  chemically synthesized
aagctggaagcattcacttt

SEQ ID NO: 563657 - DNA, 20 bp, Artificial Sequence
  chemically synthesized
gatgaagacggagacacaga

SEQ ID NO: 563658 - DNA, 20 bp, Artificial Sequence
  chemically synthesized
aaaatattacaagtgagtta

SEQ ID NO: 563659 - DNA, 20 bp, Artificial Sequence
  chemically synthesized
gaagttttggggaagggaat

SEQ ID NO: 563660 - DNA, 20 bp, Artificial Sequence
  chemically synthesized
tttgttttcattcccttccc

SEQ ID NO: 563661 - DNA, 20 bp, Artificial Sequence
  chemically synthesized
aggtgtgaagggagatgtga

SEQ ID NO: 563662 - DNA, 20 bp, Artificial Sequence
  chemically synthesized
cttcacacctacatcacctt

SEQ ID NO: 563663 - DNA, 20 bp, Artificial Sequence
  chemically synthesized
ctttctgggtgttggaacct

SEQ ID NO: 563664 - DNA, 20 bp, Artificial Sequence
  chemically synthesized
atcatgaatatcatgtttta

SEQ ID NO: 563665 - DNA, 20 bp, Artificial Sequence
  chemically synthesized
attgatacatttctgtttta

SEQ ID NO: 563666 - DNA, 20 bp, Artificial Sequence
  chemically synthesized
cgtaatttgtattacaaatt

SEQ ID NO: 563667 - DNA, 20 bp, Artificial Sequence
  chemically synthesized
tctacattcaattgtacata

SEQ ID NO: 563668 - DNA, 20 bp, Artificial Sequence
  chemically synthesized
aaggaggagatgattggagg

SEQ ID NO: 563669 - DNA, 20 bp, Artificial Sequence
  chemically synthesized
taataggtgagggataaaag

SEQ ID NO: 563670 - DNA, 20 bp, Artificial Sequence
  chemically synthesized
cactagtaagtatgctctgt

SEQ ID NO: 563671 - DNA, 20 bp, Artificial Sequence
  chemically synthesized
cctcttggtgaggaagaata

SEQ ID NO: 563672 - DNA, 20 bp, Artificial Sequence
  chemically synthesized
ttttaaacaaacggtgctga

SEQ ID NO: 563673 - DNA, 20 bp, Artificial Sequence
  chemically synthesized
tactctggatagacatggcc

SEQ ID NO: 563674 - DNA, 20 bp, Artificial Sequence
  chemically synthesized
gaaatatttattcaaaacaa

SEQ ID NO: 563675 - DNA, 20 bp, Artificial Sequence
  chemically synthesized
caaatggagaaatatttatt

SEQ ID NO: 563676 - DNA, 20 bp, Artificial Sequence
  chemically synthesized
tccatggatgctgtcccgag

SEQ ID NO: 563677 - DNA, 20 bp, Artificial Sequence
  chemically synthesized
agtttgtgaaatattaacta

SEQ ID NO: 563678 - DNA, 20 bp, Artificial Sequence
  chemically synthesized
atgagttcatttttctaaat

SEQ ID NO: 563679 - DNA, 20 bp, Artificial Sequence
  chemically synthesized
attaaacttaataaatataa

SEQ ID NO: 563680 - DNA, 20 bp, Artificial Sequence
  chemically synthesized
aaatgtttactaccgaaaaa

SEQ ID NO: 563681 - DNA, 20 bp, Artificial Sequence
  chemically synthesized
atattcactgtagaaacata

SEQ ID NO: 563682 - DNA, 20 bp, Artificial Sequence
  chemically synthesized
cgagaatttaaaggacatat

SEQ ID NO: 563683 - DNA, 20 bp, Artificial Sequence
  chemically synthesized
gtctctgttgcttttcattg

SEQ ID NO: 563684 - DNA, 20 bp, Artificial Sequence
  chemically synthesized
aagcaactgtaataaatgtt

SEQ ID NO: 563685 - DNA, 20 bp, Artificial Sequence
  chemically synthesized
tatcagcaaggtaaatgagt

SEQ ID NO: 563686 - DNA, 20 bp, Artificial Sequence
  chemically synthesized
cagtttctgtgctatctaga

SEQ ID NO: 563687 - DNA, 20 bp, Artificial Sequence
  chemically synthesized
cataaaaggtaaaatcccaa

SEQ ID NO: 563688 - DNA, 20 bp, Artificial Sequence
  chemically synthesized
ctggaattcatattatattg

SEQ ID NO: 563689 - DNA, 20 bp, Artificial Sequence
  chemically synthesized
tctatattctcctatcatga

SEQ ID NO: 563690 - DNA, 20 bp, Artificial Sequence
  chemically synthesized
gtgctcagtctggaagactc

SEQ ID NO: 563691 - DNA, 20 bp, Artificial Sequence
  chemically synthesized
tgggctatgtatatgttata

SEQ ID NO: 563692 - DNA, 20 bp, Artificial Sequence
  chemically synthesized
caaaaatttcaaccaggtac

SEQ ID NO: 563693 - DNA, 20 bp, Artificial Sequence
  chemically synthesized
aaactacagcgtaagttatc

SEQ ID NO: 563694 - DNA, 20 bp, Artificial Sequence
  chemically synthesized
cccacctcatctacagagat

SEQ ID NO: 563695 - DNA, 20 bp, Artificial Sequence
  chemically synthesized
aatttggacataataattct

SEQ ID NO: 563696 - DNA, 20 bp, Artificial Sequence
  chemically synthesized
tggaggtattattgagaaat

SEQ ID NO: 563697 - DNA, 20 bp, Artificial Sequence
  chemically synthesized
tctggatgaaatgggattat

SEQ ID NO: 563698 - DNA, 20 bp, Artificial Sequence
  chemically synthesized
ttaattaatcttcagtgatg

SEQ ID NO: 563699 - DNA, 20 bp, Artificial Sequence
  chemically synthesized
aatagaagctgaaaaaagga

SEQ ID NO: 563700 - DNA, 20 bp, Artificial Sequence
  chemically synthesized
tatgtttgctgttttggctg

SEQ ID NO: 563701 - DNA, 20 bp, Artificial Sequence
  chemically synthesized
attgacgattgttttgcagc

SEQ ID NO: 563702 - DNA, 20 bp, Artificial Sequence
  chemically synthesized
actgtaatcactcaggaaga

SEQ ID NO: 563703 - DNA, 20 bp, Artificial Sequence
  chemically synthesized
gttggttgataggtctgaga

SEQ ID NO: 563704 - DNA, 20 bp, Artificial Sequence
  chemically synthesized
tgagagaaaacagaacacag

SEQ ID NO: 563705 - DNA, 20 bp, Artificial Sequence
  chemically synthesized
tattatgttactctatagtt

SEQ ID NO: 563706 - DNA, 20 bp, Artificial Sequence
  chemically synthesized
agagttagagagatataggt

SEQ ID NO: 563707 - DNA, 20 bp, Artificial Sequence
  chemically synthesized
ccttcttagcttctatttga

SEQ ID NO: 563708 - DNA, 20 bp, Artificial Sequence
  chemically synthesized
ccaattgtcagaatggctag

SEQ ID NO: 563709 - DNA, 20 bp, Artificial Sequence
  chemically synthesized
gtatgtaaaaaaggacaatg

SEQ ID NO: 563710 - DNA, 20 bp, Artificial Sequence
  chemically synthesized
gggaatatataggtagcatg

SEQ ID NO: 563711 - DNA, 20 bp, Artificial Sequence
  chemically synthesized
gcaccacaaaaaagcaatga

SEQ ID NO: 563712 - DNA, 20 bp, Artificial Sequence
  chemically synthesized
ggaattatatgttcttcatt

SEQ ID NO: 563713 - DNA, 20 bp, Artificial Sequence
  chemically synthesized
ccatgtcaatatgatcaggt

SEQ ID NO: 563714 - DNA, 20 bp, Artificial Sequence
  chemically synthesized
ttccaagtggtattacctgt

SEQ ID NO: 563715 - DNA, 20 bp, Artificial Sequence
  chemically synthesized
attttcttacaacaaaggga

SEQ ID NO: 563716 - DNA, 20 bp, Artificial Sequence
  chemically synthesized
aataaaatttttcaaaatat

SEQ ID NO: 563717 - DNA, 20 bp, Artificial Sequence
  chemically synthesized
tcatcttactaaatattctt

SEQ ID NO: 563718 - DNA, 20 bp, Artificial Sequence
  chemically synthesized
catattgccaaaatgctttc

SEQ ID NO: 563719 - DNA, 20 bp, Artificial Sequence
  chemically synthesized
ataaaaataaatttaaaatt

SEQ ID NO: 563720 - DNA, 20 bp, Artificial Sequence
  chemically synthesized
catttccctcacagcccctg

SEQ ID NO: 563721 - DNA, 20 bp, Artificial Sequence
  chemically synthesized
atacgacattctgggaaagc

SEQ ID NO: 563722 - DNA, 20 bp, Artificial Sequence
  chemically synthesized
aaatgagctactgagccatg

SEQ ID NO: 563723 - DNA, 20 bp, Artificial Sequence
  chemically synthesized
agttgaaaattatgtccaca

SEQ ID NO: 563724 - DNA, 20 bp, Artificial Sequence
  chemically synthesized
attttaatcttagaagattt

SEQ ID NO: 563725 - DNA, 20 bp, Artificial Sequence
  chemically synthesized
tttgtgtaatctaggagaca

SEQ ID NO: 563726 - DNA, 20 bp, Artificial Sequence
  chemically synthesized
gcaaagggggaagtccctta

SEQ ID NO: 563727 - DNA, 20 bp, Artificial Sequence
  chemically synthesized
tactacaaggctacagtaac

SEQ ID NO: 563728 - DNA, 20 bp, Artificial Sequence
  chemically synthesized
aaacagcatggtactggtac

SEQ ID NO: 563729 - DNA, 20 bp, Artificial Sequence
  chemically synthesized
tgatctttgacaaacctgag

SEQ ID NO: 563730 - DNA, 20 bp, Artificial Sequence
  chemically synthesized
tatttaataaatggtgctgg

SEQ ID NO: 563731 - DNA, 20 bp, Artificial Sequence
  chemically synthesized
aaagacttaaacgttagacc

SEQ ID NO: 563732 - DNA, 20 bp, Artificial Sequence
  chemically synthesized
aacgttagacctaaaaccat

SEQ ID NO: 563733 - DNA, 20 bp, Artificial Sequence
  chemically synthesized
aaaccataaaaaccctagaa

SEQ ID NO: 563734 - DNA, 20 bp, Artificial Sequence
  chemically synthesized
ataggcaaggacttcatgtc

SEQ ID NO: 563735 - DNA, 20 bp, Artificial Sequence
  chemically synthesized
ctcaaacaaatttacaagaa

SEQ ID NO: 563736 - DNA, 20 bp, Artificial Sequence
  chemically synthesized
gccatcagagaaatgcaaat

SEQ ID NO: 563737 - DNA, 20 bp, Artificial Sequence
  chemically synthesized
agcaaaccattgcaaggaca

SEQ ID NO: 563738 - DNA, 20 bp, Artificial Sequence
  chemically synthesized
cacattgtgcacatgtaccc

SEQ ID NO: 563739 - DNA, 20 bp, Artificial Sequence
  chemically synthesized
tctatacctaatttaggaga

SEQ ID NO: 563740 - DNA, 20 bp, Artificial Sequence
  chemically synthesized
tcatttcattctatgttata

SEQ ID NO: 563741 - DNA, 20 bp, Artificial Sequence
  chemically synthesized
aatccttttcaccatgggag

SEQ ID NO: 563742 - DNA, 20 bp, Artificial Sequence
  chemically synthesized
ggcaaatggcacagaggctt

SEQ ID NO: 563743 - DNA, 20 bp, Artificial Sequence
  chemically synthesized
gaattttgtccaatactcct

SEQ ID NO: 563744 - DNA, 20 bp, Artificial Sequence
  chemically synthesized
catcttagcaattatatttg

SEQ ID NO: 563745 - DNA, 20 bp, Artificial Sequence
  chemically synthesized
gctaagagtttaaaagattc

SEQ ID NO: 563746 - DNA, 20 bp, Artificial Sequence
  chemically synthesized
aaataaataattcttccttt

SEQ ID NO: 563747 - DNA, 20 bp, Artificial Sequence
  chemically synthesized
aattccaaattggacctttg

SEQ ID NO: 563748 - DNA, 20 bp, Artificial Sequence
  chemically synthesized
tgcttgtggggtaacaaagt

SEQ ID NO: 563749 - DNA, 20 bp, Artificial Sequence
  chemically synthesized
gaattaaaataacaacaaca

SEQ ID NO: 563750 - DNA, 20 bp, Artificial Sequence
  chemically synthesized
taataatattgatgtttcaa

SEQ ID NO: 563751 - DNA, 20 bp, Artificial Sequence
  chemically synthesized
ccacttcaacaaaaatatta

SEQ ID NO: 563752 - DNA, 20 bp, Artificial Sequence
  chemically synthesized
taaagatctcaagatgtccc

SEQ ID NO: 563753 - DNA, 20 bp, Artificial Sequence
  chemically synthesized
aatgaagctaaagggatttt

SEQ ID NO: 563754 - DNA, 20 bp, Artificial Sequence
  chemically synthesized
ctttacataacttagaacag

SEQ ID NO: 563755 - DNA, 20 bp, Artificial Sequence
  chemically synthesized
acattatgaacacagcagca

SEQ ID NO: 563756 - DNA, 20 bp, Artificial Sequence
  chemically synthesized
attaccatggctagcataat

SEQ ID NO: 563757 - DNA, 20 bp, Artificial Sequence
  chemically synthesized
aagaaaataataaggagata

SEQ ID NO: 563758 - DNA, 20 bp, Artificial Sequence
  chemically synthesized
taaattctcttgctaaaaaa

SEQ ID NO: 563759 - DNA, 20 bp, Artificial Sequence
  chemically synthesized
ataacatagttgagtcctga

SEQ ID NO: 563760 - DNA, 20 bp, Artificial Sequence
  chemically synthesized
ctacactttccaacagtact

SEQ ID NO: 563761 - DNA, 20 bp, Artificial Sequence
  chemically synthesized
ttttgcctgtttttctgttt

SEQ ID NO: 563762 - DNA, 20 bp, Artificial Sequence
  chemically synthesized
aataagatgtttttaaacag

SEQ ID NO: 563763 - DNA, 20 bp, Artificial Sequence
  chemically synthesized
agaaaaagcataaaaatatg

SEQ ID NO: 563764 - DNA, 20 bp, Artificial Sequence
  chemically synthesized
attctgtgtttgggagttct

SEQ ID NO: 563765 - DNA, 20 bp, Artificial Sequence
  chemically synthesized
ggatttaaccatttgcaact

SEQ ID NO: 563766 - DNA, 20 bp, Artificial Sequence
  chemically synthesized
ttggttatggtgtttgtaca

SEQ ID NO: 563767 - DNA, 20 bp, Artificial Sequence
  chemically synthesized
ttcttaaccatagtgcctga

SEQ ID NO: 563768 - DNA, 20 bp, Artificial Sequence
  chemically synthesized
acaagtgtcactttgtatac

SEQ ID NO: 563769 - DNA, 20 bp, Artificial Sequence
  chemically synthesized
aaaaaaaaaaaaaacaaaaa

SEQ ID NO: 563770 - DNA, 20 bp, Artificial Sequence
  chemically synthesized
agaaagataaaaaaaaaaaa

SEQ ID NO: 563771 - DNA, 20 bp, Artificial Sequence
  chemically synthesized
tctttcttagagttctggac

SEQ ID NO: 563772 - DNA, 20 bp, Artificial Sequence
  chemically synthesized
agatgacttcatgaggagag

SEQ ID NO: 563773 - DNA, 20 bp, Artificial Sequence
  chemically synthesized
ttttttgacaatattaaaaa

SEQ ID NO: 563774 - DNA, 20 bp, Artificial Sequence
  chemically synthesized
atttgataaaaatctcttaa

SEQ ID NO: 563775 - DNA, 20 bp, Artificial Sequence
  chemically synthesized
agttttcaagaggtatattg

SEQ ID NO: 563776 - DNA, 20 bp, Artificial Sequence
  chemically synthesized
tgttttgcaatatacctctt

SEQ ID NO: 563777 - DNA, 20 bp, Artificial Sequence
  chemically synthesized
ttaaaagcacaattaaaagc

SEQ ID NO: 563778 - DNA, 20 bp, Artificial Sequence
  chemically synthesized
tttcctagcaataaacactg

SEQ ID NO: 563779 - DNA, 20 bp, Artificial Sequence
  chemically synthesized
agaagtaatcaagggaatgg

SEQ ID NO: 563780 - DNA, 20 bp, Artificial Sequence
  chemically synthesized
caattagctaccagagactg

SEQ ID NO: 563781 - DNA, 20 bp, Artificial Sequence
  chemically synthesized
gactgtaaaacatctgttct

SEQ ID NO: 563782 - DNA, 20 bp, Artificial Sequence
  chemically synthesized
aaattgaactaggaaagatg

SEQ ID NO: 563783 - DNA, 20 bp, Artificial Sequence
  chemically synthesized
atagatcatggatactaata

SEQ ID NO: 563784 - DNA, 20 bp, Artificial Sequence
  chemically synthesized
gatctatagatttcatgact

SEQ ID NO: 563785 - DNA, 20 bp, Artificial Sequence
  chemically synthesized
ctttttaaaaatttagaatt

SEQ ID NO: 563786 - DNA, 20 bp, Artificial Sequence
  chemically synthesized
atcacttgtcagataagaaa

SEQ ID NO: 563787 - DNA, 20 bp, Artificial Sequence
  chemically synthesized
taagtgtatattattatata

SEQ ID NO: 563788 - DNA, 20 bp, Artificial Sequence
  chemically synthesized
atccatgtatgttgttgact

SEQ ID NO: 563789 - DNA, 20 bp, Artificial Sequence
  chemically synthesized
tttagattcccatatactat

SEQ ID NO: 563790 - DNA, 20 bp, Artificial Sequence
  chemically synthesized
aattctcaaaaagagggggg

SEQ ID NO: 563791 - DNA, 20 bp, Artificial Sequence
  chemically synthesized
cagataaatttgattaaaca

SEQ ID NO: 563792 - DNA, 20 bp, Artificial Sequence
  chemically synthesized
cacagtaagcccaagaaaca

SEQ ID NO: 563793 - DNA, 20 bp, Artificial Sequence
  chemically synthesized
gagctattagtttgaatcct

SEQ ID NO: 563794 - DNA, 20 bp, Artificial Sequence
  chemically synthesized
tcgaacatgtatataaagat

SEQ ID NO: 563795 - DNA, 20 bp, Artificial Sequence
  chemically synthesized
ttttaaagtattaaaagttt

SEQ ID NO: 563796 - DNA, 20 bp, Artificial Sequence
  chemically synthesized
catcattttaaaaaaacttt

SEQ ID NO: 563797 - DNA, 20 bp, Artificial Sequence
  chemically synthesized
atgtgtaaacatcattttaa

SEQ ID NO: 563798 - DNA, 20 bp, Artificial Sequence
  chemically synthesized
ttgtcagattttgatagaag

SEQ ID NO: 563799 - DNA, 20 bp, Artificial Sequence
  chemically synthesized
ctccaacatcatgataaaaa

SEQ ID NO: 563800 - DNA, 20 bp, Artificial Sequence
  chemically synthesized
tattgctccaacatcatgat

SEQ ID NO: 563801 - DNA, 20 bp, Artificial Sequence
  chemically synthesized
aaaaatgtacataccttaac

SEQ ID NO: 563802 - DNA, 20 bp, Artificial Sequence
  chemically synthesized
tcaattgactctttctttca

SEQ ID NO: 563803 - DNA, 20 bp, Artificial Sequence
  chemically synthesized
gatgttatattagcaggtat

SEQ ID NO: 563804 - DNA, 20 bp, Artificial Sequence
  chemically synthesized
aggccactttcagggagaat

SEQ ID NO: 563805 - DNA, 20 bp, Artificial Sequence
  chemically synthesized
atttatcaccagctgtcatg

SEQ ID NO: 563806 - DNA, 20 bp, Artificial Sequence
  chemically synthesized
tgaattagacttcttctttt

SEQ ID NO: 563807 - DNA, 20 bp, Artificial Sequence
  chemically synthesized
ttacatccaatactgtttgt

SEQ ID NO: 563808 - DNA, 20 bp, Artificial Sequence
  chemically synthesized
accccatagacacagctgta

SEQ ID NO: 563809 - DNA, 20 bp, Artificial Sequence
  chemically synthesized
aaggtgtagacatcttgaat

SEQ ID NO: 563810 - DNA, 20 bp, Artificial Sequence
  chemically synthesized
tatatataaaattaaatgag

SEQ ID NO: 563811 - DNA, 20 bp, Artificial Sequence
  chemically synthesized
gcgttccattatttttaatc

SEQ ID NO: 563812 - DNA, 20 bp, Artificial Sequence
  chemically synthesized
tttgtgctgtcaaattaagg

SEQ ID NO: 563813 - DNA, 20 bp, Artificial Sequence
  chemically synthesized
gaacatattgacctttaata

SEQ ID NO: 563814 - DNA, 20 bp, Artificial Sequence
  chemically synthesized
tttttaataatggataattt

SEQ ID NO: 563815 - DNA, 20 bp, Artificial Sequence
  chemically synthesized
aggcttatctctctcaaaga

SEQ ID NO: 563816 - DNA, 20 bp, Artificial Sequence
  chemically synthesized
tgaacaaataggaatgtcaa

SEQ ID NO: 563817 - DNA, 20 bp, Artificial Sequence
  chemically synthesized
ttttctgtatcttttttttc

SEQ ID NO: 563818 - DNA, 20 bp, Artificial Sequence
  chemically synthesized
gatctataaactaggcataa

SEQ ID NO: 563819 - DNA, 20 bp, Artificial Sequence
  chemically synthesized
gtgagataaaatttagttta

SEQ ID NO: 563820 - DNA, 20 bp, Artificial Sequence
  chemically synthesized
cttcatccactatagaaaat

SEQ ID NO: 563821 - DNA, 20 bp, Artificial Sequence
  chemically synthesized
ggaaaacaaaacaaaacaaa

SEQ ID NO: 563822 - DNA, 20 bp, Artificial Sequence
  chemically synthesized
aaaaacaaaggaaaacaaaa

SEQ ID NO: 563823 - DNA, 20 bp, Artificial Sequence
  chemically synthesized
tctcaaaaaacaaaggaaaa

SEQ ID NO: 563824 - DNA, 20 bp, Artificial Sequence
  chemically synthesized
ttctgtctcaaaaaacaaag

SEQ ID NO: 563825 - DNA, 20 bp, Artificial Sequence
  chemically synthesized
cagagtgagattctgtctca

SEQ ID NO: 563826 - DNA, 20 bp, Artificial Sequence
  chemically synthesized
ggtgaaaccccatctctact

SEQ ID NO: 563827 - DNA, 20 bp, Artificial Sequence
  chemically synthesized
ccctacatggtttactagaa

SEQ ID NO: 563828 - DNA, 20 bp, Artificial Sequence
  chemically synthesized
tttataggaacttagaattt

SEQ ID NO: 563829 - DNA, 20 bp, Artificial Sequence
  chemically synthesized
tgtaaagatctcatacctat

SEQ ID NO: 563830 - DNA, 20 bp, Artificial Sequence
  chemically synthesized
atatttgtgttatagttcag

SEQ ID NO: 563831 - DNA, 20 bp, Artificial Sequence
  chemically synthesized
ttctttgtttacctaccttg

SEQ ID NO: 563832 - DNA, 20 bp, Artificial Sequence
  chemically synthesized
aaagaatattaccagcatcc

SEQ ID NO: 563833 - DNA, 20 bp, Artificial Sequence
  chemically synthesized
tttctgtcctccttgatttt

SEQ ID NO: 563834 - DNA, 20 bp, Artificial Sequence
  chemically synthesized
tggaagatgttgaaattgga

SEQ ID NO: 563835 - DNA, 20 bp, Artificial Sequence
  chemically synthesized
gcaaactttcaggaggattt

SEQ ID NO: 563836 - DNA, 20 bp, Artificial Sequence
  chemically synthesized
tcctagtgtgagtgatgtgg

SEQ ID NO: 563837 - DNA, 20 bp, Artificial Sequence
  chemically synthesized
tttcctgccactgtggccac

SEQ ID NO: 563838 - DNA, 20 bp, Artificial Sequence
  chemically synthesized
aatgagtcccacatctcccc

SEQ ID NO: 563839 - DNA, 20 bp, Artificial Sequence
  chemically synthesized
taaaagaaatctgtactagt

SEQ ID NO: 563840 - DNA, 20 bp, Artificial Sequence
  chemically synthesized
aaatattgtctagacaaaag

SEQ ID NO: 563841 - DNA, 20 bp, Artificial Sequence
  chemically synthesized
cctaacatgactggcttcca

SEQ ID NO: 563842 - DNA, 20 bp, Artificial Sequence
  chemically synthesized
tataaaatgtgacatctgaa

SEQ ID NO: 563843 - DNA, 20 bp, Artificial Sequence
  chemically synthesized
tggaaagcaaattttttaaa

SEQ ID NO: 563844 - DNA, 20 bp, Artificial Sequence
  chemically synthesized
actatctttaaattaaatga

SEQ ID NO: 563845 - DNA, 20 bp, Artificial Sequence
  chemically synthesized
atagagtggattaaatttgt

SEQ ID NO: 563846 - DNA, 20 bp, Artificial Sequence
  chemically synthesized
taaagttattgcaagtaagc

SEQ ID NO: 563847 - DNA, 20 bp, Artificial Sequence
  chemically synthesized
taacatgttaagaagataaa

SEQ ID NO: 563848 - DNA, 20 bp, Artificial Sequence
  chemically synthesized
agtcatatttatctcctttc

SEQ ID NO: 563849 - DNA, 20 bp, Artificial Sequence
  chemically synthesized
ttttaataagagaaacaaag

SEQ ID NO: 563850 - DNA, 20 bp, Artificial Sequence
  chemically synthesized
agaaacaaagtaaaacatgt

SEQ ID NO: 563851 - DNA, 20 bp, Artificial Sequence
  chemically synthesized
taaaattgactagatggtta

SEQ ID NO: 563852 - DNA, 20 bp, Artificial Sequence
  chemically synthesized
cacagaattttttctttctg

SEQ ID NO: 563853 - DNA, 20 bp, Artificial Sequence
  chemically synthesized
gggagacccactgaagacta

SEQ ID NO: 563854 - DNA, 20 bp, Artificial Sequence
  chemically synthesized
ggtagcgctggaaattcctg

SEQ ID NO: 563855 - DNA, 20 bp, Artificial Sequence
  chemically synthesized
atgtcttatcaatcatttac

SEQ ID NO: 563856 - DNA, 20 bp, Artificial Sequence
  chemically synthesized
tgttctagaagggatcaaga

SEQ ID NO: 563857 - DNA, 20 bp, Artificial Sequence
  chemically synthesized
atgttataaaagtaagtctc

SEQ ID NO: 563858 - DNA, 20 bp, Artificial Sequence
  chemically synthesized
agaaagggtgaaagtcaatg

SEQ ID NO: 563859 - DNA, 20 bp, Artificial Sequence
  chemically synthesized
gatacttgagtcaataagca

SEQ ID NO: 563860 - DNA, 20 bp, Artificial Sequence
  chemically synthesized
atataggactcctttcatgc

SEQ ID NO: 563861 - DNA, 20 bp, Artificial Sequence
  chemically synthesized
atgaaacaattcagaaacgt

SEQ ID NO: 563862 - DNA, 20 bp, Artificial Sequence
  chemically synthesized
tgagtccaatcatttctttt

SEQ ID NO: 563863 - DNA, 20 bp, Artificial Sequence
  chemically synthesized
ccaaaggattatgaccacct

SEQ ID NO: 563864 - DNA, 20 bp, Artificial Sequence
  chemically synthesized
cctgtgaaatattaatgtcc

SEQ ID NO: 563865 - DNA, 20 bp, Artificial Sequence
  chemically synthesized
gtggagagtaaataattact

SEQ ID NO: 563866 - DNA, 20 bp, Artificial Sequence
  chemically synthesized
ttaagaaggaaaaagcaaat

SEQ ID NO: 563867 - DNA, 20 bp, Artificial Sequence
  chemically synthesized
gatggagcaagcttctcagg

SEQ ID NO: 563868 - DNA, 20 bp, Artificial Sequence
  chemically synthesized
tctctaaggcatttatattc

SEQ ID NO: 563869 - DNA, 20 bp, Artificial Sequence
  chemically synthesized
tagaatataaatgccttaga

SEQ ID NO: 563870 - DNA, 20 bp, Artificial Sequence
  chemically synthesized
ctgagtttgagagaattggg

SEQ ID NO: 563871 - DNA, 20 bp, Artificial Sequence
  chemically synthesized
ctgaagtgctttaaggaaga

SEQ ID NO: 563872 - DNA, 20 bp, Artificial Sequence
  chemically synthesized
tctgccaatatttcttgctc

SEQ ID NO: 563873 - DNA, 20 bp, Artificial Sequence
  chemically synthesized
aactataaactaaaaaatac

SEQ ID NO: 563874 - DNA, 20 bp, Artificial Sequence
  chemically synthesized
cgctatcttcattgaaaaag

SEQ ID NO: 563875 - DNA, 20 bp, Artificial Sequence
  chemically synthesized
aagtgaccattcaagactgt

SEQ ID NO: 563876 - DNA, 20 bp, Artificial Sequence
  chemically synthesized
tacagtcttgaatggtcact

SEQ ID NO: 563877 - DNA, 20 bp, Artificial Sequence
  chemically synthesized
ctgctaaaatgatacatcta

SEQ ID NO: 563878 - DNA, 20 bp, Artificial Sequence
  chemically synthesized
ccaaatccttgactattttt

SEQ ID NO: 563879 - DNA, 20 bp, Artificial Sequence
  chemically synthesized
cctcttagaaagggtgagtt

SEQ ID NO: 563880 - DNA, 20 bp, Artificial Sequence
  chemically synthesized
tctaagaggaatacgtaatt

SEQ ID NO: 563881 - DNA, 20 bp, Artificial Sequence
  chemically synthesized
acatttaacaagtgattgtt

SEQ ID NO: 563882 - DNA, 20 bp, Artificial Sequence
  chemically synthesized
ccactagggtaacaagcaaa

SEQ ID NO: 563883 - DNA, 20 bp, Artificial Sequence
  chemically synthesized
taaattgctcccctttctcc

SEQ ID NO: 563884 - DNA, 20 bp, Artificial Sequence
  chemically synthesized
tgtaggggaaagaaatattg

SEQ ID NO: 563885 - DNA, 20 bp, Artificial Sequence
  chemically synthesized
aggcaagaaagaatgtaaga

SEQ ID NO: 563886 - DNA, 20 bp, Artificial Sequence
  chemically synthesized
ctgggtcgacatcaacttgg

SEQ ID NO: 563887 - DNA, 20 bp, Artificial Sequence
  chemically synthesized
aacagatgctagagttgttg

SEQ ID NO: 563888 - DNA, 20 bp, Artificial Sequence
  chemically synthesized
gtgcttgcctccaacctcag

SEQ ID NO: 563889 - DNA, 20 bp, Artificial Sequence
  chemically synthesized
tggcatgatggagtgacagg

SEQ ID NO: 563890 - DNA, 20 bp, Artificial Sequence
  chemically synthesized
tgtaacaaatcaagatagtg

SEQ ID NO: 563891 - DNA, 20 bp, Artificial Sequence
  chemically synthesized
tatctgatacgtcagtcgaa

SEQ ID NO: 563892 - DNA, 20 bp, Artificial Sequence
  chemically synthesized
acgagcattcttcctgccta

SEQ ID NO: 563893 - DNA, 20 bp, Artificial Sequence
  chemically synthesized
cttcacagccttttaagggt

SEQ ID NO: 563894 - DNA, 20 bp, Artificial Sequence
  chemically synthesized
ttataccgtataattttctc

SEQ ID NO: 563895 - DNA, 20 bp, Artificial Sequence
  chemically synthesized
attttattaatttttctcat

SEQ ID NO: 563896 - DNA, 20 bp, Artificial Sequence
  chemically synthesized
cacacaccataaccccttag

SEQ ID NO: 563897 - DNA, 20 bp, Artificial Sequence
  chemically synthesized
gaagccaagaatacaacaaa

SEQ ID NO: 563898 - DNA, 20 bp, Artificial Sequence
  chemically synthesized
aacttattcatcctgataat

SEQ ID NO: 563899 - DNA, 20 bp, Artificial Sequence
  chemically synthesized
attcacaatagccaaggcat

SEQ ID NO: 563900 - DNA, 20 bp, Artificial Sequence
  chemically synthesized
aaatttgtatagccattatg

SEQ ID NO: 563901 - DNA, 20 bp, Artificial Sequence
  chemically synthesized
ccttttatccacattcttgc

SEQ ID NO: 563902 - DNA, 20 bp, Artificial Sequence
  chemically synthesized
tcaagcaaaacacacaaaca

SEQ ID NO: 563903 - DNA, 20 bp, Artificial Sequence
  chemically synthesized
tgaggaactcagagctcaag

SEQ ID NO: 563904 - DNA, 20 bp, Artificial Sequence
  chemically synthesized
tctttaataaatggtgtttg

SEQ ID NO: 563905 - DNA, 20 bp, Artificial Sequence
  chemically synthesized
tggtgaaatatttatacagt

SEQ ID NO: 563906 - DNA, 20 bp, Artificial Sequence
  chemically synthesized
ttatctgttaatggcactta

SEQ ID NO: 563907 - DNA, 20 bp, Artificial Sequence
  chemically synthesized
ggaatattcatttatataaa

SEQ ID NO: 563908 - DNA, 20 bp, Artificial Sequence
  chemically synthesized
cataataaaggccatttatg

SEQ ID NO: 563909 - DNA, 20 bp, Artificial Sequence
  chemically synthesized
catgtattcatgggtaaatt

SEQ ID NO: 563910 - DNA, 20 bp, Artificial Sequence
  chemically synthesized
accatcttaatagatgcaga

SEQ ID NO: 563911 - DNA, 20 bp, Artificial Sequence
  chemically synthesized
aatcctcaataaaatactag

SEQ ID NO: 563912 - DNA, 20 bp, Artificial Sequence
  chemically synthesized
aaaggttacctacagtaact

SEQ ID NO: 563913 - DNA, 20 bp, Artificial Sequence
  chemically synthesized
tttggggatgtttgtttgag

SEQ ID NO: 563914 - DNA, 20 bp, Artificial Sequence
  chemically synthesized
aatgtgtaaagtttggggat

SEQ ID NO: 563915 - DNA, 20 bp, Artificial Sequence
  chemically synthesized
tgtgaatgtgtaaagtttgg

SEQ ID NO: 563916 - DNA, 20 bp, Artificial Sequence
  chemically synthesized
aacaatattgtgtgaatgtg

SEQ ID NO: 563917 - DNA, 20 bp, Artificial Sequence
  chemically synthesized
aactttacacattcacacaa

SEQ ID NO: 563918 - DNA, 20 bp, Artificial Sequence
  chemically synthesized
atatttatagttcctactcc

SEQ ID NO: 563919 - DNA, 20 bp, Artificial Sequence
  chemically synthesized
ctttgctactgtgggaaaga

SEQ ID NO: 563920 - DNA, 20 bp, Artificial Sequence
  chemically synthesized
atgtgttctgtagagctgcg

SEQ ID NO: 563921 - DNA, 20 bp, Artificial Sequence
  chemically synthesized
cagaacacatccattagtct

SEQ ID NO: 563922 - DNA, 20 bp, Artificial Sequence
  chemically synthesized
ttctcccaaacaaacacaca

SEQ ID NO: 563923 - DNA, 20 bp, Artificial Sequence
  chemically synthesized
caccggcaagcaaaatgtgt

SEQ ID NO: 563924 - DNA, 20 bp, Artificial Sequence
  chemically synthesized
tatgcaccggcaagcaaaat

SEQ ID NO: 563925 - DNA, 20 bp, Artificial Sequence
  chemically synthesized
ccggtgcataatctgtgcca

SEQ ID NO: 563926 - DNA, 20 bp, Artificial Sequence
  chemically synthesized
attaaaatgaatcgagctgg

SEQ ID NO: 563927 - DNA, 20 bp, Artificial Sequence
  chemically synthesized
ggatgactctgaggagggca

SEQ ID NO: 563928 - DNA, 20 bp, Artificial Sequence
  chemically synthesized
tcttagacgtggtgaagtat

SEQ ID NO: 563929 - DNA, 20 bp, Artificial Sequence
  chemically synthesized
gtcaccaaaacagccagtct

SEQ ID NO: 563930 - DNA, 20 bp, Artificial Sequence
  chemically synthesized
ttgtttgaaacacccagact

SEQ ID NO: 563931 - DNA, 20 bp, Artificial Sequence
  chemically synthesized
ccaccattacccgaacctac

SEQ ID NO: 563932 - DNA, 20 bp, Artificial Sequence
  chemically synthesized
cgggtaatggtgggaaggat

SEQ ID NO: 563933 - DNA, 20 bp, Artificial Sequence
  chemically synthesized
aatggtgggaaggataaatg

SEQ ID NO: 563934 - DNA, 20 bp, Artificial Sequence
  chemically synthesized
gtatgtgtggatgtcaaggg

SEQ ID NO: 563935 - DNA, 20 bp, Artificial Sequence
  chemically synthesized
cctactttcaaaaaattagc

SEQ ID NO: 563936 - DNA, 20 bp, Artificial Sequence
  chemically synthesized
ctttcaaaaaattagcaagt

SEQ ID NO: 563937 - DNA, 20 bp, Artificial Sequence
  chemically synthesized
atgatccatctcattagaaa

SEQ ID NO: 563938 - DNA, 20 bp, Artificial Sequence
  chemically synthesized
ccaccaggtgcagcctatcc

SEQ ID NO: 563939 - DNA, 20 bp, Artificial Sequence
  chemically synthesized
ctgacattgctacccacttt

SEQ ID NO: 563940 - DNA, 20 bp, Artificial Sequence
  chemically synthesized
tctcctttgcccctgccctg

SEQ ID NO: 563941 - DNA, 20 bp, Artificial Sequence
  chemically synthesized
tggtggtggttgactatggt

SEQ ID NO: 563942 - DNA, 20 bp, Artificial Sequence
  chemically synthesized
aagtcagtttgcagttcata

SEQ ID NO: 563943 - DNA, 20 bp, Artificial Sequence
  chemically synthesized
atgacaagtatattaattaa

SEQ ID NO: 563944 - DNA, 20 bp, Artificial Sequence
  chemically synthesized
gtttgtttgtttgttgtgtt

SEQ ID NO: 563945 - DNA, 20 bp, Artificial Sequence
  chemically synthesized
tcatagtgtttgtttgtttg

SEQ ID NO: 563946 - DNA, 20 bp, Artificial Sequence
  chemically synthesized
gattgatagtcatagtgttt

SEQ ID NO: 563947 - DNA, 20 bp, Artificial Sequence
  chemically synthesized
gattgattgatagtcatagt

SEQ ID NO: 563948 - DNA, 20 bp, Artificial Sequence
  chemically synthesized
gattgattgattgatagtca

SEQ ID NO: 563949 - DNA, 20 bp, Artificial Sequence
  chemically synthesized
atacattttgtgcagtgatt

SEQ ID NO: 563950 - DNA, 20 bp, Artificial Sequence
  chemically synthesized
gatgatacattttgtgcagt

SEQ ID NO: 563951 - DNA, 20 bp, Artificial Sequence
  chemically synthesized
gggagatgatacattttgtg

SEQ ID NO: 563952 - DNA, 20 bp, Artificial Sequence
  chemically synthesized
tgtatcatctcccagtctac

SEQ ID NO: 563953 - DNA, 20 bp, Artificial Sequence
  chemically synthesized
ctgtgggatacttcctagaa

SEQ ID NO: 563954 - DNA, 20 bp, Artificial Sequence
  chemically synthesized
ctcacttctaggaagtatcc

SEQ ID NO: 563955 - DNA, 20 bp, Artificial Sequence
  chemically synthesized
ttctaggaagtatcccacag

SEQ ID NO: 563956 - DNA, 20 bp, Artificial Sequence
  chemically synthesized
aggaagtatcccacagattt

SEQ ID NO: 563957 - DNA, 20 bp, Artificial Sequence
  chemically synthesized
atgtaatgagaaatgtgcaa

SEQ ID NO: 563958 - DNA, 20 bp, Artificial Sequence
  chemically synthesized
ctacatatcccaccaaaggg

SEQ ID NO: 563959 - DNA, 20 bp, Artificial Sequence
  chemically synthesized
tcttttcatttaaatatata

SEQ ID NO: 563960 - DNA, 20 bp, Artificial Sequence
  chemically synthesized
gcattttatatatttaaatg

SEQ ID NO: 563961 - DNA, 20 bp, Artificial Sequence
  chemically synthesized
gttatgcaccttacttgttt

SEQ ID NO: 563962 - DNA, 20 bp, Artificial Sequence
  chemically synthesized
cccagttatgcaccttactt

SEQ ID NO: 563963 - DNA, 20 bp, Artificial Sequence
  chemically synthesized
tgcacccagttatgcacctt

SEQ ID NO: 563964 - DNA, 20 bp, Artificial Sequence
  chemically synthesized
aggaacatatatattatttt

SEQ ID NO: 563965 - DNA, 20 bp, Artificial Sequence
  chemically synthesized
gtctactcatagagcaatga

SEQ ID NO: 563966 - DNA, 20 bp, Artificial Sequence
  chemically synthesized
actcatagagcaatgaggat

SEQ ID NO: 563967 - DNA, 20 bp, Artificial Sequence
  chemically synthesized
atgggggaaggggtagttag

SEQ ID NO: 563968 - DNA, 20 bp, Artificial Sequence
  chemically synthesized
aggagtgttttcactgtctt

SEQ ID NO: 563969 - DNA, 20 bp, Artificial Sequence
  chemically synthesized
ttttcactgtctttctggat

SEQ ID NO: 563970 - DNA, 20 bp, Artificial Sequence
  chemically synthesized
gtattgactggactgcagta

SEQ ID NO: 563971 - DNA, 20 bp, Artificial Sequence
  chemically synthesized
tacttttttgtaacataact

SEQ ID NO: 563972 - DNA, 20 bp, Artificial Sequence
  chemically synthesized
gccttactattgtattatag

SEQ ID NO: 563973 - DNA, 20 bp, Artificial Sequence
  chemically synthesized
ttgtgaaaatgcagtaaaac

SEQ ID NO: 563974 - DNA, 20 bp, Artificial Sequence
  chemically synthesized
tacgaattatttttttaaac

SEQ ID NO: 563975 - DNA, 20 bp, Artificial Sequence
  chemically synthesized
tacttgagtatcataatata

SEQ ID NO: 563976 - DNA, 20 bp, Artificial Sequence
  chemically synthesized
catcacatggcatgttttgt

SEQ ID NO: 563977 - DNA, 20 bp, Artificial Sequence
  chemically synthesized
caatgacaaaacatgccatg

SEQ ID NO: 563978 - DNA, 20 bp, Artificial Sequence
  chemically synthesized
tgaagcataaacatcacatg

SEQ ID NO: 563979 - DNA, 20 bp, Artificial Sequence
  chemically synthesized
caaaacatgccatgtgatgt

SEQ ID NO: 563980 - DNA, 20 bp, Artificial Sequence
  chemically synthesized
atgtttatgcttcagttaca

SEQ ID NO: 563981 - DNA, 20 bp, Artificial Sequence
  chemically synthesized
gcttcagttacattatgatt

SEQ ID NO: 563982 - DNA, 20 bp, Artificial Sequence
  chemically synthesized
cgaaataatgtccaaattaa

SEQ ID NO: 563983 - DNA, 20 bp, Artificial Sequence
  chemically synthesized
ataatatttgaacaaaaatt

SEQ ID NO: 563984 - DNA, 20 bp, Artificial Sequence
  chemically synthesized
atgtgtctaaaagaaaaaca

SEQ ID NO: 563985 - DNA, 20 bp, Artificial Sequence
  chemically synthesized
aaataattttgttttaatct

SEQ ID NO: 563986 - DNA, 20 bp, Artificial Sequence
  chemically synthesized
taaatagagtgcataaataa

SEQ ID NO: 563987 - DNA, 20 bp, Artificial Sequence
  chemically synthesized
tatttatgcactctatttac

SEQ ID NO: 563988 - DNA, 20 bp, Artificial Sequence
  chemically synthesized
ctactaagaagtttaagtaa

SEQ ID NO: 563989 - DNA, 20 bp, Artificial Sequence
  chemically synthesized
ggttactttacatcctacta

SEQ ID NO: 563990 - DNA, 20 bp, Artificial Sequence
  chemically synthesized
tagtaggatgtaaagtaacc

SEQ ID NO: 563991 - DNA, 20 bp, Artificial Sequence
  chemically synthesized
agtaaccccttgttttaaat

SEQ ID NO: 563992 - DNA, 20 bp, Artificial Sequence
  chemically synthesized
ttacccaaggatttttaaaa

SEQ ID NO: 563993 - DNA, 20 bp, Artificial Sequence
  chemically synthesized
cgctggaccttttctttacc

SEQ ID NO: 563994 - DNA, 20 bp, Artificial Sequence
  chemically synthesized
attaccaaattacatgaaga

SEQ ID NO: 563995 - DNA, 20 bp, Artificial Sequence
  chemically synthesized
taacaaattaccaaattaca

SEQ ID NO: 563996 - DNA, 20 bp, Artificial Sequence
  chemically synthesized
aatttggtaatttgttacct

SEQ ID NO: 563997 - DNA, 20 bp, Artificial Sequence
  chemically synthesized
taatttgttaccttagagct

SEQ ID NO: 563998 - DNA, 20 bp, Artificial Sequence
  chemically synthesized
taattgtgcacacctgagtt

SEQ ID NO: 563999 - DNA, 20 bp, Artificial Sequence
  chemically synthesized
tcatgctatttctacctcac

SEQ ID NO: 564000 - DNA, 20 bp, Artificial Sequence
  chemically synthesized
ggtagaaatagcatgagaag

SEQ ID NO: 564001 - DNA, 20 bp, Artificial Sequence
  chemically synthesized
attaattaattaacatcaaa

SEQ ID NO: 564002 - DNA, 20 bp, Artificial Sequence
  chemically synthesized
gtgtaattagcttttggaga

SEQ ID NO: 564003 - DNA, 20 bp, Artificial Sequence
  chemically synthesized
gtgggctgacatcaagtgta

SEQ ID NO: 564004 - DNA, 20 bp, Artificial Sequence
  chemically synthesized
tacctctgacatcaagtgta

SEQ ID NO: 564005 - DNA, 20 bp, Artificial Sequence
  chemically synthesized
ttacacttgatgtcagaggt

SEQ ID NO: 564006 - DNA, 20 bp, Artificial Sequence
  chemically synthesized
cacggtggtatctattgaat

SEQ ID NO: 564007 - DNA, 20 bp, Artificial Sequence
  chemically synthesized
tttcatgccattttatttct

SEQ ID NO: 564008 - DNA, 20 bp, Artificial Sequence
  chemically synthesized
aataaaatggcatgaaagag

SEQ ID NO: 564009 - DNA, 20 bp, Artificial Sequence
  chemically synthesized
aaagctaaggactggtagga

SEQ ID NO: 564010 - DNA, 20 bp, Artificial Sequence
  chemically synthesized
aaagctttttcctaccagtc

SEQ ID NO: 564011 - DNA, 20 bp, Artificial Sequence
  chemically synthesized
ccagtccttagcttttcctc

SEQ ID NO: 564012 - DNA, 20 bp, Artificial Sequence
  chemically synthesized
tctcctcttttttgagcaat

SEQ ID NO: 564013 - DNA, 20 bp, Artificial Sequence
  chemically synthesized
ctcttttttgagcaattttt

SEQ ID NO: 564014 - DNA, 20 bp, Artificial Sequence
  chemically synthesized
tttttgagcaatttttgttt

SEQ ID NO: 564015 - DNA, 20 bp, Artificial Sequence
  chemically synthesized
aacctgtctaatccaccaag

SEQ ID NO: 564016 - DNA, 20 bp, Artificial Sequence
  chemically synthesized
gttacaaaaaaacccttctt

SEQ ID NO: 564017 - DNA, 20 bp, Artificial Sequence
  chemically synthesized
agtaagtaagaaagaaggca

SEQ ID NO: 564018 - DNA, 20 bp, Artificial Sequence
  chemically synthesized
ttctctgcgagtagttccac

SEQ ID NO: 564019 - DNA, 20 bp, Artificial Sequence
  chemically synthesized
aaaggatggaaacacagttc

SEQ ID NO: 564020 - DNA, 20 bp, Artificial Sequence
  chemically synthesized
tcaacccagaagcccatgaa

SEQ ID NO: 564021 - DNA, 20 bp, Artificial Sequence
  chemically synthesized
tatcacaaatgtgatggggc

SEQ ID NO: 564022 - DNA, 20 bp, Artificial Sequence
  chemically synthesized
tactgttttacaccttttcc

SEQ ID NO: 564023 - DNA, 20 bp, Artificial Sequence
  chemically synthesized
gatttattgtcccatgtggg

SEQ ID NO: 564024 - DNA, 20 bp, Artificial Sequence
  chemically synthesized
ggtttggtttttgttgcttt

SEQ ID NO: 564025 - DNA, 20 bp, Artificial Sequence
  chemically synthesized
gaactgggtggtttggtttt

SEQ ID NO: 564026 - DNA, 20 bp, Artificial Sequence
  chemically synthesized
agtcaaaaggaactgggtgg

SEQ ID NO: 564027 - DNA, 20 bp, Artificial Sequence
  chemically synthesized
ctcacagtcaaaaggaactg

SEQ ID NO: 564028 - DNA, 20 bp, Artificial Sequence
  chemically synthesized
cactctttaagtgaaggatt

SEQ ID NO: 564029 - DNA, 20 bp, Artificial Sequence
  chemically synthesized
gagtaggccactctttaagt

SEQ ID NO: 564030 - DNA, 20 bp, Artificial Sequence
  chemically synthesized
cgatgatagggctggagggc

SEQ ID NO: 564031 - DNA, 20 bp, Artificial Sequence
  chemically synthesized
cagccctatcatcgtcctgc

SEQ ID NO: 564032 - DNA, 20 bp, Artificial Sequence
  chemically synthesized
gttcacaaggtcagaatacc

SEQ ID NO: 564033 - DNA, 20 bp, Artificial Sequence
  chemically synthesized
acaaggtcagaataccttct

SEQ ID NO: 564034 - DNA, 20 bp, Artificial Sequence
  chemically synthesized
atgccacgatttagatttaa

SEQ ID NO: 564035 - DNA, 20 bp, Artificial Sequence
  chemically synthesized
tgctgctagcaatgccacga

SEQ ID NO: 564036 - DNA, 20 bp, Artificial Sequence
  chemically synthesized
gcttcctgctgctagcaatg

SEQ ID NO: 564037 - DNA, 20 bp, Artificial Sequence
  chemically synthesized
ttgattgattgattgataca

SEQ ID NO: 564038 - DNA, 20 bp, Artificial Sequence
  chemically synthesized
ggttggttggttgattgatt

SEQ ID NO: 564039 - DNA, 20 bp, Artificial Sequence
  chemically synthesized
aatcggttggttggttgatt

SEQ ID NO: 564040 - DNA, 20 bp, Artificial Sequence
  chemically synthesized
gagtaatcggttggttggtt

SEQ ID NO: 564041 - DNA, 20 bp, Artificial Sequence
  chemically synthesized
aatcaatcaatcaaccaacc

SEQ ID NO: 564042 - DNA, 20 bp, Artificial Sequence
  chemically synthesized
gagtgagtaatcggttggtt

SEQ ID NO: 564043 - DNA, 20 bp, Artificial Sequence
  chemically synthesized
caacgaaagtaaagtaaagt

SEQ ID NO: 564044 - DNA, 20 bp, Artificial Sequence
  chemically synthesized
tactttcgttgtcagtggaa

SEQ ID NO: 564045 - DNA, 20 bp, Artificial Sequence
  chemically synthesized
aaaacattgtctacagctcc

SEQ ID NO: 564046 - DNA, 20 bp, Artificial Sequence
  chemically synthesized
gaaacatctggagctgtaga

SEQ ID NO: 564047 - DNA, 20 bp, Artificial Sequence
  chemically synthesized
tagacaatgttttagtgtgg

SEQ ID NO: 564048 - DNA, 20 bp, Artificial Sequence
  chemically synthesized
ttagtgtggtgtagtttcct

SEQ ID NO: 564049 - DNA, 20 bp, Artificial Sequence
  chemically synthesized
ggcttacctgcttggtctag

SEQ ID NO: 564050 - DNA, 20 bp, Artificial Sequence
  chemically synthesized
ctagtcagtcatccaggctt

SEQ ID NO: 564051 - DNA, 20 bp, Artificial Sequence
  chemically synthesized
aattacttctagtcagtcat

SEQ ID NO: 564052 - DNA, 20 bp, Artificial Sequence
  chemically synthesized
gtcagctgagtggggcaggc

SEQ ID NO: 564053 - DNA, 20 bp, Artificial Sequence
  chemically synthesized
agaactgtcagctgagtggg

SEQ ID NO: 564054 - DNA, 20 bp, Artificial Sequence
  chemically synthesized
cgtgatatccatatgaaatt

SEQ ID NO: 564055 - DNA, 20 bp, Artificial Sequence
  chemically synthesized
cacaaaactttgaggcagcg

SEQ ID NO: 564056 - DNA, 20 bp, Artificial Sequence
  chemically synthesized
tgcaaaacaatgcgctgcct

SEQ ID NO: 564057 - DNA, 20 bp, Artificial Sequence
  chemically synthesized
gtgtgtgtatgtgtgtgtgt

SEQ ID NO: 564058 - DNA, 20 bp, Artificial Sequence
  chemically synthesized
gtgtatgtgtgtgtgtgtgt

SEQ ID NO: 564059 - DNA, 20 bp, Artificial Sequence
  chemically synthesized
tgtgtgtgtgtgtgtgtttg

SEQ ID NO: 564060 - DNA, 20 bp, Artificial Sequence
  chemically synthesized
tgtgtgtttgttttgttttt

SEQ ID NO: 564061 - DNA, 20 bp, Artificial Sequence
  chemically synthesized
aagtgtgctttataaaaaaa

SEQ ID NO: 564062 - DNA, 20 bp, Artificial Sequence
  chemically synthesized
cttttttttataaagcacac

SEQ ID NO: 564063 - DNA, 20 bp, Artificial Sequence
  chemically synthesized
aagaaagattgtaaactaaa

SEQ ID NO: 564064 - DNA, 20 bp, Artificial Sequence
  chemically synthesized
aaatttataacagttataaa

SEQ ID NO: 564065 - DNA, 20 bp, Artificial Sequence
  chemically synthesized
tttatatggaacgcattttg

SEQ ID NO: 564066 - DNA, 20 bp, Artificial Sequence
  chemically synthesized
aatggcaagttatttagcta

SEQ ID NO: 564067 - DNA, 20 bp, Artificial Sequence
  chemically synthesized
ttagctatcaagattttaca

SEQ ID NO: 564068 - DNA, 20 bp, Artificial Sequence
  chemically synthesized
ttattgttttgttaacaatg

SEQ ID NO: 564069 - DNA, 20 bp, Artificial Sequence
  chemically synthesized
tcagtagtttctaagtctgt

SEQ ID NO: 564070 - DNA, 20 bp, Artificial Sequence
  chemically synthesized
ggtattatactgtagatttc

SEQ ID NO: 564071 - DNA, 20 bp, Artificial Sequence
  chemically synthesized
gaagggtagtggtattatac

SEQ ID NO: 564072 - DNA, 20 bp, Artificial Sequence
  chemically synthesized
accactacccttcacaaaaa

SEQ ID NO: 564073 - DNA, 20 bp, Artificial Sequence
  chemically synthesized
aacaaagaggattagacagt

SEQ ID NO: 564074 - DNA, 20 bp, Artificial Sequence
  chemically synthesized
ttataatattcatacaacaa

SEQ ID NO: 564075 - DNA, 20 bp, Artificial Sequence
  chemically synthesized
tttacaactcctgattcccg

SEQ ID NO: 564076 - DNA, 20 bp, Artificial Sequence
  chemically synthesized
cagaataaatgttttacaac

SEQ ID NO: 564077 - DNA, 20 bp, Artificial Sequence
  chemically synthesized
agatgaagaaggagcagaat

SEQ ID NO: 564078 - DNA, 20 bp, Artificial Sequence
  chemically synthesized
ggaagtcttttccacatggc

SEQ ID NO: 564079 - DNA, 20 bp, Artificial Sequence
  chemically synthesized
taaagtctgtctttctttct

SEQ ID NO: 564080 - DNA, 20 bp, Artificial Sequence
  chemically synthesized
ggtgcagatagatagcatca

SEQ ID NO: 564081 - DNA, 20 bp, Artificial Sequence
  chemically synthesized
tgtcttcacccagaaatggg

SEQ ID NO: 564082 - DNA, 20 bp, Artificial Sequence
  chemically synthesized
cttgttgtgtacaccctcga

SEQ ID NO: 564083 - DNA, 20 bp, Artificial Sequence
  chemically synthesized
tgcatcgagggtgtacacaa

SEQ ID NO: 564084 - DNA, 20 bp, Artificial Sequence
  chemically synthesized
tcgagggtgtacacaacaag

SEQ ID NO: 564085 - DNA, 20 bp, Artificial Sequence
  chemically synthesized
acaacaaggtttgatttttc

SEQ ID NO: 564086 - DNA, 20 bp, Artificial Sequence
  chemically synthesized
taatggcttcattaataagg

SEQ ID NO: 564087 - DNA, 20 bp, Artificial Sequence
  chemically synthesized
acgtgtaatggcttcattaa

SEQ ID NO: 564088 - DNA, 20 bp, Artificial Sequence
  chemically synthesized
ttattaatgaagccattaca

SEQ ID NO: 564089 - DNA, 20 bp, Artificial Sequence
  chemically synthesized
gatactaacaaacaacgtgt

SEQ ID NO: 564090 - DNA, 20 bp, Artificial Sequence
  chemically synthesized
attacacgttgtttgttagt

SEQ ID NO: 564091 - DNA, 20 bp, Artificial Sequence
  chemically synthesized
ttaatgttggatcaggctac

SEQ ID NO: 564092 - DNA, 20 bp, Artificial Sequence
  chemically synthesized
atttacattgggaacctgaa

SEQ ID NO: 564093 - DNA, 20 bp, Artificial Sequence
  chemically synthesized
aaagaattccatagataagc

SEQ ID NO: 564094 - DNA, 20 bp, Artificial Sequence
  chemically synthesized
ttcctgttctgatagaaatc

SEQ ID NO: 564095 - DNA, 20 bp, Artificial Sequence
  chemically synthesized
atcttttccaccttggctat

SEQ ID NO: 564096 - DNA, 20 bp, Artificial Sequence
  chemically synthesized
tttccaccttggctatgagt

SEQ ID NO: 564097 - DNA, 20 bp, Artificial Sequence
  chemically synthesized
caccttggctatgagtgatt

SEQ ID NO: 564098 - DNA, 20 bp, Artificial Sequence
  chemically synthesized
ttgtgaaggtggtgatggtg

SEQ ID NO: 564099 - DNA, 20 bp, Artificial Sequence
  chemically synthesized
gtagttgtgaaggtggtgat

SEQ ID NO: 564100 - DNA, 20 bp, Artificial Sequence
  chemically synthesized
acaccaacttttcatttcaa

SEQ ID NO: 564101 - DNA, 20 bp, Artificial Sequence
  chemically synthesized
tttcaaagctgtttcaggct

SEQ ID NO: 564102 - DNA, 20 bp, Artificial Sequence
  chemically synthesized
gaagcaagccaacagcctga

SEQ ID NO: 564103 - DNA, 20 bp, Artificial Sequence
  chemically synthesized
aaagctgtttcaggctgttg

SEQ ID NO: 564104 - DNA, 20 bp, Artificial Sequence
  chemically synthesized
ggtggaggtggctattttct

SEQ ID NO: 564105 - DNA, 20 bp, Artificial Sequence
  chemically synthesized
gtgcaccaaaaggtcaattc

SEQ ID NO: 564106 - DNA, 20 bp, Artificial Sequence
  chemically synthesized
ttaggaaacctcagaataaa

SEQ ID NO: 564107 - DNA, 20 bp, Artificial Sequence
  chemically synthesized
atgtaaagcaatttttattc

SEQ ID NO: 564108 - DNA, 20 bp, Artificial Sequence
  chemically synthesized
tcatttaggaggagctctaa

SEQ ID NO: 564109 - DNA, 20 bp, Artificial Sequence
  chemically synthesized
ctgttctttttctccgtgct

SEQ ID NO: 564110 - DNA, 20 bp, Artificial Sequence
  chemically synthesized
ctgggtacttcgtagcaaaa

SEQ ID NO: 564111 - DNA, 20 bp, Artificial Sequence
  chemically synthesized
aggcaagccataaagtaagt

SEQ ID NO: 564112 - DNA, 20 bp, Artificial Sequence
  chemically synthesized
agataatctgagacttactt

SEQ ID NO: 564113 - DNA, 20 bp, Artificial Sequence
  chemically synthesized
ttgccttttcgtctatgtcc

SEQ ID NO: 564114 - DNA, 20 bp, Artificial Sequence
  chemically synthesized
aagacaatacttgaatagtg

SEQ ID NO: 564115 - DNA, 20 bp, Artificial Sequence
  chemically synthesized
aagtattgtctttggaactg

SEQ ID NO: 564116 - DNA, 20 bp, Artificial Sequence
  chemically synthesized
accttgccatgtatcaactt

SEQ ID NO: 564117 - DNA, 20 bp, Artificial Sequence
  chemically synthesized
acaaaatactctccctagtc

SEQ ID NO: 564118 - DNA, 20 bp, Artificial Sequence
  chemically synthesized
gctatagactagggagagta

SEQ ID NO: 564119 - DNA, 20 bp, Artificial Sequence
  chemically synthesized
ttaatatttatttcaagaga

SEQ ID NO: 564120 - DNA, 20 bp, Artificial Sequence
  chemically synthesized
atagcttctctacaaaatga

SEQ ID NO: 564121 - DNA, 20 bp, Artificial Sequence
  chemically synthesized
gtttaagtgcctgcccgtga

SEQ ID NO: 564122 - DNA, 20 bp, Artificial Sequence
  chemically synthesized
ttcagttgatctggtgccat

SEQ ID NO: 564123 - DNA, 20 bp, Artificial Sequence
  chemically synthesized
caactgaagacttacttatt

SEQ ID NO: 564124 - DNA, 20 bp, Artificial Sequence
  chemically synthesized
aggcatttctattaaggtga

SEQ ID NO: 564125 - DNA, 20 bp, Artificial Sequence
  chemically synthesized
aagtttgtatatctatcttt

SEQ ID NO: 564126 - DNA, 20 bp, Artificial Sequence
  chemically synthesized
attatattttagaaaatcac

SEQ ID NO: 564127 - DNA, 20 bp, Artificial Sequence
  chemically synthesized
gcagtctcagccaaaatcca

SEQ ID NO: 564128 - DNA, 20 bp, Artificial Sequence
  chemically synthesized
cccactttatgaatagttgc

SEQ ID NO: 564129 - DNA, 20 bp, Artificial Sequence
  chemically synthesized
aactattcataaagtgggcc

SEQ ID NO: 564130 - DNA, 20 bp, Artificial Sequence
  chemically synthesized
agtgaagaactgaaatcatt

SEQ ID NO: 564131 - DNA, 20 bp, Artificial Sequence
  chemically synthesized
tttatggcacagaaagccaa

SEQ ID NO: 564132 - DNA, 20 bp, Artificial Sequence
  chemically synthesized
gccccactgtgtcgtcttcc

SEQ ID NO: 564133 - DNA, 20 bp, Artificial Sequence
  chemically synthesized
taactgctgctatcaagttg

SEQ ID NO: 564134 - DNA, 20 bp, Artificial Sequence
  chemically synthesized
aatttatgcatgaataatta

SEQ ID NO: 564135 - DNA, 20 bp, Artificial Sequence
  chemically synthesized
aaggtcctggactttgtttt

SEQ ID NO: 564136 - DNA, 20 bp, Artificial Sequence
  chemically synthesized
catgttgtaaaggtcctgga

SEQ ID NO: 564137 - DNA, 20 bp, Artificial Sequence
  chemically synthesized
cttttcgttgatgttttgta

SEQ ID NO: 564138 - DNA, 20 bp, Artificial Sequence
  chemically synthesized
gagttttctccccttttcgt

SEQ ID NO: 564139 - DNA, 20 bp, Artificial Sequence
  chemically synthesized
ataagctgacaggaaaaaaa

SEQ ID NO: 564140 - DNA, 20 bp, Artificial Sequence
  chemically synthesized
gaaaactcattttttttcct

SEQ ID NO: 564141 - DNA, 20 bp, Artificial Sequence
  chemically synthesized
agcctaaaaagaaagacact

SEQ ID NO: 564142 - DNA, 20 bp, Artificial Sequence
  chemically synthesized
tataatccataaatgcattt

SEQ ID NO: 564143 - DNA, 20 bp, Artificial Sequence
  chemically synthesized
ataaaacaaataaatgcatt

SEQ ID NO: 564144 - DNA, 20 bp, Artificial Sequence
  chemically synthesized
ttatggattatatagccaag

SEQ ID NO: 564145 - DNA, 20 bp, Artificial Sequence
  chemically synthesized
atagcagatacccctagaac

SEQ ID NO: 564146 - DNA, 20 bp, Artificial Sequence
  chemically synthesized
ttctaggggtatctgctatt

SEQ ID NO: 564147 - DNA, 20 bp, Artificial Sequence
  chemically synthesized
tggcacattaagaataatga

SEQ ID NO: 564148 - DNA, 20 bp, Artificial Sequence
  chemically synthesized
aaaaagttgggtggccttta

SEQ ID NO: 564149 - DNA, 20 bp, Artificial Sequence
  chemically synthesized
ctttggttacttcactaaat

SEQ ID NO: 564150 - DNA, 20 bp, Artificial Sequence
  chemically synthesized
ataattctaatttctttcca

SEQ ID NO: 564151 - DNA, 20 bp, Artificial Sequence
  chemically synthesized
ttagggcagtagtttgtaaa

SEQ ID NO: 564152 - DNA, 20 bp, Artificial Sequence
  chemically synthesized
aaagtatgattctttagggc

SEQ ID NO: 564153 - DNA, 20 bp, Artificial Sequence
  chemically synthesized
tacccctccaacggattaaa

SEQ ID NO: 564154 - DNA, 20 bp, Artificial Sequence
  chemically synthesized
cagtgcagtcttacccctcc

SEQ ID NO: 564155 - DNA, 20 bp, Artificial Sequence
  chemically synthesized
actgtgacatgactatagaa

SEQ ID NO: 564156 - DNA, 20 bp, Artificial Sequence
  chemically synthesized
ggaggtcattaatgttacct

SEQ ID NO: 564157 - DNA, 20 bp, Artificial Sequence
  chemically synthesized
tacctctcatacttcatagt

SEQ ID NO: 564158 - DNA, 20 bp, Artificial Sequence
  chemically synthesized
tgagaggtactgaaaagcag

SEQ ID NO: 564159 - DNA, 20 bp, Artificial Sequence
  chemically synthesized
attgcaaatgcctgaatcct

SEQ ID NO: 564160 - DNA, 20 bp, Artificial Sequence
  chemically synthesized
ttctgtcaccttgtgcctga

SEQ ID NO: 564161 - DNA, 20 bp, Artificial Sequence
  chemically synthesized
aaatcaatactttctataga

SEQ ID NO: 564162 - DNA, 20 bp, Artificial Sequence
  chemically synthesized
aaaactatgtctatagaaag

SEQ ID NO: 564163 - DNA, 20 bp, Artificial Sequence
  chemically synthesized
gtattgatttaatccattct

SEQ ID NO: 564164 - DNA, 20 bp, Artificial Sequence
  chemically synthesized
tgtgttcaataatccttaag

SEQ ID NO: 564165 - DNA, 20 bp, Artificial Sequence
  chemically synthesized
ccttgaacattagggcagtt

SEQ ID NO: 564166 - DNA, 20 bp, Artificial Sequence
  chemically synthesized
acgtcaccactgcctgaggg

SEQ ID NO: 564167 - DNA, 20 bp, Artificial Sequence
  chemically synthesized
cctgagggaattgttttcca

SEQ ID NO: 564168 - DNA, 20 bp, Artificial Sequence
  chemically synthesized
gtatttttaaaaaatagagc

SEQ ID NO: 564169 - DNA, 20 bp, Artificial Sequence
  chemically synthesized
agcaaatttccctgtagtat

SEQ ID NO: 564170 - DNA, 20 bp, Artificial Sequence
  chemically synthesized
agccggaatactacagggaa

SEQ ID NO: 564171 - DNA, 20 bp, Artificial Sequence
  chemically synthesized
taatttaatctctgaaaaaa

SEQ ID NO: 564172 - DNA, 20 bp, Artificial Sequence
  chemically synthesized
tacgtaaagcagattttttt

SEQ ID NO: 564173 - DNA, 20 bp, Artificial Sequence
  chemically synthesized
aatatcccaaatgtacgtaa

SEQ ID NO: 564174 - DNA, 20 bp, Artificial Sequence
  chemically synthesized
atagcattaaaaaaggtcat

SEQ ID NO: 564175 - DNA, 20 bp, Artificial Sequence
  chemically synthesized
attaaaaaaggtcattattg

SEQ ID NO: 564176 - DNA, 20 bp, Artificial Sequence
  chemically synthesized
ggtcattattgttttgattc

SEQ ID NO: 564177 - DNA, 20 bp, Artificial Sequence
  chemically synthesized
ctgaggtgtatggtgttcag

SEQ ID NO: 564178 - DNA, 20 bp, Artificial Sequence
  chemically synthesized
gaaattcatttgtgagtgaa

SEQ ID NO: 564179 - DNA, 20 bp, Artificial Sequence
  chemically synthesized
cataattttgaccaccttaa

SEQ ID NO: 564180 - DNA, 20 bp, Artificial Sequence
  chemically synthesized
gtgaagcattgaatgcccct

SEQ ID NO: 564181 - DNA, 20 bp, Artificial Sequence
  chemically synthesized
ggcaaaccgtcaggggcatt

SEQ ID NO: 564182 - DNA, 20 bp, Artificial Sequence
  chemically synthesized
gcattcaatgcttcaccaag

SEQ ID NO: 564183 - DNA, 20 bp, Artificial Sequence
  chemically synthesized
tctgtgccagtgcctccttc

SEQ ID NO: 564184 - DNA, 20 bp, Artificial Sequence
  chemically synthesized
gacacactgaagaatcatta

SEQ ID NO: 564185 - DNA, 20 bp, Artificial Sequence
  chemically synthesized
ccatacaagtctaatcaatt

SEQ ID NO: 564186 - DNA, 20 bp, Artificial Sequence
  chemically synthesized
cttgtatggcatgatgttgg

SEQ ID NO: 564187 - DNA, 20 bp, Artificial Sequence
  chemically synthesized
cagagttttcattacgactc

SEQ ID NO: 564188 - DNA, 20 bp, Artificial Sequence
  chemically synthesized
acaggatggactggagagac

SEQ ID NO: 564189 - DNA, 20 bp, Artificial Sequence
  chemically synthesized
tccttcttaaatgagaagat

SEQ ID NO: 564190 - DNA, 20 bp, Artificial Sequence
  chemically synthesized
tggagagtccttcttaaatg

SEQ ID NO: 564191 - DNA, 20 bp, Artificial Sequence
  chemically synthesized
agaacactgtcatcccatgg

SEQ ID NO: 564192 - DNA, 20 bp, Artificial Sequence
  chemically synthesized
gagctttccttctctcctcc

SEQ ID NO: 564193 - DNA, 20 bp, Artificial Sequence
  chemically synthesized
taaattcttggtaaagacaa

SEQ ID NO: 564194 - DNA, 20 bp, Artificial Sequence
  chemically synthesized
gtttcaggttttacggtgaa

SEQ ID NO: 564195 - DNA, 20 bp, Artificial Sequence
  chemically synthesized
tcttatcactgaatgtggtt

SEQ ID NO: 564196 - DNA, 20 bp, Artificial Sequence
  chemically synthesized
ggtgcagtcttatcactgaa

SEQ ID NO: 564197 - DNA, 20 bp, Artificial Sequence
  chemically synthesized
aattaaatattggagttttg

SEQ ID NO: 564198 - DNA, 20 bp, Artificial Sequence
  chemically synthesized
tcgattaaaaaattaaatat

SEQ ID NO: 564199 - DNA, 20 bp, Artificial Sequence
  chemically synthesized
gccacacagaacaataacca

SEQ ID NO: 564200 - DNA, 20 bp, Artificial Sequence
  chemically synthesized
tcgaattggttattgttctg

SEQ ID NO: 564201 - DNA, 20 bp, Artificial Sequence
  chemically synthesized
acactcttaactctcatttg

SEQ ID NO: 564202 - DNA, 20 bp, Artificial Sequence
  chemically synthesized
tgtgtcccaggtgacagagc

SEQ ID NO: 564203 - DNA, 20 bp, Artificial Sequence
  chemically synthesized
tggctctgtcacctgggaca

SEQ ID NO: 564204 - DNA, 20 bp, Artificial Sequence
  chemically synthesized
gaggtaggtactcttattaa

SEQ ID NO: 564205 - DNA, 20 bp, Artificial Sequence
  chemically synthesized
ttaataagagtacctacctc

SEQ ID NO: 564206 - DNA, 20 bp, Artificial Sequence
  chemically synthesized
aagatggcaagtgctgagaa

SEQ ID NO: 564207 - DNA, 20 bp, Artificial Sequence
  chemically synthesized
ctgggatgacttcattttgc

SEQ ID NO: 564208 - DNA, 20 bp, Artificial Sequence
  chemically synthesized
attcttctgggatgacttca

SEQ ID NO: 564209 - DNA, 20 bp, Artificial Sequence
  chemically synthesized
tagcattttctgccagcgcc

SEQ ID NO: 564210 - DNA, 20 bp, Artificial Sequence
  chemically synthesized
ctaaggtcctggaagtggaa

SEQ ID NO: 564211 - DNA, 20 bp, Artificial Sequence
  chemically synthesized
tgaacataactgatgagtca

SEQ ID NO: 564212 - DNA, 20 bp, Artificial Sequence
  chemically synthesized
gttcaaggctaaatttattt

SEQ ID NO: 564213 - DNA, 20 bp, Artificial Sequence
  chemically synthesized
atggcaacagatgatgaacg

SEQ ID NO: 564214 - DNA, 20 bp, Artificial Sequence
  chemically synthesized
gattccaacctagggactac

SEQ ID NO: 564215 - DNA, 20 bp, Artificial Sequence
  chemically synthesized
tacaaaggattgccatttta

SEQ ID NO: 564216 - DNA, 20 bp, Artificial Sequence
  chemically synthesized
ctcatcctgctttttatgtt

SEQ ID NO: 564217 - DNA, 20 bp, Artificial Sequence
  chemically synthesized
tgtctgtctcatcctgcttt

SEQ ID NO: 564218 - DNA, 20 bp, Artificial Sequence
  chemically synthesized
catggcttctgtctgtctca

SEQ ID NO: 564219 - DNA, 20 bp, Artificial Sequence
  chemically synthesized
gtgagattcaggctcacggc

SEQ ID NO: 564220 - DNA, 20 bp, Artificial Sequence
  chemically synthesized
aaagccaatgagagaggtta

SEQ ID NO: 564221 - DNA, 20 bp, Artificial Sequence
  chemically synthesized
gaatctcactaacctctctc

SEQ ID NO: 564222 - DNA, 20 bp, Artificial Sequence
  chemically synthesized
gtatgaaattgtatatttat

SEQ ID NO: 564223 - DNA, 20 bp, Artificial Sequence
  chemically synthesized
aaatatacaatttcatacca

SEQ ID NO: 564224 - DNA, 20 bp, Artificial Sequence
  chemically synthesized
gaataaatggtcatctcaac

SEQ ID NO: 564225 - DNA, 20 bp, Artificial Sequence
  chemically synthesized
gtgtcttttgggttttttgt

SEQ ID NO: 564226 - DNA, 20 bp, Artificial Sequence
  chemically synthesized
ctagatgtgtcttttgggtt

SEQ ID NO: 564227 - DNA, 20 bp, Artificial Sequence
  chemically synthesized
tatttgactagatgtgtctt

SEQ ID NO: 564228 - DNA, 20 bp, Artificial Sequence
  chemically synthesized
gacgtcttctggatcatgtt

SEQ ID NO: 564229 - DNA, 20 bp, Artificial Sequence
  chemically synthesized
ccagtttaatgcgtgaactc

SEQ ID NO: 564230 - DNA, 20 bp, Artificial Sequence
  chemically synthesized
ctattctgtgccagttttca

SEQ ID NO: 564231 - DNA, 20 bp, Artificial Sequence
  chemically synthesized
ttgtcagatttctattctgt

SEQ ID NO: 564232 - DNA, 20 bp, Artificial Sequence
  chemically synthesized
ttgaaaacaatgcccaattt

SEQ ID NO: 564233 - DNA, 20 bp, Artificial Sequence
  chemically synthesized
tagaaatctgacaaattggg

SEQ ID NO: 564234 - DNA, 20 bp, Artificial Sequence
  chemically synthesized
ttctgagactttttttaaca

SEQ ID NO: 564235 - DNA, 20 bp, Artificial Sequence
  chemically synthesized
tgtgctgattgtcaagagtg

SEQ ID NO: 564236 - DNA, 20 bp, Artificial Sequence
  chemically synthesized
ctactgtttatgtttcaatg

SEQ ID NO: 564237 - DNA, 20 bp, Artificial Sequence
  chemically synthesized
cacacagagtcaactactgt

SEQ ID NO: 564238 - DNA, 20 bp, Artificial Sequence
  chemically synthesized
tttgggcacacagagtcaac

SEQ ID NO: 564239 - DNA, 20 bp, Artificial Sequence
  chemically synthesized
ccaatttcatcatggaaatg

SEQ ID NO: 564240 - DNA, 20 bp, Artificial Sequence
  chemically synthesized
ctcttcccctcatctgttct

SEQ ID NO: 564241 - DNA, 20 bp, Artificial Sequence
  chemically synthesized
ctcattcctggatctggctc

SEQ ID NO: 564242 - DNA, 20 bp, Artificial Sequence
  chemically synthesized
ccacagagccagatccagga

SEQ ID NO: 564243 - DNA, 20 bp, Artificial Sequence
  chemically synthesized
aatggctaaagacccactgg

SEQ ID NO: 564244 - DNA, 20 bp, Artificial Sequence
  chemically synthesized
aagacccactggccttgatt

SEQ ID NO: 564245 - DNA, 20 bp, Artificial Sequence
  chemically synthesized
catgcaatttcctttaaaat

SEQ ID NO: 564246 - DNA, 20 bp, Artificial Sequence
  chemically synthesized
ctttaaaatcttggttttca

SEQ ID NO: 564247 - DNA, 20 bp, Artificial Sequence
  chemically synthesized
tagttaaaacagtttgaaaa

SEQ ID NO: 564248 - DNA, 20 bp, Artificial Sequence
  chemically synthesized
tgtcccattgctatagttaa

SEQ ID NO: 564249 - DNA, 20 bp, Artificial Sequence
  chemically synthesized
aatattggaattccatataa

SEQ ID NO: 564250 - DNA, 20 bp, Artificial Sequence
  chemically synthesized
tcaaaatattggaattccat

SEQ ID NO: 564251 - DNA, 20 bp, Artificial Sequence
  chemically synthesized
ctgtacaggatctctcacag

SEQ ID NO: 564252 - DNA, 20 bp, Artificial Sequence
  chemically synthesized
gtagttctcaaattgtttca

SEQ ID NO: 564253 - DNA, 20 bp, Artificial Sequence
  chemically synthesized
ttccagactagtagttctca

SEQ ID NO: 564254 - DNA, 20 bp, Artificial Sequence
  chemically synthesized
ctaaccttgagtgagttttg

SEQ ID NO: 564255 - DNA, 20 bp, Artificial Sequence
  chemically synthesized
gttttgaaccctaaccttga

SEQ ID NO: 564256 - DNA, 20 bp, Artificial Sequence
  chemically synthesized
actatccttaaatgtatact

SEQ ID NO: 564257 - DNA, 20 bp, Artificial Sequence
  chemically synthesized
acttctagtatacatttaag

SEQ ID NO: 564258 - DNA, 20 bp, Artificial Sequence
  chemically synthesized
tatacatttaaggatagttt

SEQ ID NO: 564259 - DNA, 20 bp, Artificial Sequence
  chemically synthesized
tctgaatttcctacatgact

SEQ ID NO: 564260 - DNA, 20 bp, Artificial Sequence
  chemically synthesized
ctcagcgatttcttaggagt

SEQ ID NO: 564261 - DNA, 20 bp, Artificial Sequence
  chemically synthesized
tttcttaggagtatcagatt

SEQ ID NO: 564262 - DNA, 20 bp, Artificial Sequence
  chemically synthesized
ccatttttctccctcttttc

SEQ ID NO: 564263 - DNA, 20 bp, Artificial Sequence
  chemically synthesized
gaaggggtgagtgattcata

SEQ ID NO: 564264 - DNA, 20 bp, Artificial Sequence
  chemically synthesized
aggaatcaaaaagaaggggt

SEQ ID NO: 564265 - DNA, 20 bp, Artificial Sequence
  chemically synthesized
atgaatcactcaccccttct

SEQ ID NO: 564266 - DNA, 20 bp, Artificial Sequence
  chemically synthesized
cttctttttgattcctttag

SEQ ID NO: 564267 - DNA, 20 bp, Artificial Sequence
  chemically synthesized
gtttttttaaaaaagtatct

SEQ ID NO: 564268 - DNA, 20 bp, Artificial Sequence
  chemically synthesized
acatgtggaccccgtcctca

SEQ ID NO: 564269 - DNA, 20 bp, Artificial Sequence
  chemically synthesized
cttgcccttcactggcacac

SEQ ID NO: 564270 - DNA, 20 bp, Artificial Sequence
  chemically synthesized
ttggatgccaaaggtgggta

SEQ ID NO: 564271 - DNA, 20 bp, Artificial Sequence
  chemically synthesized
gtttcggcatgtaactttgg

SEQ ID NO: 564272 - DNA, 20 bp, Artificial Sequence
  chemically synthesized
cactgtccttcctaaagatc

SEQ ID NO: 564273 - DNA, 20 bp, Artificial Sequence
  chemically synthesized
gacagtgttgttagaaagcc

SEQ ID NO: 564274 - DNA, 20 bp, Artificial Sequence
  chemically synthesized
cataattacattctaaatca

SEQ ID NO: 564275 - DNA, 20 bp, Artificial Sequence
  chemically synthesized
ttatgtacttcagaatgtaa

SEQ ID NO: 564276 - DNA, 20 bp, Artificial Sequence
  chemically synthesized
gaatgtaacgatgattcttt

SEQ ID NO: 564277 - DNA, 20 bp, Artificial Sequence
  chemically synthesized
attgataactgagttctgaa

SEQ ID NO: 564278 - DNA, 20 bp, Artificial Sequence
  chemically synthesized
atattcagaactcagttatc

SEQ ID NO: 564279 - DNA, 20 bp, Artificial Sequence
  chemically synthesized
ggaggtccattttcataaaa

SEQ ID NO: 564280 - DNA, 20 bp, Artificial Sequence
  chemically synthesized
ggattttagaagagattaga

SEQ ID NO: 564281 - DNA, 20 bp, Artificial Sequence
  chemically synthesized
gtgatgagggaggattttag

SEQ ID NO: 564282 - DNA, 20 bp, Artificial Sequence
  chemically synthesized
gtggggacccaagtgatgag

SEQ ID NO: 564283 - DNA, 20 bp, Artificial Sequence
  chemically synthesized
cttttacagtagaaaatatc

SEQ ID NO: 564284 - DNA, 20 bp, Artificial Sequence
  chemically synthesized
acgctgacaaaacagaggct

SEQ ID NO: 564285 - DNA, 20 bp, Artificial Sequence
  chemically synthesized
aaatgttgtaatcaagtagc

SEQ ID NO: 564286 - DNA, 20 bp, Artificial Sequence
  chemically synthesized
aaaagttcttgaccgataaa

SEQ ID NO: 564287 - DNA, 20 bp, Artificial Sequence
  chemically synthesized
accgataaataaagtttcag

SEQ ID NO: 564288 - DNA, 20 bp, Artificial Sequence
  chemically synthesized
actcatttccaaaaaaaaat

SEQ ID NO: 564289 - DNA, 20 bp, Artificial Sequence
  chemically synthesized
acatttatttttttttggaa

SEQ ID NO: 564290 - DNA, 20 bp, Artificial Sequence
  chemically synthesized
cccagcacacttcccttttg

SEQ ID NO: 564291 - DNA, 20 bp, Artificial Sequence
  chemically synthesized
ggcagtcctgagtctaaata

SEQ ID NO: 564292 - DNA, 20 bp, Artificial Sequence
  chemically synthesized
gggcactataaaattgacat

SEQ ID NO: 564293 - DNA, 20 bp, Artificial Sequence
  chemically synthesized
gagttggaattgcaggacag

SEQ ID NO: 564294 - DNA, 20 bp, Artificial Sequence
  chemically synthesized
tgcaggacagtactgtttct

SEQ ID NO: 564295 - DNA, 20 bp, Artificial Sequence
  chemically synthesized
aaggaagaataagtcccttt

SEQ ID NO: 564296 - DNA, 20 bp, Artificial Sequence
  chemically synthesized
gagctgaaattgaattgatt

SEQ ID NO: 564297 - DNA, 20 bp, Artificial Sequence
  chemically synthesized
agattattgagctgaaattg

SEQ ID NO: 564298 - DNA, 20 bp, Artificial Sequence
  chemically synthesized
gctgatcaactttcagctga

SEQ ID NO: 564299 - DNA, 20 bp, Artificial Sequence
  chemically synthesized
ctcattacatgtatagagtc

SEQ ID NO: 564300 - DNA, 20 bp, Artificial Sequence
  chemically synthesized
aacgaaataatagcgtaaag

SEQ ID NO: 564301 - DNA, 20 bp, Artificial Sequence
  chemically synthesized
tatggggaaaatttgccaat

SEQ ID NO: 564302 - DNA, 20 bp, Artificial Sequence
  chemically synthesized
agggccagatagtaaatatt

SEQ ID NO: 564303 - DNA, 20 bp, Artificial Sequence
  chemically synthesized
gaatagctggtccagagacc

SEQ ID NO: 564304 - DNA, 20 bp, Artificial Sequence
  chemically synthesized
ttcatttacatgttgcctat

SEQ ID NO: 564305 - DNA, 20 bp, Artificial Sequence
  chemically synthesized
tgggtatggctgtgttccaa

SEQ ID NO: 564306 - DNA, 20 bp, Artificial Sequence
  chemically synthesized
tggcccaatacctgttttta

SEQ ID NO: 564307 - DNA, 20 bp, Artificial Sequence
  chemically synthesized
tttataaaaacaggtattgg

SEQ ID NO: 564308 - DNA, 20 bp, Artificial Sequence
  chemically synthesized
aatgccaaatctggcccaat

SEQ ID NO: 564309 - DNA, 20 bp, Artificial Sequence
  chemically synthesized
gatttggcatttgggctgta

SEQ ID NO: 564310 - DNA, 20 bp, Artificial Sequence
  chemically synthesized
gctgtatgtagtttgctagt

SEQ ID NO: 564311 - DNA, 20 bp, Artificial Sequence
  chemically synthesized
tgtttcctgtatgctcccac

SEQ ID NO: 564312 - DNA, 20 bp, Artificial Sequence
  chemically synthesized
gtgccctttttcaggcacca

SEQ ID NO: 564313 - DNA, 20 bp, Artificial Sequence
  chemically synthesized
ttccataaaagaaccacaga

SEQ ID NO: 564314 - DNA, 20 bp, Artificial Sequence
  chemically synthesized
gattttaattttaaaagacg

SEQ ID NO: 564315 - DNA, 20 bp, Artificial Sequence
  chemically synthesized
tacccctaaattaccaaccc

SEQ ID NO: 564316 - DNA, 20 bp, Artificial Sequence
  chemically synthesized
gggtatttgatagaatgtac

SEQ ID NO: 564317 - DNA, 20 bp, Artificial Sequence
  chemically synthesized
tgtggcacaggtcagtaggc

SEQ ID NO: 564318 - DNA, 20 bp, Artificial Sequence
  chemically synthesized
gcagaaatagtagcactgct

SEQ ID NO: 564319 - DNA, 20 bp, Artificial Sequence
  chemically synthesized
agtagcactgctaactgctt

SEQ ID NO: 564320 - DNA, 20 bp, Artificial Sequence
  chemically synthesized
gcactgctaactgctttctg

SEQ ID NO: 564321 - DNA, 20 bp, Artificial Sequence
  chemically synthesized
ctggattgttttactgcatt

SEQ ID NO: 564322 - DNA, 20 bp, Artificial Sequence
  chemically synthesized
taccatactactgactagga

SEQ ID NO: 564323 - DNA, 20 bp, Artificial Sequence
  chemically synthesized
atttaaaaaataaccccatt

SEQ ID NO: 564324 - DNA, 20 bp, Artificial Sequence
  chemically synthesized
taatggggttattttttaaa

SEQ ID NO: 564325 - DNA, 20 bp, Artificial Sequence
  chemically synthesized
ggggttattttttaaattac

SEQ ID NO: 564326 - DNA, 20 bp, Artificial Sequence
  chemically synthesized
acgtttgtttattgtaccca

SEQ ID NO: 564327 - DNA, 20 bp, Artificial Sequence
  chemically synthesized
gtagttttcctatagaatgg

SEQ ID NO: 564328 - DNA, 20 bp, Artificial Sequence
  chemically synthesized
tacacatatacttacaaagg

SEQ ID NO: 564329 - DNA, 20 bp, Artificial Sequence
  chemically synthesized
aaaggaagagattagagata

SEQ ID NO: 564330 - DNA, 20 bp, Artificial Sequence
  chemically synthesized
ctgagccactcaaatctccc

SEQ ID NO: 564331 - DNA, 20 bp, Artificial Sequence
  chemically synthesized
ttagttgttcacaaacactt

SEQ ID NO: 564332 - DNA, 20 bp, Artificial Sequence
  chemically synthesized
aaagatataatcacaaagct

SEQ ID NO: 564333 - DNA, 20 bp, Artificial Sequence
  chemically synthesized
gaatgtgtaaacattcagct

SEQ ID NO: 564334 - DNA, 20 bp, Artificial Sequence
  chemically synthesized
aagatatgaatgtgtaaaca

SEQ ID NO: 564335 - DNA, 20 bp, Artificial Sequence
  chemically synthesized
cattcatatcttgaatatgc

SEQ ID NO: 564336 - DNA, 20 bp, Artificial Sequence
  chemically synthesized
tatgcaggatagtgttggcc

SEQ ID NO: 564337 - DNA, 20 bp, Artificial Sequence
  chemically synthesized
tcaaaattaataaatgagtg

SEQ ID NO: 564338 - DNA, 20 bp, Artificial Sequence
  chemically synthesized
actcatttattaattttgat

SEQ ID NO: 564339 - DNA, 20 bp, Artificial Sequence
  chemically synthesized
agtttagcaaagccattaag

SEQ ID NO: 564340 - DNA, 20 bp, Artificial Sequence
  chemically synthesized
taggcttctaatcttatctt

SEQ ID NO: 564341 - DNA, 20 bp, Artificial Sequence
  chemically synthesized
tggccattcagcaggttaag

SEQ ID NO: 564342 - DNA, 20 bp, Artificial Sequence
  chemically synthesized
aaataaggcacttgactttt

SEQ ID NO: 564343 - DNA, 20 bp, Artificial Sequence
  chemically synthesized
gttgtaaatttgaggtacat

SEQ ID NO: 564344 - DNA, 20 bp, Artificial Sequence
  chemically synthesized
agcttacctatctatatact

SEQ ID NO: 564345 - DNA, 20 bp, Artificial Sequence
  chemically synthesized
actttatgtttatgaagagc

SEQ ID NO: 564346 - DNA, 20 bp, Artificial Sequence
  chemically synthesized
aagagcataagttttttaaa

SEQ ID NO: 564347 - DNA, 20 bp, Artificial Sequence
  chemically synthesized
ataattgcccacagaggaaa

SEQ ID NO: 564348 - DNA, 20 bp, Artificial Sequence
  chemically synthesized
tgtgctattaaataccaccg

SEQ ID NO: 564349 - DNA, 20 bp, Artificial Sequence
  chemically synthesized
gtcagacctctggctctcac

SEQ ID NO: 564350 - DNA, 20 bp, Artificial Sequence
  chemically synthesized
ttgctacagctgttttggac

SEQ ID NO: 564351 - DNA, 20 bp, Artificial Sequence
  chemically synthesized
acaaagttcatgattgctac

SEQ ID NO: 564352 - DNA, 20 bp, Artificial Sequence
  chemically synthesized
acagctgtagcaatcatgaa

SEQ ID NO: 564353 - DNA, 20 bp, Artificial Sequence
  chemically synthesized
tgtgttacaaaaaacaaagt

SEQ ID NO: 564354 - DNA, 20 bp, Artificial Sequence
  chemically synthesized
gctaatgtctcagagacctt

SEQ ID NO: 564355 - DNA, 20 bp, Artificial Sequence
  chemically synthesized
aattttgagatttttgccgt

SEQ ID NO: 564356 - DNA, 20 bp, Artificial Sequence
  chemically synthesized
ctttcaaaaaaatttaaatt

SEQ ID NO: 564357 - DNA, 20 bp, Artificial Sequence
  chemically synthesized
ggcaagaaaaactgagatca

SEQ ID NO: 564358 - DNA, 20 bp, Artificial Sequence
  chemically synthesized
aaaatactaatctatgtgat

SEQ ID NO: 564359 - DNA, 20 bp, Artificial Sequence
  chemically synthesized
ctaaatggattttctgaacc

SEQ ID NO: 564360 - DNA, 20 bp, Artificial Sequence
  chemically synthesized
atgctggttgcaacccacta

SEQ ID NO: 564361 - DNA, 20 bp, Artificial Sequence
  chemically synthesized
ttagtgggttgcaaccagca

SEQ ID NO: 564362 - DNA, 20 bp, Artificial Sequence
  chemically synthesized
tccatactacatacagtgca

SEQ ID NO: 564363 - DNA, 20 bp, Artificial Sequence
  chemically synthesized
aaggcatcacttgatgaaac

SEQ ID NO: 564364 - DNA, 20 bp, Artificial Sequence
  chemically synthesized
tgcatacaaagatcagaaac

SEQ ID NO: 564365 - DNA, 20 bp, Artificial Sequence
  chemically synthesized
agatataaaataaattgtac

SEQ ID NO: 564366 - DNA, 20 bp, Artificial Sequence
  chemically synthesized
aatttattttatatctttac

SEQ ID NO: 564367 - DNA, 20 bp, Artificial Sequence
  chemically synthesized
tccaggacagtgatttctga

SEQ ID NO: 564368 - DNA, 20 bp, Artificial Sequence
  chemically synthesized
aacacttttgacatccagga

SEQ ID NO: 564369 - DNA, 20 bp, Artificial Sequence
  chemically synthesized
gactttgtaatcccaagatg

SEQ ID NO: 564370 - DNA, 20 bp, Artificial Sequence
  chemically synthesized
ttcttgagaatcttaacatc

SEQ ID NO: 564371 - DNA, 20 bp, Artificial Sequence
  chemically synthesized
atgttaagattctcaagaat

SEQ ID NO: 564372 - DNA, 20 bp, Artificial Sequence
  chemically synthesized
gtgtacacacacatataccg

SEQ ID NO: 564373 - DNA, 20 bp, Artificial Sequence
  chemically synthesized
ttttcaaaattaaaaaacaa

SEQ ID NO: 564374 - DNA, 20 bp, Artificial Sequence
  chemically synthesized
ttctttccaactaaaagcac

SEQ ID NO: 564375 - DNA, 20 bp, Artificial Sequence
  chemically synthesized
cactcaaaaaagtggttttt

SEQ ID NO: 564376 - DNA, 20 bp, Artificial Sequence
  chemically synthesized
attattgatgcactcaaaaa

SEQ ID NO: 564377 - DNA, 20 bp, Artificial Sequence
  chemically synthesized
tccccaaattcaagtggata

SEQ ID NO: 564378 - DNA, 20 bp, Artificial Sequence
  chemically synthesized
ttttgctactttcagctaac

SEQ ID NO: 564379 - DNA, 20 bp, Artificial Sequence
  chemically synthesized
accatgatcttggcatttcc

SEQ ID NO: 564380 - DNA, 20 bp, Artificial Sequence
  chemically synthesized
atggtattacagaatgatag

SEQ ID NO: 564381 - DNA, 20 bp, Artificial Sequence
  chemically synthesized
ccaataccttagctactctc

SEQ ID NO: 564382 - DNA, 20 bp, Artificial Sequence
  chemically synthesized
cttgtgttttttgtgtattt

SEQ ID NO: 564383 - DNA, 20 bp, Artificial Sequence
  chemically synthesized
gttttttgtgtatttaattg

SEQ ID NO: 564384 - DNA, 20 bp, Artificial Sequence
  chemically synthesized
ccaattccattaacttaagt

SEQ ID NO: 564385 - DNA, 20 bp, Artificial Sequence
  chemically synthesized
ttaatggaattggtatcgga

SEQ ID NO: 564386 - DNA, 20 bp, Artificial Sequence
  chemically synthesized
gaagaatttcaggccttaag

SEQ ID NO: 564387 - DNA, 20 bp, Artificial Sequence
  chemically synthesized
ctggatagtgtttactaaat

SEQ ID NO: 564388 - DNA, 20 bp, Artificial Sequence
  chemically synthesized
ctcaattcaggccacctgga

SEQ ID NO: 564389 - DNA, 20 bp, Artificial Sequence
  chemically synthesized
cactatccaggtggcctgaa

SEQ ID NO: 564390 - DNA, 20 bp, Artificial Sequence
  chemically synthesized
ggtggcctgaattgagtttc

SEQ ID NO: 564391 - DNA, 20 bp, Artificial Sequence
  chemically synthesized
ttagcagtcagtatctctga

SEQ ID NO: 564392 - DNA, 20 bp, Artificial Sequence
  chemically synthesized
ggtatatttcttgtcttcca

SEQ ID NO: 564393 - DNA, 20 bp, Artificial Sequence
  chemically synthesized
gctagataccacatgggtgt

SEQ ID NO: 564394 - DNA, 20 bp, Artificial Sequence
  chemically synthesized
gcttctacacccatgtggta

SEQ ID NO: 564395 - DNA, 20 bp, Artificial Sequence
  chemically synthesized
ctttgcaccatctccctgtg

SEQ ID NO: 564396 - DNA, 20 bp, Artificial Sequence
  chemically synthesized
gggacacagggagatggtgc

SEQ ID NO: 564397 - DNA, 20 bp, Artificial Sequence
  chemically synthesized
tcctagactcctttttgtac

SEQ ID NO: 564398 - DNA, 20 bp, Artificial Sequence
  chemically synthesized
agctacagcaaggctcatga

SEQ ID NO: 564399 - DNA, 20 bp, Artificial Sequence
  chemically synthesized
agcagagtcatgagccttgc

SEQ ID NO: 564400 - DNA, 20 bp, Artificial Sequence
  chemically synthesized
tagcttcttctctactaacc

SEQ ID NO: 564401 - DNA, 20 bp, Artificial Sequence
  chemically synthesized
cctggccccttgaactggca

SEQ ID NO: 564402 - DNA, 20 bp, Artificial Sequence
  chemically synthesized
tgatcctggccccttgaact

SEQ ID NO: 564403 - DNA, 20 bp, Artificial Sequence
  chemically synthesized
ggccaggatcatacagtaat

SEQ ID NO: 564404 - DNA, 20 bp, Artificial Sequence
  chemically synthesized
tacagtaatcaatgattgta

SEQ ID NO: 564405 - DNA, 20 bp, Artificial Sequence
  chemically synthesized
aattcaaatcacagtacaat

SEQ ID NO: 564406 - DNA, 20 bp, Artificial Sequence
  chemically synthesized
tctcctcattactttgtcct

SEQ ID NO: 564407 - DNA, 20 bp, Artificial Sequence
  chemically synthesized
cgtgtctcctcattactttg

SEQ ID NO: 564408 - DNA, 20 bp, Artificial Sequence
  chemically synthesized
atgaggagacacgtgaaagc

SEQ ID NO: 564409 - DNA, 20 bp, Artificial Sequence
  chemically synthesized
tacacaggcttgacagaatc

SEQ ID NO: 564410 - DNA, 20 bp, Artificial Sequence
  chemically synthesized
tcataatgagaagatcatac

SEQ ID NO: 564411 - DNA, 20 bp, Artificial Sequence
  chemically synthesized
tggaggtgggtggaagacag

SEQ ID NO: 564412 - DNA, 20 bp, Artificial Sequence
  chemically synthesized
actgctgagcgccactgaag

SEQ ID NO: 564413 - DNA, 20 bp, Artificial Sequence
  chemically synthesized
ggctggtgcagacatttaaa

SEQ ID NO: 564414 - DNA, 20 bp, Artificial Sequence
  chemically synthesized
gcaacgctctaccagaacat

SEQ ID NO: 564415 - DNA, 20 bp, Artificial Sequence
  chemically synthesized
tgcttttaatgtgcactgca

SEQ ID NO: 564416 - DNA, 20 bp, Artificial Sequence
  chemically synthesized
tgaggagggtgtattgagta

SEQ ID NO: 564417 - DNA, 20 bp, Artificial Sequence
  chemically synthesized
ttatggagaggaacaaacag

SEQ ID NO: 564418 - DNA, 20 bp, Artificial Sequence
  chemically synthesized
gacgggcagcaggaaatctg

SEQ ID NO: 564419 - DNA, 20 bp, Artificial Sequence
  chemically synthesized
aaaacacaaggctttgtggc

SEQ ID NO: 564420 - DNA, 20 bp, Artificial Sequence
  chemically synthesized
caatcactggccacaaagcc

SEQ ID NO: 564421 - DNA, 20 bp, Artificial Sequence
  chemically synthesized
gaaacaaaagggagaaaaca

SEQ ID NO: 564422 - DNA, 20 bp, Artificial Sequence
  chemically synthesized
aaagccttgtgttttctccc

SEQ ID NO: 564423 - DNA, 20 bp, Artificial Sequence
  chemically synthesized
gttttctcccttttgtttct

SEQ ID NO: 564424 - DNA, 20 bp, Artificial Sequence
  chemically synthesized
gaaggaaggcgagagagtga

SEQ ID NO: 564425 - DNA, 20 bp, Artificial Sequence
  chemically synthesized
ttcgtttctgggggcattta

SEQ ID NO: 564426 - DNA, 20 bp, Artificial Sequence
  chemically synthesized
gatgatgttttgctgctact

SEQ ID NO: 564427 - DNA, 20 bp, Artificial Sequence
  chemically synthesized
atgtcttgcttcatccaaga

SEQ ID NO: 564428 - DNA, 20 bp, Artificial Sequence
  chemically synthesized
gcttgcatgagcttcagatg

SEQ ID NO: 564429 - DNA, 20 bp, Artificial Sequence
  chemically synthesized
gaattttcccactggcttgc

SEQ ID NO: 564430 - DNA, 20 bp, Artificial Sequence
  chemically synthesized
ttaccctgcagaattttccc

SEQ ID NO: 564431 - DNA, 20 bp, Artificial Sequence
  chemically synthesized
gaaaattctgcagggtaaaa

SEQ ID NO: 564432 - DNA, 20 bp, Artificial Sequence
  chemically synthesized
tttacttcgatagaggaaat

SEQ ID NO: 564433 - DNA, 20 bp, Artificial Sequence
  chemically synthesized
aaaaataaccaactactcta

SEQ ID NO: 564434 - DNA, 20 bp, Artificial Sequence
  chemically synthesized
tgcctactgattggtagtgg

SEQ ID NO: 564435 - DNA, 20 bp, Artificial Sequence
  chemically synthesized
gcaaggcctagaacaatgcc

SEQ ID NO: 564436 - DNA, 20 bp, Artificial Sequence
  chemically synthesized
ctctatttgtcaagtatttt

SEQ ID NO: 564437 - DNA, 20 bp, Artificial Sequence
  chemically synthesized
ttcaaatacccgtgagggca

SEQ ID NO: 564438 - DNA, 20 bp, Artificial Sequence
  chemically synthesized
ttgatttttaagtgtgaatt

SEQ ID NO: 564439 - DNA, 20 bp, Artificial Sequence
  chemically synthesized
tttgggtccatggtgaaaag

SEQ ID NO: 564440 - DNA, 20 bp, Artificial Sequence
  chemically synthesized
ggcaatttgggtccatggtg

SEQ ID NO: 564441 - DNA, 20 bp, Artificial Sequence
  chemically synthesized
ttgccattctgatactgcgt

SEQ ID NO: 564442 - DNA, 20 bp, Artificial Sequence
  chemically synthesized
agatttgctgggatcaggcc

SEQ ID NO: 564443 - DNA, 20 bp, Artificial Sequence
  chemically synthesized
gctccaatacctagaaggga

SEQ ID NO: 564444 - DNA, 20 bp, Artificial Sequence
  chemically synthesized
tctgagtcccttctaggtat

SEQ ID NO: 564445 - DNA, 20 bp, Artificial Sequence
  chemically synthesized
ctccatcacctcctctaacc

SEQ ID NO: 564446 - DNA, 20 bp, Artificial Sequence
  chemically synthesized
tgtaattttccattatttgt

SEQ ID NO: 564447 - DNA, 20 bp, Artificial Sequence
  chemically synthesized
tataaatgtaattttccatt

SEQ ID NO: 564448 - DNA, 20 bp, Artificial Sequence
  chemically synthesized
tgtaatcatggccctttaat

SEQ ID NO: 564449 - DNA, 20 bp, Artificial Sequence
  chemically synthesized
agaaaacagatattaaaggg

SEQ ID NO: 564450 - DNA, 20 bp, Artificial Sequence
  chemically synthesized
ataaataacaaagaaaaccc

SEQ ID NO: 564451 - DNA, 20 bp, Artificial Sequence
  chemically synthesized
acttcctcattattaagctt

SEQ ID NO: 564452 - DNA, 20 bp, Artificial Sequence
  chemically synthesized
aaagaattacttcctcatta

SEQ ID NO: 564453 - DNA, 20 bp, Artificial Sequence
  chemically synthesized
agggaagaagaaatccatac

SEQ ID NO: 564454 - DNA, 20 bp, Artificial Sequence
  chemically synthesized
atgatatagataaactactg

SEQ ID NO: 564455 - DNA, 20 bp, Artificial Sequence
  chemically synthesized
aaaaaaaaaaaaaaaagata

SEQ ID NO: 564456 - DNA, 20 bp, Artificial Sequence
  chemically synthesized
aacctccgcctcccaggttc

SEQ ID NO: 564457 - DNA, 20 bp, Artificial Sequence
  chemically synthesized
tcgggaggctgaggcagaag

SEQ ID NO: 564458 - DNA, 20 bp, Artificial Sequence
  chemically synthesized
ttttgtatttttagtagaga

SEQ ID NO: 564459 - DNA, 20 bp, Artificial Sequence
  chemically synthesized
cacctcagcctcccaaagtg

SEQ ID NO: 564460 - DNA, 20 bp, Artificial Sequence
  chemically synthesized
ggcatgagcgaccgcaccca

SEQ ID NO: 564461 - DNA, 20 bp, Artificial Sequence
  chemically synthesized
cacctcggcttcccaaaggg

SEQ ID NO: 564462 - DNA, 20 bp, Artificial Sequence
  chemically synthesized
ccctttgggaagccgaggtg

SEQ ID NO: 564463 - DNA, 20 bp, Artificial Sequence
  chemically synthesized
ttgggaagccgaggtgggag

SEQ ID NO: 564464 - DNA, 20 bp, Artificial Sequence
  chemically synthesized
gcagcaaacaatcctcccac

SEQ ID NO: 564465 - DNA, 20 bp, Artificial Sequence
  chemically synthesized
tttgctgccaggaatttgag

SEQ ID NO: 564466 - DNA, 20 bp, Artificial Sequence
  chemically synthesized
tattttttgtttttttgttt

SEQ ID NO: 564467 - DNA, 20 bp, Artificial Sequence
  chemically synthesized
tttaaatttattttttgttt

SEQ ID NO: 564468 - DNA, 20 bp, Artificial Sequence
  chemically synthesized
ttttaacttttaaatttatt

SEQ ID NO: 564469 - DNA, 20 bp, Artificial Sequence
  chemically synthesized
tggggcacaaaagagagctt

SEQ ID NO: 564470 - DNA, 20 bp, Artificial Sequence
  chemically synthesized
tttgtgaatggggcacaaaa

SEQ ID NO: 564471 - DNA, 20 bp, Artificial Sequence
  chemically synthesized
acttattttattacatagaa

SEQ ID NO: 564472 - DNA, 20 bp, Artificial Sequence
  chemically synthesized
actgaggtctttttttcact

SEQ ID NO: 564473 - DNA, 20 bp, Artificial Sequence
  chemically synthesized
ggagtttaaaggtacttgag

SEQ ID NO: 564474 - DNA, 20 bp, Artificial Sequence
  chemically synthesized
acattggagtttaaaggtac

SEQ ID NO: 564475 - DNA, 20 bp, Artificial Sequence
  chemically synthesized
tatttttatttctattacat

SEQ ID NO: 564476 - DNA, 20 bp, Artificial Sequence
  chemically synthesized
tctccaatatatgccatatc

SEQ ID NO: 564477 - DNA, 20 bp, Artificial Sequence
  chemically synthesized
ttgggactactttatcataa

SEQ ID NO: 564478 - DNA, 20 bp, Artificial Sequence
  chemically synthesized
tactttatcataattatgtt

SEQ ID NO: 564479 - DNA, 20 bp, Artificial Sequence
  chemically synthesized
gaagacattacaaacatttt

SEQ ID NO: 564480 - DNA, 20 bp, Artificial Sequence
  chemically synthesized
tctcctcacataaacagtca

SEQ ID NO: 564481 - DNA, 20 bp, Artificial Sequence
  chemically synthesized
tatcatccatccataggttt

SEQ ID NO: 564482 - DNA, 20 bp, Artificial Sequence
  chemically synthesized
ccagtgaatatcatccatcc

SEQ ID NO: 564483 - DNA, 20 bp, Artificial Sequence
  chemically synthesized
actgggaatggaaatctcct

SEQ ID NO: 564484 - DNA, 20 bp, Artificial Sequence
  chemically synthesized
acagattcacaaaatctaca

SEQ ID NO: 564485 - DNA, 20 bp, Artificial Sequence
  chemically synthesized
attttgtgaatctgtgtctg

SEQ ID NO: 564486 - DNA, 20 bp, Artificial Sequence
  chemically synthesized
acatgaacaaacaatacaga

SEQ ID NO: 564487 - DNA, 20 bp, Artificial Sequence
  chemically synthesized
atttccctttaacttgcaaa

SEQ ID NO: 564488 - DNA, 20 bp, Artificial Sequence
  chemically synthesized
aaaggacctttaaagtttaa

SEQ ID NO: 564489 - DNA, 20 bp, Artificial Sequence
  chemically synthesized
agttagtttcaaaggacctt

SEQ ID NO: 564490 - DNA, 20 bp, Artificial Sequence
  chemically synthesized
aagattgtatattatgaaaa

SEQ ID NO: 564491 - DNA, 20 bp, Artificial Sequence
  chemically synthesized
tagaagttattttcactatt

SEQ ID NO: 564492 - DNA, 20 bp, Artificial Sequence
  chemically synthesized
gaaaataacttctattcaag

SEQ ID NO: 564493 - DNA, 20 bp, Artificial Sequence
  chemically synthesized
ataacttctattcaagctct

SEQ ID NO: 564494 - DNA, 20 bp, Artificial Sequence
  chemically synthesized
gtgacaatgtgcaaaacaaa

SEQ ID NO: 564495 - DNA, 20 bp, Artificial Sequence
  chemically synthesized
cacttccatctaaaacaaga

SEQ ID NO: 564496 - DNA, 20 bp, Artificial Sequence
  chemically synthesized
gttgacttgctaaagcaagg

SEQ ID NO: 564497 - DNA, 20 bp, Artificial Sequence
  chemically synthesized
gaacttaattagggacaacc

SEQ ID NO: 564498 - DNA, 20 bp, Artificial Sequence
  chemically synthesized
caggtttacatctgacttgg

SEQ ID NO: 564499 - DNA, 20 bp, Artificial Sequence
  chemically synthesized
catatttaagtcatttagtc

SEQ ID NO: 564500 - DNA, 20 bp, Artificial Sequence
  chemically synthesized
ccagtgactaaatgacttaa

SEQ ID NO: 564501 - DNA, 20 bp, Artificial Sequence
  chemically synthesized
attccctttggtctatgcca

SEQ ID NO: 564502 - DNA, 20 bp, Artificial Sequence
  chemically synthesized
ggtctatgccacttggattt

SEQ ID NO: 564503 - DNA, 20 bp, Artificial Sequence
  chemically synthesized
tatgccacttggattttcat

SEQ ID NO: 564504 - DNA, 20 bp, Artificial Sequence
  chemically synthesized
aaaaaaaaaaaggaataaat

SEQ ID NO: 564505 - DNA, 20 bp, Artificial Sequence
  chemically synthesized
ttagcattggcaatgattct

SEQ ID NO: 564506 - DNA, 20 bp, Artificial Sequence
  chemically synthesized
gtcttaatggttagcattgg

SEQ ID NO: 564507 - DNA, 20 bp, Artificial Sequence
  chemically synthesized
aagcctcacatccacctaga

SEQ ID NO: 564508 - DNA, 20 bp, Artificial Sequence
  chemically synthesized
aatcatattctaggtggatg

SEQ ID NO: 564509 - DNA, 20 bp, Artificial Sequence
  chemically synthesized
accaggagactcatgtagtc

SEQ ID NO: 564510 - DNA, 20 bp, Artificial Sequence
  chemically synthesized
tcctgtacttaatattgcaa

SEQ ID NO: 564511 - DNA, 20 bp, Artificial Sequence
  chemically synthesized
agagtttgtaactattcctt

SEQ ID NO: 564512 - DNA, 20 bp, Artificial Sequence
  chemically synthesized
agagagagaaagaggagaga

SEQ ID NO: 564513 - DNA, 20 bp, Artificial Sequence
  chemically synthesized
ccccctcacacacatgcact

SEQ ID NO: 564514 - DNA, 20 bp, Artificial Sequence
  chemically synthesized
cacacacatgcactatttgc

SEQ ID NO: 564515 - DNA, 20 bp, Artificial Sequence
  chemically synthesized
aagaagtgaaattcactatt

SEQ ID NO: 564516 - DNA, 20 bp, Artificial Sequence
  chemically synthesized
atttttagtttcatttttct

SEQ ID NO: 564517 - DNA, 20 bp, Artificial Sequence
  chemically synthesized
tttcatcttcaccagataat

SEQ ID NO: 564518 - DNA, 20 bp, Artificial Sequence
  chemically synthesized
caagatcctgacaactgcag

SEQ ID NO: 564519 - DNA, 20 bp, Artificial Sequence
  chemically synthesized
ctgcagggctgattacatct

SEQ ID NO: 564520 - DNA, 20 bp, Artificial Sequence
  chemically synthesized
ttactgccattaaaaatgcc

SEQ ID NO: 564521 - DNA, 20 bp, Artificial Sequence
  chemically synthesized
cgttcatgatgttctcttgg

SEQ ID NO: 564522 - DNA, 20 bp, Artificial Sequence
  chemically synthesized
acatcgatgttaatatttct

SEQ ID NO: 564523 - DNA, 20 bp, Artificial Sequence
  chemically synthesized
aataaacttggctgacatca

SEQ ID NO: 564524 - DNA, 20 bp, Artificial Sequence
  chemically synthesized
tataaacctaatgatgtcag

SEQ ID NO: 564525 - DNA, 20 bp, Artificial Sequence
  chemically synthesized
actcatattaaagactcaca

SEQ ID NO: 564526 - DNA, 20 bp, Artificial Sequence
  chemically synthesized
aagtataatacaaatgtaaa

SEQ ID NO: 564527 - DNA, 20 bp, Artificial Sequence
  chemically synthesized
tacaaatgtaaaattggctt

SEQ ID NO: 564528 - DNA, 20 bp, Artificial Sequence
  chemically synthesized
gatacaattatcactgcctt

SEQ ID NO: 564529 - DNA, 20 bp, Artificial Sequence
  chemically synthesized
agaaaacaagattatactct

SEQ ID NO: 564530 - DNA, 20 bp, Artificial Sequence
  chemically synthesized
taaaaacaagtagagtataa

SEQ ID NO: 564531 - DNA, 20 bp, Artificial Sequence
  chemically synthesized
aatatggagaaaagaagaaa

SEQ ID NO: 564532 - DNA, 20 bp, Artificial Sequence
  chemically synthesized
ttcttcttttctccatattt

SEQ ID NO: 564533 - DNA, 20 bp, Artificial Sequence
  chemically synthesized
atattttcatgatttctcaa

SEQ ID NO: 564534 - DNA, 20 bp, Artificial Sequence
  chemically synthesized
ttctcaagatggttttaatg

SEQ ID NO: 564535 - DNA, 20 bp, Artificial Sequence
  chemically synthesized
aaggcagaggttgcagctag

SEQ ID NO: 564536 - DNA, 20 bp, Artificial Sequence
  chemically synthesized
aacctctgccttccgggttc

SEQ ID NO: 564537 - DNA, 20 bp, Artificial Sequence
  chemically synthesized
tttatattttttagtagaga

SEQ ID NO: 564538 - DNA, 20 bp, Artificial Sequence
  chemically synthesized
ggcaggtggatcacgaggtc

SEQ ID NO: 564539 - DNA, 20 bp, Artificial Sequence
  chemically synthesized
tgcctcggcctcccaaagtg

SEQ ID NO: 564540 - DNA, 20 bp, Artificial Sequence
  chemically synthesized
tgcacatatgtgatgtctga

SEQ ID NO: 564541 - DNA, 20 bp, Artificial Sequence
  chemically synthesized
tactcatgcacatatgtgat

SEQ ID NO: 564542 - DNA, 20 bp, Artificial Sequence
  chemically synthesized
aagtgaatcaactcattgaa

SEQ ID NO: 564543 - DNA, 20 bp, Artificial Sequence
  chemically synthesized
gcattaagcatttttcaatg

SEQ ID NO: 564544 - DNA, 20 bp, Artificial Sequence
  chemically synthesized
tttaacttcaggtttcattt

SEQ ID NO: 564545 - DNA, 20 bp, Artificial Sequence
  chemically synthesized
acaatggtattactttaact

SEQ ID NO: 564546 - DNA, 20 bp, Artificial Sequence
  chemically synthesized
attgtaatatttgatactaa

SEQ ID NO: 564547 - DNA, 20 bp, Artificial Sequence
  chemically synthesized
aaatgccttttaaaaaccac

SEQ ID NO: 564548 - DNA, 20 bp, Artificial Sequence
  chemically synthesized
tcttactgtttttaaacttt

SEQ ID NO: 564549 - DNA, 20 bp, Artificial Sequence
  chemically synthesized
accacaaaagtttaaaaaca

SEQ ID NO: 564550 - DNA, 20 bp, Artificial Sequence
  chemically synthesized
ttgaataaataaatgaatct

SEQ ID NO: 564551 - DNA, 20 bp, Artificial Sequence
  chemically synthesized
aacagtgcctggcatatata

SEQ ID NO: 564552 - DNA, 20 bp, Artificial Sequence
  chemically synthesized
agagtgtgtgggtggggttt

SEQ ID NO: 564553 - DNA, 20 bp, Artificial Sequence
  chemically synthesized
agagagagtgtgtgggtggg

SEQ ID NO: 564554 - DNA, 20 bp, Artificial Sequence
  chemically synthesized
tcacagagagagtgtgtggg

SEQ ID NO: 564555 - DNA, 20 bp, Artificial Sequence
  chemically synthesized
ctgtgtgcctccttatgaat

SEQ ID NO: 564556 - DNA, 20 bp, Artificial Sequence
  chemically synthesized
tcgcattcataaggaggcac

SEQ ID NO: 564557 - DNA, 20 bp, Artificial Sequence
  chemically synthesized
atcaccactcaagataccta

SEQ ID NO: 564558 - DNA, 20 bp, Artificial Sequence
  chemically synthesized
ttgatgagatgcagttgagc

SEQ ID NO: 564559 - DNA, 20 bp, Artificial Sequence
  chemically synthesized
aactcataccctccagttct

SEQ ID NO: 564560 - DNA, 20 bp, Artificial Sequence
  chemically synthesized
agggaaaagtgctccagaca

SEQ ID NO: 564561 - DNA, 20 bp, Artificial Sequence
  chemically synthesized
gactctgagaggagagtgtg

SEQ ID NO: 564562 - DNA, 20 bp, Artificial Sequence
  chemically synthesized
tatctacattagacttcttg

SEQ ID NO: 564563 - DNA, 20 bp, Artificial Sequence
  chemically synthesized
gttttcccagctcttgttca

SEQ ID NO: 564564 - DNA, 20 bp, Artificial Sequence
  chemically synthesized
gaatccccaggccagggaag

SEQ ID NO: 564565 - DNA, 20 bp, Artificial Sequence
  chemically synthesized
aaaacagtacttccctggcc

SEQ ID NO: 564566 - DNA, 20 bp, Artificial Sequence
  chemically synthesized
gtacttccctggcctgggga

SEQ ID NO: 564567 - DNA, 20 bp, Artificial Sequence
  chemically synthesized
gattcggatttggccacata

SEQ ID NO: 564568 - DNA, 20 bp, Artificial Sequence
  chemically synthesized
taagcctctacttttgtcat

SEQ ID NO: 564569 - DNA, 20 bp, Artificial Sequence
  chemically synthesized
taagcgggcatgacaaaagt

SEQ ID NO: 564570 - DNA, 20 bp, Artificial Sequence
  chemically synthesized
gtctttgactggttggggtt

SEQ ID NO: 564571 - DNA, 20 bp, Artificial Sequence
  chemically synthesized
gactggttggggttgcccgc

SEQ ID NO: 564572 - DNA, 20 bp, Artificial Sequence
  chemically synthesized
cacaagaagcatatggccca

SEQ ID NO: 564573 - DNA, 20 bp, Artificial Sequence
  chemically synthesized
gctagcaagctacctgggcc

SEQ ID NO: 564574 - DNA, 20 bp, Artificial Sequence
  chemically synthesized
agctggacttgacaccaagt

SEQ ID NO: 564575 - DNA, 20 bp, Artificial Sequence
  chemically synthesized
cacaacttggtgtcaagtcc

SEQ ID NO: 564576 - DNA, 20 bp, Artificial Sequence
  chemically synthesized
atatttctcattcacgcatc

SEQ ID NO: 564577 - DNA, 20 bp, Artificial Sequence
  chemically synthesized
agccataaatattatatctg

SEQ ID NO: 564578 - DNA, 20 bp, Artificial Sequence
  chemically synthesized
gacaagccataaatattata

SEQ ID NO: 564579 - DNA, 20 bp, Artificial Sequence
  chemically synthesized
aacaagccagatataatatt

SEQ ID NO: 564580 - DNA, 20 bp, Artificial Sequence
  chemically synthesized
ttatgttgtagctacatagt

SEQ ID NO: 564581 - DNA, 20 bp, Artificial Sequence
  chemically synthesized
tatctctatagcagtgtgaa

SEQ ID NO: 564582 - DNA, 20 bp, Artificial Sequence
  chemically synthesized
ctgggtaatttataaaggaa

SEQ ID NO: 564583 - DNA, 20 bp, Artificial Sequence
  chemically synthesized
tgaggaggcctcaggaggcc

SEQ ID NO: 564584 - DNA, 20 bp, Artificial Sequence
  chemically synthesized
cctcaggaggcctcatgatt

SEQ ID NO: 564585 - DNA, 20 bp, Artificial Sequence
  chemically synthesized
tgcttcccctttgccttcca

SEQ ID NO: 564586 - DNA, 20 bp, Artificial Sequence
  chemically synthesized
ctgctgccatgtaagaggtg

SEQ ID NO: 564587 - DNA, 20 bp, Artificial Sequence
  chemically synthesized
agtgagttctcaggagagct

SEQ ID NO: 564588 - DNA, 20 bp, Artificial Sequence
  chemically synthesized
gggaggtgactggatcatga

SEQ ID NO: 564589 - DNA, 20 bp, Artificial Sequence
  chemically synthesized
caggtccctcccctgacacg

SEQ ID NO: 564590 - DNA, 20 bp, Artificial Sequence
  chemically synthesized
cgtggggattacaatttgag

SEQ ID NO: 564591 - DNA, 20 bp, Artificial Sequence
  chemically synthesized
attttgaggttgcctattaa

SEQ ID NO: 564592 - DNA, 20 bp, Artificial Sequence
  chemically synthesized
tgtttttgtttttggtgatg

SEQ ID NO: 564593 - DNA, 20 bp, Artificial Sequence
  chemically synthesized
tgaaaaaagtgaaaaggtgt

SEQ ID NO: 564594 - DNA, 20 bp, Artificial Sequence
  chemically synthesized
aataagtgaaaaaagtgaaa

SEQ ID NO: 564595 - DNA, 20 bp, Artificial Sequence
  chemically synthesized
cacagcccttatccctactt

SEQ ID NO: 564596 - DNA, 20 bp, Artificial Sequence
  chemically synthesized
atagcatattgctagtcttt

SEQ ID NO: 564597 - DNA, 20 bp, Artificial Sequence
  chemically synthesized
attttaaacttagttgatgg

SEQ ID NO: 564598 - DNA, 20 bp, Artificial Sequence
  chemically synthesized
tgttaaagcattgccatcaa

SEQ ID NO: 564599 - DNA, 20 bp, Artificial Sequence
  chemically synthesized
gaaatcaccttggagtagag

SEQ ID NO: 564600 - DNA, 20 bp, Artificial Sequence
  chemically synthesized
ttaaacttgactctactcca

SEQ ID NO: 564601 - DNA, 20 bp, Artificial Sequence
  chemically synthesized
cactgacatctattatttat

SEQ ID NO: 564602 - DNA, 20 bp, Artificial Sequence
  chemically synthesized
ccaccagcagtgtaaaagtg

SEQ ID NO: 564603 - DNA, 20 bp, Artificial Sequence
  chemically synthesized
gtgttttccatagtggttgt

SEQ ID NO: 564604 - DNA, 20 bp, Artificial Sequence
  chemically synthesized
agttctttaaggagcctcca

SEQ ID NO: 564605 - DNA, 20 bp, Artificial Sequence
  chemically synthesized
gtgaaaaatatacttgcata

SEQ ID NO: 564606 - DNA, 20 bp, Artificial Sequence
  chemically synthesized
cataattgcagaaatacgga

SEQ ID NO: 564607 - DNA, 20 bp, Artificial Sequence
  chemically synthesized
aagaaaatgcagtatgtacg

SEQ ID NO: 564608 - DNA, 20 bp, Artificial Sequence
  chemically synthesized
cacttataagtgagaaagta

SEQ ID NO: 564609 - DNA, 20 bp, Artificial Sequence
  chemically synthesized
ttctcatgcctttgcatccg

SEQ ID NO: 564610 - DNA, 20 bp, Artificial Sequence
  chemically synthesized
tacatgaataagttcttcgg

SEQ ID NO: 564611 - DNA, 20 bp, Artificial Sequence
  chemically synthesized
tagttttcagggaacccagg

SEQ ID NO: 564612 - DNA, 20 bp, Artificial Sequence
  chemically synthesized
ttttctctttttattatttc

SEQ ID NO: 564613 - DNA, 20 bp, Artificial Sequence
  chemically synthesized
aaataataaaaagagaaaaa

SEQ ID NO: 564614 - DNA, 20 bp, Artificial Sequence
  chemically synthesized
aaaagagaaaaataatgttt

SEQ ID NO: 564615 - DNA, 20 bp, Artificial Sequence
  chemically synthesized
attattagctatttggtctt

SEQ ID NO: 564616 - DNA, 20 bp, Artificial Sequence
  chemically synthesized
ctatttggtcttcctggctt

SEQ ID NO: 564617 - DNA, 20 bp, Artificial Sequence
  chemically synthesized
ccttattttaaaaaatgttt

SEQ ID NO: 564618 - DNA, 20 bp, Artificial Sequence
  chemically synthesized
atgtctttccttattttaaa

SEQ ID NO: 564619 - DNA, 20 bp, Artificial Sequence
  chemically synthesized
ttcttttttcttcacttcag

SEQ ID NO: 564620 - DNA, 20 bp, Artificial Sequence
  chemically synthesized
aagcattccttttctttttt

SEQ ID NO: 564621 - DNA, 20 bp, Artificial Sequence
  chemically synthesized
aatccgagaaaaaagaaaag

SEQ ID NO: 564622 - DNA, 20 bp, Artificial Sequence
  chemically synthesized
tcagtcttctgaaatataac

SEQ ID NO: 564623 - DNA, 20 bp, Artificial Sequence
  chemically synthesized
atcccatctgactcacttcc

SEQ ID NO: 564624 - DNA, 20 bp, Artificial Sequence
  chemically synthesized
taagcagatagaaccattat

SEQ ID NO: 564625 - DNA, 20 bp, Artificial Sequence
  chemically synthesized
caaacgctgataatggttct

SEQ ID NO: 564626 - DNA, 20 bp, Artificial Sequence
  chemically synthesized
aatggttctatctgcttaaa

SEQ ID NO: 564627 - DNA, 20 bp, Artificial Sequence
  chemically synthesized
aatagacacaagaattactc

SEQ ID NO: 564628 - DNA, 20 bp, Artificial Sequence
  chemically synthesized
aaaaaagagaaaataatttg

SEQ ID NO: 564629 - DNA, 20 bp, Artificial Sequence
  chemically synthesized
tttaaaaaaaagagaaaata

SEQ ID NO: 564630 - DNA, 20 bp, Artificial Sequence
  chemically synthesized
tacgcccaccaacatttttc

SEQ ID NO: 564631 - DNA, 20 bp, Artificial Sequence
  chemically synthesized
acatttttctttggatttta

SEQ ID NO: 564632 - DNA, 20 bp, Artificial Sequence
  chemically synthesized
gttgggtattggatacatca

SEQ ID NO: 564633 - DNA, 20 bp, Artificial Sequence
  chemically synthesized
ttttccatatgatataggac

SEQ ID NO: 564634 - DNA, 20 bp, Artificial Sequence
  chemically synthesized
attatggtgtacaatgttgt

SEQ ID NO: 564635 - DNA, 20 bp, Artificial Sequence
  chemically synthesized
cacgtttaggaaatttagct

SEQ ID NO: 564636 - DNA, 20 bp, Artificial Sequence
  chemically synthesized
gtgtacacatggaacagccc

SEQ ID NO: 564637 - DNA, 20 bp, Artificial Sequence
  chemically synthesized
catgtgtacacaagaatgta

SEQ ID NO: 564638 - DNA, 20 bp, Artificial Sequence
  chemically synthesized
tgtacacaagaatgtattat

SEQ ID NO: 564639 - DNA, 20 bp, Artificial Sequence
  chemically synthesized
tattaactcaacaagcactt

SEQ ID NO: 564640 - DNA, 20 bp, Artificial Sequence
  chemically synthesized
aactcaacaagcactttact

SEQ ID NO: 564641 - DNA, 20 bp, Artificial Sequence
  chemically synthesized
tgtgcaacaaacaatcagta

SEQ ID NO: 564642 - DNA, 20 bp, Artificial Sequence
  chemically synthesized
agacttacatcctgtcctta

SEQ ID NO: 564643 - DNA, 20 bp, Artificial Sequence
  chemically synthesized
gcatgagccaccacacccag

SEQ ID NO: 564644 - DNA, 20 bp, Artificial Sequence
  chemically synthesized
cgcctcagcctcccaaagtg

SEQ ID NO: 564645 - DNA, 20 bp, Artificial Sequence
  chemically synthesized
cactttgggaggctgaggcg

SEQ ID NO: 564646 - DNA, 20 bp, Artificial Sequence
  chemically synthesized
ttgggaggctgaggcgggtg

SEQ ID NO: 564647 - DNA, 20 bp, Artificial Sequence
  chemically synthesized
tcttgtatttttagtagaga

SEQ ID NO: 564648 - DNA, 20 bp, Artificial Sequence
  chemically synthesized
tgcctcaccctcctgagtag

SEQ ID NO: 564649 - DNA, 20 bp, Artificial Sequence
  chemically synthesized
tcaggagggtgaggcaggag

SEQ ID NO: 564650 - DNA, 20 bp, Artificial Sequence
  chemically synthesized
aacctccacctcctgggttc

SEQ ID NO: 564651 - DNA, 20 bp, Artificial Sequence
  chemically synthesized
ttcttttgtgtgagacggag

SEQ ID NO: 564652 - DNA, 20 bp, Artificial Sequence
  chemically synthesized
gttgttgttgttgttgttgt

SEQ ID NO: 564653 - DNA, 20 bp, Artificial Sequence
  chemically synthesized
ttaatcatgcattatatcat

SEQ ID NO: 564654 - DNA, 20 bp, Artificial Sequence
  chemically synthesized
caaaaccagaatgatataat

SEQ ID NO: 564655 - DNA, 20 bp, Artificial Sequence
  chemically synthesized
gcatcctttcttttcactca

SEQ ID NO: 564656 - DNA, 20 bp, Artificial Sequence
  chemically synthesized
gttgtcaaacagaaggcata

SEQ ID NO: 564657 - DNA, 20 bp, Artificial Sequence
  chemically synthesized
ctctttaagcattttatgcc

SEQ ID NO: 564658 - DNA, 20 bp, Artificial Sequence
  chemically synthesized
ttgaatggtagaagaggaac

SEQ ID NO: 564659 - DNA, 20 bp, Artificial Sequence
  chemically synthesized
aggaactgaagtttctggaa

SEQ ID NO: 564660 - DNA, 20 bp, Artificial Sequence
  chemically synthesized
caatccagtcaccaaggtca

SEQ ID NO: 564661 - DNA, 20 bp, Artificial Sequence
  chemically synthesized
aaaacacactgaccttggtg

SEQ ID NO: 564662 - DNA, 20 bp, Artificial Sequence
  chemically synthesized
aggggtagaaaatgactttg

SEQ ID NO: 564663 - DNA, 20 bp, Artificial Sequence
  chemically synthesized
agagatgctccaaaggttga

SEQ ID NO: 564664 - DNA, 20 bp, Artificial Sequence
  chemically synthesized
ctccaaaggttgatcatgat

SEQ ID NO: 564665 - DNA, 20 bp, Artificial Sequence
  chemically synthesized
ctatgctgacaactcttaag

SEQ ID NO: 564666 - DNA, 20 bp, Artificial Sequence
  chemically synthesized
cctgggcgctccttccatac

SEQ ID NO: 564667 - DNA, 20 bp, Artificial Sequence
  chemically synthesized
acatcacatcaaggttttcc

SEQ ID NO: 564668 - DNA, 20 bp, Artificial Sequence
  chemically synthesized
gtatcctcagtacatcacat

SEQ ID NO: 564669 - DNA, 20 bp, Artificial Sequence
  chemically synthesized
gttcgggttaaatgttttat

SEQ ID NO: 564670 - DNA, 20 bp, Artificial Sequence
  chemically synthesized
caagtgattgggttcgggtt

SEQ ID NO: 564671 - DNA, 20 bp, Artificial Sequence
  chemically synthesized
gaatttgtctgcttgtatcc

SEQ ID NO: 564672 - DNA, 20 bp, Artificial Sequence
  chemically synthesized
atgtcccccaatttgaattt

SEQ ID NO: 564673 - DNA, 20 bp, Artificial Sequence
  chemically synthesized
atattagaagaggtcgggct

SEQ ID NO: 564674 - DNA, 20 bp, Artificial Sequence
  chemically synthesized
ttctaatatatcaatgtcat

SEQ ID NO: 564675 - DNA, 20 bp, Artificial Sequence
  chemically synthesized
aagatttaaagaggctggga

SEQ ID NO: 564676 - DNA, 20 bp, Artificial Sequence
  chemically synthesized
taaagaggctgggaaagtgc

SEQ ID NO: 564677 - DNA, 20 bp, Artificial Sequence
  chemically synthesized
gttctttttgagcatgataa

SEQ ID NO: 564678 - DNA, 20 bp, Artificial Sequence
  chemically synthesized
attttagaaggcacgtgttc

SEQ ID NO: 564679 - DNA, 20 bp, Artificial Sequence
  chemically synthesized
ttcactgatccactcaatgg

SEQ ID NO: 564680 - DNA, 20 bp, Artificial Sequence
  chemically synthesized
attcatgcgtgtatatagtt

SEQ ID NO: 564681 - DNA, 20 bp, Artificial Sequence
  chemically synthesized
taatcatattcatgcgtgta

SEQ ID NO: 564682 - DNA, 20 bp, Artificial Sequence
  chemically synthesized
caaactatatacacgcatga

SEQ ID NO: 564683 - DNA, 20 bp, Artificial Sequence
  chemically synthesized
aacatatttttatatactgt

SEQ ID NO: 564684 - DNA, 20 bp, Artificial Sequence
  chemically synthesized
tgttaaatggattgcatata

SEQ ID NO: 564685 - DNA, 20 bp, Artificial Sequence
  chemically synthesized
tttacattcatgtgttgtta

SEQ ID NO: 564686 - DNA, 20 bp, Artificial Sequence
  chemically synthesized
ttaattcaacagtttgccac

SEQ ID NO: 564687 - DNA, 20 bp, Artificial Sequence
  chemically synthesized
ggcaaaactgcaattaattc

SEQ ID NO: 564688 - DNA, 20 bp, Artificial Sequence
  chemically synthesized
tggcaaactgttgaattaat

SEQ ID NO: 564689 - DNA, 20 bp, Artificial Sequence
  chemically synthesized
gaattaattgcagttttgcc

SEQ ID NO: 564690 - DNA, 20 bp, Artificial Sequence
  chemically synthesized
ggtttatgacataatggctc

SEQ ID NO: 564691 - DNA, 20 bp, Artificial Sequence
  chemically synthesized
aaaaatttatcatgtacatt

SEQ ID NO: 564692 - DNA, 20 bp, Artificial Sequence
  chemically synthesized
aattttttaaaaagcaaagg

SEQ ID NO: 564693 - DNA, 20 bp, Artificial Sequence
  chemically synthesized
atttaaaaattaaactgttc

SEQ ID NO: 564694 - DNA, 20 bp, Artificial Sequence
  chemically synthesized
ttttaaatcaataaaatata

SEQ ID NO: 564695 - DNA, 20 bp, Artificial Sequence
  chemically synthesized
ttttgaagcattttatattt

SEQ ID NO: 564696 - DNA, 20 bp, Artificial Sequence
  chemically synthesized
ctcctaactttccaccagat

SEQ ID NO: 564697 - DNA, 20 bp, Artificial Sequence
  chemically synthesized
ctgatgactcctaactttcc

SEQ ID NO: 564698 - DNA, 20 bp, Artificial Sequence
  chemically synthesized
ataaggagttgtctggacat

SEQ ID NO: 564699 - DNA, 20 bp, Artificial Sequence
  chemically synthesized
cagaacaaaatagcaattaa

SEQ ID NO: 564700 - DNA, 20 bp, Artificial Sequence
  chemically synthesized
taattgctattttgttctgt

SEQ ID NO: 564701 - DNA, 20 bp, Artificial Sequence
  chemically synthesized
tttgcttcctccaatagaat

SEQ ID NO: 564702 - DNA, 20 bp, Artificial Sequence
  chemically synthesized
agactcagtgataagtattt

SEQ ID NO: 564703 - DNA, 20 bp, Artificial Sequence
  chemically synthesized
atcacctaatatgacttgtc

SEQ ID NO: 564704 - DNA, 20 bp, Artificial Sequence
  chemically synthesized
tttaaatatgcaaccccgat

SEQ ID NO: 564705 - DNA, 20 bp, Artificial Sequence
  chemically synthesized
agtgtatatacttgggcttt

SEQ ID NO: 564706 - DNA, 20 bp, Artificial Sequence
  chemically synthesized
aataaatgcagtgtatatac

SEQ ID NO: 564707 - DNA, 20 bp, Artificial Sequence
  chemically synthesized
tcttcttgaaggatgcacac

SEQ ID NO: 564708 - DNA, 20 bp, Artificial Sequence
  chemically synthesized
tgcatccttcaagaagacgg

SEQ ID NO: 564709 - DNA, 20 bp, Artificial Sequence
  chemically synthesized
ttttttcctttttaaatgaa

SEQ ID NO: 564710 - DNA, 20 bp, Artificial Sequence
  chemically synthesized
agttagcttatgcagttcga

SEQ ID NO: 564711 - DNA, 20 bp, Artificial Sequence
  chemically synthesized
catggggattacaattcaac

SEQ ID NO: 564712 - DNA, 20 bp, Artificial Sequence
  chemically synthesized
cggacccctcccgcagcaca

SEQ ID NO: 564713 - DNA, 20 bp, Artificial Sequence
  chemically synthesized
ggaggtgactggatcatggc

SEQ ID NO: 564714 - DNA, 20 bp, Artificial Sequence
  chemically synthesized
agtgagttcgcataagatct

SEQ ID NO: 564715 - DNA, 20 bp, Artificial Sequence
  chemically synthesized
taaaagtgtggcagttctcc

SEQ ID NO: 564716 - DNA, 20 bp, Artificial Sequence
  chemically synthesized
ctgccgctatgtagcacatg

SEQ ID NO: 564717 - DNA, 20 bp, Artificial Sequence
  chemically synthesized
tgcttccccttcaccttccc

SEQ ID NO: 564718 - DNA, 20 bp, Artificial Sequence
  chemically synthesized
cttcaccttcccccatgatt

SEQ ID NO: 564719 - DNA, 20 bp, Artificial Sequence
  chemically synthesized
actgggtaatttatgaagaa

SEQ ID NO: 564720 - DNA, 20 bp, Artificial Sequence
  chemically synthesized
gttctttatagcagtgtgaa

SEQ ID NO: 564721 - DNA, 20 bp, Artificial Sequence
  chemically synthesized
ttttcttgaactgtgtatta

SEQ ID NO: 564722 - DNA, 20 bp, Artificial Sequence
  chemically synthesized
ctttcagaggacaaatttaa

SEQ ID NO: 564723 - DNA, 20 bp, Artificial Sequence
  chemically synthesized
tttatgccagcaagttatct

SEQ ID NO: 564724 - DNA, 20 bp, Artificial Sequence
  chemically synthesized
cctaatgtgcactttaattt

SEQ ID NO: 564725 - DNA, 20 bp, Artificial Sequence
  chemically synthesized
tcaacgacctaaataattat

SEQ ID NO: 564726 - DNA, 20 bp, Artificial Sequence
  chemically synthesized
gtggtcagattcagagccct

SEQ ID NO: 564727 - DNA, 20 bp, Artificial Sequence
  chemically synthesized
ctaagttacatattttagtg

SEQ ID NO: 564728 - DNA, 20 bp, Artificial Sequence
  chemically synthesized
ctgaccactaaaatatgtaa

SEQ ID NO: 564729 - DNA, 20 bp, Artificial Sequence
  chemically synthesized
aaaatatgtaacttagtttc

SEQ ID NO: 564730 - DNA, 20 bp, Artificial Sequence
  chemically synthesized
acctcttatttttttctact

SEQ ID NO: 564731 - DNA, 20 bp, Artificial Sequence
  chemically synthesized
aataagaggtactaaagctc

SEQ ID NO: 564732 - DNA, 20 bp, Artificial Sequence
  chemically synthesized
tctgtaaattctgaaaacaa

SEQ ID NO: 564733 - DNA, 20 bp, Artificial Sequence
  chemically synthesized
cagactttgcaaatgcatac

SEQ ID NO: 564734 - DNA, 20 bp, Artificial Sequence
  chemically synthesized
gtgttgtcatttacaatccc

SEQ ID NO: 564735 - DNA, 20 bp, Artificial Sequence
  chemically synthesized
tgaatatagctaataaactg

SEQ ID NO: 564736 - DNA, 20 bp, Artificial Sequence
  chemically synthesized
tggagggagataatctgaca

SEQ ID NO: 564737 - DNA, 20 bp, Artificial Sequence
  chemically synthesized
tgatttaaggcaatctctgt

SEQ ID NO: 564738 - DNA, 20 bp, Artificial Sequence
  chemically synthesized
ttcctgaatttactacacct

SEQ ID NO: 564739 - DNA, 20 bp, Artificial Sequence
  chemically synthesized
tttttttgagaaggaaaagg

SEQ ID NO: 564740 - DNA, 20 bp, Artificial Sequence
  chemically synthesized
ccttctcaaaaaaatcaaaa

SEQ ID NO: 564741 - DNA, 20 bp, Artificial Sequence
  chemically synthesized
aatcttgtaggaaagccagg

SEQ ID NO: 564742 - DNA, 20 bp, Artificial Sequence
  chemically synthesized
aatcaaaacctggctttcct

SEQ ID NO: 564743 - DNA, 20 bp, Artificial Sequence
  chemically synthesized
agccaaatcttgtaggaaag

SEQ ID NO: 564744 - DNA, 20 bp, Artificial Sequence
  chemically synthesized
aacctggctttcctacaaga

SEQ ID NO: 564745 - DNA, 20 bp, Artificial Sequence
  chemically synthesized
agttgatgagaccaacgttg

SEQ ID NO: 564746 - DNA, 20 bp, Artificial Sequence
  chemically synthesized
ggtgcctcccagcgagctgc

SEQ ID NO: 564747 - DNA, 20 bp, Artificial Sequence
  chemically synthesized
ggcaccatgttagatgtaga

SEQ ID NO: 564748 - DNA, 20 bp, Artificial Sequence
  chemically synthesized
aggaaaagtcaggggtgtgg

SEQ ID NO: 564749 - DNA, 20 bp, Artificial Sequence
  chemically synthesized
aatagaaaagacctgtgact

SEQ ID NO: 564750 - DNA, 20 bp, Artificial Sequence
  chemically synthesized
ggtcttttctattctgtgag

SEQ ID NO: 564751 - DNA, 20 bp, Artificial Sequence
  chemically synthesized
ttgagaggaccaagtatata

SEQ ID NO: 564752 - DNA, 20 bp, Artificial Sequence
  chemically synthesized
ctgtgtctggctagacaata

SEQ ID NO: 564753 - DNA, 20 bp, Artificial Sequence
  chemically synthesized
gggttcctagccagctgctc

SEQ ID NO: 564754 - DNA, 20 bp, Artificial Sequence
  chemically synthesized
accactgtaaaatgccctac

SEQ ID NO: 564755 - DNA, 20 bp, Artificial Sequence
  chemically synthesized
aaattcatccaacttttgcc

SEQ ID NO: 564756 - DNA, 20 bp, Artificial Sequence
  chemically synthesized
aaggcttccttcttacttgg

SEQ ID NO: 564757 - DNA, 20 bp, Artificial Sequence
  chemically synthesized
ttccttaatcctcattcatt

SEQ ID NO: 564758 - DNA, 20 bp, Artificial Sequence
  chemically synthesized
ctaggtaatcttaaaatgaa

SEQ ID NO: 564759 - DNA, 20 bp, Artificial Sequence
  chemically synthesized
gtctttcatttcattgaaac

SEQ ID NO: 564760 - DNA, 20 bp, Artificial Sequence
  chemically synthesized
gagaagggaaggtggaaaac

SEQ ID NO: 564761 - DNA, 20 bp, Artificial Sequence
  chemically synthesized
cttcccttctcttggcctaa

SEQ ID NO: 564762 - DNA, 20 bp, Artificial Sequence
  chemically synthesized
atttatagtgacccaatgga

SEQ ID NO: 564763 - DNA, 20 bp, Artificial Sequence
  chemically synthesized
ctggatcgaagcacctgtgt

SEQ ID NO: 564764 - DNA, 20 bp, Artificial Sequence
  chemically synthesized
atctataaaatctataacac

SEQ ID NO: 564765 - DNA, 20 bp, Artificial Sequence
  chemically synthesized
agcacctgtgttatagattt

SEQ ID NO: 564766 - DNA, 20 bp, Artificial Sequence
  chemically synthesized
tttgagaatgagtttcatag

SEQ ID NO: 564767 - DNA, 20 bp, Artificial Sequence
  chemically synthesized
caaactggagagatttgaga

SEQ ID NO: 564768 - DNA, 20 bp, Artificial Sequence
  chemically synthesized
gaaactcattctcaaatctc

SEQ ID NO: 564769 - DNA, 20 bp, Artificial Sequence
  chemically synthesized
tgaagtaagtgggcaaactg

SEQ ID NO: 564770 - DNA, 20 bp, Artificial Sequence
  chemically synthesized
aacttctgattgtggacata

SEQ ID NO: 564771 - DNA, 20 bp, Artificial Sequence
  chemically synthesized
aacacattatgtccacaatc

SEQ ID NO: 564772 - DNA, 20 bp, Artificial Sequence
  chemically synthesized
ttggaagaagatagtgaaac

SEQ ID NO: 564773 - DNA, 20 bp, Artificial Sequence
  chemically synthesized
gtaagaagaggaatgaaggg

SEQ ID NO: 564774 - DNA, 20 bp, Artificial Sequence
  chemically synthesized
aacctccgcctcctgggctc

SEQ ID NO: 564775 - DNA, 20 bp, Artificial Sequence
  chemically synthesized
tcgggaggatgaggcaggag

SEQ ID NO: 564776 - DNA, 20 bp, Artificial Sequence
  chemically synthesized
ttttctatttttagtagaga

SEQ ID NO: 564777 - DNA, 20 bp, Artificial Sequence
  chemically synthesized
cacctcaccctcccaaagtg

SEQ ID NO: 564778 - DNA, 20 bp, Artificial Sequence
  chemically synthesized
ttaggaggcaattgccaagg

SEQ ID NO: 564779 - DNA, 20 bp, Artificial Sequence
  chemically synthesized
taactggtcttctcacctat

SEQ ID NO: 564780 - DNA, 20 bp, Artificial Sequence
  chemically synthesized
ttagacttttttcgcctggt

SEQ ID NO: 564781 - DNA, 20 bp, Artificial Sequence
  chemically synthesized
ggacatgaatatttggccgt

SEQ ID NO: 564782 - DNA, 20 bp, Artificial Sequence
  chemically synthesized
gggtaagtgtcctagctact

SEQ ID NO: 564783 - DNA, 20 bp, Artificial Sequence
  chemically synthesized
ggacacttacccatggagtc

SEQ ID NO: 564784 - DNA, 20 bp, Artificial Sequence
  chemically synthesized
atgtttattatgaaaagtaa

SEQ ID NO: 564785 - DNA, 20 bp, Artificial Sequence
  chemically synthesized
attttgaaatttatacattt

SEQ ID NO: 564786 - DNA, 20 bp, Artificial Sequence
  chemically synthesized
tcctactttagaagccctcc

SEQ ID NO: 564787 - DNA, 20 bp, Artificial Sequence
  chemically synthesized
actttagaagccctcccaaa

SEQ ID NO: 564788 - DNA, 20 bp, Artificial Sequence
  chemically synthesized
ccaaattaaacaatctttgg

SEQ ID NO: 564789 - DNA, 20 bp, Artificial Sequence
  chemically synthesized
tcagatacaaagacagtttc

SEQ ID NO: 564790 - DNA, 20 bp, Artificial Sequence
  chemically synthesized
gagcacaattcagatacaaa

SEQ ID NO: 564791 - DNA, 20 bp, Artificial Sequence
  chemically synthesized
atagtctcattccagtgtag

SEQ ID NO: 564792 - DNA, 20 bp, Artificial Sequence
  chemically synthesized
catcattacattaaataact

SEQ ID NO: 564793 - DNA, 20 bp, Artificial Sequence
  chemically synthesized
tgagatctcaaaactgtaat

SEQ ID NO: 564794 - DNA, 20 bp, Artificial Sequence
  chemically synthesized
caaagatatgaatcttccat

SEQ ID NO: 564795 - DNA, 20 bp, Artificial Sequence
  chemically synthesized
aggacctacctggacatagt

SEQ ID NO: 564796 - DNA, 20 bp, Artificial Sequence
  chemically synthesized
tcttacaatgcagtatcttg

SEQ ID NO: 564797 - DNA, 20 bp, Artificial Sequence
  chemically synthesized
tatcttgctaggttttcgat

SEQ ID NO: 564798 - DNA, 20 bp, Artificial Sequence
  chemically synthesized
aggcttaaagaactatgtgt

SEQ ID NO: 564799 - DNA, 20 bp, Artificial Sequence
  chemically synthesized
ttatattttctggtatacct

SEQ ID NO: 564800 - DNA, 20 bp, Artificial Sequence
  chemically synthesized
gagaactagtggaaaccttt

SEQ ID NO: 564801 - DNA, 20 bp, Artificial Sequence
  chemically synthesized
tcttggggaaaaaaacgcct

SEQ ID NO: 564802 - DNA, 20 bp, Artificial Sequence
  chemically synthesized
ccaatattgtttcctaccaa

SEQ ID NO: 564803 - DNA, 20 bp, Artificial Sequence
  chemically synthesized
tcttttttgtatttgtccaa

SEQ ID NO: 564804 - DNA, 20 bp, Artificial Sequence
  chemically synthesized
gacaaatacaaaaaagacac

SEQ ID NO: 564805 - DNA, 20 bp, Artificial Sequence
  chemically synthesized
cataccaagcacttaagaat

SEQ ID NO: 564806 - DNA, 20 bp, Artificial Sequence
  chemically synthesized
tgcaacaagcatcaattctt

SEQ ID NO: 564807 - DNA, 20 bp, Artificial Sequence
  chemically synthesized
cacctataaaaagtgctctc

SEQ ID NO: 564808 - DNA, 20 bp, Artificial Sequence
  chemically synthesized
ataaaaagtgctctctgagg

SEQ ID NO: 564809 - DNA, 20 bp, Artificial Sequence
  chemically synthesized
aagtgctctctgaggtttag

SEQ ID NO: 564810 - DNA, 20 bp, Artificial Sequence
  chemically synthesized
tttgtttaagagggaaaaat

SEQ ID NO: 564811 - DNA, 20 bp, Artificial Sequence
  chemically synthesized
tggagcaagtgaggagagag

SEQ ID NO: 564812 - DNA, 20 bp, Artificial Sequence
  chemically synthesized
gcctgtgtaactgtgactcc

SEQ ID NO: 564813 - DNA, 20 bp, Artificial Sequence
  chemically synthesized
cagctgtttattgtggtctt

SEQ ID NO: 564814 - DNA, 20 bp, Artificial Sequence
  chemically synthesized
tggtcttccaggatttgcat

SEQ ID NO: 564815 - DNA, 20 bp, Artificial Sequence
  chemically synthesized
ggcggcctttgtgttgacgc

SEQ ID NO: 564816 - DNA, 20 bp, Artificial Sequence
  chemically synthesized
acaggcctttatgttcgtgc

SEQ ID NO: 564817 - DNA, 20 bp, Artificial Sequence
  chemically synthesized
tgctgctttagacggtcata

SEQ ID NO: 564818 - DNA, 20 bp, Artificial Sequence
  chemically synthesized
ttagacggtcatattctgct

SEQ ID NO: 564819 - DNA, 20 bp, Artificial Sequence
  chemically synthesized
aaaccattcattagtgcctc

SEQ ID NO: 564820 - DNA, 20 bp, Artificial Sequence
  chemically synthesized
aagcaaaagaggcactaatg

SEQ ID NO: 564821 - DNA, 20 bp, Artificial Sequence
  chemically synthesized
gttttgttcttttagcactg

SEQ ID NO: 564822 - DNA, 20 bp, Artificial Sequence
  chemically synthesized
taaaagaacaaaacaaaatt

SEQ ID NO: 564823 - DNA, 20 bp, Artificial Sequence
  chemically synthesized
caccaggcaaaagcttcaaa

SEQ ID NO: 564824 - DNA, 20 bp, Artificial Sequence
  chemically synthesized
gctcccttcacacaccaggc

SEQ ID NO: 564825 - DNA, 20 bp, Artificial Sequence
  chemically synthesized
tgcctggtgtgtgaagggag

SEQ ID NO: 564826 - DNA, 20 bp, Artificial Sequence
  chemically synthesized
ttatctgaacataccagtcg

SEQ ID NO: 564827 - DNA, 20 bp, Artificial Sequence
  chemically synthesized
tgttcagataagtaagcagc

SEQ ID NO: 564828 - DNA, 20 bp, Artificial Sequence
  chemically synthesized
tacaaagtgattaaatcctt

SEQ ID NO: 564829 - DNA, 20 bp, Artificial Sequence
  chemically synthesized
attataaagaaatatttaca

SEQ ID NO: 564830 - DNA, 20 bp, Artificial Sequence
  chemically synthesized
aaatatttctttataatgtc

SEQ ID NO: 564831 - DNA, 20 bp, Artificial Sequence
  chemically synthesized
ttttatacctctatcaacac

SEQ ID NO: 564832 - DNA, 20 bp, Artificial Sequence
  chemically synthesized
tttctgttgaaaatatttgc

SEQ ID NO: 564833 - DNA, 20 bp, Artificial Sequence
  chemically synthesized
gttcctatcacctccccttg

SEQ ID NO: 564834 - DNA, 20 bp, Artificial Sequence
  chemically synthesized
tcatttgccatattttcttc

SEQ ID NO: 564835 - DNA, 20 bp, Artificial Sequence
  chemically synthesized
aggcgggcatgtgagggagc

SEQ ID NO: 564836 - DNA, 20 bp, Artificial Sequence
  chemically synthesized
gtgttgaggcgggcatgtga

SEQ ID NO: 564837 - DNA, 20 bp, Artificial Sequence
  chemically synthesized
atgtatcaacaaatactagg

SEQ ID NO: 564838 - DNA, 20 bp, Artificial Sequence
  chemically synthesized
gttgagcttaaaaaagatgc

SEQ ID NO: 564839 - DNA, 20 bp, Artificial Sequence
  chemically synthesized
cctacaaaaacacccatttt

SEQ ID NO: 564840 - DNA, 20 bp, Artificial Sequence
  chemically synthesized
tagattgaatcacataaaat

SEQ ID NO: 564841 - DNA, 20 bp, Artificial Sequence
  chemically synthesized
aaaacatgcaaaataatgtt

SEQ ID NO: 564842 - DNA, 20 bp, Artificial Sequence
  chemically synthesized
caatctaataacattatttt

SEQ ID NO: 564843 - DNA, 20 bp, Artificial Sequence
  chemically synthesized
aaatgtgaagttcttaaatt

SEQ ID NO: 564844 - DNA, 20 bp, Artificial Sequence
  chemically synthesized
aatatacataccattctaag

SEQ ID NO: 564845 - DNA, 20 bp, Artificial Sequence
  chemically synthesized
ttttgccttcaacaccattt

SEQ ID NO: 564846 - DNA, 20 bp, Artificial Sequence
  chemically synthesized
atttctccaggtcgatacat

SEQ ID NO: 564847 - DNA, 20 bp, Artificial Sequence
  chemically synthesized
gccataaggtattattattc

SEQ ID NO: 564848 - DNA, 20 bp, Artificial Sequence
  chemically synthesized
ttcctgtccatggacattta

SEQ ID NO: 564849 - DNA, 20 bp, Artificial Sequence
  chemically synthesized
aaaaaagaatttcattgtat

SEQ ID NO: 564850 - DNA, 20 bp, Artificial Sequence
  chemically synthesized
atctccttggatacctgttg

SEQ ID NO: 564851 - DNA, 20 bp, Artificial Sequence
  chemically synthesized
tgaagagattctttacagaa

SEQ ID NO: 564852 - DNA, 20 bp, Artificial Sequence
  chemically synthesized
aagcaccgatttgtcaccca

SEQ ID NO: 564853 - DNA, 20 bp, Artificial Sequence
  chemically synthesized
aatcgctctgggtgacaaat

SEQ ID NO: 564854 - DNA, 20 bp, Artificial Sequence
  chemically synthesized
cgagagtaaattggtaaaag

SEQ ID NO: 564855 - DNA, 20 bp, Artificial Sequence
  chemically synthesized
cggtgcttttaccaatttac

SEQ ID NO: 564856 - DNA, 20 bp, Artificial Sequence
  chemically synthesized
actctcgcttcagtagtgaa

SEQ ID NO: 564857 - DNA, 20 bp, Artificial Sequence
  chemically synthesized
tacttggtgttatcagacat

SEQ ID NO: 564858 - DNA, 20 bp, Artificial Sequence
  chemically synthesized
attttaatttgcacatacat

SEQ ID NO: 564859 - DNA, 20 bp, Artificial Sequence
  chemically synthesized
gttagacttcttccatgtta

SEQ ID NO: 564860 - DNA, 20 bp, Artificial Sequence
  chemically synthesized
cttccatgttaactggcttt

SEQ ID NO: 564861 - DNA, 20 bp, Artificial Sequence
  chemically synthesized
cttcctttacccattttcct

SEQ ID NO: 564862 - DNA, 20 bp, Artificial Sequence
  chemically synthesized
ttagcatctagaacatatcc

SEQ ID NO: 564863 - DNA, 20 bp, Artificial Sequence
  chemically synthesized
ttgccatgcacataactaac

SEQ ID NO: 564864 - DNA, 20 bp, Artificial Sequence
  chemically synthesized
atcttctacccttatcttag

SEQ ID NO: 564865 - DNA, 20 bp, Artificial Sequence
  chemically synthesized
ttagtgtagcttatctttaa

SEQ ID NO: 564866 - DNA, 20 bp, Artificial Sequence
  chemically synthesized
ttaacatatccctgtatgtt

SEQ ID NO: 564867 - DNA, 20 bp, Artificial Sequence
  chemically synthesized
ccctgtatgttctctgcttt

SEQ ID NO: 564868 - DNA, 20 bp, Artificial Sequence
  chemically synthesized
ctttaaaatgtaggtgtaag

SEQ ID NO: 564869 - DNA, 20 bp, Artificial Sequence
  chemically synthesized
cttttcttacacctacattt

SEQ ID NO: 564870 - DNA, 20 bp, Artificial Sequence
  chemically synthesized
ctacattttaaagtttaaaa

SEQ ID NO: 564871 - DNA, 20 bp, Artificial Sequence
  chemically synthesized
aatttacccagaatctattt

SEQ ID NO: 564872 - DNA, 20 bp, Artificial Sequence
  chemically synthesized
atgttcacggcaagcacaaa

SEQ ID NO: 564873 - DNA, 20 bp, Artificial Sequence
  chemically synthesized
acaatgaatgaggctggctt

SEQ ID NO: 564874 - DNA, 20 bp, Artificial Sequence
  chemically synthesized
tggaccatacaatgaatgag

SEQ ID NO: 564875 - DNA, 20 bp, Artificial Sequence
  chemically synthesized
tatttcccactgatctctaa

SEQ ID NO: 564876 - DNA, 20 bp, Artificial Sequence
  chemically synthesized
cctgtatatttatggacact

SEQ ID NO: 564877 - DNA, 20 bp, Artificial Sequence
  chemically synthesized
aagtgtccataaatatacag

SEQ ID NO: 564878 - DNA, 20 bp, Artificial Sequence
  chemically synthesized
atccctggtagatcccacac

SEQ ID NO: 564879 - DNA, 20 bp, Artificial Sequence
  chemically synthesized
gagaaggcctatcagacatc

SEQ ID NO: 564880 - DNA, 20 bp, Artificial Sequence
  chemically synthesized
tgataggccttctcagccca

SEQ ID NO: 564881 - DNA, 20 bp, Artificial Sequence
  chemically synthesized
tctgacccctttgatcttct

SEQ ID NO: 564882 - DNA, 20 bp, Artificial Sequence
  chemically synthesized
tttgatcttctccatgattt

SEQ ID NO: 564883 - DNA, 20 bp, Artificial Sequence
  chemically synthesized
tcttctccatgattttagtg

SEQ ID NO: 564884 - DNA, 20 bp, Artificial Sequence
  chemically synthesized
catgattttagtgtttggtt

SEQ ID NO: 564885 - DNA, 20 bp, Artificial Sequence
  chemically synthesized
ttggttttctgattttatga

SEQ ID NO: 564886 - DNA, 20 bp, Artificial Sequence
  chemically synthesized
tgaaaatgcttgttgaaatt

SEQ ID NO: 564887 - DNA, 20 bp, Artificial Sequence
  chemically synthesized
ttattatgaacttagttctt

SEQ ID NO: 564888 - DNA, 20 bp, Artificial Sequence
  chemically synthesized
aaatgagaccatagtaagta

SEQ ID NO: 564889 - DNA, 20 bp, Artificial Sequence
  chemically synthesized
tctcattttatgtccattaa

SEQ ID NO: 564890 - DNA, 20 bp, Artificial Sequence
  chemically synthesized
cttgttactcttttttttcc

SEQ ID NO: 564891 - DNA, 20 bp, Artificial Sequence
  chemically synthesized
gctttacaggttgaataagt

SEQ ID NO: 564892 - DNA, 20 bp, Artificial Sequence
  chemically synthesized
taccactttaattatatacc

SEQ ID NO: 564893 - DNA, 20 bp, Artificial Sequence
  chemically synthesized
caaaagtttttatatacatc

SEQ ID NO: 564894 - DNA, 20 bp, Artificial Sequence
  chemically synthesized
acctgattcaattcagtgcc

SEQ ID NO: 564895 - DNA, 20 bp, Artificial Sequence
  chemically synthesized
cttatgttttgtaattctta

SEQ ID NO: 564896 - DNA, 20 bp, Artificial Sequence
  chemically synthesized
ttagtgcatttctaatttaa

SEQ ID NO: 564897 - DNA, 20 bp, Artificial Sequence
  chemically synthesized
atcagtatcatacaggggtt

SEQ ID NO: 564898 - DNA, 20 bp, Artificial Sequence
  chemically synthesized
gagtctctaaatacatagtg

SEQ ID NO: 564899 - DNA, 20 bp, Artificial Sequence
  chemically synthesized
ttgtccatatctttattaat

SEQ ID NO: 564900 - DNA, 20 bp, Artificial Sequence
  chemically synthesized
gatgagtgttgagatataat

SEQ ID NO: 564901 - DNA, 20 bp, Artificial Sequence
  chemically synthesized
tgagatataattatggattt

SEQ ID NO: 564902 - DNA, 20 bp, Artificial Sequence
  chemically synthesized
gaagatcctcgttgttcttg

SEQ ID NO: 564903 - DNA, 20 bp, Artificial Sequence
  chemically synthesized
atactttttcttcctaataa

SEQ ID NO: 564904 - DNA, 20 bp, Artificial Sequence
  chemically synthesized
ccataaattttattccattt

SEQ ID NO: 564905 - DNA, 20 bp, Artificial Sequence
  chemically synthesized
gggaccttcacatgtgctaa

SEQ ID NO: 564906 - DNA, 20 bp, Artificial Sequence
  chemically synthesized
ttagcacatgtgaaggtccc

SEQ ID NO: 564907 - DNA, 20 bp, Artificial Sequence
  chemically synthesized
atgtgaaggtcccaaatgct

SEQ ID NO: 564908 - DNA, 20 bp, Artificial Sequence
  chemically synthesized
tctgatatttgatatccagt

SEQ ID NO: 564909 - DNA, 20 bp, Artificial Sequence
  chemically synthesized
gataaataccaaaataagat

SEQ ID NO: 564910 - DNA, 20 bp, Artificial Sequence
  chemically synthesized
gtaagtagtgagtagccaag

SEQ ID NO: 564911 - DNA, 20 bp, Artificial Sequence
  chemically synthesized
caagaagagttttcccattg

SEQ ID NO: 564912 - DNA, 20 bp, Artificial Sequence
  chemically synthesized
cagacctggtgatgagatga

SEQ ID NO: 564913 - DNA, 20 bp, Artificial Sequence
  chemically synthesized
acggcatgtcttccaaaatg

SEQ ID NO: 564914 - DNA, 20 bp, Artificial Sequence
  chemically synthesized
cagagtagattgggttttct

SEQ ID NO: 564915 - DNA, 20 bp, Artificial Sequence
  chemically synthesized
agaaagaaaacccaatctac

SEQ ID NO: 564916 - DNA, 20 bp, Artificial Sequence
  chemically synthesized
aagaaaaaaaccagagtaga

SEQ ID NO: 564917 - DNA, 20 bp, Artificial Sequence
  chemically synthesized
aaaacaaagaaaaaaaccag

SEQ ID NO: 564918 - DNA, 20 bp, Artificial Sequence
  chemically synthesized
caatctactctggttttttt

SEQ ID NO: 564919 - DNA, 20 bp, Artificial Sequence
  chemically synthesized
tactctggtttttttctttg

SEQ ID NO: 564920 - DNA, 20 bp, Artificial Sequence
  chemically synthesized
tggtttttttctttgttttg

SEQ ID NO: 564921 - DNA, 20 bp, Artificial Sequence
  chemically synthesized
ctacctagtacctaacatta

SEQ ID NO: 564922 - DNA, 20 bp, Artificial Sequence
  chemically synthesized
tgtagatgaaaaagatcata

SEQ ID NO: 564923 - DNA, 20 bp, Artificial Sequence
  chemically synthesized
gaaatagaatctcctatctg

SEQ ID NO: 564924 - DNA, 20 bp, Artificial Sequence
  chemically synthesized
ggatttcaatcagtacagat

SEQ ID NO: 564925 - DNA, 20 bp, Artificial Sequence
  chemically synthesized
acccttgaaggctgatagca

SEQ ID NO: 564926 - DNA, 20 bp, Artificial Sequence
  chemically synthesized
tgctatcagccttcaagggt

SEQ ID NO: 564927 - DNA, 20 bp, Artificial Sequence
  chemically synthesized
ccttcaagggtagttgtttg

SEQ ID NO: 564928 - DNA, 20 bp, Artificial Sequence
  chemically synthesized
gtatagtttatttcatagca

SEQ ID NO: 564929 - DNA, 20 bp, Artificial Sequence
  chemically synthesized
tctcatcactgctttgtcaa

SEQ ID NO: 564930 - DNA, 20 bp, Artificial Sequence
  chemically synthesized
tttgacaaagcagtgatgag

SEQ ID NO: 564931 - DNA, 20 bp, Artificial Sequence
  chemically synthesized
ttcgatgaatctcttctcat

SEQ ID NO: 564932 - DNA, 20 bp, Artificial Sequence
  chemically synthesized
tcgaagtaagtacaccttca

SEQ ID NO: 564933 - DNA, 20 bp, Artificial Sequence
  chemically synthesized
tgccagttaagttctcagaa

SEQ ID NO: 564934 - DNA, 20 bp, Artificial Sequence
  chemically synthesized
aacttaactggcaatcagtt

SEQ ID NO: 564935 - DNA, 20 bp, Artificial Sequence
  chemically synthesized
tcaagttcacagaaacattg

SEQ ID NO: 564936 - DNA, 20 bp, Artificial Sequence
  chemically synthesized
gagaccttgtgaacattgga

SEQ ID NO: 564937 - DNA, 20 bp, Artificial Sequence
  chemically synthesized
tgccagttagaacattttgt

SEQ ID NO: 564938 - DNA, 20 bp, Artificial Sequence
  chemically synthesized
tggtagaaagaaaaatttga

SEQ ID NO: 564939 - DNA, 20 bp, Artificial Sequence
  chemically synthesized
ctattcaaatttttctttct

SEQ ID NO: 564940 - DNA, 20 bp, Artificial Sequence
  chemically synthesized
gccatggtgttccttttgaa

SEQ ID NO: 564941 - DNA, 20 bp, Artificial Sequence
  chemically synthesized
tcttgaggtccatgtctaaa

SEQ ID NO: 564942 - DNA, 20 bp, Artificial Sequence
  chemically synthesized
aaaataggtgggaagacagt

SEQ ID NO: 564943 - DNA, 20 bp, Artificial Sequence
  chemically synthesized
ttccttggtatcttgatcct

SEQ ID NO: 564944 - DNA, 20 bp, Artificial Sequence
  chemically synthesized
ttgtccacagggctcttctt

SEQ ID NO: 564945 - DNA, 20 bp, Artificial Sequence
  chemically synthesized
aaggacccttgttcaagagg

SEQ ID NO: 564946 - DNA, 20 bp, Artificial Sequence
  chemically synthesized
gtatatacaacacattacat

SEQ ID NO: 564947 - DNA, 20 bp, Artificial Sequence
  chemically synthesized
acacattacatttctgtttt

SEQ ID NO: 564948 - DNA, 20 bp, Artificial Sequence
  chemically synthesized
ggctgattaaaatgagcctt

SEQ ID NO: 564949 - DNA, 20 bp, Artificial Sequence
  chemically synthesized
attctttacagctcagcttt

SEQ ID NO: 564950 - DNA, 20 bp, Artificial Sequence
  chemically synthesized
gcaattgatattctttacag

SEQ ID NO: 564951 - DNA, 20 bp, Artificial Sequence
  chemically synthesized
caggcctttctttccttccc

SEQ ID NO: 564952 - DNA, 20 bp, Artificial Sequence
  chemically synthesized
tcacatccttcttcaattct

SEQ ID NO: 564953 - DNA, 20 bp, Artificial Sequence
  chemically synthesized
tctggaagattctcagctat

SEQ ID NO: 564954 - DNA, 20 bp, Artificial Sequence
  chemically synthesized
tttgtttaggagtgtatttg

SEQ ID NO: 564955 - DNA, 20 bp, Artificial Sequence
  chemically synthesized
taccttactagaatttagag

SEQ ID NO: 564956 - DNA, 20 bp, Artificial Sequence
  chemically synthesized
aatataccttactagaattt

SEQ ID NO: 564957 - DNA, 20 bp, Artificial Sequence
  chemically synthesized
tctagaatttatcctgtata

SEQ ID NO: 564958 - DNA, 20 bp, Artificial Sequence
  chemically synthesized
tgagtttagtaacttcaatg

SEQ ID NO: 564959 - DNA, 20 bp, Artificial Sequence
  chemically synthesized
agtttttttggcaaagatat

SEQ ID NO: 564960 - DNA, 20 bp, Artificial Sequence
  chemically synthesized
cctagttacatttcatccat

SEQ ID NO: 564961 - DNA, 20 bp, Artificial Sequence
  chemically synthesized
catttcatccatctctgttt

SEQ ID NO: 564962 - DNA, 20 bp, Artificial Sequence
  chemically synthesized
catctcaaaaaaaaaaaaaa

SEQ ID NO: 564963 - DNA, 20 bp, Artificial Sequence
  chemically synthesized
tcaggaggctgaggcaggag

SEQ ID NO: 564964 - DNA, 20 bp, Artificial Sequence
  chemically synthesized
tgcctcagcctcctgagtag

SEQ ID NO: 564965 - DNA, 20 bp, Artificial Sequence
  chemically synthesized
ttttgtatttttagtagagg

SEQ ID NO: 564966 - DNA, 20 bp, Artificial Sequence
  chemically synthesized
catctcagcctcccagagtg

SEQ ID NO: 564967 - DNA, 20 bp, Artificial Sequence
  chemically synthesized
aaaataatacactagtacaa

SEQ ID NO: 564968 - DNA, 20 bp, Artificial Sequence
  chemically synthesized
tttgttgtactagtgtatta

SEQ ID NO: 564969 - DNA, 20 bp, Artificial Sequence
  chemically synthesized
tcaggaggctgagataggag

SEQ ID NO: 564970 - DNA, 20 bp, Artificial Sequence
  chemically synthesized
tgggaggactgcttgtgccc

SEQ ID NO: 564971 - DNA, 20 bp, Artificial Sequence
  chemically synthesized
ttgggaggccaaggtgggag

SEQ ID NO: 564972 - DNA, 20 bp, Artificial Sequence
  chemically synthesized
caccttggcctcccaaagtg

SEQ ID NO: 564973 - DNA, 20 bp, Artificial Sequence
  chemically synthesized
tcccagcctaattcactttt

SEQ ID NO: 564974 - DNA, 20 bp, Artificial Sequence
  chemically synthesized
atttcttcatgtattttgga

SEQ ID NO: 564975 - DNA, 20 bp, Artificial Sequence
  chemically synthesized
ttggagacaaattttgcaag

SEQ ID NO: 564976 - DNA, 20 bp, Artificial Sequence
  chemically synthesized
atgtgcatacatatgcatgt

SEQ ID NO: 564977 - DNA, 20 bp, Artificial Sequence
  chemically synthesized
aaccacctgagagagagata

SEQ ID NO: 564978 - DNA, 20 bp, Artificial Sequence
  chemically synthesized
aactcattatctctctctca

SEQ ID NO: 564979 - DNA, 20 bp, Artificial Sequence
  chemically synthesized
atctctctctcaggtggttt

SEQ ID NO: 564980 - DNA, 20 bp, Artificial Sequence
  chemically synthesized
ggcttctcccagccataccc

SEQ ID NO: 564981 - DNA, 20 bp, Artificial Sequence
  chemically synthesized
cccagccatacccaggggct

SEQ ID NO: 564982 - DNA, 20 bp, Artificial Sequence
  chemically synthesized
agtttagagccacatctgtt

SEQ ID NO: 564983 - DNA, 20 bp, Artificial Sequence
  chemically synthesized
catttcattgccaggcagta

SEQ ID NO: 564984 - DNA, 20 bp, Artificial Sequence
  chemically synthesized
gtaggtagattggttcaggt

SEQ ID NO: 564985 - DNA, 20 bp, Artificial Sequence
  chemically synthesized
catagagccgagggaagagg

SEQ ID NO: 564986 - DNA, 20 bp, Artificial Sequence
  chemically synthesized
aacagtttgctgcaagggtc

SEQ ID NO: 564987 - DNA, 20 bp, Artificial Sequence
  chemically synthesized
agctgtagacccttgcagca

SEQ ID NO: 564988 - DNA, 20 bp, Artificial Sequence
  chemically synthesized
ttaaaagcaacatgaaaaga

SEQ ID NO: 564989 - DNA, 20 bp, Artificial Sequence
  chemically synthesized
cagcaaactgtttcttttca

SEQ ID NO: 564990 - DNA, 20 bp, Artificial Sequence
  chemically synthesized
gtgtatgtgtctctctctag

SEQ ID NO: 564991 - DNA, 20 bp, Artificial Sequence
  chemically synthesized
ctaggtgtgtttttgtgggg

SEQ ID NO: 564992 - DNA, 20 bp, Artificial Sequence
  chemically synthesized
ctctgatttcaaatagtaat

SEQ ID NO: 564993 - DNA, 20 bp, Artificial Sequence
  chemically synthesized
tacaaggtagtggcccaaag

SEQ ID NO: 564994 - DNA, 20 bp, Artificial Sequence
  chemically synthesized
ttcagctcgtgctgtagtaa

SEQ ID NO: 564995 - DNA, 20 bp, Artificial Sequence
  chemically synthesized
aagtaagtggggctaaatta

SEQ ID NO: 564996 - DNA, 20 bp, Artificial Sequence
  chemically synthesized
ctggttcacagagatgttca

SEQ ID NO: 564997 - DNA, 20 bp, Artificial Sequence
  chemically synthesized
gaaaaatgaaaaagacatag

SEQ ID NO: 564998 - DNA, 20 bp, Artificial Sequence
  chemically synthesized
ctgattaagataacattagc

SEQ ID NO: 564999 - DNA, 20 bp, Artificial Sequence
  chemically synthesized
atcaatgtgtcctggtaggc

SEQ ID NO: 565000 - DNA, 20 bp, Artificial Sequence
  chemically synthesized
atcagaagcctaccaggaca

SEQ ID NO: 565001 - DNA, 20 bp, Artificial Sequence
  chemically synthesized
tacaaaatcaatgtgtcctg

SEQ ID NO: 565002 - DNA, 20 bp, Artificial Sequence
  chemically synthesized
ttaatcctggcctgatgaat

SEQ ID NO: 565003 - DNA, 20 bp, Artificial Sequence
  chemically synthesized
tcaagccttaattcatcagg

SEQ ID NO: 565004 - DNA, 20 bp, Artificial Sequence
  chemically synthesized
caggattaaatgagtcgaac

SEQ ID NO: 565005 - DNA, 20 bp, Artificial Sequence
  chemically synthesized
gaggtttctgtatgtcatat

SEQ ID NO: 565006 - DNA, 20 bp, Artificial Sequence
  chemically synthesized
ataagaggtttctgtatgtc

SEQ ID NO: 565007 - DNA, 20 bp, Artificial Sequence
  chemically synthesized
gtttgctattgagcttaata

SEQ ID NO: 565008 - DNA, 20 bp, Artificial Sequence
  chemically synthesized
cttattaagctcaatagcaa

SEQ ID NO: 565009 - DNA, 20 bp, Artificial Sequence
  chemically synthesized
cctcaaaatcaagtttgcta

SEQ ID NO: 565010 - DNA, 20 bp, Artificial Sequence
  chemically synthesized
gaaaaactagtccctcaaaa

SEQ ID NO: 565011 - DNA, 20 bp, Artificial Sequence
  chemically synthesized
agcaaacttgattttgaggg

SEQ ID NO: 565012 - DNA, 20 bp, Artificial Sequence
  chemically synthesized
catgacagcttgtcctatct

SEQ ID NO: 565013 - DNA, 20 bp, Artificial Sequence
  chemically synthesized
gataggacaagctgtcatga

SEQ ID NO: 565014 - DNA, 20 bp, Artificial Sequence
  chemically synthesized
gcttttagaatccttatcat

SEQ ID NO: 565015 - DNA, 20 bp, Artificial Sequence
  chemically synthesized
agatacctcttttaaccatt

SEQ ID NO: 565016 - DNA, 20 bp, Artificial Sequence
  chemically synthesized
tggcctgcaaccaaatgaaa

SEQ ID NO: 565017 - DNA, 20 bp, Artificial Sequence
  chemically synthesized
caaccaaatgaaataaggtt

SEQ ID NO: 565018 - DNA, 20 bp, Artificial Sequence
  chemically synthesized
atcaagaagaactgatgctg

SEQ ID NO: 565019 - DNA, 20 bp, Artificial Sequence
  chemically synthesized
tgctggagggtttgaactag

SEQ ID NO: 565020 - DNA, 20 bp, Artificial Sequence
  chemically synthesized
aactagagatgatttttact

SEQ ID NO: 565021 - DNA, 20 bp, Artificial Sequence
  chemically synthesized
acctcaaaaagtattggcat

SEQ ID NO: 565022 - DNA, 20 bp, Artificial Sequence
  chemically synthesized
tttttgaggtataccataat

SEQ ID NO: 565023 - DNA, 20 bp, Artificial Sequence
  chemically synthesized
tgttccaaggtaagttattc

SEQ ID NO: 565024 - DNA, 20 bp, Artificial Sequence
  chemically synthesized
actccagcatgggcgacaga

SEQ ID NO: 565025 - DNA, 20 bp, Artificial Sequence
  chemically synthesized
gagaatgtgaacccaggagg

SEQ ID NO: 565026 - DNA, 20 bp, Artificial Sequence
  chemically synthesized
tacaggtgcccgccaccacg

SEQ ID NO: 565027 - DNA, 20 bp, Artificial Sequence
  chemically synthesized
ttttgtatttttagtagaga

SEQ ID NO: 565028 - DNA, 20 bp, Artificial Sequence
  chemically synthesized
tgcctcggcctcccaaagtg

SEQ ID NO: 565029 - DNA, 20 bp, Artificial Sequence
  chemically synthesized
gagccaacatgcccagcctc

SEQ ID NO: 565030 - DNA, 20 bp, Artificial Sequence
  chemically synthesized
gtttaacaagtacacaatgc

SEQ ID NO: 565031 - DNA, 20 bp, Artificial Sequence
  chemically synthesized
tcaattattaccaatacata

SEQ ID NO: 565032 - DNA, 20 bp, Artificial Sequence
  chemically synthesized
atacacgtacatctcacccc

SEQ ID NO: 565033 - DNA, 20 bp, Artificial Sequence
  chemically synthesized
cacagagaatctatttacgt

SEQ ID NO: 565034 - DNA, 20 bp, Artificial Sequence
  chemically synthesized
acaagataatcaagaacgta

SEQ ID NO: 565035 - DNA, 20 bp, Artificial Sequence
  chemically synthesized
attaattcaaattcaataca

SEQ ID NO: 565036 - DNA, 20 bp, Artificial Sequence
  chemically synthesized
atctacatatttgtagaatg

SEQ ID NO: 565037 - DNA, 20 bp, Artificial Sequence
  chemically synthesized
ttctacaaatatgtagatat

SEQ ID NO: 565038 - DNA, 20 bp, Artificial Sequence
  chemically synthesized
gtaaatttgtatgtagacaa

SEQ ID NO: 565039 - DNA, 20 bp, Artificial Sequence
  chemically synthesized
ttatgtccattagttggttg

SEQ ID NO: 565040 - DNA, 20 bp, Artificial Sequence
  chemically synthesized
cccaaccaactaatggacat

SEQ ID NO: 565041 - DNA, 20 bp, Artificial Sequence
  chemically synthesized
taagagattaatcaaattgg

SEQ ID NO: 565042 - DNA, 20 bp, Artificial Sequence
  chemically synthesized
taagggaacaagccttgcca

SEQ ID NO: 565043 - DNA, 20 bp, Artificial Sequence
  chemically synthesized
gctaaaagggccagctgctt

SEQ ID NO: 565044 - DNA, 20 bp, Artificial Sequence
  chemically synthesized
aaatcattgctaaaagggcc

SEQ ID NO: 565045 - DNA, 20 bp, Artificial Sequence
  chemically synthesized
aaagcagctggcccttttag

SEQ ID NO: 565046 - DNA, 20 bp, Artificial Sequence
  chemically synthesized
ttctttatcatacataatag

SEQ ID NO: 565047 - DNA, 20 bp, Artificial Sequence
  chemically synthesized
gtaaattagtttaaattaca

SEQ ID NO: 565048 - DNA, 20 bp, Artificial Sequence
  chemically synthesized
aaatcatttgacctttgtaa

SEQ ID NO: 565049 - DNA, 20 bp, Artificial Sequence
  chemically synthesized
taaactaatttacaaaggtc

SEQ ID NO: 565050 - DNA, 20 bp, Artificial Sequence
  chemically synthesized
taagtcatctactctttaaa

SEQ ID NO: 565051 - DNA, 20 bp, Artificial Sequence
  chemically synthesized
gaaggtcactttccagtgat

SEQ ID NO: 565052 - DNA, 20 bp, Artificial Sequence
  chemically synthesized
taccaaagcatgagcacaca

SEQ ID NO: 565053 - DNA, 20 bp, Artificial Sequence
  chemically synthesized
aaaataatccctgtgtgtgc

SEQ ID NO: 565054 - DNA, 20 bp, Artificial Sequence
  chemically synthesized
tttgtaaagtagaacaacta

SEQ ID NO: 565055 - DNA, 20 bp, Artificial Sequence
  chemically synthesized
aaggaatagatccaaagaaa

SEQ ID NO: 565056 - DNA, 20 bp, Artificial Sequence
  chemically synthesized
taatattatatgagggtaaa

SEQ ID NO: 565057 - DNA, 20 bp, Artificial Sequence
  chemically synthesized
tagattggtggatatgattt

SEQ ID NO: 565058 - DNA, 20 bp, Artificial Sequence
  chemically synthesized
gcctgaatttagattggtgg

SEQ ID NO: 565059 - DNA, 20 bp, Artificial Sequence
  chemically synthesized
atttactacatttgcctgaa

SEQ ID NO: 565060 - DNA, 20 bp, Artificial Sequence
  chemically synthesized
atagctgctgtaatagttct

SEQ ID NO: 565061 - DNA, 20 bp, Artificial Sequence
  chemically synthesized
agctataaatgtagccaatc

SEQ ID NO: 565062 - DNA, 20 bp, Artificial Sequence
  chemically synthesized
tctttcatttaaaaaaaaac

SEQ ID NO: 565063 - DNA, 20 bp, Artificial Sequence
  chemically synthesized
tttccagtttttaaagttca

SEQ ID NO: 565064 - DNA, 20 bp, Artificial Sequence
  chemically synthesized
ttcaagggctcaatgcaatt

SEQ ID NO: 565065 - DNA, 20 bp, Artificial Sequence
  chemically synthesized
tacaggtgtgagccattgca

SEQ ID NO: 565066 - DNA, 20 bp, Artificial Sequence
  chemically synthesized
cacctcaacctcccaaagtg

SEQ ID NO: 565067 - DNA, 20 bp, Artificial Sequence
  chemically synthesized
ggaggaggctggggtgggag

SEQ ID NO: 565068 - DNA, 20 bp, Artificial Sequence
  chemically synthesized
aatggagtctccctctgtta

SEQ ID NO: 565069 - DNA, 20 bp, Artificial Sequence
  chemically synthesized
gtgacaataaaattttacag

SEQ ID NO: 565070 - DNA, 20 bp, Artificial Sequence
  chemically synthesized
gtttaggggtatttttgaat

SEQ ID NO: 565071 - DNA, 20 bp, Artificial Sequence
  chemically synthesized
cttattaatgtctttttcca

SEQ ID NO: 565072 - DNA, 20 bp, Artificial Sequence
  chemically synthesized
atagtcttacttctcaccct

SEQ ID NO: 565073 - DNA, 20 bp, Artificial Sequence
  chemically synthesized
gggtcctgccatttttactg

SEQ ID NO: 565074 - DNA, 20 bp, Artificial Sequence
  chemically synthesized
tggaggggtcctgccatttt

SEQ ID NO: 565075 - DNA, 20 bp, Artificial Sequence
  chemically synthesized
atggcaggacccctccaggc

SEQ ID NO: 565076 - DNA, 20 bp, Artificial Sequence
  chemically synthesized
taaagggggacagtgctaag

SEQ ID NO: 565077 - DNA, 20 bp, Artificial Sequence
  chemically synthesized
gggcttggaagtaaggctct

SEQ ID NO: 565078 - DNA, 20 bp, Artificial Sequence
  chemically synthesized
ctgagcaaatttcagtagga

SEQ ID NO: 565079 - DNA, 20 bp, Artificial Sequence
  chemically synthesized
tactgaaatttgctcagtat

SEQ ID NO: 565080 - DNA, 20 bp, Artificial Sequence
  chemically synthesized
tataagacatttacatttta

SEQ ID NO: 565081 - DNA, 20 bp, Artificial Sequence
  chemically synthesized
tttcctttacgttctttgac

SEQ ID NO: 565082 - DNA, 20 bp, Artificial Sequence
  chemically synthesized
agaacgtaaaggaaaaaaat

SEQ ID NO: 565083 - DNA, 20 bp, Artificial Sequence
  chemically synthesized
caacctttcccctgatgggg

SEQ ID NO: 565084 - DNA, 20 bp, Artificial Sequence
  chemically synthesized
ggctgaggagagaattagaa

SEQ ID NO: 565085 - DNA, 20 bp, Artificial Sequence
  chemically synthesized
aacaaggcttgagagatggt

SEQ ID NO: 565086 - DNA, 20 bp, Artificial Sequence
  chemically synthesized
atggtcttggattcagaaga

SEQ ID NO: 565087 - DNA, 20 bp, Artificial Sequence
  chemically synthesized
atttatgacttacttgcctc

SEQ ID NO: 565088 - DNA, 20 bp, Artificial Sequence
  chemically synthesized
aataatcctcataactgaat

SEQ ID NO: 565089 - DNA, 20 bp, Artificial Sequence
  chemically synthesized
cttaagcactaattcagtta

SEQ ID NO: 565090 - DNA, 20 bp, Artificial Sequence
  chemically synthesized
acatatagaatgtcgaccat

SEQ ID NO: 565091 - DNA, 20 bp, Artificial Sequence
  chemically synthesized
tgggctgggcatggttcaaa

SEQ ID NO: 565092 - DNA, 20 bp, Artificial Sequence
  chemically synthesized
tctctatatattatttactt

SEQ ID NO: 565093 - DNA, 20 bp, Artificial Sequence
  chemically synthesized
ttaagtgctttctttttata

SEQ ID NO: 565094 - DNA, 20 bp, Artificial Sequence
  chemically synthesized
tgcttccatttcagataatt

SEQ ID NO: 565095 - DNA, 20 bp, Artificial Sequence
  chemically synthesized
aagctcagtaggtctaagta

SEQ ID NO: 565096 - DNA, 20 bp, Artificial Sequence
  chemically synthesized
tgccaagctcagtaggtcta

SEQ ID NO: 565097 - DNA, 20 bp, Artificial Sequence
  chemically synthesized
aagcaatctacttagaccta

SEQ ID NO: 565098 - DNA, 20 bp, Artificial Sequence
  chemically synthesized
tggcagaacatatgcatatc

SEQ ID NO: 565099 - DNA, 20 bp, Artificial Sequence
  chemically synthesized
gtatctacaggacaaatact

SEQ ID NO: 565100 - DNA, 20 bp, Artificial Sequence
  chemically synthesized
atccatcatctgtgccttag

SEQ ID NO: 565101 - DNA, 20 bp, Artificial Sequence
  chemically synthesized
tcatcctagtgatcttaact

SEQ ID NO: 565102 - DNA, 20 bp, Artificial Sequence
  chemically synthesized
actgagttaagatcactagg

SEQ ID NO: 565103 - DNA, 20 bp, Artificial Sequence
  chemically synthesized
agatcactaggatgagattt

SEQ ID NO: 565104 - DNA, 20 bp, Artificial Sequence
  chemically synthesized
ccatggacatattataattt

SEQ ID NO: 565105 - DNA, 20 bp, Artificial Sequence
  chemically synthesized
gacagaacatgacaatatta

SEQ ID NO: 565106 - DNA, 20 bp, Artificial Sequence
  chemically synthesized
acatgacaatattaattggc

SEQ ID NO: 565107 - DNA, 20 bp, Artificial Sequence
  chemically synthesized
ttcttaatctttaatgactg

SEQ ID NO: 565108 - DNA, 20 bp, Artificial Sequence
  chemically synthesized
gtgaaaaacatctcagtcat

SEQ ID NO: 565109 - DNA, 20 bp, Artificial Sequence
  chemically synthesized
gaattcttcttgtgttgaac

SEQ ID NO: 565110 - DNA, 20 bp, Artificial Sequence
  chemically synthesized
cagccactgccatttttgtc

SEQ ID NO: 565111 - DNA, 20 bp, Artificial Sequence
  chemically synthesized
tcatcagccaaaaggaaaaa

SEQ ID NO: 565112 - DNA, 20 bp, Artificial Sequence
  chemically synthesized
aaaggaaaaactaggattgg

SEQ ID NO: 565113 - DNA, 20 bp, Artificial Sequence
  chemically synthesized
acctctaaaacctctccaat

SEQ ID NO: 565114 - DNA, 20 bp, Artificial Sequence
  chemically synthesized
gaatactgccattgggaaaa

SEQ ID NO: 565115 - DNA, 20 bp, Artificial Sequence
  chemically synthesized
ttttgctgaccacagacaat

SEQ ID NO: 565116 - DNA, 20 bp, Artificial Sequence
  chemically synthesized
atgattcttctagagactgt

SEQ ID NO: 565117 - DNA, 20 bp, Artificial Sequence
  chemically synthesized
tctctagaagaatcataatt

SEQ ID NO: 565118 - DNA, 20 bp, Artificial Sequence
  chemically synthesized
gggacacacaaagcttaaaa

SEQ ID NO: 565119 - DNA, 20 bp, Artificial Sequence
  chemically synthesized
taattttaagctttgtgtgt

SEQ ID NO: 565120 - DNA, 20 bp, Artificial Sequence
  chemically synthesized
gggattgaagccgggacaca

SEQ ID NO: 565121 - DNA, 20 bp, Artificial Sequence
  chemically synthesized
gactaagtctaactacgcat

SEQ ID NO: 565122 - DNA, 20 bp, Artificial Sequence
  chemically synthesized
gaaaaaaaaaaaaaagattc

SEQ ID NO: 565123 - DNA, 20 bp, Artificial Sequence
  chemically synthesized
tcaaaaaaagaaaaaaaaaa

SEQ ID NO: 565124 - DNA, 20 bp, Artificial Sequence
  chemically synthesized
gaattcaaggttacagtgag

SEQ ID NO: 565125 - DNA, 20 bp, Artificial Sequence
  chemically synthesized
cacctcagcctgccaaagtg

SEQ ID NO: 565126 - DNA, 20 bp, Artificial Sequence
  chemically synthesized
caaatgtccatcaagtaatg

SEQ ID NO: 565127 - DNA, 20 bp, Artificial Sequence
  chemically synthesized
tataatatagataccatttt

SEQ ID NO: 565128 - DNA, 20 bp, Artificial Sequence
  chemically synthesized
acaatataaagtcttttgtg

SEQ ID NO: 565129 - DNA, 20 bp, Artificial Sequence
  chemically synthesized
tctactttctgtctctatgg

SEQ ID NO: 565130 - DNA, 20 bp, Artificial Sequence
  chemically synthesized
cctgatctactttctgtctc

SEQ ID NO: 565131 - DNA, 20 bp, Artificial Sequence
  chemically synthesized
catagagacagaaagtagat

SEQ ID NO: 565132 - DNA, 20 bp, Artificial Sequence
  chemically synthesized
atccccattttcaagtcact

SEQ ID NO: 565133 - DNA, 20 bp, Artificial Sequence
  chemically synthesized
ggagtgacttgaaaatgggg

SEQ ID NO: 565134 - DNA, 20 bp, Artificial Sequence
  chemically synthesized
acaactctgtaattaataac

SEQ ID NO: 565135 - DNA, 20 bp, Artificial Sequence
  chemically synthesized
cccatttacagtgtattagt

SEQ ID NO: 565136 - DNA, 20 bp, Artificial Sequence
  chemically synthesized
ggtcttataaaaaactaagt

SEQ ID NO: 565137 - DNA, 20 bp, Artificial Sequence
  chemically synthesized
ataaaattttgaatctagaa

SEQ ID NO: 565138 - DNA, 20 bp, Artificial Sequence
  chemically synthesized
gagaaagcattataagattt

SEQ ID NO: 565139 - DNA, 20 bp, Artificial Sequence
  chemically synthesized
gtgaaaacaataaaatctta

SEQ ID NO: 565140 - DNA, 20 bp, Artificial Sequence
  chemically synthesized
ccatagtaggagaaagcatt

SEQ ID NO: 565141 - DNA, 20 bp, Artificial Sequence
  chemically synthesized
ttctcctactatggaaaaat

SEQ ID NO: 565142 - DNA, 20 bp, Artificial Sequence
  chemically synthesized
ttttatgtacatgggttaaa

SEQ ID NO: 565143 - DNA, 20 bp, Artificial Sequence
  chemically synthesized
acattaaatattttcagatg

SEQ ID NO: 565144 - DNA, 20 bp, Artificial Sequence
  chemically synthesized
agtccaaaaataagcccaga

SEQ ID NO: 565145 - DNA, 20 bp, Artificial Sequence
  chemically synthesized
aacccagacttaagcatttt

SEQ ID NO: 565146 - DNA, 20 bp, Artificial Sequence
  chemically synthesized
gggttagcctaaacaacttg

SEQ ID NO: 565147 - DNA, 20 bp, Artificial Sequence
  chemically synthesized
cattagactgaaaccatcca

SEQ ID NO: 565148 - DNA, 20 bp, Artificial Sequence
  chemically synthesized
aaaatcccttaatatacctg

SEQ ID NO: 565149 - DNA, 20 bp, Artificial Sequence
  chemically synthesized
acaaactaaacaggtatatt

SEQ ID NO: 565150 - DNA, 20 bp, Artificial Sequence
  chemically synthesized
ttcccaaaatcccttaatat

SEQ ID NO: 565151 - DNA, 20 bp, Artificial Sequence
  chemically synthesized
ggttgattttcaggtatctc

SEQ ID NO: 565152 - DNA, 20 bp, Artificial Sequence
  chemically synthesized
gttacttgatgggtttttgg

SEQ ID NO: 565153 - DNA, 20 bp, Artificial Sequence
  chemically synthesized
tggagtttttctgttacttg

SEQ ID NO: 565154 - DNA, 20 bp, Artificial Sequence
  chemically synthesized
atgaatgggtaaatatcctt

SEQ ID NO: 565155 - DNA, 20 bp, Artificial Sequence
  chemically synthesized
tcacattctagagtgtggga

SEQ ID NO: 565156 - DNA, 20 bp, Artificial Sequence
  chemically synthesized
tctttttgccttcgagtaag

SEQ ID NO: 565157 - DNA, 20 bp, Artificial Sequence
  chemically synthesized
ccagtctttttgccttcgag

SEQ ID NO: 565158 - DNA, 20 bp, Artificial Sequence
  chemically synthesized
atttttagctttagcagtga

SEQ ID NO: 565159 - DNA, 20 bp, Artificial Sequence
  chemically synthesized
ctcactgctaaagctaaaaa

SEQ ID NO: 565160 - DNA, 20 bp, Artificial Sequence
  chemically synthesized
caaagataaaaatctgtatt

SEQ ID NO: 565161 - DNA, 20 bp, Artificial Sequence
  chemically synthesized
ttttatctttgaaattatcg

SEQ ID NO: 565162 - DNA, 20 bp, Artificial Sequence
  chemically synthesized
aaattacaggaaaagaatca

SEQ ID NO: 565163 - DNA, 20 bp, Artificial Sequence
  chemically synthesized
tacaagtcataagtaaatcc

SEQ ID NO: 565164 - DNA, 20 bp, Artificial Sequence
  chemically synthesized
atagtaaaaaaataaaatgg

SEQ ID NO: 565165 - DNA, 20 bp, Artificial Sequence
  chemically synthesized
tggtattacatatgtacatg

SEQ ID NO: 565166 - DNA, 20 bp, Artificial Sequence
  chemically synthesized
gcatgagcagcccagttaga

SEQ ID NO: 565167 - DNA, 20 bp, Artificial Sequence
  chemically synthesized
gaccaaggacctcctgatgt

SEQ ID NO: 565168 - DNA, 20 bp, Artificial Sequence
  chemically synthesized
ggacagagacctcctaggaa

SEQ ID NO: 565169 - DNA, 20 bp, Artificial Sequence
  chemically synthesized
aggaggtctctgtcctctcc

SEQ ID NO: 565170 - DNA, 20 bp, Artificial Sequence
  chemically synthesized
ctgaagccttagaagagaag

SEQ ID NO: 565171 - DNA, 20 bp, Artificial Sequence
  chemically synthesized
cttaatcaagacttctcttc

SEQ ID NO: 565172 - DNA, 20 bp, Artificial Sequence
  chemically synthesized
tggcttggtgcttagcaagt

SEQ ID NO: 565173 - DNA, 20 bp, Artificial Sequence
  chemically synthesized
ctcgtgtggcttggtgctta

SEQ ID NO: 565174 - DNA, 20 bp, Artificial Sequence
  chemically synthesized
tatatcaacctcgtgtggct

SEQ ID NO: 565175 - DNA, 20 bp, Artificial Sequence
  chemically synthesized
taatcagtatatcaacctcg

SEQ ID NO: 565176 - DNA, 20 bp, Artificial Sequence
  chemically synthesized
caagccacacgaggttgata

SEQ ID NO: 565177 - DNA, 20 bp, Artificial Sequence
  chemically synthesized
ctttcctggcactgaaattt

SEQ ID NO: 565178 - DNA, 20 bp, Artificial Sequence
  chemically synthesized
ggtatagctttcatctcaaa

SEQ ID NO: 565179 - DNA, 20 bp, Artificial Sequence
  chemically synthesized
tcttatgacagaaatgcagg

SEQ ID NO: 565180 - DNA, 20 bp, Artificial Sequence
  chemically synthesized
tgcttgaggcctctcctgga

SEQ ID NO: 565181 - DNA, 20 bp, Artificial Sequence
  chemically synthesized
agttgttgcttgaggcctct

SEQ ID NO: 565182 - DNA, 20 bp, Artificial Sequence
  chemically synthesized
agttagatgcaaaggccagt

SEQ ID NO: 565183 - DNA, 20 bp, Artificial Sequence
  chemically synthesized
tgcatctaactacttacaaa

SEQ ID NO: 565184 - DNA, 20 bp, Artificial Sequence
  chemically synthesized
tgtttaccaaagacagcacc

SEQ ID NO: 565185 - DNA, 20 bp, Artificial Sequence
  chemically synthesized
tgaaatgattgaactttgaa

SEQ ID NO: 565186 - DNA, 20 bp, Artificial Sequence
  chemically synthesized
atcgggagttctttcttgtg

SEQ ID NO: 565187 - DNA, 20 bp, Artificial Sequence
  chemically synthesized
cactggtggcaatttttctt

SEQ ID NO: 565188 - DNA, 20 bp, Artificial Sequence
  chemically synthesized
tagaatatcccaccgaataa

SEQ ID NO: 565189 - DNA, 20 bp, Artificial Sequence
  chemically synthesized
gagttaatttaatacctatc

SEQ ID NO: 565190 - DNA, 20 bp, Artificial Sequence
  chemically synthesized
gatttttcagactaaatcat

SEQ ID NO: 565191 - DNA, 20 bp, Artificial Sequence
  chemically synthesized
ccctgtagacccagaagcca

SEQ ID NO: 565192 - DNA, 20 bp, Artificial Sequence
  chemically synthesized
ggcttctgggtctacagggt

SEQ ID NO: 565193 - DNA, 20 bp, Artificial Sequence
  chemically synthesized
gttacttttgtgcgaaaaat

SEQ ID NO: 565194 - DNA, 20 bp, Artificial Sequence
  chemically synthesized
acaggtgcccacgtaggaag

SEQ ID NO: 565195 - DNA, 20 bp, Artificial Sequence
  chemically synthesized
cttcctacgtgggcacctgt

SEQ ID NO: 565196 - DNA, 20 bp, Artificial Sequence
  chemically synthesized
tgttcccagagacacaacgg

SEQ ID NO: 565197 - DNA, 20 bp, Artificial Sequence
  chemically synthesized
tcaactatgctatctcctag

SEQ ID NO: 565198 - DNA, 20 bp, Artificial Sequence
  chemically synthesized
ctatctcctagactggtttt

SEQ ID NO: 565199 - DNA, 20 bp, Artificial Sequence
  chemically synthesized
atgaggttagacaaagctaa

SEQ ID NO: 565200 - DNA, 20 bp, Artificial Sequence
  chemically synthesized
tttggaagtgaagaaacctg

SEQ ID NO: 565201 - DNA, 20 bp, Artificial Sequence
  chemically synthesized
aggagtttggaagtgaagaa

SEQ ID NO: 565202 - DNA, 20 bp, Artificial Sequence
  chemically synthesized
ttacgttagcatttgcactg

SEQ ID NO: 565203 - DNA, 20 bp, Artificial Sequence
  chemically synthesized
taatgatgactttccagtat

SEQ ID NO: 565204 - DNA, 20 bp, Artificial Sequence
  chemically synthesized
ctttccagtatgagtgcttt

SEQ ID NO: 565205 - DNA, 20 bp, Artificial Sequence
  chemically synthesized
actgagatactctgagaaaa

SEQ ID NO: 565206 - DNA, 20 bp, Artificial Sequence
  chemically synthesized
gagaactgtcaccctatctt

SEQ ID NO: 565207 - DNA, 20 bp, Artificial Sequence
  chemically synthesized
ctatctttggtgttttaatg

SEQ ID NO: 565208 - DNA, 20 bp, Artificial Sequence
  chemically synthesized
catggcctttgataattgtg

SEQ ID NO: 565209 - DNA, 20 bp, Artificial Sequence
  chemically synthesized
tcccaagggaaattatatgt

SEQ ID NO: 565210 - DNA, 20 bp, Artificial Sequence
  chemically synthesized
acagccacatataatttccc

SEQ ID NO: 565211 - DNA, 20 bp, Artificial Sequence
  chemically synthesized
cttaagcagcgttacacttg

SEQ ID NO: 565212 - DNA, 20 bp, Artificial Sequence
  chemically synthesized
aataatcacttcaagtgtaa

SEQ ID NO: 565213 - DNA, 20 bp, Artificial Sequence
  chemically synthesized
taagagttcaggaccaccac

SEQ ID NO: 565214 - DNA, 20 bp, Artificial Sequence
  chemically synthesized
atgaaagagaggctgtttcc

SEQ ID NO: 565215 - DNA, 20 bp, Artificial Sequence
  chemically synthesized
aaacaaccctatgaaagaga

SEQ ID NO: 565216 - DNA, 20 bp, Artificial Sequence
  chemically synthesized
aaacagcctctctttcatag

SEQ ID NO: 565217 - DNA, 20 bp, Artificial Sequence
  chemically synthesized
tctctttcatagggttgttt

SEQ ID NO: 565218 - DNA, 20 bp, Artificial Sequence
  chemically synthesized
aacaaaaatagctgtccttt

SEQ ID NO: 565219 - DNA, 20 bp, Artificial Sequence
  chemically synthesized
acgtagagccaggaaaacaa

SEQ ID NO: 565220 - DNA, 20 bp, Artificial Sequence
  chemically synthesized
gcagcatcctaaagaaacat

SEQ ID NO: 565221 - DNA, 20 bp, Artificial Sequence
  chemically synthesized
tgatgtttctttaggatgct

SEQ ID NO: 565222 - DNA, 20 bp, Artificial Sequence
  chemically synthesized
atattaagagacagacaaat

SEQ ID NO: 565223 - DNA, 20 bp, Artificial Sequence
  chemically synthesized
gccagggagataataggaaa

SEQ ID NO: 565224 - DNA, 20 bp, Artificial Sequence
  chemically synthesized
gactaagcttcagattcagt

SEQ ID NO: 565225 - DNA, 20 bp, Artificial Sequence
  chemically synthesized
agggaagctcaaactgaatc

SEQ ID NO: 565226 - DNA, 20 bp, Artificial Sequence
  chemically synthesized
tgatttgactaagcttcaga

SEQ ID NO: 565227 - DNA, 20 bp, Artificial Sequence
  chemically synthesized
catagttgatttgactaagc

SEQ ID NO: 565228 - DNA, 20 bp, Artificial Sequence
  chemically synthesized
gattagcatagttgatttga

SEQ ID NO: 565229 - DNA, 20 bp, Artificial Sequence
  chemically synthesized
aacatcatagggattagcat

SEQ ID NO: 565230 - DNA, 20 bp, Artificial Sequence
  chemically synthesized
taatagatcaatgaacatca

SEQ ID NO: 565231 - DNA, 20 bp, Artificial Sequence
  chemically synthesized
tttacgtattcagttttcag

SEQ ID NO: 565232 - DNA, 20 bp, Artificial Sequence
  chemically synthesized
tcctatgttgattttacgta

SEQ ID NO: 565233 - DNA, 20 bp, Artificial Sequence
  chemically synthesized
tttcaagtggaaatttccta

SEQ ID NO: 565234 - DNA, 20 bp, Artificial Sequence
  chemically synthesized
gcactaaccctttgcaaatc

SEQ ID NO: 565235 - DNA, 20 bp, Artificial Sequence
  chemically synthesized
ctagtgcacccaggaaaaac

SEQ ID NO: 565236 - DNA, 20 bp, Artificial Sequence
  chemically synthesized
agtttttcctgggtgcacta

SEQ ID NO: 565237 - DNA, 20 bp, Artificial Sequence
  chemically synthesized
tcctgggtgcactaggttgc

SEQ ID NO: 565238 - DNA, 20 bp, Artificial Sequence
  chemically synthesized
gggtgcactaggttgctttt

SEQ ID NO: 565239 - DNA, 20 bp, Artificial Sequence
  chemically synthesized
gggaggcatctggtgttacg

SEQ ID NO: 565240 - DNA, 20 bp, Artificial Sequence
  chemically synthesized
tcttttaatggactattcca

SEQ ID NO: 565241 - DNA, 20 bp, Artificial Sequence
  chemically synthesized
actgtgcttctaccaatctt

SEQ ID NO: 565242 - DNA, 20 bp, Artificial Sequence
  chemically synthesized
cttctaccaatcttcatggc

SEQ ID NO: 565243 - DNA, 20 bp, Artificial Sequence
  chemically synthesized
ctggcagaaagctaaagcca

SEQ ID NO: 565244 - DNA, 20 bp, Artificial Sequence
  chemically synthesized
tgatggctttttgacggggg

SEQ ID NO: 565245 - DNA, 20 bp, Artificial Sequence
  chemically synthesized
tcaaaaagccatcactgttc

SEQ ID NO: 565246 - DNA, 20 bp, Artificial Sequence
  chemically synthesized
cctataagcaggtgaacagt

SEQ ID NO: 565247 - DNA, 20 bp, Artificial Sequence
  chemically synthesized
tgtgcatcatactaaggagt

SEQ ID NO: 565248 - DNA, 20 bp, Artificial Sequence
  chemically synthesized
ggactttgtgcatcatacta

SEQ ID NO: 565249 - DNA, 20 bp, Artificial Sequence
  chemically synthesized
gtgggatggtaggtggggac

SEQ ID NO: 565250 - DNA, 20 bp, Artificial Sequence
  chemically synthesized
tggtggaccagtgagtaatg

SEQ ID NO: 565251 - DNA, 20 bp, Artificial Sequence
  chemically synthesized
gtctgagagatgggggaagg

SEQ ID NO: 565252 - DNA, 20 bp, Artificial Sequence
  chemically synthesized
ttaagagttgaagactgaat

SEQ ID NO: 565253 - DNA, 20 bp, Artificial Sequence
  chemically synthesized
agtagagaggcctttacaaa

SEQ ID NO: 565254 - DNA, 20 bp, Artificial Sequence
  chemically synthesized
tgctctgggggcacagaggt

SEQ ID NO: 565255 - DNA, 20 bp, Artificial Sequence
  chemically synthesized
tgtaacagtaggatataagt

SEQ ID NO: 565256 - DNA, 20 bp, Artificial Sequence
  chemically synthesized
agctccatgagggtaagaac

SEQ ID NO: 565257 - DNA, 20 bp, Artificial Sequence
  chemically synthesized
caattctgcagatagttact

SEQ ID NO: 565258 - DNA, 20 bp, Artificial Sequence
  chemically synthesized
cagtagaattgattatggtc

SEQ ID NO: 565259 - DNA, 20 bp, Artificial Sequence
  chemically synthesized
caattgtccctctacagtag

SEQ ID NO: 565260 - DNA, 20 bp, Artificial Sequence
  chemically synthesized
cttttttttttttttttttt

SEQ ID NO: 565261 - DNA, 20 bp, Artificial Sequence
  chemically synthesized
aaaaaaaaaaaaaaagggaa

SEQ ID NO: 565262 - DNA, 20 bp, Artificial Sequence
  chemically synthesized
ctccctagaacatgctggat

SEQ ID NO: 565263 - DNA, 20 bp, Artificial Sequence
  chemically synthesized
gaatattctaatcgccagag

SEQ ID NO: 565264 - DNA, 20 bp, Artificial Sequence
  chemically synthesized
aaaaaattgaagcacccctc

SEQ ID NO: 565265 - DNA, 20 bp, Artificial Sequence
  chemically synthesized
taaaattggatgtttgtgag

SEQ ID NO: 565266 - DNA, 20 bp, Artificial Sequence
  chemically synthesized
gaatcttggcatctaaaatt

SEQ ID NO: 565267 - DNA, 20 bp, Artificial Sequence
  chemically synthesized
caaacatccaattttagatg

SEQ ID NO: 565268 - DNA, 20 bp, Artificial Sequence
  chemically synthesized
tctaggctcaccagaacaca

SEQ ID NO: 565269 - DNA, 20 bp, Artificial Sequence
  chemically synthesized
agaacacaatttgattttta

SEQ ID NO: 565270 - DNA, 20 bp, Artificial Sequence
  chemically synthesized
tttattgtgattcctaagac

SEQ ID NO: 565271 - DNA, 20 bp, Artificial Sequence
  chemically synthesized
ttttttaggaggagacagca

SEQ ID NO: 565272 - DNA, 20 bp, Artificial Sequence
  chemically synthesized
cagatgctgtctcctcctaa

SEQ ID NO: 565273 - DNA, 20 bp, Artificial Sequence
  chemically synthesized
aaatgttatcaaggttgcct

SEQ ID NO: 565274 - DNA, 20 bp, Artificial Sequence
  chemically synthesized
gtgaatggataacccagaat

SEQ ID NO: 565275 - DNA, 20 bp, Artificial Sequence
  chemically synthesized
agttaattgaagtctgaggg

SEQ ID NO: 565276 - DNA, 20 bp, Artificial Sequence
  chemically synthesized
gccagtgtaactaaatttcc

SEQ ID NO: 565277 - DNA, 20 bp, Artificial Sequence
  chemically synthesized
gaatcaccattattcacaga

SEQ ID NO: 565278 - DNA, 20 bp, Artificial Sequence
  chemically synthesized
gaaactgagtctgtgaataa

SEQ ID NO: 565279 - DNA, 20 bp, Artificial Sequence
  chemically synthesized
gatggttgaccccattctta

SEQ ID NO: 565280 - DNA, 20 bp, Artificial Sequence
  chemically synthesized
tcatccttgccataaaaggt

SEQ ID NO: 565281 - DNA, 20 bp, Artificial Sequence
  chemically synthesized
tgccataaaaggtcttggct

SEQ ID NO: 565282 - DNA, 20 bp, Artificial Sequence
  chemically synthesized
cccttcttgagacaaaggga

SEQ ID NO: 565283 - DNA, 20 bp, Artificial Sequence
  chemically synthesized
tcaagaagggctctgtagcc

SEQ ID NO: 565284 - DNA, 20 bp, Artificial Sequence
  chemically synthesized
gggcccatgtcaccaaatga

SEQ ID NO: 565285 - DNA, 20 bp, Artificial Sequence
  chemically synthesized
tatgagagctataattcaag

SEQ ID NO: 565286 - DNA, 20 bp, Artificial Sequence
  chemically synthesized
tgggttcctcccatgatatg

SEQ ID NO: 565287 - DNA, 20 bp, Artificial Sequence
  chemically synthesized
aggtaactgaatcatggggg

SEQ ID NO: 565288 - DNA, 20 bp, Artificial Sequence
  chemically synthesized
agcatgggaaaaccccaccc

SEQ ID NO: 565289 - DNA, 20 bp, Artificial Sequence
  chemically synthesized
atgggggtggggttttccca

SEQ ID NO: 565290 - DNA, 20 bp, Artificial Sequence
  chemically synthesized
tagtaactctcatgagatct

SEQ ID NO: 565291 - DNA, 20 bp, Artificial Sequence
  chemically synthesized
tcctcctccttcaccttctg

SEQ ID NO: 565292 - DNA, 20 bp, Artificial Sequence
  chemically synthesized
ggggcaatttacaaagaaaa

SEQ ID NO: 565293 - DNA, 20 bp, Artificial Sequence
  chemically synthesized
tacaccaagtaacttgaatg

SEQ ID NO: 565294 - DNA, 20 bp, Artificial Sequence
  chemically synthesized
ttcgttaaatgtatcatata

SEQ ID NO: 565295 - DNA, 20 bp, Artificial Sequence
  chemically synthesized
tgattcctacggctgttccc

SEQ ID NO: 565296 - DNA, 20 bp, Artificial Sequence
  chemically synthesized
catcactggaaataattcaa

SEQ ID NO: 565297 - DNA, 20 bp, Artificial Sequence
  chemically synthesized
acattttaacattcattcca

SEQ ID NO: 565298 - DNA, 20 bp, Artificial Sequence
  chemically synthesized
gtgccagaagaagaggaggg

SEQ ID NO: 565299 - DNA, 20 bp, Artificial Sequence
  chemically synthesized
tttctccagcatgtgaaaat

SEQ ID NO: 565300 - DNA, 20 bp, Artificial Sequence
  chemically synthesized
cagtgtcgtgcagtgttcac

SEQ ID NO: 565301 - DNA, 20 bp, Artificial Sequence
  chemically synthesized
agtaaccccaacaaccataa

SEQ ID NO: 565302 - DNA, 20 bp, Artificial Sequence
  chemically synthesized
aatatttgcatatgtagaga

SEQ ID NO: 565303 - DNA, 20 bp, Artificial Sequence
  chemically synthesized
ctgccatctttcttggtttc

SEQ ID NO: 565304 - DNA, 20 bp, Artificial Sequence
  chemically synthesized
ctctggaggctgccatcttt

SEQ ID NO: 565305 - DNA, 20 bp, Artificial Sequence
  chemically synthesized
ccaaccttctcccctggctg

SEQ ID NO: 565306 - DNA, 20 bp, Artificial Sequence
  chemically synthesized
agccaggggagaaggttgga

SEQ ID NO: 565307 - DNA, 20 bp, Artificial Sequence
  chemically synthesized
ctatatgtctttttgaaccc

SEQ ID NO: 565308 - DNA, 20 bp, Artificial Sequence
  chemically synthesized
gcatgtagcagaaggagaac

SEQ ID NO: 565309 - DNA, 20 bp, Artificial Sequence
  chemically synthesized
gggatatataaattcattct

SEQ ID NO: 565310 - DNA, 20 bp, Artificial Sequence
  chemically synthesized
cgactcacagtcctaatatc

SEQ ID NO: 565311 - DNA, 20 bp, Artificial Sequence
  chemically synthesized
cagtctgagagatagaactc

SEQ ID NO: 565312 - DNA, 20 bp, Artificial Sequence
  chemically synthesized
aggtccatcctttaatgcag

SEQ ID NO: 565313 - DNA, 20 bp, Artificial Sequence
  chemically synthesized
gctgcaaataactactatca

SEQ ID NO: 565314 - DNA, 20 bp, Artificial Sequence
  chemically synthesized
tgtgggactagggtatgaag

SEQ ID NO: 565315 - DNA, 20 bp, Artificial Sequence
  chemically synthesized
tttcgggggaggatagagct

SEQ ID NO: 565316 - DNA, 20 bp, Artificial Sequence
  chemically synthesized
gatatttcgggggaggatag

SEQ ID NO: 565317 - DNA, 20 bp, Artificial Sequence
  chemically synthesized
cacatgggagcccaggaaag

SEQ ID NO: 565318 - DNA, 20 bp, Artificial Sequence
  chemically synthesized
tgggctcccatgtgactccc

SEQ ID NO: 565319 - DNA, 20 bp, Artificial Sequence
  chemically synthesized
ctcccatgtgactcccccca

SEQ ID NO: 565320 - DNA, 20 bp, Artificial Sequence
  chemically synthesized
cttaaaaaaggtaatacaac

SEQ ID NO: 565321 - DNA, 20 bp, Artificial Sequence
  chemically synthesized
tcagggtgaggaatggcaga

SEQ ID NO: 565322 - DNA, 20 bp, Artificial Sequence
  chemically synthesized
ggtgtcagggtgaggaatgg

SEQ ID NO: 565323 - DNA, 20 bp, Artificial Sequence
  chemically synthesized
gccattcctcaccctgacac

SEQ ID NO: 565324 - DNA, 20 bp, Artificial Sequence
  chemically synthesized
gaatgcccattcctaacctc

SEQ ID NO: 565325 - DNA, 20 bp, Artificial Sequence
  chemically synthesized
cctaatgaaagaacattgaa

SEQ ID NO: 565326 - DNA, 20 bp, Artificial Sequence
  chemically synthesized
ataaagatttcccgtagcta

SEQ ID NO: 565327 - DNA, 20 bp, Artificial Sequence
  chemically synthesized
tacaaagtaaagcaacggga

SEQ ID NO: 565328 - DNA, 20 bp, Artificial Sequence
  chemically synthesized
gtagctggaaatcatgatcc

SEQ ID NO: 565329 - DNA, 20 bp, Artificial Sequence
  chemically synthesized
taaattcctccagtgattgt

SEQ ID NO: 565330 - DNA, 20 bp, Artificial Sequence
  chemically synthesized
ctttttcctttaaattcctc

SEQ ID NO: 565331 - DNA, 20 bp, Artificial Sequence
  chemically synthesized
gaaaaagagaaaactcaaat

SEQ ID NO: 565332 - DNA, 20 bp, Artificial Sequence
  chemically synthesized
agaccttatgaagccaaaat

SEQ ID NO: 565333 - DNA, 20 bp, Artificial Sequence
  chemically synthesized
tatataacacgagggaactc

SEQ ID NO: 565334 - DNA, 20 bp, Artificial Sequence
  chemically synthesized
actacctgcagagcaaattg

SEQ ID NO: 565335 - DNA, 20 bp, Artificial Sequence
  chemically synthesized
gttctactacctgcagagca

SEQ ID NO: 565336 - DNA, 20 bp, Artificial Sequence
  chemically synthesized
ccttgaatttcagagcaagt

SEQ ID NO: 565337 - DNA, 20 bp, Artificial Sequence
  chemically synthesized
catctctgtatttgaacact

SEQ ID NO: 565338 - DNA, 20 bp, Artificial Sequence
  chemically synthesized
caggcttaagtcaggagact

SEQ ID NO: 565339 - DNA, 20 bp, Artificial Sequence
  chemically synthesized
aggtttacttttttttcttg

SEQ ID NO: 565340 - DNA, 20 bp, Artificial Sequence
  chemically synthesized
tgtccttagcattgcagact

SEQ ID NO: 565341 - DNA, 20 bp, Artificial Sequence
  chemically synthesized
tggcaaagagccactggatc

SEQ ID NO: 565342 - DNA, 20 bp, Artificial Sequence
  chemically synthesized
atgatgcagaagcgaaatat

SEQ ID NO: 565343 - DNA, 20 bp, Artificial Sequence
  chemically synthesized
gagatatctaatctttaata

SEQ ID NO: 565344 - DNA, 20 bp, Artificial Sequence
  chemically synthesized
tttttcccatagtgcctccc

SEQ ID NO: 565345 - DNA, 20 bp, Artificial Sequence
  chemically synthesized
ggcactatgggaaaaactca

SEQ ID NO: 565346 - DNA, 20 bp, Artificial Sequence
  chemically synthesized
atgggaaaaactcagtcaga

SEQ ID NO: 565347 - DNA, 20 bp, Artificial Sequence
  chemically synthesized
tgagtaaaagctaaatctga

SEQ ID NO: 565348 - DNA, 20 bp, Artificial Sequence
  chemically synthesized
agtcagatttagcttttact

SEQ ID NO: 565349 - DNA, 20 bp, Artificial Sequence
  chemically synthesized
atgtatcccacattggtgtt

SEQ ID NO: 565350 - DNA, 20 bp, Artificial Sequence
  chemically synthesized
atgtgggatacatacagtgc

SEQ ID NO: 565351 - DNA, 20 bp, Artificial Sequence
  chemically synthesized
ataaatttagaatgttaaga

SEQ ID NO: 565352 - DNA, 20 bp, Artificial Sequence
  chemically synthesized
ctgccttgattagcaccagg

SEQ ID NO: 565353 - DNA, 20 bp, Artificial Sequence
  chemically synthesized
ccatgcctggtgctaatcaa

SEQ ID NO: 565354 - DNA, 20 bp, Artificial Sequence
  chemically synthesized
ttctcccctttttcaaactg

SEQ ID NO: 565355 - DNA, 20 bp, Artificial Sequence
  chemically synthesized
tttcaaagactttgttttct

SEQ ID NO: 565356 - DNA, 20 bp, Artificial Sequence
  chemically synthesized
agcctttcaaagactttgtt

SEQ ID NO: 565357 - DNA, 20 bp, Artificial Sequence
  chemically synthesized
agcagaaaacaaagtctttg

SEQ ID NO: 565358 - DNA, 20 bp, Artificial Sequence
  chemically synthesized
agagaaaagcctttcaaaga

SEQ ID NO: 565359 - DNA, 20 bp, Artificial Sequence
  chemically synthesized
aaaggcttttctctacgaaa

SEQ ID NO: 565360 - DNA, 20 bp, Artificial Sequence
  chemically synthesized
tatgctacaattaaaataaa

SEQ ID NO: 565361 - DNA, 20 bp, Artificial Sequence
  chemically synthesized
acacttctcaaacagccatc

SEQ ID NO: 565362 - DNA, 20 bp, Artificial Sequence
  chemically synthesized
cccctagaaaaacagaggat

SEQ ID NO: 565363 - DNA, 20 bp, Artificial Sequence
  chemically synthesized
tatattttatgttcctttag

SEQ ID NO: 565364 - DNA, 20 bp, Artificial Sequence
  chemically synthesized
ataagaaagtatatttaaaa

SEQ ID NO: 565365 - DNA, 20 bp, Artificial Sequence
  chemically synthesized
ctaaaagtatgctcgtattt

SEQ ID NO: 565366 - DNA, 20 bp, Artificial Sequence
  chemically synthesized
agagggcatctaaagaattc

SEQ ID NO: 565367 - DNA, 20 bp, Artificial Sequence
  chemically synthesized
ttcgctacccttgaattcag

SEQ ID NO: 565368 - DNA, 20 bp, Artificial Sequence
  chemically synthesized
tgcgcaaggagcttcagagc

SEQ ID NO: 565369 - DNA, 20 bp, Artificial Sequence
  chemically synthesized
tcttcttgcagttctgcgca

SEQ ID NO: 565370 - DNA, 20 bp, Artificial Sequence
  chemically synthesized
cagatcaaagaaaacacacg

SEQ ID NO: 565371 - DNA, 20 bp, Artificial Sequence
  chemically synthesized
tcccttcctgaaaacagccc

SEQ ID NO: 565372 - DNA, 20 bp, Artificial Sequence
  chemically synthesized
accttcacgaaatgatcagg

SEQ ID NO: 565373 - DNA, 20 bp, Artificial Sequence
  chemically synthesized
gaaggtcaaggtaacttaca

SEQ ID NO: 565374 - DNA, 20 bp, Artificial Sequence
  chemically synthesized
agctctaagtaggcctggtg

SEQ ID NO: 565375 - DNA, 20 bp, Artificial Sequence
  chemically synthesized
agaccattctccaagaatgg

SEQ ID NO: 565376 - DNA, 20 bp, Artificial Sequence
  chemically synthesized
tctacttgtggcacagcgat

SEQ ID NO: 565377 - DNA, 20 bp, Artificial Sequence
  chemically synthesized
gctgtgccacaagtagatga

SEQ ID NO: 565378 - DNA, 20 bp, Artificial Sequence
  chemically synthesized
cctatttagagtcagaaaaa

SEQ ID NO: 565379 - DNA, 20 bp, Artificial Sequence
  chemically synthesized
gtggtagaactgaattgaaa

SEQ ID NO: 565380 - DNA, 20 bp, Artificial Sequence
  chemically synthesized
tagaggttcacacagcttgc

SEQ ID NO: 565381 - DNA, 20 bp, Artificial Sequence
  chemically synthesized
cacaggttcttagaggttca

SEQ ID NO: 565382 - DNA, 20 bp, Artificial Sequence
  chemically synthesized
aggcgacagtctcttctcca

SEQ ID NO: 565383 - DNA, 20 bp, Artificial Sequence
  chemically synthesized
tcttctccatagcgtttgta

SEQ ID NO: 565384 - DNA, 20 bp, Artificial Sequence
  chemically synthesized
accattgcacccgggtcaaa

SEQ ID NO: 565385 - DNA, 20 bp, Artificial Sequence
  chemically synthesized
ctcattggtcaagagccctg

SEQ ID NO: 565386 - DNA, 20 bp, Artificial Sequence
  chemically synthesized
gtgtcagttccaacttttta

SEQ ID NO: 565387 - DNA, 20 bp, Artificial Sequence
  chemically synthesized
actttgacccctacaataat

SEQ ID NO: 565388 - DNA, 20 bp, Artificial Sequence
  chemically synthesized
gatttaacataaatggatat

SEQ ID NO: 565389 - DNA, 20 bp, Artificial Sequence
  chemically synthesized
gattattctcaataaagtag

SEQ ID NO: 565390 - DNA, 20 bp, Artificial Sequence
  chemically synthesized
actttttttgttgttttaat

SEQ ID NO: 565391 - DNA, 20 bp, Artificial Sequence
  chemically synthesized
agataatattgaactttttt

SEQ ID NO: 565392 - DNA, 20 bp, Artificial Sequence
  chemically synthesized
gtgatgttcttgctgtattt

SEQ ID NO: 565393 - DNA, 20 bp, Artificial Sequence
  chemically synthesized
atatttaatggctactcagg

SEQ ID NO: 565394 - DNA, 20 bp, Artificial Sequence
  chemically synthesized
atatcctccagagtacttag

SEQ ID NO: 565395 - DNA, 20 bp, Artificial Sequence
  chemically synthesized
aagtactctggaggatatga

SEQ ID NO: 565396 - DNA, 20 bp, Artificial Sequence
  chemically synthesized
cctttctcagaaaattcctt

SEQ ID NO: 565397 - DNA, 20 bp, Artificial Sequence
  chemically synthesized
ctctgggaatagaggcaaaa

SEQ ID NO: 565398 - DNA, 20 bp, Artificial Sequence
  chemically synthesized
agcagtgtgatggaggatag

SEQ ID NO: 565399 - DNA, 20 bp, Artificial Sequence
  chemically synthesized
gttagcagttaggctgagac

SEQ ID NO: 565400 - DNA, 20 bp, Artificial Sequence
  chemically synthesized
agttaggctgagactcaagc

SEQ ID NO: 565401 - DNA, 20 bp, Artificial Sequence
  chemically synthesized
atctacctttggggtcaagc

SEQ ID NO: 565402 - DNA, 20 bp, Artificial Sequence
  chemically synthesized
ccttccacaatattctcttg

SEQ ID NO: 565403 - DNA, 20 bp, Artificial Sequence
  chemically synthesized
aagtcaagagaatattgtgg

SEQ ID NO: 565404 - DNA, 20 bp, Artificial Sequence
  chemically synthesized
agggtttgaacgccccacta

SEQ ID NO: 565405 - DNA, 20 bp, Artificial Sequence
  chemically synthesized
tttgaacgccccactaagaa

SEQ ID NO: 565406 - DNA, 20 bp, Artificial Sequence
  chemically synthesized
tttctgcatgtagaaaaaaa

SEQ ID NO: 565407 - DNA, 20 bp, Artificial Sequence
  chemically synthesized
catcatggcattcccctttc

SEQ ID NO: 565408 - DNA, 20 bp, Artificial Sequence
  chemically synthesized
tgtacaagtagagtcagtat

SEQ ID NO: 565409 - DNA, 20 bp, Artificial Sequence
  chemically synthesized
tggccatagctccttatctg

SEQ ID NO: 565410 - DNA, 20 bp, Artificial Sequence
  chemically synthesized
gcaggaagcaatggaagagt

SEQ ID NO: 565411 - DNA, 20 bp, Artificial Sequence
  chemically synthesized
aaaacaaactgccactcttc

SEQ ID NO: 565412 - DNA, 20 bp, Artificial Sequence
  chemically synthesized
gaagcaatggaagagtggca

SEQ ID NO: 565413 - DNA, 20 bp, Artificial Sequence
  chemically synthesized
cacactgcgttgcctacgtt

SEQ ID NO: 565414 - DNA, 20 bp, Artificial Sequence
  chemically synthesized
aggatttaaagtagatgttg

SEQ ID NO: 565415 - DNA, 20 bp, Artificial Sequence
  chemically synthesized
gagcaacatctactttaaat

SEQ ID NO: 565416 - DNA, 20 bp, Artificial Sequence
  chemically synthesized
ttcagacagatgccaccaag

SEQ ID NO: 565417 - DNA, 20 bp, Artificial Sequence
  chemically synthesized
atttattatgtcacaggtcc

SEQ ID NO: 565418 - DNA, 20 bp, Artificial Sequence
  chemically synthesized
gtaatacagaactgaaagtc

SEQ ID NO: 565419 - DNA, 20 bp, Artificial Sequence
  chemically synthesized
ctgacacaatacagtacccc

SEQ ID NO: 565420 - DNA, 20 bp, Artificial Sequence
  chemically synthesized
atgaaaaataagatgaaaca

SEQ ID NO: 565421 - DNA, 20 bp, Artificial Sequence
  chemically synthesized
cttggtcatattgggaaacc

SEQ ID NO: 565422 - DNA, 20 bp, Artificial Sequence
  chemically synthesized
acatttaagaaagtagggtt

SEQ ID NO: 565423 - DNA, 20 bp, Artificial Sequence
  chemically synthesized
gccaataaccctactttctt

SEQ ID NO: 565424 - DNA, 20 bp, Artificial Sequence
  chemically synthesized
gattatatgattttttttac

SEQ ID NO: 565425 - DNA, 20 bp, Artificial Sequence
  chemically synthesized
ggttatttaattttatgatt

SEQ ID NO: 565426 - DNA, 20 bp, Artificial Sequence
  chemically synthesized
aaaaagtaggttatttaatt

SEQ ID NO: 565427 - DNA, 20 bp, Artificial Sequence
  chemically synthesized
tgttgcatgtgtctccaagg

SEQ ID NO: 565428 - DNA, 20 bp, Artificial Sequence
  chemically synthesized
tgacttgttgcatgtgtctc

SEQ ID NO: 565429 - DNA, 20 bp, Artificial Sequence
  chemically synthesized
ataatctgtttagctccatt

SEQ ID NO: 565430 - DNA, 20 bp, Artificial Sequence
  chemically synthesized
agaatctgcaaatggagcta

SEQ ID NO: 565431 - DNA, 20 bp, Artificial Sequence
  chemically synthesized
tctaattgttttctaaaata

SEQ ID NO: 565432 - DNA, 20 bp, Artificial Sequence
  chemically synthesized
cttagagtcattttatgtct

SEQ ID NO: 565433 - DNA, 20 bp, Artificial Sequence
  chemically synthesized
agacataaaatgactctaag

SEQ ID NO: 565434 - DNA, 20 bp, Artificial Sequence
  chemically synthesized
gaaaacaggtgagttttctt

SEQ ID NO: 565435 - DNA, 20 bp, Artificial Sequence
  chemically synthesized
caaagctagaaagaaaactc

SEQ ID NO: 565436 - DNA, 20 bp, Artificial Sequence
  chemically synthesized
gatcttgaggaagaaaacag

SEQ ID NO: 565437 - DNA, 20 bp, Artificial Sequence
  chemically synthesized
gttttcttcctcaagatctg

SEQ ID NO: 565438 - DNA, 20 bp, Artificial Sequence
  chemically synthesized
gcctcgtagtcctgcccaga

SEQ ID NO: 565439 - DNA, 20 bp, Artificial Sequence
  chemically synthesized
tgttaatccagcattactgc

SEQ ID NO: 565440 - DNA, 20 bp, Artificial Sequence
  chemically synthesized
gttcaaactttggcagtaat

SEQ ID NO: 565441 - DNA, 20 bp, Artificial Sequence
  chemically synthesized
catctctggaaaataaaatc

SEQ ID NO: 565442 - DNA, 20 bp, Artificial Sequence
  chemically synthesized
tggaaaataaaatcaaaggt

SEQ ID NO: 565443 - DNA, 20 bp, Artificial Sequence
  chemically synthesized
gggggggaaaaaaccaaaac

SEQ ID NO: 565444 - DNA, 20 bp, Artificial Sequence
  chemically synthesized
ttggttttttccccccctta

SEQ ID NO: 565445 - DNA, 20 bp, Artificial Sequence
  chemically synthesized
attaattgttaagagcaaat

SEQ ID NO: 565446 - DNA, 20 bp, Artificial Sequence
  chemically synthesized
acaattaattagaccttttt

SEQ ID NO: 565447 - DNA, 20 bp, Artificial Sequence
  chemically synthesized
attctactggtaccaattca

SEQ ID NO: 565448 - DNA, 20 bp, Artificial Sequence
  chemically synthesized
caattcaaagtgttttcttg

SEQ ID NO: 565449 - DNA, 20 bp, Artificial Sequence
  chemically synthesized
ttgctcagattttcaaatga

SEQ ID NO: 565450 - DNA, 20 bp, Artificial Sequence
  chemically synthesized
aagatataataatggctgta

SEQ ID NO: 565451 - DNA, 20 bp, Artificial Sequence
  chemically synthesized
ttagtgaacagattatcttg

SEQ ID NO: 565452 - DNA, 20 bp, Artificial Sequence
  chemically synthesized
aacaatagcgtgggttagtg

SEQ ID NO: 565453 - DNA, 20 bp, Artificial Sequence
  chemically synthesized
aaggcaatgtaaccaaaaag

SEQ ID NO: 565454 - DNA, 20 bp, Artificial Sequence
  chemically synthesized
aaaaagtattgcttcagtaa

SEQ ID NO: 565455 - DNA, 20 bp, Artificial Sequence
  chemically synthesized
acaacaattaaactggagat

SEQ ID NO: 565456 - DNA, 20 bp, Artificial Sequence
  chemically synthesized
caattaaactggagatacat

SEQ ID NO: 565457 - DNA, 20 bp, Artificial Sequence
  chemically synthesized
gaatgaaacaatcatgtatc

SEQ ID NO: 565458 - DNA, 20 bp, Artificial Sequence
  chemically synthesized
acatgattgtttcattcagt

SEQ ID NO: 565459 - DNA, 20 bp, Artificial Sequence
  chemically synthesized
gggaaaaaagacattaaggt

SEQ ID NO: 565460 - DNA, 20 bp, Artificial Sequence
  chemically synthesized
gaacatctcattcctcgggg

SEQ ID NO: 565461 - DNA, 20 bp, Artificial Sequence
  chemically synthesized
ggggcagagtttttttaaat

SEQ ID NO: 565462 - DNA, 20 bp, Artificial Sequence
  chemically synthesized
ttatttttaaatttatacat

SEQ ID NO: 565463 - DNA, 20 bp, Artificial Sequence
  chemically synthesized
cctttttgcctccttttccc

SEQ ID NO: 565464 - DNA, 20 bp, Artificial Sequence
  chemically synthesized
cttgcgggaaaaggaggcaa

SEQ ID NO: 565465 - DNA, 20 bp, Artificial Sequence
  chemically synthesized
agagagttcctagtttccag

SEQ ID NO: 565466 - DNA, 20 bp, Artificial Sequence
  chemically synthesized
gtcctgtgtattagagagtt

SEQ ID NO: 565467 - DNA, 20 bp, Artificial Sequence
  chemically synthesized
ttggagcaatgcattcagaa

SEQ ID NO: 565468 - DNA, 20 bp, Artificial Sequence
  chemically synthesized
ttgctccaagctccggaaag

SEQ ID NO: 565469 - DNA, 20 bp, Artificial Sequence
  chemically synthesized
tggaggtaaacaggcctttc

SEQ ID NO: 565470 - DNA, 20 bp, Artificial Sequence
  chemically synthesized
cgtaatgacaggctaaagct

SEQ ID NO: 565471 - DNA, 20 bp, Artificial Sequence
  chemically synthesized
atgatatctaaccagaaaca

SEQ ID NO: 565472 - DNA, 20 bp, Artificial Sequence
  chemically synthesized
gtccttctcatttgaattat

SEQ ID NO: 565473 - DNA, 20 bp, Artificial Sequence
  chemically synthesized
tttgtttatcaagccagtta

SEQ ID NO: 565474 - DNA, 20 bp, Artificial Sequence
  chemically synthesized
tttcacatctaaaccaggta

SEQ ID NO: 565475 - DNA, 20 bp, Artificial Sequence
  chemically synthesized
atacccaataattattttta

SEQ ID NO: 565476 - DNA, 20 bp, Artificial Sequence
  chemically synthesized
ttggttgacttcacttaaat

SEQ ID NO: 565477 - DNA, 20 bp, Artificial Sequence
  chemically synthesized
caggtttggggaagtggttt

SEQ ID NO: 565478 - DNA, 20 bp, Artificial Sequence
  chemically synthesized
tttaggggcaggtttgggga

SEQ ID NO: 565479 - DNA, 20 bp, Artificial Sequence
  chemically synthesized
aaactcatggcattttaggg

SEQ ID NO: 565480 - DNA, 20 bp, Artificial Sequence
  chemically synthesized
aaacctgcccctaaaatgcc

SEQ ID NO: 565481 - DNA, 20 bp, Artificial Sequence
  chemically synthesized
gccatccaacattgagtcaa

SEQ ID NO: 565482 - DNA, 20 bp, Artificial Sequence
  chemically synthesized
tttatgtcctcagaataagc

SEQ ID NO: 565483 - DNA, 20 bp, Artificial Sequence
  chemically synthesized
tgttttattttaaaataagc

SEQ ID NO: 565484 - DNA, 20 bp, Artificial Sequence
  chemically synthesized
tgcttttgttttattttaaa

SEQ ID NO: 565485 - DNA, 20 bp, Artificial Sequence
  chemically synthesized
ttattttaaaataaaacaaa

SEQ ID NO: 565486 - DNA, 20 bp, Artificial Sequence
  chemically synthesized
aaattaggtggtaaaactgc

SEQ ID NO: 565487 - DNA, 20 bp, Artificial Sequence
  chemically synthesized
tgtgataaattaggtggtaa

SEQ ID NO: 565488 - DNA, 20 bp, Artificial Sequence
  chemically synthesized
agttgtactgctagaacttc

SEQ ID NO: 565489 - DNA, 20 bp, Artificial Sequence
  chemically synthesized
tcgaattaatctgaatgtgc

SEQ ID NO: 565490 - DNA, 20 bp, Artificial Sequence
  chemically synthesized
gtattagaagctctagcaca

SEQ ID NO: 565491 - DNA, 20 bp, Artificial Sequence
  chemically synthesized
tagcttgtgcttctttggct

SEQ ID NO: 565492 - DNA, 20 bp, Artificial Sequence
  chemically synthesized
atcagccaaatgtaaatagc

SEQ ID NO: 565493 - DNA, 20 bp, Artificial Sequence
  chemically synthesized
agcacaagctatttacattt

SEQ ID NO: 565494 - DNA, 20 bp, Artificial Sequence
  chemically synthesized
caaagaatcagccaaatgta

SEQ ID NO: 565495 - DNA, 20 bp, Artificial Sequence
  chemically synthesized
catcacagttatggttgggg

SEQ ID NO: 565496 - DNA, 20 bp, Artificial Sequence
  chemically synthesized
ttatggttggggaaaggctt

SEQ ID NO: 565497 - DNA, 20 bp, Artificial Sequence
  chemically synthesized
ggttggggaaaggctttttt

SEQ ID NO: 565498 - DNA, 20 bp, Artificial Sequence
  chemically synthesized
ggggaaaggcttttttgttt

SEQ ID NO: 565499 - DNA, 20 bp, Artificial Sequence
  chemically synthesized
atacaaatgactgagggttg

SEQ ID NO: 565500 - DNA, 20 bp, Artificial Sequence
  chemically synthesized
ggttgacttgattctttatt

SEQ ID NO: 565501 - DNA, 20 bp, Artificial Sequence
  chemically synthesized
tgattctttattattagctt

SEQ ID NO: 565502 - DNA, 20 bp, Artificial Sequence
  chemically synthesized
cttgatcgtttatgtaccag

SEQ ID NO: 565503 - DNA, 20 bp, Artificial Sequence
  chemically synthesized
agatgagaaaagaaccttca

SEQ ID NO: 565504 - DNA, 20 bp, Artificial Sequence
  chemically synthesized
tcaaagtattacgatgcctt

SEQ ID NO: 565505 - DNA, 20 bp, Artificial Sequence
  chemically synthesized
aaaggcatcgtaatactttg

SEQ ID NO: 565506 - DNA, 20 bp, Artificial Sequence
  chemically synthesized
agcaaatatgaaggaaaaaa

SEQ ID NO: 565507 - DNA, 20 bp, Artificial Sequence
  chemically synthesized
atccttattttttccttcat

SEQ ID NO: 565508 - DNA, 20 bp, Artificial Sequence
  chemically synthesized
tgaaccaagtaaatgctgac

SEQ ID NO: 565509 - DNA, 20 bp, Artificial Sequence
  chemically synthesized
tgccctcactctataatgaa

SEQ ID NO: 565510 - DNA, 20 bp, Artificial Sequence
  chemically synthesized
aacacagctatggcagggaa

SEQ ID NO: 565511 - DNA, 20 bp, Artificial Sequence
  chemically synthesized
caccgctctatctccgtcct

SEQ ID NO: 565512 - DNA, 20 bp, Artificial Sequence
  chemically synthesized
cgtccttaaagtttaacagg

SEQ ID NO: 565513 - DNA, 20 bp, Artificial Sequence
  chemically synthesized
ttctcctctggaaactcttc

SEQ ID NO: 565514 - DNA, 20 bp, Artificial Sequence
  chemically synthesized
taaagtgaggcaatcttatg

SEQ ID NO: 565515 - DNA, 20 bp, Artificial Sequence
  chemically synthesized
aaatccaaagaagtagattt

SEQ ID NO: 565516 - DNA, 20 bp, Artificial Sequence
  chemically synthesized
aaatcacaaaaatctacttc

SEQ ID NO: 565517 - DNA, 20 bp, Artificial Sequence
  chemically synthesized
ttccttcagaaatccaaaga

SEQ ID NO: 565518 - DNA, 20 bp, Artificial Sequence
  chemically synthesized
atagccatgctataccaaga

SEQ ID NO: 565519 - DNA, 20 bp, Artificial Sequence
  chemically synthesized
cctatccctttaaatatctg

SEQ ID NO: 565520 - DNA, 20 bp, Artificial Sequence
  chemically synthesized
aaatatctggcaggtttggt

SEQ ID NO: 565521 - DNA, 20 bp, Artificial Sequence
  chemically synthesized
agagtcccaagtatttatag

SEQ ID NO: 565522 - DNA, 20 bp, Artificial Sequence
  chemically synthesized
atttgaacttatttcatacc

SEQ ID NO: 565523 - DNA, 20 bp, Artificial Sequence
  chemically synthesized
ttagtattcagagtagcaaa

SEQ ID NO: 565524 - DNA, 20 bp, Artificial Sequence
  chemically synthesized
cctgacaatgaaattgcttt

SEQ ID NO: 565525 - DNA, 20 bp, Artificial Sequence
  chemically synthesized
caaaatgttcctgacaatga

SEQ ID NO: 565526 - DNA, 20 bp, Artificial Sequence
  chemically synthesized
atcatttagataagatccat

SEQ ID NO: 565527 - DNA, 20 bp, Artificial Sequence
  chemically synthesized
acataagttttaatgagctt

SEQ ID NO: 565528 - DNA, 20 bp, Artificial Sequence
  chemically synthesized
aagacgtcacataagtttta

SEQ ID NO: 565529 - DNA, 20 bp, Artificial Sequence
  chemically synthesized
aatagattctaagacgtcac

SEQ ID NO: 565530 - DNA, 20 bp, Artificial Sequence
  chemically synthesized
gaatgttcgattaggtcttg

SEQ ID NO: 565531 - DNA, 20 bp, Artificial Sequence
  chemically synthesized
atcctttagttttcaggaat

SEQ ID NO: 565532 - DNA, 20 bp, Artificial Sequence
  chemically synthesized
cttcttgccatgatttatcc

SEQ ID NO: 565533 - DNA, 20 bp, Artificial Sequence
  chemically synthesized
aggattcctttctcttcttg

SEQ ID NO: 565534 - DNA, 20 bp, Artificial Sequence
  chemically synthesized
acacacacatcctttaattt

SEQ ID NO: 565535 - DNA, 20 bp, Artificial Sequence
  chemically synthesized
tcaaattaaaggatgtgtgt

SEQ ID NO: 565536 - DNA, 20 bp, Artificial Sequence
  chemically synthesized
ttctaaggaaagttatattt

SEQ ID NO: 565537 - DNA, 20 bp, Artificial Sequence
  chemically synthesized
gttttccccctacagatcag

SEQ ID NO: 565538 - DNA, 20 bp, Artificial Sequence
  chemically synthesized
tgctttcactgagaacaggt

SEQ ID NO: 565539 - DNA, 20 bp, Artificial Sequence
  chemically synthesized
caggtctttgttttcagaag

SEQ ID NO: 565540 - DNA, 20 bp, Artificial Sequence
  chemically synthesized
gggagtgcacttattgttag

SEQ ID NO: 565541 - DNA, 20 bp, Artificial Sequence
  chemically synthesized
gacagacttacacagctagc

SEQ ID NO: 565542 - DNA, 20 bp, Artificial Sequence
  chemically synthesized
acacagctagctaatgcttt

SEQ ID NO: 565543 - DNA, 20 bp, Artificial Sequence
  chemically synthesized
gtcaatattctaactgctgg

SEQ ID NO: 565544 - DNA, 20 bp, Artificial Sequence
  chemically synthesized
aattggtggcagaatgttta

SEQ ID NO: 565545 - DNA, 20 bp, Artificial Sequence
  chemically synthesized
aaaggtaaaaattggtggca

SEQ ID NO: 565546 - DNA, 20 bp, Artificial Sequence
  chemically synthesized
tgtataattgcctgaggtga

SEQ ID NO: 565547 - DNA, 20 bp, Artificial Sequence
  chemically synthesized
tcacctcaggcaattataca

SEQ ID NO: 565548 - DNA, 20 bp, Artificial Sequence
  chemically synthesized
aggcaattatacagggggtt

SEQ ID NO: 565549 - DNA, 20 bp, Artificial Sequence
  chemically synthesized
aattatacagggggtttttt

SEQ ID NO: 565550 - DNA, 20 bp, Artificial Sequence
  chemically synthesized
atacagggggttttttgttt

SEQ ID NO: 565551 - DNA, 20 bp, Artificial Sequence
  chemically synthesized
agggggttttttgtttgttt

SEQ ID NO: 565552 - DNA, 20 bp, Artificial Sequence
  chemically synthesized
ggttttttgtttgtttgttt

SEQ ID NO: 565553 - DNA, 20 bp, Artificial Sequence
  chemically synthesized
aaaaaagttaaccaaactct

SEQ ID NO: 565554 - DNA, 20 bp, Artificial Sequence
  chemically synthesized
tttatgcttgttaaatccgt

SEQ ID NO: 565555 - DNA, 20 bp, Artificial Sequence
  chemically synthesized
attactaattttaaaatatt

SEQ ID NO: 565556 - DNA, 20 bp, Artificial Sequence
  chemically synthesized
aaatattttaaaattagtaa

SEQ ID NO: 565557 - DNA, 20 bp, Artificial Sequence
  chemically synthesized
tctcaccttctttgtgtttg

SEQ ID NO: 565558 - DNA, 20 bp, Artificial Sequence
  chemically synthesized
acttttctgtctcaccttct

SEQ ID NO: 565559 - DNA, 20 bp, Artificial Sequence
  chemically synthesized
gaaggtgagacagaaaagtc

SEQ ID NO: 565560 - DNA, 20 bp, Artificial Sequence
  chemically synthesized
taaatacacaaacggaaagc

SEQ ID NO: 565561 - DNA, 20 bp, Artificial Sequence
  chemically synthesized
agaatatgaaagcatcagct

SEQ ID NO: 565562 - DNA, 20 bp, Artificial Sequence
  chemically synthesized
tatatggagaatatgaaagc

SEQ ID NO: 565563 - DNA, 20 bp, Artificial Sequence
  chemically synthesized
catatatgaatgtctggtct

SEQ ID NO: 565564 - DNA, 20 bp, Artificial Sequence
  chemically synthesized
atttactaaattggcttaca

SEQ ID NO: 565565 - DNA, 20 bp, Artificial Sequence
  chemically synthesized
atactgagcacatttactaa

SEQ ID NO: 565566 - DNA, 20 bp, Artificial Sequence
  chemically synthesized
aaacatttccggtagccttg

SEQ ID NO: 565567 - DNA, 20 bp, Artificial Sequence
  chemically synthesized
aaacatagcaaggctaccgg

SEQ ID NO: 565568 - DNA, 20 bp, Artificial Sequence
  chemically synthesized
tgtttaaaagccagggttag

SEQ ID NO: 565569 - DNA, 20 bp, Artificial Sequence
  chemically synthesized
ccagaataatcttccctaac

SEQ ID NO: 565570 - DNA, 20 bp, Artificial Sequence
  chemically synthesized
gtgcatgccgttccactgca

SEQ ID NO: 565571 - DNA, 20 bp, Artificial Sequence
  chemically synthesized
ggcatgcacgttagagggca

SEQ ID NO: 565572 - DNA, 20 bp, Artificial Sequence
  chemically synthesized
agttgattagtaggaatcag

SEQ ID NO: 565573 - DNA, 20 bp, Artificial Sequence
  chemically synthesized
ttctttttttccccaaactt

SEQ ID NO: 565574 - DNA, 20 bp, Artificial Sequence
  chemically synthesized
acaagtttggggaaaaaaag

SEQ ID NO: 565575 - DNA, 20 bp, Artificial Sequence
  chemically synthesized
tttggggaaaaaaagaaaag

SEQ ID NO: 565576 - DNA, 20 bp, Artificial Sequence
  chemically synthesized
atttgtttaaaatatcatag

SEQ ID NO: 565577 - DNA, 20 bp, Artificial Sequence
  chemically synthesized
ctagttgtatgccaggcaaa

SEQ ID NO: 565578 - DNA, 20 bp, Artificial Sequence
  chemically synthesized
ttataggcctgcctcgtccc

SEQ ID NO: 565579 - DNA, 20 bp, Artificial Sequence
  chemically synthesized
gcaggcctataaggcagaaa

SEQ ID NO: 565580 - DNA, 20 bp, Artificial Sequence
  chemically synthesized
gtgtataacataactgtgtg

SEQ ID NO: 565581 - DNA, 20 bp, Artificial Sequence
  chemically synthesized
tatgttatacacatggccta

SEQ ID NO: 565582 - DNA, 20 bp, Artificial Sequence
  chemically synthesized
attatcaagtattttaaaat

SEQ ID NO: 565583 - DNA, 20 bp, Artificial Sequence
  chemically synthesized
ttttaaaatccaggattgag

SEQ ID NO: 565584 - DNA, 20 bp, Artificial Sequence
  chemically synthesized
atgagaaatcatctctcaat

SEQ ID NO: 565585 - DNA, 20 bp, Artificial Sequence
  chemically synthesized
tgagagatgatttctcatac

SEQ ID NO: 565586 - DNA, 20 bp, Artificial Sequence
  chemically synthesized
agaagattttggcctctctt

SEQ ID NO: 565587 - DNA, 20 bp, Artificial Sequence
  chemically synthesized
ctacgatgggaattttccag

SEQ ID NO: 565588 - DNA, 20 bp, Artificial Sequence
  chemically synthesized
tcgtagaaaaggttggggga

SEQ ID NO: 565589 - DNA, 20 bp, Artificial Sequence
  chemically synthesized
aattacaaagtaggaggaca

SEQ ID NO: 565590 - DNA, 20 bp, Artificial Sequence
  chemically synthesized
ccgaaattgtgttagcccta

SEQ ID NO: 565591 - DNA, 20 bp, Artificial Sequence
  chemically synthesized
ctatgtggtttaaaatttta

SEQ ID NO: 565592 - DNA, 20 bp, Artificial Sequence
  chemically synthesized
tgtaagtatctaggcagata

SEQ ID NO: 565593 - DNA, 20 bp, Artificial Sequence
  chemically synthesized
gcctagatacttacaattat

SEQ ID NO: 565594 - DNA, 20 bp, Artificial Sequence
  chemically synthesized
gatcaagacatcttgataca

SEQ ID NO: 565595 - DNA, 20 bp, Artificial Sequence
  chemically synthesized
ctagcacaaaatagaatgac

SEQ ID NO: 565596 - DNA, 20 bp, Artificial Sequence
  chemically synthesized
aatgaccctggattatattg

SEQ ID NO: 565597 - DNA, 20 bp, Artificial Sequence
  chemically synthesized
atctcctcttattttctcac

SEQ ID NO: 565598 - DNA, 20 bp, Artificial Sequence
  chemically synthesized
atcattagcaggaatagtct

SEQ ID NO: 565599 - DNA, 20 bp, Artificial Sequence
  chemically synthesized
ctatggagataagaaaagat

SEQ ID NO: 565600 - DNA, 20 bp, Artificial Sequence
  chemically synthesized
tctgatctattaattatcct

SEQ ID NO: 565601 - DNA, 20 bp, Artificial Sequence
  chemically synthesized
ttgaagtttttatagtatct

SEQ ID NO: 565602 - DNA, 20 bp, Artificial Sequence
  chemically synthesized
ctaaactggttttcagaaca

SEQ ID NO: 565603 - DNA, 20 bp, Artificial Sequence
  chemically synthesized
aaaaaccatctgttctgaaa

SEQ ID NO: 565604 - DNA, 20 bp, Artificial Sequence
  chemically synthesized
catctgttctgaaaaccagt

SEQ ID NO: 565605 - DNA, 20 bp, Artificial Sequence
  chemically synthesized
aagaaaaagtccaagcctaa

SEQ ID NO: 565606 - DNA, 20 bp, Artificial Sequence
  chemically synthesized
ttggatttatgcctttacct

SEQ ID NO: 565607 - DNA, 20 bp, Artificial Sequence
  chemically synthesized
gaattacattatcgttgact

SEQ ID NO: 565608 - DNA, 20 bp, Artificial Sequence
  chemically synthesized
taatgtaattcagagaggac

SEQ ID NO: 565609 - DNA, 20 bp, Artificial Sequence
  chemically synthesized
tggttgaaacactaaggaga

SEQ ID NO: 565610 - DNA, 20 bp, Artificial Sequence
  chemically synthesized
agaaacaaacacattctcct

SEQ ID NO: 565611 - DNA, 20 bp, Artificial Sequence
  chemically synthesized
tgaaacactaaggagaatgt

SEQ ID NO: 565612 - DNA, 20 bp, Artificial Sequence
  chemically synthesized
aaagatgcagttaccagtag

SEQ ID NO: 565613 - DNA, 20 bp, Artificial Sequence
  chemically synthesized
tttctggcacattttctaat

SEQ ID NO: 565614 - DNA, 20 bp, Artificial Sequence
  chemically synthesized
ttacacttgacctagatgac

SEQ ID NO: 565615 - DNA, 20 bp, Artificial Sequence
  chemically synthesized
tataactcatttcaatttga

SEQ ID NO: 565616 - DNA, 20 bp, Artificial Sequence
  chemically synthesized
cgtctttataactcatttca

SEQ ID NO: 565617 - DNA, 20 bp, Artificial Sequence
  chemically synthesized
caaattgaaatgagttataa

SEQ ID NO: 565618 - DNA, 20 bp, Artificial Sequence
  chemically synthesized
attaaattgagtagtcatcg

SEQ ID NO: 565619 - DNA, 20 bp, Artificial Sequence
  chemically synthesized
tgcttattaaattgagtagt

SEQ ID NO: 565620 - DNA, 20 bp, Artificial Sequence
  chemically synthesized
ctcaatttaataagcagatc

SEQ ID NO: 565621 - DNA, 20 bp, Artificial Sequence
  chemically synthesized
tttcacatggaaatctttgg

SEQ ID NO: 565622 - DNA, 20 bp, Artificial Sequence
  chemically synthesized
atttccatgtgaaacttcac

SEQ ID NO: 565623 - DNA, 20 bp, Artificial Sequence
  chemically synthesized
ttaactctccaaaactatag

SEQ ID NO: 565624 - DNA, 20 bp, Artificial Sequence
  chemically synthesized
tgccagggttctagaagatt

SEQ ID NO: 565625 - DNA, 20 bp, Artificial Sequence
  chemically synthesized
atgggctatgccagggttct

SEQ ID NO: 565626 - DNA, 20 bp, Artificial Sequence
  chemically synthesized
attattagaaaaatgctaag

SEQ ID NO: 565627 - DNA, 20 bp, Artificial Sequence
  chemically synthesized
taatttatcttgatctgcag

SEQ ID NO: 565628 - DNA, 20 bp, Artificial Sequence
  chemically synthesized
cagatcaagataaattaata

SEQ ID NO: 565629 - DNA, 20 bp, Artificial Sequence
  chemically synthesized
attttccctgatggtaggct

SEQ ID NO: 565630 - DNA, 20 bp, Artificial Sequence
  chemically synthesized
ctaatgtattttccctgatg

SEQ ID NO: 565631 - DNA, 20 bp, Artificial Sequence
  chemically synthesized
catcagggaaaatacattag

SEQ ID NO: 565632 - DNA, 20 bp, Artificial Sequence
  chemically synthesized
tgtacttatgctccaaggtc

SEQ ID NO: 565633 - DNA, 20 bp, Artificial Sequence
  chemically synthesized
ataaaatggtattaaagtat

SEQ ID NO: 565634 - DNA, 20 bp, Artificial Sequence
  chemically synthesized
tttatacagaaaatcttata

SEQ ID NO: 565635 - DNA, 20 bp, Artificial Sequence
  chemically synthesized
gcaaagaattaaagctctgt

SEQ ID NO: 565636 - DNA, 20 bp, Artificial Sequence
  chemically synthesized
tttctggttattgtaagttc

SEQ ID NO: 565637 - DNA, 20 bp, Artificial Sequence
  chemically synthesized
tctcttttagtgtatatttt

SEQ ID NO: 565638 - DNA, 20 bp, Artificial Sequence
  chemically synthesized
tactcccttttggctcattt

SEQ ID NO: 565639 - DNA, 20 bp, Artificial Sequence
  chemically synthesized
ttcactaattcttggttttt

SEQ ID NO: 565640 - DNA, 20 bp, Artificial Sequence
  chemically synthesized
gctttgtattttcactaatt

SEQ ID NO: 565641 - DNA, 20 bp, Artificial Sequence
  chemically synthesized
ttagttttgtttgtggacta

SEQ ID NO: 565642 - DNA, 20 bp, Artificial Sequence
  chemically synthesized
ttagaaggctttgcacttag

SEQ ID NO: 565643 - DNA, 20 bp, Artificial Sequence
  chemically synthesized
gtgttttagaaggctttgca

SEQ ID NO: 565644 - DNA, 20 bp, Artificial Sequence
  chemically synthesized
cttcttttggaagtgtttta

SEQ ID NO: 565645 - DNA, 20 bp, Artificial Sequence
  chemically synthesized
gtattattaccttcttttgg

SEQ ID NO: 565646 - DNA, 20 bp, Artificial Sequence
  chemically synthesized
aagaaggtaataatactgtt

SEQ ID NO: 565647 - DNA, 20 bp, Artificial Sequence
  chemically synthesized
atccttctgggtatatggtt

SEQ ID NO: 565648 - DNA, 20 bp, Artificial Sequence
  chemically synthesized
aacacaaaaccatataccca

SEQ ID NO: 565649 - DNA, 20 bp, Artificial Sequence
  chemically synthesized
gtaagtaatccttctgggta

SEQ ID NO: 565650 - DNA, 20 bp, Artificial Sequence
  chemically synthesized
gaatgtcagcttttaattaa

SEQ ID NO: 565651 - DNA, 20 bp, Artificial Sequence
  chemically synthesized
aattaaaagctgacattcat

SEQ ID NO: 565652 - DNA, 20 bp, Artificial Sequence
  chemically synthesized
gcattgaaacctaaatgaat

SEQ ID NO: 565653 - DNA, 20 bp, Artificial Sequence
  chemically synthesized
atgcagaatcgctcaaagaa

SEQ ID NO: 565654 - DNA, 20 bp, Artificial Sequence
  chemically synthesized
ccagtcaaacgatattcttt

SEQ ID NO: 565655 - DNA, 20 bp, Artificial Sequence
  chemically synthesized
cagacaacgtaaaggcctat

SEQ ID NO: 565656 - DNA, 20 bp, Artificial Sequence
  chemically synthesized
acgtaaaggcctatgttagc

SEQ ID NO: 565657 - DNA, 20 bp, Artificial Sequence
  chemically synthesized
tatgacaaacacaagcaaat

SEQ ID NO: 565658 - DNA, 20 bp, Artificial Sequence
  chemically synthesized
tagactaaactcttatttgc

SEQ ID NO: 565659 - DNA, 20 bp, Artificial Sequence
  chemically synthesized
tttccttagactaaactctt

SEQ ID NO: 565660 - DNA, 20 bp, Artificial Sequence
  chemically synthesized
gtttccagagatacagaccg

SEQ ID NO: 565661 - DNA, 20 bp, Artificial Sequence
  chemically synthesized
tgaaagtttccagagataca

SEQ ID NO: 565662 - DNA, 20 bp, Artificial Sequence
  chemically synthesized
tgatatggatcacagaattt

SEQ ID NO: 565663 - DNA, 20 bp, Artificial Sequence
  chemically synthesized
gatcaaatattgtaatcatc

SEQ ID NO: 565664 - DNA, 20 bp, Artificial Sequence
  chemically synthesized
tctaatgttaacaaatccta

SEQ ID NO: 565665 - DNA, 20 bp, Artificial Sequence
  chemically synthesized
ggcataagagccaggtccta

SEQ ID NO: 565666 - DNA, 20 bp, Artificial Sequence
  chemically synthesized
tggctcttatgcctgaatag

SEQ ID NO: 565667 - DNA, 20 bp, Artificial Sequence
  chemically synthesized
tgtatttaaagtatttattc

SEQ ID NO: 565668 - DNA, 20 bp, Artificial Sequence
  chemically synthesized
caaatctagcagactgaagt

SEQ ID NO: 565669 - DNA, 20 bp, Artificial Sequence
  chemically synthesized
gaaaacacagacttcagtct

SEQ ID NO: 565670 - DNA, 20 bp, Artificial Sequence
  chemically synthesized
cacagacttcagtctgctag

SEQ ID NO: 565671 - DNA, 20 bp, Artificial Sequence
  chemically synthesized
tagattattcagaaatagtg

SEQ ID NO: 565672 - DNA, 20 bp, Artificial Sequence
  chemically synthesized
tgcctttttatgaagagttg

SEQ ID NO: 565673 - DNA, 20 bp, Artificial Sequence
  chemically synthesized
ataaaaaggcaaattgggag

SEQ ID NO: 565674 - DNA, 20 bp, Artificial Sequence
  chemically synthesized
ttattaattttaaagtcttt

SEQ ID NO: 565675 - DNA, 20 bp, Artificial Sequence
  chemically synthesized
cagattaacttattttaagt

SEQ ID NO: 565676 - DNA, 20 bp, Artificial Sequence
  chemically synthesized
cttctacttaaaataagtta

SEQ ID NO: 565677 - DNA, 20 bp, Artificial Sequence
  chemically synthesized
ataagttaatctgattgtca

SEQ ID NO: 565678 - DNA, 20 bp, Artificial Sequence
  chemically synthesized
atgagaaaaacattatgaca

SEQ ID NO: 565679 - DNA, 20 bp, Artificial Sequence
  chemically synthesized
attgtcataatgtttttctc

SEQ ID NO: 565680 - DNA, 20 bp, Artificial Sequence
  chemically synthesized
ttcaaggactattaattact

SEQ ID NO: 565681 - DNA, 20 bp, Artificial Sequence
  chemically synthesized
caactgttctttagcatatt

SEQ ID NO: 565682 - DNA, 20 bp, Artificial Sequence
  chemically synthesized
gttctttagcatatttgtcg

SEQ ID NO: 565683 - DNA, 20 bp, Artificial Sequence
  chemically synthesized
tggatttactctatgtggaa

SEQ ID NO: 565684 - DNA, 20 bp, Artificial Sequence
  chemically synthesized
tgattggatcctgataaggg

SEQ ID NO: 565685 - DNA, 20 bp, Artificial Sequence
  chemically synthesized
gttgatacactacagtttca

SEQ ID NO: 565686 - DNA, 20 bp, Artificial Sequence
  chemically synthesized
aagagttgatacactacagt

SEQ ID NO: 565687 - DNA, 20 bp, Artificial Sequence
  chemically synthesized
cttttaaagagttgatacac

SEQ ID NO: 565688 - DNA, 20 bp, Artificial Sequence
  chemically synthesized
ctgtagtgtatcaactcttt

SEQ ID NO: 565689 - DNA, 20 bp, Artificial Sequence
  chemically synthesized
tgtcctctgcctcttggaaa

SEQ ID NO: 565690 - DNA, 20 bp, Artificial Sequence
  chemically synthesized
ctccctaagttctttaagca

SEQ ID NO: 565691 - DNA, 20 bp, Artificial Sequence
  chemically synthesized
ttatctgatttatttaatca

SEQ ID NO: 565692 - DNA, 20 bp, Artificial Sequence
  chemically synthesized
gtagctataagtagtatatt

SEQ ID NO: 565693 - DNA, 20 bp, Artificial Sequence
  chemically synthesized
aaaattaaggggcgcaataa

SEQ ID NO: 565694 - DNA, 20 bp, Artificial Sequence
  chemically synthesized
ggcctaaaggaagtggaagg

SEQ ID NO: 565695 - DNA, 20 bp, Artificial Sequence
  chemically synthesized
gataaatgcatattattaat

SEQ ID NO: 565696 - DNA, 20 bp, Artificial Sequence
  chemically synthesized
ataatatgcatttatcacga

SEQ ID NO: 565697 - DNA, 20 bp, Artificial Sequence
  chemically synthesized
acagggtttttaaaaaagga

SEQ ID NO: 565698 - DNA, 20 bp, Artificial Sequence
  chemically synthesized
gtttttaaaaaaggatctag

SEQ ID NO: 565699 - DNA, 20 bp, Artificial Sequence
  chemically synthesized
attatatggtggaacaataa

SEQ ID NO: 565700 - DNA, 20 bp, Artificial Sequence
  chemically synthesized
aaaagaaattgaattcttac

SEQ ID NO: 565701 - DNA, 20 bp, Artificial Sequence
  chemically synthesized
ggaaatgaccaattcggaag

SEQ ID NO: 565702 - DNA, 20 bp, Artificial Sequence
  chemically synthesized
cctttatccataacagagct

SEQ ID NO: 565703 - DNA, 20 bp, Artificial Sequence
  chemically synthesized
caaacttttggtatttcaaa

SEQ ID NO: 565704 - DNA, 20 bp, Artificial Sequence
  chemically synthesized
aaagcatactttgaaatacc

SEQ ID NO: 565705 - DNA, 20 bp, Artificial Sequence
  chemically synthesized
gttataacaaccctacataa

SEQ ID NO: 565706 - DNA, 20 bp, Artificial Sequence
  chemically synthesized
atgtagttttaaaataggca

SEQ ID NO: 565707 - DNA, 20 bp, Artificial Sequence
  chemically synthesized
agaaaactcttttttggggc

SEQ ID NO: 565708 - DNA, 20 bp, Artificial Sequence
  chemically synthesized
agaaatcacaggccccaaaa

SEQ ID NO: 565709 - DNA, 20 bp, Artificial Sequence
  chemically synthesized
taccagcagatgatttatct

SEQ ID NO: 565710 - DNA, 20 bp, Artificial Sequence
  chemically synthesized
tactgagcttagataccagc

SEQ ID NO: 565711 - DNA, 20 bp, Artificial Sequence
  chemically synthesized
attggtgtgtattaataata

SEQ ID NO: 565712 - DNA, 20 bp, Artificial Sequence
  chemically synthesized
tcctcctagagcaaatgtat

SEQ ID NO: 565713 - DNA, 20 bp, Artificial Sequence
  chemically synthesized
aattgtttatgagctgaata

SEQ ID NO: 565714 - DNA, 20 bp, Artificial Sequence
  chemically synthesized
agcttggagaggagagcaaa

SEQ ID NO: 565715 - DNA, 20 bp, Artificial Sequence
  chemically synthesized
aatttagaaacccttgtata

SEQ ID NO: 565716 - DNA, 20 bp, Artificial Sequence
  chemically synthesized
tttgactaatcattatatac

SEQ ID NO: 565717 - DNA, 20 bp, Artificial Sequence
  chemically synthesized
taattttaatgaggtgtgcg

SEQ ID NO: 565718 - DNA, 20 bp, Artificial Sequence
  chemically synthesized
attcgttttaaagtatgatg

SEQ ID NO: 565719 - DNA, 20 bp, Artificial Sequence
  chemically synthesized
tcatactttaaaacgaattc

SEQ ID NO: 565720 - DNA, 20 bp, Artificial Sequence
  chemically synthesized
gactattaaaaatcagcaga

SEQ ID NO: 565721 - DNA, 20 bp, Artificial Sequence
  chemically synthesized
agtccacttataacagaccc

SEQ ID NO: 565722 - DNA, 20 bp, Artificial Sequence
  chemically synthesized
tagccatatttcttgagatt

SEQ ID NO: 565723 - DNA, 20 bp, Artificial Sequence
  chemically synthesized
acattctttagccatatttc

SEQ ID NO: 565724 - DNA, 20 bp, Artificial Sequence
  chemically synthesized
aagaatgttattatgtaatc

SEQ ID NO: 565725 - DNA, 20 bp, Artificial Sequence
  chemically synthesized
tatgtaatcagaagcttctt

SEQ ID NO: 565726 - DNA, 20 bp, Artificial Sequence
  chemically synthesized
tataaaagcaaggaagaagc

SEQ ID NO: 565727 - DNA, 20 bp, Artificial Sequence
  chemically synthesized
tcttcatataaaagcaagga

SEQ ID NO: 565728 - DNA, 20 bp, Artificial Sequence
  chemically synthesized
tttagctgtattcctgggag

SEQ ID NO: 565729 - DNA, 20 bp, Artificial Sequence
  chemically synthesized
agctaaaactccaataactt

SEQ ID NO: 565730 - DNA, 20 bp, Artificial Sequence
  chemically synthesized
attataatcaaagaagttat

SEQ ID NO: 565731 - DNA, 20 bp, Artificial Sequence
  chemically synthesized
gattataatttgaattcaag

SEQ ID NO: 565732 - DNA, 20 bp, Artificial Sequence
  chemically synthesized
gaattcaagccaggatttct

SEQ ID NO: 565733 - DNA, 20 bp, Artificial Sequence
  chemically synthesized
aaattcaaaccagcagaaat

SEQ ID NO: 565734 - DNA, 20 bp, Artificial Sequence
  chemically synthesized
tggaggaaccaaaaaaccca

SEQ ID NO: 565735 - DNA, 20 bp, Artificial Sequence
  chemically synthesized
cacagatcaggagaatcaga

SEQ ID NO: 565736 - DNA, 20 bp, Artificial Sequence
  chemically synthesized
attaattccccttccttcat

SEQ ID NO: 565737 - DNA, 20 bp, Artificial Sequence
  chemically synthesized
gtttgttttcttttgttttg

SEQ ID NO: 565738 - DNA, 20 bp, Artificial Sequence
  chemically synthesized
tatttgtttgttttcttttg

SEQ ID NO: 565739 - DNA, 20 bp, Artificial Sequence
  chemically synthesized
ctgtttatttgtttgttttc

SEQ ID NO: 565740 - DNA, 20 bp, Artificial Sequence
  chemically synthesized
ctcttttgttctgtttattt

SEQ ID NO: 565741 - DNA, 20 bp, Artificial Sequence
  chemically synthesized
ggttctcttttgttctgttt

SEQ ID NO: 565742 - DNA, 20 bp, Artificial Sequence
  chemically synthesized
gctcgcttggttctcttttg

SEQ ID NO: 565743 - DNA, 20 bp, Artificial Sequence
  chemically synthesized
ctgctaccaccaacacattc

SEQ ID NO: 565744 - DNA, 20 bp, Artificial Sequence
  chemically synthesized
actctgatcaacttctggcc

SEQ ID NO: 565745 - DNA, 20 bp, Artificial Sequence
  chemically synthesized
gtctccttcaccacctcatt

SEQ ID NO: 565746 - DNA, 20 bp, Artificial Sequence
  chemically synthesized
ttcagtaaatttttttgcgg

SEQ ID NO: 565747 - DNA, 20 bp, Artificial Sequence
  chemically synthesized
ccatggttcatacttaattg

SEQ ID NO: 565748 - DNA, 20 bp, Artificial Sequence
  chemically synthesized
actttacaccttggtttggc

SEQ ID NO: 565749 - DNA, 20 bp, Artificial Sequence
  chemically synthesized
tcttttaattcactttacac

SEQ ID NO: 565750 - DNA, 20 bp, Artificial Sequence
  chemically synthesized
ctgatggcagtcacacaact

SEQ ID NO: 565751 - DNA, 20 bp, Artificial Sequence
  chemically synthesized
aactacttcacagtaagtag

SEQ ID NO: 565752 - DNA, 20 bp, Artificial Sequence
  chemically synthesized
atcattactacttactgtga

SEQ ID NO: 565753 - DNA, 20 bp, Artificial Sequence
  chemically synthesized
ttgtgtggtcatatctagtc

SEQ ID NO: 565754 - DNA, 20 bp, Artificial Sequence
  chemically synthesized
gatacaaaaagacacacatt

SEQ ID NO: 565755 - DNA, 20 bp, Artificial Sequence
  chemically synthesized
tgagtgattccagtatttca

SEQ ID NO: 565756 - DNA, 20 bp, Artificial Sequence
  chemically synthesized
atatgggactgtttacaaat

SEQ ID NO: 565757 - DNA, 20 bp, Artificial Sequence
  chemically synthesized
aagccttataagaaatatgg

SEQ ID NO: 565758 - DNA, 20 bp, Artificial Sequence
  chemically synthesized
aaacagtcccatatttctta

SEQ ID NO: 565759 - DNA, 20 bp, Artificial Sequence
  chemically synthesized
aattagtggctgtattgtgt

SEQ ID NO: 565760 - DNA, 20 bp, Artificial Sequence
  chemically synthesized
ttttttttccccctgtgaga

SEQ ID NO: 565761 - DNA, 20 bp, Artificial Sequence
  chemically synthesized
tgggaaagtggcaactggac

SEQ ID NO: 565762 - DNA, 20 bp, Artificial Sequence
  chemically synthesized
aaaaagaaagaaatagaaga

SEQ ID NO: 565763 - DNA, 20 bp, Artificial Sequence
  chemically synthesized
atacatcaaacaagagtgtg

SEQ ID NO: 565764 - DNA, 20 bp, Artificial Sequence
  chemically synthesized
gtagcaaaagcagaacacac

SEQ ID NO: 565765 - DNA, 20 bp, Artificial Sequence
  chemically synthesized
tgttctgcttttgctactac

SEQ ID NO: 565766 - DNA, 20 bp, Artificial Sequence
  chemically synthesized
ctggcaggtagcccattcgg

SEQ ID NO: 565767 - DNA, 20 bp, Artificial Sequence
  chemically synthesized
aaaataccttttggttcgaa

SEQ ID NO: 565768 - DNA, 20 bp, Artificial Sequence
  chemically synthesized
aaaagggagatcatggtgag

SEQ ID NO: 565769 - DNA, 20 bp, Artificial Sequence
  chemically synthesized
gtgagatcagatttaggaca

SEQ ID NO: 565770 - DNA, 20 bp, Artificial Sequence
  chemically synthesized
ggcagaagactggagtggtc

SEQ ID NO: 565771 - DNA, 20 bp, Artificial Sequence
  chemically synthesized
ccagtcttctgccccatgac

SEQ ID NO: 565772 - DNA, 20 bp, Artificial Sequence
  chemically synthesized
agagtgttgtggttgtgagc

SEQ ID NO: 565773 - DNA, 20 bp, Artificial Sequence
  chemically synthesized
ctggtttcagagccccattt

SEQ ID NO: 565774 - DNA, 20 bp, Artificial Sequence
  chemically synthesized
ccaaattagtacatgccagg

SEQ ID NO: 565775 - DNA, 20 bp, Artificial Sequence
  chemically synthesized
atgataaataaaagaaacat

SEQ ID NO: 565776 - DNA, 20 bp, Artificial Sequence
  chemically synthesized
ttgagtagcctagtaagctt

SEQ ID NO: 565777 - DNA, 20 bp, Artificial Sequence
  chemically synthesized
accatttattgagtagccta

SEQ ID NO: 565778 - DNA, 20 bp, Artificial Sequence
  chemically synthesized
tactaggctactcaataaat

SEQ ID NO: 565779 - DNA, 20 bp, Artificial Sequence
  chemically synthesized
catgctatcattttgtacta

SEQ ID NO: 565780 - DNA, 20 bp, Artificial Sequence
  chemically synthesized
ctacttagtacaaaatgata

SEQ ID NO: 565781 - DNA, 20 bp, Artificial Sequence
  chemically synthesized
attcctcttatagagatggt

SEQ ID NO: 565782 - DNA, 20 bp, Artificial Sequence
  chemically synthesized
aagagagagatgctctaaag

SEQ ID NO: 565783 - DNA, 20 bp, Artificial Sequence
  chemically synthesized
acacaacaaagtatgagaag

SEQ ID NO: 565784 - DNA, 20 bp, Artificial Sequence
  chemically synthesized
gctgcagatctcgctaaaat

SEQ ID NO: 565785 - DNA, 20 bp, Artificial Sequence
  chemically synthesized
agatctcgctaaaatgtggg

SEQ ID NO: 565786 - DNA, 20 bp, Artificial Sequence
  chemically synthesized
gagcatcaggagttggggcc

SEQ ID NO: 565787 - DNA, 20 bp, Artificial Sequence
  chemically synthesized
aggtaatgccaatagacata

SEQ ID NO: 565788 - DNA, 20 bp, Artificial Sequence
  chemically synthesized
tatcttgaatagcaagcatg

SEQ ID NO: 565789 - DNA, 20 bp, Artificial Sequence
  chemically synthesized
tctcctcttctctaaacttt

SEQ ID NO: 565790 - DNA, 20 bp, Artificial Sequence
  chemically synthesized
gttgactgtagagccaccct

SEQ ID NO: 565791 - DNA, 20 bp, Artificial Sequence
  chemically synthesized
tggctctacagtcaacaggg

SEQ ID NO: 565792 - DNA, 20 bp, Artificial Sequence
  chemically synthesized
taaagacaggctcctctcag

SEQ ID NO: 565793 - DNA, 20 bp, Artificial Sequence
  chemically synthesized
gaattaaagacaggctcctc

SEQ ID NO: 565794 - DNA, 20 bp, Artificial Sequence
  chemically synthesized
gagcctgtctttaattctta

SEQ ID NO: 565795 - DNA, 20 bp, Artificial Sequence
  chemically synthesized
ctacatccttgccatttccc

SEQ ID NO: 565796 - DNA, 20 bp, Artificial Sequence
  chemically synthesized
cctaaaataacatcttagga

SEQ ID NO: 565797 - DNA, 20 bp, Artificial Sequence
  chemically synthesized
taccctgtgtaaaataagta

SEQ ID NO: 565798 - DNA, 20 bp, Artificial Sequence
  chemically synthesized
atagtacttattttacacag

SEQ ID NO: 565799 - DNA, 20 bp, Artificial Sequence
  chemically synthesized
tagtaagtgttagcatataa

SEQ ID NO: 565800 - DNA, 20 bp, Artificial Sequence
  chemically synthesized
gacagataataggtgagcaa

SEQ ID NO: 565801 - DNA, 20 bp, Artificial Sequence
  chemically synthesized
gagcaacattgattaaaagt

SEQ ID NO: 565802 - DNA, 20 bp, Artificial Sequence
  chemically synthesized
tggttgtattgaagacgttt

SEQ ID NO: 565803 - DNA, 20 bp, Artificial Sequence
  chemically synthesized
tgtgtgcatggttgtattga

SEQ ID NO: 565804 - DNA, 20 bp, Artificial Sequence
  chemically synthesized
aatattgttggatgaataaa

SEQ ID NO: 565805 - DNA, 20 bp, Artificial Sequence
  chemically synthesized
gtggctctcaactgtaggct

SEQ ID NO: 565806 - DNA, 20 bp, Artificial Sequence
  chemically synthesized
agctaaagtggctctcaact

SEQ ID NO: 565807 - DNA, 20 bp, Artificial Sequence
  chemically synthesized
actgcagatcatgtataatg

SEQ ID NO: 565808 - DNA, 20 bp, Artificial Sequence
  chemically synthesized
ttagttcacctgggataaat

SEQ ID NO: 565809 - DNA, 20 bp, Artificial Sequence
  chemically synthesized
tggtggaatattgcactccg

SEQ ID NO: 565810 - DNA, 20 bp, Artificial Sequence
  chemically synthesized
tgcaactcgaccagaaaaaa

SEQ ID NO: 565811 - DNA, 20 bp, Artificial Sequence
  chemically synthesized
ttaattatgacatctgccaa

SEQ ID NO: 565812 - DNA, 20 bp, Artificial Sequence
  chemically synthesized
tttggcagatgtcataatta

SEQ ID NO: 565813 - DNA, 20 bp, Artificial Sequence
  chemically synthesized
attcgaagaaatacatacgt

SEQ ID NO: 565814 - DNA, 20 bp, Artificial Sequence
  chemically synthesized
tttgattcgaagaaatacat

SEQ ID NO: 565815 - DNA, 20 bp, Artificial Sequence
  chemically synthesized
ttaaagagtgttctttggga

SEQ ID NO: 565816 - DNA, 20 bp, Artificial Sequence
  chemically synthesized
tctcaaattagaacgtggta

SEQ ID NO: 565817 - DNA, 20 bp, Artificial Sequence
  chemically synthesized
tgggactaatgaacattgct

SEQ ID NO: 565818 - DNA, 20 bp, Artificial Sequence
  chemically synthesized
taccttgtgggactaatgaa

SEQ ID NO: 565819 - DNA, 20 bp, Artificial Sequence
  chemically synthesized
gttcattagtcccacaaggt

SEQ ID NO: 565820 - DNA, 20 bp, Artificial Sequence
  chemically synthesized
taagtgattaactttctgcc

SEQ ID NO: 565821 - DNA, 20 bp, Artificial Sequence
  chemically synthesized
agtaccaaaacattttggca

SEQ ID NO: 565822 - DNA, 20 bp, Artificial Sequence
  chemically synthesized
ataggataatctttctgcca

SEQ ID NO: 565823 - DNA, 20 bp, Artificial Sequence
  chemically synthesized
agtttttcttccctccttcc

SEQ ID NO: 565824 - DNA, 20 bp, Artificial Sequence
  chemically synthesized
atggaaggagggaagaaaaa

SEQ ID NO: 565825 - DNA, 20 bp, Artificial Sequence
  chemically synthesized
tagtggagtttaaataaaag

SEQ ID NO: 565826 - DNA, 20 bp, Artificial Sequence
  chemically synthesized
taatctcaaagagttcctag

SEQ ID NO: 565827 - DNA, 20 bp, Artificial Sequence
  chemically synthesized
taaactccactaggaactct

SEQ ID NO: 565828 - DNA, 20 bp, Artificial Sequence
  chemically synthesized
agttcttttaaatttgagta

SEQ ID NO: 565829 - DNA, 20 bp, Artificial Sequence
  chemically synthesized
ccccttacccatcatgggac

SEQ ID NO: 565830 - DNA, 20 bp, Artificial Sequence
  chemically synthesized
cttgacaatgttttgaaaat

SEQ ID NO: 565831 - DNA, 20 bp, Artificial Sequence
  chemically synthesized
gtgaaattgctttatcttga

SEQ ID NO: 565832 - DNA, 20 bp, Artificial Sequence
  chemically synthesized
acatttcttttgtcttgtga

SEQ ID NO: 565833 - DNA, 20 bp, Artificial Sequence
  chemically synthesized
gaactttcaattaaaacaag

SEQ ID NO: 565834 - DNA, 20 bp, Artificial Sequence
  chemically synthesized
gaaaacattattaaagcgag

SEQ ID NO: 565835 - DNA, 20 bp, Artificial Sequence
  chemically synthesized
taaaacaagtctcgctttaa

SEQ ID NO: 565836 - DNA, 20 bp, Artificial Sequence
  chemically synthesized
taatgttttctaattgactg

SEQ ID NO: 565837 - DNA, 20 bp, Artificial Sequence
  chemically synthesized
ataaaagagttcattcgagt

SEQ ID NO: 565838 - DNA, 20 bp, Artificial Sequence
  chemically synthesized
tcatttgtaggtaatggggt

SEQ ID NO: 565839 - DNA, 20 bp, Artificial Sequence
  chemically synthesized
atccaaatttcatgttctct

SEQ ID NO: 565840 - DNA, 20 bp, Artificial Sequence
  chemically synthesized
agccccaagagaacatgaaa

SEQ ID NO: 565841 - DNA, 20 bp, Artificial Sequence
  chemically synthesized
gaaatgtaccaactagtatt

SEQ ID NO: 565842 - DNA, 20 bp, Artificial Sequence
  chemically synthesized
cattatcagaatgcgatatt

SEQ ID NO: 565843 - DNA, 20 bp, Artificial Sequence
  chemically synthesized
ttgtttcatactctcctgcc

SEQ ID NO: 565844 - DNA, 20 bp, Artificial Sequence
  chemically synthesized
ccccatatgtgacataagaa

SEQ ID NO: 565845 - DNA, 20 bp, Artificial Sequence
  chemically synthesized
tgggaaggaaagctatcttt

SEQ ID NO: 565846 - DNA, 20 bp, Artificial Sequence
  chemically synthesized
gatggctggaatctaaaaaa

SEQ ID NO: 565847 - DNA, 20 bp, Artificial Sequence
  chemically synthesized
tttctctgcttccttagcta

SEQ ID NO: 565848 - DNA, 20 bp, Artificial Sequence
  chemically synthesized
agctaaggaagcagagaaaa

SEQ ID NO: 565849 - DNA, 20 bp, Artificial Sequence
  chemically synthesized
agatttctaagctacctttt

SEQ ID NO: 565850 - DNA, 20 bp, Artificial Sequence
  chemically synthesized
agggaagccacagtgactgc

SEQ ID NO: 565851 - DNA, 20 bp, Artificial Sequence
  chemically synthesized
tagaaatctaatgcagtcac

SEQ ID NO: 565852 - DNA, 20 bp, Artificial Sequence
  chemically synthesized
aaaggtcaccttctttcctt

SEQ ID NO: 565853 - DNA, 20 bp, Artificial Sequence
  chemically synthesized
gatagacaacagtgagtagg

SEQ ID NO: 565854 - DNA, 20 bp, Artificial Sequence
  chemically synthesized
acctactcactgttgtctat

SEQ ID NO: 565855 - DNA, 20 bp, Artificial Sequence
  chemically synthesized
tctaggcttcagaaacctct

SEQ ID NO: 565856 - DNA, 20 bp, Artificial Sequence
  chemically synthesized
gaggttttacaaaaactttt

SEQ ID NO: 565857 - DNA, 20 bp, Artificial Sequence
  chemically synthesized
catagtcatgctgtttacaa

SEQ ID NO: 565858 - DNA, 20 bp, Artificial Sequence
  chemically synthesized
tgtttattgttccatagtca

SEQ ID NO: 565859 - DNA, 20 bp, Artificial Sequence
  chemically synthesized
tcatagtgcttttttacttt

SEQ ID NO: 565860 - DNA, 20 bp, Artificial Sequence
  chemically synthesized
tgttgcgtgctttttattca

SEQ ID NO: 565861 - DNA, 20 bp, Artificial Sequence
  chemically synthesized
aataactaccttgtactgtt

SEQ ID NO: 565862 - DNA, 20 bp, Artificial Sequence
  chemically synthesized
tcttttccagttacgtgtga

SEQ ID NO: 565863 - DNA, 20 bp, Artificial Sequence
  chemically synthesized
gttcacacgtaactggaaaa

SEQ ID NO: 565864 - DNA, 20 bp, Artificial Sequence
  chemically synthesized
gagtgtttactttgctgcta

SEQ ID NO: 565865 - DNA, 20 bp, Artificial Sequence
  chemically synthesized
gcacaggcatagaccataga

SEQ ID NO: 565866 - DNA, 20 bp, Artificial Sequence
  chemically synthesized
atagagctagtttacaactt

SEQ ID NO: 565867 - DNA, 20 bp, Artificial Sequence
  chemically synthesized
catcactatagaaaccttga

SEQ ID NO: 565868 - DNA, 20 bp, Artificial Sequence
  chemically synthesized
ttaaatgtgtgaatcaacat

SEQ ID NO: 565869 - DNA, 20 bp, Artificial Sequence
  chemically synthesized
attcacacatttaaggacat

SEQ ID NO: 565870 - DNA, 20 bp, Artificial Sequence
  chemically synthesized
aggacatcgcagtttcagaa

SEQ ID NO: 565871 - DNA, 20 bp, Artificial Sequence
  chemically synthesized
cgcagtttcagaattaggat

SEQ ID NO: 565872 - DNA, 20 bp, Artificial Sequence
  chemically synthesized
ggatttaggattaatgttaa

SEQ ID NO: 565873 - DNA, 20 bp, Artificial Sequence
  chemically synthesized
ctgctgacctgtttggggag

SEQ ID NO: 565874 - DNA, 20 bp, Artificial Sequence
  chemically synthesized
ataaatctttagccctgctg

SEQ ID NO: 565875 - DNA, 20 bp, Artificial Sequence
  chemically synthesized
cccaaacaggtcagcagggc

SEQ ID NO: 565876 - DNA, 20 bp, Artificial Sequence
  chemically synthesized
agggctaaagatttatttgg

SEQ ID NO: 565877 - DNA, 20 bp, Artificial Sequence
  chemically synthesized
aagactatcagaataacctg

SEQ ID NO: 565878 - DNA, 20 bp, Artificial Sequence
  chemically synthesized
cttctaaatgtataaggact

SEQ ID NO: 565879 - DNA, 20 bp, Artificial Sequence
  chemically synthesized
ataaggactggttgtttttt

SEQ ID NO: 565880 - DNA, 20 bp, Artificial Sequence
  chemically synthesized
taaaaagtaggcaagtaaat

SEQ ID NO: 565881 - DNA, 20 bp, Artificial Sequence
  chemically synthesized
gatactatacaaagaatgta

SEQ ID NO: 565882 - DNA, 20 bp, Artificial Sequence
  chemically synthesized
acttgcttctttatctgtga

SEQ ID NO: 565883 - DNA, 20 bp, Artificial Sequence
  chemically synthesized
attgttttcagcatcttaga

SEQ ID NO: 565884 - DNA, 20 bp, Artificial Sequence
  chemically synthesized
tttctcccttaagtaacaag

SEQ ID NO: 565885 - DNA, 20 bp, Artificial Sequence
  chemically synthesized
ctcccagaatagaatcatct

SEQ ID NO: 565886 - DNA, 20 bp, Artificial Sequence
  chemically synthesized
gaatcagttataaaactgag

SEQ ID NO: 565887 - DNA, 20 bp, Artificial Sequence
  chemically synthesized
gaatcatctctcagttttat

SEQ ID NO: 565888 - DNA, 20 bp, Artificial Sequence
  chemically synthesized
agttttataactgattcttg

SEQ ID NO: 565889 - DNA, 20 bp, Artificial Sequence
  chemically synthesized
ctttcctttttcacggtctt

SEQ ID NO: 565890 - DNA, 20 bp, Artificial Sequence
  chemically synthesized
tgaaaaaggaaagatggtaa

SEQ ID NO: 565891 - DNA, 20 bp, Artificial Sequence
  chemically synthesized
cgtctccaaagtgggagaga

SEQ ID NO: 565892 - DNA, 20 bp, Artificial Sequence
  chemically synthesized
tggttcctaatacctgaatc

SEQ ID NO: 565893 - DNA, 20 bp, Artificial Sequence
  chemically synthesized
tctgcaaagagtgtccaatc

SEQ ID NO: 565894 - DNA, 20 bp, Artificial Sequence
  chemically synthesized
tgcagatgttacatttggcc

SEQ ID NO: 565895 - DNA, 20 bp, Artificial Sequence
  chemically synthesized
ttacatttggcctgatgctt

SEQ ID NO: 565896 - DNA, 20 bp, Artificial Sequence
  chemically synthesized
ctcatccagtctaggaagag

SEQ ID NO: 565897 - DNA, 20 bp, Artificial Sequence
  chemically synthesized
ggaagagggccgcttcgatc

SEQ ID NO: 565898 - DNA, 20 bp, Artificial Sequence
  chemically synthesized
ggcaaaggaggtgtatatca

SEQ ID NO: 565899 - DNA, 20 bp, Artificial Sequence
  chemically synthesized
accattgttctttctatctt

SEQ ID NO: 565900 - DNA, 20 bp, Artificial Sequence
  chemically synthesized
aacaatggttgcaaagctag

SEQ ID NO: 565901 - DNA, 20 bp, Artificial Sequence
  chemically synthesized
aacaagctgtgaaaagccag

SEQ ID NO: 565902 - DNA, 20 bp, Artificial Sequence
  chemically synthesized
gcaaagctaggctggctttt

SEQ ID NO: 565903 - DNA, 20 bp, Artificial Sequence
  chemically synthesized
agctaggctggcttttcaca

SEQ ID NO: 565904 - DNA, 20 bp, Artificial Sequence
  chemically synthesized
tccaaagagctacccactcc

SEQ ID NO: 565905 - DNA, 20 bp, Artificial Sequence
  chemically synthesized
tagtagccaaaaagagtaat

SEQ ID NO: 565906 - DNA, 20 bp, Artificial Sequence
  chemically synthesized
ttacctttctcgtttgttgg

SEQ ID NO: 565907 - DNA, 20 bp, Artificial Sequence
  chemically synthesized
tttgcttacctttctcgttt

SEQ ID NO: 565908 - DNA, 20 bp, Artificial Sequence
  chemically synthesized
gtgtgtagtttgcttacctt

SEQ ID NO: 565909 - DNA, 20 bp, Artificial Sequence
  chemically synthesized
aagtctcgctcaggtgtgta

SEQ ID NO: 565910 - DNA, 20 bp, Artificial Sequence
  chemically synthesized
aataaagtctcgctcaggtg

SEQ ID NO: 565911 - DNA, 20 bp, Artificial Sequence
  chemically synthesized
cacacctgagcgagacttta

SEQ ID NO: 565912 - DNA, 20 bp, Artificial Sequence
  chemically synthesized
gttagccagaagtgaaatgc

SEQ ID NO: 565913 - DNA, 20 bp, Artificial Sequence
  chemically synthesized
aaatttcaaaggagggggac

SEQ ID NO: 565914 - DNA, 20 bp, Artificial Sequence
  chemically synthesized
ctgatttttttttctagaga

SEQ ID NO: 565915 - DNA, 20 bp, Artificial Sequence
  chemically synthesized
ctcattatgattctatgaga

SEQ ID NO: 565916 - DNA, 20 bp, Artificial Sequence
  chemically synthesized
tttctcatagaatcataatg

SEQ ID NO: 565917 - DNA, 20 bp, Artificial Sequence
  chemically synthesized
atgaattttaaagcccctca

SEQ ID NO: 565918 - DNA, 20 bp, Artificial Sequence
  chemically synthesized
cagtttgcttgtctgttaga

SEQ ID NO: 565919 - DNA, 20 bp, Artificial Sequence
  chemically synthesized
cctcatctaacagacaagca

SEQ ID NO: 565920 - DNA, 20 bp, Artificial Sequence
  chemically synthesized
ttttctggtctacaaaatca

SEQ ID NO: 565921 - DNA, 20 bp, Artificial Sequence
  chemically synthesized
ctccttttctggtctacaaa

SEQ ID NO: 565922 - DNA, 20 bp, Artificial Sequence
  chemically synthesized
ctgattttgtagaccagaaa

SEQ ID NO: 565923 - DNA, 20 bp, Artificial Sequence
  chemically synthesized
tgataatagaatccaaacct

SEQ ID NO: 565924 - DNA, 20 bp, Artificial Sequence
  chemically synthesized
aacagcgctaagccaggagg

SEQ ID NO: 565925 - DNA, 20 bp, Artificial Sequence
  chemically synthesized
atgaaaacagcgctaagcca

SEQ ID NO: 565926 - DNA, 20 bp, Artificial Sequence
  chemically synthesized
atccaaacctcctggcttag

SEQ ID NO: 565927 - DNA, 20 bp, Artificial Sequence
  chemically synthesized
gcgctgttttcatgatgccc

SEQ ID NO: 565928 - DNA, 20 bp, Artificial Sequence
  chemically synthesized
ataaatcaaatggtggtatt

SEQ ID NO: 565929 - DNA, 20 bp, Artificial Sequence
  chemically synthesized
aacaatctcaaaataccacc

SEQ ID NO: 565930 - DNA, 20 bp, Artificial Sequence
  chemically synthesized
attcatgaattttaattata

SEQ ID NO: 565931 - DNA, 20 bp, Artificial Sequence
  chemically synthesized
accttgtttttttcaaccct

SEQ ID NO: 565932 - DNA, 20 bp, Artificial Sequence
  chemically synthesized
tgtttttttcaaccctatag

SEQ ID NO: 565933 - DNA, 20 bp, Artificial Sequence
  chemically synthesized
tttaattttttatattatta

SEQ ID NO: 565934 - DNA, 20 bp, Artificial Sequence
  chemically synthesized
ttgactacttttttgctctt

SEQ ID NO: 565935 - DNA, 20 bp, Artificial Sequence
  chemically synthesized
tttcatctcaaatcttccat

SEQ ID NO: 565936 - DNA, 20 bp, Artificial Sequence
  chemically synthesized
aggcagaactaatcccagat

SEQ ID NO: 565937 - DNA, 20 bp, Artificial Sequence
  chemically synthesized
ttggtggtgcatttctcaag

SEQ ID NO: 565938 - DNA, 20 bp, Artificial Sequence
  chemically synthesized
aggaggtattttcagacaaa

SEQ ID NO: 565939 - DNA, 20 bp, Artificial Sequence
  chemically synthesized
atgaagataactatcaggaa

SEQ ID NO: 565940 - DNA, 20 bp, Artificial Sequence
  chemically synthesized
aatcacttgaacccaggagg

SEQ ID NO: 565941 - DNA, 20 bp, Artificial Sequence
  chemically synthesized
aatctccgcctcctgggttc

SEQ ID NO: 565942 - DNA, 20 bp, Artificial Sequence
  chemically synthesized
ttttgtatttttagtagaga

SEQ ID NO: 565943 - DNA, 20 bp, Artificial Sequence
  chemically synthesized
gcctggcccaagtataaaat

SEQ ID NO: 565944 - DNA, 20 bp, Artificial Sequence
  chemically synthesized
aagtataaaatttttgattg

SEQ ID NO: 565945 - DNA, 20 bp, Artificial Sequence
  chemically synthesized
ttgattgaaaggttttgggg

SEQ ID NO: 565946 - DNA, 20 bp, Artificial Sequence
  chemically synthesized
gttttggggtcttgttttta

SEQ ID NO: 565947 - DNA, 20 bp, Artificial Sequence
  chemically synthesized
gtgatggtgagcattttttc

SEQ ID NO: 565948 - DNA, 20 bp, Artificial Sequence
  chemically synthesized
gagatggtatctcattgtgg

SEQ ID NO: 565949 - DNA, 20 bp, Artificial Sequence
  chemically synthesized
ggtgtgagatggtatctcat

SEQ ID NO: 565950 - DNA, 20 bp, Artificial Sequence
  chemically synthesized
cctgttgtttcctgactttt

SEQ ID NO: 565951 - DNA, 20 bp, Artificial Sequence
  chemically synthesized
tccacatcctctccagcacc

SEQ ID NO: 565952 - DNA, 20 bp, Artificial Sequence
  chemically synthesized
ctgacttccacaatggttga

SEQ ID NO: 565953 - DNA, 20 bp, Artificial Sequence
  chemically synthesized
aaccattgtggaagtcagtg

SEQ ID NO: 565954 - DNA, 20 bp, Artificial Sequence
  chemically synthesized
gtgcatgtgtctttatagca

SEQ ID NO: 565955 - DNA, 20 bp, Artificial Sequence
  chemically synthesized
ctataaagacacatgcacac

SEQ ID NO: 565956 - DNA, 20 bp, Artificial Sequence
  chemically synthesized
caaatgcccaacaatgatag

SEQ ID NO: 565957 - DNA, 20 bp, Artificial Sequence
  chemically synthesized
ttgcgatagtttactgagaa

SEQ ID NO: 565958 - DNA, 20 bp, Artificial Sequence
  chemically synthesized
gtttggttttttgtccttgc

SEQ ID NO: 565959 - DNA, 20 bp, Artificial Sequence
  chemically synthesized
atgagtgagaacatgcggtg

SEQ ID NO: 565960 - DNA, 20 bp, Artificial Sequence
  chemically synthesized
cacctatgagtgagaacatg

SEQ ID NO: 565961 - DNA, 20 bp, Artificial Sequence
  chemically synthesized
tattttatttttattatact

SEQ ID NO: 565962 - DNA, 20 bp, Artificial Sequence
  chemically synthesized
aaaaaaaataaagataatct

SEQ ID NO: 565963 - DNA, 20 bp, Artificial Sequence
  chemically synthesized
acagcacaagatagaaaaca

SEQ ID NO: 565964 - DNA, 20 bp, Artificial Sequence
  chemically synthesized
tctatctgttttctatcttg

SEQ ID NO: 565965 - DNA, 20 bp, Artificial Sequence
  chemically synthesized
ttttctatcttgtgctgttt

SEQ ID NO: 565966 - DNA, 20 bp, Artificial Sequence
  chemically synthesized
tatcttgtgctgtttctagg

SEQ ID NO: 565967 - DNA, 20 bp, Artificial Sequence
  chemically synthesized
tgtttctaggatttgattta

SEQ ID NO: 565968 - DNA, 20 bp, Artificial Sequence
  chemically synthesized
taggatttgatttagactgc

SEQ ID NO: 565969 - DNA, 20 bp, Artificial Sequence
  chemically synthesized
attcactggacttcttaaac

SEQ ID NO: 565970 - DNA, 20 bp, Artificial Sequence
  chemically synthesized
ctgattaaagactctaaatc

SEQ ID NO: 565971 - DNA, 20 bp, Artificial Sequence
  chemically synthesized
aatgacggagaagattccac

SEQ ID NO: 565972 - DNA, 20 bp, Artificial Sequence
  chemically synthesized
atttgttgagagaatgacgg

SEQ ID NO: 565973 - DNA, 20 bp, Artificial Sequence
  chemically synthesized
ggaagtcctgttcagagaaa

SEQ ID NO: 565974 - DNA, 20 bp, Artificial Sequence
  chemically synthesized
catctttttaaaacatcctt

SEQ ID NO: 565975 - DNA, 20 bp, Artificial Sequence
  chemically synthesized
aataagaatgaagcacagaa

SEQ ID NO: 565976 - DNA, 20 bp, Artificial Sequence
  chemically synthesized
gccggtctgctgtaaaccca

SEQ ID NO: 565977 - DNA, 20 bp, Artificial Sequence
  chemically synthesized
taatcaaaatttaaaactgt

SEQ ID NO: 565978 - DNA, 20 bp, Artificial Sequence
  chemically synthesized
taaacccatacagttttaaa

SEQ ID NO: 565979 - DNA, 20 bp, Artificial Sequence
  chemically synthesized
gtcatttttaaggtaacttc

SEQ ID NO: 565980 - DNA, 20 bp, Artificial Sequence
  chemically synthesized
tccctgtagatatttttcaa

SEQ ID NO: 565981 - DNA, 20 bp, Artificial Sequence
  chemically synthesized
tagacagattattttcttaa

SEQ ID NO: 565982 - DNA, 20 bp, Artificial Sequence
  chemically synthesized
atcatattccagaattatta

SEQ ID NO: 565983 - DNA, 20 bp, Artificial Sequence
  chemically synthesized
ggaatatgatgttatcgtag

SEQ ID NO: 565984 - DNA, 20 bp, Artificial Sequence
  chemically synthesized
tgttatcgtaggtctgcttc

SEQ ID NO: 565985 - DNA, 20 bp, Artificial Sequence
  chemically synthesized
tttcttctggttctcattca

SEQ ID NO: 565986 - DNA, 20 bp, Artificial Sequence
  chemically synthesized
ttgatttctttctttttcca

SEQ ID NO: 565987 - DNA, 20 bp, Artificial Sequence
  chemically synthesized
tttttccaccttgatttctt

SEQ ID NO: 565988 - DNA, 20 bp, Artificial Sequence
  chemically synthesized
cttgatttcttgtgtgctta

SEQ ID NO: 565989 - DNA, 20 bp, Artificial Sequence
  chemically synthesized
tcttgtgtgcttaatatgtt

SEQ ID NO: 565990 - DNA, 20 bp, Artificial Sequence
  chemically synthesized
ctctagaaaatattggtaag

SEQ ID NO: 565991 - DNA, 20 bp, Artificial Sequence
  chemically synthesized
aatattttctagagataaat

SEQ ID NO: 565992 - DNA, 20 bp, Artificial Sequence
  chemically synthesized
aaagcacttttattctaggc

SEQ ID NO: 565993 - DNA, 20 bp, Artificial Sequence
  chemically synthesized
aaagcttgagcctagaataa

SEQ ID NO: 565994 - DNA, 20 bp, Artificial Sequence
  chemically synthesized
aataaaagtgctttctccag

SEQ ID NO: 565995 - DNA, 20 bp, Artificial Sequence
  chemically synthesized
tttctccagagatgattctc

SEQ ID NO: 565996 - DNA, 20 bp, Artificial Sequence
  chemically synthesized
gaaattggctgtggaataag

SEQ ID NO: 565997 - DNA, 20 bp, Artificial Sequence
  chemically synthesized
gtatttgagctgcaaagcca

SEQ ID NO: 565998 - DNA, 20 bp, Artificial Sequence
  chemically synthesized
ccacattacaagagaagcaa

SEQ ID NO: 565999 - DNA, 20 bp, Artificial Sequence
  chemically synthesized
ccaagttgcttctcttgtaa

SEQ ID NO: 566000 - DNA, 20 bp, Artificial Sequence
  chemically synthesized
catttcagatagaaaggcag

SEQ ID NO: 566001 - DNA, 20 bp, Artificial Sequence
  chemically synthesized
gggtttagactgacaggtca

SEQ ID NO: 566002 - DNA, 20 bp, Artificial Sequence
  chemically synthesized
aatttagcaacactataata

SEQ ID NO: 566003 - DNA, 20 bp, Artificial Sequence
  chemically synthesized
actataataaactgtttaac

SEQ ID NO: 566004 - DNA, 20 bp, Artificial Sequence
  chemically synthesized
agctaggaaatccaaagtta

SEQ ID NO: 566005 - DNA, 20 bp, Artificial Sequence
  chemically synthesized
gtaaacagtagcatttgatc

SEQ ID NO: 566006 - DNA, 20 bp, Artificial Sequence
  chemically synthesized
tcaaacttccgatcaaatgc

SEQ ID NO: 566007 - DNA, 20 bp, Artificial Sequence
  chemically synthesized
cttccattggtgggcattta

SEQ ID NO: 566008 - DNA, 20 bp, Artificial Sequence
  chemically synthesized
cagtcttccattggtgggca

SEQ ID NO: 566009 - DNA, 20 bp, Artificial Sequence
  chemically synthesized
tattccagggtgtatatgta

SEQ ID NO: 566010 - DNA, 20 bp, Artificial Sequence
  chemically synthesized
acttggttttctgttcctgc

SEQ ID NO: 566011 - DNA, 20 bp, Artificial Sequence
  chemically synthesized
ggaacagaaaaccaagtatt

SEQ ID NO: 566012 - DNA, 20 bp, Artificial Sequence
  chemically synthesized
ataagtgaaaacatgcaata

SEQ ID NO: 566013 - DNA, 20 bp, Artificial Sequence
  chemically synthesized
tagaggggaaaaacacacac

SEQ ID NO: 566014 - DNA, 20 bp, Artificial Sequence
  chemically synthesized
atcctctgataagccacagt

SEQ ID NO: 566015 - DNA, 20 bp, Artificial Sequence
  chemically synthesized
aggaaaataactaatgggta

SEQ ID NO: 566016 - DNA, 20 bp, Artificial Sequence
  chemically synthesized
tgtgtcatgggggtttgttg

SEQ ID NO: 566017 - DNA, 20 bp, Artificial Sequence
  chemically synthesized
gtacaacaaacccccatgac

SEQ ID NO: 566018 - DNA, 20 bp, Artificial Sequence
  chemically synthesized
atgaggtaaacttgtgtcat

SEQ ID NO: 566019 - DNA, 20 bp, Artificial Sequence
  chemically synthesized
gtaagttcaggggtacctgt

SEQ ID NO: 566020 - DNA, 20 bp, Artificial Sequence
  chemically synthesized
cacagagaaaagtgctcagc

SEQ ID NO: 566021 - DNA, 20 bp, Artificial Sequence
  chemically synthesized
cagaggtactttgtggaaaa

SEQ ID NO: 566022 - DNA, 20 bp, Artificial Sequence
  chemically synthesized
cttgcatgatctttttcatt

SEQ ID NO: 566023 - DNA, 20 bp, Artificial Sequence
  chemically synthesized
accacagagctgtaagactt

SEQ ID NO: 566024 - DNA, 20 bp, Artificial Sequence
  chemically synthesized
gagtttggactcgatgaatg

SEQ ID NO: 566025 - DNA, 20 bp, Artificial Sequence
  chemically synthesized
aagcacacactggcatgggt

SEQ ID NO: 566026 - DNA, 20 bp, Artificial Sequence
  chemically synthesized
aaactcttacccatgccagt

SEQ ID NO: 566027 - DNA, 20 bp, Artificial Sequence
  chemically synthesized
tgttcaggatcaccttctaa

SEQ ID NO: 566028 - DNA, 20 bp, Artificial Sequence
  chemically synthesized
gaacttctatatgctgtgct

SEQ ID NO: 566029 - DNA, 20 bp, Artificial Sequence
  chemically synthesized
gccagtgagtggtgaactcc

SEQ ID NO: 566030 - DNA, 20 bp, Artificial Sequence
  chemically synthesized
aggtaggcactattaatatt

SEQ ID NO: 566031 - DNA, 20 bp, Artificial Sequence
  chemically synthesized
gcctacctcatagagttatt

SEQ ID NO: 566032 - DNA, 20 bp, Artificial Sequence
  chemically synthesized
tgtctgacacatagcaagaa

SEQ ID NO: 566033 - DNA, 20 bp, Artificial Sequence
  chemically synthesized
aatgacaataacaatagcaa

SEQ ID NO: 566034 - DNA, 20 bp, Artificial Sequence
  chemically synthesized
tttacttcttcttcatatga

SEQ ID NO: 566035 - DNA, 20 bp, Artificial Sequence
  chemically synthesized
ttcttcttcatatgacacgg

SEQ ID NO: 566036 - DNA, 20 bp, Artificial Sequence
  chemically synthesized
tttagaaaactattcttcaa

SEQ ID NO: 566037 - DNA, 20 bp, Artificial Sequence
  chemically synthesized
ctccgcaatcatatttgaag

SEQ ID NO: 566038 - DNA, 20 bp, Artificial Sequence
  chemically synthesized
ctatttctccagacagtgta

SEQ ID NO: 566039 - DNA, 20 bp, Artificial Sequence
  chemically synthesized
ctcaactaaaatctctgagt

SEQ ID NO: 566040 - DNA, 20 bp, Artificial Sequence
  chemically synthesized
catactgggaaacactgact

SEQ ID NO: 566041 - DNA, 20 bp, Artificial Sequence
  chemically synthesized
agcagatcaatcgtccagca

SEQ ID NO: 566042 - DNA, 20 bp, Artificial Sequence
  chemically synthesized
ttctcgtgaagcattttgct

SEQ ID NO: 566043 - DNA, 20 bp, Artificial Sequence
  chemically synthesized
taagaggcagatataatgtg

SEQ ID NO: 566044 - DNA, 20 bp, Artificial Sequence
  chemically synthesized
gttgctttactgatgacctt

SEQ ID NO: 566045 - DNA, 20 bp, Artificial Sequence
  chemically synthesized
gattccagagctgattaaca

SEQ ID NO: 566046 - DNA, 20 bp, Artificial Sequence
  chemically synthesized
agaatctgggaagattccag

SEQ ID NO: 566047 - DNA, 20 bp, Artificial Sequence
  chemically synthesized
ttaatcagctctggaatctt

SEQ ID NO: 566048 - DNA, 20 bp, Artificial Sequence
  chemically synthesized
tctctctctctgagaatctg

SEQ ID NO: 566049 - DNA, 20 bp, Artificial Sequence
  chemically synthesized
atcgccccttcagaagtcac

SEQ ID NO: 566050 - DNA, 20 bp, Artificial Sequence
  chemically synthesized
agcaagagtgacttctgaag

SEQ ID NO: 566051 - DNA, 20 bp, Artificial Sequence
  chemically synthesized
ttctgaaggggcgatttaat

SEQ ID NO: 566052 - DNA, 20 bp, Artificial Sequence
  chemically synthesized
aaattcttcatgctgcttaa

SEQ ID NO: 566053 - DNA, 20 bp, Artificial Sequence
  chemically synthesized
gctacagcctaaattcttca

SEQ ID NO: 566054 - DNA, 20 bp, Artificial Sequence
  chemically synthesized
cctcccttggtaattcacac

SEQ ID NO: 566055 - DNA, 20 bp, Artificial Sequence
  chemically synthesized
gttctactctttcaaaaaac

SEQ ID NO: 566056 - DNA, 20 bp, Artificial Sequence
  chemically synthesized
tcaaaaaactatagattctt

SEQ ID NO: 566057 - DNA, 20 bp, Artificial Sequence
  chemically synthesized
cctttaagcatagaagaatc

SEQ ID NO: 566058 - DNA, 20 bp, Artificial Sequence
  chemically synthesized
tctgtcagttggcgtaggtg

SEQ ID NO: 566059 - DNA, 20 bp, Artificial Sequence
  chemically synthesized
gacagactgaagacaaggta

SEQ ID NO: 566060 - DNA, 20 bp, Artificial Sequence
  chemically synthesized
tacggggattcacgttctca

SEQ ID NO: 566061 - DNA, 20 bp, Artificial Sequence
  chemically synthesized
gagtagtttgtcataaaaat

SEQ ID NO: 566062 - DNA, 20 bp, Artificial Sequence
  chemically synthesized
aatataccactaggatacag

SEQ ID NO: 566063 - DNA, 20 bp, Artificial Sequence
  chemically synthesized
aggaaagaattaaaagccag

SEQ ID NO: 566064 - DNA, 20 bp, Artificial Sequence
  chemically synthesized
taggtctttacagaagcttg

SEQ ID NO: 566065 - DNA, 20 bp, Artificial Sequence
  chemically synthesized
tagttctgttaggtctttac

SEQ ID NO: 566066 - DNA, 20 bp, Artificial Sequence
  chemically synthesized
tgatcgaaatgtaattttag

SEQ ID NO: 566067 - DNA, 20 bp, Artificial Sequence
  chemically synthesized
tccagaaaaaaatatatagg

SEQ ID NO: 566068 - DNA, 20 bp, Artificial Sequence
  chemically synthesized
tcaacaaataatggtactta

SEQ ID NO: 566069 - DNA, 20 bp, Artificial Sequence
  chemically synthesized
aggtcacccttgatactgag

SEQ ID NO: 566070 - DNA, 20 bp, Artificial Sequence
  chemically synthesized
ccttgtcctcatctctaaac

SEQ ID NO: 566071 - DNA, 20 bp, Artificial Sequence
  chemically synthesized
ttgcttgcatggcttgaaac

SEQ ID NO: 566072 - DNA, 20 bp, Artificial Sequence
  chemically synthesized
tttccaagagattttgcttg

SEQ ID NO: 566073 - DNA, 20 bp, Artificial Sequence
  chemically synthesized
taaatgacctttccaagaga

SEQ ID NO: 566074 - DNA, 20 bp, Artificial Sequence
  chemically synthesized
cagggctaaatgacctttcc

SEQ ID NO: 566075 - DNA, 20 bp, Artificial Sequence
  chemically synthesized
cttggaaaggtcatttagcc

SEQ ID NO: 566076 - DNA, 20 bp, Artificial Sequence
  chemically synthesized
aaaggtcatttagccctggg

SEQ ID NO: 566077 - DNA, 20 bp, Artificial Sequence
  chemically synthesized
tcatttagccctgggttttg

SEQ ID NO: 566078 - DNA, 20 bp, Artificial Sequence
  chemically synthesized
ccctgggttttgttttgttt

SEQ ID NO: 566079 - DNA, 20 bp, Artificial Sequence
  chemically synthesized
ggttttgttttgtttgttgg

SEQ ID NO: 566080 - DNA, 20 bp, Artificial Sequence
  chemically synthesized
tgttttgtttgttggctttg

SEQ ID NO: 566081 - DNA, 20 bp, Artificial Sequence
  chemically synthesized
tggctttgttttgcttttgc

SEQ ID NO: 566082 - DNA, 20 bp, Artificial Sequence
  chemically synthesized
aatggaaggagctgtgatag

SEQ ID NO: 566083 - DNA, 20 bp, Artificial Sequence
  chemically synthesized
atcataatggaaggagctgt

SEQ ID NO: 566084 - DNA, 20 bp, Artificial Sequence
  chemically synthesized
gctccttccattatgatggt

SEQ ID NO: 566085 - DNA, 20 bp, Artificial Sequence
  chemically synthesized
ggtcacagtttggaattatg

SEQ ID NO: 566086 - DNA, 20 bp, Artificial Sequence
  chemically synthesized
aatgacaactgattccttcc

SEQ ID NO: 566087 - DNA, 20 bp, Artificial Sequence
  chemically synthesized
aacagagcaatagtaatgac

SEQ ID NO: 566088 - DNA, 20 bp, Artificial Sequence
  chemically synthesized
tctgttacagcacactggag

SEQ ID NO: 566089 - DNA, 20 bp, Artificial Sequence
  chemically synthesized
aatatctggaatttctagca

SEQ ID NO: 566090 - DNA, 20 bp, Artificial Sequence
  chemically synthesized
cttattatattgataggtaa

SEQ ID NO: 566091 - DNA, 20 bp, Artificial Sequence
  chemically synthesized
ccgatttacctatcaatata

SEQ ID NO: 566092 - DNA, 20 bp, Artificial Sequence
  chemically synthesized
gtttaaaagggcattacatg

SEQ ID NO: 566093 - DNA, 20 bp, Artificial Sequence
  chemically synthesized
tgctggggttccgaagaact

SEQ ID NO: 566094 - DNA, 20 bp, Artificial Sequence
  chemically synthesized
acttttggatttctttgatg

SEQ ID NO: 566095 - DNA, 20 bp, Artificial Sequence
  chemically synthesized
gcggttggcccttcagtgtc

SEQ ID NO: 566096 - DNA, 20 bp, Artificial Sequence
  chemically synthesized
gcatttcttctgtagccatg

SEQ ID NO: 566097 - DNA, 20 bp, Artificial Sequence
  chemically synthesized
tgttcatggtagctgggatg

SEQ ID NO: 566098 - DNA, 20 bp, Artificial Sequence
  chemically synthesized
ggcaattggcatttcaattg

SEQ ID NO: 566099 - DNA, 20 bp, Artificial Sequence
  chemically synthesized
tgtagtttattaagtgttca

SEQ ID NO: 566100 - DNA, 20 bp, Artificial Sequence
  chemically synthesized
gggatgactgtactaattat

SEQ ID NO: 566101 - DNA, 20 bp, Artificial Sequence
  chemically synthesized
atccctcagtatatgctagg

SEQ ID NO: 566102 - DNA, 20 bp, Artificial Sequence
  chemically synthesized
ccgccgcagccccactccca

SEQ ID NO: 566103 - DNA, 20 bp, Artificial Sequence
  chemically synthesized
tactgtgggacttgcgtatg

SEQ ID NO: 566104 - DNA, 20 bp, Artificial Sequence
  chemically synthesized
gcccagctgaacgcatatcc

SEQ ID NO: 566105 - DNA, 20 bp, Artificial Sequence
  chemically synthesized
tgtgggtccacttataagtg

SEQ ID NO: 566106 - DNA, 20 bp, Artificial Sequence
  chemically synthesized
tggacccacacagttcaaat

SEQ ID NO: 566107 - DNA, 20 bp, Artificial Sequence
  chemically synthesized
tagagttgacccttgaaaaa

SEQ ID NO: 566108 - DNA, 20 bp, Artificial Sequence
  chemically synthesized
actgggcacagtctcttgcc

SEQ ID NO: 566109 - DNA, 20 bp, Artificial Sequence
  chemically synthesized
ttctgtattgtttccaggat

SEQ ID NO: 566110 - DNA, 20 bp, Artificial Sequence
  chemically synthesized
attaaggaggtatcgttctg

SEQ ID NO: 566111 - DNA, 20 bp, Artificial Sequence
  chemically synthesized
ccttaatttctttcctaaat

SEQ ID NO: 566112 - DNA, 20 bp, Artificial Sequence
  chemically synthesized
tcccacccactgttcaattc

SEQ ID NO: 566113 - DNA, 20 bp, Artificial Sequence
  chemically synthesized
tatgatcgcaagaaataaaa

SEQ ID NO: 566114 - DNA, 20 bp, Artificial Sequence
  chemically synthesized
tttttaaaattctgacttca

SEQ ID NO: 566115 - DNA, 20 bp, Artificial Sequence
  chemically synthesized
tttgctcttcaggatgacta

SEQ ID NO: 566116 - DNA, 20 bp, Artificial Sequence
  chemically synthesized
agagcaaaaacatacacttg

SEQ ID NO: 566117 - DNA, 20 bp, Artificial Sequence
  chemically synthesized
tttataaaatctttacaagt

SEQ ID NO: 566118 - DNA, 20 bp, Artificial Sequence
  chemically synthesized
aatcgataaaggaaattttg

SEQ ID NO: 566119 - DNA, 20 bp, Artificial Sequence
  chemically synthesized
aaactgtccaaaatttcctt

SEQ ID NO: 566120 - DNA, 20 bp, Artificial Sequence
  chemically synthesized
attacagtaaatgtccttgt

SEQ ID NO: 566121 - DNA, 20 bp, Artificial Sequence
  chemically synthesized
agaaggtatgtacagaatga

SEQ ID NO: 566122 - DNA, 20 bp, Artificial Sequence
  chemically synthesized
tgaaaggaactgcacaggca

SEQ ID NO: 566123 - DNA, 20 bp, Artificial Sequence
  chemically synthesized
gtaccccagaggaaatataa

SEQ ID NO: 566124 - DNA, 20 bp, Artificial Sequence
  chemically synthesized
tatttggcgatgtttttctc

SEQ ID NO: 566125 - DNA, 20 bp, Artificial Sequence
  chemically synthesized
aataaatttaacatatttgg

SEQ ID NO: 566126 - DNA, 20 bp, Artificial Sequence
  chemically synthesized
atttattttggaattagaaa

SEQ ID NO: 566127 - DNA, 20 bp, Artificial Sequence
  chemically synthesized
aaacttctgtttttaccaat

SEQ ID NO: 566128 - DNA, 20 bp, Artificial Sequence
  chemically synthesized
aaacttttattggtaaaaac

SEQ ID NO: 566129 - DNA, 20 bp, Artificial Sequence
  chemically synthesized
tccaagcagcttatgtaaac

SEQ ID NO: 566130 - DNA, 20 bp, Artificial Sequence
  chemically synthesized
taaaaacagaagtttacata

SEQ ID NO: 566131 - DNA, 20 bp, Artificial Sequence
  chemically synthesized
tgaaacgaactatgtttcca

SEQ ID NO: 566132 - DNA, 20 bp, Artificial Sequence
  chemically synthesized
ataagctgcttggaaacata

SEQ ID NO: 566133 - DNA, 20 bp, Artificial Sequence
  chemically synthesized
cgttgagcatctgaaacgaa

SEQ ID NO: 566134 - DNA, 20 bp, Artificial Sequence
  chemically synthesized
tgctcaacgccagaactggt

SEQ ID NO: 566135 - DNA, 20 bp, Artificial Sequence
  chemically synthesized
taacagaggaatttcttgtg

SEQ ID NO: 566136 - DNA, 20 bp, Artificial Sequence
  chemically synthesized
ttcatgctgccctggctcta

SEQ ID NO: 566137 - DNA, 20 bp, Artificial Sequence
  chemically synthesized
gttagtttgggactgacaaa

SEQ ID NO: 566138 - DNA, 20 bp, Artificial Sequence
  chemically synthesized
tagcatttagtagatagagg

SEQ ID NO: 566139 - DNA, 20 bp, Artificial Sequence
  chemically synthesized
aagctgccctgtgtgctgct

SEQ ID NO: 566140 - DNA, 20 bp, Artificial Sequence
  chemically synthesized
aaacatccagcagcacacag

SEQ ID NO: 566141 - DNA, 20 bp, Artificial Sequence
  chemically synthesized
cttcccacaacaaagaacta

SEQ ID NO: 566142 - DNA, 20 bp, Artificial Sequence
  chemically synthesized
tttctcaaccttggtgctac

SEQ ID NO: 566143 - DNA, 20 bp, Artificial Sequence
  chemically synthesized
gtaagatgttaacattgggg

SEQ ID NO: 566144 - DNA, 20 bp, Artificial Sequence
  chemically synthesized
tgtcaaaactaagaaatcca

SEQ ID NO: 566145 - DNA, 20 bp, Artificial Sequence
  chemically synthesized
tgatgaatcaatgtggattt

SEQ ID NO: 566146 - DNA, 20 bp, Artificial Sequence
  chemically synthesized
agtgaatagtgatgaatcaa

SEQ ID NO: 566147 - DNA, 20 bp, Artificial Sequence
  chemically synthesized
gcaggactctcagggaagtc

SEQ ID NO: 566148 - DNA, 20 bp, Artificial Sequence
  chemically synthesized
ctgtgttgtagaggatagtt

SEQ ID NO: 566149 - DNA, 20 bp, Artificial Sequence
  chemically synthesized
gaataggcctatggtagcct

SEQ ID NO: 566150 - DNA, 20 bp, Artificial Sequence
  chemically synthesized
tcccttttgctctctctacc

SEQ ID NO: 566151 - DNA, 20 bp, Artificial Sequence
  chemically synthesized
tttccttgtgacttctagtt

SEQ ID NO: 566152 - DNA, 20 bp, Artificial Sequence
  chemically synthesized
tagcgtgtttccttgtgact

SEQ ID NO: 566153 - DNA, 20 bp, Artificial Sequence
  chemically synthesized
aatctgagtctacaatttta

SEQ ID NO: 566154 - DNA, 20 bp, Artificial Sequence
  chemically synthesized
aaacacgctaaaattgtaga

SEQ ID NO: 566155 - DNA, 20 bp, Artificial Sequence
  chemically synthesized
tagactcagatttgaaatca

SEQ ID NO: 566156 - DNA, 20 bp, Artificial Sequence
  chemically synthesized
agttgtcagtttgagaagca

SEQ ID NO: 566157 - DNA, 20 bp, Artificial Sequence
  chemically synthesized
ggaatacactgcatagagtt

SEQ ID NO: 566158 - DNA, 20 bp, Artificial Sequence
  chemically synthesized
ttaaataaataaatttctgc

SEQ ID NO: 566159 - DNA, 20 bp, Artificial Sequence
  chemically synthesized
ttgcttgggataattatctg

SEQ ID NO: 566160 - DNA, 20 bp, Artificial Sequence
  chemically synthesized
gtactagcagacctgcttta

SEQ ID NO: 566161 - DNA, 20 bp, Artificial Sequence
  chemically synthesized
catacacattgtactagcag

SEQ ID NO: 566162 - DNA, 20 bp, Artificial Sequence
  chemically synthesized
gtatgtgtgtgtgtgtgtgt

SEQ ID NO: 566163 - DNA, 20 bp, Artificial Sequence
  chemically synthesized
tgtgtgtgtgtgtgtgtgtg

SEQ ID NO: 566164 - DNA, 20 bp, Artificial Sequence
  chemically synthesized
ttacctttttctgtcaataa

SEQ ID NO: 566165 - DNA, 20 bp, Artificial Sequence
  chemically synthesized
aaaaatctgtggtttgccca

SEQ ID NO: 566166 - DNA, 20 bp, Artificial Sequence
  chemically synthesized
ggaaaacattgtgggcaaac

SEQ ID NO: 566167 - DNA, 20 bp, Artificial Sequence
  chemically synthesized
gattaccctttttaaaaatc

SEQ ID NO: 566168 - DNA, 20 bp, Artificial Sequence
  chemically synthesized
aaaccatatcagccacaaag

SEQ ID NO: 566169 - DNA, 20 bp, Artificial Sequence
  chemically synthesized
aatctctcctttgtggctga

SEQ ID NO: 566170 - DNA, 20 bp, Artificial Sequence
  chemically synthesized
tgtgggagttataattcaag

SEQ ID NO: 566171 - DNA, 20 bp, Artificial Sequence
  chemically synthesized
cgtgggaggagcctggtggg

SEQ ID NO: 566172 - DNA, 20 bp, Artificial Sequence
  chemically synthesized
gaatgagtctcacactatct

SEQ ID NO: 566173 - DNA, 20 bp, Artificial Sequence
  chemically synthesized
tatctgatggttttaaaaac

SEQ ID NO: 566174 - DNA, 20 bp, Artificial Sequence
  chemically synthesized
aagagcttgtgcagagaaac

SEQ ID NO: 566175 - DNA, 20 bp, Artificial Sequence
  chemically synthesized
tggatggcagcaggcaaaaa

SEQ ID NO: 566176 - DNA, 20 bp, Artificial Sequence
  chemically synthesized
ttgctcctccttgccttctg

SEQ ID NO: 566177 - DNA, 20 bp, Artificial Sequence
  chemically synthesized
tgaaaatggccactgtatta

SEQ ID NO: 566178 - DNA, 20 bp, Artificial Sequence
  chemically synthesized
caatgacattgaaatgattt

SEQ ID NO: 566179 - DNA, 20 bp, Artificial Sequence
  chemically synthesized
taacaatggcaatgacattg

SEQ ID NO: 566180 - DNA, 20 bp, Artificial Sequence
  chemically synthesized
ataaaaagccttagcatttg

SEQ ID NO: 566181 - DNA, 20 bp, Artificial Sequence
  chemically synthesized
cagcaaatctttccaaatgc

SEQ ID NO: 566182 - DNA, 20 bp, Artificial Sequence
  chemically synthesized
gctgaatttaaatttataaa

SEQ ID NO: 566183 - DNA, 20 bp, Artificial Sequence
  chemically synthesized
gtacagactgtaattcaaaa

SEQ ID NO: 566184 - DNA, 20 bp, Artificial Sequence
  chemically synthesized
tttgaattacagtctgtaca

SEQ ID NO: 566185 - DNA, 20 bp, Artificial Sequence
  chemically synthesized
ccctgactaaccgttctcct

SEQ ID NO: 566186 - DNA, 20 bp, Artificial Sequence
  chemically synthesized
aatattccactgatgccctt

SEQ ID NO: 566187 - DNA, 20 bp, Artificial Sequence
  chemically synthesized
gaagagtcattaatattctt

SEQ ID NO: 566188 - DNA, 20 bp, Artificial Sequence
  chemically synthesized
ttgattttcataaaaattgg

SEQ ID NO: 566189 - DNA, 20 bp, Artificial Sequence
  chemically synthesized
tcatttgattttcataaaaa

SEQ ID NO: 566190 - DNA, 20 bp, Artificial Sequence
  chemically synthesized
atagagtctttttatcactc

SEQ ID NO: 566191 - DNA, 20 bp, Artificial Sequence
  chemically synthesized
tttgttacatgcaggttttg

SEQ ID NO: 566192 - DNA, 20 bp, Artificial Sequence
  chemically synthesized
ttctgttttatttgttacat

SEQ ID NO: 566193 - DNA, 20 bp, Artificial Sequence
  chemically synthesized
ggatcaaaatgtcaccttcc

SEQ ID NO: 566194 - DNA, 20 bp, Artificial Sequence
  chemically synthesized
tcctcttagacacaagatac

SEQ ID NO: 566195 - DNA, 20 bp, Artificial Sequence
  chemically synthesized
gatcccttgcgtccgtacac

SEQ ID NO: 566196 - DNA, 20 bp, Artificial Sequence
  chemically synthesized
atttacatgaggttgtacac

SEQ ID NO: 566197 - DNA, 20 bp, Artificial Sequence
  chemically synthesized
tttcacatcttgctcttagt

SEQ ID NO: 566198 - DNA, 20 bp, Artificial Sequence
  chemically synthesized
atgccacactctatgtacaa

SEQ ID NO: 566199 - DNA, 20 bp, Artificial Sequence
  chemically synthesized
taagactttgctgatcatgg

SEQ ID NO: 566200 - DNA, 20 bp, Artificial Sequence
  chemically synthesized
atggattattgtacttattt

SEQ ID NO: 566201 - DNA, 20 bp, Artificial Sequence
  chemically synthesized
gttataaaggccgaaaggga

SEQ ID NO: 566202 - DNA, 20 bp, Artificial Sequence
  chemically synthesized
agttacttatccctaagtgt

SEQ ID NO: 566203 - DNA, 20 bp, Artificial Sequence
  chemically synthesized
gataagtaacttttgagata

SEQ ID NO: 566204 - DNA, 20 bp, Artificial Sequence
  chemically synthesized
aggcccaaagaggttaagga

SEQ ID NO: 566205 - DNA, 20 bp, Artificial Sequence
  chemically synthesized
aaagaggttaaggaaacagc

SEQ ID NO: 566206 - DNA, 20 bp, Artificial Sequence
  chemically synthesized
taaaatcgtagataatctta

SEQ ID NO: 566207 - DNA, 20 bp, Artificial Sequence
  chemically synthesized
aggaaacagcttaagattat

SEQ ID NO: 566208 - DNA, 20 bp, Artificial Sequence
  chemically synthesized
tacgattttaatactgaaat

SEQ ID NO: 566209 - DNA, 20 bp, Artificial Sequence
  chemically synthesized
gtcttaaaaagacaggacaa

SEQ ID NO: 566210 - DNA, 20 bp, Artificial Sequence
  chemically synthesized
tcaaaagattttggggatcg

SEQ ID NO: 566211 - DNA, 20 bp, Artificial Sequence
  chemically synthesized
ttcaaacaaattaaagattc

SEQ ID NO: 566212 - DNA, 20 bp, Artificial Sequence
  chemically synthesized
caaaatcttttgaatcttta

SEQ ID NO: 566213 - DNA, 20 bp, Artificial Sequence
  chemically synthesized
tctagtactttcaaacaaat

SEQ ID NO: 566214 - DNA, 20 bp, Artificial Sequence
  chemically synthesized
tggaaattgtcctaagtggg

SEQ ID NO: 566215 - DNA, 20 bp, Artificial Sequence
  chemically synthesized
ttatcggcatataattcagt

SEQ ID NO: 566216 - DNA, 20 bp, Artificial Sequence
  chemically synthesized
aaaaaaagaaacaaaactct

SEQ ID NO: 566217 - DNA, 20 bp, Artificial Sequence
  chemically synthesized
gaattgagaagctcatagag

SEQ ID NO: 566218 - DNA, 20 bp, Artificial Sequence
  chemically synthesized
gtgctgaattgagaagctca

SEQ ID NO: 566219 - DNA, 20 bp, Artificial Sequence
  chemically synthesized
ctatgagcttctcaattcag

SEQ ID NO: 566220 - DNA, 20 bp, Artificial Sequence
  chemically synthesized
ttcagcacagttttcatgtt

SEQ ID NO: 566221 - DNA, 20 bp, Artificial Sequence
  chemically synthesized
gtcaatgtgttgttcccata

SEQ ID NO: 566222 - DNA, 20 bp, Artificial Sequence
  chemically synthesized
tggaaatgtatttattagac

SEQ ID NO: 566223 - DNA, 20 bp, Artificial Sequence
  chemically synthesized
ggatactatttttgtcttgg

SEQ ID NO: 566224 - DNA, 20 bp, Artificial Sequence
  chemically synthesized
gaccattttcttatgtaaag

SEQ ID NO: 566225 - DNA, 20 bp, Artificial Sequence
  chemically synthesized
aatattggtggttgcataat

SEQ ID NO: 566226 - DNA, 20 bp, Artificial Sequence
  chemically synthesized
cattccttaaccttttaccc

SEQ ID NO: 566227 - DNA, 20 bp, Artificial Sequence
  chemically synthesized
acaaaatgttattttgttcc

SEQ ID NO: 566228 - DNA, 20 bp, Artificial Sequence
  chemically synthesized
tttctgatggtttccttgtg

SEQ ID NO: 566229 - DNA, 20 bp, Artificial Sequence
  chemically synthesized
gggcttttctgatggtttcc

SEQ ID NO: 566230 - DNA, 20 bp, Artificial Sequence
  chemically synthesized
cccatactctgggcttttct

SEQ ID NO: 566231 - DNA, 20 bp, Artificial Sequence
  chemically synthesized
cttgaagaatgtcccatact

SEQ ID NO: 566232 - DNA, 20 bp, Artificial Sequence
  chemically synthesized
ttttgtatttttagtagaga

SEQ ID NO: 566233 - DNA, 20 bp, Artificial Sequence
  chemically synthesized
aggcatgcaccaccacaccc

SEQ ID NO: 566234 - DNA, 20 bp, Artificial Sequence
  chemically synthesized
cacctcagcctcaggagtag

SEQ ID NO: 566235 - DNA, 20 bp, Artificial Sequence
  chemically synthesized
caatctcggctcactgcaac

SEQ ID NO: 566236 - DNA, 20 bp, Artificial Sequence
  chemically synthesized
gaagcagaggttgcagtgag

SEQ ID NO: 566237 - DNA, 20 bp, Artificial Sequence
  chemically synthesized
ttttgaacagtctcccagca

SEQ ID NO: 566238 - DNA, 20 bp, Artificial Sequence
  chemically synthesized
gtcatgtctctgtaccttca

SEQ ID NO: 566239 - DNA, 20 bp, Artificial Sequence
  chemically synthesized
gttttcttccagcatctagt

SEQ ID NO: 566240 - DNA, 20 bp, Artificial Sequence
  chemically synthesized
ccagaattgttccttatagc

SEQ ID NO: 566241 - DNA, 20 bp, Artificial Sequence
  chemically synthesized
actgcatatcagagggtatt

SEQ ID NO: 566242 - DNA, 20 bp, Artificial Sequence
  chemically synthesized
taagaaaatggtgtatggtg

SEQ ID NO: 566243 - DNA, 20 bp, Artificial Sequence
  chemically synthesized
tggtgtatggtgaagtgttt

SEQ ID NO: 566244 - DNA, 20 bp, Artificial Sequence
  chemically synthesized
tttaaatggcataggggaaa

SEQ ID NO: 566245 - DNA, 20 bp, Artificial Sequence
  chemically synthesized
tacctcctccaccctctcag

SEQ ID NO: 566246 - DNA, 20 bp, Artificial Sequence
  chemically synthesized
taagtagagcgaaaagcaac

SEQ ID NO: 566247 - DNA, 20 bp, Artificial Sequence
  chemically synthesized
catacatctgttcaatccat

SEQ ID NO: 566248 - DNA, 20 bp, Artificial Sequence
  chemically synthesized
actatcctttcaactactct

SEQ ID NO: 566249 - DNA, 20 bp, Artificial Sequence
  chemically synthesized
tcaactactctttgtgcttg

SEQ ID NO: 566250 - DNA, 20 bp, Artificial Sequence
  chemically synthesized
gagaaataacggtttccaac

SEQ ID NO: 566251 - DNA, 20 bp, Artificial Sequence
  chemically synthesized
aggggtgacttgggagaaat

SEQ ID NO: 566252 - DNA, 20 bp, Artificial Sequence
  chemically synthesized
caaggcaggagggtgggcaa

SEQ ID NO: 566253 - DNA, 20 bp, Artificial Sequence
  chemically synthesized
taatgagtgtgaaaagttcc

SEQ ID NO: 566254 - DNA, 20 bp, Artificial Sequence
  chemically synthesized
agtgtgaaaagttccccagg

SEQ ID NO: 566255 - DNA, 20 bp, Artificial Sequence
  chemically synthesized
aaaatacaaacctaacgcaa

SEQ ID NO: 566256 - DNA, 20 bp, Artificial Sequence
  chemically synthesized
ggaaggaaatcaattttgcg

SEQ ID NO: 566257 - DNA, 20 bp, Artificial Sequence
  chemically synthesized
tctaggcagagtcgatgagg

SEQ ID NO: 566258 - DNA, 20 bp, Artificial Sequence
  chemically synthesized
tcctcatcgactctgcctag

SEQ ID NO: 566259 - DNA, 20 bp, Artificial Sequence
  chemically synthesized
cttaaactcattttcatgcc

SEQ ID NO: 566260 - DNA, 20 bp, Artificial Sequence
  chemically synthesized
gtgaatctccaggcatgaaa

SEQ ID NO: 566261 - DNA, 20 bp, Artificial Sequence
  chemically synthesized
acatgcgcagaagcagaact

SEQ ID NO: 566262 - DNA, 20 bp, Artificial Sequence
  chemically synthesized
ctcaatccttaaacaaaaag

SEQ ID NO: 566263 - DNA, 20 bp, Artificial Sequence
  chemically synthesized
cagaagcagaactttttgtt

SEQ ID NO: 566264 - DNA, 20 bp, Artificial Sequence
  chemically synthesized
ttgtgagacaagaagaagta

SEQ ID NO: 566265 - DNA, 20 bp, Artificial Sequence
  chemically synthesized
ttcagaactttaaataaaat

SEQ ID NO: 566266 - DNA, 20 bp, Artificial Sequence
  chemically synthesized
ctttaatgggtgattcagag

SEQ ID NO: 566267 - DNA, 20 bp, Artificial Sequence
  chemically synthesized
gggctgattttatctttaat

SEQ ID NO: 566268 - DNA, 20 bp, Artificial Sequence
  chemically synthesized
tcaccatgtgttattgtttg

SEQ ID NO: 566269 - DNA, 20 bp, Artificial Sequence
  chemically synthesized
tcagcccaaacaataacaca

SEQ ID NO: 566270 - DNA, 20 bp, Artificial Sequence
  chemically synthesized
agtggataatcaccatgtgt

SEQ ID NO: 566271 - DNA, 20 bp, Artificial Sequence
  chemically synthesized
tccctagggccatggcgtta

SEQ ID NO: 566272 - DNA, 20 bp, Artificial Sequence
  chemically synthesized
tgagtatacttagggatttg

SEQ ID NO: 566273 - DNA, 20 bp, Artificial Sequence
  chemically synthesized
ttaatactgttgagtatact

SEQ ID NO: 566274 - DNA, 20 bp, Artificial Sequence
  chemically synthesized
taacaggaaagttaaattag

SEQ ID NO: 566275 - DNA, 20 bp, Artificial Sequence
  chemically synthesized
tggtacctatagacagatat

SEQ ID NO: 566276 - DNA, 20 bp, Artificial Sequence
  chemically synthesized
cttttcctgaactggatttt

SEQ ID NO: 566277 - DNA, 20 bp, Artificial Sequence
  chemically synthesized
gtaattttgccttttcctga

SEQ ID NO: 566278 - DNA, 20 bp, Artificial Sequence
  chemically synthesized
acaggaacagaaaacagagc

SEQ ID NO: 566279 - DNA, 20 bp, Artificial Sequence
  chemically synthesized
ccaatctctggaaaccacag

SEQ ID NO: 566280 - DNA, 20 bp, Artificial Sequence
  chemically synthesized
gaaaacagagctgtggtttc

SEQ ID NO: 566281 - DNA, 20 bp, Artificial Sequence
  chemically synthesized
gagaggaaggaaggaagaaa

SEQ ID NO: 566282 - DNA, 20 bp, Artificial Sequence
  chemically synthesized
aagatggaaaacaaaatgac

SEQ ID NO: 566283 - DNA, 20 bp, Artificial Sequence
  chemically synthesized
ctaaggaaaagcacatgtca

SEQ ID NO: 566284 - DNA, 20 bp, Artificial Sequence
  chemically synthesized
gcagtaagtgtataaacaaa

SEQ ID NO: 566285 - DNA, 20 bp, Artificial Sequence
  chemically synthesized
tgtgttgtagttgaaacctg

SEQ ID NO: 566286 - DNA, 20 bp, Artificial Sequence
  chemically synthesized
aggtttgtgttgtagttgaa

SEQ ID NO: 566287 - DNA, 20 bp, Artificial Sequence
  chemically synthesized
tcttcaccagaattttgaag

SEQ ID NO: 566288 - DNA, 20 bp, Artificial Sequence
  chemically synthesized
aacttctctattggagtaat

SEQ ID NO: 566289 - DNA, 20 bp, Artificial Sequence
  chemically synthesized
atgatctgtttaagtggttt

SEQ ID NO: 566290 - DNA, 20 bp, Artificial Sequence
  chemically synthesized
tatgatgatctgtttaagtg

SEQ ID NO: 566291 - DNA, 20 bp, Artificial Sequence
  chemically synthesized
gctttatgatgatctgttta

SEQ ID NO: 566292 - DNA, 20 bp, Artificial Sequence
  chemically synthesized
accacttaaacagatcatca

SEQ ID NO: 566293 - DNA, 20 bp, Artificial Sequence
  chemically synthesized
gtgggttaagctttatgatg

SEQ ID NO: 566294 - DNA, 20 bp, Artificial Sequence
  chemically synthesized
catcataaagcttaacccac

SEQ ID NO: 566295 - DNA, 20 bp, Artificial Sequence
  chemically synthesized
aaattttaagctaccgtggg

SEQ ID NO: 566296 - DNA, 20 bp, Artificial Sequence
  chemically synthesized
agtattgtcttaagtttaat

SEQ ID NO: 566297 - DNA, 20 bp, Artificial Sequence
  chemically synthesized
agagtattatcagtattgtc

SEQ ID NO: 566298 - DNA, 20 bp, Artificial Sequence
  chemically synthesized
gtaagaggtcggtgatatct

SEQ ID NO: 566299 - DNA, 20 bp, Artificial Sequence
  chemically synthesized
agccagctatctctatggaa

SEQ ID NO: 566300 - DNA, 20 bp, Artificial Sequence
  chemically synthesized
atggaaccaaagggcccaca

SEQ ID NO: 566301 - DNA, 20 bp, Artificial Sequence
  chemically synthesized
cctccttcacttaggtttcc

SEQ ID NO: 566302 - DNA, 20 bp, Artificial Sequence
  chemically synthesized
caaaggaaacctaagtgaag

SEQ ID NO: 566303 - DNA, 20 bp, Artificial Sequence
  chemically synthesized
tcctaaaaaccctccttcac

SEQ ID NO: 566304 - DNA, 20 bp, Artificial Sequence
  chemically synthesized
ctggccgattccattttatt

SEQ ID NO: 566305 - DNA, 20 bp, Artificial Sequence
  chemically synthesized
aggcatgagccatcacacct

SEQ ID NO: 566306 - DNA, 20 bp, Artificial Sequence
  chemically synthesized
cacctcagcctcccaaagtg

SEQ ID NO: 566307 - DNA, 20 bp, Artificial Sequence
  chemically synthesized
ggtgggcggatcacaaggtc

SEQ ID NO: 566308 - DNA, 20 bp, Artificial Sequence
  chemically synthesized
atttttgtatttttaataga

SEQ ID NO: 566309 - DNA, 20 bp, Artificial Sequence
  chemically synthesized
aacctccacctcccaggttc

SEQ ID NO: 566310 - DNA, 20 bp, Artificial Sequence
  chemically synthesized
tagacagcattccccgggtc

SEQ ID NO: 566311 - DNA, 20 bp, Artificial Sequence
  chemically synthesized
cattttagagattctggaga

SEQ ID NO: 566312 - DNA, 20 bp, Artificial Sequence
  chemically synthesized
ggattgcattttagagattc

SEQ ID NO: 566313 - DNA, 20 bp, Artificial Sequence
  chemically synthesized
atcatctgtggattgcattt

SEQ ID NO: 566314 - DNA, 20 bp, Artificial Sequence
  chemically synthesized
tctaaaatgcaatccacaga

SEQ ID NO: 566315 - DNA, 20 bp, Artificial Sequence
  chemically synthesized
atctataacaaaacatcatc

SEQ ID NO: 566316 - DNA, 20 bp, Artificial Sequence
  chemically synthesized
aatatcctgccaatgttaac

SEQ ID NO: 566317 - DNA, 20 bp, Artificial Sequence
  chemically synthesized
aggtgcccagtgaatgttag

SEQ ID NO: 566318 - DNA, 20 bp, Artificial Sequence
  chemically synthesized
atgtatccactacagctctt

SEQ ID NO: 566319 - DNA, 20 bp, Artificial Sequence
  chemically synthesized
tccactacagctcttaagtg

SEQ ID NO: 566320 - DNA, 20 bp, Artificial Sequence
  chemically synthesized
tgaactcctggaggtgattg

SEQ ID NO: 566321 - DNA, 20 bp, Artificial Sequence
  chemically synthesized
cctggcccctgaactcctgg

SEQ ID NO: 566322 - DNA, 20 bp, Artificial Sequence
  chemically synthesized
acagccagcaaatagcagag

SEQ ID NO: 566323 - DNA, 20 bp, Artificial Sequence
  chemically synthesized
agatttggactcaggcacag

SEQ ID NO: 566324 - DNA, 20 bp, Artificial Sequence
  chemically synthesized
ctggcagagtggttaagtgc

SEQ ID NO: 566325 - DNA, 20 bp, Artificial Sequence
  chemically synthesized
tcacttctccagatattctg

SEQ ID NO: 566326 - DNA, 20 bp, Artificial Sequence
  chemically synthesized
aactaaaagagtagaattgg

SEQ ID NO: 566327 - DNA, 20 bp, Artificial Sequence
  chemically synthesized
cttagtattccaaatgagta

SEQ ID NO: 566328 - DNA, 20 bp, Artificial Sequence
  chemically synthesized
tcaaaatctgtttattttac

SEQ ID NO: 566329 - DNA, 20 bp, Artificial Sequence
  chemically synthesized
cagaaaacagatgtaaaata

SEQ ID NO: 566330 - DNA, 20 bp, Artificial Sequence
  chemically synthesized
atgagagctggagtgtcaaa

SEQ ID NO: 566331 - DNA, 20 bp, Artificial Sequence
  chemically synthesized
gtataccaactttatattca

SEQ ID NO: 566332 - DNA, 20 bp, Artificial Sequence
  chemically synthesized
agtaaacattttaaggactt

SEQ ID NO: 566333 - DNA, 20 bp, Artificial Sequence
  chemically synthesized
tctaaacaataaagtcctta

SEQ ID NO: 566334 - DNA, 20 bp, Artificial Sequence
  chemically synthesized
gtgcagatatctttttgtgg

SEQ ID NO: 566335 - DNA, 20 bp, Artificial Sequence
  chemically synthesized
tgggagtgcagatatctttt

SEQ ID NO: 566336 - DNA, 20 bp, Artificial Sequence
  chemically synthesized
catccactgatgggcgctta

SEQ ID NO: 566337 - DNA, 20 bp, Artificial Sequence
  chemically synthesized
ttatgcattcatccactgat

SEQ ID NO: 566338 - DNA, 20 bp, Artificial Sequence
  chemically synthesized
tggctgaataatattccatt

SEQ ID NO: 566339 - DNA, 20 bp, Artificial Sequence
  chemically synthesized
cgtacatgttgctgcaaata

SEQ ID NO: 566340 - DNA, 20 bp, Artificial Sequence
  chemically synthesized
catttcccagactctggtag

SEQ ID NO: 566341 - DNA, 20 bp, Artificial Sequence
  chemically synthesized
cagtaagaagaaatatgatc

SEQ ID NO: 566342 - DNA, 20 bp, Artificial Sequence
  chemically synthesized
tgtaaaaagatttaaaaata

SEQ ID NO: 566343 - DNA, 20 bp, Artificial Sequence
  chemically synthesized
atagtgagaccctatctgta

SEQ ID NO: 566344 - DNA, 20 bp, Artificial Sequence
  chemically synthesized
gtagcacgcacctgtaggac

SEQ ID NO: 566345 - DNA, 20 bp, Artificial Sequence
  chemically synthesized
gttcctaccagagaaatgat

SEQ ID NO: 566346 - DNA, 20 bp, Artificial Sequence
  chemically synthesized
gatgatggacaccccaatta

SEQ ID NO: 566347 - DNA, 20 bp, Artificial Sequence
  chemically synthesized
attgtgttaccctacacatt

SEQ ID NO: 566348 - DNA, 20 bp, Artificial Sequence
  chemically synthesized
gtcatttaacaggtaaaaaa

SEQ ID NO: 566349 - DNA, 20 bp, Artificial Sequence
  chemically synthesized
cctgttaaatgactggcagt

SEQ ID NO: 566350 - DNA, 20 bp, Artificial Sequence
  chemically synthesized
tcccataagatcaacgtaag

SEQ ID NO: 566351 - DNA, 20 bp, Artificial Sequence
  chemically synthesized
tacagtcatgtgctgaagaa

SEQ ID NO: 566352 - DNA, 20 bp, Artificial Sequence
  chemically synthesized
cattcttcagcacatgactg

SEQ ID NO: 566353 - DNA, 20 bp, Artificial Sequence
  chemically synthesized
tttcccacctaaaagtgata

SEQ ID NO: 566354 - DNA, 20 bp, Artificial Sequence
  chemically synthesized
agatagactaaacagctatg

SEQ ID NO: 566355 - DNA, 20 bp, Artificial Sequence
  chemically synthesized
aaatactctaatcccaacat

SEQ ID NO: 566356 - DNA, 20 bp, Artificial Sequence
  chemically synthesized
agatgggtgtgtgtgcatgt

SEQ ID NO: 566357 - DNA, 20 bp, Artificial Sequence
  chemically synthesized
atgtatgtgttttgggggag

SEQ ID NO: 566358 - DNA, 20 bp, Artificial Sequence
  chemically synthesized
atgtgatcccctatatgaat

SEQ ID NO: 566359 - DNA, 20 bp, Artificial Sequence
  chemically synthesized
tggcttcaaccagttcggag

SEQ ID NO: 566360 - DNA, 20 bp, Artificial Sequence
  chemically synthesized
tcgtgcaatttacatcatgt

SEQ ID NO: 566361 - DNA, 20 bp, Artificial Sequence
  chemically synthesized
atgtaaattgcacgatgtag

SEQ ID NO: 566362 - DNA, 20 bp, Artificial Sequence
  chemically synthesized
gattcattgtgccactgtgg

SEQ ID NO: 566363 - DNA, 20 bp, Artificial Sequence
  chemically synthesized
tagactgcctgaaggaacct

SEQ ID NO: 566364 - DNA, 20 bp, Artificial Sequence
  chemically synthesized
ctatgtgactcactgccagg

SEQ ID NO: 566365 - DNA, 20 bp, Artificial Sequence
  chemically synthesized
acagccctgttgagagatta

SEQ ID NO: 566366 - DNA, 20 bp, Artificial Sequence
  chemically synthesized
ggaaacagccctgttgagag

SEQ ID NO: 566367 - DNA, 20 bp, Artificial Sequence
  chemically synthesized
tcaatctaatctctcaacag

SEQ ID NO: 566368 - DNA, 20 bp, Artificial Sequence
  chemically synthesized
tccatggaaacagccctgtt

SEQ ID NO: 566369 - DNA, 20 bp, Artificial Sequence
  chemically synthesized
acagctgtaattaatatatt

SEQ ID NO: 566370 - DNA, 20 bp, Artificial Sequence
  chemically synthesized
gatagaagtaaagttttgca

SEQ ID NO: 566371 - DNA, 20 bp, Artificial Sequence
  chemically synthesized
cattttggtagtgatagaag

SEQ ID NO: 566372 - DNA, 20 bp, Artificial Sequence
  chemically synthesized
atactaaatgaggcaacagg

SEQ ID NO: 566373 - DNA, 20 bp, Artificial Sequence
  chemically synthesized
aggaatagtcactgtaaatt

SEQ ID NO: 566374 - DNA, 20 bp, Artificial Sequence
  chemically synthesized
ccatggatgtgacttcattt

SEQ ID NO: 566375 - DNA, 20 bp, Artificial Sequence
  chemically synthesized
ataattccttggaagaccta

SEQ ID NO: 566376 - DNA, 20 bp, Artificial Sequence
  chemically synthesized
tatcaggtctaaatgtaaaa

SEQ ID NO: 566377 - DNA, 20 bp, Artificial Sequence
  chemically synthesized
attttacatttagacctgat

SEQ ID NO: 566378 - DNA, 20 bp, Artificial Sequence
  chemically synthesized
cactctctggattatctatt

SEQ ID NO: 566379 - DNA, 20 bp, Artificial Sequence
  chemically synthesized
cgtgtttgtgtgccacactc

SEQ ID NO: 566380 - DNA, 20 bp, Artificial Sequence
  chemically synthesized
gtagtggcaagaagagaggt

SEQ ID NO: 566381 - DNA, 20 bp, Artificial Sequence
  chemically synthesized
actgggcccttgtctgaatc

SEQ ID NO: 566382 - DNA, 20 bp, Artificial Sequence
  chemically synthesized
agttagaaaggtactgaatc

SEQ ID NO: 566383 - DNA, 20 bp, Artificial Sequence
  chemically synthesized
tgtaccaacctgaaacaaag

SEQ ID NO: 566384 - DNA, 20 bp, Artificial Sequence
  chemically synthesized
gtcaccacctggaaacctta

SEQ ID NO: 566385 - DNA, 20 bp, Artificial Sequence
  chemically synthesized
tgcattgcagatttgatttc

SEQ ID NO: 566386 - DNA, 20 bp, Artificial Sequence
  chemically synthesized
gtgcattccttgcattgcag

SEQ ID NO: 566387 - DNA, 20 bp, Artificial Sequence
  chemically synthesized
tacaagtgcattccttgcat

SEQ ID NO: 566388 - DNA, 20 bp, Artificial Sequence
  chemically synthesized
aggataaacaagtactttat

SEQ ID NO: 566389 - DNA, 20 bp, Artificial Sequence
  chemically synthesized
gaggtaaacggtaataaagt

SEQ ID NO: 566390 - DNA, 20 bp, Artificial Sequence
  chemically synthesized
agaaatagcagcctttgagc

SEQ ID NO: 566391 - DNA, 20 bp, Artificial Sequence
  chemically synthesized
aggctgggctggttccttca

SEQ ID NO: 566392 - DNA, 20 bp, Artificial Sequence
  chemically synthesized
gagtgaaaatgtcctctgcc

SEQ ID NO: 566393 - DNA, 20 bp, Artificial Sequence
  chemically synthesized
gtgccacgtgcataaaaata

SEQ ID NO: 566394 - DNA, 20 bp, Artificial Sequence
  chemically synthesized
gaatccacgtcctggccctg

SEQ ID NO: 566395 - DNA, 20 bp, Artificial Sequence
  chemically synthesized
aaagcatgccagggccagga

SEQ ID NO: 566396 - DNA, 20 bp, Artificial Sequence
  chemically synthesized
atttacaatggatccattca

SEQ ID NO: 566397 - DNA, 20 bp, Artificial Sequence
  chemically synthesized
cttagatttggggagcctct

SEQ ID NO: 566398 - DNA, 20 bp, Artificial Sequence
  chemically synthesized
gtatggcgaggctttcatta

SEQ ID NO: 566399 - DNA, 20 bp, Artificial Sequence
  chemically synthesized
agtaaattccatatgtatgg

SEQ ID NO: 566400 - DNA, 20 bp, Artificial Sequence
  chemically synthesized
tacatatggaatttactagc

SEQ ID NO: 566401 - DNA, 20 bp, Artificial Sequence
  chemically synthesized
acccttgagggggaagagga

SEQ ID NO: 566402 - DNA, 20 bp, Artificial Sequence
  chemically synthesized
caggactcaggaaaagtagc

SEQ ID NO: 566403 - DNA, 20 bp, Artificial Sequence
  chemically synthesized
agtttctgatacttctgctc

SEQ ID NO: 566404 - DNA, 20 bp, Artificial Sequence
  chemically synthesized
tactacctcattcccaaata

SEQ ID NO: 566405 - DNA, 20 bp, Artificial Sequence
  chemically synthesized
gtccctcagctggtggaagg

SEQ ID NO: 566406 - DNA, 20 bp, Artificial Sequence
  chemically synthesized
taaagtccctcagctggtgg

SEQ ID NO: 566407 - DNA, 20 bp, Artificial Sequence
  chemically synthesized
tttggagattttgcttttat

SEQ ID NO: 566408 - DNA, 20 bp, Artificial Sequence
  chemically synthesized
gaatagtcaggctttggaga

SEQ ID NO: 566409 - DNA, 20 bp, Artificial Sequence
  chemically synthesized
ggaacagaatagtcaggctt

SEQ ID NO: 566410 - DNA, 20 bp, Artificial Sequence
  chemically synthesized
ctttgaggggaacagaatag

SEQ ID NO: 566411 - DNA, 20 bp, Artificial Sequence
  chemically synthesized
tgttcccctcaaagacttgg

SEQ ID NO: 566412 - DNA, 20 bp, Artificial Sequence
  chemically synthesized
aatgagagaattcatgtgaa

SEQ ID NO: 566413 - DNA, 20 bp, Artificial Sequence
  chemically synthesized
ctccttaccatttgtaccta

SEQ ID NO: 566414 - DNA, 20 bp, Artificial Sequence
  chemically synthesized
aggtacaaatggtaaggaga

SEQ ID NO: 566415 - DNA, 20 bp, Artificial Sequence
  chemically synthesized
gtttgctttcactatcatga

SEQ ID NO: 566416 - DNA, 20 bp, Artificial Sequence
  chemically synthesized
tggtttcataaccacccata

SEQ ID NO: 566417 - DNA, 20 bp, Artificial Sequence
  chemically synthesized
actctggtttcataaccacc

SEQ ID NO: 566418 - DNA, 20 bp, Artificial Sequence
  chemically synthesized
aactctcagacctttcctac

SEQ ID NO: 566419 - DNA, 20 bp, Artificial Sequence
  chemically synthesized
ctgagagttaaatagaggaa

SEQ ID NO: 566420 - DNA, 20 bp, Artificial Sequence
  chemically synthesized
caaggacggcatcatatggg

SEQ ID NO: 566421 - DNA, 20 bp, Artificial Sequence
  chemically synthesized
attggtcttattgccctcat

SEQ ID NO: 566422 - DNA, 20 bp, Artificial Sequence
  chemically synthesized
aaaggactggagtgtgaagt

SEQ ID NO: 566423 - DNA, 20 bp, Artificial Sequence
  chemically synthesized
ccaggccttctcatcattgc

SEQ ID NO: 566424 - DNA, 20 bp, Artificial Sequence
  chemically synthesized
gctttccattgccattctta

SEQ ID NO: 566425 - DNA, 20 bp, Artificial Sequence
  chemically synthesized
atggaaagcaatcaaacaaa

SEQ ID NO: 566426 - DNA, 20 bp, Artificial Sequence
  chemically synthesized
gaaagaaacatgttttgttt

SEQ ID NO: 566427 - DNA, 20 bp, Artificial Sequence
  chemically synthesized
tagggaaagaaacatgtttt

SEQ ID NO: 566428 - DNA, 20 bp, Artificial Sequence
  chemically synthesized
tttttagggaaagaaacatg

SEQ ID NO: 566429 - DNA, 20 bp, Artificial Sequence
  chemically synthesized
ctctttttttagggaaagaa

SEQ ID NO: 566430 - DNA, 20 bp, Artificial Sequence
  chemically synthesized
ctctgtactatttttatttt

SEQ ID NO: 566431 - DNA, 20 bp, Artificial Sequence
  chemically synthesized
gaatggtggtaacaggtggc

SEQ ID NO: 566432 - DNA, 20 bp, Artificial Sequence
  chemically synthesized
agatatgaatggtggtaaca

SEQ ID NO: 566433 - DNA, 20 bp, Artificial Sequence
  chemically synthesized
gttaccaccattcatatctt

SEQ ID NO: 566434 - DNA, 20 bp, Artificial Sequence
  chemically synthesized
agccacggcatccagccttg

SEQ ID NO: 566435 - DNA, 20 bp, Artificial Sequence
  chemically synthesized
ttgggaggctgaggtgggtg

SEQ ID NO: 566436 - DNA, 20 bp, Artificial Sequence
  chemically synthesized
gaaatgtgaaatgtgttttg

SEQ ID NO: 566437 - DNA, 20 bp, Artificial Sequence
  chemically synthesized
tctttgaaatgtgaaatgtg

SEQ ID NO: 566438 - DNA, 20 bp, Artificial Sequence
  chemically synthesized
caagctctttgaaatgtgaa

SEQ ID NO: 566439 - DNA, 20 bp, Artificial Sequence
  chemically synthesized
aaaacacatttcacatttca

SEQ ID NO: 566440 - DNA, 20 bp, Artificial Sequence
  chemically synthesized
atgcaaggatggactgaatt

SEQ ID NO: 566441 - DNA, 20 bp, Artificial Sequence
  chemically synthesized
caactctgtattctcagtct

SEQ ID NO: 566442 - DNA, 20 bp, Artificial Sequence
  chemically synthesized
aatgtaaccaaaccagagac

SEQ ID NO: 566443 - DNA, 20 bp, Artificial Sequence
  chemically synthesized
tactcccctaagcccatgtc

SEQ ID NO: 566444 - DNA, 20 bp, Artificial Sequence
  chemically synthesized
ggggggcagcccagggaaag

SEQ ID NO: 566445 - DNA, 20 bp, Artificial Sequence
  chemically synthesized
aagcggtggccatacagaag

SEQ ID NO: 566446 - DNA, 20 bp, Artificial Sequence
  chemically synthesized
aagcagagcttctgtatggc

SEQ ID NO: 566447 - DNA, 20 bp, Artificial Sequence
  chemically synthesized
tcactgcagcctctggccct

SEQ ID NO: 566448 - DNA, 20 bp, Artificial Sequence
  chemically synthesized
gaggctgcagtgaggatggt

SEQ ID NO: 566449 - DNA, 20 bp, Artificial Sequence
  chemically synthesized
tattcagggccagctggatt

SEQ ID NO: 566450 - DNA, 20 bp, Artificial Sequence
  chemically synthesized
ctaggctgtattcagggcca

SEQ ID NO: 566451 - DNA, 20 bp, Artificial Sequence
  chemically synthesized
ccagctggccctgaatacag

SEQ ID NO: 566452 - DNA, 20 bp, Artificial Sequence
  chemically synthesized
ccaagtcacaatgcacacac

SEQ ID NO: 566453 - DNA, 20 bp, Artificial Sequence
  chemically synthesized
ccctatatatgaacacgtgt

SEQ ID NO: 566454 - DNA, 20 bp, Artificial Sequence
  chemically synthesized
gagacttgactaaaggggaa

SEQ ID NO: 566455 - DNA, 20 bp, Artificial Sequence
  chemically synthesized
tgcctcggcctcccaaagtg

SEQ ID NO: 566456 - DNA, 20 bp, Artificial Sequence
  chemically synthesized
cactttgggaggccgaggca

SEQ ID NO: 566457 - DNA, 20 bp, Artificial Sequence
  chemically synthesized
ttgggaggccgaggcaggtg

SEQ ID NO: 566458 - DNA, 20 bp, Artificial Sequence
  chemically synthesized
caggtggattgcttgagatc

SEQ ID NO: 566459 - DNA, 20 bp, Artificial Sequence
  chemically synthesized
tggctaattttttgtggaga

SEQ ID NO: 566460 - DNA, 20 bp, Artificial Sequence
  chemically synthesized
tgcctcagcctcccgagtag

SEQ ID NO: 566461 - DNA, 20 bp, Artificial Sequence
  chemically synthesized
tcgggaggctgaggcatgac

SEQ ID NO: 566462 - DNA, 20 bp, Artificial Sequence
  chemically synthesized
tgtgtgttttttttgttttg

SEQ ID NO: 566463 - DNA, 20 bp, Artificial Sequence
  chemically synthesized
ttggttgtgtgttttttttg

SEQ ID NO: 566464 - DNA, 20 bp, Artificial Sequence
  chemically synthesized
atcttttggttgtgtgtttt

SEQ ID NO: 566465 - DNA, 20 bp, Artificial Sequence
  chemically synthesized
aacaaaaaaaacacacaacc

SEQ ID NO: 566466 - DNA, 20 bp, Artificial Sequence
  chemically synthesized
tatttcctaatcttttggtt

SEQ ID NO: 566467 - DNA, 20 bp, Artificial Sequence
  chemically synthesized
ccaaaagattaggaaataac

SEQ ID NO: 566468 - DNA, 20 bp, Artificial Sequence
  chemically synthesized
aataactcgcgtttatggca

SEQ ID NO: 566469 - DNA, 20 bp, Artificial Sequence
  chemically synthesized
ttatggcaagttgttttata

SEQ ID NO: 566470 - DNA, 20 bp, Artificial Sequence
  chemically synthesized
ttttaaaaaatcaaaatgaa

SEQ ID NO: 566471 - DNA, 20 bp, Artificial Sequence
  chemically synthesized
ccacaggcaatctaggttca

SEQ ID NO: 566472 - DNA, 20 bp, Artificial Sequence
  chemically synthesized
agttacttgtgtctacattt

SEQ ID NO: 566473 - DNA, 20 bp, Artificial Sequence
  chemically synthesized
acttgtgtctacattttgat

SEQ ID NO: 566474 - DNA, 20 bp, Artificial Sequence
  chemically synthesized
tgtctacattttgatgattg

SEQ ID NO: 566475 - DNA, 20 bp, Artificial Sequence
  chemically synthesized
gatcatctatctgcattttg

SEQ ID NO: 566476 - DNA, 20 bp, Artificial Sequence
  chemically synthesized
catttatgtaaagtgggata

SEQ ID NO: 566477 - DNA, 20 bp, Artificial Sequence
  chemically synthesized
atttatttaatagttagttg

SEQ ID NO: 566478 - DNA, 20 bp, Artificial Sequence
  chemically synthesized
aactattaaataaatactca

SEQ ID NO: 566479 - DNA, 20 bp, Artificial Sequence
  chemically synthesized
gtgaatatttaggtgtttaa

SEQ ID NO: 566480 - DNA, 20 bp, Artificial Sequence
  chemically synthesized
gcagatcactgtgaatattt

SEQ ID NO: 566481 - DNA, 20 bp, Artificial Sequence
  chemically synthesized
gatctgcccaggaaaccttc

SEQ ID NO: 566482 - DNA, 20 bp, Artificial Sequence
  chemically synthesized
cagactaggatgaaactata

SEQ ID NO: 566483 - DNA, 20 bp, Artificial Sequence
  chemically synthesized
tctaattctattaacaatgg

SEQ ID NO: 566484 - DNA, 20 bp, Artificial Sequence
  chemically synthesized
gccattgttaatagaattag

SEQ ID NO: 566485 - DNA, 20 bp, Artificial Sequence
  chemically synthesized
taagagctgtttttcttatg

SEQ ID NO: 566486 - DNA, 20 bp, Artificial Sequence
  chemically synthesized
tggttttttcaagtgctaag

SEQ ID NO: 566487 - DNA, 20 bp, Artificial Sequence
  chemically synthesized
agtgttcttatgtttttgtt

SEQ ID NO: 566488 - DNA, 20 bp, Artificial Sequence
  chemically synthesized
tattcacagtgttcttatgt

SEQ ID NO: 566489 - DNA, 20 bp, Artificial Sequence
  chemically synthesized
tcacattattcacagtgttc

SEQ ID NO: 566490 - DNA, 20 bp, Artificial Sequence
  chemically synthesized
ctatcagtattgaaggagta

SEQ ID NO: 566491 - DNA, 20 bp, Artificial Sequence
  chemically synthesized
ttttgaagaaaggccacaaa

SEQ ID NO: 566492 - DNA, 20 bp, Artificial Sequence
  chemically synthesized
tataggatcaattctcaggc

SEQ ID NO: 566493 - DNA, 20 bp, Artificial Sequence
  chemically synthesized
ctgagaattgatcctataaa

SEQ ID NO: 566494 - DNA, 20 bp, Artificial Sequence
  chemically synthesized
tatcgtttagcttttgtctt

SEQ ID NO: 566495 - DNA, 20 bp, Artificial Sequence
  chemically synthesized
tacaatgaacatccttatcg

SEQ ID NO: 566496 - DNA, 20 bp, Artificial Sequence
  chemically synthesized
agtgctacaatgaacatcct

SEQ ID NO: 566497 - DNA, 20 bp, Artificial Sequence
  chemically synthesized
aaaaattagaggccaggcac

SEQ ID NO: 566498 - DNA, 20 bp, Artificial Sequence
  chemically synthesized
tgcctcgaactcccaaagtg

SEQ ID NO: 566499 - DNA, 20 bp, Artificial Sequence
  chemically synthesized
caggtggatcacctgaggtc

SEQ ID NO: 566500 - DNA, 20 bp, Artificial Sequence
  chemically synthesized
ttttgtatttttagtagaga

SEQ ID NO: 566501 - DNA, 20 bp, Artificial Sequence
  chemically synthesized
tctctactaaaaatacaaaa

SEQ ID NO: 566502 - DNA, 20 bp, Artificial Sequence
  chemically synthesized
tacctcagcctcccgagtag

SEQ ID NO: 566503 - DNA, 20 bp, Artificial Sequence
  chemically synthesized
aacctccacctcccgggttc

SEQ ID NO: 566504 - DNA, 20 bp, Artificial Sequence
  chemically synthesized
tcaggcatttgggaagaaga

SEQ ID NO: 566505 - DNA, 20 bp, Artificial Sequence
  chemically synthesized
ttctctttcctatcctgtcc

SEQ ID NO: 566506 - DNA, 20 bp, Artificial Sequence
  chemically synthesized
ggaatgtcaaagctacaaag

SEQ ID NO: 566507 - DNA, 20 bp, Artificial Sequence
  chemically synthesized
ttttttttaaaactgtcctt

SEQ ID NO: 566508 - DNA, 20 bp, Artificial Sequence
  chemically synthesized
aaggccattttcttatatac

SEQ ID NO: 566509 - DNA, 20 bp, Artificial Sequence
  chemically synthesized
tgtggggtccctgctgcaga

SEQ ID NO: 566510 - DNA, 20 bp, Artificial Sequence
  chemically synthesized
agtaagcagcttctggaact

SEQ ID NO: 566511 - DNA, 20 bp, Artificial Sequence
  chemically synthesized
ccaaaacctagagttccaga

SEQ ID NO: 566512 - DNA, 20 bp, Artificial Sequence
  chemically synthesized
atttggaacctctgtaagta

SEQ ID NO: 566513 - DNA, 20 bp, Artificial Sequence
  chemically synthesized
ctcttcagtaggcagtaggt

SEQ ID NO: 566514 - DNA, 20 bp, Artificial Sequence
  chemically synthesized
atatgagaaaacgaagctct

SEQ ID NO: 566515 - DNA, 20 bp, Artificial Sequence
  chemically synthesized
taattaaaaaacccacagag

SEQ ID NO: 566516 - DNA, 20 bp, Artificial Sequence
  chemically synthesized
gaaattaattaaaaaaccca

SEQ ID NO: 566517 - DNA, 20 bp, Artificial Sequence
  chemically synthesized
acattgagccaagtgtccgg

SEQ ID NO: 566518 - DNA, 20 bp, Artificial Sequence
  chemically synthesized
cgcaggctgggcctccttct

SEQ ID NO: 566519 - DNA, 20 bp, Artificial Sequence
  chemically synthesized
tcaagcaagtggcaagttca

SEQ ID NO: 566520 - DNA, 20 bp, Artificial Sequence
  chemically synthesized
aaaatcctgttgaacttgcc

SEQ ID NO: 566521 - DNA, 20 bp, Artificial Sequence
  chemically synthesized
tctgctggcatccatgggtg

SEQ ID NO: 566522 - DNA, 20 bp, Artificial Sequence
  chemically synthesized
attcataaaaataataaata

SEQ ID NO: 566523 - DNA, 20 bp, Artificial Sequence
  chemically synthesized
tatatatacagtgatcatta

SEQ ID NO: 566524 - DNA, 20 bp, Artificial Sequence
  chemically synthesized
gcttgcgcttcttgcagtga

SEQ ID NO: 566525 - DNA, 20 bp, Artificial Sequence
  chemically synthesized
actgtgtcactgcaagaagc

SEQ ID NO: 566526 - DNA, 20 bp, Artificial Sequence
  chemically synthesized
tgtcgagggtacgtgtaagc

SEQ ID NO: 566527 - DNA, 20 bp, Artificial Sequence
  chemically synthesized
tttaagtgtcgagggtacgt

SEQ ID NO: 566528 - DNA, 20 bp, Artificial Sequence
  chemically synthesized
ataattcccaaggattatgt

SEQ ID NO: 566529 - DNA, 20 bp, Artificial Sequence
  chemically synthesized
atcctatatacaataattcc

SEQ ID NO: 566530 - DNA, 20 bp, Artificial Sequence
  chemically synthesized
atgtaactacatcaaaaaat

SEQ ID NO: 566531 - DNA, 20 bp, Artificial Sequence
  chemically synthesized
tctctggtgtccaaggaggg

SEQ ID NO: 566532 - DNA, 20 bp, Artificial Sequence
  chemically synthesized
gcaccaccctccttggacac

SEQ ID NO: 566533 - DNA, 20 bp, Artificial Sequence
  chemically synthesized
tttatggagtcataagatca

SEQ ID NO: 566534 - DNA, 20 bp, Artificial Sequence
  chemically synthesized
tgttcccacaggatactgtg

SEQ ID NO: 566535 - DNA, 20 bp, Artificial Sequence
  chemically synthesized
gcatagtttgttgttgttgt

SEQ ID NO: 566536 - DNA, 20 bp, Artificial Sequence
  chemically synthesized
tcaggcggctgaggcaggag

SEQ ID NO: 566537 - DNA, 20 bp, Artificial Sequence
  chemically synthesized
tgcctcagccgcctgagtag

SEQ ID NO: 566538 - DNA, 20 bp, Artificial Sequence
  chemically synthesized
tttttgtatttttactggag

SEQ ID NO: 566539 - DNA, 20 bp, Artificial Sequence
  chemically synthesized
tacctcggcctccctaagtg

SEQ ID NO: 566540 - DNA, 20 bp, Artificial Sequence
  chemically synthesized
ctcacatcatgttatgctgg

SEQ ID NO: 566541 - DNA, 20 bp, Artificial Sequence
  chemically synthesized
gcattgattcaatatgtgtc

SEQ ID NO: 566542 - DNA, 20 bp, Artificial Sequence
  chemically synthesized
acagaatgaatgaacatact

SEQ ID NO: 566543 - DNA, 20 bp, Artificial Sequence
  chemically synthesized
catactgaatgcttgcaatg

SEQ ID NO: 566544 - DNA, 20 bp, Artificial Sequence
  chemically synthesized
aacttctaggtgaatataag

SEQ ID NO: 566545 - DNA, 20 bp, Artificial Sequence
  chemically synthesized
ctcaaaaaaagtaaatccaa

SEQ ID NO: 566546 - DNA, 20 bp, Artificial Sequence
  chemically synthesized
ttatgggtacagaaagcttt

SEQ ID NO: 566547 - DNA, 20 bp, Artificial Sequence
  chemically synthesized
aaagtgtgcttatgggtaca

SEQ ID NO: 566548 - DNA, 20 bp, Artificial Sequence
  chemically synthesized
ttaatttcctagagtttaaa

SEQ ID NO: 566549 - DNA, 20 bp, Artificial Sequence
  chemically synthesized
actttaaactctaggaaatt

SEQ ID NO: 566550 - DNA, 20 bp, Artificial Sequence
  chemically synthesized
tgttaaaacatttaatttcc

SEQ ID NO: 566551 - DNA, 20 bp, Artificial Sequence
  chemically synthesized
acctaagatggcactaaaaa

SEQ ID NO: 566552 - DNA, 20 bp, Artificial Sequence
  chemically synthesized
ctaaaaattgagattgtacg

SEQ ID NO: 566553 - DNA, 20 bp, Artificial Sequence
  chemically synthesized
gctctccgatatacatacct

SEQ ID NO: 566554 - DNA, 20 bp, Artificial Sequence
  chemically synthesized
aaaatattaaatgcaaaatg

SEQ ID NO: 566555 - DNA, 20 bp, Artificial Sequence
  chemically synthesized
tctcattttgcatttaatat

SEQ ID NO: 566556 - DNA, 20 bp, Artificial Sequence
  chemically synthesized
cgaataactactaagaggga

SEQ ID NO: 566557 - DNA, 20 bp, Artificial Sequence
  chemically synthesized
agttattcgaaacaccaact

SEQ ID NO: 566558 - DNA, 20 bp, Artificial Sequence
  chemically synthesized
taattgaggaagctttgagt

SEQ ID NO: 566559 - DNA, 20 bp, Artificial Sequence
  chemically synthesized
atattaaattgaataattga

SEQ ID NO: 566560 - DNA, 20 bp, Artificial Sequence
  chemically synthesized
tgtcactataccatatatac

SEQ ID NO: 566561 - DNA, 20 bp, Artificial Sequence
  chemically synthesized
tcggatgagatgggatacct

SEQ ID NO: 566562 - DNA, 20 bp, Artificial Sequence
  chemically synthesized
gaacgagagaaaaataactg

SEQ ID NO: 566563 - DNA, 20 bp, Artificial Sequence
  chemically synthesized
cacttttatgtagtttccac

SEQ ID NO: 566564 - DNA, 20 bp, Artificial Sequence
  chemically synthesized
cattttggccctcactttta

SEQ ID NO: 566565 - DNA, 20 bp, Artificial Sequence
  chemically synthesized
tacataaaagtgagggccaa

SEQ ID NO: 566566 - DNA, 20 bp, Artificial Sequence
  chemically synthesized
ccaaaatggtttgtgtattt

SEQ ID NO: 566567 - DNA, 20 bp, Artificial Sequence
  chemically synthesized
aaatgatcagtaggagacag

SEQ ID NO: 566568 - DNA, 20 bp, Artificial Sequence
  chemically synthesized
cttttatctcctgcctgtcc

SEQ ID NO: 566569 - DNA, 20 bp, Artificial Sequence
  chemically synthesized
cacacatgtgaggagatgtg

SEQ ID NO: 566570 - DNA, 20 bp, Artificial Sequence
  chemically synthesized
gaaaagacaagctaggctga

SEQ ID NO: 566571 - DNA, 20 bp, Artificial Sequence
  chemically synthesized
ggaatattaaacaaattcag

SEQ ID NO: 566572 - DNA, 20 bp, Artificial Sequence
  chemically synthesized
tttgtttaatattcctactg

SEQ ID NO: 566573 - DNA, 20 bp, Artificial Sequence
  chemically synthesized
tttaatattcctactgaaaa

SEQ ID NO: 566574 - DNA, 20 bp, Artificial Sequence
  chemically synthesized
tgcagttggttttccccttg

SEQ ID NO: 566575 - DNA, 20 bp, Artificial Sequence
  chemically synthesized
tcatattgtgaaaggctgca

SEQ ID NO: 566576 - DNA, 20 bp, Artificial Sequence
  chemically synthesized
tgaaccatcactcctctagc

SEQ ID NO: 566577 - DNA, 20 bp, Artificial Sequence
  chemically synthesized
cctctagcattggcttttaa

SEQ ID NO: 566578 - DNA, 20 bp, Artificial Sequence
  chemically synthesized
attggcttttaatttggttt

SEQ ID NO: 566579 - DNA, 20 bp, Artificial Sequence
  chemically synthesized
tttgattacgcattgggttc

SEQ ID NO: 566580 - DNA, 20 bp, Artificial Sequence
  chemically synthesized
taccaccctacagaatttcc

SEQ ID NO: 566581 - DNA, 20 bp, Artificial Sequence
  chemically synthesized
tatttgagagacagatagct

SEQ ID NO: 566582 - DNA, 20 bp, Artificial Sequence
  chemically synthesized
attttattatttgagagaca

SEQ ID NO: 566583 - DNA, 20 bp, Artificial Sequence
  chemically synthesized
tgtcagtacaacttgcagta

SEQ ID NO: 566584 - DNA, 20 bp, Artificial Sequence
  chemically synthesized
taagatgattataaaataaa

SEQ ID NO: 566585 - DNA, 20 bp, Artificial Sequence
  chemically synthesized
tgacattcatgttcaagaaa

SEQ ID NO: 566586 - DNA, 20 bp, Artificial Sequence
  chemically synthesized
acccaaagactagacaagtg

SEQ ID NO: 566587 - DNA, 20 bp, Artificial Sequence
  chemically synthesized
gtaagtcggaaaaataagtg

SEQ ID NO: 566588 - DNA, 20 bp, Artificial Sequence
  chemically synthesized
acatgttcctaggggataaa

SEQ ID NO: 566589 - DNA, 20 bp, Artificial Sequence
  chemically synthesized
agactttatcccctaggaac

SEQ ID NO: 566590 - DNA, 20 bp, Artificial Sequence
  chemically synthesized
catttaagtagagaatgagg

SEQ ID NO: 566591 - DNA, 20 bp, Artificial Sequence
  chemically synthesized
gcaggcatttaagtagagaa

SEQ ID NO: 566592 - DNA, 20 bp, Artificial Sequence
  chemically synthesized
ctacttaaatgcctgcaatt

SEQ ID NO: 566593 - DNA, 20 bp, Artificial Sequence
  chemically synthesized
gcttttagagtgtcataaaa

SEQ ID NO: 566594 - DNA, 20 bp, Artificial Sequence
  chemically synthesized
attcctcatgtaagatgtag

SEQ ID NO: 566595 - DNA, 20 bp, Artificial Sequence
  chemically synthesized
acagactgttcttatttgac

SEQ ID NO: 566596 - DNA, 20 bp, Artificial Sequence
  chemically synthesized
catctgtacttgtcttccaa

SEQ ID NO: 566597 - DNA, 20 bp, Artificial Sequence
  chemically synthesized
gctttacacagggaaatgat

SEQ ID NO: 566598 - DNA, 20 bp, Artificial Sequence
  chemically synthesized
gggtcagtaattgttttctg

SEQ ID NO: 566599 - DNA, 20 bp, Artificial Sequence
  chemically synthesized
ggaaagggtcagtaattgtt

SEQ ID NO: 566600 - DNA, 20 bp, Artificial Sequence
  chemically synthesized
ccctctaggaaagggtcagt

SEQ ID NO: 566601 - DNA, 20 bp, Artificial Sequence
  chemically synthesized
aaggctttattcttaactag

SEQ ID NO: 566602 - DNA, 20 bp, Artificial Sequence
  chemically synthesized
actcctttatttttcctttt

SEQ ID NO: 566603 - DNA, 20 bp, Artificial Sequence
  chemically synthesized
gatgtgtgaactctattgac

SEQ ID NO: 566604 - DNA, 20 bp, Artificial Sequence
  chemically synthesized
ctctattgaccactgtttta

SEQ ID NO: 566605 - DNA, 20 bp, Artificial Sequence
  chemically synthesized
attgaccactgttttattaa

SEQ ID NO: 566606 - DNA, 20 bp, Artificial Sequence
  chemically synthesized
attcaaccaacttgaccact

SEQ ID NO: 566607 - DNA, 20 bp, Artificial Sequence
  chemically synthesized
acttgaccactgaatgttta

SEQ ID NO: 566608 - DNA, 20 bp, Artificial Sequence
  chemically synthesized
agaacttttgcagttcaaat

SEQ ID NO: 566609 - DNA, 20 bp, Artificial Sequence
  chemically synthesized
attcacctatggaaagccac

SEQ ID NO: 566610 - DNA, 20 bp, Artificial Sequence
  chemically synthesized
tgcttaccaacttaaaccaa

SEQ ID NO: 566611 - DNA, 20 bp, Artificial Sequence
  chemically synthesized
ttggtgaagattagtaattc

SEQ ID NO: 566612 - DNA, 20 bp, Artificial Sequence
  chemically synthesized
tagtaaccaaagtagattgg

SEQ ID NO: 566613 - DNA, 20 bp, Artificial Sequence
  chemically synthesized
taatttgctttagtaaccaa

SEQ ID NO: 566614 - DNA, 20 bp, Artificial Sequence
  chemically synthesized
ttccatgaccaaagtaggta

SEQ ID NO: 566615 - DNA, 20 bp, Artificial Sequence
  chemically synthesized
agttagttgctggtaatttt

SEQ ID NO: 566616 - DNA, 20 bp, Artificial Sequence
  chemically synthesized
tcttaaatgctcagatcttc

SEQ ID NO: 566617 - DNA, 20 bp, Artificial Sequence
  chemically synthesized
taacacataatatagaatat

SEQ ID NO: 566618 - DNA, 20 bp, Artificial Sequence
  chemically synthesized
ttttagatcatatatttgaa

SEQ ID NO: 566619 - DNA, 20 bp, Artificial Sequence
  chemically synthesized
taaataacctgttgctatat

SEQ ID NO: 566620 - DNA, 20 bp, Artificial Sequence
  chemically synthesized
ttgctatatcagtgttttaa

SEQ ID NO: 566621 - DNA, 20 bp, Artificial Sequence
  chemically synthesized
tatatcagtgttttaatata

SEQ ID NO: 566622 - DNA, 20 bp, Artificial Sequence
  chemically synthesized
tgttatgtgaaatgctttat

SEQ ID NO: 566623 - DNA, 20 bp, Artificial Sequence
  chemically synthesized
attaataaatttgttatgtg

SEQ ID NO: 566624 - DNA, 20 bp, Artificial Sequence
  chemically synthesized
ttttttcccccatggataaa

SEQ ID NO: 566625 - DNA, 20 bp, Artificial Sequence
  chemically synthesized
aaaaaggaaaaataagaatg

SEQ ID NO: 566626 - DNA, 20 bp, Artificial Sequence
  chemically synthesized
ttctcattgatgggcattca

SEQ ID NO: 566627 - DNA, 20 bp, Artificial Sequence
  chemically synthesized
atgagatcatgtcttttgaa

SEQ ID NO: 566628 - DNA, 20 bp, Artificial Sequence
  chemically synthesized
atttacttttctgtttctgc

SEQ ID NO: 566629 - DNA, 20 bp, Artificial Sequence
  chemically synthesized
agaacatgcagtatttactt

SEQ ID NO: 566630 - DNA, 20 bp, Artificial Sequence
  chemically synthesized
gtgttcgtgagctctcatca

SEQ ID NO: 566631 - DNA, 20 bp, Artificial Sequence
  chemically synthesized
gaaaagacaactgttgggta

SEQ ID NO: 566632 - DNA, 20 bp, Artificial Sequence
  chemically synthesized
tgctcaaggtcatcgccaag

SEQ ID NO: 566633 - DNA, 20 bp, Artificial Sequence
  chemically synthesized
gtaggataggaataattccc

SEQ ID NO: 566634 - DNA, 20 bp, Artificial Sequence
  chemically synthesized
agtgttccattattggaaca

SEQ ID NO: 566635 - DNA, 20 bp, Artificial Sequence
  chemically synthesized
cacgtcacgggggtttgttg

SEQ ID NO: 566636 - DNA, 20 bp, Artificial Sequence
  chemically synthesized
gtacaacaaacccccgtgac

SEQ ID NO: 566637 - DNA, 20 bp, Artificial Sequence
  chemically synthesized
cataggtaaactcacgtcac

SEQ ID NO: 566638 - DNA, 20 bp, Artificial Sequence
  chemically synthesized
gacactttttaactttaatt

SEQ ID NO: 566639 - DNA, 20 bp, Artificial Sequence
  chemically synthesized
aaagttaaaaagtgtctttc

SEQ ID NO: 566640 - DNA, 20 bp, Artificial Sequence
  chemically synthesized
aaagtgtctttcaatagttt

SEQ ID NO: 566641 - DNA, 20 bp, Artificial Sequence
  chemically synthesized
tttaccaatatctaagggcc

SEQ ID NO: 566642 - DNA, 20 bp, Artificial Sequence
  chemically synthesized
ccgccattgggacctatcct

SEQ ID NO: 566643 - DNA, 20 bp, Artificial Sequence
  chemically synthesized
cccaggatttctttttgact

SEQ ID NO: 566644 - DNA, 20 bp, Artificial Sequence
  chemically synthesized
tttgtttagtccattagtgc

SEQ ID NO: 566645 - DNA, 20 bp, Artificial Sequence
  chemically synthesized
aaaattttccagtgatagga

SEQ ID NO: 566646 - DNA, 20 bp, Artificial Sequence
  chemically synthesized
agacctgagttgctgtataa

SEQ ID NO: 566647 - DNA, 20 bp, Artificial Sequence
  chemically synthesized
tcccctcaaatatattttgg

SEQ ID NO: 566648 - DNA, 20 bp, Artificial Sequence
  chemically synthesized
gttttgataagagtttgtat

SEQ ID NO: 566649 - DNA, 20 bp, Artificial Sequence
  chemically synthesized
acgttcacattagttttgat

SEQ ID NO: 566650 - DNA, 20 bp, Artificial Sequence
  chemically synthesized
caattgtgaactacgttcac

SEQ ID NO: 566651 - DNA, 20 bp, Artificial Sequence
  chemically synthesized
tctaccaagtccttgaacat

SEQ ID NO: 566652 - DNA, 20 bp, Artificial Sequence
  chemically synthesized
tctttcttattttgataagg

SEQ ID NO: 566653 - DNA, 20 bp, Artificial Sequence
  chemically synthesized
acaaaggtaaaaggcaaaac

SEQ ID NO: 566654 - DNA, 20 bp, Artificial Sequence
  chemically synthesized
tctgaaaagagttgcaaaac

SEQ ID NO: 566655 - DNA, 20 bp, Artificial Sequence
  chemically synthesized
aactcttttcagaaaacctt

SEQ ID NO: 566656 - DNA, 20 bp, Artificial Sequence
  chemically synthesized
actcccatttggaaatctgg

SEQ ID NO: 566657 - DNA, 20 bp, Artificial Sequence
  chemically synthesized
atttccaaatgggagtatgt

SEQ ID NO: 566658 - DNA, 20 bp, Artificial Sequence
  chemically synthesized
agttctgatttttttttttc

SEQ ID NO: 566659 - DNA, 20 bp, Artificial Sequence
  chemically synthesized
cacaagggagatatccccag

SEQ ID NO: 566660 - DNA, 20 bp, Artificial Sequence
  chemically synthesized
cttagagaacaattgtttgt

SEQ ID NO: 566661 - DNA, 20 bp, Artificial Sequence
  chemically synthesized
ctctctcttagagaacaatt

SEQ ID NO: 566662 - DNA, 20 bp, Artificial Sequence
  chemically synthesized
atcactctctcttagagaac

SEQ ID NO: 566663 - DNA, 20 bp, Artificial Sequence
  chemically synthesized
ttaataagattttatgaagt

SEQ ID NO: 566664 - DNA, 20 bp, Artificial Sequence
  chemically synthesized
tgttttttaataagatttta

SEQ ID NO: 566665 - DNA, 20 bp, Artificial Sequence
  chemically synthesized
tcgttttcttttgtttttta

SEQ ID NO: 566666 - DNA, 20 bp, Artificial Sequence
  chemically synthesized
tgagaacatttttcgttttc

SEQ ID NO: 566667 - DNA, 20 bp, Artificial Sequence
  chemically synthesized
aaaagaaaacgaaaaatgtt

SEQ ID NO: 566668 - DNA, 20 bp, Artificial Sequence
  chemically synthesized
cttctcaaactgagaacatt

SEQ ID NO: 566669 - DNA, 20 bp, Artificial Sequence
  chemically synthesized
aatgttctcagtttgagaag

SEQ ID NO: 566670 - DNA, 20 bp, Artificial Sequence
  chemically synthesized
caagcccttaatacagcaaa

SEQ ID NO: 566671 - DNA, 20 bp, Artificial Sequence
  chemically synthesized
gaagctaagtttgctgtatt

SEQ ID NO: 566672 - DNA, 20 bp, Artificial Sequence
  chemically synthesized
ctaagtttgctgtattaagg

SEQ ID NO: 566673 - DNA, 20 bp, Artificial Sequence
  chemically synthesized
gtattaagggcttgttttca

SEQ ID NO: 566674 - DNA, 20 bp, Artificial Sequence
  chemically synthesized
gatacttaggacacttttgc

SEQ ID NO: 566675 - DNA, 20 bp, Artificial Sequence
  chemically synthesized
attcttccatgcacttcagg

SEQ ID NO: 566676 - DNA, 20 bp, Artificial Sequence
  chemically synthesized
ggttctttccctttctcgcc

SEQ ID NO: 566677 - DNA, 20 bp, Artificial Sequence
  chemically synthesized
tatttgcaaaatgagtgtct

SEQ ID NO: 566678 - DNA, 20 bp, Artificial Sequence
  chemically synthesized
gcaaaatgagtgtctcaggg

SEQ ID NO: 566679 - DNA, 20 bp, Artificial Sequence
  chemically synthesized
aatgagtgtctcagggtttt

SEQ ID NO: 566680 - DNA, 20 bp, Artificial Sequence
  chemically synthesized
gagccagaatgtagattgct

SEQ ID NO: 566681 - DNA, 20 bp, Artificial Sequence
  chemically synthesized
ctaggagttaagagccagaa

SEQ ID NO: 566682 - DNA, 20 bp, Artificial Sequence
  chemically synthesized
ctacattctggctcttaact

SEQ ID NO: 566683 - DNA, 20 bp, Artificial Sequence
  chemically synthesized
ttttcaagtcataaatgcaa

SEQ ID NO: 566684 - DNA, 20 bp, Artificial Sequence
  chemically synthesized
cacaggaagagcattaggtc

SEQ ID NO: 566685 - DNA, 20 bp, Artificial Sequence
  chemically synthesized
atttcccgggctctgtcaca

SEQ ID NO: 566686 - DNA, 20 bp, Artificial Sequence
  chemically synthesized
gtttatgatacgtacgtatg

SEQ ID NO: 566687 - DNA, 20 bp, Artificial Sequence
  chemically synthesized
atgtgtctgaactggctgct

SEQ ID NO: 566688 - DNA, 20 bp, Artificial Sequence
  chemically synthesized
tggatatcctgcagattatt

SEQ ID NO: 566689 - DNA, 20 bp, Artificial Sequence
  chemically synthesized
tgaccagcccatggatatcc

SEQ ID NO: 566690 - DNA, 20 bp, Artificial Sequence
  chemically synthesized
ggatatccatgggctggtca

SEQ ID NO: 566691 - DNA, 20 bp, Artificial Sequence
  chemically synthesized
tttgagtcatttgtgatttt

SEQ ID NO: 566692 - DNA, 20 bp, Artificial Sequence
  chemically synthesized
ggttttactctttgagtcat

SEQ ID NO: 566693 - DNA, 20 bp, Artificial Sequence
  chemically synthesized
aggaaaaaggacactgaaag

SEQ ID NO: 566694 - DNA, 20 bp, Artificial Sequence
  chemically synthesized
agggtatgagagagtcctag

SEQ ID NO: 566695 - DNA, 20 bp, Artificial Sequence
  chemically synthesized
aagagagtgtggttcacgtt

SEQ ID NO: 566696 - DNA, 20 bp, Artificial Sequence
  chemically synthesized
cctttcaaagagagtgtggt

SEQ ID NO: 566697 - DNA, 20 bp, Artificial Sequence
  chemically synthesized
tgaaccacactctctttgaa

SEQ ID NO: 566698 - DNA, 20 bp, Artificial Sequence
  chemically synthesized
tatgcctcgactctaagttg

SEQ ID NO: 566699 - DNA, 20 bp, Artificial Sequence
  chemically synthesized
catatcttcacccaatgcca

SEQ ID NO: 566700 - DNA, 20 bp, Artificial Sequence
  chemically synthesized
gcaaagatataattcccatc

SEQ ID NO: 566701 - DNA, 20 bp, Artificial Sequence
  chemically synthesized
cttattcaggtgacaattga

SEQ ID NO: 566702 - DNA, 20 bp, Artificial Sequence
  chemically synthesized
tcacctgaataagaaaaaaa

SEQ ID NO: 566703 - DNA, 20 bp, Artificial Sequence
  chemically synthesized
attagcattagagaagatct

SEQ ID NO: 566704 - DNA, 20 bp, Artificial Sequence
  chemically synthesized
agtttacacaaccttagcca

SEQ ID NO: 566705 - DNA, 20 bp, Artificial Sequence
  chemically synthesized
tataaatgcatagctagaaa

SEQ ID NO: 566706 - DNA, 20 bp, Artificial Sequence
  chemically synthesized
gctatgcatttataatcatt

SEQ ID NO: 566707 - DNA, 20 bp, Artificial Sequence
  chemically synthesized
atttcaaggagaaaagcgct

SEQ ID NO: 566708 - DNA, 20 bp, Artificial Sequence
  chemically synthesized
gactgatatttcaaggagaa

SEQ ID NO: 566709 - DNA, 20 bp, Artificial Sequence
  chemically synthesized
tggatagattatgcaattac

SEQ ID NO: 566710 - DNA, 20 bp, Artificial Sequence
  chemically synthesized
taaagtaattgcataatcta

SEQ ID NO: 566711 - DNA, 20 bp, Artificial Sequence
  chemically synthesized
agcctcaggtctgaaaactg

SEQ ID NO: 566712 - DNA, 20 bp, Artificial Sequence
  chemically synthesized
atccagttttcagacctgag

SEQ ID NO: 566713 - DNA, 20 bp, Artificial Sequence
  chemically synthesized
aaaattcccttgatctgagg

SEQ ID NO: 566714 - DNA, 20 bp, Artificial Sequence
  chemically synthesized
gttaaatttttgtccccagc

SEQ ID NO: 566715 - DNA, 20 bp, Artificial Sequence
  chemically synthesized
ttgctgatgttggacaaggt

SEQ ID NO: 566716 - DNA, 20 bp, Artificial Sequence
  chemically synthesized
ttgtccaacatcagcaaatc

SEQ ID NO: 566717 - DNA, 20 bp, Artificial Sequence
  chemically synthesized
atgacacttgggaataaagc

SEQ ID NO: 566718 - DNA, 20 bp, Artificial Sequence
  chemically synthesized
cttttcatgacacttgggaa

SEQ ID NO: 566719 - DNA, 20 bp, Artificial Sequence
  chemically synthesized
gtttctagtttggctaataa

SEQ ID NO: 566720 - DNA, 20 bp, Artificial Sequence
  chemically synthesized
aaaagcaatgttgttgtgtt

SEQ ID NO: 566721 - DNA, 20 bp, Artificial Sequence
  chemically synthesized
ccaaactagaaacacaacaa

SEQ ID NO: 566722 - DNA, 20 bp, Artificial Sequence
  chemically synthesized
gtagtataaaagcaatgttg

SEQ ID NO: 566723 - DNA, 20 bp, Artificial Sequence
  chemically synthesized
aaaggactgagaattccaac

SEQ ID NO: 566724 - DNA, 20 bp, Artificial Sequence
  chemically synthesized
tgagagatttacttaattag

SEQ ID NO: 566725 - DNA, 20 bp, Artificial Sequence
  chemically synthesized
ccccttccccctagatgcat

SEQ ID NO: 566726 - DNA, 20 bp, Artificial Sequence
  chemically synthesized
ctgggaaaggtgtttactga

SEQ ID NO: 566727 - DNA, 20 bp, Artificial Sequence
  chemically synthesized
catttctttattactgggaa

SEQ ID NO: 566728 - DNA, 20 bp, Artificial Sequence
  chemically synthesized
gtaataaagaaatgcaaact

SEQ ID NO: 566729 - DNA, 20 bp, Artificial Sequence
  chemically synthesized
ttgtaaaatatactaaagcc

SEQ ID NO: 566730 - DNA, 20 bp, Artificial Sequence
  chemically synthesized
acataggtattaaccactat

SEQ ID NO: 566731 - DNA, 20 bp, Artificial Sequence
  chemically synthesized
aaatagtggttaatacctat

SEQ ID NO: 566732 - DNA, 20 bp, Artificial Sequence
  chemically synthesized
aaaaggaaaacagaaaatcc

SEQ ID NO: 566733 - DNA, 20 bp, Artificial Sequence
  chemically synthesized
tctggggaaactccaggatt

SEQ ID NO: 566734 - DNA, 20 bp, Artificial Sequence
  chemically synthesized
ttcatgcttctggggaaact

SEQ ID NO: 566735 - DNA, 20 bp, Artificial Sequence
  chemically synthesized
cttccaccaccatgtctgtt

SEQ ID NO: 566736 - DNA, 20 bp, Artificial Sequence
  chemically synthesized
actcctgcttccaccaccat

SEQ ID NO: 566737 - DNA, 20 bp, Artificial Sequence
  chemically synthesized
tccaagggaggagtgcagac

SEQ ID NO: 566738 - DNA, 20 bp, Artificial Sequence
  chemically synthesized
tcccttggaagggaaggccc

SEQ ID NO: 566739 - DNA, 20 bp, Artificial Sequence
  chemically synthesized
cctcccactttaaagaaagt

SEQ ID NO: 566740 - DNA, 20 bp, Artificial Sequence
  chemically synthesized
aattctttattatttttctc

SEQ ID NO: 566741 - DNA, 20 bp, Artificial Sequence
  chemically synthesized
cccgtcctcctgcctccttg

SEQ ID NO: 566742 - DNA, 20 bp, Artificial Sequence
  chemically synthesized
acacagaagagagagagaag

SEQ ID NO: 566743 - DNA, 20 bp, Artificial Sequence
  chemically synthesized
ttttcttctctctctcttct

SEQ ID NO: 566744 - DNA, 20 bp, Artificial Sequence
  chemically synthesized
cttctctctctcttctgtgt

SEQ ID NO: 566745 - DNA, 20 bp, Artificial Sequence
  chemically synthesized
ccagtaatggagctggcata

SEQ ID NO: 566746 - DNA, 20 bp, Artificial Sequence
  chemically synthesized
ctccattactggaagagagg

SEQ ID NO: 566747 - DNA, 20 bp, Artificial Sequence
  chemically synthesized
aggaaacatgttgggaatat

SEQ ID NO: 566748 - DNA, 20 bp, Artificial Sequence
  chemically synthesized
tccaaacaccaatattccca

SEQ ID NO: 566749 - DNA, 20 bp, Artificial Sequence
  chemically synthesized
atatactgaaggaagctatg

SEQ ID NO: 566750 - DNA, 20 bp, Artificial Sequence
  chemically synthesized
gaaggaagctatgggtggtt

SEQ ID NO: 566751 - DNA, 20 bp, Artificial Sequence
  chemically synthesized
ttgaaaaacttcaaaccacc

SEQ ID NO: 566752 - DNA, 20 bp, Artificial Sequence
  chemically synthesized
aattattttcttttttgtta

SEQ ID NO: 566753 - DNA, 20 bp, Artificial Sequence
  chemically synthesized
aaataagactcttaatacaa

SEQ ID NO: 566754 - DNA, 20 bp, Artificial Sequence
  chemically synthesized
gccccataaaatgaaatgca

SEQ ID NO: 566755 - DNA, 20 bp, Artificial Sequence
  chemically synthesized
tgctcctgtaatttcagagc

SEQ ID NO: 566756 - DNA, 20 bp, Artificial Sequence
  chemically synthesized
tgttcttgtgtttaaccaca

SEQ ID NO: 566757 - DNA, 20 bp, Artificial Sequence
  chemically synthesized
tcttctgtgatggattgttc

SEQ ID NO: 566758 - DNA, 20 bp, Artificial Sequence
  chemically synthesized
tgtgctcttcagtcttctgt

SEQ ID NO: 566759 - DNA, 20 bp, Artificial Sequence
  chemically synthesized
agttgaattctgtttgacat

SEQ ID NO: 566760 - DNA, 20 bp, Artificial Sequence
  chemically synthesized
tgaaagttgaattctgtttg

SEQ ID NO: 566761 - DNA, 20 bp, Artificial Sequence
  chemically synthesized
atagctccatgaaagttgaa

SEQ ID NO: 566762 - DNA, 20 bp, Artificial Sequence
  chemically synthesized
cctccttttcgggtccatag

SEQ ID NO: 566763 - DNA, 20 bp, Artificial Sequence
  chemically synthesized
ggacaatttaattgccatgc

SEQ ID NO: 566764 - DNA, 20 bp, Artificial Sequence
  chemically synthesized
ttttgatgaaacattaaatg

SEQ ID NO: 566765 - DNA, 20 bp, Artificial Sequence
  chemically synthesized
aaagagctaatcattacatt

SEQ ID NO: 566766 - DNA, 20 bp, Artificial Sequence
  chemically synthesized
ttcacacaactgtatctgct

SEQ ID NO: 566767 - DNA, 20 bp, Artificial Sequence
  chemically synthesized
cagatacagttgtgtgaaac

SEQ ID NO: 566768 - DNA, 20 bp, Artificial Sequence
  chemically synthesized
aattcctagcttaaggaaac

SEQ ID NO: 566769 - DNA, 20 bp, Artificial Sequence
  chemically synthesized
taatatatttaatggaaatt

SEQ ID NO: 566770 - DNA, 20 bp, Artificial Sequence
  chemically synthesized
gtatgtgtgtgtgtgtgtgt

SEQ ID NO: 566771 - DNA, 20 bp, Artificial Sequence
  chemically synthesized
ttagaatacttgggttttta

SEQ ID NO: 566772 - DNA, 20 bp, Artificial Sequence
  chemically synthesized
gtgaagatgtattagaatac

SEQ ID NO: 566773 - DNA, 20 bp, Artificial Sequence
  chemically synthesized
atacatcttcactttctaaa

SEQ ID NO: 566774 - DNA, 20 bp, Artificial Sequence
  chemically synthesized
tgtttacagtagaggatgct

SEQ ID NO: 566775 - DNA, 20 bp, Artificial Sequence
  chemically synthesized
ccacatggtccctgttcttc

SEQ ID NO: 566776 - DNA, 20 bp, Artificial Sequence
  chemically synthesized
gccgccccccaaccgccact

SEQ ID NO: 566777 - DNA, 20 bp, Artificial Sequence
  chemically synthesized
ttgaagctagaaggttgaga

SEQ ID NO: 566778 - DNA, 20 bp, Artificial Sequence
  chemically synthesized
cctaatcatcttctcaacct

SEQ ID NO: 566779 - DNA, 20 bp, Artificial Sequence
  chemically synthesized
catacatagaaaggaaaaga

SEQ ID NO: 566780 - DNA, 20 bp, Artificial Sequence
  chemically synthesized
tgctattccttcctatgtaa

SEQ ID NO: 566781 - DNA, 20 bp, Artificial Sequence
  chemically synthesized
atagactcttagagccagaa

SEQ ID NO: 566782 - DNA, 20 bp, Artificial Sequence
  chemically synthesized
tctcagttgtctcaactgca

SEQ ID NO: 566783 - DNA, 20 bp, Artificial Sequence
  chemically synthesized
tgggtgttatggcaggatat

SEQ ID NO: 566784 - DNA, 20 bp, Artificial Sequence
  chemically synthesized
tatggcaggatatctaggtt

SEQ ID NO: 566785 - DNA, 20 bp, Artificial Sequence
  chemically synthesized
gtcattagcatggaatgcag

SEQ ID NO: 566786 - DNA, 20 bp, Artificial Sequence
  chemically synthesized
actaaccaactttttggtgc

SEQ ID NO: 566787 - DNA, 20 bp, Artificial Sequence
  chemically synthesized
ttctccactaaccaactttt

SEQ ID NO: 566788 - DNA, 20 bp, Artificial Sequence
  chemically synthesized
ttatacatcaacatagaata

SEQ ID NO: 566789 - DNA, 20 bp, Artificial Sequence
  chemically synthesized
ttccaccattactcacctct

SEQ ID NO: 566790 - DNA, 20 bp, Artificial Sequence
  chemically synthesized
gtaatggtggaagaactgct

SEQ ID NO: 566791 - DNA, 20 bp, Artificial Sequence
  chemically synthesized
tggaagaactgctgtatgtt

SEQ ID NO: 566792 - DNA, 20 bp, Artificial Sequence
  chemically synthesized
gactttcttgaagtgcaaag

SEQ ID NO: 566793 - DNA, 20 bp, Artificial Sequence
  chemically synthesized
gcattgactttcttgaagtg

SEQ ID NO: 566794 - DNA, 20 bp, Artificial Sequence
  chemically synthesized
tgcagagccctggtcaaagc

SEQ ID NO: 566795 - DNA, 20 bp, Artificial Sequence
  chemically synthesized
agtaagtcactttgaaaagc

SEQ ID NO: 566796 - DNA, 20 bp, Artificial Sequence
  chemically synthesized
catgggttgcaggttatcac

SEQ ID NO: 566797 - DNA, 20 bp, Artificial Sequence
  chemically synthesized
agtcagaccaacggaagcca

SEQ ID NO: 566798 - DNA, 20 bp, Artificial Sequence
  chemically synthesized
atgtaaccagcctcaaactc

SEQ ID NO: 566799 - DNA, 20 bp, Artificial Sequence
  chemically synthesized
gcacaaattggagtttcagc

SEQ ID NO: 566800 - DNA, 20 bp, Artificial Sequence
  chemically synthesized
ggaaaccagggagcacaaat

SEQ ID NO: 566801 - DNA, 20 bp, Artificial Sequence
  chemically synthesized
tgaaactccaatttgtgctc

SEQ ID NO: 566802 - DNA, 20 bp, Artificial Sequence
  chemically synthesized
tcttgcagacagagggcaat

SEQ ID NO: 566803 - DNA, 20 bp, Artificial Sequence
  chemically synthesized
gctgtggctgtgacacttat

SEQ ID NO: 566804 - DNA, 20 bp, Artificial Sequence
  chemically synthesized
atcctttttctgcaaggaac

SEQ ID NO: 566805 - DNA, 20 bp, Artificial Sequence
  chemically synthesized
gactcacaggaaccaaatga

SEQ ID NO: 566806 - DNA, 20 bp, Artificial Sequence
  chemically synthesized
agtcctctttagcaattgaa

SEQ ID NO: 566807 - DNA, 20 bp, Artificial Sequence
  chemically synthesized
cagggcagtgagtgtcagaa

SEQ ID NO: 566808 - DNA, 20 bp, Artificial Sequence
  chemically synthesized
gcagtgagtgtcagaagcaa

SEQ ID NO: 566809 - DNA, 20 bp, Artificial Sequence
  chemically synthesized
gttggaggtgttctaaacaa

SEQ ID NO: 566810 - DNA, 20 bp, Artificial Sequence
  chemically synthesized
cattatttagaaagaaaaaa

SEQ ID NO: 566811 - DNA, 20 bp, Artificial Sequence
  chemically synthesized
ctttgaagttgctcaacaag

SEQ ID NO: 566812 - DNA, 20 bp, Artificial Sequence
  chemically synthesized
tgtgttacttttcaaccaag

SEQ ID NO: 566813 - DNA, 20 bp, Artificial Sequence
  chemically synthesized
acgcttggttgaaaagtaac

SEQ ID NO: 566814 - DNA, 20 bp, Artificial Sequence
  chemically synthesized
taggttcaagttctctcact

SEQ ID NO: 566815 - DNA, 20 bp, Artificial Sequence
  chemically synthesized
tgaacctaaggagctaacaa

SEQ ID NO: 566816 - DNA, 20 bp, Artificial Sequence
  chemically synthesized
ttttttttagcagccttgcc

SEQ ID NO: 566817 - DNA, 20 bp, Artificial Sequence
  chemically synthesized
ttctgaacttaacattagct

SEQ ID NO: 566818 - DNA, 20 bp, Artificial Sequence
  chemically synthesized
aaagaaattctgaacttaac

SEQ ID NO: 566819 - DNA, 20 bp, Artificial Sequence
  chemically synthesized
aagttcagaatttctttcca

SEQ ID NO: 566820 - DNA, 20 bp, Artificial Sequence
  chemically synthesized
ttctcaaaaatgatagttgc

SEQ ID NO: 566821 - DNA, 20 bp, Artificial Sequence
  chemically synthesized
gcccatttctcaaaaatgat

SEQ ID NO: 566822 - DNA, 20 bp, Artificial Sequence
  chemically synthesized
caggtattccctatgtcact

SEQ ID NO: 566823 - DNA, 20 bp, Artificial Sequence
  chemically synthesized
cctgaactggggctacaatt

SEQ ID NO: 566824 - DNA, 20 bp, Artificial Sequence
  chemically synthesized
cattgatccttgtggaatgc

SEQ ID NO: 566825 - DNA, 20 bp, Artificial Sequence
  chemically synthesized
ccattccattgatccttgtg

SEQ ID NO: 566826 - DNA, 20 bp, Artificial Sequence
  chemically synthesized
cattccacaaggatcaatgg

SEQ ID NO: 566827 - DNA, 20 bp, Artificial Sequence
  chemically synthesized
aacctatgatggggttgtgt

SEQ ID NO: 566828 - DNA, 20 bp, Artificial Sequence
  chemically synthesized
acacctaactaactgaaact

SEQ ID NO: 566829 - DNA, 20 bp, Artificial Sequence
  chemically synthesized
aaggtaggctaggctaagct

SEQ ID NO: 566830 - DNA, 20 bp, Artificial Sequence
  chemically synthesized
tactgtgtaaggtgttgcta

SEQ ID NO: 566831 - DNA, 20 bp, Artificial Sequence
  chemically synthesized
accttacacagtaaagtgtc

SEQ ID NO: 566832 - DNA, 20 bp, Artificial Sequence
  chemically synthesized
tcaaaattcaaatctagaag

SEQ ID NO: 566833 - DNA, 20 bp, Artificial Sequence
  chemically synthesized
cattcaatagaaactctact

SEQ ID NO: 566834 - DNA, 20 bp, Artificial Sequence
  chemically synthesized
gaagtttcaacttaacaatt

SEQ ID NO: 566835 - DNA, 20 bp, Artificial Sequence
  chemically synthesized
tgcagacagtccccaacttg

SEQ ID NO: 566836 - DNA, 20 bp, Artificial Sequence
  chemically synthesized
tgtgtgtgtgtagctgggga

SEQ ID NO: 566837 - DNA, 20 bp, Artificial Sequence
  chemically synthesized
gtgtgtagctggggaagagg

SEQ ID NO: 566838 - DNA, 20 bp, Artificial Sequence
  chemically synthesized
ttaatgataaaaggaaaaag

SEQ ID NO: 566839 - DNA, 20 bp, Artificial Sequence
  chemically synthesized
agaaataaaaaagtatcttt

SEQ ID NO: 566840 - DNA, 20 bp, Artificial Sequence
  chemically synthesized
aatggcgtgaacctgggagg

SEQ ID NO: 566841 - DNA, 20 bp, Artificial Sequence
  chemically synthesized
ttttgtatttttagtagaga

SEQ ID NO: 566842 - DNA, 20 bp, Artificial Sequence
  chemically synthesized
tgcctcggcctcccgaagtg

SEQ ID NO: 566843 - DNA, 20 bp, Artificial Sequence
  chemically synthesized
ccgtaggcagcaacattata

SEQ ID NO: 566844 - DNA, 20 bp, Artificial Sequence
  chemically synthesized
tataatgttgctgcctacgg

SEQ ID NO: 566845 - DNA, 20 bp, Artificial Sequence
  chemically synthesized
ataagagaataatatgctcc

SEQ ID NO: 566846 - DNA, 20 bp, Artificial Sequence
  chemically synthesized
cttggctctttcaaggagga

SEQ ID NO: 566847 - DNA, 20 bp, Artificial Sequence
  chemically synthesized
acaccatggagcaatattaa

SEQ ID NO: 566848 - DNA, 20 bp, Artificial Sequence
  chemically synthesized
ctcaggttatttcctgacac

SEQ ID NO: 566849 - DNA, 20 bp, Artificial Sequence
  chemically synthesized
acccagtcaaatctgaagaa

SEQ ID NO: 566850 - DNA, 20 bp, Artificial Sequence
  chemically synthesized
attgttataaatcattgttc

SEQ ID NO: 566851 - DNA, 20 bp, Artificial Sequence
  chemically synthesized
tgatggccacacagtgttta

SEQ ID NO: 566852 - DNA, 20 bp, Artificial Sequence
  chemically synthesized
catcacaattgatggccaca

SEQ ID NO: 566853 - DNA, 20 bp, Artificial Sequence
  chemically synthesized
tggccatcaattgtgatgat

SEQ ID NO: 566854 - DNA, 20 bp, Artificial Sequence
  chemically synthesized
aaggtattgggcatgtgata

SEQ ID NO: 566855 - DNA, 20 bp, Artificial Sequence
  chemically synthesized
tgatagaaggcttacgtgct

SEQ ID NO: 566856 - DNA, 20 bp, Artificial Sequence
  chemically synthesized
gtttcatctgtcataacatt

SEQ ID NO: 566857 - DNA, 20 bp, Artificial Sequence
  chemically synthesized
caattgtccctccacccact

SEQ ID NO: 566858 - DNA, 20 bp, Artificial Sequence
  chemically synthesized
gtgggtggagggacaattgg

SEQ ID NO: 566859 - DNA, 20 bp, Artificial Sequence
  chemically synthesized
aattcaacttaaatatctgt

SEQ ID NO: 566860 - DNA, 20 bp, Artificial Sequence
  chemically synthesized
gtagccatccatatccaatt

SEQ ID NO: 566861 - DNA, 20 bp, Artificial Sequence
  chemically synthesized
gtagtcactcctaaaaggac

SEQ ID NO: 566862 - DNA, 20 bp, Artificial Sequence
  chemically synthesized
tttaggagtgactactattc

SEQ ID NO: 566863 - DNA, 20 bp, Artificial Sequence
  chemically synthesized
acatgttgccattgagaaat

SEQ ID NO: 566864 - DNA, 20 bp, Artificial Sequence
  chemically synthesized
tagaagtttcttttatttca

SEQ ID NO: 566865 - DNA, 20 bp, Artificial Sequence
  chemically synthesized
cagttcctaattctcctaat

SEQ ID NO: 566866 - DNA, 20 bp, Artificial Sequence
  chemically synthesized
gagatacctggccaggtaga

SEQ ID NO: 566867 - DNA, 20 bp, Artificial Sequence
  chemically synthesized
tgcactaggaagtctttctc

SEQ ID NO: 566868 - DNA, 20 bp, Artificial Sequence
  chemically synthesized
tggaattggatgcccttgaa

SEQ ID NO: 566869 - DNA, 20 bp, Artificial Sequence
  chemically synthesized
attctccagctatcaacctt

SEQ ID NO: 566870 - DNA, 20 bp, Artificial Sequence
  chemically synthesized
attaaagaacacctcgtagg

SEQ ID NO: 566871 - DNA, 20 bp, Artificial Sequence
  chemically synthesized
tttctctcagtcagatgcta

SEQ ID NO: 566872 - DNA, 20 bp, Artificial Sequence
  chemically synthesized
ctgttacccactagggaaag

SEQ ID NO: 566873 - DNA, 20 bp, Artificial Sequence
  chemically synthesized
ccctagtgggtaacagctaa

SEQ ID NO: 566874 - DNA, 20 bp, Artificial Sequence
  chemically synthesized
tcccaggggaaatactgtaa

SEQ ID NO: 566875 - DNA, 20 bp, Artificial Sequence
  chemically synthesized
aaactaattttctcagttta

SEQ ID NO: 566876 - DNA, 20 bp, Artificial Sequence
  chemically synthesized
aaaccatataaactgagaaa

SEQ ID NO: 566877 - DNA, 20 bp, Artificial Sequence
  chemically synthesized
gacatggccaaactaatttt

SEQ ID NO: 566878 - DNA, 20 bp, Artificial Sequence
  chemically synthesized
aggccatgtctctgttagtt

SEQ ID NO: 566879 - DNA, 20 bp, Artificial Sequence
  chemically synthesized
aatacatggtatatagaaaa

SEQ ID NO: 566880 - DNA, 20 bp, Artificial Sequence
  chemically synthesized
agccttttctggcaatagag

SEQ ID NO: 566881 - DNA, 20 bp, Artificial Sequence
  chemically synthesized
actctcaggacccacaataa

SEQ ID NO: 566882 - DNA, 20 bp, Artificial Sequence
  chemically synthesized
tgcgctaagggtgacattag

SEQ ID NO: 566883 - DNA, 20 bp, Artificial Sequence
  chemically synthesized
agaaggcggtgcatttttca

SEQ ID NO: 566884 - DNA, 20 bp, Artificial Sequence
  chemically synthesized
gctggagttgtgtgaatagt

SEQ ID NO: 566885 - DNA, 20 bp, Artificial Sequence
  chemically synthesized
ctgtaccaaatctctataat

SEQ ID NO: 566886 - DNA, 20 bp, Artificial Sequence
  chemically synthesized
agcaactaaagcacacatta

SEQ ID NO: 566887 - DNA, 20 bp, Artificial Sequence
  chemically synthesized
gcaaaatgttctctatttct

SEQ ID NO: 566888 - DNA, 20 bp, Artificial Sequence
  chemically synthesized
aactgcagtatatttagccc

SEQ ID NO: 566889 - DNA, 20 bp, Artificial Sequence
  chemically synthesized
attattaataaactaaatac

SEQ ID NO: 566890 - DNA, 20 bp, Artificial Sequence
  chemically synthesized
cacttaacaaagcaagtgta

SEQ ID NO: 566891 - DNA, 20 bp, Artificial Sequence
  chemically synthesized
aaatacacttgctttgttaa

SEQ ID NO: 566892 - DNA, 20 bp, Artificial Sequence
  chemically synthesized
ttttatttctgctcttacaa

SEQ ID NO: 566893 - DNA, 20 bp, Artificial Sequence
  chemically synthesized
ctgatgacattctacaggtg

SEQ ID NO: 566894 - DNA, 20 bp, Artificial Sequence
  chemically synthesized
gaactacaaagggagaaaga

SEQ ID NO: 566895 - DNA, 20 bp, Artificial Sequence
  chemically synthesized
atggagtatcagctatatga

SEQ ID NO: 566896 - DNA, 20 bp, Artificial Sequence
  chemically synthesized
cttggtaagaaggatttata

SEQ ID NO: 566897 - DNA, 20 bp, Artificial Sequence
  chemically synthesized
cagtttataaatccttctta

SEQ ID NO: 566898 - DNA, 20 bp, Artificial Sequence
  chemically synthesized
caaagataaaatcttggtaa

SEQ ID NO: 566899 - DNA, 20 bp, Artificial Sequence
  chemically synthesized
taccaagattttatctttgt

SEQ ID NO: 566900 - DNA, 20 bp, Artificial Sequence
  chemically synthesized
tctttgttcctgcttttcta

SEQ ID NO: 566901 - DNA, 20 bp, Artificial Sequence
  chemically synthesized
taaggagtcatgcaacactt

SEQ ID NO: 566902 - DNA, 20 bp, Artificial Sequence
  chemically synthesized
caccgttggcctataatgtc

SEQ ID NO: 566903 - DNA, 20 bp, Artificial Sequence
  chemically synthesized
tagtggatacaattgggtta

SEQ ID NO: 566904 - DNA, 20 bp, Artificial Sequence
  chemically synthesized
tttttttttcacttccctat

SEQ ID NO: 566905 - DNA, 20 bp, Artificial Sequence
  chemically synthesized
agtgaaaaaaaaataagatc

SEQ ID NO: 566906 - DNA, 20 bp, Artificial Sequence
  chemically synthesized
gtgatttcctggtgccagtg

SEQ ID NO: 566907 - DNA, 20 bp, Artificial Sequence
  chemically synthesized
gaaaattaatgatgttatct

SEQ ID NO: 566908 - DNA, 20 bp, Artificial Sequence
  chemically synthesized
ggtagggaaagctagccagg

SEQ ID NO: 566909 - DNA, 20 bp, Artificial Sequence
  chemically synthesized
ggcaaataaaacttgccctg

SEQ ID NO: 566910 - DNA, 20 bp, Artificial Sequence
  chemically synthesized
cgcagacaatagctctttat

SEQ ID NO: 566911 - DNA, 20 bp, Artificial Sequence
  chemically synthesized
tagctctttatcatggcttt

SEQ ID NO: 566912 - DNA, 20 bp, Artificial Sequence
  chemically synthesized
tatttgcttagatttagctt

SEQ ID NO: 566913 - DNA, 20 bp, Artificial Sequence
  chemically synthesized
taattttatatttgcttaga

SEQ ID NO: 566914 - DNA, 20 bp, Artificial Sequence
  chemically synthesized
ttctcctaattttatatttg

SEQ ID NO: 566915 - DNA, 20 bp, Artificial Sequence
  chemically synthesized
gaattttctcctaattttat

SEQ ID NO: 566916 - DNA, 20 bp, Artificial Sequence
  chemically synthesized
tcacattacttactttcaat

SEQ ID NO: 566917 - DNA, 20 bp, Artificial Sequence
  chemically synthesized
atggggtgaactcttcattc

SEQ ID NO: 566918 - DNA, 20 bp, Artificial Sequence
  chemically synthesized
atggcttttctaatatgtga

SEQ ID NO: 566919 - DNA, 20 bp, Artificial Sequence
  chemically synthesized
ctctgcatttcctttctgag

SEQ ID NO: 566920 - DNA, 20 bp, Artificial Sequence
  chemically synthesized
aggaaatgcagagaatttca

SEQ ID NO: 566921 - DNA, 20 bp, Artificial Sequence
  chemically synthesized
taaagaaattattctacatt

SEQ ID NO: 566922 - DNA, 20 bp, Artificial Sequence
  chemically synthesized
atgaaattcccccattttcc

SEQ ID NO: 566923 - DNA, 20 bp, Artificial Sequence
  chemically synthesized
aaaaaaaattccattcacat

SEQ ID NO: 566924 - DNA, 20 bp, Artificial Sequence
  chemically synthesized
tcaccctggatttaggcatt

SEQ ID NO: 566925 - DNA, 20 bp, Artificial Sequence
  chemically synthesized
tctataatgtccattttcac

SEQ ID NO: 566926 - DNA, 20 bp, Artificial Sequence
  chemically synthesized
atagaaaggaacagtcatta

SEQ ID NO: 566927 - DNA, 20 bp, Artificial Sequence
  chemically synthesized
tttttccatctggtctattt

SEQ ID NO: 566928 - DNA, 20 bp, Artificial Sequence
  chemically synthesized
agtataaactggaacaaatg

SEQ ID NO: 566929 - DNA, 20 bp, Artificial Sequence
  chemically synthesized
ttcagaagctaaccatttgt

SEQ ID NO: 566930 - DNA, 20 bp, Artificial Sequence
  chemically synthesized
cccctgccccatcccagagc

SEQ ID NO: 566931 - DNA, 20 bp, Artificial Sequence
  chemically synthesized
gagtcagggggctgaataga

SEQ ID NO: 566932 - DNA, 20 bp, Artificial Sequence
  chemically synthesized
atacgtcatagctgggaaaa

SEQ ID NO: 566933 - DNA, 20 bp, Artificial Sequence
  chemically synthesized
tttaaagggctttccaggtc

SEQ ID NO: 566934 - DNA, 20 bp, Artificial Sequence
  chemically synthesized
ccaagtttaactggtgttta

SEQ ID NO: 566935 - DNA, 20 bp, Artificial Sequence
  chemically synthesized
atatagttgccaagtttaac

SEQ ID NO: 566936 - DNA, 20 bp, Artificial Sequence
  chemically synthesized
atttttcagctatatagttg

SEQ ID NO: 566937 - DNA, 20 bp, Artificial Sequence
  chemically synthesized
ggctataaggaaatggaagc

SEQ ID NO: 566938 - DNA, 20 bp, Artificial Sequence
  chemically synthesized
atgcatgaatgaaagtaaac

SEQ ID NO: 566939 - DNA, 20 bp, Artificial Sequence
  chemically synthesized
ctggcacacagcatggttca

SEQ ID NO: 566940 - DNA, 20 bp, Artificial Sequence
  chemically synthesized
atattgaaccatgctgtgtg

SEQ ID NO: 566941 - DNA, 20 bp, Artificial Sequence
  chemically synthesized
tcccttcatcttggtatccc

SEQ ID NO: 566942 - DNA, 20 bp, Artificial Sequence
  chemically synthesized
ccagttctcgctccaattct

SEQ ID NO: 566943 - DNA, 20 bp, Artificial Sequence
  chemically synthesized
tttgaaggtggaacagtttc

SEQ ID NO: 566944 - DNA, 20 bp, Artificial Sequence
  chemically synthesized
gaacattattttgaaggtgg

SEQ ID NO: 566945 - DNA, 20 bp, Artificial Sequence
  chemically synthesized
accttcaaaataatgttcat

SEQ ID NO: 566946 - DNA, 20 bp, Artificial Sequence
  chemically synthesized
catccctctacctcctaatt

SEQ ID NO: 566947 - DNA, 20 bp, Artificial Sequence
  chemically synthesized
taccagtttccatatgcgtt

SEQ ID NO: 566948 - DNA, 20 bp, Artificial Sequence
  chemically synthesized
aagtgaggatttgggcaaaa

SEQ ID NO: 566949 - DNA, 20 bp, Artificial Sequence
  chemically synthesized
agagaagtgaggatttgggc

SEQ ID NO: 566950 - DNA, 20 bp, Artificial Sequence
  chemically synthesized
gaacagctgggcaagagaag

SEQ ID NO: 566951 - DNA, 20 bp, Artificial Sequence
  chemically synthesized
acgcttagcacttgggagcc

SEQ ID NO: 566952 - DNA, 20 bp, Artificial Sequence
  chemically synthesized
ggggtgtggtatttccccag

SEQ ID NO: 566953 - DNA, 20 bp, Artificial Sequence
  chemically synthesized
ctggggaaataccacacccc

SEQ ID NO: 566954 - DNA, 20 bp, Artificial Sequence
  chemically synthesized
gtgtgaacccagaggcggct

SEQ ID NO: 566955 - DNA, 20 bp, Artificial Sequence
  chemically synthesized
gccgcctctgggttcacaca

SEQ ID NO: 566956 - DNA, 20 bp, Artificial Sequence
  chemically synthesized
aacagcaggagatgatgaag

SEQ ID NO: 566957 - DNA, 20 bp, Artificial Sequence
  chemically synthesized
ggtgaaggatgtcttactat

SEQ ID NO: 566958 - DNA, 20 bp, Artificial Sequence
  chemically synthesized
catccttcaccttgctgcta

SEQ ID NO: 566959 - DNA, 20 bp, Artificial Sequence
  chemically synthesized
atctcttccctcccttgggc

SEQ ID NO: 566960 - DNA, 20 bp, Artificial Sequence
  chemically synthesized
tatgagtatgagaagacagg

SEQ ID NO: 566961 - DNA, 20 bp, Artificial Sequence
  chemically synthesized
aatacattcccacgaatact

SEQ ID NO: 566962 - DNA, 20 bp, Artificial Sequence
  chemically synthesized
atactatatgtttggcctgc

SEQ ID NO: 566963 - DNA, 20 bp, Artificial Sequence
  chemically synthesized
gaactgcttgggtcaactta

SEQ ID NO: 566964 - DNA, 20 bp, Artificial Sequence
  chemically synthesized
ccttgaacaacatgggtttg

SEQ ID NO: 566965 - DNA, 20 bp, Artificial Sequence
  chemically synthesized
tacattgatccttgaacaac

SEQ ID NO: 566966 - DNA, 20 bp, Artificial Sequence
  chemically synthesized
gcctatatgacagcgagccc

SEQ ID NO: 566967 - DNA, 20 bp, Artificial Sequence
  chemically synthesized
tatatttttactgtatcttt

SEQ ID NO: 566968 - DNA, 20 bp, Artificial Sequence
  chemically synthesized
ctgtatctttctatgtttaa

SEQ ID NO: 566969 - DNA, 20 bp, Artificial Sequence
  chemically synthesized
tgtgtactaggctataccat

SEQ ID NO: 566970 - DNA, 20 bp, Artificial Sequence
  chemically synthesized
gaaatgtatgtacagtcacg

SEQ ID NO: 566971 - DNA, 20 bp, Artificial Sequence
  chemically synthesized
tggagaattagagaaggtat

SEQ ID NO: 566972 - DNA, 20 bp, Artificial Sequence
  chemically synthesized
gaaggtccctagtaactttg

SEQ ID NO: 566973 - DNA, 20 bp, Artificial Sequence
  chemically synthesized
cctttgcagtcccttctgta

SEQ ID NO: 566974 - DNA, 20 bp, Artificial Sequence
  chemically synthesized
ggtgctgcttgtaacggggg

SEQ ID NO: 566975 - DNA, 20 bp, Artificial Sequence
  chemically synthesized
agggatcatgagcctgtagg

SEQ ID NO: 566976 - DNA, 20 bp, Artificial Sequence
  chemically synthesized
acaggctcatgatccctaaa

SEQ ID NO: 566977 - DNA, 20 bp, Artificial Sequence
  chemically synthesized
gctcaggagaaatatacaaa

SEQ ID NO: 566978 - DNA, 20 bp, Artificial Sequence
  chemically synthesized
tcaaggaagacacttaggtg

SEQ ID NO: 566979 - DNA, 20 bp, Artificial Sequence
  chemically synthesized
gggagtcaaggaagacactt

SEQ ID NO: 566980 - DNA, 20 bp, Artificial Sequence
  chemically synthesized
actccctttcacccaccaca

SEQ ID NO: 566981 - DNA, 20 bp, Artificial Sequence
  chemically synthesized
catcctgggccacaggttgg

SEQ ID NO: 566982 - DNA, 20 bp, Artificial Sequence
  chemically synthesized
ttgtccaacctgtggcccag

SEQ ID NO: 566983 - DNA, 20 bp, Artificial Sequence
  chemically synthesized
aaaaaaaaaaaatgttttag

SEQ ID NO: 566984 - DNA, 20 bp, Artificial Sequence
  chemically synthesized
aaaatcgcaaaaaaaaaaaa

SEQ ID NO: 566985 - DNA, 20 bp, Artificial Sequence
  chemically synthesized
taaaacattttttttttttt

SEQ ID NO: 566986 - DNA, 20 bp, Artificial Sequence
  chemically synthesized
cactgtggcccggagaagcc

SEQ ID NO: 566987 - DNA, 20 bp, Artificial Sequence
  chemically synthesized
ggtgcagggatgtccaatct

SEQ ID NO: 566988 - DNA, 20 bp, Artificial Sequence
  chemically synthesized
gaagtggatttgacaggcct

SEQ ID NO: 566989 - DNA, 20 bp, Artificial Sequence
  chemically synthesized
gaatttagaaatatttagga

SEQ ID NO: 566990 - DNA, 20 bp, Artificial Sequence
  chemically synthesized
ctaattcaagccaccacatt

SEQ ID NO: 566991 - DNA, 20 bp, Artificial Sequence
  chemically synthesized
gtaatctaaaccagcaatgt

SEQ ID NO: 566992 - DNA, 20 bp, Artificial Sequence
  chemically synthesized
tcaagccaccacattgctgg

SEQ ID NO: 566993 - DNA, 20 bp, Artificial Sequence
  chemically synthesized
tgctggtttagattactgca

SEQ ID NO: 566994 - DNA, 20 bp, Artificial Sequence
  chemically synthesized
attcttgctgtggaacagag

SEQ ID NO: 566995 - DNA, 20 bp, Artificial Sequence
  chemically synthesized
aatcagattgtcgcttagaa

SEQ ID NO: 566996 - DNA, 20 bp, Artificial Sequence
  chemically synthesized
aatcatctttctaagcgaca

SEQ ID NO: 566997 - DNA, 20 bp, Artificial Sequence
  chemically synthesized
tgggggtgacataatcagat

SEQ ID NO: 566998 - DNA, 20 bp, Artificial Sequence
  chemically synthesized
tttggcctgggggtgacata

SEQ ID NO: 566999 - DNA, 20 bp, Artificial Sequence
  chemically synthesized
agttaaggaatttagaggtc

SEQ ID NO: 567000 - DNA, 20 bp, Artificial Sequence
  chemically synthesized
tgacctctaaattccttaac

SEQ ID NO: 567001 - DNA, 20 bp, Artificial Sequence
  chemically synthesized
ggttttaaaaaccttgcaca

SEQ ID NO: 567002 - DNA, 20 bp, Artificial Sequence
  chemically synthesized
gaagcaggaagcagattgtg

SEQ ID NO: 567003 - DNA, 20 bp, Artificial Sequence
  chemically synthesized
aaaaccttgcacaatctgct

SEQ ID NO: 567004 - DNA, 20 bp, Artificial Sequence
  chemically synthesized
ggctggagagagaagcagga

SEQ ID NO: 567005 - DNA, 20 bp, Artificial Sequence
  chemically synthesized
tagatctttcccctggaatt

SEQ ID NO: 567006 - DNA, 20 bp, Artificial Sequence
  chemically synthesized
attttcagttcctgaatgtg

SEQ ID NO: 567007 - DNA, 20 bp, Artificial Sequence
  chemically synthesized
aacgctcttcctagagagag

SEQ ID NO: 567008 - DNA, 20 bp, Artificial Sequence
  chemically synthesized
tgcttactcttctagagtta

SEQ ID NO: 567009 - DNA, 20 bp, Artificial Sequence
  chemically synthesized
tggaatgagattcaaagaat

SEQ ID NO: 567010 - DNA, 20 bp, Artificial Sequence
  chemically synthesized
tgtgtggaatgagattcaaa

SEQ ID NO: 567011 - DNA, 20 bp, Artificial Sequence
  chemically synthesized
tgaacagctaactgtgtgga

SEQ ID NO: 567012 - DNA, 20 bp, Artificial Sequence
  chemically synthesized
tcttaatacattatacatat

SEQ ID NO: 567013 - DNA, 20 bp, Artificial Sequence
  chemically synthesized
aatgcgcccggcccaacagg

SEQ ID NO: 567014 - DNA, 20 bp, Artificial Sequence
  chemically synthesized
cgcctcagcctcccaaagtg

SEQ ID NO: 567015 - DNA, 20 bp, Artificial Sequence
  chemically synthesized
ggtctcgaactcctgacctc

SEQ ID NO: 567016 - DNA, 20 bp, Artificial Sequence
  chemically synthesized
tttgtattttttaatagaga

SEQ ID NO: 567017 - DNA, 20 bp, Artificial Sequence
  chemically synthesized
ctcctcggcctcccaaagtg

SEQ ID NO: 567018 - DNA, 20 bp, Artificial Sequence
  chemically synthesized
ttttgtaattttagtagagg

SEQ ID NO: 567019 - DNA, 20 bp, Artificial Sequence
  chemically synthesized
ccaccaccacgcctggctaa

SEQ ID NO: 567020 - DNA, 20 bp, Artificial Sequence
  chemically synthesized
tttgtttgtttgtttgtttg

SEQ ID NO: 567021 - DNA, 20 bp, Artificial Sequence
  chemically synthesized
tgttttttgtttgtttgttt

SEQ ID NO: 567022 - DNA, 20 bp, Artificial Sequence
  chemically synthesized
tttttgttttttgtttgttt

SEQ ID NO: 567023 - DNA, 20 bp, Artificial Sequence
  chemically synthesized
ctaatttttgttttttgttt

SEQ ID NO: 567024 - DNA, 20 bp, Artificial Sequence
  chemically synthesized
ccggctaatttttgtttttt

SEQ ID NO: 567025 - DNA, 20 bp, Artificial Sequence
  chemically synthesized
atgcccggctaatttttgtt

SEQ ID NO: 567026 - DNA, 20 bp, Artificial Sequence
  chemically synthesized
ccccaccatgcccggctaat

SEQ ID NO: 567027 - DNA, 20 bp, Artificial Sequence
  chemically synthesized
tgcgtcagcctcccaggtag

SEQ ID NO: 567028 - DNA, 20 bp, Artificial Sequence
  chemically synthesized
aacctccacctcccaggttc

SEQ ID NO: 567029 - DNA, 20 bp, Artificial Sequence
  chemically synthesized
cacagtttctttttcttttt

SEQ ID NO: 567030 - DNA, 20 bp, Artificial Sequence
  chemically synthesized
aaaaaagaaaaagaaactgt

SEQ ID NO: 567031 - DNA, 20 bp, Artificial Sequence
  chemically synthesized
tgatatgcccatgaaacagg

SEQ ID NO: 567032 - DNA, 20 bp, Artificial Sequence
  chemically synthesized
acagctctatcatgtcatca

SEQ ID NO: 567033 - DNA, 20 bp, Artificial Sequence
  chemically synthesized
tgatagagctgtgtaacact

SEQ ID NO: 567034 - DNA, 20 bp, Artificial Sequence
  chemically synthesized
tggtagaggaaaaatgacag

SEQ ID NO: 567035 - DNA, 20 bp, Artificial Sequence
  chemically synthesized
ttcatagacatgtgtggttt

SEQ ID NO: 567036 - DNA, 20 bp, Artificial Sequence
  chemically synthesized
aaccaaacttcatagacatg

SEQ ID NO: 567037 - DNA, 20 bp, Artificial Sequence
  chemically synthesized
taataaaccacacatgtcta

SEQ ID NO: 567038 - DNA, 20 bp, Artificial Sequence
  chemically synthesized
aaccacacatgtctatgaag

SEQ ID NO: 567039 - DNA, 20 bp, Artificial Sequence
  chemically synthesized
aaaaaaaaacaaaggtagaa

SEQ ID NO: 567040 - DNA, 20 bp, Artificial Sequence
  chemically synthesized
ttgcacaatccttgttctac

SEQ ID NO: 567041 - DNA, 20 bp, Artificial Sequence
  chemically synthesized
aaaggtagaacaaggattgt

SEQ ID NO: 567042 - DNA, 20 bp, Artificial Sequence
  chemically synthesized
tagctgaggaatggtgacag

SEQ ID NO: 567043 - DNA, 20 bp, Artificial Sequence
  chemically synthesized
cctagagtttgcctagaatg

SEQ ID NO: 567044 - DNA, 20 bp, Artificial Sequence
  chemically synthesized
cttggcctagagtttgccta

SEQ ID NO: 567045 - DNA, 20 bp, Artificial Sequence
  chemically synthesized
tctttaatgtatccttggcc

SEQ ID NO: 567046 - DNA, 20 bp, Artificial Sequence
  chemically synthesized
attgcaacaggaattgtgac

SEQ ID NO: 567047 - DNA, 20 bp, Artificial Sequence
  chemically synthesized
tgaagatcttgatactatgt

SEQ ID NO: 567048 - DNA, 20 bp, Artificial Sequence
  chemically synthesized
aaagggccttctgcagtctt

SEQ ID NO: 567049 - DNA, 20 bp, Artificial Sequence
  chemically synthesized
gacctgaataatgtcagatt

SEQ ID NO: 567050 - DNA, 20 bp, Artificial Sequence
  chemically synthesized
tttcagctgacctgaataat

SEQ ID NO: 567051 - DNA, 20 bp, Artificial Sequence
  chemically synthesized
ctgatggaataacaaatgct

SEQ ID NO: 567052 - DNA, 20 bp, Artificial Sequence
  chemically synthesized
gacaacccacccccgacgcc

SEQ ID NO: 567053 - DNA, 20 bp, Artificial Sequence
  chemically synthesized
aagcttggcgtatacacact

SEQ ID NO: 567054 - DNA, 20 bp, Artificial Sequence
  chemically synthesized
aaacatatagtgtgtatacg

SEQ ID NO: 567055 - DNA, 20 bp, Artificial Sequence
  chemically synthesized
ttaacagaattttcacctcc

SEQ ID NO: 567056 - DNA, 20 bp, Artificial Sequence
  chemically synthesized
aaaagattcactacagtaga

SEQ ID NO: 567057 - DNA, 20 bp, Artificial Sequence
  chemically synthesized
ctgtagtgaatcttttctgc

SEQ ID NO: 567058 - DNA, 20 bp, Artificial Sequence
  chemically synthesized
ttctctttaatcttgtgcag

SEQ ID NO: 567059 - DNA, 20 bp, Artificial Sequence
  chemically synthesized
aaaatgttatattgccactt

SEQ ID NO: 567060 - DNA, 20 bp, Artificial Sequence
  chemically synthesized
agaaaaaatgttatattgcc

SEQ ID NO: 567061 - DNA, 20 bp, Artificial Sequence
  chemically synthesized
tatgggcttgtggatgattt

SEQ ID NO: 567062 - DNA, 20 bp, Artificial Sequence
  chemically synthesized
ttttgagtttatgggcttgt

SEQ ID NO: 567063 - DNA, 20 bp, Artificial Sequence
  chemically synthesized
ttgtgcctatttttgagttt

SEQ ID NO: 567064 - DNA, 20 bp, Artificial Sequence
  chemically synthesized
ccagccagttgtgcctattt

SEQ ID NO: 567065 - DNA, 20 bp, Artificial Sequence
  chemically synthesized
ctcaaaaataggcacaactg

SEQ ID NO: 567066 - DNA, 20 bp, Artificial Sequence
  chemically synthesized
gtggctcatgcctgtaatcc

SEQ ID NO: 567067 - DNA, 20 bp, Artificial Sequence
  chemically synthesized
caccttggcctctcaaagcg

SEQ ID NO: 567068 - DNA, 20 bp, Artificial Sequence
  chemically synthesized
ttgagaggccaaggtgggag

SEQ ID NO: 567069 - DNA, 20 bp, Artificial Sequence
  chemically synthesized
tgggaggactgcttgaggcc

SEQ ID NO: 567070 - DNA, 20 bp, Artificial Sequence
  chemically synthesized
cttgaggccaggagcttaag

SEQ ID NO: 567071 - DNA, 20 bp, Artificial Sequence
  chemically synthesized
tgagatcccatctctacaaa

SEQ ID NO: 567072 - DNA, 20 bp, Artificial Sequence
  chemically synthesized
atgttaacagtgcttattta

SEQ ID NO: 567073 - DNA, 20 bp, Artificial Sequence
  chemically synthesized
aaaaatactcaaaatgttaa

SEQ ID NO: 567074 - DNA, 20 bp, Artificial Sequence
  chemically synthesized
gtaccttagaatatagagcc

SEQ ID NO: 567075 - DNA, 20 bp, Artificial Sequence
  chemically synthesized
ttattctgtgctgaacatta

SEQ ID NO: 567076 - DNA, 20 bp, Artificial Sequence
  chemically synthesized
ataacaacaatatatgttac

SEQ ID NO: 567077 - DNA, 20 bp, Artificial Sequence
  chemically synthesized
tcctgctaggtggcgtgagt

SEQ ID NO: 567078 - DNA, 20 bp, Artificial Sequence
  chemically synthesized
gagtaagaacatcatctaaa

SEQ ID NO: 567079 - DNA, 20 bp, Artificial Sequence
  chemically synthesized
aaatgtagcccagtatctat

SEQ ID NO: 567080 - DNA, 20 bp, Artificial Sequence
  chemically synthesized
tgacagagttcttgtcttca

SEQ ID NO: 567081 - DNA, 20 bp, Artificial Sequence
  chemically synthesized
atgcaactgccctctgaaaa

SEQ ID NO: 567082 - DNA, 20 bp, Artificial Sequence
  chemically synthesized
cggtccatgatctgtattaa

SEQ ID NO: 567083 - DNA, 20 bp, Artificial Sequence
  chemically synthesized
ctttctttcattcttttgtt

SEQ ID NO: 567084 - DNA, 20 bp, Artificial Sequence
  chemically synthesized
actttttctttctttcattc

SEQ ID NO: 567085 - DNA, 20 bp, Artificial Sequence
  chemically synthesized
gaattggtttcgtaggtgtc

SEQ ID NO: 567086 - DNA, 20 bp, Artificial Sequence
  chemically synthesized
tttcctaacacctcatcaga

SEQ ID NO: 567087 - DNA, 20 bp, Artificial Sequence
  chemically synthesized
gttgacccaagtgacttgga

SEQ ID NO: 567088 - DNA, 20 bp, Artificial Sequence
  chemically synthesized
aagtcacttgggtcaacatt

SEQ ID NO: 567089 - DNA, 20 bp, Artificial Sequence
  chemically synthesized
cctagttgaaattcaggctt

SEQ ID NO: 567090 - DNA, 20 bp, Artificial Sequence
  chemically synthesized
ttctttcccctagttgaaat

SEQ ID NO: 567091 - DNA, 20 bp, Artificial Sequence
  chemically synthesized
tgaatagtttaaattacaga

SEQ ID NO: 567092 - DNA, 20 bp, Artificial Sequence
  chemically synthesized
ttaaacaaaattgtatgctg

SEQ ID NO: 567093 - DNA, 20 bp, Artificial Sequence
  chemically synthesized
ttaaactattcagcatacaa

SEQ ID NO: 567094 - DNA, 20 bp, Artificial Sequence
  chemically synthesized
gagcgactggaattctcaga

SEQ ID NO: 567095 - DNA, 20 bp, Artificial Sequence
  chemically synthesized
caactttgggaaaccagtta

SEQ ID NO: 567096 - DNA, 20 bp, Artificial Sequence
  chemically synthesized
atttcataagaaactgccta

SEQ ID NO: 567097 - DNA, 20 bp, Artificial Sequence
  chemically synthesized
atttgagtcataatatacat

SEQ ID NO: 567098 - DNA, 20 bp, Artificial Sequence
  chemically synthesized
atgtgtacatgaatatccat

SEQ ID NO: 567099 - DNA, 20 bp, Artificial Sequence
  chemically synthesized
cattaccttactggttggtt

SEQ ID NO: 567100 - DNA, 20 bp, Artificial Sequence
  chemically synthesized
gtttatccattaccttactg

SEQ ID NO: 567101 - DNA, 20 bp, Artificial Sequence
  chemically synthesized
cactgaatgactttaccaca

SEQ ID NO: 567102 - DNA, 20 bp, Artificial Sequence
  chemically synthesized
ctggcttcttttacccagct

SEQ ID NO: 567103 - DNA, 20 bp, Artificial Sequence
  chemically synthesized
tttgtgcctggcttctttta

SEQ ID NO: 567104 - DNA, 20 bp, Artificial Sequence
  chemically synthesized
acagtatgtactgttttgtg

SEQ ID NO: 567105 - DNA, 20 bp, Artificial Sequence
  chemically synthesized
gccaggcacaaaacagtaca

SEQ ID NO: 567106 - DNA, 20 bp, Artificial Sequence
  chemically synthesized
ggcacaaaacagtacatact

SEQ ID NO: 567107 - DNA, 20 bp, Artificial Sequence
  chemically synthesized
aagtgaaatcaaacagtatg

SEQ ID NO: 567108 - DNA, 20 bp, Artificial Sequence
  chemically synthesized
gctaccatctggcatagtag

SEQ ID NO: 567109 - DNA, 20 bp, Artificial Sequence
  chemically synthesized
ctgacctcaaaggaacacaa

SEQ ID NO: 567110 - DNA, 20 bp, Artificial Sequence
  chemically synthesized
taggtgatcgaaatgttata

SEQ ID NO: 567111 - DNA, 20 bp, Artificial Sequence
  chemically synthesized
tttccattttaagtgttcag

SEQ ID NO: 567112 - DNA, 20 bp, Artificial Sequence
  chemically synthesized
cttaaaatggaaacatgtta

SEQ ID NO: 567113 - DNA, 20 bp, Artificial Sequence
  chemically synthesized
ggcataatttaaacactata

SEQ ID NO: 567114 - DNA, 20 bp, Artificial Sequence
  chemically synthesized
tcagagtgtactgttcatgt

SEQ ID NO: 567115 - DNA, 20 bp, Artificial Sequence
  chemically synthesized
acactctgatgtatgtgtgt

SEQ ID NO: 567116 - DNA, 20 bp, Artificial Sequence
  chemically synthesized
acaactgaccacctctacag

SEQ ID NO: 567117 - DNA, 20 bp, Artificial Sequence
  chemically synthesized
caaccacccttggagttcac

SEQ ID NO: 567118 - DNA, 20 bp, Artificial Sequence
  chemically synthesized
gccgcctgtggcatgaggct

SEQ ID NO: 567119 - DNA, 20 bp, Artificial Sequence
  chemically synthesized
tacagtggccgcctgtggca

SEQ ID NO: 567120 - DNA, 20 bp, Artificial Sequence
  chemically synthesized
atgccacaggcggccactgt

SEQ ID NO: 567121 - DNA, 20 bp, Artificial Sequence
  chemically synthesized
tatttagctcttattacacc

SEQ ID NO: 567122 - DNA, 20 bp, Artificial Sequence
  chemically synthesized
cgggcctgtgtagtgatatt

SEQ ID NO: 567123 - DNA, 20 bp, Artificial Sequence
  chemically synthesized
tattagtggtttgcaaaata

SEQ ID NO: 567124 - DNA, 20 bp, Artificial Sequence
  chemically synthesized
taaaggcagggagtgtttct

SEQ ID NO: 567125 - DNA, 20 bp, Artificial Sequence
  chemically synthesized
aaactcaatttaaaggcagg

SEQ ID NO: 567126 - DNA, 20 bp, Artificial Sequence
  chemically synthesized
aaacactccctgcctttaaa

SEQ ID NO: 567127 - DNA, 20 bp, Artificial Sequence
  chemically synthesized
tttctaaagatggagaacct

SEQ ID NO: 567128 - DNA, 20 bp, Artificial Sequence
  chemically synthesized
aaaatgtccagctgtggttc

SEQ ID NO: 567129 - DNA, 20 bp, Artificial Sequence
  chemically synthesized
tgaaaaccattgttctagca

SEQ ID NO: 567130 - DNA, 20 bp, Artificial Sequence
  chemically synthesized
gggaatcctgctgctagaac

SEQ ID NO: 567131 - DNA, 20 bp, Artificial Sequence
  chemically synthesized
ctatccactccaggtgattc

SEQ ID NO: 567132 - DNA, 20 bp, Artificial Sequence
  chemically synthesized
catcagaatcacctggagtg

SEQ ID NO: 567133 - DNA, 20 bp, Artificial Sequence
  chemically synthesized
atctttaaactatccactcc

SEQ ID NO: 567134 - DNA, 20 bp, Artificial Sequence
  chemically synthesized
tggagtggatagtttaaaga

SEQ ID NO: 567135 - DNA, 20 bp, Artificial Sequence
  chemically synthesized
cagatttcctaggccccacc

SEQ ID NO: 567136 - DNA, 20 bp, Artificial Sequence
  chemically synthesized
cctgggaatctgaatttcta

SEQ ID NO: 567137 - DNA, 20 bp, Artificial Sequence
  chemically synthesized
acctggaaacttgctagaaa

SEQ ID NO: 567138 - DNA, 20 bp, Artificial Sequence
  chemically synthesized
agtcacagttctgtcttttg

SEQ ID NO: 567139 - DNA, 20 bp, Artificial Sequence
  chemically synthesized
ctgtgtctctggcacaggct

SEQ ID NO: 567140 - DNA, 20 bp, Artificial Sequence
  chemically synthesized
gtctctggcacaggctgtaa

SEQ ID NO: 567141 - DNA, 20 bp, Artificial Sequence
  chemically synthesized
gtgacagaacttgtactgag

SEQ ID NO: 567142 - DNA, 20 bp, Artificial Sequence
  chemically synthesized
gtgagtccttgttagtcaaa

SEQ ID NO: 567143 - DNA, 20 bp, Artificial Sequence
  chemically synthesized
tgaggaagaatagcatcagt

SEQ ID NO: 567144 - DNA, 20 bp, Artificial Sequence
  chemically synthesized
gaatagcatcagtatctgct

SEQ ID NO: 567145 - DNA, 20 bp, Artificial Sequence
  chemically synthesized
ttcacagatctgggtggggc

SEQ ID NO: 567146 - DNA, 20 bp, Artificial Sequence
  chemically synthesized
ggctcttagtaaaatattga

SEQ ID NO: 567147 - DNA, 20 bp, Artificial Sequence
  chemically synthesized
accagaggctcttagtaaaa

SEQ ID NO: 567148 - DNA, 20 bp, Artificial Sequence
  chemically synthesized
aatattttactaagagcctc

SEQ ID NO: 567149 - DNA, 20 bp, Artificial Sequence
  chemically synthesized
tctttaaatgaatattttaa

SEQ ID NO: 567150 - DNA, 20 bp, Artificial Sequence
  chemically synthesized
tggtatacagaatttatact

SEQ ID NO: 567151 - DNA, 20 bp, Artificial Sequence
  chemically synthesized
caacaccatcctgtgttgtc

SEQ ID NO: 567152 - DNA, 20 bp, Artificial Sequence
  chemically synthesized
atctttctatcttccatttt

SEQ ID NO: 567153 - DNA, 20 bp, Artificial Sequence
  chemically synthesized
ccattttgtgggcttttatt

SEQ ID NO: 567154 - DNA, 20 bp, Artificial Sequence
  chemically synthesized
tcacaaatatatcccagagg

SEQ ID NO: 567155 - DNA, 20 bp, Artificial Sequence
  chemically synthesized
ctgggatatatttgtgagtc

SEQ ID NO: 567156 - DNA, 20 bp, Artificial Sequence
  chemically synthesized
tagcatttcaagatactccg

SEQ ID NO: 567157 - DNA, 20 bp, Artificial Sequence
  chemically synthesized
gtatcttgaaatgctatata

SEQ ID NO: 567158 - DNA, 20 bp, Artificial Sequence
  chemically synthesized
cttgaaatgctatatataca

SEQ ID NO: 567159 - DNA, 20 bp, Artificial Sequence
  chemically synthesized
tgtctcttttgcccagtcat

SEQ ID NO: 567160 - DNA, 20 bp, Artificial Sequence
  chemically synthesized
gaggacaggaattggtttct

SEQ ID NO: 567161 - DNA, 20 bp, Artificial Sequence
  chemically synthesized
atctggaggggaggacagga

SEQ ID NO: 567162 - DNA, 20 bp, Artificial Sequence
  chemically synthesized
aaccaattcctgtcctcccc

SEQ ID NO: 567163 - DNA, 20 bp, Artificial Sequence
  chemically synthesized
tcccattaacaccagcctgt

SEQ ID NO: 567164 - DNA, 20 bp, Artificial Sequence
  chemically synthesized
atgagagaaaatttgggatt

SEQ ID NO: 567165 - DNA, 20 bp, Artificial Sequence
  chemically synthesized
gtaaaggaatgagagaaaat

SEQ ID NO: 567166 - DNA, 20 bp, Artificial Sequence
  chemically synthesized
cttatgcaaaagtattgagt

SEQ ID NO: 567167 - DNA, 20 bp, Artificial Sequence
  chemically synthesized
ttatgccaatatcttctaca

SEQ ID NO: 567168 - DNA, 20 bp, Artificial Sequence
  chemically synthesized
tcttgtagaagatattggca

SEQ ID NO: 567169 - DNA, 20 bp, Artificial Sequence
  chemically synthesized
agttacgaggcagtggagaa

SEQ ID NO: 567170 - DNA, 20 bp, Artificial Sequence
  chemically synthesized
actgcctcgtaactcatgtg

SEQ ID NO: 567171 - DNA, 20 bp, Artificial Sequence
  chemically synthesized
atctttcttctttcaaagaa

SEQ ID NO: 567172 - DNA, 20 bp, Artificial Sequence
  chemically synthesized
tatgaacgctaagatttgga

SEQ ID NO: 567173 - DNA, 20 bp, Artificial Sequence
  chemically synthesized
gccaattcttgatatgaacg

SEQ ID NO: 567174 - DNA, 20 bp, Artificial Sequence
  chemically synthesized
aagtgggagaggcaagaatg

SEQ ID NO: 567175 - DNA, 20 bp, Artificial Sequence
  chemically synthesized
tagaagtatttagaagggaa

SEQ ID NO: 567176 - DNA, 20 bp, Artificial Sequence
  chemically synthesized
gtaggctgaaaagatgtcag

SEQ ID NO: 567177 - DNA, 20 bp, Artificial Sequence
  chemically synthesized
cagtgaataagccttctgct

SEQ ID NO: 567178 - DNA, 20 bp, Artificial Sequence
  chemically synthesized
tgcgtggaaaactggtagca

SEQ ID NO: 567179 - DNA, 20 bp, Artificial Sequence
  chemically synthesized
aagtccaatccattctcaaa

SEQ ID NO: 567180 - DNA, 20 bp, Artificial Sequence
  chemically synthesized
tgcctgaatcactgtttgag

SEQ ID NO: 567181 - DNA, 20 bp, Artificial Sequence
  chemically synthesized
ttcttctggtatgcctgaat

SEQ ID NO: 567182 - DNA, 20 bp, Artificial Sequence
  chemically synthesized
agaaagtagcagggaatgcc

SEQ ID NO: 567183 - DNA, 20 bp, Artificial Sequence
  chemically synthesized
aatgcctccagctttgttct

SEQ ID NO: 567184 - DNA, 20 bp, Artificial Sequence
  chemically synthesized
tggttccatatgaactttaa

SEQ ID NO: 567185 - DNA, 20 bp, Artificial Sequence
  chemically synthesized
attctgtgaagaaagtcatt

SEQ ID NO: 567186 - DNA, 20 bp, Artificial Sequence
  chemically synthesized
tcatactgcccaaggtaatt

SEQ ID NO: 567187 - DNA, 20 bp, Artificial Sequence
  chemically synthesized
cagtatgaccattttcacga

SEQ ID NO: 567188 - DNA, 20 bp, Artificial Sequence
  chemically synthesized
tgagcatggaatgttcttcc

SEQ ID NO: 567189 - DNA, 20 bp, Artificial Sequence
  chemically synthesized
cctcttttatttccttgagc

SEQ ID NO: 567190 - DNA, 20 bp, Artificial Sequence
  chemically synthesized
caaatgtccaacaatgatag

SEQ ID NO: 567191 - DNA, 20 bp, Artificial Sequence
  chemically synthesized
ttgcgatagtttactgagaa

SEQ ID NO: 567192 - DNA, 20 bp, Artificial Sequence
  chemically synthesized
gtttggttttttgttcttgc

SEQ ID NO: 567193 - DNA, 20 bp, Artificial Sequence
  chemically synthesized
atgagtgagaatatgcggtg

SEQ ID NO: 567194 - DNA, 20 bp, Artificial Sequence
  chemically synthesized
cacctatgagtgagaatatg

SEQ ID NO: 567195 - DNA, 20 bp, Artificial Sequence
  chemically synthesized
tattttttttttattatact

SEQ ID NO: 567196 - DNA, 20 bp, Artificial Sequence
  chemically synthesized
aaaaaagaaagtagcagggc

SEQ ID NO: 567197 - DNA, 20 bp, Artificial Sequence
  chemically synthesized
agaaagtagcagggcaaacg

SEQ ID NO: 567198 - DNA, 20 bp, Artificial Sequence
  chemically synthesized
gtagcattgtgatggaagct

SEQ ID NO: 567199 - DNA, 20 bp, Artificial Sequence
  chemically synthesized
agttaccagatatacatttg

SEQ ID NO: 567200 - DNA, 20 bp, Artificial Sequence
  chemically synthesized
tcaagagagttaactgcctg

SEQ ID NO: 567201 - DNA, 20 bp, Artificial Sequence
  chemically synthesized
gagtctgcagcaccactccc

SEQ ID NO: 567202 - DNA, 20 bp, Artificial Sequence
  chemically synthesized
ttcacagctgtattgcatct

SEQ ID NO: 567203 - DNA, 20 bp, Artificial Sequence
  chemically synthesized
aatgtgacactgtcctgggc

SEQ ID NO: 567204 - DNA, 20 bp, Artificial Sequence
  chemically synthesized
actttcactacacagtcatc

SEQ ID NO: 567205 - DNA, 20 bp, Artificial Sequence
  chemically synthesized
ctgtgtagtgaaagtatgta

SEQ ID NO: 567206 - DNA, 20 bp, Artificial Sequence
  chemically synthesized
ggggcacgggaatggggggc

SEQ ID NO: 567207 - DNA, 20 bp, Artificial Sequence
  chemically synthesized
tctcatggggcacgggaatg

SEQ ID NO: 567208 - DNA, 20 bp, Artificial Sequence
  chemically synthesized
tatccaagaaaccagttacg

SEQ ID NO: 567209 - DNA, 20 bp, Artificial Sequence
  chemically synthesized
tgccatggaaacatggcgta

SEQ ID NO: 567210 - DNA, 20 bp, Artificial Sequence
  chemically synthesized
agcatttttacccttctgaa

SEQ ID NO: 567211 - DNA, 20 bp, Artificial Sequence
  chemically synthesized
ttgcccttgttccttacgtt

SEQ ID NO: 567212 - DNA, 20 bp, Artificial Sequence
  chemically synthesized
ttgatgtttgcccttgttcc

SEQ ID NO: 567213 - DNA, 20 bp, Artificial Sequence
  chemically synthesized
acttgagaaggtaggtggtt

SEQ ID NO: 567214 - DNA, 20 bp, Artificial Sequence
  chemically synthesized
aaattcaacttgagaaggta

SEQ ID NO: 567215 - DNA, 20 bp, Artificial Sequence
  chemically synthesized
agagaagcctattacttgtt

SEQ ID NO: 567216 - DNA, 20 bp, Artificial Sequence
  chemically synthesized
tttgaaacatgaaacaagta

SEQ ID NO: 567217 - DNA, 20 bp, Artificial Sequence
  chemically synthesized
aggggcaagagaagcctatt

SEQ ID NO: 567218 - DNA, 20 bp, Artificial Sequence
  chemically synthesized
gtaataggcttctcttgccc

SEQ ID NO: 567219 - DNA, 20 bp, Artificial Sequence
  chemically synthesized
ttcttgactttggtaagtat

SEQ ID NO: 567220 - DNA, 20 bp, Artificial Sequence
  chemically synthesized
cagaaaagaggaacaactgg

SEQ ID NO: 567221 - DNA, 20 bp, Artificial Sequence
  chemically synthesized
gcgtcacatatctacatgtt

SEQ ID NO: 567222 - DNA, 20 bp, Artificial Sequence
  chemically synthesized
tccatggctttaaaatgctg

SEQ ID NO: 567223 - DNA, 20 bp, Artificial Sequence
  chemically synthesized
taatatctttggaatgcttc

SEQ ID NO: 567224 - DNA, 20 bp, Artificial Sequence
  chemically synthesized
ttttttctgtaatatctttg

SEQ ID NO: 567225 - DNA, 20 bp, Artificial Sequence
  chemically synthesized
aaaattgaaatgaagggact

SEQ ID NO: 567226 - DNA, 20 bp, Artificial Sequence
  chemically synthesized
cccttcatttcaattttata

SEQ ID NO: 567227 - DNA, 20 bp, Artificial Sequence
  chemically synthesized
cctcagttcagtcagagata

SEQ ID NO: 567228 - DNA, 20 bp, Artificial Sequence
  chemically synthesized
ggtctagaatttaaaacaag

SEQ ID NO: 567229 - DNA, 20 bp, Artificial Sequence
  chemically synthesized
gaaagatagactaaaacact

SEQ ID NO: 567230 - DNA, 20 bp, Artificial Sequence
  chemically synthesized
gtgttttagtctatctttcc

SEQ ID NO: 567231 - DNA, 20 bp, Artificial Sequence
  chemically synthesized
ggagactttttggaaaggcc

SEQ ID NO: 567232 - DNA, 20 bp, Artificial Sequence
  chemically synthesized
gtggaaagagctgtacggct

SEQ ID NO: 567233 - DNA, 20 bp, Artificial Sequence
  chemically synthesized
agataaattggtatagtggt

SEQ ID NO: 567234 - DNA, 20 bp, Artificial Sequence
  chemically synthesized
ttcacttaccacctgggaga

SEQ ID NO: 567235 - DNA, 20 bp, Artificial Sequence
  chemically synthesized
ttatttttcacttaccacct

SEQ ID NO: 567236 - DNA, 20 bp, Artificial Sequence
  chemically synthesized
aaaaataaaatttagagcac

SEQ ID NO: 567237 - DNA, 20 bp, Artificial Sequence
  chemically synthesized
ggggagtattgttctaaatt

SEQ ID NO: 567238 - DNA, 20 bp, Artificial Sequence
  chemically synthesized
atgtggggagactgccttgt

SEQ ID NO: 567239 - DNA, 20 bp, Artificial Sequence
  chemically synthesized
aggagtatgtggggagactg

SEQ ID NO: 567240 - DNA, 20 bp, Artificial Sequence
  chemically synthesized
ttttccagtctcactcctcc

SEQ ID NO: 567241 - DNA, 20 bp, Artificial Sequence
  chemically synthesized
caaggttcttgtctgttcta

SEQ ID NO: 567242 - DNA, 20 bp, Artificial Sequence
  chemically synthesized
ttaatttgctttcaagacag

SEQ ID NO: 567243 - DNA, 20 bp, Artificial Sequence
  chemically synthesized
agcctggatattttggctta

SEQ ID NO: 567244 - DNA, 20 bp, Artificial Sequence
  chemically synthesized
agcaaattaagccaaaatat

SEQ ID NO: 567245 - DNA, 20 bp, Artificial Sequence
  chemically synthesized
gacttctgaagcctggatat

SEQ ID NO: 567246 - DNA, 20 bp, Artificial Sequence
  chemically synthesized
gatgatgaggtttttacgag

SEQ ID NO: 567247 - DNA, 20 bp, Artificial Sequence
  chemically synthesized
gtaaagctctatgttgatga

SEQ ID NO: 567248 - DNA, 20 bp, Artificial Sequence
  chemically synthesized
taaaaacctcatcatcaaca

SEQ ID NO: 567249 - DNA, 20 bp, Artificial Sequence
  chemically synthesized
taattcctgtttatctgtgt

SEQ ID NO: 567250 - DNA, 20 bp, Artificial Sequence
  chemically synthesized
tctaagtatgaatgcataat

SEQ ID NO: 567251 - DNA, 20 bp, Artificial Sequence
  chemically synthesized
aatttataattactatcaag

SEQ ID NO: 567252 - DNA, 20 bp, Artificial Sequence
  chemically synthesized
ccctctccttcatttcttag

SEQ ID NO: 567253 - DNA, 20 bp, Artificial Sequence
  chemically synthesized
cgcctcgacctccataagtg

SEQ ID NO: 567254 - DNA, 20 bp, Artificial Sequence
  chemically synthesized
ttttgtgtttttaatagaga

SEQ ID NO: 567255 - DNA, 20 bp, Artificial Sequence
  chemically synthesized
accatgcctggctaattttt

SEQ ID NO: 567256 - DNA, 20 bp, Artificial Sequence
  chemically synthesized
tgcttcagcctcctgagtag

SEQ ID NO: 567257 - DNA, 20 bp, Artificial Sequence
  chemically synthesized
tcaggaggctgaagcaggat

SEQ ID NO: 567258 - DNA, 20 bp, Artificial Sequence
  chemically synthesized
ctcctgggttcaagcaatta

SEQ ID NO: 567259 - DNA, 20 bp, Artificial Sequence
  chemically synthesized
ttgtgccatactaggtactt

SEQ ID NO: 567260 - DNA, 20 bp, Artificial Sequence
  chemically synthesized
agatagcacaaaatcctggc

SEQ ID NO: 567261 - DNA, 20 bp, Artificial Sequence
  chemically synthesized
agcacaaaatcctggctgtg

SEQ ID NO: 567262 - DNA, 20 bp, Artificial Sequence
  chemically synthesized
atgccttaaacaatccacag

SEQ ID NO: 567263 - DNA, 20 bp, Artificial Sequence
  chemically synthesized
aggcatttctggctccctcc

SEQ ID NO: 567264 - DNA, 20 bp, Artificial Sequence
  chemically synthesized
tacagtgttgctaagaagta

SEQ ID NO: 567265 - DNA, 20 bp, Artificial Sequence
  chemically synthesized
atggcagagttgaaattcaa

SEQ ID NO: 567266 - DNA, 20 bp, Artificial Sequence
  chemically synthesized
cattgttagctgccctggta

SEQ ID NO: 567267 - DNA, 20 bp, Artificial Sequence
  chemically synthesized
ggtaaaaggtttgttgagaa

SEQ ID NO: 567268 - DNA, 20 bp, Artificial Sequence
  chemically synthesized
tatcggccatttgttacaga

SEQ ID NO: 567269 - DNA, 20 bp, Artificial Sequence
  chemically synthesized
tctgtaacaaatggccgata

SEQ ID NO: 567270 - DNA, 20 bp, Artificial Sequence
  chemically synthesized
ctgtgccatgctcctttaaa

SEQ ID NO: 567271 - DNA, 20 bp, Artificial Sequence
  chemically synthesized
ctgatccttccgctcttgaa

SEQ ID NO: 567272 - DNA, 20 bp, Artificial Sequence
  chemically synthesized
agccctgatccttccgctct

SEQ ID NO: 567273 - DNA, 20 bp, Artificial Sequence
  chemically synthesized
ttgtatgttttatatataat

SEQ ID NO: 567274 - DNA, 20 bp, Artificial Sequence
  chemically synthesized
atccataattattatggatt

SEQ ID NO: 567275 - DNA, 20 bp, Artificial Sequence
  chemically synthesized
ccttatggatccataattat

SEQ ID NO: 567276 - DNA, 20 bp, Artificial Sequence
  chemically synthesized
aagatcaggcaacactgctt

SEQ ID NO: 567277 - DNA, 20 bp, Artificial Sequence
  chemically synthesized
atttttaaaagatcaggcaa

SEQ ID NO: 567278 - DNA, 20 bp, Artificial Sequence
  chemically synthesized
gttatatattaaaataatac

SEQ ID NO: 567279 - DNA, 20 bp, Artificial Sequence
  chemically synthesized
atatgtatttgaagtaatac

SEQ ID NO: 567280 - DNA, 20 bp, Artificial Sequence
  chemically synthesized
aaaaaagactctttaggcag

SEQ ID NO: 567281 - DNA, 20 bp, Artificial Sequence
  chemically synthesized
tttaggcagaactgttttat

SEQ ID NO: 567282 - DNA, 20 bp, Artificial Sequence
  chemically synthesized
aaatattgaaaggatagatg

SEQ ID NO: 567283 - DNA, 20 bp, Artificial Sequence
  chemically synthesized
tccatgtacttggcatggtt

SEQ ID NO: 567284 - DNA, 20 bp, Artificial Sequence
  chemically synthesized
cactgcaaagtcaataaagg

SEQ ID NO: 567285 - DNA, 20 bp, Artificial Sequence
  chemically synthesized
cacctggcctacatatgaat

SEQ ID NO: 567286 - DNA, 20 bp, Artificial Sequence
  chemically synthesized
ctgccttggcctcccaaagg

SEQ ID NO: 567287 - DNA, 20 bp, Artificial Sequence
  chemically synthesized
ttttgtatttttagtagaga

SEQ ID NO: 567288 - DNA, 20 bp, Artificial Sequence
  chemically synthesized
ctcagcctcccaggtagtag

SEQ ID NO: 567289 - DNA, 20 bp, Artificial Sequence
  chemically synthesized
ctgggaggctgaggcaggag

SEQ ID NO: 567290 - DNA, 20 bp, Artificial Sequence
  chemically synthesized
agcctccacctcccaggttc

SEQ ID NO: 567291 - DNA, 20 bp, Artificial Sequence
  chemically synthesized
gaggtggaggctgcagtgag

SEQ ID NO: 567292 - DNA, 20 bp, Artificial Sequence
  chemically synthesized
gtttgttagtttgtttgaga

SEQ ID NO: 567293 - DNA, 20 bp, Artificial Sequence
  chemically synthesized
atatgaatatttgtttgtta

SEQ ID NO: 567294 - DNA, 20 bp, Artificial Sequence
  chemically synthesized
gtacatatgaatatttgttt

SEQ ID NO: 567295 - DNA, 20 bp, Artificial Sequence
  chemically synthesized
ttaccacagtacatatgaat

SEQ ID NO: 567296 - DNA, 20 bp, Artificial Sequence
  chemically synthesized
atacagtctcatcacttcct

SEQ ID NO: 567297 - DNA, 20 bp, Artificial Sequence
  chemically synthesized
catagggaaacataggtccg

SEQ ID NO: 567298 - DNA, 20 bp, Artificial Sequence
  chemically synthesized
ctccaagaagcctctcggac

SEQ ID NO: 567299 - DNA, 20 bp, Artificial Sequence
  chemically synthesized
gctcccatcatccttcaagt

SEQ ID NO: 567300 - DNA, 20 bp, Artificial Sequence
  chemically synthesized
ccccaccttcttctctgctt

SEQ ID NO: 567301 - DNA, 20 bp, Artificial Sequence
  chemically synthesized
ctctgaagcagagaagaagg

SEQ ID NO: 567302 - DNA, 20 bp, Artificial Sequence
  chemically synthesized
tcttaaagccccaccttctt

SEQ ID NO: 567303 - DNA, 20 bp, Artificial Sequence
  chemically synthesized
tttcagcaatattggccttc

SEQ ID NO: 567304 - DNA, 20 bp, Artificial Sequence
  chemically synthesized
ccactcttcctccttcctct

SEQ ID NO: 567305 - DNA, 20 bp, Artificial Sequence
  chemically synthesized
cagagccctgcacatcgtgt

SEQ ID NO: 567306 - DNA, 20 bp, Artificial Sequence
  chemically synthesized
aaatgagtctgctccatctg

SEQ ID NO: 567307 - DNA, 20 bp, Artificial Sequence
  chemically synthesized
ttcctcttctatcaacctgg

SEQ ID NO: 567308 - DNA, 20 bp, Artificial Sequence
  chemically synthesized
tgatctgttctcatctcctc

SEQ ID NO: 567309 - DNA, 20 bp, Artificial Sequence
  chemically synthesized
gatcagagctccagtatttt

SEQ ID NO: 567310 - DNA, 20 bp, Artificial Sequence
  chemically synthesized
cccaacatcattaattgagc

SEQ ID NO: 567311 - DNA, 20 bp, Artificial Sequence
  chemically synthesized
tgtctccccaacatcattaa

SEQ ID NO: 567312 - DNA, 20 bp, Artificial Sequence
  chemically synthesized
ttaatgatgttggggagaca

SEQ ID NO: 567313 - DNA, 20 bp, Artificial Sequence
  chemically synthesized
gaggaactaacaagacgcat

SEQ ID NO: 567314 - DNA, 20 bp, Artificial Sequence
  chemically synthesized
tgctaggctccaagtggggg

SEQ ID NO: 567315 - DNA, 20 bp, Artificial Sequence
  chemically synthesized
agcctagcatctcagccacc

SEQ ID NO: 567316 - DNA, 20 bp, Artificial Sequence
  chemically synthesized
cttcatcctgacagaaggct

SEQ ID NO: 567317 - DNA, 20 bp, Artificial Sequence
  chemically synthesized
ccctggtgtgtggtgcagct

SEQ ID NO: 567318 - DNA, 20 bp, Artificial Sequence
  chemically synthesized
tcatgcgccctggtgtgtgg

SEQ ID NO: 567319 - DNA, 20 bp, Artificial Sequence
  chemically synthesized
gggagaaggcactggaaaca

SEQ ID NO: 567320 - DNA, 20 bp, Artificial Sequence
  chemically synthesized
gcagagctggtatgtaatcc

SEQ ID NO: 567321 - DNA, 20 bp, Artificial Sequence
  chemically synthesized
ggaaatgaaggaaatgaatt

SEQ ID NO: 567322 - DNA, 20 bp, Artificial Sequence
  chemically synthesized
cctcaattccatatttagtc

SEQ ID NO: 567323 - DNA, 20 bp, Artificial Sequence
  chemically synthesized
aaaagaaagtgcttaggtag

SEQ ID NO: 567324 - DNA, 20 bp, Artificial Sequence
  chemically synthesized
gataaaggtggcaaaaaaga

SEQ ID NO: 567325 - DNA, 20 bp, Artificial Sequence
  chemically synthesized
actgcaaggaaagtgcattg

SEQ ID NO: 567326 - DNA, 20 bp, Artificial Sequence
  chemically synthesized
gggagactgcaaggaaagtg

SEQ ID NO: 567327 - DNA, 20 bp, Artificial Sequence
  chemically synthesized
gagccaaaggaggagaatag

SEQ ID NO: 567328 - DNA, 20 bp, Artificial Sequence
  chemically synthesized
aaccttcagtcactgctctc

SEQ ID NO: 567329 - DNA, 20 bp, Artificial Sequence
  chemically synthesized
aaggagattggggtaaattt

SEQ ID NO: 567330 - DNA, 20 bp, Artificial Sequence
  chemically synthesized
gaggttgagaatagagttga

SEQ ID NO: 567331 - DNA, 20 bp, Artificial Sequence
  chemically synthesized
tcacttatgaagagagactg

SEQ ID NO: 567332 - DNA, 20 bp, Artificial Sequence
  chemically synthesized
cttcataagtgaacacacat

SEQ ID NO: 567333 - DNA, 20 bp, Artificial Sequence
  chemically synthesized
cccagattcgccagggcaga

SEQ ID NO: 567334 - DNA, 20 bp, Artificial Sequence
  chemically synthesized
tacctttgcaaagccaaatt

SEQ ID NO: 567335 - DNA, 20 bp, Artificial Sequence
  chemically synthesized
taaaaaaaaaaatctgtgaa

SEQ ID NO: 567336 - DNA, 20 bp, Artificial Sequence
  chemically synthesized
ttttttttttaatgttgtgc

SEQ ID NO: 567337 - DNA, 20 bp, Artificial Sequence
  chemically synthesized
taatgttgtgccttagcttt

SEQ ID NO: 567338 - DNA, 20 bp, Artificial Sequence
  chemically synthesized
tgtcaaccatattatgaaga

SEQ ID NO: 567339 - DNA, 20 bp, Artificial Sequence
  chemically synthesized
tatttattttcatcattaaa

SEQ ID NO: 567340 - DNA, 20 bp, Artificial Sequence
  chemically synthesized
aaataacagtaaatttcctc

SEQ ID NO: 567341 - DNA, 20 bp, Artificial Sequence
  chemically synthesized
taacctcatcttttgcccct

SEQ ID NO: 567342 - DNA, 20 bp, Artificial Sequence
  chemically synthesized
taccttggccttaccgccgt

SEQ ID NO: 567343 - DNA, 20 bp, Artificial Sequence
  chemically synthesized
tatttctctgcccttatctc

SEQ ID NO: 567344 - DNA, 20 bp, Artificial Sequence
  chemically synthesized
taccagagaagtaattgaaa

SEQ ID NO: 567345 - DNA, 20 bp, Artificial Sequence
  chemically synthesized
gactctttttttgtgtgtgt

SEQ ID NO: 567346 - DNA, 20 bp, Artificial Sequence
  chemically synthesized
ctttttttgtgtgtgtgtgt

SEQ ID NO: 567347 - DNA, 20 bp, Artificial Sequence
  chemically synthesized
tgtgtgtgtttgattcgttg

SEQ ID NO: 567348 - DNA, 20 bp, Artificial Sequence
  chemically synthesized
tggtcagtttgggctcacat

SEQ ID NO: 567349 - DNA, 20 bp, Artificial Sequence
  chemically synthesized
tacgccattagttaaaaatc

SEQ ID NO: 567350 - DNA, 20 bp, Artificial Sequence
  chemically synthesized
aagcaagacaacgggaaatc

SEQ ID NO: 567351 - DNA, 20 bp, Artificial Sequence
  chemically synthesized
aatctggtgatttcccgttg

SEQ ID NO: 567352 - DNA, 20 bp, Artificial Sequence
  chemically synthesized
ggaggctctgttaccctaac

SEQ ID NO: 567353 - DNA, 20 bp, Artificial Sequence
  chemically synthesized
gtgggaactggggcaacctg

SEQ ID NO: 567354 - DNA, 20 bp, Artificial Sequence
  chemically synthesized
caccttcagtcattcaaatt

SEQ ID NO: 567355 - DNA, 20 bp, Artificial Sequence
  chemically synthesized
gaccactcccttgttctccc

SEQ ID NO: 567356 - DNA, 20 bp, Artificial Sequence
  chemically synthesized
tgtaactgaagggtaaatgt

SEQ ID NO: 567357 - DNA, 20 bp, Artificial Sequence
  chemically synthesized
ctctatggaaacagttgtta

SEQ ID NO: 567358 - DNA, 20 bp, Artificial Sequence
  chemically synthesized
ttttgggaaaacccagtaac

SEQ ID NO: 567359 - DNA, 20 bp, Artificial Sequence
  chemically synthesized
tgggttttcccaaaactttc

SEQ ID NO: 567360 - DNA, 20 bp, Artificial Sequence
  chemically synthesized
gtccaaagaattaatcgctg

SEQ ID NO: 567361 - DNA, 20 bp, Artificial Sequence
  chemically synthesized
tttactaatgcattcaaact

SEQ ID NO: 567362 - DNA, 20 bp, Artificial Sequence
  chemically synthesized
tatttttggcagcacaatca

SEQ ID NO: 567363 - DNA, 20 bp, Artificial Sequence
  chemically synthesized
tgaaatatagtcaggagact

SEQ ID NO: 567364 - DNA, 20 bp, Artificial Sequence
  chemically synthesized
ctgcatttaaaatcatcagt

SEQ ID NO: 567365 - DNA, 20 bp, Artificial Sequence
  chemically synthesized
gtgcttaagtaagcgtcaac

SEQ ID NO: 567366 - DNA, 20 bp, Artificial Sequence
  chemically synthesized
tacacagttaggcatataat

SEQ ID NO: 567367 - DNA, 20 bp, Artificial Sequence
  chemically synthesized
tgtgtactaagcccaggggt

SEQ ID NO: 567368 - DNA, 20 bp, Artificial Sequence
  chemically synthesized
gaaacctgaatctttaaccc

SEQ ID NO: 567369 - DNA, 20 bp, Artificial Sequence
  chemically synthesized
taagcccaggggttaaagat

SEQ ID NO: 567370 - DNA, 20 bp, Artificial Sequence
  chemically synthesized
ctaagatattggggaaaaca

SEQ ID NO: 567371 - DNA, 20 bp, Artificial Sequence
  chemically synthesized
ttttacagggtgaataatct

SEQ ID NO: 567372 - DNA, 20 bp, Artificial Sequence
  chemically synthesized
acaaatacctgggatacgtg

SEQ ID NO: 567373 - DNA, 20 bp, Artificial Sequence
  chemically synthesized
accagagttttgtatgtgtg

SEQ ID NO: 567374 - DNA, 20 bp, Artificial Sequence
  chemically synthesized
ttctttgacactcacataac

SEQ ID NO: 567375 - DNA, 20 bp, Artificial Sequence
  chemically synthesized
ttaccactttaccgtccatc

SEQ ID NO: 567376 - DNA, 20 bp, Artificial Sequence
  chemically synthesized
atggacggtaaagtggtaaa

SEQ ID NO: 567377 - DNA, 20 bp, Artificial Sequence
  chemically synthesized
ttgcaatattcctgaataaa

SEQ ID NO: 567378 - DNA, 20 bp, Artificial Sequence
  chemically synthesized
ttgatagccaaggagcaggg

SEQ ID NO: 567379 - DNA, 20 bp, Artificial Sequence
  chemically synthesized
ttacccccatgctttctctt

SEQ ID NO: 567380 - DNA, 20 bp, Artificial Sequence
  chemically synthesized
aagagaaagcatgggggtaa

SEQ ID NO: 567381 - DNA, 20 bp, Artificial Sequence
  chemically synthesized
agctagaatcccccttaccc

SEQ ID NO: 567382 - DNA, 20 bp, Artificial Sequence
  chemically synthesized
tgtcttcagcaaggttcctg

SEQ ID NO: 567383 - DNA, 20 bp, Artificial Sequence
  chemically synthesized
gaggaaggtggttcttgcta

SEQ ID NO: 567384 - DNA, 20 bp, Artificial Sequence
  chemically synthesized
gttcttgctaaactgattta

SEQ ID NO: 567385 - DNA, 20 bp, Artificial Sequence
  chemically synthesized
tgtagcgagaatcctgctaa

SEQ ID NO: 567386 - DNA, 20 bp, Artificial Sequence
  chemically synthesized
ttagcaggattctcgctaca

SEQ ID NO: 567387 - DNA, 20 bp, Artificial Sequence
  chemically synthesized
agaaggttcaggagtctggc

SEQ ID NO: 567388 - DNA, 20 bp, Artificial Sequence
  chemically synthesized
gtagacaatctttatcatga

SEQ ID NO: 567389 - DNA, 20 bp, Artificial Sequence
  chemically synthesized
gtacataagcatcctcatga

SEQ ID NO: 567390 - DNA, 20 bp, Artificial Sequence
  chemically synthesized
cacgatggtctattttcatt

SEQ ID NO: 567391 - DNA, 20 bp, Artificial Sequence
  chemically synthesized
ataatgaaaatagaccatcg

SEQ ID NO: 567392 - DNA, 20 bp, Artificial Sequence
  chemically synthesized
gtttatatgtcaaccgcaaa

SEQ ID NO: 567393 - DNA, 20 bp, Artificial Sequence
  chemically synthesized
cttaaaaatgttcattggaa

SEQ ID NO: 567394 - DNA, 20 bp, Artificial Sequence
  chemically synthesized
aattactgtttcatgagtaa

SEQ ID NO: 567395 - DNA, 20 bp, Artificial Sequence
  chemically synthesized
gcctttgtgggcttagaaat

SEQ ID NO: 567396 - DNA, 20 bp, Artificial Sequence
  chemically synthesized
acagtaatttctaagcccac

SEQ ID NO: 567397 - DNA, 20 bp, Artificial Sequence
  chemically synthesized
taaactaaatttaagccttt

SEQ ID NO: 567398 - DNA, 20 bp, Artificial Sequence
  chemically synthesized
taagcccacaaaggcttaaa

SEQ ID NO: 567399 - DNA, 20 bp, Artificial Sequence
  chemically synthesized
gtcatttctatcagtattac

SEQ ID NO: 567400 - DNA, 20 bp, Artificial Sequence
  chemically synthesized
gactgatgtaactaattaga

SEQ ID NO: 567401 - DNA, 20 bp, Artificial Sequence
  chemically synthesized
ataaatgtatttggaataaa

SEQ ID NO: 567402 - DNA, 20 bp, Artificial Sequence
  chemically synthesized
ttagattctgaaaggaactt

SEQ ID NO: 567403 - DNA, 20 bp, Artificial Sequence
  chemically synthesized
aaggaacttccttgctttta

SEQ ID NO: 567404 - DNA, 20 bp, Artificial Sequence
  chemically synthesized
caggtttaagctgtcgatga

SEQ ID NO: 567405 - DNA, 20 bp, Artificial Sequence
  chemically synthesized
gatgtaaaatcaatgtcatc

SEQ ID NO: 567406 - DNA, 20 bp, Artificial Sequence
  chemically synthesized
gtaagcaaaaataataattc

SEQ ID NO: 567407 - DNA, 20 bp, Artificial Sequence
  chemically synthesized
tgaatcactggaattattat

SEQ ID NO: 567408 - DNA, 20 bp, Artificial Sequence
  chemically synthesized
ttactccttacaacctgagc

SEQ ID NO: 567409 - DNA, 20 bp, Artificial Sequence
  chemically synthesized
agtcttgatatctttgtgag

SEQ ID NO: 567410 - DNA, 20 bp, Artificial Sequence
  chemically synthesized
gaaaataaatggtctaaaaa

SEQ ID NO: 567411 - DNA, 20 bp, Artificial Sequence
  chemically synthesized
tatctgccacaattaaatac

SEQ ID NO: 567412 - DNA, 20 bp, Artificial Sequence
  chemically synthesized
gccaggggaagctgtgtgga

SEQ ID NO: 567413 - DNA, 20 bp, Artificial Sequence
  chemically synthesized
attggccaaaactgtgtcca

SEQ ID NO: 567414 - DNA, 20 bp, Artificial Sequence
  chemically synthesized
tgtgtggacacagttttggc

SEQ ID NO: 567415 - DNA, 20 bp, Artificial Sequence
  chemically synthesized
cttgagaagatatctgcaag

SEQ ID NO: 567416 - DNA, 20 bp, Artificial Sequence
  chemically synthesized
cctgatggttccaagacgac

SEQ ID NO: 567417 - DNA, 20 bp, Artificial Sequence
  chemically synthesized
atgtcatcagagacctgggc

SEQ ID NO: 567418 - DNA, 20 bp, Artificial Sequence
  chemically synthesized
tacaaaaaatatcaactcct

SEQ ID NO: 567419 - DNA, 20 bp, Artificial Sequence
  chemically synthesized
ctatttagtcttctgcattt

SEQ ID NO: 567420 - DNA, 20 bp, Artificial Sequence
  chemically synthesized
acgtcatttctccaccgcaa

SEQ ID NO: 567421 - DNA, 20 bp, Artificial Sequence
  chemically synthesized
aggtggtgccactgatgcag

SEQ ID NO: 567422 - DNA, 20 bp, Artificial Sequence
  chemically synthesized
gaacagcttgacagctaatt

SEQ ID NO: 567423 - DNA, 20 bp, Artificial Sequence
  chemically synthesized
atataagccctctgttataa

SEQ ID NO: 567424 - DNA, 20 bp, Artificial Sequence
  chemically synthesized
tttaaaacaattttataaca

SEQ ID NO: 567425 - DNA, 20 bp, Artificial Sequence
  chemically synthesized
tcttctagacaaagtctgca

SEQ ID NO: 567426 - DNA, 20 bp, Artificial Sequence
  chemically synthesized
agtctgcaaagtgtttagcc

SEQ ID NO: 567427 - DNA, 20 bp, Artificial Sequence
  chemically synthesized
ttggaatgggacgttcacaa

SEQ ID NO: 567428 - DNA, 20 bp, Artificial Sequence
  chemically synthesized
gattctgcccagatgtaaga

SEQ ID NO: 567429 - DNA, 20 bp, Artificial Sequence
  chemically synthesized
aatttccagagaagtaactt

SEQ ID NO: 567430 - DNA, 20 bp, Artificial Sequence
  chemically synthesized
taaatgaacacatataatca

SEQ ID NO: 567431 - DNA, 20 bp, Artificial Sequence
  chemically synthesized
taaagagttaatgaaaaact

SEQ ID NO: 567432 - DNA, 20 bp, Artificial Sequence
  chemically synthesized
agataaatgttatttaaaaa

SEQ ID NO: 567433 - DNA, 20 bp, Artificial Sequence
  chemically synthesized
tttggtaacttcaactaatc

SEQ ID NO: 567434 - DNA, 20 bp, Artificial Sequence
  chemically synthesized
cttaatttgactgtcaaaac

SEQ ID NO: 567435 - DNA, 20 bp, Artificial Sequence
  chemically synthesized
catatgttttgacagtcaaa

SEQ ID NO: 567436 - DNA, 20 bp, Artificial Sequence
  chemically synthesized
tcattttcactcagaaccta

SEQ ID NO: 567437 - DNA, 20 bp, Artificial Sequence
  chemically synthesized
acattttaggttctgagtga

SEQ ID NO: 567438 - DNA, 20 bp, Artificial Sequence
  chemically synthesized
tttggcatccattttattca

SEQ ID NO: 567439 - DNA, 20 bp, Artificial Sequence
  chemically synthesized
tgttttttgcaagaaggtca

SEQ ID NO: 567440 - DNA, 20 bp, Artificial Sequence
  chemically synthesized
aaaatgttttttgcaagaag

SEQ ID NO: 567441 - DNA, 20 bp, Artificial Sequence
  chemically synthesized
ctaagacagaaatgttgcaa

SEQ ID NO: 567442 - DNA, 20 bp, Artificial Sequence
  chemically synthesized
tttctgtcttaggctggtat

SEQ ID NO: 567443 - DNA, 20 bp, Artificial Sequence
  chemically synthesized
tcacctcattaggaaagata

SEQ ID NO: 567444 - DNA, 20 bp, Artificial Sequence
  chemically synthesized
cattaggaaagatacattgt

SEQ ID NO: 567445 - DNA, 20 bp, Artificial Sequence
  chemically synthesized
tgtttgggttttgttgatgt

SEQ ID NO: 567446 - DNA, 20 bp, Artificial Sequence
  chemically synthesized
ttattcatgcataaagactc

SEQ ID NO: 567447 - DNA, 20 bp, Artificial Sequence
  chemically synthesized
gcatagtttactatgatcct

SEQ ID NO: 567448 - DNA, 20 bp, Artificial Sequence
  chemically synthesized
tcatagtaaactatgcgtat

SEQ ID NO: 567449 - DNA, 20 bp, Artificial Sequence
  chemically synthesized
atacaaaaagcagagatacg

SEQ ID NO: 567450 - DNA, 20 bp, Artificial Sequence
  chemically synthesized
atgcagaagcatgtgataga

SEQ ID NO: 567451 - DNA, 20 bp, Artificial Sequence
  chemically synthesized
aaaagaaaacattctctatc

SEQ ID NO: 567452 - DNA, 20 bp, Artificial Sequence
  chemically synthesized
gctaagtaattttgtttaag

SEQ ID NO: 567453 - DNA, 20 bp, Artificial Sequence
  chemically synthesized
taactgcagctgctaagtaa

SEQ ID NO: 567454 - DNA, 20 bp, Artificial Sequence
  chemically synthesized
tgataaaataaatcaatggt

SEQ ID NO: 567455 - DNA, 20 bp, Artificial Sequence
  chemically synthesized
atctaatgaaaatctcctac

SEQ ID NO: 567456 - DNA, 20 bp, Artificial Sequence
  chemically synthesized
tggccctctgacatagactg

SEQ ID NO: 567457 - DNA, 20 bp, Artificial Sequence
  chemically synthesized
ataaaggatgcctgaagcgt

SEQ ID NO: 567458 - DNA, 20 bp, Artificial Sequence
  chemically synthesized
gatacacagagggtaaacag

SEQ ID NO: 567459 - DNA, 20 bp, Artificial Sequence
  chemically synthesized
ggagtaccggtaatattggt

SEQ ID NO: 567460 - DNA, 20 bp, Artificial Sequence
  chemically synthesized
ctctgcctcctgggttcaag

SEQ ID NO: 567461 - DNA, 20 bp, Artificial Sequence
  chemically synthesized
tttcatatttttagtagaga

SEQ ID NO: 567462 - DNA, 20 bp, Artificial Sequence
  chemically synthesized
tgccttggcctcccaaagtg

SEQ ID NO: 567463 - DNA, 20 bp, Artificial Sequence
  chemically synthesized
caagcaactcccaaatgcag

SEQ ID NO: 567464 - DNA, 20 bp, Artificial Sequence
  chemically synthesized
aaaactatgctgcatttggg

SEQ ID NO: 567465 - DNA, 20 bp, Artificial Sequence
  chemically synthesized
catttgggagttgcttgata

SEQ ID NO: 567466 - DNA, 20 bp, Artificial Sequence
  chemically synthesized
gatataaagctttaccaatt

SEQ ID NO: 567467 - DNA, 20 bp, Artificial Sequence
  chemically synthesized
ggattgaatcttcaaattgg

SEQ ID NO: 567468 - DNA, 20 bp, Artificial Sequence
  chemically synthesized
aactcagagtctgcccgatt

SEQ ID NO: 567469 - DNA, 20 bp, Artificial Sequence
  chemically synthesized
ggcagaggaactcagagtct

SEQ ID NO: 567470 - DNA, 20 bp, Artificial Sequence
  chemically synthesized
atggccctgaagtcacagga

SEQ ID NO: 567471 - DNA, 20 bp, Artificial Sequence
  chemically synthesized
ctcctctcagtggcaatgac

SEQ ID NO: 567472 - DNA, 20 bp, Artificial Sequence
  chemically synthesized
tgaccacggattccttgtct

SEQ ID NO: 567473 - DNA, 20 bp, Artificial Sequence
  chemically synthesized
cattccccctttctctgcct

SEQ ID NO: 567474 - DNA, 20 bp, Artificial Sequence
  chemically synthesized
ctgtttctctcacttctcac

SEQ ID NO: 567475 - DNA, 20 bp, Artificial Sequence
  chemically synthesized
tttcaacacactggatctga

SEQ ID NO: 567476 - DNA, 20 bp, Artificial Sequence
  chemically synthesized
ttatcctcaagtagttttgt

SEQ ID NO: 567477 - DNA, 20 bp, Artificial Sequence
  chemically synthesized
ctgctttaggtttatcctca

SEQ ID NO: 567478 - DNA, 20 bp, Artificial Sequence
  chemically synthesized
cttaggaaaaaagggctgct

SEQ ID NO: 567479 - DNA, 20 bp, Artificial Sequence
  chemically synthesized
cctacatcttaggaaaaaag

SEQ ID NO: 567480 - DNA, 20 bp, Artificial Sequence
  chemically synthesized
ttctgccatcggcctgtcac

SEQ ID NO: 567481 - DNA, 20 bp, Artificial Sequence
  chemically synthesized
aaggccctgagttctgtatt

SEQ ID NO: 567482 - DNA, 20 bp, Artificial Sequence
  chemically synthesized
aaagataaaatgaggctcac

SEQ ID NO: 567483 - DNA, 20 bp, Artificial Sequence
  chemically synthesized
atcagaggctttgagtgtca

SEQ ID NO: 567484 - DNA, 20 bp, Artificial Sequence
  chemically synthesized
gagaagcggggaaggccatc

SEQ ID NO: 567485 - DNA, 20 bp, Artificial Sequence
  chemically synthesized
tcaaagcctctgatggcctt

SEQ ID NO: 567486 - DNA, 20 bp, Artificial Sequence
  chemically synthesized
cccattcacccttgtgctaa

SEQ ID NO: 567487 - DNA, 20 bp, Artificial Sequence
  chemically synthesized
cctccctgtggtccttgtgc

SEQ ID NO: 567488 - DNA, 20 bp, Artificial Sequence
  chemically synthesized
ctccctcatcccattgactg

SEQ ID NO: 567489 - DNA, 20 bp, Artificial Sequence
  chemically synthesized
tcccagtcctccttatctag

SEQ ID NO: 567490 - DNA, 20 bp, Artificial Sequence
  chemically synthesized
gtagaaactcgtactgcagg

SEQ ID NO: 567491 - DNA, 20 bp, Artificial Sequence
  chemically synthesized
gaataatcaacacctgcagt

SEQ ID NO: 567492 - DNA, 20 bp, Artificial Sequence
  chemically synthesized
gtttctaccatttttcctac

SEQ ID NO: 567493 - DNA, 20 bp, Artificial Sequence
  chemically synthesized
ttgctcccatagaaacatac

SEQ ID NO: 567494 - DNA, 20 bp, Artificial Sequence
  chemically synthesized
catgtaaatagaaagcagct

SEQ ID NO: 567495 - DNA, 20 bp, Artificial Sequence
  chemically synthesized
tcaggcactctgagggttaa

SEQ ID NO: 567496 - DNA, 20 bp, Artificial Sequence
  chemically synthesized
acttaccctcgggctctgtt

SEQ ID NO: 567497 - DNA, 20 bp, Artificial Sequence
  chemically synthesized
acttggaacagagcccgagg

SEQ ID NO: 567498 - DNA, 20 bp, Artificial Sequence
  chemically synthesized
aaccacattcccaccttgag

SEQ ID NO: 567499 - DNA, 20 bp, Artificial Sequence
  chemically synthesized
ggaaaatgaaaattttaaat

SEQ ID NO: 567500 - DNA, 20 bp, Artificial Sequence
  chemically synthesized
ggaattcagaacaagttact

SEQ ID NO: 567501 - DNA, 20 bp, Artificial Sequence
  chemically synthesized
aaaaagacttggattctagt

SEQ ID NO: 567502 - DNA, 20 bp, Artificial Sequence
  chemically synthesized
cacacttggggagaaaaaga

SEQ ID NO: 567503 - DNA, 20 bp, Artificial Sequence
  chemically synthesized
gagcctttatatttttgttc

SEQ ID NO: 567504 - DNA, 20 bp, Artificial Sequence
  chemically synthesized
tgggacttcaagtctactca

SEQ ID NO: 567505 - DNA, 20 bp, Artificial Sequence
  chemically synthesized
ggaaaatttgttttccagtc

SEQ ID NO: 567506 - DNA, 20 bp, Artificial Sequence
  chemically synthesized
ccctgcttgcttttgggaaa

SEQ ID NO: 567507 - DNA, 20 bp, Artificial Sequence
  chemically synthesized
acaggggaaaattagaccct

SEQ ID NO: 567508 - DNA, 20 bp, Artificial Sequence
  chemically synthesized
cttaacaggggaaaattaga

SEQ ID NO: 567509 - DNA, 20 bp, Artificial Sequence
  chemically synthesized
tctaattttcccctgttaag

SEQ ID NO: 567510 - DNA, 20 bp, Artificial Sequence
  chemically synthesized
cttggcatcttcttaaattt

SEQ ID NO: 567511 - DNA, 20 bp, Artificial Sequence
  chemically synthesized
tgacttccttctataacaca

SEQ ID NO: 567512 - DNA, 20 bp, Artificial Sequence
  chemically synthesized
gtctaagggagtgtctgaga

SEQ ID NO: 567513 - DNA, 20 bp, Artificial Sequence
  chemically synthesized
tcctctctgtacttctgatg

SEQ ID NO: 567514 - DNA, 20 bp, Artificial Sequence
  chemically synthesized
agcttaatttcccatttgaa

SEQ ID NO: 567515 - DNA, 20 bp, Artificial Sequence
  chemically synthesized
tcccatttgaataatgattt

SEQ ID NO: 567516 - DNA, 20 bp, Artificial Sequence
  chemically synthesized
atttgaataatgattttttt

SEQ ID NO: 567517 - DNA, 20 bp, Artificial Sequence
  chemically synthesized
ttcaaagcttcataaatgct

SEQ ID NO: 567518 - DNA, 20 bp, Artificial Sequence
  chemically synthesized
tgagaagcagttagcattta

SEQ ID NO: 567519 - DNA, 20 bp, Artificial Sequence
  chemically synthesized
agtcaaattggacaaccatt

SEQ ID NO: 567520 - DNA, 20 bp, Artificial Sequence
  chemically synthesized
ggaacccagaaataaatgta

SEQ ID NO: 567521 - DNA, 20 bp, Artificial Sequence
  chemically synthesized
tgcactatggagagttatgt

SEQ ID NO: 567522 - DNA, 20 bp, Artificial Sequence
  chemically synthesized
ctgacataactctccatagt

SEQ ID NO: 567523 - DNA, 20 bp, Artificial Sequence
  chemically synthesized
taccttttacataattaacc

SEQ ID NO: 567524 - DNA, 20 bp, Artificial Sequence
  chemically synthesized
aaatgggcatatttttatgt

SEQ ID NO: 567525 - DNA, 20 bp, Artificial Sequence
  chemically synthesized
attaacagtatagtttttat

SEQ ID NO: 567526 - DNA, 20 bp, Artificial Sequence
  chemically synthesized
gacaattaacagtatagttt

SEQ ID NO: 567527 - DNA, 20 bp, Artificial Sequence
  chemically synthesized
ttcctagagacaattaacag

SEQ ID NO: 567528 - DNA, 20 bp, Artificial Sequence
  chemically synthesized
tgtctctaggaagtaaaatt

SEQ ID NO: 567529 - DNA, 20 bp, Artificial Sequence
  chemically synthesized
ttttcaatactatcctctta

SEQ ID NO: 567530 - DNA, 20 bp, Artificial Sequence
  chemically synthesized
caatactatcctcttacaat

SEQ ID NO: 567531 - DNA, 20 bp, Artificial Sequence
  chemically synthesized
aaagtcatgtgcactttttt

SEQ ID NO: 567532 - DNA, 20 bp, Artificial Sequence
  chemically synthesized
gaaatcttgaaaagaagata

SEQ ID NO: 567533 - DNA, 20 bp, Artificial Sequence
  chemically synthesized
taaatctatctatcttcttt

SEQ ID NO: 567534 - DNA, 20 bp, Artificial Sequence
  chemically synthesized
tcttttcaagatttctctat

SEQ ID NO: 567535 - DNA, 20 bp, Artificial Sequence
  chemically synthesized
tctgggatttcttccaaatt

SEQ ID NO: 567536 - DNA, 20 bp, Artificial Sequence
  chemically synthesized
ttaagttttcttctctaccc

SEQ ID NO: 567537 - DNA, 20 bp, Artificial Sequence
  chemically synthesized
aaagacataaatagagccca

SEQ ID NO: 567538 - DNA, 20 bp, Artificial Sequence
  chemically synthesized
aataatggttatcatttatt

SEQ ID NO: 567539 - DNA, 20 bp, Artificial Sequence
  chemically synthesized
tcatttattaggtgcttacc

SEQ ID NO: 567540 - DNA, 20 bp, Artificial Sequence
  chemically synthesized
ttctcaggttatcatttatt

SEQ ID NO: 567541 - DNA, 20 bp, Artificial Sequence
  chemically synthesized
tcatttattaggtgcttacc

SEQ ID NO: 567542 - DNA, 20 bp, Artificial Sequence
  chemically synthesized
ttggtttccttatttataaa

SEQ ID NO: 567543 - DNA, 20 bp, Artificial Sequence
  chemically synthesized
tgaattttacttcttaggcc

SEQ ID NO: 567544 - DNA, 20 bp, Artificial Sequence
  chemically synthesized
gaggaagggctttagggtca

SEQ ID NO: 567545 - DNA, 20 bp, Artificial Sequence
  chemically synthesized
agaccatagtgatgaagagg

SEQ ID NO: 567546 - DNA, 20 bp, Artificial Sequence
  chemically synthesized
ttcatcactatggtctccca

SEQ ID NO: 567547 - DNA, 20 bp, Artificial Sequence
  chemically synthesized
ggaaagttaaggttactaga

SEQ ID NO: 567548 - DNA, 20 bp, Artificial Sequence
  chemically synthesized
gtctagtaaccttaactttc

SEQ ID NO: 567549 - DNA, 20 bp, Artificial Sequence
  chemically synthesized
aaaaatgaacaaaaaaaaaa

SEQ ID NO: 567550 - DNA, 20 bp, Artificial Sequence
  chemically synthesized
ttttgagatacactatctct

SEQ ID NO: 567551 - DNA, 20 bp, Artificial Sequence
  chemically synthesized
tccaagatacatctcctctt

SEQ ID NO: 567552 - DNA, 20 bp, Artificial Sequence
  chemically synthesized
ttgaaaaggggaaccgaaga

SEQ ID NO: 567553 - DNA, 20 bp, Artificial Sequence
  chemically synthesized
ttcttcggttccccttttca

SEQ ID NO: 567554 - DNA, 20 bp, Artificial Sequence
  chemically synthesized
tatagctgaggggctaaatc

SEQ ID NO: 567555 - DNA, 20 bp, Artificial Sequence
  chemically synthesized
tgtacttttaactcctaaac

SEQ ID NO: 567556 - DNA, 20 bp, Artificial Sequence
  chemically synthesized
agttaaaagtacacgtaaat

SEQ ID NO: 567557 - DNA, 20 bp, Artificial Sequence
  chemically synthesized
aattttctcacattgcaaag

SEQ ID NO: 567558 - DNA, 20 bp, Artificial Sequence
  chemically synthesized
ggagatacaaatatctttta

SEQ ID NO: 567559 - DNA, 20 bp, Artificial Sequence
  chemically synthesized
tatcttttacagggtttttg

SEQ ID NO: 567560 - DNA, 20 bp, Artificial Sequence
  chemically synthesized
tgaaaggattaatgagaaat

SEQ ID NO: 567561 - DNA, 20 bp, Artificial Sequence
  chemically synthesized
tttgattgaattacatactt

SEQ ID NO: 567562 - DNA, 20 bp, Artificial Sequence
  chemically synthesized
gcaacagggaatagatatga

SEQ ID NO: 567563 - DNA, 20 bp, Artificial Sequence
  chemically synthesized
atctattccctgttgctccg

SEQ ID NO: 567564 - DNA, 20 bp, Artificial Sequence
  chemically synthesized
ttctttaaaacctgtccaat

SEQ ID NO: 567565 - DNA, 20 bp, Artificial Sequence
  chemically synthesized
agaaggtaatcacagattgg

SEQ ID NO: 567566 - DNA, 20 bp, Artificial Sequence
  chemically synthesized
tagaattgccagaaggtaat

SEQ ID NO: 567567 - DNA, 20 bp, Artificial Sequence
  chemically synthesized
ggaaaagggaacgtgactcc

SEQ ID NO: 567568 - DNA, 20 bp, Artificial Sequence
  chemically synthesized
agaggggagagattatttcg

SEQ ID NO: 567569 - DNA, 20 bp, Artificial Sequence
  chemically synthesized
gttagagaggggagagatta

SEQ ID NO: 567570 - DNA, 20 bp, Artificial Sequence
  chemically synthesized
ttaaggacagttagagaggg

SEQ ID NO: 567571 - DNA, 20 bp, Artificial Sequence
  chemically synthesized
ttggaataggaatttggtgg

SEQ ID NO: 567572 - DNA, 20 bp, Artificial Sequence
  chemically synthesized
gaaataatgaagtccgtctt

SEQ ID NO: 567573 - DNA, 20 bp, Artificial Sequence
  chemically synthesized
acttcattatttctcttttc

SEQ ID NO: 567574 - DNA, 20 bp, Artificial Sequence
  chemically synthesized
tctcttttctgaagatttaa

SEQ ID NO: 567575 - DNA, 20 bp, Artificial Sequence
  chemically synthesized
gagtgagaaatttacattgc

SEQ ID NO: 567576 - DNA, 20 bp, Artificial Sequence
  chemically synthesized
gttcaccccaggggcactga

SEQ ID NO: 567577 - DNA, 20 bp, Artificial Sequence
  chemically synthesized
tccagatttttaaaagggaa

SEQ ID NO: 567578 - DNA, 20 bp, Artificial Sequence
  chemically synthesized
gagccaccgcgcctggccac

SEQ ID NO: 567579 - DNA, 20 bp, Artificial Sequence
  chemically synthesized
catctcggcttcctaaagtg

SEQ ID NO: 567580 - DNA, 20 bp, Artificial Sequence
  chemically synthesized
ttaggaagccgagatgggca

SEQ ID NO: 567581 - DNA, 20 bp, Artificial Sequence
  chemically synthesized
agctcaagccatctgcccat

SEQ ID NO: 567582 - DNA, 20 bp, Artificial Sequence
  chemically synthesized
ttttgtatttttggtagaga

SEQ ID NO: 567583 - DNA, 20 bp, Artificial Sequence
  chemically synthesized
tgccacaacctcctgggctc

SEQ ID NO: 567584 - DNA, 20 bp, Artificial Sequence
  chemically synthesized
tttttttttttttttttttt

SEQ ID NO: 567585 - DNA, 20 bp, Artificial Sequence
  chemically synthesized
aaaaaaaaaaaaaaatctgg

SEQ ID NO: 567586 - DNA, 20 bp, Artificial Sequence
  chemically synthesized
attgttctctgagaatctac

SEQ ID NO: 567587 - DNA, 20 bp, Artificial Sequence
  chemically synthesized
aacaaaggtatgaaagactg

SEQ ID NO: 567588 - DNA, 20 bp, Artificial Sequence
  chemically synthesized
cataaacaaaggtatgaaag

SEQ ID NO: 567589 - DNA, 20 bp, Artificial Sequence
  chemically synthesized
aacaagccagtctttcatac

SEQ ID NO: 567590 - DNA, 20 bp, Artificial Sequence
  chemically synthesized
tacaaaatttcttcctagaa

SEQ ID NO: 567591 - DNA, 20 bp, Artificial Sequence
  chemically synthesized
taattagaataattagggag

SEQ ID NO: 567592 - DNA, 20 bp, Artificial Sequence
  chemically synthesized
tcctacctatataaggtacc

SEQ ID NO: 567593 - DNA, 20 bp, Artificial Sequence
  chemically synthesized
gaccgtgtacaccaacttaa

SEQ ID NO: 567594 - DNA, 20 bp, Artificial Sequence
  chemically synthesized
acggtcttgtaacatttatt

SEQ ID NO: 567595 - DNA, 20 bp, Artificial Sequence
  chemically synthesized
cagcttcacaaaagatgtta

SEQ ID NO: 567596 - DNA, 20 bp, Artificial Sequence
  chemically synthesized
acatcttttgtgaagctgac

SEQ ID NO: 567597 - DNA, 20 bp, Artificial Sequence
  chemically synthesized
atcctttgaaaaaagcctat

SEQ ID NO: 567598 - DNA, 20 bp, Artificial Sequence
  chemically synthesized
agctgacataggcttttttc

SEQ ID NO: 567599 - DNA, 20 bp, Artificial Sequence
  chemically synthesized
tgtcttaggttggaatgact

SEQ ID NO: 567600 - DNA, 20 bp, Artificial Sequence
  chemically synthesized
ttaatgccaacgtataccca

SEQ ID NO: 567601 - DNA, 20 bp, Artificial Sequence
  chemically synthesized
tcttctcttattgctagtgg

SEQ ID NO: 567602 - DNA, 20 bp, Artificial Sequence
  chemically synthesized
cgctgcatgaccagagtcac

SEQ ID NO: 567603 - DNA, 20 bp, Artificial Sequence
  chemically synthesized
gtgcattctattacccagag

SEQ ID NO: 567604 - DNA, 20 bp, Artificial Sequence
  chemically synthesized
atttacagttttctgtgagg

SEQ ID NO: 567605 - DNA, 20 bp, Artificial Sequence
  chemically synthesized
agatatggtcagtttacatt

SEQ ID NO: 567606 - DNA, 20 bp, Artificial Sequence
  chemically synthesized
tcatgtataccatagatatg

SEQ ID NO: 567607 - DNA, 20 bp, Artificial Sequence
  chemically synthesized
agttattaacagaaaaggaa

SEQ ID NO: 567608 - DNA, 20 bp, Artificial Sequence
  chemically synthesized
attcagttattaacagaaaa

SEQ ID NO: 567609 - DNA, 20 bp, Artificial Sequence
  chemically synthesized
attttattctctataccaac

SEQ ID NO: 567610 - DNA, 20 bp, Artificial Sequence
  chemically synthesized
actaaggatggataaaggga

SEQ ID NO: 567611 - DNA, 20 bp, Artificial Sequence
  chemically synthesized
tcctggttacataaatactg

SEQ ID NO: 567612 - DNA, 20 bp, Artificial Sequence
  chemically synthesized
aaaagtgtgtattatatcag

SEQ ID NO: 567613 - DNA, 20 bp, Artificial Sequence
  chemically synthesized
atcagaaaagtttggaagag

SEQ ID NO: 567614 - DNA, 20 bp, Artificial Sequence
  chemically synthesized
gaagagttgtgtttggttaa

SEQ ID NO: 567615 - DNA, 20 bp, Artificial Sequence
  chemically synthesized
gttgtgtttggttaacttcg

SEQ ID NO: 567616 - DNA, 20 bp, Artificial Sequence
  chemically synthesized
ttttcttttaaatatctgct

SEQ ID NO: 567617 - DNA, 20 bp, Artificial Sequence
  chemically synthesized
tttttatttctagtgaccac

SEQ ID NO: 567618 - DNA, 20 bp, Artificial Sequence
  chemically synthesized
tacacaaatattaacaatga

SEQ ID NO: 567619 - DNA, 20 bp, Artificial Sequence
  chemically synthesized
tccatgctgggaaggacatg

SEQ ID NO: 567620 - DNA, 20 bp, Artificial Sequence
  chemically synthesized
aaatggctacagccttttga

SEQ ID NO: 567621 - DNA, 20 bp, Artificial Sequence
  chemically synthesized
gtttcaggcagtgcattcca

SEQ ID NO: 567622 - DNA, 20 bp, Artificial Sequence
  chemically synthesized
gtcaaatggtgttaatgttt

SEQ ID NO: 567623 - DNA, 20 bp, Artificial Sequence
  chemically synthesized
atcactgagtcaaatggtgt

SEQ ID NO: 567624 - DNA, 20 bp, Artificial Sequence
  chemically synthesized
aacattaacaccatttgact

SEQ ID NO: 567625 - DNA, 20 bp, Artificial Sequence
  chemically synthesized
tatgcataacacctttctac

SEQ ID NO: 567626 - DNA, 20 bp, Artificial Sequence
  chemically synthesized
gagctgataattatttccat

SEQ ID NO: 567627 - DNA, 20 bp, Artificial Sequence
  chemically synthesized
tcttgcttctaactgtcagt

SEQ ID NO: 567628 - DNA, 20 bp, Artificial Sequence
  chemically synthesized
tcccatgttcttttcaaggt

SEQ ID NO: 567629 - DNA, 20 bp, Artificial Sequence
  chemically synthesized
aacatgggaactgtacacac

SEQ ID NO: 567630 - DNA, 20 bp, Artificial Sequence
  chemically synthesized
tccaggtagaatggctagca

SEQ ID NO: 567631 - DNA, 20 bp, Artificial Sequence
  chemically synthesized
caactttatgatgggtttct

SEQ ID NO: 567632 - DNA, 20 bp, Artificial Sequence
  chemically synthesized
tacagaaacccatcataaag

SEQ ID NO: 567633 - DNA, 20 bp, Artificial Sequence
  chemically synthesized
tacagaaactcaactttatg

SEQ ID NO: 567634 - DNA, 20 bp, Artificial Sequence
  chemically synthesized
aaagttgagtttctgtataa

SEQ ID NO: 567635 - DNA, 20 bp, Artificial Sequence
  chemically synthesized
aaagttgttcctgtaattcg

SEQ ID NO: 567636 - DNA, 20 bp, Artificial Sequence
  chemically synthesized
agatatttgtggtagaaaac

SEQ ID NO: 567637 - DNA, 20 bp, Artificial Sequence
  chemically synthesized
tatagctatgaatttaaatc

SEQ ID NO: 567638 - DNA, 20 bp, Artificial Sequence
  chemically synthesized
caactttctgataactgact

SEQ ID NO: 567639 - DNA, 20 bp, Artificial Sequence
  chemically synthesized
tgtaacatcacttatacata

SEQ ID NO: 567640 - DNA, 20 bp, Artificial Sequence
  chemically synthesized
gaaggtattataacacttta

SEQ ID NO: 567641 - DNA, 20 bp, Artificial Sequence
  chemically synthesized
ctttacttggctttcttctc

SEQ ID NO: 567642 - DNA, 20 bp, Artificial Sequence
  chemically synthesized
aatctggaggcttattacta

SEQ ID NO: 567643 - DNA, 20 bp, Artificial Sequence
  chemically synthesized
aagcttgttagtaataagcc

SEQ ID NO: 567644 - DNA, 20 bp, Artificial Sequence
  chemically synthesized
gtaataagcctccagattct

SEQ ID NO: 567645 - DNA, 20 bp, Artificial Sequence
  chemically synthesized
aaggaaatctttaagaatct

SEQ ID NO: 567646 - DNA, 20 bp, Artificial Sequence
  chemically synthesized
agatgttatttttcgctagt

SEQ ID NO: 567647 - DNA, 20 bp, Artificial Sequence
  chemically synthesized
aactaagaataagagaagac

SEQ ID NO: 567648 - DNA, 20 bp, Artificial Sequence
  chemically synthesized
tatagttgtttgagataata

SEQ ID NO: 567649 - DNA, 20 bp, Artificial Sequence
  chemically synthesized
tttcctatgcatttttatat

SEQ ID NO: 567650 - DNA, 20 bp, Artificial Sequence
  chemically synthesized
ccactatttacattttaaaa

SEQ ID NO: 567651 - DNA, 20 bp, Artificial Sequence
  chemically synthesized
atagccactatttacatttt

SEQ ID NO: 567652 - DNA, 20 bp, Artificial Sequence
  chemically synthesized
tttctgggtactgagatgtg

SEQ ID NO: 567653 - DNA, 20 bp, Artificial Sequence
  chemically synthesized
gagatgtgaggtgattttca

SEQ ID NO: 567654 - DNA, 20 bp, Artificial Sequence
  chemically synthesized
aaaatttctagaatgaacat

SEQ ID NO: 567655 - DNA, 20 bp, Artificial Sequence
  chemically synthesized
aaaacgtttactgagggtat

SEQ ID NO: 567656 - DNA, 20 bp, Artificial Sequence
  chemically synthesized
aaaacttctataccctcagt

SEQ ID NO: 567657 - DNA, 20 bp, Artificial Sequence
  chemically synthesized
gctaaaaatatcaaggagaa

SEQ ID NO: 567658 - DNA, 20 bp, Artificial Sequence
  chemically synthesized
atatttttagcctgttgccc

SEQ ID NO: 567659 - DNA, 20 bp, Artificial Sequence
  chemically synthesized
aaaatacatggcacgctctt

SEQ ID NO: 567660 - DNA, 20 bp, Artificial Sequence
  chemically synthesized
gcctcgttcgttcattggtt

SEQ ID NO: 567661 - DNA, 20 bp, Artificial Sequence
  chemically synthesized
gctgatggcctcgttcgttc

SEQ ID NO: 567662 - DNA, 20 bp, Artificial Sequence
  chemically synthesized
tcagcacatcaaattgtgtt

SEQ ID NO: 567663 - DNA, 20 bp, Artificial Sequence
  chemically synthesized
agacccgtaaaaagtgtcac

SEQ ID NO: 567664 - DNA, 20 bp, Artificial Sequence
  chemically synthesized
aattccagaatagcagttca

SEQ ID NO: 567665 - DNA, 20 bp, Artificial Sequence
  chemically synthesized
atagggaatatcagttaagt

SEQ ID NO: 567666 - DNA, 20 bp, Artificial Sequence
  chemically synthesized
attccctattttaattactt

SEQ ID NO: 567667 - DNA, 20 bp, Artificial Sequence
  chemically synthesized
tctctccagagttccatctt

SEQ ID NO: 567668 - DNA, 20 bp, Artificial Sequence
  chemically synthesized
tacagatgagggttttctaa

SEQ ID NO: 567669 - DNA, 20 bp, Artificial Sequence
  chemically synthesized
gaagatggaaagatacagat

SEQ ID NO: 567670 - DNA, 20 bp, Artificial Sequence
  chemically synthesized
tttccatcttcttgagtggt

SEQ ID NO: 567671 - DNA, 20 bp, Artificial Sequence
  chemically synthesized
aagcacagtagagcaaggga

SEQ ID NO: 567672 - DNA, 20 bp, Artificial Sequence
  chemically synthesized
aatcactctcccttgctcta

SEQ ID NO: 567673 - DNA, 20 bp, Artificial Sequence
  chemically synthesized
acaaagatgaggaagacagt

SEQ ID NO: 567674 - DNA, 20 bp, Artificial Sequence
  chemically synthesized
attgcactttgtgaaaattg

SEQ ID NO: 567675 - DNA, 20 bp, Artificial Sequence
  chemically synthesized
aattgcattgtttacaaact

SEQ ID NO: 567676 - DNA, 20 bp, Artificial Sequence
  chemically synthesized
acacaggattgccacaaacc

SEQ ID NO: 567677 - DNA, 20 bp, Artificial Sequence
  chemically synthesized
tgtccatagacatgctcaac

SEQ ID NO: 567678 - DNA, 20 bp, Artificial Sequence
  chemically synthesized
gtgctcactttgggtctgtg

SEQ ID NO: 567679 - DNA, 20 bp, Artificial Sequence
  chemically synthesized
gtaacatcaacgattactga

SEQ ID NO: 567680 - DNA, 20 bp, Artificial Sequence
  chemically synthesized
aacaatttcagtagtaacat

SEQ ID NO: 567681 - DNA, 20 bp, Artificial Sequence
  chemically synthesized
atcgttgatgttactactga

SEQ ID NO: 567682 - DNA, 20 bp, Artificial Sequence
  chemically synthesized
acacgtatgacgttgatcaa

SEQ ID NO: 567683 - DNA, 20 bp, Artificial Sequence
  chemically synthesized
cattgtagggttattaatta

SEQ ID NO: 567684 - DNA, 20 bp, Artificial Sequence
  chemically synthesized
cactttacatcagaagctat

SEQ ID NO: 567685 - DNA, 20 bp, Artificial Sequence
  chemically synthesized
acatcagaagctattaatga

SEQ ID NO: 567686 - DNA, 20 bp, Artificial Sequence
  chemically synthesized
cctcactaagctcaatcatt

SEQ ID NO: 567687 - DNA, 20 bp, Artificial Sequence
  chemically synthesized
tcagtctgtctcatctttca

SEQ ID NO: 567688 - DNA, 20 bp, Artificial Sequence
  chemically synthesized
tgactgtttggcatgagagg

SEQ ID NO: 567689 - DNA, 20 bp, Artificial Sequence
  chemically synthesized
ttcctttgcattcacaactt

SEQ ID NO: 567690 - DNA, 20 bp, Artificial Sequence
  chemically synthesized
tttctccatatcaggaataa

SEQ ID NO: 567691 - DNA, 20 bp, Artificial Sequence
  chemically synthesized
agccttattcctgatatgga

SEQ ID NO: 567692 - DNA, 20 bp, Artificial Sequence
  chemically synthesized
tggcttaaagaaatgttgtg

SEQ ID NO: 567693 - DNA, 20 bp, Artificial Sequence
  chemically synthesized
ggttttgctctggattaggc

SEQ ID NO: 567694 - DNA, 20 bp, Artificial Sequence
  chemically synthesized
agttaaggttttgctctgga

SEQ ID NO: 567695 - DNA, 20 bp, Artificial Sequence
  chemically synthesized
gaagggagttaaggttttgc

SEQ ID NO: 567696 - DNA, 20 bp, Artificial Sequence
  chemically synthesized
ttcatagaattgaagggagt

SEQ ID NO: 567697 - DNA, 20 bp, Artificial Sequence
  chemically synthesized
ctagcttccaacttttcttc

SEQ ID NO: 567698 - DNA, 20 bp, Artificial Sequence
  chemically synthesized
aaaagttggaagctagtaga

SEQ ID NO: 567699 - DNA, 20 bp, Artificial Sequence
  chemically synthesized
agcttcttgaagcaacctct

SEQ ID NO: 567700 - DNA, 20 bp, Artificial Sequence
  chemically synthesized
agctagtagaggttgcttca

SEQ ID NO: 567701 - DNA, 20 bp, Artificial Sequence
  chemically synthesized
tatggatatggcttgtttcc

SEQ ID NO: 567702 - DNA, 20 bp, Artificial Sequence
  chemically synthesized
accttaatgttatggatatg

SEQ ID NO: 567703 - DNA, 20 bp, Artificial Sequence
  chemically synthesized
ttgcaccttaatgttatgga

SEQ ID NO: 567704 - DNA, 20 bp, Artificial Sequence
  chemically synthesized
gcagcttctgcatcaatgct

SEQ ID NO: 567705 - DNA, 20 bp, Artificial Sequence
  chemically synthesized
cttggctgcagcttctgcat

SEQ ID NO: 567706 - DNA, 20 bp, Artificial Sequence
  chemically synthesized
cattgatgcagaagctgcag

SEQ ID NO: 567707 - DNA, 20 bp, Artificial Sequence
  chemically synthesized
cttcatctggaaaacttggc

SEQ ID NO: 567708 - DNA, 20 bp, Artificial Sequence
  chemically synthesized
tagccaccttcatccatgac

SEQ ID NO: 567709 - DNA, 20 bp, Artificial Sequence
  chemically synthesized
tgaaggtggctacaacgaac

SEQ ID NO: 567710 - DNA, 20 bp, Artificial Sequence
  chemically synthesized
agtatcacctttaaatagaa

SEQ ID NO: 567711 - DNA, 20 bp, Artificial Sequence
  chemically synthesized
attgaagctttgaaggcagt

SEQ ID NO: 567712 - DNA, 20 bp, Artificial Sequence
  chemically synthesized
gagaaatcaatgactgcctt

SEQ ID NO: 567713 - DNA, 20 bp, Artificial Sequence
  chemically synthesized
aagagatacagcctgtccat

SEQ ID NO: 567714 - DNA, 20 bp, Artificial Sequence
  chemically synthesized
tttcagaatggtagatgagc

SEQ ID NO: 567715 - DNA, 20 bp, Artificial Sequence
  chemically synthesized
tcacataattcttaagggcc

SEQ ID NO: 567716 - DNA, 20 bp, Artificial Sequence
  chemically synthesized
ggcatgagccactgtgcccg

SEQ ID NO: 567717 - DNA, 20 bp, Artificial Sequence
  chemically synthesized
cgcctcagcctcccaaagtg

SEQ ID NO: 567718 - DNA, 20 bp, Artificial Sequence
  chemically synthesized
ttttgtatttttagtggaga

SEQ ID NO: 567719 - DNA, 20 bp, Artificial Sequence
  chemically synthesized
tgcctcagcctcctgagtag

SEQ ID NO: 567720 - DNA, 20 bp, Artificial Sequence
  chemically synthesized
tcaggaggctgaggcaggag

SEQ ID NO: 567721 - DNA, 20 bp, Artificial Sequence
  chemically synthesized
catttatacagcacaggcaa

SEQ ID NO: 567722 - DNA, 20 bp, Artificial Sequence
  chemically synthesized
gtgctgtataaatggaaaaa

SEQ ID NO: 567723 - DNA, 20 bp, Artificial Sequence
  chemically synthesized
cagatacgctgtcatccaag

SEQ ID NO: 567724 - DNA, 20 bp, Artificial Sequence
  chemically synthesized
gtaaacagatacgctgtcat

SEQ ID NO: 567725 - DNA, 20 bp, Artificial Sequence
  chemically synthesized
caaagcttggatgacagcgt

SEQ ID NO: 567726 - DNA, 20 bp, Artificial Sequence
  chemically synthesized
gacagcgtatctgtttacgg

SEQ ID NO: 567727 - DNA, 20 bp, Artificial Sequence
  chemically synthesized
tttgaacactaggtcttaca

SEQ ID NO: 567728 - DNA, 20 bp, Artificial Sequence
  chemically synthesized
tgtaagacctagtgttcaaa

SEQ ID NO: 567729 - DNA, 20 bp, Artificial Sequence
  chemically synthesized
gacaatgcaccttgtcaccc

SEQ ID NO: 567730 - DNA, 20 bp, Artificial Sequence
  chemically synthesized
atctctttgtacatctccat

SEQ ID NO: 567731 - DNA, 20 bp, Artificial Sequence
  chemically synthesized
agcttggatggagatgtaca

SEQ ID NO: 567732 - DNA, 20 bp, Artificial Sequence
  chemically synthesized
atggagatgtacaaagagat

SEQ ID NO: 567733 - DNA, 20 bp, Artificial Sequence
  chemically synthesized
aaagagattcacgttttcat

SEQ ID NO: 567734 - DNA, 20 bp, Artificial Sequence
  chemically synthesized
acaacatccattctgtagcc

SEQ ID NO: 567735 - DNA, 20 bp, Artificial Sequence
  chemically synthesized
tgagaaatattttgtaaggc

SEQ ID NO: 567736 - DNA, 20 bp, Artificial Sequence
  chemically synthesized
aggctatagcttgacataga

SEQ ID NO: 567737 - DNA, 20 bp, Artificial Sequence
  chemically synthesized
gagccaccacacctgacttc

SEQ ID NO: 567738 - DNA, 20 bp, Artificial Sequence
  chemically synthesized
tgcctcggcctcccaaagtg

SEQ ID NO: 567739 - DNA, 20 bp, Artificial Sequence
  chemically synthesized
ggcaggtggatcatgaggtc

SEQ ID NO: 567740 - DNA, 20 bp, Artificial Sequence
  chemically synthesized
ttttgtatttttagtagaga

SEQ ID NO: 567741 - DNA, 20 bp, Artificial Sequence
  chemically synthesized
ggttcaagtgattcttctgc

SEQ ID NO: 567742 - DNA, 20 bp, Artificial Sequence
  chemically synthesized
acctctgccttcctgggttc

SEQ ID NO: 567743 - DNA, 20 bp, Artificial Sequence
  chemically synthesized
aaaaaaaaaaaaatctctgg

SEQ ID NO: 567744 - DNA, 20 bp, Artificial Sequence
  chemically synthesized
atggcatcaagaatcacttc

SEQ ID NO: 567745 - DNA, 20 bp, Artificial Sequence
  chemically synthesized
cttgatgccattaagaacat

SEQ ID NO: 567746 - DNA, 20 bp, Artificial Sequence
  chemically synthesized
gtcaaaatatcaacattacc

SEQ ID NO: 567747 - DNA, 20 bp, Artificial Sequence
  chemically synthesized
attaccaggagtttggaaga

SEQ ID NO: 567748 - DNA, 20 bp, Artificial Sequence
  chemically synthesized
acttgtgatttcaattttct

SEQ ID NO: 567749 - DNA, 20 bp, Artificial Sequence
  chemically synthesized
gccatatcttcacgccccac

SEQ ID NO: 567750 - DNA, 20 bp, Artificial Sequence
  chemically synthesized
agtagcaactccctatccat

SEQ ID NO: 567751 - DNA, 20 bp, Artificial Sequence
  chemically synthesized
acttatggatgagcaaagta

SEQ ID NO: 567752 - DNA, 20 bp, Artificial Sequence
  chemically synthesized
cagttgactcttccttttgt

SEQ ID NO: 567753 - DNA, 20 bp, Artificial Sequence
  chemically synthesized
ggctgaaggctcaggtgatc

SEQ ID NO: 567754 - DNA, 20 bp, Artificial Sequence
  chemically synthesized
attttaaattaaggtatgta

SEQ ID NO: 567755 - DNA, 20 bp, Artificial Sequence
  chemically synthesized
ggttttctagtacatataag

SEQ ID NO: 567756 - DNA, 20 bp, Artificial Sequence
  chemically synthesized
aaagtaagtcacacaagtgt

SEQ ID NO: 567757 - DNA, 20 bp, Artificial Sequence
  chemically synthesized
cacaataaagtaagtcacac

SEQ ID NO: 567758 - DNA, 20 bp, Artificial Sequence
  chemically synthesized
gtgacttactttattgtgat

SEQ ID NO: 567759 - DNA, 20 bp, Artificial Sequence
  chemically synthesized
gactaaatacagacatacct

SEQ ID NO: 567760 - DNA, 20 bp, Artificial Sequence
  chemically synthesized
aaagtacttgcgacgtttac

SEQ ID NO: 567761 - DNA, 20 bp, Artificial Sequence
  chemically synthesized
gcatttgatgaaagtacttg

SEQ ID NO: 567762 - DNA, 20 bp, Artificial Sequence
  chemically synthesized
agtactttcatcaaatgcat

SEQ ID NO: 567763 - DNA, 20 bp, Artificial Sequence
  chemically synthesized
aatgcatggaagcttatcct

SEQ ID NO: 567764 - DNA, 20 bp, Artificial Sequence
  chemically synthesized
gagaagtccaaacactaagg

SEQ ID NO: 567765 - DNA, 20 bp, Artificial Sequence
  chemically synthesized
tttggacttctctgcagata

SEQ ID NO: 567766 - DNA, 20 bp, Artificial Sequence
  chemically synthesized
gctacctcctctcctttaag

SEQ ID NO: 567767 - DNA, 20 bp, Artificial Sequence
  chemically synthesized
atgtcacctcaaactcctat

SEQ ID NO: 567768 - DNA, 20 bp, Artificial Sequence
  chemically synthesized
aaaaactaaaaagctttcat

SEQ ID NO: 567769 - DNA, 20 bp, Artificial Sequence
  chemically synthesized
tcaaactcctatgaaagctt

SEQ ID NO: 567770 - DNA, 20 bp, Artificial Sequence
  chemically synthesized
caagaaacataaaaaaacta

SEQ ID NO: 567771 - DNA, 20 bp, Artificial Sequence
  chemically synthesized
atgaaagctttttagttttt

SEQ ID NO: 567772 - DNA, 20 bp, Artificial Sequence
  chemically synthesized
ggatctcctgtacttcaatc

SEQ ID NO: 567773 - DNA, 20 bp, Artificial Sequence
  chemically synthesized
tgtacttcaatcatttgctt

SEQ ID NO: 567774 - DNA, 20 bp, Artificial Sequence
  chemically synthesized
agtatcaaaaaccaacaagc

SEQ ID NO: 567775 - DNA, 20 bp, Artificial Sequence
  chemically synthesized
tctctgccttttctctgctc

SEQ ID NO: 567776 - DNA, 20 bp, Artificial Sequence
  chemically synthesized
attttcctgctcccttacca

SEQ ID NO: 567777 - DNA, 20 bp, Artificial Sequence
  chemically synthesized
ccttaccaattggcttccaa

SEQ ID NO: 567778 - DNA, 20 bp, Artificial Sequence
  chemically synthesized
ttctcctttccgcctgccct

SEQ ID NO: 567779 - DNA, 20 bp, Artificial Sequence
  chemically synthesized
agaatgaaaaaggaagtacg

SEQ ID NO: 567780 - DNA, 20 bp, Artificial Sequence
  chemically synthesized
gagaagccacacacacagca

SEQ ID NO: 567781 - DNA, 20 bp, Artificial Sequence
  chemically synthesized
cagaaacttcatgctgtgtg

SEQ ID NO: 567782 - DNA, 20 bp, Artificial Sequence
  chemically synthesized
aatttcccgcattaaattcc

SEQ ID NO: 567783 - DNA, 20 bp, Artificial Sequence
  chemically synthesized
ccctttgtttgaaataacta

SEQ ID NO: 567784 - DNA, 20 bp, Artificial Sequence
  chemically synthesized
gtttgaaataactagagggt

SEQ ID NO: 567785 - DNA, 20 bp, Artificial Sequence
  chemically synthesized
atgttttctgaccaggcaga

SEQ ID NO: 567786 - DNA, 20 bp, Artificial Sequence
  chemically synthesized
aaggttttttatactaaggt

SEQ ID NO: 567787 - DNA, 20 bp, Artificial Sequence
  chemically synthesized
atgttgaaggttttttatac

SEQ ID NO: 567788 - DNA, 20 bp, Artificial Sequence
  chemically synthesized
aaagccttatatggtatgtt

SEQ ID NO: 567789 - DNA, 20 bp, Artificial Sequence
  chemically synthesized
aaaaccttcaacataccata

SEQ ID NO: 567790 - DNA, 20 bp, Artificial Sequence
  chemically synthesized
acataccatataaggctttt

SEQ ID NO: 567791 - DNA, 20 bp, Artificial Sequence
  chemically synthesized
ggttcaagcaattctcctgc

SEQ ID NO: 567792 - DNA, 20 bp, Artificial Sequence
  chemically synthesized
tcgggaagctgaggcaggag

SEQ ID NO: 567793 - DNA, 20 bp, Artificial Sequence
  chemically synthesized
tacaggcagacgccaccact

SEQ ID NO: 567794 - DNA, 20 bp, Artificial Sequence
  chemically synthesized
aatttttattttagtagaga

SEQ ID NO: 567795 - DNA, 20 bp, Artificial Sequence
  chemically synthesized
aaataatacattttgtactg

SEQ ID NO: 567796 - DNA, 20 bp, Artificial Sequence
  chemically synthesized
catgtcaaattaaagtacgt

SEQ ID NO: 567797 - DNA, 20 bp, Artificial Sequence
  chemically synthesized
attcagatagtgagagacac

SEQ ID NO: 567798 - DNA, 20 bp, Artificial Sequence
  chemically synthesized
gtatctcaattcaggaaccc

SEQ ID NO: 567799 - DNA, 20 bp, Artificial Sequence
  chemically synthesized
atgagacttatcttgtgttg

SEQ ID NO: 567800 - DNA, 20 bp, Artificial Sequence
  chemically synthesized
tatttaatacatcacataac

SEQ ID NO: 567801 - DNA, 20 bp, Artificial Sequence
  chemically synthesized
aactgaggtttaaaattatt

SEQ ID NO: 567802 - DNA, 20 bp, Artificial Sequence
  chemically synthesized
actttgaggctggatttaaa

SEQ ID NO: 567803 - DNA, 20 bp, Artificial Sequence
  chemically synthesized
aattgttcattgactttgag

SEQ ID NO: 567804 - DNA, 20 bp, Artificial Sequence
  chemically synthesized
tatgagtttaggtttggagg

SEQ ID NO: 567805 - DNA, 20 bp, Artificial Sequence
  chemically synthesized
cctattgtcactttatgagt

SEQ ID NO: 567806 - DNA, 20 bp, Artificial Sequence
  chemically synthesized
gactttcctattgtcacttt

SEQ ID NO: 567807 - DNA, 20 bp, Artificial Sequence
  chemically synthesized
gtgcattcagtgggggaact

SEQ ID NO: 567808 - DNA, 20 bp, Artificial Sequence
  chemically synthesized
cccataaagagtgcatatat

SEQ ID NO: 567809 - DNA, 20 bp, Artificial Sequence
  chemically synthesized
gtgataagtttaaaatacag

SEQ ID NO: 567810 - DNA, 20 bp, Artificial Sequence
  chemically synthesized
taatgtgataagtttaaaat

SEQ ID NO: 567811 - DNA, 20 bp, Artificial Sequence
  chemically synthesized
aatataatgtatataatgtg

SEQ ID NO: 567812 - DNA, 20 bp, Artificial Sequence
  chemically synthesized
aagcggcagagccactgctg

SEQ ID NO: 567813 - DNA, 20 bp, Artificial Sequence
  chemically synthesized
aaactaggcagcagtggctc

SEQ ID NO: 567814 - DNA, 20 bp, Artificial Sequence
  chemically synthesized
attgtgttacaggaaggaac

SEQ ID NO: 567815 - DNA, 20 bp, Artificial Sequence
  chemically synthesized
tctggttccttcctgtaaca

SEQ ID NO: 567816 - DNA, 20 bp, Artificial Sequence
  chemically synthesized
ttcctgtaacacaatgattt

SEQ ID NO: 567817 - DNA, 20 bp, Artificial Sequence
  chemically synthesized
acttggtagctctccttagc

SEQ ID NO: 567818 - DNA, 20 bp, Artificial Sequence
  chemically synthesized
aaaatgttatttatgcggtt

SEQ ID NO: 567819 - DNA, 20 bp, Artificial Sequence
  chemically synthesized
acacctgaaaatgttattta

SEQ ID NO: 567820 - DNA, 20 bp, Artificial Sequence
  chemically synthesized
taaataacattttcaggtgt

SEQ ID NO: 567821 - DNA, 20 bp, Artificial Sequence
  chemically synthesized
atcctcccccgacctgagtc

SEQ ID NO: 567822 - DNA, 20 bp, Artificial Sequence
  chemically synthesized
cccgacctgagtcacttgat

SEQ ID NO: 567823 - DNA, 20 bp, Artificial Sequence
  chemically synthesized
acttaacacactgtccatat

SEQ ID NO: 567824 - DNA, 20 bp, Artificial Sequence
  chemically synthesized
tgtggtgtgaatgcatactt

SEQ ID NO: 567825 - DNA, 20 bp, Artificial Sequence
  chemically synthesized
gtttttaacatactacacat

SEQ ID NO: 567826 - DNA, 20 bp, Artificial Sequence
  chemically synthesized
ccactgcacccagccgcggt

SEQ ID NO: 567827 - DNA, 20 bp, Artificial Sequence
  chemically synthesized
tggttcacgcctgtaatccc

SEQ ID NO: 567828 - DNA, 20 bp, Artificial Sequence
  chemically synthesized
agcctccgcctcccaaactg

SEQ ID NO: 567829 - DNA, 20 bp, Artificial Sequence
  chemically synthesized
ttttgcatttttagtagaga

SEQ ID NO: 567830 - DNA, 20 bp, Artificial Sequence
  chemically synthesized
tgcctcagcctcccgagtag

SEQ ID NO: 567831 - DNA, 20 bp, Artificial Sequence
  chemically synthesized
tcgggaggctgaggcaggaa

SEQ ID NO: 567832 - DNA, 20 bp, Artificial Sequence
  chemically synthesized
aaactctgcctcccgggttc

SEQ ID NO: 567833 - DNA, 20 bp, Artificial Sequence
  chemically synthesized
aatcgcttgaacccgggagg

SEQ ID NO: 567834 - DNA, 20 bp, Artificial Sequence
  chemically synthesized
tgccaggctggagtgcagtg

SEQ ID NO: 567835 - DNA, 20 bp, Artificial Sequence
  chemically synthesized
tgttggtggtgggttttttt

SEQ ID NO: 567836 - DNA, 20 bp, Artificial Sequence
  chemically synthesized
gggccaggtttttgttggtg

SEQ ID NO: 567837 - DNA, 20 bp, Artificial Sequence
  chemically synthesized
caacaaaaacctggcccttc

SEQ ID NO: 567838 - DNA, 20 bp, Artificial Sequence
  chemically synthesized
cttctcaaactggtgaaggg

SEQ ID NO: 567839 - DNA, 20 bp, Artificial Sequence
  chemically synthesized
aagaagctatcactgaagag

SEQ ID NO: 567840 - DNA, 20 bp, Artificial Sequence
  chemically synthesized
gagaagcactgctcttcagt

SEQ ID NO: 567841 - DNA, 20 bp, Artificial Sequence
  chemically synthesized
gtggcacgcacctgtagtcc

SEQ ID NO: 567842 - DNA, 20 bp, Artificial Sequence
  chemically synthesized
attaattttggtaagaaagt

SEQ ID NO: 567843 - DNA, 20 bp, Artificial Sequence
  chemically synthesized
aagcattaattttggtaaga

SEQ ID NO: 567844 - DNA, 20 bp, Artificial Sequence
  chemically synthesized
aatcactttcttaccaaaat

SEQ ID NO: 567845 - DNA, 20 bp, Artificial Sequence
  chemically synthesized
cttatattgatatatttaca

SEQ ID NO: 567846 - DNA, 20 bp, Artificial Sequence
  chemically synthesized
gcttatataacggagacaaa

SEQ ID NO: 567847 - DNA, 20 bp, Artificial Sequence
  chemically synthesized
gcaacatttgtctccgttat

SEQ ID NO: 567848 - DNA, 20 bp, Artificial Sequence
  chemically synthesized
cattacaccccctcataaat

SEQ ID NO: 567849 - DNA, 20 bp, Artificial Sequence
  chemically synthesized
cctggagttatgcaagcgat

SEQ ID NO: 567850 - DNA, 20 bp, Artificial Sequence
  chemically synthesized
ttgctattccacaaagcgtt

SEQ ID NO: 567851 - DNA, 20 bp, Artificial Sequence
  chemically synthesized
gaattggtgatattctgtgg

SEQ ID NO: 567852 - DNA, 20 bp, Artificial Sequence
  chemically synthesized
tcaccaattcataaataagc

SEQ ID NO: 567853 - DNA, 20 bp, Artificial Sequence
  chemically synthesized
tatgacatagtggatgaatc

SEQ ID NO: 567854 - DNA, 20 bp, Artificial Sequence
  chemically synthesized
cagagcactcacataaaata

SEQ ID NO: 567855 - DNA, 20 bp, Artificial Sequence
  chemically synthesized
ggagctgcaattttgctgga

SEQ ID NO: 567856 - DNA, 20 bp, Artificial Sequence
  chemically synthesized
atacagaggtaatcagactt

SEQ ID NO: 567857 - DNA, 20 bp, Artificial Sequence
  chemically synthesized
tttcttttttaagcccacaa

SEQ ID NO: 567858 - DNA, 20 bp, Artificial Sequence
  chemically synthesized
aaatgtctgaataagagcag

SEQ ID NO: 567859 - DNA, 20 bp, Artificial Sequence
  chemically synthesized
tatgtagctggatctgcaga

SEQ ID NO: 567860 - DNA, 20 bp, Artificial Sequence
  chemically synthesized
ttttaaaagagctgccaaat

SEQ ID NO: 567861 - DNA, 20 bp, Artificial Sequence
  chemically synthesized
tccttagactttgactggtt

SEQ ID NO: 567862 - DNA, 20 bp, Artificial Sequence
  chemically synthesized
gaattgttccttagactttg

SEQ ID NO: 567863 - DNA, 20 bp, Artificial Sequence
  chemically synthesized
agtctaaggaacaattcttt

SEQ ID NO: 567864 - DNA, 20 bp, Artificial Sequence
  chemically synthesized
tttttgagtttccttctgaa

SEQ ID NO: 567865 - DNA, 20 bp, Artificial Sequence
  chemically synthesized
tatttctgaattgcatctct

SEQ ID NO: 567866 - DNA, 20 bp, Artificial Sequence
  chemically synthesized
atctattatgttcttcaatt

SEQ ID NO: 567867 - DNA, 20 bp, Artificial Sequence
  chemically synthesized
cttgttcaaataacttgatt

SEQ ID NO: 567868 - DNA, 20 bp, Artificial Sequence
  chemically synthesized
tattttttcttgttcaaata

SEQ ID NO: 567869 - DNA, 20 bp, Artificial Sequence
  chemically synthesized
gtccattaaaatgccataaa

SEQ ID NO: 567870 - DNA, 20 bp, Artificial Sequence
  chemically synthesized
atcctaatcaaagttaaaag

SEQ ID NO: 567871 - DNA, 20 bp, Artificial Sequence
  chemically synthesized
aaaataatctgctcttttaa

SEQ ID NO: 567872 - DNA, 20 bp, Artificial Sequence
  chemically synthesized
taaatgttcttcctttacta

SEQ ID NO: 567873 - DNA, 20 bp, Artificial Sequence
  chemically synthesized
ctagctgacaaaattagcac

SEQ ID NO: 567874 - DNA, 20 bp, Artificial Sequence
  chemically synthesized
ctagggaataaagaatgtca

SEQ ID NO: 567875 - DNA, 20 bp, Artificial Sequence
  chemically synthesized
ataaagaatgtcatatggat

SEQ ID NO: 567876 - DNA, 20 bp, Artificial Sequence
  chemically synthesized
cagtttaattatgccgataa

SEQ ID NO: 567877 - DNA, 20 bp, Artificial Sequence
  chemically synthesized
actcttagcatgatttataa

SEQ ID NO: 567878 - DNA, 20 bp, Artificial Sequence
  chemically synthesized
aggaacatccattactctta

SEQ ID NO: 567879 - DNA, 20 bp, Artificial Sequence
  chemically synthesized
tcctttgagaacagagaact

SEQ ID NO: 567880 - DNA, 20 bp, Artificial Sequence
  chemically synthesized
agactgagactcaagacttg

SEQ ID NO: 567881 - DNA, 20 bp, Artificial Sequence
  chemically synthesized
tgagcagactgagactcaag

SEQ ID NO: 567882 - DNA, 20 bp, Artificial Sequence
  chemically synthesized
cctttgagtgtccttccagt

SEQ ID NO: 567883 - DNA, 20 bp, Artificial Sequence
  chemically synthesized
gtcatccctttgagtgtcct

SEQ ID NO: 567884 - DNA, 20 bp, Artificial Sequence
  chemically synthesized
gattttctatcaatttcagt

SEQ ID NO: 567885 - DNA, 20 bp, Artificial Sequence
  chemically synthesized
gacctggattttctatcaat

SEQ ID NO: 567886 - DNA, 20 bp, Artificial Sequence
  chemically synthesized
atagagtaggtggcatatga

SEQ ID NO: 567887 - DNA, 20 bp, Artificial Sequence
  chemically synthesized
ccacctactctatagctgtg

SEQ ID NO: 567888 - DNA, 20 bp, Artificial Sequence
  chemically synthesized
tgtagcactttacaatggcg

SEQ ID NO: 567889 - DNA, 20 bp, Artificial Sequence
  chemically synthesized
ataaagtacaattattacaa

SEQ ID NO: 567890 - DNA, 20 bp, Artificial Sequence
  chemically synthesized
cgcctcggcctcccagagtg

SEQ ID NO: 567891 - DNA, 20 bp, Artificial Sequence
  chemically synthesized
ttttgtatttttagtagaga

SEQ ID NO: 567892 - DNA, 20 bp, Artificial Sequence
  chemically synthesized
ggaggctgctgaggcaggag

SEQ ID NO: 567893 - DNA, 20 bp, Artificial Sequence
  chemically synthesized
aacctccaccgcccgcgttc

SEQ ID NO: 567894 - DNA, 20 bp, Artificial Sequence
  chemically synthesized
aaaaaaaattaaattaataa

SEQ ID NO: 567895 - DNA, 20 bp, Artificial Sequence
  chemically synthesized
ggtggtgacaaagaggaact

SEQ ID NO: 567896 - DNA, 20 bp, Artificial Sequence
  chemically synthesized
ggctgacaacattcatacaa

SEQ ID NO: 567897 - DNA, 20 bp, Artificial Sequence
  chemically synthesized
gttttaacccctggctagag

SEQ ID NO: 567898 - DNA, 20 bp, Artificial Sequence
  chemically synthesized
tttcatcattaaatgactgg

SEQ ID NO: 567899 - DNA, 20 bp, Artificial Sequence
  chemically synthesized
tgatctttcatcattaaatg

SEQ ID NO: 567900 - DNA, 20 bp, Artificial Sequence
  chemically synthesized
ggtgtgacctcgggcaagtc

SEQ ID NO: 567901 - DNA, 20 bp, Artificial Sequence
  chemically synthesized
aaggatagctagattcagat

SEQ ID NO: 567902 - DNA, 20 bp, Artificial Sequence
  chemically synthesized
gctttgaactggaaaggata

SEQ ID NO: 567903 - DNA, 20 bp, Artificial Sequence
  chemically synthesized
cttttgactttttactgcca

SEQ ID NO: 567904 - DNA, 20 bp, Artificial Sequence
  chemically synthesized
gcagtaaaaagtcaaaaggc

SEQ ID NO: 567905 - DNA, 20 bp, Artificial Sequence
  chemically synthesized
aatatttagctttccttggc

SEQ ID NO: 567906 - DNA, 20 bp, Artificial Sequence
  chemically synthesized
ccaaggaaagctaaatattg

SEQ ID NO: 567907 - DNA, 20 bp, Artificial Sequence
  chemically synthesized
ctccactaagctactcaata

SEQ ID NO: 567908 - DNA, 20 bp, Artificial Sequence
  chemically synthesized
tattgagtagcttagtggag

SEQ ID NO: 567909 - DNA, 20 bp, Artificial Sequence
  chemically synthesized
tttgcattaggagcttgtcc

SEQ ID NO: 567910 - DNA, 20 bp, Artificial Sequence
  chemically synthesized
gaattccttccttttgcatt

SEQ ID NO: 567911 - DNA, 20 bp, Artificial Sequence
  chemically synthesized
ttcatagtcattcagaatcc

SEQ ID NO: 567912 - DNA, 20 bp, Artificial Sequence
  chemically synthesized
atgctcttgggttagaaact

SEQ ID NO: 567913 - DNA, 20 bp, Artificial Sequence
  chemically synthesized
ttgttcactctcctcttttg

SEQ ID NO: 567914 - DNA, 20 bp, Artificial Sequence
  chemically synthesized
aaaatccttgtacctctttc

SEQ ID NO: 567915 - DNA, 20 bp, Artificial Sequence
  chemically synthesized
gcaagctgaggaaagaggta

SEQ ID NO: 567916 - DNA, 20 bp, Artificial Sequence
  chemically synthesized
aggtacaaggattttgatag

SEQ ID NO: 567917 - DNA, 20 bp, Artificial Sequence
  chemically synthesized
tttttaactctcttgcaaat

SEQ ID NO: 567918 - DNA, 20 bp, Artificial Sequence
  chemically synthesized
atgatattgatgtatcttta

SEQ ID NO: 567919 - DNA, 20 bp, Artificial Sequence
  chemically synthesized
ctagttaagtcaatggggct

SEQ ID NO: 567920 - DNA, 20 bp, Artificial Sequence
  chemically synthesized
tgctgggcctgaggttaggg

SEQ ID NO: 567921 - DNA, 20 bp, Artificial Sequence
  chemically synthesized
gagcttcagaatgttaaaat

SEQ ID NO: 567922 - DNA, 20 bp, Artificial Sequence
  chemically synthesized
cttcatgtctatggtttgca

SEQ ID NO: 567923 - DNA, 20 bp, Artificial Sequence
  chemically synthesized
gtagcccttagcttcatgtc

SEQ ID NO: 567924 - DNA, 20 bp, Artificial Sequence
  chemically synthesized
cagtctatcagcacgtagcc

SEQ ID NO: 567925 - DNA, 20 bp, Artificial Sequence
  chemically synthesized
gatagactgccttcaaatct

SEQ ID NO: 567926 - DNA, 20 bp, Artificial Sequence
  chemically synthesized
aaaagtggtctttaaaaacc

SEQ ID NO: 567927 - DNA, 20 bp, Artificial Sequence
  chemically synthesized
attttcaaaaatggacttct

SEQ ID NO: 567928 - DNA, 20 bp, Artificial Sequence
  chemically synthesized
gaagtccatttttgaaaatt

SEQ ID NO: 567929 - DNA, 20 bp, Artificial Sequence
  chemically synthesized
gtaggatccaaaaattgggc

SEQ ID NO: 567930 - DNA, 20 bp, Artificial Sequence
  chemically synthesized
caagtgttttctcaaggggt

SEQ ID NO: 567931 - DNA, 20 bp, Artificial Sequence
  chemically synthesized
attgaagccctcttaaccac

SEQ ID NO: 567932 - DNA, 20 bp, Artificial Sequence
  chemically synthesized
gagaaaacacttgtggttaa

SEQ ID NO: 567933 - DNA, 20 bp, Artificial Sequence
  chemically synthesized
acaccagaacatacggtgca

SEQ ID NO: 567934 - DNA, 20 bp, Artificial Sequence
  chemically synthesized
ggtgcatctagattttaata

SEQ ID NO: 567935 - DNA, 20 bp, Artificial Sequence
  chemically synthesized
agaaagctgattttatttca

SEQ ID NO: 567936 - DNA, 20 bp, Artificial Sequence
  chemically synthesized
aataaactgcttgaaataaa

SEQ ID NO: 567937 - DNA, 20 bp, Artificial Sequence
  chemically synthesized
agaatcgctgcacttcagaa

SEQ ID NO: 567938 - DNA, 20 bp, Artificial Sequence
  chemically synthesized
aaaatcagctttctgaagtg

SEQ ID NO: 567939 - DNA, 20 bp, Artificial Sequence
  chemically synthesized
tgtcagtatagtacaagaag

SEQ ID NO: 567940 - DNA, 20 bp, Artificial Sequence
  chemically synthesized
gttcctttttaaattacaat

SEQ ID NO: 567941 - DNA, 20 bp, Artificial Sequence
  chemically synthesized
caataagacaggctaagaaa

SEQ ID NO: 567942 - DNA, 20 bp, Artificial Sequence
  chemically synthesized
gcctgggcaacagaacgaga

SEQ ID NO: 567943 - DNA, 20 bp, Artificial Sequence
  chemically synthesized
tcaggaggctgaggtgggag

SEQ ID NO: 567944 - DNA, 20 bp, Artificial Sequence
  chemically synthesized
tttttgtagagatggggaga

SEQ ID NO: 567945 - DNA, 20 bp, Artificial Sequence
  chemically synthesized
cgcctcggcctccaaaagtg

SEQ ID NO: 567946 - DNA, 20 bp, Artificial Sequence
  chemically synthesized
atctgtccatatgtaaatac

SEQ ID NO: 567947 - DNA, 20 bp, Artificial Sequence
  chemically synthesized
cttgattacttaaatttgta

SEQ ID NO: 567948 - DNA, 20 bp, Artificial Sequence
  chemically synthesized
gtgggaggccaaggtgggag

SEQ ID NO: 567949 - DNA, 20 bp, Artificial Sequence
  chemically synthesized
tgggaggatcgcttgagccc

SEQ ID NO: 567950 - DNA, 20 bp, Artificial Sequence
  chemically synthesized
atctctacaaaaaatttaaa

SEQ ID NO: 567951 - DNA, 20 bp, Artificial Sequence
  chemically synthesized
gtggcctgatcatggctcac

SEQ ID NO: 567952 - DNA, 20 bp, Artificial Sequence
  chemically synthesized
ctgcttagagatacttttat

SEQ ID NO: 567953 - DNA, 20 bp, Artificial Sequence
  chemically synthesized
gcccccacacacataatata

SEQ ID NO: 567954 - DNA, 20 bp, Artificial Sequence
  chemically synthesized
attatgtgtgtgggggcagg

SEQ ID NO: 567955 - DNA, 20 bp, Artificial Sequence
  chemically synthesized
acataaattgtgagaaaagg

SEQ ID NO: 567956 - DNA, 20 bp, Artificial Sequence
  chemically synthesized
attttgaaatactaatataa

SEQ ID NO: 567957 - DNA, 20 bp, Artificial Sequence
  chemically synthesized
ctaacatctactgatgttgt

SEQ ID NO: 567958 - DNA, 20 bp, Artificial Sequence
  chemically synthesized
ttctggagccttgaagagct

SEQ ID NO: 567959 - DNA, 20 bp, Artificial Sequence
  chemically synthesized
actgttccaataggttagct

SEQ ID NO: 567960 - DNA, 20 bp, Artificial Sequence
  chemically synthesized
tggaaagactgttccaatag

SEQ ID NO: 567961 - DNA, 20 bp, Artificial Sequence
  chemically synthesized
gtttgattcatgaggtgagt

SEQ ID NO: 567962 - DNA, 20 bp, Artificial Sequence
  chemically synthesized
taatatgtttgattcatgag

SEQ ID NO: 567963 - DNA, 20 bp, Artificial Sequence
  chemically synthesized
ctccctagaagtaataatat

SEQ ID NO: 567964 - DNA, 20 bp, Artificial Sequence
  chemically synthesized
gtcactccctagaagtaata

SEQ ID NO: 567965 - DNA, 20 bp, Artificial Sequence
  chemically synthesized
caagagcctctctatttgac

SEQ ID NO: 567966 - DNA, 20 bp, Artificial Sequence
  chemically synthesized
tgggtggcataatcttctcc

SEQ ID NO: 567967 - DNA, 20 bp, Artificial Sequence
  chemically synthesized
tggcataatcttctcctgtt

SEQ ID NO: 567968 - DNA, 20 bp, Artificial Sequence
  chemically synthesized
ctgagaaaacaaacaacagg

SEQ ID NO: 567969 - DNA, 20 bp, Artificial Sequence
  chemically synthesized
atgtacattttaaaacatag

SEQ ID NO: 567970 - DNA, 20 bp, Artificial Sequence
  chemically synthesized
ttctaaaaatgtaatcattc

SEQ ID NO: 567971 - DNA, 20 bp, Artificial Sequence
  chemically synthesized
ttcggctaactctgcagaca

SEQ ID NO: 567972 - DNA, 20 bp, Artificial Sequence
  chemically synthesized
cttgaaaaataatgatcaca

SEQ ID NO: 567973 - DNA, 20 bp, Artificial Sequence
  chemically synthesized
tttgggctgagggtggggca

SEQ ID NO: 567974 - DNA, 20 bp, Artificial Sequence
  chemically synthesized
attggacaagtgtctaagat

SEQ ID NO: 567975 - DNA, 20 bp, Artificial Sequence
  chemically synthesized
taacgatattggacaagtgt

SEQ ID NO: 567976 - DNA, 20 bp, Artificial Sequence
  chemically synthesized
ttttttttttttttttgaga

SEQ ID NO: 567977 - DNA, 20 bp, Artificial Sequence
  chemically synthesized
aacctccgactcctgggttc

SEQ ID NO: 567978 - DNA, 20 bp, Artificial Sequence
  chemically synthesized
agcctcggcctcttgagtag

SEQ ID NO: 567979 - DNA, 20 bp, Artificial Sequence
  chemically synthesized
gccaccacacctggctaatt

SEQ ID NO: 567980 - DNA, 20 bp, Artificial Sequence
  chemically synthesized
ttttgtttttttagtaaaga

SEQ ID NO: 567981 - DNA, 20 bp, Artificial Sequence
  chemically synthesized
cacctcgacctcccaaagtg

SEQ ID NO: 567982 - DNA, 20 bp, Artificial Sequence
  chemically synthesized
tgtctattttttgtagacct

SEQ ID NO: 567983 - DNA, 20 bp, Artificial Sequence
  chemically synthesized
acagacaaatgctgaaagaa

SEQ ID NO: 567984 - DNA, 20 bp, Artificial Sequence
  chemically synthesized
ctgaaagaaaactgatttcc

SEQ ID NO: 567985 - DNA, 20 bp, Artificial Sequence
  chemically synthesized
atcactaaaagcaactggaa

SEQ ID NO: 567986 - DNA, 20 bp, Artificial Sequence
  chemically synthesized
aactgatttccagttgcttt

SEQ ID NO: 567987 - DNA, 20 bp, Artificial Sequence
  chemically synthesized
ttccctgtgaaaatccaaga

SEQ ID NO: 567988 - DNA, 20 bp, Artificial Sequence
  chemically synthesized
tggtttgacaaaagcattgt

SEQ ID NO: 567989 - DNA, 20 bp, Artificial Sequence
  chemically synthesized
aaaattttttacatcacatt

SEQ ID NO: 567990 - DNA, 20 bp, Artificial Sequence
  chemically synthesized
taaattatttctttactatg

SEQ ID NO: 567991 - DNA, 20 bp, Artificial Sequence
  chemically synthesized
tatttctttactatgtcttg

SEQ ID NO: 567992 - DNA, 20 bp, Artificial Sequence
  chemically synthesized
tccatcaagtgttagaaata

SEQ ID NO: 567993 - DNA, 20 bp, Artificial Sequence
  chemically synthesized
atctaaaatggctttgcaga

SEQ ID NO: 567994 - DNA, 20 bp, Artificial Sequence
  chemically synthesized
attatttccaacagatctaa

SEQ ID NO: 567995 - DNA, 20 bp, Artificial Sequence
  chemically synthesized
aacaatataagataattaat

SEQ ID NO: 567996 - DNA, 20 bp, Artificial Sequence
  chemically synthesized
atctaaaattaattatctta

SEQ ID NO: 567997 - DNA, 20 bp, Artificial Sequence
  chemically synthesized
tggtagagaaaatagaactt

SEQ ID NO: 567998 - DNA, 20 bp, Artificial Sequence
  chemically synthesized
aaatacatgagatgatctct

SEQ ID NO: 567999 - DNA, 20 bp, Artificial Sequence
  chemically synthesized
agataatttatacttaagga

SEQ ID NO: 568000 - DNA, 20 bp, Artificial Sequence
  chemically synthesized
gtgtgtgtgtgtgtggctac

SEQ ID NO: 568001 - DNA, 20 bp, Artificial Sequence
  chemically synthesized
tacagttagatgtttggtaa

SEQ ID NO: 568002 - DNA, 20 bp, Artificial Sequence
  chemically synthesized
aatttatattatttacagtt

SEQ ID NO: 568003 - DNA, 20 bp, Artificial Sequence
  chemically synthesized
tttctttttcattccttttc

SEQ ID NO: 568004 - DNA, 20 bp, Artificial Sequence
  chemically synthesized
gagctctctaatacattctg

SEQ ID NO: 568005 - DNA, 20 bp, Artificial Sequence
  chemically synthesized
ggtaatatctcaagcaatat

SEQ ID NO: 568006 - DNA, 20 bp, Artificial Sequence
  chemically synthesized
ttactgatgaaaagctataa

SEQ ID NO: 568007 - DNA, 20 bp, Artificial Sequence
  chemically synthesized
ctactttttcagttctaaca

SEQ ID NO: 568008 - DNA, 20 bp, Artificial Sequence
  chemically synthesized
gcacccagggtttgaacaca

SEQ ID NO: 568009 - DNA, 20 bp, Artificial Sequence
  chemically synthesized
ttcaggtgttcccctgcacc

SEQ ID NO: 568010 - DNA, 20 bp, Artificial Sequence
  chemically synthesized
ctgggtgcaggggaacacct

SEQ ID NO: 568011 - DNA, 20 bp, Artificial Sequence
  chemically synthesized
tcccaagcagcctgttcaac

SEQ ID NO: 568012 - DNA, 20 bp, Artificial Sequence
  chemically synthesized
acataaacatgtgttgaaca

SEQ ID NO: 568013 - DNA, 20 bp, Artificial Sequence
  chemically synthesized
cctagagacgcccacttcta

SEQ ID NO: 568014 - DNA, 20 bp, Artificial Sequence
  chemically synthesized
ccatgcatactgtgaaccac

SEQ ID NO: 568015 - DNA, 20 bp, Artificial Sequence
  chemically synthesized
aggtgctgaaaatatcaaga

SEQ ID NO: 568016 - DNA, 20 bp, Artificial Sequence
  chemically synthesized
accagagacatgaggttcag

SEQ ID NO: 568017 - DNA, 20 bp, Artificial Sequence
  chemically synthesized
gtgttgtggtctggcgtgtc

SEQ ID NO: 568018 - DNA, 20 bp, Artificial Sequence
  chemically synthesized
acgccagaccacaacaccat

SEQ ID NO: 568019 - DNA, 20 bp, Artificial Sequence
  chemically synthesized
ttcaccaactgactgtagtt

SEQ ID NO: 568020 - DNA, 20 bp, Artificial Sequence
  chemically synthesized
attgattttagtttttactt

SEQ ID NO: 568021 - DNA, 20 bp, Artificial Sequence
  chemically synthesized
agtaaaaactaaaatcaatg

SEQ ID NO: 568022 - DNA, 20 bp, Artificial Sequence
  chemically synthesized
aaaagaaacttttcattgat

SEQ ID NO: 568023 - DNA, 20 bp, Artificial Sequence
  chemically synthesized
aatactgaaaagaaactttt

SEQ ID NO: 568024 - DNA, 20 bp, Artificial Sequence
  chemically synthesized
aaaagtttcttttcagtatt

SEQ ID NO: 568025 - DNA, 20 bp, Artificial Sequence
  chemically synthesized
ttcttttcagtattttatgc

SEQ ID NO: 568026 - DNA, 20 bp, Artificial Sequence
  chemically synthesized
tttccccctctccaaaatta

SEQ ID NO: 568027 - DNA, 20 bp, Artificial Sequence
  chemically synthesized
ctacatccttgagatcccat

SEQ ID NO: 568028 - DNA, 20 bp, Artificial Sequence
  chemically synthesized
gatgtaggcaggctgggcgc

SEQ ID NO: 568029 - DNA, 20 bp, Artificial Sequence
  chemically synthesized
ggcaggctgggcgctgtggc

SEQ ID NO: 568030 - DNA, 20 bp, Artificial Sequence
  chemically synthesized
caccttggcctcccaaattg

SEQ ID NO: 568031 - DNA, 20 bp, Artificial Sequence
  chemically synthesized
ttttgtatttttactaggga

SEQ ID NO: 568032 - DNA, 20 bp, Artificial Sequence
  chemically synthesized
tgcttcagcctcccgagtag

SEQ ID NO: 568033 - DNA, 20 bp, Artificial Sequence
  chemically synthesized
tccccaggatgaagtgattc

SEQ ID NO: 568034 - DNA, 20 bp, Artificial Sequence
  chemically synthesized
acctccgcctccccaggatg

SEQ ID NO: 568035 - DNA, 20 bp, Artificial Sequence
  chemically synthesized
tttgtttgtttgttttttga

SEQ ID NO: 568036 - DNA, 20 bp, Artificial Sequence
  chemically synthesized
ggctacatccttttttgttt

SEQ ID NO: 568037 - DNA, 20 bp, Artificial Sequence
  chemically synthesized
atatggctacatcctttttt

SEQ ID NO: 568038 - DNA, 20 bp, Artificial Sequence
  chemically synthesized
tgttatatggctacatcctt

SEQ ID NO: 568039 - DNA, 20 bp, Artificial Sequence
  chemically synthesized
actgttgcctggcacatata

SEQ ID NO: 568040 - DNA, 20 bp, Artificial Sequence
  chemically synthesized
gcaacagtgaaaggagtgcc

SEQ ID NO: 568041 - DNA, 20 bp, Artificial Sequence
  chemically synthesized
gctacacgtatataggaatt

SEQ ID NO: 568042 - DNA, 20 bp, Artificial Sequence
  chemically synthesized
gttagtactttcactgttct

SEQ ID NO: 568043 - DNA, 20 bp, Artificial Sequence
  chemically synthesized
gggctacacctggatttgtc

SEQ ID NO: 568044 - DNA, 20 bp, Artificial Sequence
  chemically synthesized
cacagctatgtggggctaca

SEQ ID NO: 568045 - DNA, 20 bp, Artificial Sequence
  chemically synthesized
ctgatcaattcctccctgag

SEQ ID NO: 568046 - DNA, 20 bp, Artificial Sequence
  chemically synthesized
ccatttattgcgggcctatt

SEQ ID NO: 568047 - DNA, 20 bp, Artificial Sequence
  chemically synthesized
tcgttgggcttttatccaag

SEQ ID NO: 568048 - DNA, 20 bp, Artificial Sequence
  chemically synthesized
cacttggataaaagcccaac

SEQ ID NO: 568049 - DNA, 20 bp, Artificial Sequence
  chemically synthesized
tggataaaagcccaacgaat

SEQ ID NO: 568050 - DNA, 20 bp, Artificial Sequence
  chemically synthesized
ttgtaacaatcaaacattcg

SEQ ID NO: 568051 - DNA, 20 bp, Artificial Sequence
  chemically synthesized
ctttcagagttaatatttcc

SEQ ID NO: 568052 - DNA, 20 bp, Artificial Sequence
  chemically synthesized
caagtgaactaagtgttgaa

SEQ ID NO: 568053 - DNA, 20 bp, Artificial Sequence
  chemically synthesized
cttgcaagtgaactaagtgt

SEQ ID NO: 568054 - DNA, 20 bp, Artificial Sequence
  chemically synthesized
caacacttagttcacttgca

SEQ ID NO: 568055 - DNA, 20 bp, Artificial Sequence
  chemically synthesized
aattccagccccctttgaaa

SEQ ID NO: 568056 - DNA, 20 bp, Artificial Sequence
  chemically synthesized
atataaaaattatacctgaa

SEQ ID NO: 568057 - DNA, 20 bp, Artificial Sequence
  chemically synthesized
aaagttgatttcataaaaga

SEQ ID NO: 568058 - DNA, 20 bp, Artificial Sequence
  chemically synthesized
taacagaattttacagttgc

SEQ ID NO: 568059 - DNA, 20 bp, Artificial Sequence
  chemically synthesized
atctctcatgacttgtgaca

SEQ ID NO: 568060 - DNA, 20 bp, Artificial Sequence
  chemically synthesized
agcccaatgtcacaagtcat

SEQ ID NO: 568061 - DNA, 20 bp, Artificial Sequence
  chemically synthesized
gtcacaagtcatgagagatt

SEQ ID NO: 568062 - DNA, 20 bp, Artificial Sequence
  chemically synthesized
gtcatgagagattatcagtt

SEQ ID NO: 568063 - DNA, 20 bp, Artificial Sequence
  chemically synthesized
tggagaaaattttagaaata

SEQ ID NO: 568064 - DNA, 20 bp, Artificial Sequence
  chemically synthesized
attatggactatcaatgaat

SEQ ID NO: 568065 - DNA, 20 bp, Artificial Sequence
  chemically synthesized
gtattcattgatagtccata

SEQ ID NO: 568066 - DNA, 20 bp, Artificial Sequence
  chemically synthesized
cataattagcttttcatcaa

SEQ ID NO: 568067 - DNA, 20 bp, Artificial Sequence
  chemically synthesized
tctgtaatgagaaattgcaa

SEQ ID NO: 568068 - DNA, 20 bp, Artificial Sequence
  chemically synthesized
ttgaatcattctgtcttata

SEQ ID NO: 568069 - DNA, 20 bp, Artificial Sequence
  chemically synthesized
aaaaagcaagttataagaca

SEQ ID NO: 568070 - DNA, 20 bp, Artificial Sequence
  chemically synthesized
ccccacttcttagagttagc

SEQ ID NO: 568071 - DNA, 20 bp, Artificial Sequence
  chemically synthesized
actctaagaagtggggttac

SEQ ID NO: 568072 - DNA, 20 bp, Artificial Sequence
  chemically synthesized
ttaatacctattcatatttt

SEQ ID NO: 568073 - DNA, 20 bp, Artificial Sequence
  chemically synthesized
aggtattaattctataataa

SEQ ID NO: 568074 - DNA, 20 bp, Artificial Sequence
  chemically synthesized
tgatcgtaacctgtggttta

SEQ ID NO: 568075 - DNA, 20 bp, Artificial Sequence
  chemically synthesized
tgggcctcctgatcgtaacc

SEQ ID NO: 568076 - DNA, 20 bp, Artificial Sequence
  chemically synthesized
atttaaattagctctttgtg

SEQ ID NO: 568077 - DNA, 20 bp, Artificial Sequence
  chemically synthesized
tagctctttgtggacagatt

SEQ ID NO: 568078 - DNA, 20 bp, Artificial Sequence
  chemically synthesized
tatcccagtactcccaggac

SEQ ID NO: 568079 - DNA, 20 bp, Artificial Sequence
  chemically synthesized
gggagtactgggatagaaag

SEQ ID NO: 568080 - DNA, 20 bp, Artificial Sequence
  chemically synthesized
tttggcaaatgagagaatga

SEQ ID NO: 568081 - DNA, 20 bp, Artificial Sequence
  chemically synthesized
atttgccaaaagataagcat

SEQ ID NO: 568082 - DNA, 20 bp, Artificial Sequence
  chemically synthesized
ataccacaggtggaaaacgt

SEQ ID NO: 568083 - DNA, 20 bp, Artificial Sequence
  chemically synthesized
gtttttggcttataattgtg

SEQ ID NO: 568084 - DNA, 20 bp, Artificial Sequence
  chemically synthesized
tccagcccctacagaatgtt

SEQ ID NO: 568085 - DNA, 20 bp, Artificial Sequence
  chemically synthesized
ctacatttccagcccctaca

SEQ ID NO: 568086 - DNA, 20 bp, Artificial Sequence
  chemically synthesized
ccaattttatttaaaatttt

SEQ ID NO: 568087 - DNA, 20 bp, Artificial Sequence
  chemically synthesized
cagtctggttataagtgtgt

SEQ ID NO: 568088 - DNA, 20 bp, Artificial Sequence
  chemically synthesized
tctctggctagtataagtga

SEQ ID NO: 568089 - DNA, 20 bp, Artificial Sequence
  chemically synthesized
gtgactttgtttttcctttt

SEQ ID NO: 568090 - DNA, 20 bp, Artificial Sequence
  chemically synthesized
atgttttttatttacatttt

SEQ ID NO: 568091 - DNA, 20 bp, Artificial Sequence
  chemically synthesized
ttaaacatttttctaattat

SEQ ID NO: 568092 - DNA, 20 bp, Artificial Sequence
  chemically synthesized
ttaatcatttataattagaa

SEQ ID NO: 568093 - DNA, 20 bp, Artificial Sequence
  chemically synthesized
agaagagatattagccaaaa

SEQ ID NO: 568094 - DNA, 20 bp, Artificial Sequence
  chemically synthesized
agctattactgcttttgtgt

SEQ ID NO: 568095 - DNA, 20 bp, Artificial Sequence
  chemically synthesized
gtcagggggtacgtagctat

SEQ ID NO: 568096 - DNA, 20 bp, Artificial Sequence
  chemically synthesized
tacgtatacctacacagaat

SEQ ID NO: 568097 - DNA, 20 bp, Artificial Sequence
  chemically synthesized
acagaatttatgtttaagta

SEQ ID NO: 568098 - DNA, 20 bp, Artificial Sequence
  chemically synthesized
aaaacacataaggcgatctc

SEQ ID NO: 568099 - DNA, 20 bp, Artificial Sequence
  chemically synthesized
aaatccaaagagatcgcctt

SEQ ID NO: 568100 - DNA, 20 bp, Artificial Sequence
  chemically synthesized
atatgtccattcacagaaat

SEQ ID NO: 568101 - DNA, 20 bp, Artificial Sequence
  chemically synthesized
ttgaaaaagtagaaaagaca

SEQ ID NO: 568102 - DNA, 20 bp, Artificial Sequence
  chemically synthesized
gtctcactatgttgcccagg

SEQ ID NO: 568103 - DNA, 20 bp, Artificial Sequence
  chemically synthesized
ctggagtgcagtggtgcggt

SEQ ID NO: 568104 - DNA, 20 bp, Artificial Sequence
  chemically synthesized
aagttgcagcttgttttggg

SEQ ID NO: 568105 - DNA, 20 bp, Artificial Sequence
  chemically synthesized
atcttaagttgcagcttgtt

SEQ ID NO: 568106 - DNA, 20 bp, Artificial Sequence
  chemically synthesized
atgagttatcttaagttgca

SEQ ID NO: 568107 - DNA, 20 bp, Artificial Sequence
  chemically synthesized
tgaaatgagttatcttaagt

SEQ ID NO: 568108 - DNA, 20 bp, Artificial Sequence
  chemically synthesized
aaatgtccagatgtctggtt

SEQ ID NO: 568109 - DNA, 20 bp, Artificial Sequence
  chemically synthesized
actggacaaatgtccagatg

SEQ ID NO: 568110 - DNA, 20 bp, Artificial Sequence
  chemically synthesized
tttgtccagtgtaaaaagac

SEQ ID NO: 568111 - DNA, 20 bp, Artificial Sequence
  chemically synthesized
tgggtacagagcatacaaat

SEQ ID NO: 568112 - DNA, 20 bp, Artificial Sequence
  chemically synthesized
tttatgtaagagcctgacag

SEQ ID NO: 568113 - DNA, 20 bp, Artificial Sequence
  chemically synthesized
tttctttagtatggcttgtt

SEQ ID NO: 568114 - DNA, 20 bp, Artificial Sequence
  chemically synthesized
taaatgatttctttagtatg

SEQ ID NO: 568115 - DNA, 20 bp, Artificial Sequence
  chemically synthesized
catttaaatgatttctttag

SEQ ID NO: 568116 - DNA, 20 bp, Artificial Sequence
  chemically synthesized
ggtcattaatgtgaacattt

SEQ ID NO: 568117 - DNA, 20 bp, Artificial Sequence
  chemically synthesized
aaattcctttacacaacatt

SEQ ID NO: 568118 - DNA, 20 bp, Artificial Sequence
  chemically synthesized
tggtttggcaaaagggttgt

SEQ ID NO: 568119 - DNA, 20 bp, Artificial Sequence
  chemically synthesized
agaaaactgtttcaggtgct

SEQ ID NO: 568120 - DNA, 20 bp, Artificial Sequence
  chemically synthesized
agaaatcaacaagcacctga

SEQ ID NO: 568121 - DNA, 20 bp, Artificial Sequence
  chemically synthesized
cgaagatagaaaactgtttc

SEQ ID NO: 568122 - DNA, 20 bp, Artificial Sequence
  chemically synthesized
ttcttcccacgaagatagaa

SEQ ID NO: 568123 - DNA, 20 bp, Artificial Sequence
  chemically synthesized
aaaaaatagccataaattgc

SEQ ID NO: 568124 - DNA, 20 bp, Artificial Sequence
  chemically synthesized
aaaaacaagttttagaagtt

SEQ ID NO: 568125 - DNA, 20 bp, Artificial Sequence
  chemically synthesized
ggaatcaatcaacttctaaa

SEQ ID NO: 568126 - DNA, 20 bp, Artificial Sequence
  chemically synthesized
ccttaaaaacaagttttaga

SEQ ID NO: 568127 - DNA, 20 bp, Artificial Sequence
  chemically synthesized
ttatcagaggttccttaaaa

SEQ ID NO: 568128 - DNA, 20 bp, Artificial Sequence
  chemically synthesized
cttcctatccaaaattgaca

SEQ ID NO: 568129 - DNA, 20 bp, Artificial Sequence
  chemically synthesized
aattttggataggaaggtgc

SEQ ID NO: 568130 - DNA, 20 bp, Artificial Sequence
  chemically synthesized
gctatataaatacatcacta

SEQ ID NO: 568131 - DNA, 20 bp, Artificial Sequence
  chemically synthesized
acttgctatataaatacatc

SEQ ID NO: 568132 - DNA, 20 bp, Artificial Sequence
  chemically synthesized
acaggtgacctttaggataa

SEQ ID NO: 568133 - DNA, 20 bp, Artificial Sequence
  chemically synthesized
gtctttaggtaaggacatgg

SEQ ID NO: 568134 - DNA, 20 bp, Artificial Sequence
  chemically synthesized
attttgggatggtcccagca

SEQ ID NO: 568135 - DNA, 20 bp, Artificial Sequence
  chemically synthesized
ctaaagtctttctttatgtt

SEQ ID NO: 568136 - DNA, 20 bp, Artificial Sequence
  chemically synthesized
gtaaatgctaaagtctttct

SEQ ID NO: 568137 - DNA, 20 bp, Artificial Sequence
  chemically synthesized
gttattgttgttttcttttt

SEQ ID NO: 568138 - DNA, 20 bp, Artificial Sequence
  chemically synthesized
aaaaatcatgttgttgttat

SEQ ID NO: 568139 - DNA, 20 bp, Artificial Sequence
  chemically synthesized
agaaaacaacaataacaaca

SEQ ID NO: 568140 - DNA, 20 bp, Artificial Sequence
  chemically synthesized
aacaataacaacaacatgat

SEQ ID NO: 568141 - DNA, 20 bp, Artificial Sequence
  chemically synthesized
cattcggaatctttatttca

SEQ ID NO: 568142 - DNA, 20 bp, Artificial Sequence
  chemically synthesized
actatggaagcgctttgaaa

SEQ ID NO: 568143 - DNA, 20 bp, Artificial Sequence
  chemically synthesized
atttcttcaatacactatgg

SEQ ID NO: 568144 - DNA, 20 bp, Artificial Sequence
  chemically synthesized
gcttccatagtgtattgaag

SEQ ID NO: 568145 - DNA, 20 bp, Artificial Sequence
  chemically synthesized
aacaaagcagaaaggggcct

SEQ ID NO: 568146 - DNA, 20 bp, Artificial Sequence
  chemically synthesized
ttacaagcagaaaggcccct

SEQ ID NO: 568147 - DNA, 20 bp, Artificial Sequence
  chemically synthesized
agcagaaaggcccctttctg

SEQ ID NO: 568148 - DNA, 20 bp, Artificial Sequence
  chemically synthesized
ctggaaccgaataatgttta

SEQ ID NO: 568149 - DNA, 20 bp, Artificial Sequence
  chemically synthesized
aaacaaattctggaaccgaa

SEQ ID NO: 568150 - DNA, 20 bp, Artificial Sequence
  chemically synthesized
aaacattattcggttccaga

SEQ ID NO: 568151 - DNA, 20 bp, Artificial Sequence
  chemically synthesized
atttatcataactgaagtgc

SEQ ID NO: 568152 - DNA, 20 bp, Artificial Sequence
  chemically synthesized
atgggtgaagaagtcctgat

SEQ ID NO: 568153 - DNA, 20 bp, Artificial Sequence
  chemically synthesized
actacagaaaggacaccgac

SEQ ID NO: 568154 - DNA, 20 bp, Artificial Sequence
  chemically synthesized
gtgaaagcaaatgagaagtg

SEQ ID NO: 568155 - DNA, 20 bp, Artificial Sequence
  chemically synthesized
tataaatcatctcacttctc

SEQ ID NO: 568156 - DNA, 20 bp, Artificial Sequence
  chemically synthesized
ccatgatacctgtatttcat

SEQ ID NO: 568157 - DNA, 20 bp, Artificial Sequence
  chemically synthesized
tccttcttcccattatttca

SEQ ID NO: 568158 - DNA, 20 bp, Artificial Sequence
  chemically synthesized
gtgtagtggtgtatagcgta

SEQ ID NO: 568159 - DNA, 20 bp, Artificial Sequence
  chemically synthesized
aagaaatggaagacagctgt

SEQ ID NO: 568160 - DNA, 20 bp, Artificial Sequence
  chemically synthesized
tgtaattgaatgaggaacaa

SEQ ID NO: 568161 - DNA, 20 bp, Artificial Sequence
  chemically synthesized
agtatatgtagttatttctc

SEQ ID NO: 568162 - DNA, 20 bp, Artificial Sequence
  chemically synthesized
aaactggaaatatgacgcta

SEQ ID NO: 568163 - DNA, 20 bp, Artificial Sequence
  chemically synthesized
aatcaccatagcgtcatatt

SEQ ID NO: 568164 - DNA, 20 bp, Artificial Sequence
  chemically synthesized
agcgtcatatttccagtttt

SEQ ID NO: 568165 - DNA, 20 bp, Artificial Sequence
  chemically synthesized
cagttttcagggattgcatg

SEQ ID NO: 568166 - DNA, 20 bp, Artificial Sequence
  chemically synthesized
ccttccctccccttcccctc

SEQ ID NO: 568167 - DNA, 20 bp, Artificial Sequence
  chemically synthesized
ggagggaaggaaaaaagaga

SEQ ID NO: 568168 - DNA, 20 bp, Artificial Sequence
  chemically synthesized
ctctggaaatgccccagttt

SEQ ID NO: 568169 - DNA, 20 bp, Artificial Sequence
  chemically synthesized
ttctggtcctctggaaatgc

SEQ ID NO: 568170 - DNA, 20 bp, Artificial Sequence
  chemically synthesized
caatgtcgaatggccttagc

SEQ ID NO: 568171 - DNA, 20 bp, Artificial Sequence
  chemically synthesized
taaccctccaaggtaggcag

SEQ ID NO: 568172 - DNA, 20 bp, Artificial Sequence
  chemically synthesized
cctttaaccctccaaggtag

SEQ ID NO: 568173 - DNA, 20 bp, Artificial Sequence
  chemically synthesized
cctgcctaccttggagggtt

SEQ ID NO: 568174 - DNA, 20 bp, Artificial Sequence
  chemically synthesized
ccatttggtgctcaatatgt

SEQ ID NO: 568175 - DNA, 20 bp, Artificial Sequence
  chemically synthesized
ttgtaatcaactaataacag

SEQ ID NO: 568176 - DNA, 20 bp, Artificial Sequence
  chemically synthesized
ttaaaagcaaatctgttatt

SEQ ID NO: 568177 - DNA, 20 bp, Artificial Sequence
  chemically synthesized
ctatattgtaatcaactaat

SEQ ID NO: 568178 - DNA, 20 bp, Artificial Sequence
  chemically synthesized
ctaggaagggtctttcttcg

SEQ ID NO: 568179 - DNA, 20 bp, Artificial Sequence
  chemically synthesized
taggtgataacatgtagtgt

SEQ ID NO: 568180 - DNA, 20 bp, Artificial Sequence
  chemically synthesized
aacacactacatgttatcac

SEQ ID NO: 568181 - DNA, 20 bp, Artificial Sequence
  chemically synthesized
taaaaaaaataagttaaaac

SEQ ID NO: 568182 - DNA, 20 bp, Artificial Sequence
  chemically synthesized
aagttaaaacaaccgtttaa

SEQ ID NO: 568183 - DNA, 20 bp, Artificial Sequence
  chemically synthesized
tttcttaaaccaacttaaac

SEQ ID NO: 568184 - DNA, 20 bp, Artificial Sequence
  chemically synthesized
tccatatgtctttatgaggt

SEQ ID NO: 568185 - DNA, 20 bp, Artificial Sequence
  chemically synthesized
atgatttccatatgtcttta

SEQ ID NO: 568186 - DNA, 20 bp, Artificial Sequence
  chemically synthesized
tctttgaagttgtacagttt

SEQ ID NO: 568187 - DNA, 20 bp, Artificial Sequence
  chemically synthesized
agggatggtctttgaagttg

SEQ ID NO: 568188 - DNA, 20 bp, Artificial Sequence
  chemically synthesized
tccctgtaatatttactagt

SEQ ID NO: 568189 - DNA, 20 bp, Artificial Sequence
  chemically synthesized
caagtgaacattttcttgca

SEQ ID NO: 568190 - DNA, 20 bp, Artificial Sequence
  chemically synthesized
gaaaatgttcacttgtgaag

SEQ ID NO: 568191 - DNA, 20 bp, Artificial Sequence
  chemically synthesized
gctgtttcactgtcttccaa

SEQ ID NO: 568192 - DNA, 20 bp, Artificial Sequence
  chemically synthesized
tgtcttccaaatacgtttat

SEQ ID NO: 568193 - DNA, 20 bp, Artificial Sequence
  chemically synthesized
tcacatttgaggactataac

SEQ ID NO: 568194 - DNA, 20 bp, Artificial Sequence
  chemically synthesized
aagagcaggagatatggtct

SEQ ID NO: 568195 - DNA, 20 bp, Artificial Sequence
  chemically synthesized
gatatggtctctatgcttta

SEQ ID NO: 568196 - DNA, 20 bp, Artificial Sequence
  chemically synthesized
ttaggacaccccatgaccaa

SEQ ID NO: 568197 - DNA, 20 bp, Artificial Sequence
  chemically synthesized
accccttctccagatcataa

SEQ ID NO: 568198 - DNA, 20 bp, Artificial Sequence
  chemically synthesized
catgcacagcacaaggaggc

SEQ ID NO: 568199 - DNA, 20 bp, Artificial Sequence
  chemically synthesized
agcacaaggaggctgcagct

SEQ ID NO: 568200 - DNA, 20 bp, Artificial Sequence
  chemically synthesized
ttgcagcttcgtggaaaaag

SEQ ID NO: 568201 - DNA, 20 bp, Artificial Sequence
  chemically synthesized
cttcgctcttcctttctccc

SEQ ID NO: 568202 - DNA, 20 bp, Artificial Sequence
  chemically synthesized
gtacatgtgggcacacatgt

SEQ ID NO: 568203 - DNA, 20 bp, Artificial Sequence
  chemically synthesized
tcaggcttatcagctcagct

SEQ ID NO: 568204 - DNA, 20 bp, Artificial Sequence
  chemically synthesized
ggttccctgtctctgtctga

SEQ ID NO: 568205 - DNA, 20 bp, Artificial Sequence
  chemically synthesized
atttgaagtccattccagat

SEQ ID NO: 568206 - DNA, 20 bp, Artificial Sequence
  chemically synthesized
cttttagaactgtgtttggt

SEQ ID NO: 568207 - DNA, 20 bp, Artificial Sequence
  chemically synthesized
gtttccctttccttttagaa

SEQ ID NO: 568208 - DNA, 20 bp, Artificial Sequence
  chemically synthesized
attctcctgtaaattgtaca

SEQ ID NO: 568209 - DNA, 20 bp, Artificial Sequence
  chemically synthesized
gaagccctcattcattctat

SEQ ID NO: 568210 - DNA, 20 bp, Artificial Sequence
  chemically synthesized
gaatcccacatagaatgaat

SEQ ID NO: 568211 - DNA, 20 bp, Artificial Sequence
  chemically synthesized
ttgaaggttaaaattatgaa

SEQ ID NO: 568212 - DNA, 20 bp, Artificial Sequence
  chemically synthesized
tttcagttttgccgaggact

SEQ ID NO: 568213 - DNA, 20 bp, Artificial Sequence
  chemically synthesized
ttcttccagtaaaggagatt

SEQ ID NO: 568214 - DNA, 20 bp, Artificial Sequence
  chemically synthesized
tttcctccttcttccagtaa

SEQ ID NO: 568215 - DNA, 20 bp, Artificial Sequence
  chemically synthesized
cacaaatgggcaatggaatt

SEQ ID NO: 568216 - DNA, 20 bp, Artificial Sequence
  chemically synthesized
ggtactattctcccagttat

SEQ ID NO: 568217 - DNA, 20 bp, Artificial Sequence
  chemically synthesized
tgagaaaggttagcttctgg

SEQ ID NO: 568218 - DNA, 20 bp, Artificial Sequence
  chemically synthesized
gtgtgttgaaggtgagaaag

SEQ ID NO: 568219 - DNA, 20 bp, Artificial Sequence
  chemically synthesized
ttttgcattgcttagaaata

SEQ ID NO: 568220 - DNA, 20 bp, Artificial Sequence
  chemically synthesized
ctgtttttctagttcttttg

SEQ ID NO: 568221 - DNA, 20 bp, Artificial Sequence
  chemically synthesized
caatgcaaaagaactagaaa

SEQ ID NO: 568222 - DNA, 20 bp, Artificial Sequence
  chemically synthesized
aaaagaactagaaaaacaga

SEQ ID NO: 568223 - DNA, 20 bp, Artificial Sequence
  chemically synthesized
actgcaaaggtgaaatctaa

SEQ ID NO: 568224 - DNA, 20 bp, Artificial Sequence
  chemically synthesized
ttagatttcacctttgcagt

SEQ ID NO: 568225 - DNA, 20 bp, Artificial Sequence
  chemically synthesized
tgctcacttcttttgcttag

SEQ ID NO: 568226 - DNA, 20 bp, Artificial Sequence
  chemically synthesized
tttccacttgtgctcacttc

SEQ ID NO: 568227 - DNA, 20 bp, Artificial Sequence
  chemically synthesized
aatgattaaaagactatttt

SEQ ID NO: 568228 - DNA, 20 bp, Artificial Sequence
  chemically synthesized
tgccaagcatttttagcatt

SEQ ID NO: 568229 - DNA, 20 bp, Artificial Sequence
  chemically synthesized
ttttaatcatttaatgctaa

SEQ ID NO: 568230 - DNA, 20 bp, Artificial Sequence
  chemically synthesized
ggcaacgtagccaaaaaacc

SEQ ID NO: 568231 - DNA, 20 bp, Artificial Sequence
  chemically synthesized
atatagttaccaaagaatct

SEQ ID NO: 568232 - DNA, 20 bp, Artificial Sequence
  chemically synthesized
gacgaaccaaatattcactt

SEQ ID NO: 568233 - DNA, 20 bp, Artificial Sequence
  chemically synthesized
taaatgtgtcccagtggggc

SEQ ID NO: 568234 - DNA, 20 bp, Artificial Sequence
  chemically synthesized
gagttatgcagatttgtgct

SEQ ID NO: 568235 - DNA, 20 bp, Artificial Sequence
  chemically synthesized
tagatatgagttatgcagat

SEQ ID NO: 568236 - DNA, 20 bp, Artificial Sequence
  chemically synthesized
tacaagatagatatgagtta

SEQ ID NO: 568237 - DNA, 20 bp, Artificial Sequence
  chemically synthesized
gtattgatcacagacaaaaa

SEQ ID NO: 568238 - DNA, 20 bp, Artificial Sequence
  chemically synthesized
acatttttgtctgtgatcaa

SEQ ID NO: 568239 - DNA, 20 bp, Artificial Sequence
  chemically synthesized
tctgtgatcaataccgattt

SEQ ID NO: 568240 - DNA, 20 bp, Artificial Sequence
  chemically synthesized
gatcaataccgattttacag

SEQ ID NO: 568241 - DNA, 20 bp, Artificial Sequence
  chemically synthesized
tggagttactgagaattctc

SEQ ID NO: 568242 - DNA, 20 bp, Artificial Sequence
  chemically synthesized
actccctcctccctagcaca

SEQ ID NO: 568243 - DNA, 20 bp, Artificial Sequence
  chemically synthesized
gggagtggaagggtgggtgg

SEQ ID NO: 568244 - DNA, 20 bp, Artificial Sequence
  chemically synthesized
atgtacccattaacatgtga

SEQ ID NO: 568245 - DNA, 20 bp, Artificial Sequence
  chemically synthesized
tcacatgttaatgggtacat

SEQ ID NO: 568246 - DNA, 20 bp, Artificial Sequence
  chemically synthesized
gtacgtacattaacacagag

SEQ ID NO: 568247 - DNA, 20 bp, Artificial Sequence
  chemically synthesized
taaagatgtaaagagcgttt

SEQ ID NO: 568248 - DNA, 20 bp, Artificial Sequence
  chemically synthesized
acattttttaaagatgtaaa

SEQ ID NO: 568249 - DNA, 20 bp, Artificial Sequence
  chemically synthesized
tttacatctttaaaaaatgt

SEQ ID NO: 568250 - DNA, 20 bp, Artificial Sequence
  chemically synthesized
tcagagaggcatatctgatg

SEQ ID NO: 568251 - DNA, 20 bp, Artificial Sequence
  chemically synthesized
ctctctgagcagtatttata

SEQ ID NO: 568252 - DNA, 20 bp, Artificial Sequence
  chemically synthesized
ataaaagggaaaaagattat

SEQ ID NO: 568253 - DNA, 20 bp, Artificial Sequence
  chemically synthesized
accgcctcaaataaaaggga

SEQ ID NO: 568254 - DNA, 20 bp, Artificial Sequence
  chemically synthesized
cagccttgtgctcagtagag

SEQ ID NO: 568255 - DNA, 20 bp, Artificial Sequence
  chemically synthesized
tacaatttaaattttctctc

SEQ ID NO: 568256 - DNA, 20 bp, Artificial Sequence
  chemically synthesized
ttaaattttctctcacctgc

SEQ ID NO: 568257 - DNA, 20 bp, Artificial Sequence
  chemically synthesized
ggaataatcagacttattgg

SEQ ID NO: 568258 - DNA, 20 bp, Artificial Sequence
  chemically synthesized
taaaaaagcaattccaataa

SEQ ID NO: 568259 - DNA, 20 bp, Artificial Sequence
  chemically synthesized
agacttattggaattgcttt

SEQ ID NO: 568260 - DNA, 20 bp, Artificial Sequence
  chemically synthesized
actttttataagtgtttaat

SEQ ID NO: 568261 - DNA, 20 bp, Artificial Sequence
  chemically synthesized
tgttactttttataagtgtt

SEQ ID NO: 568262 - DNA, 20 bp, Artificial Sequence
  chemically synthesized
agatatttgttactttttat

SEQ ID NO: 568263 - DNA, 20 bp, Artificial Sequence
  chemically synthesized
atggcagttgcctaattaaa

SEQ ID NO: 568264 - DNA, 20 bp, Artificial Sequence
  chemically synthesized
agatagttttttaaaaaggc

SEQ ID NO: 568265 - DNA, 20 bp, Artificial Sequence
  chemically synthesized
tccctgggaagtagtggaca

SEQ ID NO: 568266 - DNA, 20 bp, Artificial Sequence
  chemically synthesized
ttttatattgctgcatagcg

SEQ ID NO: 568267 - DNA, 20 bp, Artificial Sequence
  chemically synthesized
tccctttttatattgctgca

SEQ ID NO: 568268 - DNA, 20 bp, Artificial Sequence
  chemically synthesized
tataaaaagggagcgttctc

SEQ ID NO: 568269 - DNA, 20 bp, Artificial Sequence
  chemically synthesized
agcgttctcttgcgatttgc

SEQ ID NO: 568270 - DNA, 20 bp, Artificial Sequence
  chemically synthesized
tcttgcgatttgcagaggat

SEQ ID NO: 568271 - DNA, 20 bp, Artificial Sequence
  chemically synthesized
cgatttgcagaggattagag

SEQ ID NO: 568272 - DNA, 20 bp, Artificial Sequence
  chemically synthesized
gtgtgtgtggatcaatgggc

SEQ ID NO: 568273 - DNA, 20 bp, Artificial Sequence
  chemically synthesized
gcccattgatccacacacac

SEQ ID NO: 568274 - DNA, 20 bp, Artificial Sequence
  chemically synthesized
tctagaaaaagagtctgatc

SEQ ID NO: 568275 - DNA, 20 bp, Artificial Sequence
  chemically synthesized
ttgcgtgctgaattgttgaa

SEQ ID NO: 568276 - DNA, 20 bp, Artificial Sequence
  chemically synthesized
gtggatggtaaaatatattt

SEQ ID NO: 568277 - DNA, 20 bp, Artificial Sequence
  chemically synthesized
agtttctgctaccgtggggc

SEQ ID NO: 568278 - DNA, 20 bp, Artificial Sequence
  chemically synthesized
ggggaactagaatggatttc

SEQ ID NO: 568279 - DNA, 20 bp, Artificial Sequence
  chemically synthesized
aacaagaaatggggaactag

SEQ ID NO: 568280 - DNA, 20 bp, Artificial Sequence
  chemically synthesized
tctggctaaagccagggcaa

SEQ ID NO: 568281 - DNA, 20 bp, Artificial Sequence
  chemically synthesized
accgaggcaatcatctttgc

SEQ ID NO: 568282 - DNA, 20 bp, Artificial Sequence
  chemically synthesized
tgttccagctgttagttgtc

SEQ ID NO: 568283 - DNA, 20 bp, Artificial Sequence
  chemically synthesized
tgttagttgtcctccgtttt

SEQ ID NO: 568284 - DNA, 20 bp, Artificial Sequence
  chemically synthesized
cctccgttttatttgctttt

SEQ ID NO: 568285 - DNA, 20 bp, Artificial Sequence
  chemically synthesized
tggacacgaccctgaaaaga

SEQ ID NO: 568286 - DNA, 20 bp, Artificial Sequence
  chemically synthesized
ttcagtcatcattgtttgat

SEQ ID NO: 568287 - DNA, 20 bp, Artificial Sequence
  chemically synthesized
gtggaattggtttcagtcat

SEQ ID NO: 568288 - DNA, 20 bp, Artificial Sequence
  chemically synthesized
tgacccttgaacaccgtgga

SEQ ID NO: 568289 - DNA, 20 bp, Artificial Sequence
  chemically synthesized
agagacctttcatataaccg

SEQ ID NO: 568290 - DNA, 20 bp, Artificial Sequence
  chemically synthesized
cgtgttgcttcatttgctcc

SEQ ID NO: 568291 - DNA, 20 bp, Artificial Sequence
  chemically synthesized
agcaaatgtatcctccaaag

SEQ ID NO: 568292 - DNA, 20 bp, Artificial Sequence
  chemically synthesized
aatcaacctttctttttttg

SEQ ID NO: 568293 - DNA, 20 bp, Artificial Sequence
  chemically synthesized
aagctaggcaaaaaaagaaa

SEQ ID NO: 568294 - DNA, 20 bp, Artificial Sequence
  chemically synthesized
ggataaagcagaagaccaag

SEQ ID NO: 568295 - DNA, 20 bp, Artificial Sequence
  chemically synthesized
gcaataaactcttcttggtc

SEQ ID NO: 568296 - DNA, 20 bp, Artificial Sequence
  chemically synthesized
gtttattgcccaaggaaaaa

SEQ ID NO: 568297 - DNA, 20 bp, Artificial Sequence
  chemically synthesized
aaagttcaccacttaaatcg

SEQ ID NO: 568298 - DNA, 20 bp, Artificial Sequence
  chemically synthesized
ttacatcatgaaaaaaatcc

SEQ ID NO: 568299 - DNA, 20 bp, Artificial Sequence
  chemically synthesized
gatttttttcatgatgtaaa

SEQ ID NO: 568300 - DNA, 20 bp, Artificial Sequence
  chemically synthesized
gaggcataatattaattata

SEQ ID NO: 568301 - DNA, 20 bp, Artificial Sequence
  chemically synthesized
gcaactaaaccccttcaatt

SEQ ID NO: 568302 - DNA, 20 bp, Artificial Sequence
  chemically synthesized
agtttgaagctttaaattga

SEQ ID NO: 568303 - DNA, 20 bp, Artificial Sequence
  chemically synthesized
gtcaaatttgaagttaagtt

SEQ ID NO: 568304 - DNA, 20 bp, Artificial Sequence
  chemically synthesized
tatattagtcaaatttgaag

SEQ ID NO: 568305 - DNA, 20 bp, Artificial Sequence
  chemically synthesized
gcaataaaaagggcagaaca

SEQ ID NO: 568306 - DNA, 20 bp, Artificial Sequence
  chemically synthesized
ctgccctttttattgccgtg

SEQ ID NO: 568307 - DNA, 20 bp, Artificial Sequence
  chemically synthesized
ctgggattgggagtgacaaa

SEQ ID NO: 568308 - DNA, 20 bp, Artificial Sequence
  chemically synthesized
tgtctgtgctcatcttcaag

SEQ ID NO: 568309 - DNA, 20 bp, Artificial Sequence
  chemically synthesized
tttttttttttttttgccct

SEQ ID NO: 568310 - DNA, 20 bp, Artificial Sequence
  chemically synthesized
gggtggggatttttgtttgt

SEQ ID NO: 568311 - DNA, 20 bp, Artificial Sequence
  chemically synthesized
ttcagggggtggggattttt

SEQ ID NO: 568312 - DNA, 20 bp, Artificial Sequence
  chemically synthesized
agatttcagggggtggggat

SEQ ID NO: 568313 - DNA, 20 bp, Artificial Sequence
  chemically synthesized
aagtcaaagatttcaggggg

SEQ ID NO: 568314 - DNA, 20 bp, Artificial Sequence
  chemically synthesized
ccccctgaaatctttgactt

SEQ ID NO: 568315 - DNA, 20 bp, Artificial Sequence
  chemically synthesized
aacaactaaagcccagaagt

SEQ ID NO: 568316 - DNA, 20 bp, Artificial Sequence
  chemically synthesized
atctttgacttctgggcttt

SEQ ID NO: 568317 - DNA, 20 bp, Artificial Sequence
  chemically synthesized
ttagttgtttgttctttctt

SEQ ID NO: 568318 - DNA, 20 bp, Artificial Sequence
  chemically synthesized
actttctgcctgatttcttc

SEQ ID NO: 568319 - DNA, 20 bp, Artificial Sequence
  chemically synthesized
tgccaaaaggtcaactttct

SEQ ID NO: 568320 - DNA, 20 bp, Artificial Sequence
  chemically synthesized
cttccttctacgagtaagag

SEQ ID NO: 568321 - DNA, 20 bp, Artificial Sequence
  chemically synthesized
cacgcggggattggggccgg

SEQ ID NO: 568322 - DNA, 20 bp, Artificial Sequence
  chemically synthesized
gggataacgcgttcctcacg

SEQ ID NO: 568323 - DNA, 20 bp, Artificial Sequence
  chemically synthesized
ccctctggggacggggagaa

SEQ ID NO: 568324 - DNA, 20 bp, Artificial Sequence
  chemically synthesized
ggacgggctcggagagaaaa

SEQ ID NO: 568325 - DNA, 20 bp, Artificial Sequence
  chemically synthesized
ctagtgggggaacctcttcc

SEQ ID NO: 568326 - DNA, 20 bp, Artificial Sequence
  chemically synthesized
cgcggctgcaggtgcgcccc

SEQ ID NO: 568327 - DNA, 20 bp, Artificial Sequence
  chemically synthesized
ggtccagccgccgcgcctgt

SEQ ID NO: 568328 - DNA, 20 bp, Artificial Sequence
  chemically synthesized
cctgtccaagttttgaccgc

SEQ ID NO: 568329 - DNA, 20 bp, Artificial Sequence
  chemically synthesized
ccctgctcgcgccacaagtg

SEQ ID NO: 568330 - DNA, 20 bp, Artificial Sequence
  chemically synthesized
gtgtgggtacgagtggagga

SEQ ID NO: 568331 - DNA, 20 bp, Artificial Sequence
  chemically synthesized
cctccgcagtgctttcagct

SEQ ID NO: 568332 - DNA, 20 bp, Artificial Sequence
  chemically synthesized
cgcccgcgccggctcctccg

SEQ ID NO: 568333 - DNA, 20 bp, Artificial Sequence
  chemically synthesized
acacccagagactgggcagt

SEQ ID NO: 568334 - DNA, 20 bp, Artificial Sequence
  chemically synthesized
ctttctcttttctttttcct

SEQ ID NO: 568335 - DNA, 20 bp, Artificial Sequence
  chemically synthesized
aaagaaagaaagaaagagga

SEQ ID NO: 568336 - DNA, 20 bp, Artificial Sequence
  chemically synthesized
gaggtgttagcagagcggtg

SEQ ID NO: 568337 - DNA, 20 bp, Artificial Sequence
  chemically synthesized
agacaacaagtagtcttgct

SEQ ID NO: 568338 - DNA, 20 bp, Artificial Sequence
  chemically synthesized
catcccagataattaagagt

SEQ ID NO: 568339 - DNA, 20 bp, Artificial Sequence
  chemically synthesized
gataattaagagtgtgggct

SEQ ID NO: 568340 - DNA, 20 bp, Artificial Sequence
  chemically synthesized
actctcccttcctcctcagt

SEQ ID NO: 568341 - DNA, 20 bp, Artificial Sequence
  chemically synthesized
ttaggctcatcctgggctaa

SEQ ID NO: 568342 - DNA, 20 bp, Artificial Sequence
  chemically synthesized
aaagggattgttaaaaagac

SEQ ID NO: 568343 - DNA, 20 bp, Artificial Sequence
  chemically synthesized
attgttaaaaagactttgga

SEQ ID NO: 568344 - DNA, 20 bp, Artificial Sequence
  chemically synthesized
accagaaactctgagcatac

SEQ ID NO: 568345 - DNA, 20 bp, Artificial Sequence
  chemically synthesized
ttctcaaacattagtatgct

SEQ ID NO: 568346 - DNA, 20 bp, Artificial Sequence
  chemically synthesized
ttaatttagagagtccatac

SEQ ID NO: 568347 - DNA, 20 bp, Artificial Sequence
  chemically synthesized
caataccaccagtgctgttg

SEQ ID NO: 568348 - DNA, 20 bp, Artificial Sequence
  chemically synthesized
tttaggaagatctagaagga

SEQ ID NO: 568349 - DNA, 20 bp, Artificial Sequence
  chemically synthesized
agttcaaataattctaattt

SEQ ID NO: 568350 - DNA, 20 bp, Artificial Sequence
  chemically synthesized
gttaactacacacaattatt

SEQ ID NO: 568351 - DNA, 20 bp, Artificial Sequence
  chemically synthesized
tcttcttcttttgagtattt

SEQ ID NO: 568352 - DNA, 20 bp, Artificial Sequence
  chemically synthesized
cagaaaattcttgtgctaat

SEQ ID NO: 568353 - DNA, 20 bp, Artificial Sequence
  chemically synthesized
tgctaatctaaggtgttatg

SEQ ID NO: 568354 - DNA, 20 bp, Artificial Sequence
  chemically synthesized
ctgcaaacttcacataacac

SEQ ID NO: 568355 - DNA, 20 bp, Artificial Sequence
  chemically synthesized
agggcagtgaaaatatcact

SEQ ID NO: 568356 - DNA, 20 bp, Artificial Sequence
  chemically synthesized
cttctttgtccatttatttt

SEQ ID NO: 568357 - DNA, 20 bp, Artificial Sequence
  chemically synthesized
tttgtccatttattttgttg

SEQ ID NO: 568358 - DNA, 20 bp, Artificial Sequence
  chemically synthesized
ctttttattttctttcaaac

SEQ ID NO: 568359 - DNA, 20 bp, Artificial Sequence
  chemically synthesized
cggaaaggagagtggaaagc

SEQ ID NO: 568360 - DNA, 20 bp, Artificial Sequence
  chemically synthesized
catttgctttccactctcct

SEQ ID NO: 568361 - DNA, 20 bp, Artificial Sequence
  chemically synthesized
tgctttccactctcctttcc

SEQ ID NO: 568362 - DNA, 20 bp, Artificial Sequence
  chemically synthesized
tgattcattccacttcggtc

SEQ ID NO: 568363 - DNA, 20 bp, Artificial Sequence
  chemically synthesized
cttggaggctgaagtgggag

SEQ ID NO: 568364 - DNA, 20 bp, Artificial Sequence
  chemically synthesized
ggcacttggaggctgaagtg

SEQ ID NO: 568365 - DNA, 20 bp, Artificial Sequence
  chemically synthesized
gacaggtgcatgccaccata

SEQ ID NO: 568366 - DNA, 20 bp, Artificial Sequence
  chemically synthesized
ggggaaaaatgttgagcaga

SEQ ID NO: 568367 - DNA, 20 bp, Artificial Sequence
  chemically synthesized
gctcaacatttttcccccta

SEQ ID NO: 568368 - DNA, 20 bp, Artificial Sequence
  chemically synthesized
aatgttttaggtggaagcac

SEQ ID NO: 568369 - DNA, 20 bp, Artificial Sequence
  chemically synthesized
tttaggtggaagcacacccg

SEQ ID NO: 568370 - DNA, 20 bp, Artificial Sequence
  chemically synthesized
cattagataaagcaaaacgg

SEQ ID NO: 568371 - DNA, 20 bp, Artificial Sequence
  chemically synthesized
gacaaaagcaaaagggaatg

SEQ ID NO: 568372 - DNA, 20 bp, Artificial Sequence
  chemically synthesized
taaagaatcctggcattccc

SEQ ID NO: 568373 - DNA, 20 bp, Artificial Sequence
  chemically synthesized
tgataacatttacctttata

SEQ ID NO: 568374 - DNA, 20 bp, Artificial Sequence
  chemically synthesized
aatgccagaagaagtgccat

SEQ ID NO: 568375 - DNA, 20 bp, Artificial Sequence
  chemically synthesized
ctggcattctggctcataca

SEQ ID NO: 568376 - DNA, 20 bp, Artificial Sequence
  chemically synthesized
agcagctgcctccacaactc

SEQ ID NO: 568377 - DNA, 20 bp, Artificial Sequence
  chemically synthesized
tacggtctgaggggggcaca

SEQ ID NO: 568378 - DNA, 20 bp, Artificial Sequence
  chemically synthesized
tctgaggggggcacactaag

SEQ ID NO: 568379 - DNA, 20 bp, Artificial Sequence
  chemically synthesized
ctgctccgatccttggggaa

SEQ ID NO: 568380 - DNA, 20 bp, Artificial Sequence
  chemically synthesized
actgacacagagattggtgt

SEQ ID NO: 568381 - DNA, 20 bp, Artificial Sequence
  chemically synthesized
agtgatttgccacactgaca

SEQ ID NO: 568382 - DNA, 20 bp, Artificial Sequence
  chemically synthesized
agtgtggcaaatcacttaac

SEQ ID NO: 568383 - DNA, 20 bp, Artificial Sequence
  chemically synthesized
aataaacataaacagtagtt

SEQ ID NO: 568384 - DNA, 20 bp, Artificial Sequence
  chemically synthesized
gcaaatcacttaactactgt

SEQ ID NO: 568385 - DNA, 20 bp, Artificial Sequence
  chemically synthesized
atttacaaatgtccatgctc

SEQ ID NO: 568386 - DNA, 20 bp, Artificial Sequence
  chemically synthesized
aatattacaaatcgataaac

SEQ ID NO: 568387 - DNA, 20 bp, Artificial Sequence
  chemically synthesized
ggtgttacaaatccttagtt

SEQ ID NO: 568388 - DNA, 20 bp, Artificial Sequence
  chemically synthesized
ctatccaggtgttacaaatc

SEQ ID NO: 568389 - DNA, 20 bp, Artificial Sequence
  chemically synthesized
catttgtcactctcttcctt

SEQ ID NO: 568390 - DNA, 20 bp, Artificial Sequence
  chemically synthesized
cactctcttcctttcctgtt

SEQ ID NO: 568391 - DNA, 20 bp, Artificial Sequence
  chemically synthesized
ctcttcctttcctgtttttt

SEQ ID NO: 568392 - DNA, 20 bp, Artificial Sequence
  chemically synthesized
tcctttcctgttttttgttt

SEQ ID NO: 568393 - DNA, 20 bp, Artificial Sequence
  chemically synthesized
ctcaaaattcaggagttctg

SEQ ID NO: 568394 - DNA, 20 bp, Artificial Sequence
  chemically synthesized
gttctgacacgcttctctat

SEQ ID NO: 568395 - DNA, 20 bp, Artificial Sequence
  chemically synthesized
cttgtcaacagattattctt

SEQ ID NO: 568396 - DNA, 20 bp, Artificial Sequence
  chemically synthesized
ttccattcttttttcttgtc

SEQ ID NO: 568397 - DNA, 20 bp, Artificial Sequence
  chemically synthesized
atttttttaaaaagtctgaa

SEQ ID NO: 568398 - DNA, 20 bp, Artificial Sequence
  chemically synthesized
agaacttaaagatgtatttt

SEQ ID NO: 568399 - DNA, 20 bp, Artificial Sequence
  chemically synthesized
tatttaattataatatgacg

SEQ ID NO: 568400 - DNA, 20 bp, Artificial Sequence
  chemically synthesized
aatgacgcgggcatcacaga

SEQ ID NO: 568401 - DNA, 20 bp, Artificial Sequence
  chemically synthesized
tgttttgttgttcaattgca

SEQ ID NO: 568402 - DNA, 20 bp, Artificial Sequence
  chemically synthesized
aattgcagtcagattatgaa

SEQ ID NO: 568403 - DNA, 20 bp, Artificial Sequence
  chemically synthesized
tatcaattatgttcttttcc

SEQ ID NO: 568404 - DNA, 20 bp, Artificial Sequence
  chemically synthesized
tgatgccatgtatgataata

SEQ ID NO: 568405 - DNA, 20 bp, Artificial Sequence
  chemically synthesized
gccatgtatgataatatatt

SEQ ID NO: 568406 - DNA, 20 bp, Artificial Sequence
  chemically synthesized
atatattgtttgtttatagt

SEQ ID NO: 568407 - DNA, 20 bp, Artificial Sequence
  chemically synthesized
gatgtttcttcttctcctcc

SEQ ID NO: 568408 - DNA, 20 bp, Artificial Sequence
  chemically synthesized
tatattattattattattat

SEQ ID NO: 568409 - DNA, 20 bp, Artificial Sequence
  chemically synthesized
gctgaagtttgttctggtag

SEQ ID NO: 568410 - DNA, 20 bp, Artificial Sequence
  chemically synthesized
tctgaagtcaaaattttagc

SEQ ID NO: 568411 - DNA, 20 bp, Artificial Sequence
  chemically synthesized
actgggaacaagtaggtcat

SEQ ID NO: 568412 - DNA, 20 bp, Artificial Sequence
  chemically synthesized
taccactgtctagaatggtg

SEQ ID NO: 568413 - DNA, 20 bp, Artificial Sequence
  chemically synthesized
ctaagcgcatgagtcttcga

SEQ ID NO: 568414 - DNA, 20 bp, Artificial Sequence
  chemically synthesized
ggaatccagctcgaagactc

SEQ ID NO: 568415 - DNA, 20 bp, Artificial Sequence
  chemically synthesized
gctatgctgccatgaagaga

SEQ ID NO: 568416 - DNA, 20 bp, Artificial Sequence
  chemically synthesized
tcttttcctgtgagaaaggt

SEQ ID NO: 568417 - DNA, 20 bp, Artificial Sequence
  chemically synthesized
ttctctgctctgagccatca

SEQ ID NO: 568418 - DNA, 20 bp, Artificial Sequence
  chemically synthesized
agtttaagtggttcaaagac

SEQ ID NO: 568419 - DNA, 20 bp, Artificial Sequence
  chemically synthesized
ttattctctaaagataccct

SEQ ID NO: 568420 - DNA, 20 bp, Artificial Sequence
  chemically synthesized
ctgacctaagggactgtgca

SEQ ID NO: 568421 - DNA, 20 bp, Artificial Sequence
  chemically synthesized
gacctctgtggggacatcaa

SEQ ID NO: 568422 - DNA, 20 bp, Artificial Sequence
  chemically synthesized
ggacatcaatcaggctttcc

SEQ ID NO: 568423 - DNA, 20 bp, Artificial Sequence
  chemically synthesized
ggaagccaaacggcaggaaa

SEQ ID NO: 568424 - DNA, 20 bp, Artificial Sequence
  chemically synthesized
tcaatcaggctttcctgccg

SEQ ID NO: 568425 - DNA, 20 bp, Artificial Sequence
  chemically synthesized
tttcctgccgtttggcttcc

SEQ ID NO: 568426 - DNA, 20 bp, Artificial Sequence
  chemically synthesized
aggaaaggacaggaggaagg

SEQ ID NO: 568427 - DNA, 20 bp, Artificial Sequence
  chemically synthesized
cccaaagggataaagggagg

SEQ ID NO: 568428 - DNA, 20 bp, Artificial Sequence
  chemically synthesized
ctccctttatccctttgggc

SEQ ID NO: 568429 - DNA, 20 bp, Artificial Sequence
  chemically synthesized
ttgggcaaaagtttaccatt

SEQ ID NO: 568430 - DNA, 20 bp, Artificial Sequence
  chemically synthesized
cattatactctcttcaagtg

SEQ ID NO: 568431 - DNA, 20 bp, Artificial Sequence
  chemically synthesized
gtgttccgtttgaatgtacc

SEQ ID NO: 568432 - DNA, 20 bp, Artificial Sequence
  chemically synthesized
gtggctttggctggatgggt

SEQ ID NO: 568433 - DNA, 20 bp, Artificial Sequence
  chemically synthesized
tcaagtctattgccccagag

SEQ ID NO: 568434 - DNA, 20 bp, Artificial Sequence
  chemically synthesized
ttatccaatgactgagtctc

SEQ ID NO: 568435 - DNA, 20 bp, Artificial Sequence
  chemically synthesized
gctctttgtgggcctacaga

SEQ ID NO: 568436 - DNA, 20 bp, Artificial Sequence
  chemically synthesized
gcctcctctgtaggcccaca

SEQ ID NO: 568437 - DNA, 20 bp, Artificial Sequence
  chemically synthesized
gtgagggtaaaaaggatgca

SEQ ID NO: 568438 - DNA, 20 bp, Artificial Sequence
  chemically synthesized
gcaaccagcttgttctttac

SEQ ID NO: 568439 - DNA, 20 bp, Artificial Sequence
  chemically synthesized
tctttacaagagcttcaacg

SEQ ID NO: 568440 - DNA, 20 bp, Artificial Sequence
  chemically synthesized
agagaaatgggcaaactgga

SEQ ID NO: 568441 - DNA, 20 bp, Artificial Sequence
  chemically synthesized
gattgtcacactaagccctt

SEQ ID NO: 568442 - DNA, 20 bp, Artificial Sequence
  chemically synthesized
aagggcttagtgtgacaatc

SEQ ID NO: 568443 - DNA, 20 bp, Artificial Sequence
  chemically synthesized
tttcaggatacaagtcaaac

SEQ ID NO: 568444 - DNA, 20 bp, Artificial Sequence
  chemically synthesized
ttgtatcctgaaaggtatga

SEQ ID NO: 568445 - DNA, 20 bp, Artificial Sequence
  chemically synthesized
caaaccggacagagccacac

SEQ ID NO: 568446 - DNA, 20 bp, Artificial Sequence
  chemically synthesized
aaagcatgagtgtggctctg

SEQ ID NO: 568447 - DNA, 20 bp, Artificial Sequence
  chemically synthesized
aagcccccataccattgcct

SEQ ID NO: 568448 - DNA, 20 bp, Artificial Sequence
  chemically synthesized
aatcactcaggcaatggtat

SEQ ID NO: 568449 - DNA, 20 bp, Artificial Sequence
  chemically synthesized
aaattcagacatcaggtaca

SEQ ID NO: 568450 - DNA, 20 bp, Artificial Sequence
  chemically synthesized
aagaagtaaagcaatagtcc

SEQ ID NO: 568451 - DNA, 20 bp, Artificial Sequence
  chemically synthesized
gggcggccaagcttgaggac

SEQ ID NO: 568452 - DNA, 20 bp, Artificial Sequence
  chemically synthesized
tgagtgattccaaagggcgg

SEQ ID NO: 568453 - DNA, 20 bp, Artificial Sequence
  chemically synthesized
ggccgccctttggaatcact

SEQ ID NO: 568454 - DNA, 20 bp, Artificial Sequence
  chemically synthesized
taaatttattaacaatccct

SEQ ID NO: 568455 - DNA, 20 bp, Artificial Sequence
  chemically synthesized
cagggattgttaataaattt

SEQ ID NO: 568456 - DNA, 20 bp, Artificial Sequence
  chemically synthesized
gatgtttgggtctcaccacc

SEQ ID NO: 568457 - DNA, 20 bp, Artificial Sequence
  chemically synthesized
aatttaattggtcttggaca

SEQ ID NO: 568458 - DNA, 20 bp, Artificial Sequence
  chemically synthesized
taggatttctaagactctcc

SEQ ID NO: 568459 - DNA, 20 bp, Artificial Sequence
  chemically synthesized
ccattgtccttgagtgacaa

SEQ ID NO: 568460 - DNA, 20 bp, Artificial Sequence
  chemically synthesized
tccaattcattatgttcaag

SEQ ID NO: 568461 - DNA, 20 bp, Artificial Sequence
  chemically synthesized
gaagatgtctgaattggagc

SEQ ID NO: 568462 - DNA, 20 bp, Artificial Sequence
  chemically synthesized
tttgtggaaggtaggaacag

SEQ ID NO: 568463 - DNA, 20 bp, Artificial Sequence
  chemically synthesized
gcaacccagaaaggaaaaag

SEQ ID NO: 568464 - DNA, 20 bp, Artificial Sequence
  chemically synthesized
tttttcctttctgggttgca

SEQ ID NO: 568465 - DNA, 20 bp, Artificial Sequence
  chemically synthesized
aggaaaggacaaagacaagg

SEQ ID NO: 568466 - DNA, 20 bp, Artificial Sequence
  chemically synthesized
gacttcaccaactcctaggg

SEQ ID NO: 568467 - DNA, 20 bp, Artificial Sequence
  chemically synthesized
ctctctatctatagtgcgcc

SEQ ID NO: 568468 - DNA, 20 bp, Artificial Sequence
  chemically synthesized
ataatatttgccctaaccag

SEQ ID NO: 568469 - DNA, 20 bp, Artificial Sequence
  chemically synthesized
gttggtttcagattgatcta

SEQ ID NO: 568470 - DNA, 20 bp, Artificial Sequence
  chemically synthesized
tacatccagaagatgttggt

SEQ ID NO: 568471 - DNA, 20 bp, Artificial Sequence
  chemically synthesized
tattcttacatccagaagat

SEQ ID NO: 568472 - DNA, 20 bp, Artificial Sequence
  chemically synthesized
aagagacagggcctggaaaa

SEQ ID NO: 568473 - DNA, 20 bp, Artificial Sequence
  chemically synthesized
tcacagagaactttcctgag

SEQ ID NO: 568474 - DNA, 20 bp, Artificial Sequence
  chemically synthesized
gagccagctgccatctaaac

SEQ ID NO: 568475 - DNA, 20 bp, Artificial Sequence
  chemically synthesized
ggaacctgtctggtgaaatc

SEQ ID NO: 568476 - DNA, 20 bp, Artificial Sequence
  chemically synthesized
aggttccagataaagtcgag

SEQ ID NO: 568477 - DNA, 20 bp, Artificial Sequence
  chemically synthesized
cgagctctgcttcactctca

SEQ ID NO: 568478 - DNA, 20 bp, Artificial Sequence
  chemically synthesized
tctcacacagttttctttta

SEQ ID NO: 568479 - DNA, 20 bp, Artificial Sequence
  chemically synthesized
tttcttttaataagatttct

SEQ ID NO: 568480 - DNA, 20 bp, Artificial Sequence
  chemically synthesized
gcttgatataggtggctctg

SEQ ID NO: 568481 - DNA, 20 bp, Artificial Sequence
  chemically synthesized
aattcacatctttttagatg

SEQ ID NO: 568482 - DNA, 20 bp, Artificial Sequence
  chemically synthesized
ggcctgtgaggttaatgaag

SEQ ID NO: 568483 - DNA, 20 bp, Artificial Sequence
  chemically synthesized
cattaacctcacaggccgac

SEQ ID NO: 568484 - DNA, 20 bp, Artificial Sequence
  chemically synthesized
ggaaaggcagacaaatagtt

SEQ ID NO: 568485 - DNA, 20 bp, Artificial Sequence
  chemically synthesized
actatttgtctgcctttccc

SEQ ID NO: 568486 - DNA, 20 bp, Artificial Sequence
  chemically synthesized
atttctgcccagttttgaaa

SEQ ID NO: 568487 - DNA, 20 bp, Artificial Sequence
  chemically synthesized
gcagagtgtaagaatttctg

SEQ ID NO: 568488 - DNA, 20 bp, Artificial Sequence
  chemically synthesized
tatttgtagctgaagaggaa

SEQ ID NO: 568489 - DNA, 20 bp, Artificial Sequence
  chemically synthesized
tcttcctcttcagctacaaa

SEQ ID NO: 568490 - DNA, 20 bp, Artificial Sequence
  chemically synthesized
agctacaaataaggctttgt

SEQ ID NO: 568491 - DNA, 20 bp, Artificial Sequence
  chemically synthesized
ctcagaatgaattcactaat

SEQ ID NO: 568492 - DNA, 20 bp, Artificial Sequence
  chemically synthesized
ttgagaagagacgcagactt

SEQ ID NO: 568493 - DNA, 20 bp, Artificial Sequence
  chemically synthesized
agatcaaagggttaatttac

SEQ ID NO: 568494 - DNA, 20 bp, Artificial Sequence
  chemically synthesized
aagtcttcatgcagtaaata

SEQ ID NO: 568495 - DNA, 20 bp, Artificial Sequence
  chemically synthesized
tgaaaagtcttcatgcagta

SEQ ID NO: 568496 - DNA, 20 bp, Artificial Sequence
  chemically synthesized
ctgcaaaatgggaggatgtt

SEQ ID NO: 568497 - DNA, 20 bp, Artificial Sequence
  chemically synthesized
aattctattttatcagactt

SEQ ID NO: 568498 - DNA, 20 bp, Artificial Sequence
  chemically synthesized
gatcagaaaatgtgagtatt

SEQ ID NO: 568499 - DNA, 20 bp, Artificial Sequence
  chemically synthesized
tttctgatcaatctagaaat

SEQ ID NO: 568500 - DNA, 20 bp, Artificial Sequence
  chemically synthesized
tagaaagaaaaactgtaatt

SEQ ID NO: 568501 - DNA, 20 bp, Artificial Sequence
  chemically synthesized
caatgctaatattatctaac

SEQ ID NO: 568502 - DNA, 20 bp, Artificial Sequence
  chemically synthesized
ggtgagaaaaaaaattaaat

SEQ ID NO: 568503 - DNA, 20 bp, Artificial Sequence
  chemically synthesized
attaaattttagtttaaaca

SEQ ID NO: 568504 - DNA, 20 bp, Artificial Sequence
  chemically synthesized
cctttcctaaggccaaagca

SEQ ID NO: 568505 - DNA, 20 bp, Artificial Sequence
  chemically synthesized
attcatcattggacaaggat

SEQ ID NO: 568506 - DNA, 20 bp, Artificial Sequence
  chemically synthesized
tgaacattaaaaaaaatcaa

SEQ ID NO: 568507 - DNA, 20 bp, Artificial Sequence
  chemically synthesized
cactctaagaactaaagctg

SEQ ID NO: 568508 - DNA, 20 bp, Artificial Sequence
  chemically synthesized
caacgcagctttagttctta

SEQ ID NO: 568509 - DNA, 20 bp, Artificial Sequence
  chemically synthesized
tgatttactcatactttgtc

SEQ ID NO: 568510 - DNA, 20 bp, Artificial Sequence
  chemically synthesized
tctctggaaacaattcacaa

SEQ ID NO: 568511 - DNA, 20 bp, Artificial Sequence
  chemically synthesized
ataaataaaactaggttgtg

SEQ ID NO: 568512 - DNA, 20 bp, Artificial Sequence
  chemically synthesized
acctagttttatttatgaac

SEQ ID NO: 568513 - DNA, 20 bp, Artificial Sequence
  chemically synthesized
tgaacatatgattaaaaaac

SEQ ID NO: 568514 - DNA, 20 bp, Artificial Sequence
  chemically synthesized
acaattaaaaaagacaaagc

SEQ ID NO: 568515 - DNA, 20 bp, Artificial Sequence
  chemically synthesized
acagcagctttgtctttttt

SEQ ID NO: 568516 - DNA, 20 bp, Artificial Sequence
  chemically synthesized
tcttgtgggtaagtcctacg

SEQ ID NO: 568517 - DNA, 20 bp, Artificial Sequence
  chemically synthesized
gagcatatatcaagtagtaa

SEQ ID NO: 568518 - DNA, 20 bp, Artificial Sequence
  chemically synthesized
aaccattgttaatactctag

SEQ ID NO: 568519 - DNA, 20 bp, Artificial Sequence
  chemically synthesized
taatactctagacttgcttc

SEQ ID NO: 568520 - DNA, 20 bp, Artificial Sequence
  chemically synthesized
gcttaattgactggtaattc

SEQ ID NO: 568521 - DNA, 20 bp, Artificial Sequence
  chemically synthesized
caacttaggatgacttcctt

SEQ ID NO: 568522 - DNA, 20 bp, Artificial Sequence
  chemically synthesized
ttgattattacattttcctt

SEQ ID NO: 568523 - DNA, 20 bp, Artificial Sequence
  chemically synthesized
ctggtgtcttcatctgtagc

SEQ ID NO: 568524 - DNA, 20 bp, Artificial Sequence
  chemically synthesized
aatgctacagatgaagacac

SEQ ID NO: 568525 - DNA, 20 bp, Artificial Sequence
  chemically synthesized
gagatgaatatctacaagaa

SEQ ID NO: 568526 - DNA, 20 bp, Artificial Sequence
  chemically synthesized
aggaagctgcttttgataaa

SEQ ID NO: 568527 - DNA, 20 bp, Artificial Sequence
  chemically synthesized
aagaatcacgctttatcaaa

SEQ ID NO: 568528 - DNA, 20 bp, Artificial Sequence
  chemically synthesized
cgcttgctgaagattaagga

SEQ ID NO: 568529 - DNA, 20 bp, Artificial Sequence
  chemically synthesized
taatacacagctacgcttgc

SEQ ID NO: 568530 - DNA, 20 bp, Artificial Sequence
  chemically synthesized
gcctttgctataatacacag

SEQ ID NO: 568531 - DNA, 20 bp, Artificial Sequence
  chemically synthesized
ggcaagtcacttaaccactt

SEQ ID NO: 568532 - DNA, 20 bp, Artificial Sequence
  chemically synthesized
cattctatagatgagttaac

SEQ ID NO: 568533 - DNA, 20 bp, Artificial Sequence
  chemically synthesized
gaaatcatacctgcctgaca

SEQ ID NO: 568534 - DNA, 20 bp, Artificial Sequence
  chemically synthesized
caaagcagcctgtcaggcag

SEQ ID NO: 568535 - DNA, 20 bp, Artificial Sequence
  chemically synthesized
caaataaattcactttaaca

SEQ ID NO: 568536 - DNA, 20 bp, Artificial Sequence
  chemically synthesized
aattcactttaacattctgt

SEQ ID NO: 568537 - DNA, 20 bp, Artificial Sequence
  chemically synthesized
tgtgagggaaaatgagaggt

SEQ ID NO: 568538 - DNA, 20 bp, Artificial Sequence
  chemically synthesized
taaagagcagtttacagaag

SEQ ID NO: 568539 - DNA, 20 bp, Artificial Sequence
  chemically synthesized
tcttctgtaaactgctcttt

SEQ ID NO: 568540 - DNA, 20 bp, Artificial Sequence
  chemically synthesized
ccttttgtaaactgctaaag

SEQ ID NO: 568541 - DNA, 20 bp, Artificial Sequence
  chemically synthesized
acaaaaggcacctttcctct

SEQ ID NO: 568542 - DNA, 20 bp, Artificial Sequence
  chemically synthesized
gaaggaagcaagtaggaaaa

SEQ ID NO: 568543 - DNA, 20 bp, Artificial Sequence
  chemically synthesized
aaaaaaatcttacttttcct

SEQ ID NO: 568544 - DNA, 20 bp, Artificial Sequence
  chemically synthesized
tgagataggcataaaattca

SEQ ID NO: 568545 - DNA, 20 bp, Artificial Sequence
  chemically synthesized
tttgctatcattcagtgggg

SEQ ID NO: 568546 - DNA, 20 bp, Artificial Sequence
  chemically synthesized
tcacttgctctctgactact

SEQ ID NO: 568547 - DNA, 20 bp, Artificial Sequence
  chemically synthesized
gtagtcagagagcaagtgaa

SEQ ID NO: 568548 - DNA, 20 bp, Artificial Sequence
  chemically synthesized
acagtgagggagaaatatcc

SEQ ID NO: 568549 - DNA, 20 bp, Artificial Sequence
  chemically synthesized
cctgccacttgctggctgtt

SEQ ID NO: 568550 - DNA, 20 bp, Artificial Sequence
  chemically synthesized
aaaggggaaataagataaaa

SEQ ID NO: 568551 - DNA, 20 bp, Artificial Sequence
  chemically synthesized
gtagatcattaattggttaa

SEQ ID NO: 568552 - DNA, 20 bp, Artificial Sequence
  chemically synthesized
aagtaagccagagctggagt

SEQ ID NO: 568553 - DNA, 20 bp, Artificial Sequence
  chemically synthesized
tctgaatcttgtactccagc

SEQ ID NO: 568554 - DNA, 20 bp, Artificial Sequence
  chemically synthesized
tctggcttacttttgtcaag

SEQ ID NO: 568555 - DNA, 20 bp, Artificial Sequence
  chemically synthesized
atttatccacaaatttccaa

SEQ ID NO: 568556 - DNA, 20 bp, Artificial Sequence
  chemically synthesized
ttttatgtgctctatctaga

SEQ ID NO: 568557 - DNA, 20 bp, Artificial Sequence
  chemically synthesized
gtaagtgttccataaataca

SEQ ID NO: 568558 - DNA, 20 bp, Artificial Sequence
  chemically synthesized
tatggaacacttacatatgt

SEQ ID NO: 568559 - DNA, 20 bp, Artificial Sequence
  chemically synthesized
aaccataaagaaaaaatgag

SEQ ID NO: 568560 - DNA, 20 bp, Artificial Sequence
  chemically synthesized
tatggttggtaaaaactggg

SEQ ID NO: 568561 - DNA, 20 bp, Artificial Sequence
  chemically synthesized
atgtcattctccaaacactc

SEQ ID NO: 568562 - DNA, 20 bp, Artificial Sequence
  chemically synthesized
taaaaatttcaacattgtaa

SEQ ID NO: 568563 - DNA, 20 bp, Artificial Sequence
  chemically synthesized
gggatcccacttaaaaaaaa

SEQ ID NO: 568564 - DNA, 20 bp, Artificial Sequence
  chemically synthesized
gaaatatggccttttcctta

SEQ ID NO: 568565 - DNA, 20 bp, Artificial Sequence
  chemically synthesized
tatagctaaacacagtatca

SEQ ID NO: 568566 - DNA, 20 bp, Artificial Sequence
  chemically synthesized
ttattataatctgtctgata

SEQ ID NO: 568567 - DNA, 20 bp, Artificial Sequence
  chemically synthesized
actaatcacctttccctttt

SEQ ID NO: 568568 - DNA, 20 bp, Artificial Sequence
  chemically synthesized
aaaaagcagcaaaaagggaa

SEQ ID NO: 568569 - DNA, 20 bp, Artificial Sequence
  chemically synthesized
gcagcaaaaagggaaaggtg

SEQ ID NO: 568570 - DNA, 20 bp, Artificial Sequence
  chemically synthesized
aaggtgattagtttggcctc

SEQ ID NO: 568571 - DNA, 20 bp, Artificial Sequence
  chemically synthesized
gcacttcaattaaaaactaa

SEQ ID NO: 568572 - DNA, 20 bp, Artificial Sequence
  chemically synthesized
aactaggtgattaaagccta

SEQ ID NO: 568573 - DNA, 20 bp, Artificial Sequence
  chemically synthesized
acctgatttaagaactaact

SEQ ID NO: 568574 - DNA, 20 bp, Artificial Sequence
  chemically synthesized
tcacctagttagttcttaaa

SEQ ID NO: 568575 - DNA, 20 bp, Artificial Sequence
  chemically synthesized
cacacacacacacacacaaa

SEQ ID NO: 568576 - DNA, 20 bp, Artificial Sequence
  chemically synthesized
ctagaatatgaagagttgaa

SEQ ID NO: 568577 - DNA, 20 bp, Artificial Sequence
  chemically synthesized
tcacagagtcaatgtaagaa

SEQ ID NO: 568578 - DNA, 20 bp, Artificial Sequence
  chemically synthesized
ccttagtaaattattaatat

SEQ ID NO: 568579 - DNA, 20 bp, Artificial Sequence
  chemically synthesized
attaataatttactaaggta

SEQ ID NO: 568580 - DNA, 20 bp, Artificial Sequence
  chemically synthesized
atatacagctgtgttacgac

SEQ ID NO: 568581 - DNA, 20 bp, Artificial Sequence
  chemically synthesized
agctgtgttacgacatcagt

SEQ ID NO: 568582 - DNA, 20 bp, Artificial Sequence
  chemically synthesized
caaaaatgtatttggccaat

SEQ ID NO: 568583 - DNA, 20 bp, Artificial Sequence
  chemically synthesized
ttgttcatattaactcaata

SEQ ID NO: 568584 - DNA, 20 bp, Artificial Sequence
  chemically synthesized
cacgtgggaattgaagtcct

SEQ ID NO: 568585 - DNA, 20 bp, Artificial Sequence
  chemically synthesized
aggcttccaattctttgtcg

SEQ ID NO: 568586 - DNA, 20 bp, Artificial Sequence
  chemically synthesized
tctctatccatcatatgcaa

SEQ ID NO: 568587 - DNA, 20 bp, Artificial Sequence
  chemically synthesized
atccctaccctcttttccac

SEQ ID NO: 568588 - DNA, 20 bp, Artificial Sequence
  chemically synthesized
ttcaattggctcaaaagtag

SEQ ID NO: 568589 - DNA, 20 bp, Artificial Sequence
  chemically synthesized
gctagaggaaaaggaaaagt

SEQ ID NO: 568590 - DNA, 20 bp, Artificial Sequence
  chemically synthesized
ggccctattagctgtgcatt

SEQ ID NO: 568591 - DNA, 20 bp, Artificial Sequence
  chemically synthesized
tatactgtgcattgttctgt

SEQ ID NO: 568592 - DNA, 20 bp, Artificial Sequence
  chemically synthesized
ctatttatatttccttagtg

SEQ ID NO: 568593 - DNA, 20 bp, Artificial Sequence
  chemically synthesized
tctaaattttcctcgcttct

SEQ ID NO: 568594 - DNA, 20 bp, Artificial Sequence
  chemically synthesized
aaatctgtgttctaaatttt

SEQ ID NO: 568595 - DNA, 20 bp, Artificial Sequence
  chemically synthesized
gaagcgaggaaaatttagaa

SEQ ID NO: 568596 - DNA, 20 bp, Artificial Sequence
  chemically synthesized
gaggaaaatttagaacacag

SEQ ID NO: 568597 - DNA, 20 bp, Artificial Sequence
  chemically synthesized
atttagaacacagatttgtt

SEQ ID NO: 568598 - DNA, 20 bp, Artificial Sequence
  chemically synthesized
acacagatttgttttttgtt

SEQ ID NO: 568599 - DNA, 20 bp, Artificial Sequence
  chemically synthesized
gctcactgcaaactctgcct

SEQ ID NO: 568600 - DNA, 20 bp, Artificial Sequence
  chemically synthesized
aattgcttgaagctgggagg

SEQ ID NO: 568601 - DNA, 20 bp, Artificial Sequence
  chemically synthesized
ttgggaggctgaggcacgag

SEQ ID NO: 568602 - DNA, 20 bp, Artificial Sequence
  chemically synthesized
tgcctcagcctcccaagtag

SEQ ID NO: 568603 - DNA, 20 bp, Artificial Sequence
  chemically synthesized
ttttgtatttttggtagaga

SEQ ID NO: 568604 - DNA, 20 bp, Artificial Sequence
  chemically synthesized
caccttggcctcccaaagtg

SEQ ID NO: 568605 - DNA, 20 bp, Artificial Sequence
  chemically synthesized
gccaccatgcccagccagaa

SEQ ID NO: 568606 - DNA, 20 bp, Artificial Sequence
  chemically synthesized
ccacatcctttctaaccctg

SEQ ID NO: 568607 - DNA, 20 bp, Artificial Sequence
  chemically synthesized
cagttttccaatgtggttgt

SEQ ID NO: 568608 - DNA, 20 bp, Artificial Sequence
  chemically synthesized
ctggtacaaccacattggaa

SEQ ID NO: 568609 - DNA, 20 bp, Artificial Sequence
  chemically synthesized
agcttctgtacattcttcca

SEQ ID NO: 568610 - DNA, 20 bp, Artificial Sequence
  chemically synthesized
ggttatagggtctgtgtgtg

SEQ ID NO: 568611 - DNA, 20 bp, Artificial Sequence
  chemically synthesized
tcatcaaatggcatgtctta

SEQ ID NO: 568612 - DNA, 20 bp, Artificial Sequence
  chemically synthesized
tccatgctgttgtatgaagt

SEQ ID NO: 568613 - DNA, 20 bp, Artificial Sequence
  chemically synthesized
atacaacagcatggatgaat

SEQ ID NO: 568614 - DNA, 20 bp, Artificial Sequence
  chemically synthesized
ttgtgtctgacttctttaaa

SEQ ID NO: 568615 - DNA, 20 bp, Artificial Sequence
  chemically synthesized
atatttaatggtgttcaaaa

SEQ ID NO: 568616 - DNA, 20 bp, Artificial Sequence
  chemically synthesized
tcctccaagggtaaccacaa

SEQ ID NO: 568617 - DNA, 20 bp, Artificial Sequence
  chemically synthesized
ccttctaaaggttggtaatg

SEQ ID NO: 568618 - DNA, 20 bp, Artificial Sequence
  chemically synthesized
atgctggttaaatgagtgtg

SEQ ID NO: 568619 - DNA, 20 bp, Artificial Sequence
  chemically synthesized
gtgaaaattcactgaactgt

SEQ ID NO: 568620 - DNA, 20 bp, Artificial Sequence
  chemically synthesized
tcaattaaaaaaaaagaaaa

SEQ ID NO: 568621 - DNA, 20 bp, Artificial Sequence
  chemically synthesized
gtatatctttatcatgtata

SEQ ID NO: 568622 - DNA, 20 bp, Artificial Sequence
  chemically synthesized
gtaatgcatatgttacttag

SEQ ID NO: 568623 - DNA, 20 bp, Artificial Sequence
  chemically synthesized
atgaggtaatgcatatgtta

SEQ ID NO: 568624 - DNA, 20 bp, Artificial Sequence
  chemically synthesized
gtcttgaaaattgctaagag

SEQ ID NO: 568625 - DNA, 20 bp, Artificial Sequence
  chemically synthesized
ttagcaattttcaagactat

SEQ ID NO: 568626 - DNA, 20 bp, Artificial Sequence
  chemically synthesized
ttgaacttattcctcctaac

SEQ ID NO: 568627 - DNA, 20 bp, Artificial Sequence
  chemically synthesized
cctaatatatttcagtaaaa

SEQ ID NO: 568628 - DNA, 20 bp, Artificial Sequence
  chemically synthesized
atttccttttatattttttc

SEQ ID NO: 568629 - DNA, 20 bp, Artificial Sequence
  chemically synthesized
aaaaatataaaaggaaatat

SEQ ID NO: 568630 - DNA, 20 bp, Artificial Sequence
  chemically synthesized
aaatatgatcgattttatta

SEQ ID NO: 568631 - DNA, 20 bp, Artificial Sequence
  chemically synthesized
cattccagacttggattttc

SEQ ID NO: 568632 - DNA, 20 bp, Artificial Sequence
  chemically synthesized
tcaatctaagtcattccaga

SEQ ID NO: 568633 - DNA, 20 bp, Artificial Sequence
  chemically synthesized
aaaatccaagtctggaatga

SEQ ID NO: 568634 - DNA, 20 bp, Artificial Sequence
  chemically synthesized
ccaccttagatcccatgcag

SEQ ID NO: 568635 - DNA, 20 bp, Artificial Sequence
  chemically synthesized
actttcagaaaaatcccttc

SEQ ID NO: 568636 - DNA, 20 bp, Artificial Sequence
  chemically synthesized
aggggcactgaaaactgctg

SEQ ID NO: 568637 - DNA, 20 bp, Artificial Sequence
  chemically synthesized
gtgtacctcggcatcatgtt

SEQ ID NO: 568638 - DNA, 20 bp, Artificial Sequence
  chemically synthesized
accactttgccttggccccc

SEQ ID NO: 568639 - DNA, 20 bp, Artificial Sequence
  chemically synthesized
aaggcaaagtggtctaagaa

SEQ ID NO: 568640 - DNA, 20 bp, Artificial Sequence
  chemically synthesized
ggtggagataaaactaacta

SEQ ID NO: 568641 - DNA, 20 bp, Artificial Sequence
  chemically synthesized
gcagtttgaaaaacactgta

SEQ ID NO: 568642 - DNA, 20 bp, Artificial Sequence
  chemically synthesized
cgtactaagggttcatgacc

SEQ ID NO: 568643 - DNA, 20 bp, Artificial Sequence
  chemically synthesized
atactggtaatgatccacta

SEQ ID NO: 568644 - DNA, 20 bp, Artificial Sequence
  chemically synthesized
ctgtcatattttctattctt

SEQ ID NO: 568645 - DNA, 20 bp, Artificial Sequence
  chemically synthesized
tgtgagcatagtacccaata

SEQ ID NO: 568646 - DNA, 20 bp, Artificial Sequence
  chemically synthesized
gtggggctcatgacctgtta

SEQ ID NO: 568647 - DNA, 20 bp, Artificial Sequence
  chemically synthesized
tagatacaggaggtacatgt

SEQ ID NO: 568648 - DNA, 20 bp, Artificial Sequence
  chemically synthesized
tactatttggtatgggtaag

SEQ ID NO: 568649 - DNA, 20 bp, Artificial Sequence
  chemically synthesized
catgcttgtatgattgaaag

SEQ ID NO: 568650 - DNA, 20 bp, Artificial Sequence
  chemically synthesized
ttttctgtctattcatgctt

SEQ ID NO: 568651 - DNA, 20 bp, Artificial Sequence
  chemically synthesized
gtaaatctttttctgtctat

SEQ ID NO: 568652 - DNA, 20 bp, Artificial Sequence
  chemically synthesized
tacaagcatgaatagacaga

SEQ ID NO: 568653 - DNA, 20 bp, Artificial Sequence
  chemically synthesized
catataaaattaatttttat

SEQ ID NO: 568654 - DNA, 20 bp, Artificial Sequence
  chemically synthesized
tggcaaaaaagatgaaagct

SEQ ID NO: 568655 - DNA, 20 bp, Artificial Sequence
  chemically synthesized
tttctttatgtagtaaagcc

SEQ ID NO: 568656 - DNA, 20 bp, Artificial Sequence
  chemically synthesized
atgattgtccagtgggcatg

SEQ ID NO: 568657 - DNA, 20 bp, Artificial Sequence
  chemically synthesized
tctagagaaattataatgat

SEQ ID NO: 568658 - DNA, 20 bp, Artificial Sequence
  chemically synthesized
atcattataatttctctaga

SEQ ID NO: 568659 - DNA, 20 bp, Artificial Sequence
  chemically synthesized
ttggaaagaagttgacggaa

SEQ ID NO: 568660 - DNA, 20 bp, Artificial Sequence
  chemically synthesized
gaacattacaagagactgga

SEQ ID NO: 568661 - DNA, 20 bp, Artificial Sequence
  chemically synthesized
caagagactggaggaggatt

SEQ ID NO: 568662 - DNA, 20 bp, Artificial Sequence
  chemically synthesized
gcaggggctgagaatctgct

SEQ ID NO: 568663 - DNA, 20 bp, Artificial Sequence
  chemically synthesized
agacaccccctaaaacttgg

SEQ ID NO: 568664 - DNA, 20 bp, Artificial Sequence
  chemically synthesized
gggtgtcttctctgccagct

SEQ ID NO: 568665 - DNA, 20 bp, Artificial Sequence
  chemically synthesized
tgccagctgttcgtttgggt

SEQ ID NO: 568666 - DNA, 20 bp, Artificial Sequence
  chemically synthesized
taccaggaatcactcagcct

SEQ ID NO: 568667 - DNA, 20 bp, Artificial Sequence
  chemically synthesized
tggaagaaaacaaaaaggct

SEQ ID NO: 568668 - DNA, 20 bp, Artificial Sequence
  chemically synthesized
cttaacaatacttttagcag

SEQ ID NO: 568669 - DNA, 20 bp, Artificial Sequence
  chemically synthesized
atttctcagtttatgttttg

SEQ ID NO: 568670 - DNA, 20 bp, Artificial Sequence
  chemically synthesized
gcagaagggcatttctcagt

SEQ ID NO: 568671 - DNA, 20 bp, Artificial Sequence
  chemically synthesized
atggaagcagaagggcattt

SEQ ID NO: 568672 - DNA, 20 bp, Artificial Sequence
  chemically synthesized
acataaactgagaaatgccc

SEQ ID NO: 568673 - DNA, 20 bp, Artificial Sequence
  chemically synthesized
tggatggtccccattctatt

SEQ ID NO: 568674 - DNA, 20 bp, Artificial Sequence
  chemically synthesized
gcttataaattcatcctatt

SEQ ID NO: 568675 - DNA, 20 bp, Artificial Sequence
  chemically synthesized
tcagtcttcatggacactta

SEQ ID NO: 568676 - DNA, 20 bp, Artificial Sequence
  chemically synthesized
tccatgaagactgataatta

SEQ ID NO: 568677 - DNA, 20 bp, Artificial Sequence
  chemically synthesized
agctgttatttttactcata

SEQ ID NO: 568678 - DNA, 20 bp, Artificial Sequence
  chemically synthesized
agcatattatgagtaaaaat

SEQ ID NO: 568679 - DNA, 20 bp, Artificial Sequence
  chemically synthesized
aaattcctttcaaaagagtg

SEQ ID NO: 568680 - DNA, 20 bp, Artificial Sequence
  chemically synthesized
atactgaaaaaagaaagatt

SEQ ID NO: 568681 - DNA, 20 bp, Artificial Sequence
  chemically synthesized
gtgattaaatactgaaaaaa

SEQ ID NO: 568682 - DNA, 20 bp, Artificial Sequence
  chemically synthesized
ttttttcagtatttaatcac

SEQ ID NO: 568683 - DNA, 20 bp, Artificial Sequence
  chemically synthesized
tgggaatttaatgaaagctg

SEQ ID NO: 568684 - DNA, 20 bp, Artificial Sequence
  chemically synthesized
cagtactaataagtggttaa

SEQ ID NO: 568685 - DNA, 20 bp, Artificial Sequence
  chemically synthesized
gcttttaaaaatataagaaa

SEQ ID NO: 568686 - DNA, 20 bp, Artificial Sequence
  chemically synthesized
tttcttatatttttaaaagc

SEQ ID NO: 568687 - DNA, 20 bp, Artificial Sequence
  chemically synthesized
gacatacagcatccataatc

SEQ ID NO: 568688 - DNA, 20 bp, Artificial Sequence
  chemically synthesized
ccattggctgtgaagccaca

SEQ ID NO: 568689 - DNA, 20 bp, Artificial Sequence
  chemically synthesized
cattgctaggctaaactgtt

SEQ ID NO: 568690 - DNA, 20 bp, Artificial Sequence
  chemically synthesized
gagtaatcattgctaggcta

SEQ ID NO: 568691 - DNA, 20 bp, Artificial Sequence
  chemically synthesized
ccacaaacagtttagcctag

SEQ ID NO: 568692 - DNA, 20 bp, Artificial Sequence
  chemically synthesized
atggagtgtgctgttaaaat

SEQ ID NO: 568693 - DNA, 20 bp, Artificial Sequence
  chemically synthesized
tgggatggccctatgacatg

SEQ ID NO: 568694 - DNA, 20 bp, Artificial Sequence
  chemically synthesized
ttctcaggtttctgcttgtg

SEQ ID NO: 568695 - DNA, 20 bp, Artificial Sequence
  chemically synthesized
atgacacaagcagaaacctg

SEQ ID NO: 568696 - DNA, 20 bp, Artificial Sequence
  chemically synthesized
cacatggaaacttctcaggt

SEQ ID NO: 568697 - DNA, 20 bp, Artificial Sequence
  chemically synthesized
ctagttcacatggaaacttc

SEQ ID NO: 568698 - DNA, 20 bp, Artificial Sequence
  chemically synthesized
tcatctaggaacagatgcaa

SEQ ID NO: 568699 - DNA, 20 bp, Artificial Sequence
  chemically synthesized
agacatatgagtcaggtcac

SEQ ID NO: 568700 - DNA, 20 bp, Artificial Sequence
  chemically synthesized
gttgtactactgtttgccag

SEQ ID NO: 568701 - DNA, 20 bp, Artificial Sequence
  chemically synthesized
tgtggtgtgaccagttgtac

SEQ ID NO: 568702 - DNA, 20 bp, Artificial Sequence
  chemically synthesized
acttagctcactatttgatg

SEQ ID NO: 568703 - DNA, 20 bp, Artificial Sequence
  chemically synthesized
aatggctggccattgtgtta

SEQ ID NO: 568704 - DNA, 20 bp, Artificial Sequence
  chemically synthesized
ttgttcaaatttggtctatg

SEQ ID NO: 568705 - DNA, 20 bp, Artificial Sequence
  chemically synthesized
aaagtgctccacaaagccta

SEQ ID NO: 568706 - DNA, 20 bp, Artificial Sequence
  chemically synthesized
aggacaacatagtaaacact

SEQ ID NO: 568707 - DNA, 20 bp, Artificial Sequence
  chemically synthesized
actatgttgtcctttacaga

SEQ ID NO: 568708 - DNA, 20 bp, Artificial Sequence
  chemically synthesized
ctgacctcagtgttaagcca

SEQ ID NO: 568709 - DNA, 20 bp, Artificial Sequence
  chemically synthesized
acagaccaaccccaaaactt

SEQ ID NO: 568710 - DNA, 20 bp, Artificial Sequence
  chemically synthesized
aactgaatttgtgagaaagg

SEQ ID NO: 568711 - DNA, 20 bp, Artificial Sequence
  chemically synthesized
atccttggtgcatgtcctcc

SEQ ID NO: 568712 - DNA, 20 bp, Artificial Sequence
  chemically synthesized
cctgggaagttattttagta

SEQ ID NO: 568713 - DNA, 20 bp, Artificial Sequence
  chemically synthesized
tagtaatatgcttctcaaaa

SEQ ID NO: 568714 - DNA, 20 bp, Artificial Sequence
  chemically synthesized
aagactgctaaaaattgtat

SEQ ID NO: 568715 - DNA, 20 bp, Artificial Sequence
  chemically synthesized
ttcagcataatgattttgtt

SEQ ID NO: 568716 - DNA, 20 bp, Artificial Sequence
  chemically synthesized
tcttatattcagcataatga

SEQ ID NO: 568717 - DNA, 20 bp, Artificial Sequence
  chemically synthesized
ctggtctcttatattcagca

SEQ ID NO: 568718 - DNA, 20 bp, Artificial Sequence
  chemically synthesized
cagatacatacaaaaatact

SEQ ID NO: 568719 - DNA, 20 bp, Artificial Sequence
  chemically synthesized
caggtcatttttcctttcac

SEQ ID NO: 568720 - DNA, 20 bp, Artificial Sequence
  chemically synthesized
tgacctgcaaaggggcacaa

SEQ ID NO: 568721 - DNA, 20 bp, Artificial Sequence
  chemically synthesized
ttctgtcatttgactgcagt

SEQ ID NO: 568722 - DNA, 20 bp, Artificial Sequence
  chemically synthesized
tgcctccatttaaagtggtt

SEQ ID NO: 568723 - DNA, 20 bp, Artificial Sequence
  chemically synthesized
gctgaaccactttaaatgga

SEQ ID NO: 568724 - DNA, 20 bp, Artificial Sequence
  chemically synthesized
gtgtgtaaatttttatttaa

SEQ ID NO: 568725 - DNA, 20 bp, Artificial Sequence
  chemically synthesized
attttaaaatttttttaaaa

SEQ ID NO: 568726 - DNA, 20 bp, Artificial Sequence
  chemically synthesized
gttaaatttgattttagggc

SEQ ID NO: 568727 - DNA, 20 bp, Artificial Sequence
  chemically synthesized
tatgcatttttgaatgttaa

SEQ ID NO: 568728 - DNA, 20 bp, Artificial Sequence
  chemically synthesized
agaatgaggtgcatcacaca

SEQ ID NO: 568729 - DNA, 20 bp, Artificial Sequence
  chemically synthesized
ggatgtttacataaatatag

SEQ ID NO: 568730 - DNA, 20 bp, Artificial Sequence
  chemically synthesized
aggtcatgctgtcagttccc

SEQ ID NO: 568731 - DNA, 20 bp, Artificial Sequence
  chemically synthesized
aattccgaaaatatcaaaac

SEQ ID NO: 568732 - DNA, 20 bp, Artificial Sequence
  chemically synthesized
tttaaggtcacttgtgaatc

SEQ ID NO: 568733 - DNA, 20 bp, Artificial Sequence
  chemically synthesized
tcttgaaaatctactgtaca

SEQ ID NO: 568734 - DNA, 20 bp, Artificial Sequence
  chemically synthesized
aagcattaaactccctgtac

SEQ ID NO: 568735 - DNA, 20 bp, Artificial Sequence
  chemically synthesized
aatctactgtacagggagtt

SEQ ID NO: 568736 - DNA, 20 bp, Artificial Sequence
  chemically synthesized
agtttaatgcttttcaaagt

SEQ ID NO: 568737 - DNA, 20 bp, Artificial Sequence
  chemically synthesized
cggattttattttttggaga

SEQ ID NO: 568738 - DNA, 20 bp, Artificial Sequence
  chemically synthesized
tttttggagagctcgattac

SEQ ID NO: 568739 - DNA, 20 bp, Artificial Sequence
  chemically synthesized
ttctttaatatttagttaaa

SEQ ID NO: 568740 - DNA, 20 bp, Artificial Sequence
  chemically synthesized
ttttcctgttttattctgag

SEQ ID NO: 568741 - DNA, 20 bp, Artificial Sequence
  chemically synthesized
actctcttttgttatttttt

SEQ ID NO: 568742 - DNA, 20 bp, Artificial Sequence
  chemically synthesized
ctgcctgaagacctcatttg

SEQ ID NO: 568743 - DNA, 20 bp, Artificial Sequence
  chemically synthesized
tcttcaggcagagggctgag

SEQ ID NO: 568744 - DNA, 20 bp, Artificial Sequence
  chemically synthesized
ttggccctgcctttgcacat

SEQ ID NO: 568745 - DNA, 20 bp, Artificial Sequence
  chemically synthesized
tctttagatgtcattattta

SEQ ID NO: 568746 - DNA, 20 bp, Artificial Sequence
  chemically synthesized
ggctaataggctgaatttga

SEQ ID NO: 568747 - DNA, 20 bp, Artificial Sequence
  chemically synthesized
actgttagagacagcataac

SEQ ID NO: 568748 - DNA, 20 bp, Artificial Sequence
  chemically synthesized
ctcattttcattttttttat

SEQ ID NO: 568749 - DNA, 20 bp, Artificial Sequence
  chemically synthesized
aaatgaggtgcatgtgacat

SEQ ID NO: 568750 - DNA, 20 bp, Artificial Sequence
  chemically synthesized
ggcagattttgagagtatca

SEQ ID NO: 568751 - DNA, 20 bp, Artificial Sequence
  chemically synthesized
aatgacatcgtactgattat

SEQ ID NO: 568752 - DNA, 20 bp, Artificial Sequence
  chemically synthesized
aatcctggaaaatgacatcg

SEQ ID NO: 568753 - DNA, 20 bp, Artificial Sequence
  chemically synthesized
aatcagtacgatgtcatttt

SEQ ID NO: 568754 - DNA, 20 bp, Artificial Sequence
  chemically synthesized
tgctcatcaacatcaaactt

SEQ ID NO: 568755 - DNA, 20 bp, Artificial Sequence
  chemically synthesized
attttaaaatttacaaacca

SEQ ID NO: 568756 - DNA, 20 bp, Artificial Sequence
  chemically synthesized
ttactttttaaacgttaaaa

SEQ ID NO: 568757 - DNA, 20 bp, Artificial Sequence
  chemically synthesized
gagattagaaaacatttttt

SEQ ID NO: 568758 - DNA, 20 bp, Artificial Sequence
  chemically synthesized
gggattggtgatgtcatata

SEQ ID NO: 568759 - DNA, 20 bp, Artificial Sequence
  chemically synthesized
atgacatcaccaatcccttc

SEQ ID NO: 568760 - DNA, 20 bp, Artificial Sequence
  chemically synthesized
aaactcagagaaaacatggg

SEQ ID NO: 568761 - DNA, 20 bp, Artificial Sequence
  chemically synthesized
aatcccttcccatgttttct

SEQ ID NO: 568762 - DNA, 20 bp, Artificial Sequence
  chemically synthesized
ttagggacgatcttaactca

SEQ ID NO: 568763 - DNA, 20 bp, Artificial Sequence
  chemically synthesized
aatatgagttaagatcgtcc

SEQ ID NO: 568764 - DNA, 20 bp, Artificial Sequence
  chemically synthesized
tgttactcagctttatggga

SEQ ID NO: 568765 - DNA, 20 bp, Artificial Sequence
  chemically synthesized
caaatctgaccaaaatgtta

SEQ ID NO: 568766 - DNA, 20 bp, Artificial Sequence
  chemically synthesized
taaagctgagtaacattttg

SEQ ID NO: 568767 - DNA, 20 bp, Artificial Sequence
  chemically synthesized
cttgctttttaggtaaatat

SEQ ID NO: 568768 - DNA, 20 bp, Artificial Sequence
  chemically synthesized
aaaatatttacctaaaaagc

SEQ ID NO: 568769 - DNA, 20 bp, Artificial Sequence
  chemically synthesized
tagtctgagacattcaaatc

SEQ ID NO: 568770 - DNA, 20 bp, Artificial Sequence
  chemically synthesized
gtagagaaatggttctttat

SEQ ID NO: 568771 - DNA, 20 bp, Artificial Sequence
  chemically synthesized
aggttagaggaaatttgtta

SEQ ID NO: 568772 - DNA, 20 bp, Artificial Sequence
  chemically synthesized
ttgttacattgctttttagc

SEQ ID NO: 568773 - DNA, 20 bp, Artificial Sequence
  chemically synthesized
ttgctttttagctgttgttt

SEQ ID NO: 568774 - DNA, 20 bp, Artificial Sequence
  chemically synthesized
aaaaggcactagctatgtta

SEQ ID NO: 568775 - DNA, 20 bp, Artificial Sequence
  chemically synthesized
agaaaacactgtagttttat

SEQ ID NO: 568776 - DNA, 20 bp, Artificial Sequence
  chemically synthesized
ataaagcaaaaataaaacta

SEQ ID NO: 568777 - DNA, 20 bp, Artificial Sequence
  chemically synthesized
ggtacaatattagaaaacac

SEQ ID NO: 568778 - DNA, 20 bp, Artificial Sequence
  chemically synthesized
gatgtaaattggagatttgc

SEQ ID NO: 568779 - DNA, 20 bp, Artificial Sequence
  chemically synthesized
ggcttgtgggtgatgtaaat

SEQ ID NO: 568780 - DNA, 20 bp, Artificial Sequence
  chemically synthesized
ttaaaatctgcaaaaatata

SEQ ID NO: 568781 - DNA, 20 bp, Artificial Sequence
  chemically synthesized
ccacaagccttctatatttt

SEQ ID NO: 568782 - DNA, 20 bp, Artificial Sequence
  chemically synthesized
tgttttgcacacgtcattac

SEQ ID NO: 568783 - DNA, 20 bp, Artificial Sequence
  chemically synthesized
aatgtaatgacgtgtgcaaa

SEQ ID NO: 568784 - DNA, 20 bp, Artificial Sequence
  chemically synthesized
taaagagcactttgagcaaa

SEQ ID NO: 568785 - DNA, 20 bp, Artificial Sequence
  chemically synthesized
aagtgctctttatagatgaa

SEQ ID NO: 568786 - DNA, 20 bp, Artificial Sequence
  chemically synthesized
agatcattcattggagggaa

SEQ ID NO: 568787 - DNA, 20 bp, Artificial Sequence
  chemically synthesized
aggaaggtagaggcacagag

SEQ ID NO: 568788 - DNA, 20 bp, Artificial Sequence
  chemically synthesized
ttgatgacaccggttatatt

SEQ ID NO: 568789 - DNA, 20 bp, Artificial Sequence
  chemically synthesized
tttcattttgcattggataa

SEQ ID NO: 568790 - DNA, 20 bp, Artificial Sequence
  chemically synthesized
taagactaataaagtcattt

SEQ ID NO: 568791 - DNA, 20 bp, Artificial Sequence
  chemically synthesized
tggatttactgctgttaaat

SEQ ID NO: 568792 - DNA, 20 bp, Artificial Sequence
  chemically synthesized
atttaacagcagtaaatcca

SEQ ID NO: 568793 - DNA, 20 bp, Artificial Sequence
  chemically synthesized
aaactgttttaccaaaacat

SEQ ID NO: 568794 - DNA, 20 bp, Artificial Sequence
  chemically synthesized
aatccagtatgttttggtaa

SEQ ID NO: 568795 - DNA, 20 bp, Artificial Sequence
  chemically synthesized
gtaagtagagcttctctgaa

SEQ ID NO: 568796 - DNA, 20 bp, Artificial Sequence
  chemically synthesized
ttcagagaagctctacttac

SEQ ID NO: 568797 - DNA, 20 bp, Artificial Sequence
  chemically synthesized
ttaggaaaagctaacgtaag

SEQ ID NO: 568798 - DNA, 20 bp, Artificial Sequence
  chemically synthesized
aaagaactgacactttgcag

SEQ ID NO: 568799 - DNA, 20 bp, Artificial Sequence
  chemically synthesized
ttcttcccaacacaaaattc

SEQ ID NO: 568800 - DNA, 20 bp, Artificial Sequence
  chemically synthesized
acataatcctcatgcatgat

SEQ ID NO: 568801 - DNA, 20 bp, Artificial Sequence
  chemically synthesized
ggaaaaacaaagatcatgca

SEQ ID NO: 568802 - DNA, 20 bp, Artificial Sequence
  chemically synthesized
atgaggattatgtgtgaggg

SEQ ID NO: 568803 - DNA, 20 bp, Artificial Sequence
  chemically synthesized
atgtgtgagggtatggattg

SEQ ID NO: 568804 - DNA, 20 bp, Artificial Sequence
  chemically synthesized
ggatttcaatcattatttta

SEQ ID NO: 568805 - DNA, 20 bp, Artificial Sequence
  chemically synthesized
tttagataagccttttaaaa

SEQ ID NO: 568806 - DNA, 20 bp, Artificial Sequence
  chemically synthesized
tgttctttgaaccaagtgga

SEQ ID NO: 568807 - DNA, 20 bp, Artificial Sequence
  chemically synthesized
gagtctgatttccaatttta

SEQ ID NO: 568808 - DNA, 20 bp, Artificial Sequence
  chemically synthesized
gttgaaaaaatgagttgaca

SEQ ID NO: 568809 - DNA, 20 bp, Artificial Sequence
  chemically synthesized
taaagatcaatggaatttct

SEQ ID NO: 568810 - DNA, 20 bp, Artificial Sequence
  chemically synthesized
actaaagaattttgcctaat

SEQ ID NO: 568811 - DNA, 20 bp, Artificial Sequence
  chemically synthesized
ttagtgaaagaactcagaga

SEQ ID NO: 568812 - DNA, 20 bp, Artificial Sequence
  chemically synthesized
aagataaaatggaaatattt

SEQ ID NO: 568813 - DNA, 20 bp, Artificial Sequence
  chemically synthesized
tgcaggattctggggtaggg

SEQ ID NO: 568814 - DNA, 20 bp, Artificial Sequence
  chemically synthesized
ataaccattcacattcttat

SEQ ID NO: 568815 - DNA, 20 bp, Artificial Sequence
  chemically synthesized
ctgcataagaatgtgaatgg

SEQ ID NO: 568816 - DNA, 20 bp, Artificial Sequence
  chemically synthesized
ataagaatgtgaatggttat

SEQ ID NO: 568817 - DNA, 20 bp, Artificial Sequence
  chemically synthesized
gttatgtttgtttgcgcaga

SEQ ID NO: 568818 - DNA, 20 bp, Artificial Sequence
  chemically synthesized
cgcagatggggtttatattt

SEQ ID NO: 568819 - DNA, 20 bp, Artificial Sequence
  chemically synthesized
gataatgactacatttgtat

SEQ ID NO: 568820 - DNA, 20 bp, Artificial Sequence
  chemically synthesized
caagtagatttggccatatt

SEQ ID NO: 568821 - DNA, 20 bp, Artificial Sequence
  chemically synthesized
ataatttaaggtagggggca

SEQ ID NO: 568822 - DNA, 20 bp, Artificial Sequence
  chemically synthesized
cttgccccctaccttaaatt

SEQ ID NO: 568823 - DNA, 20 bp, Artificial Sequence
  chemically synthesized
ttagaatatttctctttttt

SEQ ID NO: 568824 - DNA, 20 bp, Artificial Sequence
  chemically synthesized
tattttcatgaattgatagc

SEQ ID NO: 568825 - DNA, 20 bp, Artificial Sequence
  chemically synthesized
ttcatgaaaatattaattat

SEQ ID NO: 568826 - DNA, 20 bp, Artificial Sequence
  chemically synthesized
taattataaaagttttatac

SEQ ID NO: 568827 - DNA, 20 bp, Artificial Sequence
  chemically synthesized
gatttggtcctcataactgc

SEQ ID NO: 568828 - DNA, 20 bp, Artificial Sequence
  chemically synthesized
tggtctatatttcaccttca

SEQ ID NO: 568829 - DNA, 20 bp, Artificial Sequence
  chemically synthesized
atcatgatttattttctaat

SEQ ID NO: 568830 - DNA, 20 bp, Artificial Sequence
  chemically synthesized
atgttttatgattctcaaca

SEQ ID NO: 568831 - DNA, 20 bp, Artificial Sequence
  chemically synthesized
caaaatttagcacacatgtt

SEQ ID NO: 568832 - DNA, 20 bp, Artificial Sequence
  chemically synthesized
ctgttcccaaaatttagcac

SEQ ID NO: 568833 - DNA, 20 bp, Artificial Sequence
  chemically synthesized
gatctagcagataaagaaaa

SEQ ID NO: 568834 - DNA, 20 bp, Artificial Sequence
  chemically synthesized
tgtcttgagcttgttcatcc

SEQ ID NO: 568835 - DNA, 20 bp, Artificial Sequence
  chemically synthesized
ggtatgctaccacacatgtc

SEQ ID NO: 568836 - DNA, 20 bp, Artificial Sequence
  chemically synthesized
aatgcatccatgagtcaact

SEQ ID NO: 568837 - DNA, 20 bp, Artificial Sequence
  chemically synthesized
tagtaatgcatccatgagtc

SEQ ID NO: 568838 - DNA, 20 bp, Artificial Sequence
  chemically synthesized
tagaatattttcaacttatg

SEQ ID NO: 568839 - DNA, 20 bp, Artificial Sequence
  chemically synthesized
taggctgagctatgatgttg

SEQ ID NO: 568840 - DNA, 20 bp, Artificial Sequence
  chemically synthesized
ggctaacgtaagtgttctga

SEQ ID NO: 568841 - DNA, 20 bp, Artificial Sequence
  chemically synthesized
tataaaataggctttgtgtt

SEQ ID NO: 568842 - DNA, 20 bp, Artificial Sequence
  chemically synthesized
attcaatgctttagtataaa

SEQ ID NO: 568843 - DNA, 20 bp, Artificial Sequence
  chemically synthesized
aataaattacatgagctatt

SEQ ID NO: 568844 - DNA, 20 bp, Artificial Sequence
  chemically synthesized
ttcaggtatccacacaaccc

SEQ ID NO: 568845 - DNA, 20 bp, Artificial Sequence
  chemically synthesized
ggttgtgtggatacctgaag

SEQ ID NO: 568846 - DNA, 20 bp, Artificial Sequence
  chemically synthesized
ctgacttacaatggttggat

SEQ ID NO: 568847 - DNA, 20 bp, Artificial Sequence
  chemically synthesized
atgatccctgacttacaatg

SEQ ID NO: 568848 - DNA, 20 bp, Artificial Sequence
  chemically synthesized
cattgtaagtcagggatcat

SEQ ID NO: 568849 - DNA, 20 bp, Artificial Sequence
  chemically synthesized
gtaagtcagggatcatctat

SEQ ID NO: 568850 - DNA, 20 bp, Artificial Sequence
  chemically synthesized
tctattctttcctcatttgc

SEQ ID NO: 568851 - DNA, 20 bp, Artificial Sequence
  chemically synthesized
ctgtctgaagatcctatcac

SEQ ID NO: 568852 - DNA, 20 bp, Artificial Sequence
  chemically synthesized
taaatgcctatgctgaactt

SEQ ID NO: 568853 - DNA, 20 bp, Artificial Sequence
  chemically synthesized
gcagttcttaaagaaggagt

SEQ ID NO: 568854 - DNA, 20 bp, Artificial Sequence
  chemically synthesized
gttattgcagttcttaaaga

SEQ ID NO: 568855 - DNA, 20 bp, Artificial Sequence
  chemically synthesized
ctttaagaactgcaataacg

SEQ ID NO: 568856 - DNA, 20 bp, Artificial Sequence
  chemically synthesized
ttgggaggctgaggtgggag

SEQ ID NO: 568857 - DNA, 20 bp, Artificial Sequence
  chemically synthesized
agccacctcctctggccaag

SEQ ID NO: 568858 - DNA, 20 bp, Artificial Sequence
  chemically synthesized
ctctggccaagaactgtttc

SEQ ID NO: 568859 - DNA, 20 bp, Artificial Sequence
  chemically synthesized
actccaactttccttaaaga

SEQ ID NO: 568860 - DNA, 20 bp, Artificial Sequence
  chemically synthesized
gcttccttaaagataaatct

SEQ ID NO: 568861 - DNA, 20 bp, Artificial Sequence
  chemically synthesized
tgtgtgtgtgtgtttaagcc

SEQ ID NO: 568862 - DNA, 20 bp, Artificial Sequence
  chemically synthesized
gtgtgtgtgtgtgtgtgtgt

SEQ ID NO: 568863 - DNA, 20 bp, Artificial Sequence
  chemically synthesized
ctcctcctgtccctcttaca

SEQ ID NO: 568864 - DNA, 20 bp, Artificial Sequence
  chemically synthesized
tttatcacacatcgtgtaga

SEQ ID NO: 568865 - DNA, 20 bp, Artificial Sequence
  chemically synthesized
cctacgtacattggcagact

SEQ ID NO: 568866 - DNA, 20 bp, Artificial Sequence
  chemically synthesized
tagcattttaaagacattga

SEQ ID NO: 568867 - DNA, 20 bp, Artificial Sequence
  chemically synthesized
tattgcagatggccctcttt

SEQ ID NO: 568868 - DNA, 20 bp, Artificial Sequence
  chemically synthesized
tttctccatctgtgacccag

SEQ ID NO: 568869 - DNA, 20 bp, Artificial Sequence
  chemically synthesized
agccattttcatgttaatgt

SEQ ID NO: 568870 - DNA, 20 bp, Artificial Sequence
  chemically synthesized
ctccaatggccctctttgtt

SEQ ID NO: 568871 - DNA, 20 bp, Artificial Sequence
  chemically synthesized
tcttctccaatggccctctt

SEQ ID NO: 568872 - DNA, 20 bp, Artificial Sequence
  chemically synthesized
ggccattctgcttattatat

SEQ ID NO: 568873 - DNA, 20 bp, Artificial Sequence
  chemically synthesized
aaacagatggcttggggcca

SEQ ID NO: 568874 - DNA, 20 bp, Artificial Sequence
  chemically synthesized
aagcagaatggccccaagcc

SEQ ID NO: 568875 - DNA, 20 bp, Artificial Sequence
  chemically synthesized
ggccccaagccatctgtttt

SEQ ID NO: 568876 - DNA, 20 bp, Artificial Sequence
  chemically synthesized
tatggtaagctttaaaaaca

SEQ ID NO: 568877 - DNA, 20 bp, Artificial Sequence
  chemically synthesized
gtcctaacagcctaaatatg

SEQ ID NO: 568878 - DNA, 20 bp, Artificial Sequence
  chemically synthesized
ctgacaatggtttaatttgt

SEQ ID NO: 568879 - DNA, 20 bp, Artificial Sequence
  chemically synthesized
ttatgataaaaattactgac

SEQ ID NO: 568880 - DNA, 20 bp, Artificial Sequence
  chemically synthesized
tgtcagtaatttttatcata

SEQ ID NO: 568881 - DNA, 20 bp, Artificial Sequence
  chemically synthesized
gtcagatttgggagcattag

SEQ ID NO: 568882 - DNA, 20 bp, Artificial Sequence
  chemically synthesized
aagaaacatttttttaaata

SEQ ID NO: 568883 - DNA, 20 bp, Artificial Sequence
  chemically synthesized
ccaaatctgactatttaaaa

SEQ ID NO: 568884 - DNA, 20 bp, Artificial Sequence
  chemically synthesized
tagggttcacagtcttaaaa

SEQ ID NO: 568885 - DNA, 20 bp, Artificial Sequence
  chemically synthesized
cttaaaatgaggattttaga

SEQ ID NO: 568886 - DNA, 20 bp, Artificial Sequence
  chemically synthesized
tcattaacgctctcctctaa

SEQ ID NO: 568887 - DNA, 20 bp, Artificial Sequence
  chemically synthesized
tctaaaatagtttcagtctt

SEQ ID NO: 568888 - DNA, 20 bp, Artificial Sequence
  chemically synthesized
ccaaaattagaactttatcc

SEQ ID NO: 568889 - DNA, 20 bp, Artificial Sequence
  chemically synthesized
ggagataaagagggaagaaa

SEQ ID NO: 568890 - DNA, 20 bp, Artificial Sequence
  chemically synthesized
aaagagggaagaaaaaaagt

SEQ ID NO: 568891 - DNA, 20 bp, Artificial Sequence
  chemically synthesized
taggctcatgatatgccagc

SEQ ID NO: 568892 - DNA, 20 bp, Artificial Sequence
  chemically synthesized
cagtatgtttttgtttttta

SEQ ID NO: 568893 - DNA, 20 bp, Artificial Sequence
  chemically synthesized
tttccaaagttccagtatgt

SEQ ID NO: 568894 - DNA, 20 bp, Artificial Sequence
  chemically synthesized
atttattttccaaagttcca

SEQ ID NO: 568895 - DNA, 20 bp, Artificial Sequence
  chemically synthesized
attcttcctattttcatttc

SEQ ID NO: 568896 - DNA, 20 bp, Artificial Sequence
  chemically synthesized
gaagaatattaatattcaga

SEQ ID NO: 568897 - DNA, 20 bp, Artificial Sequence
  chemically synthesized
aatattaatattcagaagct

SEQ ID NO: 568898 - DNA, 20 bp, Artificial Sequence
  chemically synthesized
atctggctaatacataatca

SEQ ID NO: 568899 - DNA, 20 bp, Artificial Sequence
  chemically synthesized
tcagtggctcattatcaccc

SEQ ID NO: 568900 - DNA, 20 bp, Artificial Sequence
  chemically synthesized
ggtgataatgagccactgaa

SEQ ID NO: 568901 - DNA, 20 bp, Artificial Sequence
  chemically synthesized
ttagcctttagaagcataag

SEQ ID NO: 568902 - DNA, 20 bp, Artificial Sequence
  chemically synthesized
agcaggtgaaaaaacttagc

SEQ ID NO: 568903 - DNA, 20 bp, Artificial Sequence
  chemically synthesized
agcataagctaagttttttc

SEQ ID NO: 568904 - DNA, 20 bp, Artificial Sequence
  chemically synthesized
ctgagaagcaggtgaaaaaa

SEQ ID NO: 568905 - DNA, 20 bp, Artificial Sequence
  chemically synthesized
tatcactcatgccagaagta

SEQ ID NO: 568906 - DNA, 20 bp, Artificial Sequence
  chemically synthesized
aaaaacagcatcaaaatatg

SEQ ID NO: 568907 - DNA, 20 bp, Artificial Sequence
  chemically synthesized
aaaagcttttcatattttga

SEQ ID NO: 568908 - DNA, 20 bp, Artificial Sequence
  chemically synthesized
tgtttttgccttcaggaaag

SEQ ID NO: 568909 - DNA, 20 bp, Artificial Sequence
  chemically synthesized
gggaatattggtgttcaaag

SEQ ID NO: 568910 - DNA, 20 bp, Artificial Sequence
  chemically synthesized
ctttgaacaccaatattccc

SEQ ID NO: 568911 - DNA, 20 bp, Artificial Sequence
  chemically synthesized
aaaccaagtgcatctgacat

SEQ ID NO: 568912 - DNA, 20 bp, Artificial Sequence
  chemically synthesized
aagctaagatgtcagatgca

SEQ ID NO: 568913 - DNA, 20 bp, Artificial Sequence
  chemically synthesized
cactggctcatcttgtgctc

SEQ ID NO: 568914 - DNA, 20 bp, Artificial Sequence
  chemically synthesized
tttcttttgaaagaatttgt

SEQ ID NO: 568915 - DNA, 20 bp, Artificial Sequence
  chemically synthesized
gtagaaatataaattataaa

SEQ ID NO: 568916 - DNA, 20 bp, Artificial Sequence
  chemically synthesized
ttaaataggtttcaataaaa

SEQ ID NO: 568917 - DNA, 20 bp, Artificial Sequence
  chemically synthesized
catatatattgtcattttaa

SEQ ID NO: 568918 - DNA, 20 bp, Artificial Sequence
  chemically synthesized
acaatatatatgcacacttg

SEQ ID NO: 568919 - DNA, 20 bp, Artificial Sequence
  chemically synthesized
atacaattcagagcaccaaa

SEQ ID NO: 568920 - DNA, 20 bp, Artificial Sequence
  chemically synthesized
gaattgtattaaagtcacca

SEQ ID NO: 568921 - DNA, 20 bp, Artificial Sequence
  chemically synthesized
ttctcaaagtgtggttggtc

SEQ ID NO: 568922 - DNA, 20 bp, Artificial Sequence
  chemically synthesized
ttagacccactggctcataa

SEQ ID NO: 568923 - DNA, 20 bp, Artificial Sequence
  chemically synthesized
ggctcataatctggatttta

SEQ ID NO: 568924 - DNA, 20 bp, Artificial Sequence
  chemically synthesized
gtctgggaatcttgttaaaa

SEQ ID NO: 568925 - DNA, 20 bp, Artificial Sequence
  chemically synthesized
atttgagaagcaatgttcct

SEQ ID NO: 568926 - DNA, 20 bp, Artificial Sequence
  chemically synthesized
tctgattaagctcacaggaa

SEQ ID NO: 568927 - DNA, 20 bp, Artificial Sequence
  chemically synthesized
cgtgtagaaagaaagagagg

SEQ ID NO: 568928 - DNA, 20 bp, Artificial Sequence
  chemically synthesized
cagatcctctctttctttct

SEQ ID NO: 568929 - DNA, 20 bp, Artificial Sequence
  chemically synthesized
acagagtctcactctgttac

SEQ ID NO: 568930 - DNA, 20 bp, Artificial Sequence
  chemically synthesized
ccgagatcacgccgctgcac

SEQ ID NO: 568931 - DNA, 20 bp, Artificial Sequence
  chemically synthesized
aacctccgcctcccatgttc

SEQ ID NO: 568932 - DNA, 20 bp, Artificial Sequence
  chemically synthesized
agtgattctcataactcagc

SEQ ID NO: 568933 - DNA, 20 bp, Artificial Sequence
  chemically synthesized
aactcagcctgggattacag

SEQ ID NO: 568934 - DNA, 20 bp, Artificial Sequence
  chemically synthesized
gcatgtgccgccatgcccgg

SEQ ID NO: 568935 - DNA, 20 bp, Artificial Sequence
  chemically synthesized
gttttgtatttttagtagag

SEQ ID NO: 568936 - DNA, 20 bp, Artificial Sequence
  chemically synthesized
gccaggctggtctaaacctc

SEQ ID NO: 568937 - DNA, 20 bp, Artificial Sequence
  chemically synthesized
gggcagatcgcttaatccca

SEQ ID NO: 568938 - DNA, 20 bp, Artificial Sequence
  chemically synthesized
ttgggaggccgaggagggca

SEQ ID NO: 568939 - DNA, 20 bp, Artificial Sequence
  chemically synthesized
cctcggcctcccaaagcctg

SEQ ID NO: 568940 - DNA, 20 bp, Artificial Sequence
  chemically synthesized
tcccaaagcctgttgggatt

SEQ ID NO: 568941 - DNA, 20 bp, Artificial Sequence
  chemically synthesized
ggcttaagcctgtaatccca

SEQ ID NO: 568942 - DNA, 20 bp, Artificial Sequence
  chemically synthesized
ggagaaacagggacaggcat

SEQ ID NO: 568943 - DNA, 20 bp, Artificial Sequence
  chemically synthesized
gcttaagccaccatgcctgt

SEQ ID NO: 568944 - DNA, 20 bp, Artificial Sequence
  chemically synthesized
tgtttctccactttgtattg

SEQ ID NO: 568945 - DNA, 20 bp, Artificial Sequence
  chemically synthesized
ggaatgcttttatttgaata

SEQ ID NO: 568946 - DNA, 20 bp, Artificial Sequence
  chemically synthesized
aaaacccaggcctcctaggc

SEQ ID NO: 568947 - DNA, 20 bp, Artificial Sequence
  chemically synthesized
caaaccacagcctaggaggc

SEQ ID NO: 568948 - DNA, 20 bp, Artificial Sequence
  chemically synthesized
acacaggttgaacataaaga

SEQ ID NO: 568949 - DNA, 20 bp, Artificial Sequence
  chemically synthesized
ttttggcagacagagaaatt

SEQ ID NO: 568950 - DNA, 20 bp, Artificial Sequence
  chemically synthesized
gttgtgggagtagaaggatt

SEQ ID NO: 568951 - DNA, 20 bp, Artificial Sequence
  chemically synthesized
tctcttgcgttgtgggagta

SEQ ID NO: 568952 - DNA, 20 bp, Artificial Sequence
  chemically synthesized
ccagttacttgccacttaga

SEQ ID NO: 568953 - DNA, 20 bp, Artificial Sequence
  chemically synthesized
tatctgcagttgttccaagt

SEQ ID NO: 568954 - DNA, 20 bp, Artificial Sequence
  chemically synthesized
cacaagttgttttctcctgt

SEQ ID NO: 568955 - DNA, 20 bp, Artificial Sequence
  chemically synthesized
tttcaatcttgagctgcaca

SEQ ID NO: 568956 - DNA, 20 bp, Artificial Sequence
  chemically synthesized
gagaaaacaacttgtgcagc

SEQ ID NO: 568957 - DNA, 20 bp, Artificial Sequence
  chemically synthesized
gattgaaagaaagcacaatg

SEQ ID NO: 568958 - DNA, 20 bp, Artificial Sequence
  chemically synthesized
gttttaattgaatctcctca

SEQ ID NO: 568959 - DNA, 20 bp, Artificial Sequence
  chemically synthesized
tatgctttcttctcccatca

SEQ ID NO: 568960 - DNA, 20 bp, Artificial Sequence
  chemically synthesized
tatacctgtcctcctataga

SEQ ID NO: 568961 - DNA, 20 bp, Artificial Sequence
  chemically synthesized
aggatttatacctgtcctcc

SEQ ID NO: 568962 - DNA, 20 bp, Artificial Sequence
  chemically synthesized
gacaggtataaatcctcttt

SEQ ID NO: 568963 - DNA, 20 bp, Artificial Sequence
  chemically synthesized
agactggacaaatcagaaaa

SEQ ID NO: 568964 - DNA, 20 bp, Artificial Sequence
  chemically synthesized
atttgtccagtctctactaa

SEQ ID NO: 568965 - DNA, 20 bp, Artificial Sequence
  chemically synthesized
gcatggcaaaggattctgat

SEQ ID NO: 568966 - DNA, 20 bp, Artificial Sequence
  chemically synthesized
atgcctataactagcatggc

SEQ ID NO: 568967 - DNA, 20 bp, Artificial Sequence
  chemically synthesized
tttatttacattttttaatt

SEQ ID NO: 568968 - DNA, 20 bp, Artificial Sequence
  chemically synthesized
ttatatgcttttatgtataa

SEQ ID NO: 568969 - DNA, 20 bp, Artificial Sequence
  chemically synthesized
ttgctgtacacgtaattgaa

SEQ ID NO: 568970 - DNA, 20 bp, Artificial Sequence
  chemically synthesized
gggaggttttaaggcaccag

SEQ ID NO: 568971 - DNA, 20 bp, Artificial Sequence
  chemically synthesized
tttgaaggagtctttaattg

SEQ ID NO: 568972 - DNA, 20 bp, Artificial Sequence
  chemically synthesized
ctccagtcaaagacaccaat

SEQ ID NO: 568973 - DNA, 20 bp, Artificial Sequence
  chemically synthesized
ggttatcattttgaggacag

SEQ ID NO: 568974 - DNA, 20 bp, Artificial Sequence
  chemically synthesized
cctcaaaatgataaccagtg

SEQ ID NO: 568975 - DNA, 20 bp, Artificial Sequence
  chemically synthesized
cacagtcaattggcttggga

SEQ ID NO: 568976 - DNA, 20 bp, Artificial Sequence
  chemically synthesized
gtggaattggcacacagtca

SEQ ID NO: 568977 - DNA, 20 bp, Artificial Sequence
  chemically synthesized
cccttggttgaagggagaga

SEQ ID NO: 568978 - DNA, 20 bp, Artificial Sequence
  chemically synthesized
tggttgaagggagagaaaat

SEQ ID NO: 568979 - DNA, 20 bp, Artificial Sequence
  chemically synthesized
tctgtttcttctgcttccac

SEQ ID NO: 568980 - DNA, 20 bp, Artificial Sequence
  chemically synthesized
actttttttttgtctgtttc

SEQ ID NO: 568981 - DNA, 20 bp, Artificial Sequence
  chemically synthesized
cccgcccccacttttttttt

SEQ ID NO: 568982 - DNA, 20 bp, Artificial Sequence
  chemically synthesized
cttttgatgttctatttccc

SEQ ID NO: 568983 - DNA, 20 bp, Artificial Sequence
  chemically synthesized
aaaagaacacgccagtattt

SEQ ID NO: 568984 - DNA, 20 bp, Artificial Sequence
  chemically synthesized
acacgccagtatttttgggt

SEQ ID NO: 568985 - DNA, 20 bp, Artificial Sequence
  chemically synthesized
tcccacagacttaactggtg

SEQ ID NO: 568986 - DNA, 20 bp, Artificial Sequence
  chemically synthesized
ttggcctacctgccctaagt

SEQ ID NO: 568987 - DNA, 20 bp, Artificial Sequence
  chemically synthesized
tggtatcttcaatctttttc

SEQ ID NO: 568988 - DNA, 20 bp, Artificial Sequence
  chemically synthesized
gcctaaatttaagcctttga

SEQ ID NO: 568989 - DNA, 20 bp, Artificial Sequence
  chemically synthesized
cagctggggctcaacgattg

SEQ ID NO: 568990 - DNA, 20 bp, Artificial Sequence
  chemically synthesized
aaatttagtcagctggggct

SEQ ID NO: 568991 - DNA, 20 bp, Artificial Sequence
  chemically synthesized
aattgtcgggaacataccca

SEQ ID NO: 568992 - DNA, 20 bp, Artificial Sequence
  chemically synthesized
ggactatagccgttatctta

SEQ ID NO: 568993 - DNA, 20 bp, Artificial Sequence
  chemically synthesized
gacttatagggccatgtaga

SEQ ID NO: 568994 - DNA, 20 bp, Artificial Sequence
  chemically synthesized
cagagacatgaagacgaacc

SEQ ID NO: 568995 - DNA, 20 bp, Artificial Sequence
  chemically synthesized
gacgaaccaagagattttat

SEQ ID NO: 568996 - DNA, 20 bp, Artificial Sequence
  chemically synthesized
gtctatgtaattaagtcacc

SEQ ID NO: 568997 - DNA, 20 bp, Artificial Sequence
  chemically synthesized
gacaactgacaactttggag

SEQ ID NO: 568998 - DNA, 20 bp, Artificial Sequence
  chemically synthesized
aatgactgagagcagcacta

SEQ ID NO: 568999 - DNA, 20 bp, Artificial Sequence
  chemically synthesized
gtgctgctctcagtcattca

SEQ ID NO: 569000 - DNA, 20 bp, Artificial Sequence
  chemically synthesized
ctctcagtcattcaattagt

SEQ ID NO: 569001 - DNA, 20 bp, Artificial Sequence
  chemically synthesized
agattttggattattctatt

SEQ ID NO: 569002 - DNA, 20 bp, Artificial Sequence
  chemically synthesized
aaaaaacctaaaaataagat

SEQ ID NO: 569003 - DNA, 20 bp, Artificial Sequence
  chemically synthesized
aataatccaaaatcttattt

SEQ ID NO: 569004 - DNA, 20 bp, Artificial Sequence
  chemically synthesized
tatatacaaaaaacctaaaa

SEQ ID NO: 569005 - DNA, 20 bp, Artificial Sequence
  chemically synthesized
ttaaccctctctgtcaacat

SEQ ID NO: 569006 - DNA, 20 bp, Artificial Sequence
  chemically synthesized
cgcctcgacctcccaacgtg

SEQ ID NO: 569007 - DNA, 20 bp, Artificial Sequence
  chemically synthesized
cgggtggatcatctaaggcc

SEQ ID NO: 569008 - DNA, 20 bp, Artificial Sequence
  chemically synthesized
tttttgtatttttatagaga

SEQ ID NO: 569009 - DNA, 20 bp, Artificial Sequence
  chemically synthesized
cgcctcagcctctcgagtgg

SEQ ID NO: 569010 - DNA, 20 bp, Artificial Sequence
  chemically synthesized
aacctccacctgctgggttc

SEQ ID NO: 569011 - DNA, 20 bp, Artificial Sequence
  chemically synthesized
tttgatttttttttttttga

SEQ ID NO: 569012 - DNA, 20 bp, Artificial Sequence
  chemically synthesized
tggtatatcagagtgttaaa

SEQ ID NO: 569013 - DNA, 20 bp, Artificial Sequence
  chemically synthesized
aattgacaacgcaaatacaa

SEQ ID NO: 569014 - DNA, 20 bp, Artificial Sequence
  chemically synthesized
acattctgtttacttttaaa

SEQ ID NO: 569015 - DNA, 20 bp, Artificial Sequence
  chemically synthesized
tcaaattttaaaagtaaaca

SEQ ID NO: 569016 - DNA, 20 bp, Artificial Sequence
  chemically synthesized
ataaaacataactttaaaca

SEQ ID NO: 569017 - DNA, 20 bp, Artificial Sequence
  chemically synthesized
agtaaacagaatgtttaaag

SEQ ID NO: 569018 - DNA, 20 bp, Artificial Sequence
  chemically synthesized
aatgtttaaagttatgtttt

SEQ ID NO: 569019 - DNA, 20 bp, Artificial Sequence
  chemically synthesized
gtcttatattttgctgttca

SEQ ID NO: 569020 - DNA, 20 bp, Artificial Sequence
  chemically synthesized
gttcatagaggagacagctc

SEQ ID NO: 569021 - DNA, 20 bp, Artificial Sequence
  chemically synthesized
aactgtaagtctggaagtct

SEQ ID NO: 569022 - DNA, 20 bp, Artificial Sequence
  chemically synthesized
cagacttacagttagaaaat

SEQ ID NO: 569023 - DNA, 20 bp, Artificial Sequence
  chemically synthesized
acttattatttcaatacatt

SEQ ID NO: 569024 - DNA, 20 bp, Artificial Sequence
  chemically synthesized
gaatatcgtaaaatatgtag

SEQ ID NO: 569025 - DNA, 20 bp, Artificial Sequence
  chemically synthesized
aattagcagttatttaattt

SEQ ID NO: 569026 - DNA, 20 bp, Artificial Sequence
  chemically synthesized
aaataactgctaatttattt

SEQ ID NO: 569027 - DNA, 20 bp, Artificial Sequence
  chemically synthesized
atatttgatatatagttaag

SEQ ID NO: 569028 - DNA, 20 bp, Artificial Sequence
  chemically synthesized
tatagtcacttaggttatta

SEQ ID NO: 569029 - DNA, 20 bp, Artificial Sequence
  chemically synthesized
tcgggaggctgaggcatgag

SEQ ID NO: 569030 - DNA, 20 bp, Artificial Sequence
  chemically synthesized
tgcctcagcctcccgagtag

SEQ ID NO: 569031 - DNA, 20 bp, Artificial Sequence
  chemically synthesized
aggtgcacgccaccatgcct

SEQ ID NO: 569032 - DNA, 20 bp, Artificial Sequence
  chemically synthesized
ttttatatttttagtagaga

SEQ ID NO: 569033 - DNA, 20 bp, Artificial Sequence
  chemically synthesized
ttgggaggccgaggcgggta

SEQ ID NO: 569034 - DNA, 20 bp, Artificial Sequence
  chemically synthesized
cactttgggaggccgaggcg

SEQ ID NO: 569035 - DNA, 20 bp, Artificial Sequence
  chemically synthesized
tccaggaaaaattcaggaaa

SEQ ID NO: 569036 - DNA, 20 bp, Artificial Sequence
  chemically synthesized
acctcatcctgaaaatagct

SEQ ID NO: 569037 - DNA, 20 bp, Artificial Sequence
  chemically synthesized
ttgcaaattgtatttagttg

SEQ ID NO: 569038 - DNA, 20 bp, Artificial Sequence
  chemically synthesized
ctaaatacaatttgcaaata

SEQ ID NO: 569039 - DNA, 20 bp, Artificial Sequence
  chemically synthesized
atacaatttgcaaatatttt

SEQ ID NO: 569040 - DNA, 20 bp, Artificial Sequence
  chemically synthesized
ctacctgcctagtatggcag

SEQ ID NO: 569041 - DNA, 20 bp, Artificial Sequence
  chemically synthesized
ggattaagatcctatatata

SEQ ID NO: 569042 - DNA, 20 bp, Artificial Sequence
  chemically synthesized
ttgcagggaattcagattgc

SEQ ID NO: 569043 - DNA, 20 bp, Artificial Sequence
  chemically synthesized
cttttaatttttgcagggaa

SEQ ID NO: 569044 - DNA, 20 bp, Artificial Sequence
  chemically synthesized
tgtttgtttgtttgcttttg

SEQ ID NO: 569045 - DNA, 20 bp, Artificial Sequence
  chemically synthesized
gattttttgtttgtttgttt

SEQ ID NO: 569046 - DNA, 20 bp, Artificial Sequence
  chemically synthesized
actggattttttgtttgttt

SEQ ID NO: 569047 - DNA, 20 bp, Artificial Sequence
  chemically synthesized
agttactggattttttgttt

SEQ ID NO: 569048 - DNA, 20 bp, Artificial Sequence
  chemically synthesized
ttcaagttactggatttttt

SEQ ID NO: 569049 - DNA, 20 bp, Artificial Sequence
  chemically synthesized
tcatttcaagttactggatt

SEQ ID NO: 569050 - DNA, 20 bp, Artificial Sequence
  chemically synthesized
tggtagtctcatttcaagtt

SEQ ID NO: 569051 - DNA, 20 bp, Artificial Sequence
  chemically synthesized
agtaacttgaaatgagacta

SEQ ID NO: 569052 - DNA, 20 bp, Artificial Sequence
  chemically synthesized
acttgaaatgagactaccag

SEQ ID NO: 569053 - DNA, 20 bp, Artificial Sequence
  chemically synthesized
ggctatgaactaagcaattt

SEQ ID NO: 569054 - DNA, 20 bp, Artificial Sequence
  chemically synthesized
gtcctcactccaagctttaa

SEQ ID NO: 569055 - DNA, 20 bp, Artificial Sequence
  chemically synthesized
tgacttaaattgtcctcact

SEQ ID NO: 569056 - DNA, 20 bp, Artificial Sequence
  chemically synthesized
gtgaggacaatttaagtcaa

SEQ ID NO: 569057 - DNA, 20 bp, Artificial Sequence
  chemically synthesized
gtcttgtggacattccaaaa

SEQ ID NO: 569058 - DNA, 20 bp, Artificial Sequence
  chemically synthesized
tagaatattttcatttactc

SEQ ID NO: 569059 - DNA, 20 bp, Artificial Sequence
  chemically synthesized
aatttaccatattaaaaaag

SEQ ID NO: 569060 - DNA, 20 bp, Artificial Sequence
  chemically synthesized
catttaatttaccatattaa

SEQ ID NO: 569061 - DNA, 20 bp, Artificial Sequence
  chemically synthesized
atggaattatatctgtgcta

SEQ ID NO: 569062 - DNA, 20 bp, Artificial Sequence
  chemically synthesized
ccaaatttagcccaaagtct

SEQ ID NO: 569063 - DNA, 20 bp, Artificial Sequence
  chemically synthesized
gggctaaatttggcatgcac

SEQ ID NO: 569064 - DNA, 20 bp, Artificial Sequence
  chemically synthesized
aaatttggcatgcacaaatg

SEQ ID NO: 569065 - DNA, 20 bp, Artificial Sequence
  chemically synthesized
caaatgttttgattagccca

SEQ ID NO: 569066 - DNA, 20 bp, Artificial Sequence
  chemically synthesized
aatatttaaatgttgagtaa

SEQ ID NO: 569067 - DNA, 20 bp, Artificial Sequence
  chemically synthesized
tttaaatgagaagtcagaag

SEQ ID NO: 569068 - DNA, 20 bp, Artificial Sequence
  chemically synthesized
tctgacttctcatttaaaag

SEQ ID NO: 569069 - DNA, 20 bp, Artificial Sequence
  chemically synthesized
ccctaccagctcccattaac

SEQ ID NO: 569070 - DNA, 20 bp, Artificial Sequence
  chemically synthesized
gctagcccctctgttggcat

SEQ ID NO: 569071 - DNA, 20 bp, Artificial Sequence
  chemically synthesized
tggcatttcagtttgcaacc

SEQ ID NO: 569072 - DNA, 20 bp, Artificial Sequence
  chemically synthesized
ttaaagcacactaagatact

SEQ ID NO: 569073 - DNA, 20 bp, Artificial Sequence
  chemically synthesized
agcaatcttagagtatctta

SEQ ID NO: 569074 - DNA, 20 bp, Artificial Sequence
  chemically synthesized
agtgggaaaatttataatta

SEQ ID NO: 569075 - DNA, 20 bp, Artificial Sequence
  chemically synthesized
gattggtatttctgccagtg

SEQ ID NO: 569076 - DNA, 20 bp, Artificial Sequence
  chemically synthesized
tagtctctggaagagtttct

SEQ ID NO: 569077 - DNA, 20 bp, Artificial Sequence
  chemically synthesized
ttgcctcttctagtctctgg

SEQ ID NO: 569078 - DNA, 20 bp, Artificial Sequence
  chemically synthesized
cttccagagactagaagagg

SEQ ID NO: 569079 - DNA, 20 bp, Artificial Sequence
  chemically synthesized
aggtttggtatgtggattat

SEQ ID NO: 569080 - DNA, 20 bp, Artificial Sequence
  chemically synthesized
attcttgtcaaggtttggta

SEQ ID NO: 569081 - DNA, 20 bp, Artificial Sequence
  chemically synthesized
tattggtctgccattcttgt

SEQ ID NO: 569082 - DNA, 20 bp, Artificial Sequence
  chemically synthesized
ttcctttagagttattgcat

SEQ ID NO: 569083 - DNA, 20 bp, Artificial Sequence
  chemically synthesized
ctatcaaatgaattctaaat

SEQ ID NO: 569084 - DNA, 20 bp, Artificial Sequence
  chemically synthesized
tgtaatatgtgagatagaga

SEQ ID NO: 569085 - DNA, 20 bp, Artificial Sequence
  chemically synthesized
cttttgtgtaatatgtgaga

SEQ ID NO: 569086 - DNA, 20 bp, Artificial Sequence
  chemically synthesized
aatggaaaagttaaaaaata

SEQ ID NO: 569087 - DNA, 20 bp, Artificial Sequence
  chemically synthesized
cattcattatcttgtattag

SEQ ID NO: 569088 - DNA, 20 bp, Artificial Sequence
  chemically synthesized
tccttttaattaaattgttt

SEQ ID NO: 569089 - DNA, 20 bp, Artificial Sequence
  chemically synthesized
tatagctttccttttaatta

SEQ ID NO: 569090 - DNA, 20 bp, Artificial Sequence
  chemically synthesized
gcaaatatcttctcccattt

SEQ ID NO: 569091 - DNA, 20 bp, Artificial Sequence
  chemically synthesized
taggagttttttttacatat

SEQ ID NO: 569092 - DNA, 20 bp, Artificial Sequence
  chemically synthesized
tctttttcttattgatctgt

SEQ ID NO: 569093 - DNA, 20 bp, Artificial Sequence
  chemically synthesized
agtctcttgcctattttttt

SEQ ID NO: 569094 - DNA, 20 bp, Artificial Sequence
  chemically synthesized
tgttattttaatttgcaatt

SEQ ID NO: 569095 - DNA, 20 bp, Artificial Sequence
  chemically synthesized
aattgcaaattaaaataaca

SEQ ID NO: 569096 - DNA, 20 bp, Artificial Sequence
  chemically synthesized
tggttttccaaagtggttgt

SEQ ID NO: 569097 - DNA, 20 bp, Artificial Sequence
  chemically synthesized
gctgagctttagtagatact

SEQ ID NO: 569098 - DNA, 20 bp, Artificial Sequence
  chemically synthesized
atgttgagggtaggcatatg

SEQ ID NO: 569099 - DNA, 20 bp, Artificial Sequence
  chemically synthesized
tggcacacacgtgtgtacaa

SEQ ID NO: 569100 - DNA, 20 bp, Artificial Sequence
  chemically synthesized
cctcctatgaacattcttta

SEQ ID NO: 569101 - DNA, 20 bp, Artificial Sequence
  chemically synthesized
tggggaacattttggttctt

SEQ ID NO: 569102 - DNA, 20 bp, Artificial Sequence
  chemically synthesized
aaattgcaatgaaaatgtat

SEQ ID NO: 569103 - DNA, 20 bp, Artificial Sequence
  chemically synthesized
taggactcaacattgtgttt

SEQ ID NO: 569104 - DNA, 20 bp, Artificial Sequence
  chemically synthesized
tttgtatctaggactcaaca

SEQ ID NO: 569105 - DNA, 20 bp, Artificial Sequence
  chemically synthesized
taacactatggttgagtttt

SEQ ID NO: 569106 - DNA, 20 bp, Artificial Sequence
  chemically synthesized
tctgccttataacactatgg

SEQ ID NO: 569107 - DNA, 20 bp, Artificial Sequence
  chemically synthesized
cctttaagatgagggaggaa

SEQ ID NO: 569108 - DNA, 20 bp, Artificial Sequence
  chemically synthesized
ggaatgtgggtgaggtaggg

SEQ ID NO: 569109 - DNA, 20 bp, Artificial Sequence
  chemically synthesized
tctgaggtagtggttatatt

SEQ ID NO: 569110 - DNA, 20 bp, Artificial Sequence
  chemically synthesized
gttatattctatgtttctcc

SEQ ID NO: 569111 - DNA, 20 bp, Artificial Sequence
  chemically synthesized
ggtttaaaattttcaaaatg

SEQ ID NO: 569112 - DNA, 20 bp, Artificial Sequence
  chemically synthesized
ggtgttcttttaacatttca

SEQ ID NO: 569113 - DNA, 20 bp, Artificial Sequence
  chemically synthesized
acagttggggagtctaagtg

SEQ ID NO: 569114 - DNA, 20 bp, Artificial Sequence
  chemically synthesized
tccccaactgttaacataat

SEQ ID NO: 569115 - DNA, 20 bp, Artificial Sequence
  chemically synthesized
gtgtgtgtgtgtgtgtgtag

SEQ ID NO: 569116 - DNA, 20 bp, Artificial Sequence
  chemically synthesized
gtgtgtgtgtgtgtgtgtaa

SEQ ID NO: 569117 - DNA, 20 bp, Artificial Sequence
  chemically synthesized
aacattatcagtagccctaa

SEQ ID NO: 569118 - DNA, 20 bp, Artificial Sequence
  chemically synthesized
atctggtttagggctactga

SEQ ID NO: 569119 - DNA, 20 bp, Artificial Sequence
  chemically synthesized
tgataattgcattgagctga

SEQ ID NO: 569120 - DNA, 20 bp, Artificial Sequence
  chemically synthesized
gtcattcttcaagcaaaaaa

SEQ ID NO: 569121 - DNA, 20 bp, Artificial Sequence
  chemically synthesized
aagttgattgaatctctttt

SEQ ID NO: 569122 - DNA, 20 bp, Artificial Sequence
  chemically synthesized
gagggcgttttcaaaaaata

SEQ ID NO: 569123 - DNA, 20 bp, Artificial Sequence
  chemically synthesized
attgaatgcattgttttcga

SEQ ID NO: 569124 - DNA, 20 bp, Artificial Sequence
  chemically synthesized
gtaatgtgttgtattgaatg

SEQ ID NO: 569125 - DNA, 20 bp, Artificial Sequence
  chemically synthesized
cattactgaaatactatggg

SEQ ID NO: 569126 - DNA, 20 bp, Artificial Sequence
  chemically synthesized
gggtaatgattttttgttgt

SEQ ID NO: 569127 - DNA, 20 bp, Artificial Sequence
  chemically synthesized
aaatagatcagaaaatatgg

SEQ ID NO: 569128 - DNA, 20 bp, Artificial Sequence
  chemically synthesized
aggatacctcaatgtggcag

SEQ ID NO: 569129 - DNA, 20 bp, Artificial Sequence
  chemically synthesized
atgtcacagcctcacctgct

SEQ ID NO: 569130 - DNA, 20 bp, Artificial Sequence
  chemically synthesized
tttccgtagccatactctac

SEQ ID NO: 569131 - DNA, 20 bp, Artificial Sequence
  chemically synthesized
ataagaaatctccccatact

SEQ ID NO: 569132 - DNA, 20 bp, Artificial Sequence
  chemically synthesized
ttttaaaagcagcaagtatg

SEQ ID NO: 569133 - DNA, 20 bp, Artificial Sequence
  chemically synthesized
ccccatacttgctgctttta

SEQ ID NO: 569134 - DNA, 20 bp, Artificial Sequence
  chemically synthesized
gtcagaactgtgttttactt

SEQ ID NO: 569135 - DNA, 20 bp, Artificial Sequence
  chemically synthesized
tttggcagggggagtcagaa

SEQ ID NO: 569136 - DNA, 20 bp, Artificial Sequence
  chemically synthesized
tttagcttgctcgtttaacc

SEQ ID NO: 569137 - DNA, 20 bp, Artificial Sequence
  chemically synthesized
ttatgtcctttctttagctt

SEQ ID NO: 569138 - DNA, 20 bp, Artificial Sequence
  chemically synthesized
ctggcctattatgtcctttc

SEQ ID NO: 569139 - DNA, 20 bp, Artificial Sequence
  chemically synthesized
tgccttggcatcccaaagtg

SEQ ID NO: 569140 - DNA, 20 bp, Artificial Sequence
  chemically synthesized
ttgggatgccaaggcaggag

SEQ ID NO: 569141 - DNA, 20 bp, Artificial Sequence
  chemically synthesized
tctaagctttggaaaatatt

SEQ ID NO: 569142 - DNA, 20 bp, Artificial Sequence
  chemically synthesized
ggaaagcacataatattttc

SEQ ID NO: 569143 - DNA, 20 bp, Artificial Sequence
  chemically synthesized
tcatctatcctactttttat

SEQ ID NO: 569144 - DNA, 20 bp, Artificial Sequence
  chemically synthesized
tgaaaaagaaacataattat

SEQ ID NO: 569145 - DNA, 20 bp, Artificial Sequence
  chemically synthesized
caaaggaaaaacttctataa

SEQ ID NO: 569146 - DNA, 20 bp, Artificial Sequence
  chemically synthesized
ttatagaagtttttcctttg

SEQ ID NO: 569147 - DNA, 20 bp, Artificial Sequence
  chemically synthesized
acggcacaacagaacaaaca

SEQ ID NO: 569148 - DNA, 20 bp, Artificial Sequence
  chemically synthesized
aagttgcttttgtctaagct

SEQ ID NO: 569149 - DNA, 20 bp, Artificial Sequence
  chemically synthesized
ttagacaaaagcaacttagt

SEQ ID NO: 569150 - DNA, 20 bp, Artificial Sequence
  chemically synthesized
tggactagaatctgggacta

SEQ ID NO: 569151 - DNA, 20 bp, Artificial Sequence
  chemically synthesized
agatccagacatctcaaagc

SEQ ID NO: 569152 - DNA, 20 bp, Artificial Sequence
  chemically synthesized
attcccacagacttggaaac

SEQ ID NO: 569153 - DNA, 20 bp, Artificial Sequence
  chemically synthesized
atggaatgtttgagtatcat

SEQ ID NO: 569154 - DNA, 20 bp, Artificial Sequence
  chemically synthesized
gattcttacaatatcccatg

SEQ ID NO: 569155 - DNA, 20 bp, Artificial Sequence
  chemically synthesized
actttcacctctattatcac

SEQ ID NO: 569156 - DNA, 20 bp, Artificial Sequence
  chemically synthesized
gataacttatagatagcccc

SEQ ID NO: 569157 - DNA, 20 bp, Artificial Sequence
  chemically synthesized
tgggatcaggtatcagaaga

SEQ ID NO: 569158 - DNA, 20 bp, Artificial Sequence
  chemically synthesized
cagaagatctggttttctag

SEQ ID NO: 569159 - DNA, 20 bp, Artificial Sequence
  chemically synthesized
attttcctatctgtaagatg

SEQ ID NO: 569160 - DNA, 20 bp, Artificial Sequence
  chemically synthesized
ctgtaagatgaagagtttgg

SEQ ID NO: 569161 - DNA, 20 bp, Artificial Sequence
  chemically synthesized
cagctaattagactgcagaa

SEQ ID NO: 569162 - DNA, 20 bp, Artificial Sequence
  chemically synthesized
actgatgacccgttatagag

SEQ ID NO: 569163 - DNA, 20 bp, Artificial Sequence
  chemically synthesized
tttcagagataagttaaagg

SEQ ID NO: 569164 - DNA, 20 bp, Artificial Sequence
  chemically synthesized
aaaactgttaccctaagatt

SEQ ID NO: 569165 - DNA, 20 bp, Artificial Sequence
  chemically synthesized
caagcttgtaatcttagggt

SEQ ID NO: 569166 - DNA, 20 bp, Artificial Sequence
  chemically synthesized
cttctcccaaaactgttacc

SEQ ID NO: 569167 - DNA, 20 bp, Artificial Sequence
  chemically synthesized
ctaaaggaaggcaagaagta

SEQ ID NO: 569168 - DNA, 20 bp, Artificial Sequence
  chemically synthesized
atctgatttccatttgggga

SEQ ID NO: 569169 - DNA, 20 bp, Artificial Sequence
  chemically synthesized
tctgagcacaagaattttac

SEQ ID NO: 569170 - DNA, 20 bp, Artificial Sequence
  chemically synthesized
tcttgtgctcagagacgtag

SEQ ID NO: 569171 - DNA, 20 bp, Artificial Sequence
  chemically synthesized
tgattgaagagtgcagatcc

SEQ ID NO: 569172 - DNA, 20 bp, Artificial Sequence
  chemically synthesized
tctcttagtgtcatattcat

SEQ ID NO: 569173 - DNA, 20 bp, Artificial Sequence
  chemically synthesized
acacaggcaactattcaatt

SEQ ID NO: 569174 - DNA, 20 bp, Artificial Sequence
  chemically synthesized
actcggaattgaatagttgc

SEQ ID NO: 569175 - DNA, 20 bp, Artificial Sequence
  chemically synthesized
ctgtgtttgtaagagacatt

SEQ ID NO: 569176 - DNA, 20 bp, Artificial Sequence
  chemically synthesized
gtttgtaagagacattgtag

SEQ ID NO: 569177 - DNA, 20 bp, Artificial Sequence
  chemically synthesized
gaatggcgtgaacccggggc

SEQ ID NO: 569178 - DNA, 20 bp, Artificial Sequence
  chemically synthesized
ttttgtatttttagtagaga

SEQ ID NO: 569179 - DNA, 20 bp, Artificial Sequence
  chemically synthesized
cacctcggcctcacaaagtg

SEQ ID NO: 569180 - DNA, 20 bp, Artificial Sequence
  chemically synthesized
gtgagccaccgcgcccggcc

SEQ ID NO: 569181 - DNA, 20 bp, Artificial Sequence
  chemically synthesized
gccaccgcgcccggccgtag

SEQ ID NO: 569182 - DNA, 20 bp, Artificial Sequence
  chemically synthesized
ttagcatttttttttcatat

SEQ ID NO: 569183 - DNA, 20 bp, Artificial Sequence
  chemically synthesized
tgacatttagtatacatacc

SEQ ID NO: 569184 - DNA, 20 bp, Artificial Sequence
  chemically synthesized
taaggtgtacaattcaatat

SEQ ID NO: 569185 - DNA, 20 bp, Artificial Sequence
  chemically synthesized
gtgtacaattcaatattttt

SEQ ID NO: 569186 - DNA, 20 bp, Artificial Sequence
  chemically synthesized
acaattcaatatttttgttt

SEQ ID NO: 569187 - DNA, 20 bp, Artificial Sequence
  chemically synthesized
aacctccacctcccaagtcc

SEQ ID NO: 569188 - DNA, 20 bp, Artificial Sequence
  chemically synthesized
ttgggaggctgaggcaggag

SEQ ID NO: 569189 - DNA, 20 bp, Artificial Sequence
  chemically synthesized
tgcctcagcctcccaagtag

SEQ ID NO: 569190 - DNA, 20 bp, Artificial Sequence
  chemically synthesized
attagccaggcgttcatagc

SEQ ID NO: 569191 - DNA, 20 bp, Artificial Sequence
  chemically synthesized
gctcgctatgaacgcctggc

SEQ ID NO: 569192 - DNA, 20 bp, Artificial Sequence
  chemically synthesized
gtttgtatttttagtagaga

SEQ ID NO: 569193 - DNA, 20 bp, Artificial Sequence
  chemically synthesized
ctgcccgccttggcctccca

SEQ ID NO: 569194 - DNA, 20 bp, Artificial Sequence
  chemically synthesized
tttgtattggtgatatatgg

SEQ ID NO: 569195 - DNA, 20 bp, Artificial Sequence
  chemically synthesized
tgcctcttctttggctggta

SEQ ID NO: 569196 - DNA, 20 bp, Artificial Sequence
  chemically synthesized
aaatttaactttggtgatgt

SEQ ID NO: 569197 - DNA, 20 bp, Artificial Sequence
  chemically synthesized
atagcttcatttgcattacc

SEQ ID NO: 569198 - DNA, 20 bp, Artificial Sequence
  chemically synthesized
taatactttagcttttgact

SEQ ID NO: 569199 - DNA, 20 bp, Artificial Sequence
  chemically synthesized
tgcttctgtacgcttaatac

SEQ ID NO: 569200 - DNA, 20 bp, Artificial Sequence
  chemically synthesized
ttcatagagtccatgcttct

SEQ ID NO: 569201 - DNA, 20 bp, Artificial Sequence
  chemically synthesized
gattgtttctttcatagagt

SEQ ID NO: 569202 - DNA, 20 bp, Artificial Sequence
  chemically synthesized
aaaaaaaaagtcactttttg

SEQ ID NO: 569203 - DNA, 20 bp, Artificial Sequence
  chemically synthesized
aaaaaaaaaaaaagtcactt

SEQ ID NO: 569204 - DNA, 20 bp, Artificial Sequence
  chemically synthesized
atatgtccctgatgacagac

SEQ ID NO: 569205 - DNA, 20 bp, Artificial Sequence
  chemically synthesized
cacctcaggaagattttctt

SEQ ID NO: 569206 - DNA, 20 bp, Artificial Sequence
  chemically synthesized
gttcaatgtttaacacctca

SEQ ID NO: 569207 - DNA, 20 bp, Artificial Sequence
  chemically synthesized
ctgaggtgttaaacattgaa

SEQ ID NO: 569208 - DNA, 20 bp, Artificial Sequence
  chemically synthesized
tttcatgaataatccatgtt

SEQ ID NO: 569209 - DNA, 20 bp, Artificial Sequence
  chemically synthesized
tactctcttctgattcagaa

SEQ ID NO: 569210 - DNA, 20 bp, Artificial Sequence
  chemically synthesized
tcttttctgaatcagaagag

SEQ ID NO: 569211 - DNA, 20 bp, Artificial Sequence
  chemically synthesized
atcaacaagaatctactctc

SEQ ID NO: 569212 - DNA, 20 bp, Artificial Sequence
  chemically synthesized
gtagattcttgttgatctgg

SEQ ID NO: 569213 - DNA, 20 bp, Artificial Sequence
  chemically synthesized
ttctgccatgggaataaact

SEQ ID NO: 569214 - DNA, 20 bp, Artificial Sequence
  chemically synthesized
attcaattatagagcaatca

SEQ ID NO: 569215 - DNA, 20 bp, Artificial Sequence
  chemically synthesized
tagttatagaatttatagag

SEQ ID NO: 569216 - DNA, 20 bp, Artificial Sequence
  chemically synthesized
tggtatctaaaaataagact

SEQ ID NO: 569217 - DNA, 20 bp, Artificial Sequence
  chemically synthesized
gccttttcaatgatactttc

SEQ ID NO: 569218 - DNA, 20 bp, Artificial Sequence
  chemically synthesized
aaagtatcattgaaaaggct

SEQ ID NO: 569219 - DNA, 20 bp, Artificial Sequence
  chemically synthesized
ggattaaaaaatagcttacc

SEQ ID NO: 569220 - DNA, 20 bp, Artificial Sequence
  chemically synthesized
catcatccattggattaaaa

SEQ ID NO: 569221 - DNA, 20 bp, Artificial Sequence
  chemically synthesized
tattttttaatccaatggat

SEQ ID NO: 569222 - DNA, 20 bp, Artificial Sequence
  chemically synthesized
ctttactgaaaccatcatcc

SEQ ID NO: 569223 - DNA, 20 bp, Artificial Sequence
  chemically synthesized
cagtaaaggcaattttgtca

SEQ ID NO: 569224 - DNA, 20 bp, Artificial Sequence
  chemically synthesized
atgggaatctgcagtatgta

SEQ ID NO: 569225 - DNA, 20 bp, Artificial Sequence
  chemically synthesized
aggagaatctttctacatac

SEQ ID NO: 569226 - DNA, 20 bp, Artificial Sequence
  chemically synthesized
agaaagattctcctgaggaa

SEQ ID NO: 569227 - DNA, 20 bp, Artificial Sequence
  chemically synthesized
tactgtaaagggagcagtaa

SEQ ID NO: 569228 - DNA, 20 bp, Artificial Sequence
  chemically synthesized
ctttacagtaggtcaagagt

SEQ ID NO: 569229 - DNA, 20 bp, Artificial Sequence
  chemically synthesized
cccactcatctgcctttagg

SEQ ID NO: 569230 - DNA, 20 bp, Artificial Sequence
  chemically synthesized
ggtagaactttcttactggc

SEQ ID NO: 569231 - DNA, 20 bp, Artificial Sequence
  chemically synthesized
ttcttactggcatgagattc

SEQ ID NO: 569232 - DNA, 20 bp, Artificial Sequence
  chemically synthesized
tcctaggatttttgttatcc

SEQ ID NO: 569233 - DNA, 20 bp, Artificial Sequence
  chemically synthesized
ttagcttttatattctacac

SEQ ID NO: 569234 - DNA, 20 bp, Artificial Sequence
  chemically synthesized
ggaacaatagacatcaagta

SEQ ID NO: 569235 - DNA, 20 bp, Artificial Sequence
  chemically synthesized
tcaaatgactaagaatagct

SEQ ID NO: 569236 - DNA, 20 bp, Artificial Sequence
  chemically synthesized
ttgaatttctatgtcataac

SEQ ID NO: 569237 - DNA, 20 bp, Artificial Sequence
  chemically synthesized
aaattaaatacgggctttag

SEQ ID NO: 569238 - DNA, 20 bp, Artificial Sequence
  chemically synthesized
acacaattgtaaaattaaat

SEQ ID NO: 569239 - DNA, 20 bp, Artificial Sequence
  chemically synthesized
acattagcatttgtcagtga

SEQ ID NO: 569240 - DNA, 20 bp, Artificial Sequence
  chemically synthesized
gctaatgtctcagccaggga

SEQ ID NO: 569241 - DNA, 20 bp, Artificial Sequence
  chemically synthesized
tgagttttcaggggctcttc

SEQ ID NO: 569242 - DNA, 20 bp, Artificial Sequence
  chemically synthesized
tgtagtatataattacagac

SEQ ID NO: 569243 - DNA, 20 bp, Artificial Sequence
  chemically synthesized
tctgtgagtggactacctgt

SEQ ID NO: 569244 - DNA, 20 bp, Artificial Sequence
  chemically synthesized
atacaccatcttccaaatcc

SEQ ID NO: 569245 - DNA, 20 bp, Artificial Sequence
  chemically synthesized
gtttagtttaccactaaact

SEQ ID NO: 569246 - DNA, 20 bp, Artificial Sequence
  chemically synthesized
atacagggcatcagacaagg

SEQ ID NO: 569247 - DNA, 20 bp, Artificial Sequence
  chemically synthesized
agaccatacagggcatcaga

SEQ ID NO: 569248 - DNA, 20 bp, Artificial Sequence
  chemically synthesized
tcactctgggaatagcggtc

SEQ ID NO: 569249 - DNA, 20 bp, Artificial Sequence
  chemically synthesized
agtagtgaatgtgagggacc

SEQ ID NO: 569250 - DNA, 20 bp, Artificial Sequence
  chemically synthesized
tgtgagggacctcctgtttg

SEQ ID NO: 569251 - DNA, 20 bp, Artificial Sequence
  chemically synthesized
catataaatcttgaaactta

SEQ ID NO: 569252 - DNA, 20 bp, Artificial Sequence
  chemically synthesized
tataaaaatctatgtaagtt

SEQ ID NO: 569253 - DNA, 20 bp, Artificial Sequence
  chemically synthesized
tttcccttataaaaatctat

SEQ ID NO: 569254 - DNA, 20 bp, Artificial Sequence
  chemically synthesized
tatctttcttctcgatatgc

SEQ ID NO: 569255 - DNA, 20 bp, Artificial Sequence
  chemically synthesized
gcatatcgagaagaaagata

SEQ ID NO: 569256 - DNA, 20 bp, Artificial Sequence
  chemically synthesized
atcattgccactggacttta

SEQ ID NO: 569257 - DNA, 20 bp, Artificial Sequence
  chemically synthesized
ccactggactttatttagat

SEQ ID NO: 569258 - DNA, 20 bp, Artificial Sequence
  chemically synthesized
tatgatgaaaagatttcaat

SEQ ID NO: 569259 - DNA, 20 bp, Artificial Sequence
  chemically synthesized
cctttttctcttatatgatg

SEQ ID NO: 569260 - DNA, 20 bp, Artificial Sequence
  chemically synthesized
gctggtatcacaaggctaga

SEQ ID NO: 569261 - DNA, 20 bp, Artificial Sequence
  chemically synthesized
taatggctgactactatgaa

SEQ ID NO: 569262 - DNA, 20 bp, Artificial Sequence
  chemically synthesized
cagccattaatctttccctt

SEQ ID NO: 569263 - DNA, 20 bp, Artificial Sequence
  chemically synthesized
gataactcaaactcataagg

SEQ ID NO: 569264 - DNA, 20 bp, Artificial Sequence
  chemically synthesized
tgcatattataaatacagac

SEQ ID NO: 569265 - DNA, 20 bp, Artificial Sequence
  chemically synthesized
attataaatacagacacctg

SEQ ID NO: 569266 - DNA, 20 bp, Artificial Sequence
  chemically synthesized
tagtccagaaaagaactttt

SEQ ID NO: 569267 - DNA, 20 bp, Artificial Sequence
  chemically synthesized
aagttcttttctggactagc

SEQ ID NO: 569268 - DNA, 20 bp, Artificial Sequence
  chemically synthesized
tggactagctgtggattagg

SEQ ID NO: 569269 - DNA, 20 bp, Artificial Sequence
  chemically synthesized
ctggagtgcacactgagaca

SEQ ID NO: 569270 - DNA, 20 bp, Artificial Sequence
  chemically synthesized
tcagccaatgggctgtaacc

SEQ ID NO: 569271 - DNA, 20 bp, Artificial Sequence
  chemically synthesized
tgatgatagcatagatgcat

SEQ ID NO: 569272 - DNA, 20 bp, Artificial Sequence
  chemically synthesized
gattgaaagccagatagatc

SEQ ID NO: 569273 - DNA, 20 bp, Artificial Sequence
  chemically synthesized
aaaatgaagcaaaggatcta

SEQ ID NO: 569274 - DNA, 20 bp, Artificial Sequence
  chemically synthesized
cagatagatcctttgcttca

SEQ ID NO: 569275 - DNA, 20 bp, Artificial Sequence
  chemically synthesized
ctttgttagtgtgggctagc

SEQ ID NO: 569276 - DNA, 20 bp, Artificial Sequence
  chemically synthesized
acatgtaatggagaagactg

SEQ ID NO: 569277 - DNA, 20 bp, Artificial Sequence
  chemically synthesized
acacacatacctgtctatat

SEQ ID NO: 569278 - DNA, 20 bp, Artificial Sequence
  chemically synthesized
caaacccagaagtgttaccc

SEQ ID NO: 569279 - DNA, 20 bp, Artificial Sequence
  chemically synthesized
caagcttgggggtaacactt

SEQ ID NO: 569280 - DNA, 20 bp, Artificial Sequence
  chemically synthesized
aggtaattatgaaattcaaa

SEQ ID NO: 569281 - DNA, 20 bp, Artificial Sequence
  chemically synthesized
ttcataattacctactactg

SEQ ID NO: 569282 - DNA, 20 bp, Artificial Sequence
  chemically synthesized
gagcaccatattgacctacc

SEQ ID NO: 569283 - DNA, 20 bp, Artificial Sequence
  chemically synthesized
aaaagtggcatatctagcac

SEQ ID NO: 569284 - DNA, 20 bp, Artificial Sequence
  chemically synthesized
agtgctagatatgccacttt

SEQ ID NO: 569285 - DNA, 20 bp, Artificial Sequence
  chemically synthesized
gtgtgtatgtgtgtgtgtgt

SEQ ID NO: 569286 - DNA, 20 bp, Artificial Sequence
  chemically synthesized
aggtcaatgattattctcat

SEQ ID NO: 569287 - DNA, 20 bp, Artificial Sequence
  chemically synthesized
gtcatgttgtagatataggt

SEQ ID NO: 569288 - DNA, 20 bp, Artificial Sequence
  chemically synthesized
ttttaatttaattcatggaa

SEQ ID NO: 569289 - DNA, 20 bp, Artificial Sequence
  chemically synthesized
taaaagtattatgtgtattc

SEQ ID NO: 569290 - DNA, 20 bp, Artificial Sequence
  chemically synthesized
tcatgaatacacataatact

SEQ ID NO: 569291 - DNA, 20 bp, Artificial Sequence
  chemically synthesized
gccaacctgctgctcaccaa

SEQ ID NO: 569292 - DNA, 20 bp, Artificial Sequence
  chemically synthesized
ggatcatctcctttccagat

SEQ ID NO: 569293 - DNA, 20 bp, Artificial Sequence
  chemically synthesized
gcaatgtggatcatctcctt

SEQ ID NO: 569294 - DNA, 20 bp, Artificial Sequence
  chemically synthesized
ggaacataaatatcttctga

SEQ ID NO: 569295 - DNA, 20 bp, Artificial Sequence
  chemically synthesized
tatcttctgagagagtttct

SEQ ID NO: 569296 - DNA, 20 bp, Artificial Sequence
  chemically synthesized
gtttctgtaggctttacctt

SEQ ID NO: 569297 - DNA, 20 bp, Artificial Sequence
  chemically synthesized
acaggaggtgttttgttgtg

SEQ ID NO: 569298 - DNA, 20 bp, Artificial Sequence
  chemically synthesized
gggcaacaggaggtgttttg

SEQ ID NO: 569299 - DNA, 20 bp, Artificial Sequence
  chemically synthesized
ttagcattcagggcaacagg

SEQ ID NO: 569300 - DNA, 20 bp, Artificial Sequence
  chemically synthesized
ctgtggacttcacatgaact

SEQ ID NO: 569301 - DNA, 20 bp, Artificial Sequence
  chemically synthesized
tttacaaaatgaaaacccat

SEQ ID NO: 569302 - DNA, 20 bp, Artificial Sequence
  chemically synthesized
tgtgccctcgctaatcatta

SEQ ID NO: 569303 - DNA, 20 bp, Artificial Sequence
  chemically synthesized
ggaatgctgatgcacaaaat

SEQ ID NO: 569304 - DNA, 20 bp, Artificial Sequence
  chemically synthesized
ttttgacagtgtaggctcag

SEQ ID NO: 569305 - DNA, 20 bp, Artificial Sequence
  chemically synthesized
tcaaaattaattactacgga

SEQ ID NO: 569306 - DNA, 20 bp, Artificial Sequence
  chemically synthesized
ggtacttttctttttttaaa

SEQ ID NO: 569307 - DNA, 20 bp, Artificial Sequence
  chemically synthesized
aaaatacaactgttctactc

SEQ ID NO: 569308 - DNA, 20 bp, Artificial Sequence
  chemically synthesized
ttaccttcaaatttaaaaga

SEQ ID NO: 569309 - DNA, 20 bp, Artificial Sequence
  chemically synthesized
ttatgtgtactgttagggag

SEQ ID NO: 569310 - DNA, 20 bp, Artificial Sequence
  chemically synthesized
cttttgttttgctctttgca

SEQ ID NO: 569311 - DNA, 20 bp, Artificial Sequence
  chemically synthesized
atctgaccctaggttccaac

SEQ ID NO: 569312 - DNA, 20 bp, Artificial Sequence
  chemically synthesized
tgaagaaaagtcaactaatt

SEQ ID NO: 569313 - DNA, 20 bp, Artificial Sequence
  chemically synthesized
cacctcagcgtcccaaagtg

SEQ ID NO: 569314 - DNA, 20 bp, Artificial Sequence
  chemically synthesized
ttttgtatttttagtagaga

SEQ ID NO: 569315 - DNA, 20 bp, Artificial Sequence
  chemically synthesized
ttgggaggctgaggcaggag

SEQ ID NO: 569316 - DNA, 20 bp, Artificial Sequence
  chemically synthesized
aacctccacctcccaggttc

SEQ ID NO: 569317 - DNA, 20 bp, Artificial Sequence
  chemically synthesized
gttattttttgaaatattca

SEQ ID NO: 569318 - DNA, 20 bp, Artificial Sequence
  chemically synthesized
ataccttgatattagatata

SEQ ID NO: 569319 - DNA, 20 bp, Artificial Sequence
  chemically synthesized
ttcccagttgtttaaatgtt

SEQ ID NO: 569320 - DNA, 20 bp, Artificial Sequence
  chemically synthesized
gtttcctcttgtatattccc

SEQ ID NO: 569321 - DNA, 20 bp, Artificial Sequence
  chemically synthesized
attggagagaatagaattat

SEQ ID NO: 569322 - DNA, 20 bp, Artificial Sequence
  chemically synthesized
attctattctctccaatggt

SEQ ID NO: 569323 - DNA, 20 bp, Artificial Sequence
  chemically synthesized
aagattgagttaccttaaaa

SEQ ID NO: 569324 - DNA, 20 bp, Artificial Sequence
  chemically synthesized
ctttccaactcatcttcaga

SEQ ID NO: 569325 - DNA, 20 bp, Artificial Sequence
  chemically synthesized
agagtatgttccatatttaa

SEQ ID NO: 569326 - DNA, 20 bp, Artificial Sequence
  chemically synthesized
catatttaaatttgtttcca

SEQ ID NO: 569327 - DNA, 20 bp, Artificial Sequence
  chemically synthesized
tttgctgcaaagactgcgtc

SEQ ID NO: 569328 - DNA, 20 bp, Artificial Sequence
  chemically synthesized
ttggctgcaccaatgacata

SEQ ID NO: 569329 - DNA, 20 bp, Artificial Sequence
  chemically synthesized
ccatatccagcaaatacacc

SEQ ID NO: 569330 - DNA, 20 bp, Artificial Sequence
  chemically synthesized
acaggtttggaacttctgta

SEQ ID NO: 569331 - DNA, 20 bp, Artificial Sequence
  chemically synthesized
cctacagaagttccaaacct

SEQ ID NO: 569332 - DNA, 20 bp, Artificial Sequence
  chemically synthesized
atcatatcttgccaaatcca

SEQ ID NO: 569333 - DNA, 20 bp, Artificial Sequence
  chemically synthesized
gagatgataccaatacttta

SEQ ID NO: 569334 - DNA, 20 bp, Artificial Sequence
  chemically synthesized
gacccagaatacaagtcttt

SEQ ID NO: 569335 - DNA, 20 bp, Artificial Sequence
  chemically synthesized
gtcttcccaagtgcagtacc

SEQ ID NO: 569336 - DNA, 20 bp, Artificial Sequence
  chemically synthesized
aagttagagtatcttcgtat

SEQ ID NO: 569337 - DNA, 20 bp, Artificial Sequence
  chemically synthesized
cctaccttttcttgagcaat

SEQ ID NO: 569338 - DNA, 20 bp, Artificial Sequence
  chemically synthesized
tgctgataaaatacaaaaga

SEQ ID NO: 569339 - DNA, 20 bp, Artificial Sequence
  chemically synthesized
aatatcttttgtattttatc

SEQ ID NO: 569340 - DNA, 20 bp, Artificial Sequence
  chemically synthesized
acatgttggtaatgtcttct

SEQ ID NO: 569341 - DNA, 20 bp, Artificial Sequence
  chemically synthesized
taaatatttttaatcttttt

SEQ ID NO: 569342 - DNA, 20 bp, Artificial Sequence
  chemically synthesized
ttcactgtggaaaacataga

SEQ ID NO: 569343 - DNA, 20 bp, Artificial Sequence
  chemically synthesized
cattttagaaattaatattt

SEQ ID NO: 569344 - DNA, 20 bp, Artificial Sequence
  chemically synthesized
taaaatgtattgctcagact

SEQ ID NO: 569345 - DNA, 20 bp, Artificial Sequence
  chemically synthesized
agtcattaatttatctgtcc

SEQ ID NO: 569346 - DNA, 20 bp, Artificial Sequence
  chemically synthesized
agaacaacctgaaatctgga

SEQ ID NO: 569347 - DNA, 20 bp, Artificial Sequence
  chemically synthesized
tggctaaaggccaatctctc

SEQ ID NO: 569348 - DNA, 20 bp, Artificial Sequence
  chemically synthesized
cagggatccaaatgctcagg

SEQ ID NO: 569349 - DNA, 20 bp, Artificial Sequence
  chemically synthesized
agatgccatataaactagta

SEQ ID NO: 569350 - DNA, 20 bp, Artificial Sequence
  chemically synthesized
cccaacaatttaatctccct

SEQ ID NO: 569351 - DNA, 20 bp, Artificial Sequence
  chemically synthesized
aggtggagtcccaacctttt

SEQ ID NO: 569352 - DNA, 20 bp, Artificial Sequence
  chemically synthesized
aaggtacagttcctgaagga

SEQ ID NO: 569353 - DNA, 20 bp, Artificial Sequence
  chemically synthesized
agggtgttggggaggctttc

SEQ ID NO: 569354 - DNA, 20 bp, Artificial Sequence
  chemically synthesized
agcaacacagagggtgttgg

SEQ ID NO: 569355 - DNA, 20 bp, Artificial Sequence
  chemically synthesized
ctccccaacaccctctgtgt

SEQ ID NO: 569356 - DNA, 20 bp, Artificial Sequence
  chemically synthesized
acagtagctagtcaccatga

SEQ ID NO: 569357 - DNA, 20 bp, Artificial Sequence
  chemically synthesized
cctctgaagagaagggtata

SEQ ID NO: 569358 - DNA, 20 bp, Artificial Sequence
  chemically synthesized
taaagaactacccgtgactg

SEQ ID NO: 569359 - DNA, 20 bp, Artificial Sequence
  chemically synthesized
ctgggtagtttataaagcaa

SEQ ID NO: 569360 - DNA, 20 bp, Artificial Sequence
  chemically synthesized
actgtgagtcaattaaacct

SEQ ID NO: 569361 - DNA, 20 bp, Artificial Sequence
  chemically synthesized
gcatggctggggagccctca

SEQ ID NO: 569362 - DNA, 20 bp, Artificial Sequence
  chemically synthesized
ctttgccttctgccatgatt

SEQ ID NO: 569363 - DNA, 20 bp, Artificial Sequence
  chemically synthesized
tgcttcccctttgccttctg

SEQ ID NO: 569364 - DNA, 20 bp, Artificial Sequence
  chemically synthesized
ctgctgctgtgtgaagatgt

SEQ ID NO: 569365 - DNA, 20 bp, Artificial Sequence
  chemically synthesized
tatcctgctgctgtgtgaag

SEQ ID NO: 569366 - DNA, 20 bp, Artificial Sequence
  chemically synthesized
agcaacggagaaatctgccc

SEQ ID NO: 569367 - DNA, 20 bp, Artificial Sequence
  chemically synthesized
ggaggtgaatgaatcatggg

SEQ ID NO: 569368 - DNA, 20 bp, Artificial Sequence
  chemically synthesized
caggcccctcctccaacatg

SEQ ID NO: 569369 - DNA, 20 bp, Artificial Sequence
  chemically synthesized
ggtatttcctcagtgcctga

SEQ ID NO: 569370 - DNA, 20 bp, Artificial Sequence
  chemically synthesized
aacaccagatctcatctatg

SEQ ID NO: 569371 - DNA, 20 bp, Artificial Sequence
  chemically synthesized
cagatctcatctatgtgtgg

SEQ ID NO: 569372 - DNA, 20 bp, Artificial Sequence
  chemically synthesized
gtggttttgttttgttcttt

SEQ ID NO: 569373 - DNA, 20 bp, Artificial Sequence
  chemically synthesized
ttttgttttgttcttttttt

SEQ ID NO: 569374 - DNA, 20 bp, Artificial Sequence
  chemically synthesized
ttctttttttgtttgttttt

SEQ ID NO: 569375 - DNA, 20 bp, Artificial Sequence
  chemically synthesized
ttttttgtttgttttttttt

SEQ ID NO: 569376 - DNA, 20 bp, Artificial Sequence
  chemically synthesized
ttttgtttgtttgttgttgt

SEQ ID NO: 569377 - DNA, 20 bp, Artificial Sequence
  chemically synthesized
tgtcgggcagaggcattctc

SEQ ID NO: 569378 - DNA, 20 bp, Artificial Sequence
  chemically synthesized
gacactcaaccactacacta

SEQ ID NO: 569379 - DNA, 20 bp, Artificial Sequence
  chemically synthesized
ggtaactttgtttcctcatt

SEQ ID NO: 569380 - DNA, 20 bp, Artificial Sequence
  chemically synthesized
acttcaaattcctctggtaa

SEQ ID NO: 569381 - DNA, 20 bp, Artificial Sequence
  chemically synthesized
agttgctttggttgtcattg

SEQ ID NO: 569382 - DNA, 20 bp, Artificial Sequence
  chemically synthesized
gggctgtgtttgatgttggt

SEQ ID NO: 569383 - DNA, 20 bp, Artificial Sequence
  chemically synthesized
taatctgactgggaattggg

SEQ ID NO: 569384 - DNA, 20 bp, Artificial Sequence
  chemically synthesized
caaacacagcccaattccca

SEQ ID NO: 569385 - DNA, 20 bp, Artificial Sequence
  chemically synthesized
ttaagataaattaccatgtc

SEQ ID NO: 569386 - DNA, 20 bp, Artificial Sequence
  chemically synthesized
ctgtgatttttcttgcttag

SEQ ID NO: 569387 - DNA, 20 bp, Artificial Sequence
  chemically synthesized
tctccttagactgtgatttt

SEQ ID NO: 569388 - DNA, 20 bp, Artificial Sequence
  chemically synthesized
tcttgctttgtctccttaga

SEQ ID NO: 569389 - DNA, 20 bp, Artificial Sequence
  chemically synthesized
tatctaagtctggttctgat

SEQ ID NO: 569390 - DNA, 20 bp, Artificial Sequence
  chemically synthesized
tgttacatatctaagtctgg

SEQ ID NO: 569391 - DNA, 20 bp, Artificial Sequence
  chemically synthesized
agggaaaagaaagacaatat

SEQ ID NO: 569392 - DNA, 20 bp, Artificial Sequence
  chemically synthesized
caagattagatagaaaatat

SEQ ID NO: 569393 - DNA, 20 bp, Artificial Sequence
  chemically synthesized
gtaagattagaagacaatat

SEQ ID NO: 569394 - DNA, 20 bp, Artificial Sequence
  chemically synthesized
attagaagacaatatgcaag

SEQ ID NO: 569395 - DNA, 20 bp, Artificial Sequence
  chemically synthesized
aagacaatatgcaagattag

SEQ ID NO: 569396 - DNA, 20 bp, Artificial Sequence
  chemically synthesized
gattagatttgattcactct

SEQ ID NO: 569397 - DNA, 20 bp, Artificial Sequence
  chemically synthesized
gcatttccatttgattcact

SEQ ID NO: 569398 - DNA, 20 bp, Artificial Sequence
  chemically synthesized
ttttaatttctagcatttcc

SEQ ID NO: 569399 - DNA, 20 bp, Artificial Sequence
  chemically synthesized
aaggtatttttcttttctgt

SEQ ID NO: 569400 - DNA, 20 bp, Artificial Sequence
  chemically synthesized
ataccttagatgggctcatc

SEQ ID NO: 569401 - DNA, 20 bp, Artificial Sequence
  chemically synthesized
ttttacttttccccctgctt

SEQ ID NO: 569402 - DNA, 20 bp, Artificial Sequence
  chemically synthesized
atttttttttttacttttcc

SEQ ID NO: 569403 - DNA, 20 bp, Artificial Sequence
  chemically synthesized
gcaattgcaatacaaacaca

SEQ ID NO: 569404 - DNA, 20 bp, Artificial Sequence
  chemically synthesized
tacttaatactgaaaaccta

SEQ ID NO: 569405 - DNA, 20 bp, Artificial Sequence
  chemically synthesized
gctctaggaaacagctattt

SEQ ID NO: 569406 - DNA, 20 bp, Artificial Sequence
  chemically synthesized
tgttacttaatctgaaaaat

SEQ ID NO: 569407 - DNA, 20 bp, Artificial Sequence
  chemically synthesized
agctatttttcagattaagt

SEQ ID NO: 569408 - DNA, 20 bp, Artificial Sequence
  chemically synthesized
agtctttaatttatagttct

SEQ ID NO: 569409 - DNA, 20 bp, Artificial Sequence
  chemically synthesized
taaatactttgtagcaactt

SEQ ID NO: 569410 - DNA, 20 bp, Artificial Sequence
  chemically synthesized
ctgtaaacaactggttggtc

SEQ ID NO: 569411 - DNA, 20 bp, Artificial Sequence
  chemically synthesized
taaaaagctagtgaccaacc

SEQ ID NO: 569412 - DNA, 20 bp, Artificial Sequence
  chemically synthesized
acagtgatatattttgcaat

SEQ ID NO: 569413 - DNA, 20 bp, Artificial Sequence
  chemically synthesized
atatattttgcaatatttga

SEQ ID NO: 569414 - DNA, 20 bp, Artificial Sequence
  chemically synthesized
ctgagcattagaaggaacac

SEQ ID NO: 569415 - DNA, 20 bp, Artificial Sequence
  chemically synthesized
attaacattttatctttgct

SEQ ID NO: 569416 - DNA, 20 bp, Artificial Sequence
  chemically synthesized
atggtgtattttatttcaaa

SEQ ID NO: 569417 - DNA, 20 bp, Artificial Sequence
  chemically synthesized
tacaactagtatcataactt

SEQ ID NO: 569418 - DNA, 20 bp, Artificial Sequence
  chemically synthesized
taactttggtgtttatcttt

SEQ ID NO: 569419 - DNA, 20 bp, Artificial Sequence
  chemically synthesized
gaaggtcactttttaaagtg

SEQ ID NO: 569420 - DNA, 20 bp, Artificial Sequence
  chemically synthesized
ttctggaaggtcacttttta

SEQ ID NO: 569421 - DNA, 20 bp, Artificial Sequence
  chemically synthesized
atcagaatctcattcacact

SEQ ID NO: 569422 - DNA, 20 bp, Artificial Sequence
  chemically synthesized
aactgaaaccatgagtgtga

SEQ ID NO: 569423 - DNA, 20 bp, Artificial Sequence
  chemically synthesized
gcacactatctgtctattta

SEQ ID NO: 569424 - DNA, 20 bp, Artificial Sequence
  chemically synthesized
attgtaaatgtttggatttc

SEQ ID NO: 569425 - DNA, 20 bp, Artificial Sequence
  chemically synthesized
tggcaatttgattgtaaatg

SEQ ID NO: 569426 - DNA, 20 bp, Artificial Sequence
  chemically synthesized
tagggtggcaatttgattgt

SEQ ID NO: 569427 - DNA, 20 bp, Artificial Sequence
  chemically synthesized
agatcagatttagggtggca

SEQ ID NO: 569428 - DNA, 20 bp, Artificial Sequence
  chemically synthesized
ttagggaactctaaagaaag

SEQ ID NO: 569429 - DNA, 20 bp, Artificial Sequence
  chemically synthesized
tgcattgcccagaaatctag

SEQ ID NO: 569430 - DNA, 20 bp, Artificial Sequence
  chemically synthesized
aaacatgtcaaggaatcaca

SEQ ID NO: 569431 - DNA, 20 bp, Artificial Sequence
  chemically synthesized
aatctaggtgtgattccttg

SEQ ID NO: 569432 - DNA, 20 bp, Artificial Sequence
  chemically synthesized
aggtgtgattccttgacatg

SEQ ID NO: 569433 - DNA, 20 bp, Artificial Sequence
  chemically synthesized
tgatatctatcctcaaatct

SEQ ID NO: 569434 - DNA, 20 bp, Artificial Sequence
  chemically synthesized
tttttaggaggtaaaaatcc

SEQ ID NO: 569435 - DNA, 20 bp, Artificial Sequence
  chemically synthesized
ggtgagaaaggcatagattt

SEQ ID NO: 569436 - DNA, 20 bp, Artificial Sequence
  chemically synthesized
tttggatatggtgagaaagg

SEQ ID NO: 569437 - DNA, 20 bp, Artificial Sequence
  chemically synthesized
gggatttggaccaagatgat

SEQ ID NO: 569438 - DNA, 20 bp, Artificial Sequence
  chemically synthesized
tgaaagccaggtgagagaag

SEQ ID NO: 569439 - DNA, 20 bp, Artificial Sequence
  chemically synthesized
ccaaatcccatcttctctca

SEQ ID NO: 569440 - DNA, 20 bp, Artificial Sequence
  chemically synthesized
ggctttcatcagtaaccttc

SEQ ID NO: 569441 - DNA, 20 bp, Artificial Sequence
  chemically synthesized
gatgaggagcctatgaatac

SEQ ID NO: 569442 - DNA, 20 bp, Artificial Sequence
  chemically synthesized
tgcatcagccagaggacttt

SEQ ID NO: 569443 - DNA, 20 bp, Artificial Sequence
  chemically synthesized
aggagggaacttgtcaatac

SEQ ID NO: 569444 - DNA, 20 bp, Artificial Sequence
  chemically synthesized
tcattgattcatttgtcaat

SEQ ID NO: 569445 - DNA, 20 bp, Artificial Sequence
  chemically synthesized
atactcttgactgattcatt

SEQ ID NO: 569446 - DNA, 20 bp, Artificial Sequence
  chemically synthesized
ttatctaaagatatactctt

SEQ ID NO: 569447 - DNA, 20 bp, Artificial Sequence
  chemically synthesized
tcaagagtatatctttagat

SEQ ID NO: 569448 - DNA, 20 bp, Artificial Sequence
  chemically synthesized
aattctaatgcacttaaatg

SEQ ID NO: 569449 - DNA, 20 bp, Artificial Sequence
  chemically synthesized
ttttaattctaatgcactta

SEQ ID NO: 569450 - DNA, 20 bp, Artificial Sequence
  chemically synthesized
agaatttctcacaaatgcta

SEQ ID NO: 569451 - DNA, 20 bp, Artificial Sequence
  chemically synthesized
ttctgaaagcagtaacaagt

SEQ ID NO: 569452 - DNA, 20 bp, Artificial Sequence
  chemically synthesized
aagtagaaactgctacttgt

SEQ ID NO: 569453 - DNA, 20 bp, Artificial Sequence
  chemically synthesized
gttattttttactgggtata

SEQ ID NO: 569454 - DNA, 20 bp, Artificial Sequence
  chemically synthesized
atcagagacacccttggaaa

SEQ ID NO: 569455 - DNA, 20 bp, Artificial Sequence
  chemically synthesized
atcattattccttaaagaag

SEQ ID NO: 569456 - DNA, 20 bp, Artificial Sequence
  chemically synthesized
aaggaataatgatgccattt

SEQ ID NO: 569457 - DNA, 20 bp, Artificial Sequence
  chemically synthesized
aatgatgccattttatagtt

SEQ ID NO: 569458 - DNA, 20 bp, Artificial Sequence
  chemically synthesized
atcattgcagagattaatta

SEQ ID NO: 569459 - DNA, 20 bp, Artificial Sequence
  chemically synthesized
ataggagtacaatatcattg

SEQ ID NO: 569460 - DNA, 20 bp, Artificial Sequence
  chemically synthesized
caattcaagaaagtaaatca

SEQ ID NO: 569461 - DNA, 20 bp, Artificial Sequence
  chemically synthesized
ttcctatgcttttgaaatct

SEQ ID NO: 569462 - DNA, 20 bp, Artificial Sequence
  chemically synthesized
taggcatctaaaaatttttc

SEQ ID NO: 569463 - DNA, 20 bp, Artificial Sequence
  chemically synthesized
gctaaaataaggatctctgt

SEQ ID NO: 569464 - DNA, 20 bp, Artificial Sequence
  chemically synthesized
aaaggagctaaaataaggat

SEQ ID NO: 569465 - DNA, 20 bp, Artificial Sequence
  chemically synthesized
gaactaagtcataaatatgc

SEQ ID NO: 569466 - DNA, 20 bp, Artificial Sequence
  chemically synthesized
gtacaatagcccccaataaa

SEQ ID NO: 569467 - DNA, 20 bp, Artificial Sequence
  chemically synthesized
aatagcccccaataaatata

SEQ ID NO: 569468 - DNA, 20 bp, Artificial Sequence
  chemically synthesized
cttcacaatatcgagctagt

SEQ ID NO: 569469 - DNA, 20 bp, Artificial Sequence
  chemically synthesized
ctgggacttcacaatatcga

SEQ ID NO: 569470 - DNA, 20 bp, Artificial Sequence
  chemically synthesized
agctcgatattgtgaagtcc

SEQ ID NO: 569471 - DNA, 20 bp, Artificial Sequence
  chemically synthesized
tctaagaaggatgtatatat

SEQ ID NO: 569472 - DNA, 20 bp, Artificial Sequence
  chemically synthesized
ctaggggaagacgtcaggac

SEQ ID NO: 569473 - DNA, 20 bp, Artificial Sequence
  chemically synthesized
ctcttgtcctgacgtcttcc

SEQ ID NO: 569474 - DNA, 20 bp, Artificial Sequence
  chemically synthesized
ctgcctgggtttagacatgt

SEQ ID NO: 569475 - DNA, 20 bp, Artificial Sequence
  chemically synthesized
ctagagctgcctgggtttag

SEQ ID NO: 569476 - DNA, 20 bp, Artificial Sequence
  chemically synthesized
tgtctaaacccaggcagctc

SEQ ID NO: 569477 - DNA, 20 bp, Artificial Sequence
  chemically synthesized
tgtagaaaccctagagctgc

SEQ ID NO: 569478 - DNA, 20 bp, Artificial Sequence
  chemically synthesized
ctagttgacaagcaattttt

SEQ ID NO: 569479 - DNA, 20 bp, Artificial Sequence
  chemically synthesized
atttaatctaaacaaaaaaa

SEQ ID NO: 569480 - DNA, 20 bp, Artificial Sequence
  chemically synthesized
tgacaagcaatttttttttg

SEQ ID NO: 569481 - DNA, 20 bp, Artificial Sequence
  chemically synthesized
aatttttttttgtttagatt

SEQ ID NO: 569482 - DNA, 20 bp, Artificial Sequence
  chemically synthesized
atacctgcccattagccata

SEQ ID NO: 569483 - DNA, 20 bp, Artificial Sequence
  chemically synthesized
atgtcttaaagggtggcttg

SEQ ID NO: 569484 - DNA, 20 bp, Artificial Sequence
  chemically synthesized
tttaaagagatgtcttaaag

SEQ ID NO: 569485 - DNA, 20 bp, Artificial Sequence
  chemically synthesized
tttatttgtaattgacaaat

SEQ ID NO: 569486 - DNA, 20 bp, Artificial Sequence
  chemically synthesized
tatatttatgggatacgatg

SEQ ID NO: 569487 - DNA, 20 bp, Artificial Sequence
  chemically synthesized
gtgaggtaatggatacgtta

SEQ ID NO: 569488 - DNA, 20 bp, Artificial Sequence
  chemically synthesized
tatttcaaaattgctaaaag

SEQ ID NO: 569489 - DNA, 20 bp, Artificial Sequence
  chemically synthesized
tactgcaatggaacactaaa

SEQ ID NO: 569490 - DNA, 20 bp, Artificial Sequence
  chemically synthesized
aacaaatttggtagggaaaa

SEQ ID NO: 569491 - DNA, 20 bp, Artificial Sequence
  chemically synthesized
tgctgaaagccgaggagaca

SEQ ID NO: 569492 - DNA, 20 bp, Artificial Sequence
  chemically synthesized
gagggcaatccaggtgtctc

SEQ ID NO: 569493 - DNA, 20 bp, Artificial Sequence
  chemically synthesized
ctccaatgcatcagcaagac

SEQ ID NO: 569494 - DNA, 20 bp, Artificial Sequence
  chemically synthesized
aatgcatcagcaagacctgt

SEQ ID NO: 569495 - DNA, 20 bp, Artificial Sequence
  chemically synthesized
gattgtttctaaaccatatt

SEQ ID NO: 569496 - DNA, 20 bp, Artificial Sequence
  chemically synthesized
aggtggttggaatcagggaa

SEQ ID NO: 569497 - DNA, 20 bp, Artificial Sequence
  chemically synthesized
atctagatcttatctaacac

SEQ ID NO: 569498 - DNA, 20 bp, Artificial Sequence
  chemically synthesized
cccacactactatctggtct

SEQ ID NO: 569499 - DNA, 20 bp, Artificial Sequence
  chemically synthesized
ataatgcagtttgaaagtag

SEQ ID NO: 569500 - DNA, 20 bp, Artificial Sequence
  chemically synthesized
ttgctggtgctttgttataa

SEQ ID NO: 569501 - DNA, 20 bp, Artificial Sequence
  chemically synthesized
ggaggtgtttggttttttgc

SEQ ID NO: 569502 - DNA, 20 bp, Artificial Sequence
  chemically synthesized
ggtgaagtttgttggaggtg

SEQ ID NO: 569503 - DNA, 20 bp, Artificial Sequence
  chemically synthesized
gcctaggtgaagtttgttgg

SEQ ID NO: 569504 - DNA, 20 bp, Artificial Sequence
  chemically synthesized
acacctccaacaaacttcac

SEQ ID NO: 569505 - DNA, 20 bp, Artificial Sequence
  chemically synthesized
gacctttatcaaagcctagg

SEQ ID NO: 569506 - DNA, 20 bp, Artificial Sequence
  chemically synthesized
acctaggctttgataaaggt

SEQ ID NO: 569507 - DNA, 20 bp, Artificial Sequence
  chemically synthesized
ttacaaattagccaagtata

SEQ ID NO: 569508 - DNA, 20 bp, Artificial Sequence
  chemically synthesized
atttgtaacaccattgaaag

SEQ ID NO: 569509 - DNA, 20 bp, Artificial Sequence
  chemically synthesized
tttgccagacaatatgtctt

SEQ ID NO: 569510 - DNA, 20 bp, Artificial Sequence
  chemically synthesized
atattttgccagacaatatg

SEQ ID NO: 569511 - DNA, 20 bp, Artificial Sequence
  chemically synthesized
atattttttgctgttgttgt

SEQ ID NO: 569512 - DNA, 20 bp, Artificial Sequence
  chemically synthesized
gtccagctacctgggacttc

SEQ ID NO: 569513 - DNA, 20 bp, Artificial Sequence
  chemically synthesized
tcccaggtagctggacattt

SEQ ID NO: 569514 - DNA, 20 bp, Artificial Sequence
  chemically synthesized
taaatatgttttcccaattt

SEQ ID NO: 569515 - DNA, 20 bp, Artificial Sequence
  chemically synthesized
tgacttgaatattatagtaa

SEQ ID NO: 569516 - DNA, 20 bp, Artificial Sequence
  chemically synthesized
agaatggagaattgcccaat

SEQ ID NO: 569517 - DNA, 20 bp, Artificial Sequence
  chemically synthesized
ccaattagggtttatataaa

SEQ ID NO: 569518 - DNA, 20 bp, Artificial Sequence
  chemically synthesized
attataaagatataatttag

SEQ ID NO: 569519 - DNA, 20 bp, Artificial Sequence
  chemically synthesized
tataatgtataacccttaag

SEQ ID NO: 569520 - DNA, 20 bp, Artificial Sequence
  chemically synthesized
actgaacagtgcagcagctc

SEQ ID NO: 569521 - DNA, 20 bp, Artificial Sequence
  chemically synthesized
atgcctaaatttaatttcct

SEQ ID NO: 569522 - DNA, 20 bp, Artificial Sequence
  chemically synthesized
atttcatctccgcctgactt

SEQ ID NO: 569523 - DNA, 20 bp, Artificial Sequence
  chemically synthesized
atatcccaaattaaatttcc

SEQ ID NO: 569524 - DNA, 20 bp, Artificial Sequence
  chemically synthesized
caatagtgttggctatagtg

SEQ ID NO: 569525 - DNA, 20 bp, Artificial Sequence
  chemically synthesized
ctgttcactatagccaacac

SEQ ID NO: 569526 - DNA, 20 bp, Artificial Sequence
  chemically synthesized
aaatgataaaataattacaa

SEQ ID NO: 569527 - DNA, 20 bp, Artificial Sequence
  chemically synthesized
tattttatcatttctctatt

SEQ ID NO: 569528 - DNA, 20 bp, Artificial Sequence
  chemically synthesized
gtactttgtcaatttaggaa

SEQ ID NO: 569529 - DNA, 20 bp, Artificial Sequence
  chemically synthesized
tcatgcttgactgtaccaac

SEQ ID NO: 569530 - DNA, 20 bp, Artificial Sequence
  chemically synthesized
tggtggctttattcagagat

SEQ ID NO: 569531 - DNA, 20 bp, Artificial Sequence
  chemically synthesized
tcaaagttggtggctttatt

SEQ ID NO: 569532 - DNA, 20 bp, Artificial Sequence
  chemically synthesized
tggaaacacttctcaaagtt

SEQ ID NO: 569533 - DNA, 20 bp, Artificial Sequence
  chemically synthesized
ataaagccaccaactttgag

SEQ ID NO: 569534 - DNA, 20 bp, Artificial Sequence
  chemically synthesized
catcgtgaacacctttatca

SEQ ID NO: 569535 - DNA, 20 bp, Artificial Sequence
  chemically synthesized
cacgatggaactaaaagtta

SEQ ID NO: 569536 - DNA, 20 bp, Artificial Sequence
  chemically synthesized
tggattaaaatattgctggt

SEQ ID NO: 569537 - DNA, 20 bp, Artificial Sequence
  chemically synthesized
aaatattgctggtctgggat

SEQ ID NO: 569538 - DNA, 20 bp, Artificial Sequence
  chemically synthesized
attcatgcttccccaagcaa

SEQ ID NO: 569539 - DNA, 20 bp, Artificial Sequence
  chemically synthesized
aaaatcccctagcaaatcaa

SEQ ID NO: 569540 - DNA, 20 bp, Artificial Sequence
  chemically synthesized
ccaagcaatattgatttgct

SEQ ID NO: 569541 - DNA, 20 bp, Artificial Sequence
  chemically synthesized
tttaaaatattttatattta

SEQ ID NO: 569542 - DNA, 20 bp, Artificial Sequence
  chemically synthesized
tatttatgttgctttttttc

SEQ ID NO: 569543 - DNA, 20 bp, Artificial Sequence
  chemically synthesized
atgttttactgaattaattc

SEQ ID NO: 569544 - DNA, 20 bp, Artificial Sequence
  chemically synthesized
gtaagggtatggcccatact

SEQ ID NO: 569545 - DNA, 20 bp, Artificial Sequence
  chemically synthesized
tctattacacatcaggactt

SEQ ID NO: 569546 - DNA, 20 bp, Artificial Sequence
  chemically synthesized
cttctcagaaaaaatgactt

SEQ ID NO: 569547 - DNA, 20 bp, Artificial Sequence
  chemically synthesized
aaaatgactttgtagtttga

SEQ ID NO: 569548 - DNA, 20 bp, Artificial Sequence
  chemically synthesized
tttccagttcacaagtgaaa

SEQ ID NO: 569549 - DNA, 20 bp, Artificial Sequence
  chemically synthesized
gtagattcagagcatactaa

SEQ ID NO: 569550 - DNA, 20 bp, Artificial Sequence
  chemically synthesized
tgctctgaatctaccagtca

SEQ ID NO: 569551 - DNA, 20 bp, Artificial Sequence
  chemically synthesized
gaagatgaaacatactgact

SEQ ID NO: 569552 - DNA, 20 bp, Artificial Sequence
  chemically synthesized
catcttccacctcaacattg

SEQ ID NO: 569553 - DNA, 20 bp, Artificial Sequence
  chemically synthesized
atattccaagtccttgaatg

SEQ ID NO: 569554 - DNA, 20 bp, Artificial Sequence
  chemically synthesized
tgatgccttttgctactcta

SEQ ID NO: 569555 - DNA, 20 bp, Artificial Sequence
  chemically synthesized
tagtgctttcagtaaaaaga

SEQ ID NO: 569556 - DNA, 20 bp, Artificial Sequence
  chemically synthesized
tgctttattatcaaggacct

SEQ ID NO: 569557 - DNA, 20 bp, Artificial Sequence
  chemically synthesized
atctcatgatatcgttttaa

SEQ ID NO: 569558 - DNA, 20 bp, Artificial Sequence
  chemically synthesized
ggagaaacatcatctcatga

SEQ ID NO: 569559 - DNA, 20 bp, Artificial Sequence
  chemically synthesized
tttaaaacgatatcatgaga

SEQ ID NO: 569560 - DNA, 20 bp, Artificial Sequence
  chemically synthesized
ttttttcacacatagttttt

SEQ ID NO: 569561 - DNA, 20 bp, Artificial Sequence
  chemically synthesized
gagccgatttttttttcaca

SEQ ID NO: 569562 - DNA, 20 bp, Artificial Sequence
  chemically synthesized
gcccgatgttgatacaagag

SEQ ID NO: 569563 - DNA, 20 bp, Artificial Sequence
  chemically synthesized
tatcattaccagacacatac

SEQ ID NO: 569564 - DNA, 20 bp, Artificial Sequence
  chemically synthesized
ttagaattcagttatactca

SEQ ID NO: 569565 - DNA, 20 bp, Artificial Sequence
  chemically synthesized
ccagtagggaagaaaagact

SEQ ID NO: 569566 - DNA, 20 bp, Artificial Sequence
  chemically synthesized
gctctgcctcaatgtatgtc

SEQ ID NO: 569567 - DNA, 20 bp, Artificial Sequence
  chemically synthesized
cagcctttttggcaccaggc

SEQ ID NO: 569568 - DNA, 20 bp, Artificial Sequence
  chemically synthesized
ctgggaggcaggggcggggg

SEQ ID NO: 569569 - DNA, 20 bp, Artificial Sequence
  chemically synthesized
tgcctgatgatctgaggtgg

SEQ ID NO: 569570 - DNA, 20 bp, Artificial Sequence
  chemically synthesized
tccacctcagatcatcaggc

SEQ ID NO: 569571 - DNA, 20 bp, Artificial Sequence
  chemically synthesized
ctcgcatacatagttcacaa

SEQ ID NO: 569572 - DNA, 20 bp, Artificial Sequence
  chemically synthesized
cctgtcagatcagtcgtggc

SEQ ID NO: 569573 - DNA, 20 bp, Artificial Sequence
  chemically synthesized
agggatccctctattaagac

SEQ ID NO: 569574 - DNA, 20 bp, Artificial Sequence
  chemically synthesized
gaacaatgctggctcctgaa

SEQ ID NO: 569575 - DNA, 20 bp, Artificial Sequence
  chemically synthesized
ctggctcctgaagaaagctt

SEQ ID NO: 569576 - DNA, 20 bp, Artificial Sequence
  chemically synthesized
atcctcttctatcaaaactc

SEQ ID NO: 569577 - DNA, 20 bp, Artificial Sequence
  chemically synthesized
agcttgggagttttgataga

SEQ ID NO: 569578 - DNA, 20 bp, Artificial Sequence
  chemically synthesized
tttgatagaagaggatttta

SEQ ID NO: 569579 - DNA, 20 bp, Artificial Sequence
  chemically synthesized
ttttcctaagatattctcac

SEQ ID NO: 569580 - DNA, 20 bp, Artificial Sequence
  chemically synthesized
gaaggaatatattcacttaa

SEQ ID NO: 569581 - DNA, 20 bp, Artificial Sequence
  chemically synthesized
ttcttcaaaacagtaacttt

SEQ ID NO: 569582 - DNA, 20 bp, Artificial Sequence
  chemically synthesized
aactataaatctttgaaagt

SEQ ID NO: 569583 - DNA, 20 bp, Artificial Sequence
  chemically synthesized
aacagtaactttcaaagatt

SEQ ID NO: 569584 - DNA, 20 bp, Artificial Sequence
  chemically synthesized
ttgatggggttgattgcctg

SEQ ID NO: 569585 - DNA, 20 bp, Artificial Sequence
  chemically synthesized
atggggttgagtgttgatgg

SEQ ID NO: 569586 - DNA, 20 bp, Artificial Sequence
  chemically synthesized
agtccatttattttgtatat

SEQ ID NO: 569587 - DNA, 20 bp, Artificial Sequence
  chemically synthesized
aaataaatggactgctaaaa

SEQ ID NO: 569588 - DNA, 20 bp, Artificial Sequence
  chemically synthesized
gtttattaaattacatttgg

SEQ ID NO: 569589 - DNA, 20 bp, Artificial Sequence
  chemically synthesized
ctagatagccccactggtgt

SEQ ID NO: 569590 - DNA, 20 bp, Artificial Sequence
  chemically synthesized
caggaagatcacttgagtcc

SEQ ID NO: 569591 - DNA, 20 bp, Artificial Sequence
  chemically synthesized
ctcctggactcaagtgatct

SEQ ID NO: 569592 - DNA, 20 bp, Artificial Sequence
  chemically synthesized
gactcaagtgatcttcctgc

SEQ ID NO: 569593 - DNA, 20 bp, Artificial Sequence
  chemically synthesized
aaaaatagatggcacggcac

SEQ ID NO: 569594 - DNA, 20 bp, Artificial Sequence
  chemically synthesized
cgtgccatctatttttttgt

SEQ ID NO: 569595 - DNA, 20 bp, Artificial Sequence
  chemically synthesized
aacctctgcctccagggttc

SEQ ID NO: 569596 - DNA, 20 bp, Artificial Sequence
  chemically synthesized
tgcctcagcctcctgagtag

SEQ ID NO: 569597 - DNA, 20 bp, Artificial Sequence
  chemically synthesized
ggtcttgaactcctgacctc

SEQ ID NO: 569598 - DNA, 20 bp, Artificial Sequence
  chemically synthesized
cacctcagcctcccaaagtg

SEQ ID NO: 569599 - DNA, 20 bp, Artificial Sequence
  chemically synthesized
ctgagctatgatcccaatag

SEQ ID NO: 569600 - DNA, 20 bp, Artificial Sequence
  chemically synthesized
catacctattgggatcatag

SEQ ID NO: 569601 - DNA, 20 bp, Artificial Sequence
  chemically synthesized
tgggatcatagctcagcttc

SEQ ID NO: 569602 - DNA, 20 bp, Artificial Sequence
  chemically synthesized
ttgatcatttgttttgattt

SEQ ID NO: 569603 - DNA, 20 bp, Artificial Sequence
  chemically synthesized
aataaatacttgatcatttg

SEQ ID NO: 569604 - DNA, 20 bp, Artificial Sequence
  chemically synthesized
ataataataaatacttgatc

SEQ ID NO: 569605 - DNA, 20 bp, Artificial Sequence
  chemically synthesized
ataaggcacaagcgttgtca

SEQ ID NO: 569606 - DNA, 20 bp, Artificial Sequence
  chemically synthesized
ttcagctgtaaactctctga

SEQ ID NO: 569607 - DNA, 20 bp, Artificial Sequence
  chemically synthesized
ctaagaccccaagttttctt

SEQ ID NO: 569608 - DNA, 20 bp, Artificial Sequence
  chemically synthesized
ataacgtcccagctaagacc

SEQ ID NO: 569609 - DNA, 20 bp, Artificial Sequence
  chemically synthesized
aggctcttgctatttctagg

SEQ ID NO: 569610 - DNA, 20 bp, Artificial Sequence
  chemically synthesized
accctggccttttcttagac

SEQ ID NO: 569611 - DNA, 20 bp, Artificial Sequence
  chemically synthesized
tttttccttaacatcttgtc

SEQ ID NO: 569612 - DNA, 20 bp, Artificial Sequence
  chemically synthesized
cttacacaatttgtgtttat

SEQ ID NO: 569613 - DNA, 20 bp, Artificial Sequence
  chemically synthesized
aaatgttatacttacacaat

SEQ ID NO: 569614 - DNA, 20 bp, Artificial Sequence
  chemically synthesized
cacatcagactcacacaaat

SEQ ID NO: 569615 - DNA, 20 bp, Artificial Sequence
  chemically synthesized
gattggtactagataagaat

SEQ ID NO: 569616 - DNA, 20 bp, Artificial Sequence
  chemically synthesized
ataattctttcagtcattaa

SEQ ID NO: 569617 - DNA, 20 bp, Artificial Sequence
  chemically synthesized
ggaacctgaaataatcacac

SEQ ID NO: 569618 - DNA, 20 bp, Artificial Sequence
  chemically synthesized
tggatgttttggaaacgcat

SEQ ID NO: 569619 - DNA, 20 bp, Artificial Sequence
  chemically synthesized
atcataatgggaaataacat

SEQ ID NO: 569620 - DNA, 20 bp, Artificial Sequence
  chemically synthesized
ccatgttatttcccattatg

SEQ ID NO: 569621 - DNA, 20 bp, Artificial Sequence
  chemically synthesized
tatttcccattatgatgtgc

SEQ ID NO: 569622 - DNA, 20 bp, Artificial Sequence
  chemically synthesized
ctttggtttcatattaacag

SEQ ID NO: 569623 - DNA, 20 bp, Artificial Sequence
  chemically synthesized
agactgaaatgatttccttt

SEQ ID NO: 569624 - DNA, 20 bp, Artificial Sequence
  chemically synthesized
aaggaaatcatttcagtctc

SEQ ID NO: 569625 - DNA, 20 bp, Artificial Sequence
  chemically synthesized
atggaaaacttttgagactg

SEQ ID NO: 569626 - DNA, 20 bp, Artificial Sequence
  chemically synthesized
gtttttctatttttgtaatt

SEQ ID NO: 569627 - DNA, 20 bp, Artificial Sequence
  chemically synthesized
agaatagggcatagctacat

SEQ ID NO: 569628 - DNA, 20 bp, Artificial Sequence
  chemically synthesized
gactcataaatccaaacatt

SEQ ID NO: 569629 - DNA, 20 bp, Artificial Sequence
  chemically synthesized
ttgtaaataaacctggaatg

SEQ ID NO: 569630 - DNA, 20 bp, Artificial Sequence
  chemically synthesized
gcttattgtaaataaacctg

SEQ ID NO: 569631 - DNA, 20 bp, Artificial Sequence
  chemically synthesized
gggtatacctggcctggcta

SEQ ID NO: 569632 - DNA, 20 bp, Artificial Sequence
  chemically synthesized
tactaaaatcattttataga

SEQ ID NO: 569633 - DNA, 20 bp, Artificial Sequence
  chemically synthesized
cctgcaaatccctatctata

SEQ ID NO: 569634 - DNA, 20 bp, Artificial Sequence
  chemically synthesized
gttaatgacctcccagacct

SEQ ID NO: 569635 - DNA, 20 bp, Artificial Sequence
  chemically synthesized
gaaggtctgggaggtcatta

SEQ ID NO: 569636 - DNA, 20 bp, Artificial Sequence
  chemically synthesized
tgttaataccctttattctc

SEQ ID NO: 569637 - DNA, 20 bp, Artificial Sequence
  chemically synthesized
ctcagcccctcctgctctat

SEQ ID NO: 569638 - DNA, 20 bp, Artificial Sequence
  chemically synthesized
aggattcattcttttctatt

SEQ ID NO: 569639 - DNA, 20 bp, Artificial Sequence
  chemically synthesized
tatcaaataaaggctagatt

SEQ ID NO: 569640 - DNA, 20 bp, Artificial Sequence
  chemically synthesized
aagtgctttatcaaataaag

SEQ ID NO: 569641 - DNA, 20 bp, Artificial Sequence
  chemically synthesized
ctgtgttaatatgtaaatac

SEQ ID NO: 569642 - DNA, 20 bp, Artificial Sequence
  chemically synthesized
gggtgcctacatttttcgga

SEQ ID NO: 569643 - DNA, 20 bp, Artificial Sequence
  chemically synthesized
ccgtgtttgtgccactgcac

SEQ ID NO: 569644 - DNA, 20 bp, Artificial Sequence
  chemically synthesized
aaagttgaggctatagtgaa

SEQ ID NO: 569645 - DNA, 20 bp, Artificial Sequence
  chemically synthesized
acaggatgctgaggcaggag

SEQ ID NO: 569646 - DNA, 20 bp, Artificial Sequence
  chemically synthesized
gcacacaggatgctgaggca

SEQ ID NO: 569647 - DNA, 20 bp, Artificial Sequence
  chemically synthesized
aaaatccttggcatggtggc

SEQ ID NO: 569648 - DNA, 20 bp, Artificial Sequence
  chemically synthesized
acaagcacatgccaccatgc

SEQ ID NO: 569649 - DNA, 20 bp, Artificial Sequence
  chemically synthesized
ggtatcattttgttgctcag

SEQ ID NO: 569650 - DNA, 20 bp, Artificial Sequence
  chemically synthesized
ctcaggctggcttcgaactc

SEQ ID NO: 569651 - DNA, 20 bp, Artificial Sequence
  chemically synthesized
ctcctgggcttaagtgttcc

SEQ ID NO: 569652 - DNA, 20 bp, Artificial Sequence
  chemically synthesized
tgctttgaccccccaaagtg

SEQ ID NO: 569653 - DNA, 20 bp, Artificial Sequence
  chemically synthesized
ccccccaaagtgctgggatt

SEQ ID NO: 569654 - DNA, 20 bp, Artificial Sequence
  chemically synthesized
tgtgcccagctatattcaga

SEQ ID NO: 569655 - DNA, 20 bp, Artificial Sequence
  chemically synthesized
aaataatggcttatgttttc

SEQ ID NO: 569656 - DNA, 20 bp, Artificial Sequence
  chemically synthesized
ttttgaagataaataatggc

SEQ ID NO: 569657 - DNA, 20 bp, Artificial Sequence
  chemically synthesized
atatgtttttgaagataaat

SEQ ID NO: 569658 - DNA, 20 bp, Artificial Sequence
  chemically synthesized
cttcaaaaacatattaattg

SEQ ID NO: 569659 - DNA, 20 bp, Artificial Sequence
  chemically synthesized
aaaagcaatctgggcaatta

SEQ ID NO: 569660 - DNA, 20 bp, Artificial Sequence
  chemically synthesized
aaaaacatattaattgccca

SEQ ID NO: 569661 - DNA, 20 bp, Artificial Sequence
  chemically synthesized
gactcagtattcccccagct

SEQ ID NO: 569662 - DNA, 20 bp, Artificial Sequence
  chemically synthesized
ttaagccagaggcctatggt

SEQ ID NO: 569663 - DNA, 20 bp, Artificial Sequence
  chemically synthesized
taaagctagaaccataggcc

SEQ ID NO: 569664 - DNA, 20 bp, Artificial Sequence
  chemically synthesized
tttgcaacatttgtgcatgt

SEQ ID NO: 569665 - DNA, 20 bp, Artificial Sequence
  chemically synthesized
tacttaataaatgtcatgga

SEQ ID NO: 569666 - DNA, 20 bp, Artificial Sequence
  chemically synthesized
tcatattccaccacctccat

SEQ ID NO: 569667 - DNA, 20 bp, Artificial Sequence
  chemically synthesized
tggaatatgacttagaaatc

SEQ ID NO: 569668 - DNA, 20 bp, Artificial Sequence
  chemically synthesized
gaccaatggagcagaaaagc

SEQ ID NO: 569669 - DNA, 20 bp, Artificial Sequence
  chemically synthesized
tctgctccattggtctatat

SEQ ID NO: 569670 - DNA, 20 bp, Artificial Sequence
  chemically synthesized
ctgttttggtaccagtacca

SEQ ID NO: 569671 - DNA, 20 bp, Artificial Sequence
  chemically synthesized
tggttactgtagccttgtag

SEQ ID NO: 569672 - DNA, 20 bp, Artificial Sequence
  chemically synthesized
aattcaggtggtgtgatgcc

SEQ ID NO: 569673 - DNA, 20 bp, Artificial Sequence
  chemically synthesized
gatgcctctagctttgttct

SEQ ID NO: 569674 - DNA, 20 bp, Artificial Sequence
  chemically synthesized
tcttggctatacggggtctt

SEQ ID NO: 569675 - DNA, 20 bp, Artificial Sequence
  chemically synthesized
tgattccacatgaaatttaa

SEQ ID NO: 569676 - DNA, 20 bp, Artificial Sequence
  chemically synthesized
cttcacagaattaaaaaaaa

SEQ ID NO: 569677 - DNA, 20 bp, Artificial Sequence
  chemically synthesized
aattctgtgaagaaggtcat

SEQ ID NO: 569678 - DNA, 20 bp, Artificial Sequence
  chemically synthesized
ttatactgcccaaagtaatt

SEQ ID NO: 569679 - DNA, 20 bp, Artificial Sequence
  chemically synthesized
cagtataaccattttcacga

SEQ ID NO: 569680 - DNA, 20 bp, Artificial Sequence
  chemically synthesized
tgtcaggtttatcaaagatc

SEQ ID NO: 569681 - DNA, 20 bp, Artificial Sequence
  chemically synthesized
ttccccattgcttgtttttg

SEQ ID NO: 569682 - DNA, 20 bp, Artificial Sequence
  chemically synthesized
taggagatcctttccccatt

SEQ ID NO: 569683 - DNA, 20 bp, Artificial Sequence
  chemically synthesized
tgaataggagatcctttccc

SEQ ID NO: 569684 - DNA, 20 bp, Artificial Sequence
  chemically synthesized
tggctagagagttttcccag

SEQ ID NO: 569685 - DNA, 20 bp, Artificial Sequence
  chemically synthesized
ctgttttctgcatatggcta

SEQ ID NO: 569686 - DNA, 20 bp, Artificial Sequence
  chemically synthesized
ctgtaagggaggggtccagt

SEQ ID NO: 569687 - DNA, 20 bp, Artificial Sequence
  chemically synthesized
tgtaagctgtaagggagggg

SEQ ID NO: 569688 - DNA, 20 bp, Artificial Sequence
  chemically synthesized
cagaaactggacccctccct

SEQ ID NO: 569689 - DNA, 20 bp, Artificial Sequence
  chemically synthesized
ttacacaaaaattaactcaa

SEQ ID NO: 569690 - DNA, 20 bp, Artificial Sequence
  chemically synthesized
cttctagggtttttaggatt

SEQ ID NO: 569691 - DNA, 20 bp, Artificial Sequence
  chemically synthesized
taggtttccttctagggttt

SEQ ID NO: 569692 - DNA, 20 bp, Artificial Sequence
  chemically synthesized
gtattgcctaggtttccttc

SEQ ID NO: 569693 - DNA, 20 bp, Artificial Sequence
  chemically synthesized
tatgtcttaaatggtattgc

SEQ ID NO: 569694 - DNA, 20 bp, Artificial Sequence
  chemically synthesized
tcttttgttgcagttgcttt

SEQ ID NO: 569695 - DNA, 20 bp, Artificial Sequence
  chemically synthesized
tcaattttgtcttttgttgc

SEQ ID NO: 569696 - DNA, 20 bp, Artificial Sequence
  chemically synthesized
aatggaatctaattaaacta

SEQ ID NO: 569697 - DNA, 20 bp, Artificial Sequence
  chemically synthesized
tgcagaagctctttagttta

SEQ ID NO: 569698 - DNA, 20 bp, Artificial Sequence
  chemically synthesized
cttttgctgtgcagaagctc

SEQ ID NO: 569699 - DNA, 20 bp, Artificial Sequence
  chemically synthesized
ggttgcctattcactttgat

SEQ ID NO: 569700 - DNA, 20 bp, Artificial Sequence
  chemically synthesized
gtcagatgggtagattgaaa

SEQ ID NO: 569701 - DNA, 20 bp, Artificial Sequence
  chemically synthesized
tattagacctttgtcagatg

SEQ ID NO: 569702 - DNA, 20 bp, Artificial Sequence
  chemically synthesized
tgtttgtctttttcttgtga

SEQ ID NO: 569703 - DNA, 20 bp, Artificial Sequence
  chemically synthesized
ctttgcccactttttgatag

SEQ ID NO: 569704 - DNA, 20 bp, Artificial Sequence
  chemically synthesized
gtgatgttgagctttttttc

SEQ ID NO: 569705 - DNA, 20 bp, Artificial Sequence
  chemically synthesized
ttctctgatgatcagtgatg

SEQ ID NO: 569706 - DNA, 20 bp, Artificial Sequence
  chemically synthesized
ggtgtgagatggtatctcat

SEQ ID NO: 569707 - DNA, 20 bp, Artificial Sequence
  chemically synthesized
ccatctcacaccagtcagaa

SEQ ID NO: 569708 - DNA, 20 bp, Artificial Sequence
  chemically synthesized
tccacagcctagccagcatc

SEQ ID NO: 569709 - DNA, 20 bp, Artificial Sequence
  chemically synthesized
gctaggctgtggagaaatgg

SEQ ID NO: 569710 - DNA, 20 bp, Artificial Sequence
  chemically synthesized
agatccttgaggaattgcca

SEQ ID NO: 569711 - DNA, 20 bp, Artificial Sequence
  chemically synthesized
atgcatgtgtctttatagta

SEQ ID NO: 569712 - DNA, 20 bp, Artificial Sequence
  chemically synthesized
ctataaagacacatgcatat

SEQ ID NO: 569713 - DNA, 20 bp, Artificial Sequence
  chemically synthesized
tttatggctgcgtagtattc

SEQ ID NO: 569714 - DNA, 20 bp, Artificial Sequence
  chemically synthesized
gtttgctgaggatgatggct

SEQ ID NO: 569715 - DNA, 20 bp, Artificial Sequence
  chemically synthesized
tgtgttagtttgctgaggat

SEQ ID NO: 569716 - DNA, 20 bp, Artificial Sequence
  chemically synthesized
gtttggttttctgttcctgt

SEQ ID NO: 569717 - DNA, 20 bp, Artificial Sequence
  chemically synthesized
gtgagtgagaacatgcagcg

SEQ ID NO: 569718 - DNA, 20 bp, Artificial Sequence
  chemically synthesized
cacttgtgagtgagaacatg

SEQ ID NO: 569719 - DNA, 20 bp, Artificial Sequence
  chemically synthesized
ccccaacaggccctggtgtg

SEQ ID NO: 569720 - DNA, 20 bp, Artificial Sequence
  chemically synthesized
caatgcacaccagggcctgt

SEQ ID NO: 569721 - DNA, 20 bp, Artificial Sequence
  chemically synthesized
gagatacatgtgcagaacgt

SEQ ID NO: 569722 - DNA, 20 bp, Artificial Sequence
  chemically synthesized
tgcacgttctgcacatgtat

SEQ ID NO: 569723 - DNA, 20 bp, Artificial Sequence
  chemically synthesized
acatgtatctcggttttttg

SEQ ID NO: 569724 - DNA, 20 bp, Artificial Sequence
  chemically synthesized
aaggggggagatctcatttt

SEQ ID NO: 569725 - DNA, 20 bp, Artificial Sequence
  chemically synthesized
ttttttttaatttttaaaat

SEQ ID NO: 569726 - DNA, 20 bp, Artificial Sequence
  chemically synthesized
ttttttttttttaattttta

SEQ ID NO: 569727 - DNA, 20 bp, Artificial Sequence
  chemically synthesized
aaaaaaaaaaaaaagaaata

SEQ ID NO: 569728 - DNA, 20 bp, Artificial Sequence
  chemically synthesized
cagcctgcagggaggtagaa

SEQ ID NO: 569729 - DNA, 20 bp, Artificial Sequence
  chemically synthesized
agtgcttacatcagggctgg

SEQ ID NO: 569730 - DNA, 20 bp, Artificial Sequence
  chemically synthesized
tacatcagggctggccaagt

SEQ ID NO: 569731 - DNA, 20 bp, Artificial Sequence
  chemically synthesized
ctggccaagtttttgtttca

SEQ ID NO: 569732 - DNA, 20 bp, Artificial Sequence
  chemically synthesized
cagagacctaagttactctt

SEQ ID NO: 569733 - DNA, 20 bp, Artificial Sequence
  chemically synthesized
gagtaacttaggtctctgca

SEQ ID NO: 569734 - DNA, 20 bp, Artificial Sequence
  chemically synthesized
agtccttccctgcactgtta

SEQ ID NO: 569735 - DNA, 20 bp, Artificial Sequence
  chemically synthesized
gtgcagggaaggactactag

SEQ ID NO: 569736 - DNA, 20 bp, Artificial Sequence
  chemically synthesized
caagatggcagcctcacagt

SEQ ID NO: 569737 - DNA, 20 bp, Artificial Sequence
  chemically synthesized
cacatttggttatacaaatg

SEQ ID NO: 569738 - DNA, 20 bp, Artificial Sequence
  chemically synthesized
ctgtttcaactttctaatgt

SEQ ID NO: 569739 - DNA, 20 bp, Artificial Sequence
  chemically synthesized
ttctagctgtttcaactttc

SEQ ID NO: 569740 - DNA, 20 bp, Artificial Sequence
  chemically synthesized
tcatctcagctattgcttct

SEQ ID NO: 569741 - DNA, 20 bp, Artificial Sequence
  chemically synthesized
ataatcatcatcatctcagc

SEQ ID NO: 569742 - DNA, 20 bp, Artificial Sequence
  chemically synthesized
agaagcaatagctgagatga

SEQ ID NO: 569743 - DNA, 20 bp, Artificial Sequence
  chemically synthesized
gagatgatgatgattatttt

SEQ ID NO: 569744 - DNA, 20 bp, Artificial Sequence
  chemically synthesized
ataaatttctgaggtacaag

SEQ ID NO: 569745 - DNA, 20 bp, Artificial Sequence
  chemically synthesized
tgtattgcatagtggtgaac

SEQ ID NO: 569746 - DNA, 20 bp, Artificial Sequence
  chemically synthesized
atgataagaaggatagacat

SEQ ID NO: 569747 - DNA, 20 bp, Artificial Sequence
  chemically synthesized
aatgtctatccttcttatca

SEQ ID NO: 569748 - DNA, 20 bp, Artificial Sequence
  chemically synthesized
agctgagattcaaaaaagtt

SEQ ID NO: 569749 - DNA, 20 bp, Artificial Sequence
  chemically synthesized
ctccaacttttttgaatctc

SEQ ID NO: 569750 - DNA, 20 bp, Artificial Sequence
  chemically synthesized
aaaaaaaaaggaagaaacag

SEQ ID NO: 569751 - DNA, 20 bp, Artificial Sequence
  chemically synthesized
aacctccgcctccctggttc

SEQ ID NO: 569752 - DNA, 20 bp, Artificial Sequence
  chemically synthesized
tgcatgccactacattcagc

SEQ ID NO: 569753 - DNA, 20 bp, Artificial Sequence
  chemically synthesized
ttttgtatctttggtagaga

SEQ ID NO: 569754 - DNA, 20 bp, Artificial Sequence
  chemically synthesized
caccttggcctgccaaagtg

SEQ ID NO: 569755 - DNA, 20 bp, Artificial Sequence
  chemically synthesized
agccaccacgcccgactgat

SEQ ID NO: 569756 - DNA, 20 bp, Artificial Sequence
  chemically synthesized
ggataataagtggagtgtta

SEQ ID NO: 569757 - DNA, 20 bp, Artificial Sequence
  chemically synthesized
ctactatgtgctaaatgaca

SEQ ID NO: 569758 - DNA, 20 bp, Artificial Sequence
  chemically synthesized
catagtaggcacacattaaa

SEQ ID NO: 569759 - DNA, 20 bp, Artificial Sequence
  chemically synthesized
ctgctagacaggaagaaaag

SEQ ID NO: 569760 - DNA, 20 bp, Artificial Sequence
  chemically synthesized
ctttgcttttcttcctgtct

SEQ ID NO: 569761 - DNA, 20 bp, Artificial Sequence
  chemically synthesized
atggacttatctatgagaca

SEQ ID NO: 569762 - DNA, 20 bp, Artificial Sequence
  chemically synthesized
ttggtcactatttcttgttc

SEQ ID NO: 569763 - DNA, 20 bp, Artificial Sequence
  chemically synthesized
caaaaggaaagaaaacaaca

SEQ ID NO: 569764 - DNA, 20 bp, Artificial Sequence
  chemically synthesized
tgctttagaaggaatcgttt

SEQ ID NO: 569765 - DNA, 20 bp, Artificial Sequence
  chemically synthesized
ttctttgttgctttagaagg

SEQ ID NO: 569766 - DNA, 20 bp, Artificial Sequence
  chemically synthesized
taatttttaacttgcttctt

SEQ ID NO: 569767 - DNA, 20 bp, Artificial Sequence
  chemically synthesized
agtgcaatgtgtaattttta

SEQ ID NO: 569768 - DNA, 20 bp, Artificial Sequence
  chemically synthesized
gcactgaccatctgacatgc

SEQ ID NO: 569769 - DNA, 20 bp, Artificial Sequence
  chemically synthesized
gcttttttctgtttttcttt

SEQ ID NO: 569770 - DNA, 20 bp, Artificial Sequence
  chemically synthesized
tgaaactctcaactgctttt

SEQ ID NO: 569771 - DNA, 20 bp, Artificial Sequence
  chemically synthesized
aaaaacagaaaaaagcagtt

SEQ ID NO: 569772 - DNA, 20 bp, Artificial Sequence
  chemically synthesized
ctgctcttcctgaaactctc

SEQ ID NO: 569773 - DNA, 20 bp, Artificial Sequence
  chemically synthesized
gagagtttcaggaagagcag

SEQ ID NO: 569774 - DNA, 20 bp, Artificial Sequence
  chemically synthesized
caggaagagcagcgaggctt

SEQ ID NO: 569775 - DNA, 20 bp, Artificial Sequence
  chemically synthesized
tgtcggcattcggcaaatga

SEQ ID NO: 569776 - DNA, 20 bp, Artificial Sequence
  chemically synthesized
ctcatctaggacctgctctt

SEQ ID NO: 569777 - DNA, 20 bp, Artificial Sequence
  chemically synthesized
atctctggatattgactctg

SEQ ID NO: 569778 - DNA, 20 bp, Artificial Sequence
  chemically synthesized
ccagagtcaatatccagaga

SEQ ID NO: 569779 - DNA, 20 bp, Artificial Sequence
  chemically synthesized
actgtttttctatcttgtac

SEQ ID NO: 569780 - DNA, 20 bp, Artificial Sequence
  chemically synthesized
aaaaatttgcaacgtgacag

SEQ ID NO: 569781 - DNA, 20 bp, Artificial Sequence
  chemically synthesized
gagagagagagagagagaga

SEQ ID NO: 569782 - DNA, 20 bp, Artificial Sequence
  chemically synthesized
aggaaggaggggaagactga

SEQ ID NO: 569783 - DNA, 20 bp, Artificial Sequence
  chemically synthesized
ggggaagactgaatgggatt

SEQ ID NO: 569784 - DNA, 20 bp, Artificial Sequence
  chemically synthesized
gtcagcagcaacagcccagg

SEQ ID NO: 569785 - DNA, 20 bp, Artificial Sequence
  chemically synthesized
cctttgtgaagggaacagga

SEQ ID NO: 569786 - DNA, 20 bp, Artificial Sequence
  chemically synthesized
ggcctctcctaggcttctct

SEQ ID NO: 569787 - DNA, 20 bp, Artificial Sequence
  chemically synthesized
caaacattcccgggcctctc

SEQ ID NO: 569788 - DNA, 20 bp, Artificial Sequence
  chemically synthesized
gaagcctaggagaggcccgg

SEQ ID NO: 569789 - DNA, 20 bp, Artificial Sequence
  chemically synthesized
taagaatgaaaataaactaa

SEQ ID NO: 569790 - DNA, 20 bp, Artificial Sequence
  chemically synthesized
caaatatgtccctaatcaaa

SEQ ID NO: 569791 - DNA, 20 bp, Artificial Sequence
  chemically synthesized
cactggggctatatctctat

SEQ ID NO: 569792 - DNA, 20 bp, Artificial Sequence
  chemically synthesized
ctctattagatactgagtgt

SEQ ID NO: 569793 - DNA, 20 bp, Artificial Sequence
  chemically synthesized
agaggtcaataagacttcaa

SEQ ID NO: 569794 - DNA, 20 bp, Artificial Sequence
  chemically synthesized
ctttccttttctcctctgaa

SEQ ID NO: 569795 - DNA, 20 bp, Artificial Sequence
  chemically synthesized
atattgcttaagaaatgtta

SEQ ID NO: 569796 - DNA, 20 bp, Artificial Sequence
  chemically synthesized
actttatgacacataaggaa

SEQ ID NO: 569797 - DNA, 20 bp, Artificial Sequence
  chemically synthesized
caactctgttcgtttgagcc

SEQ ID NO: 569798 - DNA, 20 bp, Artificial Sequence
  chemically synthesized
ctgtatcatatcccaactct

SEQ ID NO: 569799 - DNA, 20 bp, Artificial Sequence
  chemically synthesized
acagagttgggatatgatac

SEQ ID NO: 569800 - DNA, 20 bp, Artificial Sequence
  chemically synthesized
tatgatacagttgtttcaaa

SEQ ID NO: 569801 - DNA, 20 bp, Artificial Sequence
  chemically synthesized
cagatttatttgatgtgact

SEQ ID NO: 569802 - DNA, 20 bp, Artificial Sequence
  chemically synthesized
actactggtttttttctaac

SEQ ID NO: 569803 - DNA, 20 bp, Artificial Sequence
  chemically synthesized
acgtgattatgtaagaaagt

SEQ ID NO: 569804 - DNA, 20 bp, Artificial Sequence
  chemically synthesized
tgagcatagaacatattcaa

SEQ ID NO: 569805 - DNA, 20 bp, Artificial Sequence
  chemically synthesized
tataccatgtgtattataat

SEQ ID NO: 569806 - DNA, 20 bp, Artificial Sequence
  chemically synthesized
agagctttaaattgatcaac

SEQ ID NO: 569807 - DNA, 20 bp, Artificial Sequence
  chemically synthesized
tctggttttctagtggtcaa

SEQ ID NO: 569808 - DNA, 20 bp, Artificial Sequence
  chemically synthesized
atatcattcatgaggcttct

SEQ ID NO: 569809 - DNA, 20 bp, Artificial Sequence
  chemically synthesized
tttttcctaaatatcattca

SEQ ID NO: 569810 - DNA, 20 bp, Artificial Sequence
  chemically synthesized
tttgtttcagtagaactaga

SEQ ID NO: 569811 - DNA, 20 bp, Artificial Sequence
  chemically synthesized
gggaccactctcagctctag

SEQ ID NO: 569812 - DNA, 20 bp, Artificial Sequence
  chemically synthesized
tgcctgggaccactctcagc

SEQ ID NO: 569813 - DNA, 20 bp, Artificial Sequence
  chemically synthesized
gttatactccttatcatatt

SEQ ID NO: 569814 - DNA, 20 bp, Artificial Sequence
  chemically synthesized
gatagaacggaatctagaac

SEQ ID NO: 569815 - DNA, 20 bp, Artificial Sequence
  chemically synthesized
gtacataccaaaacatgagt

SEQ ID NO: 569816 - DNA, 20 bp, Artificial Sequence
  chemically synthesized
ttctcatagctcctacagtt

SEQ ID NO: 569817 - DNA, 20 bp, Artificial Sequence
  chemically synthesized
atagagtttctcatagctcc

SEQ ID NO: 569818 - DNA, 20 bp, Artificial Sequence
  chemically synthesized
gaagcatgccgagtgtttga

SEQ ID NO: 569819 - DNA, 20 bp, Artificial Sequence
  chemically synthesized
gaaactctatcaaacactcg

SEQ ID NO: 569820 - DNA, 20 bp, Artificial Sequence
  chemically synthesized
ttagtgttaggaagcatgcc

SEQ ID NO: 569821 - DNA, 20 bp, Artificial Sequence
  chemically synthesized
catgtctagagggcatgaga

SEQ ID NO: 569822 - DNA, 20 bp, Artificial Sequence
  chemically synthesized
ttgtagtatttgtgtgtcaa

SEQ ID NO: 569823 - DNA, 20 bp, Artificial Sequence
  chemically synthesized
taaattgacacacaaatact

SEQ ID NO: 569824 - DNA, 20 bp, Artificial Sequence
  chemically synthesized
ttgacacacaaatactacaa

SEQ ID NO: 569825 - DNA, 20 bp, Artificial Sequence
  chemically synthesized
gtcagtaattctatgtgctt

SEQ ID NO: 569826 - DNA, 20 bp, Artificial Sequence
  chemically synthesized
gaacatatgtcagtaattct

SEQ ID NO: 569827 - DNA, 20 bp, Artificial Sequence
  chemically synthesized
tttcagtcaaggtgatacaa

SEQ ID NO: 569828 - DNA, 20 bp, Artificial Sequence
  chemically synthesized
tccttttttgtagtttcata

SEQ ID NO: 569829 - DNA, 20 bp, Artificial Sequence
  chemically synthesized
aaaaccctcacatccttttt

SEQ ID NO: 569830 - DNA, 20 bp, Artificial Sequence
  chemically synthesized
gaaactacaaaaaaggatgt

SEQ ID NO: 569831 - DNA, 20 bp, Artificial Sequence
  chemically synthesized
tgcagagtgctgagtctggt

SEQ ID NO: 569832 - DNA, 20 bp, Artificial Sequence
  chemically synthesized
gtgttgtgcagagtgctgag

SEQ ID NO: 569833 - DNA, 20 bp, Artificial Sequence
  chemically synthesized
tcagttaatatcttaacctg

SEQ ID NO: 569834 - DNA, 20 bp, Artificial Sequence
  chemically synthesized
tatcttaacctgaattgttt

SEQ ID NO: 569835 - DNA, 20 bp, Artificial Sequence
  chemically synthesized
ctattccttcattgtggttc

SEQ ID NO: 569836 - DNA, 20 bp, Artificial Sequence
  chemically synthesized
tgttttctcctctgccattt

SEQ ID NO: 569837 - DNA, 20 bp, Artificial Sequence
  chemically synthesized
cagaggagaaaacacagcag

SEQ ID NO: 569838 - DNA, 20 bp, Artificial Sequence
  chemically synthesized
ccagaggtcaatcttctctg

SEQ ID NO: 569839 - DNA, 20 bp, Artificial Sequence
  chemically synthesized
cctgatgctctgacttttca

SEQ ID NO: 569840 - DNA, 20 bp, Artificial Sequence
  chemically synthesized
ccttttgaaaagtcagagca

SEQ ID NO: 569841 - DNA, 20 bp, Artificial Sequence
  chemically synthesized
tcagagcatcaggcttttgg

SEQ ID NO: 569842 - DNA, 20 bp, Artificial Sequence
  chemically synthesized
cagtctttgaggatgctggt

SEQ ID NO: 569843 - DNA, 20 bp, Artificial Sequence
  chemically synthesized
actgacagatcaaattagac

SEQ ID NO: 569844 - DNA, 20 bp, Artificial Sequence
  chemically synthesized
tagaaaggacaaataatatt

SEQ ID NO: 569845 - DNA, 20 bp, Artificial Sequence
  chemically synthesized
tatttgtcctttctatcccg

SEQ ID NO: 569846 - DNA, 20 bp, Artificial Sequence
  chemically synthesized
atgaatcttcatattgccct

SEQ ID NO: 569847 - DNA, 20 bp, Artificial Sequence
  chemically synthesized
aagaatcctcaagggcaata

SEQ ID NO: 569848 - DNA, 20 bp, Artificial Sequence
  chemically synthesized
aatgttgacttcgaaataga

SEQ ID NO: 569849 - DNA, 20 bp, Artificial Sequence
  chemically synthesized
tcatttccagtactaacatt

SEQ ID NO: 569850 - DNA, 20 bp, Artificial Sequence
  chemically synthesized
tgacctatgatatcatgtca

SEQ ID NO: 569851 - DNA, 20 bp, Artificial Sequence
  chemically synthesized
attgcttattttctgtgggc

SEQ ID NO: 569852 - DNA, 20 bp, Artificial Sequence
  chemically synthesized
ttaatacttgaccaatggga

SEQ ID NO: 569853 - DNA, 20 bp, Artificial Sequence
  chemically synthesized
cgcaagacttgaattctagt

SEQ ID NO: 569854 - DNA, 20 bp, Artificial Sequence
  chemically synthesized
atgatgtgttcacattgtat

SEQ ID NO: 569855 - DNA, 20 bp, Artificial Sequence
  chemically synthesized
gaaagattatgacaaaattc

SEQ ID NO: 569856 - DNA, 20 bp, Artificial Sequence
  chemically synthesized
atgatacaagtcttctgaca

SEQ ID NO: 569857 - DNA, 20 bp, Artificial Sequence
  chemically synthesized
gcgatctcgtccactgcatg

SEQ ID NO: 569858 - DNA, 20 bp, Artificial Sequence
  chemically synthesized
tccactgcatgctccgcttc

SEQ ID NO: 569859 - DNA, 20 bp, Artificial Sequence
  chemically synthesized
ttttgtatttttagtagaga

SEQ ID NO: 569860 - DNA, 20 bp, Artificial Sequence
  chemically synthesized
tgcctcagcctcccaaagtg

SEQ ID NO: 569861 - DNA, 20 bp, Artificial Sequence
  chemically synthesized
ccaccgcacccggcctgagg

SEQ ID NO: 569862 - DNA, 20 bp, Artificial Sequence
  chemically synthesized
tttctatgttgatatcatac

SEQ ID NO: 569863 - DNA, 20 bp, Artificial Sequence
  chemically synthesized
tgttaaatatccctgtgttg

SEQ ID NO: 569864 - DNA, 20 bp, Artificial Sequence
  chemically synthesized
caacacagggatatttaaca

SEQ ID NO: 569865 - DNA, 20 bp, Artificial Sequence
  chemically synthesized
gttgatttcttccttcataa

SEQ ID NO: 569866 - DNA, 20 bp, Artificial Sequence
  chemically synthesized
ctccaattcaagttttggtt

SEQ ID NO: 569867 - DNA, 20 bp, Artificial Sequence
  chemically synthesized
gtaccaggcattgctccaat

SEQ ID NO: 569868 - DNA, 20 bp, Artificial Sequence
  chemically synthesized
agaacaagaatgagagcaag

SEQ ID NO: 569869 - DNA, 20 bp, Artificial Sequence
  chemically synthesized
tttcggattccaaatatgtc

SEQ ID NO: 569870 - DNA, 20 bp, Artificial Sequence
  chemically synthesized
actactttcatggcaatttt

SEQ ID NO: 569871 - DNA, 20 bp, Artificial Sequence
  chemically synthesized
gggggcaggggaaggtggtg

SEQ ID NO: 569872 - DNA, 20 bp, Artificial Sequence
  chemically synthesized
tttgaactcacggatcttgg

SEQ ID NO: 569873 - DNA, 20 bp, Artificial Sequence
  chemically synthesized
tgtatcctgttggtctacat

SEQ ID NO: 569874 - DNA, 20 bp, Artificial Sequence
  chemically synthesized
cctggaactgtggccatctg

SEQ ID NO: 569875 - DNA, 20 bp, Artificial Sequence
  chemically synthesized
gctgtttgtgctgacaaaat

SEQ ID NO: 569876 - DNA, 20 bp, Artificial Sequence
  chemically synthesized
tcaacatttcttgttactgt

SEQ ID NO: 569877 - DNA, 20 bp, Artificial Sequence
  chemically synthesized
ccttattggatgaagttaac

SEQ ID NO: 569878 - DNA, 20 bp, Artificial Sequence
  chemically synthesized
caactgttaacttcatccaa

SEQ ID NO: 569879 - DNA, 20 bp, Artificial Sequence
  chemically synthesized
gctcacaactttctgctgct

SEQ ID NO: 569880 - DNA, 20 bp, Artificial Sequence
  chemically synthesized
gagttttgctcacaactttc

SEQ ID NO: 569881 - DNA, 20 bp, Artificial Sequence
  chemically synthesized
tccacaaccatttattgcat

SEQ ID NO: 569882 - DNA, 20 bp, Artificial Sequence
  chemically synthesized
aaatggttgtggaaacatgc

SEQ ID NO: 569883 - DNA, 20 bp, Artificial Sequence
  chemically synthesized
ctcttcactctcaatctcag

SEQ ID NO: 569884 - DNA, 20 bp, Artificial Sequence
  chemically synthesized
gaagcaactcatgtccaaag

SEQ ID NO: 569885 - DNA, 20 bp, Artificial Sequence
  chemically synthesized
taaacactcctttggacatg

SEQ ID NO: 569886 - DNA, 20 bp, Artificial Sequence
  chemically synthesized
tcttgggaacttgctaactg

SEQ ID NO: 569887 - DNA, 20 bp, Artificial Sequence
  chemically synthesized
ccatctttcactcttctgtg

SEQ ID NO: 569888 - DNA, 20 bp, Artificial Sequence
  chemically synthesized
cattactgctgatggagtca

SEQ ID NO: 569889 - DNA, 20 bp, Artificial Sequence
  chemically synthesized
tggagtcagcaggtttactc

SEQ ID NO: 569890 - DNA, 20 bp, Artificial Sequence
  chemically synthesized
cgtctttgaaggaggaaagg

SEQ ID NO: 569891 - DNA, 20 bp, Artificial Sequence
  chemically synthesized
ccagctgtcccttaggaagg

SEQ ID NO: 569892 - DNA, 20 bp, Artificial Sequence
  chemically synthesized
ttctgccagctgtcccttag

SEQ ID NO: 569893 - DNA, 20 bp, Artificial Sequence
  chemically synthesized
cttttctgtaataccagcaa

SEQ ID NO: 569894 - DNA, 20 bp, Artificial Sequence
  chemically synthesized
tatattagttctagccgaag

SEQ ID NO: 569895 - DNA, 20 bp, Artificial Sequence
  chemically synthesized
tgaaatttgttagcattgtc

SEQ ID NO: 569896 - DNA, 20 bp, Artificial Sequence
  chemically synthesized
gctttccccttgattatctt

SEQ ID NO: 569897 - DNA, 20 bp, Artificial Sequence
  chemically synthesized
acaactaagataatcaaggg

SEQ ID NO: 569898 - DNA, 20 bp, Artificial Sequence
  chemically synthesized
gacggaaagataagctttcc

SEQ ID NO: 569899 - DNA, 20 bp, Artificial Sequence
  chemically synthesized
agtctgtccttgacggaaag

SEQ ID NO: 569900 - DNA, 20 bp, Artificial Sequence
  chemically synthesized
aggacagactaaaagactaa

SEQ ID NO: 569901 - DNA, 20 bp, Artificial Sequence
  chemically synthesized
ttagcctcacattcccctac

SEQ ID NO: 569902 - DNA, 20 bp, Artificial Sequence
  chemically synthesized
agtcgactctggataaatat

SEQ ID NO: 569903 - DNA, 20 bp, Artificial Sequence
  chemically synthesized
cattccttgaggttaaagga

SEQ ID NO: 569904 - DNA, 20 bp, Artificial Sequence
  chemically synthesized
aaacttttcctattccccac

SEQ ID NO: 569905 - DNA, 20 bp, Artificial Sequence
  chemically synthesized
aagctgaagtggggaatagg

SEQ ID NO: 569906 - DNA, 20 bp, Artificial Sequence
  chemically synthesized
cattggataaactcactgcc

SEQ ID NO: 569907 - DNA, 20 bp, Artificial Sequence
  chemically synthesized
gcattgtaaatcaactggca

SEQ ID NO: 569908 - DNA, 20 bp, Artificial Sequence
  chemically synthesized
tcccagatgaagataccaat

SEQ ID NO: 569909 - DNA, 20 bp, Artificial Sequence
  chemically synthesized
ctgacccagtgtgatatttc

SEQ ID NO: 569910 - DNA, 20 bp, Artificial Sequence
  chemically synthesized
tatactggaacatcctgcat

SEQ ID NO: 569911 - DNA, 20 bp, Artificial Sequence
  chemically synthesized
ggaacatcctgcatgcatgt

SEQ ID NO: 569912 - DNA, 20 bp, Artificial Sequence
  chemically synthesized
agagccaagagctgggactc

SEQ ID NO: 569913 - DNA, 20 bp, Artificial Sequence
  chemically synthesized
aagagagtcccagctcttgg

SEQ ID NO: 569914 - DNA, 20 bp, Artificial Sequence
  chemically synthesized
agtcccagctcttggctctg

SEQ ID NO: 569915 - DNA, 20 bp, Artificial Sequence
  chemically synthesized
taaccagctgctgcattctg

SEQ ID NO: 569916 - DNA, 20 bp, Artificial Sequence
  chemically synthesized
gctattatattgaaattttc

SEQ ID NO: 569917 - DNA, 20 bp, Artificial Sequence
  chemically synthesized
ttttctactctctgccattt

SEQ ID NO: 569918 - DNA, 20 bp, Artificial Sequence
  chemically synthesized
tgtaacaggttgaacattgt

SEQ ID NO: 569919 - DNA, 20 bp, Artificial Sequence
  chemically synthesized
tctctttcaggttatttgat

SEQ ID NO: 569920 - DNA, 20 bp, Artificial Sequence
  chemically synthesized
gccagcatctctttcaggtt

SEQ ID NO: 569921 - DNA, 20 bp, Artificial Sequence
  chemically synthesized
tccacagcatacatcattgt

SEQ ID NO: 569922 - DNA, 20 bp, Artificial Sequence
  chemically synthesized
acaaataaactagacaaaca

SEQ ID NO: 569923 - DNA, 20 bp, Artificial Sequence
  chemically synthesized
tacttcaaactacgtgtttg

SEQ ID NO: 569924 - DNA, 20 bp, Artificial Sequence
  chemically synthesized
tgattttgatacttcaaact

SEQ ID NO: 569925 - DNA, 20 bp, Artificial Sequence
  chemically synthesized
ttttcatatgaggctaagaa

SEQ ID NO: 569926 - DNA, 20 bp, Artificial Sequence
  chemically synthesized
gtttatgcctgcatcctgac

SEQ ID NO: 569927 - DNA, 20 bp, Artificial Sequence
  chemically synthesized
aggatgcaggcataaacact

SEQ ID NO: 569928 - DNA, 20 bp, Artificial Sequence
  chemically synthesized
gctctagtttgcaaatcagg

SEQ ID NO: 569929 - DNA, 20 bp, Artificial Sequence
  chemically synthesized
aagtcattaacatcttttgc

SEQ ID NO: 569930 - DNA, 20 bp, Artificial Sequence
  chemically synthesized
gttgaattgtgcactcattc

SEQ ID NO: 569931 - DNA, 20 bp, Artificial Sequence
  chemically synthesized
aagggatcgcccacataaca

SEQ ID NO: 569932 - DNA, 20 bp, Artificial Sequence
  chemically synthesized
gtcttctctggctatgtttt

SEQ ID NO: 569933 - DNA, 20 bp, Artificial Sequence
  chemically synthesized
aaaccaggtgtcttctctgg

SEQ ID NO: 569934 - DNA, 20 bp, Artificial Sequence
  chemically synthesized
aaacatagccagagaagaca

SEQ ID NO: 569935 - DNA, 20 bp, Artificial Sequence
  chemically synthesized
gtttgtcttgacttccagtc

SEQ ID NO: 569936 - DNA, 20 bp, Artificial Sequence
  chemically synthesized
ctcatttttcctctttttta

SEQ ID NO: 569937 - DNA, 20 bp, Artificial Sequence
  chemically synthesized
caaaaatacgtttacagtga

SEQ ID NO: 569938 - DNA, 20 bp, Artificial Sequence
  chemically synthesized
ttggtctaaaaagaacaaaa

SEQ ID NO: 569939 - DNA, 20 bp, Artificial Sequence
  chemically synthesized
tttttagaccaagacggcat

SEQ ID NO: 569940 - DNA, 20 bp, Artificial Sequence
  chemically synthesized
aaggttcggtggactttatg

SEQ ID NO: 569941 - DNA, 20 bp, Artificial Sequence
  chemically synthesized
aaccttgtacatcaaattaa

SEQ ID NO: 569942 - DNA, 20 bp, Artificial Sequence
  chemically synthesized
agacacaagtgccattaatc

SEQ ID NO: 569943 - DNA, 20 bp, Artificial Sequence
  chemically synthesized
aatgaacattgtcagtaagc

SEQ ID NO: 569944 - DNA, 20 bp, Artificial Sequence
  chemically synthesized
aatgttcattttataaacat

SEQ ID NO: 569945 - DNA, 20 bp, Artificial Sequence
  chemically synthesized
ctgtaatatagggaaaacat

SEQ ID NO: 569946 - DNA, 20 bp, Artificial Sequence
  chemically synthesized
catgtatgttttccctatat

SEQ ID NO: 569947 - DNA, 20 bp, Artificial Sequence
  chemically synthesized
ttataccatccctaatttca

SEQ ID NO: 569948 - DNA, 20 bp, Artificial Sequence
  chemically synthesized
gtagagagaattgctctcca

SEQ ID NO: 569949 - DNA, 20 bp, Artificial Sequence
  chemically synthesized
gtaatttcctcatttcaagg

SEQ ID NO: 569950 - DNA, 20 bp, Artificial Sequence
  chemically synthesized
ttcaaggaactgattatttc

SEQ ID NO: 569951 - DNA, 20 bp, Artificial Sequence
  chemically synthesized
tggtatataatttaggatta

SEQ ID NO: 569952 - DNA, 20 bp, Artificial Sequence
  chemically synthesized
ctcaaatcttggtatataat

SEQ ID NO: 569953 - DNA, 20 bp, Artificial Sequence
  chemically synthesized
taataatcctaaattatata

SEQ ID NO: 569954 - DNA, 20 bp, Artificial Sequence
  chemically synthesized
ttttatttttccactgttta

SEQ ID NO: 569955 - DNA, 20 bp, Artificial Sequence
  chemically synthesized
aaacaggaattttatttttc

SEQ ID NO: 569956 - DNA, 20 bp, Artificial Sequence
  chemically synthesized
aaacagtggaaaaataaaat

SEQ ID NO: 569957 - DNA, 20 bp, Artificial Sequence
  chemically synthesized
atcgaacaaaagctgagatc

SEQ ID NO: 569958 - DNA, 20 bp, Artificial Sequence
  chemically synthesized
caaacttaaaaaccgaagat

SEQ ID NO: 569959 - DNA, 20 bp, Artificial Sequence
  chemically synthesized
aaagctgagatcttcggttt

SEQ ID NO: 569960 - DNA, 20 bp, Artificial Sequence
  chemically synthesized
ttattttataaattagaaac

SEQ ID NO: 569961 - DNA, 20 bp, Artificial Sequence
  chemically synthesized
gccaccatgcccagccaaac

SEQ ID NO: 569962 - DNA, 20 bp, Artificial Sequence
  chemically synthesized
cctcccaaagtgctgggatt

SEQ ID NO: 569963 - DNA, 20 bp, Artificial Sequence
  chemically synthesized
cgcctcggcctcccaaagtg

SEQ ID NO: 569964 - DNA, 20 bp, Artificial Sequence
  chemically synthesized
ttttgtatttttagtagaga

SEQ ID NO: 569965 - DNA, 20 bp, Artificial Sequence
  chemically synthesized
gagactacaggcacctgcca

SEQ ID NO: 569966 - DNA, 20 bp, Artificial Sequence
  chemically synthesized
ctcgggagctaagacgaaag

SEQ ID NO: 569967 - DNA, 20 bp, Artificial Sequence
  chemically synthesized
ttttttttttttttttgaga

SEQ ID NO: 569968 - DNA, 20 bp, Artificial Sequence
  chemically synthesized
aaaaaaaaaaaagaaagaaa

SEQ ID NO: 569969 - DNA, 20 bp, Artificial Sequence
  chemically synthesized
gtcacttaacctataaaaat

SEQ ID NO: 569970 - DNA, 20 bp, Artificial Sequence
  chemically synthesized
gctctgtcattaggcgactg

SEQ ID NO: 569971 - DNA, 20 bp, Artificial Sequence
  chemically synthesized
ctagactggaggactaaaat

SEQ ID NO: 569972 - DNA, 20 bp, Artificial Sequence
  chemically synthesized
ccttctgtgtattagtctct

SEQ ID NO: 569973 - DNA, 20 bp, Artificial Sequence
  chemically synthesized
actaatacacagaagggaat

SEQ ID NO: 569974 - DNA, 20 bp, Artificial Sequence
  chemically synthesized
ggggctcactagaggtctca

SEQ ID NO: 569975 - DNA, 20 bp, Artificial Sequence
  chemically synthesized
ctattattctccaaatgact

SEQ ID NO: 569976 - DNA, 20 bp, Artificial Sequence
  chemically synthesized
caagtagtcatttggagaat

SEQ ID NO: 569977 - DNA, 20 bp, Artificial Sequence
  chemically synthesized
tctttttctcctttcataga

SEQ ID NO: 569978 - DNA, 20 bp, Artificial Sequence
  chemically synthesized
taaaggaattggataaaagt

SEQ ID NO: 569979 - DNA, 20 bp, Artificial Sequence
  chemically synthesized
caaatttttatttccgacta

SEQ ID NO: 569980 - DNA, 20 bp, Artificial Sequence
  chemically synthesized
tgatgtaggaaatcactgtc

SEQ ID NO: 569981 - DNA, 20 bp, Artificial Sequence
  chemically synthesized
aattttcttcaaactctaga

SEQ ID NO: 569982 - DNA, 20 bp, Artificial Sequence
  chemically synthesized
aatatattatttaataaagc

SEQ ID NO: 569983 - DNA, 20 bp, Artificial Sequence
  chemically synthesized
tttaaatacctatttaaatc

SEQ ID NO: 569984 - DNA, 20 bp, Artificial Sequence
  chemically synthesized
ttaaataggtatttaaaatg

SEQ ID NO: 569985 - DNA, 20 bp, Artificial Sequence
  chemically synthesized
tagtatgtttgattctgctt

SEQ ID NO: 569986 - DNA, 20 bp, Artificial Sequence
  chemically synthesized
ttcttttttagtatgtttga

SEQ ID NO: 569987 - DNA, 20 bp, Artificial Sequence
  chemically synthesized
tgaaaattcttttttagtat

SEQ ID NO: 569988 - DNA, 20 bp, Artificial Sequence
  chemically synthesized
aacttgaaaattctttttta

SEQ ID NO: 569989 - DNA, 20 bp, Artificial Sequence
  chemically synthesized
atgtaataagacaaatggta

SEQ ID NO: 569990 - DNA, 20 bp, Artificial Sequence
  chemically synthesized
gagaaatacatactttagga

SEQ ID NO: 569991 - DNA, 20 bp, Artificial Sequence
  chemically synthesized
attactacagtcctcaagaa

SEQ ID NO: 569992 - DNA, 20 bp, Artificial Sequence
  chemically synthesized
tgaagatctaggactgctgt

SEQ ID NO: 569993 - DNA, 20 bp, Artificial Sequence
  chemically synthesized
atggacagtgaaagaataaa

SEQ ID NO: 569994 - DNA, 20 bp, Artificial Sequence
  chemically synthesized
cgcctgccatcttttatcga

SEQ ID NO: 569995 - DNA, 20 bp, Artificial Sequence
  chemically synthesized
tgagtctgactaaaaatatt

SEQ ID NO: 569996 - DNA, 20 bp, Artificial Sequence
  chemically synthesized
ataccaaccgaagtctttga

SEQ ID NO: 569997 - DNA, 20 bp, Artificial Sequence
  chemically synthesized
cagtaaattgtaattgttgt

SEQ ID NO: 569998 - DNA, 20 bp, Artificial Sequence
  chemically synthesized
gagagaggagagaggatatt

SEQ ID NO: 569999 - DNA, 20 bp, Artificial Sequence
  chemically synthesized
ttcatgcaaaatactacaga

SEQ ID NO: 570000 - DNA, 20 bp, Artificial Sequence
  chemically synthesized
tgtgccagtcaaaagaatac

SEQ ID NO: 570001 - DNA, 20 bp, Artificial Sequence
  chemically synthesized
cgtattcttttgactggcac

SEQ ID NO: 570002 - DNA, 20 bp, Artificial Sequence
  chemically synthesized
gtcacctaacaacagaaaga

SEQ ID NO: 570003 - DNA, 20 bp, Artificial Sequence
  chemically synthesized
aagcagcagtcctcgactcg

SEQ ID NO: 570004 - DNA, 20 bp, Artificial Sequence
  chemically synthesized
aagccctacgagtcgaggac

SEQ ID NO: 570005 - DNA, 20 bp, Artificial Sequence
  chemically synthesized
gttttgggtgaatgaatact

SEQ ID NO: 570006 - DNA, 20 bp, Artificial Sequence
  chemically synthesized
ttccgcagttatatgtacac

SEQ ID NO: 570007 - DNA, 20 bp, Artificial Sequence
  chemically synthesized
tttcttcttccgtcaaagat

SEQ ID NO: 570008 - DNA, 20 bp, Artificial Sequence
  chemically synthesized
gagaacaatttcttttattt

SEQ ID NO: 570009 - DNA, 20 bp, Artificial Sequence
  chemically synthesized
aataaaagaaattgttctcg

SEQ ID NO: 570010 - DNA, 20 bp, Artificial Sequence
  chemically synthesized
ccactatcaataaaattatc

SEQ ID NO: 570011 - DNA, 20 bp, Artificial Sequence
  chemically synthesized
gtgtgttttgtgacagaggg

SEQ ID NO: 570012 - DNA, 20 bp, Artificial Sequence
  chemically synthesized
tatttaatgcaggatatatg

SEQ ID NO: 570013 - DNA, 20 bp, Artificial Sequence
  chemically synthesized
aatggggaacgacttttaag

SEQ ID NO: 570014 - DNA, 20 bp, Artificial Sequence
  chemically synthesized
tttacaatggtaattttaga

SEQ ID NO: 570015 - DNA, 20 bp, Artificial Sequence
  chemically synthesized
ttttagaataagttttttat

SEQ ID NO: 570016 - DNA, 20 bp, Artificial Sequence
  chemically synthesized
ctgtgtcttttttttcctga

SEQ ID NO: 570017 - DNA, 20 bp, Artificial Sequence
  chemically synthesized
actaacctgtatattcacaa

SEQ ID NO: 570018 - DNA, 20 bp, Artificial Sequence
  chemically synthesized
ttacttgatatagtagggca

SEQ ID NO: 570019 - DNA, 20 bp, Artificial Sequence
  chemically synthesized
ctggagattaatgttgtctt

SEQ ID NO: 570020 - DNA, 20 bp, Artificial Sequence
  chemically synthesized
tcagtgtaaaattgtaattc

SEQ ID NO: 570021 - DNA, 20 bp, Artificial Sequence
  chemically synthesized
acaattttacactgatattg

SEQ ID NO: 570022 - DNA, 20 bp, Artificial Sequence
  chemically synthesized
tcagctgcccatgaagacag

SEQ ID NO: 570023 - DNA, 20 bp, Artificial Sequence
  chemically synthesized
cctgaatgagttcagtttcg

SEQ ID NO: 570024 - DNA, 20 bp, Artificial Sequence
  chemically synthesized
ttgtgcctgaatgagttcag

SEQ ID NO: 570025 - DNA, 20 bp, Artificial Sequence
  chemically synthesized
tatctttgtgcctgaatgag

SEQ ID NO: 570026 - DNA, 20 bp, Artificial Sequence
  chemically synthesized
gtttagcagtggaaatgttt

SEQ ID NO: 570027 - DNA, 20 bp, Artificial Sequence
  chemically synthesized
ttctataggtttagcagtgg

SEQ ID NO: 570028 - DNA, 20 bp, Artificial Sequence
  chemically synthesized
ttcagtttcttatctgttct

SEQ ID NO: 570029 - DNA, 20 bp, Artificial Sequence
  chemically synthesized
aaaccccgtcagtctactca

SEQ ID NO: 570030 - DNA, 20 bp, Artificial Sequence
  chemically synthesized
aaactgaatgagtagactga

SEQ ID NO: 570031 - DNA, 20 bp, Artificial Sequence
  chemically synthesized
ttcttgtatgtgtctccctt

SEQ ID NO: 570032 - DNA, 20 bp, Artificial Sequence
  chemically synthesized
tattttttactatttgactg

SEQ ID NO: 570033 - DNA, 20 bp, Artificial Sequence
  chemically synthesized
aagttattgaagctaaagta

SEQ ID NO: 570034 - DNA, 20 bp, Artificial Sequence
  chemically synthesized
cagagtgataagcatattac

SEQ ID NO: 570035 - DNA, 20 bp, Artificial Sequence
  chemically synthesized
tatgcttatcactctgatat

SEQ ID NO: 570036 - DNA, 20 bp, Artificial Sequence
  chemically synthesized
atatggttgtttttatcttt

SEQ ID NO: 570037 - DNA, 20 bp, Artificial Sequence
  chemically synthesized
gcatctatttggtaagtgaa

SEQ ID NO: 570038 - DNA, 20 bp, Artificial Sequence
  chemically synthesized
tccaaattcacttaccaaat

SEQ ID NO: 570039 - DNA, 20 bp, Artificial Sequence
  chemically synthesized
tgtgaaatgaaatttcacgt

SEQ ID NO: 570040 - DNA, 20 bp, Artificial Sequence
  chemically synthesized
tttcatttcacatactagga

SEQ ID NO: 570041 - DNA, 20 bp, Artificial Sequence
  chemically synthesized
ggtcaaatgaatgatctttg

SEQ ID NO: 570042 - DNA, 20 bp, Artificial Sequence
  chemically synthesized
ttgcattgtttttttttttt

SEQ ID NO: 570043 - DNA, 20 bp, Artificial Sequence
  chemically synthesized
ttttttttcaggcttaagtt

SEQ ID NO: 570044 - DNA, 20 bp, Artificial Sequence
  chemically synthesized
ataaaatatatttgtagagg

SEQ ID NO: 570045 - DNA, 20 bp, Artificial Sequence
  chemically synthesized
ctctacaaatatattttata

SEQ ID NO: 570046 - DNA, 20 bp, Artificial Sequence
  chemically synthesized
ttttatatactgtttgatct

SEQ ID NO: 570047 - DNA, 20 bp, Artificial Sequence
  chemically synthesized
aatgttatagtgcctcctca

SEQ ID NO: 570048 - DNA, 20 bp, Artificial Sequence
  chemically synthesized
aatataatcttcctcctgaa

SEQ ID NO: 570049 - DNA, 20 bp, Artificial Sequence
  chemically synthesized
tcttaaaactatattcagga

SEQ ID NO: 570050 - DNA, 20 bp, Artificial Sequence
  chemically synthesized
tgaatatagttttaagacac

SEQ ID NO: 570051 - DNA, 20 bp, Artificial Sequence
  chemically synthesized
tttctgtttctgataatatt

SEQ ID NO: 570052 - DNA, 20 bp, Artificial Sequence
  chemically synthesized
aataagaatgcgtcttttat

SEQ ID NO: 570053 - DNA, 20 bp, Artificial Sequence
  chemically synthesized
gaaataatggtcagcatcag

SEQ ID NO: 570054 - DNA, 20 bp, Artificial Sequence
  chemically synthesized
actgtgagactaatttaaaa

SEQ ID NO: 570055 - DNA, 20 bp, Artificial Sequence
  chemically synthesized
agtcgaggatatattagctt

SEQ ID NO: 570056 - DNA, 20 bp, Artificial Sequence
  chemically synthesized
tacagtgtagtcgaggatat

SEQ ID NO: 570057 - DNA, 20 bp, Artificial Sequence
  chemically synthesized
tacactgtataatatgaaag

SEQ ID NO: 570058 - DNA, 20 bp, Artificial Sequence
  chemically synthesized
caatttaagcgtaatgaaac

SEQ ID NO: 570059 - DNA, 20 bp, Artificial Sequence
  chemically synthesized
acaaagaagctggagtttca

SEQ ID NO: 570060 - DNA, 20 bp, Artificial Sequence
  chemically synthesized
gcgtaatgaaactccagctt

SEQ ID NO: 570061 - DNA, 20 bp, Artificial Sequence
  chemically synthesized
tctatataaaacaaagaagc

SEQ ID NO: 570062 - DNA, 20 bp, Artificial Sequence
  chemically synthesized
agcatgtctggttaaaggtt

SEQ ID NO: 570063 - DNA, 20 bp, Artificial Sequence
  chemically synthesized
acccaacctttaaccagaca

SEQ ID NO: 570064 - DNA, 20 bp, Artificial Sequence
  chemically synthesized
gtcatttaaacgatatagga

SEQ ID NO: 570065 - DNA, 20 bp, Artificial Sequence
  chemically synthesized
aaatacaaatccatttccta

SEQ ID NO: 570066 - DNA, 20 bp, Artificial Sequence
  chemically synthesized
gatttgtatttggccggtaa

SEQ ID NO: 570067 - DNA, 20 bp, Artificial Sequence
  chemically synthesized
agagaaaaaagacatttagc

SEQ ID NO: 570068 - DNA, 20 bp, Artificial Sequence
  chemically synthesized
ttttcccttcctcctgcctt

SEQ ID NO: 570069 - DNA, 20 bp, Artificial Sequence
  chemically synthesized
aagttcacagagtaaataag

SEQ ID NO: 570070 - DNA, 20 bp, Artificial Sequence
  chemically synthesized
ccaccacgcctggccttagc

SEQ ID NO: 570071 - DNA, 20 bp, Artificial Sequence
  chemically synthesized
tgcctcagcctcccaaagtg

SEQ ID NO: 570072 - DNA, 20 bp, Artificial Sequence
  chemically synthesized
tttggtatttttagtagaga

SEQ ID NO: 570073 - DNA, 20 bp, Artificial Sequence
  chemically synthesized
tacaggcacctgccaccatg

SEQ ID NO: 570074 - DNA, 20 bp, Artificial Sequence
  chemically synthesized
tgcctcagtctcccgagtag

SEQ ID NO: 570075 - DNA, 20 bp, Artificial Sequence
  chemically synthesized
atcctttgcctcctgggttc

SEQ ID NO: 570076 - DNA, 20 bp, Artificial Sequence
  chemically synthesized
gcccaggctggagtgcagtg

SEQ ID NO: 570077 - DNA, 20 bp, Artificial Sequence
  chemically synthesized
ttgtttgtttgtttttcagt

SEQ ID NO: 570078 - DNA, 20 bp, Artificial Sequence
  chemically synthesized
catggtttgtttgtttgttt

SEQ ID NO: 570079 - DNA, 20 bp, Artificial Sequence
  chemically synthesized
agcccatggtttgtttgttt

SEQ ID NO: 570080 - DNA, 20 bp, Artificial Sequence
  chemically synthesized
gtctagcccatggtttgttt

SEQ ID NO: 570081 - DNA, 20 bp, Artificial Sequence
  chemically synthesized
ggaagtctagcccatggttt

SEQ ID NO: 570082 - DNA, 20 bp, Artificial Sequence
  chemically synthesized
gtcaggaagtctagcccatg

SEQ ID NO: 570083 - DNA, 20 bp, Artificial Sequence
  chemically synthesized
ataggtcaggaagtctagcc

SEQ ID NO: 570084 - DNA, 20 bp, Artificial Sequence
  chemically synthesized
catgtttcctgctatagagg

SEQ ID NO: 570085 - DNA, 20 bp, Artificial Sequence
  chemically synthesized
ctataatttctggctctcca

SEQ ID NO: 570086 - DNA, 20 bp, Artificial Sequence
  chemically synthesized
ttttctcagtttaggtattc

SEQ ID NO: 570087 - DNA, 20 bp, Artificial Sequence
  chemically synthesized
gaaagaatagccattctttt

SEQ ID NO: 570088 - DNA, 20 bp, Artificial Sequence
  chemically synthesized
aatttctcttattatacctt

SEQ ID NO: 570089 - DNA, 20 bp, Artificial Sequence
  chemically synthesized
tctgatagcagaagaatcac

SEQ ID NO: 570090 - DNA, 20 bp, Artificial Sequence
  chemically synthesized
agaatagtgtaggaaatcca

SEQ ID NO: 570091 - DNA, 20 bp, Artificial Sequence
  chemically synthesized
gagggctgctggctgcctgg

SEQ ID NO: 570092 - DNA, 20 bp, Artificial Sequence
  chemically synthesized
ctggctgcctggcctggctt

SEQ ID NO: 570093 - DNA, 20 bp, Artificial Sequence
  chemically synthesized
tctgtctctcgctgcttaga

SEQ ID NO: 570094 - DNA, 20 bp, Artificial Sequence
  chemically synthesized
gccaattttcctctgtctct

SEQ ID NO: 570095 - DNA, 20 bp, Artificial Sequence
  chemically synthesized
gggtatctagagttgacttt

SEQ ID NO: 570096 - DNA, 20 bp, Artificial Sequence
  chemically synthesized
atgtcagagaagttatcaga

SEQ ID NO: 570097 - DNA, 20 bp, Artificial Sequence
  chemically synthesized
ttctagatcaatatgaaatt

SEQ ID NO: 570098 - DNA, 20 bp, Artificial Sequence
  chemically synthesized
cacttaagaactgcaattac

SEQ ID NO: 570099 - DNA, 20 bp, Artificial Sequence
  chemically synthesized
tgttcatttattttccttaa

SEQ ID NO: 570100 - DNA, 20 bp, Artificial Sequence
  chemically synthesized
tgatggctacacataagaca

SEQ ID NO: 570101 - DNA, 20 bp, Artificial Sequence
  chemically synthesized
gccatcaaataggtccaatg

SEQ ID NO: 570102 - DNA, 20 bp, Artificial Sequence
  chemically synthesized
cagtgtattttttttctgaa

SEQ ID NO: 570103 - DNA, 20 bp, Artificial Sequence
  chemically synthesized
ttctgaaagatgtttttccc

SEQ ID NO: 570104 - DNA, 20 bp, Artificial Sequence
  chemically synthesized
gatgtttttcccctttgatt

SEQ ID NO: 570105 - DNA, 20 bp, Artificial Sequence
  chemically synthesized
gtttataaattcacctaagc

SEQ ID NO: 570106 - DNA, 20 bp, Artificial Sequence
  chemically synthesized
tcaaacaatgactgcaaagc

SEQ ID NO: 570107 - DNA, 20 bp, Artificial Sequence
  chemically synthesized
ctaagcaactgctttgcagt

SEQ ID NO: 570108 - DNA, 20 bp, Artificial Sequence
  chemically synthesized
catttttgagcataaaattg

SEQ ID NO: 570109 - DNA, 20 bp, Artificial Sequence
  chemically synthesized
agtagttccagtgtgtgtgt

SEQ ID NO: 570110 - DNA, 20 bp, Artificial Sequence
  chemically synthesized
catacacacacactggaact

SEQ ID NO: 570111 - DNA, 20 bp, Artificial Sequence
  chemically synthesized
tgggttcagtgctccttctc

SEQ ID NO: 570112 - DNA, 20 bp, Artificial Sequence
  chemically synthesized
caatttcatttggggctgcc

SEQ ID NO: 570113 - DNA, 20 bp, Artificial Sequence
  chemically synthesized
gcagtactgatgccaacaac

SEQ ID NO: 570114 - DNA, 20 bp, Artificial Sequence
  chemically synthesized
tcttatctcagtgtaccagt

SEQ ID NO: 570115 - DNA, 20 bp, Artificial Sequence
  chemically synthesized
ggctagctttatgaagaatg

SEQ ID NO: 570116 - DNA, 20 bp, Artificial Sequence
  chemically synthesized
tgtgtgtgtctattacgtag

SEQ ID NO: 570117 - DNA, 20 bp, Artificial Sequence
  chemically synthesized
tagaaactatttgccgataa

SEQ ID NO: 570118 - DNA, 20 bp, Artificial Sequence
  chemically synthesized
caaaagcaaatttatcggca

SEQ ID NO: 570119 - DNA, 20 bp, Artificial Sequence
  chemically synthesized
tttggtattttcttatacag

SEQ ID NO: 570120 - DNA, 20 bp, Artificial Sequence
  chemically synthesized
accactacgtgtaattccag

SEQ ID NO: 570121 - DNA, 20 bp, Artificial Sequence
  chemically synthesized
cgtgtaattccagggcagct

SEQ ID NO: 570122 - DNA, 20 bp, Artificial Sequence
  chemically synthesized
attccagggcagctttgtga

SEQ ID NO: 570123 - DNA, 20 bp, Artificial Sequence
  chemically synthesized
tgctggtgccgtatgataat

SEQ ID NO: 570124 - DNA, 20 bp, Artificial Sequence
  chemically synthesized
ttgcaataaataaatgcatg

SEQ ID NO: 570125 - DNA, 20 bp, Artificial Sequence
  chemically synthesized
acacaaaaggaaattcagag

SEQ ID NO: 570126 - DNA, 20 bp, Artificial Sequence
  chemically synthesized
agggtagcaattctatcttc

SEQ ID NO: 570127 - DNA, 20 bp, Artificial Sequence
  chemically synthesized
gcttttccttccttgaggtg

SEQ ID NO: 570128 - DNA, 20 bp, Artificial Sequence
  chemically synthesized
ggattcaatattgtgcccaa

SEQ ID NO: 570129 - DNA, 20 bp, Artificial Sequence
  chemically synthesized
ctaaataatgtggcctgtgc

SEQ ID NO: 570130 - DNA, 20 bp, Artificial Sequence
  chemically synthesized
cttcccctaaataatgtggc

SEQ ID NO: 570131 - DNA, 20 bp, Artificial Sequence
  chemically synthesized
ttaggggaagttgttatttc

SEQ ID NO: 570132 - DNA, 20 bp, Artificial Sequence
  chemically synthesized
attttctggttaggccccta

SEQ ID NO: 570133 - DNA, 20 bp, Artificial Sequence
  chemically synthesized
tctctacttttctcatactt

SEQ ID NO: 570134 - DNA, 20 bp, Artificial Sequence
  chemically synthesized
tttctcatacttggtggatt

SEQ ID NO: 570135 - DNA, 20 bp, Artificial Sequence
  chemically synthesized
aggtgggtcaaaaaagtggg

SEQ ID NO: 570136 - DNA, 20 bp, Artificial Sequence
  chemically synthesized
tgagttttctattttacctc

SEQ ID NO: 570137 - DNA, 20 bp, Artificial Sequence
  chemically synthesized
ccttttgttcaaccccagag

SEQ ID NO: 570138 - DNA, 20 bp, Artificial Sequence
  chemically synthesized
cattagggaggatctactag

SEQ ID NO: 570139 - DNA, 20 bp, Artificial Sequence
  chemically synthesized
acagtatgtaaccttttgat

SEQ ID NO: 570140 - DNA, 20 bp, Artificial Sequence
  chemically synthesized
acaaatcgttgatacagcaa

SEQ ID NO: 570141 - DNA, 20 bp, Artificial Sequence
  chemically synthesized
cataatccatattgctgtat

SEQ ID NO: 570142 - DNA, 20 bp, Artificial Sequence
  chemically synthesized
tccatattgctgtatcaacg

SEQ ID NO: 570143 - DNA, 20 bp, Artificial Sequence
  chemically synthesized
atgccattatatgggtgtac

SEQ ID NO: 570144 - DNA, 20 bp, Artificial Sequence
  chemically synthesized
tcacctgttcaaagacatta

SEQ ID NO: 570145 - DNA, 20 bp, Artificial Sequence
  chemically synthesized
aatgttgataccagctttat

SEQ ID NO: 570146 - DNA, 20 bp, Artificial Sequence
  chemically synthesized
acctgtacacaaatgttgat

SEQ ID NO: 570147 - DNA, 20 bp, Artificial Sequence
  chemically synthesized
tggtatcaacatttgtgtac

SEQ ID NO: 570148 - DNA, 20 bp, Artificial Sequence
  chemically synthesized
gtacaggtgtttgcataagc

SEQ ID NO: 570149 - DNA, 20 bp, Artificial Sequence
  chemically synthesized
catcttagagaaatgaaaac

SEQ ID NO: 570150 - DNA, 20 bp, Artificial Sequence
  chemically synthesized
agttttcatttctctaagat

SEQ ID NO: 570151 - DNA, 20 bp, Artificial Sequence
  chemically synthesized
tctaagatgaatgcttaaga

SEQ ID NO: 570152 - DNA, 20 bp, Artificial Sequence
  chemically synthesized
gagtgggcttgtagggttac

SEQ ID NO: 570153 - DNA, 20 bp, Artificial Sequence
  chemically synthesized
aattcccacttatggatgta

SEQ ID NO: 570154 - DNA, 20 bp, Artificial Sequence
  chemically synthesized
ttgggaacatataagttgtc

SEQ ID NO: 570155 - DNA, 20 bp, Artificial Sequence
  chemically synthesized
aaaagtaactaaaatatgtg

SEQ ID NO: 570156 - DNA, 20 bp, Artificial Sequence
  chemically synthesized
agtaaatatacttctaggaa

SEQ ID NO: 570157 - DNA, 20 bp, Artificial Sequence
  chemically synthesized
aaattcctagaagtatattt

SEQ ID NO: 570158 - DNA, 20 bp, Artificial Sequence
  chemically synthesized
tttacttgattaaaggctat

SEQ ID NO: 570159 - DNA, 20 bp, Artificial Sequence
  chemically synthesized
ccataagtgtaatttatgta

SEQ ID NO: 570160 - DNA, 20 bp, Artificial Sequence
  chemically synthesized
ttacacttatatcaataaag

SEQ ID NO: 570161 - DNA, 20 bp, Artificial Sequence
  chemically synthesized
aatactattgacctgcagaa

SEQ ID NO: 570162 - DNA, 20 bp, Artificial Sequence
  chemically synthesized
ttctcaaagcaagttagata

SEQ ID NO: 570163 - DNA, 20 bp, Artificial Sequence
  chemically synthesized
tgtatcaagcagtatatcta

SEQ ID NO: 570164 - DNA, 20 bp, Artificial Sequence
  chemically synthesized
ttagatatactgcttgatac

SEQ ID NO: 570165 - DNA, 20 bp, Artificial Sequence
  chemically synthesized
ccctgatagactgtaaaact

SEQ ID NO: 570166 - DNA, 20 bp, Artificial Sequence
  chemically synthesized
cctgagtgcctttctaaact

SEQ ID NO: 570167 - DNA, 20 bp, Artificial Sequence
  chemically synthesized
tttagaaaggcactcaggat

SEQ ID NO: 570168 - DNA, 20 bp, Artificial Sequence
  chemically synthesized
ctccctctcaagatgctgga

SEQ ID NO: 570169 - DNA, 20 bp, Artificial Sequence
  chemically synthesized
atccagctccctctcaagat

SEQ ID NO: 570170 - DNA, 20 bp, Artificial Sequence
  chemically synthesized
atagcagaaaatgtccagag

SEQ ID NO: 570171 - DNA, 20 bp, Artificial Sequence
  chemically synthesized
cagagtacagattcagaaga

SEQ ID NO: 570172 - DNA, 20 bp, Artificial Sequence
  chemically synthesized
aaggcttaggcaggaaaaag

SEQ ID NO: 570173 - DNA, 20 bp, Artificial Sequence
  chemically synthesized
ccattggaatataaggaaaa

SEQ ID NO: 570174 - DNA, 20 bp, Artificial Sequence
  chemically synthesized
aaatgaggaaatcaatatga

SEQ ID NO: 570175 - DNA, 20 bp, Artificial Sequence
  chemically synthesized
cattttacaaagcaatttca

SEQ ID NO: 570176 - DNA, 20 bp, Artificial Sequence
  chemically synthesized
aatgttaatcaccacacaaa

SEQ ID NO: 570177 - DNA, 20 bp, Artificial Sequence
  chemically synthesized
gattacaaacattatttgtg

SEQ ID NO: 570178 - DNA, 20 bp, Artificial Sequence
  chemically synthesized
tcagacaacacatcatagct

SEQ ID NO: 570179 - DNA, 20 bp, Artificial Sequence
  chemically synthesized
gcacattaacagtagttagg

SEQ ID NO: 570180 - DNA, 20 bp, Artificial Sequence
  chemically synthesized
tttgaatagtatctaactgc

SEQ ID NO: 570181 - DNA, 20 bp, Artificial Sequence
  chemically synthesized
attcatcagcatgaatgata

SEQ ID NO: 570182 - DNA, 20 bp, Artificial Sequence
  chemically synthesized
actgcataaaatatagacta

SEQ ID NO: 570183 - DNA, 20 bp, Artificial Sequence
  chemically synthesized
gtgaaaatcagaggcccata

SEQ ID NO: 570184 - DNA, 20 bp, Artificial Sequence
  chemically synthesized
atgctaatcagtctatgggc

SEQ ID NO: 570185 - DNA, 20 bp, Artificial Sequence
  chemically synthesized
aatgttgataccagctttat

SEQ ID NO: 570186 - DNA, 20 bp, Artificial Sequence
  chemically synthesized
acctgtacacaaatgttgat

SEQ ID NO: 570187 - DNA, 20 bp, Artificial Sequence
  chemically synthesized
gtacaggtatttgcatcagc

SEQ ID NO: 570188 - DNA, 20 bp, Artificial Sequence
  chemically synthesized
agccattctcatagcatctg

SEQ ID NO: 570189 - DNA, 20 bp, Artificial Sequence
  chemically synthesized
acagcatttatccttctatg

SEQ ID NO: 570190 - DNA, 20 bp, Artificial Sequence
  chemically synthesized
ctggcaaccacttttctatt

SEQ ID NO: 570191 - DNA, 20 bp, Artificial Sequence
  chemically synthesized
atactcattgaataacaatt

SEQ ID NO: 570192 - DNA, 20 bp, Artificial Sequence
  chemically synthesized
aaattgttattcaatgagta

SEQ ID NO: 570193 - DNA, 20 bp, Artificial Sequence
  chemically synthesized
tgtagtgcacttaaaactta

SEQ ID NO: 570194 - DNA, 20 bp, Artificial Sequence
  chemically synthesized
ggtggaccctcttaatcccc

SEQ ID NO: 570195 - DNA, 20 bp, Artificial Sequence
  chemically synthesized
caccttggcctcccaaagtg

SEQ ID NO: 570196 - DNA, 20 bp, Artificial Sequence
  chemically synthesized
ttttgtatttttagtagaga

SEQ ID NO: 570197 - DNA, 20 bp, Artificial Sequence
  chemically synthesized
tcgggaggctgaggcaggag

SEQ ID NO: 570198 - DNA, 20 bp, Artificial Sequence
  chemically synthesized
aacctccacctcccaggttc

SEQ ID NO: 570199 - DNA, 20 bp, Artificial Sequence
  chemically synthesized
cactccagcctggcgacaga

SEQ ID NO: 570200 - DNA, 20 bp, Artificial Sequence
  chemically synthesized
cctacaaaagttttgtgtcc

SEQ ID NO: 570201 - DNA, 20 bp, Artificial Sequence
  chemically synthesized
cgaacatattcattacctac

SEQ ID NO: 570202 - DNA, 20 bp, Artificial Sequence
  chemically synthesized
taatgaatatgttcgttatc

SEQ ID NO: 570203 - DNA, 20 bp, Artificial Sequence
  chemically synthesized
tatttaatatatgtaatttg

SEQ ID NO: 570204 - DNA, 20 bp, Artificial Sequence
  chemically synthesized
tttttttttttttgtacttt

SEQ ID NO: 570205 - DNA, 20 bp, Artificial Sequence
  chemically synthesized
atttgccagggtacattccc

SEQ ID NO: 570206 - DNA, 20 bp, Artificial Sequence
  chemically synthesized
tgtgtttcatcccactttat

SEQ ID NO: 570207 - DNA, 20 bp, Artificial Sequence
  chemically synthesized
cttcaccagctaggctgttc

SEQ ID NO: 570208 - DNA, 20 bp, Artificial Sequence
  chemically synthesized
cttagtctgtcaggctcaag

SEQ ID NO: 570209 - DNA, 20 bp, Artificial Sequence
  chemically synthesized
ttatacacaacttctcaaat

SEQ ID NO: 570210 - DNA, 20 bp, Artificial Sequence
  chemically synthesized
ctttttatacacaacttctc

SEQ ID NO: 570211 - DNA, 20 bp, Artificial Sequence
  chemically synthesized
cagatgttgcccctttccat

SEQ ID NO: 570212 - DNA, 20 bp, Artificial Sequence
  chemically synthesized
cagaaatggaaaggggcaac

SEQ ID NO: 570213 - DNA, 20 bp, Artificial Sequence
  chemically synthesized
tcagttcacttcattactga

SEQ ID NO: 570214 - DNA, 20 bp, Artificial Sequence
  chemically synthesized
acttcattactgaatttgct

SEQ ID NO: 570215 - DNA, 20 bp, Artificial Sequence
  chemically synthesized
ttatatgcaaaatgtatttc

SEQ ID NO: 570216 - DNA, 20 bp, Artificial Sequence
  chemically synthesized
ttcatttcctaaagtcataa

SEQ ID NO: 570217 - DNA, 20 bp, Artificial Sequence
  chemically synthesized
gcttaaatactgtattataa

SEQ ID NO: 570218 - DNA, 20 bp, Artificial Sequence
  chemically synthesized
tcaggattataatacagtat

SEQ ID NO: 570219 - DNA, 20 bp, Artificial Sequence
  chemically synthesized
ttcaacactaataactacat

SEQ ID NO: 570220 - DNA, 20 bp, Artificial Sequence
  chemically synthesized
tcccattccaatttttttct

SEQ ID NO: 570221 - DNA, 20 bp, Artificial Sequence
  chemically synthesized
atatagttcctgtagcaaga

SEQ ID NO: 570222 - DNA, 20 bp, Artificial Sequence
  chemically synthesized
gcactatccttattttaatt

SEQ ID NO: 570223 - DNA, 20 bp, Artificial Sequence
  chemically synthesized
acgttaaattaaaataagga

SEQ ID NO: 570224 - DNA, 20 bp, Artificial Sequence
  chemically synthesized
tctatatcgtatatcaaaag

SEQ ID NO: 570225 - DNA, 20 bp, Artificial Sequence
  chemically synthesized
gaaagtttagtaagtgatct

SEQ ID NO: 570226 - DNA, 20 bp, Artificial Sequence
  chemically synthesized
tggaaagtctgcccatcttt

SEQ ID NO: 570227 - DNA, 20 bp, Artificial Sequence
  chemically synthesized
aaagatgggcagactttcca

SEQ ID NO: 570228 - DNA, 20 bp, Artificial Sequence
  chemically synthesized
ttaggaattttagttagcca

SEQ ID NO: 570229 - DNA, 20 bp, Artificial Sequence
  chemically synthesized
ggtgaacagaataccacacc

SEQ ID NO: 570230 - DNA, 20 bp, Artificial Sequence
  chemically synthesized
accacaccatgggatttgtc

SEQ ID NO: 570231 - DNA, 20 bp, Artificial Sequence
  chemically synthesized
catcagcactggatattaga

SEQ ID NO: 570232 - DNA, 20 bp, Artificial Sequence
  chemically synthesized
gaaaaaaaaaaagaaaaaaa

SEQ ID NO: 570233 - DNA, 20 bp, Artificial Sequence
  chemically synthesized
ttttctataagtcggttaga

SEQ ID NO: 570234 - DNA, 20 bp, Artificial Sequence
  chemically synthesized
aataatcaccgtgatgtttt

SEQ ID NO: 570235 - DNA, 20 bp, Artificial Sequence
  chemically synthesized
agaaaacttcaaaaacatca

SEQ ID NO: 570236 - DNA, 20 bp, Artificial Sequence
  chemically synthesized
tactcttctaataatcaccg

SEQ ID NO: 570237 - DNA, 20 bp, Artificial Sequence
  chemically synthesized
ttagaagagtaagaaagcaa

SEQ ID NO: 570238 - DNA, 20 bp, Artificial Sequence
  chemically synthesized
tatctgaccttaggaagctt

SEQ ID NO: 570239 - DNA, 20 bp, Artificial Sequence
  chemically synthesized
cctatatctgaccttaggaa

SEQ ID NO: 570240 - DNA, 20 bp, Artificial Sequence
  chemically synthesized
tcttcctatatctgacctta

SEQ ID NO: 570241 - DNA, 20 bp, Artificial Sequence
  chemically synthesized
ctgagttgctccctactgtc

SEQ ID NO: 570242 - DNA, 20 bp, Artificial Sequence
  chemically synthesized
gtacatcccatctatgatca

SEQ ID NO: 570243 - DNA, 20 bp, Artificial Sequence
  chemically synthesized
tgctagttctttctcactct

SEQ ID NO: 570244 - DNA, 20 bp, Artificial Sequence
  chemically synthesized
ttaacgcaaaaagagtatag

SEQ ID NO: 570245 - DNA, 20 bp, Artificial Sequence
  chemically synthesized
tgaggccatggctaaggtat

SEQ ID NO: 570246 - DNA, 20 bp, Artificial Sequence
  chemically synthesized
atggcctcatggtgagcgca

SEQ ID NO: 570247 - DNA, 20 bp, Artificial Sequence
  chemically synthesized
gtgcttcctagctccttgac

SEQ ID NO: 570248 - DNA, 20 bp, Artificial Sequence
  chemically synthesized
ttcctagctccttgaccttg

SEQ ID NO: 570249 - DNA, 20 bp, Artificial Sequence
  chemically synthesized
ttggcttgcttgaccatgtg

SEQ ID NO: 570250 - DNA, 20 bp, Artificial Sequence
  chemically synthesized
ttagcagatatgatgtgaac

SEQ ID NO: 570251 - DNA, 20 bp, Artificial Sequence
  chemically synthesized
aacctggggcatgttctcat

SEQ ID NO: 570252 - DNA, 20 bp, Artificial Sequence
  chemically synthesized
tgccatgagaacatgcccca

SEQ ID NO: 570253 - DNA, 20 bp, Artificial Sequence
  chemically synthesized
taggctgtgagttcagttta

SEQ ID NO: 570254 - DNA, 20 bp, Artificial Sequence
  chemically synthesized
gttcgcctctaggctgtgag

SEQ ID NO: 570255 - DNA, 20 bp, Artificial Sequence
  chemically synthesized
cagcctagaggcgaacccag

SEQ ID NO: 570256 - DNA, 20 bp, Artificial Sequence
  chemically synthesized
aggcatgcttcagtatgaag

SEQ ID NO: 570257 - DNA, 20 bp, Artificial Sequence
  chemically synthesized
tatgaagtagagctttccag

SEQ ID NO: 570258 - DNA, 20 bp, Artificial Sequence
  chemically synthesized
agacccataagcatgagaac

SEQ ID NO: 570259 - DNA, 20 bp, Artificial Sequence
  chemically synthesized
agaatataaagcttctgttc

SEQ ID NO: 570260 - DNA, 20 bp, Artificial Sequence
  chemically synthesized
ataactactatacaagaata

SEQ ID NO: 570261 - DNA, 20 bp, Artificial Sequence
  chemically synthesized
ggagaggggaaacagtatca

SEQ ID NO: 570262 - DNA, 20 bp, Artificial Sequence
  chemically synthesized
ttattctttaatctttatga

SEQ ID NO: 570263 - DNA, 20 bp, Artificial Sequence
  chemically synthesized
ccactgcctctactaacatg

SEQ ID NO: 570264 - DNA, 20 bp, Artificial Sequence
  chemically synthesized
tactaacatgcaaagattaa

SEQ ID NO: 570265 - DNA, 20 bp, Artificial Sequence
  chemically synthesized
aagttcatacttgtaactat

SEQ ID NO: 570266 - DNA, 20 bp, Artificial Sequence
  chemically synthesized
tgttagtaaattgttctagt

SEQ ID NO: 570267 - DNA, 20 bp, Artificial Sequence
  chemically synthesized
ccttattttaaaggttggtg

SEQ ID NO: 570268 - DNA, 20 bp, Artificial Sequence
  chemically synthesized
gaagcattttgcatagatta

SEQ ID NO: 570269 - DNA, 20 bp, Artificial Sequence
  chemically synthesized
taaacgggttaatctatgca

SEQ ID NO: 570270 - DNA, 20 bp, Artificial Sequence
  chemically synthesized
aacacagaggaagcattttg

SEQ ID NO: 570271 - DNA, 20 bp, Artificial Sequence
  chemically synthesized
ctttttaaaaattccaactc

SEQ ID NO: 570272 - DNA, 20 bp, Artificial Sequence
  chemically synthesized
ctgtcactttcctggttacc

SEQ ID NO: 570273 - DNA, 20 bp, Artificial Sequence
  chemically synthesized
ccatgctttggtggttaaca

SEQ ID NO: 570274 - DNA, 20 bp, Artificial Sequence
  chemically synthesized
ccttaactagttccctggtc

SEQ ID NO: 570275 - DNA, 20 bp, Artificial Sequence
  chemically synthesized
aatggctagaaaaagaggaa

SEQ ID NO: 570276 - DNA, 20 bp, Artificial Sequence
  chemically synthesized
agaggaagatttgtctccgt

SEQ ID NO: 570277 - DNA, 20 bp, Artificial Sequence
  chemically synthesized
tcagcatcagaatgccaaga

SEQ ID NO: 570278 - DNA, 20 bp, Artificial Sequence
  chemically synthesized
tcctcttggcattctgatgc

SEQ ID NO: 570279 - DNA, 20 bp, Artificial Sequence
  chemically synthesized
atgtttactatgaaaatcaa

SEQ ID NO: 570280 - DNA, 20 bp, Artificial Sequence
  chemically synthesized
agtatataatgataaaacac

SEQ ID NO: 570281 - DNA, 20 bp, Artificial Sequence
  chemically synthesized
atcattatatactatattag

SEQ ID NO: 570282 - DNA, 20 bp, Artificial Sequence
  chemically synthesized
tttagaaataaataaaacat

SEQ ID NO: 570283 - DNA, 20 bp, Artificial Sequence
  chemically synthesized
caacaattgaaattaaacaa

SEQ ID NO: 570284 - DNA, 20 bp, Artificial Sequence
  chemically synthesized
tgtttaatttcaattgttgg

SEQ ID NO: 570285 - DNA, 20 bp, Artificial Sequence
  chemically synthesized
taagcttggttatgtaaaaa

SEQ ID NO: 570286 - DNA, 20 bp, Artificial Sequence
  chemically synthesized
taaactaaatttttacataa

SEQ ID NO: 570287 - DNA, 20 bp, Artificial Sequence
  chemically synthesized
tttaaataggaaaaaaaata

SEQ ID NO: 570288 - DNA, 20 bp, Artificial Sequence
  chemically synthesized
tttcctatttaaattggtgt

SEQ ID NO: 570289 - DNA, 20 bp, Artificial Sequence
  chemically synthesized
tgacctgaagttatgtgctg

SEQ ID NO: 570290 - DNA, 20 bp, Artificial Sequence
  chemically synthesized
aaaaaaaaaggcgggggcag

SEQ ID NO: 570291 - DNA, 20 bp, Artificial Sequence
  chemically synthesized
ctgaagataacaaggttgtc

SEQ ID NO: 570292 - DNA, 20 bp, Artificial Sequence
  chemically synthesized
atacatctattagaggaaga

SEQ ID NO: 570293 - DNA, 20 bp, Artificial Sequence
  chemically synthesized
gagcagatacatctattaga

SEQ ID NO: 570294 - DNA, 20 bp, Artificial Sequence
  chemically synthesized
atggtgtgagttagggacag

SEQ ID NO: 570295 - DNA, 20 bp, Artificial Sequence
  chemically synthesized
gctcatttcattccattcct

SEQ ID NO: 570296 - DNA, 20 bp, Artificial Sequence
  chemically synthesized
gcagacgagagagaataatt

SEQ ID NO: 570297 - DNA, 20 bp, Artificial Sequence
  chemically synthesized
atataggttttagagagcac

SEQ ID NO: 570298 - DNA, 20 bp, Artificial Sequence
  chemically synthesized
tatgtataatgaatataaat

SEQ ID NO: 570299 - DNA, 20 bp, Artificial Sequence
  chemically synthesized
taccgcccttctgttcagaa

SEQ ID NO: 570300 - DNA, 20 bp, Artificial Sequence
  chemically synthesized
aaaagatgaatatctccctt

SEQ ID NO: 570301 - DNA, 20 bp, Artificial Sequence
  chemically synthesized
ttgggaggctgaggcaggag

SEQ ID NO: 570302 - DNA, 20 bp, Artificial Sequence
  chemically synthesized
tgcctcagcctcccaagtag

SEQ ID NO: 570303 - DNA, 20 bp, Artificial Sequence
  chemically synthesized
tttgtatttttcagtagaga

SEQ ID NO: 570304 - DNA, 20 bp, Artificial Sequence
  chemically synthesized
atggctaagtagaagggaga

SEQ ID NO: 570305 - DNA, 20 bp, Artificial Sequence
  chemically synthesized
gatgcattcagtgatgaaaa

SEQ ID NO: 570306 - DNA, 20 bp, Artificial Sequence
  chemically synthesized
acttagcaaagaatgtttat

SEQ ID NO: 570307 - DNA, 20 bp, Artificial Sequence
  chemically synthesized
tttgataggaacttagcaaa

SEQ ID NO: 570308 - DNA, 20 bp, Artificial Sequence
  chemically synthesized
tcaaaaggaataccctctac

SEQ ID NO: 570309 - DNA, 20 bp, Artificial Sequence
  chemically synthesized
tctcctttctctcactgtgg

SEQ ID NO: 570310 - DNA, 20 bp, Artificial Sequence
  chemically synthesized
attttttataggtctgtctt

SEQ ID NO: 570311 - DNA, 20 bp, Artificial Sequence
  chemically synthesized
ttatcttcatatttcaggtg

SEQ ID NO: 570312 - DNA, 20 bp, Artificial Sequence
  chemically synthesized
tctcacaaagcatatatgcc

SEQ ID NO: 570313 - DNA, 20 bp, Artificial Sequence
  chemically synthesized
tcgttaaaagcctttggcat

SEQ ID NO: 570314 - DNA, 20 bp, Artificial Sequence
  chemically synthesized
atcattcaccatctttcttc

SEQ ID NO: 570315 - DNA, 20 bp, Artificial Sequence
  chemically synthesized
tcttccttggcttcagtcat

SEQ ID NO: 570316 - DNA, 20 bp, Artificial Sequence
  chemically synthesized
tccaagatggagcatgctta

SEQ ID NO: 570317 - DNA, 20 bp, Artificial Sequence
  chemically synthesized
agtaaaggatccaagatgga

SEQ ID NO: 570318 - DNA, 20 bp, Artificial Sequence
  chemically synthesized
catcttggatcctttacttt

SEQ ID NO: 570319 - DNA, 20 bp, Artificial Sequence
  chemically synthesized
cccatcctctagccccttta

SEQ ID NO: 570320 - DNA, 20 bp, Artificial Sequence
  chemically synthesized
cccctttagcctgctttatt

SEQ ID NO: 570321 - DNA, 20 bp, Artificial Sequence
  chemically synthesized
ggacaatcaggtcatgataa

SEQ ID NO: 570322 - DNA, 20 bp, Artificial Sequence
  chemically synthesized
tttaaatcaaacttatcatg

SEQ ID NO: 570323 - DNA, 20 bp, Artificial Sequence
  chemically synthesized
agatggacaatcaggtcatg

SEQ ID NO: 570324 - DNA, 20 bp, Artificial Sequence
  chemically synthesized
aaaacaaagtttatttattg

SEQ ID NO: 570325 - DNA, 20 bp, Artificial Sequence
  chemically synthesized
taagctccacaataaataaa

SEQ ID NO: 570326 - DNA, 20 bp, Artificial Sequence
  chemically synthesized
ggaaacggcagtaaataaaa

SEQ ID NO: 570327 - DNA, 20 bp, Artificial Sequence
  chemically synthesized
ataaactttgttttatttac

SEQ ID NO: 570328 - DNA, 20 bp, Artificial Sequence
  chemically synthesized
cgtttccccagttcctagat

SEQ ID NO: 570329 - DNA, 20 bp, Artificial Sequence
  chemically synthesized
tccccagttcctagatcaga

SEQ ID NO: 570330 - DNA, 20 bp, Artificial Sequence
  chemically synthesized
tttatcttcagtcagttaag

SEQ ID NO: 570331 - DNA, 20 bp, Artificial Sequence
  chemically synthesized
taaaatgaaagaacttagcc

SEQ ID NO: 570332 - DNA, 20 bp, Artificial Sequence
  chemically synthesized
gaatgaataactgggcactt

SEQ ID NO: 570333 - DNA, 20 bp, Artificial Sequence
  chemically synthesized
catattagatgcaggatatg

SEQ ID NO: 570334 - DNA, 20 bp, Artificial Sequence
  chemically synthesized
tgtcatgggcatgtatgctg

SEQ ID NO: 570335 - DNA, 20 bp, Artificial Sequence
  chemically synthesized
ggcatgtatgctgctgagct

SEQ ID NO: 570336 - DNA, 20 bp, Artificial Sequence
  chemically synthesized
ctgagcttaaggtttaaggt

SEQ ID NO: 570337 - DNA, 20 bp, Artificial Sequence
  chemically synthesized
attattttgttcaggataag

SEQ ID NO: 570338 - DNA, 20 bp, Artificial Sequence
  chemically synthesized
tactcttgctttcataatga

SEQ ID NO: 570339 - DNA, 20 bp, Artificial Sequence
  chemically synthesized
cactgggtaatttgatttac

SEQ ID NO: 570340 - DNA, 20 bp, Artificial Sequence
  chemically synthesized
cccattacagtcactgggta

SEQ ID NO: 570341 - DNA, 20 bp, Artificial Sequence
  chemically synthesized
tattataatacctttttctt

SEQ ID NO: 570342 - DNA, 20 bp, Artificial Sequence
  chemically synthesized
tgtcaatttcattgccccct

SEQ ID NO: 570343 - DNA, 20 bp, Artificial Sequence
  chemically synthesized
atttcattgccccctcacag

SEQ ID NO: 570344 - DNA, 20 bp, Artificial Sequence
  chemically synthesized
ccaggaagccaactctaagg

SEQ ID NO: 570345 - DNA, 20 bp, Artificial Sequence
  chemically synthesized
tctctaatcattgccttaga

SEQ ID NO: 570346 - DNA, 20 bp, Artificial Sequence
  chemically synthesized
tgacttctccctatttctat

SEQ ID NO: 570347 - DNA, 20 bp, Artificial Sequence
  chemically synthesized
gaggcagctgatgcaattcc

SEQ ID NO: 570348 - DNA, 20 bp, Artificial Sequence
  chemically synthesized
atgcctgaggaattatttga

SEQ ID NO: 570349 - DNA, 20 bp, Artificial Sequence
  chemically synthesized
gtgcaggcattggtataaag

SEQ ID NO: 570350 - DNA, 20 bp, Artificial Sequence
  chemically synthesized
atcccaccatttctgttgcg

SEQ ID NO: 570351 - DNA, 20 bp, Artificial Sequence
  chemically synthesized
ttgtcatctgtcctagaata

SEQ ID NO: 570352 - DNA, 20 bp, Artificial Sequence
  chemically synthesized
ctcagaaaatgaaggcattt

SEQ ID NO: 570353 - DNA, 20 bp, Artificial Sequence
  chemically synthesized
tagtgcccaggtcaagaaag

SEQ ID NO: 570354 - DNA, 20 bp, Artificial Sequence
  chemically synthesized
gccacaggccagactgtaaa

SEQ ID NO: 570355 - DNA, 20 bp, Artificial Sequence
  chemically synthesized
aataaataactaatccaatc

SEQ ID NO: 570356 - DNA, 20 bp, Artificial Sequence
  chemically synthesized
tctccaagacaaagcatctg

SEQ ID NO: 570357 - DNA, 20 bp, Artificial Sequence
  chemically synthesized
caagctctccaagacaaagc

SEQ ID NO: 570358 - DNA, 20 bp, Artificial Sequence
  chemically synthesized
caatcagatgctttgtcttg

SEQ ID NO: 570359 - DNA, 20 bp, Artificial Sequence
  chemically synthesized
cttccccacccatctgtcat

SEQ ID NO: 570360 - DNA, 20 bp, Artificial Sequence
  chemically synthesized
cagagatgacagatgggtgg

SEQ ID NO: 570361 - DNA, 20 bp, Artificial Sequence
  chemically synthesized
tccacctaacaccttctact

SEQ ID NO: 570362 - DNA, 20 bp, Artificial Sequence
  chemically synthesized
gcatatacagaaagaagcaa

SEQ ID NO: 570363 - DNA, 20 bp, Artificial Sequence
  chemically synthesized
caacagacaccacgaaacat

SEQ ID NO: 570364 - DNA, 20 bp, Artificial Sequence
  chemically synthesized
ggaacaacagacaccacgaa

SEQ ID NO: 570365 - DNA, 20 bp, Artificial Sequence
  chemically synthesized
aacctccgtctcctgggttc

SEQ ID NO: 570366 - DNA, 20 bp, Artificial Sequence
  chemically synthesized
tcaggaggctgaggcaggag

SEQ ID NO: 570367 - DNA, 20 bp, Artificial Sequence
  chemically synthesized
tgcctcagcctcctgagtag

SEQ ID NO: 570368 - DNA, 20 bp, Artificial Sequence
  chemically synthesized
ttttgtgtctttagtagaga

SEQ ID NO: 570369 - DNA, 20 bp, Artificial Sequence
  chemically synthesized
cgcctcagcctcccaaagtg

SEQ ID NO: 570370 - DNA, 20 bp, Artificial Sequence
  chemically synthesized
taaggctgtaagggacaggg

SEQ ID NO: 570371 - DNA, 20 bp, Artificial Sequence
  chemically synthesized
cctgcagtcgcctgaaatca

SEQ ID NO: 570372 - DNA, 20 bp, Artificial Sequence
  chemically synthesized
gatatctgcagtaaaaatca

SEQ ID NO: 570373 - DNA, 20 bp, Artificial Sequence
  chemically synthesized
aagtctatttaaaaatctag

SEQ ID NO: 570374 - DNA, 20 bp, Artificial Sequence
  chemically synthesized
gttcctggtttaaaaaccat

SEQ ID NO: 570375 - DNA, 20 bp, Artificial Sequence
  chemically synthesized
agaatggtttttaaaccagg

SEQ ID NO: 570376 - DNA, 20 bp, Artificial Sequence
  chemically synthesized
gtagacttacataaactgtt

SEQ ID NO: 570377 - DNA, 20 bp, Artificial Sequence
  chemically synthesized
attttcagaacacaaccagt

SEQ ID NO: 570378 - DNA, 20 bp, Artificial Sequence
  chemically synthesized
ttttccattttcagaacaca

SEQ ID NO: 570379 - DNA, 20 bp, Artificial Sequence
  chemically synthesized
ttactttcgtttttccattt

SEQ ID NO: 570380 - DNA, 20 bp, Artificial Sequence
  chemically synthesized
tccaaatggaaaaacgaaag

SEQ ID NO: 570381 - DNA, 20 bp, Artificial Sequence
  chemically synthesized
ctgtgggcaagaatcattac

SEQ ID NO: 570382 - DNA, 20 bp, Artificial Sequence
  chemically synthesized
atcccactatttctgttgtg

SEQ ID NO: 570383 - DNA, 20 bp, Artificial Sequence
  chemically synthesized
tttgtcatctgtccaaaata

SEQ ID NO: 570384 - DNA, 20 bp, Artificial Sequence
  chemically synthesized
aaatagtgcccatgttataa

SEQ ID NO: 570385 - DNA, 20 bp, Artificial Sequence
  chemically synthesized
gaccagcaccagagttctga

SEQ ID NO: 570386 - DNA, 20 bp, Artificial Sequence
  chemically synthesized
tatttcatcttcctcattgt

SEQ ID NO: 570387 - DNA, 20 bp, Artificial Sequence
  chemically synthesized
atggaagagatgagacaaat

SEQ ID NO: 570388 - DNA, 20 bp, Artificial Sequence
  chemically synthesized
tgcgcccattcagctctaaa

SEQ ID NO: 570389 - DNA, 20 bp, Artificial Sequence
  chemically synthesized
ctatcataccccatgcataa

SEQ ID NO: 570390 - DNA, 20 bp, Artificial Sequence
  chemically synthesized
gattatgcatggggtatgat

SEQ ID NO: 570391 - DNA, 20 bp, Artificial Sequence
  chemically synthesized
gcagttcccatttggccaag

SEQ ID NO: 570392 - DNA, 20 bp, Artificial Sequence
  chemically synthesized
tcctcccttggccaaatggg

SEQ ID NO: 570393 - DNA, 20 bp, Artificial Sequence
  chemically synthesized
cgtgtgaattagtcattggc

SEQ ID NO: 570394 - DNA, 20 bp, Artificial Sequence
  chemically synthesized
gccaccgcgcccagccaggg

SEQ ID NO: 570395 - DNA, 20 bp, Artificial Sequence
  chemically synthesized
tgcctcggtctccaaaagtg

SEQ ID NO: 570396 - DNA, 20 bp, Artificial Sequence
  chemically synthesized
ttttgtatttttactagaga

SEQ ID NO: 570397 - DNA, 20 bp, Artificial Sequence
  chemically synthesized
gagtagctgggactaccgcg

SEQ ID NO: 570398 - DNA, 20 bp, Artificial Sequence
  chemically synthesized
tcgggaggctgaggcaggag

SEQ ID NO: 570399 - DNA, 20 bp, Artificial Sequence
  chemically synthesized
ccaagatcacgccattgcac

SEQ ID NO: 570400 - DNA, 20 bp, Artificial Sequence
  chemically synthesized
ggggcctgggctttttgttt

SEQ ID NO: 570401 - DNA, 20 bp, Artificial Sequence
  chemically synthesized
ataaggggcctgggcttttt

SEQ ID NO: 570402 - DNA, 20 bp, Artificial Sequence
  chemically synthesized
tgagataaggggcctgggct

SEQ ID NO: 570403 - DNA, 20 bp, Artificial Sequence
  chemically synthesized
cctactttgagataaggggc

SEQ ID NO: 570404 - DNA, 20 bp, Artificial Sequence
  chemically synthesized
gtgggaaggaagagactcac

SEQ ID NO: 570405 - DNA, 20 bp, Artificial Sequence
  chemically synthesized
ccagcatccttcttacttta

SEQ ID NO: 570406 - DNA, 20 bp, Artificial Sequence
  chemically synthesized
tagagccctatttagataga

SEQ ID NO: 570407 - DNA, 20 bp, Artificial Sequence
  chemically synthesized
tctaaatagggctctacttc

SEQ ID NO: 570408 - DNA, 20 bp, Artificial Sequence
  chemically synthesized
aggctagggtgagcaactat

SEQ ID NO: 570409 - DNA, 20 bp, Artificial Sequence
  chemically synthesized
tcttggtttgcctgggacta

SEQ ID NO: 570410 - DNA, 20 bp, Artificial Sequence
  chemically synthesized
cctggtttgtctgggacttt

SEQ ID NO: 570411 - DNA, 20 bp, Artificial Sequence
  chemically synthesized
gttgcagagtgaccactcat

SEQ ID NO: 570412 - DNA, 20 bp, Artificial Sequence
  chemically synthesized
gatcctgagcatccttcctg

SEQ ID NO: 570413 - DNA, 20 bp, Artificial Sequence
  chemically synthesized
catccttcctgctaagttta

SEQ ID NO: 570414 - DNA, 20 bp, Artificial Sequence
  chemically synthesized
tttttttttttttgtgcata

SEQ ID NO: 570415 - DNA, 20 bp, Artificial Sequence
  chemically synthesized
aaatactacaaattggggca

SEQ ID NO: 570416 - DNA, 20 bp, Artificial Sequence
  chemically synthesized
ggagtaaatcttcccactat

SEQ ID NO: 570417 - DNA, 20 bp, Artificial Sequence
  chemically synthesized
gcttgaaatcaggcatagtg

SEQ ID NO: 570418 - DNA, 20 bp, Artificial Sequence
  chemically synthesized
ctgatttcaagctaccaaag

SEQ ID NO: 570419 - DNA, 20 bp, Artificial Sequence
  chemically synthesized
tagttattaagcctaccttt

SEQ ID NO: 570420 - DNA, 20 bp, Artificial Sequence
  chemically synthesized
atgggaatttctgtgctggg

SEQ ID NO: 570421 - DNA, 20 bp, Artificial Sequence
  chemically synthesized
ccatagcagaaacaaaaacg

SEQ ID NO: 570422 - DNA, 20 bp, Artificial Sequence
  chemically synthesized
cacatgaggaaacagaacgt

SEQ ID NO: 570423 - DNA, 20 bp, Artificial Sequence
  chemically synthesized
tttgaacacatgaggaaaca

SEQ ID NO: 570424 - DNA, 20 bp, Artificial Sequence
  chemically synthesized
gctttacagtatcattagca

SEQ ID NO: 570425 - DNA, 20 bp, Artificial Sequence
  chemically synthesized
actgtaaagcaaataaatct

SEQ ID NO: 570426 - DNA, 20 bp, Artificial Sequence
  chemically synthesized
cccaataagctctcagattt

SEQ ID NO: 570427 - DNA, 20 bp, Artificial Sequence
  chemically synthesized
tgtatactccccaataagct

SEQ ID NO: 570428 - DNA, 20 bp, Artificial Sequence
  chemically synthesized
aatataattattactgctgt

SEQ ID NO: 570429 - DNA, 20 bp, Artificial Sequence
  chemically synthesized
ctcagggtgaaatgatttga

SEQ ID NO: 570430 - DNA, 20 bp, Artificial Sequence
  chemically synthesized
ctggctcaaatcatttcacc

SEQ ID NO: 570431 - DNA, 20 bp, Artificial Sequence
  chemically synthesized
tcaagtaaaatctcagggtg

SEQ ID NO: 570432 - DNA, 20 bp, Artificial Sequence
  chemically synthesized
aattttgcaggtccaatgtg

SEQ ID NO: 570433 - DNA, 20 bp, Artificial Sequence
  chemically synthesized
ttctttctgacttttatcat

SEQ ID NO: 570434 - DNA, 20 bp, Artificial Sequence
  chemically synthesized
tttatcatgatggcttattt

SEQ ID NO: 570435 - DNA, 20 bp, Artificial Sequence
  chemically synthesized
atgtttttatttttttgaga

SEQ ID NO: 570436 - DNA, 20 bp, Artificial Sequence
  chemically synthesized
gaggcagaggttgcagtgag

SEQ ID NO: 570437 - DNA, 20 bp, Artificial Sequence
  chemically synthesized
aacctctgcctcctgggttc

SEQ ID NO: 570438 - DNA, 20 bp, Artificial Sequence
  chemically synthesized
tgcctcagcctctcgagtag

SEQ ID NO: 570439 - DNA, 20 bp, Artificial Sequence
  chemically synthesized
ttttgtatttttagtagaga

SEQ ID NO: 570440 - DNA, 20 bp, Artificial Sequence
  chemically synthesized
cgcctcggcctcccaaagtg

SEQ ID NO: 570441 - DNA, 20 bp, Artificial Sequence
  chemically synthesized
gccaccgcacccggcctcat

SEQ ID NO: 570442 - DNA, 20 bp, Artificial Sequence
  chemically synthesized
atggcttatttaagccaatc

SEQ ID NO: 570443 - DNA, 20 bp, Artificial Sequence
  chemically synthesized
gcaataatttaaagcttcag

SEQ ID NO: 570444 - DNA, 20 bp, Artificial Sequence
  chemically synthesized
gtggggcaataatttaaagc

SEQ ID NO: 570445 - DNA, 20 bp, Artificial Sequence
  chemically synthesized
atatgagtggggcaataatt

SEQ ID NO: 570446 - DNA, 20 bp, Artificial Sequence
  chemically synthesized
gaaatgtcagcaattattag

SEQ ID NO: 570447 - DNA, 20 bp, Artificial Sequence
  chemically synthesized
agcaattattagatgtgctt

SEQ ID NO: 570448 - DNA, 20 bp, Artificial Sequence
  chemically synthesized
tagtggggaatgtccaggat

SEQ ID NO: 570449 - DNA, 20 bp, Artificial Sequence
  chemically synthesized
tgtttctatcttgagagttg

SEQ ID NO: 570450 - DNA, 20 bp, Artificial Sequence
  chemically synthesized
ttgatacatagggcctagca

SEQ ID NO: 570451 - DNA, 20 bp, Artificial Sequence
  chemically synthesized
ctccttgatacatagggcct

SEQ ID NO: 570452 - DNA, 20 bp, Artificial Sequence
  chemically synthesized
atgtatcaaggagaaactgt

SEQ ID NO: 570453 - DNA, 20 bp, Artificial Sequence
  chemically synthesized
gtcaaagtgactcaagcttt

SEQ ID NO: 570454 - DNA, 20 bp, Artificial Sequence
  chemically synthesized
ttctctcttgtcaaagtgac

SEQ ID NO: 570455 - DNA, 20 bp, Artificial Sequence
  chemically synthesized
agaaaaagacttaaccaggg

SEQ ID NO: 570456 - DNA, 20 bp, Artificial Sequence
  chemically synthesized
cagggatatgattaaggcag

SEQ ID NO: 570457 - DNA, 20 bp, Artificial Sequence
  chemically synthesized
taactgatccattatttctt

SEQ ID NO: 570458 - DNA, 20 bp, Artificial Sequence
  chemically synthesized
ctgtttcattgagtgacctt

SEQ ID NO: 570459 - DNA, 20 bp, Artificial Sequence
  chemically synthesized
ctgagaaggtcactcaatga

SEQ ID NO: 570460 - DNA, 20 bp, Artificial Sequence
  chemically synthesized
ctatttattctgaatttaaa

SEQ ID NO: 570461 - DNA, 20 bp, Artificial Sequence
  chemically synthesized
ataaaggtaacattttatac

SEQ ID NO: 570462 - DNA, 20 bp, Artificial Sequence
  chemically synthesized
ggagtataaaatgttacctt

SEQ ID NO: 570463 - DNA, 20 bp, Artificial Sequence
  chemically synthesized
aaagaaagaaatgatgcaat

SEQ ID NO: 570464 - DNA, 20 bp, Artificial Sequence
  chemically synthesized
tagcattcataactttatat

SEQ ID NO: 570465 - DNA, 20 bp, Artificial Sequence
  chemically synthesized
ataaataatgtgaccttttc

SEQ ID NO: 570466 - DNA, 20 bp, Artificial Sequence
  chemically synthesized
cattgataatacacagaggc

SEQ ID NO: 570467 - DNA, 20 bp, Artificial Sequence
  chemically synthesized
ctaatactatcctgacattt

SEQ ID NO: 570468 - DNA, 20 bp, Artificial Sequence
  chemically synthesized
ttagagattaaggtctatct

SEQ ID NO: 570469 - DNA, 20 bp, Artificial Sequence
  chemically synthesized
gcacattagaacggctcaat

SEQ ID NO: 570470 - DNA, 20 bp, Artificial Sequence
  chemically synthesized
aatgtgcaaaacactggact

SEQ ID NO: 570471 - DNA, 20 bp, Artificial Sequence
  chemically synthesized
aaggatctaatctgaaagtc

SEQ ID NO: 570472 - DNA, 20 bp, Artificial Sequence
  chemically synthesized
gtagttcctctcctttctga

SEQ ID NO: 570473 - DNA, 20 bp, Artificial Sequence
  chemically synthesized
gaatgaatgaaactttcatg

SEQ ID NO: 570474 - DNA, 20 bp, Artificial Sequence
  chemically synthesized
gttagagtcaaactagtcat

SEQ ID NO: 570475 - DNA, 20 bp, Artificial Sequence
  chemically synthesized
gcattagtatcattattact

SEQ ID NO: 570476 - DNA, 20 bp, Artificial Sequence
  chemically synthesized
gtgctattcaagtgtttgct

SEQ ID NO: 570477 - DNA, 20 bp, Artificial Sequence
  chemically synthesized
gaacatagtaagtgctattc

SEQ ID NO: 570478 - DNA, 20 bp, Artificial Sequence
  chemically synthesized
tatgttccaggcactactct

SEQ ID NO: 570479 - DNA, 20 bp, Artificial Sequence
  chemically synthesized
ctaagggttttacaaatatt

SEQ ID NO: 570480 - DNA, 20 bp, Artificial Sequence
  chemically synthesized
cccattggtcgtatggtgca

SEQ ID NO: 570481 - DNA, 20 bp, Artificial Sequence
  chemically synthesized
tgtaagacacacttttccac

SEQ ID NO: 570482 - DNA, 20 bp, Artificial Sequence
  chemically synthesized
caaatattgactcagacact

SEQ ID NO: 570483 - DNA, 20 bp, Artificial Sequence
  chemically synthesized
tgagtcaatatttgaaccca

SEQ ID NO: 570484 - DNA, 20 bp, Artificial Sequence
  chemically synthesized
gaacccagtcagtttcattt

SEQ ID NO: 570485 - DNA, 20 bp, Artificial Sequence
  chemically synthesized
tatcgataccattttgataa

SEQ ID NO: 570486 - DNA, 20 bp, Artificial Sequence
  chemically synthesized
ctcttcgtttggccatccta

SEQ ID NO: 570487 - DNA, 20 bp, Artificial Sequence
  chemically synthesized
ttattctctcgtatattcct

SEQ ID NO: 570488 - DNA, 20 bp, Artificial Sequence
  chemically synthesized
tctagtctatctgctattgc

SEQ ID NO: 570489 - DNA, 20 bp, Artificial Sequence
  chemically synthesized
acgggtaaggcagtgtgatg

SEQ ID NO: 570490 - DNA, 20 bp, Artificial Sequence
  chemically synthesized
ttataatactgggactggaa

SEQ ID NO: 570491 - DNA, 20 bp, Artificial Sequence
  chemically synthesized
gtaaaataaggaaagggctc

SEQ ID NO: 570492 - DNA, 20 bp, Artificial Sequence
  chemically synthesized
aggaaagggctcgaatgatt

SEQ ID NO: 570493 - DNA, 20 bp, Artificial Sequence
  chemically synthesized
cttctgtgggttgcagtcga

SEQ ID NO: 570494 - DNA, 20 bp, Artificial Sequence
  chemically synthesized
gactgcaacccacagaagaa

SEQ ID NO: 570495 - DNA, 20 bp, Artificial Sequence
  chemically synthesized
gcacgccagatcacagtgta

SEQ ID NO: 570496 - DNA, 20 bp, Artificial Sequence
  chemically synthesized
accgccaaaacaacacttaa

SEQ ID NO: 570497 - DNA, 20 bp, Artificial Sequence
  chemically synthesized
attacctaagcaaggttaag

SEQ ID NO: 570498 - DNA, 20 bp, Artificial Sequence
  chemically synthesized
tatggaatggaatggaatgg

SEQ ID NO: 570499 - DNA, 20 bp, Artificial Sequence
  chemically synthesized
ttgttggttgtaagtcatta

SEQ ID NO: 570500 - DNA, 20 bp, Artificial Sequence
  chemically synthesized
tgtaagtcattaaactgatt

SEQ ID NO: 570501 - DNA, 20 bp, Artificial Sequence
  chemically synthesized
gctcattagcaaatcctaaa

SEQ ID NO: 570502 - DNA, 20 bp, Artificial Sequence
  chemically synthesized
tttgctaatgagccacacct

SEQ ID NO: 570503 - DNA, 20 bp, Artificial Sequence
  chemically synthesized
gcttagaaagtatctatacc

SEQ ID NO: 570504 - DNA, 20 bp, Artificial Sequence
  chemically synthesized
actactggtatagatacttt

SEQ ID NO: 570505 - DNA, 20 bp, Artificial Sequence
  chemically synthesized
gtggagtttcctaactggag

SEQ ID NO: 570506 - DNA, 20 bp, Artificial Sequence
  chemically synthesized
ccaggagccctcttgtgctg

SEQ ID NO: 570507 - DNA, 20 bp, Artificial Sequence
  chemically synthesized
tcattttctttttaattgga

SEQ ID NO: 570508 - DNA, 20 bp, Artificial Sequence
  chemically synthesized
gccttaatgtggtatttgcc

SEQ ID NO: 570509 - DNA, 20 bp, Artificial Sequence
  chemically synthesized
tggcaaataccacattaagg

SEQ ID NO: 570510 - DNA, 20 bp, Artificial Sequence
  chemically synthesized
attcactgtgatccatggca

SEQ ID NO: 570511 - DNA, 20 bp, Artificial Sequence
  chemically synthesized
aattaactggtgtgcctgaa

SEQ ID NO: 570512 - DNA, 20 bp, Artificial Sequence
  chemically synthesized
ggataaggagtctatagttc

SEQ ID NO: 570513 - DNA, 20 bp, Artificial Sequence
  chemically synthesized
agaattctaacaagaaataa

SEQ ID NO: 570514 - DNA, 20 bp, Artificial Sequence
  chemically synthesized
acactaggtttcaaagataa

SEQ ID NO: 570515 - DNA, 20 bp, Artificial Sequence
  chemically synthesized
acttgcttatctttgaaacc

SEQ ID NO: 570516 - DNA, 20 bp, Artificial Sequence
  chemically synthesized
ttaataagattggaaaaaca

SEQ ID NO: 570517 - DNA, 20 bp, Artificial Sequence
  chemically synthesized
gaaaaaaatagtactgatta

SEQ ID NO: 570518 - DNA, 20 bp, Artificial Sequence
  chemically synthesized
ctgtcccttgaaaaaaatag

SEQ ID NO: 570519 - DNA, 20 bp, Artificial Sequence
  chemically synthesized
tttaaaacattaatgttata

SEQ ID NO: 570520 - DNA, 20 bp, Artificial Sequence
  chemically synthesized
atcaaaacctaatataacat

SEQ ID NO: 570521 - DNA, 20 bp, Artificial Sequence
  chemically synthesized
aacattaatgttttaaagaa

SEQ ID NO: 570522 - DNA, 20 bp, Artificial Sequence
  chemically synthesized
ttgtaaaatattaagaaaac

SEQ ID NO: 570523 - DNA, 20 bp, Artificial Sequence
  chemically synthesized
ctataacagtaaaaagaatc

SEQ ID NO: 570524 - DNA, 20 bp, Artificial Sequence
  chemically synthesized
ggattctttttactgttata

SEQ ID NO: 570525 - DNA, 20 bp, Artificial Sequence
  chemically synthesized
tctgtctcaaaaaaagaatt

SEQ ID NO: 570526 - DNA, 20 bp, Artificial Sequence
  chemically synthesized
ttaggaggctgaggcaggag

SEQ ID NO: 570527 - DNA, 20 bp, Artificial Sequence
  chemically synthesized
tgcctcagcctcctaagcag

SEQ ID NO: 570528 - DNA, 20 bp, Artificial Sequence
  chemically synthesized
tggcactcgcctgtaatccc

SEQ ID NO: 570529 - DNA, 20 bp, Artificial Sequence
  chemically synthesized
tttgtatttttagtacagat

SEQ ID NO: 570530 - DNA, 20 bp, Artificial Sequence
  chemically synthesized
cacctcagcctcccaaagtg

SEQ ID NO: 570531 - DNA, 20 bp, Artificial Sequence
  chemically synthesized
tccttttcttttgaagagtt

SEQ ID NO: 570532 - DNA, 20 bp, Artificial Sequence
  chemically synthesized
aaaattgtccttttcttttg

SEQ ID NO: 570533 - DNA, 20 bp, Artificial Sequence
  chemically synthesized
ttgtcagtctcttcatatgt

SEQ ID NO: 570534 - DNA, 20 bp, Artificial Sequence
  chemically synthesized
tattagaatttctccttttt

SEQ ID NO: 570535 - DNA, 20 bp, Artificial Sequence
  chemically synthesized
gacactaacttgtccttact

SEQ ID NO: 570536 - DNA, 20 bp, Artificial Sequence
  chemically synthesized
cggagaagggtcatatttca

SEQ ID NO: 570537 - DNA, 20 bp, Artificial Sequence
  chemically synthesized
gaaaaaatttctttaacatg

SEQ ID NO: 570538 - DNA, 20 bp, Artificial Sequence
  chemically synthesized
ttttactaaaaaaaagaatt

SEQ ID NO: 570539 - DNA, 20 bp, Artificial Sequence
  chemically synthesized
aaattacattaccagctgtc

SEQ ID NO: 570540 - DNA, 20 bp, Artificial Sequence
  chemically synthesized
aagataaacagagacagtaa

SEQ ID NO: 570541 - DNA, 20 bp, Artificial Sequence
  chemically synthesized
agcgtaaacatgcttactgt

SEQ ID NO: 570542 - DNA, 20 bp, Artificial Sequence
  chemically synthesized
aattgcacccgccagcgtaa

SEQ ID NO: 570543 - DNA, 20 bp, Artificial Sequence
  chemically synthesized
ttttcttttctttgtaattt

SEQ ID NO: 570544 - DNA, 20 bp, Artificial Sequence
  chemically synthesized
aataataatagggtggctcc

SEQ ID NO: 570545 - DNA, 20 bp, Artificial Sequence
  chemically synthesized
gagttgatacatgtttagta

SEQ ID NO: 570546 - DNA, 20 bp, Artificial Sequence
  chemically synthesized
ttagacaggcctgagttgat

SEQ ID NO: 570547 - DNA, 20 bp, Artificial Sequence
  chemically synthesized
ccccccaccaatgaataaaa

SEQ ID NO: 570548 - DNA, 20 bp, Artificial Sequence
  chemically synthesized
tttattcattggtgggggga

SEQ ID NO: 570549 - DNA, 20 bp, Artificial Sequence
  chemically synthesized
cacgtatttgctactataaa

SEQ ID NO: 570550 - DNA, 20 bp, Artificial Sequence
  chemically synthesized
aatacgtgacttcagagatg

SEQ ID NO: 570551 - DNA, 20 bp, Artificial Sequence
  chemically synthesized
gagatgtcctgcttcaaata

SEQ ID NO: 570552 - DNA, 20 bp, Artificial Sequence
  chemically synthesized
gtcagggtcttgctctgtca

SEQ ID NO: 570553 - DNA, 20 bp, Artificial Sequence
  chemically synthesized
cagattggagtgcggggggg

SEQ ID NO: 570554 - DNA, 20 bp, Artificial Sequence
  chemically synthesized
ggctcaagtgatcctcctgc

SEQ ID NO: 570555 - DNA, 20 bp, Artificial Sequence
  chemically synthesized
tgcctcagtttcccaaagaa

SEQ ID NO: 570556 - DNA, 20 bp, Artificial Sequence
  chemically synthesized
cacaccatgcctagctcaaa

SEQ ID NO: 570557 - DNA, 20 bp, Artificial Sequence
  chemically synthesized
tctggtgcaattttctagag

SEQ ID NO: 570558 - DNA, 20 bp, Artificial Sequence
  chemically synthesized
aagtttggcaatacacttga

SEQ ID NO: 570559 - DNA, 20 bp, Artificial Sequence
  chemically synthesized
ggtggaattgtcatgttaaa

SEQ ID NO: 570560 - DNA, 20 bp, Artificial Sequence
  chemically synthesized
ttttatacctttacaaatat

SEQ ID NO: 570561 - DNA, 20 bp, Artificial Sequence
  chemically synthesized
agccataatgctcgatataa

SEQ ID NO: 570562 - DNA, 20 bp, Artificial Sequence
  chemically synthesized
caattctaaattgctcaata

SEQ ID NO: 570563 - DNA, 20 bp, Artificial Sequence
  chemically synthesized
actatctttccaatattttc

SEQ ID NO: 570564 - DNA, 20 bp, Artificial Sequence
  chemically synthesized
acacacgaaaatattggaaa

SEQ ID NO: 570565 - DNA, 20 bp, Artificial Sequence
  chemically synthesized
aaacatgctacagttttatg

SEQ ID NO: 570566 - DNA, 20 bp, Artificial Sequence
  chemically synthesized
aagcagctcataaaactgta

SEQ ID NO: 570567 - DNA, 20 bp, Artificial Sequence
  chemically synthesized
atgcgcagataaaaacatgc

SEQ ID NO: 570568 - DNA, 20 bp, Artificial Sequence
  chemically synthesized
gtagcatgtttttatctgcg

SEQ ID NO: 570569 - DNA, 20 bp, Artificial Sequence
  chemically synthesized
cactgaggcctcccaaagtg

SEQ ID NO: 570570 - DNA, 20 bp, Artificial Sequence
  chemically synthesized
cactttgggaggcctcagtg

SEQ ID NO: 570571 - DNA, 20 bp, Artificial Sequence
  chemically synthesized
ttttgtatttttagtagaga

SEQ ID NO: 570572 - DNA, 20 bp, Artificial Sequence
  chemically synthesized
gggattacaggaatacgcca

SEQ ID NO: 570573 - DNA, 20 bp, Artificial Sequence
  chemically synthesized
tgactcagcctcccgagtag

SEQ ID NO: 570574 - DNA, 20 bp, Artificial Sequence
  chemically synthesized
acctcccccgtcctgggttc

SEQ ID NO: 570575 - DNA, 20 bp, Artificial Sequence
  chemically synthesized
acgggggaggttgcagtgag

SEQ ID NO: 570576 - DNA, 20 bp, Artificial Sequence
  chemically synthesized
tatcttttatttttttattt

SEQ ID NO: 570577 - DNA, 20 bp, Artificial Sequence
  chemically synthesized
tatataaaccaaatttctga

SEQ ID NO: 570578 - DNA, 20 bp, Artificial Sequence
  chemically synthesized
gagataatcactatcagaaa

SEQ ID NO: 570579 - DNA, 20 bp, Artificial Sequence
  chemically synthesized
atagtgattatctctgagtc

SEQ ID NO: 570580 - DNA, 20 bp, Artificial Sequence
  chemically synthesized
attatggatactttttcttt

SEQ ID NO: 570581 - DNA, 20 bp, Artificial Sequence
  chemically synthesized
tttcttttcttgtttgtact

SEQ ID NO: 570582 - DNA, 20 bp, Artificial Sequence
  chemically synthesized
ggacggtgagactaaggatg

SEQ ID NO: 570583 - DNA, 20 bp, Artificial Sequence
  chemically synthesized
aataggacggtgagactaag

SEQ ID NO: 570584 - DNA, 20 bp, Artificial Sequence
  chemically synthesized
aggtataaagaaaataccaa

SEQ ID NO: 570585 - DNA, 20 bp, Artificial Sequence
  chemically synthesized
attttctttatacctgcaag

SEQ ID NO: 570586 - DNA, 20 bp, Artificial Sequence
  chemically synthesized
tatcaatatacgcttaaaag

SEQ ID NO: 570587 - DNA, 20 bp, Artificial Sequence
  chemically synthesized
tggaatatcaatatacgctt

SEQ ID NO: 570588 - DNA, 20 bp, Artificial Sequence
  chemically synthesized
tgcccatgtggaatatcaat

SEQ ID NO: 570589 - DNA, 20 bp, Artificial Sequence
  chemically synthesized
ggaagtgggcactgatgtga

SEQ ID NO: 570590 - DNA, 20 bp, Artificial Sequence
  chemically synthesized
aaagttccttcctcacagct

SEQ ID NO: 570591 - DNA, 20 bp, Artificial Sequence
  chemically synthesized
atggccgatgttctaccacc

SEQ ID NO: 570592 - DNA, 20 bp, Artificial Sequence
  chemically synthesized
atgttctaccacctcaggct

SEQ ID NO: 570593 - DNA, 20 bp, Artificial Sequence
  chemically synthesized
catttaacccaagtgatagg

SEQ ID NO: 570594 - DNA, 20 bp, Artificial Sequence
  chemically synthesized
gagtatatcattttctgaaa

SEQ ID NO: 570595 - DNA, 20 bp, Artificial Sequence
  chemically synthesized
taatagtactattttttatt

SEQ ID NO: 570596 - DNA, 20 bp, Artificial Sequence
  chemically synthesized
ttttttatttatggtttatg

SEQ ID NO: 570597 - DNA, 20 bp, Artificial Sequence
  chemically synthesized
agccattctattcgatttaa

SEQ ID NO: 570598 - DNA, 20 bp, Artificial Sequence
  chemically synthesized
gccttggtgacagccattct

SEQ ID NO: 570599 - DNA, 20 bp, Artificial Sequence
  chemically synthesized
ccaaggcaagttaagtagac

SEQ ID NO: 570600 - DNA, 20 bp, Artificial Sequence
  chemically synthesized
tctagaaaaatgataaaggc

SEQ ID NO: 570601 - DNA, 20 bp, Artificial Sequence
  chemically synthesized
tttatctaaatgagtgggat

SEQ ID NO: 570602 - DNA, 20 bp, Artificial Sequence
  chemically synthesized
cgatcccactcatttagata

SEQ ID NO: 570603 - DNA, 20 bp, Artificial Sequence
  chemically synthesized
aagaaaaagggataagttaa

SEQ ID NO: 570604 - DNA, 20 bp, Artificial Sequence
  chemically synthesized
gttatttggacacagtttca

SEQ ID NO: 570605 - DNA, 20 bp, Artificial Sequence
  chemically synthesized
atgtggtctagttatttgga

SEQ ID NO: 570606 - DNA, 20 bp, Artificial Sequence
  chemically synthesized
tgtttttgtcatacatcgat

SEQ ID NO: 570607 - DNA, 20 bp, Artificial Sequence
  chemically synthesized
tttcctggaaggtgttggtc

SEQ ID NO: 570608 - DNA, 20 bp, Artificial Sequence
  chemically synthesized
aattaagtaaaattacagtg

SEQ ID NO: 570609 - DNA, 20 bp, Artificial Sequence
  chemically synthesized
caagaagttggctccagagt

SEQ ID NO: 570610 - DNA, 20 bp, Artificial Sequence
  chemically synthesized
cagactctggagccaacttc

SEQ ID NO: 570611 - DNA, 20 bp, Artificial Sequence
  chemically synthesized
acagctagtagatgagggag

SEQ ID NO: 570612 - DNA, 20 bp, Artificial Sequence
  chemically synthesized
ctagctgtatgaatgtgtgc

SEQ ID NO: 570613 - DNA, 20 bp, Artificial Sequence
  chemically synthesized
ataataatggtacctacctt

SEQ ID NO: 570614 - DNA, 20 bp, Artificial Sequence
  chemically synthesized
gtacctaccttaagggattg

SEQ ID NO: 570615 - DNA, 20 bp, Artificial Sequence
  chemically synthesized
agggattgaagggattgcta

SEQ ID NO: 570616 - DNA, 20 bp, Artificial Sequence
  chemically synthesized
tagaaatgttacagatttta

SEQ ID NO: 570617 - DNA, 20 bp, Artificial Sequence
  chemically synthesized
tactttgtgcctagaaatgt

SEQ ID NO: 570618 - DNA, 20 bp, Artificial Sequence
  chemically synthesized
ggtcatatatgagtatatat

SEQ ID NO: 570619 - DNA, 20 bp, Artificial Sequence
  chemically synthesized
gttaactccatgtggtaaag

SEQ ID NO: 570620 - DNA, 20 bp, Artificial Sequence
  chemically synthesized
tgattataaaagtatatgtg

SEQ ID NO: 570621 - DNA, 20 bp, Artificial Sequence
  chemically synthesized
gttaatttataccacttttt

SEQ ID NO: 570622 - DNA, 20 bp, Artificial Sequence
  chemically synthesized
aacattaatcagaggaaaac

SEQ ID NO: 570623 - DNA, 20 bp, Artificial Sequence
  chemically synthesized
attggcaagcacctgttttc

SEQ ID NO: 570624 - DNA, 20 bp, Artificial Sequence
  chemically synthesized
tgcatattaaattggcaagc

SEQ ID NO: 570625 - DNA, 20 bp, Artificial Sequence
  chemically synthesized
taatatgcaatattgtataa

SEQ ID NO: 570626 - DNA, 20 bp, Artificial Sequence
  chemically synthesized
agaaataaccttggttaact

SEQ ID NO: 570627 - DNA, 20 bp, Artificial Sequence
  chemically synthesized
tggttttgctattttattaa

SEQ ID NO: 570628 - DNA, 20 bp, Artificial Sequence
  chemically synthesized
tctagccattctttttattt

SEQ ID NO: 570629 - DNA, 20 bp, Artificial Sequence
  chemically synthesized
cgccttggcctcccaaagtg

SEQ ID NO: 570630 - DNA, 20 bp, Artificial Sequence
  chemically synthesized
ttgtatttttttagtagaga

SEQ ID NO: 570631 - DNA, 20 bp, Artificial Sequence
  chemically synthesized
tcgggaggctgaggcaggag

SEQ ID NO: 570632 - DNA, 20 bp, Artificial Sequence
  chemically synthesized
tatgggcatttcctttccct

SEQ ID NO: 570633 - DNA, 20 bp, Artificial Sequence
  chemically synthesized
gaaaggaaatgcccataggc

SEQ ID NO: 570634 - DNA, 20 bp, Artificial Sequence
  chemically synthesized
atttcaaagtaccaagaaga

SEQ ID NO: 570635 - DNA, 20 bp, Artificial Sequence
  chemically synthesized
cgtagtccttctatctaact

SEQ ID NO: 570636 - DNA, 20 bp, Artificial Sequence
  chemically synthesized
ctagtatctatcattctatt

SEQ ID NO: 570637 - DNA, 20 bp, Artificial Sequence
  chemically synthesized
gctcccacaagagtaagaac

SEQ ID NO: 570638 - DNA, 20 bp, Artificial Sequence
  chemically synthesized
atccatgttgctgtgaatga

SEQ ID NO: 570639 - DNA, 20 bp, Artificial Sequence
  chemically synthesized
atgacatggtttcattcttg

SEQ ID NO: 570640 - DNA, 20 bp, Artificial Sequence
  chemically synthesized
catctgttgatatacactta

SEQ ID NO: 570641 - DNA, 20 bp, Artificial Sequence
  chemically synthesized
ttaggttgatttcacatctt

SEQ ID NO: 570642 - DNA, 20 bp, Artificial Sequence
  chemically synthesized
cacttgcatgcttatcacag

SEQ ID NO: 570643 - DNA, 20 bp, Artificial Sequence
  chemically synthesized
tcaaaagggtacctgcactt

SEQ ID NO: 570644 - DNA, 20 bp, Artificial Sequence
  chemically synthesized
gtgcaggtacccttttgata

SEQ ID NO: 570645 - DNA, 20 bp, Artificial Sequence
  chemically synthesized
cccttttgatatactgattt

SEQ ID NO: 570646 - DNA, 20 bp, Artificial Sequence
  chemically synthesized
tttgggatggataaccagta

SEQ ID NO: 570647 - DNA, 20 bp, Artificial Sequence
  chemically synthesized
gatggtaaggtagttctatt

SEQ ID NO: 570648 - DNA, 20 bp, Artificial Sequence
  chemically synthesized
acagtaaattagtaacagta

SEQ ID NO: 570649 - DNA, 20 bp, Artificial Sequence
  chemically synthesized
ttattcaaaagacaaaaaat

SEQ ID NO: 570650 - DNA, 20 bp, Artificial Sequence
  chemically synthesized
taagacgatatatcatgtgg

SEQ ID NO: 570651 - DNA, 20 bp, Artificial Sequence
  chemically synthesized
ggtcttgatttgcatttccc

SEQ ID NO: 570652 - DNA, 20 bp, Artificial Sequence
  chemically synthesized
aattacatgatatcataatt

SEQ ID NO: 570653 - DNA, 20 bp, Artificial Sequence
  chemically synthesized
cagaaattaaaaactcaaaa

SEQ ID NO: 570654 - DNA, 20 bp, Artificial Sequence
  chemically synthesized
gctgaagcaaaaacatactt

SEQ ID NO: 570655 - DNA, 20 bp, Artificial Sequence
  chemically synthesized
ttaaaaactcaaaagtatgt

SEQ ID NO: 570656 - DNA, 20 bp, Artificial Sequence
  chemically synthesized
ccagtcttcagctaatgcat

SEQ ID NO: 570657 - DNA, 20 bp, Artificial Sequence
  chemically synthesized
atcaaccaagttatatttca

SEQ ID NO: 570658 - DNA, 20 bp, Artificial Sequence
  chemically synthesized
aagttatatttcaggatgat

SEQ ID NO: 570659 - DNA, 20 bp, Artificial Sequence
  chemically synthesized
atgcttctactgcatctgat

SEQ ID NO: 570660 - DNA, 20 bp, Artificial Sequence
  chemically synthesized
tataattcaactcttaattc

SEQ ID NO: 570661 - DNA, 20 bp, Artificial Sequence
  chemically synthesized
tatcacttaactttattgca

SEQ ID NO: 570662 - DNA, 20 bp, Artificial Sequence
  chemically synthesized
tttctttccagtaagtcatt

SEQ ID NO: 570663 - DNA, 20 bp, Artificial Sequence
  chemically synthesized
gatgctggaccaaagtccct

SEQ ID NO: 570664 - DNA, 20 bp, Artificial Sequence
  chemically synthesized
gtatcttatcagaaaggata

SEQ ID NO: 570665 - DNA, 20 bp, Artificial Sequence
  chemically synthesized
ttaaaactagagttatgaaa

SEQ ID NO: 570666 - DNA, 20 bp, Artificial Sequence
  chemically synthesized
ctaaagcaacatttcataac

SEQ ID NO: 570667 - DNA, 20 bp, Artificial Sequence
  chemically synthesized
taccgtatatagtattccag

SEQ ID NO: 570668 - DNA, 20 bp, Artificial Sequence
  chemically synthesized
ggaaatcctttgtgtttggc

SEQ ID NO: 570669 - DNA, 20 bp, Artificial Sequence
  chemically synthesized
atcaatccaaggccaaacac

SEQ ID NO: 570670 - DNA, 20 bp, Artificial Sequence
  chemically synthesized
ttgtcgagagaggaaatcct

SEQ ID NO: 570671 - DNA, 20 bp, Artificial Sequence
  chemically synthesized
cctctctcgacaatgttaaa

SEQ ID NO: 570672 - DNA, 20 bp, Artificial Sequence
  chemically synthesized
cgacaatgttaaaatgagat

SEQ ID NO: 570673 - DNA, 20 bp, Artificial Sequence
  chemically synthesized
attggcagccacaaatgaac

SEQ ID NO: 570674 - DNA, 20 bp, Artificial Sequence
  chemically synthesized
ccctaatgtttttgtgaaag

SEQ ID NO: 570675 - DNA, 20 bp, Artificial Sequence
  chemically synthesized
ataccaaatgtcaccctccc

SEQ ID NO: 570676 - DNA, 20 bp, Artificial Sequence
  chemically synthesized
aaagacaagacatgtcattt

SEQ ID NO: 570677 - DNA, 20 bp, Artificial Sequence
  chemically synthesized
cttgtctttaagtcttaggc

SEQ ID NO: 570678 - DNA, 20 bp, Artificial Sequence
  chemically synthesized
acaaatttttaaagaagcaa

SEQ ID NO: 570679 - DNA, 20 bp, Artificial Sequence
  chemically synthesized
atttattatctattaatcaa

SEQ ID NO: 570680 - DNA, 20 bp, Artificial Sequence
  chemically synthesized
atcaataattaaatatcact

SEQ ID NO: 570681 - DNA, 20 bp, Artificial Sequence
  chemically synthesized
ataattattaattaaccagt

SEQ ID NO: 570682 - DNA, 20 bp, Artificial Sequence
  chemically synthesized
caacttggcctcccaaagtg

SEQ ID NO: 570683 - DNA, 20 bp, Artificial Sequence
  chemically synthesized
tttttgtatttctagtagag

SEQ ID NO: 570684 - DNA, 20 bp, Artificial Sequence
  chemically synthesized
taatatttttttctttgagg

SEQ ID NO: 570685 - DNA, 20 bp, Artificial Sequence
  chemically synthesized
aagtatcaaagaagtacagg

SEQ ID NO: 570686 - DNA, 20 bp, Artificial Sequence
  chemically synthesized
ctgaaaactgaattccgaaa

SEQ ID NO: 570687 - DNA, 20 bp, Artificial Sequence
  chemically synthesized
gataaaactaattttcggaa

SEQ ID NO: 570688 - DNA, 20 bp, Artificial Sequence
  chemically synthesized
cctaataggaagaaaagaat

SEQ ID NO: 570689 - DNA, 20 bp, Artificial Sequence
  chemically synthesized
ctgccattcttttcttccta

SEQ ID NO: 570690 - DNA, 20 bp, Artificial Sequence
  chemically synthesized
tgcctggagccaccacttat

SEQ ID NO: 570691 - DNA, 20 bp, Artificial Sequence
  chemically synthesized
aggcatcctagctctctaac

SEQ ID NO: 570692 - DNA, 20 bp, Artificial Sequence
  chemically synthesized
cctagctctctaactctgga

SEQ ID NO: 570693 - DNA, 20 bp, Artificial Sequence
  chemically synthesized
atgctaaactaggggttgat

SEQ ID NO: 570694 - DNA, 20 bp, Artificial Sequence
  chemically synthesized
tgtgcaagctctgatcaacc

SEQ ID NO: 570695 - DNA, 20 bp, Artificial Sequence
  chemically synthesized
cacgggaactaccccctgag

SEQ ID NO: 570696 - DNA, 20 bp, Artificial Sequence
  chemically synthesized
cacttttctgatgagattaa

SEQ ID NO: 570697 - DNA, 20 bp, Artificial Sequence
  chemically synthesized
ctacctgagccacttttctg

SEQ ID NO: 570698 - DNA, 20 bp, Artificial Sequence
  chemically synthesized
attgatattggaaggccaga

SEQ ID NO: 570699 - DNA, 20 bp, Artificial Sequence
  chemically synthesized
tctagggagagagtgaaaaa

SEQ ID NO: 570700 - DNA, 20 bp, Artificial Sequence
  chemically synthesized
ctctccctagacttgcccat

SEQ ID NO: 570701 - DNA, 20 bp, Artificial Sequence
  chemically synthesized
aagtggggttcccctacaat

SEQ ID NO: 570702 - DNA, 20 bp, Artificial Sequence
  chemically synthesized
aggtaggtttgatatgtccc

SEQ ID NO: 570703 - DNA, 20 bp, Artificial Sequence
  chemically synthesized
agggtcataaggttgggaag

SEQ ID NO: 570704 - DNA, 20 bp, Artificial Sequence
  chemically synthesized
gttttggtgggcttagcagg

SEQ ID NO: 570705 - DNA, 20 bp, Artificial Sequence
  chemically synthesized
aggacaggcaggtagttttg

SEQ ID NO: 570706 - DNA, 20 bp, Artificial Sequence
  chemically synthesized
ggaatagtgcaggacaggca

SEQ ID NO: 570707 - DNA, 20 bp, Artificial Sequence
  chemically synthesized
catccaatataactcttgtg

SEQ ID NO: 570708 - DNA, 20 bp, Artificial Sequence
  chemically synthesized
ctctcccagatcaatgctgt

SEQ ID NO: 570709 - DNA, 20 bp, Artificial Sequence
  chemically synthesized
gatcaatgctgttagtgttt

SEQ ID NO: 570710 - DNA, 20 bp, Artificial Sequence
  chemically synthesized
tcatctcccaggttagaatt

SEQ ID NO: 570711 - DNA, 20 bp, Artificial Sequence
  chemically synthesized
tcctcagcattctaacagta

SEQ ID NO: 570712 - DNA, 20 bp, Artificial Sequence
  chemically synthesized
taaaatgaattatatgatag

SEQ ID NO: 570713 - DNA, 20 bp, Artificial Sequence
  chemically synthesized
tggacatgagtgtgtcttgc

SEQ ID NO: 570714 - DNA, 20 bp, Artificial Sequence
  chemically synthesized
aaaaatggtccctgctatca

SEQ ID NO: 570715 - DNA, 20 bp, Artificial Sequence
  chemically synthesized
tcttgatagcagggaccatt

SEQ ID NO: 570716 - DNA, 20 bp, Artificial Sequence
  chemically synthesized
catagtatatggtagcaaat

SEQ ID NO: 570717 - DNA, 20 bp, Artificial Sequence
  chemically synthesized
atttactcatttactcatcc

SEQ ID NO: 570718 - DNA, 20 bp, Artificial Sequence
  chemically synthesized
aggcatacttgtttgttccg

SEQ ID NO: 570719 - DNA, 20 bp, Artificial Sequence
  chemically synthesized
cactcagtgtcagtaggcat

SEQ ID NO: 570720 - DNA, 20 bp, Artificial Sequence
  chemically synthesized
tcacagacacacccagaaat

SEQ ID NO: 570721 - DNA, 20 bp, Artificial Sequence
  chemically synthesized
atttctgggtgtgtctgtga

SEQ ID NO: 570722 - DNA, 20 bp, Artificial Sequence
  chemically synthesized
tctgtgagggtgttttgcag

SEQ ID NO: 570723 - DNA, 20 bp, Artificial Sequence
  chemically synthesized
acaagattagcatttggttc

SEQ ID NO: 570724 - DNA, 20 bp, Artificial Sequence
  chemically synthesized
gcatttggttcagtggattc

SEQ ID NO: 570725 - DNA, 20 bp, Artificial Sequence
  chemically synthesized
aaaaggaacatgcctttttg

SEQ ID NO: 570726 - DNA, 20 bp, Artificial Sequence
  chemically synthesized
tgttccttttttccctgcag

SEQ ID NO: 570727 - DNA, 20 bp, Artificial Sequence
  chemically synthesized
agtcttctcctgcacttgca

SEQ ID NO: 570728 - DNA, 20 bp, Artificial Sequence
  chemically synthesized
gagagccaggaaaattggta

SEQ ID NO: 570729 - DNA, 20 bp, Artificial Sequence
  chemically synthesized
actaccaattttcctggctc

SEQ ID NO: 570730 - DNA, 20 bp, Artificial Sequence
  chemically synthesized
acatacatacatatgtatat

SEQ ID NO: 570731 - DNA, 20 bp, Artificial Sequence
  chemically synthesized
aagaataatttacccaggga

SEQ ID NO: 570732 - DNA, 20 bp, Artificial Sequence
  chemically synthesized
gtggaaaataatataactta

SEQ ID NO: 570733 - DNA, 20 bp, Artificial Sequence
  chemically synthesized
atacaatgtaaagcatttag

SEQ ID NO: 570734 - DNA, 20 bp, Artificial Sequence
  chemically synthesized
cacgtgacagaaactaggct

SEQ ID NO: 570735 - DNA, 20 bp, Artificial Sequence
  chemically synthesized
tgcctcggcctcccaaagtg

SEQ ID NO: 570736 - DNA, 20 bp, Artificial Sequence
  chemically synthesized
ttttgtatttttagtagaga

SEQ ID NO: 570737 - DNA, 20 bp, Artificial Sequence
  chemically synthesized
tctctactaaaaatacaaaa

SEQ ID NO: 570738 - DNA, 20 bp, Artificial Sequence
  chemically synthesized
tgtctcagcttcccgagtag

SEQ ID NO: 570739 - DNA, 20 bp, Artificial Sequence
  chemically synthesized
gattcaagtgattctcctgt

SEQ ID NO: 570740 - DNA, 20 bp, Artificial Sequence
  chemically synthesized
aacctccacctctcagattc

SEQ ID NO: 570741 - DNA, 20 bp, Artificial Sequence
  chemically synthesized
gcgcactgcaacctccacct

SEQ ID NO: 570742 - DNA, 20 bp, Artificial Sequence
  chemically synthesized
tatagtctattgctctcctt

SEQ ID NO: 570743 - DNA, 20 bp, Artificial Sequence
  chemically synthesized
acatacaatacaaaaatggc

SEQ ID NO: 570744 - DNA, 20 bp, Artificial Sequence
  chemically synthesized
attcatattgtcatgccaca

SEQ ID NO: 570745 - DNA, 20 bp, Artificial Sequence
  chemically synthesized
ttttttttaacctctcatgc

SEQ ID NO: 570746 - DNA, 20 bp, Artificial Sequence
  chemically synthesized
gttaaaaaaaaaaaacttgc

SEQ ID NO: 570747 - DNA, 20 bp, Artificial Sequence
  chemically synthesized
tactaactactgaagcttag

SEQ ID NO: 570748 - DNA, 20 bp, Artificial Sequence
  chemically synthesized
tctgccaatttactaactac

SEQ ID NO: 570749 - DNA, 20 bp, Artificial Sequence
  chemically synthesized
tagttagtaaattggcagag

SEQ ID NO: 570750 - DNA, 20 bp, Artificial Sequence
  chemically synthesized
aagagcaagacccagactga

SEQ ID NO: 570751 - DNA, 20 bp, Artificial Sequence
  chemically synthesized
cttgctcttaactgctatcc

SEQ ID NO: 570752 - DNA, 20 bp, Artificial Sequence
  chemically synthesized
ttataaatatttaataagta

SEQ ID NO: 570753 - DNA, 20 bp, Artificial Sequence
  chemically synthesized
ttggctttttaatttcttta

SEQ ID NO: 570754 - DNA, 20 bp, Artificial Sequence
  chemically synthesized
gaattggtctgcattcaata

SEQ ID NO: 570755 - DNA, 20 bp, Artificial Sequence
  chemically synthesized
cataaaatacgttgaacaac

SEQ ID NO: 570756 - DNA, 20 bp, Artificial Sequence
  chemically synthesized
gtcttgaagaatgtgatacc

SEQ ID NO: 570757 - DNA, 20 bp, Artificial Sequence
  chemically synthesized
tatgcccaacatttatttgc

SEQ ID NO: 570758 - DNA, 20 bp, Artificial Sequence
  chemically synthesized
aacactcacatttatctcta

SEQ ID NO: 570759 - DNA, 20 bp, Artificial Sequence
  chemically synthesized
cccaaacactcacatttatc

SEQ ID NO: 570760 - DNA, 20 bp, Artificial Sequence
  chemically synthesized
atcaatctagagataaatgt

SEQ ID NO: 570761 - DNA, 20 bp, Artificial Sequence
  chemically synthesized
gatttctttctcagtatgtg

SEQ ID NO: 570762 - DNA, 20 bp, Artificial Sequence
  chemically synthesized
ttaccatctacatcttcccc

SEQ ID NO: 570763 - DNA, 20 bp, Artificial Sequence
  chemically synthesized
aaggggaagatgtagatggt

SEQ ID NO: 570764 - DNA, 20 bp, Artificial Sequence
  chemically synthesized
ccactttctctagtaagaat

SEQ ID NO: 570765 - DNA, 20 bp, Artificial Sequence
  chemically synthesized
gaaggcaaaattcttcagag

SEQ ID NO: 570766 - DNA, 20 bp, Artificial Sequence
  chemically synthesized
tatacaaggagcgctccagt

SEQ ID NO: 570767 - DNA, 20 bp, Artificial Sequence
  chemically synthesized
ccagtgtacattcaatattg

SEQ ID NO: 570768 - DNA, 20 bp, Artificial Sequence
  chemically synthesized
tctcgctgtcataccttctc

SEQ ID NO: 570769 - DNA, 20 bp, Artificial Sequence
  chemically synthesized
aatttgtggaaagaaatatt

SEQ ID NO: 570770 - DNA, 20 bp, Artificial Sequence
  chemically synthesized
tccacaaattatcactggag

SEQ ID NO: 570771 - DNA, 20 bp, Artificial Sequence
  chemically synthesized
atcactggagaaaggttttg

SEQ ID NO: 570772 - DNA, 20 bp, Artificial Sequence
  chemically synthesized
caagtttttctcattcataa

SEQ ID NO: 570773 - DNA, 20 bp, Artificial Sequence
  chemically synthesized
ttcgaggactttggttgctt

SEQ ID NO: 570774 - DNA, 20 bp, Artificial Sequence
  chemically synthesized
ctaaagctttcgaggacttt

SEQ ID NO: 570775 - DNA, 20 bp, Artificial Sequence
  chemically synthesized
tgaaagcaaccaaagtcctc

SEQ ID NO: 570776 - DNA, 20 bp, Artificial Sequence
  chemically synthesized
caaccaaagtcctcgaaagc

SEQ ID NO: 570777 - DNA, 20 bp, Artificial Sequence
  chemically synthesized
tttgttcctaagtcccaagc

SEQ ID NO: 570778 - DNA, 20 bp, Artificial Sequence
  chemically synthesized
gcataattgctcaaagaata

SEQ ID NO: 570779 - DNA, 20 bp, Artificial Sequence
  chemically synthesized
atgcatggaggctctcgttt

SEQ ID NO: 570780 - DNA, 20 bp, Artificial Sequence
  chemically synthesized
aagatctaatgcatggaggc

SEQ ID NO: 570781 - DNA, 20 bp, Artificial Sequence
  chemically synthesized
gttttgtatataccacggta

SEQ ID NO: 570782 - DNA, 20 bp, Artificial Sequence
  chemically synthesized
tatcatttctggcttttgct

SEQ ID NO: 570783 - DNA, 20 bp, Artificial Sequence
  chemically synthesized
acaggtatatcatttctggc

SEQ ID NO: 570784 - DNA, 20 bp, Artificial Sequence
  chemically synthesized
taagacacaggtatatcatt

SEQ ID NO: 570785 - DNA, 20 bp, Artificial Sequence
  chemically synthesized
gaataaaccaccaaggaaag

SEQ ID NO: 570786 - DNA, 20 bp, Artificial Sequence
  chemically synthesized
gcacaatcagttctttcctt

SEQ ID NO: 570787 - DNA, 20 bp, Artificial Sequence
  chemically synthesized
cagagatcagggactatagc

SEQ ID NO: 570788 - DNA, 20 bp, Artificial Sequence
  chemically synthesized
tccctgatctctgcaagtgt

SEQ ID NO: 570789 - DNA, 20 bp, Artificial Sequence
  chemically synthesized
gaagtagtgacaagctgaag

SEQ ID NO: 570790 - DNA, 20 bp, Artificial Sequence
  chemically synthesized
tctgcagccccaagcctttc

SEQ ID NO: 570791 - DNA, 20 bp, Artificial Sequence
  chemically synthesized
gggacgccttgctttgcatc

SEQ ID NO: 570792 - DNA, 20 bp, Artificial Sequence
  chemically synthesized
gagcctcagagtctgggacg

SEQ ID NO: 570793 - DNA, 20 bp, Artificial Sequence
  chemically synthesized
ggcgtcccagactctgaggc

SEQ ID NO: 570794 - DNA, 20 bp, Artificial Sequence
  chemically synthesized
tcactattttagaggaaagt

SEQ ID NO: 570795 - DNA, 20 bp, Artificial Sequence
  chemically synthesized
ggaagatcagtatagtgtaa

SEQ ID NO: 570796 - DNA, 20 bp, Artificial Sequence
  chemically synthesized
agtctcaggtgccctttcga

SEQ ID NO: 570797 - DNA, 20 bp, Artificial Sequence
  chemically synthesized
agaactatccaatttggtgt

SEQ ID NO: 570798 - DNA, 20 bp, Artificial Sequence
  chemically synthesized
tctgaagaagcaaataaact

SEQ ID NO: 570799 - DNA, 20 bp, Artificial Sequence
  chemically synthesized
tactcgaaatccaagagttt

SEQ ID NO: 570800 - DNA, 20 bp, Artificial Sequence
  chemically synthesized
gtcttccttactcgaaatcc

SEQ ID NO: 570801 - DNA, 20 bp, Artificial Sequence
  chemically synthesized
acatatgctatttcttcctt

SEQ ID NO: 570802 - DNA, 20 bp, Artificial Sequence
  chemically synthesized
tatacatgacatctccagtt

SEQ ID NO: 570803 - DNA, 20 bp, Artificial Sequence
  chemically synthesized
tgagactaaaaggggtaaga

SEQ ID NO: 570804 - DNA, 20 bp, Artificial Sequence
  chemically synthesized
agccaagaaagaagagataa

SEQ ID NO: 570805 - DNA, 20 bp, Artificial Sequence
  chemically synthesized
gagataaaggagtttaaata

SEQ ID NO: 570806 - DNA, 20 bp, Artificial Sequence
  chemically synthesized
gaagagattgggttcctcct

SEQ ID NO: 570807 - DNA, 20 bp, Artificial Sequence
  chemically synthesized
gacatgccctattaattcag

SEQ ID NO: 570808 - DNA, 20 bp, Artificial Sequence
  chemically synthesized
tctgaattaatagggcatgt

SEQ ID NO: 570809 - DNA, 20 bp, Artificial Sequence
  chemically synthesized
catctttttggaagcataca

SEQ ID NO: 570810 - DNA, 20 bp, Artificial Sequence
  chemically synthesized
tctaatagttgaaacaggat

SEQ ID NO: 570811 - DNA, 20 bp, Artificial Sequence
  chemically synthesized
actattagatcatagatcac

SEQ ID NO: 570812 - DNA, 20 bp, Artificial Sequence
  chemically synthesized
aatcaaggtttcttccagtt

SEQ ID NO: 570813 - DNA, 20 bp, Artificial Sequence
  chemically synthesized
aagcttagaactggaagaaa

SEQ ID NO: 570814 - DNA, 20 bp, Artificial Sequence
  chemically synthesized
atagaccctcgtgtatcaat

SEQ ID NO: 570815 - DNA, 20 bp, Artificial Sequence
  chemically synthesized
tgagttctcatggaccagat

SEQ ID NO: 570816 - DNA, 20 bp, Artificial Sequence
  chemically synthesized
ttactgaagaattgctgcaa

SEQ ID NO: 570817 - DNA, 20 bp, Artificial Sequence
  chemically synthesized
aaaaggacctttttttcctg

SEQ ID NO: 570818 - DNA, 20 bp, Artificial Sequence
  chemically synthesized
ccaggtactgtgctactcac

SEQ ID NO: 570819 - DNA, 20 bp, Artificial Sequence
  chemically synthesized
attagttgaatgaattaatg

SEQ ID NO: 570820 - DNA, 20 bp, Artificial Sequence
  chemically synthesized
tgtcagggatcttgaaaaag

SEQ ID NO: 570821 - DNA, 20 bp, Artificial Sequence
  chemically synthesized
tctttttcaagatccctgac

SEQ ID NO: 570822 - DNA, 20 bp, Artificial Sequence
  chemically synthesized
gggagggagggaagtttttc

SEQ ID NO: 570823 - DNA, 20 bp, Artificial Sequence
  chemically synthesized
gaaaggaagaagggagggag

SEQ ID NO: 570824 - DNA, 20 bp, Artificial Sequence
  chemically synthesized
aaaagaaaagaagaaaacca

SEQ ID NO: 570825 - DNA, 20 bp, Artificial Sequence
  chemically synthesized
tataggcaaaattgaatcta

SEQ ID NO: 570826 - DNA, 20 bp, Artificial Sequence
  chemically synthesized
gattcaattttgcctataat

SEQ ID NO: 570827 - DNA, 20 bp, Artificial Sequence
  chemically synthesized
ttcagggttgttttataaat

SEQ ID NO: 570828 - DNA, 20 bp, Artificial Sequence
  chemically synthesized
ggaggagatttggacttcag

SEQ ID NO: 570829 - DNA, 20 bp, Artificial Sequence
  chemically synthesized
gaagtccaaatctcctccac

SEQ ID NO: 570830 - DNA, 20 bp, Artificial Sequence
  chemically synthesized
ctagagtaaaacaaatgtgg

SEQ ID NO: 570831 - DNA, 20 bp, Artificial Sequence
  chemically synthesized
ctcctccacatttgttttac

SEQ ID NO: 570832 - DNA, 20 bp, Artificial Sequence
  chemically synthesized
tagtttttaaataatcatat

SEQ ID NO: 570833 - DNA, 20 bp, Artificial Sequence
  chemically synthesized
tcataactctcaaatcttaa

SEQ ID NO: 570834 - DNA, 20 bp, Artificial Sequence
  chemically synthesized
gatgagttctgtagacagta

SEQ ID NO: 570835 - DNA, 20 bp, Artificial Sequence
  chemically synthesized
gtttgcagagaccttccttt

SEQ ID NO: 570836 - DNA, 20 bp, Artificial Sequence
  chemically synthesized
caaaagatattgactagaat

SEQ ID NO: 570837 - DNA, 20 bp, Artificial Sequence
  chemically synthesized
actgaatggatgaatgaatg

SEQ ID NO: 570838 - DNA, 20 bp, Artificial Sequence
  chemically synthesized
ctcattcattatacccagaa

SEQ ID NO: 570839 - DNA, 20 bp, Artificial Sequence
  chemically synthesized
tgtcgtatcgtaatttagtt

SEQ ID NO: 570840 - DNA, 20 bp, Artificial Sequence
  chemically synthesized
cactcttaattccaagctgt

SEQ ID NO: 570841 - DNA, 20 bp, Artificial Sequence
  chemically synthesized
actgagctttgggaaacagt

SEQ ID NO: 570842 - DNA, 20 bp, Artificial Sequence
  chemically synthesized
acaatacacagaggaatgga

SEQ ID NO: 570843 - DNA, 20 bp, Artificial Sequence
  chemically synthesized
tcctctgtgtattgtgaaag

SEQ ID NO: 570844 - DNA, 20 bp, Artificial Sequence
  chemically synthesized
atgttgaagaaaaaatgaaa

SEQ ID NO: 570845 - DNA, 20 bp, Artificial Sequence
  chemically synthesized
ttatttcattttttcttcaa

SEQ ID NO: 570846 - DNA, 20 bp, Artificial Sequence
  chemically synthesized
ttctttctttcttttattct

SEQ ID NO: 570847 - DNA, 20 bp, Artificial Sequence
  chemically synthesized
tgtaaatgttggttctttaa

SEQ ID NO: 570848 - DNA, 20 bp, Artificial Sequence
  chemically synthesized
tgttggttctttaactttgt

SEQ ID NO: 570849 - DNA, 20 bp, Artificial Sequence
  chemically synthesized
taactttgttttagattctc

SEQ ID NO: 570850 - DNA, 20 bp, Artificial Sequence
  chemically synthesized
tttctgttaattactctact

SEQ ID NO: 570851 - DNA, 20 bp, Artificial Sequence
  chemically synthesized
ctttgagttttatcttcact

SEQ ID NO: 570852 - DNA, 20 bp, Artificial Sequence
  chemically synthesized
ggaaatacactgctaggcaa

SEQ ID NO: 570853 - DNA, 20 bp, Artificial Sequence
  chemically synthesized
ctagtgtccaagctacatct

SEQ ID NO: 570854 - DNA, 20 bp, Artificial Sequence
  chemically synthesized
gtatgtagtaatcagtaaga

SEQ ID NO: 570855 - DNA, 20 bp, Artificial Sequence
  chemically synthesized
ctgattactacatacataaa

SEQ ID NO: 570856 - DNA, 20 bp, Artificial Sequence
  chemically synthesized
ttttctctagactggagtaa

SEQ ID NO: 570857 - DNA, 20 bp, Artificial Sequence
  chemically synthesized
gaaaatatgtaactaggaac

SEQ ID NO: 570858 - DNA, 20 bp, Artificial Sequence
  chemically synthesized
tatgtaactaggaacgtatg

SEQ ID NO: 570859 - DNA, 20 bp, Artificial Sequence
  chemically synthesized
tatgttttgattttctggtt

SEQ ID NO: 570860 - DNA, 20 bp, Artificial Sequence
  chemically synthesized
ctcatttgtgtaagtgtcat

SEQ ID NO: 570861 - DNA, 20 bp, Artificial Sequence
  chemically synthesized
tttctgtcttttgcttttgt

SEQ ID NO: 570862 - DNA, 20 bp, Artificial Sequence
  chemically synthesized
caagagtttctgtcttttgc

SEQ ID NO: 570863 - DNA, 20 bp, Artificial Sequence
  chemically synthesized
acagcacaagagtttctgtc

SEQ ID NO: 570864 - DNA, 20 bp, Artificial Sequence
  chemically synthesized
atttactagcatcacagcac

SEQ ID NO: 570865 - DNA, 20 bp, Artificial Sequence
  chemically synthesized
gagtcatttgtgtgcatatg

SEQ ID NO: 570866 - DNA, 20 bp, Artificial Sequence
  chemically synthesized
aatgactctccagtctattc

SEQ ID NO: 570867 - DNA, 20 bp, Artificial Sequence
  chemically synthesized
ctattcacgagtttttgtcc

SEQ ID NO: 570868 - DNA, 20 bp, Artificial Sequence
  chemically synthesized
gagtttttgtcctgaagttt

SEQ ID NO: 570869 - DNA, 20 bp, Artificial Sequence
  chemically synthesized
tcctgaagtttttcagtttg

SEQ ID NO: 570870 - DNA, 20 bp, Artificial Sequence
  chemically synthesized
gtatttatgagtgttacttg

SEQ ID NO: 570871 - DNA, 20 bp, Artificial Sequence
  chemically synthesized
tctcaggagcgtttcccgga

SEQ ID NO: 570872 - DNA, 20 bp, Artificial Sequence
  chemically synthesized
tatccgggaaacgctcctga

SEQ ID NO: 570873 - DNA, 20 bp, Artificial Sequence
  chemically synthesized
gaaactgtaatcagtctcag

SEQ ID NO: 570874 - DNA, 20 bp, Artificial Sequence
  chemically synthesized
gaaacgctcctgagactgat

SEQ ID NO: 570875 - DNA, 20 bp, Artificial Sequence
  chemically synthesized
aaagggattaccattagtta

SEQ ID NO: 570876 - DNA, 20 bp, Artificial Sequence
  chemically synthesized
taataatggattttaactga

SEQ ID NO: 570877 - DNA, 20 bp, Artificial Sequence
  chemically synthesized
agaatcagaattagaataat

SEQ ID NO: 570878 - DNA, 20 bp, Artificial Sequence
  chemically synthesized
aaaatccattattattctaa

SEQ ID NO: 570879 - DNA, 20 bp, Artificial Sequence
  chemically synthesized
aagtctgagataagttctgg

SEQ ID NO: 570880 - DNA, 20 bp, Artificial Sequence
  chemically synthesized
cagcactctgggaggcccag

SEQ ID NO: 570881 - DNA, 20 bp, Artificial Sequence
  chemically synthesized
ctcctgggcctcccagagtg

SEQ ID NO: 570882 - DNA, 20 bp, Artificial Sequence
  chemically synthesized
ctaccggccatcttctggaa

SEQ ID NO: 570883 - DNA, 20 bp, Artificial Sequence
  chemically synthesized
tagctctgcggcaaaacaac

SEQ ID NO: 570884 - DNA, 20 bp, Artificial Sequence
  chemically synthesized
ctttgcattcaacaagccca

SEQ ID NO: 570885 - DNA, 20 bp, Artificial Sequence
  chemically synthesized
caacctgggcttgttgaatg

SEQ ID NO: 570886 - DNA, 20 bp, Artificial Sequence
  chemically synthesized
ttaactgaattgtctttcct

SEQ ID NO: 570887 - DNA, 20 bp, Artificial Sequence
  chemically synthesized
tctttcctttgagtttattt

SEQ ID NO: 570888 - DNA, 20 bp, Artificial Sequence
  chemically synthesized
tagggcacttaggagttaaa

SEQ ID NO: 570889 - DNA, 20 bp, Artificial Sequence
  chemically synthesized
taggagttaaacagtgtttc

SEQ ID NO: 570890 - DNA, 20 bp, Artificial Sequence
  chemically synthesized
ctgaagtcaaacgcaagaaa

SEQ ID NO: 570891 - DNA, 20 bp, Artificial Sequence
  chemically synthesized
gtgagtgccatgttagcact

SEQ ID NO: 570892 - DNA, 20 bp, Artificial Sequence
  chemically synthesized
tgagtaggagcataattctt

SEQ ID NO: 570893 - DNA, 20 bp, Artificial Sequence
  chemically synthesized
gtgatgcaggaaccttaaaa

SEQ ID NO: 570894 - DNA, 20 bp, Artificial Sequence
  chemically synthesized
accttttaaggttcctgcat

SEQ ID NO: 570895 - DNA, 20 bp, Artificial Sequence
  chemically synthesized
aggagggaataaaaaaagga

SEQ ID NO: 570896 - DNA, 20 bp, Artificial Sequence
  chemically synthesized
cacagccccttcatttgagg

SEQ ID NO: 570897 - DNA, 20 bp, Artificial Sequence
  chemically synthesized
gcctcaaatgaaggggctgt

SEQ ID NO: 570898 - DNA, 20 bp, Artificial Sequence
  chemically synthesized
ggagtcctattcatatcctg

SEQ ID NO: 570899 - DNA, 20 bp, Artificial Sequence
  chemically synthesized
ctcctagcctagtgccagcc

SEQ ID NO: 570900 - DNA, 20 bp, Artificial Sequence
  chemically synthesized
tgttttgttctctcttgcct

SEQ ID NO: 570901 - DNA, 20 bp, Artificial Sequence
  chemically synthesized
ttaacaacggacaaagagct

SEQ ID NO: 570902 - DNA, 20 bp, Artificial Sequence
  chemically synthesized
taaaggcttaacaacggaca

SEQ ID NO: 570903 - DNA, 20 bp, Artificial Sequence
  chemically synthesized
aatcggtgaggtgaaagatt

SEQ ID NO: 570904 - DNA, 20 bp, Artificial Sequence
  chemically synthesized
aagcctttaatctttcacct

SEQ ID NO: 570905 - DNA, 20 bp, Artificial Sequence
  chemically synthesized
attttagaaatcggtgaggt

SEQ ID NO: 570906 - DNA, 20 bp, Artificial Sequence
  chemically synthesized
cgatttctaaaatgcacttt

SEQ ID NO: 570907 - DNA, 20 bp, Artificial Sequence
  chemically synthesized
ttctaaaatgcactttggat

SEQ ID NO: 570908 - DNA, 20 bp, Artificial Sequence
  chemically synthesized
tgcactttggatgtttgttt

SEQ ID NO: 570909 - DNA, 20 bp, Artificial Sequence
  chemically synthesized
ggatgtttgtttattggttt

SEQ ID NO: 570910 - DNA, 20 bp, Artificial Sequence
  chemically synthesized
aaacaggataggaggttgat

SEQ ID NO: 570911 - DNA, 20 bp, Artificial Sequence
  chemically synthesized
aagcagcaatcaacctccta

SEQ ID NO: 570912 - DNA, 20 bp, Artificial Sequence
  chemically synthesized
acaaatgaaacaggatagga

SEQ ID NO: 570913 - DNA, 20 bp, Artificial Sequence
  chemically synthesized
ctgtttcatttgtcaaaatc

SEQ ID NO: 570914 - DNA, 20 bp, Artificial Sequence
  chemically synthesized
tctgtagatgtaattaaaac

SEQ ID NO: 570915 - DNA, 20 bp, Artificial Sequence
  chemically synthesized
aaaaaaaaaaaaggcagaag

SEQ ID NO: 570916 - DNA, 20 bp, Artificial Sequence
  chemically synthesized
tggaaggtgatgtaacttga

SEQ ID NO: 570917 - DNA, 20 bp, Artificial Sequence
  chemically synthesized
taaaaaataggttccctttt

SEQ ID NO: 570918 - DNA, 20 bp, Artificial Sequence
  chemically synthesized
aaaagttttcctaatgtatc

SEQ ID NO: 570919 - DNA, 20 bp, Artificial Sequence
  chemically synthesized
aatagctaaggctggaatgt

SEQ ID NO: 570920 - DNA, 20 bp, Artificial Sequence
  chemically synthesized
ccagccttagctatttattc

SEQ ID NO: 570921 - DNA, 20 bp, Artificial Sequence
  chemically synthesized
ccagttctatggtatctcac

SEQ ID NO: 570922 - DNA, 20 bp, Artificial Sequence
  chemically synthesized
ttatctttttgcatttatct

SEQ ID NO: 570923 - DNA, 20 bp, Artificial Sequence
  chemically synthesized
agatgaaaatgtttgatttc

SEQ ID NO: 570924 - DNA, 20 bp, Artificial Sequence
  chemically synthesized
tctgccactgagatgaaaat

SEQ ID NO: 570925 - DNA, 20 bp, Artificial Sequence
  chemically synthesized
agcttctgccactgagatga

SEQ ID NO: 570926 - DNA, 20 bp, Artificial Sequence
  chemically synthesized
aacattttcatctcagtggc

SEQ ID NO: 570927 - DNA, 20 bp, Artificial Sequence
  chemically synthesized
tatattgttacccaaaatat

SEQ ID NO: 570928 - DNA, 20 bp, Artificial Sequence
  chemically synthesized
attttgggtaacaatatact

SEQ ID NO: 570929 - DNA, 20 bp, Artificial Sequence
  chemically synthesized
taacaatatacttgtagatt

SEQ ID NO: 570930 - DNA, 20 bp, Artificial Sequence
  chemically synthesized
ccttccagcctttattaaag

SEQ ID NO: 570931 - DNA, 20 bp, Artificial Sequence
  chemically synthesized
atggtacgggatttaaggag

SEQ ID NO: 570932 - DNA, 20 bp, Artificial Sequence
  chemically synthesized
ggaaatgctgcaaggatggt

SEQ ID NO: 570933 - DNA, 20 bp, Artificial Sequence
  chemically synthesized
taccatccttgcagcatttc

SEQ ID NO: 570934 - DNA, 20 bp, Artificial Sequence
  chemically synthesized
tgtgaagggagtcaaggtca

SEQ ID NO: 570935 - DNA, 20 bp, Artificial Sequence
  chemically synthesized
tcaatttgaccaccactcaa

SEQ ID NO: 570936 - DNA, 20 bp, Artificial Sequence
  chemically synthesized
gaaacagggtcttctggcgg

SEQ ID NO: 570937 - DNA, 20 bp, Artificial Sequence
  chemically synthesized
gaagcttgtccgccagaaga

SEQ ID NO: 570938 - DNA, 20 bp, Artificial Sequence
  chemically synthesized
gcatcagtgagagaaaagaa

SEQ ID NO: 570939 - DNA, 20 bp, Artificial Sequence
  chemically synthesized
tttgtaaagaacggcttgat

SEQ ID NO: 570940 - DNA, 20 bp, Artificial Sequence
  chemically synthesized
cggtttattgatttgtaaag

SEQ ID NO: 570941 - DNA, 20 bp, Artificial Sequence
  chemically synthesized
gtagatgagatcttccggtt

SEQ ID NO: 570942 - DNA, 20 bp, Artificial Sequence
  chemically synthesized
aagtacagtagatgagatct

SEQ ID NO: 570943 - DNA, 20 bp, Artificial Sequence
  chemically synthesized
aagagagaagacagaatgtt

SEQ ID NO: 570944 - DNA, 20 bp, Artificial Sequence
  chemically synthesized
gaagcgtgaagtaaataact

SEQ ID NO: 570945 - DNA, 20 bp, Artificial Sequence
  chemically synthesized
taagccacaagttatttact

SEQ ID NO: 570946 - DNA, 20 bp, Artificial Sequence
  chemically synthesized
aaaggacaggggatggagca

SEQ ID NO: 570947 - DNA, 20 bp, Artificial Sequence
  chemically synthesized
gggatggagcaatgtgcttc

SEQ ID NO: 570948 - DNA, 20 bp, Artificial Sequence
  chemically synthesized
tagagactgtgagtccatgg

SEQ ID NO: 570949 - DNA, 20 bp, Artificial Sequence
  chemically synthesized
ccccctcaccccacccccaa

SEQ ID NO: 570950 - DNA, 20 bp, Artificial Sequence
  chemically synthesized
gaaagtcttatgagcatttg

SEQ ID NO: 570951 - DNA, 20 bp, Artificial Sequence
  chemically synthesized
tcaactctaaactaaaacta

SEQ ID NO: 570952 - DNA, 20 bp, Artificial Sequence
  chemically synthesized
atttggaaaaacaaaatagt

SEQ ID NO: 570953 - DNA, 20 bp, Artificial Sequence
  chemically synthesized
agccacatttggaaaaacaa

SEQ ID NO: 570954 - DNA, 20 bp, Artificial Sequence
  chemically synthesized
aactattttgtttttccaaa

SEQ ID NO: 570955 - DNA, 20 bp, Artificial Sequence
  chemically synthesized
tgtactttggatgttttccc

SEQ ID NO: 570956 - DNA, 20 bp, Artificial Sequence
  chemically synthesized
aaaagatcacattgtacttt

SEQ ID NO: 570957 - DNA, 20 bp, Artificial Sequence
  chemically synthesized
tgatcttttataggagaaac

SEQ ID NO: 570958 - DNA, 20 bp, Artificial Sequence
  chemically synthesized
gatgacctagaaattcaatc

SEQ ID NO: 570959 - DNA, 20 bp, Artificial Sequence
  chemically synthesized
gcgataatctgaggtacttt

SEQ ID NO: 570960 - DNA, 20 bp, Artificial Sequence
  chemically synthesized
gaaagaagcttataaagtac

SEQ ID NO: 570961 - DNA, 20 bp, Artificial Sequence
  chemically synthesized
ttcttgctttcgtgaaagaa

SEQ ID NO: 570962 - DNA, 20 bp, Artificial Sequence
  chemically synthesized
tcttgatggattttaggatt

SEQ ID NO: 570963 - DNA, 20 bp, Artificial Sequence
  chemically synthesized
tgcacgtatcttgatggatt

SEQ ID NO: 570964 - DNA, 20 bp, Artificial Sequence
  chemically synthesized
aggcacagtgcacgtatctt

SEQ ID NO: 570965 - DNA, 20 bp, Artificial Sequence
  chemically synthesized
tgtactgtgttgatttcact

SEQ ID NO: 570966 - DNA, 20 bp, Artificial Sequence
  chemically synthesized
atttttattacactgtactg

SEQ ID NO: 570967 - DNA, 20 bp, Artificial Sequence
  chemically synthesized
taataaaaatgcatatagcc

SEQ ID NO: 570968 - DNA, 20 bp, Artificial Sequence
  chemically synthesized
ccttagcaaagagagaaaaa

SEQ ID NO: 570969 - DNA, 20 bp, Artificial Sequence
  chemically synthesized
acagtagacatatgaagtca

SEQ ID NO: 570970 - DNA, 20 bp, Artificial Sequence
  chemically synthesized
ctactgtgaataatcagtca

SEQ ID NO: 570971 - DNA, 20 bp, Artificial Sequence
  chemically synthesized
caaaatcccaaaaacgcagt

SEQ ID NO: 570972 - DNA, 20 bp, Artificial Sequence
  chemically synthesized
aataatcagtcactgcgttt

SEQ ID NO: 570973 - DNA, 20 bp, Artificial Sequence
  chemically synthesized
cagtcactgcgtttttggga

SEQ ID NO: 570974 - DNA, 20 bp, Artificial Sequence
  chemically synthesized
atggagttcactgctatacg

SEQ ID NO: 570975 - DNA, 20 bp, Artificial Sequence
  chemically synthesized
ttaacgtatagcagtgaact

SEQ ID NO: 570976 - DNA, 20 bp, Artificial Sequence
  chemically synthesized
gtttgtggtgtgacaagaat

SEQ ID NO: 570977 - DNA, 20 bp, Artificial Sequence
  chemically synthesized
ttatggaaaatatgggaaca

SEQ ID NO: 570978 - DNA, 20 bp, Artificial Sequence
  chemically synthesized
tttccataagagagacatgt

SEQ ID NO: 570979 - DNA, 20 bp, Artificial Sequence
  chemically synthesized
agattcctccctcacaccat

SEQ ID NO: 570980 - DNA, 20 bp, Artificial Sequence
  chemically synthesized
aatggtgtgagggaggaatc

SEQ ID NO: 570981 - DNA, 20 bp, Artificial Sequence
  chemically synthesized
gaaaatatacgctaacaatc

SEQ ID NO: 570982 - DNA, 20 bp, Artificial Sequence
  chemically synthesized
gttcaataacgtggctaaca

SEQ ID NO: 570983 - DNA, 20 bp, Artificial Sequence
  chemically synthesized
atagtcagcctttctttccc

SEQ ID NO: 570984 - DNA, 20 bp, Artificial Sequence
  chemically synthesized
tttcccaactgcttgtcctt

SEQ ID NO: 570985 - DNA, 20 bp, Artificial Sequence
  chemically synthesized
gtaaataaccctaggaagat

SEQ ID NO: 570986 - DNA, 20 bp, Artificial Sequence
  chemically synthesized
aagataaatgattgttcata

SEQ ID NO: 570987 - DNA, 20 bp, Artificial Sequence
  chemically synthesized
caataagtatttgagtaatt

SEQ ID NO: 570988 - DNA, 20 bp, Artificial Sequence
  chemically synthesized
taattactcaaatacttatt

SEQ ID NO: 570989 - DNA, 20 bp, Artificial Sequence
  chemically synthesized
ttcttatttatttttatttt

SEQ ID NO: 570990 - DNA, 20 bp, Artificial Sequence
  chemically synthesized
aaattcactaaagaccatcc

SEQ ID NO: 570991 - DNA, 20 bp, Artificial Sequence
  chemically synthesized
gggatggtctttagtgaatt

SEQ ID NO: 570992 - DNA, 20 bp, Artificial Sequence
  chemically synthesized
atctttcccataatacttta

SEQ ID NO: 570993 - DNA, 20 bp, Artificial Sequence
  chemically synthesized
agcataataaagtattatgg

SEQ ID NO: 570994 - DNA, 20 bp, Artificial Sequence
  chemically synthesized
ttgagaacttttcaaaaaaa

SEQ ID NO: 570995 - DNA, 20 bp, Artificial Sequence
  chemically synthesized
tcttagctcgtctaaataat

SEQ ID NO: 570996 - DNA, 20 bp, Artificial Sequence
  chemically synthesized
tgatttagttaatttgaggc

SEQ ID NO: 570997 - DNA, 20 bp, Artificial Sequence
  chemically synthesized
ctgtggagacttaaagaaag

SEQ ID NO: 570998 - DNA, 20 bp, Artificial Sequence
  chemically synthesized
ttatctaacagcctgtgaac

SEQ ID NO: 570999 - DNA, 20 bp, Artificial Sequence
  chemically synthesized
ggatatagtaaatgctctat

SEQ ID NO: 571000 - DNA, 20 bp, Artificial Sequence
  chemically synthesized
gggggtacagtaatgaataa

SEQ ID NO: 571001 - DNA, 20 bp, Artificial Sequence
  chemically synthesized
tctgtaacccccatagctgt

SEQ ID NO: 571002 - DNA, 20 bp, Artificial Sequence
  chemically synthesized
agatactctgtaacccccat

SEQ ID NO: 571003 - DNA, 20 bp, Artificial Sequence
  chemically synthesized
tggatgaaattaatgaagga

SEQ ID NO: 571004 - DNA, 20 bp, Artificial Sequence
  chemically synthesized
agcttacccaattgtgaagg

SEQ ID NO: 571005 - DNA, 20 bp, Artificial Sequence
  chemically synthesized
aactgggccttcacaattgg

SEQ ID NO: 571006 - DNA, 20 bp, Artificial Sequence
  chemically synthesized
ttcttctgtttttgcccatc

SEQ ID NO: 571007 - DNA, 20 bp, Artificial Sequence
  chemically synthesized
cttgtcacccagagtgtttc

SEQ ID NO: 571008 - DNA, 20 bp, Artificial Sequence
  chemically synthesized
cattctactcttgtcaccca

SEQ ID NO: 571009 - DNA, 20 bp, Artificial Sequence
  chemically synthesized
cttgtattattcaactcttt

SEQ ID NO: 571010 - DNA, 20 bp, Artificial Sequence
  chemically synthesized
gaataatacaaggctagaaa

SEQ ID NO: 571011 - DNA, 20 bp, Artificial Sequence
  chemically synthesized
acctgacagtcaagtacagc

SEQ ID NO: 571012 - DNA, 20 bp, Artificial Sequence
  chemically synthesized
accagagctgtacttgactg

SEQ ID NO: 571013 - DNA, 20 bp, Artificial Sequence
  chemically synthesized
cttgatttttaaataacttt

SEQ ID NO: 571014 - DNA, 20 bp, Artificial Sequence
  chemically synthesized
agagacatggtgaaagagag

SEQ ID NO: 571015 - DNA, 20 bp, Artificial Sequence
  chemically synthesized
tacgttggtgcaaatgtgat

SEQ ID NO: 571016 - DNA, 20 bp, Artificial Sequence
  chemically synthesized
taggttggtacataagtaat

SEQ ID NO: 571017 - DNA, 20 bp, Artificial Sequence
  chemically synthesized
cctaaatatcattgtcagaa

SEQ ID NO: 571018 - DNA, 20 bp, Artificial Sequence
  chemically synthesized
ttatcctctcttcgctttct

SEQ ID NO: 571019 - DNA, 20 bp, Artificial Sequence
  chemically synthesized
tttctggcagcttatcctct

SEQ ID NO: 571020 - DNA, 20 bp, Artificial Sequence
  chemically synthesized
catctcttgttttcgtttct

SEQ ID NO: 571021 - DNA, 20 bp, Artificial Sequence
  chemically synthesized
taacacagaacatctcttgt

SEQ ID NO: 571022 - DNA, 20 bp, Artificial Sequence
  chemically synthesized
tacatttaacacagaacatc

SEQ ID NO: 571023 - DNA, 20 bp, Artificial Sequence
  chemically synthesized
cctcacctagggtgagagtc

SEQ ID NO: 571024 - DNA, 20 bp, Artificial Sequence
  chemically synthesized
gataaaaatcagaaggaacc

SEQ ID NO: 571025 - DNA, 20 bp, Artificial Sequence
  chemically synthesized
tgcaacaaaccagtggttcc

SEQ ID NO: 571026 - DNA, 20 bp, Artificial Sequence
  chemically synthesized
gaaccactggtttgttgcag

SEQ ID NO: 571027 - DNA, 20 bp, Artificial Sequence
  chemically synthesized
ttgttcaaccgtccatgatt

SEQ ID NO: 571028 - DNA, 20 bp, Artificial Sequence
  chemically synthesized
tccagtctttgttcaaccgt

SEQ ID NO: 571029 - DNA, 20 bp, Artificial Sequence
  chemically synthesized
caatgagaatgaatgataag

SEQ ID NO: 571030 - DNA, 20 bp, Artificial Sequence
  chemically synthesized
agctcatttttagttaaata

SEQ ID NO: 571031 - DNA, 20 bp, Artificial Sequence
  chemically synthesized
aaaatgagctaaggcgtgta

SEQ ID NO: 571032 - DNA, 20 bp, Artificial Sequence
  chemically synthesized
accttataacagatgctgtt

SEQ ID NO: 571033 - DNA, 20 bp, Artificial Sequence
  chemically synthesized
ccaggtcactgtgagagatt

SEQ ID NO: 571034 - DNA, 20 bp, Artificial Sequence
  chemically synthesized
tcagcctcccaggtcactgt

SEQ ID NO: 571035 - DNA, 20 bp, Artificial Sequence
  chemically synthesized
ttctgctctgacaccatgtt

SEQ ID NO: 571036 - DNA, 20 bp, Artificial Sequence
  chemically synthesized
cattgtattctgctctgaca

SEQ ID NO: 571037 - DNA, 20 bp, Artificial Sequence
  chemically synthesized
tcagagcagaatacaatggg

SEQ ID NO: 571038 - DNA, 20 bp, Artificial Sequence
  chemically synthesized
tctttaggggaagttccata

SEQ ID NO: 571039 - DNA, 20 bp, Artificial Sequence
  chemically synthesized
tttttatagtaaatacttga

SEQ ID NO: 571040 - DNA, 20 bp, Artificial Sequence
  chemically synthesized
tggtttgttgagggtaaccc

SEQ ID NO: 571041 - DNA, 20 bp, Artificial Sequence
  chemically synthesized
ttccagatttaagtcctggt

SEQ ID NO: 571042 - DNA, 20 bp, Artificial Sequence
  chemically synthesized
tgaacccaactgtcatactt

SEQ ID NO: 571043 - DNA, 20 bp, Artificial Sequence
  chemically synthesized
tgacagttgggttcaagaat

SEQ ID NO: 571044 - DNA, 20 bp, Artificial Sequence
  chemically synthesized
cttgaaaatgctggtggaat

SEQ ID NO: 571045 - DNA, 20 bp, Artificial Sequence
  chemically synthesized
tcacctcttttctgatgcct

SEQ ID NO: 571046 - DNA, 20 bp, Artificial Sequence
  chemically synthesized
cctaggtcagactcagtatc

SEQ ID NO: 571047 - DNA, 20 bp, Artificial Sequence
  chemically synthesized
tgccatttgtgatataatct

SEQ ID NO: 571048 - DNA, 20 bp, Artificial Sequence
  chemically synthesized
gtgatataatcttaatgatt

SEQ ID NO: 571049 - DNA, 20 bp, Artificial Sequence
  chemically synthesized
tctcaggaatctctgaatca

SEQ ID NO: 571050 - DNA, 20 bp, Artificial Sequence
  chemically synthesized
tcttaatgattcagagattc

SEQ ID NO: 571051 - DNA, 20 bp, Artificial Sequence
  chemically synthesized
aagattgacactataagtga

SEQ ID NO: 571052 - DNA, 20 bp, Artificial Sequence
  chemically synthesized
tgttgcttactaaaataaag

SEQ ID NO: 571053 - DNA, 20 bp, Artificial Sequence
  chemically synthesized
atggtaagagaatgatgact

SEQ ID NO: 571054 - DNA, 20 bp, Artificial Sequence
  chemically synthesized
tcgggaggctgaggcaggag

SEQ ID NO: 571055 - DNA, 20 bp, Artificial Sequence
  chemically synthesized
tgcctcagcctcccgagtac

SEQ ID NO: 571056 - DNA, 20 bp, Artificial Sequence
  chemically synthesized
tttgtattttttagaagaga

SEQ ID NO: 571057 - DNA, 20 bp, Artificial Sequence
  chemically synthesized
ctatcttttaaccatttcac

SEQ ID NO: 571058 - DNA, 20 bp, Artificial Sequence
  chemically synthesized
tgcaaagaactttcaaaata

SEQ ID NO: 571059 - DNA, 20 bp, Artificial Sequence
  chemically synthesized
ctttcaaaatacagtgatta

SEQ ID NO: 571060 - DNA, 20 bp, Artificial Sequence
  chemically synthesized
aaaatacagtgattagaatg

SEQ ID NO: 571061 - DNA, 20 bp, Artificial Sequence
  chemically synthesized
tcttttccttactgtattga

SEQ ID NO: 571062 - DNA, 20 bp, Artificial Sequence
  chemically synthesized
ttttatggttaggtgaatat

SEQ ID NO: 571063 - DNA, 20 bp, Artificial Sequence
  chemically synthesized
tgattaaatataaaagcatt

SEQ ID NO: 571064 - DNA, 20 bp, Artificial Sequence
  chemically synthesized
ctaaacaacacaaaatcatt

SEQ ID NO: 571065 - DNA, 20 bp, Artificial Sequence
  chemically synthesized
aaaagcattgaatgattttg

SEQ ID NO: 571066 - DNA, 20 bp, Artificial Sequence
  chemically synthesized
ccctttactcatgcaaaatt

SEQ ID NO: 571067 - DNA, 20 bp, Artificial Sequence
  chemically synthesized
tcgctattgttcctacttga

SEQ ID NO: 571068 - DNA, 20 bp, Artificial Sequence
  chemically synthesized
ttactttggaaaagtctaga

SEQ ID NO: 571069 - DNA, 20 bp, Artificial Sequence
  chemically synthesized
agtttcaaaatttggagcat

SEQ ID NO: 571070 - DNA, 20 bp, Artificial Sequence
  chemically synthesized
tgacgtcatgtcagtactca

SEQ ID NO: 571071 - DNA, 20 bp, Artificial Sequence
  chemically synthesized
acaggtcacagtcaaaactt

SEQ ID NO: 571072 - DNA, 20 bp, Artificial Sequence
  chemically synthesized
tacttttgtgcgtgaaacac

SEQ ID NO: 571073 - DNA, 20 bp, Artificial Sequence
  chemically synthesized
atacgaaatataaatgaatt

SEQ ID NO: 571074 - DNA, 20 bp, Artificial Sequence
  chemically synthesized
aatataaatgaatttcatgt

SEQ ID NO: 571075 - DNA, 20 bp, Artificial Sequence
  chemically synthesized
tgttttggattttttatttt

SEQ ID NO: 571076 - DNA, 20 bp, Artificial Sequence
  chemically synthesized
atgcttgggaccagaagtgt

SEQ ID NO: 571077 - DNA, 20 bp, Artificial Sequence
  chemically synthesized
tccaaaatgcttgggaccag

SEQ ID NO: 571078 - DNA, 20 bp, Artificial Sequence
  chemically synthesized
agttaagtattccttatcca

SEQ ID NO: 571079 - DNA, 20 bp, Artificial Sequence
  chemically synthesized
ttttggataaggaatactta

SEQ ID NO: 571080 - DNA, 20 bp, Artificial Sequence
  chemically synthesized
caccgcacccggccttactc

SEQ ID NO: 571081 - DNA, 20 bp, Artificial Sequence
  chemically synthesized
agcctcggcctcccgaagtg

SEQ ID NO: 571082 - DNA, 20 bp, Artificial Sequence
  chemically synthesized
ttttgtgtttttactagaga

SEQ ID NO: 571083 - DNA, 20 bp, Artificial Sequence
  chemically synthesized
gcccggctaatttaattttt

SEQ ID NO: 571084 - DNA, 20 bp, Artificial Sequence
  chemically synthesized
aatggcgtgaaccccggagg

SEQ ID NO: 571085 - DNA, 20 bp, Artificial Sequence
  chemically synthesized
gtttgtttgtttgtttttgt

SEQ ID NO: 571086 - DNA, 20 bp, Artificial Sequence
  chemically synthesized
tctgttgtttgtttgtttgt

SEQ ID NO: 571087 - DNA, 20 bp, Artificial Sequence
  chemically synthesized
gtttactctgttgtttgttt

SEQ ID NO: 571088 - DNA, 20 bp, Artificial Sequence
  chemically synthesized
ggaagtttactctgttgttt

SEQ ID NO: 571089 - DNA, 20 bp, Artificial Sequence
  chemically synthesized
ctctggaagtttactctgtt

SEQ ID NO: 571090 - DNA, 20 bp, Artificial Sequence
  chemically synthesized
tttactctggaagtttactc

SEQ ID NO: 571091 - DNA, 20 bp, Artificial Sequence
  chemically synthesized
ggtatagatttgtttactct

SEQ ID NO: 571092 - DNA, 20 bp, Artificial Sequence
  chemically synthesized
taaatatccctgaggtatag

SEQ ID NO: 571093 - DNA, 20 bp, Artificial Sequence
  chemically synthesized
atatttaaatatccctgagg

SEQ ID NO: 571094 - DNA, 20 bp, Artificial Sequence
  chemically synthesized
gaagatggtaagtcaaaagt

SEQ ID NO: 571095 - DNA, 20 bp, Artificial Sequence
  chemically synthesized
gcaatgcatatgctgaacac

SEQ ID NO: 571096 - DNA, 20 bp, Artificial Sequence
  chemically synthesized
tagttaaagtccttaaagac

SEQ ID NO: 571097 - DNA, 20 bp, Artificial Sequence
  chemically synthesized
ttacgttaattcaagttaat

SEQ ID NO: 571098 - DNA, 20 bp, Artificial Sequence
  chemically synthesized
tatcctgaatatttaaaaga

SEQ ID NO: 571099 - DNA, 20 bp, Artificial Sequence
  chemically synthesized
catctatatcctgaatattt

SEQ ID NO: 571100 - DNA, 20 bp, Artificial Sequence
  chemically synthesized
cttttaaatattcaggatat

SEQ ID NO: 571101 - DNA, 20 bp, Artificial Sequence
  chemically synthesized
tttaacttttgaccagaaag

SEQ ID NO: 571102 - DNA, 20 bp, Artificial Sequence
  chemically synthesized
ttatatgtagttatgaatac

SEQ ID NO: 571103 - DNA, 20 bp, Artificial Sequence
  chemically synthesized
ccttttgttgatacattctt

SEQ ID NO: 571104 - DNA, 20 bp, Artificial Sequence
  chemically synthesized
ctatcaagaatgtatcaaca

SEQ ID NO: 571105 - DNA, 20 bp, Artificial Sequence
  chemically synthesized
ccatctcggctcactgcaac

SEQ ID NO: 571106 - DNA, 20 bp, Artificial Sequence
  chemically synthesized
aacttccgcttcccgggttc

SEQ ID NO: 571107 - DNA, 20 bp, Artificial Sequence
  chemically synthesized
tggggaggccgaggcaggag

SEQ ID NO: 571108 - DNA, 20 bp, Artificial Sequence
  chemically synthesized
tttttgtatttttagtagag

SEQ ID NO: 571109 - DNA, 20 bp, Artificial Sequence
  chemically synthesized
cacctcggcctcccaaagta

SEQ ID NO: 571110 - DNA, 20 bp, Artificial Sequence
  chemically synthesized
agacatgtatctttatagag

SEQ ID NO: 571111 - DNA, 20 bp, Artificial Sequence
  chemically synthesized
gtgtatatgaagtagagggt

SEQ ID NO: 571112 - DNA, 20 bp, Artificial Sequence
  chemically synthesized
tacttcatatacacagatat

SEQ ID NO: 571113 - DNA, 20 bp, Artificial Sequence
  chemically synthesized
gaagatctgcattgtgatct

SEQ ID NO: 571114 - DNA, 20 bp, Artificial Sequence
  chemically synthesized
tgatggcttcccttgttcaa

SEQ ID NO: 571115 - DNA, 20 bp, Artificial Sequence
  chemically synthesized
tgcaataaatctgccctggc

SEQ ID NO: 571116 - DNA, 20 bp, Artificial Sequence
  chemically synthesized
ctccaagaagcagatgccag

SEQ ID NO: 571117 - DNA, 20 bp, Artificial Sequence
  chemically synthesized
atggaatcgtggaattgatt

SEQ ID NO: 571118 - DNA, 20 bp, Artificial Sequence
  chemically synthesized
caataatcaatcaatcaatt

SEQ ID NO: 571119 - DNA, 20 bp, Artificial Sequence
  chemically synthesized
gggaatggaatcgtggaatt

SEQ ID NO: 571120 - DNA, 20 bp, Artificial Sequence
  chemically synthesized
ctaggggaatggaatcgtgg

SEQ ID NO: 571121 - DNA, 20 bp, Artificial Sequence
  chemically synthesized
agcttaaagactggtcaagt

SEQ ID NO: 571122 - DNA, 20 bp, Artificial Sequence
  chemically synthesized
agagagagctactctgaccc

SEQ ID NO: 571123 - DNA, 20 bp, Artificial Sequence
  chemically synthesized
aaaagggtgttggtgacagt

SEQ ID NO: 571124 - DNA, 20 bp, Artificial Sequence
  chemically synthesized
caccactgtcaccaacaccc

SEQ ID NO: 571125 - DNA, 20 bp, Artificial Sequence
  chemically synthesized
tgtttcttaactaatctgag

SEQ ID NO: 571126 - DNA, 20 bp, Artificial Sequence
  chemically synthesized
gtaagtgacagaaaactcaa

SEQ ID NO: 571127 - DNA, 20 bp, Artificial Sequence
  chemically synthesized
ctaattttcttaaatgtttc

SEQ ID NO: 571128 - DNA, 20 bp, Artificial Sequence
  chemically synthesized
ggatcaatgctaattttctt

SEQ ID NO: 571129 - DNA, 20 bp, Artificial Sequence
  chemically synthesized
tctttaaatttaaaaaggca

SEQ ID NO: 571130 - DNA, 20 bp, Artificial Sequence
  chemically synthesized
gaatggtacccattattata

SEQ ID NO: 571131 - DNA, 20 bp, Artificial Sequence
  chemically synthesized
caactgcggcattaattctc

SEQ ID NO: 571132 - DNA, 20 bp, Artificial Sequence
  chemically synthesized
cgcctcggcctcccaaagtg

SEQ ID NO: 571133 - DNA, 20 bp, Artificial Sequence
  chemically synthesized
gaggccgaggcgggcagatc

SEQ ID NO: 571134 - DNA, 20 bp, Artificial Sequence
  chemically synthesized
ttttgtatttttagtacaga

SEQ ID NO: 571135 - DNA, 20 bp, Artificial Sequence
  chemically synthesized
tgcctcagcctcctgagtag

SEQ ID NO: 571136 - DNA, 20 bp, Artificial Sequence
  chemically synthesized
aacctccacctcccgggttc

SEQ ID NO: 571137 - DNA, 20 bp, Artificial Sequence
  chemically synthesized
ccacaaggttatcaatatac

SEQ ID NO: 571138 - DNA, 20 bp, Artificial Sequence
  chemically synthesized
ttatcaatatacactagttt

SEQ ID NO: 571139 - DNA, 20 bp, Artificial Sequence
  chemically synthesized
ttgctaatattaggaaaaga

SEQ ID NO: 571140 - DNA, 20 bp, Artificial Sequence
  chemically synthesized
aacgtttacgtgagtatgct

SEQ ID NO: 571141 - DNA, 20 bp, Artificial Sequence
  chemically synthesized
cagtattttgtgtgcagcat

SEQ ID NO: 571142 - DNA, 20 bp, Artificial Sequence
  chemically synthesized
ttcagcactccttttaaaca

SEQ ID NO: 571143 - DNA, 20 bp, Artificial Sequence
  chemically synthesized
ttgagttttcaactaaatct

SEQ ID NO: 571144 - DNA, 20 bp, Artificial Sequence
  chemically synthesized
ttcagtggacaaatgtggct

SEQ ID NO: 571145 - DNA, 20 bp, Artificial Sequence
  chemically synthesized
aaaagctttcagtggacaaa

SEQ ID NO: 571146 - DNA, 20 bp, Artificial Sequence
  chemically synthesized
caaagccacatttgtccact

SEQ ID NO: 571147 - DNA, 20 bp, Artificial Sequence
  chemically synthesized
ttgtccactgaaagctttta

SEQ ID NO: 571148 - DNA, 20 bp, Artificial Sequence
  chemically synthesized
tttcacaaatgaagcttttt

SEQ ID NO: 571149 - DNA, 20 bp, Artificial Sequence
  chemically synthesized
tcaatgtgtcttttcacaaa

SEQ ID NO: 571150 - DNA, 20 bp, Artificial Sequence
  chemically synthesized
aatgaaagctggatcttcaa

SEQ ID NO: 571151 - DNA, 20 bp, Artificial Sequence
  chemically synthesized
cacagaatctcctttgaaga

SEQ ID NO: 571152 - DNA, 20 bp, Artificial Sequence
  chemically synthesized
ttggctaagctgcagaccac

SEQ ID NO: 571153 - DNA, 20 bp, Artificial Sequence
  chemically synthesized
tggccaaatcacaggtggtc

SEQ ID NO: 571154 - DNA, 20 bp, Artificial Sequence
  chemically synthesized
cttctttttaaaattgtatt

SEQ ID NO: 571155 - DNA, 20 bp, Artificial Sequence
  chemically synthesized
ggtaccttacattttctaac

SEQ ID NO: 571156 - DNA, 20 bp, Artificial Sequence
  chemically synthesized
tagacccagacaaggattta

SEQ ID NO: 571157 - DNA, 20 bp, Artificial Sequence
  chemically synthesized
ttaatcggtttagacccaga

SEQ ID NO: 571158 - DNA, 20 bp, Artificial Sequence
  chemically synthesized
taaatccttgtctgggtcta

SEQ ID NO: 571159 - DNA, 20 bp, Artificial Sequence
  chemically synthesized
tagatttgagttccttttta

SEQ ID NO: 571160 - DNA, 20 bp, Artificial Sequence
  chemically synthesized
ggaactcaaatctattttct

SEQ ID NO: 571161 - DNA, 20 bp, Artificial Sequence
  chemically synthesized
actctcccaatctgagagaa

SEQ ID NO: 571162 - DNA, 20 bp, Artificial Sequence
  chemically synthesized
actgggcagcatttctgttg

SEQ ID NO: 571163 - DNA, 20 bp, Artificial Sequence
  chemically synthesized
gtgcaactgggcagcatttc

SEQ ID NO: 571164 - DNA, 20 bp, Artificial Sequence
  chemically synthesized
tctagcatttgcacatcaat

SEQ ID NO: 571165 - DNA, 20 bp, Artificial Sequence
  chemically synthesized
ccggtaactagtgactgtca

SEQ ID NO: 571166 - DNA, 20 bp, Artificial Sequence
  chemically synthesized
aagaagtagagaactctaag

SEQ ID NO: 571167 - DNA, 20 bp, Artificial Sequence
  chemically synthesized
actctaagctgagttttgac

SEQ ID NO: 571168 - DNA, 20 bp, Artificial Sequence
  chemically synthesized
ccgggaatctatggtcaaaa

SEQ ID NO: 571169 - DNA, 20 bp, Artificial Sequence
  chemically synthesized
ttttgaccatagattcccgg

SEQ ID NO: 571170 - DNA, 20 bp, Artificial Sequence
  chemically synthesized
atgaccaaaaggcattttaa

SEQ ID NO: 571171 - DNA, 20 bp, Artificial Sequence
  chemically synthesized
aattgcaaagggacgaaatc

SEQ ID NO: 571172 - DNA, 20 bp, Artificial Sequence
  chemically synthesized
gggacgaaatcatgggcttc

SEQ ID NO: 571173 - DNA, 20 bp, Artificial Sequence
  chemically synthesized
tccaaagaaacacaagaagc

SEQ ID NO: 571174 - DNA, 20 bp, Artificial Sequence
  chemically synthesized
ctatgccagctctcgaagta

SEQ ID NO: 571175 - DNA, 20 bp, Artificial Sequence
  chemically synthesized
tctttctgctccagtgcccg

SEQ ID NO: 571176 - DNA, 20 bp, Artificial Sequence
  chemically synthesized
gtgcctctaagaccccagaa

SEQ ID NO: 571177 - DNA, 20 bp, Artificial Sequence
  chemically synthesized
cccttgtggatctcactgga

SEQ ID NO: 571178 - DNA, 20 bp, Artificial Sequence
  chemically synthesized
ttatttatttattttttttt

SEQ ID NO: 571179 - DNA, 20 bp, Artificial Sequence
  chemically synthesized
ctctagactttccctcctac

SEQ ID NO: 571180 - DNA, 20 bp, Artificial Sequence
  chemically synthesized
actacacactcattcttttt

SEQ ID NO: 571181 - DNA, 20 bp, Artificial Sequence
  chemically synthesized
acacagttaaaagggaggtg

SEQ ID NO: 571182 - DNA, 20 bp, Artificial Sequence
  chemically synthesized
aggacattgaaggggacata

SEQ ID NO: 571183 - DNA, 20 bp, Artificial Sequence
  chemically synthesized
attttagtctatttctgtct

SEQ ID NO: 571184 - DNA, 20 bp, Artificial Sequence
  chemically synthesized
aaagacattttctcctctat

SEQ ID NO: 571185 - DNA, 20 bp, Artificial Sequence
  chemically synthesized
tcctctattatagctttatt

SEQ ID NO: 571186 - DNA, 20 bp, Artificial Sequence
  chemically synthesized
tttctctattgtagtctctt

SEQ ID NO: 571187 - DNA, 20 bp, Artificial Sequence
  chemically synthesized
gcttttgggattggattcta

SEQ ID NO: 571188 - DNA, 20 bp, Artificial Sequence
  chemically synthesized
ccttctaaagtgcttttggg

SEQ ID NO: 571189 - DNA, 20 bp, Artificial Sequence
  chemically synthesized
tccatccttctaaagtgctt

SEQ ID NO: 571190 - DNA, 20 bp, Artificial Sequence
  chemically synthesized
gataagattccatccttcta

SEQ ID NO: 571191 - DNA, 20 bp, Artificial Sequence
  chemically synthesized
agtgattcagggagtaaatg

SEQ ID NO: 571192 - DNA, 20 bp, Artificial Sequence
  chemically synthesized
tacaccaactgtactgatga

SEQ ID NO: 571193 - DNA, 20 bp, Artificial Sequence
  chemically synthesized
agctataaaggaggaaagga

SEQ ID NO: 571194 - DNA, 20 bp, Artificial Sequence
  chemically synthesized
gctcggaaatttgtgagtga

SEQ ID NO: 571195 - DNA, 20 bp, Artificial Sequence
  chemically synthesized
tcatttatattgtatagtgc

SEQ ID NO: 571196 - DNA, 20 bp, Artificial Sequence
  chemically synthesized
gttgaatccttcctcgagca

SEQ ID NO: 571197 - DNA, 20 bp, Artificial Sequence
  chemically synthesized
aattaaactacatgctcgag

SEQ ID NO: 571198 - DNA, 20 bp, Artificial Sequence
  chemically synthesized
ctcagaagactaaaattaga

SEQ ID NO: 571199 - DNA, 20 bp, Artificial Sequence
  chemically synthesized
cactgacttctatgtaatga

SEQ ID NO: 571200 - DNA, 20 bp, Artificial Sequence
  chemically synthesized
aatgtttatacaattattat

SEQ ID NO: 571201 - DNA, 20 bp, Artificial Sequence
  chemically synthesized
agcacgcactcaatacatgt

SEQ ID NO: 571202 - DNA, 20 bp, Artificial Sequence
  chemically synthesized
aacattaacatgtattgagt

SEQ ID NO: 571203 - DNA, 20 bp, Artificial Sequence
  chemically synthesized
tttgtgccaggcactgcaca

SEQ ID NO: 571204 - DNA, 20 bp, Artificial Sequence
  chemically synthesized
gcactgcacaaagtgcttta

SEQ ID NO: 571205 - DNA, 20 bp, Artificial Sequence
  chemically synthesized
agtgtcgtgggaggtttcta

SEQ ID NO: 571206 - DNA, 20 bp, Artificial Sequence
  chemically synthesized
tcagtgcagtaagtgtcgtg

SEQ ID NO: 571207 - DNA, 20 bp, Artificial Sequence
  chemically synthesized
ctccaatgacacaaagccta

SEQ ID NO: 571208 - DNA, 20 bp, Artificial Sequence
  chemically synthesized
atacaagaattcaaagcagg

SEQ ID NO: 571209 - DNA, 20 bp, Artificial Sequence
  chemically synthesized
cttcttggtgtcaatagaat

SEQ ID NO: 571210 - DNA, 20 bp, Artificial Sequence
  chemically synthesized
gccgctgctctgctccactt

SEQ ID NO: 571211 - DNA, 20 bp, Artificial Sequence
  chemically synthesized
aggtttgtagcaaatatgtc

SEQ ID NO: 571212 - DNA, 20 bp, Artificial Sequence
  chemically synthesized
atcacatcttgtcagcccac

SEQ ID NO: 571213 - DNA, 20 bp, Artificial Sequence
  chemically synthesized
caaaagggatccctgagcct

SEQ ID NO: 571214 - DNA, 20 bp, Artificial Sequence
  chemically synthesized
tcccctgacccccatgacat

SEQ ID NO: 571215 - DNA, 20 bp, Artificial Sequence
  chemically synthesized
gcactaacccctgtggctgg

SEQ ID NO: 571216 - DNA, 20 bp, Artificial Sequence
  chemically synthesized
gcatagccagccacaggggt

SEQ ID NO: 571217 - DNA, 20 bp, Artificial Sequence
  chemically synthesized
ttcccctcccaacttctgca

SEQ ID NO: 571218 - DNA, 20 bp, Artificial Sequence
  chemically synthesized
caacttctgcacagtgttta

SEQ ID NO: 571219 - DNA, 20 bp, Artificial Sequence
  chemically synthesized
cttactcatatcatatagtt

SEQ ID NO: 571220 - DNA, 20 bp, Artificial Sequence
  chemically synthesized
acagctttgatagaaaaact

SEQ ID NO: 571221 - DNA, 20 bp, Artificial Sequence
  chemically synthesized
ataaatacaaaaaggaaaca

SEQ ID NO: 571222 - DNA, 20 bp, Artificial Sequence
  chemically synthesized
gtttcctttttgtatttata

SEQ ID NO: 571223 - DNA, 20 bp, Artificial Sequence
  chemically synthesized
atttatacttagattttcta

SEQ ID NO: 571224 - DNA, 20 bp, Artificial Sequence
  chemically synthesized
ctgaacttcacacaacgtcg

SEQ ID NO: 571225 - DNA, 20 bp, Artificial Sequence
  chemically synthesized
ggatgtgtcccactcagatc

SEQ ID NO: 571226 - DNA, 20 bp, Artificial Sequence
  chemically synthesized
tcctgctcccactggttgag

SEQ ID NO: 571227 - DNA, 20 bp, Artificial Sequence
  chemically synthesized
aggagcaggtatacacatgc

SEQ ID NO: 571228 - DNA, 20 bp, Artificial Sequence
  chemically synthesized
tcaggctgtagctacctata

SEQ ID NO: 571229 - DNA, 20 bp, Artificial Sequence
  chemically synthesized
ctgtagctacctatatccag

SEQ ID NO: 571230 - DNA, 20 bp, Artificial Sequence
  chemically synthesized
gagaattgctcatctttctt

SEQ ID NO: 571231 - DNA, 20 bp, Artificial Sequence
  chemically synthesized
cattcttcttgttctcttat

SEQ ID NO: 571232 - DNA, 20 bp, Artificial Sequence
  chemically synthesized
gaggcagaggctgcactgag

SEQ ID NO: 571233 - DNA, 20 bp, Artificial Sequence
  chemically synthesized
agcctctgcctcccgggttc

SEQ ID NO: 571234 - DNA, 20 bp, Artificial Sequence
  chemically synthesized
tgtctcagcctcccaagtag

SEQ ID NO: 571235 - DNA, 20 bp, Artificial Sequence
  chemically synthesized
actaaaaatacaaaaattag

SEQ ID NO: 571236 - DNA, 20 bp, Artificial Sequence
  chemically synthesized
ttttgtatttttagtagaga

SEQ ID NO: 571237 - DNA, 20 bp, Artificial Sequence
  chemically synthesized
atgcccggcccgaggtccct

SEQ ID NO: 571238 - DNA, 20 bp, Artificial Sequence
  chemically synthesized
tggtgagacctatcctaaga

SEQ ID NO: 571239 - DNA, 20 bp, Artificial Sequence
  chemically synthesized
catttgccttctccaagagt

SEQ ID NO: 571240 - DNA, 20 bp, Artificial Sequence
  chemically synthesized
ccactgtcaacatcacagat

SEQ ID NO: 571241 - DNA, 20 bp, Artificial Sequence
  chemically synthesized
agactttccactgtcaacat

SEQ ID NO: 571242 - DNA, 20 bp, Artificial Sequence
  chemically synthesized
cttaggtcccactgctgagg

SEQ ID NO: 571243 - DNA, 20 bp, Artificial Sequence
  chemically synthesized
aacaaatcttgttatcagat

SEQ ID NO: 571244 - DNA, 20 bp, Artificial Sequence
  chemically synthesized
atttaatccagaatctgata

SEQ ID NO: 571245 - DNA, 20 bp, Artificial Sequence
  chemically synthesized
aagttccaacaaatcttgtt

SEQ ID NO: 571246 - DNA, 20 bp, Artificial Sequence
  chemically synthesized
ccttattttaaagtctttct

SEQ ID NO: 571247 - DNA, 20 bp, Artificial Sequence
  chemically synthesized
gtaatcctcctaaaatgcag

SEQ ID NO: 571248 - DNA, 20 bp, Artificial Sequence
  chemically synthesized
ctaatcagatctgcatttta

SEQ ID NO: 571249 - DNA, 20 bp, Artificial Sequence
  chemically synthesized
actataggcgcattgtggaa

SEQ ID NO: 571250 - DNA, 20 bp, Artificial Sequence
  chemically synthesized
atttatctccctgatattgt

SEQ ID NO: 571251 - DNA, 20 bp, Artificial Sequence
  chemically synthesized
aataagggaatgaattaaga

SEQ ID NO: 571252 - DNA, 20 bp, Artificial Sequence
  chemically synthesized
agaatttggcaatgcatcat

SEQ ID NO: 571253 - DNA, 20 bp, Artificial Sequence
  chemically synthesized
atgttagatttaaagataaa

SEQ ID NO: 571254 - DNA, 20 bp, Artificial Sequence
  chemically synthesized
ttgtgctgttcttatgaacg

SEQ ID NO: 571255 - DNA, 20 bp, Artificial Sequence
  chemically synthesized
agggagggaaaaatgttgag

SEQ ID NO: 571256 - DNA, 20 bp, Artificial Sequence
  chemically synthesized
gcttcagacccagccacctt

SEQ ID NO: 571257 - DNA, 20 bp, Artificial Sequence
  chemically synthesized
aggtcagacttatttctctc

SEQ ID NO: 571258 - DNA, 20 bp, Artificial Sequence
  chemically synthesized
ataattatttgaaatggctg

SEQ ID NO: 571259 - DNA, 20 bp, Artificial Sequence
  chemically synthesized
tagcataattatttgaaatg

SEQ ID NO: 571260 - DNA, 20 bp, Artificial Sequence
  chemically synthesized
ataaagtatgaggtttaagt

SEQ ID NO: 571261 - DNA, 20 bp, Artificial Sequence
  chemically synthesized
tttgatttttatataaagta

SEQ ID NO: 571262 - DNA, 20 bp, Artificial Sequence
  chemically synthesized
tatgtttaagtctgtgatcc

SEQ ID NO: 571263 - DNA, 20 bp, Artificial Sequence
  chemically synthesized
atgtcttatagttttacatt

SEQ ID NO: 571264 - DNA, 20 bp, Artificial Sequence
  chemically synthesized
ctctcctgttttatatgtct

SEQ ID NO: 571265 - DNA, 20 bp, Artificial Sequence
  chemically synthesized
gggtttcaccattttggctc

SEQ ID NO: 571266 - DNA, 20 bp, Artificial Sequence
  chemically synthesized
ttttgtatttttagtagaga

SEQ ID NO: 571267 - DNA, 20 bp, Artificial Sequence
  chemically synthesized
gacggagcctcgctctgtcg

SEQ ID NO: 571268 - DNA, 20 bp, Artificial Sequence
  chemically synthesized
ctttgcctagccctggatcc

SEQ ID NO: 571269 - DNA, 20 bp, Artificial Sequence
  chemically synthesized
tcgctttttccttttatgga

SEQ ID NO: 571270 - DNA, 20 bp, Artificial Sequence
  chemically synthesized
aattttggcgaggttgaatt

SEQ ID NO: 571271 - DNA, 20 bp, Artificial Sequence
  chemically synthesized
ttcttgtgtatagggttttc

SEQ ID NO: 571272 - DNA, 20 bp, Artificial Sequence
  chemically synthesized
tactagtcctttcttgtgta

SEQ ID NO: 571273 - DNA, 20 bp, Artificial Sequence
  chemically synthesized
attcaaaagtttttttatag

SEQ ID NO: 571274 - DNA, 20 bp, Artificial Sequence
  chemically synthesized
ttttgtctattttctaattc

SEQ ID NO: 571275 - DNA, 20 bp, Artificial Sequence
  chemically synthesized
tgttgaacaacttttcctgt

SEQ ID NO: 571276 - DNA, 20 bp, Artificial Sequence
  chemically synthesized
tatctcattgtgcttttaat

SEQ ID NO: 571277 - DNA, 20 bp, Artificial Sequence
  chemically synthesized
atgtgtgtaggaatatctca

SEQ ID NO: 571278 - DNA, 20 bp, Artificial Sequence
  chemically synthesized
caccagcaatgtatgagtga

SEQ ID NO: 571279 - DNA, 20 bp, Artificial Sequence
  chemically synthesized
ggtggaatataaaatagtac

SEQ ID NO: 571280 - DNA, 20 bp, Artificial Sequence
  chemically synthesized
aaatagtacagacgcttcgg

SEQ ID NO: 571281 - DNA, 20 bp, Artificial Sequence
  chemically synthesized
cagacgcttcggaaaagttt

SEQ ID NO: 571282 - DNA, 20 bp, Artificial Sequence
  chemically synthesized
ggtcatatggtagttgaatg

SEQ ID NO: 571283 - DNA, 20 bp, Artificial Sequence
  chemically synthesized
tgttaggtcatatggtagtt

SEQ ID NO: 571284 - DNA, 20 bp, Artificial Sequence
  chemically synthesized
gtacaggtttttgtgtgaac

SEQ ID NO: 571285 - DNA, 20 bp, Artificial Sequence
  chemically synthesized
aaagctaccaacattaatgt

SEQ ID NO: 571286 - DNA, 20 bp, Artificial Sequence
  chemically synthesized
aaaacctgtacattaatgtt

SEQ ID NO: 571287 - DNA, 20 bp, Artificial Sequence
  chemically synthesized
ttgaagacatctgagttatc

SEQ ID NO: 571288 - DNA, 20 bp, Artificial Sequence
  chemically synthesized
ctcagatgtcttcaaggggt

SEQ ID NO: 571289 - DNA, 20 bp, Artificial Sequence
  chemically synthesized
atgctatggtttggatatac

SEQ ID NO: 571290 - DNA, 20 bp, Artificial Sequence
  chemically synthesized
ttttatcgtgagttgtatgc

SEQ ID NO: 571291 - DNA, 20 bp, Artificial Sequence
  chemically synthesized
ctctttttatatgcagcaag

SEQ ID NO: 571292 - DNA, 20 bp, Artificial Sequence
  chemically synthesized
actcactcaacataattccc

SEQ ID NO: 571293 - DNA, 20 bp, Artificial Sequence
  chemically synthesized
cctacttccagcaactacta

SEQ ID NO: 571294 - DNA, 20 bp, Artificial Sequence
  chemically synthesized
actctagttcaatgtcacaa

SEQ ID NO: 571295 - DNA, 20 bp, Artificial Sequence
  chemically synthesized
tcctggttgtgacattgaac

SEQ ID NO: 571296 - DNA, 20 bp, Artificial Sequence
  chemically synthesized
ggactccacataccttttta

SEQ ID NO: 571297 - DNA, 20 bp, Artificial Sequence
  chemically synthesized
tagatctcagcatttttaat

SEQ ID NO: 571298 - DNA, 20 bp, Artificial Sequence
  chemically synthesized
gtatcaatgactgaattttc

SEQ ID NO: 571299 - DNA, 20 bp, Artificial Sequence
  chemically synthesized
ctatcccttttcaagaatct

SEQ ID NO: 571300 - DNA, 20 bp, Artificial Sequence
  chemically synthesized
ccttttcaagaatctagaag

SEQ ID NO: 571301 - DNA, 20 bp, Artificial Sequence
  chemically synthesized
ttcaaaaagaaatctaagct

SEQ ID NO: 571302 - DNA, 20 bp, Artificial Sequence
  chemically synthesized
atattgcttcaaaaagaaat

SEQ ID NO: 571303 - DNA, 20 bp, Artificial Sequence
  chemically synthesized
tctttttgaagcaatatacc

SEQ ID NO: 571304 - DNA, 20 bp, Artificial Sequence
  chemically synthesized
taataagaaaactattggta

SEQ ID NO: 571305 - DNA, 20 bp, Artificial Sequence
  chemically synthesized
gttttcttattaaaaattca

SEQ ID NO: 571306 - DNA, 20 bp, Artificial Sequence
  chemically synthesized
ttttttaataaaaaataatt

SEQ ID NO: 571307 - DNA, 20 bp, Artificial Sequence
  chemically synthesized
agtgtcttaagagctgattt

SEQ ID NO: 571308 - DNA, 20 bp, Artificial Sequence
  chemically synthesized
tgaactgtaagtgtcttaag

SEQ ID NO: 571309 - DNA, 20 bp, Artificial Sequence
  chemically synthesized
tgagtagtgtccggtgaaag

SEQ ID NO: 571310 - DNA, 20 bp, Artificial Sequence
  chemically synthesized
caaaggttccctggaggacg

SEQ ID NO: 571311 - DNA, 20 bp, Artificial Sequence
  chemically synthesized
gagctggatctgcaatcaca

SEQ ID NO: 571312 - DNA, 20 bp, Artificial Sequence
  chemically synthesized
gaaggattccctcaatccag

SEQ ID NO: 571313 - DNA, 20 bp, Artificial Sequence
  chemically synthesized
ctgctatttgctgagtgctg

SEQ ID NO: 571314 - DNA, 20 bp, Artificial Sequence
  chemically synthesized
cttgatacctgctgtgtctg

SEQ ID NO: 571315 - DNA, 20 bp, Artificial Sequence
  chemically synthesized
ctgtccagacacagcaggta

SEQ ID NO: 571316 - DNA, 20 bp, Artificial Sequence
  chemically synthesized
ttcctcatcaggagggaagc

SEQ ID NO: 571317 - DNA, 20 bp, Artificial Sequence
  chemically synthesized
catcaggagggaagcatttg

SEQ ID NO: 571318 - DNA, 20 bp, Artificial Sequence
  chemically synthesized
aggagggaagcatttgtttt

SEQ ID NO: 571319 - DNA, 20 bp, Artificial Sequence
  chemically synthesized
tatgtccaaacaaacaaaac

SEQ ID NO: 571320 - DNA, 20 bp, Artificial Sequence
  chemically synthesized
ttgagccaaagttgtaaaca

SEQ ID NO: 571321 - DNA, 20 bp, Artificial Sequence
  chemically synthesized
agtacctgagttcttaatca

SEQ ID NO: 571322 - DNA, 20 bp, Artificial Sequence
  chemically synthesized
tggactgcctggtgtgacta

SEQ ID NO: 571323 - DNA, 20 bp, Artificial Sequence
  chemically synthesized
tgggcaaagcacttaactcg

SEQ ID NO: 571324 - DNA, 20 bp, Artificial Sequence
  chemically synthesized
aagcagaaacttagcgagtt

SEQ ID NO: 571325 - DNA, 20 bp, Artificial Sequence
  chemically synthesized
aagcacttaactcgctaagt

SEQ ID NO: 571326 - DNA, 20 bp, Artificial Sequence
  chemically synthesized
tcatctggcatatattagct

SEQ ID NO: 571327 - DNA, 20 bp, Artificial Sequence
  chemically synthesized
ttgtctctccaaaggttgca

SEQ ID NO: 571328 - DNA, 20 bp, Artificial Sequence
  chemically synthesized
agcgatagtctctgccccta

SEQ ID NO: 571329 - DNA, 20 bp, Artificial Sequence
  chemically synthesized
aacggcttaggggcagagac

SEQ ID NO: 571330 - DNA, 20 bp, Artificial Sequence
  chemically synthesized
ggacactcctggcacacagc

SEQ ID NO: 571331 - DNA, 20 bp, Artificial Sequence
  chemically synthesized
cttgcaagaacactactttt

SEQ ID NO: 571332 - DNA, 20 bp, Artificial Sequence
  chemically synthesized
ctggcaaaagtagtgttctt

SEQ ID NO: 571333 - DNA, 20 bp, Artificial Sequence
  chemically synthesized
ggctgaccagatggaggaag

SEQ ID NO: 571334 - DNA, 20 bp, Artificial Sequence
  chemically synthesized
gagtgaagttgtatcattgc

SEQ ID NO: 571335 - DNA, 20 bp, Artificial Sequence
  chemically synthesized
tgaattgaaggacatagttc

SEQ ID NO: 571336 - DNA, 20 bp, Artificial Sequence
  chemically synthesized
gactccacattttaactatg

SEQ ID NO: 571337 - DNA, 20 bp, Artificial Sequence
  chemically synthesized
attttaactatgaatagatt

SEQ ID NO: 571338 - DNA, 20 bp, Artificial Sequence
  chemically synthesized
gcctaatttgcacactacag

SEQ ID NO: 571339 - DNA, 20 bp, Artificial Sequence
  chemically synthesized
cccagtatagcagaaagaac

SEQ ID NO: 571340 - DNA, 20 bp, Artificial Sequence
  chemically synthesized
aaatgacatatgggacagaa

SEQ ID NO: 571341 - DNA, 20 bp, Artificial Sequence
  chemically synthesized
ccatcaatacctaatttatt

SEQ ID NO: 571342 - DNA, 20 bp, Artificial Sequence
  chemically synthesized
cattcagtatgatattggct

SEQ ID NO: 571343 - DNA, 20 bp, Artificial Sequence
  chemically synthesized
cagttttcagagggaatgct

SEQ ID NO: 571344 - DNA, 20 bp, Artificial Sequence
  chemically synthesized
cttgtgccagttttcagagg

SEQ ID NO: 571345 - DNA, 20 bp, Artificial Sequence
  chemically synthesized
agagggcatccctgtcttgt

SEQ ID NO: 571346 - DNA, 20 bp, Artificial Sequence
  chemically synthesized
accctttatttccttctcct

SEQ ID NO: 571347 - DNA, 20 bp, Artificial Sequence
  chemically synthesized
aaaagaggaagtcaaattgt

SEQ ID NO: 571348 - DNA, 20 bp, Artificial Sequence
  chemically synthesized
attgtccctgtttgcagatg

SEQ ID NO: 571349 - DNA, 20 bp, Artificial Sequence
  chemically synthesized
gagatttggggttgagacga

SEQ ID NO: 571350 - DNA, 20 bp, Artificial Sequence
  chemically synthesized
tgaagttgcttatcagctta

SEQ ID NO: 571351 - DNA, 20 bp, Artificial Sequence
  chemically synthesized
agactttgctgaagttgctt

SEQ ID NO: 571352 - DNA, 20 bp, Artificial Sequence
  chemically synthesized
gtatcctgagactttgctga

SEQ ID NO: 571353 - DNA, 20 bp, Artificial Sequence
  chemically synthesized
gaatgcttgtgatttttgca

SEQ ID NO: 571354 - DNA, 20 bp, Artificial Sequence
  chemically synthesized
ttattggtgtataagaatgc

SEQ ID NO: 571355 - DNA, 20 bp, Artificial Sequence
  chemically synthesized
tgtctgttattggtgtataa

SEQ ID NO: 571356 - DNA, 20 bp, Artificial Sequence
  chemically synthesized
aattgtgaatgggagttcac

SEQ ID NO: 571357 - DNA, 20 bp, Artificial Sequence
  chemically synthesized
atgagtgaactcccattcac

SEQ ID NO: 571358 - DNA, 20 bp, Artificial Sequence
  chemically synthesized
gtccttcacatcccttgtaa

SEQ ID NO: 571359 - DNA, 20 bp, Artificial Sequence
  chemically synthesized
cctcttttatttccttgagc

SEQ ID NO: 571360 - DNA, 20 bp, Artificial Sequence
  chemically synthesized
cagtatggccattttcacga

SEQ ID NO: 571361 - DNA, 20 bp, Artificial Sequence
  chemically synthesized
ccatactgcccaaggaaatt

SEQ ID NO: 571362 - DNA, 20 bp, Artificial Sequence
  chemically synthesized
attctgtgaagaaagtcatt

SEQ ID NO: 571363 - DNA, 20 bp, Artificial Sequence
  chemically synthesized
tggttccatatgaactttaa

SEQ ID NO: 571364 - DNA, 20 bp, Artificial Sequence
  chemically synthesized
tccagctttgttcttttggc

SEQ ID NO: 571365 - DNA, 20 bp, Artificial Sequence
  chemically synthesized
gatgcctccagctttgttct

SEQ ID NO: 571366 - DNA, 20 bp, Artificial Sequence
  chemically synthesized
aagtcaggtagcgtgatgcc

SEQ ID NO: 571367 - DNA, 20 bp, Artificial Sequence
  chemically synthesized
tgcttcctgtagccttgtag

SEQ ID NO: 571368 - DNA, 20 bp, Artificial Sequence
  chemically synthesized
ttggtaccagtaccatgctg

SEQ ID NO: 571369 - DNA, 20 bp, Artificial Sequence
  chemically synthesized
ctgttttggtaccagtacca

SEQ ID NO: 571370 - DNA, 20 bp, Artificial Sequence
  chemically synthesized
tctgttccattgatctatgt

SEQ ID NO: 571371 - DNA, 20 bp, Artificial Sequence
  chemically synthesized
ttccccattgcttgtttttc

SEQ ID NO: 571372 - DNA, 20 bp, Artificial Sequence
  chemically synthesized
gagaaaaacaagcaatgggg

SEQ ID NO: 571373 - DNA, 20 bp, Artificial Sequence
  chemically synthesized
tagggaatcctttccccatt

SEQ ID NO: 571374 - DNA, 20 bp, Artificial Sequence
  chemically synthesized
taaatagggaatcctttccc

SEQ ID NO: 571375 - DNA, 20 bp, Artificial Sequence
  chemically synthesized
cagctttctacatatggcta

SEQ ID NO: 571376 - DNA, 20 bp, Artificial Sequence
  chemically synthesized
gtgtaaggaagggatccagt

SEQ ID NO: 571377 - DNA, 20 bp, Artificial Sequence
  chemically synthesized
tataaggtgtaaggaaggga

SEQ ID NO: 571378 - DNA, 20 bp, Artificial Sequence
  chemically synthesized
ttatacgaaaattaattcaa

SEQ ID NO: 571379 - DNA, 20 bp, Artificial Sequence
  chemically synthesized
aggttttcttctagagtttt

SEQ ID NO: 571380 - DNA, 20 bp, Artificial Sequence
  chemically synthesized
gtaatgcctaggttttcttc

SEQ ID NO: 571381 - DNA, 20 bp, Artificial Sequence
  chemically synthesized
tatgtcctgaatggtaatgc

SEQ ID NO: 571382 - DNA, 20 bp, Artificial Sequence
  chemically synthesized
tcaattttggcttttgttgc

SEQ ID NO: 571383 - DNA, 20 bp, Artificial Sequence
  chemically synthesized
attagatcccatttgtcaat

SEQ ID NO: 571384 - DNA, 20 bp, Artificial Sequence
  chemically synthesized
aatgggatctaattaaacta

SEQ ID NO: 571385 - DNA, 20 bp, Artificial Sequence
  chemically synthesized
cttttgctgtgcagaagctc

SEQ ID NO: 571386 - DNA, 20 bp, Artificial Sequence
  chemically synthesized
ggttgcctgttcactctgat

SEQ ID NO: 571387 - DNA, 20 bp, Artificial Sequence
  chemically synthesized
gtacatttgtttgagttcat

SEQ ID NO: 571388 - DNA, 20 bp, Artificial Sequence
  chemically synthesized
tgtttgtttttttcttgtac

SEQ ID NO: 571389 - DNA, 20 bp, Artificial Sequence
  chemically synthesized
gcccactttttgatggggtt

SEQ ID NO: 571390 - DNA, 20 bp, Artificial Sequence
  chemically synthesized
cttcgcccactttttgatgg

SEQ ID NO: 571391 - DNA, 20 bp, Artificial Sequence
  chemically synthesized
gagatggtatctcattgtgg

SEQ ID NO: 571392 - DNA, 20 bp, Artificial Sequence
  chemically synthesized
ggtgtgagatggtatctcat

SEQ ID NO: 571393 - DNA, 20 bp, Artificial Sequence
  chemically synthesized
tccacatcctctccagcacc

SEQ ID NO: 571394 - DNA, 20 bp, Artificial Sequence
  chemically synthesized
ctgacttccacaatggttga

SEQ ID NO: 571395 - DNA, 20 bp, Artificial Sequence
  chemically synthesized
aaccattgtggaagtcagtg

SEQ ID NO: 571396 - DNA, 20 bp, Artificial Sequence
  chemically synthesized
gtgcatgtgtctttatagca

SEQ ID NO: 571397 - DNA, 20 bp, Artificial Sequence
  chemically synthesized
ctataaagacacatgcacac

SEQ ID NO: 571398 - DNA, 20 bp, Artificial Sequence
  chemically synthesized
caaatgtccaacaatgatag

SEQ ID NO: 571399 - DNA, 20 bp, Artificial Sequence
  chemically synthesized
atgtgatagtttactgagaa

SEQ ID NO: 571400 - DNA, 20 bp, Artificial Sequence
  chemically synthesized
gtttggtcttttgtccatgt

SEQ ID NO: 571401 - DNA, 20 bp, Artificial Sequence
  chemically synthesized
cacctatgagtgagaacatg

SEQ ID NO: 571402 - DNA, 20 bp, Artificial Sequence
  chemically synthesized
tttatttattttattatact

SEQ ID NO: 571403 - DNA, 20 bp, Artificial Sequence
  chemically synthesized
gggccaatgactggctgatg

SEQ ID NO: 571404 - DNA, 20 bp, Artificial Sequence
  chemically synthesized
agtgttccattattgggacg

SEQ ID NO: 571405 - DNA, 20 bp, Artificial Sequence
  chemically synthesized
tattgggacgctaagcttgt

SEQ ID NO: 571406 - DNA, 20 bp, Artificial Sequence
  chemically synthesized
gtaggatataaaaaactccc

SEQ ID NO: 571407 - DNA, 20 bp, Artificial Sequence
  chemically synthesized
atttatgctggaggttgcaa

SEQ ID NO: 571408 - DNA, 20 bp, Artificial Sequence
  chemically synthesized
atgggttaaagtcttcaccc

SEQ ID NO: 571409 - DNA, 20 bp, Artificial Sequence
  chemically synthesized
ctgaaaggccaaacctactc

SEQ ID NO: 571410 - DNA, 20 bp, Artificial Sequence
  chemically synthesized
gcatgcagggaagctctgga

SEQ ID NO: 571411 - DNA, 20 bp, Artificial Sequence
  chemically synthesized
taattgcaactgcatggtga

SEQ ID NO: 571412 - DNA, 20 bp, Artificial Sequence
  chemically synthesized
ctctgcgcagtcatgcccct

SEQ ID NO: 571413 - DNA, 20 bp, Artificial Sequence
  chemically synthesized
tgtcatactgggaagtgctc

SEQ ID NO: 571414 - DNA, 20 bp, Artificial Sequence
  chemically synthesized
cagttggagagttgcttgca

SEQ ID NO: 571415 - DNA, 20 bp, Artificial Sequence
  chemically synthesized
ccttctgcaagcaactctcc

SEQ ID NO: 571416 - DNA, 20 bp, Artificial Sequence
  chemically synthesized
agaagcagaagcagttggag

SEQ ID NO: 571417 - DNA, 20 bp, Artificial Sequence
  chemically synthesized
gcaagcaactctccaactgc

SEQ ID NO: 571418 - DNA, 20 bp, Artificial Sequence
  chemically synthesized
tgtgtaccttttttcccttt

SEQ ID NO: 571419 - DNA, 20 bp, Artificial Sequence
  chemically synthesized
gctgggaataaaacgagatc

SEQ ID NO: 571420 - DNA, 20 bp, Artificial Sequence
  chemically synthesized
gttttctgccaagcacatga

SEQ ID NO: 571421 - DNA, 20 bp, Artificial Sequence
  chemically synthesized
attagctgtcattgcttgaa

SEQ ID NO: 571422 - DNA, 20 bp, Artificial Sequence
  chemically synthesized
aagtatcacctattagctgt

SEQ ID NO: 571423 - DNA, 20 bp, Artificial Sequence
  chemically synthesized
cagtatttgttcctttttgg

SEQ ID NO: 571424 - DNA, 20 bp, Artificial Sequence
  chemically synthesized
aaggaacaaatactgtataa

SEQ ID NO: 571425 - DNA, 20 bp, Artificial Sequence
  chemically synthesized
ggggaaaggaggaaatgaga

SEQ ID NO: 571426 - DNA, 20 bp, Artificial Sequence
  chemically synthesized
atgagaagtggtttaatggg

SEQ ID NO: 571427 - DNA, 20 bp, Artificial Sequence
  chemically synthesized
agtggtttaatgggtacagt

SEQ ID NO: 571428 - DNA, 20 bp, Artificial Sequence
  chemically synthesized
aaaatggtaaattttacatt

SEQ ID NO: 571429 - DNA, 20 bp, Artificial Sequence
  chemically synthesized
agaaatgatggctaccatac

SEQ ID NO: 571430 - DNA, 20 bp, Artificial Sequence
  chemically synthesized
ccataccattgattccattt

SEQ ID NO: 571431 - DNA, 20 bp, Artificial Sequence
  chemically synthesized
acccacaagcaggtaccttt

SEQ ID NO: 571432 - DNA, 20 bp, Artificial Sequence
  chemically synthesized
caggagaagccagaaaaggt

SEQ ID NO: 571433 - DNA, 20 bp, Artificial Sequence
  chemically synthesized
tcatcctgttgggtgggacc

SEQ ID NO: 571434 - DNA, 20 bp, Artificial Sequence
  chemically synthesized
ggtgggacctatagtttcaa

SEQ ID NO: 571435 - DNA, 20 bp, Artificial Sequence
  chemically synthesized
gaggaggcagggagcttcaa

SEQ ID NO: 571436 - DNA, 20 bp, Artificial Sequence
  chemically synthesized
ccagggtgtcagaggaggca

SEQ ID NO: 571437 - DNA, 20 bp, Artificial Sequence
  chemically synthesized
ctggatattacgtctccgta

SEQ ID NO: 571438 - DNA, 20 bp, Artificial Sequence
  chemically synthesized
tagaaacattggtgtaaaaa

SEQ ID NO: 571439 - DNA, 20 bp, Artificial Sequence
  chemically synthesized
cgtaatctgattttttacac

SEQ ID NO: 571440 - DNA, 20 bp, Artificial Sequence
  chemically synthesized
ctaaagtctaaagagatgtg

SEQ ID NO: 571441 - DNA, 20 bp, Artificial Sequence
  chemically synthesized
ctccacacatctctttagac

SEQ ID NO: 571442 - DNA, 20 bp, Artificial Sequence
  chemically synthesized
gttcctcagagcctatgcca

SEQ ID NO: 571443 - DNA, 20 bp, Artificial Sequence
  chemically synthesized
gaaggaaggaaaatagtgct

SEQ ID NO: 571444 - DNA, 20 bp, Artificial Sequence
  chemically synthesized
agaggaaggaaggaaaatag

SEQ ID NO: 571445 - DNA, 20 bp, Artificial Sequence
  chemically synthesized
atggtggtgattttaaagag

SEQ ID NO: 571446 - DNA, 20 bp, Artificial Sequence
  chemically synthesized
tgcttttcgaaaggttatgg

SEQ ID NO: 571447 - DNA, 20 bp, Artificial Sequence
  chemically synthesized
ttgtatcatgatgcagtttg

SEQ ID NO: 571448 - DNA, 20 bp, Artificial Sequence
  chemically synthesized
taatttcttttgtatcatga

SEQ ID NO: 571449 - DNA, 20 bp, Artificial Sequence
  chemically synthesized
ggtgccaggttgttgaaaat

SEQ ID NO: 571450 - DNA, 20 bp, Artificial Sequence
  chemically synthesized
ggaagttgacagatataatg

SEQ ID NO: 571451 - DNA, 20 bp, Artificial Sequence
  chemically synthesized
atgatgtgcttagatatcct

SEQ ID NO: 571452 - DNA, 20 bp, Artificial Sequence
  chemically synthesized
gatatcctgatggattttga

SEQ ID NO: 571453 - DNA, 20 bp, Artificial Sequence
  chemically synthesized
gatggattttgacacagatt

SEQ ID NO: 571454 - DNA, 20 bp, Artificial Sequence
  chemically synthesized
accactttaaagtcctctac

SEQ ID NO: 571455 - DNA, 20 bp, Artificial Sequence
  chemically synthesized
agaggactttaaagtggttg

SEQ ID NO: 571456 - DNA, 20 bp, Artificial Sequence
  chemically synthesized
cttttgtcctgctgaccagt

SEQ ID NO: 571457 - DNA, 20 bp, Artificial Sequence
  chemically synthesized
tatattcttttgtcctgctg

SEQ ID NO: 571458 - DNA, 20 bp, Artificial Sequence
  chemically synthesized
ttggtcacgttttgtacctt

SEQ ID NO: 571459 - DNA, 20 bp, Artificial Sequence
  chemically synthesized
tggcacctccaacttcttgg

SEQ ID NO: 571460 - DNA, 20 bp, Artificial Sequence
  chemically synthesized
aggactgatcctaagccagt

SEQ ID NO: 571461 - DNA, 20 bp, Artificial Sequence
  chemically synthesized
ctaggacagaagaaacaacc

SEQ ID NO: 571462 - DNA, 20 bp, Artificial Sequence
  chemically synthesized
ccagtggttgtttcttctgt

SEQ ID NO: 571463 - DNA, 20 bp, Artificial Sequence
  chemically synthesized
tttcttctgtcctagtttta

SEQ ID NO: 571464 - DNA, 20 bp, Artificial Sequence
  chemically synthesized
tcatccaccctcactaggaa

SEQ ID NO: 571465 - DNA, 20 bp, Artificial Sequence
  chemically synthesized
gtggatgagggccaagagca

SEQ ID NO: 571466 - DNA, 20 bp, Artificial Sequence
  chemically synthesized
gggcttctccccagagtcac

SEQ ID NO: 571467 - DNA, 20 bp, Artificial Sequence
  chemically synthesized
ccagagtcacacaggattct

SEQ ID NO: 571468 - DNA, 20 bp, Artificial Sequence
  chemically synthesized
acacaggattctgcaggttt

SEQ ID NO: 571469 - DNA, 20 bp, Artificial Sequence
  chemically synthesized
gttttaatgattacagcaga

SEQ ID NO: 571470 - DNA, 20 bp, Artificial Sequence
  chemically synthesized
ttttgctgggttagaaccgc

SEQ ID NO: 571471 - DNA, 20 bp, Artificial Sequence
  chemically synthesized
gaggtggtaaatgctggcct

SEQ ID NO: 571472 - DNA, 20 bp, Artificial Sequence
  chemically synthesized
ctaagtttgcaaatggggca

SEQ ID NO: 571473 - DNA, 20 bp, Artificial Sequence
  chemically synthesized
ctcctaactgcatatatgta

SEQ ID NO: 571474 - DNA, 20 bp, Artificial Sequence
  chemically synthesized
gttgctctactcgttacaca

SEQ ID NO: 571475 - DNA, 20 bp, Artificial Sequence
  chemically synthesized
aaaatacttaaagtctggca

SEQ ID NO: 571476 - DNA, 20 bp, Artificial Sequence
  chemically synthesized
tctggcactaagtttctact

SEQ ID NO: 571477 - DNA, 20 bp, Artificial Sequence
  chemically synthesized
gcactaagtttctactccct

SEQ ID NO: 571478 - DNA, 20 bp, Artificial Sequence
  chemically synthesized
aagtttctactccctgtttg

SEQ ID NO: 571479 - DNA, 20 bp, Artificial Sequence
  chemically synthesized
tgaagggctgtctttgccaa

SEQ ID NO: 571480 - DNA, 20 bp, Artificial Sequence
  chemically synthesized
ctctgcctttctgtctatat

SEQ ID NO: 571481 - DNA, 20 bp, Artificial Sequence
  chemically synthesized
agataacagcctaattatta

SEQ ID NO: 571482 - DNA, 20 bp, Artificial Sequence
  chemically synthesized
gggtgtttgtgaactgaaca

SEQ ID NO: 571483 - DNA, 20 bp, Artificial Sequence
  chemically synthesized
aagtgaggagttccccatca

SEQ ID NO: 571484 - DNA, 20 bp, Artificial Sequence
  chemically synthesized
taagttttaagcctaggcca

SEQ ID NO: 571485 - DNA, 20 bp, Artificial Sequence
  chemically synthesized
ctgctagaaaacactttggc

SEQ ID NO: 571486 - DNA, 20 bp, Artificial Sequence
  chemically synthesized
gaaatgtggaagaactcctg

SEQ ID NO: 571487 - DNA, 20 bp, Artificial Sequence
  chemically synthesized
tcttgaaggcccctttcaac

SEQ ID NO: 571488 - DNA, 20 bp, Artificial Sequence
  chemically synthesized
tattactcaaacttgttaag

SEQ ID NO: 571489 - DNA, 20 bp, Artificial Sequence
  chemically synthesized
ctagtgttaatcacatctta

SEQ ID NO: 571490 - DNA, 20 bp, Artificial Sequence
  chemically synthesized
cttgttaagatgtgattaac

SEQ ID NO: 571491 - DNA, 20 bp, Artificial Sequence
  chemically synthesized
gagtcagcctaatgtaatgg

SEQ ID NO: 571492 - DNA, 20 bp, Artificial Sequence
  chemically synthesized
caggtctgcagccatattac

SEQ ID NO: 571493 - DNA, 20 bp, Artificial Sequence
  chemically synthesized
catattacctgggtttgaat

SEQ ID NO: 571494 - DNA, 20 bp, Artificial Sequence
  chemically synthesized
agcccacagctagtaagaag

SEQ ID NO: 571495 - DNA, 20 bp, Artificial Sequence
  chemically synthesized
atcttggcttcttactagct

SEQ ID NO: 571496 - DNA, 20 bp, Artificial Sequence
  chemically synthesized
aataagaagactaaggtata

SEQ ID NO: 571497 - DNA, 20 bp, Artificial Sequence
  chemically synthesized
agataggtactgttgtaatt

SEQ ID NO: 571498 - DNA, 20 bp, Artificial Sequence
  chemically synthesized
ggtcacaggggatatgatgg

SEQ ID NO: 571499 - DNA, 20 bp, Artificial Sequence
  chemically synthesized
gtgcaggtcacaggggatat

SEQ ID NO: 571500 - DNA, 20 bp, Artificial Sequence
  chemically synthesized
acaggccattttcacttctt

SEQ ID NO: 571501 - DNA, 20 bp, Artificial Sequence
  chemically synthesized
ccctggctcatcctggctca

SEQ ID NO: 571502 - DNA, 20 bp, Artificial Sequence
  chemically synthesized
agtcacaaggtgctcagtgg

SEQ ID NO: 571503 - DNA, 20 bp, Artificial Sequence
  chemically synthesized
aaaattacagtcaaatgggg

SEQ ID NO: 571504 - DNA, 20 bp, Artificial Sequence
  chemically synthesized
gacaggggtggggccgtttt

SEQ ID NO: 571505 - DNA, 20 bp, Artificial Sequence
  chemically synthesized
gcaaagggagacaggggtgg

SEQ ID NO: 571506 - DNA, 20 bp, Artificial Sequence
  chemically synthesized
gactcagcccgcctgcatcc

SEQ ID NO: 571507 - DNA, 20 bp, Artificial Sequence
  chemically synthesized
cgcctgcatccaggtgatta

SEQ ID NO: 571508 - DNA, 20 bp, Artificial Sequence
  chemically synthesized
agttttattgctcacacaaa

SEQ ID NO: 571509 - DNA, 20 bp, Artificial Sequence
  chemically synthesized
ccgtgtgaagagaccaccaa

SEQ ID NO: 571510 - DNA, 20 bp, Artificial Sequence
  chemically synthesized
agagtaaaaagaggccgctt

SEQ ID NO: 571511 - DNA, 20 bp, Artificial Sequence
  chemically synthesized
tggaggagagagtaaaaaga

SEQ ID NO: 571512 - DNA, 20 bp, Artificial Sequence
  chemically synthesized
ggagagattgaagtggggcg

SEQ ID NO: 571513 - DNA, 20 bp, Artificial Sequence
  chemically synthesized
gaactgaagttaagagaagg

SEQ ID NO: 571514 - DNA, 20 bp, Artificial Sequence
  chemically synthesized
ttttctggtagagacaggag

SEQ ID NO: 571515 - DNA, 20 bp, Artificial Sequence
  chemically synthesized
tccgagtccgtgaccggtgc

SEQ ID NO: 571516 - DNA, 20 bp, Artificial Sequence
  chemically synthesized
ataatcaggcaggcatcccc

SEQ ID NO: 571517 - DNA, 20 bp, Artificial Sequence
  chemically synthesized
ttaatcacgcggggatgcct

SEQ ID NO: 571518 - DNA, 20 bp, Artificial Sequence
  chemically synthesized
ccttcacctttagcggcaag

SEQ ID NO: 571519 - DNA, 20 bp, Artificial Sequence
  chemically synthesized
tctccatgtctctacccctt

SEQ ID NO: 571520 - DNA, 20 bp, Artificial Sequence
  chemically synthesized
gtgtctctactcccttttct

SEQ ID NO: 571521 - DNA, 20 bp, Artificial Sequence
  chemically synthesized
ttaggtcaggtgtgagttga

SEQ ID NO: 571522 - DNA, 20 bp, Artificial Sequence
  chemically synthesized
cgcagaagaaaataaggcat

SEQ ID NO: 571523 - DNA, 20 bp, Artificial Sequence
  chemically synthesized
ctggctatttggaactactg

SEQ ID NO: 571524 - DNA, 20 bp, Artificial Sequence
  chemically synthesized
taggatggaaaaattgaaag

SEQ ID NO: 571525 - DNA, 20 bp, Artificial Sequence
  chemically synthesized
attttatgacaagaattatt

SEQ ID NO: 571526 - DNA, 20 bp, Artificial Sequence
  chemically synthesized
cctggacatcaggcacctca

SEQ ID NO: 571527 - DNA, 20 bp, Artificial Sequence
  chemically synthesized
gacaggtgggagggaaagaa

SEQ ID NO: 571528 - DNA, 20 bp, Artificial Sequence
  chemically synthesized
ggaagattagaaagactgag

SEQ ID NO: 571529 - DNA, 20 bp, Artificial Sequence
  chemically synthesized
tcagatgggtctgtagaaaa

SEQ ID NO: 571530 - DNA, 20 bp, Artificial Sequence
  chemically synthesized
tgtgaggagcggaggtgata

SEQ ID NO: 571531 - DNA, 20 bp, Artificial Sequence
  chemically synthesized
cctccgctcctcacacccgg

SEQ ID NO: 571532 - DNA, 20 bp, Artificial Sequence
  chemically synthesized
tcctcacacccggtccggct

SEQ ID NO: 571533 - DNA, 20 bp, Artificial Sequence
  chemically synthesized
tttctttatcccaaatcaga

SEQ ID NO: 571534 - DNA, 20 bp, Artificial Sequence
  chemically synthesized
tgaaaaagagcctaaacgct

SEQ ID NO: 571535 - DNA, 20 bp, Artificial Sequence
  chemically synthesized
ccaaacgagccatgaactgg

SEQ ID NO: 571536 - DNA, 20 bp, Artificial Sequence
  chemically synthesized
aaaaacaagcccagttcatg

SEQ ID NO: 571537 - DNA, 20 bp, Artificial Sequence
  chemically synthesized
gttgccaaacgagccatgaa

SEQ ID NO: 571538 - DNA, 20 bp, Artificial Sequence
  chemically synthesized
ctcgtttggcaacaaccctg

SEQ ID NO: 571539 - DNA, 20 bp, Artificial Sequence
  chemically synthesized
ttttggagtttaatgtcggg

SEQ ID NO: 571540 - DNA, 20 bp, Artificial Sequence
  chemically synthesized
gagggctggaatttaatttt

SEQ ID NO: 571541 - DNA, 20 bp, Artificial Sequence
  chemically synthesized
gcgaggttaattaagtcttg

SEQ ID NO: 571542 - DNA, 20 bp, Artificial Sequence
  chemically synthesized
ttctgtgctggagatatggc

SEQ ID NO: 571543 - DNA, 20 bp, Artificial Sequence
  chemically synthesized
cctccagaatggcctccccc

SEQ ID NO: 571544 - DNA, 20 bp, Artificial Sequence
  chemically synthesized
gggcattccttggcccagtg

SEQ ID NO: 571545 - DNA, 20 bp, Artificial Sequence
  chemically synthesized
ggccaaggaatgcccgcagc

SEQ ID NO: 571546 - DNA, 20 bp, Artificial Sequence
  chemically synthesized
ggggtcctccacagatggga

SEQ ID NO: 571547 - DNA, 20 bp, Artificial Sequence
  chemically synthesized
gctgccaggtgagttgaaca

SEQ ID NO: 571548 - DNA, 20 bp, Artificial Sequence
  chemically synthesized
ctgactccttcccagatctt

SEQ ID NO: 571549 - DNA, 20 bp, Artificial Sequence
  chemically synthesized
agtggctgaagactgacgct

SEQ ID NO: 571550 - DNA, 20 bp, Artificial Sequence
  chemically synthesized
tcggcatctgtgatggtcta

SEQ ID NO: 571551 - DNA, 20 bp, Artificial Sequence
  chemically synthesized
tgtggagtgggtagcctccg

SEQ ID NO: 571552 - DNA, 20 bp, Artificial Sequence
  chemically synthesized
acattaccttcttttcaagg

SEQ ID NO: 571553 - DNA, 20 bp, Artificial Sequence
  chemically synthesized
actgttgtaggtattgacgg

SEQ ID NO: 571554 - DNA, 20 bp, Artificial Sequence
  chemically synthesized
accagagtttgggagtttta

SEQ ID NO: 571555 - DNA, 20 bp, Artificial Sequence
  chemically synthesized
ctaagttggcaccagagttt

SEQ ID NO: 571556 - DNA, 20 bp, Artificial Sequence
  chemically synthesized
agtatcgtctaagttggcac

SEQ ID NO: 571557 - DNA, 20 bp, Artificial Sequence
  chemically synthesized
aggtggggataactaaaaag

SEQ ID NO: 571558 - DNA, 20 bp, Artificial Sequence
  chemically synthesized
cgagacactttaactaaatg

SEQ ID NO: 571559 - DNA, 20 bp, Artificial Sequence
  chemically synthesized
gatacaaggggagatgtgaa

SEQ ID NO: 571560 - DNA, 20 bp, Artificial Sequence
  chemically synthesized
aaggagggagtagaggtgtc

SEQ ID NO: 571561 - DNA, 20 bp, Artificial Sequence
  chemically synthesized
ttaatgggatggtaaggggt

SEQ ID NO: 571562 - DNA, 20 bp, Artificial Sequence
  chemically synthesized
attgagcggagtaagggtga

SEQ ID NO: 571563 - DNA, 20 bp, Artificial Sequence
  chemically synthesized
gttggcattgagcggagtaa

SEQ ID NO: 571564 - DNA, 20 bp, Artificial Sequence
  chemically synthesized
tgccaacatcccatcccaca

SEQ ID NO: 571565 - DNA, 20 bp, Artificial Sequence
  chemically synthesized
ccatcccacagcacgcttta

SEQ ID NO: 571566 - DNA, 20 bp, Artificial Sequence
  chemically synthesized
gggaattgtaaggggagttt

SEQ ID NO: 571567 - DNA, 20 bp, Artificial Sequence
  chemically synthesized
taaaatgggggaattgtaag

SEQ ID NO: 571568 - DNA, 20 bp, Artificial Sequence
  chemically synthesized
ttacctgtcctaaaagcaga

SEQ ID NO: 571569 - DNA, 20 bp, Artificial Sequence
  chemically synthesized
tgaactaacctgtaaacctt

SEQ ID NO: 571570 - DNA, 20 bp, Artificial Sequence
  chemically synthesized
gatctgcaccttatcaacca

SEQ ID NO: 571571 - DNA, 20 bp, Artificial Sequence
  chemically synthesized
tattgaggacaggagagtat

SEQ ID NO: 571572 - DNA, 20 bp, Artificial Sequence
  chemically synthesized
tattctgttctggatctcaa

SEQ ID NO: 571573 - DNA, 20 bp, Artificial Sequence
  chemically synthesized
gcaaaggaatagtgaagaaa

SEQ ID NO: 571574 - DNA, 20 bp, Artificial Sequence
  chemically synthesized
ttacctgggctgtactgcct

SEQ ID NO: 571575 - DNA, 20 bp, Artificial Sequence
  chemically synthesized
gtaacaggtgaggaagaaat

SEQ ID NO: 571576 - DNA, 20 bp, Artificial Sequence
  chemically synthesized
atgatcagcagggagagcac

SEQ ID NO: 571577 - DNA, 20 bp, Artificial Sequence
  chemically synthesized
tctagaagggattggggttt

SEQ ID NO: 571578 - DNA, 20 bp, Artificial Sequence
  chemically synthesized
tgttgttttctagaagggat

SEQ ID NO: 571579 - DNA, 20 bp, Artificial Sequence
  chemically synthesized
aaaaacttgttgttttctag

SEQ ID NO: 571580 - DNA, 20 bp, Artificial Sequence
  chemically synthesized
ccaatcccttctagaaaaca

SEQ ID NO: 571581 - DNA, 20 bp, Artificial Sequence
  chemically synthesized
atgcctaggaggaaaaaact

SEQ ID NO: 571582 - DNA, 20 bp, Artificial Sequence
  chemically synthesized
gatactttcgactttagata

SEQ ID NO: 571583 - DNA, 20 bp, Artificial Sequence
  chemically synthesized
ttccttttgtgagtttatat

SEQ ID NO: 571584 - DNA, 20 bp, Artificial Sequence
  chemically synthesized
ggtcagctaggtttcctttt

SEQ ID NO: 571585 - DNA, 20 bp, Artificial Sequence
  chemically synthesized
tttaggatctatggggtcag

SEQ ID NO: 571586 - DNA, 20 bp, Artificial Sequence
  chemically synthesized
gaatggaaagaggagtgggg

SEQ ID NO: 571587 - DNA, 20 bp, Artificial Sequence
  chemically synthesized
tcctctttccattccttgaa

SEQ ID NO: 571588 - DNA, 20 bp, Artificial Sequence
  chemically synthesized
tgaagtgcagggctgtgcag

SEQ ID NO: 571589 - DNA, 20 bp, Artificial Sequence
  chemically synthesized
ttatccaaacaacttgacct

SEQ ID NO: 571590 - DNA, 20 bp, Artificial Sequence
  chemically synthesized
taggcaaaacagtaaggtca

SEQ ID NO: 571591 - DNA, 20 bp, Artificial Sequence
  chemically synthesized
gagagtgagttgagcatagt

SEQ ID NO: 571592 - DNA, 20 bp, Artificial Sequence
  chemically synthesized
actgtagagagtgagttgag

SEQ ID NO: 571593 - DNA, 20 bp, Artificial Sequence
  chemically synthesized
gcgtcaggtgtgaggaagaa

SEQ ID NO: 571594 - DNA, 20 bp, Artificial Sequence
  chemically synthesized
ttcttcctcacacctgacgc

SEQ ID NO: 571595 - DNA, 20 bp, Artificial Sequence
  chemically synthesized
tatcaggaataatgtgggag

SEQ ID NO: 571596 - DNA, 20 bp, Artificial Sequence
  chemically synthesized
tgttcctcaccctgatcaca

SEQ ID NO: 571597 - DNA, 20 bp, Artificial Sequence
  chemically synthesized
gaagttctaagaggcaggct

SEQ ID NO: 571598 - DNA, 20 bp, Artificial Sequence
  chemically synthesized
tgagaagttatttctttgag

SEQ ID NO: 571599 - DNA, 20 bp, Artificial Sequence
  chemically synthesized
tctgctattctactactcct

SEQ ID NO: 571600 - DNA, 20 bp, Artificial Sequence
  chemically synthesized
ccttccccacacatcaagtt

SEQ ID NO: 571601 - DNA, 20 bp, Artificial Sequence
  chemically synthesized
cccccgcccaggactggcaa

SEQ ID NO: 571602 - DNA, 20 bp, Artificial Sequence
  chemically synthesized
ttttagtttcttgactcggg

SEQ ID NO: 571603 - DNA, 20 bp, Artificial Sequence
  chemically synthesized
ctacctagaccaagaggtat

SEQ ID NO: 571604 - DNA, 20 bp, Artificial Sequence
  chemically synthesized
cccacagggaaacataattc

SEQ ID NO: 571605 - DNA, 20 bp, Artificial Sequence
  chemically synthesized
gggaaggccaaaccgaggaa

SEQ ID NO: 571606 - DNA, 20 bp, Artificial Sequence
  chemically synthesized
tttattagtcaaatcaccca

SEQ ID NO: 571607 - DNA, 20 bp, Artificial Sequence
  chemically synthesized
aagagcctgagaaactgctt

SEQ ID NO: 571608 - DNA, 20 bp, Artificial Sequence
  chemically synthesized
tgaatactaagagcctgaga

SEQ ID NO: 571609 - DNA, 20 bp, Artificial Sequence
  chemically synthesized
tggtggctgagcttggtgag

SEQ ID NO: 571610 - DNA, 20 bp, Artificial Sequence
  chemically synthesized
agtcctttttaagttggtgg

SEQ ID NO: 571611 - DNA, 20 bp, Artificial Sequence
  chemically synthesized
ataaaaaggagcgtccatac

SEQ ID NO: 571612 - DNA, 20 bp, Artificial Sequence
  chemically synthesized
gacagaagataggagggatg

SEQ ID NO: 571613 - DNA, 20 bp, Artificial Sequence
  chemically synthesized
actagtcataaatgccctgc

SEQ ID NO: 571614 - DNA, 20 bp, Artificial Sequence
  chemically synthesized
gccctgctcttgtttacact

SEQ ID NO: 571615 - DNA, 20 bp, Artificial Sequence
  chemically synthesized
ttgtttacactgctggttta

SEQ ID NO: 571616 - DNA, 20 bp, Artificial Sequence
  chemically synthesized
caccaagagatatcagctgt

SEQ ID NO: 571617 - DNA, 20 bp, Artificial Sequence
  chemically synthesized
ttactttaagagttaagagt

SEQ ID NO: 571618 - DNA, 20 bp, Artificial Sequence
  chemically synthesized
gttcagcatagccttgccag

SEQ ID NO: 571619 - DNA, 20 bp, Artificial Sequence
  chemically synthesized
ccaattcttcgtcctttaat

SEQ ID NO: 571620 - DNA, 20 bp, Artificial Sequence
  chemically synthesized
ctgtttttctccttctctta

SEQ ID NO: 571621 - DNA, 20 bp, Artificial Sequence
  chemically synthesized
tttctccttctcttattccg

SEQ ID NO: 571622 - DNA, 20 bp, Artificial Sequence
  chemically synthesized
attattggtgatggcctgga

SEQ ID NO: 571623 - DNA, 20 bp, Artificial Sequence
  chemically synthesized
caccaataattctacatgac

SEQ ID NO: 571624 - DNA, 20 bp, Artificial Sequence
  chemically synthesized
cccttaccacaaaatcttcc

SEQ ID NO: 571625 - DNA, 20 bp, Artificial Sequence
  chemically synthesized
gtgggagggattaagctgaa

SEQ ID NO: 571626 - DNA, 20 bp, Artificial Sequence
  chemically synthesized
ggcgtgggaacctagagtgg

SEQ ID NO: 571627 - DNA, 20 bp, Artificial Sequence
  chemically synthesized
taatgggtgatgtttctcag

SEQ ID NO: 571628 - DNA, 20 bp, Artificial Sequence
  chemically synthesized
tggtgtggagagataatggg

SEQ ID NO: 571629 - DNA, 20 bp, Artificial Sequence
  chemically synthesized
gccccaacacttcaacacta

SEQ ID NO: 571630 - DNA, 20 bp, Artificial Sequence
  chemically synthesized
ggtcacaggggatatgatgg

SEQ ID NO: 571631 - DNA, 20 bp, Artificial Sequence
  chemically synthesized
gtgtaggtcacaggggatat

SEQ ID NO: 571632 - DNA, 20 bp, Artificial Sequence
  chemically synthesized
ccatttaaatttcacttctt

SEQ ID NO: 571633 - DNA, 20 bp, Artificial Sequence
  chemically synthesized
gatcacaaggtgctcagtgg

SEQ ID NO: 571634 - DNA, 20 bp, Artificial Sequence
  chemically synthesized
gataggggtagggccgttct

SEQ ID NO: 571635 - DNA, 20 bp, Artificial Sequence
  chemically synthesized
gactcagctcgcctgcgccc

SEQ ID NO: 571636 - DNA, 20 bp, Artificial Sequence
  chemically synthesized
cgcctgcgcccaggtgatta

SEQ ID NO: 571637 - DNA, 20 bp, Artificial Sequence
  chemically synthesized
aacagtctttgtgtgagcaa

SEQ ID NO: 571638 - DNA, 20 bp, Artificial Sequence
  chemically synthesized
agctttattgctcacacaaa

SEQ ID NO: 571639 - DNA, 20 bp, Artificial Sequence
  chemically synthesized
atagatatgaagtacgtaga

SEQ ID NO: 571640 - DNA, 20 bp, Artificial Sequence
  chemically synthesized
tgggccacagttccaggctt

SEQ ID NO: 571641 - DNA, 20 bp, Artificial Sequence
  chemically synthesized
tctcactttgggccacagtt

SEQ ID NO: 571642 - DNA, 20 bp, Artificial Sequence
  chemically synthesized
cccaaagtgagaacttacat

SEQ ID NO: 571643 - DNA, 20 bp, Artificial Sequence
  chemically synthesized
ggagggcagggtgggctatg

SEQ ID NO: 571644 - DNA, 20 bp, Artificial Sequence
  chemically synthesized
ctcctctgtgccggctgagc

SEQ ID NO: 571645 - DNA, 20 bp, Artificial Sequence
  chemically synthesized
aaccatagtttccaacatcc

SEQ ID NO: 571646 - DNA, 20 bp, Artificial Sequence
  chemically synthesized
acttctctccaatgcacaac

SEQ ID NO: 571647 - DNA, 20 bp, Artificial Sequence
  chemically synthesized
atggttgtgcattggagaga

SEQ ID NO: 571648 - DNA, 20 bp, Artificial Sequence
  chemically synthesized
tccgagggacagcctggcag

SEQ ID NO: 571649 - DNA, 20 bp, Artificial Sequence
  chemically synthesized
cagcatagcttcagagagga

SEQ ID NO: 571650 - DNA, 20 bp, Artificial Sequence
  chemically synthesized
gcggacagctggactcgagg

SEQ ID NO: 571651 - DNA, 20 bp, Artificial Sequence
  chemically synthesized
taattggagatggtaaatgc

SEQ ID NO: 571652 - DNA, 20 bp, Artificial Sequence
  chemically synthesized
ccccgcatttaccatctcca

SEQ ID NO: 571653 - DNA, 20 bp, Artificial Sequence
  chemically synthesized
ttttatctttgccatctgca

SEQ ID NO: 571654 - DNA, 20 bp, Artificial Sequence
  chemically synthesized
gggccctgtaacactccttc

SEQ ID NO: 571655 - DNA, 20 bp, Artificial Sequence
  chemically synthesized
acactgccatggggcccaca

SEQ ID NO: 571656 - DNA, 20 bp, Artificial Sequence
  chemically synthesized
gtgggtacaggagccagggt

SEQ ID NO: 571657 - DNA, 20 bp, Artificial Sequence
  chemically synthesized
tggctcctgtacccactcac

SEQ ID NO: 571658 - DNA, 20 bp, Artificial Sequence
  chemically synthesized
gggcgggaactggactgcat

SEQ ID NO: 571659 - DNA, 20 bp, Artificial Sequence
  chemically synthesized
gcgaggggatcagggtaata

SEQ ID NO: 571660 - DNA, 20 bp, Artificial Sequence
  chemically synthesized
actactactactactactac

SEQ ID NO: 571661 - DNA, 20 bp, Artificial Sequence
  chemically synthesized
ttagcttcatagatatcaat

SEQ ID NO: 571662 - DNA, 20 bp, Artificial Sequence
  chemically synthesized
tatcaattcttgctttttgg

SEQ ID NO: 571663 - DNA, 20 bp, Artificial Sequence
  chemically synthesized
ggggaaatgagtctacattt

SEQ ID NO: 571664 - DNA, 20 bp, Artificial Sequence
  chemically synthesized
tgtagactcatttcccccat

SEQ ID NO: 571665 - DNA, 20 bp, Artificial Sequence
  chemically synthesized
tcatttcccccatgcaggtt

SEQ ID NO: 571666 - DNA, 20 bp, Artificial Sequence
  chemically synthesized
gacattagggcacaatttag

SEQ ID NO: 571667 - DNA, 20 bp, Artificial Sequence
  chemically synthesized
aggttttgtctctgctttgc

SEQ ID NO: 571668 - DNA, 20 bp, Artificial Sequence
  chemically synthesized
gaggaaacaataggttttgt

SEQ ID NO: 571669 - DNA, 20 bp, Artificial Sequence
  chemically synthesized
agcaaagcagagacaaaacc

SEQ ID NO: 571670 - DNA, 20 bp, Artificial Sequence
  chemically synthesized
ttatacagggagaggaaaca

SEQ ID NO: 571671 - DNA, 20 bp, Artificial Sequence
  chemically synthesized
gacagaaaagggcaaccggc

SEQ ID NO: 571672 - DNA, 20 bp, Artificial Sequence
  chemically synthesized
catttttgaggtcatgagag

SEQ ID NO: 571673 - DNA, 20 bp, Artificial Sequence
  chemically synthesized
tctcatgacctcaaaaatgg

SEQ ID NO: 571674 - DNA, 20 bp, Artificial Sequence
  chemically synthesized
tgagttaaattgcagctggg

SEQ ID NO: 571675 - DNA, 20 bp, Artificial Sequence
  chemically synthesized
gagctgagaaaccctctacc

SEQ ID NO: 571676 - DNA, 20 bp, Artificial Sequence
  chemically synthesized
gggcccataatcattgggta

SEQ ID NO: 571677 - DNA, 20 bp, Artificial Sequence
  chemically synthesized
agtcctccacgtttccattt

SEQ ID NO: 571678 - DNA, 20 bp, Artificial Sequence
  chemically synthesized
tgagaattatttgaagtcct

SEQ ID NO: 571679 - DNA, 20 bp, Artificial Sequence
  chemically synthesized
gtgtattctcaagggacttt

SEQ ID NO: 571680 - DNA, 20 bp, Artificial Sequence
  chemically synthesized
ggaaagcctaatgttttatc

SEQ ID NO: 571681 - DNA, 20 bp, Artificial Sequence
  chemically synthesized
aaaaagcggctgataaaaca

SEQ ID NO: 571682 - DNA, 20 bp, Artificial Sequence
  chemically synthesized
tgggcaatttttggaaagcc

SEQ ID NO: 571683 - DNA, 20 bp, Artificial Sequence
  chemically synthesized
aattcctacatgaaggttca

SEQ ID NO: 571684 - DNA, 20 bp, Artificial Sequence
  chemically synthesized
ctctcctgaggtagatttgt

SEQ ID NO: 571685 - DNA, 20 bp, Artificial Sequence
  chemically synthesized
aattaactctcctgaggtag

SEQ ID NO: 571686 - DNA, 20 bp, Artificial Sequence
  chemically synthesized
aggtgaattaactctcctga

SEQ ID NO: 571687 - DNA, 20 bp, Artificial Sequence
  chemically synthesized
atctactattcatttagcag

SEQ ID NO: 571688 - DNA, 20 bp, Artificial Sequence
  chemically synthesized
ctactgccgttgaaatggct

SEQ ID NO: 571689 - DNA, 20 bp, Artificial Sequence
  chemically synthesized
atttcaacggcagtaggaag

SEQ ID NO: 571690 - DNA, 20 bp, Artificial Sequence
  chemically synthesized
gctctccatagcactgatgt

SEQ ID NO: 571691 - DNA, 20 bp, Artificial Sequence
  chemically synthesized
tagttaggatgtctgcagtt

SEQ ID NO: 571692 - DNA, 20 bp, Artificial Sequence
  chemically synthesized
gttgtcagattagacaggca

SEQ ID NO: 571693 - DNA, 20 bp, Artificial Sequence
  chemically synthesized
gcaagatgttttggaaacat

SEQ ID NO: 571694 - DNA, 20 bp, Artificial Sequence
  chemically synthesized
ttaaacatttcctgaaacaa

SEQ ID NO: 571695 - DNA, 20 bp, Artificial Sequence
  chemically synthesized
ggaaacatatttgtttcagg

SEQ ID NO: 571696 - DNA, 20 bp, Artificial Sequence
  chemically synthesized
ggatggccacagaaccctgt

SEQ ID NO: 571697 - DNA, 20 bp, Artificial Sequence
  chemically synthesized
ttcacaaacatggatatatt

SEQ ID NO: 571698 - DNA, 20 bp, Artificial Sequence
  chemically synthesized
aattaaatctattaatatat

SEQ ID NO: 571699 - DNA, 20 bp, Artificial Sequence
  chemically synthesized
tgactaatgaagatatttat

SEQ ID NO: 571700 - DNA, 20 bp, Artificial Sequence
  chemically synthesized
ctcatatgctctataaatat

SEQ ID NO: 571701 - DNA, 20 bp, Artificial Sequence
  chemically synthesized
atatatttatagagcatatg

SEQ ID NO: 571702 - DNA, 20 bp, Artificial Sequence
  chemically synthesized
tgcaatgtgaaatcagcaca

SEQ ID NO: 571703 - DNA, 20 bp, Artificial Sequence
  chemically synthesized
ttaatataaaaagcataatg

SEQ ID NO: 571704 - DNA, 20 bp, Artificial Sequence
  chemically synthesized
gagatggtacctcattgtgg

SEQ ID NO: 571705 - DNA, 20 bp, Artificial Sequence
  chemically synthesized
ggtgtgagatggtacctcat

SEQ ID NO: 571706 - DNA, 20 bp, Artificial Sequence
  chemically synthesized
tccacatcctctctggcatc

SEQ ID NO: 571707 - DNA, 20 bp, Artificial Sequence
  chemically synthesized
ctgtcttccacaatggttga

SEQ ID NO: 571708 - DNA, 20 bp, Artificial Sequence
  chemically synthesized
ccattactgggtatataccc

SEQ ID NO: 571709 - DNA, 20 bp, Artificial Sequence
  chemically synthesized
gtgcatgtgtcttcatagca

SEQ ID NO: 571710 - DNA, 20 bp, Artificial Sequence
  chemically synthesized
ctatgaagacacatgcacac

SEQ ID NO: 571711 - DNA, 20 bp, Artificial Sequence
  chemically synthesized
tgcggcactgttcacaatag

SEQ ID NO: 571712 - DNA, 20 bp, Artificial Sequence
  chemically synthesized
caaatgtccatcaatgatag

SEQ ID NO: 571713 - DNA, 20 bp, Artificial Sequence
  chemically synthesized
gtttgctgagaatgatggtt

SEQ ID NO: 571714 - DNA, 20 bp, Artificial Sequence
  chemically synthesized
tgtgatagtttgctgagaat

SEQ ID NO: 571715 - DNA, 20 bp, Artificial Sequence
  chemically synthesized
gtttggttttctgtccttgt

SEQ ID NO: 571716 - DNA, 20 bp, Artificial Sequence
  chemically synthesized
atgagtgagaacatgcaatg

SEQ ID NO: 571717 - DNA, 20 bp, Artificial Sequence
  chemically synthesized
cacttatgagtgagaacatg

SEQ ID NO: 571718 - DNA, 20 bp, Artificial Sequence
  chemically synthesized
ggagaacatcacacaccagg

SEQ ID NO: 571719 - DNA, 20 bp, Artificial Sequence
  chemically synthesized
agggtacatgtgcacaacgt

SEQ ID NO: 571720 - DNA, 20 bp, Artificial Sequence
  chemically synthesized
tcttttttttttattattac

SEQ ID NO: 571721 - DNA, 20 bp, Artificial Sequence
  chemically synthesized
aagagatgatgttgatgggg

SEQ ID NO: 571722 - DNA, 20 bp, Artificial Sequence
  chemically synthesized
gaggctgaaaagctggtatt

SEQ ID NO: 571723 - DNA, 20 bp, Artificial Sequence
  chemically synthesized
aaaaacagaaaactgaaaat

SEQ ID NO: 571724 - DNA, 20 bp, Artificial Sequence
  chemically synthesized
aaaagctggtattttcagtt

SEQ ID NO: 571725 - DNA, 20 bp, Artificial Sequence
  chemically synthesized
gaggtaaggcattaaaagtg

SEQ ID NO: 571726 - DNA, 20 bp, Artificial Sequence
  chemically synthesized
gacaggggtctaatccatct

SEQ ID NO: 571727 - DNA, 20 bp, Artificial Sequence
  chemically synthesized
ttaaattctggaaacacaga

SEQ ID NO: 571728 - DNA, 20 bp, Artificial Sequence
  chemically synthesized
tgtgtttccagaatttaaca

SEQ ID NO: 571729 - DNA, 20 bp, Artificial Sequence
  chemically synthesized
ggcacataatggatgctcaa

SEQ ID NO: 571730 - DNA, 20 bp, Artificial Sequence
  chemically synthesized
tcattcattcatcatacagt

SEQ ID NO: 571731 - DNA, 20 bp, Artificial Sequence
  chemically synthesized
aatgaacacatgaagtaaaa

SEQ ID NO: 571732 - DNA, 20 bp, Artificial Sequence
  chemically synthesized
agatagatcaggactctaaa

SEQ ID NO: 571733 - DNA, 20 bp, Artificial Sequence
  chemically synthesized
attgaaaccaaagagttcct

SEQ ID NO: 571734 - DNA, 20 bp, Artificial Sequence
  chemically synthesized
atctaatcacaaaggaactc

SEQ ID NO: 571735 - DNA, 20 bp, Artificial Sequence
  chemically synthesized
tatgacagtcacaactactt

SEQ ID NO: 571736 - DNA, 20 bp, Artificial Sequence
  chemically synthesized
caagtagttgtgactgtcat

SEQ ID NO: 571737 - DNA, 20 bp, Artificial Sequence
  chemically synthesized
tcagctgtctttagctctgc

SEQ ID NO: 571738 - DNA, 20 bp, Artificial Sequence
  chemically synthesized
gctctgcagtagttttttta

SEQ ID NO: 571739 - DNA, 20 bp, Artificial Sequence
  chemically synthesized
catatactcaggtgttcctg

SEQ ID NO: 571740 - DNA, 20 bp, Artificial Sequence
  chemically synthesized
gaatattgctcttttttgcg

SEQ ID NO: 571741 - DNA, 20 bp, Artificial Sequence
  chemically synthesized
acaggttatgaagccaaaca

SEQ ID NO: 571742 - DNA, 20 bp, Artificial Sequence
  chemically synthesized
cactagtcctaatcactgtg

SEQ ID NO: 571743 - DNA, 20 bp, Artificial Sequence
  chemically synthesized
aagtccactagtcctaatca

SEQ ID NO: 571744 - DNA, 20 bp, Artificial Sequence
  chemically synthesized
tgattaggactagtggactt

SEQ ID NO: 571745 - DNA, 20 bp, Artificial Sequence
  chemically synthesized
caaatgtacttaatgtcaac

SEQ ID NO: 571746 - DNA, 20 bp, Artificial Sequence
  chemically synthesized
tggttgacattaagtacatt

SEQ ID NO: 571747 - DNA, 20 bp, Artificial Sequence
  chemically synthesized
attaagtacatttgtggatt

SEQ ID NO: 571748 - DNA, 20 bp, Artificial Sequence
  chemically synthesized
aacttgccaagggagtcaca

SEQ ID NO: 571749 - DNA, 20 bp, Artificial Sequence
  chemically synthesized
ttgatggaacaatgaccatt

SEQ ID NO: 571750 - DNA, 20 bp, Artificial Sequence
  chemically synthesized
gtatgatctgaaatctacag

SEQ ID NO: 571751 - DNA, 20 bp, Artificial Sequence
  chemically synthesized
aaaatgacagaaagcatggc

SEQ ID NO: 571752 - DNA, 20 bp, Artificial Sequence
  chemically synthesized
tgtaaattaattcttttttt

SEQ ID NO: 571753 - DNA, 20 bp, Artificial Sequence
  chemically synthesized
gaggcagaggatgcagtgag

SEQ ID NO: 571754 - DNA, 20 bp, Artificial Sequence
  chemically synthesized
gcatgcaccactatgcctgg

SEQ ID NO: 571755 - DNA, 20 bp, Artificial Sequence
  chemically synthesized
ttttgtatttttagtagaga

SEQ ID NO: 571756 - DNA, 20 bp, Artificial Sequence
  chemically synthesized
cgccttggcctccaaaagtg

SEQ ID NO: 571757 - DNA, 20 bp, Artificial Sequence
  chemically synthesized
attcttttaaatgttatata

SEQ ID NO: 571758 - DNA, 20 bp, Artificial Sequence
  chemically synthesized
aagtccttgaggcaagacta

SEQ ID NO: 571759 - DNA, 20 bp, Artificial Sequence
  chemically synthesized
caaggactttttatgtgttg

SEQ ID NO: 571760 - DNA, 20 bp, Artificial Sequence
  chemically synthesized
gaacaactctctagcgtctt

SEQ ID NO: 571761 - DNA, 20 bp, Artificial Sequence
  chemically synthesized
ttgttatatgataattgtgt

SEQ ID NO: 571762 - DNA, 20 bp, Artificial Sequence
  chemically synthesized
acttgtttatcatctttctt

SEQ ID NO: 571763 - DNA, 20 bp, Artificial Sequence
  chemically synthesized
atcatctttcttctttgttt

SEQ ID NO: 571764 - DNA, 20 bp, Artificial Sequence
  chemically synthesized
actccagcctgggtgactga

SEQ ID NO: 571765 - DNA, 20 bp, Artificial Sequence
  chemically synthesized
aatggcatgaacctgggagc

SEQ ID NO: 571766 - DNA, 20 bp, Artificial Sequence
  chemically synthesized
aaatacaaaaaaaaaattag

SEQ ID NO: 571767 - DNA, 20 bp, Artificial Sequence
  chemically synthesized
ttttgtatttttagtagaga

SEQ ID NO: 571768 - DNA, 20 bp, Artificial Sequence
  chemically synthesized
cgccttggcctcccaaagtg

SEQ ID NO: 571769 - DNA, 20 bp, Artificial Sequence
  chemically synthesized
gacaaaacccctgccctcag

SEQ ID NO: 571770 - DNA, 20 bp, Artificial Sequence
  chemically synthesized
atgtaagctctcctgagggc

SEQ ID NO: 571771 - DNA, 20 bp, Artificial Sequence
  chemically synthesized
tcctgagggcaggggttttg

SEQ ID NO: 571772 - DNA, 20 bp, Artificial Sequence
  chemically synthesized
ggcaggggttttgtcttgtt

SEQ ID NO: 571773 - DNA, 20 bp, Artificial Sequence
  chemically synthesized
accctgaagactttttagct

SEQ ID NO: 571774 - DNA, 20 bp, Artificial Sequence
  chemically synthesized
actcctagctaaaaagtctt

SEQ ID NO: 571775 - DNA, 20 bp, Artificial Sequence
  chemically synthesized
tcagggtttcttaggtgtaa

SEQ ID NO: 571776 - DNA, 20 bp, Artificial Sequence
  chemically synthesized
ttctcaacttggtgtgttaa

SEQ ID NO: 571777 - DNA, 20 bp, Artificial Sequence
  chemically synthesized
gctttaattatctaataatt

SEQ ID NO: 571778 - DNA, 20 bp, Artificial Sequence
  chemically synthesized
aattaaagcgaaaaaagaca

SEQ ID NO: 571779 - DNA, 20 bp, Artificial Sequence
  chemically synthesized
taggtaaacttaatgtcttt

SEQ ID NO: 571780 - DNA, 20 bp, Artificial Sequence
  chemically synthesized
caccttggcctcctaaagtg

SEQ ID NO: 571781 - DNA, 20 bp, Artificial Sequence
  chemically synthesized
tgggcggatcacctgaggtc

SEQ ID NO: 571782 - DNA, 20 bp, Artificial Sequence
  chemically synthesized
tttttgtatttttagtagag

SEQ ID NO: 571783 - DNA, 20 bp, Artificial Sequence
  chemically synthesized
tggcaggcacttgtaatccc

SEQ ID NO: 571784 - DNA, 20 bp, Artificial Sequence
  chemically synthesized
tgcctcagcctcccaagcag

SEQ ID NO: 571785 - DNA, 20 bp, Artificial Sequence
  chemically synthesized
ttgggaggctgaggcaggag

SEQ ID NO: 571786 - DNA, 20 bp, Artificial Sequence
  chemically synthesized
tgttttttggttttgttttg

SEQ ID NO: 571787 - DNA, 20 bp, Artificial Sequence
  chemically synthesized
tcaaatgttttttggttttg

SEQ ID NO: 571788 - DNA, 20 bp, Artificial Sequence
  chemically synthesized
tggtctcaaatgttttttgg

SEQ ID NO: 571789 - DNA, 20 bp, Artificial Sequence
  chemically synthesized
tccaatggtctcaaatgttt

SEQ ID NO: 571790 - DNA, 20 bp, Artificial Sequence
  chemically synthesized
tcagctcttccaatggtctc

SEQ ID NO: 571791 - DNA, 20 bp, Artificial Sequence
  chemically synthesized
taacttttcctaataggatg

SEQ ID NO: 571792 - DNA, 20 bp, Artificial Sequence
  chemically synthesized
actacttttgcaaattttct

SEQ ID NO: 571793 - DNA, 20 bp, Artificial Sequence
  chemically synthesized
ccaacttcttttactaggaa

SEQ ID NO: 571794 - DNA, 20 bp, Artificial Sequence
  chemically synthesized
ctgcccaagaaatgtctgca

SEQ ID NO: 571795 - DNA, 20 bp, Artificial Sequence
  chemically synthesized
aataagtcagctggagcatc

SEQ ID NO: 571796 - DNA, 20 bp, Artificial Sequence
  chemically synthesized
tattcattatcttgggggag

SEQ ID NO: 571797 - DNA, 20 bp, Artificial Sequence
  chemically synthesized
catttgatgacgttggataa

SEQ ID NO: 571798 - DNA, 20 bp, Artificial Sequence
  chemically synthesized
ccattttatccaacgtcatc

SEQ ID NO: 571799 - DNA, 20 bp, Artificial Sequence
  chemically synthesized
ttataaggaagaatattctg

SEQ ID NO: 571800 - DNA, 20 bp, Artificial Sequence
  chemically synthesized
ttataaataacaggaggtgc

SEQ ID NO: 571801 - DNA, 20 bp, Artificial Sequence
  chemically synthesized
aaatgagaaaataatggtac

SEQ ID NO: 571802 - DNA, 20 bp, Artificial Sequence
  chemically synthesized
gactacaatacagtgccata

SEQ ID NO: 571803 - DNA, 20 bp, Artificial Sequence
  chemically synthesized
ctgtattgtagtcttcccca

SEQ ID NO: 571804 - DNA, 20 bp, Artificial Sequence
  chemically synthesized
gactgatatcagctgcctag

SEQ ID NO: 571805 - DNA, 20 bp, Artificial Sequence
  chemically synthesized
ggcagctgatatcagtcaat

SEQ ID NO: 571806 - DNA, 20 bp, Artificial Sequence
  chemically synthesized
gctgatatcagtcaataaga

SEQ ID NO: 571807 - DNA, 20 bp, Artificial Sequence
  chemically synthesized
ataagataaagatgccgaaa

SEQ ID NO: 571808 - DNA, 20 bp, Artificial Sequence
  chemically synthesized
atctgtgattataatagaat

SEQ ID NO: 571809 - DNA, 20 bp, Artificial Sequence
  chemically synthesized
aactcagattctattataat

SEQ ID NO: 571810 - DNA, 20 bp, Artificial Sequence
  chemically synthesized
tattataatcacagattatc

SEQ ID NO: 571811 - DNA, 20 bp, Artificial Sequence
  chemically synthesized
taagctaatcaatggataat

SEQ ID NO: 571812 - DNA, 20 bp, Artificial Sequence
  chemically synthesized
taatcacagattatccattg

SEQ ID NO: 571813 - DNA, 20 bp, Artificial Sequence
  chemically synthesized
attatccattgattagctta

SEQ ID NO: 571814 - DNA, 20 bp, Artificial Sequence
  chemically synthesized
agtagggcacagaagtgtag

SEQ ID NO: 571815 - DNA, 20 bp, Artificial Sequence
  chemically synthesized
aatggaatagacacatctaa

SEQ ID NO: 571816 - DNA, 20 bp, Artificial Sequence
  chemically synthesized
ttttcttgaatatcctaaga

SEQ ID NO: 571817 - DNA, 20 bp, Artificial Sequence
  chemically synthesized
tccaatatactttaagaatc

SEQ ID NO: 571818 - DNA, 20 bp, Artificial Sequence
  chemically synthesized
taaacagatggtagaaaaac

SEQ ID NO: 571819 - DNA, 20 bp, Artificial Sequence
  chemically synthesized
gaatcctttgtttttctacc

SEQ ID NO: 571820 - DNA, 20 bp, Artificial Sequence
  chemically synthesized
ctttgtttttctaccatctg

SEQ ID NO: 571821 - DNA, 20 bp, Artificial Sequence
  chemically synthesized
cagaactgaagttagagtgt

SEQ ID NO: 571822 - DNA, 20 bp, Artificial Sequence
  chemically synthesized
atagagctcagtggataaac

SEQ ID NO: 571823 - DNA, 20 bp, Artificial Sequence
  chemically synthesized
ctctagaatggcactcaagc

SEQ ID NO: 571824 - DNA, 20 bp, Artificial Sequence
  chemically synthesized
ttctctggctcagctgtcat

SEQ ID NO: 571825 - DNA, 20 bp, Artificial Sequence
  chemically synthesized
gagatagggaagtggctgaa

SEQ ID NO: 571826 - DNA, 20 bp, Artificial Sequence
  chemically synthesized
tttcagccacttccctatct

SEQ ID NO: 571827 - DNA, 20 bp, Artificial Sequence
  chemically synthesized
atctcagataatttagaagt

SEQ ID NO: 571828 - DNA, 20 bp, Artificial Sequence
  chemically synthesized
aagtatatgattttaaaaat

SEQ ID NO: 571829 - DNA, 20 bp, Artificial Sequence
  chemically synthesized
attgatacttgatcagaaag

SEQ ID NO: 571830 - DNA, 20 bp, Artificial Sequence
  chemically synthesized
ctcagataatttgggagggt

SEQ ID NO: 571831 - DNA, 20 bp, Artificial Sequence
  chemically synthesized
gggagggtgtgggattcgta

SEQ ID NO: 571832 - DNA, 20 bp, Artificial Sequence
  chemically synthesized
gatggctttcggtctgggct

SEQ ID NO: 571833 - DNA, 20 bp, Artificial Sequence
  chemically synthesized
agtgatggatggctttcggt

SEQ ID NO: 571834 - DNA, 20 bp, Artificial Sequence
  chemically synthesized
gaataaatgtgtaagtgatg

SEQ ID NO: 571835 - DNA, 20 bp, Artificial Sequence
  chemically synthesized
aattctgagatgtcatattc

SEQ ID NO: 571836 - DNA, 20 bp, Artificial Sequence
  chemically synthesized
actgacttctcttctcctac

SEQ ID NO: 571837 - DNA, 20 bp, Artificial Sequence
  chemically synthesized
tctgcttgacttctttttct

SEQ ID NO: 571838 - DNA, 20 bp, Artificial Sequence
  chemically synthesized
ttctttttcttgaagtttat

SEQ ID NO: 571839 - DNA, 20 bp, Artificial Sequence
  chemically synthesized
cccttccctctttacatgct

SEQ ID NO: 571840 - DNA, 20 bp, Artificial Sequence
  chemically synthesized
tgtatcaatatttttctcat

SEQ ID NO: 571841 - DNA, 20 bp, Artificial Sequence
  chemically synthesized
acagttcagttttagacatg

SEQ ID NO: 571842 - DNA, 20 bp, Artificial Sequence
  chemically synthesized
gatttggaaaagatcaacag

SEQ ID NO: 571843 - DNA, 20 bp, Artificial Sequence
  chemically synthesized
gaactgttgatcttttccaa

SEQ ID NO: 571844 - DNA, 20 bp, Artificial Sequence
  chemically synthesized
gtgataaagatggaggagga

SEQ ID NO: 571845 - DNA, 20 bp, Artificial Sequence
  chemically synthesized
tttgtttgatcaacttgttg

SEQ ID NO: 571846 - DNA, 20 bp, Artificial Sequence
  chemically synthesized
gaggatgactcccaagtttt

SEQ ID NO: 571847 - DNA, 20 bp, Artificial Sequence
  chemically synthesized
tgagggattgaggatgactc

SEQ ID NO: 571848 - DNA, 20 bp, Artificial Sequence
  chemically synthesized
atggattagatgtcaggcat

SEQ ID NO: 571849 - DNA, 20 bp, Artificial Sequence
  chemically synthesized
caaaatctgtatgacttggt

SEQ ID NO: 571850 - DNA, 20 bp, Artificial Sequence
  chemically synthesized
tctaatccatcaccaagtca

SEQ ID NO: 571851 - DNA, 20 bp, Artificial Sequence
  chemically synthesized
aatggaaatagagagaaatg

SEQ ID NO: 571852 - DNA, 20 bp, Artificial Sequence
  chemically synthesized
aaatgcctcttacctggcct

SEQ ID NO: 571853 - DNA, 20 bp, Artificial Sequence
  chemically synthesized
gatggacctgctgtataaat

SEQ ID NO: 571854 - DNA, 20 bp, Artificial Sequence
  chemically synthesized
ctcatttatacagcaggtcc

SEQ ID NO: 571855 - DNA, 20 bp, Artificial Sequence
  chemically synthesized
agcaggtccatcagattgta

SEQ ID NO: 571856 - DNA, 20 bp, Artificial Sequence
  chemically synthesized
aggtgtactttcacaggtac

SEQ ID NO: 571857 - DNA, 20 bp, Artificial Sequence
  chemically synthesized
tacgtcagattatattattt

SEQ ID NO: 571858 - DNA, 20 bp, Artificial Sequence
  chemically synthesized
agtggtacaggacaaggctg

SEQ ID NO: 571859 - DNA, 20 bp, Artificial Sequence
  chemically synthesized
ttcatatgactgacctaacc

SEQ ID NO: 571860 - DNA, 20 bp, Artificial Sequence
  chemically synthesized
gactgacctaaccttcagat

SEQ ID NO: 571861 - DNA, 20 bp, Artificial Sequence
  chemically synthesized
taagtagctggaagtacaga

SEQ ID NO: 571862 - DNA, 20 bp, Artificial Sequence
  chemically synthesized
cgcctcggggtcccaaagtg

SEQ ID NO: 571863 - DNA, 20 bp, Artificial Sequence
  chemically synthesized
tttgtgccagacaatatgcc

SEQ ID NO: 571864 - DNA, 20 bp, Artificial Sequence
  chemically synthesized
tatgccgggtgtttggacta

SEQ ID NO: 571865 - DNA, 20 bp, Artificial Sequence
  chemically synthesized
catctcagcctcccaaagtg

SEQ ID NO: 571866 - DNA, 20 bp, Artificial Sequence
  chemically synthesized
ttttgtatttttaggagaca

SEQ ID NO: 571867 - DNA, 20 bp, Artificial Sequence
  chemically synthesized
tgcctcagcctcctgagtag

SEQ ID NO: 571868 - DNA, 20 bp, Artificial Sequence
  chemically synthesized
tcaggaggctgaggcaggag

SEQ ID NO: 571869 - DNA, 20 bp, Artificial Sequence
  chemically synthesized
ttttttgcttgctttttgtt

SEQ ID NO: 571870 - DNA, 20 bp, Artificial Sequence
  chemically synthesized
ggccgttttttttgcttgct

SEQ ID NO: 571871 - DNA, 20 bp, Artificial Sequence
  chemically synthesized
aatgtgtggccgtttttttt

SEQ ID NO: 571872 - DNA, 20 bp, Artificial Sequence
  chemically synthesized
actaaatgtgtggccgtttt

SEQ ID NO: 571873 - DNA, 20 bp, Artificial Sequence
  chemically synthesized
atttttcctactaaatgtgt

SEQ ID NO: 571874 - DNA, 20 bp, Artificial Sequence
  chemically synthesized
tttagtaggaaaaatcaaga

SEQ ID NO: 571875 - DNA, 20 bp, Artificial Sequence
  chemically synthesized
cactctatttataaaccttt

SEQ ID NO: 571876 - DNA, 20 bp, Artificial Sequence
  chemically synthesized
tccactctcccttttttctc

SEQ ID NO: 571877 - DNA, 20 bp, Artificial Sequence
  chemically synthesized
ctatttccacacacacaaaa

SEQ ID NO: 571878 - DNA, 20 bp, Artificial Sequence
  chemically synthesized
gaaactaagaaattgactat

SEQ ID NO: 571879 - DNA, 20 bp, Artificial Sequence
  chemically synthesized
aaagcactgatagtcaattt

SEQ ID NO: 571880 - DNA, 20 bp, Artificial Sequence
  chemically synthesized
gagatgttagggagacatgc

SEQ ID NO: 571881 - DNA, 20 bp, Artificial Sequence
  chemically synthesized
aggaagagtggcagttcttg

SEQ ID NO: 571882 - DNA, 20 bp, Artificial Sequence
  chemically synthesized
tgcatttgctatccttagcc

SEQ ID NO: 571883 - DNA, 20 bp, Artificial Sequence
  chemically synthesized
aaatgcaaagatggaaagac

SEQ ID NO: 571884 - DNA, 20 bp, Artificial Sequence
  chemically synthesized
caaaattggtttattagctc

SEQ ID NO: 571885 - DNA, 20 bp, Artificial Sequence
  chemically synthesized
aagagaaagatatacccaaa

SEQ ID NO: 571886 - DNA, 20 bp, Artificial Sequence
  chemically synthesized
atgtgagaaaaataaacgat

SEQ ID NO: 571887 - DNA, 20 bp, Artificial Sequence
  chemically synthesized
ataatgaaaatgtaagcaac

SEQ ID NO: 571888 - DNA, 20 bp, Artificial Sequence
  chemically synthesized
ggaacagtttgtgtcggtat

SEQ ID NO: 571889 - DNA, 20 bp, Artificial Sequence
  chemically synthesized
tatattgttgtcacagcagg

SEQ ID NO: 571890 - DNA, 20 bp, Artificial Sequence
  chemically synthesized
gacaccagggtcaggggatc

SEQ ID NO: 571891 - DNA, 20 bp, Artificial Sequence
  chemically synthesized
cagatcccctgaccctggtg

SEQ ID NO: 571892 - DNA, 20 bp, Artificial Sequence
  chemically synthesized
ttctgcatctgggtactcta

SEQ ID NO: 571893 - DNA, 20 bp, Artificial Sequence
  chemically synthesized
ctgggtactctaggaagctt

SEQ ID NO: 571894 - DNA, 20 bp, Artificial Sequence
  chemically synthesized
gtcatataaatgggaagcca

SEQ ID NO: 571895 - DNA, 20 bp, Artificial Sequence
  chemically synthesized
catacacatatagacacagt

SEQ ID NO: 571896 - DNA, 20 bp, Artificial Sequence
  chemically synthesized
tttattacgtacagccatct

SEQ ID NO: 571897 - DNA, 20 bp, Artificial Sequence
  chemically synthesized
tcaggagcctaatagaggat

SEQ ID NO: 571898 - DNA, 20 bp, Artificial Sequence
  chemically synthesized
ctagatttcaggagcctaat

SEQ ID NO: 571899 - DNA, 20 bp, Artificial Sequence
  chemically synthesized
ctctattaggctcctgaaat

SEQ ID NO: 571900 - DNA, 20 bp, Artificial Sequence
  chemically synthesized
ggctcctgaaatctaggttt

SEQ ID NO: 571901 - DNA, 20 bp, Artificial Sequence
  chemically synthesized
aacattactaaaccataaaa

SEQ ID NO: 571902 - DNA, 20 bp, Artificial Sequence
  chemically synthesized
atctaggttttatggtttag

SEQ ID NO: 571903 - DNA, 20 bp, Artificial Sequence
  chemically synthesized
ctttctctctgaggcatcac

SEQ ID NO: 571904 - DNA, 20 bp, Artificial Sequence
  chemically synthesized
cattctctatctgtttctat

SEQ ID NO: 571905 - DNA, 20 bp, Artificial Sequence
  chemically synthesized
tggtgtgacattcattctct

SEQ ID NO: 571906 - DNA, 20 bp, Artificial Sequence
  chemically synthesized
ctagttcactgcaaattttt

SEQ ID NO: 571907 - DNA, 20 bp, Artificial Sequence
  chemically synthesized
tggaaactttcctaaccttt

SEQ ID NO: 571908 - DNA, 20 bp, Artificial Sequence
  chemically synthesized
ataaatcattaaaaggttag

SEQ ID NO: 571909 - DNA, 20 bp, Artificial Sequence
  chemically synthesized
ctgtcatcatctccacatat

SEQ ID NO: 571910 - DNA, 20 bp, Artificial Sequence
  chemically synthesized
ttcagttttttaaaagaatg

SEQ ID NO: 571911 - DNA, 20 bp, Artificial Sequence
  chemically synthesized
ctaattgattttagatgcag

SEQ ID NO: 571912 - DNA, 20 bp, Artificial Sequence
  chemically synthesized
acatgtagatcatgagatct

SEQ ID NO: 571913 - DNA, 20 bp, Artificial Sequence
  chemically synthesized
cagtatagtaaatgatctta

SEQ ID NO: 571914 - DNA, 20 bp, Artificial Sequence
  chemically synthesized
ttttgtatttttagtggaga

SEQ ID NO: 571915 - DNA, 20 bp, Artificial Sequence
  chemically synthesized
tctggaggctgaggcagggg

SEQ ID NO: 571916 - DNA, 20 bp, Artificial Sequence
  chemically synthesized
ctcactgcaacctctgtctc

SEQ ID NO: 571917 - DNA, 20 bp, Artificial Sequence
  chemically synthesized
gagacagaggttgcagtgag

SEQ ID NO: 571918 - DNA, 20 bp, Artificial Sequence
  chemically synthesized
aagttgggtttgtttttttt

SEQ ID NO: 571919 - DNA, 20 bp, Artificial Sequence
  chemically synthesized
tgattttaagaaaaagttgg

SEQ ID NO: 571920 - DNA, 20 bp, Artificial Sequence
  chemically synthesized
tatttgattttaagaaaaag

SEQ ID NO: 571921 - DNA, 20 bp, Artificial Sequence
  chemically synthesized
atcacaccatcctatggaat

SEQ ID NO: 571922 - DNA, 20 bp, Artificial Sequence
  chemically synthesized
tgtctgaggattagatgaga

SEQ ID NO: 571923 - DNA, 20 bp, Artificial Sequence
  chemically synthesized
cactcgctcaaagagttgtc

SEQ ID NO: 571924 - DNA, 20 bp, Artificial Sequence
  chemically synthesized
ttactaacaactcccttttg

SEQ ID NO: 571925 - DNA, 20 bp, Artificial Sequence
  chemically synthesized
actctgaaaattttcagact

SEQ ID NO: 571926 - DNA, 20 bp, Artificial Sequence
  chemically synthesized
atttgcttatttctatattt

SEQ ID NO: 571927 - DNA, 20 bp, Artificial Sequence
  chemically synthesized
ataagaacgctagtttattc

SEQ ID NO: 571928 - DNA, 20 bp, Artificial Sequence
  chemically synthesized
ctttctgggctgataagaac

SEQ ID NO: 571929 - DNA, 20 bp, Artificial Sequence
  chemically synthesized
agcaatttagctaacagtaa

SEQ ID NO: 571930 - DNA, 20 bp, Artificial Sequence
  chemically synthesized
agctaaattgctctttacaa

SEQ ID NO: 571931 - DNA, 20 bp, Artificial Sequence
  chemically synthesized
agctagatttatcttaagac

SEQ ID NO: 571932 - DNA, 20 bp, Artificial Sequence
  chemically synthesized
ttctggctctgccatagcta

SEQ ID NO: 571933 - DNA, 20 bp, Artificial Sequence
  chemically synthesized
tggcagagccagaacctgag

SEQ ID NO: 571934 - DNA, 20 bp, Artificial Sequence
  chemically synthesized
caagtattagcaaatattga

SEQ ID NO: 571935 - DNA, 20 bp, Artificial Sequence
  chemically synthesized
cttggtattggtaatattac

SEQ ID NO: 571936 - DNA, 20 bp, Artificial Sequence
  chemically synthesized
atgatatccatctcaaaaat

SEQ ID NO: 571937 - DNA, 20 bp, Artificial Sequence
  chemically synthesized
aaagatgaagttatttggaa

SEQ ID NO: 571938 - DNA, 20 bp, Artificial Sequence
  chemically synthesized
ttggaaaagggattgagata

SEQ ID NO: 571939 - DNA, 20 bp, Artificial Sequence
  chemically synthesized
ggtgactacagctctgatgg

SEQ ID NO: 571940 - DNA, 20 bp, Artificial Sequence
  chemically synthesized
caaagagaacagagctacag

SEQ ID NO: 571941 - DNA, 20 bp, Artificial Sequence
  chemically synthesized
acaaggatcatatttttaca

SEQ ID NO: 571942 - DNA, 20 bp, Artificial Sequence
  chemically synthesized
tttatttatcaaataatcac

SEQ ID NO: 571943 - DNA, 20 bp, Artificial Sequence
  chemically synthesized
aaggtagtttagaaaaactg

SEQ ID NO: 571944 - DNA, 20 bp, Artificial Sequence
  chemically synthesized
ggttttaaaaatatttttaa

SEQ ID NO: 571945 - DNA, 20 bp, Artificial Sequence
  chemically synthesized
aaaatgtgtcctctttatcc

SEQ ID NO: 571946 - DNA, 20 bp, Artificial Sequence
  chemically synthesized
taattgtaagagaaaaatgc

SEQ ID NO: 571947 - DNA, 20 bp, Artificial Sequence
  chemically synthesized
gccactgcacccagctggaa

SEQ ID NO: 571948 - DNA, 20 bp, Artificial Sequence
  chemically synthesized
cacctcgacctcccaaagtg

SEQ ID NO: 571949 - DNA, 20 bp, Artificial Sequence
  chemically synthesized
tgggtggatcacctgaggtc

SEQ ID NO: 571950 - DNA, 20 bp, Artificial Sequence
  chemically synthesized
ttttgtattttcagtagaga

SEQ ID NO: 571951 - DNA, 20 bp, Artificial Sequence
  chemically synthesized
tcaggaggctgaggcaggag

SEQ ID NO: 571952 - DNA, 20 bp, Artificial Sequence
  chemically synthesized
tttatttttctccacttaaa

SEQ ID NO: 571953 - DNA, 20 bp, Artificial Sequence
  chemically synthesized
atcacaatgaatagctaggc

SEQ ID NO: 571954 - DNA, 20 bp, Artificial Sequence
  chemically synthesized
gaatagctaggccttagttt

SEQ ID NO: 571955 - DNA, 20 bp, Artificial Sequence
  chemically synthesized
ctaggccttagttttgcagc

SEQ ID NO: 571956 - DNA, 20 bp, Artificial Sequence
  chemically synthesized
ccttctactaactgcctggt

SEQ ID NO: 571957 - DNA, 20 bp, Artificial Sequence
  chemically synthesized
actaactgcctggttgttgt

SEQ ID NO: 571958 - DNA, 20 bp, Artificial Sequence
  chemically synthesized
tgcctggttgttgtttctgt

SEQ ID NO: 571959 - DNA, 20 bp, Artificial Sequence
  chemically synthesized
tttttgtttttcctttgagg

SEQ ID NO: 571960 - DNA, 20 bp, Artificial Sequence
  chemically synthesized
agtcacaagaaatatgggga

SEQ ID NO: 571961 - DNA, 20 bp, Artificial Sequence
  chemically synthesized
ttgaggaaggcaaaaaggta

SEQ ID NO: 571962 - DNA, 20 bp, Artificial Sequence
  chemically synthesized
ttgtattattttcttccttt

SEQ ID NO: 571963 - DNA, 20 bp, Artificial Sequence
  chemically synthesized
atacaaggttggaaagactt

SEQ ID NO: 571964 - DNA, 20 bp, Artificial Sequence
  chemically synthesized
taaaaagaagatgcatgtgt

SEQ ID NO: 571965 - DNA, 20 bp, Artificial Sequence
  chemically synthesized
agatgcatgtgttcctgctt

SEQ ID NO: 571966 - DNA, 20 bp, Artificial Sequence
  chemically synthesized
cttcatgtcctattctgaga

SEQ ID NO: 571967 - DNA, 20 bp, Artificial Sequence
  chemically synthesized
aagagcccctaccccatccc

SEQ ID NO: 571968 - DNA, 20 bp, Artificial Sequence
  chemically synthesized
aattagccagagttagctgc

SEQ ID NO: 571969 - DNA, 20 bp, Artificial Sequence
  chemically synthesized
caaaaagatggctagggaga

SEQ ID NO: 571970 - DNA, 20 bp, Artificial Sequence
  chemically synthesized
acaagtagaagtctttcaaa

SEQ ID NO: 571971 - DNA, 20 bp, Artificial Sequence
  chemically synthesized
aaaaaggtttctgggaaatt

SEQ ID NO: 571972 - DNA, 20 bp, Artificial Sequence
  chemically synthesized
tattaagatgtctggaaata

SEQ ID NO: 571973 - DNA, 20 bp, Artificial Sequence
  chemically synthesized
tctacagtggcttaaataaa

SEQ ID NO: 571974 - DNA, 20 bp, Artificial Sequence
  chemically synthesized
tatttatttaagccactgta

SEQ ID NO: 571975 - DNA, 20 bp, Artificial Sequence
  chemically synthesized
aaaacacagaagctatctac

SEQ ID NO: 571976 - DNA, 20 bp, Artificial Sequence
  chemically synthesized
taagccactgtagatagctt

SEQ ID NO: 571977 - DNA, 20 bp, Artificial Sequence
  chemically synthesized
tagaaggattcatatttttt

SEQ ID NO: 571978 - DNA, 20 bp, Artificial Sequence
  chemically synthesized
tgtttagaaggattcatatt

SEQ ID NO: 571979 - DNA, 20 bp, Artificial Sequence
  chemically synthesized
cataaattcttcattgttta

SEQ ID NO: 571980 - DNA, 20 bp, Artificial Sequence
  chemically synthesized
ccctaaccccataaattctt

SEQ ID NO: 571981 - DNA, 20 bp, Artificial Sequence
  chemically synthesized
caatgaagaatttatggggt

SEQ ID NO: 571982 - DNA, 20 bp, Artificial Sequence
  chemically synthesized
ctttgtcctttagctattac

SEQ ID NO: 571983 - DNA, 20 bp, Artificial Sequence
  chemically synthesized
atatccaggatgcaatgttc

SEQ ID NO: 571984 - DNA, 20 bp, Artificial Sequence
  chemically synthesized
tgatactctgatacagggcc

SEQ ID NO: 571985 - DNA, 20 bp, Artificial Sequence
  chemically synthesized
aatggcgtgaacccgggagg

SEQ ID NO: 571986 - DNA, 20 bp, Artificial Sequence
  chemically synthesized
ttttgtatttttagtagaga

SEQ ID NO: 571987 - DNA, 20 bp, Artificial Sequence
  chemically synthesized
cgcctcggcctcccaaagtg

SEQ ID NO: 571988 - DNA, 20 bp, Artificial Sequence
  chemically synthesized
tacttagacaaaggaaatcc

SEQ ID NO: 571989 - DNA, 20 bp, Artificial Sequence
  chemically synthesized
aaaaaaaaaaaaaaaaaacc

SEQ ID NO: 571990 - DNA, 20 bp, Artificial Sequence
  chemically synthesized
attttgtcagtgcctttttc

SEQ ID NO: 571991 - DNA, 20 bp, Artificial Sequence
  chemically synthesized
ctgtatgtcttgcctacagt

SEQ ID NO: 571992 - DNA, 20 bp, Artificial Sequence
  chemically synthesized
ggcaagacatacagtctcct

SEQ ID NO: 571993 - DNA, 20 bp, Artificial Sequence
  chemically synthesized
agaaaggtcaataatagaaa

SEQ ID NO: 571994 - DNA, 20 bp, Artificial Sequence
  chemically synthesized
gctgttttcctcctttcact

SEQ ID NO: 571995 - DNA, 20 bp, Artificial Sequence
  chemically synthesized
aggaaaatcattcaaaaact

SEQ ID NO: 571996 - DNA, 20 bp, Artificial Sequence
  chemically synthesized
caggaaatcatgcagttttt

SEQ ID NO: 571997 - DNA, 20 bp, Artificial Sequence
  chemically synthesized
gaggtcacctcaggaaatca

SEQ ID NO: 571998 - DNA, 20 bp, Artificial Sequence
  chemically synthesized
tttattgattgcattagatg

SEQ ID NO: 571999 - DNA, 20 bp, Artificial Sequence
  chemically synthesized
ctaacacagattcttgattt

SEQ ID NO: 572000 - DNA, 20 bp, Artificial Sequence
  chemically synthesized
tcaaaatgcctaacacagat

SEQ ID NO: 572001 - DNA, 20 bp, Artificial Sequence
  chemically synthesized
aaaactctcaaaatgcctaa

SEQ ID NO: 572002 - DNA, 20 bp, Artificial Sequence
  chemically synthesized
gaatctgtgttaggcatttt

SEQ ID NO: 572003 - DNA, 20 bp, Artificial Sequence
  chemically synthesized
aagtcttcctaagagaataa

SEQ ID NO: 572004 - DNA, 20 bp, Artificial Sequence
  chemically synthesized
ttcataagacacactctaaa

SEQ ID NO: 572005 - DNA, 20 bp, Artificial Sequence
  chemically synthesized
agagtgtgtcttatgaaaac

SEQ ID NO: 572006 - DNA, 20 bp, Artificial Sequence
  chemically synthesized
tgggaaggcatgggggaaac

SEQ ID NO: 572007 - DNA, 20 bp, Artificial Sequence
  chemically synthesized
ttaactcatttgtataattt

SEQ ID NO: 572008 - DNA, 20 bp, Artificial Sequence
  chemically synthesized
catttgtataattttggggc

SEQ ID NO: 572009 - DNA, 20 bp, Artificial Sequence
  chemically synthesized
gggctcctttatttgcaaca

SEQ ID NO: 572010 - DNA, 20 bp, Artificial Sequence
  chemically synthesized
aacatttagattaagttaat

SEQ ID NO: 572011 - DNA, 20 bp, Artificial Sequence
  chemically synthesized
ggaggtcaatggctattagc

SEQ ID NO: 572012 - DNA, 20 bp, Artificial Sequence
  chemically synthesized
ttcttgatgataccaaagag

SEQ ID NO: 572013 - DNA, 20 bp, Artificial Sequence
  chemically synthesized
gagtttgagggggaagaagt

SEQ ID NO: 572014 - DNA, 20 bp, Artificial Sequence
  chemically synthesized
ttgagggggaagaagtgtgg

SEQ ID NO: 572015 - DNA, 20 bp, Artificial Sequence
  chemically synthesized
agaagtgtgggcttgattac

SEQ ID NO: 572016 - DNA, 20 bp, Artificial Sequence
  chemically synthesized
agtcatccctgagacatcat

SEQ ID NO: 572017 - DNA, 20 bp, Artificial Sequence
  chemically synthesized
acaacacaactgtcagagga

SEQ ID NO: 572018 - DNA, 20 bp, Artificial Sequence
  chemically synthesized
agaggaacaagctttcaatt

SEQ ID NO: 572019 - DNA, 20 bp, Artificial Sequence
  chemically synthesized
ccctcttgaaactggaaatt

SEQ ID NO: 572020 - DNA, 20 bp, Artificial Sequence
  chemically synthesized
agtttcaagagggaatgaga

SEQ ID NO: 572021 - DNA, 20 bp, Artificial Sequence
  chemically synthesized
atgatcatttatggtgactg

SEQ ID NO: 572022 - DNA, 20 bp, Artificial Sequence
  chemically synthesized
ccgtaaagtccacgaacaag

SEQ ID NO: 572023 - DNA, 20 bp, Artificial Sequence
  chemically synthesized
taggaaagatgcaacagata

SEQ ID NO: 572024 - DNA, 20 bp, Artificial Sequence
  chemically synthesized
tctttatctgttgcatcttt

SEQ ID NO: 572025 - DNA, 20 bp, Artificial Sequence
  chemically synthesized
aatactgtaaaatttacaaa

SEQ ID NO: 572026 - DNA, 20 bp, Artificial Sequence
  chemically synthesized
gtagcttaggcaaaatgcaa

SEQ ID NO: 572027 - DNA, 20 bp, Artificial Sequence
  chemically synthesized
ggagagaaagcgaacaggag

SEQ ID NO: 572028 - DNA, 20 bp, Artificial Sequence
  chemically synthesized
tgattctaaacggtcctcct

SEQ ID NO: 572029 - DNA, 20 bp, Artificial Sequence
  chemically synthesized
tttgcattatgtttcctaca

SEQ ID NO: 572030 - DNA, 20 bp, Artificial Sequence
  chemically synthesized
accagccttacaattttgca

SEQ ID NO: 572031 - DNA, 20 bp, Artificial Sequence
  chemically synthesized
ctttgcattatgtgcagttc

SEQ ID NO: 572032 - DNA, 20 bp, Artificial Sequence
  chemically synthesized
cataggaactgcacataatg

SEQ ID NO: 572033 - DNA, 20 bp, Artificial Sequence
  chemically synthesized
tcactttgagctcagtgaat

SEQ ID NO: 572034 - DNA, 20 bp, Artificial Sequence
  chemically synthesized
ttgagctcagtgaatctggg

SEQ ID NO: 572035 - DNA, 20 bp, Artificial Sequence
  chemically synthesized
tctttgttcataaaacaaat

SEQ ID NO: 572036 - DNA, 20 bp, Artificial Sequence
  chemically synthesized
ttttatgaacaaagatagca

SEQ ID NO: 572037 - DNA, 20 bp, Artificial Sequence
  chemically synthesized
aaggtcaattgttctttttt

SEQ ID NO: 572038 - DNA, 20 bp, Artificial Sequence
  chemically synthesized
tatgtactgtgttatgtaca

SEQ ID NO: 572039 - DNA, 20 bp, Artificial Sequence
  chemically synthesized
gtgttatgtacatgaggatt

SEQ ID NO: 572040 - DNA, 20 bp, Artificial Sequence
  chemically synthesized
cttttttcatagggttgtag

SEQ ID NO: 572041 - DNA, 20 bp, Artificial Sequence
  chemically synthesized
gtagaatgaaaataatacag

SEQ ID NO: 572042 - DNA, 20 bp, Artificial Sequence
  chemically synthesized
aatcaagttatgtactatgc

SEQ ID NO: 572043 - DNA, 20 bp, Artificial Sequence
  chemically synthesized
aaactgaggcatagtacata

SEQ ID NO: 572044 - DNA, 20 bp, Artificial Sequence
  chemically synthesized
ttgcaattctgtcagattct

SEQ ID NO: 572045 - DNA, 20 bp, Artificial Sequence
  chemically synthesized
tagatttaaattgcaattct

SEQ ID NO: 572046 - DNA, 20 bp, Artificial Sequence
  chemically synthesized
tagtggcttagttcagaggc

SEQ ID NO: 572047 - DNA, 20 bp, Artificial Sequence
  chemically synthesized
actctgagccagtccatttt

SEQ ID NO: 572048 - DNA, 20 bp, Artificial Sequence
  chemically synthesized
ttgaataagaataggaattt

SEQ ID NO: 572049 - DNA, 20 bp, Artificial Sequence
  chemically synthesized
ataggaatttccaggtttat

SEQ ID NO: 572050 - DNA, 20 bp, Artificial Sequence
  chemically synthesized
ggccctctcgctatgtcttt

SEQ ID NO: 572051 - DNA, 20 bp, Artificial Sequence
  chemically synthesized
gttgtagatatgaagtctca

SEQ ID NO: 572052 - DNA, 20 bp, Artificial Sequence
  chemically synthesized
ttgagaggccaagacaggag

SEQ ID NO: 572053 - DNA, 20 bp, Artificial Sequence
  chemically synthesized
tgtcttggcctctcaaagtg

SEQ ID NO: 572054 - DNA, 20 bp, Artificial Sequence
  chemically synthesized
ccttcctcctggctgggcac

SEQ ID NO: 572055 - DNA, 20 bp, Artificial Sequence
  chemically synthesized
tgggaggatctcttgaaccc

SEQ ID NO: 572056 - DNA, 20 bp, Artificial Sequence
  chemically synthesized
ggggtggaccagcgagtgag

SEQ ID NO: 572057 - DNA, 20 bp, Artificial Sequence
  chemically synthesized
aggaagtgttacagcgccct

SEQ ID NO: 572058 - DNA, 20 bp, Artificial Sequence
  chemically synthesized
ttttagctttgccattcaca

SEQ ID NO: 572059 - DNA, 20 bp, Artificial Sequence
  chemically synthesized
aaattgaagatggtaaatat

SEQ ID NO: 572060 - DNA, 20 bp, Artificial Sequence
  chemically synthesized
gtggatggtcagactccagg

SEQ ID NO: 572061 - DNA, 20 bp, Artificial Sequence
  chemically synthesized
ttagagggacagtttgacag

SEQ ID NO: 572062 - DNA, 20 bp, Artificial Sequence
  chemically synthesized
aagcggcttgactttagagg

SEQ ID NO: 572063 - DNA, 20 bp, Artificial Sequence
  chemically synthesized
aaactgtccctctaaagtca

SEQ ID NO: 572064 - DNA, 20 bp, Artificial Sequence
  chemically synthesized
acagttggacatcaaagaga

SEQ ID NO: 572065 - DNA, 20 bp, Artificial Sequence
  chemically synthesized
gcttctctttgatgtccaac

SEQ ID NO: 572066 - DNA, 20 bp, Artificial Sequence
  chemically synthesized
aactgtagtttctgacatcc

SEQ ID NO: 572067 - DNA, 20 bp, Artificial Sequence
  chemically synthesized
tccttctgccagctgagctc

SEQ ID NO: 572068 - DNA, 20 bp, Artificial Sequence
  chemically synthesized
ggggtgggtggggggtaatg

SEQ ID NO: 572069 - DNA, 20 bp, Artificial Sequence
  chemically synthesized
cccaaagtgagaacttacat

SEQ ID NO: 572070 - DNA, 20 bp, Artificial Sequence
  chemically synthesized
tctcactttgggccatggtt

SEQ ID NO: 572071 - DNA, 20 bp, Artificial Sequence
  chemically synthesized
tgggccatggttccaggctt

SEQ ID NO: 572072 - DNA, 20 bp, Artificial Sequence
  chemically synthesized
gtatccatagcctgtcaaga

SEQ ID NO: 572073 - DNA, 20 bp, Artificial Sequence
  chemically synthesized
ggagagaaagctgtagctat

SEQ ID NO: 572074 - DNA, 20 bp, Artificial Sequence
  chemically synthesized
ttaaaaaaatcttctatagc

SEQ ID NO: 572075 - DNA, 20 bp, Artificial Sequence
  chemically synthesized
ttttttaatataatggggta

SEQ ID NO: 572076 - DNA, 20 bp, Artificial Sequence
  chemically synthesized
tggggtactaggattagatc

SEQ ID NO: 572077 - DNA, 20 bp, Artificial Sequence
  chemically synthesized
ctattaatgatttggccttc

SEQ ID NO: 572078 - DNA, 20 bp, Artificial Sequence
  chemically synthesized
agtcctttctcagtgactat

SEQ ID NO: 572079 - DNA, 20 bp, Artificial Sequence
  chemically synthesized
agagtagttagagaggaata

SEQ ID NO: 572080 - DNA, 20 bp, Artificial Sequence
  chemically synthesized
agagaggaatagctggattt

SEQ ID NO: 572081 - DNA, 20 bp, Artificial Sequence
  chemically synthesized
gtttttatttggtcactaaa

SEQ ID NO: 572082 - DNA, 20 bp, Artificial Sequence
  chemically synthesized
acttcttcctctctattatc

SEQ ID NO: 572083 - DNA, 20 bp, Artificial Sequence
  chemically synthesized
aagtaaatgcaaggtgcaaa

SEQ ID NO: 572084 - DNA, 20 bp, Artificial Sequence
  chemically synthesized
aaatgcaaggtgcaaaacag

SEQ ID NO: 572085 - DNA, 20 bp, Artificial Sequence
  chemically synthesized
acataccatatcacaatcaa

SEQ ID NO: 572086 - DNA, 20 bp, Artificial Sequence
  chemically synthesized
ggcccaaccaatggaaatga

SEQ ID NO: 572087 - DNA, 20 bp, Artificial Sequence
  chemically synthesized
agatatggcccaaccaatgg

SEQ ID NO: 572088 - DNA, 20 bp, Artificial Sequence
  chemically synthesized
gaatattatcatcagttctg

SEQ ID NO: 572089 - DNA, 20 bp, Artificial Sequence
  chemically synthesized
agtttggtgattttgaggcc

SEQ ID NO: 572090 - DNA, 20 bp, Artificial Sequence
  chemically synthesized
cttgacttttccctttagtt

SEQ ID NO: 572091 - DNA, 20 bp, Artificial Sequence
  chemically synthesized
ttcccagcttgacttttccc

SEQ ID NO: 572092 - DNA, 20 bp, Artificial Sequence
  chemically synthesized
aagggaaaagtcaagctggg

SEQ ID NO: 572093 - DNA, 20 bp, Artificial Sequence
  chemically synthesized
caggtttgccctaagcagtt

SEQ ID NO: 572094 - DNA, 20 bp, Artificial Sequence
  chemically synthesized
gactttgaatagaatgggag

SEQ ID NO: 572095 - DNA, 20 bp, Artificial Sequence
  chemically synthesized
atccctctgctcactgagat

SEQ ID NO: 572096 - DNA, 20 bp, Artificial Sequence
  chemically synthesized
gctcactgagatagatgctt

SEQ ID NO: 572097 - DNA, 20 bp, Artificial Sequence
  chemically synthesized
atggttgcattcttttgagt

SEQ ID NO: 572098 - DNA, 20 bp, Artificial Sequence
  chemically synthesized
cctgtgacctggaagcccct

SEQ ID NO: 572099 - DNA, 20 bp, Artificial Sequence
  chemically synthesized
tgggacaacttgaagcaagg

SEQ ID NO: 572100 - DNA, 20 bp, Artificial Sequence
  chemically synthesized
ccaaggtgtttggggcacag

SEQ ID NO: 572101 - DNA, 20 bp, Artificial Sequence
  chemically synthesized
tgtgcccaaggtgtttgggg

SEQ ID NO: 572102 - DNA, 20 bp, Artificial Sequence
  chemically synthesized
gttctaacgacatgtgccca

SEQ ID NO: 572103 - DNA, 20 bp, Artificial Sequence
  chemically synthesized
atgtcgttagaacctcctga

SEQ ID NO: 572104 - DNA, 20 bp, Artificial Sequence
  chemically synthesized
gactggtctcagttaattta

SEQ ID NO: 572105 - DNA, 20 bp, Artificial Sequence
  chemically synthesized
tttgtaaaagtattcaatta

SEQ ID NO: 572106 - DNA, 20 bp, Artificial Sequence
  chemically synthesized
tcagggtatacactctaaat

SEQ ID NO: 572107 - DNA, 20 bp, Artificial Sequence
  chemically synthesized
atataacagtgatgaaagag

SEQ ID NO: 572108 - DNA, 20 bp, Artificial Sequence
  chemically synthesized
gatgaaagagccaagctttt

SEQ ID NO: 572109 - DNA, 20 bp, Artificial Sequence
  chemically synthesized
tgctaagtcgaaaagctaag

SEQ ID NO: 572110 - DNA, 20 bp, Artificial Sequence
  chemically synthesized
tgtgaactagttgggttttt

SEQ ID NO: 572111 - DNA, 20 bp, Artificial Sequence
  chemically synthesized
ctgatgtgaactagttgggt

SEQ ID NO: 572112 - DNA, 20 bp, Artificial Sequence
  chemically synthesized
ttcaagctgatgtgaactag

SEQ ID NO: 572113 - DNA, 20 bp, Artificial Sequence
  chemically synthesized
caaaaacccaactagttcac

SEQ ID NO: 572114 - DNA, 20 bp, Artificial Sequence
  chemically synthesized
ttcacatcagcttgaaacga

SEQ ID NO: 572115 - DNA, 20 bp, Artificial Sequence
  chemically synthesized
ttcgtatcttctctaagcat

SEQ ID NO: 572116 - DNA, 20 bp, Artificial Sequence
  chemically synthesized
attttacagatgtagagaag

SEQ ID NO: 572117 - DNA, 20 bp, Artificial Sequence
  chemically synthesized
ggcaggaatagatcaatata

SEQ ID NO: 572118 - DNA, 20 bp, Artificial Sequence
  chemically synthesized
agtctttataataaatgaaa

SEQ ID NO: 572119 - DNA, 20 bp, Artificial Sequence
  chemically synthesized
ttttcccagggagcagttct

SEQ ID NO: 572120 - DNA, 20 bp, Artificial Sequence
  chemically synthesized
agaactgctccctgggaaaa

SEQ ID NO: 572121 - DNA, 20 bp, Artificial Sequence
  chemically synthesized
catcaatgactgtactcaaa

SEQ ID NO: 572122 - DNA, 20 bp, Artificial Sequence
  chemically synthesized
tgtcagtttggtcattcaaa

SEQ ID NO: 572123 - DNA, 20 bp, Artificial Sequence
  chemically synthesized
ggtttgaatgaccaaactga

SEQ ID NO: 572124 - DNA, 20 bp, Artificial Sequence
  chemically synthesized
ttcgaccctataaaatccct

SEQ ID NO: 572125 - DNA, 20 bp, Artificial Sequence
  chemically synthesized
tcattcattttcttcctaag

SEQ ID NO: 572126 - DNA, 20 bp, Artificial Sequence
  chemically synthesized
tcctgccttaggaagaaaat

SEQ ID NO: 572127 - DNA, 20 bp, Artificial Sequence
  chemically synthesized
ttcttaaatccctttaaatt

SEQ ID NO: 572128 - DNA, 20 bp, Artificial Sequence
  chemically synthesized
ccatgcaatctcagaattta

SEQ ID NO: 572129 - DNA, 20 bp, Artificial Sequence
  chemically synthesized
tttaggtagtgtgatcttca

SEQ ID NO: 572130 - DNA, 20 bp, Artificial Sequence
  chemically synthesized
acactacctaaaaagagagg

SEQ ID NO: 572131 - DNA, 20 bp, Artificial Sequence
  chemically synthesized
tgatttcaggtcctagaagc

SEQ ID NO: 572132 - DNA, 20 bp, Artificial Sequence
  chemically synthesized
aaactaagggccaataaaac

SEQ ID NO: 572133 - DNA, 20 bp, Artificial Sequence
  chemically synthesized
aagccttggttttattggcc

SEQ ID NO: 572134 - DNA, 20 bp, Artificial Sequence
  chemically synthesized
ttagtttccatatctatgat

SEQ ID NO: 572135 - DNA, 20 bp, Artificial Sequence
  chemically synthesized
gagtttagatgagttatttc

SEQ ID NO: 572136 - DNA, 20 bp, Artificial Sequence
  chemically synthesized
gagttatttctaaggtttcc

SEQ ID NO: 572137 - DNA, 20 bp, Artificial Sequence
  chemically synthesized
tcctgttgctttaaaacatt

SEQ ID NO: 572138 - DNA, 20 bp, Artificial Sequence
  chemically synthesized
caagcaactctaaaatcatt

SEQ ID NO: 572139 - DNA, 20 bp, Artificial Sequence
  chemically synthesized
aaaacattcaatgattttag

SEQ ID NO: 572140 - DNA, 20 bp, Artificial Sequence
  chemically synthesized
tgtttcttaaaatttttgaa

SEQ ID NO: 572141 - DNA, 20 bp, Artificial Sequence
  chemically synthesized
ctaagtgcagctttaatagt

SEQ ID NO: 572142 - DNA, 20 bp, Artificial Sequence
  chemically synthesized
gcctctaagtgcagctttaa

SEQ ID NO: 572143 - DNA, 20 bp, Artificial Sequence
  chemically synthesized
gcagataaatagcctctaag

SEQ ID NO: 572144 - DNA, 20 bp, Artificial Sequence
  chemically synthesized
tgcttagctcactagctgaa

SEQ ID NO: 572145 - DNA, 20 bp, Artificial Sequence
  chemically synthesized
taaatgagatcatttatatc

SEQ ID NO: 572146 - DNA, 20 bp, Artificial Sequence
  chemically synthesized
atgttttaacctctccaagg

SEQ ID NO: 572147 - DNA, 20 bp, Artificial Sequence
  chemically synthesized
ggcaaatgttttaacctctc

SEQ ID NO: 572148 - DNA, 20 bp, Artificial Sequence
  chemically synthesized
gaaactgtgtaaccttgggc

SEQ ID NO: 572149 - DNA, 20 bp, Artificial Sequence
  chemically synthesized
aaaacatttgcccaaggtta

SEQ ID NO: 572150 - DNA, 20 bp, Artificial Sequence
  chemically synthesized
acacagtttctaagtggtag

SEQ ID NO: 572151 - DNA, 20 bp, Artificial Sequence
  chemically synthesized
agggccagaaagtaaatatt

SEQ ID NO: 572152 - DNA, 20 bp, Artificial Sequence
  chemically synthesized
acccaaagaagaatatgtaa

SEQ ID NO: 572153 - DNA, 20 bp, Artificial Sequence
  chemically synthesized
tctccgttacatattcttct

SEQ ID NO: 572154 - DNA, 20 bp, Artificial Sequence
  chemically synthesized
acaacttattaaaacaagta

SEQ ID NO: 572155 - DNA, 20 bp, Artificial Sequence
  chemically synthesized
aggggagctaaaaacagttt

SEQ ID NO: 572156 - DNA, 20 bp, Artificial Sequence
  chemically synthesized
ttaatagcaggggagctaaa

SEQ ID NO: 572157 - DNA, 20 bp, Artificial Sequence
  chemically synthesized
gtacaaattcaacatggggc

SEQ ID NO: 572158 - DNA, 20 bp, Artificial Sequence
  chemically synthesized
gttgaatttgtactgagacc

SEQ ID NO: 572159 - DNA, 20 bp, Artificial Sequence
  chemically synthesized
gctctcttactacaacaccc

SEQ ID NO: 572160 - DNA, 20 bp, Artificial Sequence
  chemically synthesized
tatgggccagacactgcgct

SEQ ID NO: 572161 - DNA, 20 bp, Artificial Sequence
  chemically synthesized
gtaatacaacgagcctctgg

SEQ ID NO: 572162 - DNA, 20 bp, Artificial Sequence
  chemically synthesized
ttccattttatagatggaaa

SEQ ID NO: 572163 - DNA, 20 bp, Artificial Sequence
  chemically synthesized
atagatggaaaataggctta

SEQ ID NO: 572164 - DNA, 20 bp, Artificial Sequence
  chemically synthesized
gccactttctagccttgtat

SEQ ID NO: 572165 - DNA, 20 bp, Artificial Sequence
  chemically synthesized
ggctagaaagtggcagagct

SEQ ID NO: 572166 - DNA, 20 bp, Artificial Sequence
  chemically synthesized
gagctttgtgaatctggaaa

SEQ ID NO: 572167 - DNA, 20 bp, Artificial Sequence
  chemically synthesized
caatggataaaatcacagtt

SEQ ID NO: 572168 - DNA, 20 bp, Artificial Sequence
  chemically synthesized
tctactgcaatggataaaat

SEQ ID NO: 572169 - DNA, 20 bp, Artificial Sequence
  chemically synthesized
gctgttgccatgctctacac

SEQ ID NO: 572170 - DNA, 20 bp, Artificial Sequence
  chemically synthesized
aacagcctagacaattatgg

SEQ ID NO: 572171 - DNA, 20 bp, Artificial Sequence
  chemically synthesized
tggtatggtttgaaaaacac

SEQ ID NO: 572172 - DNA, 20 bp, Artificial Sequence
  chemically synthesized
tccagttgattatgaagcta

SEQ ID NO: 572173 - DNA, 20 bp, Artificial Sequence
  chemically synthesized
acactgtagcttcataatca

SEQ ID NO: 572174 - DNA, 20 bp, Artificial Sequence
  chemically synthesized
cttcataatcaactggattt

SEQ ID NO: 572175 - DNA, 20 bp, Artificial Sequence
  chemically synthesized
tccaataaactgacaaatcc

SEQ ID NO: 572176 - DNA, 20 bp, Artificial Sequence
  chemically synthesized
gtttattggatgtcaggcag

SEQ ID NO: 572177 - DNA, 20 bp, Artificial Sequence
  chemically synthesized
ggggaaggtcactctaaggt

SEQ ID NO: 572178 - DNA, 20 bp, Artificial Sequence
  chemically synthesized
aggtcactctaaggtctgag

SEQ ID NO: 572179 - DNA, 20 bp, Artificial Sequence
  chemically synthesized
aataaggaaatcaggtatag

SEQ ID NO: 572180 - DNA, 20 bp, Artificial Sequence
  chemically synthesized
tctcctcaaagcagccctat

SEQ ID NO: 572181 - DNA, 20 bp, Artificial Sequence
  chemically synthesized
gagataaacggatgggccga

SEQ ID NO: 572182 - DNA, 20 bp, Artificial Sequence
  chemically synthesized
accataagctttatcggccc

SEQ ID NO: 572183 - DNA, 20 bp, Artificial Sequence
  chemically synthesized
ctataagggatcttgccacc

SEQ ID NO: 572184 - DNA, 20 bp, Artificial Sequence
  chemically synthesized
cttatggtggcaagatccct

SEQ ID NO: 572185 - DNA, 20 bp, Artificial Sequence
  chemically synthesized
gcaagatcccttatagtttt

SEQ ID NO: 572186 - DNA, 20 bp, Artificial Sequence
  chemically synthesized
gtgttatggcaggcaaaaaa

SEQ ID NO: 572187 - DNA, 20 bp, Artificial Sequence
  chemically synthesized
aggcaaaaaaattagcttct

SEQ ID NO: 572188 - DNA, 20 bp, Artificial Sequence
  chemically synthesized
gggaccatctaattcaacac

SEQ ID NO: 572189 - DNA, 20 bp, Artificial Sequence
  chemically synthesized
ggtgttgaattagatggtcc

SEQ ID NO: 572190 - DNA, 20 bp, Artificial Sequence
  chemically synthesized
ggcagtttcctagaattttc

SEQ ID NO: 572191 - DNA, 20 bp, Artificial Sequence
  chemically synthesized
tattctaggctctttctttt

SEQ ID NO: 572192 - DNA, 20 bp, Artificial Sequence
  chemically synthesized
gccaaaagaaagagcctaga

SEQ ID NO: 572193 - DNA, 20 bp, Artificial Sequence
  chemically synthesized
ctagaataggctttttgagg

SEQ ID NO: 572194 - DNA, 20 bp, Artificial Sequence
  chemically synthesized
aattgaacagaagggtgcta

SEQ ID NO: 572195 - DNA, 20 bp, Artificial Sequence
  chemically synthesized
ataaagatcaaacagggtat

SEQ ID NO: 572196 - DNA, 20 bp, Artificial Sequence
  chemically synthesized
tgaccttgcaaacacaaata

SEQ ID NO: 572197 - DNA, 20 bp, Artificial Sequence
  chemically synthesized
tcagccatttgataatggac

SEQ ID NO: 572198 - DNA, 20 bp, Artificial Sequence
  chemically synthesized
taggagaaaactaatggaaa

SEQ ID NO: 572199 - DNA, 20 bp, Artificial Sequence
  chemically synthesized
tcacgttaatcactctttcc

SEQ ID NO: 572200 - DNA, 20 bp, Artificial Sequence
  chemically synthesized
atggaaagagtgattaacgt

SEQ ID NO: 572201 - DNA, 20 bp, Artificial Sequence
  chemically synthesized
tcttcatatttcttcatttc

SEQ ID NO: 572202 - DNA, 20 bp, Artificial Sequence
  chemically synthesized
taatataaatgaacaggtca

SEQ ID NO: 572203 - DNA, 20 bp, Artificial Sequence
  chemically synthesized
ccaattgtactaggaggcat

SEQ ID NO: 572204 - DNA, 20 bp, Artificial Sequence
  chemically synthesized
cttttcctagtgatactagc

SEQ ID NO: 572205 - DNA, 20 bp, Artificial Sequence
  chemically synthesized
acttttagaatcatcaaaaa

SEQ ID NO: 572206 - DNA, 20 bp, Artificial Sequence
  chemically synthesized
aagctttcaaacttattttt

SEQ ID NO: 572207 - DNA, 20 bp, Artificial Sequence
  chemically synthesized
aatcatcaaaaaataagttt

SEQ ID NO: 572208 - DNA, 20 bp, Artificial Sequence
  chemically synthesized
ttcacttctgtgctttttgc

SEQ ID NO: 572209 - DNA, 20 bp, Artificial Sequence
  chemically synthesized
tttgcaaaaagcacagaagt

SEQ ID NO: 572210 - DNA, 20 bp, Artificial Sequence
  chemically synthesized
ttgcttcaaaacattcactt

SEQ ID NO: 572211 - DNA, 20 bp, Artificial Sequence
  chemically synthesized
ttataattcccattagtttc

SEQ ID NO: 572212 - DNA, 20 bp, Artificial Sequence
  chemically synthesized
tgtgtctcattataattccc

SEQ ID NO: 572213 - DNA, 20 bp, Artificial Sequence
  chemically synthesized
ggaattataatgagacacat

SEQ ID NO: 572214 - DNA, 20 bp, Artificial Sequence
  chemically synthesized
tctgacacattacaagagag

SEQ ID NO: 572215 - DNA, 20 bp, Artificial Sequence
  chemically synthesized
acaagaaccctgctatttta

SEQ ID NO: 572216 - DNA, 20 bp, Artificial Sequence
  chemically synthesized
tgagagcatgtagtatctgg

SEQ ID NO: 572217 - DNA, 20 bp, Artificial Sequence
  chemically synthesized
tctggatctgtttctagact

SEQ ID NO: 572218 - DNA, 20 bp, Artificial Sequence
  chemically synthesized
ctagactatgtgattcattt

SEQ ID NO: 572219 - DNA, 20 bp, Artificial Sequence
  chemically synthesized
tattgatattatttcagaac

SEQ ID NO: 572220 - DNA, 20 bp, Artificial Sequence
  chemically synthesized
ttcacatacataaaattaga

SEQ ID NO: 572221 - DNA, 20 bp, Artificial Sequence
  chemically synthesized
aatgaatatgagtttatata

SEQ ID NO: 572222 - DNA, 20 bp, Artificial Sequence
  chemically synthesized
tatttgtttctcgaatgaat

SEQ ID NO: 572223 - DNA, 20 bp, Artificial Sequence
  chemically synthesized
cttgatatccaacttggagt

SEQ ID NO: 572224 - DNA, 20 bp, Artificial Sequence
  chemically synthesized
atactccaagttggatatca

SEQ ID NO: 572225 - DNA, 20 bp, Artificial Sequence
  chemically synthesized
tactgggtacaaaaagaaaa

SEQ ID NO: 572226 - DNA, 20 bp, Artificial Sequence
  chemically synthesized
tgtttagttgacctcatttc

SEQ ID NO: 572227 - DNA, 20 bp, Artificial Sequence
  chemically synthesized
tttaaaccctacaaatagat

SEQ ID NO: 572228 - DNA, 20 bp, Artificial Sequence
  chemically synthesized
actaaacagaaatctatttg

SEQ ID NO: 572229 - DNA, 20 bp, Artificial Sequence
  chemically synthesized
atggtgttttaaaccctaca

SEQ ID NO: 572230 - DNA, 20 bp, Artificial Sequence
  chemically synthesized
acaaaagatgatctcattca

SEQ ID NO: 572231 - DNA, 20 bp, Artificial Sequence
  chemically synthesized
accatgaatgagatcatctt

SEQ ID NO: 572232 - DNA, 20 bp, Artificial Sequence
  chemically synthesized
ttttaggcaatgaacatagg

SEQ ID NO: 572233 - DNA, 20 bp, Artificial Sequence
  chemically synthesized
tgcctatgttcattgcctaa

SEQ ID NO: 572234 - DNA, 20 bp, Artificial Sequence
  chemically synthesized
attgcctaaaatagcttttc

SEQ ID NO: 572235 - DNA, 20 bp, Artificial Sequence
  chemically synthesized
tataaggctattttgcatag

SEQ ID NO: 572236 - DNA, 20 bp, Artificial Sequence
  chemically synthesized
atagataaatatttacacca

SEQ ID NO: 572237 - DNA, 20 bp, Artificial Sequence
  chemically synthesized
taactagtccccactcccta

SEQ ID NO: 572238 - DNA, 20 bp, Artificial Sequence
  chemically synthesized
ggagtggggactagttattt

SEQ ID NO: 572239 - DNA, 20 bp, Artificial Sequence
  chemically synthesized
attatacaatgaaaatttta

SEQ ID NO: 572240 - DNA, 20 bp, Artificial Sequence
  chemically synthesized
ctaaactggcatataaaata

SEQ ID NO: 572241 - DNA, 20 bp, Artificial Sequence
  chemically synthesized
ttaaacatattattttatat

SEQ ID NO: 572242 - DNA, 20 bp, Artificial Sequence
  chemically synthesized
taggaagggagggagaaatt

SEQ ID NO: 572243 - DNA, 20 bp, Artificial Sequence
  chemically synthesized
tttttttaatataaccacct

SEQ ID NO: 572244 - DNA, 20 bp, Artificial Sequence
  chemically synthesized
cgaccctgagattttcatac

SEQ ID NO: 572245 - DNA, 20 bp, Artificial Sequence
  chemically synthesized
tggtgtttgggcatacgacc

SEQ ID NO: 572246 - DNA, 20 bp, Artificial Sequence
  chemically synthesized
ccttaatttttatatcgcat

SEQ ID NO: 572247 - DNA, 20 bp, Artificial Sequence
  chemically synthesized
ataaaaattaaggtgcacat

SEQ ID NO: 572248 - DNA, 20 bp, Artificial Sequence
  chemically synthesized
cagaaagtctggagtgtatg

SEQ ID NO: 572249 - DNA, 20 bp, Artificial Sequence
  chemically synthesized
tttcatacactccagacttt

SEQ ID NO: 572250 - DNA, 20 bp, Artificial Sequence
  chemically synthesized
gcaactctgacatggcaagc

SEQ ID NO: 572251 - DNA, 20 bp, Artificial Sequence
  chemically synthesized
gacatggcaagctgctgttt

SEQ ID NO: 572252 - DNA, 20 bp, Artificial Sequence
  chemically synthesized
acaaatgaaatctagaaaac

SEQ ID NO: 572253 - DNA, 20 bp, Artificial Sequence
  chemically synthesized
ctgtgcagtgttatggatta

SEQ ID NO: 572254 - DNA, 20 bp, Artificial Sequence
  chemically synthesized
ccaagacatctgtgcagtgt

SEQ ID NO: 572255 - DNA, 20 bp, Artificial Sequence
  chemically synthesized
aacactgcacagatgtcttg

SEQ ID NO: 572256 - DNA, 20 bp, Artificial Sequence
  chemically synthesized
tcgacattcagcctcctggt

SEQ ID NO: 572257 - DNA, 20 bp, Artificial Sequence
  chemically synthesized
ttagatggacaagtcagaaa

SEQ ID NO: 572258 - DNA, 20 bp, Artificial Sequence
  chemically synthesized
aaaaatgtactactttttaa

SEQ ID NO: 572259 - DNA, 20 bp, Artificial Sequence
  chemically synthesized
aaagtagtacatttttaaat

SEQ ID NO: 572260 - DNA, 20 bp, Artificial Sequence
  chemically synthesized
gtgtaaattgctgactacag

SEQ ID NO: 572261 - DNA, 20 bp, Artificial Sequence
  chemically synthesized
tcattcattaggcttctccc

SEQ ID NO: 572262 - DNA, 20 bp, Artificial Sequence
  chemically synthesized
tttcatctgaagatcattca

SEQ ID NO: 572263 - DNA, 20 bp, Artificial Sequence
  chemically synthesized
aaccacagctggatattttt

SEQ ID NO: 572264 - DNA, 20 bp, Artificial Sequence
  chemically synthesized
aaaaatatccagctgtggtt

SEQ ID NO: 572265 - DNA, 20 bp, Artificial Sequence
  chemically synthesized
gtattttgccaaggatcctg

SEQ ID NO: 572266 - DNA, 20 bp, Artificial Sequence
  chemically synthesized
ttggcaaaataccaatgaaa

SEQ ID NO: 572267 - DNA, 20 bp, Artificial Sequence
  chemically synthesized
tattcctggaagaataacca

SEQ ID NO: 572268 - DNA, 20 bp, Artificial Sequence
  chemically synthesized
gccattgtttcccagaactc

SEQ ID NO: 572269 - DNA, 20 bp, Artificial Sequence
  chemically synthesized
ataagtcttgtttctgtggc

SEQ ID NO: 572270 - DNA, 20 bp, Artificial Sequence
  chemically synthesized
atggccacagaaacaagact

SEQ ID NO: 572271 - DNA, 20 bp, Artificial Sequence
  chemically synthesized
tcttaatttaaatcaataag

SEQ ID NO: 572272 - DNA, 20 bp, Artificial Sequence
  chemically synthesized
acaagacttattgatttaaa

SEQ ID NO: 572273 - DNA, 20 bp, Artificial Sequence
  chemically synthesized
gatttaaattaagatttcag

SEQ ID NO: 572274 - DNA, 20 bp, Artificial Sequence
  chemically synthesized
atgatataattgtagtcatt

SEQ ID NO: 572275 - DNA, 20 bp, Artificial Sequence
  chemically synthesized
tctaatttttcattgcctgt

SEQ ID NO: 572276 - DNA, 20 bp, Artificial Sequence
  chemically synthesized
gaaaaattagaacagaatta

SEQ ID NO: 572277 - DNA, 20 bp, Artificial Sequence
  chemically synthesized
atatgcattgaaaaatttct

SEQ ID NO: 572278 - DNA, 20 bp, Artificial Sequence
  chemically synthesized
gaactgtttatttctactac

SEQ ID NO: 572279 - DNA, 20 bp, Artificial Sequence
  chemically synthesized
tttaaaagttgggatttttg

SEQ ID NO: 572280 - DNA, 20 bp, Artificial Sequence
  chemically synthesized
tgaaggtaattctttaaaag

SEQ ID NO: 572281 - DNA, 20 bp, Artificial Sequence
  chemically synthesized
gtcaattatagatggttgtc

SEQ ID NO: 572282 - DNA, 20 bp, Artificial Sequence
  chemically synthesized
attaatttgagtcaacttat

SEQ ID NO: 572283 - DNA, 20 bp, Artificial Sequence
  chemically synthesized
taggcagaatttttttaaat

SEQ ID NO: 572284 - DNA, 20 bp, Artificial Sequence
  chemically synthesized
aaaaaaattctgcctaaatc

SEQ ID NO: 572285 - DNA, 20 bp, Artificial Sequence
  chemically synthesized
attctgaacttcggctaaac

SEQ ID NO: 572286 - DNA, 20 bp, Artificial Sequence
  chemically synthesized
aattgatttacatctattat

SEQ ID NO: 572287 - DNA, 20 bp, Artificial Sequence
  chemically synthesized
cacttacatccataagtgga

SEQ ID NO: 572288 - DNA, 20 bp, Artificial Sequence
  chemically synthesized
gtcatagattgcttttagta

SEQ ID NO: 572289 - DNA, 20 bp, Artificial Sequence
  chemically synthesized
ggccttagaaaattgtcata

SEQ ID NO: 572290 - DNA, 20 bp, Artificial Sequence
  chemically synthesized
cagaggccttagaaaattgt

SEQ ID NO: 572291 - DNA, 20 bp, Artificial Sequence
  chemically synthesized
gaagtgaaagttccaataat

SEQ ID NO: 572292 - DNA, 20 bp, Artificial Sequence
  chemically synthesized
tcattgttcccctcttgtgt

SEQ ID NO: 572293 - DNA, 20 bp, Artificial Sequence
  chemically synthesized
tatctgtcattgttcccctc

SEQ ID NO: 572294 - DNA, 20 bp, Artificial Sequence
  chemically synthesized
aggggaacaatgacagatat

SEQ ID NO: 572295 - DNA, 20 bp, Artificial Sequence
  chemically synthesized
ctaacaaacagtgcatgaat

SEQ ID NO: 572296 - DNA, 20 bp, Artificial Sequence
  chemically synthesized
ttgaaaagctgaaattcatg

SEQ ID NO: 572297 - DNA, 20 bp, Artificial Sequence
  chemically synthesized
cctcaagagctcatgtaaat

SEQ ID NO: 572298 - DNA, 20 bp, Artificial Sequence
  chemically synthesized
ccatcatttacatgagctct

SEQ ID NO: 572299 - DNA, 20 bp, Artificial Sequence
  chemically synthesized
ataccaaattagaaactaag

SEQ ID NO: 572300 - DNA, 20 bp, Artificial Sequence
  chemically synthesized
atgtatgggtacaatctgct

SEQ ID NO: 572301 - DNA, 20 bp, Artificial Sequence
  chemically synthesized
gaaaaaacattgatatttcc

SEQ ID NO: 572302 - DNA, 20 bp, Artificial Sequence
  chemically synthesized
ttagaagccataggaaatat

SEQ ID NO: 572303 - DNA, 20 bp, Artificial Sequence
  chemically synthesized
gaaaagataactattgagta

SEQ ID NO: 572304 - DNA, 20 bp, Artificial Sequence
  chemically synthesized
gtacaacaaacctccatgac

SEQ ID NO: 572305 - DNA, 20 bp, Artificial Sequence
  chemically synthesized
cataggtaaacacatgtcat

SEQ ID NO: 572306 - DNA, 20 bp, Artificial Sequence
  chemically synthesized
ttaggtttgacggtacatgt

SEQ ID NO: 572307 - DNA, 20 bp, Artificial Sequence
  chemically synthesized
ttctttttttagcttttatt

SEQ ID NO: 572308 - DNA, 20 bp, Artificial Sequence
  chemically synthesized
ttctagttgtattttctttt

SEQ ID NO: 572309 - DNA, 20 bp, Artificial Sequence
  chemically synthesized
atgctgtatcatggagcctt

SEQ ID NO: 572310 - DNA, 20 bp, Artificial Sequence
  chemically synthesized
tacagcatggtcttgacatt

SEQ ID NO: 572311 - DNA, 20 bp, Artificial Sequence
  chemically synthesized
aagacagtgatagataacat

SEQ ID NO: 572312 - DNA, 20 bp, Artificial Sequence
  chemically synthesized
agaatgaaaatgacataact

SEQ ID NO: 572313 - DNA, 20 bp, Artificial Sequence
  chemically synthesized
ttctccaaaagcctcacgaa

SEQ ID NO: 572314 - DNA, 20 bp, Artificial Sequence
  chemically synthesized
ggaattaaaaaccaacttcg

SEQ ID NO: 572315 - DNA, 20 bp, Artificial Sequence
  chemically synthesized
accttgagtccttcctgtgc

SEQ ID NO: 572316 - DNA, 20 bp, Artificial Sequence
  chemically synthesized
ggttatatatctatcaatgg

SEQ ID NO: 572317 - DNA, 20 bp, Artificial Sequence
  chemically synthesized
atatatctatcaatggagtg

SEQ ID NO: 572318 - DNA, 20 bp, Artificial Sequence
  chemically synthesized
cttttcataaacagatcaag

SEQ ID NO: 572319 - DNA, 20 bp, Artificial Sequence
  chemically synthesized
tgccaactaaactgaccttg

SEQ ID NO: 572320 - DNA, 20 bp, Artificial Sequence
  chemically synthesized
caaggtcagtttagttggca

SEQ ID NO: 572321 - DNA, 20 bp, Artificial Sequence
  chemically synthesized
gcttgtggaaatgaacatgc

SEQ ID NO: 572322 - DNA, 20 bp, Artificial Sequence
  chemically synthesized
tccaaggcatgttcatttcc

SEQ ID NO: 572323 - DNA, 20 bp, Artificial Sequence
  chemically synthesized
gtattaataaaaaattgtgg

SEQ ID NO: 572324 - DNA, 20 bp, Artificial Sequence
  chemically synthesized
atgatggcactatattcttt

SEQ ID NO: 572325 - DNA, 20 bp, Artificial Sequence
  chemically synthesized
tttcattgatgacttaatgt

SEQ ID NO: 572326 - DNA, 20 bp, Artificial Sequence
  chemically synthesized
aggcatcatagaaaaatgca

SEQ ID NO: 572327 - DNA, 20 bp, Artificial Sequence
  chemically synthesized
ttatttcattttatttgaga

SEQ ID NO: 572328 - DNA, 20 bp, Artificial Sequence
  chemically synthesized
gaggcagaggttgcagtgag

SEQ ID NO: 572329 - DNA, 20 bp, Artificial Sequence
  chemically synthesized
tacggaggctgaggcaggag

SEQ ID NO: 572330 - DNA, 20 bp, Artificial Sequence
  chemically synthesized
tgcctcagcctccgtagtag

SEQ ID NO: 572331 - DNA, 20 bp, Artificial Sequence
  chemically synthesized
ttttgtatttttagtagaga

SEQ ID NO: 572332 - DNA, 20 bp, Artificial Sequence
  chemically synthesized
cacctcggcctctcaaagtg

SEQ ID NO: 572333 - DNA, 20 bp, Artificial Sequence
  chemically synthesized
gggattacaggtgtgagcca

SEQ ID NO: 572334 - DNA, 20 bp, Artificial Sequence
  chemically synthesized
tggtgcaatcttggctcact

SEQ ID NO: 572335 - DNA, 20 bp, Artificial Sequence
  chemically synthesized
gaggtgaagctcgcagtgag

SEQ ID NO: 572336 - DNA, 20 bp, Artificial Sequence
  chemically synthesized
tttttttttttaagtagaga

SEQ ID NO: 572337 - DNA, 20 bp, Artificial Sequence
  chemically synthesized
cgcctcggcctctcaaagtg

SEQ ID NO: 572338 - DNA, 20 bp, Artificial Sequence
  chemically synthesized
gctaaataaaattatactat

SEQ ID NO: 572339 - DNA, 20 bp, Artificial Sequence
  chemically synthesized
ataattttatttagctgaag

SEQ ID NO: 572340 - DNA, 20 bp, Artificial Sequence
  chemically synthesized
tctcattatgtccagtttta

SEQ ID NO: 572341 - DNA, 20 bp, Artificial Sequence
  chemically synthesized
tgtttgtttgtctcattatg

SEQ ID NO: 572342 - DNA, 20 bp, Artificial Sequence
  chemically synthesized
agaccactttgcgtttgttt

SEQ ID NO: 572343 - DNA, 20 bp, Artificial Sequence
  chemically synthesized
ttttagaccactttgcgttt

SEQ ID NO: 572344 - DNA, 20 bp, Artificial Sequence
  chemically synthesized
aacattttagaccactttgc

SEQ ID NO: 572345 - DNA, 20 bp, Artificial Sequence
  chemically synthesized
tcgaaacattttagaccact

SEQ ID NO: 572346 - DNA, 20 bp, Artificial Sequence
  chemically synthesized
aacaaacgcaaagtggtcta

SEQ ID NO: 572347 - DNA, 20 bp, Artificial Sequence
  chemically synthesized
acgcaaagtggtctaaaatg

SEQ ID NO: 572348 - DNA, 20 bp, Artificial Sequence
  chemically synthesized
tgatgccttctctcatatat

SEQ ID NO: 572349 - DNA, 20 bp, Artificial Sequence
  chemically synthesized
agagaaggcatcatgaggat

SEQ ID NO: 572350 - DNA, 20 bp, Artificial Sequence
  chemically synthesized
atgaggatctcagctttggg

SEQ ID NO: 572351 - DNA, 20 bp, Artificial Sequence
  chemically synthesized
ctagagcattagtccagccc

SEQ ID NO: 572352 - DNA, 20 bp, Artificial Sequence
  chemically synthesized
ttcagtactctagtgagcca

SEQ ID NO: 572353 - DNA, 20 bp, Artificial Sequence
  chemically synthesized
gtggataacatgagcgtgat

SEQ ID NO: 572354 - DNA, 20 bp, Artificial Sequence
  chemically synthesized
atccacttagtaaccaatgg

SEQ ID NO: 572355 - DNA, 20 bp, Artificial Sequence
  chemically synthesized
ggggcagttttaaaaaccac

SEQ ID NO: 572356 - DNA, 20 bp, Artificial Sequence
  chemically synthesized
aacagatccctacaaacatt

SEQ ID NO: 572357 - DNA, 20 bp, Artificial Sequence
  chemically synthesized
aaccacaaatgtttgtaggg

SEQ ID NO: 572358 - DNA, 20 bp, Artificial Sequence
  chemically synthesized
agatatgtttcgcaggagaa

SEQ ID NO: 572359 - DNA, 20 bp, Artificial Sequence
  chemically synthesized
atttctccatgcttcaggag

SEQ ID NO: 572360 - DNA, 20 bp, Artificial Sequence
  chemically synthesized
aagaaaaataagttatttct

SEQ ID NO: 572361 - DNA, 20 bp, Artificial Sequence
  chemically synthesized
tgtctcaaattaaaaaaaaa

SEQ ID NO: 572362 - DNA, 20 bp, Artificial Sequence
  chemically synthesized
ttttttaatttgagacagag

SEQ ID NO: 572363 - DNA, 20 bp, Artificial Sequence
  chemically synthesized
gaggcagaggttgcagtgag

SEQ ID NO: 572364 - DNA, 20 bp, Artificial Sequence
  chemically synthesized
ctcactgcaacctctgcctc

SEQ ID NO: 572365 - DNA, 20 bp, Artificial Sequence
  chemically synthesized
aacctctgcctcccaggttt

SEQ ID NO: 572366 - DNA, 20 bp, Artificial Sequence
  chemically synthesized
attctcatgcctcagtgtag

SEQ ID NO: 572367 - DNA, 20 bp, Artificial Sequence
  chemically synthesized
ttttgtatttttagtggaaa

SEQ ID NO: 572368 - DNA, 20 bp, Artificial Sequence
  chemically synthesized
gcctggccaacacggtgaaa

SEQ ID NO: 572369 - DNA, 20 bp, Artificial Sequence
  chemically synthesized
tgcctcggcctcccaaagtg

SEQ ID NO: 572370 - DNA, 20 bp, Artificial Sequence
  chemically synthesized
cccggcctctttgaactttt

SEQ ID NO: 572371 - DNA, 20 bp, Artificial Sequence
  chemically synthesized
cctctttgaacttttttttg

SEQ ID NO: 572372 - DNA, 20 bp, Artificial Sequence
  chemically synthesized
ttgaacttttttttgttttg

SEQ ID NO: 572373 - DNA, 20 bp, Artificial Sequence
  chemically synthesized
cttttttttgttttgttttg

SEQ ID NO: 572374 - DNA, 20 bp, Artificial Sequence
  chemically synthesized
ttttgttttgttttgttttg

SEQ ID NO: 572375 - DNA, 20 bp, Artificial Sequence
  chemically synthesized
ttttgttttgttttgttttt

SEQ ID NO: 572376 - DNA, 20 bp, Artificial Sequence
  chemically synthesized
atcttactacttttattata

SEQ ID NO: 572377 - DNA, 20 bp, Artificial Sequence
  chemically synthesized
aattttattattattatact

SEQ ID NO: 572378 - DNA, 20 bp, Artificial Sequence
  chemically synthesized
agggtacatgtgcacaacgt

SEQ ID NO: 572379 - DNA, 20 bp, Artificial Sequence
  chemically synthesized
ggggaacatcacacaccggg

SEQ ID NO: 572380 - DNA, 20 bp, Artificial Sequence
  chemically synthesized
cacctatgagtgagaacatg

SEQ ID NO: 572381 - DNA, 20 bp, Artificial Sequence
  chemically synthesized
atgagtgagaacatggggtg

SEQ ID NO: 572382 - DNA, 20 bp, Artificial Sequence
  chemically synthesized
gtttggtttttggtccttgt

SEQ ID NO: 572383 - DNA, 20 bp, Artificial Sequence
  chemically synthesized
tgtgatagtttgctgagaat

SEQ ID NO: 572384 - DNA, 20 bp, Artificial Sequence
  chemically synthesized
gtttgctgagaatgatggtt

SEQ ID NO: 572385 - DNA, 20 bp, Artificial Sequence
  chemically synthesized
aggtatctagcccattttct

SEQ ID NO: 572386 - DNA, 20 bp, Artificial Sequence
  chemically synthesized
ggtatacaggatcatagcac

SEQ ID NO: 572387 - DNA, 20 bp, Artificial Sequence
  chemically synthesized
aacccctcctttactacaat

SEQ ID NO: 572388 - DNA, 20 bp, Artificial Sequence
  chemically synthesized
tttactacaatgggggtttt

SEQ ID NO: 572389 - DNA, 20 bp, Artificial Sequence
  chemically synthesized
ctgctttccagtggggaaat

SEQ ID NO: 572390 - DNA, 20 bp, Artificial Sequence
  chemically synthesized
tggggaaatgggggcttctc

SEQ ID NO: 572391 - DNA, 20 bp, Artificial Sequence
  chemically synthesized
gtagaagactgctgatttta

SEQ ID NO: 572392 - DNA, 20 bp, Artificial Sequence
  chemically synthesized
tttgttcctatgtagaagac

SEQ ID NO: 572393 - DNA, 20 bp, Artificial Sequence
  chemically synthesized
ttctacataggaacaaataa

SEQ ID NO: 572394 - DNA, 20 bp, Artificial Sequence
  chemically synthesized
ttgtttacttaatggggaga

SEQ ID NO: 572395 - DNA, 20 bp, Artificial Sequence
  chemically synthesized
ttaagtaaacaaaacttagg

SEQ ID NO: 572396 - DNA, 20 bp, Artificial Sequence
  chemically synthesized
tttttcaagcctaccctaag

SEQ ID NO: 572397 - DNA, 20 bp, Artificial Sequence
  chemically synthesized
tgtcctttttcaagcctacc

SEQ ID NO: 572398 - DNA, 20 bp, Artificial Sequence
  chemically synthesized
acaagttgtgaaattaaatt

SEQ ID NO: 572399 - DNA, 20 bp, Artificial Sequence
  chemically synthesized
ccagatttttaattcaattt

SEQ ID NO: 572400 - DNA, 20 bp, Artificial Sequence
  chemically synthesized
ttaggtgttttctggtgcca

SEQ ID NO: 572401 - DNA, 20 bp, Artificial Sequence
  chemically synthesized
aatgaataaaataaaataaa

SEQ ID NO: 572402 - DNA, 20 bp, Artificial Sequence
  chemically synthesized
aacctctgccttccgggttc

SEQ ID NO: 572403 - DNA, 20 bp, Artificial Sequence
  chemically synthesized
tgcctcagcctcccgagtag

SEQ ID NO: 572404 - DNA, 20 bp, Artificial Sequence
  chemically synthesized
tttgtattttttagtagaga

SEQ ID NO: 572405 - DNA, 20 bp, Artificial Sequence
  chemically synthesized
cacctcagcctcccaaagtg

SEQ ID NO: 572406 - DNA, 20 bp, Artificial Sequence
  chemically synthesized
aagatgcatgccgctttaaa

SEQ ID NO: 572407 - DNA, 20 bp, Artificial Sequence
  chemically synthesized
cattaaaggttaaagatgca

SEQ ID NO: 572408 - DNA, 20 bp, Artificial Sequence
  chemically synthesized
ttgaccttattcatgcaatg

SEQ ID NO: 572409 - DNA, 20 bp, Artificial Sequence
  chemically synthesized
tagagtgcaaagttgacatc

SEQ ID NO: 572410 - DNA, 20 bp, Artificial Sequence
  chemically synthesized
tataaatggttactgagaaa

SEQ ID NO: 572411 - DNA, 20 bp, Artificial Sequence
  chemically synthesized
tagaagcacgatgcagcaaa

SEQ ID NO: 572412 - DNA, 20 bp, Artificial Sequence
  chemically synthesized
gagaaacagagtttgctgca

SEQ ID NO: 572413 - DNA, 20 bp, Artificial Sequence
  chemically synthesized
ttcattatgtaatgggaact

SEQ ID NO: 572414 - DNA, 20 bp, Artificial Sequence
  chemically synthesized
aacatttttacatctagctc

SEQ ID NO: 572415 - DNA, 20 bp, Artificial Sequence
  chemically synthesized
tgttctccatttcacaatgt

SEQ ID NO: 572416 - DNA, 20 bp, Artificial Sequence
  chemically synthesized
acaatttggcctcctgtcat

SEQ ID NO: 572417 - DNA, 20 bp, Artificial Sequence
  chemically synthesized
gccatactgtctactccttc

SEQ ID NO: 572418 - DNA, 20 bp, Artificial Sequence
  chemically synthesized
gagtagacagtatggccttt

SEQ ID NO: 572419 - DNA, 20 bp, Artificial Sequence
  chemically synthesized
tttgacctacattacatttt

SEQ ID NO: 572420 - DNA, 20 bp, Artificial Sequence
  chemically synthesized
aatatatatatataattatc

SEQ ID NO: 572421 - DNA, 20 bp, Artificial Sequence
  chemically synthesized
tataaatatatatatataat

SEQ ID NO: 572422 - DNA, 20 bp, Artificial Sequence
  chemically synthesized
actccagcctgagtgacaga

SEQ ID NO: 572423 - DNA, 20 bp, Artificial Sequence
  chemically synthesized
aacctccacctctcaggttc

SEQ ID NO: 572424 - DNA, 20 bp, Artificial Sequence
  chemically synthesized
ttgggaggctgatgtggaag

SEQ ID NO: 572425 - DNA, 20 bp, Artificial Sequence
  chemically synthesized
cctggctaatttttctgtgt

SEQ ID NO: 572426 - DNA, 20 bp, Artificial Sequence
  chemically synthesized
ctcctgacctcaagtgatcc

SEQ ID NO: 572427 - DNA, 20 bp, Artificial Sequence
  chemically synthesized
tgcttcggcctcccaaagtg

SEQ ID NO: 572428 - DNA, 20 bp, Artificial Sequence
  chemically synthesized
aattcacataagttcacaga

SEQ ID NO: 572429 - DNA, 20 bp, Artificial Sequence
  chemically synthesized
aattcattattccttactta

SEQ ID NO: 572430 - DNA, 20 bp, Artificial Sequence
  chemically synthesized
ctatgggaagttgtaagtag

SEQ ID NO: 572431 - DNA, 20 bp, Artificial Sequence
  chemically synthesized
gttggtggtattcttcattg

SEQ ID NO: 572432 - DNA, 20 bp, Artificial Sequence
  chemically synthesized
gaacttactttaggccacca

SEQ ID NO: 572433 - DNA, 20 bp, Artificial Sequence
  chemically synthesized
ttaggttttcttagcctgtg

SEQ ID NO: 572434 - DNA, 20 bp, Artificial Sequence
  chemically synthesized
gttttgtgtgcatattttca

SEQ ID NO: 572435 - DNA, 20 bp, Artificial Sequence
  chemically synthesized
gtgttcctttaagaaaagac

SEQ ID NO: 572436 - DNA, 20 bp, Artificial Sequence
  chemically synthesized
aaagagaattggttctcaag

SEQ ID NO: 572437 - DNA, 20 bp, Artificial Sequence
  chemically synthesized
attataggatcatagactct

SEQ ID NO: 572438 - DNA, 20 bp, Artificial Sequence
  chemically synthesized
taggatcatagactcttttt

SEQ ID NO: 572439 - DNA, 20 bp, Artificial Sequence
  chemically synthesized
tcgggaggctgaggcaggag

SEQ ID NO: 572440 - DNA, 20 bp, Artificial Sequence
  chemically synthesized
ttttgtacttttagtagaga

SEQ ID NO: 572441 - DNA, 20 bp, Artificial Sequence
  chemically synthesized
cagggggatcacttgaggtc

SEQ ID NO: 572442 - DNA, 20 bp, Artificial Sequence
  chemically synthesized
gacctccctaagtgctggga

SEQ ID NO: 572443 - DNA, 20 bp, Artificial Sequence
  chemically synthesized
cgcctcgacctccctaagtg

SEQ ID NO: 572444 - DNA, 20 bp, Artificial Sequence
  chemically synthesized
ttttgtatttttagtagaga

SEQ ID NO: 572445 - DNA, 20 bp, Artificial Sequence
  chemically synthesized
aacctccacctcccgggttc

SEQ ID NO: 572446 - DNA, 20 bp, Artificial Sequence
  chemically synthesized
agagagagttgataggatct

SEQ ID NO: 572447 - DNA, 20 bp, Artificial Sequence
  chemically synthesized
aatcaacagtacttgcacaa

SEQ ID NO: 572448 - DNA, 20 bp, Artificial Sequence
  chemically synthesized
aaacatctttgtgcaagtac

SEQ ID NO: 572449 - DNA, 20 bp, Artificial Sequence
  chemically synthesized
tccttcaccagaactttgtc

SEQ ID NO: 572450 - DNA, 20 bp, Artificial Sequence
  chemically synthesized
tatcaggggatacatttcat

SEQ ID NO: 572451 - DNA, 20 bp, Artificial Sequence
  chemically synthesized
tacatttcatgacagtttct

SEQ ID NO: 572452 - DNA, 20 bp, Artificial Sequence
  chemically synthesized
gtcaccacatggtccaatat

SEQ ID NO: 572453 - DNA, 20 bp, Artificial Sequence
  chemically synthesized
gatcaggcctccttccgcta

SEQ ID NO: 572454 - DNA, 20 bp, Artificial Sequence
  chemically synthesized
gaggcctgatctacctagtt

SEQ ID NO: 572455 - DNA, 20 bp, Artificial Sequence
  chemically synthesized
gagagagacctacatttctc

SEQ ID NO: 572456 - DNA, 20 bp, Artificial Sequence
  chemically synthesized
tctattgtttaagctattgt

SEQ ID NO: 572457 - DNA, 20 bp, Artificial Sequence
  chemically synthesized
ctaataggacaaactgtaac

SEQ ID NO: 572458 - DNA, 20 bp, Artificial Sequence
  chemically synthesized
tttgtcctattagcagatga

SEQ ID NO: 572459 - DNA, 20 bp, Artificial Sequence
  chemically synthesized
caaatttccatcatttttta

SEQ ID NO: 572460 - DNA, 20 bp, Artificial Sequence
  chemically synthesized
agttgttattaagtggcatg

SEQ ID NO: 572461 - DNA, 20 bp, Artificial Sequence
  chemically synthesized
atgccacttaataacaactc

SEQ ID NO: 572462 - DNA, 20 bp, Artificial Sequence
  chemically synthesized
actatgggcaagtgttacag

SEQ ID NO: 572463 - DNA, 20 bp, Artificial Sequence
  chemically synthesized
gacacagcacacttaattaa

SEQ ID NO: 572464 - DNA, 20 bp, Artificial Sequence
  chemically synthesized
aagataacatgaaaatacag

SEQ ID NO: 572465 - DNA, 20 bp, Artificial Sequence
  chemically synthesized
gttatcttcttactgaacat

SEQ ID NO: 572466 - DNA, 20 bp, Artificial Sequence
  chemically synthesized
atacattgacagcagggcaa

SEQ ID NO: 572467 - DNA, 20 bp, Artificial Sequence
  chemically synthesized
gttgccctgctgtcaatgta

SEQ ID NO: 572468 - DNA, 20 bp, Artificial Sequence
  chemically synthesized
taagtcaatatgactgcaga

SEQ ID NO: 572469 - DNA, 20 bp, Artificial Sequence
  chemically synthesized
cagatgtggtttaactagtg

SEQ ID NO: 572470 - DNA, 20 bp, Artificial Sequence
  chemically synthesized
actgtacgaggcaatacagt

SEQ ID NO: 572471 - DNA, 20 bp, Artificial Sequence
  chemically synthesized
taatctccagtatgatctgg

SEQ ID NO: 572472 - DNA, 20 bp, Artificial Sequence
  chemically synthesized
taagccacaccagatcatac

SEQ ID NO: 572473 - DNA, 20 bp, Artificial Sequence
  chemically synthesized
tgtggttatttaaaatccca

SEQ ID NO: 572474 - DNA, 20 bp, Artificial Sequence
  chemically synthesized
cgctttatatgaaaaacaaa

SEQ ID NO: 572475 - DNA, 20 bp, Artificial Sequence
  chemically synthesized
ctgaggaacatctgactttg

SEQ ID NO: 572476 - DNA, 20 bp, Artificial Sequence
  chemically synthesized
acaagcaagatgtcctgcct

SEQ ID NO: 572477 - DNA, 20 bp, Artificial Sequence
  chemically synthesized
aaaatcttaaaggcaggaca

SEQ ID NO: 572478 - DNA, 20 bp, Artificial Sequence
  chemically synthesized
tgttataatcttattttgag

SEQ ID NO: 572479 - DNA, 20 bp, Artificial Sequence
  chemically synthesized
gatcaaaatcaagactcaaa

SEQ ID NO: 572480 - DNA, 20 bp, Artificial Sequence
  chemically synthesized
aattaataagtgcacaatgt

SEQ ID NO: 572481 - DNA, 20 bp, Artificial Sequence
  chemically synthesized
cctccttgcctgtactttga

SEQ ID NO: 572482 - DNA, 20 bp, Artificial Sequence
  chemically synthesized
tgttaaactgtcaatttgag

SEQ ID NO: 572483 - DNA, 20 bp, Artificial Sequence
  chemically synthesized
cacaaaacacttctcaaatt

SEQ ID NO: 572484 - DNA, 20 bp, Artificial Sequence
  chemically synthesized
atataatttggtaaatttgg

SEQ ID NO: 572485 - DNA, 20 bp, Artificial Sequence
  chemically synthesized
ttctctccatgtataattca

SEQ ID NO: 572486 - DNA, 20 bp, Artificial Sequence
  chemically synthesized
tgtataattcatgtagttta

SEQ ID NO: 572487 - DNA, 20 bp, Artificial Sequence
  chemically synthesized
ttttttactttgccaactta

SEQ ID NO: 572488 - DNA, 20 bp, Artificial Sequence
  chemically synthesized
aaagttttcaccttaatatt

SEQ ID NO: 572489 - DNA, 20 bp, Artificial Sequence
  chemically synthesized
tattcactagagtcatgttg

SEQ ID NO: 572490 - DNA, 20 bp, Artificial Sequence
  chemically synthesized
aaggaaaagaaacagttgct

SEQ ID NO: 572491 - DNA, 20 bp, Artificial Sequence
  chemically synthesized
cgtatttggaaacattgagc

SEQ ID NO: 572492 - DNA, 20 bp, Artificial Sequence
  chemically synthesized
agttgctcaatgtttccaaa

SEQ ID NO: 572493 - DNA, 20 bp, Artificial Sequence
  chemically synthesized
tgtttccaaatacggtttct

SEQ ID NO: 572494 - DNA, 20 bp, Artificial Sequence
  chemically synthesized
aatacggtttctcccagatt

SEQ ID NO: 572495 - DNA, 20 bp, Artificial Sequence
  chemically synthesized
tttattattattttttgaga

SEQ ID NO: 572496 - DNA, 20 bp, Artificial Sequence
  chemically synthesized
tgcctcagcctcccaagtag

SEQ ID NO: 572497 - DNA, 20 bp, Artificial Sequence
  chemically synthesized
ggcatgcaccaccacacccg

SEQ ID NO: 572498 - DNA, 20 bp, Artificial Sequence
  chemically synthesized
ttttttgtattcagtagaga

SEQ ID NO: 572499 - DNA, 20 bp, Artificial Sequence
  chemically synthesized
cacctcggcctcccaaagtg

SEQ ID NO: 572500 - DNA, 20 bp, Artificial Sequence
  chemically synthesized
atgagccactgcacccggcc

SEQ ID NO: 572501 - DNA, 20 bp, Artificial Sequence
  chemically synthesized
ctgcacccggcccccagatt

SEQ ID NO: 572502 - DNA, 20 bp, Artificial Sequence
  chemically synthesized
tttaaaacattaatttggct

SEQ ID NO: 572503 - DNA, 20 bp, Artificial Sequence
  chemically synthesized
ataaaagcgacaagccaaat

SEQ ID NO: 572504 - DNA, 20 bp, Artificial Sequence
  chemically synthesized
cgagctttttaaaacattaa

SEQ ID NO: 572505 - DNA, 20 bp, Artificial Sequence
  chemically synthesized
aatttttccccccatatgtt

SEQ ID NO: 572506 - DNA, 20 bp, Artificial Sequence
  chemically synthesized
tttgtttaatttttcccccc

SEQ ID NO: 572507 - DNA, 20 bp, Artificial Sequence
  chemically synthesized
tgtatgttcactacttggca

SEQ ID NO: 572508 - DNA, 20 bp, Artificial Sequence
  chemically synthesized
ataataaaaagtagtcatac

SEQ ID NO: 572509 - DNA, 20 bp, Artificial Sequence
  chemically synthesized
cacccttactctttgaggaa

SEQ ID NO: 572510 - DNA, 20 bp, Artificial Sequence
  chemically synthesized
agacatttaattaaagttcc

SEQ ID NO: 572511 - DNA, 20 bp, Artificial Sequence
  chemically synthesized
gaaatgtaaaagggtttggg

SEQ ID NO: 572512 - DNA, 20 bp, Artificial Sequence
  chemically synthesized
gatgagcggaagaaatgtaa

SEQ ID NO: 572513 - DNA, 20 bp, Artificial Sequence
  chemically synthesized
acagacataattaaaatgct

SEQ ID NO: 572514 - DNA, 20 bp, Artificial Sequence
  chemically synthesized
ttttcttttataatatttgg

SEQ ID NO: 572515 - DNA, 20 bp, Artificial Sequence
  chemically synthesized
taaaagaaaatatgaaaaac

SEQ ID NO: 572516 - DNA, 20 bp, Artificial Sequence
  chemically synthesized
tcttaaggagctactgaaac

SEQ ID NO: 572517 - DNA, 20 bp, Artificial Sequence
  chemically synthesized
cttaagaagctggaatttta

SEQ ID NO: 572518 - DNA, 20 bp, Artificial Sequence
  chemically synthesized
tgtagaaatcccattaaaat

SEQ ID NO: 572519 - DNA, 20 bp, Artificial Sequence
  chemically synthesized
acacatctattggttttccc

SEQ ID NO: 572520 - DNA, 20 bp, Artificial Sequence
  chemically synthesized
gcatgcctgcttacacatct

SEQ ID NO: 572521 - DNA, 20 bp, Artificial Sequence
  chemically synthesized
gtttgtgtgtgtgtgtgcat

SEQ ID NO: 572522 - DNA, 20 bp, Artificial Sequence
  chemically synthesized
acacacacacacaaactgtc

SEQ ID NO: 572523 - DNA, 20 bp, Artificial Sequence
  chemically synthesized
tattttcagaggaatcttga

SEQ ID NO: 572524 - DNA, 20 bp, Artificial Sequence
  chemically synthesized
cagtgaataccacagacaac

SEQ ID NO: 572525 - DNA, 20 bp, Artificial Sequence
  chemically synthesized
ccacagacaactatagtttc

SEQ ID NO: 572526 - DNA, 20 bp, Artificial Sequence
  chemically synthesized
agccgctattaaggaatgct

SEQ ID NO: 572527 - DNA, 20 bp, Artificial Sequence
  chemically synthesized
ctttctgagccgctattaag

SEQ ID NO: 572528 - DNA, 20 bp, Artificial Sequence
  chemically synthesized
gaaaggcactctttaagaga

SEQ ID NO: 572529 - DNA, 20 bp, Artificial Sequence
  chemically synthesized
taagagaaacagtttggaat

SEQ ID NO: 572530 - DNA, 20 bp, Artificial Sequence
  chemically synthesized
acaaggaagcctgaattcca

SEQ ID NO: 572531 - DNA, 20 bp, Artificial Sequence
  chemically synthesized
aggctggtttttttccattt

SEQ ID NO: 572532 - DNA, 20 bp, Artificial Sequence
  chemically synthesized
atgaagctgggattgtccag

SEQ ID NO: 572533 - DNA, 20 bp, Artificial Sequence
  chemically synthesized
aaaaaaccagcctggacaat

SEQ ID NO: 572534 - DNA, 20 bp, Artificial Sequence
  chemically synthesized
aacttgcatatagaatgaag

SEQ ID NO: 572535 - DNA, 20 bp, Artificial Sequence
  chemically synthesized
gtttgggagttaggatcaac

SEQ ID NO: 572536 - DNA, 20 bp, Artificial Sequence
  chemically synthesized
tcttgtatatgattaataaa

SEQ ID NO: 572537 - DNA, 20 bp, Artificial Sequence
  chemically synthesized
tcaatgtgttttcatcttgt

SEQ ID NO: 572538 - DNA, 20 bp, Artificial Sequence
  chemically synthesized
tagtagaccttgtttgatca

SEQ ID NO: 572539 - DNA, 20 bp, Artificial Sequence
  chemically synthesized
agaagtctcatgttagtaga

SEQ ID NO: 572540 - DNA, 20 bp, Artificial Sequence
  chemically synthesized
tctcttatttcctttctctt

SEQ ID NO: 572541 - DNA, 20 bp, Artificial Sequence
  chemically synthesized
actggggtaaatagagaatt

SEQ ID NO: 572542 - DNA, 20 bp, Artificial Sequence
  chemically synthesized
tctatttaccccagtcgtct

SEQ ID NO: 572543 - DNA, 20 bp, Artificial Sequence
  chemically synthesized
tgtctcttttccaaaatttc

SEQ ID NO: 572544 - DNA, 20 bp, Artificial Sequence
  chemically synthesized
ctcctcctaatttaccagac

SEQ ID NO: 572545 - DNA, 20 bp, Artificial Sequence
  chemically synthesized
aaggctgggtctcagtagga

SEQ ID NO: 572546 - DNA, 20 bp, Artificial Sequence
  chemically synthesized
aaaagtcaattatggataaa

SEQ ID NO: 572547 - DNA, 20 bp, Artificial Sequence
  chemically synthesized
atatccttcctcattcctgg

SEQ ID NO: 572548 - DNA, 20 bp, Artificial Sequence
  chemically synthesized
aagagaatgggaggagggat

SEQ ID NO: 572549 - DNA, 20 bp, Artificial Sequence
  chemically synthesized
tcctcccattctcttattac

SEQ ID NO: 572550 - DNA, 20 bp, Artificial Sequence
  chemically synthesized
cccaggattacaaagtgcgg

SEQ ID NO: 572551 - DNA, 20 bp, Artificial Sequence
  chemically synthesized
ttcaccgcactttgtaatcc

SEQ ID NO: 572552 - DNA, 20 bp, Artificial Sequence
  chemically synthesized
tcagcatttgttgaaaatcc

SEQ ID NO: 572553 - DNA, 20 bp, Artificial Sequence
  chemically synthesized
tggggattttcaacaaatgc

SEQ ID NO: 572554 - DNA, 20 bp, Artificial Sequence
  chemically synthesized
tgatgcttggagcccacccc

SEQ ID NO: 572555 - DNA, 20 bp, Artificial Sequence
  chemically synthesized
tgagatgcagcctgggcatg

SEQ ID NO: 572556 - DNA, 20 bp, Artificial Sequence
  chemically synthesized
aggagctttataagctgccc

SEQ ID NO: 572557 - DNA, 20 bp, Artificial Sequence
  chemically synthesized
ccacatatcagaatcccctg

SEQ ID NO: 572558 - DNA, 20 bp, Artificial Sequence
  chemically synthesized
aggggattctgatatgtggt

SEQ ID NO: 572559 - DNA, 20 bp, Artificial Sequence
  chemically synthesized
tgggataacaacttgataat

SEQ ID NO: 572560 - DNA, 20 bp, Artificial Sequence
  chemically synthesized
ttagtgcaaccttcaactct

SEQ ID NO: 572561 - DNA, 20 bp, Artificial Sequence
  chemically synthesized
atatatagtagtagcagtct

SEQ ID NO: 572562 - DNA, 20 bp, Artificial Sequence
  chemically synthesized
tatatatctctgtgaacctt

SEQ ID NO: 572563 - DNA, 20 bp, Artificial Sequence
  chemically synthesized
gcatgtaatagatatcgcaa

SEQ ID NO: 572564 - DNA, 20 bp, Artificial Sequence
  chemically synthesized
gtgtttttgctgagggaaat

SEQ ID NO: 572565 - DNA, 20 bp, Artificial Sequence
  chemically synthesized
aatttaagacaatcaagata

SEQ ID NO: 572566 - DNA, 20 bp, Artificial Sequence
  chemically synthesized
tattttagttaatccatgta

SEQ ID NO: 572567 - DNA, 20 bp, Artificial Sequence
  chemically synthesized
ggttttgctggattcttata

SEQ ID NO: 572568 - DNA, 20 bp, Artificial Sequence
  chemically synthesized
tataagaatccagcaaaacc

SEQ ID NO: 572569 - DNA, 20 bp, Artificial Sequence
  chemically synthesized
aagcccaagcaacaggtttt

SEQ ID NO: 572570 - DNA, 20 bp, Artificial Sequence
  chemically synthesized
aatccagcaaaacctgttgc

SEQ ID NO: 572571 - DNA, 20 bp, Artificial Sequence
  chemically synthesized
taaaattaaaagcccaagca

SEQ ID NO: 572572 - DNA, 20 bp, Artificial Sequence
  chemically synthesized
caatggccttgtatccaacc

SEQ ID NO: 572573 - DNA, 20 bp, Artificial Sequence
  chemically synthesized
aaatacagtattctcttacc

SEQ ID NO: 572574 - DNA, 20 bp, Artificial Sequence
  chemically synthesized
tttttatgaagtgtaggatt

SEQ ID NO: 572575 - DNA, 20 bp, Artificial Sequence
  chemically synthesized
ttctacaatttttatgaagt

SEQ ID NO: 572576 - DNA, 20 bp, Artificial Sequence
  chemically synthesized
ttgttagaaggcaggcagaa

SEQ ID NO: 572577 - DNA, 20 bp, Artificial Sequence
  chemically synthesized
ctaacaaatgttggttaacg

SEQ ID NO: 572578 - DNA, 20 bp, Artificial Sequence
  chemically synthesized
ttcagcatgaagcatgaagc

SEQ ID NO: 572579 - DNA, 20 bp, Artificial Sequence
  chemically synthesized
ggctacctcaagccgcagct

SEQ ID NO: 572580 - DNA, 20 bp, Artificial Sequence
  chemically synthesized
gaggaatggctacctcaagc

SEQ ID NO: 572581 - DNA, 20 bp, Artificial Sequence
  chemically synthesized
gaaataatggagaaccacag

SEQ ID NO: 572582 - DNA, 20 bp, Artificial Sequence
  chemically synthesized
gggtaagagggtcttctgca

SEQ ID NO: 572583 - DNA, 20 bp, Artificial Sequence
  chemically synthesized
cacaacgattaaatagttct

SEQ ID NO: 572584 - DNA, 20 bp, Artificial Sequence
  chemically synthesized
tgggaccactcttataaatg

SEQ ID NO: 572585 - DNA, 20 bp, Artificial Sequence
  chemically synthesized
aacagagactgaaataaagt

SEQ ID NO: 572586 - DNA, 20 bp, Artificial Sequence
  chemically synthesized
ctgaaataaagtggtcgttt

SEQ ID NO: 572587 - DNA, 20 bp, Artificial Sequence
  chemically synthesized
tcgtttcaaagctttaaata

SEQ ID NO: 572588 - DNA, 20 bp, Artificial Sequence
  chemically synthesized
gtagctgaaagcagagtatt

SEQ ID NO: 572589 - DNA, 20 bp, Artificial Sequence
  chemically synthesized
atatgggctcctgtttcctt

SEQ ID NO: 572590 - DNA, 20 bp, Artificial Sequence
  chemically synthesized
gcctgtgctataatatgggc

SEQ ID NO: 572591 - DNA, 20 bp, Artificial Sequence
  chemically synthesized
acaggagcccatattatagc

SEQ ID NO: 572592 - DNA, 20 bp, Artificial Sequence
  chemically synthesized
tcttcttcggggctctttca

SEQ ID NO: 572593 - DNA, 20 bp, Artificial Sequence
  chemically synthesized
cttaccccattaatttctaa

SEQ ID NO: 572594 - DNA, 20 bp, Artificial Sequence
  chemically synthesized
atgtaggtaatcggtataaa

SEQ ID NO: 572595 - DNA, 20 bp, Artificial Sequence
  chemically synthesized
actcaagaaagcagccttta

SEQ ID NO: 572596 - DNA, 20 bp, Artificial Sequence
  chemically synthesized
gaaaaaagaaattataggct

SEQ ID NO: 572597 - DNA, 20 bp, Artificial Sequence
  chemically synthesized
aagaaaagaaaaaagaaatt

SEQ ID NO: 572598 - DNA, 20 bp, Artificial Sequence
  chemically synthesized
aacctcctcctcccaggttc

SEQ ID NO: 572599 - DNA, 20 bp, Artificial Sequence
  chemically synthesized
tttttgtatttttagtagag

SEQ ID NO: 572600 - DNA, 20 bp, Artificial Sequence
  chemically synthesized
gaaacaggactttagaaatt

SEQ ID NO: 572601 - DNA, 20 bp, Artificial Sequence
  chemically synthesized
caagcctataatttctaaag

SEQ ID NO: 572602 - DNA, 20 bp, Artificial Sequence
  chemically synthesized
ttctaaagtcctgtttcatt

SEQ ID NO: 572603 - DNA, 20 bp, Artificial Sequence
  chemically synthesized
tactaatgactgcaggggag

SEQ ID NO: 572604 - DNA, 20 bp, Artificial Sequence
  chemically synthesized
aatacgtaaataatatgtgg

SEQ ID NO: 572605 - DNA, 20 bp, Artificial Sequence
  chemically synthesized
ttcttttttttttttttgga

SEQ ID NO: 572606 - DNA, 20 bp, Artificial Sequence
  chemically synthesized
aacctctgcctcctgagttc

SEQ ID NO: 572607 - DNA, 20 bp, Artificial Sequence
  chemically synthesized
tgcctcagcctcctgagtag

SEQ ID NO: 572608 - DNA, 20 bp, Artificial Sequence
  chemically synthesized
cactgtggcctcccaaagtg

SEQ ID NO: 572609 - DNA, 20 bp, Artificial Sequence
  chemically synthesized
cctggccctattattactct

SEQ ID NO: 572610 - DNA, 20 bp, Artificial Sequence
  chemically synthesized
aaaaaaaaaaaaaaaagaat

SEQ ID NO: 572611 - DNA, 20 bp, Artificial Sequence
  chemically synthesized
gaatgctggcttataaatgg

SEQ ID NO: 572612 - DNA, 20 bp, Artificial Sequence
  chemically synthesized
gagtagattttctggaaaat

SEQ ID NO: 572613 - DNA, 20 bp, Artificial Sequence
  chemically synthesized
taacaaaatatcataaactg

SEQ ID NO: 572614 - DNA, 20 bp, Artificial Sequence
  chemically synthesized
ctttggttgtctataagcca

SEQ ID NO: 572615 - DNA, 20 bp, Artificial Sequence
  chemically synthesized
ctgggtggcttatagacaac

SEQ ID NO: 572616 - DNA, 20 bp, Artificial Sequence
  chemically synthesized
aagtctgatatcaaggcgct

SEQ ID NO: 572617 - DNA, 20 bp, Artificial Sequence
  chemically synthesized
tatcaaggcgctggcagatt

SEQ ID NO: 572618 - DNA, 20 bp, Artificial Sequence
  chemically synthesized
agattcagtgtttggtgaag

SEQ ID NO: 572619 - DNA, 20 bp, Artificial Sequence
  chemically synthesized
cttataaaagagacccagag

SEQ ID NO: 572620 - DNA, 20 bp, Artificial Sequence
  chemically synthesized
tgagggcagagcccacatga

SEQ ID NO: 572621 - DNA, 20 bp, Artificial Sequence
  chemically synthesized
taggaggtaggccccttggg

SEQ ID NO: 572622 - DNA, 20 bp, Artificial Sequence
  chemically synthesized
taataccatcatatatggaa

SEQ ID NO: 572623 - DNA, 20 bp, Artificial Sequence
  chemically synthesized
ttttgtgattgccttactgc

SEQ ID NO: 572624 - DNA, 20 bp, Artificial Sequence
  chemically synthesized
ttaaatctaactgccctatt

SEQ ID NO: 572625 - DNA, 20 bp, Artificial Sequence
  chemically synthesized
ggcaatcacaaaatagggca

SEQ ID NO: 572626 - DNA, 20 bp, Artificial Sequence
  chemically synthesized
ccaatagcaaaaactacatc

SEQ ID NO: 572627 - DNA, 20 bp, Artificial Sequence
  chemically synthesized
ctaacctataaagcattgga

SEQ ID NO: 572628 - DNA, 20 bp, Artificial Sequence
  chemically synthesized
aggatgagaacttgatccac

SEQ ID NO: 572629 - DNA, 20 bp, Artificial Sequence
  chemically synthesized
atccaaagagaagtgttgga

SEQ ID NO: 572630 - DNA, 20 bp, Artificial Sequence
  chemically synthesized
aagagaagtgttggaacatg

SEQ ID NO: 572631 - DNA, 20 bp, Artificial Sequence
  chemically synthesized
gcacattttcatgcaaatgt

SEQ ID NO: 572632 - DNA, 20 bp, Artificial Sequence
  chemically synthesized
ggtggtaacagttatcaggt

SEQ ID NO: 572633 - DNA, 20 bp, Artificial Sequence
  chemically synthesized
atttactagacattcttttt

SEQ ID NO: 572634 - DNA, 20 bp, Artificial Sequence
  chemically synthesized
agacattctttttttttgtt

SEQ ID NO: 572635 - DNA, 20 bp, Artificial Sequence
  chemically synthesized
tggggaggctgaggcaggag

SEQ ID NO: 572636 - DNA, 20 bp, Artificial Sequence
  chemically synthesized
ttttgtatttttagcagaga

SEQ ID NO: 572637 - DNA, 20 bp, Artificial Sequence
  chemically synthesized
tgccttggcctcccaaagtg

SEQ ID NO: 572638 - DNA, 20 bp, Artificial Sequence
  chemically synthesized
gggatagtagaggtcatgtg

SEQ ID NO: 572639 - DNA, 20 bp, Artificial Sequence
  chemically synthesized
attataatactagttagaac

SEQ ID NO: 572640 - DNA, 20 bp, Artificial Sequence
  chemically synthesized
ttcttactgtaggtcatggt

SEQ ID NO: 572641 - DNA, 20 bp, Artificial Sequence
  chemically synthesized
cattcatgggtgtatgtgtg

SEQ ID NO: 572642 - DNA, 20 bp, Artificial Sequence
  chemically synthesized
gacctggtgtagtaggcctg

SEQ ID NO: 572643 - DNA, 20 bp, Artificial Sequence
  chemically synthesized
tctgttatactctctcagca

SEQ ID NO: 572644 - DNA, 20 bp, Artificial Sequence
  chemically synthesized
ccatctctagatctgtattc

SEQ ID NO: 572645 - DNA, 20 bp, Artificial Sequence
  chemically synthesized
gcaaaatgttattgcttcag

SEQ ID NO: 572646 - DNA, 20 bp, Artificial Sequence
  chemically synthesized
agctcttatgtgcaaaatgt

SEQ ID NO: 572647 - DNA, 20 bp, Artificial Sequence
  chemically synthesized
aataacattttgcacataag

SEQ ID NO: 572648 - DNA, 20 bp, Artificial Sequence
  chemically synthesized
tgacctactccagctctacc

SEQ ID NO: 572649 - DNA, 20 bp, Artificial Sequence
  chemically synthesized
tcatccaacatgttcattgg

SEQ ID NO: 572650 - DNA, 20 bp, Artificial Sequence
  chemically synthesized
accttttctcattatttttt

SEQ ID NO: 572651 - DNA, 20 bp, Artificial Sequence
  chemically synthesized
attattttttcagggcttga

SEQ ID NO: 572652 - DNA, 20 bp, Artificial Sequence
  chemically synthesized
ttgtgtcattaccaacttaa

SEQ ID NO: 572653 - DNA, 20 bp, Artificial Sequence
  chemically synthesized
tatcaaaacttaagaaaaat

SEQ ID NO: 572654 - DNA, 20 bp, Artificial Sequence
  chemically synthesized
ctagaaaacacccatttttc

SEQ ID NO: 572655 - DNA, 20 bp, Artificial Sequence
  chemically synthesized
aaagttgggtaaaaatacac

SEQ ID NO: 572656 - DNA, 20 bp, Artificial Sequence
  chemically synthesized
gtaaaaatacactattgttt

SEQ ID NO: 572657 - DNA, 20 bp, Artificial Sequence
  chemically synthesized
gttcctaactcctgtcttta

SEQ ID NO: 572658 - DNA, 20 bp, Artificial Sequence
  chemically synthesized
tgtaaattctattctataga

SEQ ID NO: 572659 - DNA, 20 bp, Artificial Sequence
  chemically synthesized
atttacatcctgtgagttgg

SEQ ID NO: 572660 - DNA, 20 bp, Artificial Sequence
  chemically synthesized
gttggtcatgtttttagtaa

SEQ ID NO: 572661 - DNA, 20 bp, Artificial Sequence
  chemically synthesized
aattgacttggattctggtt

SEQ ID NO: 572662 - DNA, 20 bp, Artificial Sequence
  chemically synthesized
gaagtaatggacaaaattga

SEQ ID NO: 572663 - DNA, 20 bp, Artificial Sequence
  chemically synthesized
attatttgtcatccagctga

SEQ ID NO: 572664 - DNA, 20 bp, Artificial Sequence
  chemically synthesized
accctcagctggatgacaaa

SEQ ID NO: 572665 - DNA, 20 bp, Artificial Sequence
  chemically synthesized
gacaaataatgattgccagg

SEQ ID NO: 572666 - DNA, 20 bp, Artificial Sequence
  chemically synthesized
aaacagatgtcaggtgagag

SEQ ID NO: 572667 - DNA, 20 bp, Artificial Sequence
  chemically synthesized
aagcaaaactctcacctgac

SEQ ID NO: 572668 - DNA, 20 bp, Artificial Sequence
  chemically synthesized
aaaaaaaacagatgtcaggt

SEQ ID NO: 572669 - DNA, 20 bp, Artificial Sequence
  chemically synthesized
ttaaaactaacttgctataa

SEQ ID NO: 572670 - DNA, 20 bp, Artificial Sequence
  chemically synthesized
tttaatcacccttatagcaa

SEQ ID NO: 572671 - DNA, 20 bp, Artificial Sequence
  chemically synthesized
agccacgtctggttataaga

SEQ ID NO: 572672 - DNA, 20 bp, Artificial Sequence
  chemically synthesized
aacttcttcttataaccaga

SEQ ID NO: 572673 - DNA, 20 bp, Artificial Sequence
  chemically synthesized
taccttatggcctgggaata

SEQ ID NO: 572674 - DNA, 20 bp, Artificial Sequence
  chemically synthesized
tgtcatacaactgctgccat

SEQ ID NO: 572675 - DNA, 20 bp, Artificial Sequence
  chemically synthesized
ggcactggatgggagcaagg

SEQ ID NO: 572676 - DNA, 20 bp, Artificial Sequence
  chemically synthesized
cggagattacactttgattc

SEQ ID NO: 572677 - DNA, 20 bp, Artificial Sequence
  chemically synthesized
gagtggcagcggagattaca

SEQ ID NO: 572678 - DNA, 20 bp, Artificial Sequence
  chemically synthesized
ttgaacatgaggagtggcag

SEQ ID NO: 572679 - DNA, 20 bp, Artificial Sequence
  chemically synthesized
ctttaatattgcataatggt

SEQ ID NO: 572680 - DNA, 20 bp, Artificial Sequence
  chemically synthesized
cattaacagagttccaggat

SEQ ID NO: 572681 - DNA, 20 bp, Artificial Sequence
  chemically synthesized
ttcacaacattaacagagtt

SEQ ID NO: 572682 - DNA, 20 bp, Artificial Sequence
  chemically synthesized
tccctgctttttacaatgaa

SEQ ID NO: 572683 - DNA, 20 bp, Artificial Sequence
  chemically synthesized
tcattgtaaaaagcagggag

SEQ ID NO: 572684 - DNA, 20 bp, Artificial Sequence
  chemically synthesized
ccccatatagaaactcaact

SEQ ID NO: 572685 - DNA, 20 bp, Artificial Sequence
  chemically synthesized
gcccagctatttttcagatg

SEQ ID NO: 572686 - DNA, 20 bp, Artificial Sequence
  chemically synthesized
cacaaaataatagaggtaaa

SEQ ID NO: 572687 - DNA, 20 bp, Artificial Sequence
  chemically synthesized
cttatttgcttattttattc

SEQ ID NO: 572688 - DNA, 20 bp, Artificial Sequence
  chemically synthesized
gaataaaataagcaaataag

SEQ ID NO: 572689 - DNA, 20 bp, Artificial Sequence
  chemically synthesized
gtagactagaaactagtctt

SEQ ID NO: 572690 - DNA, 20 bp, Artificial Sequence
  chemically synthesized
aaataagactagtttctagt

SEQ ID NO: 572691 - DNA, 20 bp, Artificial Sequence
  chemically synthesized
aatgcgagaactttagttaa

SEQ ID NO: 572692 - DNA, 20 bp, Artificial Sequence
  chemically synthesized
attcacctagaataaaataa

SEQ ID NO: 572693 - DNA, 20 bp, Artificial Sequence
  chemically synthesized
catataataattgatagaaa

SEQ ID NO: 572694 - DNA, 20 bp, Artificial Sequence
  chemically synthesized
tattcaagtacaactaaacc

SEQ ID NO: 572695 - DNA, 20 bp, Artificial Sequence
  chemically synthesized
attattttctgatgaaatct

SEQ ID NO: 572696 - DNA, 20 bp, Artificial Sequence
  chemically synthesized
tttgcaatagcagctcattt

SEQ ID NO: 572697 - DNA, 20 bp, Artificial Sequence
  chemically synthesized
atatgatgtaaacaggcatt

SEQ ID NO: 572698 - DNA, 20 bp, Artificial Sequence
  chemically synthesized
tttatctgaaagcccaaaat

SEQ ID NO: 572699 - DNA, 20 bp, Artificial Sequence
  chemically synthesized
gtatcctgttcaaaaattta

SEQ ID NO: 572700 - DNA, 20 bp, Artificial Sequence
  chemically synthesized
aaatttttgaacaggatacg

SEQ ID NO: 572701 - DNA, 20 bp, Artificial Sequence
  chemically synthesized
attcaacgctcttcactaca

SEQ ID NO: 572702 - DNA, 20 bp, Artificial Sequence
  chemically synthesized
agtgaagagcgttgaattgt

SEQ ID NO: 572703 - DNA, 20 bp, Artificial Sequence
  chemically synthesized
gaattgtgtctgatttctga

SEQ ID NO: 572704 - DNA, 20 bp, Artificial Sequence
  chemically synthesized
ctttaatttatagattagga

SEQ ID NO: 572705 - DNA, 20 bp, Artificial Sequence
  chemically synthesized
atttcctaatctataaatta

SEQ ID NO: 572706 - DNA, 20 bp, Artificial Sequence
  chemically synthesized
ctaggccaaaccctttaatt

SEQ ID NO: 572707 - DNA, 20 bp, Artificial Sequence
  chemically synthesized
ctagataatttctagtcttt

SEQ ID NO: 572708 - DNA, 20 bp, Artificial Sequence
  chemically synthesized
cttttctggcttcaacccct

SEQ ID NO: 572709 - DNA, 20 bp, Artificial Sequence
  chemically synthesized
atatatatatatatatgtgt

SEQ ID NO: 572710 - DNA, 20 bp, Artificial Sequence
  chemically synthesized
tcgggaggctgaggtgggag

SEQ ID NO: 572711 - DNA, 20 bp, Artificial Sequence
  chemically synthesized
gcatgccaccacacccggct

SEQ ID NO: 572712 - DNA, 20 bp, Artificial Sequence
  chemically synthesized
ttttgtatttttagtagaga

SEQ ID NO: 572713 - DNA, 20 bp, Artificial Sequence
  chemically synthesized
cctgaggccaggagttcgag

SEQ ID NO: 572714 - DNA, 20 bp, Artificial Sequence
  chemically synthesized
tgccttggcctctcaaagtg

SEQ ID NO: 572715 - DNA, 20 bp, Artificial Sequence
  chemically synthesized
ggcatgggccaccgcacctg

SEQ ID NO: 572716 - DNA, 20 bp, Artificial Sequence
  chemically synthesized
tgttagcagctatatgtttc

SEQ ID NO: 572717 - DNA, 20 bp, Artificial Sequence
  chemically synthesized
ttgggaaacatatagctgct

SEQ ID NO: 572718 - DNA, 20 bp, Artificial Sequence
  chemically synthesized
agttaaaactgttagcagct

SEQ ID NO: 572719 - DNA, 20 bp, Artificial Sequence
  chemically synthesized
aacagttttaacttcctact

SEQ ID NO: 572720 - DNA, 20 bp, Artificial Sequence
  chemically synthesized
aacttcctactctatgttta

SEQ ID NO: 572721 - DNA, 20 bp, Artificial Sequence
  chemically synthesized
gctgcagtttaatattgtct

SEQ ID NO: 572722 - DNA, 20 bp, Artificial Sequence
  chemically synthesized
ttttcttctccatgtgttgc

SEQ ID NO: 572723 - DNA, 20 bp, Artificial Sequence
  chemically synthesized
cccatcttaccccatttcca

SEQ ID NO: 572724 - DNA, 20 bp, Artificial Sequence
  chemically synthesized
ggggtaagatgggactctag

SEQ ID NO: 572725 - DNA, 20 bp, Artificial Sequence
  chemically synthesized
ttacttaaaatttcagcatg

SEQ ID NO: 572726 - DNA, 20 bp, Artificial Sequence
  chemically synthesized
tagaatactcctacctcttc

SEQ ID NO: 572727 - DNA, 20 bp, Artificial Sequence
  chemically synthesized
ttactttggaaagtatccta

SEQ ID NO: 572728 - DNA, 20 bp, Artificial Sequence
  chemically synthesized
ttggaaagtatcctatggag

SEQ ID NO: 572729 - DNA, 20 bp, Artificial Sequence
  chemically synthesized
agaattcatgtgaggcaaaa

SEQ ID NO: 572730 - DNA, 20 bp, Artificial Sequence
  chemically synthesized
cttataactgcccagtggtt

SEQ ID NO: 572731 - DNA, 20 bp, Artificial Sequence
  chemically synthesized
aaaaagtcttataactgccc

SEQ ID NO: 572732 - DNA, 20 bp, Artificial Sequence
  chemically synthesized
cctatagccttgacctgtgt

SEQ ID NO: 572733 - DNA, 20 bp, Artificial Sequence
  chemically synthesized
ctcccacctatagccttgac

SEQ ID NO: 572734 - DNA, 20 bp, Artificial Sequence
  chemically synthesized
aaaattaagaccatttctca

SEQ ID NO: 572735 - DNA, 20 bp, Artificial Sequence
  chemically synthesized
tggtcttaattttttgttat

SEQ ID NO: 572736 - DNA, 20 bp, Artificial Sequence
  chemically synthesized
atgccaggcagtgaattcat

SEQ ID NO: 572737 - DNA, 20 bp, Artificial Sequence
  chemically synthesized
aatgaattcactgcctggca

SEQ ID NO: 572738 - DNA, 20 bp, Artificial Sequence
  chemically synthesized
tttccacaagggtgtactcc

SEQ ID NO: 572739 - DNA, 20 bp, Artificial Sequence
  chemically synthesized
cctctaaaatgtacagactt

SEQ ID NO: 572740 - DNA, 20 bp, Artificial Sequence
  chemically synthesized
aaaatgtacagactttatag

SEQ ID NO: 572741 - DNA, 20 bp, Artificial Sequence
  chemically synthesized
ccattacctgacagggtaat

SEQ ID NO: 572742 - DNA, 20 bp, Artificial Sequence
  chemically synthesized
cagttttatttgcactggtg

SEQ ID NO: 572743 - DNA, 20 bp, Artificial Sequence
  chemically synthesized
aattatcattttatttgtat

SEQ ID NO: 572744 - DNA, 20 bp, Artificial Sequence
  chemically synthesized
acaaaatgcatcgcatttaa

SEQ ID NO: 572745 - DNA, 20 bp, Artificial Sequence
  chemically synthesized
ggtttaaaaacacaacacac

SEQ ID NO: 572746 - DNA, 20 bp, Artificial Sequence
  chemically synthesized
ctttgggaagctgcagtgtg

SEQ ID NO: 572747 - DNA, 20 bp, Artificial Sequence
  chemically synthesized
cacaacacactgcagcttcc

SEQ ID NO: 572748 - DNA, 20 bp, Artificial Sequence
  chemically synthesized
tttttttttccagtaaaata

SEQ ID NO: 572749 - DNA, 20 bp, Artificial Sequence
  chemically synthesized
ccaaaggaagatgaattgct

SEQ ID NO: 572750 - DNA, 20 bp, Artificial Sequence
  chemically synthesized
atgaatgacattttactgtg

SEQ ID NO: 572751 - DNA, 20 bp, Artificial Sequence
  chemically synthesized
aaggcagcatctccgaggga

SEQ ID NO: 572752 - DNA, 20 bp, Artificial Sequence
  chemically synthesized
tattttaaggcagcatctcc

SEQ ID NO: 572753 - DNA, 20 bp, Artificial Sequence
  chemically synthesized
aagagtattctgttttctac

SEQ ID NO: 572754 - DNA, 20 bp, Artificial Sequence
  chemically synthesized
tttattcataattaagagta

SEQ ID NO: 572755 - DNA, 20 bp, Artificial Sequence
  chemically synthesized
catgagatggatatgcaatt

SEQ ID NO: 572756 - DNA, 20 bp, Artificial Sequence
  chemically synthesized
aagctgtatacagctgtgtt

SEQ ID NO: 572757 - DNA, 20 bp, Artificial Sequence
  chemically synthesized
aaactggaaacacagctgta

SEQ ID NO: 572758 - DNA, 20 bp, Artificial Sequence
  chemically synthesized
catctctaagctgtatacag

SEQ ID NO: 572759 - DNA, 20 bp, Artificial Sequence
  chemically synthesized
aaacatctgcgtcattactg

SEQ ID NO: 572760 - DNA, 20 bp, Artificial Sequence
  chemically synthesized
aatcataccagtaatgacgc

SEQ ID NO: 572761 - DNA, 20 bp, Artificial Sequence
  chemically synthesized
atgacgcagatgtttataaa

SEQ ID NO: 572762 - DNA, 20 bp, Artificial Sequence
  chemically synthesized
ttcagtgacacaatataaga

SEQ ID NO: 572763 - DNA, 20 bp, Artificial Sequence
  chemically synthesized
ttcttatattgtgtcactga

SEQ ID NO: 572764 - DNA, 20 bp, Artificial Sequence
  chemically synthesized
gatcctgattcctggtgttc

SEQ ID NO: 572765 - DNA, 20 bp, Artificial Sequence
  chemically synthesized
ctaatttgccgtccctgaga

SEQ ID NO: 572766 - DNA, 20 bp, Artificial Sequence
  chemically synthesized
gtgttgtctgaatgtcagca

SEQ ID NO: 572767 - DNA, 20 bp, Artificial Sequence
  chemically synthesized
gaatgtcagcaatttgattc

SEQ ID NO: 572768 - DNA, 20 bp, Artificial Sequence
  chemically synthesized
ttgaagaccatgcaactaac

SEQ ID NO: 572769 - DNA, 20 bp, Artificial Sequence
  chemically synthesized
tgccagcaacttttggttgt

SEQ ID NO: 572770 - DNA, 20 bp, Artificial Sequence
  chemically synthesized
ctggtttgccagcaactttt

SEQ ID NO: 572771 - DNA, 20 bp, Artificial Sequence
  chemically synthesized
aaagttgctggcaaaccagt

SEQ ID NO: 572772 - DNA, 20 bp, Artificial Sequence
  chemically synthesized
cttctctgattgaagcaggg

SEQ ID NO: 572773 - DNA, 20 bp, Artificial Sequence
  chemically synthesized
tacagatactttaccgtctt

SEQ ID NO: 572774 - DNA, 20 bp, Artificial Sequence
  chemically synthesized
acagtcacacacagcagtgt

SEQ ID NO: 572775 - DNA, 20 bp, Artificial Sequence
  chemically synthesized
gccctggggttctcttttct

SEQ ID NO: 572776 - DNA, 20 bp, Artificial Sequence
  chemically synthesized
actgccgggaaaagagcaga

SEQ ID NO: 572777 - DNA, 20 bp, Artificial Sequence
  chemically synthesized
tgcttccttagttgtgaaga

SEQ ID NO: 572778 - DNA, 20 bp, Artificial Sequence
  chemically synthesized
tcctactgcttccttagttg

SEQ ID NO: 572779 - DNA, 20 bp, Artificial Sequence
  chemically synthesized
gtgtaatgacggcattttcc

SEQ ID NO: 572780 - DNA, 20 bp, Artificial Sequence
  chemically synthesized
ttctgttgcactttggaaac

SEQ ID NO: 572781 - DNA, 20 bp, Artificial Sequence
  chemically synthesized
gcactttggaaacttccgtt

SEQ ID NO: 572782 - DNA, 20 bp, Artificial Sequence
  chemically synthesized
ggtgtggataagcaaaaaac

SEQ ID NO: 572783 - DNA, 20 bp, Artificial Sequence
  chemically synthesized
aagggaaatgtctctatggt

SEQ ID NO: 572784 - DNA, 20 bp, Artificial Sequence
  chemically synthesized
gtctatgcagagatcatgta

SEQ ID NO: 572785 - DNA, 20 bp, Artificial Sequence
  chemically synthesized
ttacatgatctctgcataga

SEQ ID NO: 572786 - DNA, 20 bp, Artificial Sequence
  chemically synthesized
actggatactgtgtcctaac

SEQ ID NO: 572787 - DNA, 20 bp, Artificial Sequence
  chemically synthesized
actgtgtcctaaccatagtt

SEQ ID NO: 572788 - DNA, 20 bp, Artificial Sequence
  chemically synthesized
catagactagtctttggaaa

SEQ ID NO: 572789 - DNA, 20 bp, Artificial Sequence
  chemically synthesized
tagtctttggaaatcaggtt

SEQ ID NO: 572790 - DNA, 20 bp, Artificial Sequence
  chemically synthesized
gctttgtccagaaaccaaaa

SEQ ID NO: 572791 - DNA, 20 bp, Artificial Sequence
  chemically synthesized
tcaggtttttggtttctgga

SEQ ID NO: 572792 - DNA, 20 bp, Artificial Sequence
  chemically synthesized
ttgttggtttgaataatgcc

SEQ ID NO: 572793 - DNA, 20 bp, Artificial Sequence
  chemically synthesized
caccatccagcctaatagtt

SEQ ID NO: 572794 - DNA, 20 bp, Artificial Sequence
  chemically synthesized
ccaacaactattaggctgga

SEQ ID NO: 572795 - DNA, 20 bp, Artificial Sequence
  chemically synthesized
aaagatggaagatggtagac

SEQ ID NO: 572796 - DNA, 20 bp, Artificial Sequence
  chemically synthesized
tttgactacaccttacagtg

SEQ ID NO: 572797 - DNA, 20 bp, Artificial Sequence
  chemically synthesized
acagaagatatatttgtcac

SEQ ID NO: 572798 - DNA, 20 bp, Artificial Sequence
  chemically synthesized
agatatatttgtcaccttag

SEQ ID NO: 572799 - DNA, 20 bp, Artificial Sequence
  chemically synthesized
gttttattttcctttacagc

SEQ ID NO: 572800 - DNA, 20 bp, Artificial Sequence
  chemically synthesized
ttaactaatgtcagactatc

SEQ ID NO: 572801 - DNA, 20 bp, Artificial Sequence
  chemically synthesized
ctgaattcaaggaggatgcc

SEQ ID NO: 572802 - DNA, 20 bp, Artificial Sequence
  chemically synthesized
tcaggggagaccttttacta

SEQ ID NO: 572803 - DNA, 20 bp, Artificial Sequence
  chemically synthesized
cttgaggctcaaataaacaa

SEQ ID NO: 572804 - DNA, 20 bp, Artificial Sequence
  chemically synthesized
gtcaacacagtggaaaactg

SEQ ID NO: 572805 - DNA, 20 bp, Artificial Sequence
  chemically synthesized
tggtgtgtctttttatgtgt

SEQ ID NO: 572806 - DNA, 20 bp, Artificial Sequence
  chemically synthesized
atatagtggtgtgtcttttt

SEQ ID NO: 572807 - DNA, 20 bp, Artificial Sequence
  chemically synthesized
taaaaagacacaccactata

SEQ ID NO: 572808 - DNA, 20 bp, Artificial Sequence
  chemically synthesized
tatgttggatacctataaat

SEQ ID NO: 572809 - DNA, 20 bp, Artificial Sequence
  chemically synthesized
atgtgttagtctgcacaagt

SEQ ID NO: 572810 - DNA, 20 bp, Artificial Sequence
  chemically synthesized
ggctttgcctataatttcag

SEQ ID NO: 572811 - DNA, 20 bp, Artificial Sequence
  chemically synthesized
taaatttcattacctgaagg

SEQ ID NO: 572812 - DNA, 20 bp, Artificial Sequence
  chemically synthesized
tcacagtatgcatgtactca

SEQ ID NO: 572813 - DNA, 20 bp, Artificial Sequence
  chemically synthesized
gctagtaaataatgtatgat

SEQ ID NO: 572814 - DNA, 20 bp, Artificial Sequence
  chemically synthesized
ctgaacctcattataatcac

SEQ ID NO: 572815 - DNA, 20 bp, Artificial Sequence
  chemically synthesized
acaaatgggttctgaaacaa

SEQ ID NO: 572816 - DNA, 20 bp, Artificial Sequence
  chemically synthesized
tgcccaatatctgaacataa

SEQ ID NO: 572817 - DNA, 20 bp, Artificial Sequence
  chemically synthesized
gcttactgtgattggcttag

SEQ ID NO: 572818 - DNA, 20 bp, Artificial Sequence
  chemically synthesized
tctggtctaagccaatcaca

SEQ ID NO: 572819 - DNA, 20 bp, Artificial Sequence
  chemically synthesized
tgagaaacaagcttactgtg

SEQ ID NO: 572820 - DNA, 20 bp, Artificial Sequence
  chemically synthesized
gtctaagccaatcacagtaa

SEQ ID NO: 572821 - DNA, 20 bp, Artificial Sequence
  chemically synthesized
ggctatgagaaacaagctta

SEQ ID NO: 572822 - DNA, 20 bp, Artificial Sequence
  chemically synthesized
ccaatcactggctatgagaa

SEQ ID NO: 572823 - DNA, 20 bp, Artificial Sequence
  chemically synthesized
gtaagcttgtttctcatagc

SEQ ID NO: 572824 - DNA, 20 bp, Artificial Sequence
  chemically synthesized
cttgtttctcatagccagtg

SEQ ID NO: 572825 - DNA, 20 bp, Artificial Sequence
  chemically synthesized
acataagaagaaatttgttg

SEQ ID NO: 572826 - DNA, 20 bp, Artificial Sequence
  chemically synthesized
tttgttggggagcttctggg

SEQ ID NO: 572827 - DNA, 20 bp, Artificial Sequence
  chemically synthesized
ttggggagcttctgggaaac

SEQ ID NO: 572828 - DNA, 20 bp, Artificial Sequence
  chemically synthesized
gtgtctgtgtttggaaaagc

SEQ ID NO: 572829 - DNA, 20 bp, Artificial Sequence
  chemically synthesized
gtgtactcatgcctgtgtgt

SEQ ID NO: 572830 - DNA, 20 bp, Artificial Sequence
  chemically synthesized
gttattgttgtctgcggata

SEQ ID NO: 572831 - DNA, 20 bp, Artificial Sequence
  chemically synthesized
ctttttcctcatggtcccaa

SEQ ID NO: 572832 - DNA, 20 bp, Artificial Sequence
  chemically synthesized
aagacttgaggtcagcttct

SEQ ID NO: 572833 - DNA, 20 bp, Artificial Sequence
  chemically synthesized
tagctatatcaagacttgag

SEQ ID NO: 572834 - DNA, 20 bp, Artificial Sequence
  chemically synthesized
gacctagagctggttaattc

SEQ ID NO: 572835 - DNA, 20 bp, Artificial Sequence
  chemically synthesized
aggtctgatggtctttggac

SEQ ID NO: 572836 - DNA, 20 bp, Artificial Sequence
  chemically synthesized
ggtctttggacttcagttta

SEQ ID NO: 572837 - DNA, 20 bp, Artificial Sequence
  chemically synthesized
cagtaggtccagcgtggagt

SEQ ID NO: 572838 - DNA, 20 bp, Artificial Sequence
  chemically synthesized
acaggctggcaggctgctcc

SEQ ID NO: 572839 - DNA, 20 bp, Artificial Sequence
  chemically synthesized
ctgggagcagcctgccagcc

SEQ ID NO: 572840 - DNA, 20 bp, Artificial Sequence
  chemically synthesized
ctgtagtttaacaagccccc

SEQ ID NO: 572841 - DNA, 20 bp, Artificial Sequence
  chemically synthesized
agtatgcatcagaatcccct

SEQ ID NO: 572842 - DNA, 20 bp, Artificial Sequence
  chemically synthesized
caggggattctgatgcatac

SEQ ID NO: 572843 - DNA, 20 bp, Artificial Sequence
  chemically synthesized
tactaaagtttgggaactgt

SEQ ID NO: 572844 - DNA, 20 bp, Artificial Sequence
  chemically synthesized
aatgtgtctattattaacga

SEQ ID NO: 572845 - DNA, 20 bp, Artificial Sequence
  chemically synthesized
cgatagggttttcacttctt

SEQ ID NO: 572846 - DNA, 20 bp, Artificial Sequence
  chemically synthesized
tgcatcagaatctccagtga

SEQ ID NO: 572847 - DNA, 20 bp, Artificial Sequence
  chemically synthesized
taattcacaagccccttcac

SEQ ID NO: 572848 - DNA, 20 bp, Artificial Sequence
  chemically synthesized
ataatttaatcaagtgcccc

SEQ ID NO: 572849 - DNA, 20 bp, Artificial Sequence
  chemically synthesized
tcataagaatcaccaggggc

SEQ ID NO: 572850 - DNA, 20 bp, Artificial Sequence
  chemically synthesized
gttcttaagtttgtctttcc

SEQ ID NO: 572851 - DNA, 20 bp, Artificial Sequence
  chemically synthesized
gatacctgactttaaagttc

SEQ ID NO: 572852 - DNA, 20 bp, Artificial Sequence
  chemically synthesized
ctgacattccatctgcaatc

SEQ ID NO: 572853 - DNA, 20 bp, Artificial Sequence
  chemically synthesized
gagctgcggccagttgaaac

SEQ ID NO: 572854 - DNA, 20 bp, Artificial Sequence
  chemically synthesized
ttgccaaggcaagagctagt

SEQ ID NO: 572855 - DNA, 20 bp, Artificial Sequence
  chemically synthesized
tggcaaatatattatgaagt

SEQ ID NO: 572856 - DNA, 20 bp, Artificial Sequence
  chemically synthesized
ggagagcctttgacttaaag

SEQ ID NO: 572857 - DNA, 20 bp, Artificial Sequence
  chemically synthesized
gaggtttacatttctaagat

SEQ ID NO: 572858 - DNA, 20 bp, Artificial Sequence
  chemically synthesized
cctgatcttttccattcaga

SEQ ID NO: 572859 - DNA, 20 bp, Artificial Sequence
  chemically synthesized
cagcctaagagttaaggaat

SEQ ID NO: 572860 - DNA, 20 bp, Artificial Sequence
  chemically synthesized
cttaggctgcattcttaggg

SEQ ID NO: 572861 - DNA, 20 bp, Artificial Sequence
  chemically synthesized
gtttttaacagactaattgt

SEQ ID NO: 572862 - DNA, 20 bp, Artificial Sequence
  chemically synthesized
tcagacttcaggaatatatg

SEQ ID NO: 572863 - DNA, 20 bp, Artificial Sequence
  chemically synthesized
ttttttcagacttcaggaat

SEQ ID NO: 572864 - DNA, 20 bp, Artificial Sequence
  chemically synthesized
cattcaacctgaaagaacat

SEQ ID NO: 572865 - DNA, 20 bp, Artificial Sequence
  chemically synthesized
tacattaaaaactttctgtc

SEQ ID NO: 572866 - DNA, 20 bp, Artificial Sequence
  chemically synthesized
ggccaagtaaacaagggaca

SEQ ID NO: 572867 - DNA, 20 bp, Artificial Sequence
  chemically synthesized
ggtcaaaacaatcttagtga

SEQ ID NO: 572868 - DNA, 20 bp, Artificial Sequence
  chemically synthesized
taaggaaacaatttcactaa

SEQ ID NO: 572869 - DNA, 20 bp, Artificial Sequence
  chemically synthesized
ttcataaggaaacaatttca

SEQ ID NO: 572870 - DNA, 20 bp, Artificial Sequence
  chemically synthesized
atatttcatctcccctaatt

SEQ ID NO: 572871 - DNA, 20 bp, Artificial Sequence
  chemically synthesized
cccctaattacatgtttttc

SEQ ID NO: 572872 - DNA, 20 bp, Artificial Sequence
  chemically synthesized
gaagatctgatataacctga

SEQ ID NO: 572873 - DNA, 20 bp, Artificial Sequence
  chemically synthesized
ttatatcagatcttcccaga

SEQ ID NO: 572874 - DNA, 20 bp, Artificial Sequence
  chemically synthesized
agaggtaaagaaaaaaatgg

SEQ ID NO: 572875 - DNA, 20 bp, Artificial Sequence
  chemically synthesized
ttttgcacaaggggtgacat

SEQ ID NO: 572876 - DNA, 20 bp, Artificial Sequence
  chemically synthesized
atgacacaggctcccttcaa

SEQ ID NO: 572877 - DNA, 20 bp, Artificial Sequence
  chemically synthesized
ctgaactgaacttcatgcaa

SEQ ID NO: 572878 - DNA, 20 bp, Artificial Sequence
  chemically synthesized
aatagtgccttaattttatt

SEQ ID NO: 572879 - DNA, 20 bp, Artificial Sequence
  chemically synthesized
ttaattttattacttgtttt

SEQ ID NO: 572880 - DNA, 20 bp, Artificial Sequence
  chemically synthesized
gcaagtaggaggctaatgaa

SEQ ID NO: 572881 - DNA, 20 bp, Artificial Sequence
  chemically synthesized
taggaggctaatgaaaaatg

SEQ ID NO: 572882 - DNA, 20 bp, Artificial Sequence
  chemically synthesized
gtggtggtggtgaggggcat

SEQ ID NO: 572883 - DNA, 20 bp, Artificial Sequence
  chemically synthesized
ccagcttgagtggtagaggt

SEQ ID NO: 572884 - DNA, 20 bp, Artificial Sequence
  chemically synthesized
gccccagaaatggttacacc

SEQ ID NO: 572885 - DNA, 20 bp, Artificial Sequence
  chemically synthesized
ctacatgtctagtcatctct

SEQ ID NO: 572886 - DNA, 20 bp, Artificial Sequence
  chemically synthesized
gaaagaacatattataaacc

SEQ ID NO: 572887 - DNA, 20 bp, Artificial Sequence
  chemically synthesized
cttttctactgagcaaagca

SEQ ID NO: 572888 - DNA, 20 bp, Artificial Sequence
  chemically synthesized
tttctctttctcttgttgac

SEQ ID NO: 572889 - DNA, 20 bp, Artificial Sequence
  chemically synthesized
tcaacaagagaaagagaaag

SEQ ID NO: 572890 - DNA, 20 bp, Artificial Sequence
  chemically synthesized
gaatactgtggtgtctgcta

SEQ ID NO: 572891 - DNA, 20 bp, Artificial Sequence
  chemically synthesized
gcaagaccatgtgccagatg

SEQ ID NO: 572892 - DNA, 20 bp, Artificial Sequence
  chemically synthesized
gtagaaaactgatatgggtt

SEQ ID NO: 572893 - DNA, 20 bp, Artificial Sequence
  chemically synthesized
ggaacaaacatccaacccat

SEQ ID NO: 572894 - DNA, 20 bp, Artificial Sequence
  chemically synthesized
actggggattacatttcagc

SEQ ID NO: 572895 - DNA, 20 bp, Artificial Sequence
  chemically synthesized
ccgggccccacatccaacac

SEQ ID NO: 572896 - DNA, 20 bp, Artificial Sequence
  chemically synthesized
agtgagttcatgtgggatct

SEQ ID NO: 572897 - DNA, 20 bp, Artificial Sequence
  chemically synthesized
ggttctcctttcaccttcca

SEQ ID NO: 572898 - DNA, 20 bp, Artificial Sequence
  chemically synthesized
tttcaccttccaccatgatt

SEQ ID NO: 572899 - DNA, 20 bp, Artificial Sequence
  chemically synthesized
tgcttctggtgagggcttca

SEQ ID NO: 572900 - DNA, 20 bp, Artificial Sequence
  chemically synthesized
tgacagcctctgcttctggt

SEQ ID NO: 572901 - DNA, 20 bp, Artificial Sequence
  chemically synthesized
acaggaagtgtggtgacagc

SEQ ID NO: 572902 - DNA, 20 bp, Artificial Sequence
  chemically synthesized
gctgggtaatttataaggaa

SEQ ID NO: 572903 - DNA, 20 bp, Artificial Sequence
  chemically synthesized
actagtcaagacattttgtg

SEQ ID NO: 572904 - DNA, 20 bp, Artificial Sequence
  chemically synthesized
tctggattacccagtcctgg

SEQ ID NO: 572905 - DNA, 20 bp, Artificial Sequence
  chemically synthesized
tggaataatgtcattgtgct

SEQ ID NO: 572906 - DNA, 20 bp, Artificial Sequence
  chemically synthesized
aggaacctggaataatgtca

SEQ ID NO: 572907 - DNA, 20 bp, Artificial Sequence
  chemically synthesized
tccatgaggccagggatatt

SEQ ID NO: 572908 - DNA, 20 bp, Artificial Sequence
  chemically synthesized
ccgccttggcctcccaagtg

SEQ ID NO: 572909 - DNA, 20 bp, Artificial Sequence
  chemically synthesized
ttttttatttttagtagaga

SEQ ID NO: 572910 - DNA, 20 bp, Artificial Sequence
  chemically synthesized
ggcatccaccaccacgccca

SEQ ID NO: 572911 - DNA, 20 bp, Artificial Sequence
  chemically synthesized
cactgcactccagcctgggc

SEQ ID NO: 572912 - DNA, 20 bp, Artificial Sequence
  chemically synthesized
tcctatcatacactcattct

SEQ ID NO: 572913 - DNA, 20 bp, Artificial Sequence
  chemically synthesized
ggaacatctgtcctgttttt

SEQ ID NO: 572914 - DNA, 20 bp, Artificial Sequence
  chemically synthesized
tatagcaaaaggaacatctg

SEQ ID NO: 572915 - DNA, 20 bp, Artificial Sequence
  chemically synthesized
tgagttgactgtgctcaggt

SEQ ID NO: 572916 - DNA, 20 bp, Artificial Sequence
  chemically synthesized
actgtgctcaggtgggtgtt

SEQ ID NO: 572917 - DNA, 20 bp, Artificial Sequence
  chemically synthesized
tttcttgcttgggttctttc

SEQ ID NO: 572918 - DNA, 20 bp, Artificial Sequence
  chemically synthesized
caatggagccttcagatcaa

SEQ ID NO: 572919 - DNA, 20 bp, Artificial Sequence
  chemically synthesized
ggctccattggaatggctgt

SEQ ID NO: 572920 - DNA, 20 bp, Artificial Sequence
  chemically synthesized
gccacgtatttgtctttcca

SEQ ID NO: 572921 - DNA, 20 bp, Artificial Sequence
  chemically synthesized
ccatgcagcttccccatgtg

SEQ ID NO: 572922 - DNA, 20 bp, Artificial Sequence
  chemically synthesized
cagcttccccatgtggctag

SEQ ID NO: 572923 - DNA, 20 bp, Artificial Sequence
  chemically synthesized
ccatgtggctagcttagatt

SEQ ID NO: 572924 - DNA, 20 bp, Artificial Sequence
  chemically synthesized
agctaaataagaaggagtct

SEQ ID NO: 572925 - DNA, 20 bp, Artificial Sequence
  chemically synthesized
agctacaagactccttctta

SEQ ID NO: 572926 - DNA, 20 bp, Artificial Sequence
  chemically synthesized
caacaaactgaaggaggtag

SEQ ID NO: 572927 - DNA, 20 bp, Artificial Sequence
  chemically synthesized
gcagaatcaattctacctcc

SEQ ID NO: 572928 - DNA, 20 bp, Artificial Sequence
  chemically synthesized
agtttgttgtacaggagcag

SEQ ID NO: 572929 - DNA, 20 bp, Artificial Sequence
  chemically synthesized
caaggaacaattgcctggag

SEQ ID NO: 572930 - DNA, 20 bp, Artificial Sequence
  chemically synthesized
tcataaaaaggtaagtggga

SEQ ID NO: 572931 - DNA, 20 bp, Artificial Sequence
  chemically synthesized
ttagtgtggtcaaattttaa

SEQ ID NO: 572932 - DNA, 20 bp, Artificial Sequence
  chemically synthesized
aggttttttttttttttaag

SEQ ID NO: 572933 - DNA, 20 bp, Artificial Sequence
  chemically synthesized
ggaaatgacagagttagtca

SEQ ID NO: 572934 - DNA, 20 bp, Artificial Sequence
  chemically synthesized
catagtgcccggagaaggat

SEQ ID NO: 572935 - DNA, 20 bp, Artificial Sequence
  chemically synthesized
cagctaagggaccttctgag

SEQ ID NO: 572936 - DNA, 20 bp, Artificial Sequence
  chemically synthesized
atttcatggtgctctcgcag

SEQ ID NO: 572937 - DNA, 20 bp, Artificial Sequence
  chemically synthesized
cattatgtattcccttgggt

SEQ ID NO: 572938 - DNA, 20 bp, Artificial Sequence
  chemically synthesized
ttctcctttgctggcagcca

SEQ ID NO: 572939 - DNA, 20 bp, Artificial Sequence
  chemically synthesized
ggtgtggggaagaaagatac

SEQ ID NO: 572940 - DNA, 20 bp, Artificial Sequence
  chemically synthesized
tatctttcttccccacaccc

SEQ ID NO: 572941 - DNA, 20 bp, Artificial Sequence
  chemically synthesized
ttagacaggcccaaaaggag

SEQ ID NO: 572942 - DNA, 20 bp, Artificial Sequence
  chemically synthesized
tgactatcagcagagaattc

SEQ ID NO: 572943 - DNA, 20 bp, Artificial Sequence
  chemically synthesized
caaaggggccaccacccaca

SEQ ID NO: 572944 - DNA, 20 bp, Artificial Sequence
  chemically synthesized
ttcccattatgaatgctacc

SEQ ID NO: 572945 - DNA, 20 bp, Artificial Sequence
  chemically synthesized
agtaaagttgcccatgtggc

SEQ ID NO: 572946 - DNA, 20 bp, Artificial Sequence
  chemically synthesized
atgggcaactttactgcccc

SEQ ID NO: 572947 - DNA, 20 bp, Artificial Sequence
  chemically synthesized
aattggaattgggggtcctg

SEQ ID NO: 572948 - DNA, 20 bp, Artificial Sequence
  chemically synthesized
aaaaaaaaaaaaagacctta

SEQ ID NO: 572949 - DNA, 20 bp, Artificial Sequence
  chemically synthesized
aatggcatgaacctgggagg

SEQ ID NO: 572950 - DNA, 20 bp, Artificial Sequence
  chemically synthesized
cgcctgccaccatgcccggc

SEQ ID NO: 572951 - DNA, 20 bp, Artificial Sequence
  chemically synthesized
tgttttgtatttcagtagag

SEQ ID NO: 572952 - DNA, 20 bp, Artificial Sequence
  chemically synthesized
cgcctcggcctcccaaagtg

SEQ ID NO: 572953 - DNA, 20 bp, Artificial Sequence
  chemically synthesized
acttacaataatccacctac

SEQ ID NO: 572954 - DNA, 20 bp, Artificial Sequence
  chemically synthesized
aacagagaaaatcaagtgta

SEQ ID NO: 572955 - DNA, 20 bp, Artificial Sequence
  chemically synthesized
tagtctttctaaatattcac

SEQ ID NO: 572956 - DNA, 20 bp, Artificial Sequence
  chemically synthesized
tatatttctttattatctca

SEQ ID NO: 572957 - DNA, 20 bp, Artificial Sequence
  chemically synthesized
agcttatatttctttattat

SEQ ID NO: 572958 - DNA, 20 bp, Artificial Sequence
  chemically synthesized
ggcattccattcctctgaat

SEQ ID NO: 572959 - DNA, 20 bp, Artificial Sequence
  chemically synthesized
atgagagcatagtcatgaac

SEQ ID NO: 572960 - DNA, 20 bp, Artificial Sequence
  chemically synthesized
agaaattattattatgatga

SEQ ID NO: 572961 - DNA, 20 bp, Artificial Sequence
  chemically synthesized
tattattatgatgatgatga

SEQ ID NO: 572962 - DNA, 20 bp, Artificial Sequence
  chemically synthesized
tgattattattattttgaga

SEQ ID NO: 572963 - DNA, 20 bp, Artificial Sequence
  chemically synthesized
tcgggaggctgaggcaggag

SEQ ID NO: 572964 - DNA, 20 bp, Artificial Sequence
  chemically synthesized
tgcctcagcctcccgagtag

SEQ ID NO: 572965 - DNA, 20 bp, Artificial Sequence
  chemically synthesized
ttttgtatttttagtagaga

SEQ ID NO: 572966 - DNA, 20 bp, Artificial Sequence
  chemically synthesized
cgcctcggcctcccaaagtg

SEQ ID NO: 572967 - DNA, 20 bp, Artificial Sequence
  chemically synthesized
ttgttaaaattgaacaggct

SEQ ID NO: 572968 - DNA, 20 bp, Artificial Sequence
  chemically synthesized
catccttttgttaaaattga

SEQ ID NO: 572969 - DNA, 20 bp, Artificial Sequence
  chemically synthesized
aacctccacctcccgggttc

SEQ ID NO: 572970 - DNA, 20 bp, Artificial Sequence
  chemically synthesized
tgcctcagcctcctgagtag

SEQ ID NO: 572971 - DNA, 20 bp, Artificial Sequence
  chemically synthesized
tgcctggctaatttttgtat

SEQ ID NO: 572972 - DNA, 20 bp, Artificial Sequence
  chemically synthesized
ttttgtatttttgattgaga

SEQ ID NO: 572973 - DNA, 20 bp, Artificial Sequence
  chemically synthesized
ttaaatagaaagggtacttt

SEQ ID NO: 572974 - DNA, 20 bp, Artificial Sequence
  chemically synthesized
gtaccctttctatttaaaga

SEQ ID NO: 572975 - DNA, 20 bp, Artificial Sequence
  chemically synthesized
gtgtaatataatcaaatatc

SEQ ID NO: 572976 - DNA, 20 bp, Artificial Sequence
  chemically synthesized
cttttctataatctattgat

SEQ ID NO: 572977 - DNA, 20 bp, Artificial Sequence
  chemically synthesized
cttacaacccagcagggcgg

SEQ ID NO: 572978 - DNA, 20 bp, Artificial Sequence
  chemically synthesized
cttcttataaagggagaaca

SEQ ID NO: 572979 - DNA, 20 bp, Artificial Sequence
  chemically synthesized
agtcaagttcagaaaagtga

SEQ ID NO: 572980 - DNA, 20 bp, Artificial Sequence
  chemically synthesized
agaaaagtgagaaagtttag

SEQ ID NO: 572981 - DNA, 20 bp, Artificial Sequence
  chemically synthesized
tatcaaatgttataaaaatg

SEQ ID NO: 572982 - DNA, 20 bp, Artificial Sequence
  chemically synthesized
ttaacatttttataacattt

SEQ ID NO: 572983 - DNA, 20 bp, Artificial Sequence
  chemically synthesized
taacatttgatagtttcgga

SEQ ID NO: 572984 - DNA, 20 bp, Artificial Sequence
  chemically synthesized
caatgagataaggtctgtga

SEQ ID NO: 572985 - DNA, 20 bp, Artificial Sequence
  chemically synthesized
cagtttcacagaccttatct

SEQ ID NO: 572986 - DNA, 20 bp, Artificial Sequence
  chemically synthesized
acatggaccttgtaagacag

SEQ ID NO: 572987 - DNA, 20 bp, Artificial Sequence
  chemically synthesized
gtgtctttgtaaactcaagg

SEQ ID NO: 572988 - DNA, 20 bp, Artificial Sequence
  chemically synthesized
aaagtccagaaatccaaccc

SEQ ID NO: 572989 - DNA, 20 bp, Artificial Sequence
  chemically synthesized
ttactgaatattttaatatt

SEQ ID NO: 572990 - DNA, 20 bp, Artificial Sequence
  chemically synthesized
ttgaatctactgatatgttt

SEQ ID NO: 572991 - DNA, 20 bp, Artificial Sequence
  chemically synthesized
taaaagcaatgaaacatatc

SEQ ID NO: 572992 - DNA, 20 bp, Artificial Sequence
  chemically synthesized
gaaaacaattgaatctactg

SEQ ID NO: 572993 - DNA, 20 bp, Artificial Sequence
  chemically synthesized
tgaaacatatcagtagattc

SEQ ID NO: 572994 - DNA, 20 bp, Artificial Sequence
  chemically synthesized
aattgttttcttatttattt

SEQ ID NO: 572995 - DNA, 20 bp, Artificial Sequence
  chemically synthesized
atgatttgatattttatatt

SEQ ID NO: 572996 - DNA, 20 bp, Artificial Sequence
  chemically synthesized
tagactcaaggggtacatgt

SEQ ID NO: 572997 - DNA, 20 bp, Artificial Sequence
  chemically synthesized
atgggtatattgtgtgacac

SEQ ID NO: 572998 - DNA, 20 bp, Artificial Sequence
  chemically synthesized
agtgagtatagtactcgata

SEQ ID NO: 572999 - DNA, 20 bp, Artificial Sequence
  chemically synthesized
atgtgtacccaaaggttagc

SEQ ID NO: 573000 - DNA, 20 bp, Artificial Sequence
  chemically synthesized
ataagtgagcacatgcatta

SEQ ID NO: 573001 - DNA, 20 bp, Artificial Sequence
  chemically synthesized
agcacatgcattatttggtt

SEQ ID NO: 573002 - DNA, 20 bp, Artificial Sequence
  chemically synthesized
tgcattatttggttttctgt

SEQ ID NO: 573003 - DNA, 20 bp, Artificial Sequence
  chemically synthesized
ggttttctgtttctgcttta

SEQ ID NO: 573004 - DNA, 20 bp, Artificial Sequence
  chemically synthesized
caaccatgttgctacagagg

SEQ ID NO: 573005 - DNA, 20 bp, Artificial Sequence
  chemically synthesized
tattccatggtgcatatatg

SEQ ID NO: 573006 - DNA, 20 bp, Artificial Sequence
  chemically synthesized
caacctaggtgcccatcaat

SEQ ID NO: 573007 - DNA, 20 bp, Artificial Sequence
  chemically synthesized
tgcctcagccttccgagtaa

SEQ ID NO: 573008 - DNA, 20 bp, Artificial Sequence
  chemically synthesized
ttttgtatttttagtagaga

SEQ ID NO: 573009 - DNA, 20 bp, Artificial Sequence
  chemically synthesized
acacccggtcatttttttct

SEQ ID NO: 573010 - DNA, 20 bp, Artificial Sequence
  chemically synthesized
ataaggttaaccaacactta

SEQ ID NO: 573011 - DNA, 20 bp, Artificial Sequence
  chemically synthesized
gtagtacttacatctaaatt

SEQ ID NO: 573012 - DNA, 20 bp, Artificial Sequence
  chemically synthesized
agtactacgtcttcagaaat

SEQ ID NO: 573013 - DNA, 20 bp, Artificial Sequence
  chemically synthesized
ttttctcctctggtataact

SEQ ID NO: 573014 - DNA, 20 bp, Artificial Sequence
  chemically synthesized
tataactttctgcttatttt

SEQ ID NO: 573015 - DNA, 20 bp, Artificial Sequence
  chemically synthesized
agttttcagtaacattttaa

SEQ ID NO: 573016 - DNA, 20 bp, Artificial Sequence
  chemically synthesized
atctattcaagacatttata

SEQ ID NO: 573017 - DNA, 20 bp, Artificial Sequence
  chemically synthesized
tggtggcttgtttaatgaaa

SEQ ID NO: 573018 - DNA, 20 bp, Artificial Sequence
  chemically synthesized
ctatagctatgtgtttggtg

SEQ ID NO: 573019 - DNA, 20 bp, Artificial Sequence
  chemically synthesized
aaatctatagctatgtgttt

SEQ ID NO: 573020 - DNA, 20 bp, Artificial Sequence
  chemically synthesized
caagccaccaaacacatagc

SEQ ID NO: 573021 - DNA, 20 bp, Artificial Sequence
  chemically synthesized
acttacgaaaatctatagct

SEQ ID NO: 573022 - DNA, 20 bp, Artificial Sequence
  chemically synthesized
attatcacagagagcatcct

SEQ ID NO: 573023 - DNA, 20 bp, Artificial Sequence
  chemically synthesized
catcattatcacagagagca

SEQ ID NO: 573024 - DNA, 20 bp, Artificial Sequence
  chemically synthesized
tataattaagtcacatctag

SEQ ID NO: 573025 - DNA, 20 bp, Artificial Sequence
  chemically synthesized
tacatactggaattttacaa

SEQ ID NO: 573026 - DNA, 20 bp, Artificial Sequence
  chemically synthesized
acaaccctgtttagttagtc

SEQ ID NO: 573027 - DNA, 20 bp, Artificial Sequence
  chemically synthesized
ctcttctattcatctatatc

SEQ ID NO: 573028 - DNA, 20 bp, Artificial Sequence
  chemically synthesized
atagatgaatagaagagtca

SEQ ID NO: 573029 - DNA, 20 bp, Artificial Sequence
  chemically synthesized
tcacttttattgggagggtg

SEQ ID NO: 573030 - DNA, 20 bp, Artificial Sequence
  chemically synthesized
gacacatttgtaattatttt

SEQ ID NO: 573031 - DNA, 20 bp, Artificial Sequence
  chemically synthesized
ttctctgccctcatggaggt

SEQ ID NO: 573032 - DNA, 20 bp, Artificial Sequence
  chemically synthesized
ccaaactctgtttgagatga

SEQ ID NO: 573033 - DNA, 20 bp, Artificial Sequence
  chemically synthesized
tgaatccctatcatctcaaa

SEQ ID NO: 573034 - DNA, 20 bp, Artificial Sequence
  chemically synthesized
ggtgtctactctttaccaaa

SEQ ID NO: 573035 - DNA, 20 bp, Artificial Sequence
  chemically synthesized
gaaaaaaataattattgaat

SEQ ID NO: 573036 - DNA, 20 bp, Artificial Sequence
  chemically synthesized
tgaatgaatgattgaacaaa

SEQ ID NO: 573037 - DNA, 20 bp, Artificial Sequence
  chemically synthesized
cgttcacttcagcaagactt

SEQ ID NO: 573038 - DNA, 20 bp, Artificial Sequence
  chemically synthesized
accctcttggtcctacagaa

SEQ ID NO: 573039 - DNA, 20 bp, Artificial Sequence
  chemically synthesized
tggtcctacagaagagtgat

SEQ ID NO: 573040 - DNA, 20 bp, Artificial Sequence
  chemically synthesized
gattctagtttttagtctgt

SEQ ID NO: 573041 - DNA, 20 bp, Artificial Sequence
  chemically synthesized
agaccacgatctcaagaatt

SEQ ID NO: 573042 - DNA, 20 bp, Artificial Sequence
  chemically synthesized
atttcctcaactcatgatcc

SEQ ID NO: 573043 - DNA, 20 bp, Artificial Sequence
  chemically synthesized
tgtgagaatgatgctgttct

SEQ ID NO: 573044 - DNA, 20 bp, Artificial Sequence
  chemically synthesized
tgacaacatttcctattcat

SEQ ID NO: 573045 - DNA, 20 bp, Artificial Sequence
  chemically synthesized
actgcatagttaggagttct

SEQ ID NO: 573046 - DNA, 20 bp, Artificial Sequence
  chemically synthesized
atatcaggtaagtgagagag

SEQ ID NO: 573047 - DNA, 20 bp, Artificial Sequence
  chemically synthesized
acctccctcactgggttacg

SEQ ID NO: 573048 - DNA, 20 bp, Artificial Sequence
  chemically synthesized
ataagcacttttgcatgtgc

SEQ ID NO: 573049 - DNA, 20 bp, Artificial Sequence
  chemically synthesized
aaaagcattagcacatgcaa

SEQ ID NO: 573050 - DNA, 20 bp, Artificial Sequence
  chemically synthesized
tttagtgagcattacgctta

SEQ ID NO: 573051 - DNA, 20 bp, Artificial Sequence
  chemically synthesized
gaaaataattttagtgagca

SEQ ID NO: 573052 - DNA, 20 bp, Artificial Sequence
  chemically synthesized
aaatttataccatatgacta

SEQ ID NO: 573053 - DNA, 20 bp, Artificial Sequence
  chemically synthesized
tcagaagtacagcctttata

SEQ ID NO: 573054 - DNA, 20 bp, Artificial Sequence
  chemically synthesized
tggaaatataataaattaga

SEQ ID NO: 573055 - DNA, 20 bp, Artificial Sequence
  chemically synthesized
caaagtgaatttcaaattca

SEQ ID NO: 573056 - DNA, 20 bp, Artificial Sequence
  chemically synthesized
agcatttctgaatttcatac

SEQ ID NO: 573057 - DNA, 20 bp, Artificial Sequence
  chemically synthesized
tttccattcccctttatgga

SEQ ID NO: 573058 - DNA, 20 bp, Artificial Sequence
  chemically synthesized
ttatggagttggctttaaca

SEQ ID NO: 573059 - DNA, 20 bp, Artificial Sequence
  chemically synthesized
agcttctcatgtggcctgaa

SEQ ID NO: 573060 - DNA, 20 bp, Artificial Sequence
  chemically synthesized
ctgttctcacatggccgcca

SEQ ID NO: 573061 - DNA, 20 bp, Artificial Sequence
  chemically synthesized
actgtgagcagctactggcg

SEQ ID NO: 573062 - DNA, 20 bp, Artificial Sequence
  chemically synthesized
cttctgcatttgtttgcact

SEQ ID NO: 573063 - DNA, 20 bp, Artificial Sequence
  chemically synthesized
cgccccaccctttcttctgc

SEQ ID NO: 573064 - DNA, 20 bp, Artificial Sequence
  chemically synthesized
ggctgacctctctccttccc

SEQ ID NO: 573065 - DNA, 20 bp, Artificial Sequence
  chemically synthesized
tgcccttgtctccaatttct

SEQ ID NO: 573066 - DNA, 20 bp, Artificial Sequence
  chemically synthesized
atttaaaattgccatgatgg

SEQ ID NO: 573067 - DNA, 20 bp, Artificial Sequence
  chemically synthesized
ttaaatgcctggaattatat

SEQ ID NO: 573068 - DNA, 20 bp, Artificial Sequence
  chemically synthesized
ttatgcatgcatgtatttat

SEQ ID NO: 573069 - DNA, 20 bp, Artificial Sequence
  chemically synthesized
atggaatgtgttcctagtaa

SEQ ID NO: 573070 - DNA, 20 bp, Artificial Sequence
  chemically synthesized
atccatgtaagtgtgtttat

SEQ ID NO: 573071 - DNA, 20 bp, Artificial Sequence
  chemically synthesized
aacaataataaacacactta

SEQ ID NO: 573072 - DNA, 20 bp, Artificial Sequence
  chemically synthesized
tattatggtaatccatgtaa

SEQ ID NO: 573073 - DNA, 20 bp, Artificial Sequence
  chemically synthesized
ttagaactagcaaaaatagt

SEQ ID NO: 573074 - DNA, 20 bp, Artificial Sequence
  chemically synthesized
tctttatatactaatttcta

SEQ ID NO: 573075 - DNA, 20 bp, Artificial Sequence
  chemically synthesized
aagtattaattaggctactt

SEQ ID NO: 573076 - DNA, 20 bp, Artificial Sequence
  chemically synthesized
tataaagtattaattaggct

SEQ ID NO: 573077 - DNA, 20 bp, Artificial Sequence
  chemically synthesized
gtagcctaattaatacttta

SEQ ID NO: 573078 - DNA, 20 bp, Artificial Sequence
  chemically synthesized
taaaatatctgaaaataata

SEQ ID NO: 573079 - DNA, 20 bp, Artificial Sequence
  chemically synthesized
taaatatttctttggctcct

SEQ ID NO: 573080 - DNA, 20 bp, Artificial Sequence
  chemically synthesized
acatcgttcatttatccccc

SEQ ID NO: 573081 - DNA, 20 bp, Artificial Sequence
  chemically synthesized
tcaccctaggagaagaatgg

SEQ ID NO: 573082 - DNA, 20 bp, Artificial Sequence
  chemically synthesized
ctctggaatatttgggccat

SEQ ID NO: 573083 - DNA, 20 bp, Artificial Sequence
  chemically synthesized
gcttaagaacatttggtttt

SEQ ID NO: 573084 - DNA, 20 bp, Artificial Sequence
  chemically synthesized
acattgaaaaccaaatgttc

SEQ ID NO: 573085 - DNA, 20 bp, Artificial Sequence
  chemically synthesized
tactgtcaagcttaagaaca

SEQ ID NO: 573086 - DNA, 20 bp, Artificial Sequence
  chemically synthesized
aaatgttcttaagcttgaca

SEQ ID NO: 573087 - DNA, 20 bp, Artificial Sequence
  chemically synthesized
actgaggtcaaagcgtactg

SEQ ID NO: 573088 - DNA, 20 bp, Artificial Sequence
  chemically synthesized
tctccttcttcaattcttta

SEQ ID NO: 573089 - DNA, 20 bp, Artificial Sequence
  chemically synthesized
ttcttcaattctttaaaggg

SEQ ID NO: 573090 - DNA, 20 bp, Artificial Sequence
  chemically synthesized
acagagttgaggttaagcat

SEQ ID NO: 573091 - DNA, 20 bp, Artificial Sequence
  chemically synthesized
agtaaggagagaataatcat

SEQ ID NO: 573092 - DNA, 20 bp, Artificial Sequence
  chemically synthesized
ttattctctccttactgaaa

SEQ ID NO: 573093 - DNA, 20 bp, Artificial Sequence
  chemically synthesized
tttgaaaaggttaggtcaca

SEQ ID NO: 573094 - DNA, 20 bp, Artificial Sequence
  chemically synthesized
aaaaaaagaaagaagtatgt

SEQ ID NO: 573095 - DNA, 20 bp, Artificial Sequence
  chemically synthesized
aataaaaaaaagaaagaagt

SEQ ID NO: 573096 - DNA, 20 bp, Artificial Sequence
  chemically synthesized
ttttttttatttcctttact

SEQ ID NO: 573097 - DNA, 20 bp, Artificial Sequence
  chemically synthesized
agtctgatgtgcccactggc

SEQ ID NO: 573098 - DNA, 20 bp, Artificial Sequence
  chemically synthesized
atatttacataagagcaacc

SEQ ID NO: 573099 - DNA, 20 bp, Artificial Sequence
  chemically synthesized
tatagtttagaatatgttag

SEQ ID NO: 573100 - DNA, 20 bp, Artificial Sequence
  chemically synthesized
ttactgcagtattttgggag

SEQ ID NO: 573101 - DNA, 20 bp, Artificial Sequence
  chemically synthesized
tttgggagaggtgctttcta

SEQ ID NO: 573102 - DNA, 20 bp, Artificial Sequence
  chemically synthesized
cttttattatgtggcaattc

SEQ ID NO: 573103 - DNA, 20 bp, Artificial Sequence
  chemically synthesized
ctattagctgataaaaactt

SEQ ID NO: 573104 - DNA, 20 bp, Artificial Sequence
  chemically synthesized
gcagttgtgttacaaagcat

SEQ ID NO: 573105 - DNA, 20 bp, Artificial Sequence
  chemically synthesized
acttgtatgctttgtaacac

SEQ ID NO: 573106 - DNA, 20 bp, Artificial Sequence
  chemically synthesized
aattatgttgcccatatacc

SEQ ID NO: 573107 - DNA, 20 bp, Artificial Sequence
  chemically synthesized
ttttgtattcaagctacaga

SEQ ID NO: 573108 - DNA, 20 bp, Artificial Sequence
  chemically synthesized
tttttgcatcaagcattgtc

SEQ ID NO: 573109 - DNA, 20 bp, Artificial Sequence
  chemically synthesized
ctctgtaaaactctatcatc

SEQ ID NO: 573110 - DNA, 20 bp, Artificial Sequence
  chemically synthesized
cattcccaaactacagatga

SEQ ID NO: 573111 - DNA, 20 bp, Artificial Sequence
  chemically synthesized
cccgatactaaatttctggg

SEQ ID NO: 573112 - DNA, 20 bp, Artificial Sequence
  chemically synthesized
tactaaatttctgggggcgg

SEQ ID NO: 573113 - DNA, 20 bp, Artificial Sequence
  chemically synthesized
tctgggggcggattggttta

SEQ ID NO: 573114 - DNA, 20 bp, Artificial Sequence
  chemically synthesized
attggtttaacaagctttgc

SEQ ID NO: 573115 - DNA, 20 bp, Artificial Sequence
  chemically synthesized
gcatggataagaatcacctg

SEQ ID NO: 573116 - DNA, 20 bp, Artificial Sequence
  chemically synthesized
tgcaggtgattcttatccat

SEQ ID NO: 573117 - DNA, 20 bp, Artificial Sequence
  chemically synthesized
ctgttggatagcattggcct

SEQ ID NO: 573118 - DNA, 20 bp, Artificial Sequence
  chemically synthesized
gcttcggctacaacaatggg

SEQ ID NO: 573119 - DNA, 20 bp, Artificial Sequence
  chemically synthesized
gaaaatgaatgaagtgagcc

SEQ ID NO: 573120 - DNA, 20 bp, Artificial Sequence
  chemically synthesized
ttcattttcaagaaaaataa

SEQ ID NO: 573121 - DNA, 20 bp, Artificial Sequence
  chemically synthesized
taatgaatttcactcattta

SEQ ID NO: 573122 - DNA, 20 bp, Artificial Sequence
  chemically synthesized
aaatgatagtatttttatgt

SEQ ID NO: 573123 - DNA, 20 bp, Artificial Sequence
  chemically synthesized
aaaatatctcattattttta

SEQ ID NO: 573124 - DNA, 20 bp, Artificial Sequence
  chemically synthesized
acatattacatgtgtatata

SEQ ID NO: 573125 - DNA, 20 bp, Artificial Sequence
  chemically synthesized
ggacagcacagttctagacc

SEQ ID NO: 573126 - DNA, 20 bp, Artificial Sequence
  chemically synthesized
agaaacacaatttgctgcta

SEQ ID NO: 573127 - DNA, 20 bp, Artificial Sequence
  chemically synthesized
taaatccatatagcagcaaa

SEQ ID NO: 573128 - DNA, 20 bp, Artificial Sequence
  chemically synthesized
tgtgtttctggggatctatt

SEQ ID NO: 573129 - DNA, 20 bp, Artificial Sequence
  chemically synthesized
taacagtttcccttcatcct

SEQ ID NO: 573130 - DNA, 20 bp, Artificial Sequence
  chemically synthesized
ttctgcctcatagaaaagtt

SEQ ID NO: 573131 - DNA, 20 bp, Artificial Sequence
  chemically synthesized
acttgaacactcctccaaca

SEQ ID NO: 573132 - DNA, 20 bp, Artificial Sequence
  chemically synthesized
gacttctgtaagacactgtg

SEQ ID NO: 573133 - DNA, 20 bp, Artificial Sequence
  chemically synthesized
aggggttatcaaagtgtggt

SEQ ID NO: 573134 - DNA, 20 bp, Artificial Sequence
  chemically synthesized
cagcagcattagcctcactt

SEQ ID NO: 573135 - DNA, 20 bp, Artificial Sequence
  chemically synthesized
acttgaaagtttgttagaga

SEQ ID NO: 573136 - DNA, 20 bp, Artificial Sequence
  chemically synthesized
atgattcagtgggtctggtg

SEQ ID NO: 573137 - DNA, 20 bp, Artificial Sequence
  chemically synthesized
ggctccacataccaagtttc

SEQ ID NO: 573138 - DNA, 20 bp, Artificial Sequence
  chemically synthesized
agataactgggctccacata

SEQ ID NO: 573139 - DNA, 20 bp, Artificial Sequence
  chemically synthesized
ggtatgtggagcccagttat

SEQ ID NO: 573140 - DNA, 20 bp, Artificial Sequence
  chemically synthesized
acaagcatcaaattcacctg

SEQ ID NO: 573141 - DNA, 20 bp, Artificial Sequence
  chemically synthesized
ataagccttccaggtgaatt

SEQ ID NO: 573142 - DNA, 20 bp, Artificial Sequence
  chemically synthesized
tgaggccattctccaaataa

SEQ ID NO: 573143 - DNA, 20 bp, Artificial Sequence
  chemically synthesized
ctttaagaagactaaaatga

SEQ ID NO: 573144 - DNA, 20 bp, Artificial Sequence
  chemically synthesized
ttctttctttaagaagacta

SEQ ID NO: 573145 - DNA, 20 bp, Artificial Sequence
  chemically synthesized
agaagtgaccccataatgca

SEQ ID NO: 573146 - DNA, 20 bp, Artificial Sequence
  chemically synthesized
attttcctcatatctttctt

SEQ ID NO: 573147 - DNA, 20 bp, Artificial Sequence
  chemically synthesized
tttgatcctttaaatgtgtt

SEQ ID NO: 573148 - DNA, 20 bp, Artificial Sequence
  chemically synthesized
tgttcttaccatcattgagc

SEQ ID NO: 573149 - DNA, 20 bp, Artificial Sequence
  chemically synthesized
ggtcttttatctgtatctat

SEQ ID NO: 573150 - DNA, 20 bp, Artificial Sequence
  chemically synthesized
tacatagatacagataaaag

SEQ ID NO: 573151 - DNA, 20 bp, Artificial Sequence
  chemically synthesized
atattctttactttggtgag

SEQ ID NO: 573152 - DNA, 20 bp, Artificial Sequence
  chemically synthesized
ataaatggttctgatataag

SEQ ID NO: 573153 - DNA, 20 bp, Artificial Sequence
  chemically synthesized
tgcttgttggaaaaaaactg

SEQ ID NO: 573154 - DNA, 20 bp, Artificial Sequence
  chemically synthesized
gcttcattttaaaaaaacta

SEQ ID NO: 573155 - DNA, 20 bp, Artificial Sequence
  chemically synthesized
ctaaacaataggagtatttg

SEQ ID NO: 573156 - DNA, 20 bp, Artificial Sequence
  chemically synthesized
tgaagccacacaaatactcc

SEQ ID NO: 573157 - DNA, 20 bp, Artificial Sequence
  chemically synthesized
gatcccatcacatcctctca

SEQ ID NO: 573158 - DNA, 20 bp, Artificial Sequence
  chemically synthesized
tggtctatatagtcatagta

SEQ ID NO: 573159 - DNA, 20 bp, Artificial Sequence
  chemically synthesized
tactactatgactatataga

SEQ ID NO: 573160 - DNA, 20 bp, Artificial Sequence
  chemically synthesized
aagcagtacccattattatc

SEQ ID NO: 573161 - DNA, 20 bp, Artificial Sequence
  chemically synthesized
aaaccagagataataatggg

SEQ ID NO: 573162 - DNA, 20 bp, Artificial Sequence
  chemically synthesized
agtatgtaagtatgtatatt

SEQ ID NO: 573163 - DNA, 20 bp, Artificial Sequence
  chemically synthesized
aataaaagagaacccatctt

SEQ ID NO: 573164 - DNA, 20 bp, Artificial Sequence
  chemically synthesized
actgcttatgctatattaag

SEQ ID NO: 573165 - DNA, 20 bp, Artificial Sequence
  chemically synthesized
aatatagcataagcagtaaa

SEQ ID NO: 573166 - DNA, 20 bp, Artificial Sequence
  chemically synthesized
agcataagcagtaaagggag

SEQ ID NO: 573167 - DNA, 20 bp, Artificial Sequence
  chemically synthesized
atactaaacaaaactccctt

SEQ ID NO: 573168 - DNA, 20 bp, Artificial Sequence
  chemically synthesized
cctagaagacattgtaatga

SEQ ID NO: 573169 - DNA, 20 bp, Artificial Sequence
  chemically synthesized
ttgttctttcattcagtcag

SEQ ID NO: 573170 - DNA, 20 bp, Artificial Sequence
  chemically synthesized
caaagggatgaaagaaggaa

SEQ ID NO: 573171 - DNA, 20 bp, Artificial Sequence
  chemically synthesized
gatgtctacatgactttgga

SEQ ID NO: 573172 - DNA, 20 bp, Artificial Sequence
  chemically synthesized
gtatgttttttaaaggtttc

SEQ ID NO: 573173 - DNA, 20 bp, Artificial Sequence
  chemically synthesized
ataaattatgtatgtttttt

SEQ ID NO: 573174 - DNA, 20 bp, Artificial Sequence
  chemically synthesized
agaacagtatcataaattat

SEQ ID NO: 573175 - DNA, 20 bp, Artificial Sequence
  chemically synthesized
atatgaaggcatttccagct

SEQ ID NO: 573176 - DNA, 20 bp, Artificial Sequence
  chemically synthesized
ctggaaatgccttcatatta

SEQ ID NO: 573177 - DNA, 20 bp, Artificial Sequence
  chemically synthesized
tcatattattcagattttaa

SEQ ID NO: 573178 - DNA, 20 bp, Artificial Sequence
  chemically synthesized
aacactttaacataaggagt

SEQ ID NO: 573179 - DNA, 20 bp, Artificial Sequence
  chemically synthesized
aacaaatactccttatgtta

SEQ ID NO: 573180 - DNA, 20 bp, Artificial Sequence
  chemically synthesized
tccttatgttaaagtgtttt

SEQ ID NO: 573181 - DNA, 20 bp, Artificial Sequence
  chemically synthesized
ttgcagcttttgtgctattt

SEQ ID NO: 573182 - DNA, 20 bp, Artificial Sequence
  chemically synthesized
aatattcctttatatactac

SEQ ID NO: 573183 - DNA, 20 bp, Artificial Sequence
  chemically synthesized
ctacttgcgcttggtgaata

SEQ ID NO: 573184 - DNA, 20 bp, Artificial Sequence
  chemically synthesized
gtgtactatttcaaaattag

SEQ ID NO: 573185 - DNA, 20 bp, Artificial Sequence
  chemically synthesized
tcattttaacttttttctca

SEQ ID NO: 573186 - DNA, 20 bp, Artificial Sequence
  chemically synthesized
ttttctcacctggtttagat

SEQ ID NO: 573187 - DNA, 20 bp, Artificial Sequence
  chemically synthesized
ctacttggtcaaatattagc

SEQ ID NO: 573188 - DNA, 20 bp, Artificial Sequence
  chemically synthesized
tggtcaaatattagcattag

SEQ ID NO: 573189 - DNA, 20 bp, Artificial Sequence
  chemically synthesized
agcattagtttggctttaag

SEQ ID NO: 573190 - DNA, 20 bp, Artificial Sequence
  chemically synthesized
gattcactgaaatcactttt

SEQ ID NO: 573191 - DNA, 20 bp, Artificial Sequence
  chemically synthesized
attgtactaaaatcagccaa

SEQ ID NO: 573192 - DNA, 20 bp, Artificial Sequence
  chemically synthesized
tctaaaggcaatgaggaata

SEQ ID NO: 573193 - DNA, 20 bp, Artificial Sequence
  chemically synthesized
aaattttatatttgaaacaa

SEQ ID NO: 573194 - DNA, 20 bp, Artificial Sequence
  chemically synthesized
gtgtaccccttagaaatcac

SEQ ID NO: 573195 - DNA, 20 bp, Artificial Sequence
  chemically synthesized
tgaactgggttcattaatcc

SEQ ID NO: 573196 - DNA, 20 bp, Artificial Sequence
  chemically synthesized
aaatcttccttttataaacc

SEQ ID NO: 573197 - DNA, 20 bp, Artificial Sequence
  chemically synthesized
taatccattggtttataaaa

SEQ ID NO: 573198 - DNA, 20 bp, Artificial Sequence
  chemically synthesized
tacatgtatcttcttttttg

SEQ ID NO: 573199 - DNA, 20 bp, Artificial Sequence
  chemically synthesized
tttacacctgtattgtccaa

SEQ ID NO: 573200 - DNA, 20 bp, Artificial Sequence
  chemically synthesized
tgtccaaaatagttttaaag

SEQ ID NO: 573201 - DNA, 20 bp, Artificial Sequence
  chemically synthesized
ctggagtgcagtggcatgat

SEQ ID NO: 573202 - DNA, 20 bp, Artificial Sequence
  chemically synthesized
aacatccgcctcccgggttc

SEQ ID NO: 573203 - DNA, 20 bp, Artificial Sequence
  chemically synthesized
ggttcaagcgattctcctgc

SEQ ID NO: 573204 - DNA, 20 bp, Artificial Sequence
  chemically synthesized
ttgggaagctgaggcaggag

SEQ ID NO: 573205 - DNA, 20 bp, Artificial Sequence
  chemically synthesized
aattagctgggtgtggtggc

SEQ ID NO: 573206 - DNA, 20 bp, Artificial Sequence
  chemically synthesized
ttttgtatttttagtagtga

SEQ ID NO: 573207 - DNA, 20 bp, Artificial Sequence
  chemically synthesized
cgcctcaccctcccaaagta

SEQ ID NO: 573208 - DNA, 20 bp, Artificial Sequence
  chemically synthesized
gagccaccacacccagccat

SEQ ID NO: 573209 - DNA, 20 bp, Artificial Sequence
  chemically synthesized
ctttgttaagtccaaacgta

SEQ ID NO: 573210 - DNA, 20 bp, Artificial Sequence
  chemically synthesized
ctcctcttctcaaaatccta

SEQ ID NO: 573211 - DNA, 20 bp, Artificial Sequence
  chemically synthesized
tgtatcagtcaagatctgag

SEQ ID NO: 573212 - DNA, 20 bp, Artificial Sequence
  chemically synthesized
gtgactgtgactgtggtact

SEQ ID NO: 573213 - DNA, 20 bp, Artificial Sequence
  chemically synthesized
ggtacttcatgtttctaagc

SEQ ID NO: 573214 - DNA, 20 bp, Artificial Sequence
  chemically synthesized
ccttttacgtgtaaggaaac

SEQ ID NO: 573215 - DNA, 20 bp, Artificial Sequence
  chemically synthesized
cttgtgattttgtattatga

SEQ ID NO: 573216 - DNA, 20 bp, Artificial Sequence
  chemically synthesized
cacaaccttgtgattttgta

SEQ ID NO: 573217 - DNA, 20 bp, Artificial Sequence
  chemically synthesized
cataatacaaaatcacaagg

SEQ ID NO: 573218 - DNA, 20 bp, Artificial Sequence
  chemically synthesized
ctcatctaagaatcacaacc

SEQ ID NO: 573219 - DNA, 20 bp, Artificial Sequence
  chemically synthesized
tttttctaactgcaaggagt

SEQ ID NO: 573220 - DNA, 20 bp, Artificial Sequence
  chemically synthesized
aatgtaagagacattggttt

SEQ ID NO: 573221 - DNA, 20 bp, Artificial Sequence
  chemically synthesized
ctaatagaaatgtaagagac

SEQ ID NO: 573222 - DNA, 20 bp, Artificial Sequence
  chemically synthesized
atgtctcttacatttctatt

SEQ ID NO: 573223 - DNA, 20 bp, Artificial Sequence
  chemically synthesized
tttctattagaagattcaaa

SEQ ID NO: 573224 - DNA, 20 bp, Artificial Sequence
  chemically synthesized
agtttggaattctctataca

SEQ ID NO: 573225 - DNA, 20 bp, Artificial Sequence
  chemically synthesized
tatacataggtaaattgtga

SEQ ID NO: 573226 - DNA, 20 bp, Artificial Sequence
  chemically synthesized
gttggtgctcacatccctta

SEQ ID NO: 573227 - DNA, 20 bp, Artificial Sequence
  chemically synthesized
acagacagctaaaaaactag

SEQ ID NO: 573228 - DNA, 20 bp, Artificial Sequence
  chemically synthesized
taattttcaaggaaagccat

SEQ ID NO: 573229 - DNA, 20 bp, Artificial Sequence
  chemically synthesized
ttgggcaaaatagtataata

SEQ ID NO: 573230 - DNA, 20 bp, Artificial Sequence
  chemically synthesized
ttaagactcttcttcttttc

SEQ ID NO: 573231 - DNA, 20 bp, Artificial Sequence
  chemically synthesized
gctcactgcaacctctgcct

SEQ ID NO: 573232 - DNA, 20 bp, Artificial Sequence
  chemically synthesized
tctggaggctgaggcaggag

SEQ ID NO: 573233 - DNA, 20 bp, Artificial Sequence
  chemically synthesized
tgcctcagcctccagagtag

SEQ ID NO: 573234 - DNA, 20 bp, Artificial Sequence
  chemically synthesized
gcacgcaccaccacacccag

SEQ ID NO: 573235 - DNA, 20 bp, Artificial Sequence
  chemically synthesized
ttttgtatttttagtagaga

SEQ ID NO: 573236 - DNA, 20 bp, Artificial Sequence
  chemically synthesized
caggcggatcacttgaggtc

SEQ ID NO: 573237 - DNA, 20 bp, Artificial Sequence
  chemically synthesized
tgcctcggcctcccaaagtg

SEQ ID NO: 573238 - DNA, 20 bp, Artificial Sequence
  chemically synthesized
tgcccagagagttctttact

SEQ ID NO: 573239 - DNA, 20 bp, Artificial Sequence
  chemically synthesized
gaggcaaagatgaacttgta

SEQ ID NO: 573240 - DNA, 20 bp, Artificial Sequence
  chemically synthesized
gaacttgtacttggttttta

SEQ ID NO: 573241 - DNA, 20 bp, Artificial Sequence
  chemically synthesized
acttggtttttatcacgatt

SEQ ID NO: 573242 - DNA, 20 bp, Artificial Sequence
  chemically synthesized
atgtcataatggtggtgggc

SEQ ID NO: 573243 - DNA, 20 bp, Artificial Sequence
  chemically synthesized
attatccaagttctatggcg

SEQ ID NO: 573244 - DNA, 20 bp, Artificial Sequence
  chemically synthesized
tattctcaacaggatgtatg

SEQ ID NO: 573245 - DNA, 20 bp, Artificial Sequence
  chemically synthesized
ttttccagtaatgggaaaaa

SEQ ID NO: 573246 - DNA, 20 bp, Artificial Sequence
  chemically synthesized
tgcttgatgtgaacctcatt

SEQ ID NO: 573247 - DNA, 20 bp, Artificial Sequence
  chemically synthesized
ggttatatgcaaaccaaaac

SEQ ID NO: 573248 - DNA, 20 bp, Artificial Sequence
  chemically synthesized
aaagctgataaatccaaggt

SEQ ID NO: 573249 - DNA, 20 bp, Artificial Sequence
  chemically synthesized
caaaccaaaaccttggattt

SEQ ID NO: 573250 - DNA, 20 bp, Artificial Sequence
  chemically synthesized
tagcagaaagctgataaatc

SEQ ID NO: 573251 - DNA, 20 bp, Artificial Sequence
  chemically synthesized
accttaaagatatgcttaaa

SEQ ID NO: 573252 - DNA, 20 bp, Artificial Sequence
  chemically synthesized
ttttgaacatgaccttaaag

SEQ ID NO: 573253 - DNA, 20 bp, Artificial Sequence
  chemically synthesized
gctctatattgtagcaaatt

SEQ ID NO: 573254 - DNA, 20 bp, Artificial Sequence
  chemically synthesized
agagcagacaccacaaactg

SEQ ID NO: 573255 - DNA, 20 bp, Artificial Sequence
  chemically synthesized
agccttctcctattaaacag

SEQ ID NO: 573256 - DNA, 20 bp, Artificial Sequence
  chemically synthesized
taggagaaggctgtgtatat

SEQ ID NO: 573257 - DNA, 20 bp, Artificial Sequence
  chemically synthesized
tatatgtgggtttagggaag

SEQ ID NO: 573258 - DNA, 20 bp, Artificial Sequence
  chemically synthesized
ttctttattcataatacaaa

SEQ ID NO: 573259 - DNA, 20 bp, Artificial Sequence
  chemically synthesized
tgaataaagaaaggaacttc

SEQ ID NO: 573260 - DNA, 20 bp, Artificial Sequence
  chemically synthesized
gagatacacatttgacagaa

SEQ ID NO: 573261 - DNA, 20 bp, Artificial Sequence
  chemically synthesized
agatatctagagacagaatc

SEQ ID NO: 573262 - DNA, 20 bp, Artificial Sequence
  chemically synthesized
aggtcacatacagttcaatc

SEQ ID NO: 573263 - DNA, 20 bp, Artificial Sequence
  chemically synthesized
ctgtatgtgaccttagacaa

SEQ ID NO: 573264 - DNA, 20 bp, Artificial Sequence
  chemically synthesized
gagaaagccatttaacctct

SEQ ID NO: 573265 - DNA, 20 bp, Artificial Sequence
  chemically synthesized
attaaagctgagagaggtta

SEQ ID NO: 573266 - DNA, 20 bp, Artificial Sequence
  chemically synthesized
ataacacggtcaaataatgg

SEQ ID NO: 573267 - DNA, 20 bp, Artificial Sequence
  chemically synthesized
cggtcaaataatggctgagc

SEQ ID NO: 573268 - DNA, 20 bp, Artificial Sequence
  chemically synthesized
tatgatatagcgaaaagagc

SEQ ID NO: 573269 - DNA, 20 bp, Artificial Sequence
  chemically synthesized
atatcatactatctccttac

SEQ ID NO: 573270 - DNA, 20 bp, Artificial Sequence
  chemically synthesized
gtgttttcctgtacttataa

SEQ ID NO: 573271 - DNA, 20 bp, Artificial Sequence
  chemically synthesized
tggctacatagtaagctatt

SEQ ID NO: 573272 - DNA, 20 bp, Artificial Sequence
  chemically synthesized
ttaaggtatcaaaaacagta

SEQ ID NO: 573273 - DNA, 20 bp, Artificial Sequence
  chemically synthesized
aactagaatggatcacttag

SEQ ID NO: 573274 - DNA, 20 bp, Artificial Sequence
  chemically synthesized
aaaggattatgactagtaag

SEQ ID NO: 573275 - DNA, 20 bp, Artificial Sequence
  chemically synthesized
gtagatttccaaatgaggtc

SEQ ID NO: 573276 - DNA, 20 bp, Artificial Sequence
  chemically synthesized
aaagatttgtgacagtggca

SEQ ID NO: 573277 - DNA, 20 bp, Artificial Sequence
  chemically synthesized
gtttgctttcagaacgtggt

SEQ ID NO: 573278 - DNA, 20 bp, Artificial Sequence
  chemically synthesized
tttagagagcagaatgccac

SEQ ID NO: 573279 - DNA, 20 bp, Artificial Sequence
  chemically synthesized
ttcttttagagagcagaatg

SEQ ID NO: 573280 - DNA, 20 bp, Artificial Sequence
  chemically synthesized
tatatgggactaatgtggcc

SEQ ID NO: 573281 - DNA, 20 bp, Artificial Sequence
  chemically synthesized
ttttatctgttccatcctta

SEQ ID NO: 573282 - DNA, 20 bp, Artificial Sequence
  chemically synthesized
ctaagtgattatatgccttt

SEQ ID NO: 573283 - DNA, 20 bp, Artificial Sequence
  chemically synthesized
taaagcaaggcgatatagct

SEQ ID NO: 573284 - DNA, 20 bp, Artificial Sequence
  chemically synthesized
ataatcacttagctatatcg

SEQ ID NO: 573285 - DNA, 20 bp, Artificial Sequence
  chemically synthesized
tagtcctgaaagatttgtat

SEQ ID NO: 573286 - DNA, 20 bp, Artificial Sequence
  chemically synthesized
ttgttgtgatggatagtcct

SEQ ID NO: 573287 - DNA, 20 bp, Artificial Sequence
  chemically synthesized
tatgtgagatctcaagaggt

SEQ ID NO: 573288 - DNA, 20 bp, Artificial Sequence
  chemically synthesized
tattgtcagtccatttaggg

SEQ ID NO: 573289 - DNA, 20 bp, Artificial Sequence
  chemically synthesized
taaatggactgacaatagga

SEQ ID NO: 573290 - DNA, 20 bp, Artificial Sequence
  chemically synthesized
gactgacaataggaaagtga

SEQ ID NO: 573291 - DNA, 20 bp, Artificial Sequence
  chemically synthesized
ttattaaaaagttaaaacca

SEQ ID NO: 573292 - DNA, 20 bp, Artificial Sequence
  chemically synthesized
ggaaactgggtttaaaacta

SEQ ID NO: 573293 - DNA, 20 bp, Artificial Sequence
  chemically synthesized
taaaaccaaatagttttaaa

SEQ ID NO: 573294 - DNA, 20 bp, Artificial Sequence
  chemically synthesized
aaggtatgcctctgaggaaa

SEQ ID NO: 573295 - DNA, 20 bp, Artificial Sequence
  chemically synthesized
agaaaattggaaaggagaga

SEQ ID NO: 573296 - DNA, 20 bp, Artificial Sequence
  chemically synthesized
ttctacggttaaactaattt

SEQ ID NO: 573297 - DNA, 20 bp, Artificial Sequence
  chemically synthesized
ttataccccaaaaccctaaa

SEQ ID NO: 573298 - DNA, 20 bp, Artificial Sequence
  chemically synthesized
gatgagtaaatggacaacca

SEQ ID NO: 573299 - DNA, 20 bp, Artificial Sequence
  chemically synthesized
caaggtcactcagctaatat

SEQ ID NO: 573300 - DNA, 20 bp, Artificial Sequence
  chemically synthesized
tattattattattacagtac

SEQ ID NO: 573301 - DNA, 20 bp, Artificial Sequence
  chemically synthesized
atcaagagctagaatttgta

SEQ ID NO: 573302 - DNA, 20 bp, Artificial Sequence
  chemically synthesized
ataataaaattctctgcaat

SEQ ID NO: 573303 - DNA, 20 bp, Artificial Sequence
  chemically synthesized
cttacatgtggaagtttttc

SEQ ID NO: 573304 - DNA, 20 bp, Artificial Sequence
  chemically synthesized
cctacgaaaaacttccacat

SEQ ID NO: 573305 - DNA, 20 bp, Artificial Sequence
  chemically synthesized
cctatcacaaacttacatgt

SEQ ID NO: 573306 - DNA, 20 bp, Artificial Sequence
  chemically synthesized
ggacacatcttactattgac

SEQ ID NO: 573307 - DNA, 20 bp, Artificial Sequence
  chemically synthesized
actattgactcttgtttaaa

SEQ ID NO: 573308 - DNA, 20 bp, Artificial Sequence
  chemically synthesized
aattaggattctaaagggaa

SEQ ID NO: 573309 - DNA, 20 bp, Artificial Sequence
  chemically synthesized
gttcctttgtactcttactg

SEQ ID NO: 573310 - DNA, 20 bp, Artificial Sequence
  chemically synthesized
atgcagttcctttgtactct

SEQ ID NO: 573311 - DNA, 20 bp, Artificial Sequence
  chemically synthesized
gtggcaattcacatcttcca

SEQ ID NO: 573312 - DNA, 20 bp, Artificial Sequence
  chemically synthesized
catcatgattcagcattatt

SEQ ID NO: 573313 - DNA, 20 bp, Artificial Sequence
  chemically synthesized
atcgtaagaatactgctaca

SEQ ID NO: 573314 - DNA, 20 bp, Artificial Sequence
  chemically synthesized
cctcaccaccaacacggggg

SEQ ID NO: 573315 - DNA, 20 bp, Artificial Sequence
  chemically synthesized
gtaggagtgaatccctcatg

SEQ ID NO: 573316 - DNA, 20 bp, Artificial Sequence
  chemically synthesized
aatggcaccaaaccattcat

SEQ ID NO: 573317 - DNA, 20 bp, Artificial Sequence
  chemically synthesized
gccattctcacggtagtgag

SEQ ID NO: 573318 - DNA, 20 bp, Artificial Sequence
  chemically synthesized
agtgagcgaggttttgctct

SEQ ID NO: 573319 - DNA, 20 bp, Artificial Sequence
  chemically synthesized
tgcttctggcgagggcgtca

SEQ ID NO: 573320 - DNA, 20 bp, Artificial Sequence
  chemically synthesized
ctgacgccctcgccagaagc

SEQ ID NO: 573321 - DNA, 20 bp, Artificial Sequence
  chemically synthesized
ctgcaggctgtacaagaagc

SEQ ID NO: 573322 - DNA, 20 bp, Artificial Sequence
  chemically synthesized
ctgggtaattcataaagaac

SEQ ID NO: 573323 - DNA, 20 bp, Artificial Sequence
  chemically synthesized
aagacttagtatatgtctta

SEQ ID NO: 573324 - DNA, 20 bp, Artificial Sequence
  chemically synthesized
taagacatatactaagtctt

SEQ ID NO: 573325 - DNA, 20 bp, Artificial Sequence
  chemically synthesized
aattaatattaataatttga

SEQ ID NO: 573326 - DNA, 20 bp, Artificial Sequence
  chemically synthesized
gtgaggataggatattttat

SEQ ID NO: 573327 - DNA, 20 bp, Artificial Sequence
  chemically synthesized
tttactgtaacaaaggacaa

SEQ ID NO: 573328 - DNA, 20 bp, Artificial Sequence
  chemically synthesized
aaaggacaacaatgtttaca

SEQ ID NO: 573329 - DNA, 20 bp, Artificial Sequence
  chemically synthesized
tttacaatgtgcttacctgc

SEQ ID NO: 573330 - DNA, 20 bp, Artificial Sequence
  chemically synthesized
ggaagacctgaacaccagat

SEQ ID NO: 573331 - DNA, 20 bp, Artificial Sequence
  chemically synthesized
ccacgtcaatgaccttgctc

SEQ ID NO: 573332 - DNA, 20 bp, Artificial Sequence
  chemically synthesized
ttaaatattctcatcttcca

SEQ ID NO: 573333 - DNA, 20 bp, Artificial Sequence
  chemically synthesized
taagcccaggtatcagttct

SEQ ID NO: 573334 - DNA, 20 bp, Artificial Sequence
  chemically synthesized
aaaacaagaagaactgatac

SEQ ID NO: 573335 - DNA, 20 bp, Artificial Sequence
  chemically synthesized
tctttagggtgcagtgccag

SEQ ID NO: 573336 - DNA, 20 bp, Artificial Sequence
  chemically synthesized
cagtaatgtttgctctatgc

SEQ ID NO: 573337 - DNA, 20 bp, Artificial Sequence
  chemically synthesized
tttgctctatgctacggttt

SEQ ID NO: 573338 - DNA, 20 bp, Artificial Sequence
  chemically synthesized
tttcgtttcctttttatttt

SEQ ID NO: 573339 - DNA, 20 bp, Artificial Sequence
  chemically synthesized
cattgccttaggtgttttga

SEQ ID NO: 573340 - DNA, 20 bp, Artificial Sequence
  chemically synthesized
taataccattgccttaggtg

SEQ ID NO: 573341 - DNA, 20 bp, Artificial Sequence
  chemically synthesized
tctcctaataccattgcctt

SEQ ID NO: 573342 - DNA, 20 bp, Artificial Sequence
  chemically synthesized
aggagatggggcctttaggg

SEQ ID NO: 573343 - DNA, 20 bp, Artificial Sequence
  chemically synthesized
ggcctttagggaggtgattt

SEQ ID NO: 573344 - DNA, 20 bp, Artificial Sequence
  chemically synthesized
catgtgagggtgcagtgaga

SEQ ID NO: 573345 - DNA, 20 bp, Artificial Sequence
  chemically synthesized
aagtccaagatcaaaatacc

SEQ ID NO: 573346 - DNA, 20 bp, Artificial Sequence
  chemically synthesized
aacctccagaacagtgagaa

SEQ ID NO: 573347 - DNA, 20 bp, Artificial Sequence
  chemically synthesized
aacagtgagaaataagtttt

SEQ ID NO: 573348 - DNA, 20 bp, Artificial Sequence
  chemically synthesized
aatagaaatgccataaattg

SEQ ID NO: 573349 - DNA, 20 bp, Artificial Sequence
  chemically synthesized
atgagctctattcatacata

SEQ ID NO: 573350 - DNA, 20 bp, Artificial Sequence
  chemically synthesized
gattgttgggtagaaataaa

SEQ ID NO: 573351 - DNA, 20 bp, Artificial Sequence
  chemically synthesized
attctccaactactggcctc

SEQ ID NO: 573352 - DNA, 20 bp, Artificial Sequence
  chemically synthesized
acatgagaaaacaaacttgc

SEQ ID NO: 573353 - DNA, 20 bp, Artificial Sequence
  chemically synthesized
ttgaaaacaaacctctgcaa

SEQ ID NO: 573354 - DNA, 20 bp, Artificial Sequence
  chemically synthesized
gagaaaacaaacttgcagag

SEQ ID NO: 573355 - DNA, 20 bp, Artificial Sequence
  chemically synthesized
tgttttgaaaacaaacctct

SEQ ID NO: 573356 - DNA, 20 bp, Artificial Sequence
  chemically synthesized
atgagagcttggcaaggttt

SEQ ID NO: 573357 - DNA, 20 bp, Artificial Sequence
  chemically synthesized
acccatgagagcttggcaag

SEQ ID NO: 573358 - DNA, 20 bp, Artificial Sequence
  chemically synthesized
ttttacccatgagagcttgg

SEQ ID NO: 573359 - DNA, 20 bp, Artificial Sequence
  chemically synthesized
gttcctcaatttttacccat

SEQ ID NO: 573360 - DNA, 20 bp, Artificial Sequence
  chemically synthesized
ggaacctgggatacctatat

SEQ ID NO: 573361 - DNA, 20 bp, Artificial Sequence
  chemically synthesized
atattcttaactattatgtt

SEQ ID NO: 573362 - DNA, 20 bp, Artificial Sequence
  chemically synthesized
atatgcttcccctaagaaat

SEQ ID NO: 573363 - DNA, 20 bp, Artificial Sequence
  chemically synthesized
aacaagaaaaatatattgct

SEQ ID NO: 573364 - DNA, 20 bp, Artificial Sequence
  chemically synthesized
ctttgcaccaaccacatcat

SEQ ID NO: 573365 - DNA, 20 bp, Artificial Sequence
  chemically synthesized
atgacttcagaaggctcccg

SEQ ID NO: 573366 - DNA, 20 bp, Artificial Sequence
  chemically synthesized
tgcatcagagactcctgctc

SEQ ID NO: 573367 - DNA, 20 bp, Artificial Sequence
  chemically synthesized
tgcatagggttcttctgctc

SEQ ID NO: 573368 - DNA, 20 bp, Artificial Sequence
  chemically synthesized
gagggaatttgtcccttaga

SEQ ID NO: 573369 - DNA, 20 bp, Artificial Sequence
  chemically synthesized
caaattccctcacttaggag

SEQ ID NO: 573370 - DNA, 20 bp, Artificial Sequence
  chemically synthesized
cagcaccacttgactatacg

SEQ ID NO: 573371 - DNA, 20 bp, Artificial Sequence
  chemically synthesized
tgactatacgtgttgttttg

SEQ ID NO: 573372 - DNA, 20 bp, Artificial Sequence
  chemically synthesized
taaatgaggtcagtgtaacc

SEQ ID NO: 573373 - DNA, 20 bp, Artificial Sequence
  chemically synthesized
atttggagtgggaggaaatg

SEQ ID NO: 573374 - DNA, 20 bp, Artificial Sequence
  chemically synthesized
gtttactgatgaagtattca

SEQ ID NO: 573375 - DNA, 20 bp, Artificial Sequence
  chemically synthesized
tgttatgctctatacagcac

SEQ ID NO: 573376 - DNA, 20 bp, Artificial Sequence
  chemically synthesized
gttcaacagagtgattatca

SEQ ID NO: 573377 - DNA, 20 bp, Artificial Sequence
  chemically synthesized
ttaaaactttaagttcaaca

SEQ ID NO: 573378 - DNA, 20 bp, Artificial Sequence
  chemically synthesized
gataatcactctgttgaact

SEQ ID NO: 573379 - DNA, 20 bp, Artificial Sequence
  chemically synthesized
aaccccctgattgcttaacg

SEQ ID NO: 573380 - DNA, 20 bp, Artificial Sequence
  chemically synthesized
aacattacgttaagcaatca

SEQ ID NO: 573381 - DNA, 20 bp, Artificial Sequence
  chemically synthesized
tcgtccaaaagaaaccccct

SEQ ID NO: 573382 - DNA, 20 bp, Artificial Sequence
  chemically synthesized
gttatcgtccaaaagaaacc

SEQ ID NO: 573383 - DNA, 20 bp, Artificial Sequence
  chemically synthesized
caagattgtgccaccatcac

SEQ ID NO: 573384 - DNA, 20 bp, Artificial Sequence
  chemically synthesized
cagtggtgtttagtatattc

SEQ ID NO: 573385 - DNA, 20 bp, Artificial Sequence
  chemically synthesized
tttcaaagtgtacaattcag

SEQ ID NO: 573386 - DNA, 20 bp, Artificial Sequence
  chemically synthesized
gtcagaaggggctctctttt

SEQ ID NO: 573387 - DNA, 20 bp, Artificial Sequence
  chemically synthesized
tatggtcagaaggggctctc

SEQ ID NO: 573388 - DNA, 20 bp, Artificial Sequence
  chemically synthesized
aatacagatgaatacatcac

SEQ ID NO: 573389 - DNA, 20 bp, Artificial Sequence
  chemically synthesized
ataaaactttctgaatttca

SEQ ID NO: 573390 - DNA, 20 bp, Artificial Sequence
  chemically synthesized
tggaatcagtgtgaaattca

SEQ ID NO: 573391 - DNA, 20 bp, Artificial Sequence
  chemically synthesized
catttccttatgaataaata

SEQ ID NO: 573392 - DNA, 20 bp, Artificial Sequence
  chemically synthesized
aataagggcccatggagaaa

SEQ ID NO: 573393 - DNA, 20 bp, Artificial Sequence
  chemically synthesized
tagagataagtattcatata

SEQ ID NO: 573394 - DNA, 20 bp, Artificial Sequence
  chemically synthesized
aaggaaatgatccatattaa

SEQ ID NO: 573395 - DNA, 20 bp, Artificial Sequence
  chemically synthesized
gcataatagaaaggttagaa

SEQ ID NO: 573396 - DNA, 20 bp, Artificial Sequence
  chemically synthesized
cccccattgacatttaagaa

SEQ ID NO: 573397 - DNA, 20 bp, Artificial Sequence
  chemically synthesized
tttgtaaccgttgtccttgt

SEQ ID NO: 573398 - DNA, 20 bp, Artificial Sequence
  chemically synthesized
gcacgttattatccagaaga

SEQ ID NO: 573399 - DNA, 20 bp, Artificial Sequence
  chemically synthesized
tctctgcagaggttcctgtt

SEQ ID NO: 573400 - DNA, 20 bp, Artificial Sequence
  chemically synthesized
cttgccctctctgcagaggt

SEQ ID NO: 573401 - DNA, 20 bp, Artificial Sequence
  chemically synthesized
atcactgaaagatgctgcct

SEQ ID NO: 573402 - DNA, 20 bp, Artificial Sequence
  chemically synthesized
agagtcttgcttgtaaagag

SEQ ID NO: 573403 - DNA, 20 bp, Artificial Sequence
  chemically synthesized
tcaacttaatggcttgagag

SEQ ID NO: 573404 - DNA, 20 bp, Artificial Sequence
  chemically synthesized
gcaagactctcaagccatta

SEQ ID NO: 573405 - DNA, 20 bp, Artificial Sequence
  chemically synthesized
cgaggtaggataatcaactt

SEQ ID NO: 573406 - DNA, 20 bp, Artificial Sequence
  chemically synthesized
tcctacctcgttaagccata

SEQ ID NO: 573407 - DNA, 20 bp, Artificial Sequence
  chemically synthesized
aaagggaactgaaatctagc

SEQ ID NO: 573408 - DNA, 20 bp, Artificial Sequence
  chemically synthesized
aaatgtctcttattagaata

SEQ ID NO: 573409 - DNA, 20 bp, Artificial Sequence
  chemically synthesized
ttcctgagcacacatattaa

SEQ ID NO: 573410 - DNA, 20 bp, Artificial Sequence
  chemically synthesized
cacacatattaatcctgctt

SEQ ID NO: 573411 - DNA, 20 bp, Artificial Sequence
  chemically synthesized
tcatcctccaaaacattgaa

SEQ ID NO: 573412 - DNA, 20 bp, Artificial Sequence
  chemically synthesized
ttcaatgttttggaggatga

SEQ ID NO: 573413 - DNA, 20 bp, Artificial Sequence
  chemically synthesized
aggatgaaggggattcaaaa

SEQ ID NO: 573414 - DNA, 20 bp, Artificial Sequence
  chemically synthesized
aaaatcccaagatcttatgg

SEQ ID NO: 573415 - DNA, 20 bp, Artificial Sequence
  chemically synthesized
ttaaactttaccataagatc

SEQ ID NO: 573416 - DNA, 20 bp, Artificial Sequence
  chemically synthesized
tttttttttttttttttttt

SEQ ID NO: 573417 - DNA, 20 bp, Artificial Sequence
  chemically synthesized
gttcagagaacttccactat

SEQ ID NO: 573418 - DNA, 20 bp, Artificial Sequence
  chemically synthesized
ctaatttggtgagtcttaag

SEQ ID NO: 573419 - DNA, 20 bp, Artificial Sequence
  chemically synthesized
ctgtgagaggttcccatcac

SEQ ID NO: 573420 - DNA, 20 bp, Artificial Sequence
  chemically synthesized
cacaacagttactggcaaag

SEQ ID NO: 573421 - DNA, 20 bp, Artificial Sequence
  chemically synthesized
cctatctttgccagtaactg

SEQ ID NO: 573422 - DNA, 20 bp, Artificial Sequence
  chemically synthesized
tgattatgtaatttaataaa

SEQ ID NO: 573423 - DNA, 20 bp, Artificial Sequence
  chemically synthesized
atttcctaaatcataaaaat

SEQ ID NO: 573424 - DNA, 20 bp, Artificial Sequence
  chemically synthesized
ttctttttaaactaatattt

SEQ ID NO: 573425 - DNA, 20 bp, Artificial Sequence
  chemically synthesized
caactctccagagtatttgg

SEQ ID NO: 573426 - DNA, 20 bp, Artificial Sequence
  chemically synthesized
ccaggccaaatactctggag

SEQ ID NO: 573427 - DNA, 20 bp, Artificial Sequence
  chemically synthesized
gagccaccccacctggtctg

SEQ ID NO: 573428 - DNA, 20 bp, Artificial Sequence
  chemically synthesized
cacctcagcctcccaaagtg

SEQ ID NO: 573429 - DNA, 20 bp, Artificial Sequence
  chemically synthesized
ttttgtatctttagtagaga

SEQ ID NO: 573430 - DNA, 20 bp, Artificial Sequence
  chemically synthesized
tcagggggctgaggcatgag

SEQ ID NO: 573431 - DNA, 20 bp, Artificial Sequence
  chemically synthesized
aacctccacctcccaggttc

SEQ ID NO: 573432 - DNA, 20 bp, Artificial Sequence
  chemically synthesized
aaaagaaaaaatgccaaata

SEQ ID NO: 573433 - DNA, 20 bp, Artificial Sequence
  chemically synthesized
ttttaacagaaatttaggaa

SEQ ID NO: 573434 - DNA, 20 bp, Artificial Sequence
  chemically synthesized
ctgttaaaatatttgacaat

SEQ ID NO: 573435 - DNA, 20 bp, Artificial Sequence
  chemically synthesized
tcaactgacctcacaccagt

SEQ ID NO: 573436 - DNA, 20 bp, Artificial Sequence
  chemically synthesized
gtgaacctttgcccccagtt

SEQ ID NO: 573437 - DNA, 20 bp, Artificial Sequence
  chemically synthesized
tcatgcgttgagtgccctca

SEQ ID NO: 573438 - DNA, 20 bp, Artificial Sequence
  chemically synthesized
atgtcagtcttcactttggc

SEQ ID NO: 573439 - DNA, 20 bp, Artificial Sequence
  chemically synthesized
tcttcactttggcatttgat

SEQ ID NO: 573440 - DNA, 20 bp, Artificial Sequence
  chemically synthesized
catttgatttaggttttggt

SEQ ID NO: 573441 - DNA, 20 bp, Artificial Sequence
  chemically synthesized
agggtgaaggtcttgtgact

SEQ ID NO: 573442 - DNA, 20 bp, Artificial Sequence
  chemically synthesized
gctatttaaatagatgtgac

SEQ ID NO: 573443 - DNA, 20 bp, Artificial Sequence
  chemically synthesized
acattggtttggctatattt

SEQ ID NO: 573444 - DNA, 20 bp, Artificial Sequence
  chemically synthesized
tttggctatatttcacagat

SEQ ID NO: 573445 - DNA, 20 bp, Artificial Sequence
  chemically synthesized
ttaatatgacacacataaat

SEQ ID NO: 573446 - DNA, 20 bp, Artificial Sequence
  chemically synthesized
gctttttgacattttaggtg

SEQ ID NO: 573447 - DNA, 20 bp, Artificial Sequence
  chemically synthesized
ctcgtattgctcagcgttaa

SEQ ID NO: 573448 - DNA, 20 bp, Artificial Sequence
  chemically synthesized
gaggtgctatttaagtgata

SEQ ID NO: 573449 - DNA, 20 bp, Artificial Sequence
  chemically synthesized
taagtgatatcaggattgca

SEQ ID NO: 573450 - DNA, 20 bp, Artificial Sequence
  chemically synthesized
ggattgcattaggttttttt

SEQ ID NO: 573451 - DNA, 20 bp, Artificial Sequence
  chemically synthesized
ttcttcaatgttttctcact

SEQ ID NO: 573452 - DNA, 20 bp, Artificial Sequence
  chemically synthesized
cacaatataatggctttctt

SEQ ID NO: 573453 - DNA, 20 bp, Artificial Sequence
  chemically synthesized
ttgaagaaagccattatatt

SEQ ID NO: 573454 - DNA, 20 bp, Artificial Sequence
  chemically synthesized
tcaaagaaaacccacaatat

SEQ ID NO: 573455 - DNA, 20 bp, Artificial Sequence
  chemically synthesized
agaacatattccagatgttt

SEQ ID NO: 573456 - DNA, 20 bp, Artificial Sequence
  chemically synthesized
tttcatggagaacatattcc

SEQ ID NO: 573457 - DNA, 20 bp, Artificial Sequence
  chemically synthesized
ctagtcataataaaattaga

SEQ ID NO: 573458 - DNA, 20 bp, Artificial Sequence
  chemically synthesized
ccaagtctaattttattatg

SEQ ID NO: 573459 - DNA, 20 bp, Artificial Sequence
  chemically synthesized
ttttcagttcattaaatgtt

SEQ ID NO: 573460 - DNA, 20 bp, Artificial Sequence
  chemically synthesized
tctgattatagatacaaaag

SEQ ID NO: 573461 - DNA, 20 bp, Artificial Sequence
  chemically synthesized
tgataggtaagtctgatata

SEQ ID NO: 573462 - DNA, 20 bp, Artificial Sequence
  chemically synthesized
aattaaattgcctgtcatat

SEQ ID NO: 573463 - DNA, 20 bp, Artificial Sequence
  chemically synthesized
tttgcttatctttatgtagc

SEQ ID NO: 573464 - DNA, 20 bp, Artificial Sequence
  chemically synthesized
tcaaaattcctccctcaaaa

SEQ ID NO: 573465 - DNA, 20 bp, Artificial Sequence
  chemically synthesized
tagtctttccaactgacctt

SEQ ID NO: 573466 - DNA, 20 bp, Artificial Sequence
  chemically synthesized
gaaagagtaaattgagggaa

SEQ ID NO: 573467 - DNA, 20 bp, Artificial Sequence
  chemically synthesized
attgagggaattctgcttgg

SEQ ID NO: 573468 - DNA, 20 bp, Artificial Sequence
  chemically synthesized
actgcagactatgccaggtc

SEQ ID NO: 573469 - DNA, 20 bp, Artificial Sequence
  chemically synthesized
tgttcccacttacccttaat

SEQ ID NO: 573470 - DNA, 20 bp, Artificial Sequence
  chemically synthesized
actccctctcacagtctcta

SEQ ID NO: 573471 - DNA, 20 bp, Artificial Sequence
  chemically synthesized
atcctcaagtgggccctcaa

SEQ ID NO: 573472 - DNA, 20 bp, Artificial Sequence
  chemically synthesized
tggagaaaatgagaaagtca

SEQ ID NO: 573473 - DNA, 20 bp, Artificial Sequence
  chemically synthesized
acctggatcaactgttttcc

SEQ ID NO: 573474 - DNA, 20 bp, Artificial Sequence
  chemically synthesized
gcatggggaaaacagttgat

SEQ ID NO: 573475 - DNA, 20 bp, Artificial Sequence
  chemically synthesized
cgaaaccccaaacctggatc

SEQ ID NO: 573476 - DNA, 20 bp, Artificial Sequence
  chemically synthesized
gaaaacagttgatccaggtt

SEQ ID NO: 573477 - DNA, 20 bp, Artificial Sequence
  chemically synthesized
gctcacacatttagggataa

SEQ ID NO: 573478 - DNA, 20 bp, Artificial Sequence
  chemically synthesized
aaatatactgtggaatctaa

SEQ ID NO: 573479 - DNA, 20 bp, Artificial Sequence
  chemically synthesized
ttgctttcctcctaatccag

SEQ ID NO: 573480 - DNA, 20 bp, Artificial Sequence
  chemically synthesized
ttgctttgctttcctcctaa

SEQ ID NO: 573481 - DNA, 20 bp, Artificial Sequence
  chemically synthesized
aggaggaaagcaaagcaaaa

SEQ ID NO: 573482 - DNA, 20 bp, Artificial Sequence
  chemically synthesized
catctacaagcttcattttg

SEQ ID NO: 573483 - DNA, 20 bp, Artificial Sequence
  chemically synthesized
ctctccatctacaagcttca

SEQ ID NO: 573484 - DNA, 20 bp, Artificial Sequence
  chemically synthesized
cctctactttctctccatct

SEQ ID NO: 573485 - DNA, 20 bp, Artificial Sequence
  chemically synthesized
ctactcctgctgtggccttt

SEQ ID NO: 573486 - DNA, 20 bp, Artificial Sequence
  chemically synthesized
cagagtctcccctctctgtc

SEQ ID NO: 573487 - DNA, 20 bp, Artificial Sequence
  chemically synthesized
atcccagagtctcccctctc

SEQ ID NO: 573488 - DNA, 20 bp, Artificial Sequence
  chemically synthesized
agaggggagactctgggatg

SEQ ID NO: 573489 - DNA, 20 bp, Artificial Sequence
  chemically synthesized
gggatgctcagattagctct

SEQ ID NO: 573490 - DNA, 20 bp, Artificial Sequence
  chemically synthesized
ctctactggatttgccactt

SEQ ID NO: 573491 - DNA, 20 bp, Artificial Sequence
  chemically synthesized
tatatatttatatatatata

SEQ ID NO: 573492 - DNA, 20 bp, Artificial Sequence
  chemically synthesized
taaatatatatagtgctact

SEQ ID NO: 573493 - DNA, 20 bp, Artificial Sequence
  chemically synthesized
tatttaatatccctaagaag

SEQ ID NO: 573494 - DNA, 20 bp, Artificial Sequence
  chemically synthesized
gacgtctatgagttagcagg

SEQ ID NO: 573495 - DNA, 20 bp, Artificial Sequence
  chemically synthesized
accatgaatccttgtcaaac

SEQ ID NO: 573496 - DNA, 20 bp, Artificial Sequence
  chemically synthesized
gttaacaaacatttgtttga

SEQ ID NO: 573497 - DNA, 20 bp, Artificial Sequence
  chemically synthesized
aagagtcttggttaacaaac

SEQ ID NO: 573498 - DNA, 20 bp, Artificial Sequence
  chemically synthesized
cctagcacctcctcttttta

SEQ ID NO: 573499 - DNA, 20 bp, Artificial Sequence
  chemically synthesized
taaacaccagtatttatagg

SEQ ID NO: 573500 - DNA, 20 bp, Artificial Sequence
  chemically synthesized
aaatcatgtcctataaatac

SEQ ID NO: 573501 - DNA, 20 bp, Artificial Sequence
  chemically synthesized
cccgggtaattgcattctgt

SEQ ID NO: 573502 - DNA, 20 bp, Artificial Sequence
  chemically synthesized
tggcagcaggtacagcccag

SEQ ID NO: 573503 - DNA, 20 bp, Artificial Sequence
  chemically synthesized
caagagagtcaaggactgta

SEQ ID NO: 573504 - DNA, 20 bp, Artificial Sequence
  chemically synthesized
ctcattccgcccaggtattt

SEQ ID NO: 573505 - DNA, 20 bp, Artificial Sequence
  chemically synthesized
ctcaacttgtgtttcttttt

SEQ ID NO: 573506 - DNA, 20 bp, Artificial Sequence
  chemically synthesized
gggcttgcttacagctcaac

SEQ ID NO: 573507 - DNA, 20 bp, Artificial Sequence
  chemically synthesized
cctgatacatttcatgaagg

SEQ ID NO: 573508 - DNA, 20 bp, Artificial Sequence
  chemically synthesized
tgagcctgatacatttcatg

SEQ ID NO: 573509 - DNA, 20 bp, Artificial Sequence
  chemically synthesized
tctgatgcccagaatgtagg

SEQ ID NO: 573510 - DNA, 20 bp, Artificial Sequence
  chemically synthesized
cagatacctactgccttcag

SEQ ID NO: 573511 - DNA, 20 bp, Artificial Sequence
  chemically synthesized
ttttcttaagagcactcaga

SEQ ID NO: 573512 - DNA, 20 bp, Artificial Sequence
  chemically synthesized
ttaactttcttgccctgtct

SEQ ID NO: 573513 - DNA, 20 bp, Artificial Sequence
  chemically synthesized
gatctgggaattcccatggg

SEQ ID NO: 573514 - DNA, 20 bp, Artificial Sequence
  chemically synthesized
caggtgccatgatgaggcaa

SEQ ID NO: 573515 - DNA, 20 bp, Artificial Sequence
  chemically synthesized
ggttttccctttgtacccct

SEQ ID NO: 573516 - DNA, 20 bp, Artificial Sequence
  chemically synthesized
tggtgggacatgccagtcaa

SEQ ID NO: 573517 - DNA, 20 bp, Artificial Sequence
  chemically synthesized
tctggaaaggggtgaaacca

SEQ ID NO: 573518 - DNA, 20 bp, Artificial Sequence
  chemically synthesized
agtattagctgctaaagcct

SEQ ID NO: 573519 - DNA, 20 bp, Artificial Sequence
  chemically synthesized
tggatgctgttggtgcccca

SEQ ID NO: 573520 - DNA, 20 bp, Artificial Sequence
  chemically synthesized
ggcaccaacagcatccatta

SEQ ID NO: 573521 - DNA, 20 bp, Artificial Sequence
  chemically synthesized
ccattacttagattaacttc

SEQ ID NO: 573522 - DNA, 20 bp, Artificial Sequence
  chemically synthesized
tcagttgtcaagcacttata

SEQ ID NO: 573523 - DNA, 20 bp, Artificial Sequence
  chemically synthesized
aaaaaaaaaaaacaaaatat

SEQ ID NO: 573524 - DNA, 20 bp, Artificial Sequence
  chemically synthesized
ttttttttttttttccaagg

SEQ ID NO: 573525 - DNA, 20 bp, Artificial Sequence
  chemically synthesized
aacttctacctcctgggttc

SEQ ID NO: 573526 - DNA, 20 bp, Artificial Sequence
  chemically synthesized
tgcctcagcctcctgagtag

SEQ ID NO: 573527 - DNA, 20 bp, Artificial Sequence
  chemically synthesized
ttttgtatttttagaagaga

SEQ ID NO: 573528 - DNA, 20 bp, Artificial Sequence
  chemically synthesized
cacgtaggcctcccaaagtg

SEQ ID NO: 573529 - DNA, 20 bp, Artificial Sequence
  chemically synthesized
ttcatagctctccaacaaaa

SEQ ID NO: 573530 - DNA, 20 bp, Artificial Sequence
  chemically synthesized
tttcgagaaagggtgacaat

SEQ ID NO: 573531 - DNA, 20 bp, Artificial Sequence
  chemically synthesized
ccctctgcctttagtatcac

SEQ ID NO: 573532 - DNA, 20 bp, Artificial Sequence
  chemically synthesized
atcccttttttttttttaaa

SEQ ID NO: 573533 - DNA, 20 bp, Artificial Sequence
  chemically synthesized
actttaaaaaaaaaaaaggg

SEQ ID NO: 573534 - DNA, 20 bp, Artificial Sequence
  chemically synthesized
tgattgcatttttttccagc

SEQ ID NO: 573535 - DNA, 20 bp, Artificial Sequence
  chemically synthesized
agcctgaaggcaaaatatta

SEQ ID NO: 573536 - DNA, 20 bp, Artificial Sequence
  chemically synthesized
cttttcgttgtctccttccg

SEQ ID NO: 573537 - DNA, 20 bp, Artificial Sequence
  chemically synthesized
aagtgatcatgcccaaatat

SEQ ID NO: 573538 - DNA, 20 bp, Artificial Sequence
  chemically synthesized
tttcattatttatattgtta

SEQ ID NO: 573539 - DNA, 20 bp, Artificial Sequence
  chemically synthesized
atctaggccattagttctga

SEQ ID NO: 573540 - DNA, 20 bp, Artificial Sequence
  chemically synthesized
aacagactcagaactaatgg

SEQ ID NO: 573541 - DNA, 20 bp, Artificial Sequence
  chemically synthesized
ctttaacctttcttaagtgt

SEQ ID NO: 573542 - DNA, 20 bp, Artificial Sequence
  chemically synthesized
ttttgactttaacctttctt

SEQ ID NO: 573543 - DNA, 20 bp, Artificial Sequence
  chemically synthesized
aagatcttgggaaaacaata

SEQ ID NO: 573544 - DNA, 20 bp, Artificial Sequence
  chemically synthesized
cttcatgcctacaaacttaa

SEQ ID NO: 573545 - DNA, 20 bp, Artificial Sequence
  chemically synthesized
tttgtaggcatgaagaaatt

SEQ ID NO: 573546 - DNA, 20 bp, Artificial Sequence
  chemically synthesized
atttagggcttttatttccc

SEQ ID NO: 573547 - DNA, 20 bp, Artificial Sequence
  chemically synthesized
gttaaaatataattactgat

SEQ ID NO: 573548 - DNA, 20 bp, Artificial Sequence
  chemically synthesized
atcagtaattatattttaac

SEQ ID NO: 573549 - DNA, 20 bp, Artificial Sequence
  chemically synthesized
atggtttcttctcagactca

SEQ ID NO: 573550 - DNA, 20 bp, Artificial Sequence
  chemically synthesized
aaaaatagcaattaactgct

SEQ ID NO: 573551 - DNA, 20 bp, Artificial Sequence
  chemically synthesized
gattgttttttataaaaaga

SEQ ID NO: 573552 - DNA, 20 bp, Artificial Sequence
  chemically synthesized
gagccaccgcacctggttga

SEQ ID NO: 573553 - DNA, 20 bp, Artificial Sequence
  chemically synthesized
gcgtgagccaccgcacctgg

SEQ ID NO: 573554 - DNA, 20 bp, Artificial Sequence
  chemically synthesized
cacctcagcctcccaaagtg

SEQ ID NO: 573555 - DNA, 20 bp, Artificial Sequence
  chemically synthesized
ttttctgtttttagtagaga

SEQ ID NO: 573556 - DNA, 20 bp, Artificial Sequence
  chemically synthesized
ccaccatgcccggctaattt

SEQ ID NO: 573557 - DNA, 20 bp, Artificial Sequence
  chemically synthesized
tgcctcagcctccagagtgg

SEQ ID NO: 573558 - DNA, 20 bp, Artificial Sequence
  chemically synthesized
tctggaggctgaggcaggag

SEQ ID NO: 573559 - DNA, 20 bp, Artificial Sequence
  chemically synthesized
gaggtggaggttgcagtgag

SEQ ID NO: 573560 - DNA, 20 bp, Artificial Sequence
  chemically synthesized
ttttgttcttgtttttgaga

SEQ ID NO: 573561 - DNA, 20 bp, Artificial Sequence
  chemically synthesized
gagaaactagagttttttgt

SEQ ID NO: 573562 - DNA, 20 bp, Artificial Sequence
  chemically synthesized
caaaaacaagaacaaaaaac

SEQ ID NO: 573563 - DNA, 20 bp, Artificial Sequence
  chemically synthesized
tcgatattgtaaagagaaac

SEQ ID NO: 573564 - DNA, 20 bp, Artificial Sequence
  chemically synthesized
aaaaagaaaaagttatcctt

SEQ ID NO: 573565 - DNA, 20 bp, Artificial Sequence
  chemically synthesized
taattcttcatcttttagga

SEQ ID NO: 573566 - DNA, 20 bp, Artificial Sequence
  chemically synthesized
ttttaggacatggctttcta

SEQ ID NO: 573567 - DNA, 20 bp, Artificial Sequence
  chemically synthesized
attataagaacattggagtt

SEQ ID NO: 573568 - DNA, 20 bp, Artificial Sequence
  chemically synthesized
ttaatatggccaagatataa

SEQ ID NO: 573569 - DNA, 20 bp, Artificial Sequence
  chemically synthesized
ggaagtattgaccacaaagg

SEQ ID NO: 573570 - DNA, 20 bp, Artificial Sequence
  chemically synthesized
tactgaccccttaccgggtg

SEQ ID NO: 573571 - DNA, 20 bp, Artificial Sequence
  chemically synthesized
gctcattttttagtcaggtg

SEQ ID NO: 573572 - DNA, 20 bp, Artificial Sequence
  chemically synthesized
tacttgctcattttttagtc

SEQ ID NO: 573573 - DNA, 20 bp, Artificial Sequence
  chemically synthesized
agaagatatagaaatgagta

SEQ ID NO: 573574 - DNA, 20 bp, Artificial Sequence
  chemically synthesized
ttatagacaggaaatagaat

SEQ ID NO: 573575 - DNA, 20 bp, Artificial Sequence
  chemically synthesized
aaaaaaccacagtaattccc

SEQ ID NO: 573576 - DNA, 20 bp, Artificial Sequence
  chemically synthesized
aggaagcaatggggaattac

SEQ ID NO: 573577 - DNA, 20 bp, Artificial Sequence
  chemically synthesized
ttgggaggctgaggcagcag

SEQ ID NO: 573578 - DNA, 20 bp, Artificial Sequence
  chemically synthesized
tgcctcagcctcccaagtag

SEQ ID NO: 573579 - DNA, 20 bp, Artificial Sequence
  chemically synthesized
ttttgtatttttagtagaga

SEQ ID NO: 573580 - DNA, 20 bp, Artificial Sequence
  chemically synthesized
tgccttggcctcccaaagtg

SEQ ID NO: 573581 - DNA, 20 bp, Artificial Sequence
  chemically synthesized
gtgtgagccaccatgcctgg

SEQ ID NO: 573582 - DNA, 20 bp, Artificial Sequence
  chemically synthesized
ggattatcgttgaatagaca

SEQ ID NO: 573583 - DNA, 20 bp, Artificial Sequence
  chemically synthesized
tcgttgaatagacatagagt

SEQ ID NO: 573584 - DNA, 20 bp, Artificial Sequence
  chemically synthesized
gtggtaaaatacaaattaca

SEQ ID NO: 573585 - DNA, 20 bp, Artificial Sequence
  chemically synthesized
cttttacaaattgtacttat

SEQ ID NO: 573586 - DNA, 20 bp, Artificial Sequence
  chemically synthesized
aggaaattaataaaatttgt

SEQ ID NO: 573587 - DNA, 20 bp, Artificial Sequence
  chemically synthesized
ttttattaatttccttggga

SEQ ID NO: 573588 - DNA, 20 bp, Artificial Sequence
  chemically synthesized
gagataactggcagttgcag

SEQ ID NO: 573589 - DNA, 20 bp, Artificial Sequence
  chemically synthesized
tttttttttttttttttttt

SEQ ID NO: 573590 - DNA, 20 bp, Artificial Sequence
  chemically synthesized
tttttttttttttttttttt

SEQ ID NO: 573591 - DNA, 20 bp, Artificial Sequence
  chemically synthesized
aaaaaaaaccacaaaatact

SEQ ID NO: 573592 - DNA, 20 bp, Artificial Sequence
  chemically synthesized
ttggaaagcttgaagtattt

SEQ ID NO: 573593 - DNA, 20 bp, Artificial Sequence
  chemically synthesized
ttgttttaattgtgtcattg

SEQ ID NO: 573594 - DNA, 20 bp, Artificial Sequence
  chemically synthesized
cactcatgaactatcttttt

SEQ ID NO: 573595 - DNA, 20 bp, Artificial Sequence
  chemically synthesized
caaataaaaagatagttcat

SEQ ID NO: 573596 - DNA, 20 bp, Artificial Sequence
  chemically synthesized
aatatacacaattaacacaa

SEQ ID NO: 573597 - DNA, 20 bp, Artificial Sequence
  chemically synthesized
aaataagtcatttaagcagg

SEQ ID NO: 573598 - DNA, 20 bp, Artificial Sequence
  chemically synthesized
ccttagcaacctaaagcatg

SEQ ID NO: 573599 - DNA, 20 bp, Artificial Sequence
  chemically synthesized
acagaaaatattggtatttt

SEQ ID NO: 573600 - DNA, 20 bp, Artificial Sequence
  chemically synthesized
ataggtttcattaactgcca

SEQ ID NO: 573601 - DNA, 20 bp, Artificial Sequence
  chemically synthesized
acttacttttaaggaagtta

SEQ ID NO: 573602 - DNA, 20 bp, Artificial Sequence
  chemically synthesized
tggttgatattttaatggtt

SEQ ID NO: 573603 - DNA, 20 bp, Artificial Sequence
  chemically synthesized
atcctcatggttgatatttt

SEQ ID NO: 573604 - DNA, 20 bp, Artificial Sequence
  chemically synthesized
cattaaaatatcaaccatga

SEQ ID NO: 573605 - DNA, 20 bp, Artificial Sequence
  chemically synthesized
cagaagttacttcagacaga

SEQ ID NO: 573606 - DNA, 20 bp, Artificial Sequence
  chemically synthesized
gttttactttttttttgaga

SEQ ID NO: 573607 - DNA, 20 bp, Artificial Sequence
  chemically synthesized
aacctccgcctcgtgggttc

SEQ ID NO: 573608 - DNA, 20 bp, Artificial Sequence
  chemically synthesized
ctcgtgggttcaagcgattc

SEQ ID NO: 573609 - DNA, 20 bp, Artificial Sequence
  chemically synthesized
ttgggaggttgaagcaggag

SEQ ID NO: 573610 - DNA, 20 bp, Artificial Sequence
  chemically synthesized
tgcttcaacctcccaagtag

SEQ ID NO: 573611 - DNA, 20 bp, Artificial Sequence
  chemically synthesized
ttttctatttttactagaga

SEQ ID NO: 573612 - DNA, 20 bp, Artificial Sequence
  chemically synthesized
cgcctcggcctcccaaagtg

SEQ ID NO: 573613 - DNA, 20 bp, Artificial Sequence
  chemically synthesized
caggcgtgagccactgcgcc

SEQ ID NO: 573614 - DNA, 20 bp, Artificial Sequence
  chemically synthesized
cgcctgaagttttacattta

SEQ ID NO: 573615 - DNA, 20 bp, Artificial Sequence
  chemically synthesized
gttttacatttaacaagttt

SEQ ID NO: 573616 - DNA, 20 bp, Artificial Sequence
  chemically synthesized
cacatgtggctcagaccaag

SEQ ID NO: 573617 - DNA, 20 bp, Artificial Sequence
  chemically synthesized
tgagaatcactgccttagac

SEQ ID NO: 573618 - DNA, 20 bp, Artificial Sequence
  chemically synthesized
ctcaaaacatcagtctaagg

SEQ ID NO: 573619 - DNA, 20 bp, Artificial Sequence
  chemically synthesized
gtgcatctcattgtcatgtg

SEQ ID NO: 573620 - DNA, 20 bp, Artificial Sequence
  chemically synthesized
agagactgctgagtcccact

SEQ ID NO: 573621 - DNA, 20 bp, Artificial Sequence
  chemically synthesized
tgctgagtcccacttagtgc

SEQ ID NO: 573622 - DNA, 20 bp, Artificial Sequence
  chemically synthesized
tgttgagttcctagaactca

SEQ ID NO: 573623 - DNA, 20 bp, Artificial Sequence
  chemically synthesized
taaaaataaataaagaaata

SEQ ID NO: 573624 - DNA, 20 bp, Artificial Sequence
  chemically synthesized
caggaggatcgcttgagccc

SEQ ID NO: 573625 - DNA, 20 bp, Artificial Sequence
  chemically synthesized
ctcctgggctcaagcgatcc

SEQ ID NO: 573626 - DNA, 20 bp, Artificial Sequence
  chemically synthesized
ttgggaggctgaagcaggag

SEQ ID NO: 573627 - DNA, 20 bp, Artificial Sequence
  chemically synthesized
tatatatcaatgccagtggt

SEQ ID NO: 573628 - DNA, 20 bp, Artificial Sequence
  chemically synthesized
tgatatatatatatttttaa

SEQ ID NO: 573629 - DNA, 20 bp, Artificial Sequence
  chemically synthesized
ttttgcgagatgggatctct

SEQ ID NO: 573630 - DNA, 20 bp, Artificial Sequence
  chemically synthesized
tgggaggatcacttgagccc

SEQ ID NO: 573631 - DNA, 20 bp, Artificial Sequence
  chemically synthesized
cacttcggcctcccaaagtg

SEQ ID NO: 573632 - DNA, 20 bp, Artificial Sequence
  chemically synthesized
cttgggccaggcacggtggc

SEQ ID NO: 573633 - DNA, 20 bp, Artificial Sequence
  chemically synthesized
catgagccaccgtgcctggc

SEQ ID NO: 573634 - DNA, 20 bp, Artificial Sequence
  chemically synthesized
ctgaaggttctaagtcaaga

SEQ ID NO: 573635 - DNA, 20 bp, Artificial Sequence
  chemically synthesized
accttcagatacactgttcc

SEQ ID NO: 573636 - DNA, 20 bp, Artificial Sequence
  chemically synthesized
gatacactgttccctctgct

SEQ ID NO: 573637 - DNA, 20 bp, Artificial Sequence
  chemically synthesized
ttattaaggcaatcctacat

SEQ ID NO: 573638 - DNA, 20 bp, Artificial Sequence
  chemically synthesized
tactggtgaaaaacaataat

SEQ ID NO: 573639 - DNA, 20 bp, Artificial Sequence
  chemically synthesized
attgagggattatcatgtac

SEQ ID NO: 573640 - DNA, 20 bp, Artificial Sequence
  chemically synthesized
ttctttaataaaaatgtatt

SEQ ID NO: 573641 - DNA, 20 bp, Artificial Sequence
  chemically synthesized
cagaagtgcctaattctctt

SEQ ID NO: 573642 - DNA, 20 bp, Artificial Sequence
  chemically synthesized
cagaccaatagctattgtca

SEQ ID NO: 573643 - DNA, 20 bp, Artificial Sequence
  chemically synthesized
tattgtcagactgcttcgta

SEQ ID NO: 573644 - DNA, 20 bp, Artificial Sequence
  chemically synthesized
tatgtcaggtttctgtgaga

SEQ ID NO: 573645 - DNA, 20 bp, Artificial Sequence
  chemically synthesized
tcttatttaggaactctatg

SEQ ID NO: 573646 - DNA, 20 bp, Artificial Sequence
  chemically synthesized
gatatgggataaggaaaatg

SEQ ID NO: 573647 - DNA, 20 bp, Artificial Sequence
  chemically synthesized
ctgaattatttatatctatc

SEQ ID NO: 573648 - DNA, 20 bp, Artificial Sequence
  chemically synthesized
attcttgcccaaagaatgag

SEQ ID NO: 573649 - DNA, 20 bp, Artificial Sequence
  chemically synthesized
tttgggcaagaatataacat

SEQ ID NO: 573650 - DNA, 20 bp, Artificial Sequence
  chemically synthesized
tttcagtttttggtctctac

SEQ ID NO: 573651 - DNA, 20 bp, Artificial Sequence
  chemically synthesized
gcctattcaaggaaaatata

SEQ ID NO: 573652 - DNA, 20 bp, Artificial Sequence
  chemically synthesized
ttttcatatgtaaatatttt

SEQ ID NO: 573653 - DNA, 20 bp, Artificial Sequence
  chemically synthesized
agagcccaggctggatttca

SEQ ID NO: 573654 - DNA, 20 bp, Artificial Sequence
  chemically synthesized
aatttggtagtagagcccag

SEQ ID NO: 573655 - DNA, 20 bp, Artificial Sequence
  chemically synthesized
gggctctactaccaaattgg

SEQ ID NO: 573656 - DNA, 20 bp, Artificial Sequence
  chemically synthesized
gggcaaagaagaaaaaggca

SEQ ID NO: 573657 - DNA, 20 bp, Artificial Sequence
  chemically synthesized
tttgcccaaagaggcccttg

SEQ ID NO: 573658 - DNA, 20 bp, Artificial Sequence
  chemically synthesized
caaagaggcccttgcaggga

SEQ ID NO: 573659 - DNA, 20 bp, Artificial Sequence
  chemically synthesized
tgggattatagatgctgggg

SEQ ID NO: 573660 - DNA, 20 bp, Artificial Sequence
  chemically synthesized
tctccctgcctccctaattt

SEQ ID NO: 573661 - DNA, 20 bp, Artificial Sequence
  chemically synthesized
ggctgttacaaagatggatg

SEQ ID NO: 573662 - DNA, 20 bp, Artificial Sequence
  chemically synthesized
tcatggatgaacttattacc

SEQ ID NO: 573663 - DNA, 20 bp, Artificial Sequence
  chemically synthesized
ccgggtagctacctttttgg

SEQ ID NO: 573664 - DNA, 20 bp, Artificial Sequence
  chemically synthesized
ttccaatgtctagttcgagg

SEQ ID NO: 573665 - DNA, 20 bp, Artificial Sequence
  chemically synthesized
ccacactatgcttcctcttt

SEQ ID NO: 573666 - DNA, 20 bp, Artificial Sequence
  chemically synthesized
acatatctttcttccccaca

SEQ ID NO: 573667 - DNA, 20 bp, Artificial Sequence
  chemically synthesized
gaacaaagggtaagaggtag

SEQ ID NO: 573668 - DNA, 20 bp, Artificial Sequence
  chemically synthesized
attttaagttattaaaggct

SEQ ID NO: 573669 - DNA, 20 bp, Artificial Sequence
  chemically synthesized
agctgtaaaagatgaatcat

SEQ ID NO: 573670 - DNA, 20 bp, Artificial Sequence
  chemically synthesized
atcttgatcccagaaaacac

SEQ ID NO: 573671 - DNA, 20 bp, Artificial Sequence
  chemically synthesized
atcatgggtgttttctggga

SEQ ID NO: 573672 - DNA, 20 bp, Artificial Sequence
  chemically synthesized
agttgccgagaaaatgccat

SEQ ID NO: 573673 - DNA, 20 bp, Artificial Sequence
  chemically synthesized
atggcattttctcggcaact

SEQ ID NO: 573674 - DNA, 20 bp, Artificial Sequence
  chemically synthesized
gtatctagtggatataaagt

SEQ ID NO: 573675 - DNA, 20 bp, Artificial Sequence
  chemically synthesized
attaaattgtgtacctctgc

SEQ ID NO: 573676 - DNA, 20 bp, Artificial Sequence
  chemically synthesized
tatgactcaacttctcataa

SEQ ID NO: 573677 - DNA, 20 bp, Artificial Sequence
  chemically synthesized
attatgagaagttgagtcat

SEQ ID NO: 573678 - DNA, 20 bp, Artificial Sequence
  chemically synthesized
cttctagtgttcccctctgt

SEQ ID NO: 573679 - DNA, 20 bp, Artificial Sequence
  chemically synthesized
cacaagttatactgatctac

SEQ ID NO: 573680 - DNA, 20 bp, Artificial Sequence
  chemically synthesized
tggaaaggagaagagacaca

SEQ ID NO: 573681 - DNA, 20 bp, Artificial Sequence
  chemically synthesized
aataatttgctccatttgcc

SEQ ID NO: 573682 - DNA, 20 bp, Artificial Sequence
  chemically synthesized
ctaaaagatagcattttgcc

SEQ ID NO: 573683 - DNA, 20 bp, Artificial Sequence
  chemically synthesized
tgccctatgcttttgcacaa

SEQ ID NO: 573684 - DNA, 20 bp, Artificial Sequence
  chemically synthesized
gcatataataggtacccaat

SEQ ID NO: 573685 - DNA, 20 bp, Artificial Sequence
  chemically synthesized
agaccaagtctctgtaatca

SEQ ID NO: 573686 - DNA, 20 bp, Artificial Sequence
  chemically synthesized
atatccattagccttaagct

SEQ ID NO: 573687 - DNA, 20 bp, Artificial Sequence
  chemically synthesized
taaatgatgactattaataa

SEQ ID NO: 573688 - DNA, 20 bp, Artificial Sequence
  chemically synthesized
atgatatattttggcttgga

SEQ ID NO: 573689 - DNA, 20 bp, Artificial Sequence
  chemically synthesized
attttatagccatgatatat

SEQ ID NO: 573690 - DNA, 20 bp, Artificial Sequence
  chemically synthesized
tattgcagatagcagtctca

SEQ ID NO: 573691 - DNA, 20 bp, Artificial Sequence
  chemically synthesized
agatagcagtctcaaagaga

SEQ ID NO: 573692 - DNA, 20 bp, Artificial Sequence
  chemically synthesized
agacatgcagaggtagctta

SEQ ID NO: 573693 - DNA, 20 bp, Artificial Sequence
  chemically synthesized
tcattattcagacatgcaga

SEQ ID NO: 573694 - DNA, 20 bp, Artificial Sequence
  chemically synthesized
gctacctctgcatgtctgaa

SEQ ID NO: 573695 - DNA, 20 bp, Artificial Sequence
  chemically synthesized
ttgcacgggtaactcacaat

SEQ ID NO: 573696 - DNA, 20 bp, Artificial Sequence
  chemically synthesized
tacccgtgcaatatgctgta

SEQ ID NO: 573697 - DNA, 20 bp, Artificial Sequence
  chemically synthesized
cgtgcaatatgctgtacctg

SEQ ID NO: 573698 - DNA, 20 bp, Artificial Sequence
  chemically synthesized
ctttatatggagcacattta

SEQ ID NO: 573699 - DNA, 20 bp, Artificial Sequence
  chemically synthesized
ggcactcactactgaaacaa

SEQ ID NO: 573700 - DNA, 20 bp, Artificial Sequence
  chemically synthesized
atcaaatcagtaaaaatcca

SEQ ID NO: 573701 - DNA, 20 bp, Artificial Sequence
  chemically synthesized
actgaaacaaaatggatttt

SEQ ID NO: 573702 - DNA, 20 bp, Artificial Sequence
  chemically synthesized
aacaaaatggatttttactg

SEQ ID NO: 573703 - DNA, 20 bp, Artificial Sequence
  chemically synthesized
atactaaggcagaaatgaac

SEQ ID NO: 573704 - DNA, 20 bp, Artificial Sequence
  chemically synthesized
aatacacagaagagggctaa

SEQ ID NO: 573705 - DNA, 20 bp, Artificial Sequence
  chemically synthesized
aagtaaaattggatattaaa

SEQ ID NO: 573706 - DNA, 20 bp, Artificial Sequence
  chemically synthesized
ctttaatatccaattttact

SEQ ID NO: 573707 - DNA, 20 bp, Artificial Sequence
  chemically synthesized
ttgtagttcctaaatgtaat

SEQ ID NO: 573708 - DNA, 20 bp, Artificial Sequence
  chemically synthesized
ttgaacatcctgctttttta

SEQ ID NO: 573709 - DNA, 20 bp, Artificial Sequence
  chemically synthesized
tgactttaagtagttgaaca

SEQ ID NO: 573710 - DNA, 20 bp, Artificial Sequence
  chemically synthesized
gaaaattcgttttctgttcc

SEQ ID NO: 573711 - DNA, 20 bp, Artificial Sequence
  chemically synthesized
catagattttaatgaagaaa

SEQ ID NO: 573712 - DNA, 20 bp, Artificial Sequence
  chemically synthesized
gatgaaccattatgatgttg

SEQ ID NO: 573713 - DNA, 20 bp, Artificial Sequence
  chemically synthesized
atacatgaggttgtgaaaag

SEQ ID NO: 573714 - DNA, 20 bp, Artificial Sequence
  chemically synthesized
aaagtctagcttcttgagtc

SEQ ID NO: 573715 - DNA, 20 bp, Artificial Sequence
  chemically synthesized
cttcttgagtcaagagttta

SEQ ID NO: 573716 - DNA, 20 bp, Artificial Sequence
  chemically synthesized
ttgatattttcaagatatta

SEQ ID NO: 573717 - DNA, 20 bp, Artificial Sequence
  chemically synthesized
acatctgagaacgttgttta

SEQ ID NO: 573718 - DNA, 20 bp, Artificial Sequence
  chemically synthesized
tgtctaaacaacgttctcag

SEQ ID NO: 573719 - DNA, 20 bp, Artificial Sequence
  chemically synthesized
ttggaaatcacatctgagaa

SEQ ID NO: 573720 - DNA, 20 bp, Artificial Sequence
  chemically synthesized
aaagggtagatttggccaat

SEQ ID NO: 573721 - DNA, 20 bp, Artificial Sequence
  chemically synthesized
atcaatcactttttctaaag

SEQ ID NO: 573722 - DNA, 20 bp, Artificial Sequence
  chemically synthesized
ccaaatctaccctttagaaa

SEQ ID NO: 573723 - DNA, 20 bp, Artificial Sequence
  chemically synthesized
ttttctttttcaaaatagga

SEQ ID NO: 573724 - DNA, 20 bp, Artificial Sequence
  chemically synthesized
aatcaatgcagcatcacccc

SEQ ID NO: 573725 - DNA, 20 bp, Artificial Sequence
  chemically synthesized
aatctgtgggggtgatgctg

SEQ ID NO: 573726 - DNA, 20 bp, Artificial Sequence
  chemically synthesized
agtgaaaagattattttaaa

SEQ ID NO: 573727 - DNA, 20 bp, Artificial Sequence
  chemically synthesized
aaattactgaattattagtg

SEQ ID NO: 573728 - DNA, 20 bp, Artificial Sequence
  chemically synthesized
ttcactaataattcagtaat

SEQ ID NO: 573729 - DNA, 20 bp, Artificial Sequence
  chemically synthesized
taattttagattcaaagtgg

SEQ ID NO: 573730 - DNA, 20 bp, Artificial Sequence
  chemically synthesized
taaaactgcctagggtttgg

SEQ ID NO: 573731 - DNA, 20 bp, Artificial Sequence
  chemically synthesized
acaatcaaccccaaacccta

SEQ ID NO: 573732 - DNA, 20 bp, Artificial Sequence
  chemically synthesized
gtttctcctataaaactgcc

SEQ ID NO: 573733 - DNA, 20 bp, Artificial Sequence
  chemically synthesized
ttgaaggaagacatttgcaa

SEQ ID NO: 573734 - DNA, 20 bp, Artificial Sequence
  chemically synthesized
aaatgagcataaattactcc

SEQ ID NO: 573735 - DNA, 20 bp, Artificial Sequence
  chemically synthesized
caacggagtaatttatgctc

SEQ ID NO: 573736 - DNA, 20 bp, Artificial Sequence
  chemically synthesized
agcctgtatttcttttaacc

SEQ ID NO: 573737 - DNA, 20 bp, Artificial Sequence
  chemically synthesized
ctgatattggataacctttg

SEQ ID NO: 573738 - DNA, 20 bp, Artificial Sequence
  chemically synthesized
tttgtggagattctagtata

SEQ ID NO: 573739 - DNA, 20 bp, Artificial Sequence
  chemically synthesized
aagcaagggagagaatggtc

SEQ ID NO: 573740 - DNA, 20 bp, Artificial Sequence
  chemically synthesized
aaacaatggaccattctctc

SEQ ID NO: 573741 - DNA, 20 bp, Artificial Sequence
  chemically synthesized
ccagttggtttttggtcttc

SEQ ID NO: 573742 - DNA, 20 bp, Artificial Sequence
  chemically synthesized
gcttcaccttctgcttgcca

SEQ ID NO: 573743 - DNA, 20 bp, Artificial Sequence
  chemically synthesized
ggcattttacctgcttcacc

SEQ ID NO: 573744 - DNA, 20 bp, Artificial Sequence
  chemically synthesized
actgtatgcaacggcatttt

SEQ ID NO: 573745 - DNA, 20 bp, Artificial Sequence
  chemically synthesized
gtaaaatgccgttgcataca

SEQ ID NO: 573746 - DNA, 20 bp, Artificial Sequence
  chemically synthesized
aatgccgttgcatacagtct

SEQ ID NO: 573747 - DNA, 20 bp, Artificial Sequence
  chemically synthesized
ccatttaactgacctgtgat

SEQ ID NO: 573748 - DNA, 20 bp, Artificial Sequence
  chemically synthesized
ataatacccatttaactgac

SEQ ID NO: 573749 - DNA, 20 bp, Artificial Sequence
  chemically synthesized
gtattatttaataagaccta

SEQ ID NO: 573750 - DNA, 20 bp, Artificial Sequence
  chemically synthesized
atagatctcaaaatgggtta

SEQ ID NO: 573751 - DNA, 20 bp, Artificial Sequence
  chemically synthesized
taaatgaaaggaaactcagc

SEQ ID NO: 573752 - DNA, 20 bp, Artificial Sequence
  chemically synthesized
gaaccaatgataaactactg

SEQ ID NO: 573753 - DNA, 20 bp, Artificial Sequence
  chemically synthesized
gagtctttggcaatacattg

SEQ ID NO: 573754 - DNA, 20 bp, Artificial Sequence
  chemically synthesized
tgccaaagactctcattcac

SEQ ID NO: 573755 - DNA, 20 bp, Artificial Sequence
  chemically synthesized
tgacttcactctgttcacta

SEQ ID NO: 573756 - DNA, 20 bp, Artificial Sequence
  chemically synthesized
atttttagaagtttggtttt

SEQ ID NO: 573757 - DNA, 20 bp, Artificial Sequence
  chemically synthesized
aacacacttatttttagaag

SEQ ID NO: 573758 - DNA, 20 bp, Artificial Sequence
  chemically synthesized
ttcgaaacacacttattttt

SEQ ID NO: 573759 - DNA, 20 bp, Artificial Sequence
  chemically synthesized
aaccaaacttctaaaaataa

SEQ ID NO: 573760 - DNA, 20 bp, Artificial Sequence
  chemically synthesized
taaagttaagaacctgccag

SEQ ID NO: 573761 - DNA, 20 bp, Artificial Sequence
  chemically synthesized
atttctattttcttttaagg

SEQ ID NO: 573762 - DNA, 20 bp, Artificial Sequence
  chemically synthesized
gctggaggatctaacactaa

SEQ ID NO: 573763 - DNA, 20 bp, Artificial Sequence
  chemically synthesized
tcattctggttaagagaatt

SEQ ID NO: 573764 - DNA, 20 bp, Artificial Sequence
  chemically synthesized
tgtggaaacttaataaatat

SEQ ID NO: 573765 - DNA, 20 bp, Artificial Sequence
  chemically synthesized
tttgtaaacctcaatattta

SEQ ID NO: 573766 - DNA, 20 bp, Artificial Sequence
  chemically synthesized
ccacatatcattgttatgct

SEQ ID NO: 573767 - DNA, 20 bp, Artificial Sequence
  chemically synthesized
aattggtccacatatcattg

SEQ ID NO: 573768 - DNA, 20 bp, Artificial Sequence
  chemically synthesized
aattaggcagagtaagggca

SEQ ID NO: 573769 - DNA, 20 bp, Artificial Sequence
  chemically synthesized
aactcaattatttaatgtac

SEQ ID NO: 573770 - DNA, 20 bp, Artificial Sequence
  chemically synthesized
ttaatgtacacttgatttga

SEQ ID NO: 573771 - DNA, 20 bp, Artificial Sequence
  chemically synthesized
tttccattgaacattaatca

SEQ ID NO: 573772 - DNA, 20 bp, Artificial Sequence
  chemically synthesized
gaaattttacattagaagca

SEQ ID NO: 573773 - DNA, 20 bp, Artificial Sequence
  chemically synthesized
ttttctcatccttctcctct

SEQ ID NO: 573774 - DNA, 20 bp, Artificial Sequence
  chemically synthesized
cccagattctaggataaggg

SEQ ID NO: 573775 - DNA, 20 bp, Artificial Sequence
  chemically synthesized
ttctaggataagggaaaagt

SEQ ID NO: 573776 - DNA, 20 bp, Artificial Sequence
  chemically synthesized
aaaagtttaagtttcatgtc

SEQ ID NO: 573777 - DNA, 20 bp, Artificial Sequence
  chemically synthesized
atggaaacagatgtcttaaa

SEQ ID NO: 573778 - DNA, 20 bp, Artificial Sequence
  chemically synthesized
ttaaaagcaaattttaagac

SEQ ID NO: 573779 - DNA, 20 bp, Artificial Sequence
  chemically synthesized
attttaagacatctgtttcc

SEQ ID NO: 573780 - DNA, 20 bp, Artificial Sequence
  chemically synthesized
tttttcacagatatttaata

SEQ ID NO: 573781 - DNA, 20 bp, Artificial Sequence
  chemically synthesized
tagctgaagtggttgaggaa

SEQ ID NO: 573782 - DNA, 20 bp, Artificial Sequence
  chemically synthesized
cttgctagatatgaatagct

SEQ ID NO: 573783 - DNA, 20 bp, Artificial Sequence
  chemically synthesized
ttagctattcatatctagca

SEQ ID NO: 573784 - DNA, 20 bp, Artificial Sequence
  chemically synthesized
atcccaactatttttaatat

SEQ ID NO: 573785 - DNA, 20 bp, Artificial Sequence
  chemically synthesized
gatgataaaatagtacttta

SEQ ID NO: 573786 - DNA, 20 bp, Artificial Sequence
  chemically synthesized
aaagtactattttatcatca

SEQ ID NO: 573787 - DNA, 20 bp, Artificial Sequence
  chemically synthesized
taaggagaatttttaaatgt

SEQ ID NO: 573788 - DNA, 20 bp, Artificial Sequence
  chemically synthesized
gttatgtgactaaatatata

SEQ ID NO: 573789 - DNA, 20 bp, Artificial Sequence
  chemically synthesized
atatatagtttgagacaagg

SEQ ID NO: 573790 - DNA, 20 bp, Artificial Sequence
  chemically synthesized
ccgaaaggctggggcaggag

SEQ ID NO: 573791 - DNA, 20 bp, Artificial Sequence
  chemically synthesized
ttttgtattttttgtccaaa

SEQ ID NO: 573792 - DNA, 20 bp, Artificial Sequence
  chemically synthesized
gcctggacaacatagtgaaa

SEQ ID NO: 573793 - DNA, 20 bp, Artificial Sequence
  chemically synthesized
tgggtgggttgcatgagctc

SEQ ID NO: 573794 - DNA, 20 bp, Artificial Sequence
  chemically synthesized
cacctcggcctcccaaagtg

SEQ ID NO: 573795 - DNA, 20 bp, Artificial Sequence
  chemically synthesized
tgacactggtacaattttgg

SEQ ID NO: 573796 - DNA, 20 bp, Artificial Sequence
  chemically synthesized
cacttgtggaagactttgac

SEQ ID NO: 573797 - DNA, 20 bp, Artificial Sequence
  chemically synthesized
accgtcaaagtcttccacaa

SEQ ID NO: 573798 - DNA, 20 bp, Artificial Sequence
  chemically synthesized
taggaaccttgaaatgaata

SEQ ID NO: 573799 - DNA, 20 bp, Artificial Sequence
  chemically synthesized
gagcatcatagggagcattg

SEQ ID NO: 573800 - DNA, 20 bp, Artificial Sequence
  chemically synthesized
tatgggagcatcatagggag

SEQ ID NO: 573801 - DNA, 20 bp, Artificial Sequence
  chemically synthesized
agcctcttgttggattgatt

SEQ ID NO: 573802 - DNA, 20 bp, Artificial Sequence
  chemically synthesized
aggcacacagcctcttgttg

SEQ ID NO: 573803 - DNA, 20 bp, Artificial Sequence
  chemically synthesized
atgcaggcacacagcctctt

SEQ ID NO: 573804 - DNA, 20 bp, Artificial Sequence
  chemically synthesized
atttatcaatatccagaaga

SEQ ID NO: 573805 - DNA, 20 bp, Artificial Sequence
  chemically synthesized
ttttatatttatcaatatcc

SEQ ID NO: 573806 - DNA, 20 bp, Artificial Sequence
  chemically synthesized
agacatattttgtgtagtgt

SEQ ID NO: 573807 - DNA, 20 bp, Artificial Sequence
  chemically synthesized
atgtcttcaggtacatacac

SEQ ID NO: 573808 - DNA, 20 bp, Artificial Sequence
  chemically synthesized
gtgaaccccttccccagagt

SEQ ID NO: 573809 - DNA, 20 bp, Artificial Sequence
  chemically synthesized
tggggaaggggttcaccaac

SEQ ID NO: 573810 - DNA, 20 bp, Artificial Sequence
  chemically synthesized
tgagtttctacaagccctcc

SEQ ID NO: 573811 - DNA, 20 bp, Artificial Sequence
  chemically synthesized
gcatacatcagaatcacctg

SEQ ID NO: 573812 - DNA, 20 bp, Artificial Sequence
  chemically synthesized
tgtctgaatgcctagacatt

SEQ ID NO: 573813 - DNA, 20 bp, Artificial Sequence
  chemically synthesized
aaaatggcctcataagtgag

SEQ ID NO: 573814 - DNA, 20 bp, Artificial Sequence
  chemically synthesized
gtaagaaaatggcctcataa

SEQ ID NO: 573815 - DNA, 20 bp, Artificial Sequence
  chemically synthesized
ctaccctccaccctaccatg

SEQ ID NO: 573816 - DNA, 20 bp, Artificial Sequence
  chemically synthesized
tcatggtagggtggagggta

SEQ ID NO: 573817 - DNA, 20 bp, Artificial Sequence
  chemically synthesized
ttctttataaataatgagaa

SEQ ID NO: 573818 - DNA, 20 bp, Artificial Sequence
  chemically synthesized
cttggctttttttaatgctg

SEQ ID NO: 573819 - DNA, 20 bp, Artificial Sequence
  chemically synthesized
ttcaacttggctttttttaa

SEQ ID NO: 573820 - DNA, 20 bp, Artificial Sequence
  chemically synthesized
cactcactcttcatattcaa

SEQ ID NO: 573821 - DNA, 20 bp, Artificial Sequence
  chemically synthesized
caagttgaatatgaagagtg

SEQ ID NO: 573822 - DNA, 20 bp, Artificial Sequence
  chemically synthesized
tatgaagagtgagtggatta

SEQ ID NO: 573823 - DNA, 20 bp, Artificial Sequence
  chemically synthesized
ctgccttctccacatgtgac

SEQ ID NO: 573824 - DNA, 20 bp, Artificial Sequence
  chemically synthesized
ggagtatttacaccacgaaa

SEQ ID NO: 573825 - DNA, 20 bp, Artificial Sequence
  chemically synthesized
gaatcctggtgtgtatcaaa

SEQ ID NO: 573826 - DNA, 20 bp, Artificial Sequence
  chemically synthesized
aaaactggttttgatacaca

SEQ ID NO: 573827 - DNA, 20 bp, Artificial Sequence
  chemically synthesized
gcacaactccggctcggtgt

SEQ ID NO: 573828 - DNA, 20 bp, Artificial Sequence
  chemically synthesized
cacctcagcctcccaaagtg

SEQ ID NO: 573829 - DNA, 20 bp, Artificial Sequence
  chemically synthesized
ttttgtgtttttagtagaga

SEQ ID NO: 573830 - DNA, 20 bp, Artificial Sequence
  chemically synthesized
ccgccacgcctggctaattt

SEQ ID NO: 573831 - DNA, 20 bp, Artificial Sequence
  chemically synthesized
tgcctcagcctcctgagtag

SEQ ID NO: 573832 - DNA, 20 bp, Artificial Sequence
  chemically synthesized
aacctccgcctcccaggttc

SEQ ID NO: 573833 - DNA, 20 bp, Artificial Sequence
  chemically synthesized
gaggcggaggttgcagtgag

SEQ ID NO: 573834 - DNA, 20 bp, Artificial Sequence
  chemically synthesized
tttattttatttttttgaga

SEQ ID NO: 573835 - DNA, 20 bp, Artificial Sequence
  chemically synthesized
taaagagtacaactccacag

SEQ ID NO: 573836 - DNA, 20 bp, Artificial Sequence
  chemically synthesized
ccacagcgaggtttctgctc

SEQ ID NO: 573837 - DNA, 20 bp, Artificial Sequence
  chemically synthesized
tctctggatcagacacaatg

SEQ ID NO: 573838 - DNA, 20 bp, Artificial Sequence
  chemically synthesized
ctgggctctttcttctcctg

SEQ ID NO: 573839 - DNA, 20 bp, Artificial Sequence
  chemically synthesized
attgtttccctaactccaat

SEQ ID NO: 573840 - DNA, 20 bp, Artificial Sequence
  chemically synthesized
gagaacaggggtctaggtgc

SEQ ID NO: 573841 - DNA, 20 bp, Artificial Sequence
  chemically synthesized
ttagttaagtgactatgcac

SEQ ID NO: 573842 - DNA, 20 bp, Artificial Sequence
  chemically synthesized
aattttgaacatgtattatt

SEQ ID NO: 573843 - DNA, 20 bp, Artificial Sequence
  chemically synthesized
aatttatcttttgcaggttc

SEQ ID NO: 573844 - DNA, 20 bp, Artificial Sequence
  chemically synthesized
taaaggattgcccagttttt

SEQ ID NO: 573845 - DNA, 20 bp, Artificial Sequence
  chemically synthesized
aatcacagtataaaggattg

SEQ ID NO: 573846 - DNA, 20 bp, Artificial Sequence
  chemically synthesized
aaactgggcaatcctttata

SEQ ID NO: 573847 - DNA, 20 bp, Artificial Sequence
  chemically synthesized
taagttgagaatcacagtat

SEQ ID NO: 573848 - DNA, 20 bp, Artificial Sequence
  chemically synthesized
tttatactgtgattctcaac

SEQ ID NO: 573849 - DNA, 20 bp, Artificial Sequence
  chemically synthesized
tgtccataggtgaatgtgct

SEQ ID NO: 573850 - DNA, 20 bp, Artificial Sequence
  chemically synthesized
ttcatcatgttttaatatga

SEQ ID NO: 573851 - DNA, 20 bp, Artificial Sequence
  chemically synthesized
tattttccataatggattca

SEQ ID NO: 573852 - DNA, 20 bp, Artificial Sequence
  chemically synthesized
aattttatggtattttccat

SEQ ID NO: 573853 - DNA, 20 bp, Artificial Sequence
  chemically synthesized
gaaaataccataaaattgat

SEQ ID NO: 573854 - DNA, 20 bp, Artificial Sequence
  chemically synthesized
gcatgaaatttctttgatgt

SEQ ID NO: 573855 - DNA, 20 bp, Artificial Sequence
  chemically synthesized
agaagacatagcctgacatc

SEQ ID NO: 573856 - DNA, 20 bp, Artificial Sequence
  chemically synthesized
tgttaagataactgaagtaa

SEQ ID NO: 573857 - DNA, 20 bp, Artificial Sequence
  chemically synthesized
ttaaaagcatcttccgagag

SEQ ID NO: 573858 - DNA, 20 bp, Artificial Sequence
  chemically synthesized
taagaatcactgctctcgga

SEQ ID NO: 573859 - DNA, 20 bp, Artificial Sequence
  chemically synthesized
agttatagtttacacttact

SEQ ID NO: 573860 - DNA, 20 bp, Artificial Sequence
  chemically synthesized
gttaaaataatatttttagt

SEQ ID NO: 573861 - DNA, 20 bp, Artificial Sequence
  chemically synthesized
taagaaagaactttttcata

SEQ ID NO: 573862 - DNA, 20 bp, Artificial Sequence
  chemically synthesized
tgttcccataatacccagaa

SEQ ID NO: 573863 - DNA, 20 bp, Artificial Sequence
  chemically synthesized
tgaataatttttcttggtaa

SEQ ID NO: 573864 - DNA, 20 bp, Artificial Sequence
  chemically synthesized
aaggagttcgcttcttcctg

SEQ ID NO: 573865 - DNA, 20 bp, Artificial Sequence
  chemically synthesized
aagatcaaataacccaagga

SEQ ID NO: 573866 - DNA, 20 bp, Artificial Sequence
  chemically synthesized
ttatttgatcttaaagcatt

SEQ ID NO: 573867 - DNA, 20 bp, Artificial Sequence
  chemically synthesized
ctaccgttcagtaaaacagg

SEQ ID NO: 573868 - DNA, 20 bp, Artificial Sequence
  chemically synthesized
attaaaaatatatattggct

SEQ ID NO: 573869 - DNA, 20 bp, Artificial Sequence
  chemically synthesized
ataaataactcacattttag

SEQ ID NO: 573870 - DNA, 20 bp, Artificial Sequence
  chemically synthesized
ctgagggagcaagaatttgt

SEQ ID NO: 573871 - DNA, 20 bp, Artificial Sequence
  chemically synthesized
ctaatacaaattcttgctcc

SEQ ID NO: 573872 - DNA, 20 bp, Artificial Sequence
  chemically synthesized
gagagttgtatagatggcat

SEQ ID NO: 573873 - DNA, 20 bp, Artificial Sequence
  chemically synthesized
tatacaactctcaatataat

SEQ ID NO: 573874 - DNA, 20 bp, Artificial Sequence
  chemically synthesized
gagatcagacttctctgggt

SEQ ID NO: 573875 - DNA, 20 bp, Artificial Sequence
  chemically synthesized
cactcattcattaattcatg

SEQ ID NO: 573876 - DNA, 20 bp, Artificial Sequence
  chemically synthesized
taatactgagagtatattac

SEQ ID NO: 573877 - DNA, 20 bp, Artificial Sequence
  chemically synthesized
cctcaagagtctcgggtaat

SEQ ID NO: 573878 - DNA, 20 bp, Artificial Sequence
  chemically synthesized
tagttattacccaccacaaa

SEQ ID NO: 573879 - DNA, 20 bp, Artificial Sequence
  chemically synthesized
ttgctaggattttctgaaag

SEQ ID NO: 573880 - DNA, 20 bp, Artificial Sequence
  chemically synthesized
cctgtttgctaggattttct

SEQ ID NO: 573881 - DNA, 20 bp, Artificial Sequence
  chemically synthesized
ctttcagaaaatcctagcaa

SEQ ID NO: 573882 - DNA, 20 bp, Artificial Sequence
  chemically synthesized
taatatgccaatcctgtttg

SEQ ID NO: 573883 - DNA, 20 bp, Artificial Sequence
  chemically synthesized
ctgatcctataatatgccaa

SEQ ID NO: 573884 - DNA, 20 bp, Artificial Sequence
  chemically synthesized
ataggatcagatgttgatat

SEQ ID NO: 573885 - DNA, 20 bp, Artificial Sequence
  chemically synthesized
tatttggagaaatttttatt

SEQ ID NO: 573886 - DNA, 20 bp, Artificial Sequence
  chemically synthesized
ttcatctgattctactcaag

SEQ ID NO: 573887 - DNA, 20 bp, Artificial Sequence
  chemically synthesized
aatgttcagctaatgagttc

SEQ ID NO: 573888 - DNA, 20 bp, Artificial Sequence
  chemically synthesized
atgaactcattagctgaaca

SEQ ID NO: 573889 - DNA, 20 bp, Artificial Sequence
  chemically synthesized
ccagaagagtagctgtacaa

SEQ ID NO: 573890 - DNA, 20 bp, Artificial Sequence
  chemically synthesized
tagaattggttattattgtt

SEQ ID NO: 573891 - DNA, 20 bp, Artificial Sequence
  chemically synthesized
aactttgcttaaagacagga

SEQ ID NO: 573892 - DNA, 20 bp, Artificial Sequence
  chemically synthesized
tgagataatgactgaatgaa

SEQ ID NO: 573893 - DNA, 20 bp, Artificial Sequence
  chemically synthesized
ctatgaaagtaaaagcagaa

SEQ ID NO: 573894 - DNA, 20 bp, Artificial Sequence
  chemically synthesized
atttaataagggaaacatcc

SEQ ID NO: 573895 - DNA, 20 bp, Artificial Sequence
  chemically synthesized
gatgtttcccttattaaata

SEQ ID NO: 573896 - DNA, 20 bp, Artificial Sequence
  chemically synthesized
cccttattaaataaatggct

SEQ ID NO: 573897 - DNA, 20 bp, Artificial Sequence
  chemically synthesized
ttcataacagtcaaaaaagg

SEQ ID NO: 573898 - DNA, 20 bp, Artificial Sequence
  chemically synthesized
aaatgagttgatggcattca

SEQ ID NO: 573899 - DNA, 20 bp, Artificial Sequence
  chemically synthesized
tcaactcatttcctcccacc

SEQ ID NO: 573900 - DNA, 20 bp, Artificial Sequence
  chemically synthesized
tcctcccacccactgtttta

SEQ ID NO: 573901 - DNA, 20 bp, Artificial Sequence
  chemically synthesized
cccacccactgttttaaatc

SEQ ID NO: 573902 - DNA, 20 bp, Artificial Sequence
  chemically synthesized
agtatacattggaaccaaac

SEQ ID NO: 573903 - DNA, 20 bp, Artificial Sequence
  chemically synthesized
atgtatactacacttacata

SEQ ID NO: 573904 - DNA, 20 bp, Artificial Sequence
  chemically synthesized
gccaaattaatagtctttgc

SEQ ID NO: 573905 - DNA, 20 bp, Artificial Sequence
  chemically synthesized
aaaatggcaattctacatga

SEQ ID NO: 573906 - DNA, 20 bp, Artificial Sequence
  chemically synthesized
ggagaagtaggacaacttaa

SEQ ID NO: 573907 - DNA, 20 bp, Artificial Sequence
  chemically synthesized
aagtaggacaacttaattca

SEQ ID NO: 573908 - DNA, 20 bp, Artificial Sequence
  chemically synthesized
gaagtgcatataagttcttt

SEQ ID NO: 573909 - DNA, 20 bp, Artificial Sequence
  chemically synthesized
gcggagtaattgtttcagac

SEQ ID NO: 573910 - DNA, 20 bp, Artificial Sequence
  chemically synthesized
ctgaaaaggcagagcggagt

SEQ ID NO: 573911 - DNA, 20 bp, Artificial Sequence
  chemically synthesized
ttactccgctctgccttttc

SEQ ID NO: 573912 - DNA, 20 bp, Artificial Sequence
  chemically synthesized
aatagcatggtaaacgaagg

SEQ ID NO: 573913 - DNA, 20 bp, Artificial Sequence
  chemically synthesized
tcgacttaggcaaacagaac

SEQ ID NO: 573914 - DNA, 20 bp, Artificial Sequence
  chemically synthesized
ctgtttgcctaagtcgaggt

SEQ ID NO: 573915 - DNA, 20 bp, Artificial Sequence
  chemically synthesized
ctgattttagatagcgctgt

SEQ ID NO: 573916 - DNA, 20 bp, Artificial Sequence
  chemically synthesized
acacagcgctatctaaaatc

SEQ ID NO: 573917 - DNA, 20 bp, Artificial Sequence
  chemically synthesized
tcactttctttccccaaagc

SEQ ID NO: 573918 - DNA, 20 bp, Artificial Sequence
  chemically synthesized
tcagatgctttggggaaaga

SEQ ID NO: 573919 - DNA, 20 bp, Artificial Sequence
  chemically synthesized
tgacattgctgtcctaagta

SEQ ID NO: 573920 - DNA, 20 bp, Artificial Sequence
  chemically synthesized
gctgtcctaagtaatttgct

SEQ ID NO: 573921 - DNA, 20 bp, Artificial Sequence
  chemically synthesized
gtattccctctcatctcctg

SEQ ID NO: 573922 - DNA, 20 bp, Artificial Sequence
  chemically synthesized
accatgtattccctctcatc

SEQ ID NO: 573923 - DNA, 20 bp, Artificial Sequence
  chemically synthesized
ttgtaagttagtgttgccag

SEQ ID NO: 573924 - DNA, 20 bp, Artificial Sequence
  chemically synthesized
acattgaataaataatttgg

SEQ ID NO: 573925 - DNA, 20 bp, Artificial Sequence
  chemically synthesized
gggatacatgtgcagaacgt

SEQ ID NO: 573926 - DNA, 20 bp, Artificial Sequence
  chemically synthesized
cataggtatacacatgccat

SEQ ID NO: 573927 - DNA, 20 bp, Artificial Sequence
  chemically synthesized
acgagtgagaacatgcggtg

SEQ ID NO: 573928 - DNA, 20 bp, Artificial Sequence
  chemically synthesized
gcctggttttctgttcctgt

SEQ ID NO: 573929 - DNA, 20 bp, Artificial Sequence
  chemically synthesized
tctgttcctgtgttagtttg

SEQ ID NO: 573930 - DNA, 20 bp, Artificial Sequence
  chemically synthesized
tgtgttagtttgctgagatt

SEQ ID NO: 573931 - DNA, 20 bp, Artificial Sequence
  chemically synthesized
gtttgctgagattgatggct

SEQ ID NO: 573932 - DNA, 20 bp, Artificial Sequence
  chemically synthesized
tattccatggtgtatctgtg

SEQ ID NO: 573933 - DNA, 20 bp, Artificial Sequence
  chemically synthesized
ctataaagacacatgcacat

SEQ ID NO: 573934 - DNA, 20 bp, Artificial Sequence
  chemically synthesized
gtgcatgtgtctttatagta

SEQ ID NO: 573935 - DNA, 20 bp, Artificial Sequence
  chemically synthesized
ccattactggttatataccc

SEQ ID NO: 573936 - DNA, 20 bp, Artificial Sequence
  chemically synthesized
ctttgggtatataaccagta

SEQ ID NO: 573937 - DNA, 20 bp, Artificial Sequence
  chemically synthesized
gggaagatgtggagaaatag

SEQ ID NO: 573938 - DNA, 20 bp, Artificial Sequence
  chemically synthesized
tccacatcttccccagcacc

SEQ ID NO: 573939 - DNA, 20 bp, Artificial Sequence
  chemically synthesized
aatgatcgccattgtaactg

SEQ ID NO: 573940 - DNA, 20 bp, Artificial Sequence
  chemically synthesized
tcgccattgtaactggtgtg

SEQ ID NO: 573941 - DNA, 20 bp, Artificial Sequence
  chemically synthesized
ttctctaatcaccagtgatg

SEQ ID NO: 573942 - DNA, 20 bp, Artificial Sequence
  chemically synthesized
gaaaaaaagctcatcatcac

SEQ ID NO: 573943 - DNA, 20 bp, Artificial Sequence
  chemically synthesized
cagtgatgatgagctttttt

SEQ ID NO: 573944 - DNA, 20 bp, Artificial Sequence
  chemically synthesized
gttcatatcctttgcccaat

SEQ ID NO: 573945 - DNA, 20 bp, Artificial Sequence
  chemically synthesized
atcctttgcccaatttttga

SEQ ID NO: 573946 - DNA, 20 bp, Artificial Sequence
  chemically synthesized
gattaggttttttcttgtaa

SEQ ID NO: 573947 - DNA, 20 bp, Artificial Sequence
  chemically synthesized
gtaaatttgtttaagttcct

SEQ ID NO: 573948 - DNA, 20 bp, Artificial Sequence
  chemically synthesized
gcaacctacagaatgggaga

SEQ ID NO: 573949 - DNA, 20 bp, Artificial Sequence
  chemically synthesized
acattttctcccattctgta

SEQ ID NO: 573950 - DNA, 20 bp, Artificial Sequence
  chemically synthesized
ggttgcttgttcactctgat

SEQ ID NO: 573951 - DNA, 20 bp, Artificial Sequence
  chemically synthesized
cttttgctgtgcagaagctc

SEQ ID NO: 573952 - DNA, 20 bp, Artificial Sequence
  chemically synthesized
tgcagaagctctttagttta

SEQ ID NO: 573953 - DNA, 20 bp, Artificial Sequence
  chemically synthesized
aatggaatctaattaaacta

SEQ ID NO: 573954 - DNA, 20 bp, Artificial Sequence
  chemically synthesized
attagattccatttgtcaat

SEQ ID NO: 573955 - DNA, 20 bp, Artificial Sequence
  chemically synthesized
tcaattttggcttttgttgc

SEQ ID NO: 573956 - DNA, 20 bp, Artificial Sequence
  chemically synthesized
gcttttgttgccattgcttt

SEQ ID NO: 573957 - DNA, 20 bp, Artificial Sequence
  chemically synthesized
tatatcctgaatggtattgc

SEQ ID NO: 573958 - DNA, 20 bp, Artificial Sequence
  chemically synthesized
gtattgcctaggttttcttc

SEQ ID NO: 573959 - DNA, 20 bp, Artificial Sequence
  chemically synthesized
aggttttcttctagggtttt

SEQ ID NO: 573960 - DNA, 20 bp, Artificial Sequence
  chemically synthesized
cttctagggtttttatggtt

SEQ ID NO: 573961 - DNA, 20 bp, Artificial Sequence
  chemically synthesized
ggtttttatggttttaggtt

SEQ ID NO: 573962 - DNA, 20 bp, Artificial Sequence
  chemically synthesized
tataaggtgtaaggaagggg

SEQ ID NO: 573963 - DNA, 20 bp, Artificial Sequence
  chemically synthesized
gtgtaaggaaggggtccagt

SEQ ID NO: 573964 - DNA, 20 bp, Artificial Sequence
  chemically synthesized
cagttttctgtagatggcta

SEQ ID NO: 573965 - DNA, 20 bp, Artificial Sequence
  chemically synthesized
tgaatagggaatcctttctc

SEQ ID NO: 573966 - DNA, 20 bp, Artificial Sequence
  chemically synthesized
tagggaatcctttctccatt

SEQ ID NO: 573967 - DNA, 20 bp, Artificial Sequence
  chemically synthesized
gacaaaaacaagcaatggag

SEQ ID NO: 573968 - DNA, 20 bp, Artificial Sequence
  chemically synthesized
ttctccattgcttgtttttg

SEQ ID NO: 573969 - DNA, 20 bp, Artificial Sequence
  chemically synthesized
tctgttccattggtctatat

SEQ ID NO: 573970 - DNA, 20 bp, Artificial Sequence
  chemically synthesized
ctgttttggtaccaatacca

SEQ ID NO: 573971 - DNA, 20 bp, Artificial Sequence
  chemically synthesized
tggttactgaagccttgtag

SEQ ID NO: 573972 - DNA, 20 bp, Artificial Sequence
  chemically synthesized
cctgacttcaaactatacta

SEQ ID NO: 573973 - DNA, 20 bp, Artificial Sequence
  chemically synthesized
aagtcaggtagcatgatgcc

SEQ ID NO: 573974 - DNA, 20 bp, Artificial Sequence
  chemically synthesized
gatgcctccagctttgttct

SEQ ID NO: 573975 - DNA, 20 bp, Artificial Sequence
  chemically synthesized
tccagctttgttctttttgc

SEQ ID NO: 573976 - DNA, 20 bp, Artificial Sequence
  chemically synthesized
tggttccatatgaaatttaa

SEQ ID NO: 573977 - DNA, 20 bp, Artificial Sequence
  chemically synthesized
attatgtgaagaaagtcaat

SEQ ID NO: 573978 - DNA, 20 bp, Artificial Sequence
  chemically synthesized
ccatactgtccaaagtaatt

SEQ ID NO: 573979 - DNA, 20 bp, Artificial Sequence
  chemically synthesized
cagtatggccattttcacga

SEQ ID NO: 573980 - DNA, 20 bp, Artificial Sequence
  chemically synthesized
tgagcatggaatgttcttcc

SEQ ID NO: 573981 - DNA, 20 bp, Artificial Sequence
  chemically synthesized
cctctctcatttccttgagc

SEQ ID NO: 573982 - DNA, 20 bp, Artificial Sequence
  chemically synthesized
atgagtgaattcccattcac

SEQ ID NO: 573983 - DNA, 20 bp, Artificial Sequence
  chemically synthesized
aattgtgaatgggaattcac

SEQ ID NO: 573984 - DNA, 20 bp, Artificial Sequence
  chemically synthesized
tgtctattattggcgtatag

SEQ ID NO: 573985 - DNA, 20 bp, Artificial Sequence
  chemically synthesized
gaatgcttactatttttcca

SEQ ID NO: 573986 - DNA, 20 bp, Artificial Sequence
  chemically synthesized
gtatcctgagactttgctga

SEQ ID NO: 573987 - DNA, 20 bp, Artificial Sequence
  chemically synthesized
agactttgctgaagttgctt

SEQ ID NO: 573988 - DNA, 20 bp, Artificial Sequence
  chemically synthesized
tgaagttgcttatcagctta

SEQ ID NO: 573989 - DNA, 20 bp, Artificial Sequence
  chemically synthesized
aagattttgggttgagacga

SEQ ID NO: 573990 - DNA, 20 bp, Artificial Sequence
  chemically synthesized
attgtctctgtttgcagctg

SEQ ID NO: 573991 - DNA, 20 bp, Artificial Sequence
  chemically synthesized
aagagaggaagtcagattgt

SEQ ID NO: 573992 - DNA, 20 bp, Artificial Sequence
  chemically synthesized
ttcaaataggaagagaggaa

SEQ ID NO: 573993 - DNA, 20 bp, Artificial Sequence
  chemically synthesized
accctttatttctttccctt

SEQ ID NO: 573994 - DNA, 20 bp, Artificial Sequence
  chemically synthesized
ctcgtattcaacataatatt

SEQ ID NO: 573995 - DNA, 20 bp, Artificial Sequence
  chemically synthesized
agagggcatccttgtcttgt

SEQ ID NO: 573996 - DNA, 20 bp, Artificial Sequence
  chemically synthesized
cttgtgccggtttttaaagg

SEQ ID NO: 573997 - DNA, 20 bp, Artificial Sequence
  chemically synthesized
cggtttttaaagggagtgct

SEQ ID NO: 573998 - DNA, 20 bp, Artificial Sequence
  chemically synthesized
cattcagtatgataatggct

SEQ ID NO: 573999 - DNA, 20 bp, Artificial Sequence
  chemically synthesized
ccatcagtacctaatttatt

SEQ ID NO: 574000 - DNA, 20 bp, Artificial Sequence
  chemically synthesized
tgaattttattgaaggcctt

SEQ ID NO: 574001 - DNA, 20 bp, Artificial Sequence
  chemically synthesized
cgcttctattgagataatca

SEQ ID NO: 574002 - DNA, 20 bp, Artificial Sequence
  chemically synthesized
cagaaccaatgacaaaaacc

SEQ ID NO: 574003 - DNA, 20 bp, Artificial Sequence
  chemically synthesized
catgtggtttttgtcattgg

SEQ ID NO: 574004 - DNA, 20 bp, Artificial Sequence
  chemically synthesized
gtcattggttctgtttaagt

SEQ ID NO: 574005 - DNA, 20 bp, Artificial Sequence
  chemically synthesized
ggttctgtttaagtgatgga

SEQ ID NO: 574006 - DNA, 20 bp, Artificial Sequence
  chemically synthesized
tttaagtgatggattatgtt

SEQ ID NO: 574007 - DNA, 20 bp, Artificial Sequence
  chemically synthesized
agcttatccagcatgatcaa

SEQ ID NO: 574008 - DNA, 20 bp, Artificial Sequence
  chemically synthesized
agccaacttgatcatgctgg

SEQ ID NO: 574009 - DNA, 20 bp, Artificial Sequence
  chemically synthesized
ccgaatccagcagcacatga

SEQ ID NO: 574010 - DNA, 20 bp, Artificial Sequence
  chemically synthesized
gataagctttttcatgtgct

SEQ ID NO: 574011 - DNA, 20 bp, Artificial Sequence
  chemically synthesized
ctttttcatgtgctgctgga

SEQ ID NO: 574012 - DNA, 20 bp, Artificial Sequence
  chemically synthesized
tcggtttgccagtattttat

SEQ ID NO: 574013 - DNA, 20 bp, Artificial Sequence
  chemically synthesized
ctttgtctgttgtgtctctg

SEQ ID NO: 574014 - DNA, 20 bp, Artificial Sequence
  chemically synthesized
gggaggagtccctcttttcc

SEQ ID NO: 574015 - DNA, 20 bp, Artificial Sequence
  chemically synthesized
cctcttttcctattgtttag

SEQ ID NO: 574016 - DNA, 20 bp, Artificial Sequence
  chemically synthesized
agctgtgaatccatctgttc

SEQ ID NO: 574017 - DNA, 20 bp, Artificial Sequence
  chemically synthesized
ccaaaaaaagcccaggaaca

SEQ ID NO: 574018 - DNA, 20 bp, Artificial Sequence
  chemically synthesized
gaactcgttattggtctatt

SEQ ID NO: 574019 - DNA, 20 bp, Artificial Sequence
  chemically synthesized
cgttattggtctattcaggg

SEQ ID NO: 574020 - DNA, 20 bp, Artificial Sequence
  chemically synthesized
attcagggattcgatttctt

SEQ ID NO: 574021 - DNA, 20 bp, Artificial Sequence
  chemically synthesized
ccagaaattaatcaatttct

SEQ ID NO: 574022 - DNA, 20 bp, Artificial Sequence
  chemically synthesized
aaactagaaaatctagaaga

SEQ ID NO: 574023 - DNA, 20 bp, Artificial Sequence
  chemically synthesized
aatcaatttcttctagattt

SEQ ID NO: 574024 - DNA, 20 bp, Artificial Sequence
  chemically synthesized
tttctagtttatttgcgtag

SEQ ID NO: 574025 - DNA, 20 bp, Artificial Sequence
  chemically synthesized
tgtttatagtattctctgat

SEQ ID NO: 574026 - DNA, 20 bp, Artificial Sequence
  chemically synthesized
tatcattttttcttgtgtct

SEQ ID NO: 574027 - DNA, 20 bp, Artificial Sequence
  chemically synthesized
agccaggggctggttttttg

SEQ ID NO: 574028 - DNA, 20 bp, Artificial Sequence
  chemically synthesized
atcttttcaaaaaaccagcc

SEQ ID NO: 574029 - DNA, 20 bp, Artificial Sequence
  chemically synthesized
aaaaatcaatgaagccaggg

SEQ ID NO: 574030 - DNA, 20 bp, Artificial Sequence
  chemically synthesized
aaaaaaccagcccctggctt

SEQ ID NO: 574031 - DNA, 20 bp, Artificial Sequence
  chemically synthesized
cctggcttcattgatttttt

SEQ ID NO: 574032 - DNA, 20 bp, Artificial Sequence
  chemically synthesized
gtagttatttcttctcttct

SEQ ID NO: 574033 - DNA, 20 bp, Artificial Sequence
  chemically synthesized
tctcttctgctagctttgga

SEQ ID NO: 574034 - DNA, 20 bp, Artificial Sequence
  chemically synthesized
tagctttggaatttgtttgc

SEQ ID NO: 574035 - DNA, 20 bp, Artificial Sequence
  chemically synthesized
aggtgtcaattttagatatt

SEQ ID NO: 574036 - DNA, 20 bp, Artificial Sequence
  chemically synthesized
atatttcctgctttctcctg

SEQ ID NO: 574037 - DNA, 20 bp, Artificial Sequence
  chemically synthesized
gctgtaaatttccctctaaa

SEQ ID NO: 574038 - DNA, 20 bp, Artificial Sequence
  chemically synthesized
atactgctttagctgtgtcc

SEQ ID NO: 574039 - DNA, 20 bp, Artificial Sequence
  chemically synthesized
tccgttgtgtatttattctc

SEQ ID NO: 574040 - DNA, 20 bp, Artificial Sequence
  chemically synthesized
agtcattcaggagcaggttg

SEQ ID NO: 574041 - DNA, 20 bp, Artificial Sequence
  chemically synthesized
gctcagtttccatgtagttg

SEQ ID NO: 574042 - DNA, 20 bp, Artificial Sequence
  chemically synthesized
atgtagttgtgtggttttga

SEQ ID NO: 574043 - DNA, 20 bp, Artificial Sequence
  chemically synthesized
tttcttaatcctgagttcta

SEQ ID NO: 574044 - DNA, 20 bp, Artificial Sequence
  chemically synthesized
cagtacaatcaaattagaac

SEQ ID NO: 574045 - DNA, 20 bp, Artificial Sequence
  chemically synthesized
tactgtggtctgagagactc

SEQ ID NO: 574046 - DNA, 20 bp, Artificial Sequence
  chemically synthesized
gtctgagagactcttatgat

SEQ ID NO: 574047 - DNA, 20 bp, Artificial Sequence
  chemically synthesized
gtttttttgcatttgctgag

SEQ ID NO: 574048 - DNA, 20 bp, Artificial Sequence
  chemically synthesized
gctgagaataatgtatattc

SEQ ID NO: 574049 - DNA, 20 bp, Artificial Sequence
  chemically synthesized
taagtccacttggtccagag

SEQ ID NO: 574050 - DNA, 20 bp, Artificial Sequence
  chemically synthesized
cctgaatatccttgttaatt

SEQ ID NO: 574051 - DNA, 20 bp, Artificial Sequence
  chemically synthesized
gatgcccatacaataatagt

SEQ ID NO: 574052 - DNA, 20 bp, Artificial Sequence
  chemically synthesized
atgcacccaatataggagca

SEQ ID NO: 574053 - DNA, 20 bp, Artificial Sequence
  chemically synthesized
ttttgtcctttttgatcttt

SEQ ID NO: 574054 - DNA, 20 bp, Artificial Sequence
  chemically synthesized
ttgatctttattggtttaaa

SEQ ID NO: 574055 - DNA, 20 bp, Artificial Sequence
  chemically synthesized
aaagtctgttttgtctgaga

SEQ ID NO: 574056 - DNA, 20 bp, Artificial Sequence
  chemically synthesized
tctgagactaggattgcaac

SEQ ID NO: 574057 - DNA, 20 bp, Artificial Sequence
  chemically synthesized
gctttttttttctttccatt

SEQ ID NO: 574058 - DNA, 20 bp, Artificial Sequence
  chemically synthesized
tcttttaattggggcattta

SEQ ID NO: 574059 - DNA, 20 bp, Artificial Sequence
  chemically synthesized
ttactttgcccgttagttga

SEQ ID NO: 574060 - DNA, 20 bp, Artificial Sequence
  chemically synthesized
gtgatggtctttacaatttg

SEQ ID NO: 574061 - DNA, 20 bp, Artificial Sequence
  chemically synthesized
atgtttttaccatggctggt

SEQ ID NO: 574062 - DNA, 20 bp, Artificial Sequence
  chemically synthesized
cagtttttcctttccatatt

SEQ ID NO: 574063 - DNA, 20 bp, Artificial Sequence
  chemically synthesized
caccaccaggcctgccttac

SEQ ID NO: 574064 - DNA, 20 bp, Artificial Sequence
  chemically synthesized
tggtgacaaaatctctcagc

SEQ ID NO: 574065 - DNA, 20 bp, Artificial Sequence
  chemically synthesized
tttacagacaagcaaatgct

SEQ ID NO: 574066 - DNA, 20 bp, Artificial Sequence
  chemically synthesized
ctcagcatttgcttgtctgt

SEQ ID NO: 574067 - DNA, 20 bp, Artificial Sequence
  chemically synthesized
tgtaaaggattttatttcta

SEQ ID NO: 574068 - DNA, 20 bp, Artificial Sequence
  chemically synthesized
ttttatttctactttgctta

SEQ ID NO: 574069 - DNA, 20 bp, Artificial Sequence
  chemically synthesized
tttctactttgcttatgaag

SEQ ID NO: 574070 - DNA, 20 bp, Artificial Sequence
  chemically synthesized
gaatttcatatccagccaaa

SEQ ID NO: 574071 - DNA, 20 bp, Artificial Sequence
  chemically synthesized
aatattggcccccactctct

SEQ ID NO: 574072 - DNA, 20 bp, Artificial Sequence
  chemically synthesized
ccccactctcttctggcttg

SEQ ID NO: 574073 - DNA, 20 bp, Artificial Sequence
  chemically synthesized
aatgatccgctgttagtctg

SEQ ID NO: 574074 - DNA, 20 bp, Artificial Sequence
  chemically synthesized
cttcatttcaaccttggtga

SEQ ID NO: 574075 - DNA, 20 bp, Artificial Sequence
  chemically synthesized
gcaacccaagacacataata

SEQ ID NO: 574076 - DNA, 20 bp, Artificial Sequence
  chemically synthesized
ctcctggataataacctgaa

SEQ ID NO: 574077 - DNA, 20 bp, Artificial Sequence
  chemically synthesized
ttcaggtacaccaatcaaat

SEQ ID NO: 574078 - DNA, 20 bp, Artificial Sequence
  chemically synthesized
tgtgaaaagaccaaacctac

SEQ ID NO: 574079 - DNA, 20 bp, Artificial Sequence
  chemically synthesized
cacatcgtcccatatttctt

SEQ ID NO: 574080 - DNA, 20 bp, Artificial Sequence
  chemically synthesized
cgtcccatatttcttgaagg

SEQ ID NO: 574081 - DNA, 20 bp, Artificial Sequence
  chemically synthesized
ttttttcagtaatcttctct

SEQ ID NO: 574082 - DNA, 20 bp, Artificial Sequence
  chemically synthesized
taatgaaataaagcatgaag

SEQ ID NO: 574083 - DNA, 20 bp, Artificial Sequence
  chemically synthesized
tcagtctctgatatcctttc

SEQ ID NO: 574084 - DNA, 20 bp, Artificial Sequence
  chemically synthesized
tgatatcctttcttttgctt

SEQ ID NO: 574085 - DNA, 20 bp, Artificial Sequence
  chemically synthesized
atttggctattgatacttgt

SEQ ID NO: 574086 - DNA, 20 bp, Artificial Sequence
  chemically synthesized
tgcttcacaaagttctcgtg

SEQ ID NO: 574087 - DNA, 20 bp, Artificial Sequence
  chemically synthesized
aggaattgctaactagaata

SEQ ID NO: 574088 - DNA, 20 bp, Artificial Sequence
  chemically synthesized
ctaaccttttttttaaggtt

SEQ ID NO: 574089 - DNA, 20 bp, Artificial Sequence
  chemically synthesized
aacacgctcctttagctcgt

SEQ ID NO: 574090 - DNA, 20 bp, Artificial Sequence
  chemically synthesized
agtttgacgaattgacggaa

SEQ ID NO: 574091 - DNA, 20 bp, Artificial Sequence
  chemically synthesized
ttcgtcaaactcattctcca

SEQ ID NO: 574092 - DNA, 20 bp, Artificial Sequence
  chemically synthesized
ggaacaaaactggatggaga

SEQ ID NO: 574093 - DNA, 20 bp, Artificial Sequence
  chemically synthesized
atttggaggagaagaggcgt

SEQ ID NO: 574094 - DNA, 20 bp, Artificial Sequence
  chemically synthesized
cgttccggtttttggaattt

SEQ ID NO: 574095 - DNA, 20 bp, Artificial Sequence
  chemically synthesized
ggaattttcaggctttttgt

SEQ ID NO: 574096 - DNA, 20 bp, Artificial Sequence
  chemically synthesized
tgctggtttttcctcatctt

SEQ ID NO: 574097 - DNA, 20 bp, Artificial Sequence
  chemically synthesized
tgatgttggtgaccttcaga

SEQ ID NO: 574098 - DNA, 20 bp, Artificial Sequence
  chemically synthesized
tgctggaggtccactccaga

SEQ ID NO: 574099 - DNA, 20 bp, Artificial Sequence
  chemically synthesized
cagcagaagctgcagaacag

SEQ ID NO: 574100 - DNA, 20 bp, Artificial Sequence
  chemically synthesized
gacagcaatctttgctgttc

SEQ ID NO: 574101 - DNA, 20 bp, Artificial Sequence
  chemically synthesized
tgctgtctgttccttcctct

SEQ ID NO: 574102 - DNA, 20 bp, Artificial Sequence
  chemically synthesized
tggcaggtgcccctctggga

SEQ ID NO: 574103 - DNA, 20 bp, Artificial Sequence
  chemically synthesized
tcttcagagccagcaggcag

SEQ ID NO: 574104 - DNA, 20 bp, Artificial Sequence
  chemically synthesized
gtgctctgtcccagggagat

SEQ ID NO: 574105 - DNA, 20 bp, Artificial Sequence
  chemically synthesized
gaaaggcagcagccccagtc

SEQ ID NO: 574106 - DNA, 20 bp, Artificial Sequence
  chemically synthesized
cactgtagccagattgcctc

SEQ ID NO: 574107 - DNA, 20 bp, Artificial Sequence
  chemically synthesized
tagagaggcaatctggctac

SEQ ID NO: 574108 - DNA, 20 bp, Artificial Sequence
  chemically synthesized
agctcggcaaagccactgta

SEQ ID NO: 574109 - DNA, 20 bp, Artificial Sequence
  chemically synthesized
ccgcccagttagaacttctt

SEQ ID NO: 574110 - DNA, 20 bp, Artificial Sequence
  chemically synthesized
cagttagaacttcttgacgg

SEQ ID NO: 574111 - DNA, 20 bp, Artificial Sequence
  chemically synthesized
gtgaggggaaaactgcctac

SEQ ID NO: 574112 - DNA, 20 bp, Artificial Sequence
  chemically synthesized
ccattactgaagcttgagta

SEQ ID NO: 574113 - DNA, 20 bp, Artificial Sequence
  chemically synthesized
ggaggggcacctgccattac

SEQ ID NO: 574114 - DNA, 20 bp, Artificial Sequence
  chemically synthesized
ggcaggtgcccctccccaca

SEQ ID NO: 574115 - DNA, 20 bp, Artificial Sequence
  chemically synthesized
ctgaagtggacctgggatac

SEQ ID NO: 574116 - DNA, 20 bp, Artificial Sequence
  chemically synthesized
agcccagccagctaagatcc

SEQ ID NO: 574117 - DNA, 20 bp, Artificial Sequence
  chemically synthesized
gcagacaccgagctagctgc

SEQ ID NO: 574118 - DNA, 20 bp, Artificial Sequence
  chemically synthesized
tttcaagcacaaaattgggc

SEQ ID NO: 574119 - DNA, 20 bp, Artificial Sequence
  chemically synthesized
gcccaaacagctgcccaatt

SEQ ID NO: 574120 - DNA, 20 bp, Artificial Sequence
  chemically synthesized
gtgcctacgccaccagggcc

SEQ ID NO: 574121 - DNA, 20 bp, Artificial Sequence
  chemically synthesized
gcctccgcaacatgcagacc

SEQ ID NO: 574122 - DNA, 20 bp, Artificial Sequence
  chemically synthesized
ggagcattccagcccagaca

SEQ ID NO: 574123 - DNA, 20 bp, Artificial Sequence
  chemically synthesized
ttcctcagggcacagtccct

SEQ ID NO: 574124 - DNA, 20 bp, Artificial Sequence
  chemically synthesized
ggagggaattccctgacccc

SEQ ID NO: 574125 - DNA, 20 bp, Artificial Sequence
  chemically synthesized
cggggtgaggcgacatccca

SEQ ID NO: 574126 - DNA, 20 bp, Artificial Sequence
  chemically synthesized
gtgagatcaacacagaaggt

SEQ ID NO: 574127 - DNA, 20 bp, Artificial Sequence
  chemically synthesized
cttgccagccacttctttgg

SEQ ID NO: 574128 - DNA, 20 bp, Artificial Sequence
  chemically synthesized
ggattttaaagatgaataat

SEQ ID NO: 574129 - DNA, 20 bp, Artificial Sequence
  chemically synthesized
taaagatgaataattcctgc

SEQ ID NO: 574130 - DNA, 20 bp, Artificial Sequence
  chemically synthesized
atagaatatctagggtttaa

SEQ ID NO: 574131 - DNA, 20 bp, Artificial Sequence
  chemically synthesized
tagcttttcaatagaatatc

SEQ ID NO: 574132 - DNA, 20 bp, Artificial Sequence
  chemically synthesized
atatatattgatttactttc

SEQ ID NO: 574133 - DNA, 20 bp, Artificial Sequence
  chemically synthesized
ggattatgtgaattcatata

SEQ ID NO: 574134 - DNA, 20 bp, Artificial Sequence
  chemically synthesized
attttatgctattgtaagat

SEQ ID NO: 574135 - DNA, 20 bp, Artificial Sequence
  chemically synthesized
attaaggattttatgctatt

SEQ ID NO: 574136 - DNA, 20 bp, Artificial Sequence
  chemically synthesized
cataaaatccttaatacagt

SEQ ID NO: 574137 - DNA, 20 bp, Artificial Sequence
  chemically synthesized
tttctaaaccagtactgtat

SEQ ID NO: 574138 - DNA, 20 bp, Artificial Sequence
  chemically synthesized
actggtgataagagatgtta

SEQ ID NO: 574139 - DNA, 20 bp, Artificial Sequence
  chemically synthesized
agtacggtatatttttaata

SEQ ID NO: 574140 - DNA, 20 bp, Artificial Sequence
  chemically synthesized
cagatattaaaggccaaatc

SEQ ID NO: 574141 - DNA, 20 bp, Artificial Sequence
  chemically synthesized
caattgcaatgtttaaaagc

SEQ ID NO: 574142 - DNA, 20 bp, Artificial Sequence
  chemically synthesized
tgcttttaaacattgcaatt

SEQ ID NO: 574143 - DNA, 20 bp, Artificial Sequence
  chemically synthesized
gtttacaaagcatgcaattg

SEQ ID NO: 574144 - DNA, 20 bp, Artificial Sequence
  chemically synthesized
ttggagtaaccagggtttta

SEQ ID NO: 574145 - DNA, 20 bp, Artificial Sequence
  chemically synthesized
ttcctgttatttggagtaac

SEQ ID NO: 574146 - DNA, 20 bp, Artificial Sequence
  chemically synthesized
ggttactccaaataacagga

SEQ ID NO: 574147 - DNA, 20 bp, Artificial Sequence
  chemically synthesized
ggaattagcttcatatttaa

SEQ ID NO: 574148 - DNA, 20 bp, Artificial Sequence
  chemically synthesized
catatttaacccagatttat

SEQ ID NO: 574149 - DNA, 20 bp, Artificial Sequence
  chemically synthesized
tgaaggattaaatatttttt

SEQ ID NO: 574150 - DNA, 20 bp, Artificial Sequence
  chemically synthesized
tttgttttttcttctccatc

SEQ ID NO: 574151 - DNA, 20 bp, Artificial Sequence
  chemically synthesized
ctacaaatgaattgccgtgt

SEQ ID NO: 574152 - DNA, 20 bp, Artificial Sequence
  chemically synthesized
gtaggaagaggaaaatttat

SEQ ID NO: 574153 - DNA, 20 bp, Artificial Sequence
  chemically synthesized
ttattcattatgaagatatc

SEQ ID NO: 574154 - DNA, 20 bp, Artificial Sequence
  chemically synthesized
acaagtttattcagagttgg

SEQ ID NO: 574155 - DNA, 20 bp, Artificial Sequence
  chemically synthesized
attcagagttgggagagctt

SEQ ID NO: 574156 - DNA, 20 bp, Artificial Sequence
  chemically synthesized
tgggagagcttacatgtttt

SEQ ID NO: 574157 - DNA, 20 bp, Artificial Sequence
  chemically synthesized
ccctaattctataagaaaag

SEQ ID NO: 574158 - DNA, 20 bp, Artificial Sequence
  chemically synthesized
atatgagtcaagtcaacctt

SEQ ID NO: 574159 - DNA, 20 bp, Artificial Sequence
  chemically synthesized
ttcttattgtattaattttg

SEQ ID NO: 574160 - DNA, 20 bp, Artificial Sequence
  chemically synthesized
tctcttcttaaccttggttc

SEQ ID NO: 574161 - DNA, 20 bp, Artificial Sequence
  chemically synthesized
ttcatgcaactatcttccct

SEQ ID NO: 574162 - DNA, 20 bp, Artificial Sequence
  chemically synthesized
catgaacatggttgcaagta

SEQ ID NO: 574163 - DNA, 20 bp, Artificial Sequence
  chemically synthesized
acattatctattcagaggaa

SEQ ID NO: 574164 - DNA, 20 bp, Artificial Sequence
  chemically synthesized
atctattcagaggaaatatg

SEQ ID NO: 574165 - DNA, 20 bp, Artificial Sequence
  chemically synthesized
ctcaatgtcaaattctaaca

SEQ ID NO: 574166 - DNA, 20 bp, Artificial Sequence
  chemically synthesized
catcctcagtccctgtggct

SEQ ID NO: 574167 - DNA, 20 bp, Artificial Sequence
  chemically synthesized
ggcttaccatcctcagtccc

SEQ ID NO: 574168 - DNA, 20 bp, Artificial Sequence
  chemically synthesized
gaggatggtaagcctaaaaa

SEQ ID NO: 574169 - DNA, 20 bp, Artificial Sequence
  chemically synthesized
aaactggcaaatccaccttt

SEQ ID NO: 574170 - DNA, 20 bp, Artificial Sequence
  chemically synthesized
aagcctaaaaaggtggattt

SEQ ID NO: 574171 - DNA, 20 bp, Artificial Sequence
  chemically synthesized
ttatcttcagcattcacatc

SEQ ID NO: 574172 - DNA, 20 bp, Artificial Sequence
  chemically synthesized
ttttttggcattcaaattga

SEQ ID NO: 574173 - DNA, 20 bp, Artificial Sequence
  chemically synthesized
aaccttttttggcattcaaa

SEQ ID NO: 574174 - DNA, 20 bp, Artificial Sequence
  chemically synthesized
atctcaatttgaatgccaaa

SEQ ID NO: 574175 - DNA, 20 bp, Artificial Sequence
  chemically synthesized
aaagttcctacaatgaaatg

SEQ ID NO: 574176 - DNA, 20 bp, Artificial Sequence
  chemically synthesized
tctttaaagttcctacaatg

SEQ ID NO: 574177 - DNA, 20 bp, Artificial Sequence
  chemically synthesized
aaagtcagggcagggattct

SEQ ID NO: 574178 - DNA, 20 bp, Artificial Sequence
  chemically synthesized
cttactgtgaaaagtcaggg

SEQ ID NO: 574179 - DNA, 20 bp, Artificial Sequence
  chemically synthesized
cacagtaagaaatgcaagtt

SEQ ID NO: 574180 - DNA, 20 bp, Artificial Sequence
  chemically synthesized
atgcataactacatagatgc

SEQ ID NO: 574181 - DNA, 20 bp, Artificial Sequence
  chemically synthesized
gtttacctgttgactctgaa

SEQ ID NO: 574182 - DNA, 20 bp, Artificial Sequence
  chemically synthesized
gccaggaatatttcactgtt

SEQ ID NO: 574183 - DNA, 20 bp, Artificial Sequence
  chemically synthesized
cacttttggtacagagaaac

SEQ ID NO: 574184 - DNA, 20 bp, Artificial Sequence
  chemically synthesized
actgcgcccagactataaac

SEQ ID NO: 574185 - DNA, 20 bp, Artificial Sequence
  chemically synthesized
caccttggcctcccaaagtg

SEQ ID NO: 574186 - DNA, 20 bp, Artificial Sequence
  chemically synthesized
tttggattttttagtagaga

SEQ ID NO: 574187 - DNA, 20 bp, Artificial Sequence
  chemically synthesized
tggctaattttttttttttt

SEQ ID NO: 574188 - DNA, 20 bp, Artificial Sequence
  chemically synthesized
tgcctcagcctcctgagtag

SEQ ID NO: 574189 - DNA, 20 bp, Artificial Sequence
  chemically synthesized
ctcaggaggctgaggcagag

SEQ ID NO: 574190 - DNA, 20 bp, Artificial Sequence
  chemically synthesized
aaaattaaaaaaagagaaac

SEQ ID NO: 574191 - DNA, 20 bp, Artificial Sequence
  chemically synthesized
ttgtttttgttttaataaac

SEQ ID NO: 574192 - DNA, 20 bp, Artificial Sequence
  chemically synthesized
gctgttttttaatgttttgt

SEQ ID NO: 574193 - DNA, 20 bp, Artificial Sequence
  chemically synthesized
cagattgctgttttttaatg

SEQ ID NO: 574194 - DNA, 20 bp, Artificial Sequence
  chemically synthesized
ccggccagattgctgttttt

SEQ ID NO: 574195 - DNA, 20 bp, Artificial Sequence
  chemically synthesized
gccaccgctcccggccagat

SEQ ID NO: 574196 - DNA, 20 bp, Artificial Sequence
  chemically synthesized
ggcgtgagccaccgctcccg

SEQ ID NO: 574197 - DNA, 20 bp, Artificial Sequence
  chemically synthesized
caccttggcctcccaaagtg

SEQ ID NO: 574198 - DNA, 20 bp, Artificial Sequence
  chemically synthesized
ttttgtaattttagtagaga

SEQ ID NO: 574199 - DNA, 20 bp, Artificial Sequence
  chemically synthesized
aggcgcgcaccaccacgccc

SEQ ID NO: 574200 - DNA, 20 bp, Artificial Sequence
  chemically synthesized
tcaggaggctgaggcaggag

SEQ ID NO: 574201 - DNA, 20 bp, Artificial Sequence
  chemically synthesized
aggtgaaaaggtttgtggat

SEQ ID NO: 574202 - DNA, 20 bp, Artificial Sequence
  chemically synthesized
aatcccaaggtgaaaaggtt

SEQ ID NO: 574203 - DNA, 20 bp, Artificial Sequence
  chemically synthesized
aatccacaaaccttttcacc

SEQ ID NO: 574204 - DNA, 20 bp, Artificial Sequence
  chemically synthesized
tcaggacaatcccaaggtga

SEQ ID NO: 574205 - DNA, 20 bp, Artificial Sequence
  chemically synthesized
tttaaacctgtagtctggat

SEQ ID NO: 574206 - DNA, 20 bp, Artificial Sequence
  chemically synthesized
aaaaatcttgtatccagact

SEQ ID NO: 574207 - DNA, 20 bp, Artificial Sequence
  chemically synthesized
gatctgtaagtggaatatat

SEQ ID NO: 574208 - DNA, 20 bp, Artificial Sequence
  chemically synthesized
cactttactgaaaatagcac

SEQ ID NO: 574209 - DNA, 20 bp, Artificial Sequence
  chemically synthesized
cttttaaaattcatgattta

SEQ ID NO: 574210 - DNA, 20 bp, Artificial Sequence
  chemically synthesized
tgcttctttacttttaaaat

SEQ ID NO: 574211 - DNA, 20 bp, Artificial Sequence
  chemically synthesized
tagaatcaaatttaagtttt

SEQ ID NO: 574212 - DNA, 20 bp, Artificial Sequence
  chemically synthesized
aagaagcatttaaaacttaa

SEQ ID NO: 574213 - DNA, 20 bp, Artificial Sequence
  chemically synthesized
aaaaaacagtagaatcaaat

SEQ ID NO: 574214 - DNA, 20 bp, Artificial Sequence
  chemically synthesized
ttaaaacttaaatttgattc

SEQ ID NO: 574215 - DNA, 20 bp, Artificial Sequence
  chemically synthesized
actgttttttcctatggaag

SEQ ID NO: 574216 - DNA, 20 bp, Artificial Sequence
  chemically synthesized
gagaatctcagccttccaaa

SEQ ID NO: 574217 - DNA, 20 bp, Artificial Sequence
  chemically synthesized
tggaagctatgtttggaagg

SEQ ID NO: 574218 - DNA, 20 bp, Artificial Sequence
  chemically synthesized
caatatagtcaatattaata

SEQ ID NO: 574219 - DNA, 20 bp, Artificial Sequence
  chemically synthesized
aaggccagggacttagtcat

SEQ ID NO: 574220 - DNA, 20 bp, Artificial Sequence
  chemically synthesized
ttgtattagcaaatgtggct

SEQ ID NO: 574221 - DNA, 20 bp, Artificial Sequence
  chemically synthesized
tctgtaattgtattagcaaa

SEQ ID NO: 574222 - DNA, 20 bp, Artificial Sequence
  chemically synthesized
actaagtaatatgtgtttct

SEQ ID NO: 574223 - DNA, 20 bp, Artificial Sequence
  chemically synthesized
tctcacagaaacacatatta

SEQ ID NO: 574224 - DNA, 20 bp, Artificial Sequence
  chemically synthesized
tattcaagaaactaagtaat

SEQ ID NO: 574225 - DNA, 20 bp, Artificial Sequence
  chemically synthesized
cactcaccttggcctcccaa

SEQ ID NO: 574226 - DNA, 20 bp, Artificial Sequence
  chemically synthesized
tttgtattttttagtagaga

SEQ ID NO: 574227 - DNA, 20 bp, Artificial Sequence
  chemically synthesized
tttgggaggctgaggcggag

SEQ ID NO: 574228 - DNA, 20 bp, Artificial Sequence
  chemically synthesized
taaaataaaaaaagagaaac

SEQ ID NO: 574229 - DNA, 20 bp, Artificial Sequence
  chemically synthesized
agggaacttttctaataaac

SEQ ID NO: 574230 - DNA, 20 bp, Artificial Sequence
  chemically synthesized
ccctacagcatgaatcctct

SEQ ID NO: 574231 - DNA, 20 bp, Artificial Sequence
  chemically synthesized
actcagcaatttaagccctc

SEQ ID NO: 574232 - DNA, 20 bp, Artificial Sequence
  chemically synthesized
ctgagtggaaaaatgggaag

SEQ ID NO: 574233 - DNA, 20 bp, Artificial Sequence
  chemically synthesized
ggggtagtagtttacaaaga

SEQ ID NO: 574234 - DNA, 20 bp, Artificial Sequence
  chemically synthesized
tctttgtaaactactacccc

SEQ ID NO: 574235 - DNA, 20 bp, Artificial Sequence
  chemically synthesized
aactctgaagctttgggggt

SEQ ID NO: 574236 - DNA, 20 bp, Artificial Sequence
  chemically synthesized
aactactacccccaaagctt

SEQ ID NO: 574237 - DNA, 20 bp, Artificial Sequence
  chemically synthesized
tgacactgggtttgaaactc

SEQ ID NO: 574238 - DNA, 20 bp, Artificial Sequence
  chemically synthesized
tccactgcatcttattgaca

SEQ ID NO: 574239 - DNA, 20 bp, Artificial Sequence
  chemically synthesized
caataagatgcagtggagaa

SEQ ID NO: 574240 - DNA, 20 bp, Artificial Sequence
  chemically synthesized
atatatgaattcatgtaatt

SEQ ID NO: 574241 - DNA, 20 bp, Artificial Sequence
  chemically synthesized
gaatctgtgttgtattttat

SEQ ID NO: 574242 - DNA, 20 bp, Artificial Sequence
  chemically synthesized
gaaacacgcataaaatacaa

SEQ ID NO: 574243 - DNA, 20 bp, Artificial Sequence
  chemically synthesized
actggtaatagtagatgtga

SEQ ID NO: 574244 - DNA, 20 bp, Artificial Sequence
  chemically synthesized
ttatgtactggtaatagtag

SEQ ID NO: 574245 - DNA, 20 bp, Artificial Sequence
  chemically synthesized
taaatataatttttcgaaag

SEQ ID NO: 574246 - DNA, 20 bp, Artificial Sequence
  chemically synthesized
aatttttcgaaaggtatgtt

SEQ ID NO: 574247 - DNA, 20 bp, Artificial Sequence
  chemically synthesized
gaaaggtatgtttaatgttt

SEQ ID NO: 574248 - DNA, 20 bp, Artificial Sequence
  chemically synthesized
gctatcattgggatcagaat

SEQ ID NO: 574249 - DNA, 20 bp, Artificial Sequence
  chemically synthesized
gacaaacttcattttccata

SEQ ID NO: 574250 - DNA, 20 bp, Artificial Sequence
  chemically synthesized
accaatcagggtatggaaaa

SEQ ID NO: 574251 - DNA, 20 bp, Artificial Sequence
  chemically synthesized
accctatttgcggtattcct

SEQ ID NO: 574252 - DNA, 20 bp, Artificial Sequence
  chemically synthesized
gccagctgatacttgaactg

SEQ ID NO: 574253 - DNA, 20 bp, Artificial Sequence
  chemically synthesized
ataggctgtagagcagacat

SEQ ID NO: 574254 - DNA, 20 bp, Artificial Sequence
  chemically synthesized
ttgaataaaatcaacatatt

SEQ ID NO: 574255 - DNA, 20 bp, Artificial Sequence
  chemically synthesized
tattttaaaagcattaaata

SEQ ID NO: 574256 - DNA, 20 bp, Artificial Sequence
  chemically synthesized
aggtaatacatttcaaaacc

SEQ ID NO: 574257 - DNA, 20 bp, Artificial Sequence
  chemically synthesized
ttgctgtgtactggaaaact

SEQ ID NO: 574258 - DNA, 20 bp, Artificial Sequence
  chemically synthesized
gtcataaaacattggggtag

SEQ ID NO: 574259 - DNA, 20 bp, Artificial Sequence
  chemically synthesized
ttgtaaaatcccttctaccc

SEQ ID NO: 574260 - DNA, 20 bp, Artificial Sequence
  chemically synthesized
taggtaaaatttttaaaaag

SEQ ID NO: 574261 - DNA, 20 bp, Artificial Sequence
  chemically synthesized
atgcaattcaacattagacc

SEQ ID NO: 574262 - DNA, 20 bp, Artificial Sequence
  chemically synthesized
ttcatgaaggcaatgatcaa

SEQ ID NO: 574263 - DNA, 20 bp, Artificial Sequence
  chemically synthesized
ccttcatttattcactcaac

SEQ ID NO: 574264 - DNA, 20 bp, Artificial Sequence
  chemically synthesized
tgaataaatgaaggtaccta

SEQ ID NO: 574265 - DNA, 20 bp, Artificial Sequence
  chemically synthesized
atttcacatatattgtagca

SEQ ID NO: 574266 - DNA, 20 bp, Artificial Sequence
  chemically synthesized
aatttaagtgtgacaattta

SEQ ID NO: 574267 - DNA, 20 bp, Artificial Sequence
  chemically synthesized
ctatgagagtaccaactgta

SEQ ID NO: 574268 - DNA, 20 bp, Artificial Sequence
  chemically synthesized
taccaactgtaagcagtttc

SEQ ID NO: 574269 - DNA, 20 bp, Artificial Sequence
  chemically synthesized
aactcccaccaagcagaaga

SEQ ID NO: 574270 - DNA, 20 bp, Artificial Sequence
  chemically synthesized
gccacgtaatctccttattc

SEQ ID NO: 574271 - DNA, 20 bp, Artificial Sequence
  chemically synthesized
agaatgaaatccaatgaata

SEQ ID NO: 574272 - DNA, 20 bp, Artificial Sequence
  chemically synthesized
taggcaagtattctcccgca

SEQ ID NO: 574273 - DNA, 20 bp, Artificial Sequence
  chemically synthesized
aagtattctcccgcaaggag

SEQ ID NO: 574274 - DNA, 20 bp, Artificial Sequence
  chemically synthesized
ttgctgatgttcctgcatta

SEQ ID NO: 574275 - DNA, 20 bp, Artificial Sequence
  chemically synthesized
ggtgaattaatggatggatg

SEQ ID NO: 574276 - DNA, 20 bp, Artificial Sequence
  chemically synthesized
catccatccattaattcacc

SEQ ID NO: 574277 - DNA, 20 bp, Artificial Sequence
  chemically synthesized
ccaggcacacagaggggtga

SEQ ID NO: 574278 - DNA, 20 bp, Artificial Sequence
  chemically synthesized
atcatctaagtaaaagatgc

SEQ ID NO: 574279 - DNA, 20 bp, Artificial Sequence
  chemically synthesized
gttacctcagaatagctctt

SEQ ID NO: 574280 - DNA, 20 bp, Artificial Sequence
  chemically synthesized
tgccatcagtgaaaatgcag

SEQ ID NO: 574281 - DNA, 20 bp, Artificial Sequence
  chemically synthesized
gaagggtttaaggatgaacc

SEQ ID NO: 574282 - DNA, 20 bp, Artificial Sequence
  chemically synthesized
agcctggaaaatttgttgga

SEQ ID NO: 574283 - DNA, 20 bp, Artificial Sequence
  chemically synthesized
ctcttatctgaccttttttt

SEQ ID NO: 574284 - DNA, 20 bp, Artificial Sequence
  chemically synthesized
gaaaccaagttcatttgttc

SEQ ID NO: 574285 - DNA, 20 bp, Artificial Sequence
  chemically synthesized
aaaacaggagaacaaatgaa

SEQ ID NO: 574286 - DNA, 20 bp, Artificial Sequence
  chemically synthesized
catttgtgatcgtaatgcca

SEQ ID NO: 574287 - DNA, 20 bp, Artificial Sequence
  chemically synthesized
tccaggccatctcaaacagg

SEQ ID NO: 574288 - DNA, 20 bp, Artificial Sequence
  chemically synthesized
cttttgattgtttaaaccct

SEQ ID NO: 574289 - DNA, 20 bp, Artificial Sequence
  chemically synthesized
ccttagcctaattctctttt

SEQ ID NO: 574290 - DNA, 20 bp, Artificial Sequence
  chemically synthesized
ctaaccttagcctaattctc

SEQ ID NO: 574291 - DNA, 20 bp, Artificial Sequence
  chemically synthesized
cccctcaaatactgttgtgc

SEQ ID NO: 574292 - DNA, 20 bp, Artificial Sequence
  chemically synthesized
tgttcttcttcctatatttt

SEQ ID NO: 574293 - DNA, 20 bp, Artificial Sequence
  chemically synthesized
ttctagaagttgtcctcttc

SEQ ID NO: 574294 - DNA, 20 bp, Artificial Sequence
  chemically synthesized
taaattccctcatgcactca

SEQ ID NO: 574295 - DNA, 20 bp, Artificial Sequence
  chemically synthesized
ttcttttgaattttaatcta

SEQ ID NO: 574296 - DNA, 20 bp, Artificial Sequence
  chemically synthesized
attttaatctaggaggattt

SEQ ID NO: 574297 - DNA, 20 bp, Artificial Sequence
  chemically synthesized
gtcaaaatcacaaaaatcct

SEQ ID NO: 574298 - DNA, 20 bp, Artificial Sequence
  chemically synthesized
tttgacaatagatgagtagt

SEQ ID NO: 574299 - DNA, 20 bp, Artificial Sequence
  chemically synthesized
acagtggtcttccaaatata

SEQ ID NO: 574300 - DNA, 20 bp, Artificial Sequence
  chemically synthesized
gcaacatttgtaatacagtt

SEQ ID NO: 574301 - DNA, 20 bp, Artificial Sequence
  chemically synthesized
ttggaaggcaacatttgtaa

SEQ ID NO: 574302 - DNA, 20 bp, Artificial Sequence
  chemically synthesized
attacatgacttgggtaagt

SEQ ID NO: 574303 - DNA, 20 bp, Artificial Sequence
  chemically synthesized
aaagggccaacacctagact

SEQ ID NO: 574304 - DNA, 20 bp, Artificial Sequence
  chemically synthesized
ccaacacctagactcctggc

SEQ ID NO: 574305 - DNA, 20 bp, Artificial Sequence
  chemically synthesized
tagactcctggcttttgatt

SEQ ID NO: 574306 - DNA, 20 bp, Artificial Sequence
  chemically synthesized
tgtgtgtgtgtgtattggtg

SEQ ID NO: 574307 - DNA, 20 bp, Artificial Sequence
  chemically synthesized
atcactttgactttgatatt

SEQ ID NO: 574308 - DNA, 20 bp, Artificial Sequence
  chemically synthesized
atcacttaatatcaaagtca

SEQ ID NO: 574309 - DNA, 20 bp, Artificial Sequence
  chemically synthesized
aaagtgatttcttgccctgt

SEQ ID NO: 574310 - DNA, 20 bp, Artificial Sequence
  chemically synthesized
gactgaatttgtgaaagacg

SEQ ID NO: 574311 - DNA, 20 bp, Artificial Sequence
  chemically synthesized
gtgaaagacggactgatttc

SEQ ID NO: 574312 - DNA, 20 bp, Artificial Sequence
  chemically synthesized
aagataacactgcactcaag

SEQ ID NO: 574313 - DNA, 20 bp, Artificial Sequence
  chemically synthesized
gggccctttgagagactcaa

SEQ ID NO: 574314 - DNA, 20 bp, Artificial Sequence
  chemically synthesized
agtcaaggtaccgtctactt

SEQ ID NO: 574315 - DNA, 20 bp, Artificial Sequence
  chemically synthesized
tgccaggatcccttgatcac

SEQ ID NO: 574316 - DNA, 20 bp, Artificial Sequence
  chemically synthesized
ccttgatcacctcagcttgg

SEQ ID NO: 574317 - DNA, 20 bp, Artificial Sequence
  chemically synthesized
actcagtattgacctcctca

SEQ ID NO: 574318 - DNA, 20 bp, Artificial Sequence
  chemically synthesized
ggagagagcccagaatgtca

SEQ ID NO: 574319 - DNA, 20 bp, Artificial Sequence
  chemically synthesized
gctctaaattggcaatatga

SEQ ID NO: 574320 - DNA, 20 bp, Artificial Sequence
  chemically synthesized
ttccagtatgacctttttga

SEQ ID NO: 574321 - DNA, 20 bp, Artificial Sequence
  chemically synthesized
agttgaacaagagggtaacc

SEQ ID NO: 574322 - DNA, 20 bp, Artificial Sequence
  chemically synthesized
aagagggtaacctactgatt

SEQ ID NO: 574323 - DNA, 20 bp, Artificial Sequence
  chemically synthesized
aacatctaaagtatatcttc

SEQ ID NO: 574324 - DNA, 20 bp, Artificial Sequence
  chemically synthesized
ccttatatcaatccgacaat

SEQ ID NO: 574325 - DNA, 20 bp, Artificial Sequence
  chemically synthesized
gcttaagtgaatcttaaatt

SEQ ID NO: 574326 - DNA, 20 bp, Artificial Sequence
  chemically synthesized
atcctaacgtttttctcctc

SEQ ID NO: 574327 - DNA, 20 bp, Artificial Sequence
  chemically synthesized
agagcttgtggtatgcatcc

SEQ ID NO: 574328 - DNA, 20 bp, Artificial Sequence
  chemically synthesized
agagcctgcctgaagtaaat

SEQ ID NO: 574329 - DNA, 20 bp, Artificial Sequence
  chemically synthesized
tcctcctcacagataactcc

SEQ ID NO: 574330 - DNA, 20 bp, Artificial Sequence
  chemically synthesized
tattttctaaatgttccaat

SEQ ID NO: 574331 - DNA, 20 bp, Artificial Sequence
  chemically synthesized
aactgattgctaatctcttt

SEQ ID NO: 574332 - DNA, 20 bp, Artificial Sequence
  chemically synthesized
cattcataaataaacatcaa

SEQ ID NO: 574333 - DNA, 20 bp, Artificial Sequence
  chemically synthesized
tgtttatttatgaatgcaca

SEQ ID NO: 574334 - DNA, 20 bp, Artificial Sequence
  chemically synthesized
tcataaactaccatgcataa

SEQ ID NO: 574335 - DNA, 20 bp, Artificial Sequence
  chemically synthesized
gcacaaactgatttatgcat

SEQ ID NO: 574336 - DNA, 20 bp, Artificial Sequence
  chemically synthesized
ccttatttttttttcagcat

SEQ ID NO: 574337 - DNA, 20 bp, Artificial Sequence
  chemically synthesized
cagcatctatgtttaatttg

SEQ ID NO: 574338 - DNA, 20 bp, Artificial Sequence
  chemically synthesized
aattacctctgggctcctgg

SEQ ID NO: 574339 - DNA, 20 bp, Artificial Sequence
  chemically synthesized
tcgtacagtctcaagagtac

SEQ ID NO: 574340 - DNA, 20 bp, Artificial Sequence
  chemically synthesized
gtactcatgattacaggttc

SEQ ID NO: 574341 - DNA, 20 bp, Artificial Sequence
  chemically synthesized
ctgtgaaatgagatgaaaag

SEQ ID NO: 574342 - DNA, 20 bp, Artificial Sequence
  chemically synthesized
gagatgaaaagaagtgctta

SEQ ID NO: 574343 - DNA, 20 bp, Artificial Sequence
  chemically synthesized
cataaacaagttctgagcac

SEQ ID NO: 574344 - DNA, 20 bp, Artificial Sequence
  chemically synthesized
attaatcctgggtgctcaga

SEQ ID NO: 574345 - DNA, 20 bp, Artificial Sequence
  chemically synthesized
aaagagatagaaattgacct

SEQ ID NO: 574346 - DNA, 20 bp, Artificial Sequence
  chemically synthesized
tttatacactgatggttata

SEQ ID NO: 574347 - DNA, 20 bp, Artificial Sequence
  chemically synthesized
atctgttaatgaggaaagcg

SEQ ID NO: 574348 - DNA, 20 bp, Artificial Sequence
  chemically synthesized
ccagaatagctttacaaaca

SEQ ID NO: 574349 - DNA, 20 bp, Artificial Sequence
  chemically synthesized
tgctccccccatctccccag

SEQ ID NO: 574350 - DNA, 20 bp, Artificial Sequence
  chemically synthesized
atgccctctcattgagataa

SEQ ID NO: 574351 - DNA, 20 bp, Artificial Sequence
  chemically synthesized
ctctcattgagataagagtg

SEQ ID NO: 574352 - DNA, 20 bp, Artificial Sequence
  chemically synthesized
ccatacttcaaatctacagc

SEQ ID NO: 574353 - DNA, 20 bp, Artificial Sequence
  chemically synthesized
atataccttgaaactttagc

SEQ ID NO: 574354 - DNA, 20 bp, Artificial Sequence
  chemically synthesized
taagtcctcattagccatgc

SEQ ID NO: 574355 - DNA, 20 bp, Artificial Sequence
  chemically synthesized
ctggatatccactatttggg

SEQ ID NO: 574356 - DNA, 20 bp, Artificial Sequence
  chemically synthesized
aaggtcctgcaaatggccct

SEQ ID NO: 574357 - DNA, 20 bp, Artificial Sequence
  chemically synthesized
gaattaactggtgattgtca

SEQ ID NO: 574358 - DNA, 20 bp, Artificial Sequence
  chemically synthesized
gacattttgacagaattaac

SEQ ID NO: 574359 - DNA, 20 bp, Artificial Sequence
  chemically synthesized
aaaagtattgagacttttct

SEQ ID NO: 574360 - DNA, 20 bp, Artificial Sequence
  chemically synthesized
gacctctttgagaatagtag

SEQ ID NO: 574361 - DNA, 20 bp, Artificial Sequence
  chemically synthesized
tggatgtaggaattgcggac

SEQ ID NO: 574362 - DNA, 20 bp, Artificial Sequence
  chemically synthesized
gataaaggaagattacagat

SEQ ID NO: 574363 - DNA, 20 bp, Artificial Sequence
  chemically synthesized
tcccctggataaaggaagat

SEQ ID NO: 574364 - DNA, 20 bp, Artificial Sequence
  chemically synthesized
ctcttgatcccctggataaa

SEQ ID NO: 574365 - DNA, 20 bp, Artificial Sequence
  chemically synthesized
atcaagagaaaaacaaaatg

SEQ ID NO: 574366 - DNA, 20 bp, Artificial Sequence
  chemically synthesized
ttgaaggcagaaactattca

SEQ ID NO: 574367 - DNA, 20 bp, Artificial Sequence
  chemically synthesized
atgaatagtttctgccttca

SEQ ID NO: 574368 - DNA, 20 bp, Artificial Sequence
  chemically synthesized
gtgtgaacttactgttttca

SEQ ID NO: 574369 - DNA, 20 bp, Artificial Sequence
  chemically synthesized
cactcgattatgtgtgaact

SEQ ID NO: 574370 - DNA, 20 bp, Artificial Sequence
  chemically synthesized
tacctcacgatccttttagc

SEQ ID NO: 574371 - DNA, 20 bp, Artificial Sequence
  chemically synthesized
ccattgaagagagttattga

SEQ ID NO: 574372 - DNA, 20 bp, Artificial Sequence
  chemically synthesized
tgctacataaatgctaatat

SEQ ID NO: 574373 - DNA, 20 bp, Artificial Sequence
  chemically synthesized
cagtaatatttgccctgatc

SEQ ID NO: 574374 - DNA, 20 bp, Artificial Sequence
  chemically synthesized
gtttttccccagtgaaagaa

SEQ ID NO: 574375 - DNA, 20 bp, Artificial Sequence
  chemically synthesized
ttcaaggaagaatactgcta

SEQ ID NO: 574376 - DNA, 20 bp, Artificial Sequence
  chemically synthesized
cttttgaatggtgaacaccg

SEQ ID NO: 574377 - DNA, 20 bp, Artificial Sequence
  chemically synthesized
cattttgcaaagtatcagac

SEQ ID NO: 574378 - DNA, 20 bp, Artificial Sequence
  chemically synthesized
cctgagtctgatactttgca

SEQ ID NO: 574379 - DNA, 20 bp, Artificial Sequence
  chemically synthesized
caattcaatagagaaaggga

SEQ ID NO: 574380 - DNA, 20 bp, Artificial Sequence
  chemically synthesized
ggagttctgtaagtagaata

SEQ ID NO: 574381 - DNA, 20 bp, Artificial Sequence
  chemically synthesized
gtaaataactcacgtatcta

SEQ ID NO: 574382 - DNA, 20 bp, Artificial Sequence
  chemically synthesized
ctagatacgtgagttattta

SEQ ID NO: 574383 - DNA, 20 bp, Artificial Sequence
  chemically synthesized
tttactctgcttacatataa

SEQ ID NO: 574384 - DNA, 20 bp, Artificial Sequence
  chemically synthesized
tcaagtgaaatatcaggaga

SEQ ID NO: 574385 - DNA, 20 bp, Artificial Sequence
  chemically synthesized
tgatatttcacttgaaatct

SEQ ID NO: 574386 - DNA, 20 bp, Artificial Sequence
  chemically synthesized
cacacacacacacacaaaca

SEQ ID NO: 574387 - DNA, 20 bp, Artificial Sequence
  chemically synthesized
tgtgttcagttgttgtattc

SEQ ID NO: 574388 - DNA, 20 bp, Artificial Sequence
  chemically synthesized
ttgtgttttttttcatacaa

SEQ ID NO: 574389 - DNA, 20 bp, Artificial Sequence
  chemically synthesized
tcaagtaaattatcattttg

SEQ ID NO: 574390 - DNA, 20 bp, Artificial Sequence
  chemically synthesized
attatcattttgcctagttt

SEQ ID NO: 574391 - DNA, 20 bp, Artificial Sequence
  chemically synthesized
tttgcattcaactttgtatt

SEQ ID NO: 574392 - DNA, 20 bp, Artificial Sequence
  chemically synthesized
aaatattcctaaatagaaag

SEQ ID NO: 574393 - DNA, 20 bp, Artificial Sequence
  chemically synthesized
atatggggaagaaaatcggg

SEQ ID NO: 574394 - DNA, 20 bp, Artificial Sequence
  chemically synthesized
tagcttctcctggaagcttt

SEQ ID NO: 574395 - DNA, 20 bp, Artificial Sequence
  chemically synthesized
tgtgattactagcttctcct

SEQ ID NO: 574396 - DNA, 20 bp, Artificial Sequence
  chemically synthesized
cttttgaattctatgtgatt

SEQ ID NO: 574397 - DNA, 20 bp, Artificial Sequence
  chemically synthesized
tgttcatgcttttgaattct

SEQ ID NO: 574398 - DNA, 20 bp, Artificial Sequence
  chemically synthesized
cttccttgaataagtcatgt

SEQ ID NO: 574399 - DNA, 20 bp, Artificial Sequence
  chemically synthesized
tatcggaatctcaagcaggc

SEQ ID NO: 574400 - DNA, 20 bp, Artificial Sequence
  chemically synthesized
ctctagaaacactggcctgc

SEQ ID NO: 574401 - DNA, 20 bp, Artificial Sequence
  chemically synthesized
tttatgctctagaaacactg

SEQ ID NO: 574402 - DNA, 20 bp, Artificial Sequence
  chemically synthesized
ctattgctatctggaaatac

SEQ ID NO: 574403 - DNA, 20 bp, Artificial Sequence
  chemically synthesized
agagaggcagagcttcaaat

SEQ ID NO: 574404 - DNA, 20 bp, Artificial Sequence
  chemically synthesized
catatgtgatcatagagagg

SEQ ID NO: 574405 - DNA, 20 bp, Artificial Sequence
  chemically synthesized
tgatcacatatggtccacta

SEQ ID NO: 574406 - DNA, 20 bp, Artificial Sequence
  chemically synthesized
aaggtaatcaggaacctttg

SEQ ID NO: 574407 - DNA, 20 bp, Artificial Sequence
  chemically synthesized
ggttaaaaccgttcaaaggt

SEQ ID NO: 574408 - DNA, 20 bp, Artificial Sequence
  chemically synthesized
agggagtggcacaggaatat

SEQ ID NO: 574409 - DNA, 20 bp, Artificial Sequence
  chemically synthesized
ttacaattgcctcattatct

SEQ ID NO: 574410 - DNA, 20 bp, Artificial Sequence
  chemically synthesized
ggcaattgtaagaattcagt

SEQ ID NO: 574411 - DNA, 20 bp, Artificial Sequence
  chemically synthesized
aagaattcagtgcaagatta

SEQ ID NO: 574412 - DNA, 20 bp, Artificial Sequence
  chemically synthesized
cagtcaccaaattttcacac

SEQ ID NO: 574413 - DNA, 20 bp, Artificial Sequence
  chemically synthesized
acctagacactaagtgtcat

SEQ ID NO: 574414 - DNA, 20 bp, Artificial Sequence
  chemically synthesized
atacttagttgaattgcacc

SEQ ID NO: 574415 - DNA, 20 bp, Artificial Sequence
  chemically synthesized
aggtgaactgagacatccag

SEQ ID NO: 574416 - DNA, 20 bp, Artificial Sequence
  chemically synthesized
tgggaagtttctcaggaggc

SEQ ID NO: 574417 - DNA, 20 bp, Artificial Sequence
  chemically synthesized
ctgagaaacttcccacacca

SEQ ID NO: 574418 - DNA, 20 bp, Artificial Sequence
  chemically synthesized
gatctaatctccatggtgtg

SEQ ID NO: 574419 - DNA, 20 bp, Artificial Sequence
  chemically synthesized
aggaacctaccctgagctat

SEQ ID NO: 574420 - DNA, 20 bp, Artificial Sequence
  chemically synthesized
gtctttctaacaacatagag

SEQ ID NO: 574421 - DNA, 20 bp, Artificial Sequence
  chemically synthesized
tctggaaatgtctccaaggt

SEQ ID NO: 574422 - DNA, 20 bp, Artificial Sequence
  chemically synthesized
gcccataccttggagacatt

SEQ ID NO: 574423 - DNA, 20 bp, Artificial Sequence
  chemically synthesized
accagctagccctgtgtgtc

SEQ ID NO: 574424 - DNA, 20 bp, Artificial Sequence
  chemically synthesized
acatgagacacacagggcta

SEQ ID NO: 574425 - DNA, 20 bp, Artificial Sequence
  chemically synthesized
taacaggcctgagtcctaat

SEQ ID NO: 574426 - DNA, 20 bp, Artificial Sequence
  chemically synthesized
ggaattaggactcaggcctg

SEQ ID NO: 574427 - DNA, 20 bp, Artificial Sequence
  chemically synthesized
ttctcctttataagcagaaa

SEQ ID NO: 574428 - DNA, 20 bp, Artificial Sequence
  chemically synthesized
agactaggaaaaatcatttt

SEQ ID NO: 574429 - DNA, 20 bp, Artificial Sequence
  chemically synthesized
acccagccactcaagtagga

SEQ ID NO: 574430 - DNA, 20 bp, Artificial Sequence
  chemically synthesized
ggtaattaaatgaaatctgc

SEQ ID NO: 574431 - DNA, 20 bp, Artificial Sequence
  chemically synthesized
atgaggggttctgaatcaga

SEQ ID NO: 574432 - DNA, 20 bp, Artificial Sequence
  chemically synthesized
gagtaagggactgtgatatg

SEQ ID NO: 574433 - DNA, 20 bp, Artificial Sequence
  chemically synthesized
tatttccttgtggaaggaat

SEQ ID NO: 574434 - DNA, 20 bp, Artificial Sequence
  chemically synthesized
cacaaggaaataataaattc

SEQ ID NO: 574435 - DNA, 20 bp, Artificial Sequence
  chemically synthesized
tacgttgagtgcctacatat

SEQ ID NO: 574436 - DNA, 20 bp, Artificial Sequence
  chemically synthesized
tctctcaagagatcctgttc

SEQ ID NO: 574437 - DNA, 20 bp, Artificial Sequence
  chemically synthesized
agaaaaggaacaaataggtg

SEQ ID NO: 574438 - DNA, 20 bp, Artificial Sequence
  chemically synthesized
atgctgatcttactttactt

SEQ ID NO: 574439 - DNA, 20 bp, Artificial Sequence
  chemically synthesized
tcctcagctatgcctacttc

SEQ ID NO: 574440 - DNA, 20 bp, Artificial Sequence
  chemically synthesized
tcagaaaaagaaaattgaac

SEQ ID NO: 574441 - DNA, 20 bp, Artificial Sequence
  chemically synthesized
agaagttctttttagcatag

SEQ ID NO: 574442 - DNA, 20 bp, Artificial Sequence
  chemically synthesized
agatggttggttaccctact

SEQ ID NO: 574443 - DNA, 20 bp, Artificial Sequence
  chemically synthesized
gcagtagggtaaccaaccat

SEQ ID NO: 574444 - DNA, 20 bp, Artificial Sequence
  chemically synthesized
ccatcttggtttgtccagca

SEQ ID NO: 574445 - DNA, 20 bp, Artificial Sequence
  chemically synthesized
actttcgatgttaaaaccag

SEQ ID NO: 574446 - DNA, 20 bp, Artificial Sequence
  chemically synthesized
tccaattttcctgaaactat

SEQ ID NO: 574447 - DNA, 20 bp, Artificial Sequence
  chemically synthesized
tatctagggtgaccaacttt

SEQ ID NO: 574448 - DNA, 20 bp, Artificial Sequence
  chemically synthesized
gaggtggagcttgcagtgag

SEQ ID NO: 574449 - DNA, 20 bp, Artificial Sequence
  chemically synthesized
aatggcatgaacctgggagg

SEQ ID NO: 574450 - DNA, 20 bp, Artificial Sequence
  chemically synthesized
ttttgtatttttagtagaga

SEQ ID NO: 574451 - DNA, 20 bp, Artificial Sequence
  chemically synthesized
cgccttggcctcccaaagtg

SEQ ID NO: 574452 - DNA, 20 bp, Artificial Sequence
  chemically synthesized
gtttttagtgccttaagttt

SEQ ID NO: 574453 - DNA, 20 bp, Artificial Sequence
  chemically synthesized
ctttttaagtttttagtgcc

SEQ ID NO: 574454 - DNA, 20 bp, Artificial Sequence
  chemically synthesized
caaatagtgccttggacttt

SEQ ID NO: 574455 - DNA, 20 bp, Artificial Sequence
  chemically synthesized
tagctttgaattatttactg

SEQ ID NO: 574456 - DNA, 20 bp, Artificial Sequence
  chemically synthesized
gtctctcacaatggatgctc

SEQ ID NO: 574457 - DNA, 20 bp, Artificial Sequence
  chemically synthesized
agcatccattgtgagagacc

SEQ ID NO: 574458 - DNA, 20 bp, Artificial Sequence
  chemically synthesized
atttcttaaatatgagtcat

SEQ ID NO: 574459 - DNA, 20 bp, Artificial Sequence
  chemically synthesized
aggcaacaatgtgaaaataa

SEQ ID NO: 574460 - DNA, 20 bp, Artificial Sequence
  chemically synthesized
agtggatggaagagagggtt

SEQ ID NO: 574461 - DNA, 20 bp, Artificial Sequence
  chemically synthesized
gattgtatctttagaatttc

SEQ ID NO: 574462 - DNA, 20 bp, Artificial Sequence
  chemically synthesized
atctttagaatttcaaaaga

SEQ ID NO: 574463 - DNA, 20 bp, Artificial Sequence
  chemically synthesized
aactatttctctctttttgt

SEQ ID NO: 574464 - DNA, 20 bp, Artificial Sequence
  chemically synthesized
taaaattacatattgttatt

SEQ ID NO: 574465 - DNA, 20 bp, Artificial Sequence
  chemically synthesized
aaagaggatcttacatataa

SEQ ID NO: 574466 - DNA, 20 bp, Artificial Sequence
  chemically synthesized
tctgatacatagtagttgct

SEQ ID NO: 574467 - DNA, 20 bp, Artificial Sequence
  chemically synthesized
aacagtgtctgatacatagt

SEQ ID NO: 574468 - DNA, 20 bp, Artificial Sequence
  chemically synthesized
catctgtggtctttgtagca

SEQ ID NO: 574469 - DNA, 20 bp, Artificial Sequence
  chemically synthesized
gtagcatggagcttaaaaca

SEQ ID NO: 574470 - DNA, 20 bp, Artificial Sequence
  chemically synthesized
tttttttactacataaagcc

SEQ ID NO: 574471 - DNA, 20 bp, Artificial Sequence
  chemically synthesized
ttattttaatgcagattcta

SEQ ID NO: 574472 - DNA, 20 bp, Artificial Sequence
  chemically synthesized
ttggctttccattattttaa

SEQ ID NO: 574473 - DNA, 20 bp, Artificial Sequence
  chemically synthesized
gagttattagatactgaaaa

SEQ ID NO: 574474 - DNA, 20 bp, Artificial Sequence
  chemically synthesized
caataaattatactacaaca

SEQ ID NO: 574475 - DNA, 20 bp, Artificial Sequence
  chemically synthesized
aggctcttgacattaaatat

SEQ ID NO: 574476 - DNA, 20 bp, Artificial Sequence
  chemically synthesized
agaatatttaatgtcaagag

SEQ ID NO: 574477 - DNA, 20 bp, Artificial Sequence
  chemically synthesized
gtgtcttgtctcccaaaaag

SEQ ID NO: 574478 - DNA, 20 bp, Artificial Sequence
  chemically synthesized
cccaaaaaggcctgtttgaa

SEQ ID NO: 574479 - DNA, 20 bp, Artificial Sequence
  chemically synthesized
agaaaatatatactcatata

SEQ ID NO: 574480 - DNA, 20 bp, Artificial Sequence
  chemically synthesized
cacataaaggaactgacttc

SEQ ID NO: 574481 - DNA, 20 bp, Artificial Sequence
  chemically synthesized
aaagataattttatctgttc

SEQ ID NO: 574482 - DNA, 20 bp, Artificial Sequence
  chemically synthesized
agaaaggtatggggaagagg

SEQ ID NO: 574483 - DNA, 20 bp, Artificial Sequence
  chemically synthesized
gaggtgctctacgtctttag

SEQ ID NO: 574484 - DNA, 20 bp, Artificial Sequence
  chemically synthesized
aaatgttaggaatactacac

SEQ ID NO: 574485 - DNA, 20 bp, Artificial Sequence
  chemically synthesized
tactacacagatgtttgtcc

SEQ ID NO: 574486 - DNA, 20 bp, Artificial Sequence
  chemically synthesized
agtgtagtagcatacttcat

SEQ ID NO: 574487 - DNA, 20 bp, Artificial Sequence
  chemically synthesized
tcataataaatagatttatc

SEQ ID NO: 574488 - DNA, 20 bp, Artificial Sequence
  chemically synthesized
ataattcaaccttcataata

SEQ ID NO: 574489 - DNA, 20 bp, Artificial Sequence
  chemically synthesized
ttatgaaggttgaattatct

SEQ ID NO: 574490 - DNA, 20 bp, Artificial Sequence
  chemically synthesized
acccggttggccagtaccta

SEQ ID NO: 574491 - DNA, 20 bp, Artificial Sequence
  chemically synthesized
taggtactggccaaccgggt

SEQ ID NO: 574492 - DNA, 20 bp, Artificial Sequence
  chemically synthesized
aactattggctccttaatga

SEQ ID NO: 574493 - DNA, 20 bp, Artificial Sequence
  chemically synthesized
atctttgtcattaaggagcc

SEQ ID NO: 574494 - DNA, 20 bp, Artificial Sequence
  chemically synthesized
ggtgtatacttttatattat

SEQ ID NO: 574495 - DNA, 20 bp, Artificial Sequence
  chemically synthesized
aaattgagatacagataagt

SEQ ID NO: 574496 - DNA, 20 bp, Artificial Sequence
  chemically synthesized
ttcactttagaattgcaaga

SEQ ID NO: 574497 - DNA, 20 bp, Artificial Sequence
  chemically synthesized
ttcagcttcactttagaatt

SEQ ID NO: 574498 - DNA, 20 bp, Artificial Sequence
  chemically synthesized
atgttttgttatcactcact

SEQ ID NO: 574499 - DNA, 20 bp, Artificial Sequence
  chemically synthesized
tattctaagtcagggagatt

SEQ ID NO: 574500 - DNA, 20 bp, Artificial Sequence
  chemically synthesized
ttccaaattattctaagtca

SEQ ID NO: 574501 - DNA, 20 bp, Artificial Sequence
  chemically synthesized
ccattaggattttccactta

SEQ ID NO: 574502 - DNA, 20 bp, Artificial Sequence
  chemically synthesized
tctgatttcttccatggcca

SEQ ID NO: 574503 - DNA, 20 bp, Artificial Sequence
  chemically synthesized
ctttcaggaattttttaagt

SEQ ID NO: 574504 - DNA, 20 bp, Artificial Sequence
  chemically synthesized
ctattactttcaggaatttt

SEQ ID NO: 574505 - DNA, 20 bp, Artificial Sequence
  chemically synthesized
gtaatagagaagaaccaagt

SEQ ID NO: 574506 - DNA, 20 bp, Artificial Sequence
  chemically synthesized
ctggagtgcagtggcacgat

SEQ ID NO: 574507 - DNA, 20 bp, Artificial Sequence
  chemically synthesized
aacctctgcctcctgggttc

SEQ ID NO: 574508 - DNA, 20 bp, Artificial Sequence
  chemically synthesized
ttttgtatttttagtagaga

SEQ ID NO: 574509 - DNA, 20 bp, Artificial Sequence
  chemically synthesized
cctgaggtcaggagtttgag

SEQ ID NO: 574510 - DNA, 20 bp, Artificial Sequence
  chemically synthesized
caaacggatcacctgaggtc

SEQ ID NO: 574511 - DNA, 20 bp, Artificial Sequence
  chemically synthesized
caaactcctgacctcaggtg

SEQ ID NO: 574512 - DNA, 20 bp, Artificial Sequence
  chemically synthesized
tgcctcggcctcgcaaagtg

SEQ ID NO: 574513 - DNA, 20 bp, Artificial Sequence
  chemically synthesized
tgtgagccaccacacctggc

SEQ ID NO: 574514 - DNA, 20 bp, Artificial Sequence
  chemically synthesized
tgattatttttttctgtccc

SEQ ID NO: 574515 - DNA, 20 bp, Artificial Sequence
  chemically synthesized
ttttttctgtccctcttgct

SEQ ID NO: 574516 - DNA, 20 bp, Artificial Sequence
  chemically synthesized
ggaggggatgaaaggtgaga

SEQ ID NO: 574517 - DNA, 20 bp, Artificial Sequence
  chemically synthesized
ggatgaaaggtgagatattg

SEQ ID NO: 574518 - DNA, 20 bp, Artificial Sequence
  chemically synthesized
catgacagggagaaaagcta

SEQ ID NO: 574519 - DNA, 20 bp, Artificial Sequence
  chemically synthesized
ctgtccccaggagaaagcaa

SEQ ID NO: 574520 - DNA, 20 bp, Artificial Sequence
  chemically synthesized
tcttgctttctcctggggac

SEQ ID NO: 574521 - DNA, 20 bp, Artificial Sequence
  chemically synthesized
ctatggatgtgagtaaaagc

SEQ ID NO: 574522 - DNA, 20 bp, Artificial Sequence
  chemically synthesized
acatctgtgttttgaaaagc

SEQ ID NO: 574523 - DNA, 20 bp, Artificial Sequence
  chemically synthesized
tgtacatgattgaaagacat

SEQ ID NO: 574524 - DNA, 20 bp, Artificial Sequence
  chemically synthesized
acagatgtctttcaatcatg

SEQ ID NO: 574525 - DNA, 20 bp, Artificial Sequence
  chemically synthesized
ttcagcgccaggcaagctgt

SEQ ID NO: 574526 - DNA, 20 bp, Artificial Sequence
  chemically synthesized
ttcatattgaaatggtaaat

SEQ ID NO: 574527 - DNA, 20 bp, Artificial Sequence
  chemically synthesized
gtagtatttctagtcattcc

SEQ ID NO: 574528 - DNA, 20 bp, Artificial Sequence
  chemically synthesized
cccaggatgattctaggaag

SEQ ID NO: 574529 - DNA, 20 bp, Artificial Sequence
  chemically synthesized
ccacttcagcctgcctccca

SEQ ID NO: 574530 - DNA, 20 bp, Artificial Sequence
  chemically synthesized
tgttctgagtggcagaagcc

SEQ ID NO: 574531 - DNA, 20 bp, Artificial Sequence
  chemically synthesized
cccagcccaggcttgaagcc

SEQ ID NO: 574532 - DNA, 20 bp, Artificial Sequence
  chemically synthesized
cagccaggttctggcccagc

SEQ ID NO: 574533 - DNA, 20 bp, Artificial Sequence
  chemically synthesized
tgaggacacagaggagcagg

SEQ ID NO: 574534 - DNA, 20 bp, Artificial Sequence
  chemically synthesized
actggatgttagaacttaga

SEQ ID NO: 574535 - DNA, 20 bp, Artificial Sequence
  chemically synthesized
gccgattaatgatcttaaca

SEQ ID NO: 574536 - DNA, 20 bp, Artificial Sequence
  chemically synthesized
ccaccatagagcaggcctgt

SEQ ID NO: 574537 - DNA, 20 bp, Artificial Sequence
  chemically synthesized
ccacaggcctgctctatggt

SEQ ID NO: 574538 - DNA, 20 bp, Artificial Sequence
  chemically synthesized
ctgctaagcatcgttattat

SEQ ID NO: 574539 - DNA, 20 bp, Artificial Sequence
  chemically synthesized
tttttaagcatcgataataa

SEQ ID NO: 574540 - DNA, 20 bp, Artificial Sequence
  chemically synthesized
cgatgcttaaaaaccatagc

SEQ ID NO: 574541 - DNA, 20 bp, Artificial Sequence
  chemically synthesized
actatatgccaagctatggc

SEQ ID NO: 574542 - DNA, 20 bp, Artificial Sequence
  chemically synthesized
gtgttctgtatcttagtcaa

SEQ ID NO: 574543 - DNA, 20 bp, Artificial Sequence
  chemically synthesized
agtgtgttatatgaaggcca

SEQ ID NO: 574544 - DNA, 20 bp, Artificial Sequence
  chemically synthesized
caagttgatttagatgcaaa

SEQ ID NO: 574545 - DNA, 20 bp, Artificial Sequence
  chemically synthesized
gtccaggctttcccctgcaa

SEQ ID NO: 574546 - DNA, 20 bp, Artificial Sequence
  chemically synthesized
ttcacttatgattcatgagt

SEQ ID NO: 574547 - DNA, 20 bp, Artificial Sequence
  chemically synthesized
tacagcattaattttttcac

SEQ ID NO: 574548 - DNA, 20 bp, Artificial Sequence
  chemically synthesized
ccagtaactcagcagtgaca

SEQ ID NO: 574549 - DNA, 20 bp, Artificial Sequence
  chemically synthesized
tagcattgccttcttcaacc

SEQ ID NO: 574550 - DNA, 20 bp, Artificial Sequence
  chemically synthesized
tcaacctagtgatttcttaa

SEQ ID NO: 574551 - DNA, 20 bp, Artificial Sequence
  chemically synthesized
gttcaaaccatggaacttct

SEQ ID NO: 574552 - DNA, 20 bp, Artificial Sequence
  chemically synthesized
gtccaaacactcagaagttc

SEQ ID NO: 574553 - DNA, 20 bp, Artificial Sequence
  chemically synthesized
agaagttccatggtttgaac

SEQ ID NO: 574554 - DNA, 20 bp, Artificial Sequence
  chemically synthesized
ccatggtttgaactgctgct

SEQ ID NO: 574555 - DNA, 20 bp, Artificial Sequence
  chemically synthesized
tggggctttttctgtagtct

SEQ ID NO: 574556 - DNA, 20 bp, Artificial Sequence
  chemically synthesized
ctgtaacttgatctgtattt

SEQ ID NO: 574557 - DNA, 20 bp, Artificial Sequence
  chemically synthesized
cttattttttatgtctcctg

SEQ ID NO: 574558 - DNA, 20 bp, Artificial Sequence
  chemically synthesized
gcatttggtaaaatattctt

SEQ ID NO: 574559 - DNA, 20 bp, Artificial Sequence
  chemically synthesized
tcgcttttaagttaactgag

SEQ ID NO: 574560 - DNA, 20 bp, Artificial Sequence
  chemically synthesized
ttgcttgcccttttccaaga

SEQ ID NO: 574561 - DNA, 20 bp, Artificial Sequence
  chemically synthesized
accctgccatgtacatcctg

SEQ ID NO: 574562 - DNA, 20 bp, Artificial Sequence
  chemically synthesized
tgccaccctgccatgtacat

SEQ ID NO: 574563 - DNA, 20 bp, Artificial Sequence
  chemically synthesized
atgaacccctatgaatttgc

SEQ ID NO: 574564 - DNA, 20 bp, Artificial Sequence
  chemically synthesized
tcttccatgaacccctatga

SEQ ID NO: 574565 - DNA, 20 bp, Artificial Sequence
  chemically synthesized
atggagcaaacaacagaaag

SEQ ID NO: 574566 - DNA, 20 bp, Artificial Sequence
  chemically synthesized
ttaagggaaacctctctttc

SEQ ID NO: 574567 - DNA, 20 bp, Artificial Sequence
  chemically synthesized
gttcttatctcaataagaaa

SEQ ID NO: 574568 - DNA, 20 bp, Artificial Sequence
  chemically synthesized
aatggcgtgaacctgggaga

SEQ ID NO: 574569 - DNA, 20 bp, Artificial Sequence
  chemically synthesized
ttttgtatttttagtagaga

SEQ ID NO: 574570 - DNA, 20 bp, Artificial Sequence
  chemically synthesized
attgtgcctatagttaacaa

SEQ ID NO: 574571 - DNA, 20 bp, Artificial Sequence
  chemically synthesized
gagttgttgctcaatggata

SEQ ID NO: 574572 - DNA, 20 bp, Artificial Sequence
  chemically synthesized
atggcaaccatttttctact

SEQ ID NO: 574573 - DNA, 20 bp, Artificial Sequence
  chemically synthesized
tttttctactctctgcttct

SEQ ID NO: 574574 - DNA, 20 bp, Artificial Sequence
  chemically synthesized
agctttttgtcatcttattt

SEQ ID NO: 574575 - DNA, 20 bp, Artificial Sequence
  chemically synthesized
gaagtggagtgaaaataagg

SEQ ID NO: 574576 - DNA, 20 bp, Artificial Sequence
  chemically synthesized
ttctgaataaaagtgaagat

SEQ ID NO: 574577 - DNA, 20 bp, Artificial Sequence
  chemically synthesized
aagtatcagatacatccatt

SEQ ID NO: 574578 - DNA, 20 bp, Artificial Sequence
  chemically synthesized
acaacaatattaatttataa

SEQ ID NO: 574579 - DNA, 20 bp, Artificial Sequence
  chemically synthesized
aacatatttcaggcctgaaa

SEQ ID NO: 574580 - DNA, 20 bp, Artificial Sequence
  chemically synthesized
atgttttttcattgactata

SEQ ID NO: 574581 - DNA, 20 bp, Artificial Sequence
  chemically synthesized
ttttccccttatacactcaa

SEQ ID NO: 574582 - DNA, 20 bp, Artificial Sequence
  chemically synthesized
tttgagtgtataaggggaaa

SEQ ID NO: 574583 - DNA, 20 bp, Artificial Sequence
  chemically synthesized
tgtgtttaacaaactctgtg

SEQ ID NO: 574584 - DNA, 20 bp, Artificial Sequence
  chemically synthesized
cagaaaaataaatctcaaca

SEQ ID NO: 574585 - DNA, 20 bp, Artificial Sequence
  chemically synthesized
tttctggaagtctttgaaaa

SEQ ID NO: 574586 - DNA, 20 bp, Artificial Sequence
  chemically synthesized
ttgatctcagagaatacaat

SEQ ID NO: 574587 - DNA, 20 bp, Artificial Sequence
  chemically synthesized
gcacgggctagaatagtcca

SEQ ID NO: 574588 - DNA, 20 bp, Artificial Sequence
  chemically synthesized
ggtctgtgatactatggagg

SEQ ID NO: 574589 - DNA, 20 bp, Artificial Sequence
  chemically synthesized
gcgcacacagcatcttgaac

SEQ ID NO: 574590 - DNA, 20 bp, Artificial Sequence
  chemically synthesized
gactcttaattctaaggctg

SEQ ID NO: 574591 - DNA, 20 bp, Artificial Sequence
  chemically synthesized
tcagtaggaagtaacttccc

SEQ ID NO: 574592 - DNA, 20 bp, Artificial Sequence
  chemically synthesized
aaatggccacgggaactaga

SEQ ID NO: 574593 - DNA, 20 bp, Artificial Sequence
  chemically synthesized
ttccctaaatggccacggga

SEQ ID NO: 574594 - DNA, 20 bp, Artificial Sequence
  chemically synthesized
taggtcattaagcctaaact

SEQ ID NO: 574595 - DNA, 20 bp, Artificial Sequence
  chemically synthesized
taatttccaaatcttaaagt

SEQ ID NO: 574596 - DNA, 20 bp, Artificial Sequence
  chemically synthesized
cagaagtaatttccaaatct

SEQ ID NO: 574597 - DNA, 20 bp, Artificial Sequence
  chemically synthesized
ctgaaatgttagtagaaatg

SEQ ID NO: 574598 - DNA, 20 bp, Artificial Sequence
  chemically synthesized
atacacaaattaatttgtca

SEQ ID NO: 574599 - DNA, 20 bp, Artificial Sequence
  chemically synthesized
tcaagatactgagccaaaat

SEQ ID NO: 574600 - DNA, 20 bp, Artificial Sequence
  chemically synthesized
ttgatagacagacacaaagg

SEQ ID NO: 574601 - DNA, 20 bp, Artificial Sequence
  chemically synthesized
gaatgaaccagggttccatt

SEQ ID NO: 574602 - DNA, 20 bp, Artificial Sequence
  chemically synthesized
gaatgatcacgtttgagtgt

SEQ ID NO: 574603 - DNA, 20 bp, Artificial Sequence
  chemically synthesized
tgagaaagacttgggaatga

SEQ ID NO: 574604 - DNA, 20 bp, Artificial Sequence
  chemically synthesized
tcaaggaaaattctgaggtc

SEQ ID NO: 574605 - DNA, 20 bp, Artificial Sequence
  chemically synthesized
cctcagaattttccttgact

SEQ ID NO: 574606 - DNA, 20 bp, Artificial Sequence
  chemically synthesized
aacttaagatagatagaatg

SEQ ID NO: 574607 - DNA, 20 bp, Artificial Sequence
  chemically synthesized
ggtggagtcatctcagaagg

SEQ ID NO: 574608 - DNA, 20 bp, Artificial Sequence
  chemically synthesized
ccaccctccttttctgtgtc

SEQ ID NO: 574609 - DNA, 20 bp, Artificial Sequence
  chemically synthesized
gggatgatgtgatctgattt

SEQ ID NO: 574610 - DNA, 20 bp, Artificial Sequence
  chemically synthesized
ctctcagcagggatgatgtg

SEQ ID NO: 574611 - DNA, 20 bp, Artificial Sequence
  chemically synthesized
ccctgctgagagccttccag

SEQ ID NO: 574612 - DNA, 20 bp, Artificial Sequence
  chemically synthesized
cttgcaggccatagtttgga

SEQ ID NO: 574613 - DNA, 20 bp, Artificial Sequence
  chemically synthesized
taatgaatggtcttgcaggc

SEQ ID NO: 574614 - DNA, 20 bp, Artificial Sequence
  chemically synthesized
tcaaaagcccaatggtaaga

SEQ ID NO: 574615 - DNA, 20 bp, Artificial Sequence
  chemically synthesized
ctcaaaacctgttcttacca

SEQ ID NO: 574616 - DNA, 20 bp, Artificial Sequence
  chemically synthesized
taccattgggcttttgaatt

SEQ ID NO: 574617 - DNA, 20 bp, Artificial Sequence
  chemically synthesized
tgcctagaatcctcttcatt

SEQ ID NO: 574618 - DNA, 20 bp, Artificial Sequence
  chemically synthesized
catgcaaaaaccttgaatga

SEQ ID NO: 574619 - DNA, 20 bp, Artificial Sequence
  chemically synthesized
ctcttcattcaaggtttttg

SEQ ID NO: 574620 - DNA, 20 bp, Artificial Sequence
  chemically synthesized
tgcatggtttactcactcac

SEQ ID NO: 574621 - DNA, 20 bp, Artificial Sequence
  chemically synthesized
ggtttactcactcacacagg

SEQ ID NO: 574622 - DNA, 20 bp, Artificial Sequence
  chemically synthesized
tactcactcacacaggtttt

SEQ ID NO: 574623 - DNA, 20 bp, Artificial Sequence
  chemically synthesized
cactcacacaggttttgttt

SEQ ID NO: 574624 - DNA, 20 bp, Artificial Sequence
  chemically synthesized
gaggcggaggttgaagtgaa

SEQ ID NO: 574625 - DNA, 20 bp, Artificial Sequence
  chemically synthesized
aacctccgcctcccaagttc

SEQ ID NO: 574626 - DNA, 20 bp, Artificial Sequence
  chemically synthesized
ccaggaggctgaggtaccag

SEQ ID NO: 574627 - DNA, 20 bp, Artificial Sequence
  chemically synthesized
ggcacgtgtcaccacgccca

SEQ ID NO: 574628 - DNA, 20 bp, Artificial Sequence
  chemically synthesized
cagctagtttttggtagaaa

SEQ ID NO: 574629 - DNA, 20 bp, Artificial Sequence
  chemically synthesized
gcctggccaacatagtgaaa

SEQ ID NO: 574630 - DNA, 20 bp, Artificial Sequence
  chemically synthesized
agtttcactatgttggccag

SEQ ID NO: 574631 - DNA, 20 bp, Artificial Sequence
  chemically synthesized
ctcttgacgtccagggatct

SEQ ID NO: 574632 - DNA, 20 bp, Artificial Sequence
  chemically synthesized
tgtttcagccacccaaagtg

SEQ ID NO: 574633 - DNA, 20 bp, Artificial Sequence
  chemically synthesized
actcctcaatctttctctat

SEQ ID NO: 574634 - DNA, 20 bp, Artificial Sequence
  chemically synthesized
ataaacaaagcatgaataga

SEQ ID NO: 574635 - DNA, 20 bp, Artificial Sequence
  chemically synthesized
tcaatctttctctattcatg

SEQ ID NO: 574636 - DNA, 20 bp, Artificial Sequence
  chemically synthesized
ataatttcatatattaattt

SEQ ID NO: 574637 - DNA, 20 bp, Artificial Sequence
  chemically synthesized
agtctctgcccctatggatg

SEQ ID NO: 574638 - DNA, 20 bp, Artificial Sequence
  chemically synthesized
aaatgagtctctgcccctat

SEQ ID NO: 574639 - DNA, 20 bp, Artificial Sequence
  chemically synthesized
gactcattttgttccctaac

SEQ ID NO: 574640 - DNA, 20 bp, Artificial Sequence
  chemically synthesized
taggaaaaattataccataa

SEQ ID NO: 574641 - DNA, 20 bp, Artificial Sequence
  chemically synthesized
tggtataatttttcctaaaa

SEQ ID NO: 574642 - DNA, 20 bp, Artificial Sequence
  chemically synthesized
catttaattacaaatgatcc

SEQ ID NO: 574643 - DNA, 20 bp, Artificial Sequence
  chemically synthesized
taaatgaataatgtgtgtaa

SEQ ID NO: 574644 - DNA, 20 bp, Artificial Sequence
  chemically synthesized
aaggcaaaacactatgcaga

SEQ ID NO: 574645 - DNA, 20 bp, Artificial Sequence
  chemically synthesized
tctttaaaacagtatctgca

SEQ ID NO: 574646 - DNA, 20 bp, Artificial Sequence
  chemically synthesized
gagagaagactggtagagaa

SEQ ID NO: 574647 - DNA, 20 bp, Artificial Sequence
  chemically synthesized
gagtcatctaggaattgctg

SEQ ID NO: 574648 - DNA, 20 bp, Artificial Sequence
  chemically synthesized
gaactgagtcatctaggaat

SEQ ID NO: 574649 - DNA, 20 bp, Artificial Sequence
  chemically synthesized
attcctagatgactcagttc

SEQ ID NO: 574650 - DNA, 20 bp, Artificial Sequence
  chemically synthesized
tcttcagttttgatgataaa

SEQ ID NO: 574651 - DNA, 20 bp, Artificial Sequence
  chemically synthesized
taagtctaagtcttctgaaa

SEQ ID NO: 574652 - DNA, 20 bp, Artificial Sequence
  chemically synthesized
tagttttcagaagacttaga

SEQ ID NO: 574653 - DNA, 20 bp, Artificial Sequence
  chemically synthesized
ctattcttcatcatttttgt

SEQ ID NO: 574654 - DNA, 20 bp, Artificial Sequence
  chemically synthesized
gtagatataactaacagtca

SEQ ID NO: 574655 - DNA, 20 bp, Artificial Sequence
  chemically synthesized
cattcaatgacctggcctct

SEQ ID NO: 574656 - DNA, 20 bp, Artificial Sequence
  chemically synthesized
tgagccaccgcgcccggcca

SEQ ID NO: 574657 - DNA, 20 bp, Artificial Sequence
  chemically synthesized
cgcctcagcctcccaaagtg

SEQ ID NO: 574658 - DNA, 20 bp, Artificial Sequence
  chemically synthesized
ttttgtatttttagtagaga

SEQ ID NO: 574659 - DNA, 20 bp, Artificial Sequence
  chemically synthesized
cacccaccaccacacctggc

SEQ ID NO: 574660 - DNA, 20 bp, Artificial Sequence
  chemically synthesized
aatggcgtgaacccaggagg

SEQ ID NO: 574661 - DNA, 20 bp, Artificial Sequence
  chemically synthesized
aacaaccaaaagttgcgata

SEQ ID NO: 574662 - DNA, 20 bp, Artificial Sequence
  chemically synthesized
atcactctatcgcaactttt

SEQ ID NO: 574663 - DNA, 20 bp, Artificial Sequence
  chemically synthesized
ttggatgtcatttgtgaatg

SEQ ID NO: 574664 - DNA, 20 bp, Artificial Sequence
  chemically synthesized
atgttagcttgacgagtttt

SEQ ID NO: 574665 - DNA, 20 bp, Artificial Sequence
  chemically synthesized
ttagtatgtatgttagcttg

SEQ ID NO: 574666 - DNA, 20 bp, Artificial Sequence
  chemically synthesized
ggatacattttagtatgtat

SEQ ID NO: 574667 - DNA, 20 bp, Artificial Sequence
  chemically synthesized
tcattctgttatcagtgctg

SEQ ID NO: 574668 - DNA, 20 bp, Artificial Sequence
  chemically synthesized
aaataaatgtataatctaca

SEQ ID NO: 574669 - DNA, 20 bp, Artificial Sequence
  chemically synthesized
aaattatcctgaaatcatgt

SEQ ID NO: 574670 - DNA, 20 bp, Artificial Sequence
  chemically synthesized
tcaggtcatatattatgcat

SEQ ID NO: 574671 - DNA, 20 bp, Artificial Sequence
  chemically synthesized
aaatgaaaaggcttgaataa

SEQ ID NO: 574672 - DNA, 20 bp, Artificial Sequence
  chemically synthesized
tggatgctgttgacaaatga

SEQ ID NO: 574673 - DNA, 20 bp, Artificial Sequence
  chemically synthesized
gtcaacagcatccaagcaat

SEQ ID NO: 574674 - DNA, 20 bp, Artificial Sequence
  chemically synthesized
aagagtggacagaaagccat

SEQ ID NO: 574675 - DNA, 20 bp, Artificial Sequence
  chemically synthesized
cactcttttaataatgtatg

SEQ ID NO: 574676 - DNA, 20 bp, Artificial Sequence
  chemically synthesized
agcttcccgagattttctgg

SEQ ID NO: 574677 - DNA, 20 bp, Artificial Sequence
  chemically synthesized
atcttaaccagaaaatctcg

SEQ ID NO: 574678 - DNA, 20 bp, Artificial Sequence
  chemically synthesized
aaggataccttcaaagcttc

SEQ ID NO: 574679 - DNA, 20 bp, Artificial Sequence
  chemically synthesized
gagatcattaaggatacctt

SEQ ID NO: 574680 - DNA, 20 bp, Artificial Sequence
  chemically synthesized
atccttaatgatctctaggg

SEQ ID NO: 574681 - DNA, 20 bp, Artificial Sequence
  chemically synthesized
gatctctagggaagggatta

SEQ ID NO: 574682 - DNA, 20 bp, Artificial Sequence
  chemically synthesized
actaatgaaattgtttgtca

SEQ ID NO: 574683 - DNA, 20 bp, Artificial Sequence
  chemically synthesized
gtttgcctttttactaatga

SEQ ID NO: 574684 - DNA, 20 bp, Artificial Sequence
  chemically synthesized
caacagtgtaggtaatgact

SEQ ID NO: 574685 - DNA, 20 bp, Artificial Sequence
  chemically synthesized
aaatccaaatggagattaga

SEQ ID NO: 574686 - DNA, 20 bp, Artificial Sequence
  chemically synthesized
caatcaagatctaatctcca

SEQ ID NO: 574687 - DNA, 20 bp, Artificial Sequence
  chemically synthesized
cctcctaccccaaatccaaa

SEQ ID NO: 574688 - DNA, 20 bp, Artificial Sequence
  chemically synthesized
aggaagggagttgaataagc

SEQ ID NO: 574689 - DNA, 20 bp, Artificial Sequence
  chemically synthesized
aaggagaactgcaataaaac

SEQ ID NO: 574690 - DNA, 20 bp, Artificial Sequence
  chemically synthesized
ttctccttagaaattcccca

SEQ ID NO: 574691 - DNA, 20 bp, Artificial Sequence
  chemically synthesized
acttctgtgattaacctaga

SEQ ID NO: 574692 - DNA, 20 bp, Artificial Sequence
  chemically synthesized
tatttattacttgtctactt

SEQ ID NO: 574693 - DNA, 20 bp, Artificial Sequence
  chemically synthesized
gctcaagtaaaacaaaggaa

SEQ ID NO: 574694 - DNA, 20 bp, Artificial Sequence
  chemically synthesized
atattttaaaaactgacttc

SEQ ID NO: 574695 - DNA, 20 bp, Artificial Sequence
  chemically synthesized
ttacttgcctcactagactg

SEQ ID NO: 574696 - DNA, 20 bp, Artificial Sequence
  chemically synthesized
atgtcttttgaatacattat

SEQ ID NO: 574697 - DNA, 20 bp, Artificial Sequence
  chemically synthesized
ttcaaaagacataaaaattg

SEQ ID NO: 574698 - DNA, 20 bp, Artificial Sequence
  chemically synthesized
ttatatttgctaaggcatat

SEQ ID NO: 574699 - DNA, 20 bp, Artificial Sequence
  chemically synthesized
tgcagttgttatgctgccca

SEQ ID NO: 574700 - DNA, 20 bp, Artificial Sequence
  chemically synthesized
tctactcccatgggtgtgaa

SEQ ID NO: 574701 - DNA, 20 bp, Artificial Sequence
  chemically synthesized
tgtttttctttgtataccat

SEQ ID NO: 574702 - DNA, 20 bp, Artificial Sequence
  chemically synthesized
tacaaagaaaaacacaaatt

SEQ ID NO: 574703 - DNA, 20 bp, Artificial Sequence
  chemically synthesized
atgtttacaaaacaggtaat

SEQ ID NO: 574704 - DNA, 20 bp, Artificial Sequence
  chemically synthesized
aattacctgttttgtaaaca

SEQ ID NO: 574705 - DNA, 20 bp, Artificial Sequence
  chemically synthesized
ctttcattttctataaatca

SEQ ID NO: 574706 - DNA, 20 bp, Artificial Sequence
  chemically synthesized
tgaaagtgaaaatgaacaac

SEQ ID NO: 574707 - DNA, 20 bp, Artificial Sequence
  chemically synthesized
gaaaatgaacaacatttgat

SEQ ID NO: 574708 - DNA, 20 bp, Artificial Sequence
  chemically synthesized
tttcaactattgacatttta

SEQ ID NO: 574709 - DNA, 20 bp, Artificial Sequence
  chemically synthesized
aaattattaatatcctttgc

SEQ ID NO: 574710 - DNA, 20 bp, Artificial Sequence
  chemically synthesized
tgccacttttttaaaaagtc

SEQ ID NO: 574711 - DNA, 20 bp, Artificial Sequence
  chemically synthesized
gcactctaaatacttgcgga

SEQ ID NO: 574712 - DNA, 20 bp, Artificial Sequence
  chemically synthesized
acagtgacccatcttgatac

SEQ ID NO: 574713 - DNA, 20 bp, Artificial Sequence
  chemically synthesized
tatgggtttcttgatttaat

SEQ ID NO: 574714 - DNA, 20 bp, Artificial Sequence
  chemically synthesized
tgtattgctctttatgggtt

SEQ ID NO: 574715 - DNA, 20 bp, Artificial Sequence
  chemically synthesized
tgtacattgtattgctcttt

SEQ ID NO: 574716 - DNA, 20 bp, Artificial Sequence
  chemically synthesized
tggacttttgttttactttg

SEQ ID NO: 574717 - DNA, 20 bp, Artificial Sequence
  chemically synthesized
cagatcttatatttgtggac

SEQ ID NO: 574718 - DNA, 20 bp, Artificial Sequence
  chemically synthesized
tagatcttgatggaattttg

SEQ ID NO: 574719 - DNA, 20 bp, Artificial Sequence
  chemically synthesized
caggagatctgatacgcaga

SEQ ID NO: 574720 - DNA, 20 bp, Artificial Sequence
  chemically synthesized
ctgatacgcagatccagttt

SEQ ID NO: 574721 - DNA, 20 bp, Artificial Sequence
  chemically synthesized
tttccattgttcttttgccc

SEQ ID NO: 574722 - DNA, 20 bp, Artificial Sequence
  chemically synthesized
gtttagtagcctgtttgact

SEQ ID NO: 574723 - DNA, 20 bp, Artificial Sequence
  chemically synthesized
gatgagagaacagtttagta

SEQ ID NO: 574724 - DNA, 20 bp, Artificial Sequence
  chemically synthesized
ctcctgagtgctgatgagag

SEQ ID NO: 574725 - DNA, 20 bp, Artificial Sequence
  chemically synthesized
tcagcactcaggagcgatga

SEQ ID NO: 574726 - DNA, 20 bp, Artificial Sequence
  chemically synthesized
tgatgttgtttgaggaagga

SEQ ID NO: 574727 - DNA, 20 bp, Artificial Sequence
  chemically synthesized
tttttcttaaagataccaag

SEQ ID NO: 574728 - DNA, 20 bp, Artificial Sequence
  chemically synthesized
tagtttggcgcaatgctttt

SEQ ID NO: 574729 - DNA, 20 bp, Artificial Sequence
  chemically synthesized
cttttacttgtagtttggcg

SEQ ID NO: 574730 - DNA, 20 bp, Artificial Sequence
  chemically synthesized
tacgacatacagcttttact

SEQ ID NO: 574731 - DNA, 20 bp, Artificial Sequence
  chemically synthesized
acaagtaaaagctgtatgtc

SEQ ID NO: 574732 - DNA, 20 bp, Artificial Sequence
  chemically synthesized
gcttcaataaacatacgaca

SEQ ID NO: 574733 - DNA, 20 bp, Artificial Sequence
  chemically synthesized
cacgcctttgctattgtgaa

SEQ ID NO: 574734 - DNA, 20 bp, Artificial Sequence
  chemically synthesized
caaatgcccatcaatgatat

SEQ ID NO: 574735 - DNA, 20 bp, Artificial Sequence
  chemically synthesized
gacatgatctcatccttttt

SEQ ID NO: 574736 - DNA, 20 bp, Artificial Sequence
  chemically synthesized
gtttgctgagaatgatggtt

SEQ ID NO: 574737 - DNA, 20 bp, Artificial Sequence
  chemically synthesized
tctgttagtttgctgagaat

SEQ ID NO: 574738 - DNA, 20 bp, Artificial Sequence
  chemically synthesized
gtttggttttcggttcctct

SEQ ID NO: 574739 - DNA, 20 bp, Artificial Sequence
  chemically synthesized
atgagtgagaccatgcagtg

SEQ ID NO: 574740 - DNA, 20 bp, Artificial Sequence
  chemically synthesized
cacttatgagtgagaccatg

SEQ ID NO: 574741 - DNA, 20 bp, Artificial Sequence
  chemically synthesized
tccctgtgtccatatgtttt

SEQ ID NO: 574742 - DNA, 20 bp, Artificial Sequence
  chemically synthesized
atgttcccctccctgtgtcc

SEQ ID NO: 574743 - DNA, 20 bp, Artificial Sequence
  chemically synthesized
cataggtatacatgtgccat

SEQ ID NO: 574744 - DNA, 20 bp, Artificial Sequence
  chemically synthesized
gggatacatgtgcagaaagt

SEQ ID NO: 574745 - DNA, 20 bp, Artificial Sequence
  chemically synthesized
gtgtagagctactttgatgc

SEQ ID NO: 574746 - DNA, 20 bp, Artificial Sequence
  chemically synthesized
gctctacacactttacaaaa

SEQ ID NO: 574747 - DNA, 20 bp, Artificial Sequence
  chemically synthesized
ccttcttatttacaggagtt

SEQ ID NO: 574748 - DNA, 20 bp, Artificial Sequence
  chemically synthesized
ggtattcccttcttatttac

SEQ ID NO: 574749 - DNA, 20 bp, Artificial Sequence
  chemically synthesized
aatgtgctgagtagaaaaat

SEQ ID NO: 574750 - DNA, 20 bp, Artificial Sequence
  chemically synthesized
ccaaaaatcttcttgaagga

SEQ ID NO: 574751 - DNA, 20 bp, Artificial Sequence
  chemically synthesized
ttgctaaaccatgtccttca

SEQ ID NO: 574752 - DNA, 20 bp, Artificial Sequence
  chemically synthesized
tctacttttctataacatag

SEQ ID NO: 574753 - DNA, 20 bp, Artificial Sequence
  chemically synthesized
gtcaaatgtagacaacaggg

SEQ ID NO: 574754 - DNA, 20 bp, Artificial Sequence
  chemically synthesized
caatgtccgagccaagatgt

SEQ ID NO: 574755 - DNA, 20 bp, Artificial Sequence
  chemically synthesized
gagtgggtgggtataggtaa

SEQ ID NO: 574756 - DNA, 20 bp, Artificial Sequence
  chemically synthesized
ttctgcgtgtccctcttatg

SEQ ID NO: 574757 - DNA, 20 bp, Artificial Sequence
  chemically synthesized
tttcctagatgctcttccct

SEQ ID NO: 574758 - DNA, 20 bp, Artificial Sequence
  chemically synthesized
acaagggtgacaaggcacta

SEQ ID NO: 574759 - DNA, 20 bp, Artificial Sequence
  chemically synthesized
tagtgccttgtcacccttgt

SEQ ID NO: 574760 - DNA, 20 bp, Artificial Sequence
  chemically synthesized
ttaagataaggactgatata

SEQ ID NO: 574761 - DNA, 20 bp, Artificial Sequence
  chemically synthesized
aaggactgatataattggat

SEQ ID NO: 574762 - DNA, 20 bp, Artificial Sequence
  chemically synthesized
aattggatttatgtttttta

SEQ ID NO: 574763 - DNA, 20 bp, Artificial Sequence
  chemically synthesized
agattattctgactgaaatg

SEQ ID NO: 574764 - DNA, 20 bp, Artificial Sequence
  chemically synthesized
cctggccaatttaccttcaa

SEQ ID NO: 574765 - DNA, 20 bp, Artificial Sequence
  chemically synthesized
tgtcttggcctcccaaagtg

SEQ ID NO: 574766 - DNA, 20 bp, Artificial Sequence
  chemically synthesized
gtttgtatttttagtagaga

SEQ ID NO: 574767 - DNA, 20 bp, Artificial Sequence
  chemically synthesized
cacgcgccaccatgcccacc

SEQ ID NO: 574768 - DNA, 20 bp, Artificial Sequence
  chemically synthesized
tcgggaggctgaggcgggag

SEQ ID NO: 574769 - DNA, 20 bp, Artificial Sequence
  chemically synthesized
gaggcggaggttgcagtgag

SEQ ID NO: 574770 - DNA, 20 bp, Artificial Sequence
  chemically synthesized
agagtctcggaatatttagc

SEQ ID NO: 574771 - DNA, 20 bp, Artificial Sequence
  chemically synthesized
ggaatatttagctagagttt

SEQ ID NO: 574772 - DNA, 20 bp, Artificial Sequence
  chemically synthesized
tagctagagttttggagttt

SEQ ID NO: 574773 - DNA, 20 bp, Artificial Sequence
  chemically synthesized
aacaaaaagataaagaagca

SEQ ID NO: 574774 - DNA, 20 bp, Artificial Sequence
  chemically synthesized
gttttcaaaagtctgaaacc

SEQ ID NO: 574775 - DNA, 20 bp, Artificial Sequence
  chemically synthesized
caatcatctaaattttaata

SEQ ID NO: 574776 - DNA, 20 bp, Artificial Sequence
  chemically synthesized
aaaacaagttattaaaattt

SEQ ID NO: 574777 - DNA, 20 bp, Artificial Sequence
  chemically synthesized
ttacctccttccaaatacaa

SEQ ID NO: 574778 - DNA, 20 bp, Artificial Sequence
  chemically synthesized
cttccagcccattgattact

SEQ ID NO: 574779 - DNA, 20 bp, Artificial Sequence
  chemically synthesized
atttcacaggacttccagcc

SEQ ID NO: 574780 - DNA, 20 bp, Artificial Sequence
  chemically synthesized
aatccgtccccacttggtta

SEQ ID NO: 574781 - DNA, 20 bp, Artificial Sequence
  chemically synthesized
aagcacactaaccaagtggg

SEQ ID NO: 574782 - DNA, 20 bp, Artificial Sequence
  chemically synthesized
cccaagtcatgttctttgtc

SEQ ID NO: 574783 - DNA, 20 bp, Artificial Sequence
  chemically synthesized
tattcctggttattagtttt

SEQ ID NO: 574784 - DNA, 20 bp, Artificial Sequence
  chemically synthesized
ctgcttcactattcctggtt

SEQ ID NO: 574785 - DNA, 20 bp, Artificial Sequence
  chemically synthesized
agccagtattttgttataaa

SEQ ID NO: 574786 - DNA, 20 bp, Artificial Sequence
  chemically synthesized
aaattggtccaaataattgc

SEQ ID NO: 574787 - DNA, 20 bp, Artificial Sequence
  chemically synthesized
atatttcttcataagatgga

SEQ ID NO: 574788 - DNA, 20 bp, Artificial Sequence
  chemically synthesized
ctagtcatatttcttcataa

SEQ ID NO: 574789 - DNA, 20 bp, Artificial Sequence
  chemically synthesized
gtgcactaggagtcaggaga

SEQ ID NO: 574790 - DNA, 20 bp, Artificial Sequence
  chemically synthesized
tgactcctagtgcacatgtc

SEQ ID NO: 574791 - DNA, 20 bp, Artificial Sequence
  chemically synthesized
atgtccagtgattcattttc

SEQ ID NO: 574792 - DNA, 20 bp, Artificial Sequence
  chemically synthesized
aaaggcccatccttctcaat

SEQ ID NO: 574793 - DNA, 20 bp, Artificial Sequence
  chemically synthesized
gcttttctatatgtacacca

SEQ ID NO: 574794 - DNA, 20 bp, Artificial Sequence
  chemically synthesized
tatgtacaccagagtgtttt

SEQ ID NO: 574795 - DNA, 20 bp, Artificial Sequence
  chemically synthesized
gggtgaaatgtaatggtgct

SEQ ID NO: 574796 - DNA, 20 bp, Artificial Sequence
  chemically synthesized
catatatttctgaatattaa

SEQ ID NO: 574797 - DNA, 20 bp, Artificial Sequence
  chemically synthesized
aaatggctaaaggagaaact

SEQ ID NO: 574798 - DNA, 20 bp, Artificial Sequence
  chemically synthesized
aaaaaaatgccagggaaact

SEQ ID NO: 574799 - DNA, 20 bp, Artificial Sequence
  chemically synthesized
tggcatcttgaggaaaggtc

SEQ ID NO: 574800 - DNA, 20 bp, Artificial Sequence
  chemically synthesized
acaaaagtggtaccatttta

SEQ ID NO: 574801 - DNA, 20 bp, Artificial Sequence
  chemically synthesized
gtttttattatttggtagta

SEQ ID NO: 574802 - DNA, 20 bp, Artificial Sequence
  chemically synthesized
tattatttggtagtaatttg

SEQ ID NO: 574803 - DNA, 20 bp, Artificial Sequence
  chemically synthesized
ggtgtagagtggatactgat

SEQ ID NO: 574804 - DNA, 20 bp, Artificial Sequence
  chemically synthesized
taagctctgagtgaaaaagg

SEQ ID NO: 574805 - DNA, 20 bp, Artificial Sequence
  chemically synthesized
aaatctctgcctttttcact

SEQ ID NO: 574806 - DNA, 20 bp, Artificial Sequence
  chemically synthesized
gaccaattatttctttgttt

SEQ ID NO: 574807 - DNA, 20 bp, Artificial Sequence
  chemically synthesized
cgatgaccaattatttcttt

SEQ ID NO: 574808 - DNA, 20 bp, Artificial Sequence
  chemically synthesized
ccaacgatgaccaattattt

SEQ ID NO: 574809 - DNA, 20 bp, Artificial Sequence
  chemically synthesized
attggtaaaattgaaacgta

SEQ ID NO: 574810 - DNA, 20 bp, Artificial Sequence
  chemically synthesized
tttcataccgaacaagcaaa

SEQ ID NO: 574811 - DNA, 20 bp, Artificial Sequence
  chemically synthesized
ctggggtaggtctatgaaaa

SEQ ID NO: 574812 - DNA, 20 bp, Artificial Sequence
  chemically synthesized
ccttgttttctctttttgtg

SEQ ID NO: 574813 - DNA, 20 bp, Artificial Sequence
  chemically synthesized
tcaggaggtggtatataatg

SEQ ID NO: 574814 - DNA, 20 bp, Artificial Sequence
  chemically synthesized
ggtttggctttttttggcaa

SEQ ID NO: 574815 - DNA, 20 bp, Artificial Sequence
  chemically synthesized
atagtttgattgtatttggg

SEQ ID NO: 574816 - DNA, 20 bp, Artificial Sequence
  chemically synthesized
gttctatagtttgattgtat

SEQ ID NO: 574817 - DNA, 20 bp, Artificial Sequence
  chemically synthesized
ttgaacagtgcagttctata

SEQ ID NO: 574818 - DNA, 20 bp, Artificial Sequence
  chemically synthesized
ccgattgaacagtgcagttc

SEQ ID NO: 574819 - DNA, 20 bp, Artificial Sequence
  chemically synthesized
agccagatgttgccagtagc

SEQ ID NO: 574820 - DNA, 20 bp, Artificial Sequence
  chemically synthesized
ctgtaaatgtacattttttc

SEQ ID NO: 574821 - DNA, 20 bp, Artificial Sequence
  chemically synthesized
tagtttccctgtatctttca

SEQ ID NO: 574822 - DNA, 20 bp, Artificial Sequence
  chemically synthesized
acagtaagtttctaaaatag

SEQ ID NO: 574823 - DNA, 20 bp, Artificial Sequence
  chemically synthesized
gaagtaattacagattcaca

SEQ ID NO: 574824 - DNA, 20 bp, Artificial Sequence
  chemically synthesized
actttttgtttggaagtaat

SEQ ID NO: 574825 - DNA, 20 bp, Artificial Sequence
  chemically synthesized
tagttggtctttttattact

SEQ ID NO: 574826 - DNA, 20 bp, Artificial Sequence
  chemically synthesized
ctaaccaaagtaaggtgtgg

SEQ ID NO: 574827 - DNA, 20 bp, Artificial Sequence
  chemically synthesized
ttatttaaaccaaaaccaga

SEQ ID NO: 574828 - DNA, 20 bp, Artificial Sequence
  chemically synthesized
ttttttaaactttttctggt

SEQ ID NO: 574829 - DNA, 20 bp, Artificial Sequence
  chemically synthesized
tatgcattttttaaactttt

SEQ ID NO: 574830 - DNA, 20 bp, Artificial Sequence
  chemically synthesized
aggtaatcaccttgctacta

SEQ ID NO: 574831 - DNA, 20 bp, Artificial Sequence
  chemically synthesized
tcaaaagcattatagtagca

SEQ ID NO: 574832 - DNA, 20 bp, Artificial Sequence
  chemically synthesized
atatttcaaaaggttaaaag

SEQ ID NO: 574833 - DNA, 20 bp, Artificial Sequence
  chemically synthesized
taaaataacacacgcctgat

SEQ ID NO: 574834 - DNA, 20 bp, Artificial Sequence
  chemically synthesized
ttattctatagctcttccca

SEQ ID NO: 574835 - DNA, 20 bp, Artificial Sequence
  chemically synthesized
ttatttattctatagctctt

SEQ ID NO: 574836 - DNA, 20 bp, Artificial Sequence
  chemically synthesized
tatagaataaataagatctg

SEQ ID NO: 574837 - DNA, 20 bp, Artificial Sequence
  chemically synthesized
ttgttgatgtcttgatgagt

SEQ ID NO: 574838 - DNA, 20 bp, Artificial Sequence
  chemically synthesized
gttcaatatttttcatcatg

SEQ ID NO: 574839 - DNA, 20 bp, Artificial Sequence
  chemically synthesized
tctcttttggctatataaaa

SEQ ID NO: 574840 - DNA, 20 bp, Artificial Sequence
  chemically synthesized
tttatatagccaaaagagat

SEQ ID NO: 574841 - DNA, 20 bp, Artificial Sequence
  chemically synthesized
aaagggtattattaacacaa

SEQ ID NO: 574842 - DNA, 20 bp, Artificial Sequence
  chemically synthesized
gtgtttgacatttacagtgt

SEQ ID NO: 574843 - DNA, 20 bp, Artificial Sequence
  chemically synthesized
tgacatttacagtgtaatgg

SEQ ID NO: 574844 - DNA, 20 bp, Artificial Sequence
  chemically synthesized
cccttgggtgagaagagtaa

SEQ ID NO: 574845 - DNA, 20 bp, Artificial Sequence
  chemically synthesized
agtgactattttaaaattaa

SEQ ID NO: 574846 - DNA, 20 bp, Artificial Sequence
  chemically synthesized
aaattaattttaaaatagtc

SEQ ID NO: 574847 - DNA, 20 bp, Artificial Sequence
  chemically synthesized
aaaatagtcactggattact

SEQ ID NO: 574848 - DNA, 20 bp, Artificial Sequence
  chemically synthesized
tgcttaacatgtgcaaggca

SEQ ID NO: 574849 - DNA, 20 bp, Artificial Sequence
  chemically synthesized
gtcctaccctatgtacatcg

SEQ ID NO: 574850 - DNA, 20 bp, Artificial Sequence
  chemically synthesized
gtcgcctccaataggtgcct

SEQ ID NO: 574851 - DNA, 20 bp, Artificial Sequence
  chemically synthesized
gttcctgcagagaaaggtgc

SEQ ID NO: 574852 - DNA, 20 bp, Artificial Sequence
  chemically synthesized
agacgcttccactggtcaga

SEQ ID NO: 574853 - DNA, 20 bp, Artificial Sequence
  chemically synthesized
agaatatctagaagtgtaat

SEQ ID NO: 574854 - DNA, 20 bp, Artificial Sequence
  chemically synthesized
agactgctttgtagttcaca

SEQ ID NO: 574855 - DNA, 20 bp, Artificial Sequence
  chemically synthesized
gtagccagatttttattcaa

SEQ ID NO: 574856 - DNA, 20 bp, Artificial Sequence
  chemically synthesized
gtggctctcaaaagtaagta

SEQ ID NO: 574857 - DNA, 20 bp, Artificial Sequence
  chemically synthesized
ttgagagccacaaaacagag

SEQ ID NO: 574858 - DNA, 20 bp, Artificial Sequence
  chemically synthesized
aaaattgccatcaaactatc

SEQ ID NO: 574859 - DNA, 20 bp, Artificial Sequence
  chemically synthesized
atggcaattttgagaaaagg

SEQ ID NO: 574860 - DNA, 20 bp, Artificial Sequence
  chemically synthesized
agaaaaggcagtgtttagcc

SEQ ID NO: 574861 - DNA, 20 bp, Artificial Sequence
  chemically synthesized
atgaaatacacactggaatc

SEQ ID NO: 574862 - DNA, 20 bp, Artificial Sequence
  chemically synthesized
ctacaacagtatggaaaagc

SEQ ID NO: 574863 - DNA, 20 bp, Artificial Sequence
  chemically synthesized
gcagtgactaatgaaaaaca

SEQ ID NO: 574864 - DNA, 20 bp, Artificial Sequence
  chemically synthesized
gcatgagtcacatgaaaacg

SEQ ID NO: 574865 - DNA, 20 bp, Artificial Sequence
  chemically synthesized
ccttctttatttgtgtgcac

SEQ ID NO: 574866 - DNA, 20 bp, Artificial Sequence
  chemically synthesized
gcacctgggatttgtcttca

SEQ ID NO: 574867 - DNA, 20 bp, Artificial Sequence
  chemically synthesized
cttcaccaagtttcaacatt

SEQ ID NO: 574868 - DNA, 20 bp, Artificial Sequence
  chemically synthesized
ccaagtttcaacattttctg

SEQ ID NO: 574869 - DNA, 20 bp, Artificial Sequence
  chemically synthesized
ggggaagctttcagataaat

SEQ ID NO: 574870 - DNA, 20 bp, Artificial Sequence
  chemically synthesized
gtaaaatcagacatttatct

SEQ ID NO: 574871 - DNA, 20 bp, Artificial Sequence
  chemically synthesized
ctaaattattcatgttcggg

SEQ ID NO: 574872 - DNA, 20 bp, Artificial Sequence
  chemically synthesized
aataatttaggcaggagact

SEQ ID NO: 574873 - DNA, 20 bp, Artificial Sequence
  chemically synthesized
gtgtattcttaaatggcttc

SEQ ID NO: 574874 - DNA, 20 bp, Artificial Sequence
  chemically synthesized
cattcatttgtgtattctta

SEQ ID NO: 574875 - DNA, 20 bp, Artificial Sequence
  chemically synthesized
cttctcatcttcaagtgaaa

SEQ ID NO: 574876 - DNA, 20 bp, Artificial Sequence
  chemically synthesized
atgatgatttattttattaa

SEQ ID NO: 574877 - DNA, 20 bp, Artificial Sequence
  chemically synthesized
tttcctctttgttttctgga

SEQ ID NO: 574878 - DNA, 20 bp, Artificial Sequence
  chemically synthesized
ttgctaacactgcgtttcct

SEQ ID NO: 574879 - DNA, 20 bp, Artificial Sequence
  chemically synthesized
aagaggaaacgcagtgttag

SEQ ID NO: 574880 - DNA, 20 bp, Artificial Sequence
  chemically synthesized
aagataaagctttgctaaca

SEQ ID NO: 574881 - DNA, 20 bp, Artificial Sequence
  chemically synthesized
atttctaatttacctgaaga

SEQ ID NO: 574882 - DNA, 20 bp, Artificial Sequence
  chemically synthesized
agtaattgctgataatagct

SEQ ID NO: 574883 - DNA, 20 bp, Artificial Sequence
  chemically synthesized
taataaagactttaacgctg

SEQ ID NO: 574884 - DNA, 20 bp, Artificial Sequence
  chemically synthesized
aatgttgctccacctggttg

SEQ ID NO: 574885 - DNA, 20 bp, Artificial Sequence
  chemically synthesized
agggaaatgttgctccacct

SEQ ID NO: 574886 - DNA, 20 bp, Artificial Sequence
  chemically synthesized
ttcccttagccatttggtaa

SEQ ID NO: 574887 - DNA, 20 bp, Artificial Sequence
  chemically synthesized
agataagtattctttggtga

SEQ ID NO: 574888 - DNA, 20 bp, Artificial Sequence
  chemically synthesized
ttcagtagataagtattctt

SEQ ID NO: 574889 - DNA, 20 bp, Artificial Sequence
  chemically synthesized
tattgtcaaattatccttca

SEQ ID NO: 574890 - DNA, 20 bp, Artificial Sequence
  chemically synthesized
atgtgcaaagacaatgaccc

SEQ ID NO: 574891 - DNA, 20 bp, Artificial Sequence
  chemically synthesized
aatgttatatatagcatcat

SEQ ID NO: 574892 - DNA, 20 bp, Artificial Sequence
  chemically synthesized
gaatatttaagttgtttctg

SEQ ID NO: 574893 - DNA, 20 bp, Artificial Sequence
  chemically synthesized
atattgaatatttaagttgt

SEQ ID NO: 574894 - DNA, 20 bp, Artificial Sequence
  chemically synthesized
tccctcatattgaatattta

SEQ ID NO: 574895 - DNA, 20 bp, Artificial Sequence
  chemically synthesized
ttaaatattcaatatgaggg

SEQ ID NO: 574896 - DNA, 20 bp, Artificial Sequence
  chemically synthesized
agaaatgcaaaaccccaacc

SEQ ID NO: 574897 - DNA, 20 bp, Artificial Sequence
  chemically synthesized
atgcaaaaccccaacctact

SEQ ID NO: 574898 - DNA, 20 bp, Artificial Sequence
  chemically synthesized
tttgaaaacaatcagtaggt

SEQ ID NO: 574899 - DNA, 20 bp, Artificial Sequence
  chemically synthesized
tcaaatgtaatgaaacttgt

SEQ ID NO: 574900 - DNA, 20 bp, Artificial Sequence
  chemically synthesized
tttctaaatttaaagcatat

SEQ ID NO: 574901 - DNA, 20 bp, Artificial Sequence
  chemically synthesized
gtcatcatattgaaccttgc

SEQ ID NO: 574902 - DNA, 20 bp, Artificial Sequence
  chemically synthesized
aaaaatgtatttgttttgta

SEQ ID NO: 574903 - DNA, 20 bp, Artificial Sequence
  chemically synthesized
tagaaaaattcaaaaaatgt

SEQ ID NO: 574904 - DNA, 20 bp, Artificial Sequence
  chemically synthesized
acaaatacatacacatacac

SEQ ID NO: 574905 - DNA, 20 bp, Artificial Sequence
  chemically synthesized
atgtgtatgtatttgtatgc

SEQ ID NO: 574906 - DNA, 20 bp, Artificial Sequence
  chemically synthesized
caaccaggttatccctcaga

SEQ ID NO: 574907 - DNA, 20 bp, Artificial Sequence
  chemically synthesized
tccctcagaggtagatttac

SEQ ID NO: 574908 - DNA, 20 bp, Artificial Sequence
  chemically synthesized
cttgacaatttggaaaagta

SEQ ID NO: 574909 - DNA, 20 bp, Artificial Sequence
  chemically synthesized
ctttctacttttccaaattg

SEQ ID NO: 574910 - DNA, 20 bp, Artificial Sequence
  chemically synthesized
gccttcatttttcctggaca

SEQ ID NO: 574911 - DNA, 20 bp, Artificial Sequence
  chemically synthesized
ttcatgacatttatggtatt

SEQ ID NO: 574912 - DNA, 20 bp, Artificial Sequence
  chemically synthesized
gaattgaatataatagtgca

SEQ ID NO: 574913 - DNA, 20 bp, Artificial Sequence
  chemically synthesized
acaattagaggtcagttctt

SEQ ID NO: 574914 - DNA, 20 bp, Artificial Sequence
  chemically synthesized
cttgcatggggaattgtcgc

SEQ ID NO: 574915 - DNA, 20 bp, Artificial Sequence
  chemically synthesized
taaaatcttgcatggggaat

SEQ ID NO: 574916 - DNA, 20 bp, Artificial Sequence
  chemically synthesized
cctaagcgacaattccccat

SEQ ID NO: 574917 - DNA, 20 bp, Artificial Sequence
  chemically synthesized
aattccccatgcaagatttt

SEQ ID NO: 574918 - DNA, 20 bp, Artificial Sequence
  chemically synthesized
aattccagacaccccaagga

SEQ ID NO: 574919 - DNA, 20 bp, Artificial Sequence
  chemically synthesized
tccttggggtgtctggaatt

SEQ ID NO: 574920 - DNA, 20 bp, Artificial Sequence
  chemically synthesized
tccacctacttttcaatatg

SEQ ID NO: 574921 - DNA, 20 bp, Artificial Sequence
  chemically synthesized
tcagtgtcttttctaccatt

SEQ ID NO: 574922 - DNA, 20 bp, Artificial Sequence
  chemically synthesized
gcagcaaatggtagaaaaga

SEQ ID NO: 574923 - DNA, 20 bp, Artificial Sequence
  chemically synthesized
agagagaatataacgatgac

SEQ ID NO: 574924 - DNA, 20 bp, Artificial Sequence
  chemically synthesized
acctctctgccacaaggata

SEQ ID NO: 574925 - DNA, 20 bp, Artificial Sequence
  chemically synthesized
cctatgttaagacctcaagc

SEQ ID NO: 574926 - DNA, 20 bp, Artificial Sequence
  chemically synthesized
gttaagacctcaagctgcgg

SEQ ID NO: 574927 - DNA, 20 bp, Artificial Sequence
  chemically synthesized
cttccttacataaacaaagc

SEQ ID NO: 574928 - DNA, 20 bp, Artificial Sequence
  chemically synthesized
ttgggaggctgatgcaggag

SEQ ID NO: 574929 - DNA, 20 bp, Artificial Sequence
  chemically synthesized
tgcatcagcctcccaagtgg

SEQ ID NO: 574930 - DNA, 20 bp, Artificial Sequence
  chemically synthesized
tttggtatttttagtagaga

SEQ ID NO: 574931 - DNA, 20 bp, Artificial Sequence
  chemically synthesized
ctgaattcccggctgggtgt

SEQ ID NO: 574932 - DNA, 20 bp, Artificial Sequence
  chemically synthesized
aacttccctatttcatgcta

SEQ ID NO: 574933 - DNA, 20 bp, Artificial Sequence
  chemically synthesized
tctcttgactgtcctctgtc

SEQ ID NO: 574934 - DNA, 20 bp, Artificial Sequence
  chemically synthesized
gtccccttacccagatatgt

SEQ ID NO: 574935 - DNA, 20 bp, Artificial Sequence
  chemically synthesized
tctgaaattttatctaactc

SEQ ID NO: 574936 - DNA, 20 bp, Artificial Sequence
  chemically synthesized
tggagttagataaaatttca

SEQ ID NO: 574937 - DNA, 20 bp, Artificial Sequence
  chemically synthesized
atcatcctaactacatatca

SEQ ID NO: 574938 - DNA, 20 bp, Artificial Sequence
  chemically synthesized
tcacatttttcctttcactc

SEQ ID NO: 574939 - DNA, 20 bp, Artificial Sequence
  chemically synthesized
gtcctttgtaagtttttcgc

SEQ ID NO: 574940 - DNA, 20 bp, Artificial Sequence
  chemically synthesized
ttctctgtcctttgtaagtt

SEQ ID NO: 574941 - DNA, 20 bp, Artificial Sequence
  chemically synthesized
ctcagtgttctctgtccttt

SEQ ID NO: 574942 - DNA, 20 bp, Artificial Sequence
  chemically synthesized
aggttgaatacatttgtata

SEQ ID NO: 574943 - DNA, 20 bp, Artificial Sequence
  chemically synthesized
acacactatagtttgagacc

SEQ ID NO: 574944 - DNA, 20 bp, Artificial Sequence
  chemically synthesized
caaatgtttcttatacacac

SEQ ID NO: 574945 - DNA, 20 bp, Artificial Sequence
  chemically synthesized
gtgtgtataagaaacatttg

SEQ ID NO: 574946 - DNA, 20 bp, Artificial Sequence
  chemically synthesized
gtataagaaacatttgagta

SEQ ID NO: 574947 - DNA, 20 bp, Artificial Sequence
  chemically synthesized
caattttaaacaagctactc

SEQ ID NO: 574948 - DNA, 20 bp, Artificial Sequence
  chemically synthesized
tttgagtagcttgtttaaaa

SEQ ID NO: 574949 - DNA, 20 bp, Artificial Sequence
  chemically synthesized
tctataattctatcaacaat

SEQ ID NO: 574950 - DNA, 20 bp, Artificial Sequence
  chemically synthesized
gtgaaggttcttgttgaaag

SEQ ID NO: 574951 - DNA, 20 bp, Artificial Sequence
  chemically synthesized
gctttatcaaagaatggttc

SEQ ID NO: 574952 - DNA, 20 bp, Artificial Sequence
  chemically synthesized
catatcagaaatgctttaat

SEQ ID NO: 574953 - DNA, 20 bp, Artificial Sequence
  chemically synthesized
taatgtttggggcatatcag

SEQ ID NO: 574954 - DNA, 20 bp, Artificial Sequence
  chemically synthesized
gccctgtggagaccaagaag

SEQ ID NO: 574955 - DNA, 20 bp, Artificial Sequence
  chemically synthesized
aaaggtggcatttgtcagtg

SEQ ID NO: 574956 - DNA, 20 bp, Artificial Sequence
  chemically synthesized
gggcttaacatggtcaaaga

SEQ ID NO: 574957 - DNA, 20 bp, Artificial Sequence
  chemically synthesized
ttgaccatgttaagcccgtg

SEQ ID NO: 574958 - DNA, 20 bp, Artificial Sequence
  chemically synthesized
atgtgacttgaaaacatttc

SEQ ID NO: 574959 - DNA, 20 bp, Artificial Sequence
  chemically synthesized
catgaaaataaaaatagggc

SEQ ID NO: 574960 - DNA, 20 bp, Artificial Sequence
  chemically synthesized
tgtatataccagatattttg

SEQ ID NO: 574961 - DNA, 20 bp, Artificial Sequence
  chemically synthesized
gatattttgaaatgattaac

SEQ ID NO: 574962 - DNA, 20 bp, Artificial Sequence
  chemically synthesized
tgtggaatatctcctcctga

SEQ ID NO: 574963 - DNA, 20 bp, Artificial Sequence
  chemically synthesized
gttggggttggaaggaacct

SEQ ID NO: 574964 - DNA, 20 bp, Artificial Sequence
  chemically synthesized
gagagattatagttcaacct

SEQ ID NO: 574965 - DNA, 20 bp, Artificial Sequence
  chemically synthesized
ttgttttgcatatgtagaaa

SEQ ID NO: 574966 - DNA, 20 bp, Artificial Sequence
  chemically synthesized
gctgttttatacctttgcaa

SEQ ID NO: 574967 - DNA, 20 bp, Artificial Sequence
  chemically synthesized
ctcaagttatgtttttcagc

SEQ ID NO: 574968 - DNA, 20 bp, Artificial Sequence
  chemically synthesized
tctaaataggacagctcaag

SEQ ID NO: 574969 - DNA, 20 bp, Artificial Sequence
  chemically synthesized
taaggattttctcatctaac

SEQ ID NO: 574970 - DNA, 20 bp, Artificial Sequence
  chemically synthesized
tgagaaaatccttaaacctt

SEQ ID NO: 574971 - DNA, 20 bp, Artificial Sequence
  chemically synthesized
tggttaaaaccactaaggtt

SEQ ID NO: 574972 - DNA, 20 bp, Artificial Sequence
  chemically synthesized
aaacatttggttaaaaccac

SEQ ID NO: 574973 - DNA, 20 bp, Artificial Sequence
  chemically synthesized
aaaccttagtggttttaacc

SEQ ID NO: 574974 - DNA, 20 bp, Artificial Sequence
  chemically synthesized
tgtttttgatctctgaacaa

SEQ ID NO: 574975 - DNA, 20 bp, Artificial Sequence
  chemically synthesized
tgcagtttgctatgtacaga

SEQ ID NO: 574976 - DNA, 20 bp, Artificial Sequence
  chemically synthesized
ctgtacatagcaaactgcaa

SEQ ID NO: 574977 - DNA, 20 bp, Artificial Sequence
  chemically synthesized
gcttacatgccaagctgggt

SEQ ID NO: 574978 - DNA, 20 bp, Artificial Sequence
  chemically synthesized
gaatgtactcttaagttgca

SEQ ID NO: 574979 - DNA, 20 bp, Artificial Sequence
  chemically synthesized
gcctcagccaatcccagcag

SEQ ID NO: 574980 - DNA, 20 bp, Artificial Sequence
  chemically synthesized
gattagctgaaacttgactg

SEQ ID NO: 574981 - DNA, 20 bp, Artificial Sequence
  chemically synthesized
tgagctgatcagtttacagc

SEQ ID NO: 574982 - DNA, 20 bp, Artificial Sequence
  chemically synthesized
ccttatatggacatgagctg

SEQ ID NO: 574983 - DNA, 20 bp, Artificial Sequence
  chemically synthesized
acagaaacagcttgactggt

SEQ ID NO: 574984 - DNA, 20 bp, Artificial Sequence
  chemically synthesized
ttctaagctgtaaccagtca

SEQ ID NO: 574985 - DNA, 20 bp, Artificial Sequence
  chemically synthesized
aaaaggaagtgacatacaga

SEQ ID NO: 574986 - DNA, 20 bp, Artificial Sequence
  chemically synthesized
tgcctgcccaccttgctggg

SEQ ID NO: 574987 - DNA, 20 bp, Artificial Sequence
  chemically synthesized
aacttctaattctgagtact

SEQ ID NO: 574988 - DNA, 20 bp, Artificial Sequence
  chemically synthesized
tgagtactgtctgattcatg

SEQ ID NO: 574989 - DNA, 20 bp, Artificial Sequence
  chemically synthesized
tttagacaaattccgttttg

SEQ ID NO: 574990 - DNA, 20 bp, Artificial Sequence
  chemically synthesized
tctgcaaaacggaatttgtc

SEQ ID NO: 574991 - DNA, 20 bp, Artificial Sequence
  chemically synthesized
aaagacaaactttagacaaa

SEQ ID NO: 574992 - DNA, 20 bp, Artificial Sequence
  chemically synthesized
attgctaattgtcaaatata

SEQ ID NO: 574993 - DNA, 20 bp, Artificial Sequence
  chemically synthesized
aaaagaggtggttcaaaggg

SEQ ID NO: 574994 - DNA, 20 bp, Artificial Sequence
  chemically synthesized
aggtggttcaaaggggcatg

SEQ ID NO: 574995 - DNA, 20 bp, Artificial Sequence
  chemically synthesized
taagctcttgtcttcactaa

SEQ ID NO: 574996 - DNA, 20 bp, Artificial Sequence
  chemically synthesized
taatctttattagtgaagac

SEQ ID NO: 574997 - DNA, 20 bp, Artificial Sequence
  chemically synthesized
gacaagagcttaggggttac

SEQ ID NO: 574998 - DNA, 20 bp, Artificial Sequence
  chemically synthesized
tgtggaaattatcagctttt

SEQ ID NO: 574999 - DNA, 20 bp, Artificial Sequence
  chemically synthesized
ccttacaaattgtggaaatt

SEQ ID NO: 575000 - DNA, 20 bp, Artificial Sequence
  chemically synthesized
ctgataatttccacaatttg

SEQ ID NO: 575001 - DNA, 20 bp, Artificial Sequence
  chemically synthesized
ctccagcacatctaaaggct

SEQ ID NO: 575002 - DNA, 20 bp, Artificial Sequence
  chemically synthesized
cctttagatgtgctggagta

SEQ ID NO: 575003 - DNA, 20 bp, Artificial Sequence
  chemically synthesized
aagaattataggggctgata

SEQ ID NO: 575004 - DNA, 20 bp, Artificial Sequence
  chemically synthesized
tctagacacagatatttcaa

SEQ ID NO: 575005 - DNA, 20 bp, Artificial Sequence
  chemically synthesized
caactgtgatttggttaatg

SEQ ID NO: 575006 - DNA, 20 bp, Artificial Sequence
  chemically synthesized
ctttcagagtaaagttttat

SEQ ID NO: 575007 - DNA, 20 bp, Artificial Sequence
  chemically synthesized
agaatgcatgcctttcagag

SEQ ID NO: 575008 - DNA, 20 bp, Artificial Sequence
  chemically synthesized
aagatttatagggatatatc

SEQ ID NO: 575009 - DNA, 20 bp, Artificial Sequence
  chemically synthesized
attttattacatgagggtac

SEQ ID NO: 575010 - DNA, 20 bp, Artificial Sequence
  chemically synthesized
cattcctcccttttctttct

SEQ ID NO: 575011 - DNA, 20 bp, Artificial Sequence
  chemically synthesized
tcttttccatgggtctttgt

SEQ ID NO: 575012 - DNA, 20 bp, Artificial Sequence
  chemically synthesized
agttaactgtaggtgtgtgg

SEQ ID NO: 575013 - DNA, 20 bp, Artificial Sequence
  chemically synthesized
aaatgagttaactgtaggtg

SEQ ID NO: 575014 - DNA, 20 bp, Artificial Sequence
  chemically synthesized
attcattctgcatatggata

SEQ ID NO: 575015 - DNA, 20 bp, Artificial Sequence
  chemically synthesized
tatatggtgagagatagggg

SEQ ID NO: 575016 - DNA, 20 bp, Artificial Sequence
  chemically synthesized
atatacaaaaatcaaatcaa

SEQ ID NO: 575017 - DNA, 20 bp, Artificial Sequence
  chemically synthesized
taagtctttaatctactttg

SEQ ID NO: 575018 - DNA, 20 bp, Artificial Sequence
  chemically synthesized
acatttaagtctttaatcta

SEQ ID NO: 575019 - DNA, 20 bp, Artificial Sequence
  chemically synthesized
gtgttctcttgtagtagttt

SEQ ID NO: 575020 - DNA, 20 bp, Artificial Sequence
  chemically synthesized
ttttctcagtgttctcttgt

SEQ ID NO: 575021 - DNA, 20 bp, Artificial Sequence
  chemically synthesized
ttcatctgttgatgacaccc

SEQ ID NO: 575022 - DNA, 20 bp, Artificial Sequence
  chemically synthesized
ttctgtggttctttaatttt

SEQ ID NO: 575023 - DNA, 20 bp, Artificial Sequence
  chemically synthesized
aaaaaaatgttgacttctct

SEQ ID NO: 575024 - DNA, 20 bp, Artificial Sequence
  chemically synthesized
tctctcttttagaatgttaa

SEQ ID NO: 575025 - DNA, 20 bp, Artificial Sequence
  chemically synthesized
gagatattcaatgtccaagt

SEQ ID NO: 575026 - DNA, 20 bp, Artificial Sequence
  chemically synthesized
tctaatagcaagcactcccc

SEQ ID NO: 575027 - DNA, 20 bp, Artificial Sequence
  chemically synthesized
gaagccataaatctattggg

SEQ ID NO: 575028 - DNA, 20 bp, Artificial Sequence
  chemically synthesized
caagcactccccaatagatt

SEQ ID NO: 575029 - DNA, 20 bp, Artificial Sequence
  chemically synthesized
ttcagcagaatttacattat

SEQ ID NO: 575030 - DNA, 20 bp, Artificial Sequence
  chemically synthesized
aattatgttgataacatatt

SEQ ID NO: 575031 - DNA, 20 bp, Artificial Sequence
  chemically synthesized
agatttcaatttagtctact

SEQ ID NO: 575032 - DNA, 20 bp, Artificial Sequence
  chemically synthesized
ttttacataagaaatatata

SEQ ID NO: 575033 - DNA, 20 bp, Artificial Sequence
  chemically synthesized
acttgagaagtggtcaagtc

SEQ ID NO: 575034 - DNA, 20 bp, Artificial Sequence
  chemically synthesized
atattctaaaattaaaaatg

SEQ ID NO: 575035 - DNA, 20 bp, Artificial Sequence
  chemically synthesized
agatggtaattagtcaaaga

SEQ ID NO: 575036 - DNA, 20 bp, Artificial Sequence
  chemically synthesized
tttctcccacttaaagcagt

SEQ ID NO: 575037 - DNA, 20 bp, Artificial Sequence
  chemically synthesized
ccacttaaagcagttaatgt

SEQ ID NO: 575038 - DNA, 20 bp, Artificial Sequence
  chemically synthesized
tcaaacaaaacgaaaacatt

SEQ ID NO: 575039 - DNA, 20 bp, Artificial Sequence
  chemically synthesized
taaagcagttaatgttttcg

SEQ ID NO: 575040 - DNA, 20 bp, Artificial Sequence
  chemically synthesized
ttcttgaattaaattatgag

SEQ ID NO: 575041 - DNA, 20 bp, Artificial Sequence
  chemically synthesized
ttcttaattaaaatagaact

SEQ ID NO: 575042 - DNA, 20 bp, Artificial Sequence
  chemically synthesized
ggttttcttaattaaaatag

SEQ ID NO: 575043 - DNA, 20 bp, Artificial Sequence
  chemically synthesized
aaattgtttaatttttctac

SEQ ID NO: 575044 - DNA, 20 bp, Artificial Sequence
  chemically synthesized
cacactttatgaacctggaa

SEQ ID NO: 575045 - DNA, 20 bp, Artificial Sequence
  chemically synthesized
caattttccaggttcataaa

SEQ ID NO: 575046 - DNA, 20 bp, Artificial Sequence
  chemically synthesized
agaactaaaagaataaaatt

SEQ ID NO: 575047 - DNA, 20 bp, Artificial Sequence
  chemically synthesized
ttttctccttcactgaaatg

SEQ ID NO: 575048 - DNA, 20 bp, Artificial Sequence
  chemically synthesized
taatcttgatcaagtcactt

SEQ ID NO: 575049 - DNA, 20 bp, Artificial Sequence
  chemically synthesized
gaagcagttaagtgacttga

SEQ ID NO: 575050 - DNA, 20 bp, Artificial Sequence
  chemically synthesized
atgggccagcagctgggcaa

SEQ ID NO: 575051 - DNA, 20 bp, Artificial Sequence
  chemically synthesized
ctctaccatactcacatatt

SEQ ID NO: 575052 - DNA, 20 bp, Artificial Sequence
  chemically synthesized
tcaagagttgctttataggg

SEQ ID NO: 575053 - DNA, 20 bp, Artificial Sequence
  chemically synthesized
tgtttcttcaagtgttcaag

SEQ ID NO: 575054 - DNA, 20 bp, Artificial Sequence
  chemically synthesized
attctaatttacacttgata

SEQ ID NO: 575055 - DNA, 20 bp, Artificial Sequence
  chemically synthesized
tgaggaaacagccagaaaag

SEQ ID NO: 575056 - DNA, 20 bp, Artificial Sequence
  chemically synthesized
taacaaatcttttcttttct

SEQ ID NO: 575057 - DNA, 20 bp, Artificial Sequence
  chemically synthesized
ctttcctcttattctccaaa

SEQ ID NO: 575058 - DNA, 20 bp, Artificial Sequence
  chemically synthesized
tggggttagaaaatagaatt

SEQ ID NO: 575059 - DNA, 20 bp, Artificial Sequence
  chemically synthesized
atcattctgttactccccaa

SEQ ID NO: 575060 - DNA, 20 bp, Artificial Sequence
  chemically synthesized
tatgttggggagtaacagaa

SEQ ID NO: 575061 - DNA, 20 bp, Artificial Sequence
  chemically synthesized
tggcagagagagaaggttct

SEQ ID NO: 575062 - DNA, 20 bp, Artificial Sequence
  chemically synthesized
gagaaggttctactagattc

SEQ ID NO: 575063 - DNA, 20 bp, Artificial Sequence
  chemically synthesized
taaatataacttcattagag

SEQ ID NO: 575064 - DNA, 20 bp, Artificial Sequence
  chemically synthesized
tagagcagtgattttttttg

SEQ ID NO: 575065 - DNA, 20 bp, Artificial Sequence
  chemically synthesized
tgagggagatatggagacct

SEQ ID NO: 575066 - DNA, 20 bp, Artificial Sequence
  chemically synthesized
gatatggagacctacaagat

SEQ ID NO: 575067 - DNA, 20 bp, Artificial Sequence
  chemically synthesized
tatcatattactcttttgtt

SEQ ID NO: 575068 - DNA, 20 bp, Artificial Sequence
  chemically synthesized
caagaatactctaccttgga

SEQ ID NO: 575069 - DNA, 20 bp, Artificial Sequence
  chemically synthesized
catcttttctcttcctgtga

SEQ ID NO: 575070 - DNA, 20 bp, Artificial Sequence
  chemically synthesized
gccatacatcttttctcttc

SEQ ID NO: 575071 - DNA, 20 bp, Artificial Sequence
  chemically synthesized
ccaaatacaagtccatattg

SEQ ID NO: 575072 - DNA, 20 bp, Artificial Sequence
  chemically synthesized
ttggctcataagagatatcc

SEQ ID NO: 575073 - DNA, 20 bp, Artificial Sequence
  chemically synthesized
aaagggaaacttcgaaatca

SEQ ID NO: 575074 - DNA, 20 bp, Artificial Sequence
  chemically synthesized
aatttaaatccaaatgattt

SEQ ID NO: 575075 - DNA, 20 bp, Artificial Sequence
  chemically synthesized
acaaaattgaatttaaatcc

SEQ ID NO: 575076 - DNA, 20 bp, Artificial Sequence
  chemically synthesized
tcatttggatttaaattcaa

SEQ ID NO: 575077 - DNA, 20 bp, Artificial Sequence
  chemically synthesized
tctttaaaaatggacacatt

SEQ ID NO: 575078 - DNA, 20 bp, Artificial Sequence
  chemically synthesized
ttatttttttgaaatataag

SEQ ID NO: 575079 - DNA, 20 bp, Artificial Sequence
  chemically synthesized
cagttggcccattgtttggt

SEQ ID NO: 575080 - DNA, 20 bp, Artificial Sequence
  chemically synthesized
ataaaaaattacagttggcc

SEQ ID NO: 575081 - DNA, 20 bp, Artificial Sequence
  chemically synthesized
gatatactggaaaaataggc

SEQ ID NO: 575082 - DNA, 20 bp, Artificial Sequence
  chemically synthesized
aaaagttgccacaattaaaa

SEQ ID NO: 575083 - DNA, 20 bp, Artificial Sequence
  chemically synthesized
taacccccatggaagaagtg

SEQ ID NO: 575084 - DNA, 20 bp, Artificial Sequence
  chemically synthesized
gaagtgacaagattcataat

SEQ ID NO: 575085 - DNA, 20 bp, Artificial Sequence
  chemically synthesized
acagtataggcagtaattag

SEQ ID NO: 575086 - DNA, 20 bp, Artificial Sequence
  chemically synthesized
aattgaaccctgccatttgc

SEQ ID NO: 575087 - DNA, 20 bp, Artificial Sequence
  chemically synthesized
aatttagcttatttcctgac

SEQ ID NO: 575088 - DNA, 20 bp, Artificial Sequence
  chemically synthesized
aagtgtcaggaaataagcta

SEQ ID NO: 575089 - DNA, 20 bp, Artificial Sequence
  chemically synthesized
aattctccacatcaaagcaa

SEQ ID NO: 575090 - DNA, 20 bp, Artificial Sequence
  chemically synthesized
tttgatgtggagaattactt

SEQ ID NO: 575091 - DNA, 20 bp, Artificial Sequence
  chemically synthesized
attacttctttgctttttat

SEQ ID NO: 575092 - DNA, 20 bp, Artificial Sequence
  chemically synthesized
taaatattcagatcaatggt

SEQ ID NO: 575093 - DNA, 20 bp, Artificial Sequence
  chemically synthesized
agaatttaaatattcagatc

SEQ ID NO: 575094 - DNA, 20 bp, Artificial Sequence
  chemically synthesized
ggcagcaccttagataagct

SEQ ID NO: 575095 - DNA, 20 bp, Artificial Sequence
  chemically synthesized
cattaatcaggtagaaaaca

SEQ ID NO: 575096 - DNA, 20 bp, Artificial Sequence
  chemically synthesized
agataagctaactgttttct

SEQ ID NO: 575097 - DNA, 20 bp, Artificial Sequence
  chemically synthesized
ttcccatgtcagctaccgca

SEQ ID NO: 575098 - DNA, 20 bp, Artificial Sequence
  chemically synthesized
cagtttcccatgtcagctac

SEQ ID NO: 575099 - DNA, 20 bp, Artificial Sequence
  chemically synthesized
aatatggactcttcattctc

SEQ ID NO: 575100 - DNA, 20 bp, Artificial Sequence
  chemically synthesized
cacacatactgacctctctt

SEQ ID NO: 575101 - DNA, 20 bp, Artificial Sequence
  chemically synthesized
gggaggctctattagctttc

SEQ ID NO: 575102 - DNA, 20 bp, Artificial Sequence
  chemically synthesized
ttcaaagatagggaggctct

SEQ ID NO: 575103 - DNA, 20 bp, Artificial Sequence
  chemically synthesized
tgtttttcacaagtttgcac

SEQ ID NO: 575104 - DNA, 20 bp, Artificial Sequence
  chemically synthesized
tttgttttgttttgtttttc

SEQ ID NO: 575105 - DNA, 20 bp, Artificial Sequence
  chemically synthesized
atgtataaggttttgttttg

SEQ ID NO: 575106 - DNA, 20 bp, Artificial Sequence
  chemically synthesized
tttttatgtataaggttttg

SEQ ID NO: 575107 - DNA, 20 bp, Artificial Sequence
  chemically synthesized
gtttatttttatgtataagg

SEQ ID NO: 575108 - DNA, 20 bp, Artificial Sequence
  chemically synthesized
aacaggtttatttttatgta

SEQ ID NO: 575109 - DNA, 20 bp, Artificial Sequence
  chemically synthesized
agtagattgctaggagtaga

SEQ ID NO: 575110 - DNA, 20 bp, Artificial Sequence
  chemically synthesized
aaggatttgtttttatgaga

SEQ ID NO: 575111 - DNA, 20 bp, Artificial Sequence
  chemically synthesized
ttttctaggagtagaaaagg

SEQ ID NO: 575112 - DNA, 20 bp, Artificial Sequence
  chemically synthesized
agattttttctaggagtaga

SEQ ID NO: 575113 - DNA, 20 bp, Artificial Sequence
  chemically synthesized
attgaaaggatgaaatagag

SEQ ID NO: 575114 - DNA, 20 bp, Artificial Sequence
  chemically synthesized
attagtatgcatttctttgt

SEQ ID NO: 575115 - DNA, 20 bp, Artificial Sequence
  chemically synthesized
tcagactctgaagtcagact

SEQ ID NO: 575116 - DNA, 20 bp, Artificial Sequence
  chemically synthesized
aacctccacctcccgggttc

SEQ ID NO: 575117 - DNA, 20 bp, Artificial Sequence
  chemically synthesized
tcaggaggctgaggcaggag

SEQ ID NO: 575118 - DNA, 20 bp, Artificial Sequence
  chemically synthesized
tttttgtatttttggtagag

SEQ ID NO: 575119 - DNA, 20 bp, Artificial Sequence
  chemically synthesized
tgcctcggcctcccaaagtg

SEQ ID NO: 575120 - DNA, 20 bp, Artificial Sequence
  chemically synthesized
acgcctggcccacccagact

SEQ ID NO: 575121 - DNA, 20 bp, Artificial Sequence
  chemically synthesized
tgctctcagcaaccctaaga

SEQ ID NO: 575122 - DNA, 20 bp, Artificial Sequence
  chemically synthesized
taagcactttccattcattg

SEQ ID NO: 575123 - DNA, 20 bp, Artificial Sequence
  chemically synthesized
taaaccggtcaatgaatgga

SEQ ID NO: 575124 - DNA, 20 bp, Artificial Sequence
  chemically synthesized
cttgatgcagacatttacaa

SEQ ID NO: 575125 - DNA, 20 bp, Artificial Sequence
  chemically synthesized
tgcttctgaattactaaaaa

SEQ ID NO: 575126 - DNA, 20 bp, Artificial Sequence
  chemically synthesized
taggtagaaagattacagaa

SEQ ID NO: 575127 - DNA, 20 bp, Artificial Sequence
  chemically synthesized
gtagttactacctctaggta

SEQ ID NO: 575128 - DNA, 20 bp, Artificial Sequence
  chemically synthesized
ttctctttattaaaaatatt

SEQ ID NO: 575129 - DNA, 20 bp, Artificial Sequence
  chemically synthesized
agaaatgaattaagaaaggc

SEQ ID NO: 575130 - DNA, 20 bp, Artificial Sequence
  chemically synthesized
actgcttagaaagcaggaag

SEQ ID NO: 575131 - DNA, 20 bp, Artificial Sequence
  chemically synthesized
cggggaatgaaagccaggct

SEQ ID NO: 575132 - DNA, 20 bp, Artificial Sequence
  chemically synthesized
gcaagggcggggaatgaaag

SEQ ID NO: 575133 - DNA, 20 bp, Artificial Sequence
  chemically synthesized
tagatcatttaagttacaat

SEQ ID NO: 575134 - DNA, 20 bp, Artificial Sequence
  chemically synthesized
cagagggaagttcttgttat

SEQ ID NO: 575135 - DNA, 20 bp, Artificial Sequence
  chemically synthesized
tattttgcccccttctatgt

SEQ ID NO: 575136 - DNA, 20 bp, Artificial Sequence
  chemically synthesized
tatgtgagtatactacaact

SEQ ID NO: 575137 - DNA, 20 bp, Artificial Sequence
  chemically synthesized
gagtatactacaactaaaag

SEQ ID NO: 575138 - DNA, 20 bp, Artificial Sequence
  chemically synthesized
taaaacacatcctctgtaaa

SEQ ID NO: 575139 - DNA, 20 bp, Artificial Sequence
  chemically synthesized
aaaagcttagtttacagagg

SEQ ID NO: 575140 - DNA, 20 bp, Artificial Sequence
  chemically synthesized
cttcctgtcttttgcttcct

SEQ ID NO: 575141 - DNA, 20 bp, Artificial Sequence
  chemically synthesized
gactatagcaacttcctgtc

SEQ ID NO: 575142 - DNA, 20 bp, Artificial Sequence
  chemically synthesized
acctgtaacacattataatt

SEQ ID NO: 575143 - DNA, 20 bp, Artificial Sequence
  chemically synthesized
actgttaattataatgtgtt

SEQ ID NO: 575144 - DNA, 20 bp, Artificial Sequence
  chemically synthesized
tataattgtaatgtgttata

SEQ ID NO: 575145 - DNA, 20 bp, Artificial Sequence
  chemically synthesized
taaatgaggagtgcagctat

SEQ ID NO: 575146 - DNA, 20 bp, Artificial Sequence
  chemically synthesized
tgtcttaatatgcatgtctc

SEQ ID NO: 575147 - DNA, 20 bp, Artificial Sequence
  chemically synthesized
ttcagattagattaaagtgg

SEQ ID NO: 575148 - DNA, 20 bp, Artificial Sequence
  chemically synthesized
gatgatacttgaggattcag

SEQ ID NO: 575149 - DNA, 20 bp, Artificial Sequence
  chemically synthesized
atggagatgatacttgagga

SEQ ID NO: 575150 - DNA, 20 bp, Artificial Sequence
  chemically synthesized
cttggtatggagatgatact

SEQ ID NO: 575151 - DNA, 20 bp, Artificial Sequence
  chemically synthesized
catctccataccaagcaaat

SEQ ID NO: 575152 - DNA, 20 bp, Artificial Sequence
  chemically synthesized
tttgaataaatgaatcattt

SEQ ID NO: 575153 - DNA, 20 bp, Artificial Sequence
  chemically synthesized
cagtgaatcattctgaaatt

SEQ ID NO: 575154 - DNA, 20 bp, Artificial Sequence
  chemically synthesized
acgtaaatcatccaatttca

SEQ ID NO: 575155 - DNA, 20 bp, Artificial Sequence
  chemically synthesized
atgatgcagtcctgttacaa

SEQ ID NO: 575156 - DNA, 20 bp, Artificial Sequence
  chemically synthesized
atcggaaccttccagggatc

SEQ ID NO: 575157 - DNA, 20 bp, Artificial Sequence
  chemically synthesized
cagggatctcaggatttttt

SEQ ID NO: 575158 - DNA, 20 bp, Artificial Sequence
  chemically synthesized
aggttgtgataaacatctgt

SEQ ID NO: 575159 - DNA, 20 bp, Artificial Sequence
  chemically synthesized
ggtgaaattgaagctcacac

SEQ ID NO: 575160 - DNA, 20 bp, Artificial Sequence
  chemically synthesized
tcacattcatcgcttgtttc

SEQ ID NO: 575161 - DNA, 20 bp, Artificial Sequence
  chemically synthesized
tctccaaattcacattcatc

SEQ ID NO: 575162 - DNA, 20 bp, Artificial Sequence
  chemically synthesized
caattctccaaattcacatt

SEQ ID NO: 575163 - DNA, 20 bp, Artificial Sequence
  chemically synthesized
tgtatcttcttgttagttta

SEQ ID NO: 575164 - DNA, 20 bp, Artificial Sequence
  chemically synthesized
gatttgagatgtatcttctt

SEQ ID NO: 575165 - DNA, 20 bp, Artificial Sequence
  chemically synthesized
agaaggcaatacgccaagaa

SEQ ID NO: 575166 - DNA, 20 bp, Artificial Sequence
  chemically synthesized
attgccttctcctgttatta

SEQ ID NO: 575167 - DNA, 20 bp, Artificial Sequence
  chemically synthesized
atgggcatcttattagttgt

SEQ ID NO: 575168 - DNA, 20 bp, Artificial Sequence
  chemically synthesized
tttatggtcagagttaactc

SEQ ID NO: 575169 - DNA, 20 bp, Artificial Sequence
  chemically synthesized
aatcttgtttattagtctct

SEQ ID NO: 575170 - DNA, 20 bp, Artificial Sequence
  chemically synthesized
aagcgtggagagactaataa

SEQ ID NO: 575171 - DNA, 20 bp, Artificial Sequence
  chemically synthesized
gtgctgtgggccaagtgcaa

SEQ ID NO: 575172 - DNA, 20 bp, Artificial Sequence
  chemically synthesized
gaacttaatttgtgttgtca

SEQ ID NO: 575173 - DNA, 20 bp, Artificial Sequence
  chemically synthesized
tagtacagcatcatacattt

SEQ ID NO: 575174 - DNA, 20 bp, Artificial Sequence
  chemically synthesized
cagcatcatacatttattag

SEQ ID NO: 575175 - DNA, 20 bp, Artificial Sequence
  chemically synthesized
ttcccatttaatacacattt

SEQ ID NO: 575176 - DNA, 20 bp, Artificial Sequence
  chemically synthesized
ggaagacataccatgtaaag

SEQ ID NO: 575177 - DNA, 20 bp, Artificial Sequence
  chemically synthesized
atgtcttcctgtgtaacatt

SEQ ID NO: 575178 - DNA, 20 bp, Artificial Sequence
  chemically synthesized
ctttcagtttctgggttttc

SEQ ID NO: 575179 - DNA, 20 bp, Artificial Sequence
  chemically synthesized
aagcagggctctttcagttt

SEQ ID NO: 575180 - DNA, 20 bp, Artificial Sequence
  chemically synthesized
aaacccagaaactgaaagag

SEQ ID NO: 575181 - DNA, 20 bp, Artificial Sequence
  chemically synthesized
gcattttaaagcagggctct

SEQ ID NO: 575182 - DNA, 20 bp, Artificial Sequence
  chemically synthesized
gccctgctttaaaatgccaa

SEQ ID NO: 575183 - DNA, 20 bp, Artificial Sequence
  chemically synthesized
tttagtgcggagtacaaagt

SEQ ID NO: 575184 - DNA, 20 bp, Artificial Sequence
  chemically synthesized
cccacatccacacgcctggc

SEQ ID NO: 575185 - DNA, 20 bp, Artificial Sequence
  chemically synthesized
gaggcctggaatatgcaact

SEQ ID NO: 575186 - DNA, 20 bp, Artificial Sequence
  chemically synthesized
gcagaatgataagaaaagtt

SEQ ID NO: 575187 - DNA, 20 bp, Artificial Sequence
  chemically synthesized
taaaatgaatttataatgtc

SEQ ID NO: 575188 - DNA, 20 bp, Artificial Sequence
  chemically synthesized
attataaattcattttatat

SEQ ID NO: 575189 - DNA, 20 bp, Artificial Sequence
  chemically synthesized
agctctctgaggaatgttcc

SEQ ID NO: 575190 - DNA, 20 bp, Artificial Sequence
  chemically synthesized
tttctgcctacacaatgaat

SEQ ID NO: 575191 - DNA, 20 bp, Artificial Sequence
  chemically synthesized
tatattatctgacttgctct

SEQ ID NO: 575192 - DNA, 20 bp, Artificial Sequence
  chemically synthesized
tgacttgctcttagagattt

SEQ ID NO: 575193 - DNA, 20 bp, Artificial Sequence
  chemically synthesized
gatttgtatgcttctgttca

SEQ ID NO: 575194 - DNA, 20 bp, Artificial Sequence
  chemically synthesized
tcattctgaagctccaaaca

SEQ ID NO: 575195 - DNA, 20 bp, Artificial Sequence
  chemically synthesized
cacagatcaatccaattgtt

SEQ ID NO: 575196 - DNA, 20 bp, Artificial Sequence
  chemically synthesized
ctagttacacagatcaatcc

SEQ ID NO: 575197 - DNA, 20 bp, Artificial Sequence
  chemically synthesized
ggattgatctgtgtaactag

SEQ ID NO: 575198 - DNA, 20 bp, Artificial Sequence
  chemically synthesized
agaaattctgaagaactggc

SEQ ID NO: 575199 - DNA, 20 bp, Artificial Sequence
  chemically synthesized
ctctctttagagtccatcag

SEQ ID NO: 575200 - DNA, 20 bp, Artificial Sequence
  chemically synthesized
ttcccttctttcaacttctg

SEQ ID NO: 575201 - DNA, 20 bp, Artificial Sequence
  chemically synthesized
gtatctctgagtagtacaaa

SEQ ID NO: 575202 - DNA, 20 bp, Artificial Sequence
  chemically synthesized
ctatatccttccagtacaaa

SEQ ID NO: 575203 - DNA, 20 bp, Artificial Sequence
  chemically synthesized
gtttgtactggaaggatata

SEQ ID NO: 575204 - DNA, 20 bp, Artificial Sequence
  chemically synthesized
ggatatagcctgattttgaa

SEQ ID NO: 575205 - DNA, 20 bp, Artificial Sequence
  chemically synthesized
tatatggtagaaggttagta

SEQ ID NO: 575206 - DNA, 20 bp, Artificial Sequence
  chemically synthesized
gtattgggattcttgcagaa

SEQ ID NO: 575207 - DNA, 20 bp, Artificial Sequence
  chemically synthesized
tggtcaaatatatagccatt

SEQ ID NO: 575208 - DNA, 20 bp, Artificial Sequence
  chemically synthesized
ttatctggaacttagatctg

SEQ ID NO: 575209 - DNA, 20 bp, Artificial Sequence
  chemically synthesized
tactttacttcttctgttgt

SEQ ID NO: 575210 - DNA, 20 bp, Artificial Sequence
  chemically synthesized
ttccttttgtgtatgcactt

SEQ ID NO: 575211 - DNA, 20 bp, Artificial Sequence
  chemically synthesized
atacttttacttgaacaact

SEQ ID NO: 575212 - DNA, 20 bp, Artificial Sequence
  chemically synthesized
aaagtattctcactagtagc

SEQ ID NO: 575213 - DNA, 20 bp, Artificial Sequence
  chemically synthesized
tcactagtagcatcagtttt

SEQ ID NO: 575214 - DNA, 20 bp, Artificial Sequence
  chemically synthesized
tatacataaccttaaggagc

SEQ ID NO: 575215 - DNA, 20 bp, Artificial Sequence
  chemically synthesized
cttctcaagcataaatagga

SEQ ID NO: 575216 - DNA, 20 bp, Artificial Sequence
  chemically synthesized
ttcatgaatcaacatcctat

SEQ ID NO: 575217 - DNA, 20 bp, Artificial Sequence
  chemically synthesized
atttgttgataatacaacaa

SEQ ID NO: 575218 - DNA, 20 bp, Artificial Sequence
  chemically synthesized
taaatcagtcctcaataaat

SEQ ID NO: 575219 - DNA, 20 bp, Artificial Sequence
  chemically synthesized
ataaacaagcatttattgag

SEQ ID NO: 575220 - DNA, 20 bp, Artificial Sequence
  chemically synthesized
acaataaatcagtcctcaat

SEQ ID NO: 575221 - DNA, 20 bp, Artificial Sequence
  chemically synthesized
tattgaggactgatttattg

SEQ ID NO: 575222 - DNA, 20 bp, Artificial Sequence
  chemically synthesized
tcctaaaacctagtgtgcat

SEQ ID NO: 575223 - DNA, 20 bp, Artificial Sequence
  chemically synthesized
gaattaaacaaaaatgcaca

SEQ ID NO: 575224 - DNA, 20 bp, Artificial Sequence
  chemically synthesized
ctagtgtgcatttttgttta

SEQ ID NO: 575225 - DNA, 20 bp, Artificial Sequence
  chemically synthesized
gaagataagtcttctgtcag

SEQ ID NO: 575226 - DNA, 20 bp, Artificial Sequence
  chemically synthesized
taaatgacacgtgtacagta

SEQ ID NO: 575227 - DNA, 20 bp, Artificial Sequence
  chemically synthesized
aactaaggtggtacatttgt

SEQ ID NO: 575228 - DNA, 20 bp, Artificial Sequence
  chemically synthesized
tctgtgaagtacatcacatt

SEQ ID NO: 575229 - DNA, 20 bp, Artificial Sequence
  chemically synthesized
agatgagagcactgagactc

SEQ ID NO: 575230 - DNA, 20 bp, Artificial Sequence
  chemically synthesized
gttctaacacttatcagcta

SEQ ID NO: 575231 - DNA, 20 bp, Artificial Sequence
  chemically synthesized
ctgggaaatggatccaattc

SEQ ID NO: 575232 - DNA, 20 bp, Artificial Sequence
  chemically synthesized
tgactactgtgtattatatc

SEQ ID NO: 575233 - DNA, 20 bp, Artificial Sequence
  chemically synthesized
ctcaagaatgctgtctttca

SEQ ID NO: 575234 - DNA, 20 bp, Artificial Sequence
  chemically synthesized
caccctgaaagacagcattc

SEQ ID NO: 575235 - DNA, 20 bp, Artificial Sequence
  chemically synthesized
cagcattcttgagtttgata

SEQ ID NO: 575236 - DNA, 20 bp, Artificial Sequence
  chemically synthesized
tttgataaaatgtttaccca

SEQ ID NO: 575237 - DNA, 20 bp, Artificial Sequence
  chemically synthesized
ataaaatgtttacccacgtg

SEQ ID NO: 575238 - DNA, 20 bp, Artificial Sequence
  chemically synthesized
aatggcgtgaacctgggagg

SEQ ID NO: 575239 - DNA, 20 bp, Artificial Sequence
  chemically synthesized
ttttgtatttttagtagaaa

SEQ ID NO: 575240 - DNA, 20 bp, Artificial Sequence
  chemically synthesized
tcctggctaacatggtgaaa

SEQ ID NO: 575241 - DNA, 20 bp, Artificial Sequence
  chemically synthesized
ccgcccaccttggcctccca

SEQ ID NO: 575242 - DNA, 20 bp, Artificial Sequence
  chemically synthesized
caccttggcctcccaaagtg

SEQ ID NO: 575243 - DNA, 20 bp, Artificial Sequence
  chemically synthesized
gcgtgagccaccacacctgg

SEQ ID NO: 575244 - DNA, 20 bp, Artificial Sequence
  chemically synthesized
cccaaaggaacatggatgaa

SEQ ID NO: 575245 - DNA, 20 bp, Artificial Sequence
  chemically synthesized
ctatctgagtcctgtagctt

SEQ ID NO: 575246 - DNA, 20 bp, Artificial Sequence
  chemically synthesized
agggcaacctatctgagtcc

SEQ ID NO: 575247 - DNA, 20 bp, Artificial Sequence
  chemically synthesized
aaaaatctccactacagcat

SEQ ID NO: 575248 - DNA, 20 bp, Artificial Sequence
  chemically synthesized
caaaagctggcatgctgtag

SEQ ID NO: 575249 - DNA, 20 bp, Artificial Sequence
  chemically synthesized
atcaataaggcagcatgagt

SEQ ID NO: 575250 - DNA, 20 bp, Artificial Sequence
  chemically synthesized
aaataaataaataaaaaatg

SEQ ID NO: 575251 - DNA, 20 bp, Artificial Sequence
  chemically synthesized
cacctatgagtgagaatatg

SEQ ID NO: 575252 - DNA, 20 bp, Artificial Sequence
  chemically synthesized
gtttggtgttctgttcttgt

SEQ ID NO: 575253 - DNA, 20 bp, Artificial Sequence
  chemically synthesized
ttgtgatagtttactgagaa

SEQ ID NO: 575254 - DNA, 20 bp, Artificial Sequence
  chemically synthesized
caaatgtccaacagtgatag

SEQ ID NO: 575255 - DNA, 20 bp, Artificial Sequence
  chemically synthesized
ctataaagacacatgcacac

SEQ ID NO: 575256 - DNA, 20 bp, Artificial Sequence
  chemically synthesized
gtgcatgtgtctttatagca

SEQ ID NO: 575257 - DNA, 20 bp, Artificial Sequence
  chemically synthesized
aaccattgtggaagtcagtg

SEQ ID NO: 575258 - DNA, 20 bp, Artificial Sequence
  chemically synthesized
ctgacttccacaatggttga

SEQ ID NO: 575259 - DNA, 20 bp, Artificial Sequence
  chemically synthesized
tccacatcctctccagcacc

SEQ ID NO: 575260 - DNA, 20 bp, Artificial Sequence
  chemically synthesized
cctgttgtttcctgactttt

SEQ ID NO: 575261 - DNA, 20 bp, Artificial Sequence
  chemically synthesized
ggtgtgagatggtatctcat

SEQ ID NO: 575262 - DNA, 20 bp, Artificial Sequence
  chemically synthesized
gagatggtatctcattgtgg

SEQ ID NO: 575263 - DNA, 20 bp, Artificial Sequence
  chemically synthesized
cttcacccactttttgatgg

SEQ ID NO: 575264 - DNA, 20 bp, Artificial Sequence
  chemically synthesized
acccactttttgatggggtt

SEQ ID NO: 575265 - DNA, 20 bp, Artificial Sequence
  chemically synthesized
tgtttgtttttttcttgtac

SEQ ID NO: 575266 - DNA, 20 bp, Artificial Sequence
  chemically synthesized
gtacatttgtttgagttcat

SEQ ID NO: 575267 - DNA, 20 bp, Artificial Sequence
  chemically synthesized
ggttgcctgttcactctgat

SEQ ID NO: 575268 - DNA, 20 bp, Artificial Sequence
  chemically synthesized
cttttgctgtgcagaagctc

SEQ ID NO: 575269 - DNA, 20 bp, Artificial Sequence
  chemically synthesized
aatgggatctaattaaacta

SEQ ID NO: 575270 - DNA, 20 bp, Artificial Sequence
  chemically synthesized
attagatcccatttgtcaat

SEQ ID NO: 575271 - DNA, 20 bp, Artificial Sequence
  chemically synthesized
tcaattctggcttttgttgc

SEQ ID NO: 575272 - DNA, 20 bp, Artificial Sequence
  chemically synthesized
gcttttgttgccattgcttt

SEQ ID NO: 575273 - DNA, 20 bp, Artificial Sequence
  chemically synthesized
tatgtcctgaatggtaatgc

SEQ ID NO: 575274 - DNA, 20 bp, Artificial Sequence
  chemically synthesized
gtaatgcctaggttttcttc

SEQ ID NO: 575275 - DNA, 20 bp, Artificial Sequence
  chemically synthesized
aggttttcttctagggtttt

SEQ ID NO: 575276 - DNA, 20 bp, Artificial Sequence
  chemically synthesized
ggtttttatggttttaggtc

SEQ ID NO: 575277 - DNA, 20 bp, Artificial Sequence
  chemically synthesized
taagtctttaatccatcttg

SEQ ID NO: 575278 - DNA, 20 bp, Artificial Sequence
  chemically synthesized
ttatacaaaaatcaattcaa

SEQ ID NO: 575279 - DNA, 20 bp, Artificial Sequence
  chemically synthesized
tataaggtgtaaggaaggga

SEQ ID NO: 575280 - DNA, 20 bp, Artificial Sequence
  chemically synthesized
gtgtaaggaagggatccagt

SEQ ID NO: 575281 - DNA, 20 bp, Artificial Sequence
  chemically synthesized
cagctttctacatatggcta

SEQ ID NO: 575282 - DNA, 20 bp, Artificial Sequence
  chemically synthesized
taaatagggaatcctttccc

SEQ ID NO: 575283 - DNA, 20 bp, Artificial Sequence
  chemically synthesized
tagggaatcctttccccatt

SEQ ID NO: 575284 - DNA, 20 bp, Artificial Sequence
  chemically synthesized
gagaaaaacaagcaatgggg

SEQ ID NO: 575285 - DNA, 20 bp, Artificial Sequence
  chemically synthesized
ttccccattgcttgtttttc

SEQ ID NO: 575286 - DNA, 20 bp, Artificial Sequence
  chemically synthesized
tctgttccactgatctatat

SEQ ID NO: 575287 - DNA, 20 bp, Artificial Sequence
  chemically synthesized
ctgttttggtaccagtacca

SEQ ID NO: 575288 - DNA, 20 bp, Artificial Sequence
  chemically synthesized
tggttactgtagccttgtag

SEQ ID NO: 575289 - DNA, 20 bp, Artificial Sequence
  chemically synthesized
aagtcagctagtgtgatgcc

SEQ ID NO: 575290 - DNA, 20 bp, Artificial Sequence
  chemically synthesized
tccagctttgttcttttggc

SEQ ID NO: 575291 - DNA, 20 bp, Artificial Sequence
  chemically synthesized
tggttccatatgaactttaa

SEQ ID NO: 575292 - DNA, 20 bp, Artificial Sequence
  chemically synthesized
attctgtgaagaaaggcatt

SEQ ID NO: 575293 - DNA, 20 bp, Artificial Sequence
  chemically synthesized
ccatactgcccaaggtgatt

SEQ ID NO: 575294 - DNA, 20 bp, Artificial Sequence
  chemically synthesized
gaaaatggccatactgccca

SEQ ID NO: 575295 - DNA, 20 bp, Artificial Sequence
  chemically synthesized
cagtatggccattttcacaa

SEQ ID NO: 575296 - DNA, 20 bp, Artificial Sequence
  chemically synthesized
tgagcatggaatgttcttcc

SEQ ID NO: 575297 - DNA, 20 bp, Artificial Sequence
  chemically synthesized
cctcttttatttccttgagc

SEQ ID NO: 575298 - DNA, 20 bp, Artificial Sequence
  chemically synthesized
atgagtgaactcccattcac

SEQ ID NO: 575299 - DNA, 20 bp, Artificial Sequence
  chemically synthesized
aattgtgaatgggagttcac

SEQ ID NO: 575300 - DNA, 20 bp, Artificial Sequence
  chemically synthesized
agttcactcatgatttggct

SEQ ID NO: 575301 - DNA, 20 bp, Artificial Sequence
  chemically synthesized
tgtctgttgttggtgtataa

SEQ ID NO: 575302 - DNA, 20 bp, Artificial Sequence
  chemically synthesized
ttgttggtgtataagaatgc

SEQ ID NO: 575303 - DNA, 20 bp, Artificial Sequence
  chemically synthesized
gaatgcttgtgatttttgta

SEQ ID NO: 575304 - DNA, 20 bp, Artificial Sequence
  chemically synthesized
gtatcctgagactttgctga

SEQ ID NO: 575305 - DNA, 20 bp, Artificial Sequence
  chemically synthesized
agactttgctgaagttgctt

SEQ ID NO: 575306 - DNA, 20 bp, Artificial Sequence
  chemically synthesized
tgaagttgcttatcagctta

SEQ ID NO: 575307 - DNA, 20 bp, Artificial Sequence
  chemically synthesized
gagattttgggctgagacga

SEQ ID NO: 575308 - DNA, 20 bp, Artificial Sequence
  chemically synthesized
attgtccctgtttgcagacg

SEQ ID NO: 575309 - DNA, 20 bp, Artificial Sequence
  chemically synthesized
aaaagaggaagtcaaattgt

SEQ ID NO: 575310 - DNA, 20 bp, Artificial Sequence
  chemically synthesized
accctttatttccttctcct

SEQ ID NO: 575311 - DNA, 20 bp, Artificial Sequence
  chemically synthesized
tgaggtgtagtctttaaatg

SEQ ID NO: 575312 - DNA, 20 bp, Artificial Sequence
  chemically synthesized
ctcaggtagcacaaaagagc

SEQ ID NO: 575313 - DNA, 20 bp, Artificial Sequence
  chemically synthesized
ggctacccactgagaactcc

SEQ ID NO: 575314 - DNA, 20 bp, Artificial Sequence
  chemically synthesized
tctatgaaaattatcctttg

SEQ ID NO: 575315 - DNA, 20 bp, Artificial Sequence
  chemically synthesized
aattttcatagaaatttttg

SEQ ID NO: 575316 - DNA, 20 bp, Artificial Sequence
  chemically synthesized
catacagtgaatgcagtaat

SEQ ID NO: 575317 - DNA, 20 bp, Artificial Sequence
  chemically synthesized
tctaatttttttcttctttt

SEQ ID NO: 575318 - DNA, 20 bp, Artificial Sequence
  chemically synthesized
tttcccctttgttcattcgt

SEQ ID NO: 575319 - DNA, 20 bp, Artificial Sequence
  chemically synthesized
cttgctgctgctgctgctgc

SEQ ID NO: 575320 - DNA, 20 bp, Artificial Sequence
  chemically synthesized
aaaatgagctcatgtatata

SEQ ID NO: 575321 - DNA, 20 bp, Artificial Sequence
  chemically synthesized
gcatttttagttaaccttac

SEQ ID NO: 575322 - DNA, 20 bp, Artificial Sequence
  chemically synthesized
tcacacagctaataaatgca

SEQ ID NO: 575323 - DNA, 20 bp, Artificial Sequence
  chemically synthesized
gaacctcgtcagtcagactt

SEQ ID NO: 575324 - DNA, 20 bp, Artificial Sequence
  chemically synthesized
ccactaggctatattacctt

SEQ ID NO: 575325 - DNA, 20 bp, Artificial Sequence
  chemically synthesized
tttcaagtttagttgttggt

SEQ ID NO: 575326 - DNA, 20 bp, Artificial Sequence
  chemically synthesized
ctttattttctaatggcagt

SEQ ID NO: 575327 - DNA, 20 bp, Artificial Sequence
  chemically synthesized
tattaatataaagactatta

SEQ ID NO: 575328 - DNA, 20 bp, Artificial Sequence
  chemically synthesized
atctctatccactgctacaa

SEQ ID NO: 575329 - DNA, 20 bp, Artificial Sequence
  chemically synthesized
cacccattttctcaattact

SEQ ID NO: 575330 - DNA, 20 bp, Artificial Sequence
  chemically synthesized
atggggacacacattatttg

SEQ ID NO: 575331 - DNA, 20 bp, Artificial Sequence
  chemically synthesized
cttttatggggacacacatt

SEQ ID NO: 575332 - DNA, 20 bp, Artificial Sequence
  chemically synthesized
attgtacagaactttaggcc

SEQ ID NO: 575333 - DNA, 20 bp, Artificial Sequence
  chemically synthesized
aaactgctatactgtgaaca

SEQ ID NO: 575334 - DNA, 20 bp, Artificial Sequence
  chemically synthesized
aagcaatatgttcacagtat

SEQ ID NO: 575335 - DNA, 20 bp, Artificial Sequence
  chemically synthesized
agttttaggagtaggggaga

SEQ ID NO: 575336 - DNA, 20 bp, Artificial Sequence
  chemically synthesized
aggggagatcctgttttctg

SEQ ID NO: 575337 - DNA, 20 bp, Artificial Sequence
  chemically synthesized
tcttgttgtgaatctccttt

SEQ ID NO: 575338 - DNA, 20 bp, Artificial Sequence
  chemically synthesized
ttttctctggaagctgagaa

SEQ ID NO: 575339 - DNA, 20 bp, Artificial Sequence
  chemically synthesized
ctatttaactgcactttgcc

SEQ ID NO: 575340 - DNA, 20 bp, Artificial Sequence
  chemically synthesized
caaagtgcagttaaatagac

SEQ ID NO: 575341 - DNA, 20 bp, Artificial Sequence
  chemically synthesized
gatgaaaactctttcattac

SEQ ID NO: 575342 - DNA, 20 bp, Artificial Sequence
  chemically synthesized
tagtgaaaccaaagtaatga

SEQ ID NO: 575343 - DNA, 20 bp, Artificial Sequence
  chemically synthesized
agcaggtatgtattattatt

SEQ ID NO: 575344 - DNA, 20 bp, Artificial Sequence
  chemically synthesized
ttaataaataatagcaaatg

SEQ ID NO: 575345 - DNA, 20 bp, Artificial Sequence
  chemically synthesized
tttctaacatctgatttcca

SEQ ID NO: 575346 - DNA, 20 bp, Artificial Sequence
  chemically synthesized
tgtggaaatcagatgttaga

SEQ ID NO: 575347 - DNA, 20 bp, Artificial Sequence
  chemically synthesized
tcatgaaatctatttctaac

SEQ ID NO: 575348 - DNA, 20 bp, Artificial Sequence
  chemically synthesized
gatttcatgaagttacagga

SEQ ID NO: 575349 - DNA, 20 bp, Artificial Sequence
  chemically synthesized
gcttgagccttgagggatgt

SEQ ID NO: 575350 - DNA, 20 bp, Artificial Sequence
  chemically synthesized
tggagtaaaggtgaaatgaa

SEQ ID NO: 575351 - DNA, 20 bp, Artificial Sequence
  chemically synthesized
cagggacaatgaattgcaca

SEQ ID NO: 575352 - DNA, 20 bp, Artificial Sequence
  chemically synthesized
aaataggtagaatgcagacc

SEQ ID NO: 575353 - DNA, 20 bp, Artificial Sequence
  chemically synthesized
taaaggaagactttattcta

SEQ ID NO: 575354 - DNA, 20 bp, Artificial Sequence
  chemically synthesized
tttaggaagccaccgagaat

SEQ ID NO: 575355 - DNA, 20 bp, Artificial Sequence
  chemically synthesized
ctttctaaacttttattctc

SEQ ID NO: 575356 - DNA, 20 bp, Artificial Sequence
  chemically synthesized
ttagaaagaaaagtacaaag

SEQ ID NO: 575357 - DNA, 20 bp, Artificial Sequence
  chemically synthesized
ggaagaataggaaaagttat

SEQ ID NO: 575358 - DNA, 20 bp, Artificial Sequence
  chemically synthesized
tctagaatagtatcacaacc

SEQ ID NO: 575359 - DNA, 20 bp, Artificial Sequence
  chemically synthesized
ataggaaaggaaatatgtgg

SEQ ID NO: 575360 - DNA, 20 bp, Artificial Sequence
  chemically synthesized
tctcagctatattaaaatgg

SEQ ID NO: 575361 - DNA, 20 bp, Artificial Sequence
  chemically synthesized
tattctttctacaccattgt

SEQ ID NO: 575362 - DNA, 20 bp, Artificial Sequence
  chemically synthesized
ttgttattctttctacacca

SEQ ID NO: 575363 - DNA, 20 bp, Artificial Sequence
  chemically synthesized
tgtctataataaaattctta

SEQ ID NO: 575364 - DNA, 20 bp, Artificial Sequence
  chemically synthesized
tccttaagaattttattata

SEQ ID NO: 575365 - DNA, 20 bp, Artificial Sequence
  chemically synthesized
ttattatagacagattatct

SEQ ID NO: 575366 - DNA, 20 bp, Artificial Sequence
  chemically synthesized
catatactaactgctttcag

SEQ ID NO: 575367 - DNA, 20 bp, Artificial Sequence
  chemically synthesized
cttataattattcatatact

SEQ ID NO: 575368 - DNA, 20 bp, Artificial Sequence
  chemically synthesized
ataatttttatctaatttaa

SEQ ID NO: 575369 - DNA, 20 bp, Artificial Sequence
  chemically synthesized
gcttgatgggaaaaaaagtg

SEQ ID NO: 575370 - DNA, 20 bp, Artificial Sequence
  chemically synthesized
ccatggctccttttacacct

SEQ ID NO: 575371 - DNA, 20 bp, Artificial Sequence
  chemically synthesized
ctactgatgcatggagagct

SEQ ID NO: 575372 - DNA, 20 bp, Artificial Sequence
  chemically synthesized
agtagcccttgaaggcatca

SEQ ID NO: 575373 - DNA, 20 bp, Artificial Sequence
  chemically synthesized
atcatcctgagcattaacta

SEQ ID NO: 575374 - DNA, 20 bp, Artificial Sequence
  chemically synthesized
atgctgaattagccagggaa

SEQ ID NO: 575375 - DNA, 20 bp, Artificial Sequence
  chemically synthesized
acagattttactgaatgtaa

SEQ ID NO: 575376 - DNA, 20 bp, Artificial Sequence
  chemically synthesized
gcagatttacattcagtaaa

SEQ ID NO: 575377 - DNA, 20 bp, Artificial Sequence
  chemically synthesized
catacactgctttcttctta

SEQ ID NO: 575378 - DNA, 20 bp, Artificial Sequence
  chemically synthesized
aagaagaaagcagtgtatgt

SEQ ID NO: 575379 - DNA, 20 bp, Artificial Sequence
  chemically synthesized
tcatttgaagcatttacata

SEQ ID NO: 575380 - DNA, 20 bp, Artificial Sequence
  chemically synthesized
aaatgactgttatttgatac

SEQ ID NO: 575381 - DNA, 20 bp, Artificial Sequence
  chemically synthesized
cagttgttttgaaaaggtgt

SEQ ID NO: 575382 - DNA, 20 bp, Artificial Sequence
  chemically synthesized
ttctactttcatataattgt

SEQ ID NO: 575383 - DNA, 20 bp, Artificial Sequence
  chemically synthesized
agggagttctactttcatat

SEQ ID NO: 575384 - DNA, 20 bp, Artificial Sequence
  chemically synthesized
aaagctctactatttagagc

SEQ ID NO: 575385 - DNA, 20 bp, Artificial Sequence
  chemically synthesized
taaacatgagctctaaatag

SEQ ID NO: 575386 - DNA, 20 bp, Artificial Sequence
  chemically synthesized
ttatgtcttcataatagaat

SEQ ID NO: 575387 - DNA, 20 bp, Artificial Sequence
  chemically synthesized
tgctgtacacgtttctaaag

SEQ ID NO: 575388 - DNA, 20 bp, Artificial Sequence
  chemically synthesized
tagattgctgtacacgtttc

SEQ ID NO: 575389 - DNA, 20 bp, Artificial Sequence
  chemically synthesized
ttttatttttagattgctgt

SEQ ID NO: 575390 - DNA, 20 bp, Artificial Sequence
  chemically synthesized
ttaagccgatgctttttatt

SEQ ID NO: 575391 - DNA, 20 bp, Artificial Sequence
  chemically synthesized
gcaatctaaaaataaaaagc

SEQ ID NO: 575392 - DNA, 20 bp, Artificial Sequence
  chemically synthesized
cagacatacaaaatttaagc

SEQ ID NO: 575393 - DNA, 20 bp, Artificial Sequence
  chemically synthesized
ttacaaaagtatcagtctat

SEQ ID NO: 575394 - DNA, 20 bp, Artificial Sequence
  chemically synthesized
ttttttttttttttttttgc

SEQ ID NO: 575395 - DNA, 20 bp, Artificial Sequence
  chemically synthesized
gggttttttttttttttttt

SEQ ID NO: 575396 - DNA, 20 bp, Artificial Sequence
  chemically synthesized
cttgttaggaaagatccact

SEQ ID NO: 575397 - DNA, 20 bp, Artificial Sequence
  chemically synthesized
cccgaagtggatctttccta

SEQ ID NO: 575398 - DNA, 20 bp, Artificial Sequence
  chemically synthesized
ctgtgggtccaatttcttcc

SEQ ID NO: 575399 - DNA, 20 bp, Artificial Sequence
  chemically synthesized
gacccacagtcttggcctta

SEQ ID NO: 575400 - DNA, 20 bp, Artificial Sequence
  chemically synthesized
ctggttaggaacctccggtg

SEQ ID NO: 575401 - DNA, 20 bp, Artificial Sequence
  chemically synthesized
acagactcacaagagggtgt

SEQ ID NO: 575402 - DNA, 20 bp, Artificial Sequence
  chemically synthesized
ttctcttgggacgacaactc

SEQ ID NO: 575403 - DNA, 20 bp, Artificial Sequence
  chemically synthesized
acagcagtcctcaaattaac

SEQ ID NO: 575404 - DNA, 20 bp, Artificial Sequence
  chemically synthesized
acaagagttaatttgaggac

SEQ ID NO: 575405 - DNA, 20 bp, Artificial Sequence
  chemically synthesized
agttaatttgaggactgctg

SEQ ID NO: 575406 - DNA, 20 bp, Artificial Sequence
  chemically synthesized
ttgctctaggtagataagga

SEQ ID NO: 575407 - DNA, 20 bp, Artificial Sequence
  chemically synthesized
ttgcatcttaaacgagcagc

SEQ ID NO: 575408 - DNA, 20 bp, Artificial Sequence
  chemically synthesized
ggactcctaaatccatagct

SEQ ID NO: 575409 - DNA, 20 bp, Artificial Sequence
  chemically synthesized
agctatggatttaggagtcc

SEQ ID NO: 575410 - DNA, 20 bp, Artificial Sequence
  chemically synthesized
tggatttaggagtccacagg

SEQ ID NO: 575411 - DNA, 20 bp, Artificial Sequence
  chemically synthesized
tctctgaggactttaataac

SEQ ID NO: 575412 - DNA, 20 bp, Artificial Sequence
  chemically synthesized
cctcagagactattatcctg

SEQ ID NO: 575413 - DNA, 20 bp, Artificial Sequence
  chemically synthesized
tatcctgcagggtttgttgt

SEQ ID NO: 575414 - DNA, 20 bp, Artificial Sequence
  chemically synthesized
atcccttctctctgctgttg

SEQ ID NO: 575415 - DNA, 20 bp, Artificial Sequence
  chemically synthesized
tctctcagcagggagaaggg

SEQ ID NO: 575416 - DNA, 20 bp, Artificial Sequence
  chemically synthesized
cctcagtatattcccaagtg

SEQ ID NO: 575417 - DNA, 20 bp, Artificial Sequence
  chemically synthesized
ttaaagattagattttgaaa

SEQ ID NO: 575418 - DNA, 20 bp, Artificial Sequence
  chemically synthesized
taggccaggcatttttaaag

SEQ ID NO: 575419 - DNA, 20 bp, Artificial Sequence
  chemically synthesized
caccctaggccaggcatttt

SEQ ID NO: 575420 - DNA, 20 bp, Artificial Sequence
  chemically synthesized
tttaaaaatgcctggcctag

SEQ ID NO: 575421 - DNA, 20 bp, Artificial Sequence
  chemically synthesized
gggattgcttaaggcggttt

SEQ ID NO: 575422 - DNA, 20 bp, Artificial Sequence
  chemically synthesized
cagagttcgggattgcttaa

SEQ ID NO: 575423 - DNA, 20 bp, Artificial Sequence
  chemically synthesized
cacgtattaccagagttcgg

SEQ ID NO: 575424 - DNA, 20 bp, Artificial Sequence
  chemically synthesized
gcatcacgtattaccagagt

SEQ ID NO: 575425 - DNA, 20 bp, Artificial Sequence
  chemically synthesized
tcccgaactctggtaatacg

SEQ ID NO: 575426 - DNA, 20 bp, Artificial Sequence
  chemically synthesized
gtgaccctctgactccattc

SEQ ID NO: 575427 - DNA, 20 bp, Artificial Sequence
  chemically synthesized
aggagatcttaaatgaactc

SEQ ID NO: 575428 - DNA, 20 bp, Artificial Sequence
  chemically synthesized
aggtatctttctcatctacg

SEQ ID NO: 575429 - DNA, 20 bp, Artificial Sequence
  chemically synthesized
ctcatctacgtcttgttttt

SEQ ID NO: 575430 - DNA, 20 bp, Artificial Sequence
  chemically synthesized
ggccgataatacctaccttt

SEQ ID NO: 575431 - DNA, 20 bp, Artificial Sequence
  chemically synthesized
cctaccttttaaggttttgg

SEQ ID NO: 575432 - DNA, 20 bp, Artificial Sequence
  chemically synthesized
acccaatgcctaacctattg

SEQ ID NO: 575433 - DNA, 20 bp, Artificial Sequence
  chemically synthesized
gcctcatatcttctctgcta

SEQ ID NO: 575434 - DNA, 20 bp, Artificial Sequence
  chemically synthesized
cccatcttcatgcagtaggt

SEQ ID NO: 575435 - DNA, 20 bp, Artificial Sequence
  chemically synthesized
aagggtacagtgtagccaat

SEQ ID NO: 575436 - DNA, 20 bp, Artificial Sequence
  chemically synthesized
tgagagcttagaatgccgcc

SEQ ID NO: 575437 - DNA, 20 bp, Artificial Sequence
  chemically synthesized
aatgccgcctggagattttt

SEQ ID NO: 575438 - DNA, 20 bp, Artificial Sequence
  chemically synthesized
ctgtaaggataatattccac

SEQ ID NO: 575439 - DNA, 20 bp, Artificial Sequence
  chemically synthesized
attgtgaaaatagcatctgg

SEQ ID NO: 575440 - DNA, 20 bp, Artificial Sequence
  chemically synthesized
catacaggaaccaaaacagc

SEQ ID NO: 575441 - DNA, 20 bp, Artificial Sequence
  chemically synthesized
ctctctgattctgaagccac

SEQ ID NO: 575442 - DNA, 20 bp, Artificial Sequence
  chemically synthesized
atccctcttctttaccttct

SEQ ID NO: 575443 - DNA, 20 bp, Artificial Sequence
  chemically synthesized
agttataaaaatagctgcat

SEQ ID NO: 575444 - DNA, 20 bp, Artificial Sequence
  chemically synthesized
gtaagaaaaaaatacatatg

SEQ ID NO: 575445 - DNA, 20 bp, Artificial Sequence
  chemically synthesized
gtgtgtgtgtgtgtgtgtgt

SEQ ID NO: 575446 - DNA, 20 bp, Artificial Sequence
  chemically synthesized
tgcccttgtcatttggtgtc

SEQ ID NO: 575447 - DNA, 20 bp, Artificial Sequence
  chemically synthesized
gggagtcacctgtgcctata

SEQ ID NO: 575448 - DNA, 20 bp, Artificial Sequence
  chemically synthesized
ctggcacccatatagtttag

SEQ ID NO: 575449 - DNA, 20 bp, Artificial Sequence
  chemically synthesized
tcctttagaactggcaccca

SEQ ID NO: 575450 - DNA, 20 bp, Artificial Sequence
  chemically synthesized
agaaaaagtgggtagagtaa

SEQ ID NO: 575451 - DNA, 20 bp, Artificial Sequence
  chemically synthesized
cattagttctccactgggtc

SEQ ID NO: 575452 - DNA, 20 bp, Artificial Sequence
  chemically synthesized
aaaggcatgccattcttttt

SEQ ID NO: 575453 - DNA, 20 bp, Artificial Sequence
  chemically synthesized
aaactcagcctgtctttaag

SEQ ID NO: 575454 - DNA, 20 bp, Artificial Sequence
  chemically synthesized
aaacgagtcttaaagacagg

SEQ ID NO: 575455 - DNA, 20 bp, Artificial Sequence
  chemically synthesized
tattgcagcacagtattttc

SEQ ID NO: 575456 - DNA, 20 bp, Artificial Sequence
  chemically synthesized
ggtttgcatgttaaggtctt

SEQ ID NO: 575457 - DNA, 20 bp, Artificial Sequence
  chemically synthesized
aaagaccttaacatgcaaac

SEQ ID NO: 575458 - DNA, 20 bp, Artificial Sequence
  chemically synthesized
tgtgacttaaatgtacaatc

SEQ ID NO: 575459 - DNA, 20 bp, Artificial Sequence
  chemically synthesized
tctacaatgttgaaggtact

SEQ ID NO: 575460 - DNA, 20 bp, Artificial Sequence
  chemically synthesized
tattttatgtgcaggaatca

SEQ ID NO: 575461 - DNA, 20 bp, Artificial Sequence
  chemically synthesized
agggtagttttcttcaaaca

SEQ ID NO: 575462 - DNA, 20 bp, Artificial Sequence
  chemically synthesized
tctggtctttctcagataag

SEQ ID NO: 575463 - DNA, 20 bp, Artificial Sequence
  chemically synthesized
tctttccaactctgagacat

SEQ ID NO: 575464 - DNA, 20 bp, Artificial Sequence
  chemically synthesized
gctgtaagtattagttcctg

SEQ ID NO: 575465 - DNA, 20 bp, Artificial Sequence
  chemically synthesized
ctatttcatagagttggtgt

SEQ ID NO: 575466 - DNA, 20 bp, Artificial Sequence
  chemically synthesized
tatcccctatcgaggaaacc

SEQ ID NO: 575467 - DNA, 20 bp, Artificial Sequence
  chemically synthesized
gttactttacctctcaaact

SEQ ID NO: 575468 - DNA, 20 bp, Artificial Sequence
  chemically synthesized
tctgccacataacaacaact

SEQ ID NO: 575469 - DNA, 20 bp, Artificial Sequence
  chemically synthesized
caggaagatctatgctctaa

SEQ ID NO: 575470 - DNA, 20 bp, Artificial Sequence
  chemically synthesized
agggaagagaataaaaataa

SEQ ID NO: 575471 - DNA, 20 bp, Artificial Sequence
  chemically synthesized
ttaatggatggggaagacac

SEQ ID NO: 575472 - DNA, 20 bp, Artificial Sequence
  chemically synthesized
tgtagcccaagtcagaagtc

SEQ ID NO: 575473 - DNA, 20 bp, Artificial Sequence
  chemically synthesized
attaaggcatctgtgagata

SEQ ID NO: 575474 - DNA, 20 bp, Artificial Sequence
  chemically synthesized
tgaataattttccaattagg

SEQ ID NO: 575475 - DNA, 20 bp, Artificial Sequence
  chemically synthesized
caactcagaactaatatcat

SEQ ID NO: 575476 - DNA, 20 bp, Artificial Sequence
  chemically synthesized
tatgtaatatagacaaattg

SEQ ID NO: 575477 - DNA, 20 bp, Artificial Sequence
  chemically synthesized
attccagaaataagagcttt

SEQ ID NO: 575478 - DNA, 20 bp, Artificial Sequence
  chemically synthesized
gacaaagagattccagaaat

SEQ ID NO: 575479 - DNA, 20 bp, Artificial Sequence
  chemically synthesized
caaaaaatagcttagtgaca

SEQ ID NO: 575480 - DNA, 20 bp, Artificial Sequence
  chemically synthesized
tgattctctggaggacaaaa

SEQ ID NO: 575481 - DNA, 20 bp, Artificial Sequence
  chemically synthesized
taatatacaaccttgaacca

SEQ ID NO: 575482 - DNA, 20 bp, Artificial Sequence
  chemically synthesized
gatgagacttgacatcaact

SEQ ID NO: 575483 - DNA, 20 bp, Artificial Sequence
  chemically synthesized
tatggcactttgccatatgt

SEQ ID NO: 575484 - DNA, 20 bp, Artificial Sequence
  chemically synthesized
gggaattacctacatggctg

SEQ ID NO: 575485 - DNA, 20 bp, Artificial Sequence
  chemically synthesized
cagccatgtaggtaattccc

SEQ ID NO: 575486 - DNA, 20 bp, Artificial Sequence
  chemically synthesized
catgtaggtaattccctctg

SEQ ID NO: 575487 - DNA, 20 bp, Artificial Sequence
  chemically synthesized
agtgggggatagaatgaagt

SEQ ID NO: 575488 - DNA, 20 bp, Artificial Sequence
  chemically synthesized
gtggttgcgtgggagtattt

SEQ ID NO: 575489 - DNA, 20 bp, Artificial Sequence
  chemically synthesized
aaacaattacatcagtgtag

SEQ ID NO: 575490 - DNA, 20 bp, Artificial Sequence
  chemically synthesized
aaacaaccctacactgatgt

SEQ ID NO: 575491 - DNA, 20 bp, Artificial Sequence
  chemically synthesized
aatgaaaaaaatagaaatgt

SEQ ID NO: 575492 - DNA, 20 bp, Artificial Sequence
  chemically synthesized
cagttgtgtctgatgagtgt

SEQ ID NO: 575493 - DNA, 20 bp, Artificial Sequence
  chemically synthesized
aaaacttatgaatacctaga

SEQ ID NO: 575494 - DNA, 20 bp, Artificial Sequence
  chemically synthesized
aaaactatttctaggtattc

SEQ ID NO: 575495 - DNA, 20 bp, Artificial Sequence
  chemically synthesized
tccaattatatcagcaggac

SEQ ID NO: 575496 - DNA, 20 bp, Artificial Sequence
  chemically synthesized
agtcctgctgatataattgg

SEQ ID NO: 575497 - DNA, 20 bp, Artificial Sequence
  chemically synthesized
tagatagttctttcatccta

SEQ ID NO: 575498 - DNA, 20 bp, Artificial Sequence
  chemically synthesized
atacattaacaaaagagtaa

SEQ ID NO: 575499 - DNA, 20 bp, Artificial Sequence
  chemically synthesized
ctcattcttagaacccattc

SEQ ID NO: 575500 - DNA, 20 bp, Artificial Sequence
  chemically synthesized
tcatgagctttccattgtga

SEQ ID NO: 575501 - DNA, 20 bp, Artificial Sequence
  chemically synthesized
agctttccattgtgatatgg

SEQ ID NO: 575502 - DNA, 20 bp, Artificial Sequence
  chemically synthesized
cccccggattacagttctag

SEQ ID NO: 575503 - DNA, 20 bp, Artificial Sequence
  chemically synthesized
atcacctcccaccaggttcc

SEQ ID NO: 575504 - DNA, 20 bp, Artificial Sequence
  chemically synthesized
atccgggggaacctggtggg

SEQ ID NO: 575505 - DNA, 20 bp, Artificial Sequence
  chemically synthesized
ggaggtgattggatcatggg

SEQ ID NO: 575506 - DNA, 20 bp, Artificial Sequence
  chemically synthesized
catgggggtggcttccccca

SEQ ID NO: 575507 - DNA, 20 bp, Artificial Sequence
  chemically synthesized
gtgatagtgagtgagttctc

SEQ ID NO: 575508 - DNA, 20 bp, Artificial Sequence
  chemically synthesized
agtgagttctcatgagattt

SEQ ID NO: 575509 - DNA, 20 bp, Artificial Sequence
  chemically synthesized
tctctcctgctgccttgtga

SEQ ID NO: 575510 - DNA, 20 bp, Artificial Sequence
  chemically synthesized
tgtgaaggtgcttccttccc

SEQ ID NO: 575511 - DNA, 20 bp, Artificial Sequence
  chemically synthesized
tccttcccctttgctttcca

SEQ ID NO: 575512 - DNA, 20 bp, Artificial Sequence
  chemically synthesized
ctttgctttccaccatgatt

SEQ ID NO: 575513 - DNA, 20 bp, Artificial Sequence
  chemically synthesized
ggtaatttatttaaagaaaa

SEQ ID NO: 575514 - DNA, 20 bp, Artificial Sequence
  chemically synthesized
tagatacacgatgtatatta

SEQ ID NO: 575515 - DNA, 20 bp, Artificial Sequence
  chemically synthesized
agcatcttctgaactgaact

SEQ ID NO: 575516 - DNA, 20 bp, Artificial Sequence
  chemically synthesized
ggacacaaaaaataccctgg

SEQ ID NO: 575517 - DNA, 20 bp, Artificial Sequence
  chemically synthesized
aatggcgtgaacccgggagg

SEQ ID NO: 575518 - DNA, 20 bp, Artificial Sequence
  chemically synthesized
cacctcagcctcccaaagtg

SEQ ID NO: 575519 - DNA, 20 bp, Artificial Sequence
  chemically synthesized
cccaaaccttgctcttttgg

SEQ ID NO: 575520 - DNA, 20 bp, Artificial Sequence
  chemically synthesized
gaaaatcatccccaaaagag

SEQ ID NO: 575521 - DNA, 20 bp, Artificial Sequence
  chemically synthesized
cccaaaagagcaaggtttgg

SEQ ID NO: 575522 - DNA, 20 bp, Artificial Sequence
  chemically synthesized
aacagataagaggatgactt

SEQ ID NO: 575523 - DNA, 20 bp, Artificial Sequence
  chemically synthesized
acttttttttttttttgaga

SEQ ID NO: 575524 - DNA, 20 bp, Artificial Sequence
  chemically synthesized
tctgtccccctcctgggttc

SEQ ID NO: 575525 - DNA, 20 bp, Artificial Sequence
  chemically synthesized
tcaggaggctgaggcaggag

SEQ ID NO: 575526 - DNA, 20 bp, Artificial Sequence
  chemically synthesized
tgcctcagcctcctgagtag

SEQ ID NO: 575527 - DNA, 20 bp, Artificial Sequence
  chemically synthesized
ggcacctgccaccatgcccg

SEQ ID NO: 575528 - DNA, 20 bp, Artificial Sequence
  chemically synthesized
ttttttatttttagtagaga

SEQ ID NO: 575529 - DNA, 20 bp, Artificial Sequence
  chemically synthesized
accttatgtgacccacctgc

SEQ ID NO: 575530 - DNA, 20 bp, Artificial Sequence
  chemically synthesized
tgcctcagcttcccaaagtg

SEQ ID NO: 575531 - DNA, 20 bp, Artificial Sequence
  chemically synthesized
gcacctggactacattttaa

SEQ ID NO: 575532 - DNA, 20 bp, Artificial Sequence
  chemically synthesized
acgattaaagaacagtggaa

SEQ ID NO: 575533 - DNA, 20 bp, Artificial Sequence
  chemically synthesized
tcttactcagggtgttatga

SEQ ID NO: 575534 - DNA, 20 bp, Artificial Sequence
  chemically synthesized
tttgggtcaccatgaggctt

SEQ ID NO: 575535 - DNA, 20 bp, Artificial Sequence
  chemically synthesized
attctctgtttgggtcacca

SEQ ID NO: 575536 - DNA, 20 bp, Artificial Sequence
  chemically synthesized
acatgacttagttaacaatt

SEQ ID NO: 575537 - DNA, 20 bp, Artificial Sequence
  chemically synthesized
tgttaactaagtcatgtcca

SEQ ID NO: 575538 - DNA, 20 bp, Artificial Sequence
  chemically synthesized
catagtgctttaccatggac

SEQ ID NO: 575539 - DNA, 20 bp, Artificial Sequence
  chemically synthesized
gcagagatttacaacatttc

SEQ ID NO: 575540 - DNA, 20 bp, Artificial Sequence
  chemically synthesized
gctgttgaaatgttgtaaat

SEQ ID NO: 575541 - DNA, 20 bp, Artificial Sequence
  chemically synthesized
gaaatgttgtaaatctctgc

SEQ ID NO: 575542 - DNA, 20 bp, Artificial Sequence
  chemically synthesized
aaccgtatcacaaactcaag

SEQ ID NO: 575543 - DNA, 20 bp, Artificial Sequence
  chemically synthesized
atctctgcttgagtttgtga

SEQ ID NO: 575544 - DNA, 20 bp, Artificial Sequence
  chemically synthesized
taacattaataattatccac

SEQ ID NO: 575545 - DNA, 20 bp, Artificial Sequence
  chemically synthesized
cttgctgaaaaacctttctg

SEQ ID NO: 575546 - DNA, 20 bp, Artificial Sequence
  chemically synthesized
actctgacaaaaccaggcag

SEQ ID NO: 575547 - DNA, 20 bp, Artificial Sequence
  chemically synthesized
ccttttacacattcactttt

SEQ ID NO: 575548 - DNA, 20 bp, Artificial Sequence
  chemically synthesized
gttttaagagtatttttagt

SEQ ID NO: 575549 - DNA, 20 bp, Artificial Sequence
  chemically synthesized
aaaatagagaacttacatct

SEQ ID NO: 575550 - DNA, 20 bp, Artificial Sequence
  chemically synthesized
catgttattttggttcattt

SEQ ID NO: 575551 - DNA, 20 bp, Artificial Sequence
  chemically synthesized
ttgttcccacagggctgtgt

SEQ ID NO: 575552 - DNA, 20 bp, Artificial Sequence
  chemically synthesized
agaacaattagccttgcccc

SEQ ID NO: 575553 - DNA, 20 bp, Artificial Sequence
  chemically synthesized
aacttcattcatgtttttcc

SEQ ID NO: 575554 - DNA, 20 bp, Artificial Sequence
  chemically synthesized
cgtcttatcttcaacttcat

SEQ ID NO: 575555 - DNA, 20 bp, Artificial Sequence
  chemically synthesized
tagctgcacaggaaggaggg

SEQ ID NO: 575556 - DNA, 20 bp, Artificial Sequence
  chemically synthesized
aaggagggcctggattgtga

SEQ ID NO: 575557 - DNA, 20 bp, Artificial Sequence
  chemically synthesized
aggggcttgtgtatcaagct

SEQ ID NO: 575558 - DNA, 20 bp, Artificial Sequence
  chemically synthesized
cacaggataaagtccaaacc

SEQ ID NO: 575559 - DNA, 20 bp, Artificial Sequence
  chemically synthesized
ttatcctgtgaagatgtcta

SEQ ID NO: 575560 - DNA, 20 bp, Artificial Sequence
  chemically synthesized
tgtgaagatgtctaatctgt

SEQ ID NO: 575561 - DNA, 20 bp, Artificial Sequence
  chemically synthesized
gatgttaccaaaaaatctta

SEQ ID NO: 575562 - DNA, 20 bp, Artificial Sequence
  chemically synthesized
tctcatcctgtgtctattac

SEQ ID NO: 575563 - DNA, 20 bp, Artificial Sequence
  chemically synthesized
ataacatatagggaggcaag

SEQ ID NO: 575564 - DNA, 20 bp, Artificial Sequence
  chemically synthesized
atagggaggcaagttgggtt

SEQ ID NO: 575565 - DNA, 20 bp, Artificial Sequence
  chemically synthesized
tgaatttccaaggagatgtg

SEQ ID NO: 575566 - DNA, 20 bp, Artificial Sequence
  chemically synthesized
ggagatgtgagcagtttaac

SEQ ID NO: 575567 - DNA, 20 bp, Artificial Sequence
  chemically synthesized
acagtggttctcaaacttga

SEQ ID NO: 575568 - DNA, 20 bp, Artificial Sequence
  chemically synthesized
tgggtgattctcaagcccac

SEQ ID NO: 575569 - DNA, 20 bp, Artificial Sequence
  chemically synthesized
tgtgttttaatgagccctct

SEQ ID NO: 575570 - DNA, 20 bp, Artificial Sequence
  chemically synthesized
tcagagtggagcccagcagc

SEQ ID NO: 575571 - DNA, 20 bp, Artificial Sequence
  chemically synthesized
ctgggctccactctgagaga

SEQ ID NO: 575572 - DNA, 20 bp, Artificial Sequence
  chemically synthesized
taagggctgttatgctagaa

SEQ ID NO: 575573 - DNA, 20 bp, Artificial Sequence
  chemically synthesized
taaaggcattcatgacctcc

SEQ ID NO: 575574 - DNA, 20 bp, Artificial Sequence
  chemically synthesized
ttgtgtttataaatatttct

SEQ ID NO: 575575 - DNA, 20 bp, Artificial Sequence
  chemically synthesized
gtgaagtaataggtcgtatt

SEQ ID NO: 575576 - DNA, 20 bp, Artificial Sequence
  chemically synthesized
aaaatacgacctattacttc

SEQ ID NO: 575577 - DNA, 20 bp, Artificial Sequence
  chemically synthesized
cctccacccccgggacatac

SEQ ID NO: 575578 - DNA, 20 bp, Artificial Sequence
  chemically synthesized
cattggaaaatggcaccaaa

SEQ ID NO: 575579 - DNA, 20 bp, Artificial Sequence
  chemically synthesized
gtgagcctacgtacaaaatg

SEQ ID NO: 575580 - DNA, 20 bp, Artificial Sequence
  chemically synthesized
gcctgcctgtggaaggacgg

SEQ ID NO: 575581 - DNA, 20 bp, Artificial Sequence
  chemically synthesized
cagagagcctagagccctac

SEQ ID NO: 575582 - DNA, 20 bp, Artificial Sequence
  chemically synthesized
tatcttttcctttgatcttg

SEQ ID NO: 575583 - DNA, 20 bp, Artificial Sequence
  chemically synthesized
aaaggaaaagataattaaga

SEQ ID NO: 575584 - DNA, 20 bp, Artificial Sequence
  chemically synthesized
tttgtgtagcacagctgatt

SEQ ID NO: 575585 - DNA, 20 bp, Artificial Sequence
  chemically synthesized
ctcatatctttgtgtagcac

SEQ ID NO: 575586 - DNA, 20 bp, Artificial Sequence
  chemically synthesized
ttaccctaagaatctttctt

SEQ ID NO: 575587 - DNA, 20 bp, Artificial Sequence
  chemically synthesized
gggctatggaaagcacataa

SEQ ID NO: 575588 - DNA, 20 bp, Artificial Sequence
  chemically synthesized
attcatgcaataaagaacac

SEQ ID NO: 575589 - DNA, 20 bp, Artificial Sequence
  chemically synthesized
ggggttaaggttctttaaat

SEQ ID NO: 575590 - DNA, 20 bp, Artificial Sequence
  chemically synthesized
gcccgctgagctggagagca

SEQ ID NO: 575591 - DNA, 20 bp, Artificial Sequence
  chemically synthesized
ctggagagcagaacgcttcc

SEQ ID NO: 575592 - DNA, 20 bp, Artificial Sequence
  chemically synthesized
tgactcagaggcgtattttc

SEQ ID NO: 575593 - DNA, 20 bp, Artificial Sequence
  chemically synthesized
aaaatacgcctctgagtcaa

SEQ ID NO: 575594 - DNA, 20 bp, Artificial Sequence
  chemically synthesized
agattttctgttattgcatg

SEQ ID NO: 575595 - DNA, 20 bp, Artificial Sequence
  chemically synthesized
aagaaaattctgtctgatgg

SEQ ID NO: 575596 - DNA, 20 bp, Artificial Sequence
  chemically synthesized
tctgatggtaatgttttagc

SEQ ID NO: 575597 - DNA, 20 bp, Artificial Sequence
  chemically synthesized
tgcccaggatgagacccaat

SEQ ID NO: 575598 - DNA, 20 bp, Artificial Sequence
  chemically synthesized
taatgataacatctcttcaa

SEQ ID NO: 575599 - DNA, 20 bp, Artificial Sequence
  chemically synthesized
cagccagcctatggaatgac

SEQ ID NO: 575600 - DNA, 20 bp, Artificial Sequence
  chemically synthesized
atgaccccggtttcactctg

SEQ ID NO: 575601 - DNA, 20 bp, Artificial Sequence
  chemically synthesized
gtttcactctgataagattc

SEQ ID NO: 575602 - DNA, 20 bp, Artificial Sequence
  chemically synthesized
actctgataagattccatgg

SEQ ID NO: 575603 - DNA, 20 bp, Artificial Sequence
  chemically synthesized
ccatggctttgtttgaggct

SEQ ID NO: 575604 - DNA, 20 bp, Artificial Sequence
  chemically synthesized
acttatctctccaataaaga

SEQ ID NO: 575605 - DNA, 20 bp, Artificial Sequence
  chemically synthesized
atggacttatctctccaata

SEQ ID NO: 575606 - DNA, 20 bp, Artificial Sequence
  chemically synthesized
agtgttcacttccgtgctca

SEQ ID NO: 575607 - DNA, 20 bp, Artificial Sequence
  chemically synthesized
catcctttcagctttcacct

SEQ ID NO: 575608 - DNA, 20 bp, Artificial Sequence
  chemically synthesized
gacaggtgaaagctgaaagg

SEQ ID NO: 575609 - DNA, 20 bp, Artificial Sequence
  chemically synthesized
tctcagggcaagcacatcct

SEQ ID NO: 575610 - DNA, 20 bp, Artificial Sequence
  chemically synthesized
aggccataggacataaggag

SEQ ID NO: 575611 - DNA, 20 bp, Artificial Sequence
  chemically synthesized
tatgtcctatggcctactct

SEQ ID NO: 575612 - DNA, 20 bp, Artificial Sequence
  chemically synthesized
gcctactctcatggttttaa

SEQ ID NO: 575613 - DNA, 20 bp, Artificial Sequence
  chemically synthesized
ccattcagggaattgtaacc

SEQ ID NO: 575614 - DNA, 20 bp, Artificial Sequence
  chemically synthesized
ttacaattccctgaatggat

SEQ ID NO: 575615 - DNA, 20 bp, Artificial Sequence
  chemically synthesized
ccttgctttctcaggcacca

SEQ ID NO: 575616 - DNA, 20 bp, Artificial Sequence
  chemically synthesized
tgactactcaaggagtattt

SEQ ID NO: 575617 - DNA, 20 bp, Artificial Sequence
  chemically synthesized
ggaaatactccttgagtagt

SEQ ID NO: 575618 - DNA, 20 bp, Artificial Sequence
  chemically synthesized
gaaatagtcttagctacttt

SEQ ID NO: 575619 - DNA, 20 bp, Artificial Sequence
  chemically synthesized
ttcttcactgtaaaatcaat

SEQ ID NO: 575620 - DNA, 20 bp, Artificial Sequence
  chemically synthesized
tccaaagcttaaaaatctta

SEQ ID NO: 575621 - DNA, 20 bp, Artificial Sequence
  chemically synthesized
gtaaaatcaatataagattt

SEQ ID NO: 575622 - DNA, 20 bp, Artificial Sequence
  chemically synthesized
ttttcgggtttgagtagttc

SEQ ID NO: 575623 - DNA, 20 bp, Artificial Sequence
  chemically synthesized
tggaactactcaaacccgaa

SEQ ID NO: 575624 - DNA, 20 bp, Artificial Sequence
  chemically synthesized
tctgggtaggcaagctattt

SEQ ID NO: 575625 - DNA, 20 bp, Artificial Sequence
  chemically synthesized
agtattcattaaatgatatg

SEQ ID NO: 575626 - DNA, 20 bp, Artificial Sequence
  chemically synthesized
aactgattttttacttggct

SEQ ID NO: 575627 - DNA, 20 bp, Artificial Sequence
  chemically synthesized
tatgatttccctgtcatatg

SEQ ID NO: 575628 - DNA, 20 bp, Artificial Sequence
  chemically synthesized
tttattcgccccatgtgtta

SEQ ID NO: 575629 - DNA, 20 bp, Artificial Sequence
  chemically synthesized
cgaataaaatctttcaaaag

SEQ ID NO: 575630 - DNA, 20 bp, Artificial Sequence
  chemically synthesized
gatctcaaaactgatctttt

SEQ ID NO: 575631 - DNA, 20 bp, Artificial Sequence
  chemically synthesized
atccaagatgatcattaaat

SEQ ID NO: 575632 - DNA, 20 bp, Artificial Sequence
  chemically synthesized
aaagttccaagtcctctttt

SEQ ID NO: 575633 - DNA, 20 bp, Artificial Sequence
  chemically synthesized
tctccatgaatattgtcatg

SEQ ID NO: 575634 - DNA, 20 bp, Artificial Sequence
  chemically synthesized
ctatttcatttagcacaata

SEQ ID NO: 575635 - DNA, 20 bp, Artificial Sequence
  chemically synthesized
tgggagttatgaaataactc

SEQ ID NO: 575636 - DNA, 20 bp, Artificial Sequence
  chemically synthesized
ctcaaatgatttctactaat

SEQ ID NO: 575637 - DNA, 20 bp, Artificial Sequence
  chemically synthesized
tcagtaaattaaagaccctc

SEQ ID NO: 575638 - DNA, 20 bp, Artificial Sequence
  chemically synthesized
aaattctcatcaaatagtta

SEQ ID NO: 575639 - DNA, 20 bp, Artificial Sequence
  chemically synthesized
taaaatatatcagatttcta

SEQ ID NO: 575640 - DNA, 20 bp, Artificial Sequence
  chemically synthesized
atgtgcctcttttaaaatat

SEQ ID NO: 575641 - DNA, 20 bp, Artificial Sequence
  chemically synthesized
tcaacgagtaaagtgaaatt

SEQ ID NO: 575642 - DNA, 20 bp, Artificial Sequence
  chemically synthesized
cattaactttttgctgtaac

SEQ ID NO: 575643 - DNA, 20 bp, Artificial Sequence
  chemically synthesized
gttacagcaaaaagttaatg

SEQ ID NO: 575644 - DNA, 20 bp, Artificial Sequence
  chemically synthesized
tgaaacaggggaattttatc

SEQ ID NO: 575645 - DNA, 20 bp, Artificial Sequence
  chemically synthesized
ttaaaccttggataaaattc

SEQ ID NO: 575646 - DNA, 20 bp, Artificial Sequence
  chemically synthesized
cactatcaccatcacagata

SEQ ID NO: 575647 - DNA, 20 bp, Artificial Sequence
  chemically synthesized
agaatggtgttgtcttttca

SEQ ID NO: 575648 - DNA, 20 bp, Artificial Sequence
  chemically synthesized
gacaacaccattctcagtag

SEQ ID NO: 575649 - DNA, 20 bp, Artificial Sequence
  chemically synthesized
acaccattctcagtagaact

SEQ ID NO: 575650 - DNA, 20 bp, Artificial Sequence
  chemically synthesized
gtttgcttacactcagttag

SEQ ID NO: 575651 - DNA, 20 bp, Artificial Sequence
  chemically synthesized
cagttagccaagcttctact

SEQ ID NO: 575652 - DNA, 20 bp, Artificial Sequence
  chemically synthesized
tggcaatgaaatcaggtagt

SEQ ID NO: 575653 - DNA, 20 bp, Artificial Sequence
  chemically synthesized
gctgctacccaagttatcct

SEQ ID NO: 575654 - DNA, 20 bp, Artificial Sequence
  chemically synthesized
tattacttctcccaacatcc

SEQ ID NO: 575655 - DNA, 20 bp, Artificial Sequence
  chemically synthesized
atcccactgcttccagttgc

SEQ ID NO: 575656 - DNA, 20 bp, Artificial Sequence
  chemically synthesized
ggttcaagtttctaggctac

SEQ ID NO: 575657 - DNA, 20 bp, Artificial Sequence
  chemically synthesized
cctagaaacttgaaccaccc

SEQ ID NO: 575658 - DNA, 20 bp, Artificial Sequence
  chemically synthesized
atttaaaacacttgggtggt

SEQ ID NO: 575659 - DNA, 20 bp, Artificial Sequence
  chemically synthesized
tttttccttcccaattttcc

SEQ ID NO: 575660 - DNA, 20 bp, Artificial Sequence
  chemically synthesized
agggaaaattgggaaggaaa

SEQ ID NO: 575661 - DNA, 20 bp, Artificial Sequence
  chemically synthesized
ttgggaaggaaaaagtgttt

SEQ ID NO: 575662 - DNA, 20 bp, Artificial Sequence
  chemically synthesized
catgtttccgaagagcggca

SEQ ID NO: 575663 - DNA, 20 bp, Artificial Sequence
  chemically synthesized
gagcggcattgtgcttgtat

SEQ ID NO: 575664 - DNA, 20 bp, Artificial Sequence
  chemically synthesized
tgcttgtatgactgtttttc

SEQ ID NO: 575665 - DNA, 20 bp, Artificial Sequence
  chemically synthesized
cagctttgactttttggaga

SEQ ID NO: 575666 - DNA, 20 bp, Artificial Sequence
  chemically synthesized
agaactctttgtaagttggg

SEQ ID NO: 575667 - DNA, 20 bp, Artificial Sequence
  chemically synthesized
ttagagaactctttgtaagt

SEQ ID NO: 575668 - DNA, 20 bp, Artificial Sequence
  chemically synthesized
gttctggaccatttatttgc

SEQ ID NO: 575669 - DNA, 20 bp, Artificial Sequence
  chemically synthesized
actattgtgtccatggaaat

SEQ ID NO: 575670 - DNA, 20 bp, Artificial Sequence
  chemically synthesized
agctatttaacctataccat

SEQ ID NO: 575671 - DNA, 20 bp, Artificial Sequence
  chemically synthesized
tgatagcatgactttgggtt

SEQ ID NO: 575672 - DNA, 20 bp, Artificial Sequence
  chemically synthesized
atatgcatcttttgggatat

SEQ ID NO: 575673 - DNA, 20 bp, Artificial Sequence
  chemically synthesized
aaatacttcctattttaaga

SEQ ID NO: 575674 - DNA, 20 bp, Artificial Sequence
  chemically synthesized
ttttctactcccaaacttcc

SEQ ID NO: 575675 - DNA, 20 bp, Artificial Sequence
  chemically synthesized
gaatgaggattaaaacataa

SEQ ID NO: 575676 - DNA, 20 bp, Artificial Sequence
  chemically synthesized
tttcaacagatagaagagaa

SEQ ID NO: 575677 - DNA, 20 bp, Artificial Sequence
  chemically synthesized
tgtcagtctatactttggga

SEQ ID NO: 575678 - DNA, 20 bp, Artificial Sequence
  chemically synthesized
actgacaactttcacattct

SEQ ID NO: 575679 - DNA, 20 bp, Artificial Sequence
  chemically synthesized
cttcagcccaggaatctgag

SEQ ID NO: 575680 - DNA, 20 bp, Artificial Sequence
  chemically synthesized
gccacattgcctaagctggt

SEQ ID NO: 575681 - DNA, 20 bp, Artificial Sequence
  chemically synthesized
gcttaggcaatgtggcgaaa

SEQ ID NO: 575682 - DNA, 20 bp, Artificial Sequence
  chemically synthesized
ttttgtattttctgtagaaa

SEQ ID NO: 575683 - DNA, 20 bp, Artificial Sequence
  chemically synthesized
gatgtcgaagttgcagtgag

SEQ ID NO: 575684 - DNA, 20 bp, Artificial Sequence
  chemically synthesized
ttcagattggtttggtttaa

SEQ ID NO: 575685 - DNA, 20 bp, Artificial Sequence
  chemically synthesized
caatctgtgattcagattgg

SEQ ID NO: 575686 - DNA, 20 bp, Artificial Sequence
  chemically synthesized
taaaccaaaccaatctgaat

SEQ ID NO: 575687 - DNA, 20 bp, Artificial Sequence
  chemically synthesized
cctatcaatctgtgattcag

SEQ ID NO: 575688 - DNA, 20 bp, Artificial Sequence
  chemically synthesized
gaaatcctatcaatctgtga

SEQ ID NO: 575689 - DNA, 20 bp, Artificial Sequence
  chemically synthesized
ccaatctgaatcacagattg

SEQ ID NO: 575690 - DNA, 20 bp, Artificial Sequence
  chemically synthesized
ttcttggaaatcctatcaat

SEQ ID NO: 575691 - DNA, 20 bp, Artificial Sequence
  chemically synthesized
gctaaagcctttctgccccc

SEQ ID NO: 575692 - DNA, 20 bp, Artificial Sequence
  chemically synthesized
gcataagcgtctgggggcag

SEQ ID NO: 575693 - DNA, 20 bp, Artificial Sequence
  chemically synthesized
cagttcacagtattaaccaa

SEQ ID NO: 575694 - DNA, 20 bp, Artificial Sequence
  chemically synthesized
gtccaactggaaggatggta

SEQ ID NO: 575695 - DNA, 20 bp, Artificial Sequence
  chemically synthesized
ctgcatggaagtctggcaaa

SEQ ID NO: 575696 - DNA, 20 bp, Artificial Sequence
  chemically synthesized
agacttccatgcagctagtg

SEQ ID NO: 575697 - DNA, 20 bp, Artificial Sequence
  chemically synthesized
catacttaacactaaataaa

SEQ ID NO: 575698 - DNA, 20 bp, Artificial Sequence
  chemically synthesized
tttttatttgctaaatctgg

SEQ ID NO: 575699 - DNA, 20 bp, Artificial Sequence
  chemically synthesized
tacacatttggcaaaacgtt

SEQ ID NO: 575700 - DNA, 20 bp, Artificial Sequence
  chemically synthesized
ccttttggctatttctgttg

SEQ ID NO: 575701 - DNA, 20 bp, Artificial Sequence
  chemically synthesized
gcgagcttagtcaaagaaac

SEQ ID NO: 575702 - DNA, 20 bp, Artificial Sequence
  chemically synthesized
gaactctgatgtaggaaatc

SEQ ID NO: 575703 - DNA, 20 bp, Artificial Sequence
  chemically synthesized
cagagttccaaagttctttc

SEQ ID NO: 575704 - DNA, 20 bp, Artificial Sequence
  chemically synthesized
ggagaagggcagttgctaac

SEQ ID NO: 575705 - DNA, 20 bp, Artificial Sequence
  chemically synthesized
cagcttcaaaagtggtagcg

SEQ ID NO: 575706 - DNA, 20 bp, Artificial Sequence
  chemically synthesized
acaaagtatgttcttgaaat

SEQ ID NO: 575707 - DNA, 20 bp, Artificial Sequence
  chemically synthesized
tctccggggtaccactgaag

SEQ ID NO: 575708 - DNA, 20 bp, Artificial Sequence
  chemically synthesized
ttcagtggtaccccggagat

SEQ ID NO: 575709 - DNA, 20 bp, Artificial Sequence
  chemically synthesized
ttcttattggatcagttcta

SEQ ID NO: 575710 - DNA, 20 bp, Artificial Sequence
  chemically synthesized
gttttagacttggcttcgag

SEQ ID NO: 575711 - DNA, 20 bp, Artificial Sequence
  chemically synthesized
ctaaagtagcaggttttaga

SEQ ID NO: 575712 - DNA, 20 bp, Artificial Sequence
  chemically synthesized
gttttggaaaggctaaagta

SEQ ID NO: 575713 - DNA, 20 bp, Artificial Sequence
  chemically synthesized
taggtacgttagacacatat

SEQ ID NO: 575714 - DNA, 20 bp, Artificial Sequence
  chemically synthesized
tatgtgtctaacgtacctag

SEQ ID NO: 575715 - DNA, 20 bp, Artificial Sequence
  chemically synthesized
ccttcagggccacctcctct

SEQ ID NO: 575716 - DNA, 20 bp, Artificial Sequence
  chemically synthesized
aaccataaagttgtattgtt

SEQ ID NO: 575717 - DNA, 20 bp, Artificial Sequence
  chemically synthesized
atctacaaacaatacaactt

SEQ ID NO: 575718 - DNA, 20 bp, Artificial Sequence
  chemically synthesized
ttaagaaaaccataaagttg

SEQ ID NO: 575719 - DNA, 20 bp, Artificial Sequence
  chemically synthesized
aacatggttctttgtcacag

SEQ ID NO: 575720 - DNA, 20 bp, Artificial Sequence
  chemically synthesized
gataggaattgaggaaggca

SEQ ID NO: 575721 - DNA, 20 bp, Artificial Sequence
  chemically synthesized
tttgtacctatggagagatg

SEQ ID NO: 575722 - DNA, 20 bp, Artificial Sequence
  chemically synthesized
gttcctaaaggatgctggta

SEQ ID NO: 575723 - DNA, 20 bp, Artificial Sequence
  chemically synthesized
atttgatgcctagggaaaat

SEQ ID NO: 575724 - DNA, 20 bp, Artificial Sequence
  chemically synthesized
ctagggaaaatattcgattc

SEQ ID NO: 575725 - DNA, 20 bp, Artificial Sequence
  chemically synthesized
ggaaatttaatgtcagtgta

SEQ ID NO: 575726 - DNA, 20 bp, Artificial Sequence
  chemically synthesized
aagtttgtgatatttcactt

SEQ ID NO: 575727 - DNA, 20 bp, Artificial Sequence
  chemically synthesized
catgtgactatacgtatgta

SEQ ID NO: 575728 - DNA, 20 bp, Artificial Sequence
  chemically synthesized
agggatactaaggaaagaca

SEQ ID NO: 575729 - DNA, 20 bp, Artificial Sequence
  chemically synthesized
aaagacagtgtgttttcaaa

SEQ ID NO: 575730 - DNA, 20 bp, Artificial Sequence
  chemically synthesized
gttcacctcacacgtgcaag

SEQ ID NO: 575731 - DNA, 20 bp, Artificial Sequence
  chemically synthesized
cactcgaggcgctcaataaa

SEQ ID NO: 575732 - DNA, 20 bp, Artificial Sequence
  chemically synthesized
gaaaagatttaaaaaattaa

SEQ ID NO: 575733 - DNA, 20 bp, Artificial Sequence
  chemically synthesized
cagaatgggcgaagggagcg

SEQ ID NO: 575734 - DNA, 20 bp, Artificial Sequence
  chemically synthesized
tataggatcaccctaattac

SEQ ID NO: 575735 - DNA, 20 bp, Artificial Sequence
  chemically synthesized
ctggacactctcaaaagtgt

SEQ ID NO: 575736 - DNA, 20 bp, Artificial Sequence
  chemically synthesized
gagccagtgtgcctgaccct

SEQ ID NO: 575737 - DNA, 20 bp, Artificial Sequence
  chemically synthesized
ctggctcatgcctgtaatcc

SEQ ID NO: 575738 - DNA, 20 bp, Artificial Sequence
  chemically synthesized
tacctcggcctcccaaagca

SEQ ID NO: 575739 - DNA, 20 bp, Artificial Sequence
  chemically synthesized
ttgggaggccgaggtaggag

SEQ ID NO: 575740 - DNA, 20 bp, Artificial Sequence
  chemically synthesized
taggagtattgcttgaagcc

SEQ ID NO: 575741 - DNA, 20 bp, Artificial Sequence
  chemically synthesized
gcccaggctgatctcaaact

SEQ ID NO: 575742 - DNA, 20 bp, Artificial Sequence
  chemically synthesized
gcatgactcttatctctaca

SEQ ID NO: 575743 - DNA, 20 bp, Artificial Sequence
  chemically synthesized
aaaaataaaaaaacagttaa

SEQ ID NO: 575744 - DNA, 20 bp, Artificial Sequence
  chemically synthesized
ggctgttctcaaactccttt

SEQ ID NO: 575745 - DNA, 20 bp, Artificial Sequence
  chemically synthesized
ttttgtatttttagtagaga

SEQ ID NO: 575746 - DNA, 20 bp, Artificial Sequence
  chemically synthesized
tgcctcagcctcctgagtag

SEQ ID NO: 575747 - DNA, 20 bp, Artificial Sequence
  chemically synthesized
tcaggaggctgaggcaggag

SEQ ID NO: 575748 - DNA, 20 bp, Artificial Sequence
  chemically synthesized
aacctccacctcccgggttc

SEQ ID NO: 575749 - DNA, 20 bp, Artificial Sequence
  chemically synthesized
ccgagatcgcaccactgcac

SEQ ID NO: 575750 - DNA, 20 bp, Artificial Sequence
  chemically synthesized
tccttcagcctactgagtag

SEQ ID NO: 575751 - DNA, 20 bp, Artificial Sequence
  chemically synthesized
ctactcagtaggctgaagga

SEQ ID NO: 575752 - DNA, 20 bp, Artificial Sequence
  chemically synthesized
tcagtaggctgaaggaggag

SEQ ID NO: 575753 - DNA, 20 bp, Artificial Sequence
  chemically synthesized
gaggaggattgcttgagctc

SEQ ID NO: 575754 - DNA, 20 bp, Artificial Sequence
  chemically synthesized
cctaatttgtctccggctgt

SEQ ID NO: 575755 - DNA, 20 bp, Artificial Sequence
  chemically synthesized
cgcagtgaattgatcactgc

SEQ ID NO: 575756 - DNA, 20 bp, Artificial Sequence
  chemically synthesized
ggtgtgaaccactggccttt

SEQ ID NO: 575757 - DNA, 20 bp, Artificial Sequence
  chemically synthesized
gaaaggccagtggttcacac

SEQ ID NO: 575758 - DNA, 20 bp, Artificial Sequence
  chemically synthesized
tggggagtaaacaccttcgg

SEQ ID NO: 575759 - DNA, 20 bp, Artificial Sequence
  chemically synthesized
tccgtagcaaacagaaccga

SEQ ID NO: 575760 - DNA, 20 bp, Artificial Sequence
  chemically synthesized
ttgctacacacaggctcaca

SEQ ID NO: 575761 - DNA, 20 bp, Artificial Sequence
  chemically synthesized
tgtcatgagaaagatcctag

SEQ ID NO: 575762 - DNA, 20 bp, Artificial Sequence
  chemically synthesized
cctagaatagcttcttgaaa

SEQ ID NO: 575763 - DNA, 20 bp, Artificial Sequence
  chemically synthesized
gccatatccctcttagcaaa

SEQ ID NO: 575764 - DNA, 20 bp, Artificial Sequence
  chemically synthesized
ccctcttagcaaatgacgat

SEQ ID NO: 575765 - DNA, 20 bp, Artificial Sequence
  chemically synthesized
tttcaggaaagtgaattctt

SEQ ID NO: 575766 - DNA, 20 bp, Artificial Sequence
  chemically synthesized
ttaaattttcctttacggag

SEQ ID NO: 575767 - DNA, 20 bp, Artificial Sequence
  chemically synthesized
atttcatacctgatatgtaa

SEQ ID NO: 575768 - DNA, 20 bp, Artificial Sequence
  chemically synthesized
cctgatatgtaatacagatt

SEQ ID NO: 575769 - DNA, 20 bp, Artificial Sequence
  chemically synthesized
acagattttatgtttaaaaa

SEQ ID NO: 575770 - DNA, 20 bp, Artificial Sequence
  chemically synthesized
ttcttgttttgttttgatgt

SEQ ID NO: 575771 - DNA, 20 bp, Artificial Sequence
  chemically synthesized
gctgtgttgttgtgttcttg

SEQ ID NO: 575772 - DNA, 20 bp, Artificial Sequence
  chemically synthesized
attttgctgtgttgttgtgt

SEQ ID NO: 575773 - DNA, 20 bp, Artificial Sequence
  chemically synthesized
acacaacaacacagcaaaat

SEQ ID NO: 575774 - DNA, 20 bp, Artificial Sequence
  chemically synthesized
tgactttataaattgaaaat

SEQ ID NO: 575775 - DNA, 20 bp, Artificial Sequence
  chemically synthesized
tataaagtcatggatgaaga

SEQ ID NO: 575776 - DNA, 20 bp, Artificial Sequence
  chemically synthesized
aagttctctgattatggatt

SEQ ID NO: 575777 - DNA, 20 bp, Artificial Sequence
  chemically synthesized
tctctttgaagttctctgat

SEQ ID NO: 575778 - DNA, 20 bp, Artificial Sequence
  chemically synthesized
taccatatctctttgaagtt

SEQ ID NO: 575779 - DNA, 20 bp, Artificial Sequence
  chemically synthesized
ttccccttccagtgtcttct

SEQ ID NO: 575780 - DNA, 20 bp, Artificial Sequence
  chemically synthesized
taggagctcccagagtagca

SEQ ID NO: 575781 - DNA, 20 bp, Artificial Sequence
  chemically synthesized
ctgcggctgtatctcccact

SEQ ID NO: 575782 - DNA, 20 bp, Artificial Sequence
  chemically synthesized
cagcttgatagctggtatgc

SEQ ID NO: 575783 - DNA, 20 bp, Artificial Sequence
  chemically synthesized
gatagctggtatgcaactgc

SEQ ID NO: 575784 - DNA, 20 bp, Artificial Sequence
  chemically synthesized
tttcaataaagttatcgagt

SEQ ID NO: 575785 - DNA, 20 bp, Artificial Sequence
  chemically synthesized
aatgattggatacattaata

SEQ ID NO: 575786 - DNA, 20 bp, Artificial Sequence
  chemically synthesized
aggtatataccaaggttacc

SEQ ID NO: 575787 - DNA, 20 bp, Artificial Sequence
  chemically synthesized
atatacctagataatagagc

SEQ ID NO: 575788 - DNA, 20 bp, Artificial Sequence
  chemically synthesized
ttttttttttttattatact

SEQ ID NO: 575789 - DNA, 20 bp, Artificial Sequence
  chemically synthesized
cacctatgagtgagaatatg

SEQ ID NO: 575790 - DNA, 20 bp, Artificial Sequence
  chemically synthesized
atgagtgagaatatgcggtg

SEQ ID NO: 575791 - DNA, 20 bp, Artificial Sequence
  chemically synthesized
gtttggttttttgttcttgc

SEQ ID NO: 575792 - DNA, 20 bp, Artificial Sequence
  chemically synthesized
tgcgatagtttactgagaat

SEQ ID NO: 575793 - DNA, 20 bp, Artificial Sequence
  chemically synthesized
caaatgtccaacaatgatag

SEQ ID NO: 575794 - DNA, 20 bp, Artificial Sequence
  chemically synthesized
ctataaagacacatgcacac

SEQ ID NO: 575795 - DNA, 20 bp, Artificial Sequence
  chemically synthesized
gtgcatgtgtctttatagca

SEQ ID NO: 575796 - DNA, 20 bp, Artificial Sequence
  chemically synthesized
aaccattgtggaagtcagtg

SEQ ID NO: 575797 - DNA, 20 bp, Artificial Sequence
  chemically synthesized
ctgacttccacaatggttga

SEQ ID NO: 575798 - DNA, 20 bp, Artificial Sequence
  chemically synthesized
tccacatcctctccagcacc

SEQ ID NO: 575799 - DNA, 20 bp, Artificial Sequence
  chemically synthesized
cctgttgtttcctgactttt

SEQ ID NO: 575800 - DNA, 20 bp, Artificial Sequence
  chemically synthesized
ggtgtgagatgatatctcat

SEQ ID NO: 575801 - DNA, 20 bp, Artificial Sequence
  chemically synthesized
gagatgatatctcatagtgg

SEQ ID NO: 575802 - DNA, 20 bp, Artificial Sequence
  chemically synthesized
gtgatgatgagcatttcttc

SEQ ID NO: 575803 - DNA, 20 bp, Artificial Sequence
  chemically synthesized
cttcgcccactttttgatgg

SEQ ID NO: 575804 - DNA, 20 bp, Artificial Sequence
  chemically synthesized
gcccactttttgatggggtt

SEQ ID NO: 575805 - DNA, 20 bp, Artificial Sequence
  chemically synthesized
tgtttgtttttttcttgtaa

SEQ ID NO: 575806 - DNA, 20 bp, Artificial Sequence
  chemically synthesized
gtaaatttgtttgagttcat

SEQ ID NO: 575807 - DNA, 20 bp, Artificial Sequence
  chemically synthesized
ggttgcctgttcactctgat

SEQ ID NO: 575808 - DNA, 20 bp, Artificial Sequence
  chemically synthesized
cttttgctgtgcagaagctc

SEQ ID NO: 575809 - DNA, 20 bp, Artificial Sequence
  chemically synthesized
aatgggatctaattaaactc

SEQ ID NO: 575810 - DNA, 20 bp, Artificial Sequence
  chemically synthesized
attagatcccatttgtcaat

SEQ ID NO: 575811 - DNA, 20 bp, Artificial Sequence
  chemically synthesized
tcaattttggcttttgttgc

SEQ ID NO: 575812 - DNA, 20 bp, Artificial Sequence
  chemically synthesized
acattcttctaaattttttt

SEQ ID NO: 575813 - DNA, 20 bp, Artificial Sequence
  chemically synthesized
ctagaataacgaatacagag

SEQ ID NO: 575814 - DNA, 20 bp, Artificial Sequence
  chemically synthesized
tcttcacgtagttctcgagc

SEQ ID NO: 575815 - DNA, 20 bp, Artificial Sequence
  chemically synthesized
cagttgatcgcatcggctcc

SEQ ID NO: 575816 - DNA, 20 bp, Artificial Sequence
  chemically synthesized
gaatgaaatgaagcgagaag

SEQ ID NO: 575817 - DNA, 20 bp, Artificial Sequence
  chemically synthesized
ttttttctctaaacttccct

SEQ ID NO: 575818 - DNA, 20 bp, Artificial Sequence
  chemically synthesized
cacatagtcccatatttctt

SEQ ID NO: 575819 - DNA, 20 bp, Artificial Sequence
  chemically synthesized
tgtgaaaagaccaaatctac

SEQ ID NO: 575820 - DNA, 20 bp, Artificial Sequence
  chemically synthesized
tttcaggtacaccaatcaga

SEQ ID NO: 575821 - DNA, 20 bp, Artificial Sequence
  chemically synthesized
ctcctggataatatcctgca

SEQ ID NO: 575822 - DNA, 20 bp, Artificial Sequence
  chemically synthesized
tctgaacgttggcctgcctt

SEQ ID NO: 575823 - DNA, 20 bp, Artificial Sequence
  chemically synthesized
tctagtaaggcaggccaacg

SEQ ID NO: 575824 - DNA, 20 bp, Artificial Sequence
  chemically synthesized
caactccaagacacataatt

SEQ ID NO: 575825 - DNA, 20 bp, Artificial Sequence
  chemically synthesized
agagatccgctgttagtctg

SEQ ID NO: 575826 - DNA, 20 bp, Artificial Sequence
  chemically synthesized
ccccactctcttctggcttg

SEQ ID NO: 575827 - DNA, 20 bp, Artificial Sequence
  chemically synthesized
aatattggcccccactctct

SEQ ID NO: 575828 - DNA, 20 bp, Artificial Sequence
  chemically synthesized
gaatttcatatccagccaaa

SEQ ID NO: 575829 - DNA, 20 bp, Artificial Sequence
  chemically synthesized
tttctccttcacttatgaag

SEQ ID NO: 575830 - DNA, 20 bp, Artificial Sequence
  chemically synthesized
ttttatttctccttcactta

SEQ ID NO: 575831 - DNA, 20 bp, Artificial Sequence
  chemically synthesized
tttatagacaagcaaatgct

SEQ ID NO: 575832 - DNA, 20 bp, Artificial Sequence
  chemically synthesized
tggtgacaaaatctctcagc

SEQ ID NO: 575833 - DNA, 20 bp, Artificial Sequence
  chemically synthesized
cggttgttcctttccatgtt

SEQ ID NO: 575834 - DNA, 20 bp, Artificial Sequence
  chemically synthesized
ctggtaccggttgttccttt

SEQ ID NO: 575835 - DNA, 20 bp, Artificial Sequence
  chemically synthesized
tcgatggtctttacattttg

SEQ ID NO: 575836 - DNA, 20 bp, Artificial Sequence
  chemically synthesized
tgattttgctcattagttga

SEQ ID NO: 575837 - DNA, 20 bp, Artificial Sequence
  chemically synthesized
cctgtcattatgatgttagc

SEQ ID NO: 575838 - DNA, 20 bp, Artificial Sequence
  chemically synthesized
tgtgtgtctctgcacgtgag

SEQ ID NO: 575839 - DNA, 20 bp, Artificial Sequence
  chemically synthesized
cctgcctttttttgttttcc

SEQ ID NO: 575840 - DNA, 20 bp, Artificial Sequence
  chemically synthesized
ggattgcaacccctgccttt

SEQ ID NO: 575841 - DNA, 20 bp, Artificial Sequence
  chemically synthesized
aaagtctgttttatcagaga

SEQ ID NO: 575842 - DNA, 20 bp, Artificial Sequence
  chemically synthesized
ttgatctttgttggtttaaa

SEQ ID NO: 575843 - DNA, 20 bp, Artificial Sequence
  chemically synthesized
ctttgtctcttttgatcttt

SEQ ID NO: 575844 - DNA, 20 bp, Artificial Sequence
  chemically synthesized
atgcacccaatacaggagca

SEQ ID NO: 575845 - DNA, 20 bp, Artificial Sequence
  chemically synthesized
ctctttgtaggtcactcagg

SEQ ID NO: 575846 - DNA, 20 bp, Artificial Sequence
  chemically synthesized
gctgaaaaaaatgtatattc

SEQ ID NO: 575847 - DNA, 20 bp, Artificial Sequence
  chemically synthesized
gttcttttacatttgctgag

SEQ ID NO: 575848 - DNA, 20 bp, Artificial Sequence
  chemically synthesized
gattgcactgtggtctgaga

SEQ ID NO: 575849 - DNA, 20 bp, Artificial Sequence
  chemically synthesized
cagtgcaatcaaactagaac

SEQ ID NO: 575850 - DNA, 20 bp, Artificial Sequence
  chemically synthesized
attcttaatcctgagttcta

SEQ ID NO: 575851 - DNA, 20 bp, Artificial Sequence
  chemically synthesized
tgagattcttaatcctgagt

SEQ ID NO: 575852 - DNA, 20 bp, Artificial Sequence
  chemically synthesized
atgtagttgagcggctttga

SEQ ID NO: 575853 - DNA, 20 bp, Artificial Sequence
  chemically synthesized
gttcagtttccatgtagttg

SEQ ID NO: 575854 - DNA, 20 bp, Artificial Sequence
  chemically synthesized
agtcattcaggagcaggttg

SEQ ID NO: 575855 - DNA, 20 bp, Artificial Sequence
  chemically synthesized
tatgtggtgtctttgttctc

SEQ ID NO: 575856 - DNA, 20 bp, Artificial Sequence
  chemically synthesized
acactgctttgaatgcgtcc

SEQ ID NO: 575857 - DNA, 20 bp, Artificial Sequence
  chemically synthesized
gctataaatttccctctaca

SEQ ID NO: 575858 - DNA, 20 bp, Artificial Sequence
  chemically synthesized
gggtgtcaattttggatctt

SEQ ID NO: 575859 - DNA, 20 bp, Artificial Sequence
  chemically synthesized
tagcttttgaatgtgtttgc

SEQ ID NO: 575860 - DNA, 20 bp, Artificial Sequence
  chemically synthesized
tgccttctgctagcttttga

SEQ ID NO: 575861 - DNA, 20 bp, Artificial Sequence
  chemically synthesized
ttagttatttcttgccttct

SEQ ID NO: 575862 - DNA, 20 bp, Artificial Sequence
  chemically synthesized
ctctatttccttcagttctg

SEQ ID NO: 575863 - DNA, 20 bp, Artificial Sequence
  chemically synthesized
ctggattcattgattttttg

SEQ ID NO: 575864 - DNA, 20 bp, Artificial Sequence
  chemically synthesized
aaaaaaccagctcctggatt

SEQ ID NO: 575865 - DNA, 20 bp, Artificial Sequence
  chemically synthesized
aaaaatcaatgaatccagga

SEQ ID NO: 575866 - DNA, 20 bp, Artificial Sequence
  chemically synthesized
atcctttcaaaaaaccagct

SEQ ID NO: 575867 - DNA, 20 bp, Artificial Sequence
  chemically synthesized
tatcattttttattgtgtct

SEQ ID NO: 575868 - DNA, 20 bp, Artificial Sequence
  chemically synthesized
tgtttgtagtattctctgat

SEQ ID NO: 575869 - DNA, 20 bp, Artificial Sequence
  chemically synthesized
tttctagtttatttgcatag

SEQ ID NO: 575870 - DNA, 20 bp, Artificial Sequence
  chemically synthesized
tatccatttcttctagattt

SEQ ID NO: 575871 - DNA, 20 bp, Artificial Sequence
  chemically synthesized
cgaggaatgtatccatttct

SEQ ID NO: 575872 - DNA, 20 bp, Artificial Sequence
  chemically synthesized
attcagagattcaacttctt

SEQ ID NO: 575873 - DNA, 20 bp, Artificial Sequence
  chemically synthesized
gagcctgttattggtctatt

SEQ ID NO: 575874 - DNA, 20 bp, Artificial Sequence
  chemically synthesized
actctttttggttggtaaaa

SEQ ID NO: 575875 - DNA, 20 bp, Artificial Sequence
  chemically synthesized
ccaaaaagagtccaggacca

SEQ ID NO: 575876 - DNA, 20 bp, Artificial Sequence
  chemically synthesized
cctctttttctattgattgg

SEQ ID NO: 575877 - DNA, 20 bp, Artificial Sequence
  chemically synthesized
gggaggattccctctttttc

SEQ ID NO: 575878 - DNA, 20 bp, Artificial Sequence
  chemically synthesized
ggcctcataaaatgagttag

SEQ ID NO: 575879 - DNA, 20 bp, Artificial Sequence
  chemically synthesized
cttttttggttgtgtctctg

SEQ ID NO: 575880 - DNA, 20 bp, Artificial Sequence
  chemically synthesized
ggtttgccagtattttattg

SEQ ID NO: 575881 - DNA, 20 bp, Artificial Sequence
  chemically synthesized
ctttttgatgtgctgctgga

SEQ ID NO: 575882 - DNA, 20 bp, Artificial Sequence
  chemically synthesized
gataagctttttgatgtgct

SEQ ID NO: 575883 - DNA, 20 bp, Artificial Sequence
  chemically synthesized
ccgaatccagcagcacatca

SEQ ID NO: 575884 - DNA, 20 bp, Artificial Sequence
  chemically synthesized
agcccacttgatcatggtgg

SEQ ID NO: 575885 - DNA, 20 bp, Artificial Sequence
  chemically synthesized
agcttatccaccatgatcaa

SEQ ID NO: 575886 - DNA, 20 bp, Artificial Sequence
  chemically synthesized
tttatatgctggattacatt

SEQ ID NO: 575887 - DNA, 20 bp, Artificial Sequence
  chemically synthesized
gtctttggctctgtttatat

SEQ ID NO: 575888 - DNA, 20 bp, Artificial Sequence
  chemically synthesized
catgtggtttttgtctttgg

SEQ ID NO: 575889 - DNA, 20 bp, Artificial Sequence
  chemically synthesized
cagagccaaagacaaaaacc

SEQ ID NO: 575890 - DNA, 20 bp, Artificial Sequence
  chemically synthesized
tgcatctattgagataatca

SEQ ID NO: 575891 - DNA, 20 bp, Artificial Sequence
  chemically synthesized
aagggttgttgaattttgtc

SEQ ID NO: 575892 - DNA, 20 bp, Artificial Sequence
  chemically synthesized
ccatcaatacctaatttatt

SEQ ID NO: 575893 - DNA, 20 bp, Artificial Sequence
  chemically synthesized
cattcagtatgatattggct

SEQ ID NO: 575894 - DNA, 20 bp, Artificial Sequence
  chemically synthesized
cagtttttaaagggaatgct

SEQ ID NO: 575895 - DNA, 20 bp, Artificial Sequence
  chemically synthesized
cttgtgccagtttttaaagg

SEQ ID NO: 575896 - DNA, 20 bp, Artificial Sequence
  chemically synthesized
agagggcatccctgtcttgt

SEQ ID NO: 575897 - DNA, 20 bp, Artificial Sequence
  chemically synthesized
accctttatttccttctcct

SEQ ID NO: 575898 - DNA, 20 bp, Artificial Sequence
  chemically synthesized
aaaagaggaagtcaaattgt

SEQ ID NO: 575899 - DNA, 20 bp, Artificial Sequence
  chemically synthesized
attgtccctgtttgcagacg

SEQ ID NO: 575900 - DNA, 20 bp, Artificial Sequence
  chemically synthesized
tccctgtttgcagacgacat

SEQ ID NO: 575901 - DNA, 20 bp, Artificial Sequence
  chemically synthesized
gagattttgggctgagacga

SEQ ID NO: 575902 - DNA, 20 bp, Artificial Sequence
  chemically synthesized
tgaagttgcttatcagctta

SEQ ID NO: 575903 - DNA, 20 bp, Artificial Sequence
  chemically synthesized
agactttgctgaagttgctt

SEQ ID NO: 575904 - DNA, 20 bp, Artificial Sequence
  chemically synthesized
gtatcctgagactttgctga

SEQ ID NO: 575905 - DNA, 20 bp, Artificial Sequence
  chemically synthesized
gaatgcttgtgattttagta

SEQ ID NO: 575906 - DNA, 20 bp, Artificial Sequence
  chemically synthesized
ttgttggtgtataagaatgc

SEQ ID NO: 575907 - DNA, 20 bp, Artificial Sequence
  chemically synthesized
tgtctgttgttggtgtataa

SEQ ID NO: 575908 - DNA, 20 bp, Artificial Sequence
  chemically synthesized
agttcactcatgatttggct

SEQ ID NO: 575909 - DNA, 20 bp, Artificial Sequence
  chemically synthesized
aattgtgaatgggagttcac

SEQ ID NO: 575910 - DNA, 20 bp, Artificial Sequence
  chemically synthesized
atgagtgaactcccattcac

SEQ ID NO: 575911 - DNA, 20 bp, Artificial Sequence
  chemically synthesized
gtccttcacatcccttgtaa

SEQ ID NO: 575912 - DNA, 20 bp, Artificial Sequence
  chemically synthesized
cctcttttatttccttgagc

SEQ ID NO: 575913 - DNA, 20 bp, Artificial Sequence
  chemically synthesized
tgagcatggaatattcttcc

SEQ ID NO: 575914 - DNA, 20 bp, Artificial Sequence
  chemically synthesized
cagtatggccattttcacga

SEQ ID NO: 575915 - DNA, 20 bp, Artificial Sequence
  chemically synthesized
ccatactgcccaaggtaatt

SEQ ID NO: 575916 - DNA, 20 bp, Artificial Sequence
  chemically synthesized
attctgtgaagaaagtcatt

SEQ ID NO: 575917 - DNA, 20 bp, Artificial Sequence
  chemically synthesized
tggttccatatgaactttaa

SEQ ID NO: 575918 - DNA, 20 bp, Artificial Sequence
  chemically synthesized
tccagctttgttcttttggc

SEQ ID NO: 575919 - DNA, 20 bp, Artificial Sequence
  chemically synthesized
gatgcctccagctttgttct

SEQ ID NO: 575920 - DNA, 20 bp, Artificial Sequence
  chemically synthesized
aagtcaggtagtgtgatgcc

SEQ ID NO: 575921 - DNA, 20 bp, Artificial Sequence
  chemically synthesized
tggttactgtagccttgtag

SEQ ID NO: 575922 - DNA, 20 bp, Artificial Sequence
  chemically synthesized
ctgttttggtaccagtacca

SEQ ID NO: 575923 - DNA, 20 bp, Artificial Sequence
  chemically synthesized
tctgttccattgatctatat

SEQ ID NO: 575924 - DNA, 20 bp, Artificial Sequence
  chemically synthesized
ttccccattgcttgtttttc

SEQ ID NO: 575925 - DNA, 20 bp, Artificial Sequence
  chemically synthesized
gagaaaaacaagcaatgggg

SEQ ID NO: 575926 - DNA, 20 bp, Artificial Sequence
  chemically synthesized
tagggaatcctttccccatt

SEQ ID NO: 575927 - DNA, 20 bp, Artificial Sequence
  chemically synthesized
taaatagggaatcctttccc

SEQ ID NO: 575928 - DNA, 20 bp, Artificial Sequence
  chemically synthesized
cagctttctacatatggcta

SEQ ID NO: 575929 - DNA, 20 bp, Artificial Sequence
  chemically synthesized
gtgtaaggaagggatccagt

SEQ ID NO: 575930 - DNA, 20 bp, Artificial Sequence
  chemically synthesized
tataaggtgtaaggaaggga

SEQ ID NO: 575931 - DNA, 20 bp, Artificial Sequence
  chemically synthesized
ttatacaaaaatcaattcaa

SEQ ID NO: 575932 - DNA, 20 bp, Artificial Sequence
  chemically synthesized
taaatctttaatccatcttg

SEQ ID NO: 575933 - DNA, 20 bp, Artificial Sequence
  chemically synthesized
aaaatcaattcaagatggat

SEQ ID NO: 575934 - DNA, 20 bp, Artificial Sequence
  chemically synthesized
ggtttttatggttttaggtc

SEQ ID NO: 575935 - DNA, 20 bp, Artificial Sequence
  chemically synthesized
aggttttcttctagggtttt

SEQ ID NO: 575936 - DNA, 20 bp, Artificial Sequence
  chemically synthesized
gtaatgcctaggttttcttc

SEQ ID NO: 575937 - DNA, 20 bp, Artificial Sequence
  chemically synthesized
tatgtcctgaatggtaatgc

SEQ ID NO: 575938 - DNA, 20 bp, Artificial Sequence
  chemically synthesized
gcttttgttgccattgcttt

SEQ ID NO: 575939 - DNA, 20 bp, Artificial Sequence
  chemically synthesized
tcaattttggcttttgttgc

SEQ ID NO: 575940 - DNA, 20 bp, Artificial Sequence
  chemically synthesized
aacaaaagccaaaattgaca

SEQ ID NO: 575941 - DNA, 20 bp, Artificial Sequence
  chemically synthesized
aagagaaaccatttgtcaat

SEQ ID NO: 575942 - DNA, 20 bp, Artificial Sequence
  chemically synthesized
atggtttctcttgatagcag

SEQ ID NO: 575943 - DNA, 20 bp, Artificial Sequence
  chemically synthesized
tgatagcagcccagtttact

SEQ ID NO: 575944 - DNA, 20 bp, Artificial Sequence
  chemically synthesized
agcagcccagtttactgtat

SEQ ID NO: 575945 - DNA, 20 bp, Artificial Sequence
  chemically synthesized
gaggagaactgctgtaactt

SEQ ID NO: 575946 - DNA, 20 bp, Artificial Sequence
  chemically synthesized
caaaagtgtgatggtaggac

SEQ ID NO: 575947 - DNA, 20 bp, Artificial Sequence
  chemically synthesized
gacactgtcccagtctaatc

SEQ ID NO: 575948 - DNA, 20 bp, Artificial Sequence
  chemically synthesized
attcttttataacagaaaac

SEQ ID NO: 575949 - DNA, 20 bp, Artificial Sequence
  chemically synthesized
ctgttataaaagaatgatat

SEQ ID NO: 575950 - DNA, 20 bp, Artificial Sequence
  chemically synthesized
ataaaagaatgatatcaggg

SEQ ID NO: 575951 - DNA, 20 bp, Artificial Sequence
  chemically synthesized
tcagagttgtccaactttca

SEQ ID NO: 575952 - DNA, 20 bp, Artificial Sequence
  chemically synthesized
gcaaacagttttaccctttt

SEQ ID NO: 575953 - DNA, 20 bp, Artificial Sequence
  chemically synthesized
aaaatcagctaaaagggtaa

SEQ ID NO: 575954 - DNA, 20 bp, Artificial Sequence
  chemically synthesized
atggtttggttttctgtgca

SEQ ID NO: 575955 - DNA, 20 bp, Artificial Sequence
  chemically synthesized
ttcaatctcttcttaaatgg

SEQ ID NO: 575956 - DNA, 20 bp, Artificial Sequence
  chemically synthesized
agaaaaccaaaccatttaag

SEQ ID NO: 575957 - DNA, 20 bp, Artificial Sequence
  chemically synthesized
aactattcaatctcttctta

SEQ ID NO: 575958 - DNA, 20 bp, Artificial Sequence
  chemically synthesized
taagaagagattgaatagtt

SEQ ID NO: 575959 - DNA, 20 bp, Artificial Sequence
  chemically synthesized
ttgagattttaactcccagg

SEQ ID NO: 575960 - DNA, 20 bp, Artificial Sequence
  chemically synthesized
taggccaagaagagcctatc

SEQ ID NO: 575961 - DNA, 20 bp, Artificial Sequence
  chemically synthesized
atgaggagattctagtggag

SEQ ID NO: 575962 - DNA, 20 bp, Artificial Sequence
  chemically synthesized
tgcataaaatgcataaaatg

SEQ ID NO: 575963 - DNA, 20 bp, Artificial Sequence
  chemically synthesized
attttatgcattttatgcaa

SEQ ID NO: 575964 - DNA, 20 bp, Artificial Sequence
  chemically synthesized
atgcaaggttgcttagtggc

SEQ ID NO: 575965 - DNA, 20 bp, Artificial Sequence
  chemically synthesized
atcagtttgggattgggttc

SEQ ID NO: 575966 - DNA, 20 bp, Artificial Sequence
  chemically synthesized
agctaatgaacccaatccca

SEQ ID NO: 575967 - DNA, 20 bp, Artificial Sequence
  chemically synthesized
aaagatactgcaaaatcagt

SEQ ID NO: 575968 - DNA, 20 bp, Artificial Sequence
  chemically synthesized
ctgataaaagatactgcaaa

SEQ ID NO: 575969 - DNA, 20 bp, Artificial Sequence
  chemically synthesized
attttgcagtatcttttatc

SEQ ID NO: 575970 - DNA, 20 bp, Artificial Sequence
  chemically synthesized
tttaattgtaaaaaattcgg

SEQ ID NO: 575971 - DNA, 20 bp, Artificial Sequence
  chemically synthesized
tccttctgttttctcacctc

SEQ ID NO: 575972 - DNA, 20 bp, Artificial Sequence
  chemically synthesized
cttatttctacctcttttcc

SEQ ID NO: 575973 - DNA, 20 bp, Artificial Sequence
  chemically synthesized
aggtagaaataagaagcaca

SEQ ID NO: 575974 - DNA, 20 bp, Artificial Sequence
  chemically synthesized
aaaactggttcacaatcttc

SEQ ID NO: 575975 - DNA, 20 bp, Artificial Sequence
  chemically synthesized
gaagcacaagaagattgtga

SEQ ID NO: 575976 - DNA, 20 bp, Artificial Sequence
  chemically synthesized
tcaagtacctttcattgctt

SEQ ID NO: 575977 - DNA, 20 bp, Artificial Sequence
  chemically synthesized
ttgcagtttcaagtaccttt

SEQ ID NO: 575978 - DNA, 20 bp, Artificial Sequence
  chemically synthesized
taagtccactctattctgtt

SEQ ID NO: 575979 - DNA, 20 bp, Artificial Sequence
  chemically synthesized
gcagttttaagtccactcta

SEQ ID NO: 575980 - DNA, 20 bp, Artificial Sequence
  chemically synthesized
agagtggacttaaaactgct

SEQ ID NO: 575981 - DNA, 20 bp, Artificial Sequence
  chemically synthesized
tgttgagtacacaatcagtg

SEQ ID NO: 575982 - DNA, 20 bp, Artificial Sequence
  chemically synthesized
gatgaggaaggtgttggagt

SEQ ID NO: 575983 - DNA, 20 bp, Artificial Sequence
  chemically synthesized
ctcatcactgggcatttagc

SEQ ID NO: 575984 - DNA, 20 bp, Artificial Sequence
  chemically synthesized
aggttaagtaggattgttgt

SEQ ID NO: 575985 - DNA, 20 bp, Artificial Sequence
  chemically synthesized
taagtttggtgaaaggttaa

SEQ ID NO: 575986 - DNA, 20 bp, Artificial Sequence
  chemically synthesized
gcatagctactggtagtttt

SEQ ID NO: 575987 - DNA, 20 bp, Artificial Sequence
  chemically synthesized
ggaggatgggcatagctact

SEQ ID NO: 575988 - DNA, 20 bp, Artificial Sequence
  chemically synthesized
gcttcagataggaaggaaag

SEQ ID NO: 575989 - DNA, 20 bp, Artificial Sequence
  chemically synthesized
cagaaagatgaaatttagaa

SEQ ID NO: 575990 - DNA, 20 bp, Artificial Sequence
  chemically synthesized
gccttctcaagtacctgtgc

SEQ ID NO: 575991 - DNA, 20 bp, Artificial Sequence
  chemically synthesized
ttaaaagggtagtgacttac

SEQ ID NO: 575992 - DNA, 20 bp, Artificial Sequence
  chemically synthesized
gcagccaaaagtcttaaaat

SEQ ID NO: 575993 - DNA, 20 bp, Artificial Sequence
  chemically synthesized
caagattgcagtacgttcag

SEQ ID NO: 575994 - DNA, 20 bp, Artificial Sequence
  chemically synthesized
acttggtggtaactaaagaa

SEQ ID NO: 575995 - DNA, 20 bp, Artificial Sequence
  chemically synthesized
ctttatgcaagtgatttcag

SEQ ID NO: 575996 - DNA, 20 bp, Artificial Sequence
  chemically synthesized
ggtattgacaacctttatgc

SEQ ID NO: 575997 - DNA, 20 bp, Artificial Sequence
  chemically synthesized
tattttggtcttatctttca

SEQ ID NO: 575998 - DNA, 20 bp, Artificial Sequence
  chemically synthesized
ttcttgaaaacctctcttcc

SEQ ID NO: 575999 - DNA, 20 bp, Artificial Sequence
  chemically synthesized
gtcacagaatccaagggaag

SEQ ID NO: 576000 - DNA, 20 bp, Artificial Sequence
  chemically synthesized
caaatttccctgtctccact

SEQ ID NO: 576001 - DNA, 20 bp, Artificial Sequence
  chemically synthesized
tcaggggtaaataaagaaaa

SEQ ID NO: 576002 - DNA, 20 bp, Artificial Sequence
  chemically synthesized
gagtgaacccaggaaaatgg

SEQ ID NO: 576003 - DNA, 20 bp, Artificial Sequence
  chemically synthesized
tgaaccatttcaaacccttg

SEQ ID NO: 576004 - DNA, 20 bp, Artificial Sequence
  chemically synthesized
atacgtaattaaaaccttgc

SEQ ID NO: 576005 - DNA, 20 bp, Artificial Sequence
  chemically synthesized
ctgataattaaatatccaat

SEQ ID NO: 576006 - DNA, 20 bp, Artificial Sequence
  chemically synthesized
tagcaaactggaggcaagaa

SEQ ID NO: 576007 - DNA, 20 bp, Artificial Sequence
  chemically synthesized
gctgaagctatcttcttgcc

SEQ ID NO: 576008 - DNA, 20 bp, Artificial Sequence
  chemically synthesized
atcttcttgcctccagtttg

SEQ ID NO: 576009 - DNA, 20 bp, Artificial Sequence
  chemically synthesized
tgttatttcaagggactaga

SEQ ID NO: 576010 - DNA, 20 bp, Artificial Sequence
  chemically synthesized
aggagttagacaggtcaagt

SEQ ID NO: 576011 - DNA, 20 bp, Artificial Sequence
  chemically synthesized
cccaacttgacctgtctaac

SEQ ID NO: 576012 - DNA, 20 bp, Artificial Sequence
  chemically synthesized
tcttcaggtctcagctgagg

SEQ ID NO: 576013 - DNA, 20 bp, Artificial Sequence
  chemically synthesized
ccctggcttggcaggatgca

SEQ ID NO: 576014 - DNA, 20 bp, Artificial Sequence
  chemically synthesized
tgtacatcaaggtaattgac

SEQ ID NO: 576015 - DNA, 20 bp, Artificial Sequence
  chemically synthesized
gactgaaagtatttcaaatt

SEQ ID NO: 576016 - DNA, 20 bp, Artificial Sequence
  chemically synthesized
agagaatataccagcaaaca

SEQ ID NO: 576017 - DNA, 20 bp, Artificial Sequence
  chemically synthesized
aaacctacgtgcattaatca

SEQ ID NO: 576018 - DNA, 20 bp, Artificial Sequence
  chemically synthesized
aaacacagtgattaatgcac

SEQ ID NO: 576019 - DNA, 20 bp, Artificial Sequence
  chemically synthesized
tgccatttttcgtacctttt

SEQ ID NO: 576020 - DNA, 20 bp, Artificial Sequence
  chemically synthesized
atttttcgtaccttttgtgg

SEQ ID NO: 576021 - DNA, 20 bp, Artificial Sequence
  chemically synthesized
atatatcttttccacccaca

SEQ ID NO: 576022 - DNA, 20 bp, Artificial Sequence
  chemically synthesized
gaaaatgcaggcacaccaca

SEQ ID NO: 576023 - DNA, 20 bp, Artificial Sequence
  chemically synthesized
ttgtcacatgaggtcagaag

SEQ ID NO: 576024 - DNA, 20 bp, Artificial Sequence
  chemically synthesized
tgatgtcatgtcagcattca

SEQ ID NO: 576025 - DNA, 20 bp, Artificial Sequence
  chemically synthesized
ccaaatgttccaaattccaa

SEQ ID NO: 576026 - DNA, 20 bp, Artificial Sequence
  chemically synthesized
cagttttggaatttggaaca

SEQ ID NO: 576027 - DNA, 20 bp, Artificial Sequence
  chemically synthesized
gaatttggaacatttggatt

SEQ ID NO: 576028 - DNA, 20 bp, Artificial Sequence
  chemically synthesized
atgttcaacctgtagtagtt

SEQ ID NO: 576029 - DNA, 20 bp, Artificial Sequence
  chemically synthesized
gatctctatcttctttgatc

SEQ ID NO: 576030 - DNA, 20 bp, Artificial Sequence
  chemically synthesized
cacatcaataaataaaggaa

SEQ ID NO: 576031 - DNA, 20 bp, Artificial Sequence
  chemically synthesized
tgtgtctctagtgtctagcc

SEQ ID NO: 576032 - DNA, 20 bp, Artificial Sequence
  chemically synthesized
aaagaaatggataaataact

SEQ ID NO: 576033 - DNA, 20 bp, Artificial Sequence
  chemically synthesized
atacaaaaaattcaaattac

SEQ ID NO: 576034 - DNA, 20 bp, Artificial Sequence
  chemically synthesized
gtaatttgaattttttgtat

SEQ ID NO: 576035 - DNA, 20 bp, Artificial Sequence
  chemically synthesized
gtcctgcgaagtagtagtac

SEQ ID NO: 576036 - DNA, 20 bp, Artificial Sequence
  chemically synthesized
cgaagtagtagtacatatgt

SEQ ID NO: 576037 - DNA, 20 bp, Artificial Sequence
  chemically synthesized
atgtttctgtttttaaaaga

SEQ ID NO: 576038 - DNA, 20 bp, Artificial Sequence
  chemically synthesized
tgaaggaaaaatgtaatagc

SEQ ID NO: 576039 - DNA, 20 bp, Artificial Sequence
  chemically synthesized
tgtctaatttaatacacatt

SEQ ID NO: 576040 - DNA, 20 bp, Artificial Sequence
  chemically synthesized
ttgcacagctgttcatggcc

SEQ ID NO: 576041 - DNA, 20 bp, Artificial Sequence
  chemically synthesized
tcatgatgtgaatggtactt

SEQ ID NO: 576042 - DNA, 20 bp, Artificial Sequence
  chemically synthesized
taccattcacatcatgagtt

SEQ ID NO: 576043 - DNA, 20 bp, Artificial Sequence
  chemically synthesized
aggactgccatgaagagccg

SEQ ID NO: 576044 - DNA, 20 bp, Artificial Sequence
  chemically synthesized
gactctctcttcatggtgag

SEQ ID NO: 576045 - DNA, 20 bp, Artificial Sequence
  chemically synthesized
acttcatgtttaagatactc

SEQ ID NO: 576046 - DNA, 20 bp, Artificial Sequence
  chemically synthesized
tttgtcatctctaggctact

SEQ ID NO: 576047 - DNA, 20 bp, Artificial Sequence
  chemically synthesized
aagtagcctagagatgacaa

SEQ ID NO: 576048 - DNA, 20 bp, Artificial Sequence
  chemically synthesized
gtgaatggcttccgtttctg

SEQ ID NO: 576049 - DNA, 20 bp, Artificial Sequence
  chemically synthesized
aaggaaaatacgtgaatggc

SEQ ID NO: 576050 - DNA, 20 bp, Artificial Sequence
  chemically synthesized
acaaggaaggaaaatacgtg

SEQ ID NO: 576051 - DNA, 20 bp, Artificial Sequence
  chemically synthesized
attttctcttctggaaaatg

SEQ ID NO: 576052 - DNA, 20 bp, Artificial Sequence
  chemically synthesized
ctgatgttaagagcaagttg

SEQ ID NO: 576053 - DNA, 20 bp, Artificial Sequence
  chemically synthesized
catcagtgctggagcagaac

SEQ ID NO: 576054 - DNA, 20 bp, Artificial Sequence
  chemically synthesized
cctacgtcccttccttcaca

SEQ ID NO: 576055 - DNA, 20 bp, Artificial Sequence
  chemically synthesized
cccttccttcacacctggtt

SEQ ID NO: 576056 - DNA, 20 bp, Artificial Sequence
  chemically synthesized
ataaattataaattctagcc

SEQ ID NO: 576057 - DNA, 20 bp, Artificial Sequence
  chemically synthesized
ctgtgttctcacatggcata

SEQ ID NO: 576058 - DNA, 20 bp, Artificial Sequence
  chemically synthesized
cttggcactacattttatgt

SEQ ID NO: 576059 - DNA, 20 bp, Artificial Sequence
  chemically synthesized
tttcccccctgcattgctta

SEQ ID NO: 576060 - DNA, 20 bp, Artificial Sequence
  chemically synthesized
gacaatttctttcccccctg

SEQ ID NO: 576061 - DNA, 20 bp, Artificial Sequence
  chemically synthesized
aacgaagagatcatctgtaa

SEQ ID NO: 576062 - DNA, 20 bp, Artificial Sequence
  chemically synthesized
taatatcgttttgagacata

SEQ ID NO: 576063 - DNA, 20 bp, Artificial Sequence
  chemically synthesized
aagtattctgctgccatttg

SEQ ID NO: 576064 - DNA, 20 bp, Artificial Sequence
  chemically synthesized
tgtgaagaggtaacaactgg

SEQ ID NO: 576065 - DNA, 20 bp, Artificial Sequence
  chemically synthesized
ctatgtctttcctgtttact

SEQ ID NO: 576066 - DNA, 20 bp, Artificial Sequence
  chemically synthesized
aaagatagggactatgtctt

SEQ ID NO: 576067 - DNA, 20 bp, Artificial Sequence
  chemically synthesized
gaggcactgaacaatgatgt

SEQ ID NO: 576068 - DNA, 20 bp, Artificial Sequence
  chemically synthesized
atcacaaattgatctctata

SEQ ID NO: 576069 - DNA, 20 bp, Artificial Sequence
  chemically synthesized
gctggatatccaaaacaaac

SEQ ID NO: 576070 - DNA, 20 bp, Artificial Sequence
  chemically synthesized
aagttttccagcaatccagt

SEQ ID NO: 576071 - DNA, 20 bp, Artificial Sequence
  chemically synthesized
tcctaagttttccagcaatc

SEQ ID NO: 576072 - DNA, 20 bp, Artificial Sequence
  chemically synthesized
gatttgtgaatattaaattc

SEQ ID NO: 576073 - DNA, 20 bp, Artificial Sequence
  chemically synthesized
tgtttttacttattttagaa

SEQ ID NO: 576074 - DNA, 20 bp, Artificial Sequence
  chemically synthesized
aagtaaaaacaattagaaaa

SEQ ID NO: 576075 - DNA, 20 bp, Artificial Sequence
  chemically synthesized
tgtgtgaatctgtcttttct

SEQ ID NO: 576076 - DNA, 20 bp, Artificial Sequence
  chemically synthesized
cattttataactagtatcta

SEQ ID NO: 576077 - DNA, 20 bp, Artificial Sequence
  chemically synthesized
cttttagacatcagaagatg

SEQ ID NO: 576078 - DNA, 20 bp, Artificial Sequence
  chemically synthesized
tacatcttctgatgtctaaa

SEQ ID NO: 576079 - DNA, 20 bp, Artificial Sequence
  chemically synthesized
tactcactagactctttttc

SEQ ID NO: 576080 - DNA, 20 bp, Artificial Sequence
  chemically synthesized
ctttttcacttgctttgcaa

SEQ ID NO: 576081 - DNA, 20 bp, Artificial Sequence
  chemically synthesized
ctgattaccatgtatgttta

SEQ ID NO: 576082 - DNA, 20 bp, Artificial Sequence
  chemically synthesized
taatgactcctgattaccat

SEQ ID NO: 576083 - DNA, 20 bp, Artificial Sequence
  chemically synthesized
aagtgaataaaaataatgac

SEQ ID NO: 576084 - DNA, 20 bp, Artificial Sequence
  chemically synthesized
gtcagaagtaccttttccca

SEQ ID NO: 576085 - DNA, 20 bp, Artificial Sequence
  chemically synthesized
aaagtaaaacacccttcatt

SEQ ID NO: 576086 - DNA, 20 bp, Artificial Sequence
  chemically synthesized
ccataaaatctccaaatgaa

SEQ ID NO: 576087 - DNA, 20 bp, Artificial Sequence
  chemically synthesized
gattttatgggtgtctaaac

SEQ ID NO: 576088 - DNA, 20 bp, Artificial Sequence
  chemically synthesized
catttcctgtttagaaaagc

SEQ ID NO: 576089 - DNA, 20 bp, Artificial Sequence
  chemically synthesized
catgtgcttttctaaacagg

SEQ ID NO: 576090 - DNA, 20 bp, Artificial Sequence
  chemically synthesized
ttgataagtcataaatcatt

SEQ ID NO: 576091 - DNA, 20 bp, Artificial Sequence
  chemically synthesized
tggagaaagtcagctgggtt

SEQ ID NO: 576092 - DNA, 20 bp, Artificial Sequence
  chemically synthesized
agagaaatggagaaagtcag

SEQ ID NO: 576093 - DNA, 20 bp, Artificial Sequence
  chemically synthesized
agcgtagcaaaaggagacgc

SEQ ID NO: 576094 - DNA, 20 bp, Artificial Sequence
  chemically synthesized
atctaaaagtgctgcattta

SEQ ID NO: 576095 - DNA, 20 bp, Artificial Sequence
  chemically synthesized
cttttagatgaaaattgctc

SEQ ID NO: 576096 - DNA, 20 bp, Artificial Sequence
  chemically synthesized
ttctggtattataagaactc

SEQ ID NO: 576097 - DNA, 20 bp, Artificial Sequence
  chemically synthesized
atattgtgcattaagggctt

SEQ ID NO: 576098 - DNA, 20 bp, Artificial Sequence
  chemically synthesized
tcagtgtaatattgtgcatt

SEQ ID NO: 576099 - DNA, 20 bp, Artificial Sequence
  chemically synthesized
aatgcctttctacctatttt

SEQ ID NO: 576100 - DNA, 20 bp, Artificial Sequence
  chemically synthesized
ttccagactcggcattttag

SEQ ID NO: 576101 - DNA, 20 bp, Artificial Sequence
  chemically synthesized
aaaaagatcttaatttccaa

SEQ ID NO: 576102 - DNA, 20 bp, Artificial Sequence
  chemically synthesized
cttacttctttctgagcaga

SEQ ID NO: 576103 - DNA, 20 bp, Artificial Sequence
  chemically synthesized
ctcccacactctcaaaaggg

SEQ ID NO: 576104 - DNA, 20 bp, Artificial Sequence
  chemically synthesized
ggagaaaatgggtggagaac

SEQ ID NO: 576105 - DNA, 20 bp, Artificial Sequence
  chemically synthesized
atgacagtgtagaaaatttg

SEQ ID NO: 576106 - DNA, 20 bp, Artificial Sequence
  chemically synthesized
ctgcaaattttctacactgt

SEQ ID NO: 576107 - DNA, 20 bp, Artificial Sequence
  chemically synthesized
tgattaatttcttcaataaa

SEQ ID NO: 576108 - DNA, 20 bp, Artificial Sequence
  chemically synthesized
gaacacagtagatcctaaat

SEQ ID NO: 576109 - DNA, 20 bp, Artificial Sequence
  chemically synthesized
tcagtctctccgtctcacta

SEQ ID NO: 576110 - DNA, 20 bp, Artificial Sequence
  chemically synthesized
ggctagtgagacggagagac

SEQ ID NO: 576111 - DNA, 20 bp, Artificial Sequence
  chemically synthesized
agttattgaaaaacttttgt

SEQ ID NO: 576112 - DNA, 20 bp, Artificial Sequence
  chemically synthesized
aagttgttccaaacatacac

SEQ ID NO: 576113 - DNA, 20 bp, Artificial Sequence
  chemically synthesized
taaactttatagttgaaaaa

SEQ ID NO: 576114 - DNA, 20 bp, Artificial Sequence
  chemically synthesized
gaatcttcttttttcaacta

SEQ ID NO: 576115 - DNA, 20 bp, Artificial Sequence
  chemically synthesized
agggcacatgtgcacaacgt

SEQ ID NO: 576116 - DNA, 20 bp, Artificial Sequence
  chemically synthesized
cgcctgtgagtaagaacatg

SEQ ID NO: 576117 - DNA, 20 bp, Artificial Sequence
  chemically synthesized
gtgagtaagaacatgtggtg

SEQ ID NO: 576118 - DNA, 20 bp, Artificial Sequence
  chemically synthesized
gtttggttttctgtccttgt

SEQ ID NO: 576119 - DNA, 20 bp, Artificial Sequence
  chemically synthesized
tgtgatagtttgctcagaat

SEQ ID NO: 576120 - DNA, 20 bp, Artificial Sequence
  chemically synthesized
gtttgctcagaatgatggtt

SEQ ID NO: 576121 - DNA, 20 bp, Artificial Sequence
  chemically synthesized
caaatgtccatcaatgatag

SEQ ID NO: 576122 - DNA, 20 bp, Artificial Sequence
  chemically synthesized
atttggtctcacctgcacac

SEQ ID NO: 576123 - DNA, 20 bp, Artificial Sequence
  chemically synthesized
gatgcaattgaaagacacat

SEQ ID NO: 576124 - DNA, 20 bp, Artificial Sequence
  chemically synthesized
caataaaaagtattaataaa

SEQ ID NO: 576125 - DNA, 20 bp, Artificial Sequence
  chemically synthesized
caaattttattaatactttt

SEQ ID NO: 576126 - DNA, 20 bp, Artificial Sequence
  chemically synthesized
tatatcagggtcaataaaat

SEQ ID NO: 576127 - DNA, 20 bp, Artificial Sequence
  chemically synthesized
gaacgtggctactagaatac

SEQ ID NO: 576128 - DNA, 20 bp, Artificial Sequence
  chemically synthesized
gtaaaatccttaagggaatg

SEQ ID NO: 576129 - DNA, 20 bp, Artificial Sequence
  chemically synthesized
cataaaactaaacattccct

SEQ ID NO: 576130 - DNA, 20 bp, Artificial Sequence
  chemically synthesized
attccgtaaaatccttaagg

SEQ ID NO: 576131 - DNA, 20 bp, Artificial Sequence
  chemically synthesized
ccatggctacctaaaataag

SEQ ID NO: 576132 - DNA, 20 bp, Artificial Sequence
  chemically synthesized
ggcatgcttaaattgatcct

SEQ ID NO: 576133 - DNA, 20 bp, Artificial Sequence
  chemically synthesized
ttgggagaagtagtacaata

SEQ ID NO: 576134 - DNA, 20 bp, Artificial Sequence
  chemically synthesized
atgactcaaagggtagaggt

SEQ ID NO: 576135 - DNA, 20 bp, Artificial Sequence
  chemically synthesized
atctcacagatagtaagtgg

SEQ ID NO: 576136 - DNA, 20 bp, Artificial Sequence
  chemically synthesized
aggcatcatgcattcaccag

SEQ ID NO: 576137 - DNA, 20 bp, Artificial Sequence
  chemically synthesized
cttttatccttcaagctgtg

SEQ ID NO: 576138 - DNA, 20 bp, Artificial Sequence
  chemically synthesized
caagatgtgactaatcctct

SEQ ID NO: 576139 - DNA, 20 bp, Artificial Sequence
  chemically synthesized
ctgctactcttatgcctgga

SEQ ID NO: 576140 - DNA, 20 bp, Artificial Sequence
  chemically synthesized
tggccccgcagcactgctca

SEQ ID NO: 576141 - DNA, 20 bp, Artificial Sequence
  chemically synthesized
taaatgctcttgaaaccttt

SEQ ID NO: 576142 - DNA, 20 bp, Artificial Sequence
  chemically synthesized
atacctaaaaagaagcagag

SEQ ID NO: 576143 - DNA, 20 bp, Artificial Sequence
  chemically synthesized
cagatggaagacccttgctg

SEQ ID NO: 576144 - DNA, 20 bp, Artificial Sequence
  chemically synthesized
tctcactgcaacctccgcct

SEQ ID NO: 576145 - DNA, 20 bp, Artificial Sequence
  chemically synthesized
aacctccgcctcccggcttc

SEQ ID NO: 576146 - DNA, 20 bp, Artificial Sequence
  chemically synthesized
ctcccggcttcaagtgattc

SEQ ID NO: 576147 - DNA, 20 bp, Artificial Sequence
  chemically synthesized
tgcttcagcctcccaagtag

SEQ ID NO: 576148 - DNA, 20 bp, Artificial Sequence
  chemically synthesized
ttttgtatttttagtagaga

SEQ ID NO: 576149 - DNA, 20 bp, Artificial Sequence
  chemically synthesized
caccttggcctcccaaagtg

SEQ ID NO: 576150 - DNA, 20 bp, Artificial Sequence
  chemically synthesized
actaacatgaattcacctta

SEQ ID NO: 576151 - DNA, 20 bp, Artificial Sequence
  chemically synthesized
gagaaagaaatacatttcta

SEQ ID NO: 576152 - DNA, 20 bp, Artificial Sequence
  chemically synthesized
attttaatagtccatttggt

SEQ ID NO: 576153 - DNA, 20 bp, Artificial Sequence
  chemically synthesized
aaatgcttttagctctttaa

SEQ ID NO: 576154 - DNA, 20 bp, Artificial Sequence
  chemically synthesized
aagtctttttttcctcgtaa

SEQ ID NO: 576155 - DNA, 20 bp, Artificial Sequence
  chemically synthesized
caagaacatacttatcggtt

SEQ ID NO: 576156 - DNA, 20 bp, Artificial Sequence
  chemically synthesized
tctgctgaattgaggaagat

SEQ ID NO: 576157 - DNA, 20 bp, Artificial Sequence
  chemically synthesized
tcaattcagcagaaaagagg

SEQ ID NO: 576158 - DNA, 20 bp, Artificial Sequence
  chemically synthesized
taccttaaccaaatgactct

SEQ ID NO: 576159 - DNA, 20 bp, Artificial Sequence
  chemically synthesized
gtcatttggttaaggtattg

SEQ ID NO: 576160 - DNA, 20 bp, Artificial Sequence
  chemically synthesized
tgagccaccgcacccagccg

SEQ ID NO: 576161 - DNA, 20 bp, Artificial Sequence
  chemically synthesized
ttttgtatctttagtagaga

SEQ ID NO: 576162 - DNA, 20 bp, Artificial Sequence
  chemically synthesized
tgcctcagcctcccgagtaa

SEQ ID NO: 576163 - DNA, 20 bp, Artificial Sequence
  chemically synthesized
aacctccacctcccaagttc

SEQ ID NO: 576164 - DNA, 20 bp, Artificial Sequence
  chemically synthesized
gaggtggaggttgtagtgag

SEQ ID NO: 576165 - DNA, 20 bp, Artificial Sequence
  chemically synthesized
gtctcaaaaaaaaaaaaaaa

SEQ ID NO: 576166 - DNA, 20 bp, Artificial Sequence
  chemically synthesized
tactccaaaatccacaatat

SEQ ID NO: 576167 - DNA, 20 bp, Artificial Sequence
  chemically synthesized
caaataccaagctgccatat

SEQ ID NO: 576168 - DNA, 20 bp, Artificial Sequence
  chemically synthesized
ggggaaggtgagagtgacca

SEQ ID NO: 576169 - DNA, 20 bp, Artificial Sequence
  chemically synthesized
tctggtatgatagtctcatg

SEQ ID NO: 576170 - DNA, 20 bp, Artificial Sequence
  chemically synthesized
ctgcagaacctcctgtgtcc

SEQ ID NO: 576171 - DNA, 20 bp, Artificial Sequence
  chemically synthesized
actggggtgaccacagcaag

SEQ ID NO: 576172 - DNA, 20 bp, Artificial Sequence
  chemically synthesized
acaggccttgctgtggtcac

SEQ ID NO: 576173 - DNA, 20 bp, Artificial Sequence
  chemically synthesized
gaaaagtgtgtatttttatg

SEQ ID NO: 576174 - DNA, 20 bp, Artificial Sequence
  chemically synthesized
gcataaaaatacacactttt

SEQ ID NO: 576175 - DNA, 20 bp, Artificial Sequence
  chemically synthesized
agcatgcgaatttatttaat

SEQ ID NO: 576176 - DNA, 20 bp, Artificial Sequence
  chemically synthesized
aacttatattaaataaattc

SEQ ID NO: 576177 - DNA, 20 bp, Artificial Sequence
  chemically synthesized
aaattcgcatgcttttatgt

SEQ ID NO: 576178 - DNA, 20 bp, Artificial Sequence
  chemically synthesized
tttctcccctgtaagagtca

SEQ ID NO: 576179 - DNA, 20 bp, Artificial Sequence
  chemically synthesized
gattctaaaattctaaacaa

SEQ ID NO: 576180 - DNA, 20 bp, Artificial Sequence
  chemically synthesized
tttctgagaacccgaaacct

SEQ ID NO: 576181 - DNA, 20 bp, Artificial Sequence
  chemically synthesized
ctgttttctgagaacccgaa

SEQ ID NO: 576182 - DNA, 20 bp, Artificial Sequence
  chemically synthesized
cagaaccattcttgtcaacc

SEQ ID NO: 576183 - DNA, 20 bp, Artificial Sequence
  chemically synthesized
tggaatcataattcagtttt

SEQ ID NO: 576184 - DNA, 20 bp, Artificial Sequence
  chemically synthesized
cccaaactgtgaaaactgaa

SEQ ID NO: 576185 - DNA, 20 bp, Artificial Sequence
  chemically synthesized
ctattgccttggaatcataa

SEQ ID NO: 576186 - DNA, 20 bp, Artificial Sequence
  chemically synthesized
aaggcaatagcatttaatac

SEQ ID NO: 576187 - DNA, 20 bp, Artificial Sequence
  chemically synthesized
ctcatgcttgttgaataggc

SEQ ID NO: 576188 - DNA, 20 bp, Artificial Sequence
  chemically synthesized
ttcatctctggaaacctaga

SEQ ID NO: 576189 - DNA, 20 bp, Artificial Sequence
  chemically synthesized
attctaagagtaaaccacat

SEQ ID NO: 576190 - DNA, 20 bp, Artificial Sequence
  chemically synthesized
aaaaagggataaaccttcaa

SEQ ID NO: 576191 - DNA, 20 bp, Artificial Sequence
  chemically synthesized
gatattttacaaacccagtt

SEQ ID NO: 576192 - DNA, 20 bp, Artificial Sequence
  chemically synthesized
acttttgaccttggtcttga

SEQ ID NO: 576193 - DNA, 20 bp, Artificial Sequence
  chemically synthesized
ggtcaaaagtgatggtcaca

SEQ ID NO: 576194 - DNA, 20 bp, Artificial Sequence
  chemically synthesized
gaattgcctggctggtgagg

SEQ ID NO: 576195 - DNA, 20 bp, Artificial Sequence
  chemically synthesized
ctgctgaattgcctggctgg

SEQ ID NO: 576196 - DNA, 20 bp, Artificial Sequence
  chemically synthesized
ctcttccatgctgtccctga

SEQ ID NO: 576197 - DNA, 20 bp, Artificial Sequence
  chemically synthesized
ggtgtgagctctagacttca

SEQ ID NO: 576198 - DNA, 20 bp, Artificial Sequence
  chemically synthesized
actatatttccttctgcctt

SEQ ID NO: 576199 - DNA, 20 bp, Artificial Sequence
  chemically synthesized
cttctgggattccttctgac

SEQ ID NO: 576200 - DNA, 20 bp, Artificial Sequence
  chemically synthesized
ggattccttctgacacttgt

SEQ ID NO: 576201 - DNA, 20 bp, Artificial Sequence
  chemically synthesized
cacttgtttcagtttaagaa

SEQ ID NO: 576202 - DNA, 20 bp, Artificial Sequence
  chemically synthesized
ttctcaaatcattttcctta

SEQ ID NO: 576203 - DNA, 20 bp, Artificial Sequence
  chemically synthesized
gtgaagaaacagcataagga

SEQ ID NO: 576204 - DNA, 20 bp, Artificial Sequence
  chemically synthesized
aaaatactgtgtgctatctg

SEQ ID NO: 576205 - DNA, 20 bp, Artificial Sequence
  chemically synthesized
gcccattctcacaacttctg

SEQ ID NO: 576206 - DNA, 20 bp, Artificial Sequence
  chemically synthesized
gaagttgtgagaatgggcat

SEQ ID NO: 576207 - DNA, 20 bp, Artificial Sequence
  chemically synthesized
tgggcatttgtgatttctaa

SEQ ID NO: 576208 - DNA, 20 bp, Artificial Sequence
  chemically synthesized
gggggcaggtttaaggagtt

SEQ ID NO: 576209 - DNA, 20 bp, Artificial Sequence
  chemically synthesized
agctcctgatacatttgggg

SEQ ID NO: 576210 - DNA, 20 bp, Artificial Sequence
  chemically synthesized
cctccactagcaggcagggt

SEQ ID NO: 576211 - DNA, 20 bp, Artificial Sequence
  chemically synthesized
cagtttctttgtatccgcag

SEQ ID NO: 576212 - DNA, 20 bp, Artificial Sequence
  chemically synthesized
gctgagtcacctctatatac

SEQ ID NO: 576213 - DNA, 20 bp, Artificial Sequence
  chemically synthesized
aatggctgtgtataatattg

SEQ ID NO: 576214 - DNA, 20 bp, Artificial Sequence
  chemically synthesized
tgggcttctaatatttgact

SEQ ID NO: 576215 - DNA, 20 bp, Artificial Sequence
  chemically synthesized
aatccatctgttggcggggc

SEQ ID NO: 576216 - DNA, 20 bp, Artificial Sequence
  chemically synthesized
aagcccaagccccgccaaca

SEQ ID NO: 576217 - DNA, 20 bp, Artificial Sequence
  chemically synthesized
tacaggaatccatctgttgg

SEQ ID NO: 576218 - DNA, 20 bp, Artificial Sequence
  chemically synthesized
aacagatggattcctgtatt

SEQ ID NO: 576219 - DNA, 20 bp, Artificial Sequence
  chemically synthesized
gcagataatgctgctgccat

SEQ ID NO: 576220 - DNA, 20 bp, Artificial Sequence
  chemically synthesized
ttgtgccacataccatatta

SEQ ID NO: 576221 - DNA, 20 bp, Artificial Sequence
  chemically synthesized
cccactggatactgggatta

SEQ ID NO: 576222 - DNA, 20 bp, Artificial Sequence
  chemically synthesized
ctgctgacgcccactggata

SEQ ID NO: 576223 - DNA, 20 bp, Artificial Sequence
  chemically synthesized
tgcaacctctttcattagca

SEQ ID NO: 576224 - DNA, 20 bp, Artificial Sequence
  chemically synthesized
ttttggctgggctactctgg

SEQ ID NO: 576225 - DNA, 20 bp, Artificial Sequence
  chemically synthesized
tgcctgagctgaagctagaa

SEQ ID NO: 576226 - DNA, 20 bp, Artificial Sequence
  chemically synthesized
tccagggtgcaaagccacgt

SEQ ID NO: 576227 - DNA, 20 bp, Artificial Sequence
  chemically synthesized
agaaaactggcaaaatatag

SEQ ID NO: 576228 - DNA, 20 bp, Artificial Sequence
  chemically synthesized
tggaaacctgcctatatttt

SEQ ID NO: 576229 - DNA, 20 bp, Artificial Sequence
  chemically synthesized
aagcaattcttaggtaccag

SEQ ID NO: 576230 - DNA, 20 bp, Artificial Sequence
  chemically synthesized
aaacctagctggtacctaag

SEQ ID NO: 576231 - DNA, 20 bp, Artificial Sequence
  chemically synthesized
gggaaggtggtgtggccata

SEQ ID NO: 576232 - DNA, 20 bp, Artificial Sequence
  chemically synthesized
aggagagcatcggtcagcac

SEQ ID NO: 576233 - DNA, 20 bp, Artificial Sequence
  chemically synthesized
cgatgctctcctctccttct

SEQ ID NO: 576234 - DNA, 20 bp, Artificial Sequence
  chemically synthesized
ctttacaacttcctcttgcc

SEQ ID NO: 576235 - DNA, 20 bp, Artificial Sequence
  chemically synthesized
tgcccactgattttggaata

SEQ ID NO: 576236 - DNA, 20 bp, Artificial Sequence
  chemically synthesized
gcagttagctgctacagaca

SEQ ID NO: 576237 - DNA, 20 bp, Artificial Sequence
  chemically synthesized
cttgtcagaggcaatgtggg

SEQ ID NO: 576238 - DNA, 20 bp, Artificial Sequence
  chemically synthesized
atgtcatagatagggggcta

SEQ ID NO: 576239 - DNA, 20 bp, Artificial Sequence
  chemically synthesized
cagaaagagtgttagagata

SEQ ID NO: 576240 - DNA, 20 bp, Artificial Sequence
  chemically synthesized
ttaacagtgggaaaggaaaa

SEQ ID NO: 576241 - DNA, 20 bp, Artificial Sequence
  chemically synthesized
attggaaatttgagttatcg

SEQ ID NO: 576242 - DNA, 20 bp, Artificial Sequence
  chemically synthesized
ttctaattggaaatttgagt

SEQ ID NO: 576243 - DNA, 20 bp, Artificial Sequence
  chemically synthesized
cagaataccaactagaactg

SEQ ID NO: 576244 - DNA, 20 bp, Artificial Sequence
  chemically synthesized
attggtgcagtatgaaatga

SEQ ID NO: 576245 - DNA, 20 bp, Artificial Sequence
  chemically synthesized
ataaaaagaagaacattaca

SEQ ID NO: 576246 - DNA, 20 bp, Artificial Sequence
  chemically synthesized
cccagggttaggttatgtta

SEQ ID NO: 576247 - DNA, 20 bp, Artificial Sequence
  chemically synthesized
tttaacataacctaaccctg

SEQ ID NO: 576248 - DNA, 20 bp, Artificial Sequence
  chemically synthesized
aacctaaccctgggaagatt

SEQ ID NO: 576249 - DNA, 20 bp, Artificial Sequence
  chemically synthesized
ggtgctagcatttcattata

SEQ ID NO: 576250 - DNA, 20 bp, Artificial Sequence
  chemically synthesized
aatgaaatgctagcaccacg

SEQ ID NO: 576251 - DNA, 20 bp, Artificial Sequence
  chemically synthesized
cctccaactattgccacact

SEQ ID NO: 576252 - DNA, 20 bp, Artificial Sequence
  chemically synthesized
taattatatctccagccatt

SEQ ID NO: 576253 - DNA, 20 bp, Artificial Sequence
  chemically synthesized
taattaccttctgtttcaga

SEQ ID NO: 576254 - DNA, 20 bp, Artificial Sequence
  chemically synthesized
ccgaagatatattaattacc

SEQ ID NO: 576255 - DNA, 20 bp, Artificial Sequence
  chemically synthesized
ttaatatatcttcggggaaa

SEQ ID NO: 576256 - DNA, 20 bp, Artificial Sequence
  chemically synthesized
catgtctgattcattaaaaa

SEQ ID NO: 576257 - DNA, 20 bp, Artificial Sequence
  chemically synthesized
gagcctttctctgcggtcat

SEQ ID NO: 576258 - DNA, 20 bp, Artificial Sequence
  chemically synthesized
ctaggaggtccctagtgtgg

SEQ ID NO: 576259 - DNA, 20 bp, Artificial Sequence
  chemically synthesized
cacatttgtgagcagtaagc

SEQ ID NO: 576260 - DNA, 20 bp, Artificial Sequence
  chemically synthesized
ctgcaagagtgccagcaaac

SEQ ID NO: 576261 - DNA, 20 bp, Artificial Sequence
  chemically synthesized
cactaaatgtctttgttcta

SEQ ID NO: 576262 - DNA, 20 bp, Artificial Sequence
  chemically synthesized
aaatgagtcattttcagact

SEQ ID NO: 576263 - DNA, 20 bp, Artificial Sequence
  chemically synthesized
agaaaataggattttatacc

SEQ ID NO: 576264 - DNA, 20 bp, Artificial Sequence
  chemically synthesized
agtatggtttcatttagaaa

SEQ ID NO: 576265 - DNA, 20 bp, Artificial Sequence
  chemically synthesized
tcatatattccacttttgag

SEQ ID NO: 576266 - DNA, 20 bp, Artificial Sequence
  chemically synthesized
gccaaagggagagatgggaa

SEQ ID NO: 576267 - DNA, 20 bp, Artificial Sequence
  chemically synthesized
gaactttctagaatgacttg

SEQ ID NO: 576268 - DNA, 20 bp, Artificial Sequence
  chemically synthesized
agaatgacttgaatggtttg

SEQ ID NO: 576269 - DNA, 20 bp, Artificial Sequence
  chemically synthesized
gaatggtttgcatggtttga

SEQ ID NO: 576270 - DNA, 20 bp, Artificial Sequence
  chemically synthesized
atgagtgttgctccagatct

SEQ ID NO: 576271 - DNA, 20 bp, Artificial Sequence
  chemically synthesized
atacttttcaggtgaggtaa

SEQ ID NO: 576272 - DNA, 20 bp, Artificial Sequence
  chemically synthesized
taactgggatttaagaagtt

SEQ ID NO: 576273 - DNA, 20 bp, Artificial Sequence
  chemically synthesized
ctcaactgatttacttgtcg

SEQ ID NO: 576274 - DNA, 20 bp, Artificial Sequence
  chemically synthesized
actctggttccttccctctc

SEQ ID NO: 576275 - DNA, 20 bp, Artificial Sequence
  chemically synthesized
attttcgtagcaccaggtct

SEQ ID NO: 576276 - DNA, 20 bp, Artificial Sequence
  chemically synthesized
tagcaggtctgtggcaaggc

SEQ ID NO: 576277 - DNA, 20 bp, Artificial Sequence
  chemically synthesized
tctggatcccaccacagaga

SEQ ID NO: 576278 - DNA, 20 bp, Artificial Sequence
  chemically synthesized
cagttgtctggatcccacca

SEQ ID NO: 576279 - DNA, 20 bp, Artificial Sequence
  chemically synthesized
atccagacaactgcattttc

SEQ ID NO: 576280 - DNA, 20 bp, Artificial Sequence
  chemically synthesized
ggatgcttaagaatgacctg

SEQ ID NO: 576281 - DNA, 20 bp, Artificial Sequence
  chemically synthesized
ggaaagatgttcaagggtga

SEQ ID NO: 576282 - DNA, 20 bp, Artificial Sequence
  chemically synthesized
cgtctttccttttcttctgg

SEQ ID NO: 576283 - DNA, 20 bp, Artificial Sequence
  chemically synthesized
taacaacattttcactactt

SEQ ID NO: 576284 - DNA, 20 bp, Artificial Sequence
  chemically synthesized
tgaagtcattttggaaatta

SEQ ID NO: 576285 - DNA, 20 bp, Artificial Sequence
  chemically synthesized
ttttttttttttttttgaga

SEQ ID NO: 576286 - DNA, 20 bp, Artificial Sequence
  chemically synthesized
cttgaggtcaggagttcgag

SEQ ID NO: 576287 - DNA, 20 bp, Artificial Sequence
  chemically synthesized
ctcctcagcctcccaaagta

SEQ ID NO: 576288 - DNA, 20 bp, Artificial Sequence
  chemically synthesized
caggcctggaaattaagtat

SEQ ID NO: 576289 - DNA, 20 bp, Artificial Sequence
  chemically synthesized
ccactcctcttcccggttac

SEQ ID NO: 576290 - DNA, 20 bp, Artificial Sequence
  chemically synthesized
agtttgaaaaaaaatgattt

SEQ ID NO: 576291 - DNA, 20 bp, Artificial Sequence
  chemically synthesized
aagacatttagtttgaaaaa

SEQ ID NO: 576292 - DNA, 20 bp, Artificial Sequence
  chemically synthesized
ttttttcaaactaaatgtct

SEQ ID NO: 576293 - DNA, 20 bp, Artificial Sequence
  chemically synthesized
acatgataaacatgaagaca

SEQ ID NO: 576294 - DNA, 20 bp, Artificial Sequence
  chemically synthesized
taacatttgttatgtaaact

SEQ ID NO: 576295 - DNA, 20 bp, Artificial Sequence
  chemically synthesized
ctagtccttctatttaaaca

SEQ ID NO: 576296 - DNA, 20 bp, Artificial Sequence
  chemically synthesized
atatgcacacacacaaacat

SEQ ID NO: 576297 - DNA, 20 bp, Artificial Sequence
  chemically synthesized
ttttttttaaaaaaaatcag

SEQ ID NO: 576298 - DNA, 20 bp, Artificial Sequence
  chemically synthesized
tggcatatttttaaagtaat

SEQ ID NO: 576299 - DNA, 20 bp, Artificial Sequence
  chemically synthesized
tttgtttagcacattcatac

SEQ ID NO: 576300 - DNA, 20 bp, Artificial Sequence
  chemically synthesized
aaattattttgtgttagtct

SEQ ID NO: 576301 - DNA, 20 bp, Artificial Sequence
  chemically synthesized
gcccataaaaatgaggaggg

SEQ ID NO: 576302 - DNA, 20 bp, Artificial Sequence
  chemically synthesized
cattcacgggaatgtttcta

SEQ ID NO: 576303 - DNA, 20 bp, Artificial Sequence
  chemically synthesized
ttgtctccttgcattcacgg

SEQ ID NO: 576304 - DNA, 20 bp, Artificial Sequence
  chemically synthesized
aattattatctgactcttct

SEQ ID NO: 576305 - DNA, 20 bp, Artificial Sequence
  chemically synthesized
ttcagggtagttgttctcag

SEQ ID NO: 576306 - DNA, 20 bp, Artificial Sequence
  chemically synthesized
caactaccctgaaaaaaaaa

SEQ ID NO: 576307 - DNA, 20 bp, Artificial Sequence
  chemically synthesized
caaggtctatgcaaagttat

SEQ ID NO: 576308 - DNA, 20 bp, Artificial Sequence
  chemically synthesized
ttgaatagaaaccctgagtg

SEQ ID NO: 576309 - DNA, 20 bp, Artificial Sequence
  chemically synthesized
atattcttaaacattgcact

SEQ ID NO: 576310 - DNA, 20 bp, Artificial Sequence
  chemically synthesized
agaatttttgcatgttggga

SEQ ID NO: 576311 - DNA, 20 bp, Artificial Sequence
  chemically synthesized
actctgctactgtgtatgtg

SEQ ID NO: 576312 - DNA, 20 bp, Artificial Sequence
  chemically synthesized
tgtgttttttgtggctttag

SEQ ID NO: 576313 - DNA, 20 bp, Artificial Sequence
  chemically synthesized
tgaattctatttgtgttttt

SEQ ID NO: 576314 - DNA, 20 bp, Artificial Sequence
  chemically synthesized
ataagaactttgaattctat

SEQ ID NO: 576315 - DNA, 20 bp, Artificial Sequence
  chemically synthesized
acaaatagaattcaaagttc

SEQ ID NO: 576316 - DNA, 20 bp, Artificial Sequence
  chemically synthesized
ttctttcataaaacacatca

SEQ ID NO: 576317 - DNA, 20 bp, Artificial Sequence
  chemically synthesized
agaaacgtgaaaactaggtg

SEQ ID NO: 576318 - DNA, 20 bp, Artificial Sequence
  chemically synthesized
taaaacacatcacctagttt

SEQ ID NO: 576319 - DNA, 20 bp, Artificial Sequence
  chemically synthesized
ctcctaagttaagctaaaac

SEQ ID NO: 576320 - DNA, 20 bp, Artificial Sequence
  chemically synthesized
gttgtcttaaaatcatgcgt

SEQ ID NO: 576321 - DNA, 20 bp, Artificial Sequence
  chemically synthesized
atttaggttgtcttaaaatc

SEQ ID NO: 576322 - DNA, 20 bp, Artificial Sequence
  chemically synthesized
catgaatttatgaatgtgtt

SEQ ID NO: 576323 - DNA, 20 bp, Artificial Sequence
  chemically synthesized
tcataagcatgaatttatga

SEQ ID NO: 576324 - DNA, 20 bp, Artificial Sequence
  chemically synthesized
cacaaaacacattcataaat

SEQ ID NO: 576325 - DNA, 20 bp, Artificial Sequence
  chemically synthesized
ttattcttgatatttaaaag

SEQ ID NO: 576326 - DNA, 20 bp, Artificial Sequence
  chemically synthesized
gatatttaaaagaatcgttt

SEQ ID NO: 576327 - DNA, 20 bp, Artificial Sequence
  chemically synthesized
tcatgatgacaaaaactcat

SEQ ID NO: 576328 - DNA, 20 bp, Artificial Sequence
  chemically synthesized
ttatgagtttttgtcatcat

SEQ ID NO: 576329 - DNA, 20 bp, Artificial Sequence
  chemically synthesized
gtcatcatgaatgtttgaca

SEQ ID NO: 576330 - DNA, 20 bp, Artificial Sequence
  chemically synthesized
caacaagattatctgtgaac

SEQ ID NO: 576331 - DNA, 20 bp, Artificial Sequence
  chemically synthesized
atctgtgaacaagagattgt

SEQ ID NO: 576332 - DNA, 20 bp, Artificial Sequence
  chemically synthesized
ttcaactaaaagttacggta

SEQ ID NO: 576333 - DNA, 20 bp, Artificial Sequence
  chemically synthesized
cacagaaaccacaccatagg

SEQ ID NO: 576334 - DNA, 20 bp, Artificial Sequence
  chemically synthesized
atctcaaacttaacctatgg

SEQ ID NO: 576335 - DNA, 20 bp, Artificial Sequence
  chemically synthesized
aaccacaccataggttaagt

SEQ ID NO: 576336 - DNA, 20 bp, Artificial Sequence
  chemically synthesized
agctataaatgggctgtatt

SEQ ID NO: 576337 - DNA, 20 bp, Artificial Sequence
  chemically synthesized
atacagcccatttatagctc

SEQ ID NO: 576338 - DNA, 20 bp, Artificial Sequence
  chemically synthesized
ccatttatagctcatcagtt

SEQ ID NO: 576339 - DNA, 20 bp, Artificial Sequence
  chemically synthesized
ctctctcaccttccttgagt

SEQ ID NO: 576340 - DNA, 20 bp, Artificial Sequence
  chemically synthesized
tccctggagatacagccaat

SEQ ID NO: 576341 - DNA, 20 bp, Artificial Sequence
  chemically synthesized
taagtgtggcacatttccat

SEQ ID NO: 576342 - DNA, 20 bp, Artificial Sequence
  chemically synthesized
ctccttggaactgaatgagt

SEQ ID NO: 576343 - DNA, 20 bp, Artificial Sequence
  chemically synthesized
gtataatgacaagcaagttc

SEQ ID NO: 576344 - DNA, 20 bp, Artificial Sequence
  chemically synthesized
attttattccaaacaaatga

SEQ ID NO: 576345 - DNA, 20 bp, Artificial Sequence
  chemically synthesized
aggcctcttctagcagactt

SEQ ID NO: 576346 - DNA, 20 bp, Artificial Sequence
  chemically synthesized
gaagtctgctagaagaggcc

SEQ ID NO: 576347 - DNA, 20 bp, Artificial Sequence
  chemically synthesized
gccttcagtttatcaacaca

SEQ ID NO: 576348 - DNA, 20 bp, Artificial Sequence
  chemically synthesized
aataatttcctttcctcttt

SEQ ID NO: 576349 - DNA, 20 bp, Artificial Sequence
  chemically synthesized
acctgacccaatgctttaat

SEQ ID NO: 576350 - DNA, 20 bp, Artificial Sequence
  chemically synthesized
attgggcaaaatacctgacc

SEQ ID NO: 576351 - DNA, 20 bp, Artificial Sequence
  chemically synthesized
ctatttccaattttaactgt

SEQ ID NO: 576352 - DNA, 20 bp, Artificial Sequence
  chemically synthesized
atactcaaattatttactgg

SEQ ID NO: 576353 - DNA, 20 bp, Artificial Sequence
  chemically synthesized
agtaaataatttgagtatag

SEQ ID NO: 576354 - DNA, 20 bp, Artificial Sequence
  chemically synthesized
gtctgttatggtgactcagt

SEQ ID NO: 576355 - DNA, 20 bp, Artificial Sequence
  chemically synthesized
tcctcctttcctgttcccta

SEQ ID NO: 576356 - DNA, 20 bp, Artificial Sequence
  chemically synthesized
cagcccaataaagaactctg

SEQ ID NO: 576357 - DNA, 20 bp, Artificial Sequence
  chemically synthesized
cgcccagcccaataaagaac

SEQ ID NO: 576358 - DNA, 20 bp, Artificial Sequence
  chemically synthesized
cgccttggcctcccaaagtc

SEQ ID NO: 576359 - DNA, 20 bp, Artificial Sequence
  chemically synthesized
ttttgtatttttagtagaga

SEQ ID NO: 576360 - DNA, 20 bp, Artificial Sequence
  chemically synthesized
aacctccacctcccgagttc

SEQ ID NO: 576361 - DNA, 20 bp, Artificial Sequence
  chemically synthesized
gaggtggaggttgcagtgag

SEQ ID NO: 576362 - DNA, 20 bp, Artificial Sequence
  chemically synthesized
aaaaaaagaggtatttattg

SEQ ID NO: 576363 - DNA, 20 bp, Artificial Sequence
  chemically synthesized
acagcattgagccccagttc

SEQ ID NO: 576364 - DNA, 20 bp, Artificial Sequence
  chemically synthesized
cccagtgaggggagagaaag

SEQ ID NO: 576365 - DNA, 20 bp, Artificial Sequence
  chemically synthesized
gagagtagatgggtacaaat

SEQ ID NO: 576366 - DNA, 20 bp, Artificial Sequence
  chemically synthesized
cctgttaataccctgtcact

SEQ ID NO: 576367 - DNA, 20 bp, Artificial Sequence
  chemically synthesized
aggtatcctttccatgtcct

SEQ ID NO: 576368 - DNA, 20 bp, Artificial Sequence
  chemically synthesized
tttgagtccatgatcctgta

SEQ ID NO: 576369 - DNA, 20 bp, Artificial Sequence
  chemically synthesized
cctttgtgaacagtgtgtgc

SEQ ID NO: 576370 - DNA, 20 bp, Artificial Sequence
  chemically synthesized
cagatgcacacactgttcac

SEQ ID NO: 576371 - DNA, 20 bp, Artificial Sequence
  chemically synthesized
gcacacactgttcacaaagg

SEQ ID NO: 576372 - DNA, 20 bp, Artificial Sequence
  chemically synthesized
actgttcacaaaggatttga

SEQ ID NO: 576373 - DNA, 20 bp, Artificial Sequence
  chemically synthesized
tttatatgcaaagaaatgta

SEQ ID NO: 576374 - DNA, 20 bp, Artificial Sequence
  chemically synthesized
tttgaaatttaagggatgag

SEQ ID NO: 576375 - DNA, 20 bp, Artificial Sequence
  chemically synthesized
ccacagctttcgctcagttg

SEQ ID NO: 576376 - DNA, 20 bp, Artificial Sequence
  chemically synthesized
actctgaggaacttctgtgc

SEQ ID NO: 576377 - DNA, 20 bp, Artificial Sequence
  chemically synthesized
gctgtggcacagaagttcct

SEQ ID NO: 576378 - DNA, 20 bp, Artificial Sequence
  chemically synthesized
gttcctcagagttttaaaag

SEQ ID NO: 576379 - DNA, 20 bp, Artificial Sequence
  chemically synthesized
agagttttaaaagatgtgct

SEQ ID NO: 576380 - DNA, 20 bp, Artificial Sequence
  chemically synthesized
ccacatacatataaaaccat

SEQ ID NO: 576381 - DNA, 20 bp, Artificial Sequence
  chemically synthesized
gacctagactttgaaactga

SEQ ID NO: 576382 - DNA, 20 bp, Artificial Sequence
  chemically synthesized
tgagatttgagtctagctgt

SEQ ID NO: 576383 - DNA, 20 bp, Artificial Sequence
  chemically synthesized
atgctctgagatttgagtct

SEQ ID NO: 576384 - DNA, 20 bp, Artificial Sequence
  chemically synthesized
catccagttatgaaaatgct

SEQ ID NO: 576385 - DNA, 20 bp, Artificial Sequence
  chemically synthesized
aagtaccaaaaatgttaatg

SEQ ID NO: 576386 - DNA, 20 bp, Artificial Sequence
  chemically synthesized
atgtgtcgaaagttaggcac

SEQ ID NO: 576387 - DNA, 20 bp, Artificial Sequence
  chemically synthesized
aacacaaaaagacttcagac

SEQ ID NO: 576388 - DNA, 20 bp, Artificial Sequence
  chemically synthesized
atctaaggtctgaagtcttt

SEQ ID NO: 576389 - DNA, 20 bp, Artificial Sequence
  chemically synthesized
acaatatttatactattcct

SEQ ID NO: 576390 - DNA, 20 bp, Artificial Sequence
  chemically synthesized
atagtatctgaatgtgcact

SEQ ID NO: 576391 - DNA, 20 bp, Artificial Sequence
  chemically synthesized
tgaatgtgcactgtgagttt

SEQ ID NO: 576392 - DNA, 20 bp, Artificial Sequence
  chemically synthesized
cagctctgaaaagaggatct

SEQ ID NO: 576393 - DNA, 20 bp, Artificial Sequence
  chemically synthesized
ctagatcctcttttcagagc

SEQ ID NO: 576394 - DNA, 20 bp, Artificial Sequence
  chemically synthesized
ctcttttcagagctgctgct

SEQ ID NO: 576395 - DNA, 20 bp, Artificial Sequence
  chemically synthesized
ccgtggtctcaccactgcac

SEQ ID NO: 576396 - DNA, 20 bp, Artificial Sequence
  chemically synthesized
gtggtgagaccacggctcac

SEQ ID NO: 576397 - DNA, 20 bp, Artificial Sequence
  chemically synthesized
ggctgaggtgggaggattgc

SEQ ID NO: 576398 - DNA, 20 bp, Artificial Sequence
  chemically synthesized
tcaggaggctgaggtgggag

SEQ ID NO: 576399 - DNA, 20 bp, Artificial Sequence
  chemically synthesized
ctactcaggaggctgaggtg

SEQ ID NO: 576400 - DNA, 20 bp, Artificial Sequence
  chemically synthesized
cacctcagcctcctgagtag

SEQ ID NO: 576401 - DNA, 20 bp, Artificial Sequence
  chemically synthesized
gtgtgtgccaccacacccag

SEQ ID NO: 576402 - DNA, 20 bp, Artificial Sequence
  chemically synthesized
tttattagagatgaagtccc

SEQ ID NO: 576403 - DNA, 20 bp, Artificial Sequence
  chemically synthesized
cgcctcagcctcccaaagca

SEQ ID NO: 576404 - DNA, 20 bp, Artificial Sequence
  chemically synthesized
gtggctcacacttgtaatcc

SEQ ID NO: 576405 - DNA, 20 bp, Artificial Sequence
  chemically synthesized
agccaccacacatggcccag

SEQ ID NO: 576406 - DNA, 20 bp, Artificial Sequence
  chemically synthesized
ggtgaagatcagagcacata

SEQ ID NO: 576407 - DNA, 20 bp, Artificial Sequence
  chemically synthesized
atgagcttgtctggaacaaa

SEQ ID NO: 576408 - DNA, 20 bp, Artificial Sequence
  chemically synthesized
gtctggaacaaattaagatt

SEQ ID NO: 576409 - DNA, 20 bp, Artificial Sequence
  chemically synthesized
ctcaaacccatgtaacccat

SEQ ID NO: 576410 - DNA, 20 bp, Artificial Sequence
  chemically synthesized
gtcaaacagacatgggttac

SEQ ID NO: 576411 - DNA, 20 bp, Artificial Sequence
  chemically synthesized
caggagacttctgtgcggta

SEQ ID NO: 576412 - DNA, 20 bp, Artificial Sequence
  chemically synthesized
ttttcaggagacttctgtgc

SEQ ID NO: 576413 - DNA, 20 bp, Artificial Sequence
  chemically synthesized
aagtctcctgaaaatctgaa

SEQ ID NO: 576414 - DNA, 20 bp, Artificial Sequence
  chemically synthesized
ctggatttccccaagccttt

SEQ ID NO: 576415 - DNA, 20 bp, Artificial Sequence
  chemically synthesized
gcttggggaaatccagcaga

SEQ ID NO: 576416 - DNA, 20 bp, Artificial Sequence
  chemically synthesized
agaaagggaaagctctctct

SEQ ID NO: 576417 - DNA, 20 bp, Artificial Sequence
  chemically synthesized
gctttccctttcttcagagc

SEQ ID NO: 576418 - DNA, 20 bp, Artificial Sequence
  chemically synthesized
tcagagcagaggtttttaag

SEQ ID NO: 576419 - DNA, 20 bp, Artificial Sequence
  chemically synthesized
agctggctgggccccatccc

SEQ ID NO: 576420 - DNA, 20 bp, Artificial Sequence
  chemically synthesized
tggggatggggcccagccag

SEQ ID NO: 576421 - DNA, 20 bp, Artificial Sequence
  chemically synthesized
tacgttttaaaaaggcattc

SEQ ID NO: 576422 - DNA, 20 bp, Artificial Sequence
  chemically synthesized
ttcctgctattccgctagag

SEQ ID NO: 576423 - DNA, 20 bp, Artificial Sequence
  chemically synthesized
caggaagggtaaatgctaag

SEQ ID NO: 576424 - DNA, 20 bp, Artificial Sequence
  chemically synthesized
aacgtcccatatgaactaag

SEQ ID NO: 576425 - DNA, 20 bp, Artificial Sequence
  chemically synthesized
ctcctgggcagatctagcat

SEQ ID NO: 576426 - DNA, 20 bp, Artificial Sequence
  chemically synthesized
ttaggttggtgcaaaagtaa

SEQ ID NO: 576427 - DNA, 20 bp, Artificial Sequence
  chemically synthesized
aaagtaattgtggtctttgc

SEQ ID NO: 576428 - DNA, 20 bp, Artificial Sequence
  chemically synthesized
tgcaccaacctaacagctgt

SEQ ID NO: 576429 - DNA, 20 bp, Artificial Sequence
  chemically synthesized
aagtctttctagtcagtctt

SEQ ID NO: 576430 - DNA, 20 bp, Artificial Sequence
  chemically synthesized
ttttacaggccattttaagt

SEQ ID NO: 576431 - DNA, 20 bp, Artificial Sequence
  chemically synthesized
acaggccattttaagtcctt

SEQ ID NO: 576432 - DNA, 20 bp, Artificial Sequence
  chemically synthesized
agtgcttatatagacataga

SEQ ID NO: 576433 - DNA, 20 bp, Artificial Sequence
  chemically synthesized
atatgattgttaacacactg

SEQ ID NO: 576434 - DNA, 20 bp, Artificial Sequence
  chemically synthesized
atactctcatgggcgtgatt

SEQ ID NO: 576435 - DNA, 20 bp, Artificial Sequence
  chemically synthesized
attacatgatactctcatgg

SEQ ID NO: 576436 - DNA, 20 bp, Artificial Sequence
  chemically synthesized
acaatcctgtatgatttcta

SEQ ID NO: 576437 - DNA, 20 bp, Artificial Sequence
  chemically synthesized
taaatctacttagaaatcat

SEQ ID NO: 576438 - DNA, 20 bp, Artificial Sequence
  chemically synthesized
agaatttaccacacaatcct

SEQ ID NO: 576439 - DNA, 20 bp, Artificial Sequence
  chemically synthesized
attctgtgtattaacataaa

SEQ ID NO: 576440 - DNA, 20 bp, Artificial Sequence
  chemically synthesized
aaagtcagatttcaaatctt

SEQ ID NO: 576441 - DNA, 20 bp, Artificial Sequence
  chemically synthesized
aaatgttattctacaagcct

SEQ ID NO: 576442 - DNA, 20 bp, Artificial Sequence
  chemically synthesized
taatagttgtaaagaaaaga

SEQ ID NO: 576443 - DNA, 20 bp, Artificial Sequence
  chemically synthesized
gacatatgtaatgatattgt

SEQ ID NO: 576444 - DNA, 20 bp, Artificial Sequence
  chemically synthesized
caaaaggacatatgtaatga

SEQ ID NO: 576445 - DNA, 20 bp, Artificial Sequence
  chemically synthesized
caatatcattacatatgtcc

SEQ ID NO: 576446 - DNA, 20 bp, Artificial Sequence
  chemically synthesized
ggagcagatatttttttcag

SEQ ID NO: 576447 - DNA, 20 bp, Artificial Sequence
  chemically synthesized
acatgtttcttagacacata

SEQ ID NO: 576448 - DNA, 20 bp, Artificial Sequence
  chemically synthesized
aattaacagccagctcttct

SEQ ID NO: 576449 - DNA, 20 bp, Artificial Sequence
  chemically synthesized
gaatatgagagtaagaagaa

SEQ ID NO: 576450 - DNA, 20 bp, Artificial Sequence
  chemically synthesized
tttggctaaattggaatcat

SEQ ID NO: 576451 - DNA, 20 bp, Artificial Sequence
  chemically synthesized
atatcattgtttttaatctt

SEQ ID NO: 576452 - DNA, 20 bp, Artificial Sequence
  chemically synthesized
tttgtggggaacccagatat

SEQ ID NO: 576453 - DNA, 20 bp, Artificial Sequence
  chemically synthesized
ccccacaaaagtctgatatc

SEQ ID NO: 576454 - DNA, 20 bp, Artificial Sequence
  chemically synthesized
ggtacagctggggcattttt

SEQ ID NO: 576455 - DNA, 20 bp, Artificial Sequence
  chemically synthesized
atgatcattagcatcatctt

SEQ ID NO: 576456 - DNA, 20 bp, Artificial Sequence
  chemically synthesized
accagctagtacagatcata

SEQ ID NO: 576457 - DNA, 20 bp, Artificial Sequence
  chemically synthesized
ggttgggagaatcactagta

SEQ ID NO: 576458 - DNA, 20 bp, Artificial Sequence
  chemically synthesized
gaaatacaaaaacccagtac

SEQ ID NO: 576459 - DNA, 20 bp, Artificial Sequence
  chemically synthesized
ggcgttgatcatattttaca

SEQ ID NO: 576460 - DNA, 20 bp, Artificial Sequence
  chemically synthesized
gaacatagggccactgcctg

SEQ ID NO: 576461 - DNA, 20 bp, Artificial Sequence
  chemically synthesized
gtgagtgaatgagtattcaa

SEQ ID NO: 576462 - DNA, 20 bp, Artificial Sequence
  chemically synthesized
ccattcacttacttattcat

SEQ ID NO: 576463 - DNA, 20 bp, Artificial Sequence
  chemically synthesized
aaaagtacaaaaagacctca

SEQ ID NO: 576464 - DNA, 20 bp, Artificial Sequence
  chemically synthesized
tttgtattcctgtttagatc

SEQ ID NO: 576465 - DNA, 20 bp, Artificial Sequence
  chemically synthesized
aattgcccatgaatttgtat

SEQ ID NO: 576466 - DNA, 20 bp, Artificial Sequence
  chemically synthesized
cacattgaaggtgcaggaga

SEQ ID NO: 576467 - DNA, 20 bp, Artificial Sequence
  chemically synthesized
ttttcagacagcacctcata

SEQ ID NO: 576468 - DNA, 20 bp, Artificial Sequence
  chemically synthesized
tttatgaggtgctgtctgaa

SEQ ID NO: 576469 - DNA, 20 bp, Artificial Sequence
  chemically synthesized
atctgtctctcctctatcac

SEQ ID NO: 576470 - DNA, 20 bp, Artificial Sequence
  chemically synthesized
aacaaaggtgatagaggaga

SEQ ID NO: 576471 - DNA, 20 bp, Artificial Sequence
  chemically synthesized
tcaaataaaatatctttgtt

SEQ ID NO: 576472 - DNA, 20 bp, Artificial Sequence
  chemically synthesized
gcaagaaacaaagatatttt

SEQ ID NO: 576473 - DNA, 20 bp, Artificial Sequence
  chemically synthesized
tctacaatcaaataaaatat

SEQ ID NO: 576474 - DNA, 20 bp, Artificial Sequence
  chemically synthesized
tagagttcagtaaagaggga

SEQ ID NO: 576475 - DNA, 20 bp, Artificial Sequence
  chemically synthesized
ggtgtaagtgctctcacaat

SEQ ID NO: 576476 - DNA, 20 bp, Artificial Sequence
  chemically synthesized
tcattcaatgacatcaagtt

SEQ ID NO: 576477 - DNA, 20 bp, Artificial Sequence
  chemically synthesized
ctatgtttagtacacacatg

SEQ ID NO: 576478 - DNA, 20 bp, Artificial Sequence
  chemically synthesized
gtccttctatccctcactat

SEQ ID NO: 576479 - DNA, 20 bp, Artificial Sequence
  chemically synthesized
tggtgcctgattcagtggca

SEQ ID NO: 576480 - DNA, 20 bp, Artificial Sequence
  chemically synthesized
gggagtccaaaatgggtggt

SEQ ID NO: 576481 - DNA, 20 bp, Artificial Sequence
  chemically synthesized
catcagccttcccaattatg

SEQ ID NO: 576482 - DNA, 20 bp, Artificial Sequence
  chemically synthesized
caagtactctaatcttcaca

SEQ ID NO: 576483 - DNA, 20 bp, Artificial Sequence
  chemically synthesized
aatagagtgtaagcagactg

SEQ ID NO: 576484 - DNA, 20 bp, Artificial Sequence
  chemically synthesized
gaaagatatgtgctaagtta

SEQ ID NO: 576485 - DNA, 20 bp, Artificial Sequence
  chemically synthesized
gttaacttagcacatatctt

SEQ ID NO: 576486 - DNA, 20 bp, Artificial Sequence
  chemically synthesized
acttagcacatatctttccc

SEQ ID NO: 576487 - DNA, 20 bp, Artificial Sequence
  chemically synthesized
tctttcccgtttgcttctca

SEQ ID NO: 576488 - DNA, 20 bp, Artificial Sequence
  chemically synthesized
cactgtgattttaataaact

SEQ ID NO: 576489 - DNA, 20 bp, Artificial Sequence
  chemically synthesized
aaattaaaatacttgaatca

SEQ ID NO: 576490 - DNA, 20 bp, Artificial Sequence
  chemically synthesized
ttaatttggtctatgagcct

SEQ ID NO: 576491 - DNA, 20 bp, Artificial Sequence
  chemically synthesized
ggtctatgagcctttctgtt

SEQ ID NO: 576492 - DNA, 20 bp, Artificial Sequence
  chemically synthesized
gtaattccccagatgacaga

SEQ ID NO: 576493 - DNA, 20 bp, Artificial Sequence
  chemically synthesized
tttatcataggtgaaatttt

SEQ ID NO: 576494 - DNA, 20 bp, Artificial Sequence
  chemically synthesized
tttaaaagatttatgatagg

SEQ ID NO: 576495 - DNA, 20 bp, Artificial Sequence
  chemically synthesized
cacctcggcctcccaaagtg

SEQ ID NO: 576496 - DNA, 20 bp, Artificial Sequence
  chemically synthesized
ttgtgcatttttagtagaga

SEQ ID NO: 576497 - DNA, 20 bp, Artificial Sequence
  chemically synthesized
aatggcgtgaacccaggagg

SEQ ID NO: 576498 - DNA, 20 bp, Artificial Sequence
  chemically synthesized
aatgatcttcatcaactccg

SEQ ID NO: 576499 - DNA, 20 bp, Artificial Sequence
  chemically synthesized
tgatgaagatcattcgttga

SEQ ID NO: 576500 - DNA, 20 bp, Artificial Sequence
  chemically synthesized
ttcattctttaaaatgtagc

SEQ ID NO: 576501 - DNA, 20 bp, Artificial Sequence
  chemically synthesized
ttcaagattttttttttttt

SEQ ID NO: 576502 - DNA, 20 bp, Artificial Sequence
  chemically synthesized
aaaaaaaaaaaaaatcttga

SEQ ID NO: 576503 - DNA, 20 bp, Artificial Sequence
  chemically synthesized
atttcagaagtcaatccatt

SEQ ID NO: 576504 - DNA, 20 bp, Artificial Sequence
  chemically synthesized
ttgaaatggattgacttctg

SEQ ID NO: 576505 - DNA, 20 bp, Artificial Sequence
  chemically synthesized
gtgtcatcagaatatgatgc

SEQ ID NO: 576506 - DNA, 20 bp, Artificial Sequence
  chemically synthesized
gagcaagtgtcatcagaata

SEQ ID NO: 576507 - DNA, 20 bp, Artificial Sequence
  chemically synthesized
gtcatcaaatgattcatctc

SEQ ID NO: 576508 - DNA, 20 bp, Artificial Sequence
  chemically synthesized
gcattgttttaaatgtcatc

SEQ ID NO: 576509 - DNA, 20 bp, Artificial Sequence
  chemically synthesized
tagatctaaatttatttttg

SEQ ID NO: 576510 - DNA, 20 bp, Artificial Sequence
  chemically synthesized
aagtgtcattgaaagaccta

SEQ ID NO: 576511 - DNA, 20 bp, Artificial Sequence
  chemically synthesized
taaataatattcagaaacag

SEQ ID NO: 576512 - DNA, 20 bp, Artificial Sequence
  chemically synthesized
aaaggccagagcataatcct

SEQ ID NO: 576513 - DNA, 20 bp, Artificial Sequence
  chemically synthesized
gcaatttggagaaatttaat

SEQ ID NO: 576514 - DNA, 20 bp, Artificial Sequence
  chemically synthesized
agaaatttaatttaagtttg

SEQ ID NO: 576515 - DNA, 20 bp, Artificial Sequence
  chemically synthesized
ttgggatttatttactgccc

SEQ ID NO: 576516 - DNA, 20 bp, Artificial Sequence
  chemically synthesized
tatttgtactaaattgtatt

SEQ ID NO: 576517 - DNA, 20 bp, Artificial Sequence
  chemically synthesized
aagtacaaataaaaagctaa

SEQ ID NO: 576518 - DNA, 20 bp, Artificial Sequence
  chemically synthesized
ttctcctttcttcaaacctc

SEQ ID NO: 576519 - DNA, 20 bp, Artificial Sequence
  chemically synthesized
gttcccgatcctcccagcag

SEQ ID NO: 576520 - DNA, 20 bp, Artificial Sequence
  chemically synthesized
catataatggccttggcctt

SEQ ID NO: 576521 - DNA, 20 bp, Artificial Sequence
  chemically synthesized
agtttggggtctttattcaa

SEQ ID NO: 576522 - DNA, 20 bp, Artificial Sequence
  chemically synthesized
ctagcatagtaattacccat

SEQ ID NO: 576523 - DNA, 20 bp, Artificial Sequence
  chemically synthesized
ggtgagaggatactgagaca

SEQ ID NO: 576524 - DNA, 20 bp, Artificial Sequence
  chemically synthesized
ttggggtgagaggatactga

SEQ ID NO: 576525 - DNA, 20 bp, Artificial Sequence
  chemically synthesized
cctcatgatcagtttaataa

SEQ ID NO: 576526 - DNA, 20 bp, Artificial Sequence
  chemically synthesized
catcattattaaactgatca

SEQ ID NO: 576527 - DNA, 20 bp, Artificial Sequence
  chemically synthesized
ttgccctgggaaacctcatg

SEQ ID NO: 576528 - DNA, 20 bp, Artificial Sequence
  chemically synthesized
tatacccagactggagatga

SEQ ID NO: 576529 - DNA, 20 bp, Artificial Sequence
  chemically synthesized
atacagacttatgcacaact

SEQ ID NO: 576530 - DNA, 20 bp, Artificial Sequence
  chemically synthesized
cactctaggctctagaggcc

SEQ ID NO: 576531 - DNA, 20 bp, Artificial Sequence
  chemically synthesized
tgttaaacaatgtactaatt

SEQ ID NO: 576532 - DNA, 20 bp, Artificial Sequence
  chemically synthesized
cttaaatctagcaattagta

SEQ ID NO: 576533 - DNA, 20 bp, Artificial Sequence
  chemically synthesized
acacttagcaagtgctcaat

SEQ ID NO: 576534 - DNA, 20 bp, Artificial Sequence
  chemically synthesized
attttgatgcactattgttt

SEQ ID NO: 576535 - DNA, 20 bp, Artificial Sequence
  chemically synthesized
gagcaaacattttgatgcac

SEQ ID NO: 576536 - DNA, 20 bp, Artificial Sequence
  chemically synthesized
tatcaaacaatagtgcatca

SEQ ID NO: 576537 - DNA, 20 bp, Artificial Sequence
  chemically synthesized
gcatcaaaatgtttgctcca

SEQ ID NO: 576538 - DNA, 20 bp, Artificial Sequence
  chemically synthesized
aagacactgagttattaata

SEQ ID NO: 576539 - DNA, 20 bp, Artificial Sequence
  chemically synthesized
gtgtagtagaagagggggaa

SEQ ID NO: 576540 - DNA, 20 bp, Artificial Sequence
  chemically synthesized
agattctaactagcacaatg

SEQ ID NO: 576541 - DNA, 20 bp, Artificial Sequence
  chemically synthesized
gtatgtgagtatcacgtcta

SEQ ID NO: 576542 - DNA, 20 bp, Artificial Sequence
  chemically synthesized
acgtgatactcacatacaaa

SEQ ID NO: 576543 - DNA, 20 bp, Artificial Sequence
  chemically synthesized
ctccactcctcgtagcccag

SEQ ID NO: 576544 - DNA, 20 bp, Artificial Sequence
  chemically synthesized
gaattggaatgagagaggca

SEQ ID NO: 576545 - DNA, 20 bp, Artificial Sequence
  chemically synthesized
tggaatgagagaggcatact

SEQ ID NO: 576546 - DNA, 20 bp, Artificial Sequence
  chemically synthesized
cttagataaagcctgaataa

SEQ ID NO: 576547 - DNA, 20 bp, Artificial Sequence
  chemically synthesized
attgttataagcgaaattat

SEQ ID NO: 576548 - DNA, 20 bp, Artificial Sequence
  chemically synthesized
catgtattcaccaaaaaaga

SEQ ID NO: 576549 - DNA, 20 bp, Artificial Sequence
  chemically synthesized
ccttttcttttttggtgaat

SEQ ID NO: 576550 - DNA, 20 bp, Artificial Sequence
  chemically synthesized
aattttacgttgctggaagg

SEQ ID NO: 576551 - DNA, 20 bp, Artificial Sequence
  chemically synthesized
catggaactagtctccacct

SEQ ID NO: 576552 - DNA, 20 bp, Artificial Sequence
  chemically synthesized
tgtgtatatgtgtgatactg

SEQ ID NO: 576553 - DNA, 20 bp, Artificial Sequence
  chemically synthesized
caagggatctgcacgcacgt

SEQ ID NO: 576554 - DNA, 20 bp, Artificial Sequence
  chemically synthesized
caacgtgcgtgcagatccct

SEQ ID NO: 576555 - DNA, 20 bp, Artificial Sequence
  chemically synthesized
cttggggattgtcttacaat

SEQ ID NO: 576556 - DNA, 20 bp, Artificial Sequence
  chemically synthesized
gattgtcttacaatggcgga

SEQ ID NO: 576557 - DNA, 20 bp, Artificial Sequence
  chemically synthesized
caacagttctgaagtggggc

SEQ ID NO: 576558 - DNA, 20 bp, Artificial Sequence
  chemically synthesized
ttgaagcctcaacatctctt

SEQ ID NO: 576559 - DNA, 20 bp, Artificial Sequence
  chemically synthesized
aaaaaactcccaagagatgt

SEQ ID NO: 576560 - DNA, 20 bp, Artificial Sequence
  chemically synthesized
gcatcaccttgctgtgcaaa

SEQ ID NO: 576561 - DNA, 20 bp, Artificial Sequence
  chemically synthesized
acctatttgttagtaattgc

SEQ ID NO: 576562 - DNA, 20 bp, Artificial Sequence
  chemically synthesized
tatgtgacctatttgttagt

SEQ ID NO: 576563 - DNA, 20 bp, Artificial Sequence
  chemically synthesized
tcatagttctttcttttgtg

SEQ ID NO: 576564 - DNA, 20 bp, Artificial Sequence
  chemically synthesized
agcaacaaagtgaaagataa

SEQ ID NO: 576565 - DNA, 20 bp, Artificial Sequence
  chemically synthesized
agccaaattatctttcactt

SEQ ID NO: 576566 - DNA, 20 bp, Artificial Sequence
  chemically synthesized
gctatctaactatgttggta

SEQ ID NO: 576567 - DNA, 20 bp, Artificial Sequence
  chemically synthesized
gcttgagtgtgttgtgacag

SEQ ID NO: 576568 - DNA, 20 bp, Artificial Sequence
  chemically synthesized
ggcaggcttgagtgtgttgt

SEQ ID NO: 576569 - DNA, 20 bp, Artificial Sequence
  chemically synthesized
gatttgtacgaactcctttg

SEQ ID NO: 576570 - DNA, 20 bp, Artificial Sequence
  chemically synthesized
gtctctcctgtaaattattt

SEQ ID NO: 576571 - DNA, 20 bp, Artificial Sequence
  chemically synthesized
gaataatagctgaaaagtat

SEQ ID NO: 576572 - DNA, 20 bp, Artificial Sequence
  chemically synthesized
attattcagtaagtgagtcc

SEQ ID NO: 576573 - DNA, 20 bp, Artificial Sequence
  chemically synthesized
ccagcaagggaagggctaga

SEQ ID NO: 576574 - DNA, 20 bp, Artificial Sequence
  chemically synthesized
agcaacccagcaagggaagg

SEQ ID NO: 576575 - DNA, 20 bp, Artificial Sequence
  chemically synthesized
cgtctcggcctcccaaagtg

SEQ ID NO: 576576 - DNA, 20 bp, Artificial Sequence
  chemically synthesized
ttttgtatttttagtagaga

SEQ ID NO: 576577 - DNA, 20 bp, Artificial Sequence
  chemically synthesized
aatggcgtgaacccgggagg

SEQ ID NO: 576578 - DNA, 20 bp, Artificial Sequence
  chemically synthesized
ttttttttttttttttgaga

SEQ ID NO: 576579 - DNA, 20 bp, Artificial Sequence
  chemically synthesized
ctctggttccagtgtaaatt

SEQ ID NO: 576580 - DNA, 20 bp, Artificial Sequence
  chemically synthesized
ctcagcgccccgaaccctca

SEQ ID NO: 576581 - DNA, 20 bp, Artificial Sequence
  chemically synthesized
taggtgtgaacactatttct

SEQ ID NO: 576582 - DNA, 20 bp, Artificial Sequence
  chemically synthesized
tccaagaaatagtgttcaca

SEQ ID NO: 576583 - DNA, 20 bp, Artificial Sequence
  chemically synthesized
tagcctgccattttctggcc

SEQ ID NO: 576584 - DNA, 20 bp, Artificial Sequence
  chemically synthesized
tacaggaaacacttcataag

SEQ ID NO: 576585 - DNA, 20 bp, Artificial Sequence
  chemically synthesized
aacagaaaacaacacttatg

SEQ ID NO: 576586 - DNA, 20 bp, Artificial Sequence
  chemically synthesized
ccacttatgcaagagtaggg

SEQ ID NO: 576587 - DNA, 20 bp, Artificial Sequence
  chemically synthesized
agccatctaacattcctcac

SEQ ID NO: 576588 - DNA, 20 bp, Artificial Sequence
  chemically synthesized
atcttaggtgaggaatgtta

SEQ ID NO: 576589 - DNA, 20 bp, Artificial Sequence
  chemically synthesized
agatggcttctcttctcttt

SEQ ID NO: 576590 - DNA, 20 bp, Artificial Sequence
  chemically synthesized
ttttggggatcttcttacaa

SEQ ID NO: 576591 - DNA, 20 bp, Artificial Sequence
  chemically synthesized
ggatcttcttacaatgcaga

SEQ ID NO: 576592 - DNA, 20 bp, Artificial Sequence
  chemically synthesized
tacaatgcagattctgattc

SEQ ID NO: 576593 - DNA, 20 bp, Artificial Sequence
  chemically synthesized
caacagttttgaagtggggc

SEQ ID NO: 576594 - DNA, 20 bp, Artificial Sequence
  chemically synthesized
ttgaagccttgacataactt

SEQ ID NO: 576595 - DNA, 20 bp, Artificial Sequence
  chemically synthesized
aacaaacccccaagttatgt

SEQ ID NO: 576596 - DNA, 20 bp, Artificial Sequence
  chemically synthesized
agtgtcaaccttgctataca

SEQ ID NO: 576597 - DNA, 20 bp, Artificial Sequence
  chemically synthesized
agattcagttctgtaataat

SEQ ID NO: 576598 - DNA, 20 bp, Artificial Sequence
  chemically synthesized
atggttccttttttagtgat

SEQ ID NO: 576599 - DNA, 20 bp, Artificial Sequence
  chemically synthesized
gaagcccattcagctttgtg

SEQ ID NO: 576600 - DNA, 20 bp, Artificial Sequence
  chemically synthesized
taagctcttcacaaagctga

SEQ ID NO: 576601 - DNA, 20 bp, Artificial Sequence
  chemically synthesized
cctgatcattgtgaagccca

SEQ ID NO: 576602 - DNA, 20 bp, Artificial Sequence
  chemically synthesized
atccgtaatataagttgcaa

SEQ ID NO: 576603 - DNA, 20 bp, Artificial Sequence
  chemically synthesized
gctgggcccagccaatgggt

SEQ ID NO: 576604 - DNA, 20 bp, Artificial Sequence
  chemically synthesized
cccattggctgggcccagca

SEQ ID NO: 576605 - DNA, 20 bp, Artificial Sequence
  chemically synthesized
taaatatatttttctcttcc

SEQ ID NO: 576606 - DNA, 20 bp, Artificial Sequence
  chemically synthesized
agccatactgataacataaa

SEQ ID NO: 576607 - DNA, 20 bp, Artificial Sequence
  chemically synthesized
atcactctttatgttatcag

SEQ ID NO: 576608 - DNA, 20 bp, Artificial Sequence
  chemically synthesized
caacagtagcctattagtag

SEQ ID NO: 576609 - DNA, 20 bp, Artificial Sequence
  chemically synthesized
tgggggagtgaaaagttcta

SEQ ID NO: 576610 - DNA, 20 bp, Artificial Sequence
  chemically synthesized
ctcagcgcccctaaccctca

SEQ ID NO: 576611 - DNA, 20 bp, Artificial Sequence
  chemically synthesized
tagacagtatgtggctcatt

SEQ ID NO: 576612 - DNA, 20 bp, Artificial Sequence
  chemically synthesized
gaactttgatcccttttttc

SEQ ID NO: 576613 - DNA, 20 bp, Artificial Sequence
  chemically synthesized
gggatcaaagttcctacttc

SEQ ID NO: 576614 - DNA, 20 bp, Artificial Sequence
  chemically synthesized
gttcctgaggctacagctgt

SEQ ID NO: 576615 - DNA, 20 bp, Artificial Sequence
  chemically synthesized
ctgtagcctcaggaactttc

SEQ ID NO: 576616 - DNA, 20 bp, Artificial Sequence
  chemically synthesized
gcaaatttggcttcctggag

SEQ ID NO: 576617 - DNA, 20 bp, Artificial Sequence
  chemically synthesized
gagagtgtggcagctgcaaa

SEQ ID NO: 576618 - DNA, 20 bp, Artificial Sequence
  chemically synthesized
ccatcagtccctgaggtgaa

SEQ ID NO: 576619 - DNA, 20 bp, Artificial Sequence
  chemically synthesized
cccaccccgttttttgcttt

SEQ ID NO: 576620 - DNA, 20 bp, Artificial Sequence
  chemically synthesized
ttctaccctcccaccccgtt

SEQ ID NO: 576621 - DNA, 20 bp, Artificial Sequence
  chemically synthesized
ctgttctttctaccctccca

SEQ ID NO: 576622 - DNA, 20 bp, Artificial Sequence
  chemically synthesized
acagcagattttcactccag

SEQ ID NO: 576623 - DNA, 20 bp, Artificial Sequence
  chemically synthesized
aagggtggtgcttaaggcac

SEQ ID NO: 576624 - DNA, 20 bp, Artificial Sequence
  chemically synthesized
ttggcctggggatggaaggg

SEQ ID NO: 576625 - DNA, 20 bp, Artificial Sequence
  chemically synthesized
caacagtgctagttacagac

SEQ ID NO: 576626 - DNA, 20 bp, Artificial Sequence
  chemically synthesized
gtagtgcctaccttaatata

SEQ ID NO: 576627 - DNA, 20 bp, Artificial Sequence
  chemically synthesized
gccattcaataaatgatagt

SEQ ID NO: 576628 - DNA, 20 bp, Artificial Sequence
  chemically synthesized
gaatggccacatggcaggta

SEQ ID NO: 576629 - DNA, 20 bp, Artificial Sequence
  chemically synthesized
atggcaggtactatgcttat

SEQ ID NO: 576630 - DNA, 20 bp, Artificial Sequence
  chemically synthesized
ggcttccctgtctgctcagc

SEQ ID NO: 576631 - DNA, 20 bp, Artificial Sequence
  chemically synthesized
aatactgttgttttaatatg

SEQ ID NO: 576632 - DNA, 20 bp, Artificial Sequence
  chemically synthesized
atatttttgtctccaaatac

SEQ ID NO: 576633 - DNA, 20 bp, Artificial Sequence
  chemically synthesized
gttggttttattatgaggtg

SEQ ID NO: 576634 - DNA, 20 bp, Artificial Sequence
  chemically synthesized
ctcataataaaaccaacata

SEQ ID NO: 576635 - DNA, 20 bp, Artificial Sequence
  chemically synthesized
taatatagaaaactgaatat

SEQ ID NO: 576636 - DNA, 20 bp, Artificial Sequence
  chemically synthesized
aaagaggaacaaataatgta

SEQ ID NO: 576637 - DNA, 20 bp, Artificial Sequence
  chemically synthesized
aggttatcagtatttgttac

SEQ ID NO: 576638 - DNA, 20 bp, Artificial Sequence
  chemically synthesized
cttcatggttatgtaatccc

SEQ ID NO: 576639 - DNA, 20 bp, Artificial Sequence
  chemically synthesized
aaaaagataaaattaatctt

SEQ ID NO: 576640 - DNA, 20 bp, Artificial Sequence
  chemically synthesized
aatggaatatgttaattgaa

SEQ ID NO: 576641 - DNA, 20 bp, Artificial Sequence
  chemically synthesized
aatatgttaattgaaacttg

SEQ ID NO: 576642 - DNA, 20 bp, Artificial Sequence
  chemically synthesized
gatatctttcaaaaatcaaa

SEQ ID NO: 576643 - DNA, 20 bp, Artificial Sequence
  chemically synthesized
taatttccacactgaagggt

SEQ ID NO: 576644 - DNA, 20 bp, Artificial Sequence
  chemically synthesized
ttccacactgaagggtattt

SEQ ID NO: 576645 - DNA, 20 bp, Artificial Sequence
  chemically synthesized
tggtacttttatttctgtag

SEQ ID NO: 576646 - DNA, 20 bp, Artificial Sequence
  chemically synthesized
tcctcaaagaccacagcaat

SEQ ID NO: 576647 - DNA, 20 bp, Artificial Sequence
  chemically synthesized
actatgaggaagcatattat

SEQ ID NO: 576648 - DNA, 20 bp, Artificial Sequence
  chemically synthesized
ggaaaaataaaactatgata

SEQ ID NO: 576649 - DNA, 20 bp, Artificial Sequence
  chemically synthesized
ttgcatattcctatacttcg

SEQ ID NO: 576650 - DNA, 20 bp, Artificial Sequence
  chemically synthesized
cttcggccagttttgtactg

SEQ ID NO: 576651 - DNA, 20 bp, Artificial Sequence
  chemically synthesized
gcgaatacatctactctatt

SEQ ID NO: 576652 - DNA, 20 bp, Artificial Sequence
  chemically synthesized
aaggaaaaaatataccttgt

SEQ ID NO: 576653 - DNA, 20 bp, Artificial Sequence
  chemically synthesized
aacaaggtatattttttcct

SEQ ID NO: 576654 - DNA, 20 bp, Artificial Sequence
  chemically synthesized
atattttttccttatagctt

SEQ ID NO: 576655 - DNA, 20 bp, Artificial Sequence
  chemically synthesized
tatagcttttgagttttgtg

SEQ ID NO: 576656 - DNA, 20 bp, Artificial Sequence
  chemically synthesized
aaaaattcttggaatgagga

SEQ ID NO: 576657 - DNA, 20 bp, Artificial Sequence
  chemically synthesized
gtcttcctcattccaagaat

SEQ ID NO: 576658 - DNA, 20 bp, Artificial Sequence
  chemically synthesized
agaatacatttcaaatgcat

SEQ ID NO: 576659 - DNA, 20 bp, Artificial Sequence
  chemically synthesized
tgcataagctaggaggcaat

SEQ ID NO: 576660 - DNA, 20 bp, Artificial Sequence
  chemically synthesized
ttagaaaacacagattgcct

SEQ ID NO: 576661 - DNA, 20 bp, Artificial Sequence
  chemically synthesized
ttgcaattcctcttagaaaa

SEQ ID NO: 576662 - DNA, 20 bp, Artificial Sequence
  chemically synthesized
tattttaattcaaggaataa

SEQ ID NO: 576663 - DNA, 20 bp, Artificial Sequence
  chemically synthesized
aaaataacacatttgccata

SEQ ID NO: 576664 - DNA, 20 bp, Artificial Sequence
  chemically synthesized
taaataaataaatagataca

SEQ ID NO: 576665 - DNA, 20 bp, Artificial Sequence
  chemically synthesized
tatttatttattttttgaga

SEQ ID NO: 576666 - DNA, 20 bp, Artificial Sequence
  chemically synthesized
aacctccgcctcctgggttc

SEQ ID NO: 576667 - DNA, 20 bp, Artificial Sequence
  chemically synthesized
ttgggaggctgaggcaggag

SEQ ID NO: 576668 - DNA, 20 bp, Artificial Sequence
  chemically synthesized
ttttgtatttttagtagaga

SEQ ID NO: 576669 - DNA, 20 bp, Artificial Sequence
  chemically synthesized
cactttgggagtctgaggtg

SEQ ID NO: 576670 - DNA, 20 bp, Artificial Sequence
  chemically synthesized
cacctcagactcccaaagtg

SEQ ID NO: 576671 - DNA, 20 bp, Artificial Sequence
  chemically synthesized
tgtttttggaggccgggcat

SEQ ID NO: 576672 - DNA, 20 bp, Artificial Sequence
  chemically synthesized
cggcctccaaaaacaatctg

SEQ ID NO: 576673 - DNA, 20 bp, Artificial Sequence
  chemically synthesized
gagagtccagaagcagatca

SEQ ID NO: 576674 - DNA, 20 bp, Artificial Sequence
  chemically synthesized
aattgagagtccagaagcag

SEQ ID NO: 576675 - DNA, 20 bp, Artificial Sequence
  chemically synthesized
atctgcttctggactctcaa

SEQ ID NO: 576676 - DNA, 20 bp, Artificial Sequence
  chemically synthesized
ttgcttcagtgatctacttg

SEQ ID NO: 576677 - DNA, 20 bp, Artificial Sequence
  chemically synthesized
tttgtgctaatactatacta

SEQ ID NO: 576678 - DNA, 20 bp, Artificial Sequence
  chemically synthesized
tactatactatttggattac

SEQ ID NO: 576679 - DNA, 20 bp, Artificial Sequence
  chemically synthesized
tggattacagtagctttaca

SEQ ID NO: 576680 - DNA, 20 bp, Artificial Sequence
  chemically synthesized
tctgcatcaataataaggga

SEQ ID NO: 576681 - DNA, 20 bp, Artificial Sequence
  chemically synthesized
ttcatgcattcctgagatac

SEQ ID NO: 576682 - DNA, 20 bp, Artificial Sequence
  chemically synthesized
atttacagggaatttaaatt

SEQ ID NO: 576683 - DNA, 20 bp, Artificial Sequence
  chemically synthesized
tttatagtattttaggctta

SEQ ID NO: 576684 - DNA, 20 bp, Artificial Sequence
  chemically synthesized
tagaatagatttatagtatt

SEQ ID NO: 576685 - DNA, 20 bp, Artificial Sequence
  chemically synthesized
tattggtgtctgtttcatag

SEQ ID NO: 576686 - DNA, 20 bp, Artificial Sequence
  chemically synthesized
tgttttgccttaatattggt

SEQ ID NO: 576687 - DNA, 20 bp, Artificial Sequence
  chemically synthesized
attttattggttttcacttt

SEQ ID NO: 576688 - DNA, 20 bp, Artificial Sequence
  chemically synthesized
agcagtgctctgaacatttt

SEQ ID NO: 576689 - DNA, 20 bp, Artificial Sequence
  chemically synthesized
aaccaataaaatgttcagag

SEQ ID NO: 576690 - DNA, 20 bp, Artificial Sequence
  chemically synthesized
aatgttcagagcactgctta

SEQ ID NO: 576691 - DNA, 20 bp, Artificial Sequence
  chemically synthesized
ccatagcaaagaacttaacc

SEQ ID NO: 576692 - DNA, 20 bp, Artificial Sequence
  chemically synthesized
aaccaaatgacctcatttta

SEQ ID NO: 576693 - DNA, 20 bp, Artificial Sequence
  chemically synthesized
atctacaggacaaggagcac

SEQ ID NO: 576694 - DNA, 20 bp, Artificial Sequence
  chemically synthesized
attccattcccctagtttct

SEQ ID NO: 576695 - DNA, 20 bp, Artificial Sequence
  chemically synthesized
aatctgttccattccattcc

SEQ ID NO: 576696 - DNA, 20 bp, Artificial Sequence
  chemically synthesized
aaactaggggaatggaatgg

SEQ ID NO: 576697 - DNA, 20 bp, Artificial Sequence
  chemically synthesized
gacttcttttggttaagtca

SEQ ID NO: 576698 - DNA, 20 bp, Artificial Sequence
  chemically synthesized
tatcagtacataaagaatgt

SEQ ID NO: 576699 - DNA, 20 bp, Artificial Sequence
  chemically synthesized
gaattatgcttctctctcaa

SEQ ID NO: 576700 - DNA, 20 bp, Artificial Sequence
  chemically synthesized
gatacacattttcttctgaa

SEQ ID NO: 576701 - DNA, 20 bp, Artificial Sequence
  chemically synthesized
tatgttatgtatatgtgtgt

SEQ ID NO: 576702 - DNA, 20 bp, Artificial Sequence
  chemically synthesized
cataacataaacttatgcat

SEQ ID NO: 576703 - DNA, 20 bp, Artificial Sequence
  chemically synthesized
cgaatttcaagcgaatatgc

SEQ ID NO: 576704 - DNA, 20 bp, Artificial Sequence
  chemically synthesized
gatatacaaacagctgacaa

SEQ ID NO: 576705 - DNA, 20 bp, Artificial Sequence
  chemically synthesized
caccaccaatcagtattgtc

SEQ ID NO: 576706 - DNA, 20 bp, Artificial Sequence
  chemically synthesized
tgattggtggtgggtagggg

SEQ ID NO: 576707 - DNA, 20 bp, Artificial Sequence
  chemically synthesized
tttccactaggtgatcattt

SEQ ID NO: 576708 - DNA, 20 bp, Artificial Sequence
  chemically synthesized
taatttagggggtcttattt

SEQ ID NO: 576709 - DNA, 20 bp, Artificial Sequence
  chemically synthesized
ctgataatttagggggtctt

SEQ ID NO: 576710 - DNA, 20 bp, Artificial Sequence
  chemically synthesized
caaataagaccccctaaatt

SEQ ID NO: 576711 - DNA, 20 bp, Artificial Sequence
  chemically synthesized
aaagaagatctgttcaagtt

SEQ ID NO: 576712 - DNA, 20 bp, Artificial Sequence
  chemically synthesized
tatgcaaatactttgtatta

SEQ ID NO: 576713 - DNA, 20 bp, Artificial Sequence
  chemically synthesized
caatgttaacatgtgttcaa

SEQ ID NO: 576714 - DNA, 20 bp, Artificial Sequence
  chemically synthesized
cttttctccatcactcagtt

SEQ ID NO: 576715 - DNA, 20 bp, Artificial Sequence
  chemically synthesized
gaaactgaagtgacttactt

SEQ ID NO: 576716 - DNA, 20 bp, Artificial Sequence
  chemically synthesized
gaagcatgaaagtaagtcac

SEQ ID NO: 576717 - DNA, 20 bp, Artificial Sequence
  chemically synthesized
agtcacttcagtttctttgt

SEQ ID NO: 576718 - DNA, 20 bp, Artificial Sequence
  chemically synthesized
ttgaagtcttaaaatttctg

SEQ ID NO: 576719 - DNA, 20 bp, Artificial Sequence
  chemically synthesized
taaaatttctgaattgtttt

SEQ ID NO: 576720 - DNA, 20 bp, Artificial Sequence
  chemically synthesized
ttgttttttgaaattacact

SEQ ID NO: 576721 - DNA, 20 bp, Artificial Sequence
  chemically synthesized
ggagacggggtcaggggtat

SEQ ID NO: 576722 - DNA, 20 bp, Artificial Sequence
  chemically synthesized
gatattgtactatatttttg

SEQ ID NO: 576723 - DNA, 20 bp, Artificial Sequence
  chemically synthesized
agtgttggaactgttcttta

SEQ ID NO: 576724 - DNA, 20 bp, Artificial Sequence
  chemically synthesized
ttaaagaatgaagaacagat

SEQ ID NO: 576725 - DNA, 20 bp, Artificial Sequence
  chemically synthesized
gacagaattaaagaatgaag

SEQ ID NO: 576726 - DNA, 20 bp, Artificial Sequence
  chemically synthesized
aaaggttacataatgaatga

SEQ ID NO: 576727 - DNA, 20 bp, Artificial Sequence
  chemically synthesized
atctgaaaaggttacataat

SEQ ID NO: 576728 - DNA, 20 bp, Artificial Sequence
  chemically synthesized
ttatgtaaccttttcagatg

SEQ ID NO: 576729 - DNA, 20 bp, Artificial Sequence
  chemically synthesized
ttttactcagcataattctg

SEQ ID NO: 576730 - DNA, 20 bp, Artificial Sequence
  chemically synthesized
cctggtatgtatggatgtac

SEQ ID NO: 576731 - DNA, 20 bp, Artificial Sequence
  chemically synthesized
tgttgaccgtctgggttctt

SEQ ID NO: 576732 - DNA, 20 bp, Artificial Sequence
  chemically synthesized
tgctgggttgtatggtagct

SEQ ID NO: 576733 - DNA, 20 bp, Artificial Sequence
  chemically synthesized
ggttgtatggtagctgcatg

SEQ ID NO: 576734 - DNA, 20 bp, Artificial Sequence
  chemically synthesized
agttttacagaaaattgata

SEQ ID NO: 576735 - DNA, 20 bp, Artificial Sequence
  chemically synthesized
atggtacagccactgtagca

SEQ ID NO: 576736 - DNA, 20 bp, Artificial Sequence
  chemically synthesized
agcatctggtgttgtaacta

SEQ ID NO: 576737 - DNA, 20 bp, Artificial Sequence
  chemically synthesized
atttgcatttctctaatggc

SEQ ID NO: 576738 - DNA, 20 bp, Artificial Sequence
  chemically synthesized
agatagcaaataggtgcatg

SEQ ID NO: 576739 - DNA, 20 bp, Artificial Sequence
  chemically synthesized
tctgtatatcctttttggtg

SEQ ID NO: 576740 - DNA, 20 bp, Artificial Sequence
  chemically synthesized
aatgggcaagacacatcaag

SEQ ID NO: 576741 - DNA, 20 bp, Artificial Sequence
  chemically synthesized
tcttgcccatttcctaattg

SEQ ID NO: 576742 - DNA, 20 bp, Artificial Sequence
  chemically synthesized
gcccatttcctaattgcatt

SEQ ID NO: 576743 - DNA, 20 bp, Artificial Sequence
  chemically synthesized
tcctaattgcattgtttgtt

SEQ ID NO: 576744 - DNA, 20 bp, Artificial Sequence
  chemically synthesized
gtttgtttcttgttttacct

SEQ ID NO: 576745 - DNA, 20 bp, Artificial Sequence
  chemically synthesized
agacatccatcttttggcta

SEQ ID NO: 576746 - DNA, 20 bp, Artificial Sequence
  chemically synthesized
gaaaatattttctatcagtc

SEQ ID NO: 576747 - DNA, 20 bp, Artificial Sequence
  chemically synthesized
tcacaggtcttttgcagtgc

SEQ ID NO: 576748 - DNA, 20 bp, Artificial Sequence
  chemically synthesized
aaaaaatcagttggactgca

SEQ ID NO: 576749 - DNA, 20 bp, Artificial Sequence
  chemically synthesized
tttaaatcttgatgcagtcc

SEQ ID NO: 576750 - DNA, 20 bp, Artificial Sequence
  chemically synthesized
gatttttttctgtgtgtgga

SEQ ID NO: 576751 - DNA, 20 bp, Artificial Sequence
  chemically synthesized
ccaattctagccctagagcc

SEQ ID NO: 576752 - DNA, 20 bp, Artificial Sequence
  chemically synthesized
ctcatttttccctaaatttt

SEQ ID NO: 576753 - DNA, 20 bp, Artificial Sequence
  chemically synthesized
ttccctaaattttgatagtt

SEQ ID NO: 576754 - DNA, 20 bp, Artificial Sequence
  chemically synthesized
agtccatgatctattttgaa

SEQ ID NO: 576755 - DNA, 20 bp, Artificial Sequence
  chemically synthesized
gaattaagtttttacaaggt

SEQ ID NO: 576756 - DNA, 20 bp, Artificial Sequence
  chemically synthesized
caggaccatttgttgaaaag

SEQ ID NO: 576757 - DNA, 20 bp, Artificial Sequence
  chemically synthesized
aaggtgagctttctctattg

SEQ ID NO: 576758 - DNA, 20 bp, Artificial Sequence
  chemically synthesized
agacccatgcaaatgtgccc

SEQ ID NO: 576759 - DNA, 20 bp, Artificial Sequence
  chemically synthesized
tgttgggcacatttgcatgg

SEQ ID NO: 576760 - DNA, 20 bp, Artificial Sequence
  chemically synthesized
gtctgtttttgggttctcta

SEQ ID NO: 576761 - DNA, 20 bp, Artificial Sequence
  chemically synthesized
ctttatttacctttttaaaa

SEQ ID NO: 576762 - DNA, 20 bp, Artificial Sequence
  chemically synthesized
ctgtggcctgtgacttttct

SEQ ID NO: 576763 - DNA, 20 bp, Artificial Sequence
  chemically synthesized
cttttcttatagattttaga

SEQ ID NO: 576764 - DNA, 20 bp, Artificial Sequence
  chemically synthesized
tatgtgtacagaaatccttg

SEQ ID NO: 576765 - DNA, 20 bp, Artificial Sequence
  chemically synthesized
agtttctatcaaaatcttat

SEQ ID NO: 576766 - DNA, 20 bp, Artificial Sequence
  chemically synthesized
gatagaaactaaattaaacc

SEQ ID NO: 576767 - DNA, 20 bp, Artificial Sequence
  chemically synthesized
aaatcaatctaaaggtttaa

SEQ ID NO: 576768 - DNA, 20 bp, Artificial Sequence
  chemically synthesized
gaaactaaattaaaccttta

SEQ ID NO: 576769 - DNA, 20 bp, Artificial Sequence
  chemically synthesized
agttcttctcaaatcaatct

SEQ ID NO: 576770 - DNA, 20 bp, Artificial Sequence
  chemically synthesized
ctaaataagtggattatatg

SEQ ID NO: 576771 - DNA, 20 bp, Artificial Sequence
  chemically synthesized
ccatataatccacttattta

SEQ ID NO: 576772 - DNA, 20 bp, Artificial Sequence
  chemically synthesized
cattaaaaacaacctaaata

SEQ ID NO: 576773 - DNA, 20 bp, Artificial Sequence
  chemically synthesized
taccgatcctgtacatgtat

SEQ ID NO: 576774 - DNA, 20 bp, Artificial Sequence
  chemically synthesized
aaaaacacaacaccatttat

SEQ ID NO: 576775 - DNA, 20 bp, Artificial Sequence
  chemically synthesized
ataagcaattataaatggtg

SEQ ID NO: 576776 - DNA, 20 bp, Artificial Sequence
  chemically synthesized
atagataatccgtaagttgt

SEQ ID NO: 576777 - DNA, 20 bp, Artificial Sequence
  chemically synthesized
taaggcaagccatcacaact

SEQ ID NO: 576778 - DNA, 20 bp, Artificial Sequence
  chemically synthesized
gtaagttgtgatggcttgcc

SEQ ID NO: 576779 - DNA, 20 bp, Artificial Sequence
  chemically synthesized
tatgattttttgactttatg

SEQ ID NO: 576780 - DNA, 20 bp, Artificial Sequence
  chemically synthesized
cagatgctcctcatcttatg

SEQ ID NO: 576781 - DNA, 20 bp, Artificial Sequence
  chemically synthesized
catctgtatataaaaatgtg

SEQ ID NO: 576782 - DNA, 20 bp, Artificial Sequence
  chemically synthesized
ccatgagcatttttggttat

SEQ ID NO: 576783 - DNA, 20 bp, Artificial Sequence
  chemically synthesized
gcatttttggttatttttgc

SEQ ID NO: 576784 - DNA, 20 bp, Artificial Sequence
  chemically synthesized
tattttatacttttcaatat

SEQ ID NO: 576785 - DNA, 20 bp, Artificial Sequence
  chemically synthesized
acttttcaatatgcatgctt

SEQ ID NO: 576786 - DNA, 20 bp, Artificial Sequence
  chemically synthesized
atgcatgctttattgttttt

SEQ ID NO: 576787 - DNA, 20 bp, Artificial Sequence
  chemically synthesized
ggaaggcttaatgtttccac

SEQ ID NO: 576788 - DNA, 20 bp, Artificial Sequence
  chemically synthesized
aattttaataatggaaggct

SEQ ID NO: 576789 - DNA, 20 bp, Artificial Sequence
  chemically synthesized
atagcataattttaataatg

SEQ ID NO: 576790 - DNA, 20 bp, Artificial Sequence
  chemically synthesized
attaaaattatgctattaac

SEQ ID NO: 576791 - DNA, 20 bp, Artificial Sequence
  chemically synthesized
tgtggaagttatcctctatt

SEQ ID NO: 576792 - DNA, 20 bp, Artificial Sequence
  chemically synthesized
tcctctattcccagttttct

SEQ ID NO: 576793 - DNA, 20 bp, Artificial Sequence
  chemically synthesized
aatggatgctgggtgttgtc

SEQ ID NO: 576794 - DNA, 20 bp, Artificial Sequence
  chemically synthesized
ctgcatcaatcaatataatc

SEQ ID NO: 576795 - DNA, 20 bp, Artificial Sequence
  chemically synthesized
aagaaaaaatcatatgatta

SEQ ID NO: 576796 - DNA, 20 bp, Artificial Sequence
  chemically synthesized
aaactaaagaagaaaaaatc

SEQ ID NO: 576797 - DNA, 20 bp, Artificial Sequence
  chemically synthesized
aatcatatgattttttcttc

SEQ ID NO: 576798 - DNA, 20 bp, Artificial Sequence
  chemically synthesized
cttctttagtttgttgatat

SEQ ID NO: 576799 - DNA, 20 bp, Artificial Sequence
  chemically synthesized
gagtgtcataccataactaa

SEQ ID NO: 576800 - DNA, 20 bp, Artificial Sequence
  chemically synthesized
aaatattaaataacatgcgt

SEQ ID NO: 576801 - DNA, 20 bp, Artificial Sequence
  chemically synthesized
atgttatttaatattttgtt

SEQ ID NO: 576802 - DNA, 20 bp, Artificial Sequence
  chemically synthesized
ttgagaataaaatgtatagc

SEQ ID NO: 576803 - DNA, 20 bp, Artificial Sequence
  chemically synthesized
gctatacattttattctcaa

SEQ ID NO: 576804 - DNA, 20 bp, Artificial Sequence
  chemically synthesized
tttttttgccagagaaaaag

SEQ ID NO: 576805 - DNA, 20 bp, Artificial Sequence
  chemically synthesized
taaaatgttggttctttgac

SEQ ID NO: 576806 - DNA, 20 bp, Artificial Sequence
  chemically synthesized
caggtgtctcctgaacttct

SEQ ID NO: 576807 - DNA, 20 bp, Artificial Sequence
  chemically synthesized
caggagacacctgtacacac

SEQ ID NO: 576808 - DNA, 20 bp, Artificial Sequence
  chemically synthesized
tgcatcacaggagagaaacc

SEQ ID NO: 576809 - DNA, 20 bp, Artificial Sequence
  chemically synthesized
gagagaaaccctgagcttaa

SEQ ID NO: 576810 - DNA, 20 bp, Artificial Sequence
  chemically synthesized
agattaagcttccttaagct

SEQ ID NO: 576811 - DNA, 20 bp, Artificial Sequence
  chemically synthesized
ctactgtctatttttaaaga

SEQ ID NO: 576812 - DNA, 20 bp, Artificial Sequence
  chemically synthesized
gcatatctactgtctatttt

SEQ ID NO: 576813 - DNA, 20 bp, Artificial Sequence
  chemically synthesized
tctttaaaaatagacagtag

SEQ ID NO: 576814 - DNA, 20 bp, Artificial Sequence
  chemically synthesized
agacagtagatatgcttgcc

SEQ ID NO: 576815 - DNA, 20 bp, Artificial Sequence
  chemically synthesized
cttcagaatctcactcatgt

SEQ ID NO: 576816 - DNA, 20 bp, Artificial Sequence
  chemically synthesized
aaaataaaacatcaacatga

SEQ ID NO: 576817 - DNA, 20 bp, Artificial Sequence
  chemically synthesized
ttttcattttatttagttct

SEQ ID NO: 576818 - DNA, 20 bp, Artificial Sequence
  chemically synthesized
cctcctccttgacctgggga

SEQ ID NO: 576819 - DNA, 20 bp, Artificial Sequence
  chemically synthesized
gggaaaatgatttaaaggtg

SEQ ID NO: 576820 - DNA, 20 bp, Artificial Sequence
  chemically synthesized
aggtgtgctgcttcatttcc

SEQ ID NO: 576821 - DNA, 20 bp, Artificial Sequence
  chemically synthesized
tgcttcatttccaagtgttt

SEQ ID NO: 576822 - DNA, 20 bp, Artificial Sequence
  chemically synthesized
tttttcttttgtctttctct

SEQ ID NO: 576823 - DNA, 20 bp, Artificial Sequence
  chemically synthesized
ttgtctttctcttattgatt

SEQ ID NO: 576824 - DNA, 20 bp, Artificial Sequence
  chemically synthesized
tttctcttattgatttctag

SEQ ID NO: 576825 - DNA, 20 bp, Artificial Sequence
  chemically synthesized
gaattctctaaatttgctga

SEQ ID NO: 576826 - DNA, 20 bp, Artificial Sequence
  chemically synthesized
aagttgcttggagtccagaa

SEQ ID NO: 576827 - DNA, 20 bp, Artificial Sequence
  chemically synthesized
agaatatggcttatatcagt

SEQ ID NO: 576828 - DNA, 20 bp, Artificial Sequence
  chemically synthesized
tatatcagtgaatgtttcat

SEQ ID NO: 576829 - DNA, 20 bp, Artificial Sequence
  chemically synthesized
tattctgctactgttgggag

SEQ ID NO: 576830 - DNA, 20 bp, Artificial Sequence
  chemically synthesized
tgttgttcagttctctttac

SEQ ID NO: 576831 - DNA, 20 bp, Artificial Sequence
  chemically synthesized
ttgaagtccctaactagaaa

SEQ ID NO: 576832 - DNA, 20 bp, Artificial Sequence
  chemically synthesized
ctaactagaaatatggattt

SEQ ID NO: 576833 - DNA, 20 bp, Artificial Sequence
  chemically synthesized
cttttttcagctctattcat

SEQ ID NO: 576834 - DNA, 20 bp, Artificial Sequence
  chemically synthesized
aatgtgtttgcacctaacaa

SEQ ID NO: 576835 - DNA, 20 bp, Artificial Sequence
  chemically synthesized
gttgttaggtgcaaacacat

SEQ ID NO: 576836 - DNA, 20 bp, Artificial Sequence
  chemically synthesized
ggaagacataataatcctaa

SEQ ID NO: 576837 - DNA, 20 bp, Artificial Sequence
  chemically synthesized
tgacaaacagggacattaca

SEQ ID NO: 576838 - DNA, 20 bp, Artificial Sequence
  chemically synthesized
acttaatctttatgtaatgt

SEQ ID NO: 576839 - DNA, 20 bp, Artificial Sequence
  chemically synthesized
taatgttaatatcagataaa

SEQ ID NO: 576840 - DNA, 20 bp, Artificial Sequence
  chemically synthesized
tctgatattaacattactgc

SEQ ID NO: 576841 - DNA, 20 bp, Artificial Sequence
  chemically synthesized
acattactgctgctgctttc

SEQ ID NO: 576842 - DNA, 20 bp, Artificial Sequence
  chemically synthesized
attgttgcataatgtaactt

SEQ ID NO: 576843 - DNA, 20 bp, Artificial Sequence
  chemically synthesized
cacacaatatgccgtctaaa

SEQ ID NO: 576844 - DNA, 20 bp, Artificial Sequence
  chemically synthesized
tttagacggcatattgtgtg

SEQ ID NO: 576845 - DNA, 20 bp, Artificial Sequence
  chemically synthesized
aattaaaagagatttagctg

SEQ ID NO: 576846 - DNA, 20 bp, Artificial Sequence
  chemically synthesized
ggtctaaatataccaattaa

SEQ ID NO: 576847 - DNA, 20 bp, Artificial Sequence
  chemically synthesized
taaggtaattatggatatat

SEQ ID NO: 576848 - DNA, 20 bp, Artificial Sequence
  chemically synthesized
ggcttcaatctgccacctta

SEQ ID NO: 576849 - DNA, 20 bp, Artificial Sequence
  chemically synthesized
aaacagaaaccaaataaggt

SEQ ID NO: 576850 - DNA, 20 bp, Artificial Sequence
  chemically synthesized
aatctgccaccttatttggt

SEQ ID NO: 576851 - DNA, 20 bp, Artificial Sequence
  chemically synthesized
tgccaccttatttggtttct

SEQ ID NO: 576852 - DNA, 20 bp, Artificial Sequence
  chemically synthesized
gtgggttatttgaacatttc

SEQ ID NO: 576853 - DNA, 20 bp, Artificial Sequence
  chemically synthesized
tttcttaacgtatcactttg

SEQ ID NO: 576854 - DNA, 20 bp, Artificial Sequence
  chemically synthesized
cgtcacctgaagtcaattcc

SEQ ID NO: 576855 - DNA, 20 bp, Artificial Sequence
  chemically synthesized
agaaccacatcaggtggtgt

SEQ ID NO: 576856 - DNA, 20 bp, Artificial Sequence
  chemically synthesized
aatagactatcctatttacc

SEQ ID NO: 576857 - DNA, 20 bp, Artificial Sequence
  chemically synthesized
agacttcgttataatttcct

SEQ ID NO: 576858 - DNA, 20 bp, Artificial Sequence
  chemically synthesized
tctttttgtcattctttaag

SEQ ID NO: 576859 - DNA, 20 bp, Artificial Sequence
  chemically synthesized
agatttgctagcaagaaatt

SEQ ID NO: 576860 - DNA, 20 bp, Artificial Sequence
  chemically synthesized
attaaagggaaagagacatt

SEQ ID NO: 576861 - DNA, 20 bp, Artificial Sequence
  chemically synthesized
ttaggaaaaccttaggagtt

SEQ ID NO: 576862 - DNA, 20 bp, Artificial Sequence
  chemically synthesized
ttagataatcagataactcc

SEQ ID NO: 576863 - DNA, 20 bp, Artificial Sequence
  chemically synthesized
ttatgctattttgcaattct

SEQ ID NO: 576864 - DNA, 20 bp, Artificial Sequence
  chemically synthesized
tggagggctgatggtgacac

SEQ ID NO: 576865 - DNA, 20 bp, Artificial Sequence
  chemically synthesized
aaaattttctcatggaacgc

SEQ ID NO: 576866 - DNA, 20 bp, Artificial Sequence
  chemically synthesized
aaattcctatcagcattcta

SEQ ID NO: 576867 - DNA, 20 bp, Artificial Sequence
  chemically synthesized
catcagttaatgatctaata

SEQ ID NO: 576868 - DNA, 20 bp, Artificial Sequence
  chemically synthesized
caaaaggtacctatgtatct

SEQ ID NO: 576869 - DNA, 20 bp, Artificial Sequence
  chemically synthesized
agttttctaagtgcctgaca

SEQ ID NO: 576870 - DNA, 20 bp, Artificial Sequence
  chemically synthesized
gataactcttctgtacgcat

SEQ ID NO: 576871 - DNA, 20 bp, Artificial Sequence
  chemically synthesized
tgttgtatcagtgtttgttt

SEQ ID NO: 576872 - DNA, 20 bp, Artificial Sequence
  chemically synthesized
gttaatagtgttgtatcagt

SEQ ID NO: 576873 - DNA, 20 bp, Artificial Sequence
  chemically synthesized
ttttgttaatagtgttgtat

SEQ ID NO: 576874 - DNA, 20 bp, Artificial Sequence
  chemically synthesized
taacaaaactacagacttta

SEQ ID NO: 576875 - DNA, 20 bp, Artificial Sequence
  chemically synthesized
ggtgaaatctgaataaagtc

SEQ ID NO: 576876 - DNA, 20 bp, Artificial Sequence
  chemically synthesized
acagactttattcagatttc

SEQ ID NO: 576877 - DNA, 20 bp, Artificial Sequence
  chemically synthesized
tttttccactcatgtcattt

SEQ ID NO: 576878 - DNA, 20 bp, Artificial Sequence
  chemically synthesized
gaccaaatgcagtaggagat

SEQ ID NO: 576879 - DNA, 20 bp, Artificial Sequence
  chemically synthesized
acccaaggaccaaatgcagt

SEQ ID NO: 576880 - DNA, 20 bp, Artificial Sequence
  chemically synthesized
cctctagtctgtgacagtct

SEQ ID NO: 576881 - DNA, 20 bp, Artificial Sequence
  chemically synthesized
atacctgactagtcctattc

SEQ ID NO: 576882 - DNA, 20 bp, Artificial Sequence
  chemically synthesized
aggtatattctagaagtctc

SEQ ID NO: 576883 - DNA, 20 bp, Artificial Sequence
  chemically synthesized
tttccctattagaagaagtt

SEQ ID NO: 576884 - DNA, 20 bp, Artificial Sequence
  chemically synthesized
cttagttaacttggtgcctg

SEQ ID NO: 576885 - DNA, 20 bp, Artificial Sequence
  chemically synthesized
gtaagttaccaagttcatgg

SEQ ID NO: 576886 - DNA, 20 bp, Artificial Sequence
  chemically synthesized
agttcatggaggggcttagg

SEQ ID NO: 576887 - DNA, 20 bp, Artificial Sequence
  chemically synthesized
gatactcctttcctgggatg

SEQ ID NO: 576888 - DNA, 20 bp, Artificial Sequence
  chemically synthesized
aagggaaaattttctctcaa

SEQ ID NO: 576889 - DNA, 20 bp, Artificial Sequence
  chemically synthesized
ctcagataataatgtgtttt

SEQ ID NO: 576890 - DNA, 20 bp, Artificial Sequence
  chemically synthesized
tagcaaccactcagataata

SEQ ID NO: 576891 - DNA, 20 bp, Artificial Sequence
  chemically synthesized
gaattgacaaaagaaggtaa

SEQ ID NO: 576892 - DNA, 20 bp, Artificial Sequence
  chemically synthesized
ggcccgaaaagggaaaaaag

SEQ ID NO: 576893 - DNA, 20 bp, Artificial Sequence
  chemically synthesized
tttcgggccagtataactta

SEQ ID NO: 576894 - DNA, 20 bp, Artificial Sequence
  chemically synthesized
gggccagtataacttaatag

SEQ ID NO: 576895 - DNA, 20 bp, Artificial Sequence
  chemically synthesized
attaatttatttgtagatga

SEQ ID NO: 576896 - DNA, 20 bp, Artificial Sequence
  chemically synthesized
ggttctggcactcaagacta

SEQ ID NO: 576897 - DNA, 20 bp, Artificial Sequence
  chemically synthesized
gatattccctgtaggatacc

SEQ ID NO: 576898 - DNA, 20 bp, Artificial Sequence
  chemically synthesized
tacagggaatatcgagttac

SEQ ID NO: 576899 - DNA, 20 bp, Artificial Sequence
  chemically synthesized
accattgtcacatctttctt

SEQ ID NO: 576900 - DNA, 20 bp, Artificial Sequence
  chemically synthesized
gtgacaatggttaaccataa

SEQ ID NO: 576901 - DNA, 20 bp, Artificial Sequence
  chemically synthesized
atggttaaccataatttaga

SEQ ID NO: 576902 - DNA, 20 bp, Artificial Sequence
  chemically synthesized
gctggcccatcaatttttta

SEQ ID NO: 576903 - DNA, 20 bp, Artificial Sequence
  chemically synthesized
ttttttatgatgtttttctc

SEQ ID NO: 576904 - DNA, 20 bp, Artificial Sequence
  chemically synthesized
tttctcaacaatttctctgg

SEQ ID NO: 576905 - DNA, 20 bp, Artificial Sequence
  chemically synthesized
tcaacaatttctctgggcaa

SEQ ID NO: 576906 - DNA, 20 bp, Artificial Sequence
  chemically synthesized
tttcaaatgcaagactaatt

SEQ ID NO: 576907 - DNA, 20 bp, Artificial Sequence
  chemically synthesized
aaatgcaagactaattttaa

SEQ ID NO: 576908 - DNA, 20 bp, Artificial Sequence
  chemically synthesized
gagtctgtttaacattttaa

SEQ ID NO: 576909 - DNA, 20 bp, Artificial Sequence
  chemically synthesized
ggataatacaaatggcatga

SEQ ID NO: 576910 - DNA, 20 bp, Artificial Sequence
  chemically synthesized
cctaagaaagtctattaaag

SEQ ID NO: 576911 - DNA, 20 bp, Artificial Sequence
  chemically synthesized
aatgctattgagtttctcaa

SEQ ID NO: 576912 - DNA, 20 bp, Artificial Sequence
  chemically synthesized
tactttatttaacaatgcta

SEQ ID NO: 576913 - DNA, 20 bp, Artificial Sequence
  chemically synthesized
taaataaagtagaatgtccc

SEQ ID NO: 576914 - DNA, 20 bp, Artificial Sequence
  chemically synthesized
aaatcttttatcatgtaact

SEQ ID NO: 576915 - DNA, 20 bp, Artificial Sequence
  chemically synthesized
gaagcaatgagttacatgat

SEQ ID NO: 576916 - DNA, 20 bp, Artificial Sequence
  chemically synthesized
gtgtgtgtgtgtgtatagaa

SEQ ID NO: 576917 - DNA, 20 bp, Artificial Sequence
  chemically synthesized
agaatactgtaatgtttaaa

SEQ ID NO: 576918 - DNA, 20 bp, Artificial Sequence
  chemically synthesized
acccttagctcagaatactg

SEQ ID NO: 576919 - DNA, 20 bp, Artificial Sequence
  chemically synthesized
caatagaacatggtaatgtt

SEQ ID NO: 576920 - DNA, 20 bp, Artificial Sequence
  chemically synthesized
tttaaaaatctgtctccgct

SEQ ID NO: 576921 - DNA, 20 bp, Artificial Sequence
  chemically synthesized
gctcacaatctagtagcgga

SEQ ID NO: 576922 - DNA, 20 bp, Artificial Sequence
  chemically synthesized
gcagagaattcacatcacag

SEQ ID NO: 576923 - DNA, 20 bp, Artificial Sequence
  chemically synthesized
ggtccaatatgtcagtagtg

SEQ ID NO: 576924 - DNA, 20 bp, Artificial Sequence
  chemically synthesized
agaataagtcttggccacct

SEQ ID NO: 576925 - DNA, 20 bp, Artificial Sequence
  chemically synthesized
gaaaagataactactgagta

SEQ ID NO: 576926 - DNA, 20 bp, Artificial Sequence
  chemically synthesized
ggcaaaccggtgtcacaggg

SEQ ID NO: 576927 - DNA, 20 bp, Artificial Sequence
  chemically synthesized
gtaaaacggacccctgtgac

SEQ ID NO: 576928 - DNA, 20 bp, Artificial Sequence
  chemically synthesized
taggtttgtggggtacatgt

SEQ ID NO: 576929 - DNA, 20 bp, Artificial Sequence
  chemically synthesized
tcatttttttaacttttatt

SEQ ID NO: 576930 - DNA, 20 bp, Artificial Sequence
  chemically synthesized
aaaaaaatgaaaagaatagg

SEQ ID NO: 576931 - DNA, 20 bp, Artificial Sequence
  chemically synthesized
agattaaaaaataaaaataa

SEQ ID NO: 576932 - DNA, 20 bp, Artificial Sequence
  chemically synthesized
aaagtgatttcacatataac

SEQ ID NO: 576933 - DNA, 20 bp, Artificial Sequence
  chemically synthesized
cctatcattgcataaggcaa

SEQ ID NO: 576934 - DNA, 20 bp, Artificial Sequence
  chemically synthesized
ggttgcttctcatgactgcg

SEQ ID NO: 576935 - DNA, 20 bp, Artificial Sequence
  chemically synthesized
ggttaagagaaatggggaag

SEQ ID NO: 576936 - DNA, 20 bp, Artificial Sequence
  chemically synthesized
cttatgcaagaatttaattt

SEQ ID NO: 576937 - DNA, 20 bp, Artificial Sequence
  chemically synthesized
ttgcataagaggtaaccacc

SEQ ID NO: 576938 - DNA, 20 bp, Artificial Sequence
  chemically synthesized
agtctgcactaaagtggtaa

SEQ ID NO: 576939 - DNA, 20 bp, Artificial Sequence
  chemically synthesized
accactttagtgcagactgg

SEQ ID NO: 576940 - DNA, 20 bp, Artificial Sequence
  chemically synthesized
gatccacattttttttccct

SEQ ID NO: 576941 - DNA, 20 bp, Artificial Sequence
  chemically synthesized
cctgctagtcattggtttag

SEQ ID NO: 576942 - DNA, 20 bp, Artificial Sequence
  chemically synthesized
cagtcctaaaccaatgacta

SEQ ID NO: 576943 - DNA, 20 bp, Artificial Sequence
  chemically synthesized
tacacaaaatcctgctagtc

SEQ ID NO: 576944 - DNA, 20 bp, Artificial Sequence
  chemically synthesized
attctaaatggattgaagac

SEQ ID NO: 576945 - DNA, 20 bp, Artificial Sequence
  chemically synthesized
atcccactggggaaattcta

SEQ ID NO: 576946 - DNA, 20 bp, Artificial Sequence
  chemically synthesized
atccatttagaatttcccca

SEQ ID NO: 576947 - DNA, 20 bp, Artificial Sequence
  chemically synthesized
gccaactgccactggtctag

SEQ ID NO: 576948 - DNA, 20 bp, Artificial Sequence
  chemically synthesized
actccactagaccagtggca

SEQ ID NO: 576949 - DNA, 20 bp, Artificial Sequence
  chemically synthesized
ttgataatgcattttttact

SEQ ID NO: 576950 - DNA, 20 bp, Artificial Sequence
  chemically synthesized
tctctgccttctgcagtagc

SEQ ID NO: 576951 - DNA, 20 bp, Artificial Sequence
  chemically synthesized
aagttctaagtacttggaat

SEQ ID NO: 576952 - DNA, 20 bp, Artificial Sequence
  chemically synthesized
attttttatcttttttattt

SEQ ID NO: 576953 - DNA, 20 bp, Artificial Sequence
  chemically synthesized
tttattttattgtttttcct

SEQ ID NO: 576954 - DNA, 20 bp, Artificial Sequence
  chemically synthesized
tagcttacagagagaggagt

SEQ ID NO: 576955 - DNA, 20 bp, Artificial Sequence
  chemically synthesized
aatttaaggctataaagaat

SEQ ID NO: 576956 - DNA, 20 bp, Artificial Sequence
  chemically synthesized
atagccttaaatttcccagg

SEQ ID NO: 576957 - DNA, 20 bp, Artificial Sequence
  chemically synthesized
ttgtgtgacttaaagttaca

SEQ ID NO: 576958 - DNA, 20 bp, Artificial Sequence
  chemically synthesized
taagtcacacaattctaatt

SEQ ID NO: 576959 - DNA, 20 bp, Artificial Sequence
  chemically synthesized
acaaaattagtaggaaattt

SEQ ID NO: 576960 - DNA, 20 bp, Artificial Sequence
  chemically synthesized
aaagtattagtttgagccat

SEQ ID NO: 576961 - DNA, 20 bp, Artificial Sequence
  chemically synthesized
cataaacaatatgttaaagt

SEQ ID NO: 576962 - DNA, 20 bp, Artificial Sequence
  chemically synthesized
ctcaaactaatactttaaca

SEQ ID NO: 576963 - DNA, 20 bp, Artificial Sequence
  chemically synthesized
tgctaacttctacactggga

SEQ ID NO: 576964 - DNA, 20 bp, Artificial Sequence
  chemically synthesized
accttgtatgaacatattta

SEQ ID NO: 576965 - DNA, 20 bp, Artificial Sequence
  chemically synthesized
aggttgtactctggttaaca

SEQ ID NO: 576966 - DNA, 20 bp, Artificial Sequence
  chemically synthesized
aattttctcatgtttcatat

SEQ ID NO: 576967 - DNA, 20 bp, Artificial Sequence
  chemically synthesized
tttaactgattcaaattttc

SEQ ID NO: 576968 - DNA, 20 bp, Artificial Sequence
  chemically synthesized
ctaagtagatctttcagttt

SEQ ID NO: 576969 - DNA, 20 bp, Artificial Sequence
  chemically synthesized
atgtttttctaagtagatct

SEQ ID NO: 576970 - DNA, 20 bp, Artificial Sequence
  chemically synthesized
atgtgactcggagaagaagt

SEQ ID NO: 576971 - DNA, 20 bp, Artificial Sequence
  chemically synthesized
cgagtcacattcttgtgaat

SEQ ID NO: 576972 - DNA, 20 bp, Artificial Sequence
  chemically synthesized
aaattatttttgaaatttta

SEQ ID NO: 576973 - DNA, 20 bp, Artificial Sequence
  chemically synthesized
atcctttatagtttacatgg

SEQ ID NO: 576974 - DNA, 20 bp, Artificial Sequence
  chemically synthesized
ttcatttgtatatgatcctt

SEQ ID NO: 576975 - DNA, 20 bp, Artificial Sequence
  chemically synthesized
cattataattactaatagta

SEQ ID NO: 576976 - DNA, 20 bp, Artificial Sequence
  chemically synthesized
tgaaggcttggtatgttgtt

SEQ ID NO: 576977 - DNA, 20 bp, Artificial Sequence
  chemically synthesized
tacggtgccctgcatattgt

SEQ ID NO: 576978 - DNA, 20 bp, Artificial Sequence
  chemically synthesized
aatatgcagggcaccgtact

SEQ ID NO: 576979 - DNA, 20 bp, Artificial Sequence
  chemically synthesized
caccgtactaagtgctttat

SEQ ID NO: 576980 - DNA, 20 bp, Artificial Sequence
  chemically synthesized
aggagtagagattaatattg

SEQ ID NO: 576981 - DNA, 20 bp, Artificial Sequence
  chemically synthesized
tctaaatagaggaataggag

SEQ ID NO: 576982 - DNA, 20 bp, Artificial Sequence
  chemically synthesized
ctatttagaaaccagacctg

SEQ ID NO: 576983 - DNA, 20 bp, Artificial Sequence
  chemically synthesized
agtttctcaatcactccagg

SEQ ID NO: 576984 - DNA, 20 bp, Artificial Sequence
  chemically synthesized
tcaaactgtgtgattttcct

SEQ ID NO: 576985 - DNA, 20 bp, Artificial Sequence
  chemically synthesized
agaaacttgaaggaaaatca

SEQ ID NO: 576986 - DNA, 20 bp, Artificial Sequence
  chemically synthesized
agctatgtcactttcaaact

SEQ ID NO: 576987 - DNA, 20 bp, Artificial Sequence
  chemically synthesized
gatagtaatgaaagtgtaga

SEQ ID NO: 576988 - DNA, 20 bp, Artificial Sequence
  chemically synthesized
taattccagtgcaaaggatg

SEQ ID NO: 576989 - DNA, 20 bp, Artificial Sequence
  chemically synthesized
tccagtgcaaaggatgatct

SEQ ID NO: 576990 - DNA, 20 bp, Artificial Sequence
  chemically synthesized
gatgatctgtttgttttttt

SEQ ID NO: 576991 - DNA, 20 bp, Artificial Sequence
  chemically synthesized
gctcaccgcaagctccacct

SEQ ID NO: 576992 - DNA, 20 bp, Artificial Sequence
  chemically synthesized
gatggcatgaatccgggagg

SEQ ID NO: 576993 - DNA, 20 bp, Artificial Sequence
  chemically synthesized
aggcgcccaccacaacaccc

SEQ ID NO: 576994 - DNA, 20 bp, Artificial Sequence
  chemically synthesized
ttttgtattttcagtagaga

SEQ ID NO: 576995 - DNA, 20 bp, Artificial Sequence
  chemically synthesized
tgcctcggcctcccaaagtg

SEQ ID NO: 576996 - DNA, 20 bp, Artificial Sequence
  chemically synthesized
gagccactgtgcccggctgc

SEQ ID NO: 576997 - DNA, 20 bp, Artificial Sequence
  chemically synthesized
tccattttacatccttattt

SEQ ID NO: 576998 - DNA, 20 bp, Artificial Sequence
  chemically synthesized
attacctagcttttcatagc

SEQ ID NO: 576999 - DNA, 20 bp, Artificial Sequence
  chemically synthesized
gggtatttgtggacaaatta

SEQ ID NO: 577000 - DNA, 20 bp, Artificial Sequence
  chemically synthesized
tcccagagaagtcatttccc

SEQ ID NO: 577001 - DNA, 20 bp, Artificial Sequence
  chemically synthesized
caaggggaaatgacttctct

SEQ ID NO: 577002 - DNA, 20 bp, Artificial Sequence
  chemically synthesized
tgaattgatgttaattttat

SEQ ID NO: 577003 - DNA, 20 bp, Artificial Sequence
  chemically synthesized
tctcaagagacaaaataaaa

SEQ ID NO: 577004 - DNA, 20 bp, Artificial Sequence
  chemically synthesized
agtaactacgattagaaaat

SEQ ID NO: 577005 - DNA, 20 bp, Artificial Sequence
  chemically synthesized
aaagattaggagaaaagtaa

SEQ ID NO: 577006 - DNA, 20 bp, Artificial Sequence
  chemically synthesized
atagagaaggtgacatttgc

SEQ ID NO: 577007 - DNA, 20 bp, Artificial Sequence
  chemically synthesized
cttgataccgaatatatatt

SEQ ID NO: 577008 - DNA, 20 bp, Artificial Sequence
  chemically synthesized
caaatttacactatcagaat

SEQ ID NO: 577009 - DNA, 20 bp, Artificial Sequence
  chemically synthesized
ctggtcttgttgtataaaca

SEQ ID NO: 577010 - DNA, 20 bp, Artificial Sequence
  chemically synthesized
atcaagaagatactgaaaca

SEQ ID NO: 577011 - DNA, 20 bp, Artificial Sequence
  chemically synthesized
tatcttcttgatgataatga

SEQ ID NO: 577012 - DNA, 20 bp, Artificial Sequence
  chemically synthesized
cagagcagactttttaaata

SEQ ID NO: 577013 - DNA, 20 bp, Artificial Sequence
  chemically synthesized
agtctgctctgttcttttaa

SEQ ID NO: 577014 - DNA, 20 bp, Artificial Sequence
  chemically synthesized
aatctcagagaatttccata

SEQ ID NO: 577015 - DNA, 20 bp, Artificial Sequence
  chemically synthesized
aaactagttatggaaattct

SEQ ID NO: 577016 - DNA, 20 bp, Artificial Sequence
  chemically synthesized
agcaccaattttatgtgaaa

SEQ ID NO: 577017 - DNA, 20 bp, Artificial Sequence
  chemically synthesized
acagaaataatatgtggact

SEQ ID NO: 577018 - DNA, 20 bp, Artificial Sequence
  chemically synthesized
gccaaatgttcaataatagt

SEQ ID NO: 577019 - DNA, 20 bp, Artificial Sequence
  chemically synthesized
gagctcgatatagttccagc

SEQ ID NO: 577020 - DNA, 20 bp, Artificial Sequence
  chemically synthesized
caaacccagcagttacacca

SEQ ID NO: 577021 - DNA, 20 bp, Artificial Sequence
  chemically synthesized
aaatcatgctggtgtaactg

SEQ ID NO: 577022 - DNA, 20 bp, Artificial Sequence
  chemically synthesized
gttatattcattgtggtgcc

SEQ ID NO: 577023 - DNA, 20 bp, Artificial Sequence
  chemically synthesized
tgtttggaaagaagggcaca

SEQ ID NO: 577024 - DNA, 20 bp, Artificial Sequence
  chemically synthesized
aggattttgagtacatattt

SEQ ID NO: 577025 - DNA, 20 bp, Artificial Sequence
  chemically synthesized
cacaaagcagacacatttta

SEQ ID NO: 577026 - DNA, 20 bp, Artificial Sequence
  chemically synthesized
ctaaaatcacaataaaatgt

SEQ ID NO: 577027 - DNA, 20 bp, Artificial Sequence
  chemically synthesized
tgtgtgaaggtaagtaagtg

SEQ ID NO: 577028 - DNA, 20 bp, Artificial Sequence
  chemically synthesized
aagatttgaaatgccttaca

SEQ ID NO: 577029 - DNA, 20 bp, Artificial Sequence
  chemically synthesized
aaatataaaaggcgttgtgt

SEQ ID NO: 577030 - DNA, 20 bp, Artificial Sequence
  chemically synthesized
gtgctcatttttataattac

SEQ ID NO: 577031 - DNA, 20 bp, Artificial Sequence
  chemically synthesized
ttacagtagtttcctacata

SEQ ID NO: 577032 - DNA, 20 bp, Artificial Sequence
  chemically synthesized
gttgcagtgggtccatttaa

SEQ ID NO: 577033 - DNA, 20 bp, Artificial Sequence
  chemically synthesized
gctatgatacatataaatat

SEQ ID NO: 577034 - DNA, 20 bp, Artificial Sequence
  chemically synthesized
tctgatctagacttacttga

SEQ ID NO: 577035 - DNA, 20 bp, Artificial Sequence
  chemically synthesized
ctaaaataactttactttga

SEQ ID NO: 577036 - DNA, 20 bp, Artificial Sequence
  chemically synthesized
gaagtctctgtactatattt

SEQ ID NO: 577037 - DNA, 20 bp, Artificial Sequence
  chemically synthesized
gacttctcacgcacctttta

SEQ ID NO: 577038 - DNA, 20 bp, Artificial Sequence
  chemically synthesized
tattgtgccaatgtcagttt

SEQ ID NO: 577039 - DNA, 20 bp, Artificial Sequence
  chemically synthesized
gttaatagtattgtgccaat

SEQ ID NO: 577040 - DNA, 20 bp, Artificial Sequence
  chemically synthesized
taaataaatatttattttaa

SEQ ID NO: 577041 - DNA, 20 bp, Artificial Sequence
  chemically synthesized
ccataagacttaggatttaa

SEQ ID NO: 577042 - DNA, 20 bp, Artificial Sequence
  chemically synthesized
atacttgcctaccataagac

SEQ ID NO: 577043 - DNA, 20 bp, Artificial Sequence
  chemically synthesized
ctaagtcttatggtaggcaa

SEQ ID NO: 577044 - DNA, 20 bp, Artificial Sequence
  chemically synthesized
ggtaggcaagtatgttttat

SEQ ID NO: 577045 - DNA, 20 bp, Artificial Sequence
  chemically synthesized
tgatcacttaattcaaaact

SEQ ID NO: 577046 - DNA, 20 bp, Artificial Sequence
  chemically synthesized
cagtcccatagcagaaagca

SEQ ID NO: 577047 - DNA, 20 bp, Artificial Sequence
  chemically synthesized
aagtcaggccctctcattca

SEQ ID NO: 577048 - DNA, 20 bp, Artificial Sequence
  chemically synthesized
ctccatagaaaccatatatg

SEQ ID NO: 577049 - DNA, 20 bp, Artificial Sequence
  chemically synthesized
gcagaactaaacttttcata

SEQ ID NO: 577050 - DNA, 20 bp, Artificial Sequence
  chemically synthesized
accatatatgaaaagtttag

SEQ ID NO: 577051 - DNA, 20 bp, Artificial Sequence
  chemically synthesized
tggttcaatgttcacagcag

SEQ ID NO: 577052 - DNA, 20 bp, Artificial Sequence
  chemically synthesized
aatgtaaaattgactaattt

SEQ ID NO: 577053 - DNA, 20 bp, Artificial Sequence
  chemically synthesized
tgaaaacatacattttgcct

SEQ ID NO: 577054 - DNA, 20 bp, Artificial Sequence
  chemically synthesized
aaaaatcctaaaggcaaaat

SEQ ID NO: 577055 - DNA, 20 bp, Artificial Sequence
  chemically synthesized
tttcaagtaaaaatatatga

SEQ ID NO: 577056 - DNA, 20 bp, Artificial Sequence
  chemically synthesized
gaggcagagcttgcagtgag

SEQ ID NO: 577057 - DNA, 20 bp, Artificial Sequence
  chemically synthesized
tagtcccactactcaggagg

SEQ ID NO: 577058 - DNA, 20 bp, Artificial Sequence
  chemically synthesized
caccacgcccggctaatttt

SEQ ID NO: 577059 - DNA, 20 bp, Artificial Sequence
  chemically synthesized
ttttgtgtttttagtagaga

SEQ ID NO: 577060 - DNA, 20 bp, Artificial Sequence
  chemically synthesized
cgcctcggcctcccaaagtg

SEQ ID NO: 577061 - DNA, 20 bp, Artificial Sequence
  chemically synthesized
ggccgatgagttattatata

SEQ ID NO: 577062 - DNA, 20 bp, Artificial Sequence
  chemically synthesized
ctaaatagctatgccaactc

SEQ ID NO: 577063 - DNA, 20 bp, Artificial Sequence
  chemically synthesized
tttagcaaatataaacaaat

SEQ ID NO: 577064 - DNA, 20 bp, Artificial Sequence
  chemically synthesized
aaaatatttaggaagcagat

SEQ ID NO: 577065 - DNA, 20 bp, Artificial Sequence
  chemically synthesized
atattatatggttgcgatta

SEQ ID NO: 577066 - DNA, 20 bp, Artificial Sequence
  chemically synthesized
attacaaagatattatatgg

SEQ ID NO: 577067 - DNA, 20 bp, Artificial Sequence
  chemically synthesized
gtgatattactttaattaat

SEQ ID NO: 577068 - DNA, 20 bp, Artificial Sequence
  chemically synthesized
attaatagcaaatgagcttt

SEQ ID NO: 577069 - DNA, 20 bp, Artificial Sequence
  chemically synthesized
tatattcacattaatagcaa

SEQ ID NO: 577070 - DNA, 20 bp, Artificial Sequence
  chemically synthesized
gtaattccattctaatctag

SEQ ID NO: 577071 - DNA, 20 bp, Artificial Sequence
  chemically synthesized
ccaagtgaacattaatcact

SEQ ID NO: 577072 - DNA, 20 bp, Artificial Sequence
  chemically synthesized
gtggccttttaaagaaccac

SEQ ID NO: 577073 - DNA, 20 bp, Artificial Sequence
  chemically synthesized
aagaatcctttctctttgtc

SEQ ID NO: 577074 - DNA, 20 bp, Artificial Sequence
  chemically synthesized
attaatctaaggacaaagag

SEQ ID NO: 577075 - DNA, 20 bp, Artificial Sequence
  chemically synthesized
aggtgaataatggttaagtg

SEQ ID NO: 577076 - DNA, 20 bp, Artificial Sequence
  chemically synthesized
tactattttttggtcaatca

SEQ ID NO: 577077 - DNA, 20 bp, Artificial Sequence
  chemically synthesized
tactgggtacatatgaagca

SEQ ID NO: 577078 - DNA, 20 bp, Artificial Sequence
  chemically synthesized
aacatgtcgatttcagtttt

SEQ ID NO: 577079 - DNA, 20 bp, Artificial Sequence
  chemically synthesized
aacaaagaaaactgaaatcg

SEQ ID NO: 577080 - DNA, 20 bp, Artificial Sequence
  chemically synthesized
ggctttttaaacatgtcgat

SEQ ID NO: 577081 - DNA, 20 bp, Artificial Sequence
  chemically synthesized
aaacagtggctttttaaaca

SEQ ID NO: 577082 - DNA, 20 bp, Artificial Sequence
  chemically synthesized
aatcgacatgtttaaaaagc

SEQ ID NO: 577083 - DNA, 20 bp, Artificial Sequence
  chemically synthesized
tggcatcatggagctaaaac

SEQ ID NO: 577084 - DNA, 20 bp, Artificial Sequence
  chemically synthesized
gccaatgaattttcaaacta

SEQ ID NO: 577085 - DNA, 20 bp, Artificial Sequence
  chemically synthesized
catttaggacagggaatcca

SEQ ID NO: 577086 - DNA, 20 bp, Artificial Sequence
  chemically synthesized
atggattccctgtcctaaat

SEQ ID NO: 577087 - DNA, 20 bp, Artificial Sequence
  chemically synthesized
atatatcatcgatgtgtttt

SEQ ID NO: 577088 - DNA, 20 bp, Artificial Sequence
  chemically synthesized
aatattaatatatatcatcg

SEQ ID NO: 577089 - DNA, 20 bp, Artificial Sequence
  chemically synthesized
tcgatgatatatattaatat

SEQ ID NO: 577090 - DNA, 20 bp, Artificial Sequence
  chemically synthesized
ttgatgttaatggaagtttg

SEQ ID NO: 577091 - DNA, 20 bp, Artificial Sequence
  chemically synthesized
tctctctggttgatgttaat

SEQ ID NO: 577092 - DNA, 20 bp, Artificial Sequence
  chemically synthesized
gatcagagcagtgctagtca

SEQ ID NO: 577093 - DNA, 20 bp, Artificial Sequence
  chemically synthesized
ctccagtaagtttaatattt

SEQ ID NO: 577094 - DNA, 20 bp, Artificial Sequence
  chemically synthesized
ataacctataatgttctcca

SEQ ID NO: 577095 - DNA, 20 bp, Artificial Sequence
  chemically synthesized
tataggttatctgtaggcat

SEQ ID NO: 577096 - DNA, 20 bp, Artificial Sequence
  chemically synthesized
ctgtcttgcctatacttcaa

SEQ ID NO: 577097 - DNA, 20 bp, Artificial Sequence
  chemically synthesized
tcaatctccgcatctgtgaa

SEQ ID NO: 577098 - DNA, 20 bp, Artificial Sequence
  chemically synthesized
ttaatcttatttcacagatg

SEQ ID NO: 577099 - DNA, 20 bp, Artificial Sequence
  chemically synthesized
gttccagtaaatgctctgta

SEQ ID NO: 577100 - DNA, 20 bp, Artificial Sequence
  chemically synthesized
acagagcatttactggaacc

SEQ ID NO: 577101 - DNA, 20 bp, Artificial Sequence
  chemically synthesized
cagatgtaagaaaaattgcc

SEQ ID NO: 577102 - DNA, 20 bp, Artificial Sequence
  chemically synthesized
cctggccaccctaatagtct

SEQ ID NO: 577103 - DNA, 20 bp, Artificial Sequence
  chemically synthesized
aagagaggaaatcaggaagg

SEQ ID NO: 577104 - DNA, 20 bp, Artificial Sequence
  chemically synthesized
ggtttgaaaaatcccagcct

SEQ ID NO: 577105 - DNA, 20 bp, Artificial Sequence
  chemically synthesized
ataaacctggggtgtgccca

SEQ ID NO: 577106 - DNA, 20 bp, Artificial Sequence
  chemically synthesized
tcaaaccatttgggcacacc

SEQ ID NO: 577107 - DNA, 20 bp, Artificial Sequence
  chemically synthesized
attacaaagaccatcagaaa

SEQ ID NO: 577108 - DNA, 20 bp, Artificial Sequence
  chemically synthesized
ctctggtagcgcatcaaaaa

SEQ ID NO: 577109 - DNA, 20 bp, Artificial Sequence
  chemically synthesized
catttataggccagcctcat

SEQ ID NO: 577110 - DNA, 20 bp, Artificial Sequence
  chemically synthesized
agatgaggctggcctataaa

SEQ ID NO: 577111 - DNA, 20 bp, Artificial Sequence
  chemically synthesized
agtaccagttgtatctacca

SEQ ID NO: 577112 - DNA, 20 bp, Artificial Sequence
  chemically synthesized
ttttccaaggtgacgcattg

SEQ ID NO: 577113 - DNA, 20 bp, Artificial Sequence
  chemically synthesized
cttgttgaaaattatgaata

SEQ ID NO: 577114 - DNA, 20 bp, Artificial Sequence
  chemically synthesized
agctgtgaacttattgaagg

SEQ ID NO: 577115 - DNA, 20 bp, Artificial Sequence
  chemically synthesized
agctgataaaggctctaaaa

SEQ ID NO: 577116 - DNA, 20 bp, Artificial Sequence
  chemically synthesized
ttagcatacccattggaaag

SEQ ID NO: 577117 - DNA, 20 bp, Artificial Sequence
  chemically synthesized
tgggtatgctaaggcacatg

SEQ ID NO: 577118 - DNA, 20 bp, Artificial Sequence
  chemically synthesized
tctcagccctgggatggtta

SEQ ID NO: 577119 - DNA, 20 bp, Artificial Sequence
  chemically synthesized
taggcagcttagagtcttcg

SEQ ID NO: 577120 - DNA, 20 bp, Artificial Sequence
  chemically synthesized
gtctttttgatatcatgatg

SEQ ID NO: 577121 - DNA, 20 bp, Artificial Sequence
  chemically synthesized
aagactgaggaacactgcag

SEQ ID NO: 577122 - DNA, 20 bp, Artificial Sequence
  chemically synthesized
gaggaacactgcagagaagt

SEQ ID NO: 577123 - DNA, 20 bp, Artificial Sequence
  chemically synthesized
cttacagaacagactgactg

SEQ ID NO: 577124 - DNA, 20 bp, Artificial Sequence
  chemically synthesized
agggagatctggagaccaga

SEQ ID NO: 577125 - DNA, 20 bp, Artificial Sequence
  chemically synthesized
ttccaagaagtgtgataaat

SEQ ID NO: 577126 - DNA, 20 bp, Artificial Sequence
  chemically synthesized
cacctgtcttctggcttaag

SEQ ID NO: 577127 - DNA, 20 bp, Artificial Sequence
  chemically synthesized
acaaagactctcacctgtct

SEQ ID NO: 577128 - DNA, 20 bp, Artificial Sequence
  chemically synthesized
gagtctttgtgaacatttca

SEQ ID NO: 577129 - DNA, 20 bp, Artificial Sequence
  chemically synthesized
tcttgacatgtcttaatgtt

SEQ ID NO: 577130 - DNA, 20 bp, Artificial Sequence
  chemically synthesized
tccaacaacattaagacatg

SEQ ID NO: 577131 - DNA, 20 bp, Artificial Sequence
  chemically synthesized
attaagacatgtcaagatta

SEQ ID NO: 577132 - DNA, 20 bp, Artificial Sequence
  chemically synthesized
acatgtcaagattagcaagc

SEQ ID NO: 577133 - DNA, 20 bp, Artificial Sequence
  chemically synthesized
tgcacttttatcacacaatc

SEQ ID NO: 577134 - DNA, 20 bp, Artificial Sequence
  chemically synthesized
aacaattctacccattggcc

SEQ ID NO: 577135 - DNA, 20 bp, Artificial Sequence
  chemically synthesized
tttaggtggttcaaaggagc

SEQ ID NO: 577136 - DNA, 20 bp, Artificial Sequence
  chemically synthesized
ctcctttgaaccacctaaat

SEQ ID NO: 577137 - DNA, 20 bp, Artificial Sequence
  chemically synthesized
gcaaaccacattttgggaaa

SEQ ID NO: 577138 - DNA, 20 bp, Artificial Sequence
  chemically synthesized
taaatcgctgtttcccaaaa

SEQ ID NO: 577139 - DNA, 20 bp, Artificial Sequence
  chemically synthesized
tttaccatgttacacagata

SEQ ID NO: 577140 - DNA, 20 bp, Artificial Sequence
  chemically synthesized
tgttacacagataaacagct

SEQ ID NO: 577141 - DNA, 20 bp, Artificial Sequence
  chemically synthesized
atattaaaatttaaactata

SEQ ID NO: 577142 - DNA, 20 bp, Artificial Sequence
  chemically synthesized
agtttaaattttaatattca

SEQ ID NO: 577143 - DNA, 20 bp, Artificial Sequence
  chemically synthesized
aaaactgtagtctgatgttg

SEQ ID NO: 577144 - DNA, 20 bp, Artificial Sequence
  chemically synthesized
aaaacactgcaacatcagac

SEQ ID NO: 577145 - DNA, 20 bp, Artificial Sequence
  chemically synthesized
taaaatcagctcattttgtt

SEQ ID NO: 577146 - DNA, 20 bp, Artificial Sequence
  chemically synthesized
taaaagcagaaaacaaaatg

SEQ ID NO: 577147 - DNA, 20 bp, Artificial Sequence
  chemically synthesized
tttttcttaaaatcagctca

SEQ ID NO: 577148 - DNA, 20 bp, Artificial Sequence
  chemically synthesized
cacatatactattatttact

SEQ ID NO: 577149 - DNA, 20 bp, Artificial Sequence
  chemically synthesized
taatagtatatgtgttattc

SEQ ID NO: 577150 - DNA, 20 bp, Artificial Sequence
  chemically synthesized
gattgaacaatggagcgtat

SEQ ID NO: 577151 - DNA, 20 bp, Artificial Sequence
  chemically synthesized
tggagcgtatatttgtttcc

SEQ ID NO: 577152 - DNA, 20 bp, Artificial Sequence
  chemically synthesized
atttgtgttgttttaggcca

SEQ ID NO: 577153 - DNA, 20 bp, Artificial Sequence
  chemically synthesized
tactggcctaaaacaacaca

SEQ ID NO: 577154 - DNA, 20 bp, Artificial Sequence
  chemically synthesized
actataagataatcaatttg

SEQ ID NO: 577155 - DNA, 20 bp, Artificial Sequence
  chemically synthesized
acaacacaaattgattatct

SEQ ID NO: 577156 - DNA, 20 bp, Artificial Sequence
  chemically synthesized
atcttatagttttggaagtc

SEQ ID NO: 577157 - DNA, 20 bp, Artificial Sequence
  chemically synthesized
ttggaagtcagaagtttgaa

SEQ ID NO: 577158 - DNA, 20 bp, Artificial Sequence
  chemically synthesized
cagaagtttgaaatgggttt

SEQ ID NO: 577159 - DNA, 20 bp, Artificial Sequence
  chemically synthesized
cagggctatactccttctga

SEQ ID NO: 577160 - DNA, 20 bp, Artificial Sequence
  chemically synthesized
gcagggaaatagattgtcct

SEQ ID NO: 577161 - DNA, 20 bp, Artificial Sequence
  chemically synthesized
aatgctggaaaaggcaggga

SEQ ID NO: 577162 - DNA, 20 bp, Artificial Sequence
  chemically synthesized
ccagcattagatgctaccaa

SEQ ID NO: 577163 - DNA, 20 bp, Artificial Sequence
  chemically synthesized
gagagatgaagatagcccct

SEQ ID NO: 577164 - DNA, 20 bp, Artificial Sequence
  chemically synthesized
catctctctgactcccactc

SEQ ID NO: 577165 - DNA, 20 bp, Artificial Sequence
  chemically synthesized
tcacttatatgaaccctgtg

SEQ ID NO: 577166 - DNA, 20 bp, Artificial Sequence
  chemically synthesized
aagcaggtgactttgagatg

SEQ ID NO: 577167 - DNA, 20 bp, Artificial Sequence
  chemically synthesized
aatctccccatctcaaagtc

SEQ ID NO: 577168 - DNA, 20 bp, Artificial Sequence
  chemically synthesized
cacagcatattcacaggttc

SEQ ID NO: 577169 - DNA, 20 bp, Artificial Sequence
  chemically synthesized
gattaacatcttcgaggggc

SEQ ID NO: 577170 - DNA, 20 bp, Artificial Sequence
  chemically synthesized
ctaccacagggggaaataaa

SEQ ID NO: 577171 - DNA, 20 bp, Artificial Sequence
  chemically synthesized
gcaatatccgattggctaaa

SEQ ID NO: 577172 - DNA, 20 bp, Artificial Sequence
  chemically synthesized
gctttagccaatcggatatt

SEQ ID NO: 577173 - DNA, 20 bp, Artificial Sequence
  chemically synthesized
gcttccattaagcctgcaat

SEQ ID NO: 577174 - DNA, 20 bp, Artificial Sequence
  chemically synthesized
atgtaaacaatttgttgagc

SEQ ID NO: 577175 - DNA, 20 bp, Artificial Sequence
  chemically synthesized
atggaagcaggggctcaaca

SEQ ID NO: 577176 - DNA, 20 bp, Artificial Sequence
  chemically synthesized
aggggctcaacaaattgttt

SEQ ID NO: 577177 - DNA, 20 bp, Artificial Sequence
  chemically synthesized
tgggaatctggagggtagct

SEQ ID NO: 577178 - DNA, 20 bp, Artificial Sequence
  chemically synthesized
acttaagctctcagctaccc

SEQ ID NO: 577179 - DNA, 20 bp, Artificial Sequence
  chemically synthesized
tgggctgatggtttacattg

SEQ ID NO: 577180 - DNA, 20 bp, Artificial Sequence
  chemically synthesized
agttcactaatttgtgggct

SEQ ID NO: 577181 - DNA, 20 bp, Artificial Sequence
  chemically synthesized
tagtgaactcaagaagtacc

SEQ ID NO: 577182 - DNA, 20 bp, Artificial Sequence
  chemically synthesized
gtacctactgttttaagcta

SEQ ID NO: 577183 - DNA, 20 bp, Artificial Sequence
  chemically synthesized
accaaaccgcctcaaaactc

SEQ ID NO: 577184 - DNA, 20 bp, Artificial Sequence
  chemically synthesized
tttaagctactgagttttga

SEQ ID NO: 577185 - DNA, 20 bp, Artificial Sequence
  chemically synthesized
ggtaaatcttgttttgtttt

SEQ ID NO: 577186 - DNA, 20 bp, Artificial Sequence
  chemically synthesized
aggtaaactattaaaacaaa

SEQ ID NO: 577187 - DNA, 20 bp, Artificial Sequence
  chemically synthesized
acagtggatggtaaatcttg

SEQ ID NO: 577188 - DNA, 20 bp, Artificial Sequence
  chemically synthesized
tggtaacagtggatggtaaa

SEQ ID NO: 577189 - DNA, 20 bp, Artificial Sequence
  chemically synthesized
tttaggctgagactatgtct

SEQ ID NO: 577190 - DNA, 20 bp, Artificial Sequence
  chemically synthesized
agaaaggaggatgacaagct

SEQ ID NO: 577191 - DNA, 20 bp, Artificial Sequence
  chemically synthesized
aaagagaaattatttaagct

SEQ ID NO: 577192 - DNA, 20 bp, Artificial Sequence
  chemically synthesized
gagagagaaagagaaattat

SEQ ID NO: 577193 - DNA, 20 bp, Artificial Sequence
  chemically synthesized
tgtccttatagttctcattt

SEQ ID NO: 577194 - DNA, 20 bp, Artificial Sequence
  chemically synthesized
caaatgcagatgatctgtga

SEQ ID NO: 577195 - DNA, 20 bp, Artificial Sequence
  chemically synthesized
ctgccacacacgacttaatg

SEQ ID NO: 577196 - DNA, 20 bp, Artificial Sequence
  chemically synthesized
actcatttaacaacattctt

SEQ ID NO: 577197 - DNA, 20 bp, Artificial Sequence
  chemically synthesized
tgtgaatgacttaattcaca

SEQ ID NO: 577198 - DNA, 20 bp, Artificial Sequence
  chemically synthesized
tttttttctagaagttttca

SEQ ID NO: 577199 - DNA, 20 bp, Artificial Sequence
  chemically synthesized
tttctctataatttttttct

SEQ ID NO: 577200 - DNA, 20 bp, Artificial Sequence
  chemically synthesized
cagcttcccataaagtccca

SEQ ID NO: 577201 - DNA, 20 bp, Artificial Sequence
  chemically synthesized
ggcgcagcttcccataaagt

SEQ ID NO: 577202 - DNA, 20 bp, Artificial Sequence
  chemically synthesized
gtccttttaaattagcaagg

SEQ ID NO: 577203 - DNA, 20 bp, Artificial Sequence
  chemically synthesized
aaaaggacacactgactaca

SEQ ID NO: 577204 - DNA, 20 bp, Artificial Sequence
  chemically synthesized
gacacactgactacatgctg

SEQ ID NO: 577205 - DNA, 20 bp, Artificial Sequence
  chemically synthesized
catgctgattggcttggggg

SEQ ID NO: 577206 - DNA, 20 bp, Artificial Sequence
  chemically synthesized
ctgattggcttggggggaag

SEQ ID NO: 577207 - DNA, 20 bp, Artificial Sequence
  chemically synthesized
gggggaaggattgcttacca

SEQ ID NO: 577208 - DNA, 20 bp, Artificial Sequence
  chemically synthesized
aaggattgcttaccatgttg

SEQ ID NO: 577209 - DNA, 20 bp, Artificial Sequence
  chemically synthesized
cgaattttccttaccatggt

SEQ ID NO: 577210 - DNA, 20 bp, Artificial Sequence
  chemically synthesized
attaaatcttcataacacct

SEQ ID NO: 577211 - DNA, 20 bp, Artificial Sequence
  chemically synthesized
aattaatcaataaggtgtta

SEQ ID NO: 577212 - DNA, 20 bp, Artificial Sequence
  chemically synthesized
tgtcaaatacactttaaaaa

SEQ ID NO: 577213 - DNA, 20 bp, Artificial Sequence
  chemically synthesized
tagacctggaagttttcaaa

SEQ ID NO: 577214 - DNA, 20 bp, Artificial Sequence
  chemically synthesized
gacatgtgctaaatagacct

SEQ ID NO: 577215 - DNA, 20 bp, Artificial Sequence
  chemically synthesized
ctatttagcacatgtcgtag

SEQ ID NO: 577216 - DNA, 20 bp, Artificial Sequence
  chemically synthesized
attccagtgggataaaaaac

SEQ ID NO: 577217 - DNA, 20 bp, Artificial Sequence
  chemically synthesized
ttgtcaatatagaaaaaaac

SEQ ID NO: 577218 - DNA, 20 bp, Artificial Sequence
  chemically synthesized
tttttttctatattgacaaa

SEQ ID NO: 577219 - DNA, 20 bp, Artificial Sequence
  chemically synthesized
gagttattataattaagaat

SEQ ID NO: 577220 - DNA, 20 bp, Artificial Sequence
  chemically synthesized
gtttattaatattccactgt

SEQ ID NO: 577221 - DNA, 20 bp, Artificial Sequence
  chemically synthesized
gtacagtggaatattaataa

SEQ ID NO: 577222 - DNA, 20 bp, Artificial Sequence
  chemically synthesized
atataaccagagaatataaa

SEQ ID NO: 577223 - DNA, 20 bp, Artificial Sequence
  chemically synthesized
ttagaaggcactacagtgca

SEQ ID NO: 577224 - DNA, 20 bp, Artificial Sequence
  chemically synthesized
tgcatattgttttatcaagg

SEQ ID NO: 577225 - DNA, 20 bp, Artificial Sequence
  chemically synthesized
ttttatcaagggcaagttta

SEQ ID NO: 577226 - DNA, 20 bp, Artificial Sequence
  chemically synthesized
agttatcttttcaaaaaata

SEQ ID NO: 577227 - DNA, 20 bp, Artificial Sequence
  chemically synthesized
tgccattgaaattttactat

SEQ ID NO: 577228 - DNA, 20 bp, Artificial Sequence
  chemically synthesized
aaatttctttcgactttgct

SEQ ID NO: 577229 - DNA, 20 bp, Artificial Sequence
  chemically synthesized
caatttaggattattgttgt

SEQ ID NO: 577230 - DNA, 20 bp, Artificial Sequence
  chemically synthesized
aaagatacagtgcttacaat

SEQ ID NO: 577231 - DNA, 20 bp, Artificial Sequence
  chemically synthesized
tatacaagtatgtaaagata

SEQ ID NO: 577232 - DNA, 20 bp, Artificial Sequence
  chemically synthesized
agctaattccttttctgtaa

SEQ ID NO: 577233 - DNA, 20 bp, Artificial Sequence
  chemically synthesized
gtgccagatatttcagtgtt

SEQ ID NO: 577234 - DNA, 20 bp, Artificial Sequence
  chemically synthesized
tattttattattattatact

SEQ ID NO: 577235 - DNA, 20 bp, Artificial Sequence
  chemically synthesized
aaaaattgaaatatctgaaa

SEQ ID NO: 577236 - DNA, 20 bp, Artificial Sequence
  chemically synthesized
gatgaacacgccccctaaaa

SEQ ID NO: 577237 - DNA, 20 bp, Artificial Sequence
  chemically synthesized
ttcatcctgtacaacttact

SEQ ID NO: 577238 - DNA, 20 bp, Artificial Sequence
  chemically synthesized
tatggaccagaggtctagtc

SEQ ID NO: 577239 - DNA, 20 bp, Artificial Sequence
  chemically synthesized
gtggaagaaatggggccttg

SEQ ID NO: 577240 - DNA, 20 bp, Artificial Sequence
  chemically synthesized
tgatgccgtcacccccatac

SEQ ID NO: 577241 - DNA, 20 bp, Artificial Sequence
  chemically synthesized
aagaccagtgaacaagttac

SEQ ID NO: 577242 - DNA, 20 bp, Artificial Sequence
  chemically synthesized
agggtgactaaagggcttaa

SEQ ID NO: 577243 - DNA, 20 bp, Artificial Sequence
  chemically synthesized
tctgtttcttagggtgacta

SEQ ID NO: 577244 - DNA, 20 bp, Artificial Sequence
  chemically synthesized
ctcagtttcctcataaagtt

SEQ ID NO: 577245 - DNA, 20 bp, Artificial Sequence
  chemically synthesized
ttctagcctcagtttcctca

SEQ ID NO: 577246 - DNA, 20 bp, Artificial Sequence
  chemically synthesized
tatgaggaaactgaggctag

SEQ ID NO: 577247 - DNA, 20 bp, Artificial Sequence
  chemically synthesized
atttttaaatctcttctagc

SEQ ID NO: 577248 - DNA, 20 bp, Artificial Sequence
  chemically synthesized
ttaaaaatttgccaacggtg

SEQ ID NO: 577249 - DNA, 20 bp, Artificial Sequence
  chemically synthesized
ggtgacaagattcgaatcag

SEQ ID NO: 577250 - DNA, 20 bp, Artificial Sequence
  chemically synthesized
atcactgtgaagtcaagcat

SEQ ID NO: 577251 - DNA, 20 bp, Artificial Sequence
  chemically synthesized
gatttttctctatgattctc

SEQ ID NO: 577252 - DNA, 20 bp, Artificial Sequence
  chemically synthesized
atagagaatcatagagaaaa

SEQ ID NO: 577253 - DNA, 20 bp, Artificial Sequence
  chemically synthesized
gtcttaaagcagatttttct

SEQ ID NO: 577254 - DNA, 20 bp, Artificial Sequence
  chemically synthesized
acctcctaagtctgtcttaa

SEQ ID NO: 577255 - DNA, 20 bp, Artificial Sequence
  chemically synthesized
agagaagtctcaccagaatc

SEQ ID NO: 577256 - DNA, 20 bp, Artificial Sequence
  chemically synthesized
tctcaccagaatcagaagtt

SEQ ID NO: 577257 - DNA, 20 bp, Artificial Sequence
  chemically synthesized
caattatttaagctagaaac

SEQ ID NO: 577258 - DNA, 20 bp, Artificial Sequence
  chemically synthesized
aaatagagaatagaggcagt

SEQ ID NO: 577259 - DNA, 20 bp, Artificial Sequence
  chemically synthesized
gaatagaggcagtaggggat

SEQ ID NO: 577260 - DNA, 20 bp, Artificial Sequence
  chemically synthesized
taagactcaaaatatttgac

SEQ ID NO: 577261 - DNA, 20 bp, Artificial Sequence
  chemically synthesized
gtagtgttttctctatttgg

SEQ ID NO: 577262 - DNA, 20 bp, Artificial Sequence
  chemically synthesized
cacaggtagggtgtactgag

SEQ ID NO: 577263 - DNA, 20 bp, Artificial Sequence
  chemically synthesized
cactactcagtacaccctac

SEQ ID NO: 577264 - DNA, 20 bp, Artificial Sequence
  chemically synthesized
aagaggggtacataggcagc

SEQ ID NO: 577265 - DNA, 20 bp, Artificial Sequence
  chemically synthesized
cagcatatgctttgagagtc

SEQ ID NO: 577266 - DNA, 20 bp, Artificial Sequence
  chemically synthesized
ggacatttgagtctctttcc

SEQ ID NO: 577267 - DNA, 20 bp, Artificial Sequence
  chemically synthesized
gttctctaacaccctcttcc

SEQ ID NO: 577268 - DNA, 20 bp, Artificial Sequence
  chemically synthesized
ccccctgccaaattgcctga

SEQ ID NO: 577269 - DNA, 20 bp, Artificial Sequence
  chemically synthesized
caatttggcagggggtaggc

SEQ ID NO: 577270 - DNA, 20 bp, Artificial Sequence
  chemically synthesized
ctattgattttcttagtgag

SEQ ID NO: 577271 - DNA, 20 bp, Artificial Sequence
  chemically synthesized
tcttttctttttttaaagtt

SEQ ID NO: 577272 - DNA, 20 bp, Artificial Sequence
  chemically synthesized
gtggtacatgtgcaggatgt

SEQ ID NO: 577273 - DNA, 20 bp, Artificial Sequence
  chemically synthesized
cataggtaaacatgtgccat

SEQ ID NO: 577274 - DNA, 20 bp, Artificial Sequence
  chemically synthesized
gtgcagcaaaccaccatggc

SEQ ID NO: 577275 - DNA, 20 bp, Artificial Sequence
  chemically synthesized
atatattttattattatact

SEQ ID NO: 577276 - DNA, 20 bp, Artificial Sequence
  chemically synthesized
cacctgtgagtgagaacatg

SEQ ID NO: 577277 - DNA, 20 bp, Artificial Sequence
  chemically synthesized
gtgagtgagaacatgtggtg

SEQ ID NO: 577278 - DNA, 20 bp, Artificial Sequence
  chemically synthesized
gtttggttttttgtccttgc

SEQ ID NO: 577279 - DNA, 20 bp, Artificial Sequence
  chemically synthesized
tgccatagtttgctgagaat

SEQ ID NO: 577280 - DNA, 20 bp, Artificial Sequence
  chemically synthesized
gtttgctgagaatgatggtt

SEQ ID NO: 577281 - DNA, 20 bp, Artificial Sequence
  chemically synthesized
caaatgtccaacaatgatag

SEQ ID NO: 577282 - DNA, 20 bp, Artificial Sequence
  chemically synthesized
ggaaaaatagctaatgcatg

SEQ ID NO: 577283 - DNA, 20 bp, Artificial Sequence
  chemically synthesized
tttaagtgagaacatgtgat

SEQ ID NO: 577284 - DNA, 20 bp, Artificial Sequence
  chemically synthesized
atttgcttttctgttcctgt

SEQ ID NO: 577285 - DNA, 20 bp, Artificial Sequence
  chemically synthesized
tgtgttagtttgctgaggat

SEQ ID NO: 577286 - DNA, 20 bp, Artificial Sequence
  chemically synthesized
ctttgggtatataaccaata

SEQ ID NO: 577287 - DNA, 20 bp, Artificial Sequence
  chemically synthesized
tgcatgtatctttaaaatag

SEQ ID NO: 577288 - DNA, 20 bp, Artificial Sequence
  chemically synthesized
ctatcactgatgggcatttg

SEQ ID NO: 577289 - DNA, 20 bp, Artificial Sequence
  chemically synthesized
gaacacatatggagctgtgc

SEQ ID NO: 577290 - DNA, 20 bp, Artificial Sequence
  chemically synthesized
ggagctgtgctacagtttca

SEQ ID NO: 577291 - DNA, 20 bp, Artificial Sequence
  chemically synthesized
ggggtgaaggagcagcaccg

SEQ ID NO: 577292 - DNA, 20 bp, Artificial Sequence
  chemically synthesized
cagcaccggtaagcttggac

SEQ ID NO: 577293 - DNA, 20 bp, Artificial Sequence
  chemically synthesized
accggtaagcttggacaatt

SEQ ID NO: 577294 - DNA, 20 bp, Artificial Sequence
  chemically synthesized
tttaacaaacaaacaattgt

SEQ ID NO: 577295 - DNA, 20 bp, Artificial Sequence
  chemically synthesized
cttcctactgatcctttgct

SEQ ID NO: 577296 - DNA, 20 bp, Artificial Sequence
  chemically synthesized
gacttaaaaagtatagaagg

SEQ ID NO: 577297 - DNA, 20 bp, Artificial Sequence
  chemically synthesized
atagtcacacaatagccaga

SEQ ID NO: 577298 - DNA, 20 bp, Artificial Sequence
  chemically synthesized
tgtgagccaccgcgcctcat

SEQ ID NO: 577299 - DNA, 20 bp, Artificial Sequence
  chemically synthesized
cacctcagcctcccaaagtg

SEQ ID NO: 577300 - DNA, 20 bp, Artificial Sequence
  chemically synthesized
tgggcagatcacttgagcct

SEQ ID NO: 577301 - DNA, 20 bp, Artificial Sequence
  chemically synthesized
tttgtatttttttgcagaga

SEQ ID NO: 577302 - DNA, 20 bp, Artificial Sequence
  chemically synthesized
ggtcccaccctctggagttt

SEQ ID NO: 577303 - DNA, 20 bp, Artificial Sequence
  chemically synthesized
ctaacagtggtcccaccctc

SEQ ID NO: 577304 - DNA, 20 bp, Artificial Sequence
  chemically synthesized
gccctgtgaacaatttaata

SEQ ID NO: 577305 - DNA, 20 bp, Artificial Sequence
  chemically synthesized
aagctgaggttagctttgtg

SEQ ID NO: 577306 - DNA, 20 bp, Artificial Sequence
  chemically synthesized
aaaccaaccacaaagctaac

SEQ ID NO: 577307 - DNA, 20 bp, Artificial Sequence
  chemically synthesized
aatttggaaaaaaagctgag

SEQ ID NO: 577308 - DNA, 20 bp, Artificial Sequence
  chemically synthesized
ctttttttccaaattatccc

SEQ ID NO: 577309 - DNA, 20 bp, Artificial Sequence
  chemically synthesized
cccttttgcttgctatgaac

SEQ ID NO: 577310 - DNA, 20 bp, Artificial Sequence
  chemically synthesized
tggtgataattttgcccata

SEQ ID NO: 577311 - DNA, 20 bp, Artificial Sequence
  chemically synthesized
tattttgttttatttttgcc

SEQ ID NO: 577312 - DNA, 20 bp, Artificial Sequence
  chemically synthesized
gaatgaggcctaaagactta

SEQ ID NO: 577313 - DNA, 20 bp, Artificial Sequence
  chemically synthesized
tctttaggcctcattcttta

SEQ ID NO: 577314 - DNA, 20 bp, Artificial Sequence
  chemically synthesized
taggaggttttgctggccta

SEQ ID NO: 577315 - DNA, 20 bp, Artificial Sequence
  chemically synthesized
gttttgctggcctaaattgt

SEQ ID NO: 577316 - DNA, 20 bp, Artificial Sequence
  chemically synthesized
ctttttaatggtattttaat

SEQ ID NO: 577317 - DNA, 20 bp, Artificial Sequence
  chemically synthesized
ttcccaggggatactattgt

SEQ ID NO: 577318 - DNA, 20 bp, Artificial Sequence
  chemically synthesized
atcaggcccctctcataact

SEQ ID NO: 577319 - DNA, 20 bp, Artificial Sequence
  chemically synthesized
tatatacagagattttcttc

SEQ ID NO: 577320 - DNA, 20 bp, Artificial Sequence
  chemically synthesized
caatgaagaaaatctctgta

SEQ ID NO: 577321 - DNA, 20 bp, Artificial Sequence
  chemically synthesized
accaaaaaaaaaactatata

SEQ ID NO: 577322 - DNA, 20 bp, Artificial Sequence
  chemically synthesized
tctctgtatatagttttttt

SEQ ID NO: 577323 - DNA, 20 bp, Artificial Sequence
  chemically synthesized
tgtatatagttttttttttg

SEQ ID NO: 577324 - DNA, 20 bp, Artificial Sequence
  chemically synthesized
tatagttttttttttggttt

SEQ ID NO: 577325 - DNA, 20 bp, Artificial Sequence
  chemically synthesized
tttttttttggtttgtttgt

SEQ ID NO: 577326 - DNA, 20 bp, Artificial Sequence
  chemically synthesized
tttttggtttgtttgttttt

SEQ ID NO: 577327 - DNA, 20 bp, Artificial Sequence
  chemically synthesized
tggtttgtttgtttttgttt

SEQ ID NO: 577328 - DNA, 20 bp, Artificial Sequence
  chemically synthesized
gtttgttttttaatggttct

SEQ ID NO: 577329 - DNA, 20 bp, Artificial Sequence
  chemically synthesized
cacattgctcacaaatttcc

SEQ ID NO: 577330 - DNA, 20 bp, Artificial Sequence
  chemically synthesized
agattgaatggtcccatgcc

SEQ ID NO: 577331 - DNA, 20 bp, Artificial Sequence
  chemically synthesized
tactagaggacttgtagaaa

SEQ ID NO: 577332 - DNA, 20 bp, Artificial Sequence
  chemically synthesized
tgtatttctacaagtcctct

SEQ ID NO: 577333 - DNA, 20 bp, Artificial Sequence
  chemically synthesized
gttcaagtcggccctaaagt

SEQ ID NO: 577334 - DNA, 20 bp, Artificial Sequence
  chemically synthesized
gtgttggatttataacctat

SEQ ID NO: 577335 - DNA, 20 bp, Artificial Sequence
  chemically synthesized
ttttatttttcccccgacat

SEQ ID NO: 577336 - DNA, 20 bp, Artificial Sequence
  chemically synthesized
tgtcgggggaaaaataaaaa

SEQ ID NO: 577337 - DNA, 20 bp, Artificial Sequence
  chemically synthesized
attcctttagctcttgaatt

SEQ ID NO: 577338 - DNA, 20 bp, Artificial Sequence
  chemically synthesized
gagctaaaggaatctcagga

SEQ ID NO: 577339 - DNA, 20 bp, Artificial Sequence
  chemically synthesized
tatctttgctaatcattgtc

SEQ ID NO: 577340 - DNA, 20 bp, Artificial Sequence
  chemically synthesized
agagaacgtggactaacaca

SEQ ID NO: 577341 - DNA, 20 bp, Artificial Sequence
  chemically synthesized
tgtagcttttaaatagtata

SEQ ID NO: 577342 - DNA, 20 bp, Artificial Sequence
  chemically synthesized
attctgagatttagcacata

SEQ ID NO: 577343 - DNA, 20 bp, Artificial Sequence
  chemically synthesized
agcacatggaaagaagaatt

SEQ ID NO: 577344 - DNA, 20 bp, Artificial Sequence
  chemically synthesized
cagaattcttctttccatgt

SEQ ID NO: 577345 - DNA, 20 bp, Artificial Sequence
  chemically synthesized
taatacactgcatttagtaa

SEQ ID NO: 577346 - DNA, 20 bp, Artificial Sequence
  chemically synthesized
gcatttttctcacattgaaa

SEQ ID NO: 577347 - DNA, 20 bp, Artificial Sequence
  chemically synthesized
catgaaaatgttgcccttta

SEQ ID NO: 577348 - DNA, 20 bp, Artificial Sequence
  chemically synthesized
tataaacaggaatagtcaag

SEQ ID NO: 577349 - DNA, 20 bp, Artificial Sequence
  chemically synthesized
aaaaagcttcccttgactat

SEQ ID NO: 577350 - DNA, 20 bp, Artificial Sequence
  chemically synthesized
gtttatattcttgatagcag

SEQ ID NO: 577351 - DNA, 20 bp, Artificial Sequence
  chemically synthesized
cagcctatctttagagtagc

SEQ ID NO: 577352 - DNA, 20 bp, Artificial Sequence
  chemically synthesized
ccttgtcagcctatctttag

SEQ ID NO: 577353 - DNA, 20 bp, Artificial Sequence
  chemically synthesized
accatgaatcttagaatcaa

SEQ ID NO: 577354 - DNA, 20 bp, Artificial Sequence
  chemically synthesized
tgattcaaacgttcttgatt

SEQ ID NO: 577355 - DNA, 20 bp, Artificial Sequence
  chemically synthesized
aaatgtcttgattcaaacgt

SEQ ID NO: 577356 - DNA, 20 bp, Artificial Sequence
  chemically synthesized
cagattggctctgagaaatg

SEQ ID NO: 577357 - DNA, 20 bp, Artificial Sequence
  chemically synthesized
acatataaatatacacatat

SEQ ID NO: 577358 - DNA, 20 bp, Artificial Sequence
  chemically synthesized
agcgtataaccttttgatca

SEQ ID NO: 577359 - DNA, 20 bp, Artificial Sequence
  chemically synthesized
tcttgaaaggcagtttcaaa

SEQ ID NO: 577360 - DNA, 20 bp, Artificial Sequence
  chemically synthesized
tttttgaaactgcctttcaa

SEQ ID NO: 577361 - DNA, 20 bp, Artificial Sequence
  chemically synthesized
aattgcaaactgtcttgaaa

SEQ ID NO: 577362 - DNA, 20 bp, Artificial Sequence
  chemically synthesized
tctactttttttatttgaaa

SEQ ID NO: 577363 - DNA, 20 bp, Artificial Sequence
  chemically synthesized
atttgaaaaattgattgcat

SEQ ID NO: 577364 - DNA, 20 bp, Artificial Sequence
  chemically synthesized
agaattctaacttacaggta

SEQ ID NO: 577365 - DNA, 20 bp, Artificial Sequence
  chemically synthesized
aaattgtgtttccttcgaac

SEQ ID NO: 577366 - DNA, 20 bp, Artificial Sequence
  chemically synthesized
ctcctcctgtctaattgaaa

SEQ ID NO: 577367 - DNA, 20 bp, Artificial Sequence
  chemically synthesized
gtgaggtaatgcatacgata

SEQ ID NO: 577368 - DNA, 20 bp, Artificial Sequence
  chemically synthesized
ggtaatgcatacgataattg

SEQ ID NO: 577369 - DNA, 20 bp, Artificial Sequence
  chemically synthesized
tatattcatggtgtacaaca

SEQ ID NO: 577370 - DNA, 20 bp, Artificial Sequence
  chemically synthesized
atacaactgatttttaatta

SEQ ID NO: 577371 - DNA, 20 bp, Artificial Sequence
  chemically synthesized
acaagcaacttaagtaatac

SEQ ID NO: 577372 - DNA, 20 bp, Artificial Sequence
  chemically synthesized
aaaatcagttgtattactta

SEQ ID NO: 577373 - DNA, 20 bp, Artificial Sequence
  chemically synthesized
aactgcttcataattatttg

SEQ ID NO: 577374 - DNA, 20 bp, Artificial Sequence
  chemically synthesized
tggctttgccagcatgcatg

SEQ ID NO: 577375 - DNA, 20 bp, Artificial Sequence
  chemically synthesized
aggcacttacgaatggcttg

SEQ ID NO: 577376 - DNA, 20 bp, Artificial Sequence
  chemically synthesized
gccaacgagaggcacttacg

SEQ ID NO: 577377 - DNA, 20 bp, Artificial Sequence
  chemically synthesized
gcccttatgactttttctgg

SEQ ID NO: 577378 - DNA, 20 bp, Artificial Sequence
  chemically synthesized
gctccattctcaatggtcag

SEQ ID NO: 577379 - DNA, 20 bp, Artificial Sequence
  chemically synthesized
ttctcaatggtcagcgaggc

SEQ ID NO: 577380 - DNA, 20 bp, Artificial Sequence
  chemically synthesized
ttaagctgaaataaagattt

SEQ ID NO: 577381 - DNA, 20 bp, Artificial Sequence
  chemically synthesized
ataagctcccaaatctttat

SEQ ID NO: 577382 - DNA, 20 bp, Artificial Sequence
  chemically synthesized
gatagaatattaagctgaaa

SEQ ID NO: 577383 - DNA, 20 bp, Artificial Sequence
  chemically synthesized
gaacactgatttaggacgtg

SEQ ID NO: 577384 - DNA, 20 bp, Artificial Sequence
  chemically synthesized
gagggaccaggctttgagaa

SEQ ID NO: 577385 - DNA, 20 bp, Artificial Sequence
  chemically synthesized
ttgatgccgctggtgaggga

SEQ ID NO: 577386 - DNA, 20 bp, Artificial Sequence
  chemically synthesized
tgcatttctacaaagttctt

SEQ ID NO: 577387 - DNA, 20 bp, Artificial Sequence
  chemically synthesized
ctccccagacctccccaatt

SEQ ID NO: 577388 - DNA, 20 bp, Artificial Sequence
  chemically synthesized
tgcagatgaccgttttaccc

SEQ ID NO: 577389 - DNA, 20 bp, Artificial Sequence
  chemically synthesized
aaacttgttaatatgcagat

SEQ ID NO: 577390 - DNA, 20 bp, Artificial Sequence
  chemically synthesized
aaacggtcatctgcatatta

SEQ ID NO: 577391 - DNA, 20 bp, Artificial Sequence
  chemically synthesized
tgcatattaacaagttttcc

SEQ ID NO: 577392 - DNA, 20 bp, Artificial Sequence
  chemically synthesized
ccaggagattccagtggagc

SEQ ID NO: 577393 - DNA, 20 bp, Artificial Sequence
  chemically synthesized
ccactgtcctatatcatgcc

SEQ ID NO: 577394 - DNA, 20 bp, Artificial Sequence
  chemically synthesized
gcgtttactctgtgtattta

SEQ ID NO: 577395 - DNA, 20 bp, Artificial Sequence
  chemically synthesized
aaaaaatttccatattttat

SEQ ID NO: 577396 - DNA, 20 bp, Artificial Sequence
  chemically synthesized
aacttgtaaacttgctccct

SEQ ID NO: 577397 - DNA, 20 bp, Artificial Sequence
  chemically synthesized
tccaacaaatccacaaggga

SEQ ID NO: 577398 - DNA, 20 bp, Artificial Sequence
  chemically synthesized
acttgctcccttgtggattt

SEQ ID NO: 577399 - DNA, 20 bp, Artificial Sequence
  chemically synthesized
gctcccttgtggatttgttg

SEQ ID NO: 577400 - DNA, 20 bp, Artificial Sequence
  chemically synthesized
gggatacggactttggatta

SEQ ID NO: 577401 - DNA, 20 bp, Artificial Sequence
  chemically synthesized
aggtagttggggatacggac

SEQ ID NO: 577402 - DNA, 20 bp, Artificial Sequence
  chemically synthesized
aaagttagggtgggggaaat

SEQ ID NO: 577403 - DNA, 20 bp, Artificial Sequence
  chemically synthesized
ctaactttttcccctcaccc

SEQ ID NO: 577404 - DNA, 20 bp, Artificial Sequence
  chemically synthesized
ggtagaataggcaagtctga

SEQ ID NO: 577405 - DNA, 20 bp, Artificial Sequence
  chemically synthesized
tttccttggaaaccacaata

SEQ ID NO: 577406 - DNA, 20 bp, Artificial Sequence
  chemically synthesized
gcacagcccaaaccctttat

SEQ ID NO: 577407 - DNA, 20 bp, Artificial Sequence
  chemically synthesized
accacaataaagggtttggg

SEQ ID NO: 577408 - DNA, 20 bp, Artificial Sequence
  chemically synthesized
actctggaacttttttcctg

SEQ ID NO: 577409 - DNA, 20 bp, Artificial Sequence
  chemically synthesized
gatcaattccattaaaagaa

SEQ ID NO: 577410 - DNA, 20 bp, Artificial Sequence
  chemically synthesized
gagagatcaattccattaaa

SEQ ID NO: 577411 - DNA, 20 bp, Artificial Sequence
  chemically synthesized
ggtattttagttgcacaggg

SEQ ID NO: 577412 - DNA, 20 bp, Artificial Sequence
  chemically synthesized
ggcagggtattttagttgca

SEQ ID NO: 577413 - DNA, 20 bp, Artificial Sequence
  chemically synthesized
ccgaagtagggaacccaaga

SEQ ID NO: 577414 - DNA, 20 bp, Artificial Sequence
  chemically synthesized
cttgggttccctacttcggt

SEQ ID NO: 577415 - DNA, 20 bp, Artificial Sequence
  chemically synthesized
taatatacaaaaggaaaaag

SEQ ID NO: 577416 - DNA, 20 bp, Artificial Sequence
  chemically synthesized
catagactttgctatctagt

SEQ ID NO: 577417 - DNA, 20 bp, Artificial Sequence
  chemically synthesized
ccattactagatagcaaagt

SEQ ID NO: 577418 - DNA, 20 bp, Artificial Sequence
  chemically synthesized
ataagtgggggaaagaggtt

SEQ ID NO: 577419 - DNA, 20 bp, Artificial Sequence
  chemically synthesized
tcccccacttataccaatac

SEQ ID NO: 577420 - DNA, 20 bp, Artificial Sequence
  chemically synthesized
gaagcccagttgaacacact

SEQ ID NO: 577421 - DNA, 20 bp, Artificial Sequence
  chemically synthesized
taagccaccagtgtgttcaa

SEQ ID NO: 577422 - DNA, 20 bp, Artificial Sequence
  chemically synthesized
ttaacgaaggatatttttgc

SEQ ID NO: 577423 - DNA, 20 bp, Artificial Sequence
  chemically synthesized
gacttcatttaaaaaggtaa

SEQ ID NO: 577424 - DNA, 20 bp, Artificial Sequence
  chemically synthesized
ctttttaaatgaagtcactc

SEQ ID NO: 577425 - DNA, 20 bp, Artificial Sequence
  chemically synthesized
ctgcttaacacagaaccttt

SEQ ID NO: 577426 - DNA, 20 bp, Artificial Sequence
  chemically synthesized
aagctagaaagttagtaagg

SEQ ID NO: 577427 - DNA, 20 bp, Artificial Sequence
  chemically synthesized
aatctgacccttactaactt

SEQ ID NO: 577428 - DNA, 20 bp, Artificial Sequence
  chemically synthesized
catctctcccaattcaaact

SEQ ID NO: 577429 - DNA, 20 bp, Artificial Sequence
  chemically synthesized
ggattgctgcttggtaaacc

SEQ ID NO: 577430 - DNA, 20 bp, Artificial Sequence
  chemically synthesized
gaaagtgattttgagaggat

SEQ ID NO: 577431 - DNA, 20 bp, Artificial Sequence
  chemically synthesized
gtcatgggaaagtgattttg

SEQ ID NO: 577432 - DNA, 20 bp, Artificial Sequence
  chemically synthesized
acaagtctgaagtcatggga

SEQ ID NO: 577433 - DNA, 20 bp, Artificial Sequence
  chemically synthesized
gacttgtgcacagtatgttg

SEQ ID NO: 577434 - DNA, 20 bp, Artificial Sequence
  chemically synthesized
cctggcttagagaatactcc

SEQ ID NO: 577435 - DNA, 20 bp, Artificial Sequence
  chemically synthesized
aacccctacccgctttcctt

SEQ ID NO: 577436 - DNA, 20 bp, Artificial Sequence
  chemically synthesized
tccttcttcccctaacccct

SEQ ID NO: 577437 - DNA, 20 bp, Artificial Sequence
  chemically synthesized
acactcatggaaaatgcctt

SEQ ID NO: 577438 - DNA, 20 bp, Artificial Sequence
  chemically synthesized
gtgatctgtgaaagtgatta

SEQ ID NO: 577439 - DNA, 20 bp, Artificial Sequence
  chemically synthesized
tttttgaaggtgatctgtga

SEQ ID NO: 577440 - DNA, 20 bp, Artificial Sequence
  chemically synthesized
gatcaccttcaaaaatactg

SEQ ID NO: 577441 - DNA, 20 bp, Artificial Sequence
  chemically synthesized
ttatttagttgacattgtta

SEQ ID NO: 577442 - DNA, 20 bp, Artificial Sequence
  chemically synthesized
gattgacatttattgaccca

SEQ ID NO: 577443 - DNA, 20 bp, Artificial Sequence
  chemically synthesized
aacagttgattttaagatat

SEQ ID NO: 577444 - DNA, 20 bp, Artificial Sequence
  chemically synthesized
agcaatgatatcttaaaatc

SEQ ID NO: 577445 - DNA, 20 bp, Artificial Sequence
  chemically synthesized
atatagccggtactataaac

SEQ ID NO: 577446 - DNA, 20 bp, Artificial Sequence
  chemically synthesized
tatttgcctaaaacacatta

SEQ ID NO: 577447 - DNA, 20 bp, Artificial Sequence
  chemically synthesized
aatttaatttaatctattta

SEQ ID NO: 577448 - DNA, 20 bp, Artificial Sequence
  chemically synthesized
aagtataattttgttacatg

SEQ ID NO: 577449 - DNA, 20 bp, Artificial Sequence
  chemically synthesized
ttttgggaggcattgagttt

SEQ ID NO: 577450 - DNA, 20 bp, Artificial Sequence
  chemically synthesized
tgtatttattttgggaggca

SEQ ID NO: 577451 - DNA, 20 bp, Artificial Sequence
  chemically synthesized
caaaataaatacataattgt

SEQ ID NO: 577452 - DNA, 20 bp, Artificial Sequence
  chemically synthesized
tggaatattattacatggca

SEQ ID NO: 577453 - DNA, 20 bp, Artificial Sequence
  chemically synthesized
gtcatctataatttttccct

SEQ ID NO: 577454 - DNA, 20 bp, Artificial Sequence
  chemically synthesized
taagtagtctttttttttta

SEQ ID NO: 577455 - DNA, 20 bp, Artificial Sequence
  chemically synthesized
atttcaattatcaagggcct

SEQ ID NO: 577456 - DNA, 20 bp, Artificial Sequence
  chemically synthesized
atacacttagcaatgaacaa

SEQ ID NO: 577457 - DNA, 20 bp, Artificial Sequence
  chemically synthesized
atgaacaatcgagtttattt

SEQ ID NO: 577458 - DNA, 20 bp, Artificial Sequence
  chemically synthesized
attgtgaatcagcaaaataa

SEQ ID NO: 577459 - DNA, 20 bp, Artificial Sequence
  chemically synthesized
attcacaagtaatcttaagg

SEQ ID NO: 577460 - DNA, 20 bp, Artificial Sequence
  chemically synthesized
gagcaatcagaaacctgacc

SEQ ID NO: 577461 - DNA, 20 bp, Artificial Sequence
  chemically synthesized
aagtaatcttaaggtcaggt

SEQ ID NO: 577462 - DNA, 20 bp, Artificial Sequence
  chemically synthesized
gtttctgattgctcattcgt

SEQ ID NO: 577463 - DNA, 20 bp, Artificial Sequence
  chemically synthesized
ccaaagtgttgataatctaa

SEQ ID NO: 577464 - DNA, 20 bp, Artificial Sequence
  chemically synthesized
tcatttggagcacaaacaaa

SEQ ID NO: 577465 - DNA, 20 bp, Artificial Sequence
  chemically synthesized
tctaattttgtttgtgctcc

SEQ ID NO: 577466 - DNA, 20 bp, Artificial Sequence
  chemically synthesized
ttccaatgcaaaaaggtccc

SEQ ID NO: 577467 - DNA, 20 bp, Artificial Sequence
  chemically synthesized
cagctgctttgcaaaggtag

SEQ ID NO: 577468 - DNA, 20 bp, Artificial Sequence
  chemically synthesized
tgtcttgtgggtgatgtcgt

SEQ ID NO: 577469 - DNA, 20 bp, Artificial Sequence
  chemically synthesized
cttttagtatattttcagac

SEQ ID NO: 577470 - DNA, 20 bp, Artificial Sequence
  chemically synthesized
taatggaagattaagagcaa

SEQ ID NO: 577471 - DNA, 20 bp, Artificial Sequence
  chemically synthesized
atgaaagtcttgtttttaat

SEQ ID NO: 577472 - DNA, 20 bp, Artificial Sequence
  chemically synthesized
attcatatctagaatgaaag

SEQ ID NO: 577473 - DNA, 20 bp, Artificial Sequence
  chemically synthesized
gagaatgttgtcttaaatgt

SEQ ID NO: 577474 - DNA, 20 bp, Artificial Sequence
  chemically synthesized
tctcaggggtgataaatgac

SEQ ID NO: 577475 - DNA, 20 bp, Artificial Sequence
  chemically synthesized
gtgataaatgactacagttt

SEQ ID NO: 577476 - DNA, 20 bp, Artificial Sequence
  chemically synthesized
acagtttttgcgcttttaaa

SEQ ID NO: 577477 - DNA, 20 bp, Artificial Sequence
  chemically synthesized
aacactctgtaagagcaatt

SEQ ID NO: 577478 - DNA, 20 bp, Artificial Sequence
  chemically synthesized
tagtctatcttaacatctct

SEQ ID NO: 577479 - DNA, 20 bp, Artificial Sequence
  chemically synthesized
gcattcccaaatgtagtcta

SEQ ID NO: 577480 - DNA, 20 bp, Artificial Sequence
  chemically synthesized
actctgtagactacatttgg

SEQ ID NO: 577481 - DNA, 20 bp, Artificial Sequence
  chemically synthesized
gggccggaagttcttttcct

SEQ ID NO: 577482 - DNA, 20 bp, Artificial Sequence
  chemically synthesized
tagtggttaccatattagaa

SEQ ID NO: 577483 - DNA, 20 bp, Artificial Sequence
  chemically synthesized
gcgctgtaagagtaaaactt

SEQ ID NO: 577484 - DNA, 20 bp, Artificial Sequence
  chemically synthesized
cgttaagtatttaaaatctg

SEQ ID NO: 577485 - DNA, 20 bp, Artificial Sequence
  chemically synthesized
aattgttacaaaagttatta

SEQ ID NO: 577486 - DNA, 20 bp, Artificial Sequence
  chemically synthesized
acaattacatgttaaaatga

SEQ ID NO: 577487 - DNA, 20 bp, Artificial Sequence
  chemically synthesized
aagaatagccccacagatat

SEQ ID NO: 577488 - DNA, 20 bp, Artificial Sequence
  chemically synthesized
agaaaattgtctaataaatt

SEQ ID NO: 577489 - DNA, 20 bp, Artificial Sequence
  chemically synthesized
gctcacaccacaggatctct

SEQ ID NO: 577490 - DNA, 20 bp, Artificial Sequence
  chemically synthesized
tcagagagatcctgtggtgt

SEQ ID NO: 577491 - DNA, 20 bp, Artificial Sequence
  chemically synthesized
tatttttcatggaccattgt

SEQ ID NO: 577492 - DNA, 20 bp, Artificial Sequence
  chemically synthesized
ttcatggaccattgttctgg

SEQ ID NO: 577493 - DNA, 20 bp, Artificial Sequence
  chemically synthesized
tttatactatattacactat

SEQ ID NO: 577494 - DNA, 20 bp, Artificial Sequence
  chemically synthesized
taaatgaacaaaaatgcaaa

SEQ ID NO: 577495 - DNA, 20 bp, Artificial Sequence
  chemically synthesized
ttttgcatttttgttcattt

SEQ ID NO: 577496 - DNA, 20 bp, Artificial Sequence
  chemically synthesized
agtcagcaagatgagcattt

SEQ ID NO: 577497 - DNA, 20 bp, Artificial Sequence
  chemically synthesized
ataaacttgatgatcaaaaa

SEQ ID NO: 577498 - DNA, 20 bp, Artificial Sequence
  chemically synthesized
ataatctgaatttttgatca

SEQ ID NO: 577499 - DNA, 20 bp, Artificial Sequence
  chemically synthesized
aaatgctattgattctttgc

SEQ ID NO: 577500 - DNA, 20 bp, Artificial Sequence
  chemically synthesized
ctggggaaatgctattgatt

SEQ ID NO: 577501 - DNA, 20 bp, Artificial Sequence
  chemically synthesized
attgggggctggggaaatgc

SEQ ID NO: 577502 - DNA, 20 bp, Artificial Sequence
  chemically synthesized
ccccagcccccaatcctcgg

SEQ ID NO: 577503 - DNA, 20 bp, Artificial Sequence
  chemically synthesized
taatgagagagaatctcccc

SEQ ID NO: 577504 - DNA, 20 bp, Artificial Sequence
  chemically synthesized
aaagacagtaaaataggctc

SEQ ID NO: 577505 - DNA, 20 bp, Artificial Sequence
  chemically synthesized
ctcaaatgttttaattgtat

SEQ ID NO: 577506 - DNA, 20 bp, Artificial Sequence
  chemically synthesized
ctgagtgaattgacagatgg

SEQ ID NO: 577507 - DNA, 20 bp, Artificial Sequence
  chemically synthesized
tattaaagtagttcctccta

SEQ ID NO: 577508 - DNA, 20 bp, Artificial Sequence
  chemically synthesized
aactgcccaataggaccagg

SEQ ID NO: 577509 - DNA, 20 bp, Artificial Sequence
  chemically synthesized
tcgctgtcccaaactagagt

SEQ ID NO: 577510 - DNA, 20 bp, Artificial Sequence
  chemically synthesized
tgttgtcaggaagcacacac

SEQ ID NO: 577511 - DNA, 20 bp, Artificial Sequence
  chemically synthesized
tggactagtcattgataata

SEQ ID NO: 577512 - DNA, 20 bp, Artificial Sequence
  chemically synthesized
atccaaaatgtgcatatatt

SEQ ID NO: 577513 - DNA, 20 bp, Artificial Sequence
  chemically synthesized
tacatatatgtagaatatat

SEQ ID NO: 577514 - DNA, 20 bp, Artificial Sequence
  chemically synthesized
atacatatattctacatata

SEQ ID NO: 577515 - DNA, 20 bp, Artificial Sequence
  chemically synthesized
atttgatgatggccaatttt

SEQ ID NO: 577516 - DNA, 20 bp, Artificial Sequence
  chemically synthesized
ttgtcttctaaatgcaatca

SEQ ID NO: 577517 - DNA, 20 bp, Artificial Sequence
  chemically synthesized
tctaaatgcaatcacttcga

SEQ ID NO: 577518 - DNA, 20 bp, Artificial Sequence
  chemically synthesized
cctttcagcaaacgtaatcg

SEQ ID NO: 577519 - DNA, 20 bp, Artificial Sequence
  chemically synthesized
cacttcgattacgtttgctg

SEQ ID NO: 577520 - DNA, 20 bp, Artificial Sequence
  chemically synthesized
tacaattatttaattatact

SEQ ID NO: 577521 - DNA, 20 bp, Artificial Sequence
  chemically synthesized
ctcatttgtaaatgcccatc

SEQ ID NO: 577522 - DNA, 20 bp, Artificial Sequence
  chemically synthesized
gggtcaacatatagtaatga

SEQ ID NO: 577523 - DNA, 20 bp, Artificial Sequence
  chemically synthesized
gtctattgtgatctcatctc

SEQ ID NO: 577524 - DNA, 20 bp, Artificial Sequence
  chemically synthesized
tgatattcatgaaattttcc

SEQ ID NO: 577525 - DNA, 20 bp, Artificial Sequence
  chemically synthesized
tttggcattgtaatgaaaag

SEQ ID NO: 577526 - DNA, 20 bp, Artificial Sequence
  chemically synthesized
gagggatcaaagaagtgtgt

SEQ ID NO: 577527 - DNA, 20 bp, Artificial Sequence
  chemically synthesized
gtacatgatttagctgctca

SEQ ID NO: 577528 - DNA, 20 bp, Artificial Sequence
  chemically synthesized
tcaacacttttagctatgaa

SEQ ID NO: 577529 - DNA, 20 bp, Artificial Sequence
  chemically synthesized
gtttagaccattataatagt

SEQ ID NO: 577530 - DNA, 20 bp, Artificial Sequence
  chemically synthesized
gttataagggatcatatttc

SEQ ID NO: 577531 - DNA, 20 bp, Artificial Sequence
  chemically synthesized
ccacttttagattttctata

SEQ ID NO: 577532 - DNA, 20 bp, Artificial Sequence
  chemically synthesized
aggcaataaaaatttccact

SEQ ID NO: 577533 - DNA, 20 bp, Artificial Sequence
  chemically synthesized
cagaggagaaaatggtggca

SEQ ID NO: 577534 - DNA, 20 bp, Artificial Sequence
  chemically synthesized
gtagctggtaaagacttgga

SEQ ID NO: 577535 - DNA, 20 bp, Artificial Sequence
  chemically synthesized
agattctatagctacagagc

SEQ ID NO: 577536 - DNA, 20 bp, Artificial Sequence
  chemically synthesized
gttggaagattctatagcta

SEQ ID NO: 577537 - DNA, 20 bp, Artificial Sequence
  chemically synthesized
gttttgtctagtatccagtt

SEQ ID NO: 577538 - DNA, 20 bp, Artificial Sequence
  chemically synthesized
ctagacaaaacaaaagttcc

SEQ ID NO: 577539 - DNA, 20 bp, Artificial Sequence
  chemically synthesized
tgcagcgaagctctgggaac

SEQ ID NO: 577540 - DNA, 20 bp, Artificial Sequence
  chemically synthesized
ttcccagagcttcgctgcac

SEQ ID NO: 577541 - DNA, 20 bp, Artificial Sequence
  chemically synthesized
ctgcacattagattgagctg

SEQ ID NO: 577542 - DNA, 20 bp, Artificial Sequence
  chemically synthesized
tggttttcacaagatttcct

SEQ ID NO: 577543 - DNA, 20 bp, Artificial Sequence
  chemically synthesized
tcaggaaatcttgtgaaaac

SEQ ID NO: 577544 - DNA, 20 bp, Artificial Sequence
  chemically synthesized
cttttgaaactttggttttc

SEQ ID NO: 577545 - DNA, 20 bp, Artificial Sequence
  chemically synthesized
aagtttcattcttttgaaac

SEQ ID NO: 577546 - DNA, 20 bp, Artificial Sequence
  chemically synthesized
cactttgagcatcaattgag

SEQ ID NO: 577547 - DNA, 20 bp, Artificial Sequence
  chemically synthesized
atgtcatttgagcctctctt

SEQ ID NO: 577548 - DNA, 20 bp, Artificial Sequence
  chemically synthesized
catttgagcctctcttatct

SEQ ID NO: 577549 - DNA, 20 bp, Artificial Sequence
  chemically synthesized
tggggaattcttcatagttt

SEQ ID NO: 577550 - DNA, 20 bp, Artificial Sequence
  chemically synthesized
acgaggcatggggaattctt

SEQ ID NO: 577551 - DNA, 20 bp, Artificial Sequence
  chemically synthesized
tccccatgcctcgtcataaa

SEQ ID NO: 577552 - DNA, 20 bp, Artificial Sequence
  chemically synthesized
agtagctttttcctcgactt

SEQ ID NO: 577553 - DNA, 20 bp, Artificial Sequence
  chemically synthesized
tcctcgactttatagatttt

SEQ ID NO: 577554 - DNA, 20 bp, Artificial Sequence
  chemically synthesized
acaattttttaaattacatg

SEQ ID NO: 577555 - DNA, 20 bp, Artificial Sequence
  chemically synthesized
agttaacaattttttaaatt

SEQ ID NO: 577556 - DNA, 20 bp, Artificial Sequence
  chemically synthesized
ttttatttttttcactttaa

SEQ ID NO: 577557 - DNA, 20 bp, Artificial Sequence
  chemically synthesized
ttgttaaagtgaaaaaaata

SEQ ID NO: 577558 - DNA, 20 bp, Artificial Sequence
  chemically synthesized
ataatattcattatatagac

SEQ ID NO: 577559 - DNA, 20 bp, Artificial Sequence
  chemically synthesized
aggattttatttaacattta

SEQ ID NO: 577560 - DNA, 20 bp, Artificial Sequence
  chemically synthesized
agcttatattagtatattaa

SEQ ID NO: 577561 - DNA, 20 bp, Artificial Sequence
  chemically synthesized
tttaattatttgaactttat

SEQ ID NO: 577562 - DNA, 20 bp, Artificial Sequence
  chemically synthesized
tgaaatgttgataatataaa

SEQ ID NO: 577563 - DNA, 20 bp, Artificial Sequence
  chemically synthesized
gaagagcttttaattattta

SEQ ID NO: 577564 - DNA, 20 bp, Artificial Sequence
  chemically synthesized
tagtcatttttgcatggtgg

SEQ ID NO: 577565 - DNA, 20 bp, Artificial Sequence
  chemically synthesized
tccaccatgcaaaaatgact

SEQ ID NO: 577566 - DNA, 20 bp, Artificial Sequence
  chemically synthesized
aaaagctttagaaattaaaa

SEQ ID NO: 577567 - DNA, 20 bp, Artificial Sequence
  chemically synthesized
ctaaacgattttttaatttc

SEQ ID NO: 577568 - DNA, 20 bp, Artificial Sequence
  chemically synthesized
tttttaatttctaaagcttt

SEQ ID NO: 577569 - DNA, 20 bp, Artificial Sequence
  chemically synthesized
cccctttcacagtaatctca

SEQ ID NO: 577570 - DNA, 20 bp, Artificial Sequence
  chemically synthesized
gagattactgtgaaagggga

SEQ ID NO: 577571 - DNA, 20 bp, Artificial Sequence
  chemically synthesized
tgagaaatgctagtctaata

SEQ ID NO: 577572 - DNA, 20 bp, Artificial Sequence
  chemically synthesized
aggcatttttaattattatt

SEQ ID NO: 577573 - DNA, 20 bp, Artificial Sequence
  chemically synthesized
tctctagtttgtttatgcta

SEQ ID NO: 577574 - DNA, 20 bp, Artificial Sequence
  chemically synthesized
aagtcgaaagggcttctcta

SEQ ID NO: 577575 - DNA, 20 bp, Artificial Sequence
  chemically synthesized
ccagaagtcgaaagggcttc

SEQ ID NO: 577576 - DNA, 20 bp, Artificial Sequence
  chemically synthesized
ttcttcagaccagaagtcga

SEQ ID NO: 577577 - DNA, 20 bp, Artificial Sequence
  chemically synthesized
gaattctgcgtgtctataat

SEQ ID NO: 577578 - DNA, 20 bp, Artificial Sequence
  chemically synthesized
tcagctgatataacaatttg

SEQ ID NO: 577579 - DNA, 20 bp, Artificial Sequence
  chemically synthesized
tttctgaatcatcaaaaaaa

SEQ ID NO: 577580 - DNA, 20 bp, Artificial Sequence
  chemically synthesized
gcattcaaacaacatttttt

SEQ ID NO: 577581 - DNA, 20 bp, Artificial Sequence
  chemically synthesized
tcatcaaaaaaatgttgttt

SEQ ID NO: 577582 - DNA, 20 bp, Artificial Sequence
  chemically synthesized
aaatgttgtttgaatgctta

SEQ ID NO: 577583 - DNA, 20 bp, Artificial Sequence
  chemically synthesized
ttgaatgcttaagatgctta

SEQ ID NO: 577584 - DNA, 20 bp, Artificial Sequence
  chemically synthesized
ttcagttaattaatgatttc

SEQ ID NO: 577585 - DNA, 20 bp, Artificial Sequence
  chemically synthesized
attatatggcttcagttaat

SEQ ID NO: 577586 - DNA, 20 bp, Artificial Sequence
  chemically synthesized
aactgaagccatataatttt

SEQ ID NO: 577587 - DNA, 20 bp, Artificial Sequence
  chemically synthesized
taaccaaactatcaaaatta

SEQ ID NO: 577588 - DNA, 20 bp, Artificial Sequence
  chemically synthesized
atctattggaagatttacag

SEQ ID NO: 577589 - DNA, 20 bp, Artificial Sequence
  chemically synthesized
tggaaatctattggaagatt

SEQ ID NO: 577590 - DNA, 20 bp, Artificial Sequence
  chemically synthesized
atctaatctgtaaatcttcc

SEQ ID NO: 577591 - DNA, 20 bp, Artificial Sequence
  chemically synthesized
tctgagtttggaaatctatt

SEQ ID NO: 577592 - DNA, 20 bp, Artificial Sequence
  chemically synthesized
atcagagcaggatgaaaatt

SEQ ID NO: 577593 - DNA, 20 bp, Artificial Sequence
  chemically synthesized
aactcagaattttcatcctg

SEQ ID NO: 577594 - DNA, 20 bp, Artificial Sequence
  chemically synthesized
ctctgattggttaatctttg

SEQ ID NO: 577595 - DNA, 20 bp, Artificial Sequence
  chemically synthesized
ggataaatggtaaatcccac

SEQ ID NO: 577596 - DNA, 20 bp, Artificial Sequence
  chemically synthesized
agtaggttattatgttcttt

SEQ ID NO: 577597 - DNA, 20 bp, Artificial Sequence
  chemically synthesized
taatggtttacacattgaag

SEQ ID NO: 577598 - DNA, 20 bp, Artificial Sequence
  chemically synthesized
gagattactgtgaaaggggg

SEQ ID NO: 577599 - DNA, 20 bp, Artificial Sequence
  chemically synthesized
ttgttaatttctaaggcttt

SEQ ID NO: 577600 - DNA, 20 bp, Artificial Sequence
  chemically synthesized
ctaaataaattgttaatttc

SEQ ID NO: 577601 - DNA, 20 bp, Artificial Sequence
  chemically synthesized
tagtcatttttgcacggtgg

SEQ ID NO: 577602 - DNA, 20 bp, Artificial Sequence
  chemically synthesized
gaagagtttttaattattta

SEQ ID NO: 577603 - DNA, 20 bp, Artificial Sequence
  chemically synthesized
ttaaacaatatttatatgat

SEQ ID NO: 577604 - DNA, 20 bp, Artificial Sequence
  chemically synthesized
taaaacattgatcatataaa

SEQ ID NO: 577605 - DNA, 20 bp, Artificial Sequence
  chemically synthesized
tttaattatttgtactttat

SEQ ID NO: 577606 - DNA, 20 bp, Artificial Sequence
  chemically synthesized
taatagcttacattagtata

SEQ ID NO: 577607 - DNA, 20 bp, Artificial Sequence
  chemically synthesized
taggatttttataacattta

SEQ ID NO: 577608 - DNA, 20 bp, Artificial Sequence
  chemically synthesized
gtagtatttgttatgtagac

SEQ ID NO: 577609 - DNA, 20 bp, Artificial Sequence
  chemically synthesized
tcattgttaaaagctcactt

SEQ ID NO: 577610 - DNA, 20 bp, Artificial Sequence
  chemically synthesized
gcttatgtcaaaacatttaa

SEQ ID NO: 577611 - DNA, 20 bp, Artificial Sequence
  chemically synthesized
tcttaatattttcaaattat

SEQ ID NO: 577612 - DNA, 20 bp, Artificial Sequence
  chemically synthesized
gcattaatgttttcaaattc

SEQ ID NO: 577613 - DNA, 20 bp, Artificial Sequence
  chemically synthesized
ccatatggaattcaatgcat

SEQ ID NO: 577614 - DNA, 20 bp, Artificial Sequence
  chemically synthesized
tgaattccatatggaagaaa

SEQ ID NO: 577615 - DNA, 20 bp, Artificial Sequence
  chemically synthesized
tgtttagttgagggacttca

SEQ ID NO: 577616 - DNA, 20 bp, Artificial Sequence
  chemically synthesized
tccattttccacttctgaag

SEQ ID NO: 577617 - DNA, 20 bp, Artificial Sequence
  chemically synthesized
catctttaccctcgctcccc

SEQ ID NO: 577618 - DNA, 20 bp, Artificial Sequence
  chemically synthesized
ctcgctccccaaatgcttca

SEQ ID NO: 577619 - DNA, 20 bp, Artificial Sequence
  chemically synthesized
gctcccccacacaaaaagaa

SEQ ID NO: 577620 - DNA, 20 bp, Artificial Sequence
  chemically synthesized
tagatgaatatcttccacac

SEQ ID NO: 577621 - DNA, 20 bp, Artificial Sequence
  chemically synthesized
cttcaattaaaaatacacta

SEQ ID NO: 577622 - DNA, 20 bp, Artificial Sequence
  chemically synthesized
accatagaaaggacattgag

SEQ ID NO: 577623 - DNA, 20 bp, Artificial Sequence
  chemically synthesized
tatactgaccccagttttgt

SEQ ID NO: 577624 - DNA, 20 bp, Artificial Sequence
  chemically synthesized
taaatatatactgaccccag

SEQ ID NO: 577625 - DNA, 20 bp, Artificial Sequence
  chemically synthesized
tcatttaaatatatactgac

SEQ ID NO: 577626 - DNA, 20 bp, Artificial Sequence
  chemically synthesized
aagtgaaataccttttttcc

SEQ ID NO: 577627 - DNA, 20 bp, Artificial Sequence
  chemically synthesized
tttcactttcaaaggaccta

SEQ ID NO: 577628 - DNA, 20 bp, Artificial Sequence
  chemically synthesized
cctatgctgttttttttttt

SEQ ID NO: 577629 - DNA, 20 bp, Artificial Sequence
  chemically synthesized
ggaatgcctctggtaccagc

SEQ ID NO: 577630 - DNA, 20 bp, Artificial Sequence
  chemically synthesized
aagaaaggaatgcctctggt

SEQ ID NO: 577631 - DNA, 20 bp, Artificial Sequence
  chemically synthesized
aatgagaaacatttcaaaag

SEQ ID NO: 577632 - DNA, 20 bp, Artificial Sequence
  chemically synthesized
ggataaaaacgttgcttttg

SEQ ID NO: 577633 - DNA, 20 bp, Artificial Sequence
  chemically synthesized
ttaacatgaaaggataaaaa

SEQ ID NO: 577634 - DNA, 20 bp, Artificial Sequence
  chemically synthesized
gatggtttctctcattttat

SEQ ID NO: 577635 - DNA, 20 bp, Artificial Sequence
  chemically synthesized
attaacttttgctttttgct

SEQ ID NO: 577636 - DNA, 20 bp, Artificial Sequence
  chemically synthesized
gaatatctgtctttattaac

SEQ ID NO: 577637 - DNA, 20 bp, Artificial Sequence
  chemically synthesized
ttaataaagacagatattct

SEQ ID NO: 577638 - DNA, 20 bp, Artificial Sequence
  chemically synthesized
aaaccaaatacttttgtgat

SEQ ID NO: 577639 - DNA, 20 bp, Artificial Sequence
  chemically synthesized
aagctcaaatcacaaaagta

SEQ ID NO: 577640 - DNA, 20 bp, Artificial Sequence
  chemically synthesized
aaaggagaaaccaaatactt

SEQ ID NO: 577641 - DNA, 20 bp, Artificial Sequence
  chemically synthesized
tatttggtttctcctttttt

SEQ ID NO: 577642 - DNA, 20 bp, Artificial Sequence
  chemically synthesized
tcttaggtgattttaattat

SEQ ID NO: 577643 - DNA, 20 bp, Artificial Sequence
  chemically synthesized
gcaaagttttgttgtttctt

SEQ ID NO: 577644 - DNA, 20 bp, Artificial Sequence
  chemically synthesized
tgaagtacatcgcaaagttt

SEQ ID NO: 577645 - DNA, 20 bp, Artificial Sequence
  chemically synthesized
tagtttactgaagtacatcg

SEQ ID NO: 577646 - DNA, 20 bp, Artificial Sequence
  chemically synthesized
atgtacttcagtaaactact

SEQ ID NO: 577647 - DNA, 20 bp, Artificial Sequence
  chemically synthesized
cttctttgtataaatcttag

SEQ ID NO: 577648 - DNA, 20 bp, Artificial Sequence
  chemically synthesized
aaattttgaattttgcccaa

SEQ ID NO: 577649 - DNA, 20 bp, Artificial Sequence
  chemically synthesized
tttccttatgctttattcat

SEQ ID NO: 577650 - DNA, 20 bp, Artificial Sequence
  chemically synthesized
tccaataacatgaactttcc

SEQ ID NO: 577651 - DNA, 20 bp, Artificial Sequence
  chemically synthesized
catgttattggaatggagtt

SEQ ID NO: 577652 - DNA, 20 bp, Artificial Sequence
  chemically synthesized
gtcaaattggagtgtccata

SEQ ID NO: 577653 - DNA, 20 bp, Artificial Sequence
  chemically synthesized
tttgacagatactactctga

SEQ ID NO: 577654 - DNA, 20 bp, Artificial Sequence
  chemically synthesized
caggtcttctcaattctcgt

SEQ ID NO: 577655 - DNA, 20 bp, Artificial Sequence
  chemically synthesized
gctgttggacctttgaagtc

SEQ ID NO: 577656 - DNA, 20 bp, Artificial Sequence
  chemically synthesized
agagatttcaactctcagaa

SEQ ID NO: 577657 - DNA, 20 bp, Artificial Sequence
  chemically synthesized
ttggacaacctcaagaagag

SEQ ID NO: 577658 - DNA, 20 bp, Artificial Sequence
  chemically synthesized
tgatggtgctgggctgctca

SEQ ID NO: 577659 - DNA, 20 bp, Artificial Sequence
  chemically synthesized
aataacctgataccgtgcta

SEQ ID NO: 577660 - DNA, 20 bp, Artificial Sequence
  chemically synthesized
cacatgctgaatagtgggct

SEQ ID NO: 577661 - DNA, 20 bp, Artificial Sequence
  chemically synthesized
cttagccccaaccccagaga

SEQ ID NO: 577662 - DNA, 20 bp, Artificial Sequence
  chemically synthesized
tggggttggggctaagtaat

SEQ ID NO: 577663 - DNA, 20 bp, Artificial Sequence
  chemically synthesized
gcctggagagcttgttaaaa

SEQ ID NO: 577664 - DNA, 20 bp, Artificial Sequence
  chemically synthesized
atatgcatagcaattgcctg

SEQ ID NO: 577665 - DNA, 20 bp, Artificial Sequence
  chemically synthesized
gctatgcatattaagagaag

SEQ ID NO: 577666 - DNA, 20 bp, Artificial Sequence
  chemically synthesized
gttctcacaatgctctgaat

SEQ ID NO: 577667 - DNA, 20 bp, Artificial Sequence
  chemically synthesized
gtgagaacatagaagatatt

SEQ ID NO: 577668 - DNA, 20 bp, Artificial Sequence
  chemically synthesized
ctaggctttgcctcaagaac

SEQ ID NO: 577669 - DNA, 20 bp, Artificial Sequence
  chemically synthesized
cattatgaaagattttgcta

SEQ ID NO: 577670 - DNA, 20 bp, Artificial Sequence
  chemically synthesized
tacagatattacttcattat

SEQ ID NO: 577671 - DNA, 20 bp, Artificial Sequence
  chemically synthesized
agtggctggggttataatag

SEQ ID NO: 577672 - DNA, 20 bp, Artificial Sequence
  chemically synthesized
ttataatagttctgcttttg

SEQ ID NO: 577673 - DNA, 20 bp, Artificial Sequence
  chemically synthesized
tgtttatttgggtatacttc

SEQ ID NO: 577674 - DNA, 20 bp, Artificial Sequence
  chemically synthesized
cgtatttttaaaatttatat

SEQ ID NO: 577675 - DNA, 20 bp, Artificial Sequence
  chemically synthesized
aaatatataaattttaaaaa

SEQ ID NO: 577676 - DNA, 20 bp, Artificial Sequence
  chemically synthesized
ctatgaaaacaaagaacaga

SEQ ID NO: 577677 - DNA, 20 bp, Artificial Sequence
  chemically synthesized
ccctcaaagccatttctgtt

SEQ ID NO: 577678 - DNA, 20 bp, Artificial Sequence
  chemically synthesized
aaattgttaataataatatg

SEQ ID NO: 577679 - DNA, 20 bp, Artificial Sequence
  chemically synthesized
gcatgcatgcagttggtatt

SEQ ID NO: 577680 - DNA, 20 bp, Artificial Sequence
  chemically synthesized
gcatactcttatattccaca

SEQ ID NO: 577681 - DNA, 20 bp, Artificial Sequence
  chemically synthesized
aatataagagtatgccctgg

SEQ ID NO: 577682 - DNA, 20 bp, Artificial Sequence
  chemically synthesized
gtttataatcagttggaaag

SEQ ID NO: 577683 - DNA, 20 bp, Artificial Sequence
  chemically synthesized
tgattaaatcttatctttcc

SEQ ID NO: 577684 - DNA, 20 bp, Artificial Sequence
  chemically synthesized
gacaccatactgattatagt

SEQ ID NO: 577685 - DNA, 20 bp, Artificial Sequence
  chemically synthesized
gtggtctactgcggacacca

SEQ ID NO: 577686 - DNA, 20 bp, Artificial Sequence
  chemically synthesized
ctttgttgaaactctctcct

SEQ ID NO: 577687 - DNA, 20 bp, Artificial Sequence
  chemically synthesized
taagtaagaagcagagagga

SEQ ID NO: 577688 - DNA, 20 bp, Artificial Sequence
  chemically synthesized
tcctctctgcttcttactta

SEQ ID NO: 577689 - DNA, 20 bp, Artificial Sequence
  chemically synthesized
cttcttacttaataagcttt

SEQ ID NO: 577690 - DNA, 20 bp, Artificial Sequence
  chemically synthesized
accaggaattggaaaaccag

SEQ ID NO: 577691 - DNA, 20 bp, Artificial Sequence
  chemically synthesized
gcttttctggttttccaatt

SEQ ID NO: 577692 - DNA, 20 bp, Artificial Sequence
  chemically synthesized
tctgcattaatttcagccaa

SEQ ID NO: 577693 - DNA, 20 bp, Artificial Sequence
  chemically synthesized
ttcacctttatacattctac

SEQ ID NO: 577694 - DNA, 20 bp, Artificial Sequence
  chemically synthesized
agtaccagttattagaaata

SEQ ID NO: 577695 - DNA, 20 bp, Artificial Sequence
  chemically synthesized
ctgttaataccacatatcag

SEQ ID NO: 577696 - DNA, 20 bp, Artificial Sequence
  chemically synthesized
tcagccccagacatgataca

SEQ ID NO: 577697 - DNA, 20 bp, Artificial Sequence
  chemically synthesized
agacatgatacattgtgttt

SEQ ID NO: 577698 - DNA, 20 bp, Artificial Sequence
  chemically synthesized
ttactttggcaaacaacgtc

SEQ ID NO: 577699 - DNA, 20 bp, Artificial Sequence
  chemically synthesized
ggaaggttaaaatcaaaaga

SEQ ID NO: 577700 - DNA, 20 bp, Artificial Sequence
  chemically synthesized
ttatgtaacaaccatttgtg

SEQ ID NO: 577701 - DNA, 20 bp, Artificial Sequence
  chemically synthesized
cgcaaatatatgtgtgtgta

SEQ ID NO: 577702 - DNA, 20 bp, Artificial Sequence
  chemically synthesized
tcaggacgctgaggcaggag

SEQ ID NO: 577703 - DNA, 20 bp, Artificial Sequence
  chemically synthesized
ctactcaggacgctgaggca

SEQ ID NO: 577704 - DNA, 20 bp, Artificial Sequence
  chemically synthesized
tgcctcagcgtcctgagtag

SEQ ID NO: 577705 - DNA, 20 bp, Artificial Sequence
  chemically synthesized
ggtctcgaactcctgggctc

SEQ ID NO: 577706 - DNA, 20 bp, Artificial Sequence
  chemically synthesized
ttgggaggctaaggcaggag

SEQ ID NO: 577707 - DNA, 20 bp, Artificial Sequence
  chemically synthesized
tgccttagcctcccaaattg

SEQ ID NO: 577708 - DNA, 20 bp, Artificial Sequence
  chemically synthesized
atagtgagtatttctactgt

SEQ ID NO: 577709 - DNA, 20 bp, Artificial Sequence
  chemically synthesized
ttacagtagaaatactcact

SEQ ID NO: 577710 - DNA, 20 bp, Artificial Sequence
  chemically synthesized
atactcactatttgcttttc

SEQ ID NO: 577711 - DNA, 20 bp, Artificial Sequence
  chemically synthesized
attgcttgctctgaagagca

SEQ ID NO: 577712 - DNA, 20 bp, Artificial Sequence
  chemically synthesized
cttatttcctgtttaactag

SEQ ID NO: 577713 - DNA, 20 bp, Artificial Sequence
  chemically synthesized
atatttttattagtcttatt

SEQ ID NO: 577714 - DNA, 20 bp, Artificial Sequence
  chemically synthesized
ctttatttcactgtactgtt

SEQ ID NO: 577715 - DNA, 20 bp, Artificial Sequence
  chemically synthesized
gaattttctttatttcactg

SEQ ID NO: 577716 - DNA, 20 bp, Artificial Sequence
  chemically synthesized
acttgtagctcctgagaaca

SEQ ID NO: 577717 - DNA, 20 bp, Artificial Sequence
  chemically synthesized
acatttctcattgtgtaagg

SEQ ID NO: 577718 - DNA, 20 bp, Artificial Sequence
  chemically synthesized
tctgaaatatctgcaactag

SEQ ID NO: 577719 - DNA, 20 bp, Artificial Sequence
  chemically synthesized
atttattttcccccaatggt

SEQ ID NO: 577720 - DNA, 20 bp, Artificial Sequence
  chemically synthesized
gaaaataaatccttttagaa

SEQ ID NO: 577721 - DNA, 20 bp, Artificial Sequence
  chemically synthesized
acagttcaatcctatttcta

SEQ ID NO: 577722 - DNA, 20 bp, Artificial Sequence
  chemically synthesized
taggattgaactgtcaataa

SEQ ID NO: 577723 - DNA, 20 bp, Artificial Sequence
  chemically synthesized
ctttataagaatttattata

SEQ ID NO: 577724 - DNA, 20 bp, Artificial Sequence
  chemically synthesized
ctgtttataataaattctta

SEQ ID NO: 577725 - DNA, 20 bp, Artificial Sequence
  chemically synthesized
gtgattttcttttgaataac

SEQ ID NO: 577726 - DNA, 20 bp, Artificial Sequence
  chemically synthesized
gttattcaaaagaaaatcac

SEQ ID NO: 577727 - DNA, 20 bp, Artificial Sequence
  chemically synthesized
gctgtagcaataaaaatcag

SEQ ID NO: 577728 - DNA, 20 bp, Artificial Sequence
  chemically synthesized
acttttgtctcatttttcat

SEQ ID NO: 577729 - DNA, 20 bp, Artificial Sequence
  chemically synthesized
ctcatttttcatggaggctt

SEQ ID NO: 577730 - DNA, 20 bp, Artificial Sequence
  chemically synthesized
tttaacaaaatacaaaattg

SEQ ID NO: 577731 - DNA, 20 bp, Artificial Sequence
  chemically synthesized
attgaagagctttttaaaag

SEQ ID NO: 577732 - DNA, 20 bp, Artificial Sequence
  chemically synthesized
agagatttatgcgatgtata

SEQ ID NO: 577733 - DNA, 20 bp, Artificial Sequence
  chemically synthesized
ttcctaagtatatctggtga

SEQ ID NO: 577734 - DNA, 20 bp, Artificial Sequence
  chemically synthesized
gatcaccagatatacttagg

SEQ ID NO: 577735 - DNA, 20 bp, Artificial Sequence
  chemically synthesized
gataattacatttctagagt

SEQ ID NO: 577736 - DNA, 20 bp, Artificial Sequence
  chemically synthesized
gcaaacttcagaccttaaat

SEQ ID NO: 577737 - DNA, 20 bp, Artificial Sequence
  chemically synthesized
aaaatcttgcatttaaggtc

SEQ ID NO: 577738 - DNA, 20 bp, Artificial Sequence
  chemically synthesized
ggatgcctctcactagtaaa

SEQ ID NO: 577739 - DNA, 20 bp, Artificial Sequence
  chemically synthesized
gcatccttgaattctcctta

SEQ ID NO: 577740 - DNA, 20 bp, Artificial Sequence
  chemically synthesized
ttaaacattttaagtaacta

SEQ ID NO: 577741 - DNA, 20 bp, Artificial Sequence
  chemically synthesized
ttaatctgtttagttactta

SEQ ID NO: 577742 - DNA, 20 bp, Artificial Sequence
  chemically synthesized
ccttcgagactgtaggcttc

SEQ ID NO: 577743 - DNA, 20 bp, Artificial Sequence
  chemically synthesized
aacattatgccttcgagact

SEQ ID NO: 577744 - DNA, 20 bp, Artificial Sequence
  chemically synthesized
attaaataacctaaagttaa

SEQ ID NO: 577745 - DNA, 20 bp, Artificial Sequence
  chemically synthesized
aatatttttgaaggagtgaa

SEQ ID NO: 577746 - DNA, 20 bp, Artificial Sequence
  chemically synthesized
cttccctattcatggagagg

SEQ ID NO: 577747 - DNA, 20 bp, Artificial Sequence
  chemically synthesized
tgattagaaagacaattgta

SEQ ID NO: 577748 - DNA, 20 bp, Artificial Sequence
  chemically synthesized
ttttaataaaatctatttat

SEQ ID NO: 577749 - DNA, 20 bp, Artificial Sequence
  chemically synthesized
cattaaacaaaaccaaaata

SEQ ID NO: 577750 - DNA, 20 bp, Artificial Sequence
  chemically synthesized
ataaaatctatttattttgg

SEQ ID NO: 577751 - DNA, 20 bp, Artificial Sequence
  chemically synthesized
gttttgtttaatgcaattcc

SEQ ID NO: 577752 - DNA, 20 bp, Artificial Sequence
  chemically synthesized
tgcaattccacaagctttta

SEQ ID NO: 577753 - DNA, 20 bp, Artificial Sequence
  chemically synthesized
caagatagtgcaaactcagt

SEQ ID NO: 577754 - DNA, 20 bp, Artificial Sequence
  chemically synthesized
aaaaattacagaatcactca

SEQ ID NO: 577755 - DNA, 20 bp, Artificial Sequence
  chemically synthesized
cactaaactttaagcttctt

SEQ ID NO: 577756 - DNA, 20 bp, Artificial Sequence
  chemically synthesized
acagaatcactcaagaagct

SEQ ID NO: 577757 - DNA, 20 bp, Artificial Sequence
  chemically synthesized
aattaacacaccactaaact

SEQ ID NO: 577758 - DNA, 20 bp, Artificial Sequence
  chemically synthesized
ttagtggtgtgttaatttgc

SEQ ID NO: 577759 - DNA, 20 bp, Artificial Sequence
  chemically synthesized
ggtgtgttaatttgcagatg

SEQ ID NO: 577760 - DNA, 20 bp, Artificial Sequence
  chemically synthesized
ttaatttgcagatgatttga

SEQ ID NO: 577761 - DNA, 20 bp, Artificial Sequence
  chemically synthesized
atgatttgattctgctttta

SEQ ID NO: 577762 - DNA, 20 bp, Artificial Sequence
  chemically synthesized
acttgtttaaggacagtgat

SEQ ID NO: 577763 - DNA, 20 bp, Artificial Sequence
  chemically synthesized
agctcataagatcattcaga

SEQ ID NO: 577764 - DNA, 20 bp, Artificial Sequence
  chemically synthesized
gagctcattagtatgtctca

SEQ ID NO: 577765 - DNA, 20 bp, Artificial Sequence
  chemically synthesized
ttagtatgtctcatgtggtt

SEQ ID NO: 577766 - DNA, 20 bp, Artificial Sequence
  chemically synthesized
aaaaatgaccatagttgatt

SEQ ID NO: 577767 - DNA, 20 bp, Artificial Sequence
  chemically synthesized
gtgcagaaaaaaatgaccat

SEQ ID NO: 577768 - DNA, 20 bp, Artificial Sequence
  chemically synthesized
ttttgcattttttgtagaga

SEQ ID NO: 577769 - DNA, 20 bp, Artificial Sequence
  chemically synthesized
caggcagatcacttgagtcc

SEQ ID NO: 577770 - DNA, 20 bp, Artificial Sequence
  chemically synthesized
gactcaagtgatctgcctgc

SEQ ID NO: 577771 - DNA, 20 bp, Artificial Sequence
  chemically synthesized
tgcctcagcttcccaaatcc

SEQ ID NO: 577772 - DNA, 20 bp, Artificial Sequence
  chemically synthesized
atggctcatgcctgtaatcc

SEQ ID NO: 577773 - DNA, 20 bp, Artificial Sequence
  chemically synthesized
aatttctattagtattcaac

SEQ ID NO: 577774 - DNA, 20 bp, Artificial Sequence
  chemically synthesized
tagacctcttactatattta

SEQ ID NO: 577775 - DNA, 20 bp, Artificial Sequence
  chemically synthesized
aaaaaaaccatagttggcat

SEQ ID NO: 577776 - DNA, 20 bp, Artificial Sequence
  chemically synthesized
caataaacaagcatgccaac

SEQ ID NO: 577777 - DNA, 20 bp, Artificial Sequence
  chemically synthesized
aaaaaaaaaaaccatagttg

SEQ ID NO: 577778 - DNA, 20 bp, Artificial Sequence
  chemically synthesized
tccaccttccagggggctga

SEQ ID NO: 577779 - DNA, 20 bp, Artificial Sequence
  chemically synthesized
atcattagactcctatgccc

SEQ ID NO: 577780 - DNA, 20 bp, Artificial Sequence
  chemically synthesized
gactcctatgccctatggtt

SEQ ID NO: 577781 - DNA, 20 bp, Artificial Sequence
  chemically synthesized
tatgccctatggttttctgt

SEQ ID NO: 577782 - DNA, 20 bp, Artificial Sequence
  chemically synthesized
caagactctcccttctctgc

SEQ ID NO: 577783 - DNA, 20 bp, Artificial Sequence
  chemically synthesized
gggagagtcttgggtcagag

SEQ ID NO: 577784 - DNA, 20 bp, Artificial Sequence
  chemically synthesized
tttaatgccttgggaggagc

SEQ ID NO: 577785 - DNA, 20 bp, Artificial Sequence
  chemically synthesized
ccaaggcattaaaatctgca

SEQ ID NO: 577786 - DNA, 20 bp, Artificial Sequence
  chemically synthesized
gaaaaaaaaaaaaaacatca

SEQ ID NO: 577787 - DNA, 20 bp, Artificial Sequence
  chemically synthesized
ctgaagccgttgttggggag

SEQ ID NO: 577788 - DNA, 20 bp, Artificial Sequence
  chemically synthesized
gagaaacctctctccccaac

SEQ ID NO: 577789 - DNA, 20 bp, Artificial Sequence
  chemically synthesized
ctagagtcttgtgctatctt

SEQ ID NO: 577790 - DNA, 20 bp, Artificial Sequence
  chemically synthesized
atttacaaggcactacatac

SEQ ID NO: 577791 - DNA, 20 bp, Artificial Sequence
  chemically synthesized
taccctaatctgaatgtgcc

SEQ ID NO: 577792 - DNA, 20 bp, Artificial Sequence
  chemically synthesized
aacaagaaacagatggcaca

SEQ ID NO: 577793 - DNA, 20 bp, Artificial Sequence
  chemically synthesized
tgctgaatttgtgtcctgtt

SEQ ID NO: 577794 - DNA, 20 bp, Artificial Sequence
  chemically synthesized
tgtgaagtgctgaatttgtg

SEQ ID NO: 577795 - DNA, 20 bp, Artificial Sequence
  chemically synthesized
atcaacatcggtatggcact

SEQ ID NO: 577796 - DNA, 20 bp, Artificial Sequence
  chemically synthesized
aactgtaagtgccataccga

SEQ ID NO: 577797 - DNA, 20 bp, Artificial Sequence
  chemically synthesized
tggacatagtctgaactttt

SEQ ID NO: 577798 - DNA, 20 bp, Artificial Sequence
  chemically synthesized
tatcaagttagaccatgtca

SEQ ID NO: 577799 - DNA, 20 bp, Artificial Sequence
  chemically synthesized
ttgacatggtctaacttgat

SEQ ID NO: 577800 - DNA, 20 bp, Artificial Sequence
  chemically synthesized
gtccaataatcatgttgtaa

SEQ ID NO: 577801 - DNA, 20 bp, Artificial Sequence
  chemically synthesized
atattaaaaacttatttaca

SEQ ID NO: 577802 - DNA, 20 bp, Artificial Sequence
  chemically synthesized
actggataagtctgataaca

SEQ ID NO: 577803 - DNA, 20 bp, Artificial Sequence
  chemically synthesized
cttcacagagctagtctctt

SEQ ID NO: 577804 - DNA, 20 bp, Artificial Sequence
  chemically synthesized
acttataactcagaaaaagg

SEQ ID NO: 577805 - DNA, 20 bp, Artificial Sequence
  chemically synthesized
gtcagccctgcattctttta

SEQ ID NO: 577806 - DNA, 20 bp, Artificial Sequence
  chemically synthesized
ccctaagcttgaagagacaa

SEQ ID NO: 577807 - DNA, 20 bp, Artificial Sequence
  chemically synthesized
tacaaatctcctttgtctct

SEQ ID NO: 577808 - DNA, 20 bp, Artificial Sequence
  chemically synthesized
ctttgtctcttcaagcttag

SEQ ID NO: 577809 - DNA, 20 bp, Artificial Sequence
  chemically synthesized
aaaatttcctgcaagctccc

SEQ ID NO: 577810 - DNA, 20 bp, Artificial Sequence
  chemically synthesized
ggaaattttctgttaagaat

SEQ ID NO: 577811 - DNA, 20 bp, Artificial Sequence
  chemically synthesized
tacactctgtgtctcagtat

SEQ ID NO: 577812 - DNA, 20 bp, Artificial Sequence
  chemically synthesized
tttgtccatgtgaggtgttt

SEQ ID NO: 577813 - DNA, 20 bp, Artificial Sequence
  chemically synthesized
atatgatttttgtccatgtg

SEQ ID NO: 577814 - DNA, 20 bp, Artificial Sequence
  chemically synthesized
ctcacatggacaaaaatcat

SEQ ID NO: 577815 - DNA, 20 bp, Artificial Sequence
  chemically synthesized
gcccaaatagtaagaaaccg

SEQ ID NO: 577816 - DNA, 20 bp, Artificial Sequence
  chemically synthesized
aatatcatactacagtgcct

SEQ ID NO: 577817 - DNA, 20 bp, Artificial Sequence
  chemically synthesized
ctgtagtatgatatttttga

SEQ ID NO: 577818 - DNA, 20 bp, Artificial Sequence
  chemically synthesized
gggtccatttgcagctcatt

SEQ ID NO: 577819 - DNA, 20 bp, Artificial Sequence
  chemically synthesized
cctagagtatattaaaataa

SEQ ID NO: 577820 - DNA, 20 bp, Artificial Sequence
  chemically synthesized
gtcctatactattttataga

SEQ ID NO: 577821 - DNA, 20 bp, Artificial Sequence
  chemically synthesized
atggcttctgttgccttaga

SEQ ID NO: 577822 - DNA, 20 bp, Artificial Sequence
  chemically synthesized
aacaagcagcactaaaagtt

SEQ ID NO: 577823 - DNA, 20 bp, Artificial Sequence
  chemically synthesized
ataaatcttttaacttttag

SEQ ID NO: 577824 - DNA, 20 bp, Artificial Sequence
  chemically synthesized
atcttttaacttttagtgct

SEQ ID NO: 577825 - DNA, 20 bp, Artificial Sequence
  chemically synthesized
gtgctgcttgtttcacttct

SEQ ID NO: 577826 - DNA, 20 bp, Artificial Sequence
  chemically synthesized
ttcctttatgaagtagtatt

SEQ ID NO: 577827 - DNA, 20 bp, Artificial Sequence
  chemically synthesized
aagacgccaccccttgacct

SEQ ID NO: 577828 - DNA, 20 bp, Artificial Sequence
  chemically synthesized
cgtttgtgacccataatgca

SEQ ID NO: 577829 - DNA, 20 bp, Artificial Sequence
  chemically synthesized
ccttccttggaagtgcagac

SEQ ID NO: 577830 - DNA, 20 bp, Artificial Sequence
  chemically synthesized
cttggaagtgcagacaagtg

SEQ ID NO: 577831 - DNA, 20 bp, Artificial Sequence
  chemically synthesized
caagtgttttgtttatttgt

SEQ ID NO: 577832 - DNA, 20 bp, Artificial Sequence
  chemically synthesized
gttttgtttatttgttcttg

SEQ ID NO: 577833 - DNA, 20 bp, Artificial Sequence
  chemically synthesized
tcaattcactggctcctttc

SEQ ID NO: 577834 - DNA, 20 bp, Artificial Sequence
  chemically synthesized
tttttttttttaaacacctt

SEQ ID NO: 577835 - DNA, 20 bp, Artificial Sequence
  chemically synthesized
agatgtattagaagctttca

SEQ ID NO: 577836 - DNA, 20 bp, Artificial Sequence
  chemically synthesized
ttttggctagcagatgtatt

SEQ ID NO: 577837 - DNA, 20 bp, Artificial Sequence
  chemically synthesized
cacaagcatgtaatgaaaat

SEQ ID NO: 577838 - DNA, 20 bp, Artificial Sequence
  chemically synthesized
ccaaaacagtcattttcatt

SEQ ID NO: 577839 - DNA, 20 bp, Artificial Sequence
  chemically synthesized
agggccatgtactttttata

SEQ ID NO: 577840 - DNA, 20 bp, Artificial Sequence
  chemically synthesized
cattccatctgactcttcat

SEQ ID NO: 577841 - DNA, 20 bp, Artificial Sequence
  chemically synthesized
gaagagctaccaagcagata

SEQ ID NO: 577842 - DNA, 20 bp, Artificial Sequence
  chemically synthesized
ttaagagttctaaacttatt

SEQ ID NO: 577843 - DNA, 20 bp, Artificial Sequence
  chemically synthesized
attcccaaattgaagaaaac

SEQ ID NO: 577844 - DNA, 20 bp, Artificial Sequence
  chemically synthesized
attatagcagtagccaaaac

SEQ ID NO: 577845 - DNA, 20 bp, Artificial Sequence
  chemically synthesized
aggactgaattgctccccct

SEQ ID NO: 577846 - DNA, 20 bp, Artificial Sequence
  chemically synthesized
gtcctatctgacggttgttc

SEQ ID NO: 577847 - DNA, 20 bp, Artificial Sequence
  chemically synthesized
cctcatctttgaagttatac

SEQ ID NO: 577848 - DNA, 20 bp, Artificial Sequence
  chemically synthesized
ttccgtcatcgtcagagaga

SEQ ID NO: 577849 - DNA, 20 bp, Artificial Sequence
  chemically synthesized
cttccattttaactaactcg

SEQ ID NO: 577850 - DNA, 20 bp, Artificial Sequence
  chemically synthesized
tcgttgagcttgtctccaat

SEQ ID NO: 577851 - DNA, 20 bp, Artificial Sequence
  chemically synthesized
atgatactactagggatgtg

SEQ ID NO: 577852 - DNA, 20 bp, Artificial Sequence
  chemically synthesized
tattttcctaccccttgact

SEQ ID NO: 577853 - DNA, 20 bp, Artificial Sequence
  chemically synthesized
actttgggcttggccacaag

SEQ ID NO: 577854 - DNA, 20 bp, Artificial Sequence
  chemically synthesized
aaaatctctcctcttgtcac

SEQ ID NO: 577855 - DNA, 20 bp, Artificial Sequence
  chemically synthesized
ataaacaaatgtgacaagag

SEQ ID NO: 577856 - DNA, 20 bp, Artificial Sequence
  chemically synthesized
agaggagagattttgaaaag

SEQ ID NO: 577857 - DNA, 20 bp, Artificial Sequence
  chemically synthesized
gagattttgaaaagtgttgt

SEQ ID NO: 577858 - DNA, 20 bp, Artificial Sequence
  chemically synthesized
ccccgagtagctgatgtccc

SEQ ID NO: 577859 - DNA, 20 bp, Artificial Sequence
  chemically synthesized
catggctggaaatggtttag

SEQ ID NO: 577860 - DNA, 20 bp, Artificial Sequence
  chemically synthesized
catagctaaaccatttccag

SEQ ID NO: 577861 - DNA, 20 bp, Artificial Sequence
  chemically synthesized
tttggccaatcatggctgga

SEQ ID NO: 577862 - DNA, 20 bp, Artificial Sequence
  chemically synthesized
ttcatggagctgcagtttgg

SEQ ID NO: 577863 - DNA, 20 bp, Artificial Sequence
  chemically synthesized
tattgatttattcatggagc

SEQ ID NO: 577864 - DNA, 20 bp, Artificial Sequence
  chemically synthesized
tcagtggctaataacaacaa

SEQ ID NO: 577865 - DNA, 20 bp, Artificial Sequence
  chemically synthesized
ccactgaattaaattttttt

SEQ ID NO: 577866 - DNA, 20 bp, Artificial Sequence
  chemically synthesized
tggactgatatgaactgaaa

SEQ ID NO: 577867 - DNA, 20 bp, Artificial Sequence
  chemically synthesized
agtagaactttactggattg

SEQ ID NO: 577868 - DNA, 20 bp, Artificial Sequence
  chemically synthesized
catacatttagtagaacttt

SEQ ID NO: 577869 - DNA, 20 bp, Artificial Sequence
  chemically synthesized
ctaatcatctgttttttttc

SEQ ID NO: 577870 - DNA, 20 bp, Artificial Sequence
  chemically synthesized
tcaagcaaaagaaaaaaaac

SEQ ID NO: 577871 - DNA, 20 bp, Artificial Sequence
  chemically synthesized
aatttgacaactttctaatc

SEQ ID NO: 577872 - DNA, 20 bp, Artificial Sequence
  chemically synthesized
gaacccactaggtcgtattt

SEQ ID NO: 577873 - DNA, 20 bp, Artificial Sequence
  chemically synthesized
caggttttcaagcagactgt

SEQ ID NO: 577874 - DNA, 20 bp, Artificial Sequence
  chemically synthesized
aaatattgcaaaccagaaca

SEQ ID NO: 577875 - DNA, 20 bp, Artificial Sequence
  chemically synthesized
atagttccaaaatgctaagc

SEQ ID NO: 577876 - DNA, 20 bp, Artificial Sequence
  chemically synthesized
aatccaattttgttttaaac

SEQ ID NO: 577877 - DNA, 20 bp, Artificial Sequence
  chemically synthesized
aagctcaagtttaaaacaaa

SEQ ID NO: 577878 - DNA, 20 bp, Artificial Sequence
  chemically synthesized
aaagatatttgagaatccaa

SEQ ID NO: 577879 - DNA, 20 bp, Artificial Sequence
  chemically synthesized
caaatatctttcttgctcag

SEQ ID NO: 577880 - DNA, 20 bp, Artificial Sequence
  chemically synthesized
agcccaaaaggtaccttatc

SEQ ID NO: 577881 - DNA, 20 bp, Artificial Sequence
  chemically synthesized
aacaagtgataaggtacctt

SEQ ID NO: 577882 - DNA, 20 bp, Artificial Sequence
  chemically synthesized
ccttttgggctttctattac

SEQ ID NO: 577883 - DNA, 20 bp, Artificial Sequence
  chemically synthesized
gagtggtaaaactggatctc

SEQ ID NO: 577884 - DNA, 20 bp, Artificial Sequence
  chemically synthesized
atgactgaaaacaagagaga

SEQ ID NO: 577885 - DNA, 20 bp, Artificial Sequence
  chemically synthesized
tcctaaggatgatccttcct

SEQ ID NO: 577886 - DNA, 20 bp, Artificial Sequence
  chemically synthesized
ggatgatccttcctggtggc

SEQ ID NO: 577887 - DNA, 20 bp, Artificial Sequence
  chemically synthesized
ttcctttacgaagtagtgtt

SEQ ID NO: 577888 - DNA, 20 bp, Artificial Sequence
  chemically synthesized
cattcttgacccataatgca

SEQ ID NO: 577889 - DNA, 20 bp, Artificial Sequence
  chemically synthesized
agggtgatgtctggaaatga

SEQ ID NO: 577890 - DNA, 20 bp, Artificial Sequence
  chemically synthesized
gtctttcacctcctgccacc

SEQ ID NO: 577891 - DNA, 20 bp, Artificial Sequence
  chemically synthesized
ccaccaacagcttatttgag

SEQ ID NO: 577892 - DNA, 20 bp, Artificial Sequence
  chemically synthesized
atttgaggagagtttaagaa

SEQ ID NO: 577893 - DNA, 20 bp, Artificial Sequence
  chemically synthesized
ccaatttcatgtgcctcttt

SEQ ID NO: 577894 - DNA, 20 bp, Artificial Sequence
  chemically synthesized
tgtgcctctttatatgcttt

SEQ ID NO: 577895 - DNA, 20 bp, Artificial Sequence
  chemically synthesized
ttgatgttaagaaattattt

SEQ ID NO: 577896 - DNA, 20 bp, Artificial Sequence
  chemically synthesized
attattgaaacatagtaact

SEQ ID NO: 577897 - DNA, 20 bp, Artificial Sequence
  chemically synthesized
caatgtaaaacaatgagtta

SEQ ID NO: 577898 - DNA, 20 bp, Artificial Sequence
  chemically synthesized
attggaggctaaatagaatg

SEQ ID NO: 577899 - DNA, 20 bp, Artificial Sequence
  chemically synthesized
gttttaaaatggctatctcc

SEQ ID NO: 577900 - DNA, 20 bp, Artificial Sequence
  chemically synthesized
tttttttttctcatctgata

SEQ ID NO: 577901 - DNA, 20 bp, Artificial Sequence
  chemically synthesized
tctcatctgataagtggatt

SEQ ID NO: 577902 - DNA, 20 bp, Artificial Sequence
  chemically synthesized
ataagtggattcaatgattt

SEQ ID NO: 577903 - DNA, 20 bp, Artificial Sequence
  chemically synthesized
ggattcaatgatttccaaga

SEQ ID NO: 577904 - DNA, 20 bp, Artificial Sequence
  chemically synthesized
ccaagattttgttttcaact

SEQ ID NO: 577905 - DNA, 20 bp, Artificial Sequence
  chemically synthesized
ttaaagttcgagacagcgcc

SEQ ID NO: 577906 - DNA, 20 bp, Artificial Sequence
  chemically synthesized
tttatattctaaattcatat

SEQ ID NO: 577907 - DNA, 20 bp, Artificial Sequence
  chemically synthesized
taagttgatattttcttctc

SEQ ID NO: 577908 - DNA, 20 bp, Artificial Sequence
  chemically synthesized
tatttgaatagttcaccagc

SEQ ID NO: 577909 - DNA, 20 bp, Artificial Sequence
  chemically synthesized
tctcagctcagtggttatca

SEQ ID NO: 577910 - DNA, 20 bp, Artificial Sequence
  chemically synthesized
cagcctccagcgactgtagg

SEQ ID NO: 577911 - DNA, 20 bp, Artificial Sequence
  chemically synthesized
atcaataaaaggtgcatttg

SEQ ID NO: 577912 - DNA, 20 bp, Artificial Sequence
  chemically synthesized
atttgaggggatttccagca

SEQ ID NO: 577913 - DNA, 20 bp, Artificial Sequence
  chemically synthesized
cggaggaaatcatttatgtc

SEQ ID NO: 577914 - DNA, 20 bp, Artificial Sequence
  chemically synthesized
cagttttaatcttttgacat

SEQ ID NO: 577915 - DNA, 20 bp, Artificial Sequence
  chemically synthesized
ttatgtcaaaagattaaaac

SEQ ID NO: 577916 - DNA, 20 bp, Artificial Sequence
  chemically synthesized
agattaaaactgctgttttc

SEQ ID NO: 577917 - DNA, 20 bp, Artificial Sequence
  chemically synthesized
tcaattaagcaattgaaaac

SEQ ID NO: 577918 - DNA, 20 bp, Artificial Sequence
  chemically synthesized
gtggtaaagcagaatgaata

SEQ ID NO: 577919 - DNA, 20 bp, Artificial Sequence
  chemically synthesized
tgtaataagcaatgtattca

SEQ ID NO: 577920 - DNA, 20 bp, Artificial Sequence
  chemically synthesized
acttccttatttatggctgg

SEQ ID NO: 577921 - DNA, 20 bp, Artificial Sequence
  chemically synthesized
agggccctaagtccctttgt

SEQ ID NO: 577922 - DNA, 20 bp, Artificial Sequence
  chemically synthesized
ggaaaaatttatgcctgtct

SEQ ID NO: 577923 - DNA, 20 bp, Artificial Sequence
  chemically synthesized
agcagagttggctgaccaaa

SEQ ID NO: 577924 - DNA, 20 bp, Artificial Sequence
  chemically synthesized
aacatggtcagagaaggaat

SEQ ID NO: 577925 - DNA, 20 bp, Artificial Sequence
  chemically synthesized
gatggagtatacaacaacct

SEQ ID NO: 577926 - DNA, 20 bp, Artificial Sequence
  chemically synthesized
aggccactttcacacatatt

SEQ ID NO: 577927 - DNA, 20 bp, Artificial Sequence
  chemically synthesized
ctttcccatttatccaaaaa

SEQ ID NO: 577928 - DNA, 20 bp, Artificial Sequence
  chemically synthesized
gcacaaaaaagaataatttg

SEQ ID NO: 577929 - DNA, 20 bp, Artificial Sequence
  chemically synthesized
ttaatgtattacactgctac

SEQ ID NO: 577930 - DNA, 20 bp, Artificial Sequence
  chemically synthesized
ttcaattcatatatatttaa

SEQ ID NO: 577931 - DNA, 20 bp, Artificial Sequence
  chemically synthesized
ttagctaagaacagcttatg

SEQ ID NO: 577932 - DNA, 20 bp, Artificial Sequence
  chemically synthesized
ttatggtggttttagctaag

SEQ ID NO: 577933 - DNA, 20 bp, Artificial Sequence
  chemically synthesized
agtatttctttctcaattat

SEQ ID NO: 577934 - DNA, 20 bp, Artificial Sequence
  chemically synthesized
ttgagaaagaaatacttgag

SEQ ID NO: 577935 - DNA, 20 bp, Artificial Sequence
  chemically synthesized
agttgaatggagcagtgaaa

SEQ ID NO: 577936 - DNA, 20 bp, Artificial Sequence
  chemically synthesized
tgaaaagtagattttggtgt

SEQ ID NO: 577937 - DNA, 20 bp, Artificial Sequence
  chemically synthesized
tgatttagaactttattttc

SEQ ID NO: 577938 - DNA, 20 bp, Artificial Sequence
  chemically synthesized
tttttgtttttgtttaatgg

SEQ ID NO: 577939 - DNA, 20 bp, Artificial Sequence
  chemically synthesized
ccaaaaactctgttttttgt

SEQ ID NO: 577940 - DNA, 20 bp, Artificial Sequence
  chemically synthesized
cattaaacaaaaacaaaaaa

SEQ ID NO: 577941 - DNA, 20 bp, Artificial Sequence
  chemically synthesized
gccataccaaaaactctgtt

SEQ ID NO: 577942 - DNA, 20 bp, Artificial Sequence
  chemically synthesized
acaaaaaacagagtttttgg

SEQ ID NO: 577943 - DNA, 20 bp, Artificial Sequence
  chemically synthesized
cagccaagccataccaaaaa

SEQ ID NO: 577944 - DNA, 20 bp, Artificial Sequence
  chemically synthesized
tatggggattacaatttaag

SEQ ID NO: 577945 - DNA, 20 bp, Artificial Sequence
  chemically synthesized
cgtggggattatggaggtta

SEQ ID NO: 577946 - DNA, 20 bp, Artificial Sequence
  chemically synthesized
ctggtctctcccttgacacg

SEQ ID NO: 577947 - DNA, 20 bp, Artificial Sequence
  chemically synthesized
ggaggtaatggaatcataag

SEQ ID NO: 577948 - DNA, 20 bp, Artificial Sequence
  chemically synthesized
cagcatgggagaaactgccc

SEQ ID NO: 577949 - DNA, 20 bp, Artificial Sequence
  chemically synthesized
ttctcatgatagcgggatct

SEQ ID NO: 577950 - DNA, 20 bp, Artificial Sequence
  chemically synthesized
ggggctcttcctacttcgct

SEQ ID NO: 577951 - DNA, 20 bp, Artificial Sequence
  chemically synthesized
ttcctgcggccttgtgaaga

SEQ ID NO: 577952 - DNA, 20 bp, Artificial Sequence
  chemically synthesized
tgcggccttgtgaagaagat

SEQ ID NO: 577953 - DNA, 20 bp, Artificial Sequence
  chemically synthesized
tgcttccccttcaccttctg

SEQ ID NO: 577954 - DNA, 20 bp, Artificial Sequence
  chemically synthesized
cttcaccttctgccatgatt

SEQ ID NO: 577955 - DNA, 20 bp, Artificial Sequence
  chemically synthesized
ctgggtaatttctaaaggaa

SEQ ID NO: 577956 - DNA, 20 bp, Artificial Sequence
  chemically synthesized
gtatgaaaatggactaatac

SEQ ID NO: 577957 - DNA, 20 bp, Artificial Sequence
  chemically synthesized
aaaatggactaatacagtag

SEQ ID NO: 577958 - DNA, 20 bp, Artificial Sequence
  chemically synthesized
aatattcatttcagtactta

SEQ ID NO: 577959 - DNA, 20 bp, Artificial Sequence
  chemically synthesized
taagatcagtttatccacct

SEQ ID NO: 577960 - DNA, 20 bp, Artificial Sequence
  chemically synthesized
acagaaccccatttcataag

SEQ ID NO: 577961 - DNA, 20 bp, Artificial Sequence
  chemically synthesized
cttatgaaatggggttctgt

SEQ ID NO: 577962 - DNA, 20 bp, Artificial Sequence
  chemically synthesized
taacacacaacgtacaatgt

SEQ ID NO: 577963 - DNA, 20 bp, Artificial Sequence
  chemically synthesized
tatacataatatcacaacac

SEQ ID NO: 577964 - DNA, 20 bp, Artificial Sequence
  chemically synthesized
aagtaacatgtacattctat

SEQ ID NO: 577965 - DNA, 20 bp, Artificial Sequence
  chemically synthesized
gggatcactgcactaaaacc

SEQ ID NO: 577966 - DNA, 20 bp, Artificial Sequence
  chemically synthesized
ttgtaaaataaataaaagcc

SEQ ID NO: 577967 - DNA, 20 bp, Artificial Sequence
  chemically synthesized
aaaatttctagttaatgatc

SEQ ID NO: 577968 - DNA, 20 bp, Artificial Sequence
  chemically synthesized
tctagttaatgatctaagga

SEQ ID NO: 577969 - DNA, 20 bp, Artificial Sequence
  chemically synthesized
tacttccagtcaatatatac

SEQ ID NO: 577970 - DNA, 20 bp, Artificial Sequence
  chemically synthesized
aaagctgttttgttttatat

SEQ ID NO: 577971 - DNA, 20 bp, Artificial Sequence
  chemically synthesized
gaaactattatataaaacaa

SEQ ID NO: 577972 - DNA, 20 bp, Artificial Sequence
  chemically synthesized
tacaaaaaagtcaaaagctg

SEQ ID NO: 577973 - DNA, 20 bp, Artificial Sequence
  chemically synthesized
actgatacaaaaaagtcaaa

SEQ ID NO: 577974 - DNA, 20 bp, Artificial Sequence
  chemically synthesized
gcttttgacttttttgtatc

SEQ ID NO: 577975 - DNA, 20 bp, Artificial Sequence
  chemically synthesized
ttgacttttttgtatcagtt

SEQ ID NO: 577976 - DNA, 20 bp, Artificial Sequence
  chemically synthesized
aagttgttcttcaagtggga

SEQ ID NO: 577977 - DNA, 20 bp, Artificial Sequence
  chemically synthesized
aaattgcagtcttacagatc

SEQ ID NO: 577978 - DNA, 20 bp, Artificial Sequence
  chemically synthesized
tttcttttcatggggacaaa

SEQ ID NO: 577979 - DNA, 20 bp, Artificial Sequence
  chemically synthesized
tatttgtgaatgctctcttc

SEQ ID NO: 577980 - DNA, 20 bp, Artificial Sequence
  chemically synthesized
ttcacaaataaattccgatc

SEQ ID NO: 577981 - DNA, 20 bp, Artificial Sequence
  chemically synthesized
tgaaaatgctcagtctgcac

SEQ ID NO: 577982 - DNA, 20 bp, Artificial Sequence
  chemically synthesized
cggctccagtcatttcataa

SEQ ID NO: 577983 - DNA, 20 bp, Artificial Sequence
  chemically synthesized
aataataaaagtagcagtag

SEQ ID NO: 577984 - DNA, 20 bp, Artificial Sequence
  chemically synthesized
atttatatattcacagtatt

SEQ ID NO: 577985 - DNA, 20 bp, Artificial Sequence
  chemically synthesized
ccattattgttcataggttc

SEQ ID NO: 577986 - DNA, 20 bp, Artificial Sequence
  chemically synthesized
atgaacaataatggtggata

SEQ ID NO: 577987 - DNA, 20 bp, Artificial Sequence
  chemically synthesized
tatgcagattcacatcaaac

SEQ ID NO: 577988 - DNA, 20 bp, Artificial Sequence
  chemically synthesized
gaacacttgaagaaccaaac

SEQ ID NO: 577989 - DNA, 20 bp, Artificial Sequence
  chemically synthesized
ttgtagccattgttattact

SEQ ID NO: 577990 - DNA, 20 bp, Artificial Sequence
  chemically synthesized
gaatgttgttccagtaccta

SEQ ID NO: 577991 - DNA, 20 bp, Artificial Sequence
  chemically synthesized
tctgggagattggctctctg

SEQ ID NO: 577992 - DNA, 20 bp, Artificial Sequence
  chemically synthesized
gtttgattgctcaaaattct

SEQ ID NO: 577993 - DNA, 20 bp, Artificial Sequence
  chemically synthesized
attctaaaatgtcacaagga

SEQ ID NO: 577994 - DNA, 20 bp, Artificial Sequence
  chemically synthesized
gtgcattctaaaatgtcaca

SEQ ID NO: 577995 - DNA, 20 bp, Artificial Sequence
  chemically synthesized
ctaggtgagttaggtatagt

SEQ ID NO: 577996 - DNA, 20 bp, Artificial Sequence
  chemically synthesized
gtgtctcttgaaaggctcaa

SEQ ID NO: 577997 - DNA, 20 bp, Artificial Sequence
  chemically synthesized
aaatgaagtctgaacatata

SEQ ID NO: 577998 - DNA, 20 bp, Artificial Sequence
  chemically synthesized
tcgtcaagacaaatccattg

SEQ ID NO: 577999 - DNA, 20 bp, Artificial Sequence
  chemically synthesized
tcagctgaagaaaaccaggc

SEQ ID NO: 578000 - DNA, 20 bp, Artificial Sequence
  chemically synthesized
tttttatgtagacggtatga

SEQ ID NO: 578001 - DNA, 20 bp, Artificial Sequence
  chemically synthesized
ttggattattctgaatttct

SEQ ID NO: 578002 - DNA, 20 bp, Artificial Sequence
  chemically synthesized
ttttgcatgccttttgaata

SEQ ID NO: 578003 - DNA, 20 bp, Artificial Sequence
  chemically synthesized
tgaaaagagattttttaaat

SEQ ID NO: 578004 - DNA, 20 bp, Artificial Sequence
  chemically synthesized
atttaaaaaatctcttttca

SEQ ID NO: 578005 - DNA, 20 bp, Artificial Sequence
  chemically synthesized
caaaacaaaaacactgtgaa

SEQ ID NO: 578006 - DNA, 20 bp, Artificial Sequence
  chemically synthesized
aaaatctcttttcacagtgt

SEQ ID NO: 578007 - DNA, 20 bp, Artificial Sequence
  chemically synthesized
agtgtttttgttttgagtac

SEQ ID NO: 578008 - DNA, 20 bp, Artificial Sequence
  chemically synthesized
gctttgtaaacatttaatta

SEQ ID NO: 578009 - DNA, 20 bp, Artificial Sequence
  chemically synthesized
acccataaagctagataatt

SEQ ID NO: 578010 - DNA, 20 bp, Artificial Sequence
  chemically synthesized
acatttaattatctagcttt

SEQ ID NO: 578011 - DNA, 20 bp, Artificial Sequence
  chemically synthesized
taattatctagctttatggg

SEQ ID NO: 578012 - DNA, 20 bp, Artificial Sequence
  chemically synthesized
tagctttatgggtttcgttt

SEQ ID NO: 578013 - DNA, 20 bp, Artificial Sequence
  chemically synthesized
agaaatacttccaaaattgg

SEQ ID NO: 578014 - DNA, 20 bp, Artificial Sequence
  chemically synthesized
aaattggaaaggaattttgt

SEQ ID NO: 578015 - DNA, 20 bp, Artificial Sequence
  chemically synthesized
atagctctgttaattactct

SEQ ID NO: 578016 - DNA, 20 bp, Artificial Sequence
  chemically synthesized
cacaagagtaattaacagag

SEQ ID NO: 578017 - DNA, 20 bp, Artificial Sequence
  chemically synthesized
gaaaatagtgaacatgaact

SEQ ID NO: 578018 - DNA, 20 bp, Artificial Sequence
  chemically synthesized
caggagaactgaactgatac

SEQ ID NO: 578019 - DNA, 20 bp, Artificial Sequence
  chemically synthesized
cagttctcctggaaattcat

SEQ ID NO: 578020 - DNA, 20 bp, Artificial Sequence
  chemically synthesized
aaatattgcctaataatgtg

SEQ ID NO: 578021 - DNA, 20 bp, Artificial Sequence
  chemically synthesized
tatcaaaatattgcctaata

SEQ ID NO: 578022 - DNA, 20 bp, Artificial Sequence
  chemically synthesized
atataaggagtgggtagcta

SEQ ID NO: 578023 - DNA, 20 bp, Artificial Sequence
  chemically synthesized
acagaagtgtgtgtatcatc

SEQ ID NO: 578024 - DNA, 20 bp, Artificial Sequence
  chemically synthesized
aaaatgagcagaaataaaca

SEQ ID NO: 578025 - DNA, 20 bp, Artificial Sequence
  chemically synthesized
ttatttatacatcataaaca

SEQ ID NO: 578026 - DNA, 20 bp, Artificial Sequence
  chemically synthesized
gaaccattaaaaaataaaac

SEQ ID NO: 578027 - DNA, 20 bp, Artificial Sequence
  chemically synthesized
gtatgataaaaatataaagc

SEQ ID NO: 578028 - DNA, 20 bp, Artificial Sequence
  chemically synthesized
aattgaaatagtaaatatac

SEQ ID NO: 578029 - DNA, 20 bp, Artificial Sequence
  chemically synthesized
agtaatgtagaataaagctc

SEQ ID NO: 578030 - DNA, 20 bp, Artificial Sequence
  chemically synthesized
atgattgttgcataaagcca

SEQ ID NO: 578031 - DNA, 20 bp, Artificial Sequence
  chemically synthesized
ccattcacatccaggaaaag

SEQ ID NO: 578032 - DNA, 20 bp, Artificial Sequence
  chemically synthesized
gccctgctgttcatgtcttt

SEQ ID NO: 578033 - DNA, 20 bp, Artificial Sequence
  chemically synthesized
agagatctatacattcctgt

SEQ ID NO: 578034 - DNA, 20 bp, Artificial Sequence
  chemically synthesized
gccttaagagatctatacat

SEQ ID NO: 578035 - DNA, 20 bp, Artificial Sequence
  chemically synthesized
aatgagcaggagtgagaggt

SEQ ID NO: 578036 - DNA, 20 bp, Artificial Sequence
  chemically synthesized
tcttaggggttggccatgtg

SEQ ID NO: 578037 - DNA, 20 bp, Artificial Sequence
  chemically synthesized
cctagtcttaggggttggcc

SEQ ID NO: 578038 - DNA, 20 bp, Artificial Sequence
  chemically synthesized
ataaggaggcattgttaagg

SEQ ID NO: 578039 - DNA, 20 bp, Artificial Sequence
  chemically synthesized
ttgcagaaggtggagaagaa

SEQ ID NO: 578040 - DNA, 20 bp, Artificial Sequence
  chemically synthesized
aggtggagaagaaatgggat

SEQ ID NO: 578041 - DNA, 20 bp, Artificial Sequence
  chemically synthesized
agaaactgttatgtagctgt

SEQ ID NO: 578042 - DNA, 20 bp, Artificial Sequence
  chemically synthesized
taaatctactacagctacat

SEQ ID NO: 578043 - DNA, 20 bp, Artificial Sequence
  chemically synthesized
gtcatgttccacaatatatc

SEQ ID NO: 578044 - DNA, 20 bp, Artificial Sequence
  chemically synthesized
ccacaatatttacccgtgct

SEQ ID NO: 578045 - DNA, 20 bp, Artificial Sequence
  chemically synthesized
ttatgtatttttattgttat

SEQ ID NO: 578046 - DNA, 20 bp, Artificial Sequence
  chemically synthesized
caagaatctggaaaaaaaaa

SEQ ID NO: 578047 - DNA, 20 bp, Artificial Sequence
  chemically synthesized
agagaatcttactttttttt

SEQ ID NO: 578048 - DNA, 20 bp, Artificial Sequence
  chemically synthesized
ctatactcacatccgctgtt

SEQ ID NO: 578049 - DNA, 20 bp, Artificial Sequence
  chemically synthesized
ataagacaacactgccccta

SEQ ID NO: 578050 - DNA, 20 bp, Artificial Sequence
  chemically synthesized
gcaagaaaatatttcacatc

SEQ ID NO: 578051 - DNA, 20 bp, Artificial Sequence
  chemically synthesized
gcatgcacaggtgatgagag

SEQ ID NO: 578052 - DNA, 20 bp, Artificial Sequence
  chemically synthesized
acgtgtgtgtgcgtgtgtgt

SEQ ID NO: 578053 - DNA, 20 bp, Artificial Sequence
  chemically synthesized
tgtgtttgtgtacacattct

SEQ ID NO: 578054 - DNA, 20 bp, Artificial Sequence
  chemically synthesized
tctcatctcgtctttcaaat

SEQ ID NO: 578055 - DNA, 20 bp, Artificial Sequence
  chemically synthesized
aatagaaaagtaaaagaaga

SEQ ID NO: 578056 - DNA, 20 bp, Artificial Sequence
  chemically synthesized
atttgaaattcaccctctga

SEQ ID NO: 578057 - DNA, 20 bp, Artificial Sequence
  chemically synthesized
gcgtctctattagaggacta

SEQ ID NO: 578058 - DNA, 20 bp, Artificial Sequence
  chemically synthesized
catatgcaacagtgatcaca

SEQ ID NO: 578059 - DNA, 20 bp, Artificial Sequence
  chemically synthesized
tgatcactgttgcatatgtt

SEQ ID NO: 578060 - DNA, 20 bp, Artificial Sequence
  chemically synthesized
taccatgtgagagtctcaaa

SEQ ID NO: 578061 - DNA, 20 bp, Artificial Sequence
  chemically synthesized
tcacatggtaggtcgatagc

SEQ ID NO: 578062 - DNA, 20 bp, Artificial Sequence
  chemically synthesized
aatatggtagaatattctcc

SEQ ID NO: 578063 - DNA, 20 bp, Artificial Sequence
  chemically synthesized
ttctaccatatttctctttc

SEQ ID NO: 578064 - DNA, 20 bp, Artificial Sequence
  chemically synthesized
actttacacactagcaaagc

SEQ ID NO: 578065 - DNA, 20 bp, Artificial Sequence
  chemically synthesized
gcaagagaaaaatgccaatc

SEQ ID NO: 578066 - DNA, 20 bp, Artificial Sequence
  chemically synthesized
gcatatgattggcatttttc

SEQ ID NO: 578067 - DNA, 20 bp, Artificial Sequence
  chemically synthesized
gattaaaatggaaaataatt

SEQ ID NO: 578068 - DNA, 20 bp, Artificial Sequence
  chemically synthesized
taaaatatattgacttatga

SEQ ID NO: 578069 - DNA, 20 bp, Artificial Sequence
  chemically synthesized
taagtaaaacgacaacaaaa

SEQ ID NO: 578070 - DNA, 20 bp, Artificial Sequence
  chemically synthesized
attctgaaacaggtttttgt

SEQ ID NO: 578071 - DNA, 20 bp, Artificial Sequence
  chemically synthesized
gaagattattttattctgaa

SEQ ID NO: 578072 - DNA, 20 bp, Artificial Sequence
  chemically synthesized
aacttggttagttctagcaa

SEQ ID NO: 578073 - DNA, 20 bp, Artificial Sequence
  chemically synthesized
cccacccctgactgatggtg

SEQ ID NO: 578074 - DNA, 20 bp, Artificial Sequence
  chemically synthesized
atgtgtgtttactgtattga

SEQ ID NO: 578075 - DNA, 20 bp, Artificial Sequence
  chemically synthesized
atttgatttggaatgtgtat

SEQ ID NO: 578076 - DNA, 20 bp, Artificial Sequence
  chemically synthesized
ggaaaaaaggttttgttttg

SEQ ID NO: 578077 - DNA, 20 bp, Artificial Sequence
  chemically synthesized
gagaaggaaaaaaggttttg

SEQ ID NO: 578078 - DNA, 20 bp, Artificial Sequence
  chemically synthesized
atcaagagaaggaaaaaagg

SEQ ID NO: 578079 - DNA, 20 bp, Artificial Sequence
  chemically synthesized
agttaatcaagagaaggaaa

SEQ ID NO: 578080 - DNA, 20 bp, Artificial Sequence
  chemically synthesized
aacaaaaccttttttccttc

SEQ ID NO: 578081 - DNA, 20 bp, Artificial Sequence
  chemically synthesized
gattaactttacttttgaga

SEQ ID NO: 578082 - DNA, 20 bp, Artificial Sequence
  chemically synthesized
gagaaattgattataatgaa

SEQ ID NO: 578083 - DNA, 20 bp, Artificial Sequence
  chemically synthesized
ataaaaatgcattttgttaa

SEQ ID NO: 578084 - DNA, 20 bp, Artificial Sequence
  chemically synthesized
aatgcatttttatgataaag

SEQ ID NO: 578085 - DNA, 20 bp, Artificial Sequence
  chemically synthesized
ttttcacaattatgtctcag

SEQ ID NO: 578086 - DNA, 20 bp, Artificial Sequence
  chemically synthesized
aaaattcagccagtattata

SEQ ID NO: 578087 - DNA, 20 bp, Artificial Sequence
  chemically synthesized
tattataattggattaagtt

SEQ ID NO: 578088 - DNA, 20 bp, Artificial Sequence
  chemically synthesized
atggctctgatggaggcatg

SEQ ID NO: 578089 - DNA, 20 bp, Artificial Sequence
  chemically synthesized
aaaggcttccattaccattt

SEQ ID NO: 578090 - DNA, 20 bp, Artificial Sequence
  chemically synthesized
agctaagccagatgacacct

SEQ ID NO: 578091 - DNA, 20 bp, Artificial Sequence
  chemically synthesized
atggaagcctttaggtgtca

SEQ ID NO: 578092 - DNA, 20 bp, Artificial Sequence
  chemically synthesized
agcctttaggtgtcatctgg

SEQ ID NO: 578093 - DNA, 20 bp, Artificial Sequence
  chemically synthesized
atagtattgtttattcttcc

SEQ ID NO: 578094 - DNA, 20 bp, Artificial Sequence
  chemically synthesized
ggaagaataaacaatactat

SEQ ID NO: 578095 - DNA, 20 bp, Artificial Sequence
  chemically synthesized
ggctagccaatcaagaatag

SEQ ID NO: 578096 - DNA, 20 bp, Artificial Sequence
  chemically synthesized
gaaatgaagaaaataatact

SEQ ID NO: 578097 - DNA, 20 bp, Artificial Sequence
  chemically synthesized
gattctgcaagacagagtct

SEQ ID NO: 578098 - DNA, 20 bp, Artificial Sequence
  chemically synthesized
ctgaaatttgaaaaaaaaaa

SEQ ID NO: 578099 - DNA, 20 bp, Artificial Sequence
  chemically synthesized
gagaaccactagaccagatg

SEQ ID NO: 578100 - DNA, 20 bp, Artificial Sequence
  chemically synthesized
aatttgagaaccactagacc

SEQ ID NO: 578101 - DNA, 20 bp, Artificial Sequence
  chemically synthesized
acctaggggctctttacata

SEQ ID NO: 578102 - DNA, 20 bp, Artificial Sequence
  chemically synthesized
gattccacgacccatcccca

SEQ ID NO: 578103 - DNA, 20 bp, Artificial Sequence
  chemically synthesized
ctgacacaatgcatttttaa

SEQ ID NO: 578104 - DNA, 20 bp, Artificial Sequence
  chemically synthesized
taggtaaaagatatgtttct

SEQ ID NO: 578105 - DNA, 20 bp, Artificial Sequence
  chemically synthesized
atgatggatctaggtaaaag

SEQ ID NO: 578106 - DNA, 20 bp, Artificial Sequence
  chemically synthesized
ctccaacagcactgacttcc

SEQ ID NO: 578107 - DNA, 20 bp, Artificial Sequence
  chemically synthesized
ttccccaggattacagaggc

SEQ ID NO: 578108 - DNA, 20 bp, Artificial Sequence
  chemically synthesized
accttaatacttctattaaa

SEQ ID NO: 578109 - DNA, 20 bp, Artificial Sequence
  chemically synthesized
tttaagtatccttaaaaagg

SEQ ID NO: 578110 - DNA, 20 bp, Artificial Sequence
  chemically synthesized
ttaaggatacttaaaagcga

SEQ ID NO: 578111 - DNA, 20 bp, Artificial Sequence
  chemically synthesized
acaaaaatggggaaaagcct

SEQ ID NO: 578112 - DNA, 20 bp, Artificial Sequence
  chemically synthesized
tgatcattttaatcatttct

SEQ ID NO: 578113 - DNA, 20 bp, Artificial Sequence
  chemically synthesized
caagatcccaaatcaaaaag

SEQ ID NO: 578114 - DNA, 20 bp, Artificial Sequence
  chemically synthesized
tgctggggtacagtgtcatt

SEQ ID NO: 578115 - DNA, 20 bp, Artificial Sequence
  chemically synthesized
acacactggaggctgaggca

SEQ ID NO: 578116 - DNA, 20 bp, Artificial Sequence
  chemically synthesized
aattaactgggtgtgggagc

SEQ ID NO: 578117 - DNA, 20 bp, Artificial Sequence
  chemically synthesized
ctcctgagctcaagtgatcc

SEQ ID NO: 578118 - DNA, 20 bp, Artificial Sequence
  chemically synthesized
tgctttagcctcccacagtt

SEQ ID NO: 578119 - DNA, 20 bp, Artificial Sequence
  chemically synthesized
aatggtaccccgttatcctg

SEQ ID NO: 578120 - DNA, 20 bp, Artificial Sequence
  chemically synthesized
atcaccactatccatctcta

SEQ ID NO: 578121 - DNA, 20 bp, Artificial Sequence
  chemically synthesized
tgtttaatgagtacctgagt

SEQ ID NO: 578122 - DNA, 20 bp, Artificial Sequence
  chemically synthesized
gcttattgtttaatgagtac

SEQ ID NO: 578123 - DNA, 20 bp, Artificial Sequence
  chemically synthesized
ggaagaagagaatgagggct

SEQ ID NO: 578124 - DNA, 20 bp, Artificial Sequence
  chemically synthesized
agctggaggaagaagagaat

SEQ ID NO: 578125 - DNA, 20 bp, Artificial Sequence
  chemically synthesized
gacacaaaatgaaaaatatt

SEQ ID NO: 578126 - DNA, 20 bp, Artificial Sequence
  chemically synthesized
acaatatttttcattttgtg

SEQ ID NO: 578127 - DNA, 20 bp, Artificial Sequence
  chemically synthesized
tttcacttagcataatgcct

SEQ ID NO: 578128 - DNA, 20 bp, Artificial Sequence
  chemically synthesized
ttcacccatattagctcatc

SEQ ID NO: 578129 - DNA, 20 bp, Artificial Sequence
  chemically synthesized
cacccaggaatgccctttct

SEQ ID NO: 578130 - DNA, 20 bp, Artificial Sequence
  chemically synthesized
ttaagaaagtcttagttttt

SEQ ID NO: 578131 - DNA, 20 bp, Artificial Sequence
  chemically synthesized
cagcgcagccttaagaaagt

SEQ ID NO: 578132 - DNA, 20 bp, Artificial Sequence
  chemically synthesized
tttcttaaggctgcgctgtg

SEQ ID NO: 578133 - DNA, 20 bp, Artificial Sequence
  chemically synthesized
tttatttgcttttctttgtc

SEQ ID NO: 578134 - DNA, 20 bp, Artificial Sequence
  chemically synthesized
cttctttatttcacttcttt

SEQ ID NO: 578135 - DNA, 20 bp, Artificial Sequence
  chemically synthesized
tacctctcgaatagcaacat

SEQ ID NO: 578136 - DNA, 20 bp, Artificial Sequence
  chemically synthesized
tgctattcgagaggtattta

SEQ ID NO: 578137 - DNA, 20 bp, Artificial Sequence
  chemically synthesized
tcgagaggtatttatcgtgc

SEQ ID NO: 578138 - DNA, 20 bp, Artificial Sequence
  chemically synthesized
agttactgtcatgagcattt

SEQ ID NO: 578139 - DNA, 20 bp, Artificial Sequence
  chemically synthesized
cagaagggaagttatttaat

SEQ ID NO: 578140 - DNA, 20 bp, Artificial Sequence
  chemically synthesized
atttatgttttattgtagaa

SEQ ID NO: 578141 - DNA, 20 bp, Artificial Sequence
  chemically synthesized
ttttattgtagaaaaaagtt

SEQ ID NO: 578142 - DNA, 20 bp, Artificial Sequence
  chemically synthesized
ttggagatacaccagtatac

SEQ ID NO: 578143 - DNA, 20 bp, Artificial Sequence
  chemically synthesized
cacttagaggcaaggcctgg

SEQ ID NO: 578144 - DNA, 20 bp, Artificial Sequence
  chemically synthesized
gtaatgctttcgagaagagg

SEQ ID NO: 578145 - DNA, 20 bp, Artificial Sequence
  chemically synthesized
tgactgggataatgactact

SEQ ID NO: 578146 - DNA, 20 bp, Artificial Sequence
  chemically synthesized
atttataagaaactttgtat

SEQ ID NO: 578147 - DNA, 20 bp, Artificial Sequence
  chemically synthesized
atttaattaaagctgccata

SEQ ID NO: 578148 - DNA, 20 bp, Artificial Sequence
  chemically synthesized
ctttccatggagaagtatca

SEQ ID NO: 578149 - DNA, 20 bp, Artificial Sequence
  chemically synthesized
gatacttctccatggaaagg

SEQ ID NO: 578150 - DNA, 20 bp, Artificial Sequence
  chemically synthesized
cccttgaatcagagctctgt

SEQ ID NO: 578151 - DNA, 20 bp, Artificial Sequence
  chemically synthesized
tttgtcaatcagtgacagag

SEQ ID NO: 578152 - DNA, 20 bp, Artificial Sequence
  chemically synthesized
tatgggagaagcaaaaccat

SEQ ID NO: 578153 - DNA, 20 bp, Artificial Sequence
  chemically synthesized
tgccctaaaagcaagaatgg

SEQ ID NO: 578154 - DNA, 20 bp, Artificial Sequence
  chemically synthesized
aggcctgccctaaaagcaag

SEQ ID NO: 578155 - DNA, 20 bp, Artificial Sequence
  chemically synthesized
tgcttttagggcaggccttg

SEQ ID NO: 578156 - DNA, 20 bp, Artificial Sequence
  chemically synthesized
agggcaggccttgagaagct

SEQ ID NO: 578157 - DNA, 20 bp, Artificial Sequence
  chemically synthesized
agggacaagaaattaaagct

SEQ ID NO: 578158 - DNA, 20 bp, Artificial Sequence
  chemically synthesized
ggacctctccatggagcagt

SEQ ID NO: 578159 - DNA, 20 bp, Artificial Sequence
  chemically synthesized
tcatgtggacctctccatgg

SEQ ID NO: 578160 - DNA, 20 bp, Artificial Sequence
  chemically synthesized
ctggaaaataggtgctgact

SEQ ID NO: 578161 - DNA, 20 bp, Artificial Sequence
  chemically synthesized
ggggtagattgcctgatgct

SEQ ID NO: 578162 - DNA, 20 bp, Artificial Sequence
  chemically synthesized
tttcagttgatatcagttgg

SEQ ID NO: 578163 - DNA, 20 bp, Artificial Sequence
  chemically synthesized
gttcaatggggcttgcttat

SEQ ID NO: 578164 - DNA, 20 bp, Artificial Sequence
  chemically synthesized
tttgctcaaggttcaatggg

SEQ ID NO: 578165 - DNA, 20 bp, Artificial Sequence
  chemically synthesized
acagtttgctcaaggttcaa

SEQ ID NO: 578166 - DNA, 20 bp, Artificial Sequence
  chemically synthesized
ccattgaaccttgagcaaac

SEQ ID NO: 578167 - DNA, 20 bp, Artificial Sequence
  chemically synthesized
acttgttttgttcatgaatc

SEQ ID NO: 578168 - DNA, 20 bp, Artificial Sequence
  chemically synthesized
tcatggcttcagtaaaaatt

SEQ ID NO: 578169 - DNA, 20 bp, Artificial Sequence
  chemically synthesized
agtaatttttactgaagcca

SEQ ID NO: 578170 - DNA, 20 bp, Artificial Sequence
  chemically synthesized
aacaagccagcccaaaactt

SEQ ID NO: 578171 - DNA, 20 bp, Artificial Sequence
  chemically synthesized
ctgaagccatgaagttttgg

SEQ ID NO: 578172 - DNA, 20 bp, Artificial Sequence
  chemically synthesized
aaaagaggaattaatagtgg

SEQ ID NO: 578173 - DNA, 20 bp, Artificial Sequence
  chemically synthesized
atcaacttgtatattttcat

SEQ ID NO: 578174 - DNA, 20 bp, Artificial Sequence
  chemically synthesized
agtggaaaatgtactttttg

SEQ ID NO: 578175 - DNA, 20 bp, Artificial Sequence
  chemically synthesized
ttatttggatgcaaccattg

SEQ ID NO: 578176 - DNA, 20 bp, Artificial Sequence
  chemically synthesized
ggttgcatccaaataagaac

SEQ ID NO: 578177 - DNA, 20 bp, Artificial Sequence
  chemically synthesized
cttcacctggtatggtaaat

SEQ ID NO: 578178 - DNA, 20 bp, Artificial Sequence
  chemically synthesized
taaaaagtgcaatgagtaga

SEQ ID NO: 578179 - DNA, 20 bp, Artificial Sequence
  chemically synthesized
tttggaaaatggctgtgcaa

SEQ ID NO: 578180 - DNA, 20 bp, Artificial Sequence
  chemically synthesized
aaatcctttttagtttttgc

SEQ ID NO: 578181 - DNA, 20 bp, Artificial Sequence
  chemically synthesized
aaagctactgcaaaaactaa

SEQ ID NO: 578182 - DNA, 20 bp, Artificial Sequence
  chemically synthesized
gatttactccataaatcctt

SEQ ID NO: 578183 - DNA, 20 bp, Artificial Sequence
  chemically synthesized
cacttgaccaggcattcttc

SEQ ID NO: 578184 - DNA, 20 bp, Artificial Sequence
  chemically synthesized
tcccaattcaacaattcaat

SEQ ID NO: 578185 - DNA, 20 bp, Artificial Sequence
  chemically synthesized
gctcctgagagcaactgaaa

SEQ ID NO: 578186 - DNA, 20 bp, Artificial Sequence
  chemically synthesized
agtaaaatctttagagaact

SEQ ID NO: 578187 - DNA, 20 bp, Artificial Sequence
  chemically synthesized
aatataatctttcagttctc

SEQ ID NO: 578188 - DNA, 20 bp, Artificial Sequence
  chemically synthesized
aggagcaaacaaaagtaatt

SEQ ID NO: 578189 - DNA, 20 bp, Artificial Sequence
  chemically synthesized
gtgagaaagcaacaaattac

SEQ ID NO: 578190 - DNA, 20 bp, Artificial Sequence
  chemically synthesized
attagtctagatggaagaat

SEQ ID NO: 578191 - DNA, 20 bp, Artificial Sequence
  chemically synthesized
ctaatatgatctccagtggg

SEQ ID NO: 578192 - DNA, 20 bp, Artificial Sequence
  chemically synthesized
cattacgcctggttatgaga

SEQ ID NO: 578193 - DNA, 20 bp, Artificial Sequence
  chemically synthesized
cttttacctcttcggagaat

SEQ ID NO: 578194 - DNA, 20 bp, Artificial Sequence
  chemically synthesized
tttgtgcaataacttttctt

SEQ ID NO: 578195 - DNA, 20 bp, Artificial Sequence
  chemically synthesized
tcagaaagttcacatttttt

SEQ ID NO: 578196 - DNA, 20 bp, Artificial Sequence
  chemically synthesized
tgaggtccttttgcagttta

SEQ ID NO: 578197 - DNA, 20 bp, Artificial Sequence
  chemically synthesized
cattccacatgaggtccttt

SEQ ID NO: 578198 - DNA, 20 bp, Artificial Sequence
  chemically synthesized
aaataatttaggttatcagc

SEQ ID NO: 578199 - DNA, 20 bp, Artificial Sequence
  chemically synthesized
aaaacattccaggtattagt

SEQ ID NO: 578200 - DNA, 20 bp, Artificial Sequence
  chemically synthesized
taatctttgactaatacctg

SEQ ID NO: 578201 - DNA, 20 bp, Artificial Sequence
  chemically synthesized
ttaaaaataatttaaaggac

SEQ ID NO: 578202 - DNA, 20 bp, Artificial Sequence
  chemically synthesized
gaattttccagtaggatggg

SEQ ID NO: 578203 - DNA, 20 bp, Artificial Sequence
  chemically synthesized
acatagaggaatatcatttt

SEQ ID NO: 578204 - DNA, 20 bp, Artificial Sequence
  chemically synthesized
caagaattgaaaaggtcagg

SEQ ID NO: 578205 - DNA, 20 bp, Artificial Sequence
  chemically synthesized
cttttcctgaccttttcaat

SEQ ID NO: 578206 - DNA, 20 bp, Artificial Sequence
  chemically synthesized
gcaaatagtcccagccttct

SEQ ID NO: 578207 - DNA, 20 bp, Artificial Sequence
  chemically synthesized
aacgttaataaaattaataa

SEQ ID NO: 578208 - DNA, 20 bp, Artificial Sequence
  chemically synthesized
acgttatctatcagtcattg

SEQ ID NO: 578209 - DNA, 20 bp, Artificial Sequence
  chemically synthesized
gtgatttcctgtgttactca

SEQ ID NO: 578210 - DNA, 20 bp, Artificial Sequence
  chemically synthesized
ctgaaacacagtttggtaaa

SEQ ID NO: 578211 - DNA, 20 bp, Artificial Sequence
  chemically synthesized
aagaaactccttttaccaaa

SEQ ID NO: 578212 - DNA, 20 bp, Artificial Sequence
  chemically synthesized
aaagttgagattgcctgaaa

SEQ ID NO: 578213 - DNA, 20 bp, Artificial Sequence
  chemically synthesized
caggcaatctcaactttggt

SEQ ID NO: 578214 - DNA, 20 bp, Artificial Sequence
  chemically synthesized
ctttcaatcagacaccaaag

SEQ ID NO: 578215 - DNA, 20 bp, Artificial Sequence
  chemically synthesized
ctcttacaattttcagtata

SEQ ID NO: 578216 - DNA, 20 bp, Artificial Sequence
  chemically synthesized
tcatgaatgagggtattcag

SEQ ID NO: 578217 - DNA, 20 bp, Artificial Sequence
  chemically synthesized
gtttatatcccaagacttta

SEQ ID NO: 578218 - DNA, 20 bp, Artificial Sequence
  chemically synthesized
tttccaaaacgagtcaatat

SEQ ID NO: 578219 - DNA, 20 bp, Artificial Sequence
  chemically synthesized
gttcttaagcgttcatattg

SEQ ID NO: 578220 - DNA, 20 bp, Artificial Sequence
  chemically synthesized
gcttaagaactaaaatttat

SEQ ID NO: 578221 - DNA, 20 bp, Artificial Sequence
  chemically synthesized
atttatggaagattaacaat

SEQ ID NO: 578222 - DNA, 20 bp, Artificial Sequence
  chemically synthesized
gaaaatccattttgtttaaa

SEQ ID NO: 578223 - DNA, 20 bp, Artificial Sequence
  chemically synthesized
ttgaagctttctttaaacaa

SEQ ID NO: 578224 - DNA, 20 bp, Artificial Sequence
  chemically synthesized
ctgtgagtgttgaaaatcca

SEQ ID NO: 578225 - DNA, 20 bp, Artificial Sequence
  chemically synthesized
acagtaaccaatatttcaag

SEQ ID NO: 578226 - DNA, 20 bp, Artificial Sequence
  chemically synthesized
aaatagacgtgtgaatgaaa

SEQ ID NO: 578227 - DNA, 20 bp, Artificial Sequence
  chemically synthesized
cacacgtctatttctttcta

SEQ ID NO: 578228 - DNA, 20 bp, Artificial Sequence
  chemically synthesized
accttgagagcacaattctc

SEQ ID NO: 578229 - DNA, 20 bp, Artificial Sequence
  chemically synthesized
tatgtataaatagactttgg

SEQ ID NO: 578230 - DNA, 20 bp, Artificial Sequence
  chemically synthesized
atattatgttattactattt

SEQ ID NO: 578231 - DNA, 20 bp, Artificial Sequence
  chemically synthesized
tagtaataacataatattag

SEQ ID NO: 578232 - DNA, 20 bp, Artificial Sequence
  chemically synthesized
taatattagctatgtttatt

SEQ ID NO: 578233 - DNA, 20 bp, Artificial Sequence
  chemically synthesized
taatgtactgaagtgcatgg

SEQ ID NO: 578234 - DNA, 20 bp, Artificial Sequence
  chemically synthesized
gaagaggtagctgtcattac

SEQ ID NO: 578235 - DNA, 20 bp, Artificial Sequence
  chemically synthesized
agacgcatttctgaattgct

SEQ ID NO: 578236 - DNA, 20 bp, Artificial Sequence
  chemically synthesized
atggtcagtaagccccagaa

SEQ ID NO: 578237 - DNA, 20 bp, Artificial Sequence
  chemically synthesized
ctgagtttaaatcgtgattc

SEQ ID NO: 578238 - DNA, 20 bp, Artificial Sequence
  chemically synthesized
cccgactgcctgagtttaaa

SEQ ID NO: 578239 - DNA, 20 bp, Artificial Sequence
  chemically synthesized
cacgatttaaactcaggcag

SEQ ID NO: 578240 - DNA, 20 bp, Artificial Sequence
  chemically synthesized
gaactttgaagcccgactgc

SEQ ID NO: 578241 - DNA, 20 bp, Artificial Sequence
  chemically synthesized
tagagagaggctggggtgga

SEQ ID NO: 578242 - DNA, 20 bp, Artificial Sequence
  chemically synthesized
gcatttctctgcactttaaa

SEQ ID NO: 578243 - DNA, 20 bp, Artificial Sequence
  chemically synthesized
gagatggagacaagatgtct

SEQ ID NO: 578244 - DNA, 20 bp, Artificial Sequence
  chemically synthesized
ttgggggctcagggaaaaag

SEQ ID NO: 578245 - DNA, 20 bp, Artificial Sequence
  chemically synthesized
ggaaaaagggaagattcgaa

SEQ ID NO: 578246 - DNA, 20 bp, Artificial Sequence
  chemically synthesized
ggctttccttgaaaagtagg

SEQ ID NO: 578247 - DNA, 20 bp, Artificial Sequence
  chemically synthesized
gaaaagtaggtaatgtttgg

SEQ ID NO: 578248 - DNA, 20 bp, Artificial Sequence
  chemically synthesized
ttgagattcctttttttcat

SEQ ID NO: 578249 - DNA, 20 bp, Artificial Sequence
  chemically synthesized
cgatgatcttgttttttgtc

SEQ ID NO: 578250 - DNA, 20 bp, Artificial Sequence
  chemically synthesized
acttctgtgtctttcgatga

SEQ ID NO: 578251 - DNA, 20 bp, Artificial Sequence
  chemically synthesized
cctactaaaatgaacagcta

SEQ ID NO: 578252 - DNA, 20 bp, Artificial Sequence
  chemically synthesized
attgagaggtaaaataagaa

SEQ ID NO: 578253 - DNA, 20 bp, Artificial Sequence
  chemically synthesized
tctccacaattgcccctgag

SEQ ID NO: 578254 - DNA, 20 bp, Artificial Sequence
  chemically synthesized
ggagtctgtagaatattctg

SEQ ID NO: 578255 - DNA, 20 bp, Artificial Sequence
  chemically synthesized
aagggctttgaagtcaaaaa

SEQ ID NO: 578256 - DNA, 20 bp, Artificial Sequence
  chemically synthesized
tccatgagagcaaagatttc

SEQ ID NO: 578257 - DNA, 20 bp, Artificial Sequence
  chemically synthesized
caatgcaaattccatgagag

SEQ ID NO: 578258 - DNA, 20 bp, Artificial Sequence
  chemically synthesized
cattgtagttacaacctaag

SEQ ID NO: 578259 - DNA, 20 bp, Artificial Sequence
  chemically synthesized
acaacctaagctatgtttta

SEQ ID NO: 578260 - DNA, 20 bp, Artificial Sequence
  chemically synthesized
ttaaattaagcttcctaaaa

SEQ ID NO: 578261 - DNA, 20 bp, Artificial Sequence
  chemically synthesized
cttgcagatttccatttaaa

SEQ ID NO: 578262 - DNA, 20 bp, Artificial Sequence
  chemically synthesized
atttaaatggaaatctgcaa

SEQ ID NO: 578263 - DNA, 20 bp, Artificial Sequence
  chemically synthesized
ccagtggctccaatccaact

SEQ ID NO: 578264 - DNA, 20 bp, Artificial Sequence
  chemically synthesized
tcaagttcatttttaaggtc

SEQ ID NO: 578265 - DNA, 20 bp, Artificial Sequence
  chemically synthesized
tgaaagtgaggcaagtaagt

SEQ ID NO: 578266 - DNA, 20 bp, Artificial Sequence
  chemically synthesized
ggaataaaaatgttcaaatc

SEQ ID NO: 578267 - DNA, 20 bp, Artificial Sequence
  chemically synthesized
tttctccatctcctttaatc

SEQ ID NO: 578268 - DNA, 20 bp, Artificial Sequence
  chemically synthesized
attaaaggagatggagaaaa

SEQ ID NO: 578269 - DNA, 20 bp, Artificial Sequence
  chemically synthesized
ctaaatatcaaatgaagata

SEQ ID NO: 578270 - DNA, 20 bp, Artificial Sequence
  chemically synthesized
tatcaattctatgcattctt

SEQ ID NO: 578271 - DNA, 20 bp, Artificial Sequence
  chemically synthesized
gaatgcatagaattgatact

SEQ ID NO: 578272 - DNA, 20 bp, Artificial Sequence
  chemically synthesized
gtggctcacacctgtaatct

SEQ ID NO: 578273 - DNA, 20 bp, Artificial Sequence
  chemically synthesized
cgccccggcctcccaaaacg

SEQ ID NO: 578274 - DNA, 20 bp, Artificial Sequence
  chemically synthesized
cgggcgcatcacctgaggtc

SEQ ID NO: 578275 - DNA, 20 bp, Artificial Sequence
  chemically synthesized
ttttttatttttagtacaga

SEQ ID NO: 578276 - DNA, 20 bp, Artificial Sequence
  chemically synthesized
tgcctcagcctcccaagtag

SEQ ID NO: 578277 - DNA, 20 bp, Artificial Sequence
  chemically synthesized
aacctccacctcccgggttc

SEQ ID NO: 578278 - DNA, 20 bp, Artificial Sequence
  chemically synthesized
gaggtggaggttgcagtgag

SEQ ID NO: 578279 - DNA, 20 bp, Artificial Sequence
  chemically synthesized
gtgaggttgtgaagaaaggg

SEQ ID NO: 578280 - DNA, 20 bp, Artificial Sequence
  chemically synthesized
ttagttcagccactgtggaa

SEQ ID NO: 578281 - DNA, 20 bp, Artificial Sequence
  chemically synthesized
agttcttagaggtatttcca

SEQ ID NO: 578282 - DNA, 20 bp, Artificial Sequence
  chemically synthesized
attgctgggttgaacggtag

SEQ ID NO: 578283 - DNA, 20 bp, Artificial Sequence
  chemically synthesized
ctgcatgtgtctttatggta

SEQ ID NO: 578284 - DNA, 20 bp, Artificial Sequence
  chemically synthesized
ctaccattgatgggcattta

SEQ ID NO: 578285 - DNA, 20 bp, Artificial Sequence
  chemically synthesized
ctgtgcagccagaaaaaaga

SEQ ID NO: 578286 - DNA, 20 bp, Artificial Sequence
  chemically synthesized
ataagtgagaatatatggta

SEQ ID NO: 578287 - DNA, 20 bp, Artificial Sequence
  chemically synthesized
tctttgtgttcatatgtact

SEQ ID NO: 578288 - DNA, 20 bp, Artificial Sequence
  chemically synthesized
ccctccaccctagagtagat

SEQ ID NO: 578289 - DNA, 20 bp, Artificial Sequence
  chemically synthesized
aataagcatggtacctgata

SEQ ID NO: 578290 - DNA, 20 bp, Artificial Sequence
  chemically synthesized
gagaaactacctatcaggta

SEQ ID NO: 578291 - DNA, 20 bp, Artificial Sequence
  chemically synthesized
catgtcatgggagtttggtg

SEQ ID NO: 578292 - DNA, 20 bp, Artificial Sequence
  chemically synthesized
atgggtaaattgcatgtcat

SEQ ID NO: 578293 - DNA, 20 bp, Artificial Sequence
  chemically synthesized
taagctctaggggcacatgt

SEQ ID NO: 578294 - DNA, 20 bp, Artificial Sequence
  chemically synthesized
caaacctgcacatgtgcccc

SEQ ID NO: 578295 - DNA, 20 bp, Artificial Sequence
  chemically synthesized
agaaagaaagaggaaggaat

SEQ ID NO: 578296 - DNA, 20 bp, Artificial Sequence
  chemically synthesized
agcagtaataacaaaatatg

SEQ ID NO: 578297 - DNA, 20 bp, Artificial Sequence
  chemically synthesized
atatttgcatttggtagtta

SEQ ID NO: 578298 - DNA, 20 bp, Artificial Sequence
  chemically synthesized
gttatggtgatttcatagag

SEQ ID NO: 578299 - DNA, 20 bp, Artificial Sequence
  chemically synthesized
ctttcctttacattttaaag

SEQ ID NO: 578300 - DNA, 20 bp, Artificial Sequence
  chemically synthesized
ttaaaatgtaaaggaaagat

SEQ ID NO: 578301 - DNA, 20 bp, Artificial Sequence
  chemically synthesized
tccactaatttctattagat

SEQ ID NO: 578302 - DNA, 20 bp, Artificial Sequence
  chemically synthesized
tttctattagatgagtgatt

SEQ ID NO: 578303 - DNA, 20 bp, Artificial Sequence
  chemically synthesized
tattagatgagtgatttgaa

SEQ ID NO: 578304 - DNA, 20 bp, Artificial Sequence
  chemically synthesized
aagacccaagatcaccaaaa

SEQ ID NO: 578305 - DNA, 20 bp, Artificial Sequence
  chemically synthesized
agaaaagtcagcatttgaac

SEQ ID NO: 578306 - DNA, 20 bp, Artificial Sequence
  chemically synthesized
agttttttggattttggatt

SEQ ID NO: 578307 - DNA, 20 bp, Artificial Sequence
  chemically synthesized
gcttttagagttttttggat

SEQ ID NO: 578308 - DNA, 20 bp, Artificial Sequence
  chemically synthesized
attttcagcttttagagttt

SEQ ID NO: 578309 - DNA, 20 bp, Artificial Sequence
  chemically synthesized
gctcaaaaattttcagcttt

SEQ ID NO: 578310 - DNA, 20 bp, Artificial Sequence
  chemically synthesized
catgtcggcgctcaaaaatt

SEQ ID NO: 578311 - DNA, 20 bp, Artificial Sequence
  chemically synthesized
ctgaaaatttttgagcgccg

SEQ ID NO: 578312 - DNA, 20 bp, Artificial Sequence
  chemically synthesized
gtatttccaattttgaattt

SEQ ID NO: 578313 - DNA, 20 bp, Artificial Sequence
  chemically synthesized
attttgaattttggggtttg

SEQ ID NO: 578314 - DNA, 20 bp, Artificial Sequence
  chemically synthesized
attttttcagattttggatt

SEQ ID NO: 578315 - DNA, 20 bp, Artificial Sequence
  chemically synthesized
gatttcagattttttcagat

SEQ ID NO: 578316 - DNA, 20 bp, Artificial Sequence
  chemically synthesized
ttttttggatttcagatttt

SEQ ID NO: 578317 - DNA, 20 bp, Artificial Sequence
  chemically synthesized
ttctgattctttttttggat

SEQ ID NO: 578318 - DNA, 20 bp, Artificial Sequence
  chemically synthesized
aatttttttctgattctttt

SEQ ID NO: 578319 - DNA, 20 bp, Artificial Sequence
  chemically synthesized
tgttatggatatcaattttt

SEQ ID NO: 578320 - DNA, 20 bp, Artificial Sequence
  chemically synthesized
tccataacacttgtggtccc

SEQ ID NO: 578321 - DNA, 20 bp, Artificial Sequence
  chemically synthesized
tagtagaagttacccagcct

SEQ ID NO: 578322 - DNA, 20 bp, Artificial Sequence
  chemically synthesized
gccaaggtgtgtactaagtg

SEQ ID NO: 578323 - DNA, 20 bp, Artificial Sequence
  chemically synthesized
tatgtgccaaggtgtgtact

SEQ ID NO: 578324 - DNA, 20 bp, Artificial Sequence
  chemically synthesized
cacaataaatgtttactttt

SEQ ID NO: 578325 - DNA, 20 bp, Artificial Sequence
  chemically synthesized
aaaagtaaacatttattgtg

SEQ ID NO: 578326 - DNA, 20 bp, Artificial Sequence
  chemically synthesized
aactaaaagcttgtcacaat

SEQ ID NO: 578327 - DNA, 20 bp, Artificial Sequence
  chemically synthesized
aacatttattgtgacaagct

SEQ ID NO: 578328 - DNA, 20 bp, Artificial Sequence
  chemically synthesized
ggagggcaattatataaact

SEQ ID NO: 578329 - DNA, 20 bp, Artificial Sequence
  chemically synthesized
ataataggagtaccaacatc

SEQ ID NO: 578330 - DNA, 20 bp, Artificial Sequence
  chemically synthesized
aagaataataactaaatatt

SEQ ID NO: 578331 - DNA, 20 bp, Artificial Sequence
  chemically synthesized
ttgacttttaagagcatcct

SEQ ID NO: 578332 - DNA, 20 bp, Artificial Sequence
  chemically synthesized
catcctattagatttacatc

SEQ ID NO: 578333 - DNA, 20 bp, Artificial Sequence
  chemically synthesized
atttacatcttcagtttgac

SEQ ID NO: 578334 - DNA, 20 bp, Artificial Sequence
  chemically synthesized
ttaataaggacctttcactt

SEQ ID NO: 578335 - DNA, 20 bp, Artificial Sequence
  chemically synthesized
ttcacttgaaagctttttca

SEQ ID NO: 578336 - DNA, 20 bp, Artificial Sequence
  chemically synthesized
taaatatgaaagcactttga

SEQ ID NO: 578337 - DNA, 20 bp, Artificial Sequence
  chemically synthesized
ccattgtgttttattcctcg

SEQ ID NO: 578338 - DNA, 20 bp, Artificial Sequence
  chemically synthesized
ttgttagcctccaataacca

SEQ ID NO: 578339 - DNA, 20 bp, Artificial Sequence
  chemically synthesized
cacagtgtcttcttaccaat

SEQ ID NO: 578340 - DNA, 20 bp, Artificial Sequence
  chemically synthesized
ttaccaatgtgggcttttct

SEQ ID NO: 578341 - DNA, 20 bp, Artificial Sequence
  chemically synthesized
aataactttgtaaattaact

SEQ ID NO: 578342 - DNA, 20 bp, Artificial Sequence
  chemically synthesized
tactttgtatcattctagat

SEQ ID NO: 578343 - DNA, 20 bp, Artificial Sequence
  chemically synthesized
tgtaatggcaacatccagaa

SEQ ID NO: 578344 - DNA, 20 bp, Artificial Sequence
  chemically synthesized
aacatccagaagtaggtttt

SEQ ID NO: 578345 - DNA, 20 bp, Artificial Sequence
  chemically synthesized
taaaggttttaatacaatta

SEQ ID NO: 578346 - DNA, 20 bp, Artificial Sequence
  chemically synthesized
ctatttgattttaagtgttg

SEQ ID NO: 578347 - DNA, 20 bp, Artificial Sequence
  chemically synthesized
aatgcaatatgagtttagct

SEQ ID NO: 578348 - DNA, 20 bp, Artificial Sequence
  chemically synthesized
tcaccccaatttaatgcaat

SEQ ID NO: 578349 - DNA, 20 bp, Artificial Sequence
  chemically synthesized
attggggtgactggatgaaa

SEQ ID NO: 578350 - DNA, 20 bp, Artificial Sequence
  chemically synthesized
atgaaataatgaaaataatt

SEQ ID NO: 578351 - DNA, 20 bp, Artificial Sequence
  chemically synthesized
aattattttcattatttcat

SEQ ID NO: 578352 - DNA, 20 bp, Artificial Sequence
  chemically synthesized
ctcaggaatactcaagactc

SEQ ID NO: 578353 - DNA, 20 bp, Artificial Sequence
  chemically synthesized
gtcagaggttctcactgaac

SEQ ID NO: 578354 - DNA, 20 bp, Artificial Sequence
  chemically synthesized
agtagtattgtgaatgagga

SEQ ID NO: 578355 - DNA, 20 bp, Artificial Sequence
  chemically synthesized
aaaaggaaaaatgaaaattt

SEQ ID NO: 578356 - DNA, 20 bp, Artificial Sequence
  chemically synthesized
gaactaattatcttattgaa

SEQ ID NO: 578357 - DNA, 20 bp, Artificial Sequence
  chemically synthesized
atcctctgcctcctacgttc

SEQ ID NO: 578358 - DNA, 20 bp, Artificial Sequence
  chemically synthesized
tcgggaggcagaggcaggag

SEQ ID NO: 578359 - DNA, 20 bp, Artificial Sequence
  chemically synthesized
tgcctctgcctcccgagtag

SEQ ID NO: 578360 - DNA, 20 bp, Artificial Sequence
  chemically synthesized
ttttgtatttttagtagaga

SEQ ID NO: 578361 - DNA, 20 bp, Artificial Sequence
  chemically synthesized
cacctcagcctcccaaagtg

SEQ ID NO: 578362 - DNA, 20 bp, Artificial Sequence
  chemically synthesized
ccatgatatgaattttatgc

SEQ ID NO: 578363 - DNA, 20 bp, Artificial Sequence
  chemically synthesized
tgaaaaaggcaaagaattag

SEQ ID NO: 578364 - DNA, 20 bp, Artificial Sequence
  chemically synthesized
aattctttgcctttttcaca

SEQ ID NO: 578365 - DNA, 20 bp, Artificial Sequence
  chemically synthesized
tgtgtaatataatttatttc

SEQ ID NO: 578366 - DNA, 20 bp, Artificial Sequence
  chemically synthesized
gtttggaaaaagatctgggt

SEQ ID NO: 578367 - DNA, 20 bp, Artificial Sequence
  chemically synthesized
acccagatctttttccaaac

SEQ ID NO: 578368 - DNA, 20 bp, Artificial Sequence
  chemically synthesized
agcagttgtgaatgtaaatc

SEQ ID NO: 578369 - DNA, 20 bp, Artificial Sequence
  chemically synthesized
aaccttagatttacattcac

SEQ ID NO: 578370 - DNA, 20 bp, Artificial Sequence
  chemically synthesized
cacaactgcttcaagagagg

SEQ ID NO: 578371 - DNA, 20 bp, Artificial Sequence
  chemically synthesized
aagagaggtaaggttttcac

SEQ ID NO: 578372 - DNA, 20 bp, Artificial Sequence
  chemically synthesized
aggagcaaagtcaagaacgt

SEQ ID NO: 578373 - DNA, 20 bp, Artificial Sequence
  chemically synthesized
tgtgaggagcaaagtcaaga

SEQ ID NO: 578374 - DNA, 20 bp, Artificial Sequence
  chemically synthesized
ttcttgactttgctcctcac

SEQ ID NO: 578375 - DNA, 20 bp, Artificial Sequence
  chemically synthesized
gccatcttgaattctgcaac

SEQ ID NO: 578376 - DNA, 20 bp, Artificial Sequence
  chemically synthesized
cagtgcctgcttaccacttg

SEQ ID NO: 578377 - DNA, 20 bp, Artificial Sequence
  chemically synthesized
catgccaagtggtaagcagg

SEQ ID NO: 578378 - DNA, 20 bp, Artificial Sequence
  chemically synthesized
aggtaaaatgagaaatcagt

SEQ ID NO: 578379 - DNA, 20 bp, Artificial Sequence
  chemically synthesized
tcccacaaaacatatgacag

SEQ ID NO: 578380 - DNA, 20 bp, Artificial Sequence
  chemically synthesized
gagataaaatcaacactgtc

SEQ ID NO: 578381 - DNA, 20 bp, Artificial Sequence
  chemically synthesized
tatctccaaatagctcacgt

SEQ ID NO: 578382 - DNA, 20 bp, Artificial Sequence
  chemically synthesized
ccaaatagctcacgtatctg

SEQ ID NO: 578383 - DNA, 20 bp, Artificial Sequence
  chemically synthesized
tcaccactttgatcatcaat

SEQ ID NO: 578384 - DNA, 20 bp, Artificial Sequence
  chemically synthesized
actttgatcatcaattcttg

SEQ ID NO: 578385 - DNA, 20 bp, Artificial Sequence
  chemically synthesized
gaatgatcttttaaaaacat

SEQ ID NO: 578386 - DNA, 20 bp, Artificial Sequence
  chemically synthesized
caaggaaatggactaatcag

SEQ ID NO: 578387 - DNA, 20 bp, Artificial Sequence
  chemically synthesized
catgtctgattagtccattt

SEQ ID NO: 578388 - DNA, 20 bp, Artificial Sequence
  chemically synthesized
ggtggcaaggggcagagaga

SEQ ID NO: 578389 - DNA, 20 bp, Artificial Sequence
  chemically synthesized
gagtacatcacaggatttta

SEQ ID NO: 578390 - DNA, 20 bp, Artificial Sequence
  chemically synthesized
ttctatacaatgagtacatc

SEQ ID NO: 578391 - DNA, 20 bp, Artificial Sequence
  chemically synthesized
agaccccttatttagcactt

SEQ ID NO: 578392 - DNA, 20 bp, Artificial Sequence
  chemically synthesized
aagtgctaaataaggggtct

SEQ ID NO: 578393 - DNA, 20 bp, Artificial Sequence
  chemically synthesized
ccataccccagccaagttcc

SEQ ID NO: 578394 - DNA, 20 bp, Artificial Sequence
  chemically synthesized
actgactaagcctttggata

SEQ ID NO: 578395 - DNA, 20 bp, Artificial Sequence
  chemically synthesized
atagaggaaacaccatatcc

SEQ ID NO: 578396 - DNA, 20 bp, Artificial Sequence
  chemically synthesized
atctattgtccagtgagaac

SEQ ID NO: 578397 - DNA, 20 bp, Artificial Sequence
  chemically synthesized
aacagaggttctcactggac

SEQ ID NO: 578398 - DNA, 20 bp, Artificial Sequence
  chemically synthesized
taaccttgcttatgcactgg

SEQ ID NO: 578399 - DNA, 20 bp, Artificial Sequence
  chemically synthesized
cctagaacggtggattttaa

SEQ ID NO: 578400 - DNA, 20 bp, Artificial Sequence
  chemically synthesized
gttaaaatccaccgttctag

SEQ ID NO: 578401 - DNA, 20 bp, Artificial Sequence
  chemically synthesized
ccaggaaactcacctagaac

SEQ ID NO: 578402 - DNA, 20 bp, Artificial Sequence
  chemically synthesized
tgagtttcctggcctctttg

SEQ ID NO: 578403 - DNA, 20 bp, Artificial Sequence
  chemically synthesized
ttggaaggtttagcctagtc

SEQ ID NO: 578404 - DNA, 20 bp, Artificial Sequence
  chemically synthesized
cagaaataatgttaaaatac

SEQ ID NO: 578405 - DNA, 20 bp, Artificial Sequence
  chemically synthesized
acacacacaaaccaccgaac

SEQ ID NO: 578406 - DNA, 20 bp, Artificial Sequence
  chemically synthesized
tgttcgtaaaactttggttc

SEQ ID NO: 578407 - DNA, 20 bp, Artificial Sequence
  chemically synthesized
aaggagtccatcacttttaa

SEQ ID NO: 578408 - DNA, 20 bp, Artificial Sequence
  chemically synthesized
attcatttctatcttaaaaa

SEQ ID NO: 578409 - DNA, 20 bp, Artificial Sequence
  chemically synthesized
atatggattgatactcatta

SEQ ID NO: 578410 - DNA, 20 bp, Artificial Sequence
  chemically synthesized
acaacccagtacttttactg

SEQ ID NO: 578411 - DNA, 20 bp, Artificial Sequence
  chemically synthesized
catcataagggccccaagaa

SEQ ID NO: 578412 - DNA, 20 bp, Artificial Sequence
  chemically synthesized
gcccctcttcctggtttgca

SEQ ID NO: 578413 - DNA, 20 bp, Artificial Sequence
  chemically synthesized
gcctggtgagggcccctctt

SEQ ID NO: 578414 - DNA, 20 bp, Artificial Sequence
  chemically synthesized
atttctcacagttctggagg

SEQ ID NO: 578415 - DNA, 20 bp, Artificial Sequence
  chemically synthesized
agcctccagaactgtgagaa

SEQ ID NO: 578416 - DNA, 20 bp, Artificial Sequence
  chemically synthesized
tggggggtgggtaagggaaa

SEQ ID NO: 578417 - DNA, 20 bp, Artificial Sequence
  chemically synthesized
aaagaaaatcatctctctga

SEQ ID NO: 578418 - DNA, 20 bp, Artificial Sequence
  chemically synthesized
tgatacaaacatgttcagag

SEQ ID NO: 578419 - DNA, 20 bp, Artificial Sequence
  chemically synthesized
ctaacaccacgacacatggc

SEQ ID NO: 578420 - DNA, 20 bp, Artificial Sequence
  chemically synthesized
tttagacaacaatcaaaata

SEQ ID NO: 578421 - DNA, 20 bp, Artificial Sequence
  chemically synthesized
tgtattttttaatctttcta

SEQ ID NO: 578422 - DNA, 20 bp, Artificial Sequence
  chemically synthesized
tcctgttgctttagtttgaa

SEQ ID NO: 578423 - DNA, 20 bp, Artificial Sequence
  chemically synthesized
agtgtattccttcctgttgc

SEQ ID NO: 578424 - DNA, 20 bp, Artificial Sequence
  chemically synthesized
acctttagtgtattccttcc

SEQ ID NO: 578425 - DNA, 20 bp, Artificial Sequence
  chemically synthesized
gcaacaggaaggaatacact

SEQ ID NO: 578426 - DNA, 20 bp, Artificial Sequence
  chemically synthesized
tcaaggtactaattgtgcta

SEQ ID NO: 578427 - DNA, 20 bp, Artificial Sequence
  chemically synthesized
ttctcaccaaaattttggcg

SEQ ID NO: 578428 - DNA, 20 bp, Artificial Sequence
  chemically synthesized
ataaaataaaataaaattgg

SEQ ID NO: 578429 - DNA, 20 bp, Artificial Sequence
  chemically synthesized
tcaggaggctgaggcaggag

SEQ ID NO: 578430 - DNA, 20 bp, Artificial Sequence
  chemically synthesized
tttgtatttttagtagagac

SEQ ID NO: 578431 - DNA, 20 bp, Artificial Sequence
  chemically synthesized
cgcctctgcctcccaaagtg

SEQ ID NO: 578432 - DNA, 20 bp, Artificial Sequence
  chemically synthesized
acacctatgaattaagatat

SEQ ID NO: 578433 - DNA, 20 bp, Artificial Sequence
  chemically synthesized
ttccagagagacaagtttca

SEQ ID NO: 578434 - DNA, 20 bp, Artificial Sequence
  chemically synthesized
aataaaacatttccagagag

SEQ ID NO: 578435 - DNA, 20 bp, Artificial Sequence
  chemically synthesized
tatgaaacttgtctctctgg

SEQ ID NO: 578436 - DNA, 20 bp, Artificial Sequence
  chemically synthesized
agaagacaatttttataatg

SEQ ID NO: 578437 - DNA, 20 bp, Artificial Sequence
  chemically synthesized
agaggagacgtaggtaaaac

SEQ ID NO: 578438 - DNA, 20 bp, Artificial Sequence
  chemically synthesized
aatcactcccttccctaatc

SEQ ID NO: 578439 - DNA, 20 bp, Artificial Sequence
  chemically synthesized
aaacacgagattagggaagg

SEQ ID NO: 578440 - DNA, 20 bp, Artificial Sequence
  chemically synthesized
atctcatatatttattgctc

SEQ ID NO: 578441 - DNA, 20 bp, Artificial Sequence
  chemically synthesized
ccctgagagatcattgtaat

SEQ ID NO: 578442 - DNA, 20 bp, Artificial Sequence
  chemically synthesized
tgtctttctgaatatttcac

SEQ ID NO: 578443 - DNA, 20 bp, Artificial Sequence
  chemically synthesized
tccattttcagttagttacc

SEQ ID NO: 578444 - DNA, 20 bp, Artificial Sequence
  chemically synthesized
tggtagtactttgaaccatg

SEQ ID NO: 578445 - DNA, 20 bp, Artificial Sequence
  chemically synthesized
cttcttaggcccaaagcaga

SEQ ID NO: 578446 - DNA, 20 bp, Artificial Sequence
  chemically synthesized
atttctctatccaaaacatt

SEQ ID NO: 578447 - DNA, 20 bp, Artificial Sequence
  chemically synthesized
atgttttggatagagaaata

SEQ ID NO: 578448 - DNA, 20 bp, Artificial Sequence
  chemically synthesized
aaaactatattcgtaattga

SEQ ID NO: 578449 - DNA, 20 bp, Artificial Sequence
  chemically synthesized
taatccgattcaattacgaa

SEQ ID NO: 578450 - DNA, 20 bp, Artificial Sequence
  chemically synthesized
aagtttcaggatttttaaat

SEQ ID NO: 578451 - DNA, 20 bp, Artificial Sequence
  chemically synthesized
agcctttaggggtgaaagtt

SEQ ID NO: 578452 - DNA, 20 bp, Artificial Sequence
  chemically synthesized
atcctgaaactttcacccct

SEQ ID NO: 578453 - DNA, 20 bp, Artificial Sequence
  chemically synthesized
catacaaagcctttaggggt

SEQ ID NO: 578454 - DNA, 20 bp, Artificial Sequence
  chemically synthesized
atggcgttctataaaaatac

SEQ ID NO: 578455 - DNA, 20 bp, Artificial Sequence
  chemically synthesized
ccttgtacttcaggataagg

SEQ ID NO: 578456 - DNA, 20 bp, Artificial Sequence
  chemically synthesized
tacaaggacgacggtaaagt

SEQ ID NO: 578457 - DNA, 20 bp, Artificial Sequence
  chemically synthesized
atacattctgaatggaatta

SEQ ID NO: 578458 - DNA, 20 bp, Artificial Sequence
  chemically synthesized
gttaattccattcagaatgt

SEQ ID NO: 578459 - DNA, 20 bp, Artificial Sequence
  chemically synthesized
gtatatgctttatattacat

SEQ ID NO: 578460 - DNA, 20 bp, Artificial Sequence
  chemically synthesized
atgtttaaagaatctatgaa

SEQ ID NO: 578461 - DNA, 20 bp, Artificial Sequence
  chemically synthesized
tctcagcaataatcataatt

SEQ ID NO: 578462 - DNA, 20 bp, Artificial Sequence
  chemically synthesized
ggagtctccatatatagaaa

SEQ ID NO: 578463 - DNA, 20 bp, Artificial Sequence
  chemically synthesized
gtttttctctaagactgtca

SEQ ID NO: 578464 - DNA, 20 bp, Artificial Sequence
  chemically synthesized
tagagaaaaacacattttgt

SEQ ID NO: 578465 - DNA, 20 bp, Artificial Sequence
  chemically synthesized
agggtgaaaaccttcacaaa

SEQ ID NO: 578466 - DNA, 20 bp, Artificial Sequence
  chemically synthesized
tctgtctaccccaaaagtag

SEQ ID NO: 578467 - DNA, 20 bp, Artificial Sequence
  chemically synthesized
gccaaagcaacagctctgcc

SEQ ID NO: 578468 - DNA, 20 bp, Artificial Sequence
  chemically synthesized
tcaaaatctgttggcagagc

SEQ ID NO: 578469 - DNA, 20 bp, Artificial Sequence
  chemically synthesized
ttttttttaatatatgagaa

SEQ ID NO: 578470 - DNA, 20 bp, Artificial Sequence
  chemically synthesized
gaagctggtagcattgtatt

SEQ ID NO: 578471 - DNA, 20 bp, Artificial Sequence
  chemically synthesized
gaatctatgaatacaatgct

SEQ ID NO: 578472 - DNA, 20 bp, Artificial Sequence
  chemically synthesized
ggtaggagaaaagtgaaatg

SEQ ID NO: 578473 - DNA, 20 bp, Artificial Sequence
  chemically synthesized
tatttcagctaaatggaagt

SEQ ID NO: 578474 - DNA, 20 bp, Artificial Sequence
  chemically synthesized
tcagtatttcagctaaatgg

SEQ ID NO: 578475 - DNA, 20 bp, Artificial Sequence
  chemically synthesized
gcatgtaatctcttaaggta

SEQ ID NO: 578476 - DNA, 20 bp, Artificial Sequence
  chemically synthesized
taaataaagcagcatacctt

SEQ ID NO: 578477 - DNA, 20 bp, Artificial Sequence
  chemically synthesized
aagagcaacaaatggaaatg

SEQ ID NO: 578478 - DNA, 20 bp, Artificial Sequence
  chemically synthesized
tccatttgttgctcttcaac

SEQ ID NO: 578479 - DNA, 20 bp, Artificial Sequence
  chemically synthesized
tattgttaatggcacatttc

SEQ ID NO: 578480 - DNA, 20 bp, Artificial Sequence
  chemically synthesized
atgtgccattaacaataatc

SEQ ID NO: 578481 - DNA, 20 bp, Artificial Sequence
  chemically synthesized
aaacggtgaactactgaaac

SEQ ID NO: 578482 - DNA, 20 bp, Artificial Sequence
  chemically synthesized
aatcaatagtttcagtagtt

SEQ ID NO: 578483 - DNA, 20 bp, Artificial Sequence
  chemically synthesized
aaatgacatttatagccaac

SEQ ID NO: 578484 - DNA, 20 bp, Artificial Sequence
  chemically synthesized
tgtcatttcaatccataaaa

SEQ ID NO: 578485 - DNA, 20 bp, Artificial Sequence
  chemically synthesized
ccaaggtttaaactacattt

SEQ ID NO: 578486 - DNA, 20 bp, Artificial Sequence
  chemically synthesized
tgtagtttaaaccttgggca

SEQ ID NO: 578487 - DNA, 20 bp, Artificial Sequence
  chemically synthesized
tttctataaatccacttgcc

SEQ ID NO: 578488 - DNA, 20 bp, Artificial Sequence
  chemically synthesized
ccagggaagagggaaactgt

SEQ ID NO: 578489 - DNA, 20 bp, Artificial Sequence
  chemically synthesized
caaaattattttaaaacaga

SEQ ID NO: 578490 - DNA, 20 bp, Artificial Sequence
  chemically synthesized
cttaactataataaggttaa

SEQ ID NO: 578491 - DNA, 20 bp, Artificial Sequence
  chemically synthesized
tatagttaagacgcaaatgt

SEQ ID NO: 578492 - DNA, 20 bp, Artificial Sequence
  chemically synthesized
gaggttttcagaggctctat

SEQ ID NO: 578493 - DNA, 20 bp, Artificial Sequence
  chemically synthesized
gaggctctatgggagtttta

SEQ ID NO: 578494 - DNA, 20 bp, Artificial Sequence
  chemically synthesized
atctggattttgagaataaa

SEQ ID NO: 578495 - DNA, 20 bp, Artificial Sequence
  chemically synthesized
agagagcttgggaataaggc

SEQ ID NO: 578496 - DNA, 20 bp, Artificial Sequence
  chemically synthesized
gtacccgaggtagaaaaaga

SEQ ID NO: 578497 - DNA, 20 bp, Artificial Sequence
  chemically synthesized
tatgtgagcaacaaataaac

SEQ ID NO: 578498 - DNA, 20 bp, Artificial Sequence
  chemically synthesized
gtccagtggcttaaccaaac

SEQ ID NO: 578499 - DNA, 20 bp, Artificial Sequence
  chemically synthesized
gtatttattcgtttttgtcc

SEQ ID NO: 578500 - DNA, 20 bp, Artificial Sequence
  chemically synthesized
ttactcaagaaaatgtattt

SEQ ID NO: 578501 - DNA, 20 bp, Artificial Sequence
  chemically synthesized
aaattatgctgagaaaatgt

SEQ ID NO: 578502 - DNA, 20 bp, Artificial Sequence
  chemically synthesized
attttctcagcataatttcc

SEQ ID NO: 578503 - DNA, 20 bp, Artificial Sequence
  chemically synthesized
tggaaaataaatattttatg

SEQ ID NO: 578504 - DNA, 20 bp, Artificial Sequence
  chemically synthesized
aagcatggaaaataaatatt

SEQ ID NO: 578505 - DNA, 20 bp, Artificial Sequence
  chemically synthesized
aaacataaaatatttatttt

SEQ ID NO: 578506 - DNA, 20 bp, Artificial Sequence
  chemically synthesized
cacatggtgaatcttccctt

SEQ ID NO: 578507 - DNA, 20 bp, Artificial Sequence
  chemically synthesized
aagcttctgaatcattaaag

SEQ ID NO: 578508 - DNA, 20 bp, Artificial Sequence
  chemically synthesized
aatcttccctttaatgattc

SEQ ID NO: 578509 - DNA, 20 bp, Artificial Sequence
  chemically synthesized
cctttaatgattcagaagct

SEQ ID NO: 578510 - DNA, 20 bp, Artificial Sequence
  chemically synthesized
attcagaagcttgcagtttc

SEQ ID NO: 578511 - DNA, 20 bp, Artificial Sequence
  chemically synthesized
atttctaatctcaagaaact

SEQ ID NO: 578512 - DNA, 20 bp, Artificial Sequence
  chemically synthesized
tagacgtatttttgccctca

SEQ ID NO: 578513 - DNA, 20 bp, Artificial Sequence
  chemically synthesized
gccctcaactagatttaaag

SEQ ID NO: 578514 - DNA, 20 bp, Artificial Sequence
  chemically synthesized
actaaaaaattattttatgt

SEQ ID NO: 578515 - DNA, 20 bp, Artificial Sequence
  chemically synthesized
gtctattttagtctattttt

SEQ ID NO: 578516 - DNA, 20 bp, Artificial Sequence
  chemically synthesized
tagactaaaatagacttaat

SEQ ID NO: 578517 - DNA, 20 bp, Artificial Sequence
  chemically synthesized
tatggtaggtaaataataag

SEQ ID NO: 578518 - DNA, 20 bp, Artificial Sequence
  chemically synthesized
tcagctatggtaggtaaata

SEQ ID NO: 578519 - DNA, 20 bp, Artificial Sequence
  chemically synthesized
aaataaataaataaaaatac

SEQ ID NO: 578520 - DNA, 20 bp, Artificial Sequence
  chemically synthesized
gtatttttatttatttattt

SEQ ID NO: 578521 - DNA, 20 bp, Artificial Sequence
  chemically synthesized
aacctctgcctcctgggttc

SEQ ID NO: 578522 - DNA, 20 bp, Artificial Sequence
  chemically synthesized
ttgggaggctgaggtgggag

SEQ ID NO: 578523 - DNA, 20 bp, Artificial Sequence
  chemically synthesized
cacctcagcctcccaagtag

SEQ ID NO: 578524 - DNA, 20 bp, Artificial Sequence
  chemically synthesized
ttttgtatttttagtagaga

SEQ ID NO: 578525 - DNA, 20 bp, Artificial Sequence
  chemically synthesized
tccagaattttaatagatat

SEQ ID NO: 578526 - DNA, 20 bp, Artificial Sequence
  chemically synthesized
catatctattaaaattctgg

SEQ ID NO: 578527 - DNA, 20 bp, Artificial Sequence
  chemically synthesized
caatgtaccactgtaatata

SEQ ID NO: 578528 - DNA, 20 bp, Artificial Sequence
  chemically synthesized
atataagggcaatgcaaatg

SEQ ID NO: 578529 - DNA, 20 bp, Artificial Sequence
  chemically synthesized
cagactttatagatatctcc

SEQ ID NO: 578530 - DNA, 20 bp, Artificial Sequence
  chemically synthesized
agtttgatcatttggaggta

SEQ ID NO: 578531 - DNA, 20 bp, Artificial Sequence
  chemically synthesized
tcctccaaaatgcgtgttga

SEQ ID NO: 578532 - DNA, 20 bp, Artificial Sequence
  chemically synthesized
ttatcgttcttgcttcatca

SEQ ID NO: 578533 - DNA, 20 bp, Artificial Sequence
  chemically synthesized
atggctcctgaatttatcgt

SEQ ID NO: 578534 - DNA, 20 bp, Artificial Sequence
  chemically synthesized
ccctcctatcgttctccttc

SEQ ID NO: 578535 - DNA, 20 bp, Artificial Sequence
  chemically synthesized
aggagggagaggagaagaac

SEQ ID NO: 578536 - DNA, 20 bp, Artificial Sequence
  chemically synthesized
aggagaagaacttctgctta

SEQ ID NO: 578537 - DNA, 20 bp, Artificial Sequence
  chemically synthesized
aagaacttctgcttattatg

SEQ ID NO: 578538 - DNA, 20 bp, Artificial Sequence
  chemically synthesized
aactattatgaaaagtatat

SEQ ID NO: 578539 - DNA, 20 bp, Artificial Sequence
  chemically synthesized
aactagaatatacttttcat

SEQ ID NO: 578540 - DNA, 20 bp, Artificial Sequence
  chemically synthesized
taatagtttaaaaatatcat

SEQ ID NO: 578541 - DNA, 20 bp, Artificial Sequence
  chemically synthesized
aaatatcataatagtttcat

SEQ ID NO: 578542 - DNA, 20 bp, Artificial Sequence
  chemically synthesized
gtttcataatagtttttcat

SEQ ID NO: 578543 - DNA, 20 bp, Artificial Sequence
  chemically synthesized
ataaatcattataataagat

SEQ ID NO: 578544 - DNA, 20 bp, Artificial Sequence
  chemically synthesized
aaaaatcaatcatcttatta

SEQ ID NO: 578545 - DNA, 20 bp, Artificial Sequence
  chemically synthesized
ggatataaatcattataata

SEQ ID NO: 578546 - DNA, 20 bp, Artificial Sequence
  chemically synthesized
atggagttttgttatgtata

SEQ ID NO: 578547 - DNA, 20 bp, Artificial Sequence
  chemically synthesized
ataattttcctgaactatta

SEQ ID NO: 578548 - DNA, 20 bp, Artificial Sequence
  chemically synthesized
ctgtagtacaaggaggctct

SEQ ID NO: 578549 - DNA, 20 bp, Artificial Sequence
  chemically synthesized
gagcctccttgtactacaga

SEQ ID NO: 578550 - DNA, 20 bp, Artificial Sequence
  chemically synthesized
gaaaacagaacgtggggtag

SEQ ID NO: 578551 - DNA, 20 bp, Artificial Sequence
  chemically synthesized
ttaaacaaaactaccccacg

SEQ ID NO: 578552 - DNA, 20 bp, Artificial Sequence
  chemically synthesized
acagtgaaaacagaacgtgg

SEQ ID NO: 578553 - DNA, 20 bp, Artificial Sequence
  chemically synthesized
actaccccacgttctgtttt

SEQ ID NO: 578554 - DNA, 20 bp, Artificial Sequence
  chemically synthesized
tggaactttatggaaataat

SEQ ID NO: 578555 - DNA, 20 bp, Artificial Sequence
  chemically synthesized
aggaaaaacaattgtctgaa

SEQ ID NO: 578556 - DNA, 20 bp, Artificial Sequence
  chemically synthesized
tgatcaaacaattttcagac

SEQ ID NO: 578557 - DNA, 20 bp, Artificial Sequence
  chemically synthesized
taggaagaaagctacaaaat

SEQ ID NO: 578558 - DNA, 20 bp, Artificial Sequence
  chemically synthesized
gaaatgttaatctggcattt

SEQ ID NO: 578559 - DNA, 20 bp, Artificial Sequence
  chemically synthesized
tttcccttcattactttcaa

SEQ ID NO: 578560 - DNA, 20 bp, Artificial Sequence
  chemically synthesized
atttgaaagtaatgaaggga

SEQ ID NO: 578561 - DNA, 20 bp, Artificial Sequence
  chemically synthesized
tatttagcgttgctaactga

SEQ ID NO: 578562 - DNA, 20 bp, Artificial Sequence
  chemically synthesized
ggaaagcatctgtatgaatt

SEQ ID NO: 578563 - DNA, 20 bp, Artificial Sequence
  chemically synthesized
ataaaacagacaattcatac

SEQ ID NO: 578564 - DNA, 20 bp, Artificial Sequence
  chemically synthesized
ttttaaaagttgacattttt

SEQ ID NO: 578565 - DNA, 20 bp, Artificial Sequence
  chemically synthesized
ctcagagaaataacttaggg

SEQ ID NO: 578566 - DNA, 20 bp, Artificial Sequence
  chemically synthesized
ctttgctcagagaaataact

SEQ ID NO: 578567 - DNA, 20 bp, Artificial Sequence
  chemically synthesized
ccctaagttatttctctgag

SEQ ID NO: 578568 - DNA, 20 bp, Artificial Sequence
  chemically synthesized
agtttctccttgaccgaagc

SEQ ID NO: 578569 - DNA, 20 bp, Artificial Sequence
  chemically synthesized
aaaacatttgcatataaaac

SEQ ID NO: 578570 - DNA, 20 bp, Artificial Sequence
  chemically synthesized
gaagctctggttttatatgc

SEQ ID NO: 578571 - DNA, 20 bp, Artificial Sequence
  chemically synthesized
gtgttaagtggaattataaa

SEQ ID NO: 578572 - DNA, 20 bp, Artificial Sequence
  chemically synthesized
aggctgtataaaagcaacta

SEQ ID NO: 578573 - DNA, 20 bp, Artificial Sequence
  chemically synthesized
agccagggacaaaacaaaat

SEQ ID NO: 578574 - DNA, 20 bp, Artificial Sequence
  chemically synthesized
agcaactattttgttttgtc

SEQ ID NO: 578575 - DNA, 20 bp, Artificial Sequence
  chemically synthesized
atggcaagtaagtcaggcat

SEQ ID NO: 578576 - DNA, 20 bp, Artificial Sequence
  chemically synthesized
gaaatgcctgacttacttgc

SEQ ID NO: 578577 - DNA, 20 bp, Artificial Sequence
  chemically synthesized
gcatcctgtaggacattggc

SEQ ID NO: 578578 - DNA, 20 bp, Artificial Sequence
  chemically synthesized
tgtaggacattggcagttgt

SEQ ID NO: 578579 - DNA, 20 bp, Artificial Sequence
  chemically synthesized
ggacctggaaaagtttcttg

SEQ ID NO: 578580 - DNA, 20 bp, Artificial Sequence
  chemically synthesized
acagttccccctggacctgg

SEQ ID NO: 578581 - DNA, 20 bp, Artificial Sequence
  chemically synthesized
gggaactgttgcagtaatct

SEQ ID NO: 578582 - DNA, 20 bp, Artificial Sequence
  chemically synthesized
aggctgctttggaagaaact

SEQ ID NO: 578583 - DNA, 20 bp, Artificial Sequence
  chemically synthesized
tgcagggtgagtgagcgaga

SEQ ID NO: 578584 - DNA, 20 bp, Artificial Sequence
  chemically synthesized
agactgcacaatattatagt

SEQ ID NO: 578585 - DNA, 20 bp, Artificial Sequence
  chemically synthesized
ttcatttttatttaacttaa

SEQ ID NO: 578586 - DNA, 20 bp, Artificial Sequence
  chemically synthesized
aggcatgcaagaatgacaat

SEQ ID NO: 578587 - DNA, 20 bp, Artificial Sequence
  chemically synthesized
atgaaacctcctctgtggag

SEQ ID NO: 578588 - DNA, 20 bp, Artificial Sequence
  chemically synthesized
tataaacccctctccacaga

SEQ ID NO: 578589 - DNA, 20 bp, Artificial Sequence
  chemically synthesized
aagtacctttttttcaattt

SEQ ID NO: 578590 - DNA, 20 bp, Artificial Sequence
  chemically synthesized
agtttttgttggtcaatttt

SEQ ID NO: 578591 - DNA, 20 bp, Artificial Sequence
  chemically synthesized
aatttggcagtatattaaaa

SEQ ID NO: 578592 - DNA, 20 bp, Artificial Sequence
  chemically synthesized
gattttagggttttaactat

SEQ ID NO: 578593 - DNA, 20 bp, Artificial Sequence
  chemically synthesized
caagcatggtacagggattt

SEQ ID NO: 578594 - DNA, 20 bp, Artificial Sequence
  chemically synthesized
aaaaccctaaaatccctgta

SEQ ID NO: 578595 - DNA, 20 bp, Artificial Sequence
  chemically synthesized
catcaaagacaagcatggta

SEQ ID NO: 578596 - DNA, 20 bp, Artificial Sequence
  chemically synthesized
tgctgctctgaggcagaaaa

SEQ ID NO: 578597 - DNA, 20 bp, Artificial Sequence
  chemically synthesized
tttctccttgcatatcaaat

SEQ ID NO: 578598 - DNA, 20 bp, Artificial Sequence
  chemically synthesized
ctagtcttttccttttgatt

SEQ ID NO: 578599 - DNA, 20 bp, Artificial Sequence
  chemically synthesized
cttttcctctagtcttttcc

SEQ ID NO: 578600 - DNA, 20 bp, Artificial Sequence
  chemically synthesized
tagaggaaaagacaaaaaga

SEQ ID NO: 578601 - DNA, 20 bp, Artificial Sequence
  chemically synthesized
aatgatagtttgcacaaaat

SEQ ID NO: 578602 - DNA, 20 bp, Artificial Sequence
  chemically synthesized
taactgatgtcatgcaaaat

SEQ ID NO: 578603 - DNA, 20 bp, Artificial Sequence
  chemically synthesized
acatcagttataattattgt

SEQ ID NO: 578604 - DNA, 20 bp, Artificial Sequence
  chemically synthesized
ttatgtgtaatgaaaaagag

SEQ ID NO: 578605 - DNA, 20 bp, Artificial Sequence
  chemically synthesized
gggaattgaactcagatctg

SEQ ID NO: 578606 - DNA, 20 bp, Artificial Sequence
  chemically synthesized
cgtgatatggcaagttccct

SEQ ID NO: 578607 - DNA, 20 bp, Artificial Sequence
  chemically synthesized
ggcaagttccctctctgatt

SEQ ID NO: 578608 - DNA, 20 bp, Artificial Sequence
  chemically synthesized
gggatatgggtagaaggaac

SEQ ID NO: 578609 - DNA, 20 bp, Artificial Sequence
  chemically synthesized
agagtttttgtcatgaaaga

SEQ ID NO: 578610 - DNA, 20 bp, Artificial Sequence
  chemically synthesized
ttttagagtttttgtcatga

SEQ ID NO: 578611 - DNA, 20 bp, Artificial Sequence
  chemically synthesized
caaaaatatgaatacatttt

SEQ ID NO: 578612 - DNA, 20 bp, Artificial Sequence
  chemically synthesized
tcagcaaatatctatataat

SEQ ID NO: 578613 - DNA, 20 bp, Artificial Sequence
  chemically synthesized
ggcagtaacagtcctatgga

SEQ ID NO: 578614 - DNA, 20 bp, Artificial Sequence
  chemically synthesized
actaatttcctcattgcaga

SEQ ID NO: 578615 - DNA, 20 bp, Artificial Sequence
  chemically synthesized
tattactacacaaacacttt

SEQ ID NO: 578616 - DNA, 20 bp, Artificial Sequence
  chemically synthesized
agcttatgtttaatcccaga

SEQ ID NO: 578617 - DNA, 20 bp, Artificial Sequence
  chemically synthesized
gggattaaacataagctaaa

SEQ ID NO: 578618 - DNA, 20 bp, Artificial Sequence
  chemically synthesized
ttttaaaatccatttttagc

SEQ ID NO: 578619 - DNA, 20 bp, Artificial Sequence
  chemically synthesized
tcaattttttaaaatccatt

SEQ ID NO: 578620 - DNA, 20 bp, Artificial Sequence
  chemically synthesized
gaacacttgaatatgataca

SEQ ID NO: 578621 - DNA, 20 bp, Artificial Sequence
  chemically synthesized
gatacacattgcttgttaag

SEQ ID NO: 578622 - DNA, 20 bp, Artificial Sequence
  chemically synthesized
aagttgctgctgaaataaat

SEQ ID NO: 578623 - DNA, 20 bp, Artificial Sequence
  chemically synthesized
tcggcaggagttgtttattg

SEQ ID NO: 578624 - DNA, 20 bp, Artificial Sequence
  chemically synthesized
gctgccgctggctcggcagg

SEQ ID NO: 578625 - DNA, 20 bp, Artificial Sequence
  chemically synthesized
ggcagcaaagcccccggaag

SEQ ID NO: 578626 - DNA, 20 bp, Artificial Sequence
  chemically synthesized
gatgaataaacagctcttcc

SEQ ID NO: 578627 - DNA, 20 bp, Artificial Sequence
  chemically synthesized
agctgtttattcatcatggg

SEQ ID NO: 578628 - DNA, 20 bp, Artificial Sequence
  chemically synthesized
gagcacacagtcttccacag

SEQ ID NO: 578629 - DNA, 20 bp, Artificial Sequence
  chemically synthesized
ctccaccagttaatgcagac

SEQ ID NO: 578630 - DNA, 20 bp, Artificial Sequence
  chemically synthesized
attaactggtggagggtaga

SEQ ID NO: 578631 - DNA, 20 bp, Artificial Sequence
  chemically synthesized
agttgataaatagcttagtg

SEQ ID NO: 578632 - DNA, 20 bp, Artificial Sequence
  chemically synthesized
agtttatttaggagttgata

SEQ ID NO: 578633 - DNA, 20 bp, Artificial Sequence
  chemically synthesized
acctttcagctgtgcagtat

SEQ ID NO: 578634 - DNA, 20 bp, Artificial Sequence
  chemically synthesized
acgttagcccttgaactaca

SEQ ID NO: 578635 - DNA, 20 bp, Artificial Sequence
  chemically synthesized
gctaacgtggactgccggct

SEQ ID NO: 578636 - DNA, 20 bp, Artificial Sequence
  chemically synthesized
gactgccggctccctgctta

SEQ ID NO: 578637 - DNA, 20 bp, Artificial Sequence
  chemically synthesized
ttgatatttctccttgcatt

SEQ ID NO: 578638 - DNA, 20 bp, Artificial Sequence
  chemically synthesized
gtcatttatctttttatgta

SEQ ID NO: 578639 - DNA, 20 bp, Artificial Sequence
  chemically synthesized
gtgtatgcccaattgtagca

SEQ ID NO: 578640 - DNA, 20 bp, Artificial Sequence
  chemically synthesized
ctacaattgggcatacacct

SEQ ID NO: 578641 - DNA, 20 bp, Artificial Sequence
  chemically synthesized
tgggtgtgacctataaaagt

SEQ ID NO: 578642 - DNA, 20 bp, Artificial Sequence
  chemically synthesized
ctataaaagtggcagtttca

SEQ ID NO: 578643 - DNA, 20 bp, Artificial Sequence
  chemically synthesized
gcatttatattctggaatgt

SEQ ID NO: 578644 - DNA, 20 bp, Artificial Sequence
  chemically synthesized
gagaatttcatatttttaaa

SEQ ID NO: 578645 - DNA, 20 bp, Artificial Sequence
  chemically synthesized
aatgcacaatattacattct

SEQ ID NO: 578646 - DNA, 20 bp, Artificial Sequence
  chemically synthesized
atattgtgcattttatcagc

SEQ ID NO: 578647 - DNA, 20 bp, Artificial Sequence
  chemically synthesized
agcatcagcttcatgatgag

SEQ ID NO: 578648 - DNA, 20 bp, Artificial Sequence
  chemically synthesized
ctctatccttaaactagaaa

SEQ ID NO: 578649 - DNA, 20 bp, Artificial Sequence
  chemically synthesized
agcagagggtaagcggcatt

SEQ ID NO: 578650 - DNA, 20 bp, Artificial Sequence
  chemically synthesized
aactagaaatgccgcttacc

SEQ ID NO: 578651 - DNA, 20 bp, Artificial Sequence
  chemically synthesized
tgtctcggtagaactctttc

SEQ ID NO: 578652 - DNA, 20 bp, Artificial Sequence
  chemically synthesized
gaaagagttctaccgagaca

SEQ ID NO: 578653 - DNA, 20 bp, Artificial Sequence
  chemically synthesized
ttttcagccaaatcctacca

SEQ ID NO: 578654 - DNA, 20 bp, Artificial Sequence
  chemically synthesized
acaaagcagcaaacttgctg

SEQ ID NO: 578655 - DNA, 20 bp, Artificial Sequence
  chemically synthesized
ccaaatcctaccagcaagtt

SEQ ID NO: 578656 - DNA, 20 bp, Artificial Sequence
  chemically synthesized
acaagggtatcatttaggaa

SEQ ID NO: 578657 - DNA, 20 bp, Artificial Sequence
  chemically synthesized
cacgtaaaggagctcatttg

SEQ ID NO: 578658 - DNA, 20 bp, Artificial Sequence
  chemically synthesized
tcttgaataataggtaagac

SEQ ID NO: 578659 - DNA, 20 bp, Artificial Sequence
  chemically synthesized
taataggtaagactgttgtt

SEQ ID NO: 578660 - DNA, 20 bp, Artificial Sequence
  chemically synthesized
ctgttgtttcctgcttgtgt

SEQ ID NO: 578661 - DNA, 20 bp, Artificial Sequence
  chemically synthesized
tcctgcttgtgtgggggttt

SEQ ID NO: 578662 - DNA, 20 bp, Artificial Sequence
  chemically synthesized
agggattcaacgtacacaca

SEQ ID NO: 578663 - DNA, 20 bp, Artificial Sequence
  chemically synthesized
gacctggcacaattaaaatt

SEQ ID NO: 578664 - DNA, 20 bp, Artificial Sequence
  chemically synthesized
aacatgctctaaatgtatca

SEQ ID NO: 578665 - DNA, 20 bp, Artificial Sequence
  chemically synthesized
tttaaattttccggaaccat

SEQ ID NO: 578666 - DNA, 20 bp, Artificial Sequence
  chemically synthesized
tccggaaccatatgggttta

SEQ ID NO: 578667 - DNA, 20 bp, Artificial Sequence
  chemically synthesized
tgaacatatcttttttttct

SEQ ID NO: 578668 - DNA, 20 bp, Artificial Sequence
  chemically synthesized
aaaaaatctaattcaagacc

SEQ ID NO: 578669 - DNA, 20 bp, Artificial Sequence
  chemically synthesized
aaaaaaaccaaaggtcttga

SEQ ID NO: 578670 - DNA, 20 bp, Artificial Sequence
  chemically synthesized
gccaaattttctccagggcc

SEQ ID NO: 578671 - DNA, 20 bp, Artificial Sequence
  chemically synthesized
ccagatattagaaactgtaa

SEQ ID NO: 578672 - DNA, 20 bp, Artificial Sequence
  chemically synthesized
ttctgtttgcaaagcattat

SEQ ID NO: 578673 - DNA, 20 bp, Artificial Sequence
  chemically synthesized
tacttaaccaatacagtaga

SEQ ID NO: 578674 - DNA, 20 bp, Artificial Sequence
  chemically synthesized
aaaaagtacttaaccaatac

SEQ ID NO: 578675 - DNA, 20 bp, Artificial Sequence
  chemically synthesized
ttaagtacttttttacataa

SEQ ID NO: 578676 - DNA, 20 bp, Artificial Sequence
  chemically synthesized
aaagttttataatcagctat

SEQ ID NO: 578677 - DNA, 20 bp, Artificial Sequence
  chemically synthesized
gtgcaccataaagctggaat

SEQ ID NO: 578678 - DNA, 20 bp, Artificial Sequence
  chemically synthesized
atttgatggagtaaggaata

SEQ ID NO: 578679 - DNA, 20 bp, Artificial Sequence
  chemically synthesized
taaggaataatgtgatttca

SEQ ID NO: 578680 - DNA, 20 bp, Artificial Sequence
  chemically synthesized
tggtccatggactatgagaa

SEQ ID NO: 578681 - DNA, 20 bp, Artificial Sequence
  chemically synthesized
ccggattttacccacagagt

SEQ ID NO: 578682 - DNA, 20 bp, Artificial Sequence
  chemically synthesized
tgtgggtaaaatccggcaag

SEQ ID NO: 578683 - DNA, 20 bp, Artificial Sequence
  chemically synthesized
ggcttgttaaaacacagctt

SEQ ID NO: 578684 - DNA, 20 bp, Artificial Sequence
  chemically synthesized
tattggaaggcttgttaaaa

SEQ ID NO: 578685 - DNA, 20 bp, Artificial Sequence
  chemically synthesized
tcaagctttagcatatattg

SEQ ID NO: 578686 - DNA, 20 bp, Artificial Sequence
  chemically synthesized
acaagccttccaatatatgc

SEQ ID NO: 578687 - DNA, 20 bp, Artificial Sequence
  chemically synthesized
gttcctggcaactgtgattc

SEQ ID NO: 578688 - DNA, 20 bp, Artificial Sequence
  chemically synthesized
tcaaatctggttcctggcaa

SEQ ID NO: 578689 - DNA, 20 bp, Artificial Sequence
  chemically synthesized
gagaatcacagttgccagga

SEQ ID NO: 578690 - DNA, 20 bp, Artificial Sequence
  chemically synthesized
ctgaaaaggggtccgggcag

SEQ ID NO: 578691 - DNA, 20 bp, Artificial Sequence
  chemically synthesized
cctgagttgcagcaagggac

SEQ ID NO: 578692 - DNA, 20 bp, Artificial Sequence
  chemically synthesized
gctaggaaggagaggcggag

SEQ ID NO: 578693 - DNA, 20 bp, Artificial Sequence
  chemically synthesized
tagttgtgactgtatggtag

SEQ ID NO: 578694 - DNA, 20 bp, Artificial Sequence
  chemically synthesized
agcggaggaaaggaaaggga

SEQ ID NO: 578695 - DNA, 20 bp, Artificial Sequence
  chemically synthesized
aattttattggagagtgctc

SEQ ID NO: 578696 - DNA, 20 bp, Artificial Sequence
  chemically synthesized
atgctaatcactttctcaga

SEQ ID NO: 578697 - DNA, 20 bp, Artificial Sequence
  chemically synthesized
ccagaaagcagattctgaga

SEQ ID NO: 578698 - DNA, 20 bp, Artificial Sequence
  chemically synthesized
gaggtcaagttctcccagaa

SEQ ID NO: 578699 - DNA, 20 bp, Artificial Sequence
  chemically synthesized
tcctgaattgtcatgctgaa

SEQ ID NO: 578700 - DNA, 20 bp, Artificial Sequence
  chemically synthesized
gtctccaaagggaacaagat

SEQ ID NO: 578701 - DNA, 20 bp, Artificial Sequence
  chemically synthesized
taaggagacctatagataat

SEQ ID NO: 578702 - DNA, 20 bp, Artificial Sequence
  chemically synthesized
actccgccccttcagtagat

SEQ ID NO: 578703 - DNA, 20 bp, Artificial Sequence
  chemically synthesized
ctccaacactccgccccttc

SEQ ID NO: 578704 - DNA, 20 bp, Artificial Sequence
  chemically synthesized
ggggcggagtgttggagcta

SEQ ID NO: 578705 - DNA, 20 bp, Artificial Sequence
  chemically synthesized
ttggcacgtatagggttgca

SEQ ID NO: 578706 - DNA, 20 bp, Artificial Sequence
  chemically synthesized
aaccctatacgtgccaaaga

SEQ ID NO: 578707 - DNA, 20 bp, Artificial Sequence
  chemically synthesized
aaggtaaagaatcacagaag

SEQ ID NO: 578708 - DNA, 20 bp, Artificial Sequence
  chemically synthesized
gtatgctgaaaacatgcctt

SEQ ID NO: 578709 - DNA, 20 bp, Artificial Sequence
  chemically synthesized
atacccattttctttttaag

SEQ ID NO: 578710 - DNA, 20 bp, Artificial Sequence
  chemically synthesized
tgacaggtcagaacttactt

SEQ ID NO: 578711 - DNA, 20 bp, Artificial Sequence
  chemically synthesized
tattcaactcaatgcagtct

SEQ ID NO: 578712 - DNA, 20 bp, Artificial Sequence
  chemically synthesized
aggaaaaaggaagggaaact

SEQ ID NO: 578713 - DNA, 20 bp, Artificial Sequence
  chemically synthesized
taggcttaccccggaaagca

SEQ ID NO: 578714 - DNA, 20 bp, Artificial Sequence
  chemically synthesized
tgctttccggggtaagccta

SEQ ID NO: 578715 - DNA, 20 bp, Artificial Sequence
  chemically synthesized
gtatacaataattaagctct

SEQ ID NO: 578716 - DNA, 20 bp, Artificial Sequence
  chemically synthesized
cctttttctaaaaatactca

SEQ ID NO: 578717 - DNA, 20 bp, Artificial Sequence
  chemically synthesized
tgggcaaaataacctttcat

SEQ ID NO: 578718 - DNA, 20 bp, Artificial Sequence
  chemically synthesized
ggaaagattcagagtatttt

SEQ ID NO: 578719 - DNA, 20 bp, Artificial Sequence
  chemically synthesized
aatactctgaatctttcctt

SEQ ID NO: 578720 - DNA, 20 bp, Artificial Sequence
  chemically synthesized
attgcaaataaactaggaag

SEQ ID NO: 578721 - DNA, 20 bp, Artificial Sequence
  chemically synthesized
tttcctatgatattttagga

SEQ ID NO: 578722 - DNA, 20 bp, Artificial Sequence
  chemically synthesized
agcacctggatgtaagatca

SEQ ID NO: 578723 - DNA, 20 bp, Artificial Sequence
  chemically synthesized
tggttacaggaaatttgaat

SEQ ID NO: 578724 - DNA, 20 bp, Artificial Sequence
  chemically synthesized
ctgtaaccataacagttcct

SEQ ID NO: 578725 - DNA, 20 bp, Artificial Sequence
  chemically synthesized
tagtttgctagtaaattgca

SEQ ID NO: 578726 - DNA, 20 bp, Artificial Sequence
  chemically synthesized
ctcacaagtacaatataaag

SEQ ID NO: 578727 - DNA, 20 bp, Artificial Sequence
  chemically synthesized
atatccataggtgacaaaat

SEQ ID NO: 578728 - DNA, 20 bp, Artificial Sequence
  chemically synthesized
ggatatacagcactttgtag

SEQ ID NO: 578729 - DNA, 20 bp, Artificial Sequence
  chemically synthesized
cacgttactaatagaattgc

SEQ ID NO: 578730 - DNA, 20 bp, Artificial Sequence
  chemically synthesized
atccaggcaatgttgacagc

SEQ ID NO: 578731 - DNA, 20 bp, Artificial Sequence
  chemically synthesized
agcaaaagctgtcaacattg

SEQ ID NO: 578732 - DNA, 20 bp, Artificial Sequence
  chemically synthesized
ctactaatccaggcaatgtt

SEQ ID NO: 578733 - DNA, 20 bp, Artificial Sequence
  chemically synthesized
attcctagcaaaaccaactc

SEQ ID NO: 578734 - DNA, 20 bp, Artificial Sequence
  chemically synthesized
aaaacagataaaaccacaga

SEQ ID NO: 578735 - DNA, 20 bp, Artificial Sequence
  chemically synthesized
aaaaccaactctgtggtttt

SEQ ID NO: 578736 - DNA, 20 bp, Artificial Sequence
  chemically synthesized
gaagggtggtggcaatgaga

SEQ ID NO: 578737 - DNA, 20 bp, Artificial Sequence
  chemically synthesized
atgtcatatattcctcgcct

SEQ ID NO: 578738 - DNA, 20 bp, Artificial Sequence
  chemically synthesized
catcattttaatttaacttc

SEQ ID NO: 578739 - DNA, 20 bp, Artificial Sequence
  chemically synthesized
attttaatttaacttctgat

SEQ ID NO: 578740 - DNA, 20 bp, Artificial Sequence
  chemically synthesized
atataaagagttatgtggat

SEQ ID NO: 578741 - DNA, 20 bp, Artificial Sequence
  chemically synthesized
taacatccacataactcttt

SEQ ID NO: 578742 - DNA, 20 bp, Artificial Sequence
  chemically synthesized
tgatgatagaataactctga

SEQ ID NO: 578743 - DNA, 20 bp, Artificial Sequence
  chemically synthesized
tggatatttcattctctgcc

SEQ ID NO: 578744 - DNA, 20 bp, Artificial Sequence
  chemically synthesized
gccaatggctttacactcga

SEQ ID NO: 578745 - DNA, 20 bp, Artificial Sequence
  chemically synthesized
aataccaaagtccatgtatt

SEQ ID NO: 578746 - DNA, 20 bp, Artificial Sequence
  chemically synthesized
gactttggtatttaacatat

SEQ ID NO: 578747 - DNA, 20 bp, Artificial Sequence
  chemically synthesized
attacattgtaactctagtt

SEQ ID NO: 578748 - DNA, 20 bp, Artificial Sequence
  chemically synthesized
agctactgggaaggactcca

SEQ ID NO: 578749 - DNA, 20 bp, Artificial Sequence
  chemically synthesized
ctcaaatgtaacatatatca

SEQ ID NO: 578750 - DNA, 20 bp, Artificial Sequence
  chemically synthesized
ttgagatagaagtttatgaa

SEQ ID NO: 578751 - DNA, 20 bp, Artificial Sequence
  chemically synthesized
cttgtttggcaaattgagat

SEQ ID NO: 578752 - DNA, 20 bp, Artificial Sequence
  chemically synthesized
atgtttaagatacatttatc

SEQ ID NO: 578753 - DNA, 20 bp, Artificial Sequence
  chemically synthesized
aagtgataaatgtatcttaa

SEQ ID NO: 578754 - DNA, 20 bp, Artificial Sequence
  chemically synthesized
cttttgatggaaagagtaaa

SEQ ID NO: 578755 - DNA, 20 bp, Artificial Sequence
  chemically synthesized
aagaggtggagatcatccag

SEQ ID NO: 578756 - DNA, 20 bp, Artificial Sequence
  chemically synthesized
ttatctcaaaatagagtgat

SEQ ID NO: 578757 - DNA, 20 bp, Artificial Sequence
  chemically synthesized
tagagtgatggatgcttaac

SEQ ID NO: 578758 - DNA, 20 bp, Artificial Sequence
  chemically synthesized
aagcctgtactgtatatcta

SEQ ID NO: 578759 - DNA, 20 bp, Artificial Sequence
  chemically synthesized
aaaccttttagatatacagt

SEQ ID NO: 578760 - DNA, 20 bp, Artificial Sequence
  chemically synthesized
gatatacagtacaggctttt

SEQ ID NO: 578761 - DNA, 20 bp, Artificial Sequence
  chemically synthesized
ctggtttcattttagggctg

SEQ ID NO: 578762 - DNA, 20 bp, Artificial Sequence
  chemically synthesized
tttcattttagggctggaga

SEQ ID NO: 578763 - DNA, 20 bp, Artificial Sequence
  chemically synthesized
caagtcttgcattctagaaa

SEQ ID NO: 578764 - DNA, 20 bp, Artificial Sequence
  chemically synthesized
taaaagaaagaaaggcacaa

SEQ ID NO: 578765 - DNA, 20 bp, Artificial Sequence
  chemically synthesized
tttgtgctctaaaatgaaga

SEQ ID NO: 578766 - DNA, 20 bp, Artificial Sequence
  chemically synthesized
tcccttatgtgtaggtattt

SEQ ID NO: 578767 - DNA, 20 bp, Artificial Sequence
  chemically synthesized
agcagccagatcttttctgc

SEQ ID NO: 578768 - DNA, 20 bp, Artificial Sequence
  chemically synthesized
gcagaaaagatctggctgct

SEQ ID NO: 578769 - DNA, 20 bp, Artificial Sequence
  chemically synthesized
accagcaaatttgcattaaa

SEQ ID NO: 578770 - DNA, 20 bp, Artificial Sequence
  chemically synthesized
tccatttttaatgcaaattt

SEQ ID NO: 578771 - DNA, 20 bp, Artificial Sequence
  chemically synthesized
ttcaccaacatatgaattaa

SEQ ID NO: 578772 - DNA, 20 bp, Artificial Sequence
  chemically synthesized
atggtttccaattaactctg

SEQ ID NO: 578773 - DNA, 20 bp, Artificial Sequence
  chemically synthesized
tactttgggaacatttaggt

SEQ ID NO: 578774 - DNA, 20 bp, Artificial Sequence
  chemically synthesized
cctaaatgttcccaaagtat

SEQ ID NO: 578775 - DNA, 20 bp, Artificial Sequence
  chemically synthesized
tggggtgacaaaagatggga

SEQ ID NO: 578776 - DNA, 20 bp, Artificial Sequence
  chemically synthesized
agcaacacactggcatgaga

SEQ ID NO: 578777 - DNA, 20 bp, Artificial Sequence
  chemically synthesized
caaagctgtggtttatcttt

SEQ ID NO: 578778 - DNA, 20 bp, Artificial Sequence
  chemically synthesized
ttaatcctccaaagataaac

SEQ ID NO: 578779 - DNA, 20 bp, Artificial Sequence
  chemically synthesized
tacacagatagcttcaaagc

SEQ ID NO: 578780 - DNA, 20 bp, Artificial Sequence
  chemically synthesized
cagtgaaggaagtttacaca

SEQ ID NO: 578781 - DNA, 20 bp, Artificial Sequence
  chemically synthesized
aaaatgtctgtatcagtgaa

SEQ ID NO: 578782 - DNA, 20 bp, Artificial Sequence
  chemically synthesized
tgtgtctttcaaaattcctt

SEQ ID NO: 578783 - DNA, 20 bp, Artificial Sequence
  chemically synthesized
tctcatttttttaaccttat

SEQ ID NO: 578784 - DNA, 20 bp, Artificial Sequence
  chemically synthesized
ccttatgaatgtttttaaaa

SEQ ID NO: 578785 - DNA, 20 bp, Artificial Sequence
  chemically synthesized
tagggaaagtgtataattat

SEQ ID NO: 578786 - DNA, 20 bp, Artificial Sequence
  chemically synthesized
ggtcttttcaggaaagtact

SEQ ID NO: 578787 - DNA, 20 bp, Artificial Sequence
  chemically synthesized
ttaggagacagcagtagaaa

SEQ ID NO: 578788 - DNA, 20 bp, Artificial Sequence
  chemically synthesized
tttctactttactttgcatt

SEQ ID NO: 578789 - DNA, 20 bp, Artificial Sequence
  chemically synthesized
tactttgcattacccgtttc

SEQ ID NO: 578790 - DNA, 20 bp, Artificial Sequence
  chemically synthesized
ctttatcaactaattttttt

SEQ ID NO: 578791 - DNA, 20 bp, Artificial Sequence
  chemically synthesized
ttttctttcttgaattttta

SEQ ID NO: 578792 - DNA, 20 bp, Artificial Sequence
  chemically synthesized
gttgggagtaatgaattaca

SEQ ID NO: 578793 - DNA, 20 bp, Artificial Sequence
  chemically synthesized
ttctgttctaaataaattct

SEQ ID NO: 578794 - DNA, 20 bp, Artificial Sequence
  chemically synthesized
tgtataatgcgaatttttaa

SEQ ID NO: 578795 - DNA, 20 bp, Artificial Sequence
  chemically synthesized
cattaggaaatatatcttta

SEQ ID NO: 578796 - DNA, 20 bp, Artificial Sequence
  chemically synthesized
ttcctaatgttgatagacta

SEQ ID NO: 578797 - DNA, 20 bp, Artificial Sequence
  chemically synthesized
tccttttaggagagaagaaa

SEQ ID NO: 578798 - DNA, 20 bp, Artificial Sequence
  chemically synthesized
gcagcttttcttctctccta

SEQ ID NO: 578799 - DNA, 20 bp, Artificial Sequence
  chemically synthesized
ttttcttctctcctaaaagg

SEQ ID NO: 578800 - DNA, 20 bp, Artificial Sequence
  chemically synthesized
atcttaggctcatcttttaa

SEQ ID NO: 578801 - DNA, 20 bp, Artificial Sequence
  chemically synthesized
tatataactgcacagtctta

SEQ ID NO: 578802 - DNA, 20 bp, Artificial Sequence
  chemically synthesized
agctacagttagttgttttg

SEQ ID NO: 578803 - DNA, 20 bp, Artificial Sequence
  chemically synthesized
aacagaacaaaacaactaac

SEQ ID NO: 578804 - DNA, 20 bp, Artificial Sequence
  chemically synthesized
acaactaacaagctacagtt

SEQ ID NO: 578805 - DNA, 20 bp, Artificial Sequence
  chemically synthesized
aagacagcaaagcaggcagg

SEQ ID NO: 578806 - DNA, 20 bp, Artificial Sequence
  chemically synthesized
gatattagaaaactgaacct

SEQ ID NO: 578807 - DNA, 20 bp, Artificial Sequence
  chemically synthesized
atatcaaatggcaaacacac

SEQ ID NO: 578808 - DNA, 20 bp, Artificial Sequence
  chemically synthesized
tcttttaaagtgaatctgtt

SEQ ID NO: 578809 - DNA, 20 bp, Artificial Sequence
  chemically synthesized
taagtttatttcatctgttg

SEQ ID NO: 578810 - DNA, 20 bp, Artificial Sequence
  chemically synthesized
tccactgacaggactctact

SEQ ID NO: 578811 - DNA, 20 bp, Artificial Sequence
  chemically synthesized
cttttaaaaagtgtctgttc

SEQ ID NO: 578812 - DNA, 20 bp, Artificial Sequence
  chemically synthesized
catatgcttgttggtcgcat

SEQ ID NO: 578813 - DNA, 20 bp, Artificial Sequence
  chemically synthesized
gtgatgttgagctttttttc

SEQ ID NO: 578814 - DNA, 20 bp, Artificial Sequence
  chemically synthesized
ttctccaatgatcagtgatg

SEQ ID NO: 578815 - DNA, 20 bp, Artificial Sequence
  chemically synthesized
gtgatggtatctccttgtgg

SEQ ID NO: 578816 - DNA, 20 bp, Artificial Sequence
  chemically synthesized
ggtatgtgatggtatctcct

SEQ ID NO: 578817 - DNA, 20 bp, Artificial Sequence
  chemically synthesized
aacaggttctggagaaaaag

SEQ ID NO: 578818 - DNA, 20 bp, Artificial Sequence
  chemically synthesized
tataaccaacagtttataag

SEQ ID NO: 578819 - DNA, 20 bp, Artificial Sequence
  chemically synthesized
aaataacatacactataacc

SEQ ID NO: 578820 - DNA, 20 bp, Artificial Sequence
  chemically synthesized
agtcattgtgaaaaccagtg

SEQ ID NO: 578821 - DNA, 20 bp, Artificial Sequence
  chemically synthesized
gatctctgaagaatctccac

SEQ ID NO: 578822 - DNA, 20 bp, Artificial Sequence
  chemically synthesized
atttggttttctgttcctgc

SEQ ID NO: 578823 - DNA, 20 bp, Artificial Sequence
  chemically synthesized
ataagtgagaacatgcagta

SEQ ID NO: 578824 - DNA, 20 bp, Artificial Sequence
  chemically synthesized
ctcccaccctccccactcca

SEQ ID NO: 578825 - DNA, 20 bp, Artificial Sequence
  chemically synthesized
agaaaaatatctaatgtgta

SEQ ID NO: 578826 - DNA, 20 bp, Artificial Sequence
  chemically synthesized
catgtcatgggggtttgttg

SEQ ID NO: 578827 - DNA, 20 bp, Artificial Sequence
  chemically synthesized
gtacaacaaacccccatgac

SEQ ID NO: 578828 - DNA, 20 bp, Artificial Sequence
  chemically synthesized
tataggtaaactcatgtcat

SEQ ID NO: 578829 - DNA, 20 bp, Artificial Sequence
  chemically synthesized
ttaagttcaggagcacgtgt

SEQ ID NO: 578830 - DNA, 20 bp, Artificial Sequence
  chemically synthesized
acaatacatgttgaatataa

SEQ ID NO: 578831 - DNA, 20 bp, Artificial Sequence
  chemically synthesized
tttacactaaaataatgttc

SEQ ID NO: 578832 - DNA, 20 bp, Artificial Sequence
  chemically synthesized
ctatctgtggatcctgtcaa

SEQ ID NO: 578833 - DNA, 20 bp, Artificial Sequence
  chemically synthesized
gcacctcctttcatatttta

SEQ ID NO: 578834 - DNA, 20 bp, Artificial Sequence
  chemically synthesized
ggcaggttgtaattatcatg

SEQ ID NO: 578835 - DNA, 20 bp, Artificial Sequence
  chemically synthesized
tcatttattttggcaactca

SEQ ID NO: 578836 - DNA, 20 bp, Artificial Sequence
  chemically synthesized
gtacagtggactagattgtt

SEQ ID NO: 578837 - DNA, 20 bp, Artificial Sequence
  chemically synthesized
tcttatagtacagtggacta

SEQ ID NO: 578838 - DNA, 20 bp, Artificial Sequence
  chemically synthesized
aatgtcttatagtacagtgg

SEQ ID NO: 578839 - DNA, 20 bp, Artificial Sequence
  chemically synthesized
tgtcactattctcaaaagcc

SEQ ID NO: 578840 - DNA, 20 bp, Artificial Sequence
  chemically synthesized
tataataataacagaaaaca

SEQ ID NO: 578841 - DNA, 20 bp, Artificial Sequence
  chemically synthesized
ttctgttattattatatgaa

SEQ ID NO: 578842 - DNA, 20 bp, Artificial Sequence
  chemically synthesized
gagaaaagaaattattattc

SEQ ID NO: 578843 - DNA, 20 bp, Artificial Sequence
  chemically synthesized
tactgaactttgaactcgag

SEQ ID NO: 578844 - DNA, 20 bp, Artificial Sequence
  chemically synthesized
ctttgaactcgaggtaagct

SEQ ID NO: 578845 - DNA, 20 bp, Artificial Sequence
  chemically synthesized
aactcgaggtaagcttgagg

SEQ ID NO: 578846 - DNA, 20 bp, Artificial Sequence
  chemically synthesized
cttctttctaaatcaaatcc

SEQ ID NO: 578847 - DNA, 20 bp, Artificial Sequence
  chemically synthesized
aatttcataagaattaaaat

SEQ ID NO: 578848 - DNA, 20 bp, Artificial Sequence
  chemically synthesized
tgaaaataaaatacttcata

SEQ ID NO: 578849 - DNA, 20 bp, Artificial Sequence
  chemically synthesized
acaaattaattcatcgttca

SEQ ID NO: 578850 - DNA, 20 bp, Artificial Sequence
  chemically synthesized
gaattaatttgtcgaagtga

SEQ ID NO: 578851 - DNA, 20 bp, Artificial Sequence
  chemically synthesized
tgtcgaagtgacttagttta

SEQ ID NO: 578852 - DNA, 20 bp, Artificial Sequence
  chemically synthesized
atcatatctgagccattaaa

SEQ ID NO: 578853 - DNA, 20 bp, Artificial Sequence
  chemically synthesized
aacctattttaatggctcag

SEQ ID NO: 578854 - DNA, 20 bp, Artificial Sequence
  chemically synthesized
tatgatttacaagacaagat

SEQ ID NO: 578855 - DNA, 20 bp, Artificial Sequence
  chemically synthesized
agacaagatgtgggattaca

SEQ ID NO: 578856 - DNA, 20 bp, Artificial Sequence
  chemically synthesized
ctaattaaaacttatcaaaa

SEQ ID NO: 578857 - DNA, 20 bp, Artificial Sequence
  chemically synthesized
aactttaaatctttattttg

SEQ ID NO: 578858 - DNA, 20 bp, Artificial Sequence
  chemically synthesized
aacttatcaaaataaagatt

SEQ ID NO: 578859 - DNA, 20 bp, Artificial Sequence
  chemically synthesized
caaaataaagatttaaagtt

SEQ ID NO: 578860 - DNA, 20 bp, Artificial Sequence
  chemically synthesized
ttataaagaacagtcataat

SEQ ID NO: 578861 - DNA, 20 bp, Artificial Sequence
  chemically synthesized
ggaatgaatctgagggtgca

SEQ ID NO: 578862 - DNA, 20 bp, Artificial Sequence
  chemically synthesized
ttcttaaaaccagatgcacc

SEQ ID NO: 578863 - DNA, 20 bp, Artificial Sequence
  chemically synthesized
aagtggtatattcataagtc

SEQ ID NO: 578864 - DNA, 20 bp, Artificial Sequence
  chemically synthesized
tactgtaaattatttgaggg

SEQ ID NO: 578865 - DNA, 20 bp, Artificial Sequence
  chemically synthesized
agctgtataccttatcggta

SEQ ID NO: 578866 - DNA, 20 bp, Artificial Sequence
  chemically synthesized
aacctactaccgataaggta

SEQ ID NO: 578867 - DNA, 20 bp, Artificial Sequence
  chemically synthesized
ttaagaacaagagcctatgg

SEQ ID NO: 578868 - DNA, 20 bp, Artificial Sequence
  chemically synthesized
aaattcacatcaagaaaatt

SEQ ID NO: 578869 - DNA, 20 bp, Artificial Sequence
  chemically synthesized
tttatatttatatagaattt

SEQ ID NO: 578870 - DNA, 20 bp, Artificial Sequence
  chemically synthesized
atagaattttagagtttaga

SEQ ID NO: 578871 - DNA, 20 bp, Artificial Sequence
  chemically synthesized
catcttggttataactgaac

SEQ ID NO: 578872 - DNA, 20 bp, Artificial Sequence
  chemically synthesized
ctattgttcagttataacca

SEQ ID NO: 578873 - DNA, 20 bp, Artificial Sequence
  chemically synthesized
gagcaattctgtgcccaaaa

SEQ ID NO: 578874 - DNA, 20 bp, Artificial Sequence
  chemically synthesized
attctgtgcccaaaattgtg

SEQ ID NO: 578875 - DNA, 20 bp, Artificial Sequence
  chemically synthesized
ttgatgaaagatacaaattc

SEQ ID NO: 578876 - DNA, 20 bp, Artificial Sequence
  chemically synthesized
ttgtatttagctgtcaatga

SEQ ID NO: 578877 - DNA, 20 bp, Artificial Sequence
  chemically synthesized
acctgttattttggcaaatg

SEQ ID NO: 578878 - DNA, 20 bp, Artificial Sequence
  chemically synthesized
ggcaaatgttcagattgcct

SEQ ID NO: 578879 - DNA, 20 bp, Artificial Sequence
  chemically synthesized
caaatgggtgtctggacagg

SEQ ID NO: 578880 - DNA, 20 bp, Artificial Sequence
  chemically synthesized
gcatcctgtccagacaccca

SEQ ID NO: 578881 - DNA, 20 bp, Artificial Sequence
  chemically synthesized
acccaaaatactcctgccct

SEQ ID NO: 578882 - DNA, 20 bp, Artificial Sequence
  chemically synthesized
ctccctgctttttatcaccc

SEQ ID NO: 578883 - DNA, 20 bp, Artificial Sequence
  chemically synthesized
gttctcaaccctgacacact

SEQ ID NO: 578884 - DNA, 20 bp, Artificial Sequence
  chemically synthesized
agtgtgtcagggttgagaac

SEQ ID NO: 578885 - DNA, 20 bp, Artificial Sequence
  chemically synthesized
aagatctctggtgctatgtc

SEQ ID NO: 578886 - DNA, 20 bp, Artificial Sequence
  chemically synthesized
tcatgattttacgcaaagga

SEQ ID NO: 578887 - DNA, 20 bp, Artificial Sequence
  chemically synthesized
tcctttgcgtaaaatcatga

SEQ ID NO: 578888 - DNA, 20 bp, Artificial Sequence
  chemically synthesized
tggatggcttagaagccact

SEQ ID NO: 578889 - DNA, 20 bp, Artificial Sequence
  chemically synthesized
gctagatgcaagataaattg

SEQ ID NO: 578890 - DNA, 20 bp, Artificial Sequence
  chemically synthesized
ttttacttacctacttgtct

SEQ ID NO: 578891 - DNA, 20 bp, Artificial Sequence
  chemically synthesized
tctaaattattgagataaaa

SEQ ID NO: 578892 - DNA, 20 bp, Artificial Sequence
  chemically synthesized
tatctcaataatttagacaa

SEQ ID NO: 578893 - DNA, 20 bp, Artificial Sequence
  chemically synthesized
cctgtatgcaggtatatctg

SEQ ID NO: 578894 - DNA, 20 bp, Artificial Sequence
  chemically synthesized
aaatatgaacccatttattg

SEQ ID NO: 578895 - DNA, 20 bp, Artificial Sequence
  chemically synthesized
tttatcaacaactggttagg

SEQ ID NO: 578896 - DNA, 20 bp, Artificial Sequence
  chemically synthesized
catgccattcaagtggtgaa

SEQ ID NO: 578897 - DNA, 20 bp, Artificial Sequence
  chemically synthesized
tagcccagtcttttacaatt

SEQ ID NO: 578898 - DNA, 20 bp, Artificial Sequence
  chemically synthesized
gaaattaccatttcagacct

SEQ ID NO: 578899 - DNA, 20 bp, Artificial Sequence
  chemically synthesized
taaatatctttccagacaaa

SEQ ID NO: 578900 - DNA, 20 bp, Artificial Sequence
  chemically synthesized
gggaggacatttgactatca

SEQ ID NO: 578901 - DNA, 20 bp, Artificial Sequence
  chemically synthesized
gacatgcatgtatgtggaaa

SEQ ID NO: 578902 - DNA, 20 bp, Artificial Sequence
  chemically synthesized
caggtttaggtgtttataaa

SEQ ID NO: 578903 - DNA, 20 bp, Artificial Sequence
  chemically synthesized
ttgagttacgttccaggttt

SEQ ID NO: 578904 - DNA, 20 bp, Artificial Sequence
  chemically synthesized
gtgtaaaattgagttacgtt

SEQ ID NO: 578905 - DNA, 20 bp, Artificial Sequence
  chemically synthesized
aaaatcatgaggaaaatatc

SEQ ID NO: 578906 - DNA, 20 bp, Artificial Sequence
  chemically synthesized
gtaaacataagatattttcc

SEQ ID NO: 578907 - DNA, 20 bp, Artificial Sequence
  chemically synthesized
acacaatggtgtcattctgc

SEQ ID NO: 578908 - DNA, 20 bp, Artificial Sequence
  chemically synthesized
ggatcacactggaacacaag

SEQ ID NO: 578909 - DNA, 20 bp, Artificial Sequence
  chemically synthesized
cataccctacttatacaggc

SEQ ID NO: 578910 - DNA, 20 bp, Artificial Sequence
  chemically synthesized
agggtatgttgtctacatat

SEQ ID NO: 578911 - DNA, 20 bp, Artificial Sequence
  chemically synthesized
aatactttgtaataccttct

SEQ ID NO: 578912 - DNA, 20 bp, Artificial Sequence
  chemically synthesized
gaggggtggcattgggtctg

SEQ ID NO: 578913 - DNA, 20 bp, Artificial Sequence
  chemically synthesized
ttccccagtggctctgtatc

SEQ ID NO: 578914 - DNA, 20 bp, Artificial Sequence
  chemically synthesized
gccactggggaatctcaaga

SEQ ID NO: 578915 - DNA, 20 bp, Artificial Sequence
  chemically synthesized
tcagtataataaactttctc

SEQ ID NO: 578916 - DNA, 20 bp, Artificial Sequence
  chemically synthesized
ctctatggagctctagggat

SEQ ID NO: 578917 - DNA, 20 bp, Artificial Sequence
  chemically synthesized
tctgaactgactcaagggct

SEQ ID NO: 578918 - DNA, 20 bp, Artificial Sequence
  chemically synthesized
agtcagttcagagcccacgt

SEQ ID NO: 578919 - DNA, 20 bp, Artificial Sequence
  chemically synthesized
atttgagtcttaagatatga

SEQ ID NO: 578920 - DNA, 20 bp, Artificial Sequence
  chemically synthesized
ccctgagttgagcactgtca

SEQ ID NO: 578921 - DNA, 20 bp, Artificial Sequence
  chemically synthesized
cctgacagtgctcaactcag

SEQ ID NO: 578922 - DNA, 20 bp, Artificial Sequence
  chemically synthesized
cccagctcatctcctaggga

SEQ ID NO: 578923 - DNA, 20 bp, Artificial Sequence
  chemically synthesized
aagctgatttgctccttcca

SEQ ID NO: 578924 - DNA, 20 bp, Artificial Sequence
  chemically synthesized
aaacacgctggaaggagcaa

SEQ ID NO: 578925 - DNA, 20 bp, Artificial Sequence
  chemically synthesized
agttagtgtaaaagttaaaa

SEQ ID NO: 578926 - DNA, 20 bp, Artificial Sequence
  chemically synthesized
taacttttacactaactatt

SEQ ID NO: 578927 - DNA, 20 bp, Artificial Sequence
  chemically synthesized
agtttacctaagtctggtaa

SEQ ID NO: 578928 - DNA, 20 bp, Artificial Sequence
  chemically synthesized
tcgttgtcattcttgtcaaa

SEQ ID NO: 578929 - DNA, 20 bp, Artificial Sequence
  chemically synthesized
tttgacaagaatgacaacga

SEQ ID NO: 578930 - DNA, 20 bp, Artificial Sequence
  chemically synthesized
caacgaggaagctttttttg

SEQ ID NO: 578931 - DNA, 20 bp, Artificial Sequence
  chemically synthesized
ttataaaaaatcataacaaa

SEQ ID NO: 578932 - DNA, 20 bp, Artificial Sequence
  chemically synthesized
tatgattttttataactgcg

SEQ ID NO: 578933 - DNA, 20 bp, Artificial Sequence
  chemically synthesized
tgcgcaaagtttaagataac

SEQ ID NO: 578934 - DNA, 20 bp, Artificial Sequence
  chemically synthesized
taaaaatattcacattgtgt

SEQ ID NO: 578935 - DNA, 20 bp, Artificial Sequence
  chemically synthesized
ttacaagttacttgtcaaat

SEQ ID NO: 578936 - DNA, 20 bp, Artificial Sequence
  chemically synthesized
aaagaaaggctgtttcttct

SEQ ID NO: 578937 - DNA, 20 bp, Artificial Sequence
  chemically synthesized
tgcaccgtttaccaaagaaa

SEQ ID NO: 578938 - DNA, 20 bp, Artificial Sequence
  chemically synthesized
agttgcaaattattttaatg

SEQ ID NO: 578939 - DNA, 20 bp, Artificial Sequence
  chemically synthesized
gaccttgacatttactcact

SEQ ID NO: 578940 - DNA, 20 bp, Artificial Sequence
  chemically synthesized
accaaggacatttttgtgca

SEQ ID NO: 578941 - DNA, 20 bp, Artificial Sequence
  chemically synthesized
tacctttctatgcagatcag

SEQ ID NO: 578942 - DNA, 20 bp, Artificial Sequence
  chemically synthesized
aatggaaagtgacaaggtaa

SEQ ID NO: 578943 - DNA, 20 bp, Artificial Sequence
  chemically synthesized
atgcttcatggtggctgtgc

SEQ ID NO: 578944 - DNA, 20 bp, Artificial Sequence
  chemically synthesized
tcttccatgtctgcactgtc

SEQ ID NO: 578945 - DNA, 20 bp, Artificial Sequence
  chemically synthesized
tttttcccacttttctagat

SEQ ID NO: 578946 - DNA, 20 bp, Artificial Sequence
  chemically synthesized
ctcagtatttttcccacttt

SEQ ID NO: 578947 - DNA, 20 bp, Artificial Sequence
  chemically synthesized
ttatatacatgttcctgttc

SEQ ID NO: 578948 - DNA, 20 bp, Artificial Sequence
  chemically synthesized
tctgtgagctcttgcacact

SEQ ID NO: 578949 - DNA, 20 bp, Artificial Sequence
  chemically synthesized
atttctctattactgttagc

SEQ ID NO: 578950 - DNA, 20 bp, Artificial Sequence
  chemically synthesized
caccttggcctcccaaagtg

SEQ ID NO: 578951 - DNA, 20 bp, Artificial Sequence
  chemically synthesized
ttttgtatttttagtagaga

SEQ ID NO: 578952 - DNA, 20 bp, Artificial Sequence
  chemically synthesized
tgtctcagcctcccgagtgg

SEQ ID NO: 578953 - DNA, 20 bp, Artificial Sequence
  chemically synthesized
ctcgggaggctgagacagag

SEQ ID NO: 578954 - DNA, 20 bp, Artificial Sequence
  chemically synthesized
gttaatctttgggtgaatag

SEQ ID NO: 578955 - DNA, 20 bp, Artificial Sequence
  chemically synthesized
cccaaacatccctattcacc

SEQ ID NO: 578956 - DNA, 20 bp, Artificial Sequence
  chemically synthesized
tacatacatttgggaattag

SEQ ID NO: 578957 - DNA, 20 bp, Artificial Sequence
  chemically synthesized
ggaattagaatggattttta

SEQ ID NO: 578958 - DNA, 20 bp, Artificial Sequence
  chemically synthesized
atttttaattggtttctgat

SEQ ID NO: 578959 - DNA, 20 bp, Artificial Sequence
  chemically synthesized
gtcctggcttctttcctgca

SEQ ID NO: 578960 - DNA, 20 bp, Artificial Sequence
  chemically synthesized
tattcatatgttgtaagagt

SEQ ID NO: 578961 - DNA, 20 bp, Artificial Sequence
  chemically synthesized
attatgtataatatcattta

SEQ ID NO: 578962 - DNA, 20 bp, Artificial Sequence
  chemically synthesized
tcttcaattatgcacatcca

SEQ ID NO: 578963 - DNA, 20 bp, Artificial Sequence
  chemically synthesized
tacttctcggtaaattaatt

SEQ ID NO: 578964 - DNA, 20 bp, Artificial Sequence
  chemically synthesized
attaattgacggtttctcct

SEQ ID NO: 578965 - DNA, 20 bp, Artificial Sequence
  chemically synthesized
aagaagtgttgctcatagta

SEQ ID NO: 578966 - DNA, 20 bp, Artificial Sequence
  chemically synthesized
actatgagcaacacttcttc

SEQ ID NO: 578967 - DNA, 20 bp, Artificial Sequence
  chemically synthesized
tctacaacagaagacgtgaa

SEQ ID NO: 578968 - DNA, 20 bp, Artificial Sequence
  chemically synthesized
ttctcaacattaagaactgt

SEQ ID NO: 578969 - DNA, 20 bp, Artificial Sequence
  chemically synthesized
tgacacttatagcagtggac

SEQ ID NO: 578970 - DNA, 20 bp, Artificial Sequence
  chemically synthesized
tgaagttaacatatacctag

SEQ ID NO: 578971 - DNA, 20 bp, Artificial Sequence
  chemically synthesized
tttgtaaaaaataatcagaa

SEQ ID NO: 578972 - DNA, 20 bp, Artificial Sequence
  chemically synthesized
attttttcactaaagcttat

SEQ ID NO: 578973 - DNA, 20 bp, Artificial Sequence
  chemically synthesized
caacatgtggattttttcac

SEQ ID NO: 578974 - DNA, 20 bp, Artificial Sequence
  chemically synthesized
agaaacagcaaaattcaaca

SEQ ID NO: 578975 - DNA, 20 bp, Artificial Sequence
  chemically synthesized
aaaatccacatgttgaattt

SEQ ID NO: 578976 - DNA, 20 bp, Artificial Sequence
  chemically synthesized
ctgtttctcacattacctta

SEQ ID NO: 578977 - DNA, 20 bp, Artificial Sequence
  chemically synthesized
cttaaagtgtttttccaaat

SEQ ID NO: 578978 - DNA, 20 bp, Artificial Sequence
  chemically synthesized
ggatttctatttcagtttcc

SEQ ID NO: 578979 - DNA, 20 bp, Artificial Sequence
  chemically synthesized
gtcactcaaaggatttctat

SEQ ID NO: 578980 - DNA, 20 bp, Artificial Sequence
  chemically synthesized
aaagtatgtagtagtcactc

SEQ ID NO: 578981 - DNA, 20 bp, Artificial Sequence
  chemically synthesized
tgacagcacaagaatgagcc

SEQ ID NO: 578982 - DNA, 20 bp, Artificial Sequence
  chemically synthesized
tctggctcattcttgtgctg

SEQ ID NO: 578983 - DNA, 20 bp, Artificial Sequence
  chemically synthesized
attttccaaaataaaacatt

SEQ ID NO: 578984 - DNA, 20 bp, Artificial Sequence
  chemically synthesized
aatgacaacatctaaacagc

SEQ ID NO: 578985 - DNA, 20 bp, Artificial Sequence
  chemically synthesized
ttgtcatttaaaaagaccct

SEQ ID NO: 578986 - DNA, 20 bp, Artificial Sequence
  chemically synthesized
aagacccttaatgattagtc

SEQ ID NO: 578987 - DNA, 20 bp, Artificial Sequence
  chemically synthesized
ccttaatgattagtcaactg

SEQ ID NO: 578988 - DNA, 20 bp, Artificial Sequence
  chemically synthesized
ttagtcaactgatttgcttt

SEQ ID NO: 578989 - DNA, 20 bp, Artificial Sequence
  chemically synthesized
ttgttcagtggacaacttgt

SEQ ID NO: 578990 - DNA, 20 bp, Artificial Sequence
  chemically synthesized
cactaaaaaaaaaatgataa

SEQ ID NO: 578991 - DNA, 20 bp, Artificial Sequence
  chemically synthesized
taatttattttaatccaatg

SEQ ID NO: 578992 - DNA, 20 bp, Artificial Sequence
  chemically synthesized
caaaataaggaaaacggaac

SEQ ID NO: 578993 - DNA, 20 bp, Artificial Sequence
  chemically synthesized
cgttttccttattttgctct

SEQ ID NO: 578994 - DNA, 20 bp, Artificial Sequence
  chemically synthesized
taaactggcctcttccccag

SEQ ID NO: 578995 - DNA, 20 bp, Artificial Sequence
  chemically synthesized
aaagcagtgctggggaagag

SEQ ID NO: 578996 - DNA, 20 bp, Artificial Sequence
  chemically synthesized
gcaataccttttacttggaa

SEQ ID NO: 578997 - DNA, 20 bp, Artificial Sequence
  chemically synthesized
aatatgtttgaagatcacct

SEQ ID NO: 578998 - DNA, 20 bp, Artificial Sequence
  chemically synthesized
tgccattcagacaatcgttc

SEQ ID NO: 578999 - DNA, 20 bp, Artificial Sequence
  chemically synthesized
tagtcagatcaaaatcggaa

SEQ ID NO: 579000 - DNA, 20 bp, Artificial Sequence
  chemically synthesized
cgattttgatctgactatct

SEQ ID NO: 579001 - DNA, 20 bp, Artificial Sequence
  chemically synthesized
aatgattccctgtagacctg

SEQ ID NO: 579002 - DNA, 20 bp, Artificial Sequence
  chemically synthesized
tcgaaagtacttgggggaac

SEQ ID NO: 579003 - DNA, 20 bp, Artificial Sequence
  chemically synthesized
gagatagcaataaattcaga

SEQ ID NO: 579004 - DNA, 20 bp, Artificial Sequence
  chemically synthesized
aataaatgtcaataggaaaa

SEQ ID NO: 579005 - DNA, 20 bp, Artificial Sequence
  chemically synthesized
ggttttgataaactatattt

SEQ ID NO: 579006 - DNA, 20 bp, Artificial Sequence
  chemically synthesized
tagtttatcaaactataaaa

SEQ ID NO: 579007 - DNA, 20 bp, Artificial Sequence
  chemically synthesized
tttatagtttgataaactat

SEQ ID NO: 579008 - DNA, 20 bp, Artificial Sequence
  chemically synthesized
aaggtgaaaaagaaagcata

SEQ ID NO: 579009 - DNA, 20 bp, Artificial Sequence
  chemically synthesized
ccttcttattgacaacattt

SEQ ID NO: 579010 - DNA, 20 bp, Artificial Sequence
  chemically synthesized
tatattagcaggttccagga

SEQ ID NO: 579011 - DNA, 20 bp, Artificial Sequence
  chemically synthesized
taagtttaacaattattgtt

SEQ ID NO: 579012 - DNA, 20 bp, Artificial Sequence
  chemically synthesized
tgataatttatgtaaaaatt

SEQ ID NO: 579013 - DNA, 20 bp, Artificial Sequence
  chemically synthesized
gatgttcatattttcaaatg

SEQ ID NO: 579014 - DNA, 20 bp, Artificial Sequence
  chemically synthesized
aaatatatgcttcaggaaag

SEQ ID NO: 579015 - DNA, 20 bp, Artificial Sequence
  chemically synthesized
ttaagagctactttaaaaat

SEQ ID NO: 579016 - DNA, 20 bp, Artificial Sequence
  chemically synthesized
ttatagctacatcacatgtt

SEQ ID NO: 579017 - DNA, 20 bp, Artificial Sequence
  chemically synthesized
ttttatcctattatttttca

SEQ ID NO: 579018 - DNA, 20 bp, Artificial Sequence
  chemically synthesized
tagaactaataacattgcac

SEQ ID NO: 579019 - DNA, 20 bp, Artificial Sequence
  chemically synthesized
gctttcactgcattgatgaa

SEQ ID NO: 579020 - DNA, 20 bp, Artificial Sequence
  chemically synthesized
gagaatctagagaattctgt

SEQ ID NO: 579021 - DNA, 20 bp, Artificial Sequence
  chemically synthesized
tgaaagcaaatacagaattc

SEQ ID NO: 579022 - DNA, 20 bp, Artificial Sequence
  chemically synthesized
aatattctattaatatcagc

SEQ ID NO: 579023 - DNA, 20 bp, Artificial Sequence
  chemically synthesized
aggcataatattctattaat

SEQ ID NO: 579024 - DNA, 20 bp, Artificial Sequence
  chemically synthesized
gtccacattctatgaaagta

SEQ ID NO: 579025 - DNA, 20 bp, Artificial Sequence
  chemically synthesized
tgcagtatctggcaaagagt

SEQ ID NO: 579026 - DNA, 20 bp, Artificial Sequence
  chemically synthesized
atatttgccattttctaatt

SEQ ID NO: 579027 - DNA, 20 bp, Artificial Sequence
  chemically synthesized
tggcagttatatatgcacta

SEQ ID NO: 579028 - DNA, 20 bp, Artificial Sequence
  chemically synthesized
gtgcatatataactgccact

SEQ ID NO: 579029 - DNA, 20 bp, Artificial Sequence
  chemically synthesized
tttgaaaatgggttacctgg

SEQ ID NO: 579030 - DNA, 20 bp, Artificial Sequence
  chemically synthesized
tattccaaagttttgccaaa

SEQ ID NO: 579031 - DNA, 20 bp, Artificial Sequence
  chemically synthesized
tttgtattccaaagttttgc

SEQ ID NO: 579032 - DNA, 20 bp, Artificial Sequence
  chemically synthesized
ccatcttcttttttgtattc

SEQ ID NO: 579033 - DNA, 20 bp, Artificial Sequence
  chemically synthesized
ttgccattcttcctggaaag

SEQ ID NO: 579034 - DNA, 20 bp, Artificial Sequence
  chemically synthesized
tctcctttttctgtgtgtgt

SEQ ID NO: 579035 - DNA, 20 bp, Artificial Sequence
  chemically synthesized
gtgtcagaattaacacaaac

SEQ ID NO: 579036 - DNA, 20 bp, Artificial Sequence
  chemically synthesized
aattaacacaaactggtgtt

SEQ ID NO: 579037 - DNA, 20 bp, Artificial Sequence
  chemically synthesized
gactttcctaagctcaaaac

SEQ ID NO: 579038 - DNA, 20 bp, Artificial Sequence
  chemically synthesized
gttctgctccctgggatatg

SEQ ID NO: 579039 - DNA, 20 bp, Artificial Sequence
  chemically synthesized
taattgataatggtaggaca

SEQ ID NO: 579040 - DNA, 20 bp, Artificial Sequence
  chemically synthesized
cccttaattgataatggtag

SEQ ID NO: 579041 - DNA, 20 bp, Artificial Sequence
  chemically synthesized
ctgtcctaccattatcaatt

SEQ ID NO: 579042 - DNA, 20 bp, Artificial Sequence
  chemically synthesized
tcaagaatgagtcccaagcc

SEQ ID NO: 579043 - DNA, 20 bp, Artificial Sequence
  chemically synthesized
tgcagactccttggcaaacc

SEQ ID NO: 579044 - DNA, 20 bp, Artificial Sequence
  chemically synthesized
aattgaaagtcaaagttcta

SEQ ID NO: 579045 - DNA, 20 bp, Artificial Sequence
  chemically synthesized
actctacatgagaagtgtat

SEQ ID NO: 579046 - DNA, 20 bp, Artificial Sequence
  chemically synthesized
ggggtttactcacacacacc

SEQ ID NO: 579047 - DNA, 20 bp, Artificial Sequence
  chemically synthesized
cacacacaccaagtgcttgg

SEQ ID NO: 579048 - DNA, 20 bp, Artificial Sequence
  chemically synthesized
ggaattgcctacctgtcagg

SEQ ID NO: 579049 - DNA, 20 bp, Artificial Sequence
  chemically synthesized
aaaagtaatcactagcgtgg

SEQ ID NO: 579050 - DNA, 20 bp, Artificial Sequence
  chemically synthesized
acctataaaccacaccacgc

SEQ ID NO: 579051 - DNA, 20 bp, Artificial Sequence
  chemically synthesized
tcactagcgtggtgtggttt

SEQ ID NO: 579052 - DNA, 20 bp, Artificial Sequence
  chemically synthesized
atggaagtaactcataattt

SEQ ID NO: 579053 - DNA, 20 bp, Artificial Sequence
  chemically synthesized
tgtcaaggagggttaatggc

SEQ ID NO: 579054 - DNA, 20 bp, Artificial Sequence
  chemically synthesized
aaattgctgggatctgctaa

SEQ ID NO: 579055 - DNA, 20 bp, Artificial Sequence
  chemically synthesized
ctattgtctattgcctctat

SEQ ID NO: 579056 - DNA, 20 bp, Artificial Sequence
  chemically synthesized
aaaatagagactttattaag

SEQ ID NO: 579057 - DNA, 20 bp, Artificial Sequence
  chemically synthesized
gcttcttttactgaagatat

SEQ ID NO: 579058 - DNA, 20 bp, Artificial Sequence
  chemically synthesized
aagatatccctgattacttc

SEQ ID NO: 579059 - DNA, 20 bp, Artificial Sequence
  chemically synthesized
gtgggaagtctcaggaaaaa

SEQ ID NO: 579060 - DNA, 20 bp, Artificial Sequence
  chemically synthesized
tcaggaaaaaaaaagattca

SEQ ID NO: 579061 - DNA, 20 bp, Artificial Sequence
  chemically synthesized
agagacagagagaggataga

SEQ ID NO: 579062 - DNA, 20 bp, Artificial Sequence
  chemically synthesized
agctagagacagagagagga

SEQ ID NO: 579063 - DNA, 20 bp, Artificial Sequence
  chemically synthesized
taaggacttttttctgggaa

SEQ ID NO: 579064 - DNA, 20 bp, Artificial Sequence
  chemically synthesized
ttcttacctcatattctggt

SEQ ID NO: 579065 - DNA, 20 bp, Artificial Sequence
  chemically synthesized
ttggttagcatggcaaatgt

SEQ ID NO: 579066 - DNA, 20 bp, Artificial Sequence
  chemically synthesized
tattcaggtaactcacggtg

SEQ ID NO: 579067 - DNA, 20 bp, Artificial Sequence
  chemically synthesized
gcatagaacatgcactcagt

SEQ ID NO: 579068 - DNA, 20 bp, Artificial Sequence
  chemically synthesized
accagatactgtagtgttgt

SEQ ID NO: 579069 - DNA, 20 bp, Artificial Sequence
  chemically synthesized
gttgtataagattcttgaga

SEQ ID NO: 579070 - DNA, 20 bp, Artificial Sequence
  chemically synthesized
atacagtatgcatcccttct

SEQ ID NO: 579071 - DNA, 20 bp, Artificial Sequence
  chemically synthesized
tttagaagggatgcatactg

SEQ ID NO: 579072 - DNA, 20 bp, Artificial Sequence
  chemically synthesized
tttcataaatacacatactt

SEQ ID NO: 579073 - DNA, 20 bp, Artificial Sequence
  chemically synthesized
aatcagacccttattacagt

SEQ ID NO: 579074 - DNA, 20 bp, Artificial Sequence
  chemically synthesized
aagcatgcactgtaataagg

SEQ ID NO: 579075 - DNA, 20 bp, Artificial Sequence
  chemically synthesized
ctcctatgggaaagaagtct

SEQ ID NO: 579076 - DNA, 20 bp, Artificial Sequence
  chemically synthesized
atgggaaagaagtctgttcg

SEQ ID NO: 579077 - DNA, 20 bp, Artificial Sequence
  chemically synthesized
aaagggttctatggatgaaa

SEQ ID NO: 579078 - DNA, 20 bp, Artificial Sequence
  chemically synthesized
gggagttttctttttccaaa

SEQ ID NO: 579079 - DNA, 20 bp, Artificial Sequence
  chemically synthesized
acatactcatcatctagagt

SEQ ID NO: 579080 - DNA, 20 bp, Artificial Sequence
  chemically synthesized
ggcagcctgttccatctttg

SEQ ID NO: 579081 - DNA, 20 bp, Artificial Sequence
  chemically synthesized
ctagtcctaagaacgtatat

SEQ ID NO: 579082 - DNA, 20 bp, Artificial Sequence
  chemically synthesized
tacgttcttaggactaggtt

SEQ ID NO: 579083 - DNA, 20 bp, Artificial Sequence
  chemically synthesized
ttattcggcctaagatcccc

SEQ ID NO: 579084 - DNA, 20 bp, Artificial Sequence
  chemically synthesized
aaagagagaagtgaaacaga

SEQ ID NO: 579085 - DNA, 20 bp, Artificial Sequence
  chemically synthesized
ttttagcaacaataatctcc

SEQ ID NO: 579086 - DNA, 20 bp, Artificial Sequence
  chemically synthesized
ttccaaatatggagataaca

SEQ ID NO: 579087 - DNA, 20 bp, Artificial Sequence
  chemically synthesized
ctatgttatctccatatttg

SEQ ID NO: 579088 - DNA, 20 bp, Artificial Sequence
  chemically synthesized
tagaaataacttggaggcct

SEQ ID NO: 579089 - DNA, 20 bp, Artificial Sequence
  chemically synthesized
tgggacttggggaactttta

SEQ ID NO: 579090 - DNA, 20 bp, Artificial Sequence
  chemically synthesized
agttccccaagtcccatccc

SEQ ID NO: 579091 - DNA, 20 bp, Artificial Sequence
  chemically synthesized
ccaagtcccatccccagaga

SEQ ID NO: 579092 - DNA, 20 bp, Artificial Sequence
  chemically synthesized
atgggaaagagcagactgga

SEQ ID NO: 579093 - DNA, 20 bp, Artificial Sequence
  chemically synthesized
tgggttcaaaggtccagatc

SEQ ID NO: 579094 - DNA, 20 bp, Artificial Sequence
  chemically synthesized
ctgcagtgcgttgcggcctc

SEQ ID NO: 579095 - DNA, 20 bp, Artificial Sequence
  chemically synthesized
tgatgaggccgcaacgcact

SEQ ID NO: 579096 - DNA, 20 bp, Artificial Sequence
  chemically synthesized
tgtgtaaggttgtaagatag

SEQ ID NO: 579097 - DNA, 20 bp, Artificial Sequence
  chemically synthesized
aagatagagagttgtgtgca

SEQ ID NO: 579098 - DNA, 20 bp, Artificial Sequence
  chemically synthesized
gggagcccagtctaagttag

SEQ ID NO: 579099 - DNA, 20 bp, Artificial Sequence
  chemically synthesized
cagtctaagttagatgggtt

SEQ ID NO: 579100 - DNA, 20 bp, Artificial Sequence
  chemically synthesized
agttagatgggttttttgtt

SEQ ID NO: 579101 - DNA, 20 bp, Artificial Sequence
  chemically synthesized
gacaagagtatcaggagcca

SEQ ID NO: 579102 - DNA, 20 bp, Artificial Sequence
  chemically synthesized
ctgctatatttgctatttct

SEQ ID NO: 579103 - DNA, 20 bp, Artificial Sequence
  chemically synthesized
tatttctccctgctttgtgg

SEQ ID NO: 579104 - DNA, 20 bp, Artificial Sequence
  chemically synthesized
tccttttcaatattttcatc

SEQ ID NO: 579105 - DNA, 20 bp, Artificial Sequence
  chemically synthesized
aaatattgaaaaggacagag

SEQ ID NO: 579106 - DNA, 20 bp, Artificial Sequence
  chemically synthesized
ttgaaaaggacagagctgag

SEQ ID NO: 579107 - DNA, 20 bp, Artificial Sequence
  chemically synthesized
ggatacctatcaatttggaa

SEQ ID NO: 579108 - DNA, 20 bp, Artificial Sequence
  chemically synthesized
gggagcataggcctcagagt

SEQ ID NO: 579109 - DNA, 20 bp, Artificial Sequence
  chemically synthesized
gatttgggatggaacaacag

SEQ ID NO: 579110 - DNA, 20 bp, Artificial Sequence
  chemically synthesized
ctgtgagtctagcttttgac

SEQ ID NO: 579111 - DNA, 20 bp, Artificial Sequence
  chemically synthesized
ttgttctctttagctgtgag

SEQ ID NO: 579112 - DNA, 20 bp, Artificial Sequence
  chemically synthesized
atgtgttatataagtgatac

SEQ ID NO: 579113 - DNA, 20 bp, Artificial Sequence
  chemically synthesized
ttttatgtttttatagtgag

SEQ ID NO: 579114 - DNA, 20 bp, Artificial Sequence
  chemically synthesized
cataatgattatttatgatt

SEQ ID NO: 579115 - DNA, 20 bp, Artificial Sequence
  chemically synthesized
cataaattcataatgattat

SEQ ID NO: 579116 - DNA, 20 bp, Artificial Sequence
  chemically synthesized
cataaataatcattatgaat

SEQ ID NO: 579117 - DNA, 20 bp, Artificial Sequence
  chemically synthesized
gaataataatcataaattca

SEQ ID NO: 579118 - DNA, 20 bp, Artificial Sequence
  chemically synthesized
ccctccatgaaatgaccaaa

SEQ ID NO: 579119 - DNA, 20 bp, Artificial Sequence
  chemically synthesized
ctgtatttggtcatttcatg

SEQ ID NO: 579120 - DNA, 20 bp, Artificial Sequence
  chemically synthesized
ggtcatttcatggagggttt

SEQ ID NO: 579121 - DNA, 20 bp, Artificial Sequence
  chemically synthesized
tggccgctcatacaattact

SEQ ID NO: 579122 - DNA, 20 bp, Artificial Sequence
  chemically synthesized
cagtaattgtatgagcggcc

SEQ ID NO: 579123 - DNA, 20 bp, Artificial Sequence
  chemically synthesized
cctttgtagataataaccta

SEQ ID NO: 579124 - DNA, 20 bp, Artificial Sequence
  chemically synthesized
acgtaggttattatctacaa

SEQ ID NO: 579125 - DNA, 20 bp, Artificial Sequence
  chemically synthesized
aaggtgattgaatttggttc

SEQ ID NO: 579126 - DNA, 20 bp, Artificial Sequence
  chemically synthesized
gattgaatttggttcacctg

SEQ ID NO: 579127 - DNA, 20 bp, Artificial Sequence
  chemically synthesized
catcactctgtgtccagtca

SEQ ID NO: 579128 - DNA, 20 bp, Artificial Sequence
  chemically synthesized
ttctaatagtcagtttcaca

SEQ ID NO: 579129 - DNA, 20 bp, Artificial Sequence
  chemically synthesized
gtttcaaatatcttctaata

SEQ ID NO: 579130 - DNA, 20 bp, Artificial Sequence
  chemically synthesized
agatatttgaaacacacaac

SEQ ID NO: 579131 - DNA, 20 bp, Artificial Sequence
  chemically synthesized
ccccattcaaagcagtagtt

SEQ ID NO: 579132 - DNA, 20 bp, Artificial Sequence
  chemically synthesized
aactactgctttgaatgggg

SEQ ID NO: 579133 - DNA, 20 bp, Artificial Sequence
  chemically synthesized
catagtgacattcttccagc

SEQ ID NO: 579134 - DNA, 20 bp, Artificial Sequence
  chemically synthesized
acttcaagaaattatttccc

SEQ ID NO: 579135 - DNA, 20 bp, Artificial Sequence
  chemically synthesized
ttattaggaaggaaatggac

SEQ ID NO: 579136 - DNA, 20 bp, Artificial Sequence
  chemically synthesized
tccttcctaataaaaatgtg

SEQ ID NO: 579137 - DNA, 20 bp, Artificial Sequence
  chemically synthesized
gaaaaaataaaactatctga

SEQ ID NO: 579138 - DNA, 20 bp, Artificial Sequence
  chemically synthesized
aacagttaaaagcattttca

SEQ ID NO: 579139 - DNA, 20 bp, Artificial Sequence
  chemically synthesized
ctatttttattttacttact

SEQ ID NO: 579140 - DNA, 20 bp, Artificial Sequence
  chemically synthesized
ggaattgctaagaatgttga

SEQ ID NO: 579141 - DNA, 20 bp, Artificial Sequence
  chemically synthesized
ttctttatttgtaaattttt

SEQ ID NO: 579142 - DNA, 20 bp, Artificial Sequence
  chemically synthesized
taacttctttcctttagtac

SEQ ID NO: 579143 - DNA, 20 bp, Artificial Sequence
  chemically synthesized
tctaccatttttctgtgttt

SEQ ID NO: 579144 - DNA, 20 bp, Artificial Sequence
  chemically synthesized
gtattttatctaccattttt

SEQ ID NO: 579145 - DNA, 20 bp, Artificial Sequence
  chemically synthesized
tctaagcccagattgtgcct

SEQ ID NO: 579146 - DNA, 20 bp, Artificial Sequence
  chemically synthesized
gaaaatcaaaaaggcacaat

SEQ ID NO: 579147 - DNA, 20 bp, Artificial Sequence
  chemically synthesized
ctacttaacttgtttctaag

SEQ ID NO: 579148 - DNA, 20 bp, Artificial Sequence
  chemically synthesized
ctgaaacacagagctactta

SEQ ID NO: 579149 - DNA, 20 bp, Artificial Sequence
  chemically synthesized
tagaaacaagttaagtagct

SEQ ID NO: 579150 - DNA, 20 bp, Artificial Sequence
  chemically synthesized
ctgcagccccgtgcaccact

SEQ ID NO: 579151 - DNA, 20 bp, Artificial Sequence
  chemically synthesized
ggtgcacggggctgcagaca

SEQ ID NO: 579152 - DNA, 20 bp, Artificial Sequence
  chemically synthesized
taggtagcagtagccaggag

SEQ ID NO: 579153 - DNA, 20 bp, Artificial Sequence
  chemically synthesized
tttgtcttataccgagtgtt

SEQ ID NO: 579154 - DNA, 20 bp, Artificial Sequence
  chemically synthesized
caggtcctttgtcttatacc

SEQ ID NO: 579155 - DNA, 20 bp, Artificial Sequence
  chemically synthesized
gcaattagtcaaggatgata

SEQ ID NO: 579156 - DNA, 20 bp, Artificial Sequence
  chemically synthesized
agttctaggttgtgatcaat

SEQ ID NO: 579157 - DNA, 20 bp, Artificial Sequence
  chemically synthesized
tgctattgatcacaacctag

SEQ ID NO: 579158 - DNA, 20 bp, Artificial Sequence
  chemically synthesized
ccctttttagggggaaattg

SEQ ID NO: 579159 - DNA, 20 bp, Artificial Sequence
  chemically synthesized
tttagggggaaattggaaag

SEQ ID NO: 579160 - DNA, 20 bp, Artificial Sequence
  chemically synthesized
gtttggacatataggtatta

SEQ ID NO: 579161 - DNA, 20 bp, Artificial Sequence
  chemically synthesized
caaatgatttcttatattaa

SEQ ID NO: 579162 - DNA, 20 bp, Artificial Sequence
  chemically synthesized
atataagaaatcatttgaat

SEQ ID NO: 579163 - DNA, 20 bp, Artificial Sequence
  chemically synthesized
tttctctaaatcattaattc

SEQ ID NO: 579164 - DNA, 20 bp, Artificial Sequence
  chemically synthesized
ttattcagtatgtaacaggg

SEQ ID NO: 579165 - DNA, 20 bp, Artificial Sequence
  chemically synthesized
atcttatagttttgggatcc

SEQ ID NO: 579166 - DNA, 20 bp, Artificial Sequence
  chemically synthesized
agccaaaggatcccaaaact

SEQ ID NO: 579167 - DNA, 20 bp, Artificial Sequence
  chemically synthesized
ctgcacaattctagaaatct

SEQ ID NO: 579168 - DNA, 20 bp, Artificial Sequence
  chemically synthesized
cagaaaaaaattaagtcaag

SEQ ID NO: 579169 - DNA, 20 bp, Artificial Sequence
  chemically synthesized
gtagatttatttttagaaag

SEQ ID NO: 579170 - DNA, 20 bp, Artificial Sequence
  chemically synthesized
ttcaataaaaatagaattta

SEQ ID NO: 579171 - DNA, 20 bp, Artificial Sequence
  chemically synthesized
acctaaattctatttttatt

SEQ ID NO: 579172 - DNA, 20 bp, Artificial Sequence
  chemically synthesized
atgggagaaagtttttctta

SEQ ID NO: 579173 - DNA, 20 bp, Artificial Sequence
  chemically synthesized
aataagaaaaactttctccc

SEQ ID NO: 579174 - DNA, 20 bp, Artificial Sequence
  chemically synthesized
aaatattaaagcaaatggga

SEQ ID NO: 579175 - DNA, 20 bp, Artificial Sequence
  chemically synthesized
aaaattataggataccaaca

SEQ ID NO: 579176 - DNA, 20 bp, Artificial Sequence
  chemically synthesized
ttttttattaggaaacaatg

SEQ ID NO: 579177 - DNA, 20 bp, Artificial Sequence
  chemically synthesized
tagtattatcgaaaacttac

SEQ ID NO: 579178 - DNA, 20 bp, Artificial Sequence
  chemically synthesized
tggtaagttttcgataatac

SEQ ID NO: 579179 - DNA, 20 bp, Artificial Sequence
  chemically synthesized
gcttagaaatgctcctatgt

SEQ ID NO: 579180 - DNA, 20 bp, Artificial Sequence
  chemically synthesized
ctgaaccaacgcaccaaaat

SEQ ID NO: 579181 - DNA, 20 bp, Artificial Sequence
  chemically synthesized
gacatttggaaccatgtcat

SEQ ID NO: 579182 - DNA, 20 bp, Artificial Sequence
  chemically synthesized
attagaatgtttctagcttg

SEQ ID NO: 579183 - DNA, 20 bp, Artificial Sequence
  chemically synthesized
tttcaagtaattagaatgtt

SEQ ID NO: 579184 - DNA, 20 bp, Artificial Sequence
  chemically synthesized
catctcctttcaagtaatta

SEQ ID NO: 579185 - DNA, 20 bp, Artificial Sequence
  chemically synthesized
aaaggttcatagtggtaaca

SEQ ID NO: 579186 - DNA, 20 bp, Artificial Sequence
  chemically synthesized
acactctctggcccggagcc

SEQ ID NO: 579187 - DNA, 20 bp, Artificial Sequence
  chemically synthesized
tcttcggaggtttaagtgag

SEQ ID NO: 579188 - DNA, 20 bp, Artificial Sequence
  chemically synthesized
atgaagcataagaactcttc

SEQ ID NO: 579189 - DNA, 20 bp, Artificial Sequence
  chemically synthesized
cttaaacctccgaagagttc

SEQ ID NO: 579190 - DNA, 20 bp, Artificial Sequence
  chemically synthesized
ttatgcttcataatcagttg

SEQ ID NO: 579191 - DNA, 20 bp, Artificial Sequence
  chemically synthesized
gctgagacccaaatcttccc

SEQ ID NO: 579192 - DNA, 20 bp, Artificial Sequence
  chemically synthesized
tgggtctcagcaatataaaa

SEQ ID NO: 579193 - DNA, 20 bp, Artificial Sequence
  chemically synthesized
gtgtacctaaaggagttgat

SEQ ID NO: 579194 - DNA, 20 bp, Artificial Sequence
  chemically synthesized
gtagtccattttaaggactg

SEQ ID NO: 579195 - DNA, 20 bp, Artificial Sequence
  chemically synthesized
aaaattgagagggttgaact

SEQ ID NO: 579196 - DNA, 20 bp, Artificial Sequence
  chemically synthesized
ctggtggctttggggtcatt

SEQ ID NO: 579197 - DNA, 20 bp, Artificial Sequence
  chemically synthesized
ggttcaagaaatcctcttgc

SEQ ID NO: 579198 - DNA, 20 bp, Artificial Sequence
  chemically synthesized
ctacttgggaagctgaggca

SEQ ID NO: 579199 - DNA, 20 bp, Artificial Sequence
  chemically synthesized
caagtagctgggactacaaa

SEQ ID NO: 579200 - DNA, 20 bp, Artificial Sequence
  chemically synthesized
taaaaaaaaaaaaaaaaaag

SEQ ID NO: 579201 - DNA, 20 bp, Artificial Sequence
  chemically synthesized
tggctttttttttttttttt

SEQ ID NO: 579202 - DNA, 20 bp, Artificial Sequence
  chemically synthesized
tgggaggatcactagaggcc

SEQ ID NO: 579203 - DNA, 20 bp, Artificial Sequence
  chemically synthesized
cacctcggcctcccaaagtg

SEQ ID NO: 579204 - DNA, 20 bp, Artificial Sequence
  chemically synthesized
tgatagaatgctagcgggat

SEQ ID NO: 579205 - DNA, 20 bp, Artificial Sequence
  chemically synthesized
cattctatcatatttttgta

SEQ ID NO: 579206 - DNA, 20 bp, Artificial Sequence
  chemically synthesized
atttccaaaaatttaaagga

SEQ ID NO: 579207 - DNA, 20 bp, Artificial Sequence
  chemically synthesized
gatgttgggcactgaatggc

SEQ ID NO: 579208 - DNA, 20 bp, Artificial Sequence
  chemically synthesized
tcatcagatgttgggcactg

SEQ ID NO: 579209 - DNA, 20 bp, Artificial Sequence
  chemically synthesized
tcagtgcccaacatctgatg

SEQ ID NO: 579210 - DNA, 20 bp, Artificial Sequence
  chemically synthesized
gctgagtaattgtactcaat

SEQ ID NO: 579211 - DNA, 20 bp, Artificial Sequence
  chemically synthesized
cttttctggaactacttaag

SEQ ID NO: 579212 - DNA, 20 bp, Artificial Sequence
  chemically synthesized
ataagactcttatgaagttc

SEQ ID NO: 579213 - DNA, 20 bp, Artificial Sequence
  chemically synthesized
acatttttgcttgttcattt

SEQ ID NO: 579214 - DNA, 20 bp, Artificial Sequence
  chemically synthesized
ttatacatttttgcttgttc

SEQ ID NO: 579215 - DNA, 20 bp, Artificial Sequence
  chemically synthesized
aagcaaatagtgttatacat

SEQ ID NO: 579216 - DNA, 20 bp, Artificial Sequence
  chemically synthesized
aagcaaaaatgtataacact

SEQ ID NO: 579217 - DNA, 20 bp, Artificial Sequence
  chemically synthesized
atttgcttttcttcccagga

SEQ ID NO: 579218 - DNA, 20 bp, Artificial Sequence
  chemically synthesized
ggaaaatgttttactttttc

SEQ ID NO: 579219 - DNA, 20 bp, Artificial Sequence
  chemically synthesized
ttactttcagaaaaatttga

SEQ ID NO: 579220 - DNA, 20 bp, Artificial Sequence
  chemically synthesized
gcatgatatttacatgtatg

SEQ ID NO: 579221 - DNA, 20 bp, Artificial Sequence
  chemically synthesized
ttcttgcttccctttgattc

SEQ ID NO: 579222 - DNA, 20 bp, Artificial Sequence
  chemically synthesized
actggaatcaaagggaagca

SEQ ID NO: 579223 - DNA, 20 bp, Artificial Sequence
  chemically synthesized
aaatgaatcttcttgcttcc

SEQ ID NO: 579224 - DNA, 20 bp, Artificial Sequence
  chemically synthesized
gtcttccttgaaatgaatct

SEQ ID NO: 579225 - DNA, 20 bp, Artificial Sequence
  chemically synthesized
ttcatcctttgtagatttct

SEQ ID NO: 579226 - DNA, 20 bp, Artificial Sequence
  chemically synthesized
cctaaagcctcttcatcctt

SEQ ID NO: 579227 - DNA, 20 bp, Artificial Sequence
  chemically synthesized
cagaaatctacaaaggatga

SEQ ID NO: 579228 - DNA, 20 bp, Artificial Sequence
  chemically synthesized
caatagggataaagagaggg

SEQ ID NO: 579229 - DNA, 20 bp, Artificial Sequence
  chemically synthesized
agaattcacagaatttggaa

SEQ ID NO: 579230 - DNA, 20 bp, Artificial Sequence
  chemically synthesized
tctactgacacatgtattaa

SEQ ID NO: 579231 - DNA, 20 bp, Artificial Sequence
  chemically synthesized
gccagtttaatacatgtgtc

SEQ ID NO: 579232 - DNA, 20 bp, Artificial Sequence
  chemically synthesized
agaaaggtagaaggtaattc

SEQ ID NO: 579233 - DNA, 20 bp, Artificial Sequence
  chemically synthesized
tagaaggtaattcttaggtt

SEQ ID NO: 579234 - DNA, 20 bp, Artificial Sequence
  chemically synthesized
ctaaaagaaagttaaatttt

SEQ ID NO: 579235 - DNA, 20 bp, Artificial Sequence
  chemically synthesized
cattttgagtagctttgtct

SEQ ID NO: 579236 - DNA, 20 bp, Artificial Sequence
  chemically synthesized
ctttctctctgcacattttg

SEQ ID NO: 579237 - DNA, 20 bp, Artificial Sequence
  chemically synthesized
cttgagctactccccataac

SEQ ID NO: 579238 - DNA, 20 bp, Artificial Sequence
  chemically synthesized
atattttgggtacagagcac

SEQ ID NO: 579239 - DNA, 20 bp, Artificial Sequence
  chemically synthesized
ggtgaatgtggtgaggagtg

SEQ ID NO: 579240 - DNA, 20 bp, Artificial Sequence
  chemically synthesized
tctcttgactgaattatgac

SEQ ID NO: 579241 - DNA, 20 bp, Artificial Sequence
  chemically synthesized
tttcctaatggtctcactac

SEQ ID NO: 579242 - DNA, 20 bp, Artificial Sequence
  chemically synthesized
gggttttgaatggaggagtg

SEQ ID NO: 579243 - DNA, 20 bp, Artificial Sequence
  chemically synthesized
gaatgagatgggagttattg

SEQ ID NO: 579244 - DNA, 20 bp, Artificial Sequence
  chemically synthesized
ctccaataactcccatctca

SEQ ID NO: 579245 - DNA, 20 bp, Artificial Sequence
  chemically synthesized
ggccttttaggcctgtggac

SEQ ID NO: 579246 - DNA, 20 bp, Artificial Sequence
  chemically synthesized
aatttagaggggtaactggc

SEQ ID NO: 579247 - DNA, 20 bp, Artificial Sequence
  chemically synthesized
ttattgtcaactaccttcct

SEQ ID NO: 579248 - DNA, 20 bp, Artificial Sequence
  chemically synthesized
cttcaacatgccaagaatat

SEQ ID NO: 579249 - DNA, 20 bp, Artificial Sequence
  chemically synthesized
acatcctcaggtcttttaga

SEQ ID NO: 579250 - DNA, 20 bp, Artificial Sequence
  chemically synthesized
caccttttcagtaagacctt

SEQ ID NO: 579251 - DNA, 20 bp, Artificial Sequence
  chemically synthesized
ccacctccctctctctctcc

SEQ ID NO: 579252 - DNA, 20 bp, Artificial Sequence
  chemically synthesized
gtcaatgtctgtcttccaac

SEQ ID NO: 579253 - DNA, 20 bp, Artificial Sequence
  chemically synthesized
caacttctgcttccaagaat

SEQ ID NO: 579254 - DNA, 20 bp, Artificial Sequence
  chemically synthesized
gaatataagctttatgaggg

SEQ ID NO: 579255 - DNA, 20 bp, Artificial Sequence
  chemically synthesized
aatgaaaagccctaccctca

SEQ ID NO: 579256 - DNA, 20 bp, Artificial Sequence
  chemically synthesized
actcaacaaatacttttgta

SEQ ID NO: 579257 - DNA, 20 bp, Artificial Sequence
  chemically synthesized
ctaatcatataataattgtg

SEQ ID NO: 579258 - DNA, 20 bp, Artificial Sequence
  chemically synthesized
ccaagcacctcacaattatt

SEQ ID NO: 579259 - DNA, 20 bp, Artificial Sequence
  chemically synthesized
gttctgggaaccaaggagga

SEQ ID NO: 579260 - DNA, 20 bp, Artificial Sequence
  chemically synthesized
gggaaccaaggaggataaag

SEQ ID NO: 579261 - DNA, 20 bp, Artificial Sequence
  chemically synthesized
cactgatgatcttagtaagt

SEQ ID NO: 579262 - DNA, 20 bp, Artificial Sequence
  chemically synthesized
ttttaagcagtagttggcat

SEQ ID NO: 579263 - DNA, 20 bp, Artificial Sequence
  chemically synthesized
caggaaacagtaatgccaac

SEQ ID NO: 579264 - DNA, 20 bp, Artificial Sequence
  chemically synthesized
ttctatccagctgtacttgc

SEQ ID NO: 579265 - DNA, 20 bp, Artificial Sequence
  chemically synthesized
ttttttttctatccagctgt

SEQ ID NO: 579266 - DNA, 20 bp, Artificial Sequence
  chemically synthesized
ctcttttacattctccaaca

SEQ ID NO: 579267 - DNA, 20 bp, Artificial Sequence
  chemically synthesized
tggagaatgtaaaagagatc

SEQ ID NO: 579268 - DNA, 20 bp, Artificial Sequence
  chemically synthesized
ctacacacaaaatagggctc

SEQ ID NO: 579269 - DNA, 20 bp, Artificial Sequence
  chemically synthesized
gaaggcacttgtaagtcact

SEQ ID NO: 579270 - DNA, 20 bp, Artificial Sequence
  chemically synthesized
aagacggagaaaacaggtca

SEQ ID NO: 579271 - DNA, 20 bp, Artificial Sequence
  chemically synthesized
gatcatctgaaaacattttg

SEQ ID NO: 579272 - DNA, 20 bp, Artificial Sequence
  chemically synthesized
gtattctctgttctttataa

SEQ ID NO: 579273 - DNA, 20 bp, Artificial Sequence
  chemically synthesized
ctgagatgttatggaagaaa

SEQ ID NO: 579274 - DNA, 20 bp, Artificial Sequence
  chemically synthesized
aaaatccctctaggttctaa

SEQ ID NO: 579275 - DNA, 20 bp, Artificial Sequence
  chemically synthesized
tgaatctttcttagaaccta

SEQ ID NO: 579276 - DNA, 20 bp, Artificial Sequence
  chemically synthesized
agagggattttttagtatct

SEQ ID NO: 579277 - DNA, 20 bp, Artificial Sequence
  chemically synthesized
cttagctaaggaacttctag

SEQ ID NO: 579278 - DNA, 20 bp, Artificial Sequence
  chemically synthesized
tctgatgcaaggaccatctc

SEQ ID NO: 579279 - DNA, 20 bp, Artificial Sequence
  chemically synthesized
aggaccatctcctctgcttg

SEQ ID NO: 579280 - DNA, 20 bp, Artificial Sequence
  chemically synthesized
ttgtctgcttgtagctgtat

SEQ ID NO: 579281 - DNA, 20 bp, Artificial Sequence
  chemically synthesized
ataagcattaactctgaatt

SEQ ID NO: 579282 - DNA, 20 bp, Artificial Sequence
  chemically synthesized
acaagcagacaattcagagt

SEQ ID NO: 579283 - DNA, 20 bp, Artificial Sequence
  chemically synthesized
attcagagttaatgcttatt

SEQ ID NO: 579284 - DNA, 20 bp, Artificial Sequence
  chemically synthesized
gactttatgatgacactgtc

SEQ ID NO: 579285 - DNA, 20 bp, Artificial Sequence
  chemically synthesized
gtccttgaaatctaatcctt

SEQ ID NO: 579286 - DNA, 20 bp, Artificial Sequence
  chemically synthesized
attgtgagaagcctctaagg

SEQ ID NO: 579287 - DNA, 20 bp, Artificial Sequence
  chemically synthesized
aaattattgtgagaagcctc

SEQ ID NO: 579288 - DNA, 20 bp, Artificial Sequence
  chemically synthesized
ttcaatctctgtgaatagat

SEQ ID NO: 579289 - DNA, 20 bp, Artificial Sequence
  chemically synthesized
cacaaactcatatctattca

SEQ ID NO: 579290 - DNA, 20 bp, Artificial Sequence
  chemically synthesized
aacttgcagaggctcacatt

SEQ ID NO: 579291 - DNA, 20 bp, Artificial Sequence
  chemically synthesized
gtgacctatgtaggaaaata

SEQ ID NO: 579292 - DNA, 20 bp, Artificial Sequence
  chemically synthesized
acaataatctatgttcagat

SEQ ID NO: 579293 - DNA, 20 bp, Artificial Sequence
  chemically synthesized
tttagaaacccagatctgaa

SEQ ID NO: 579294 - DNA, 20 bp, Artificial Sequence
  chemically synthesized
gctgcttctcaactaaattg

SEQ ID NO: 579295 - DNA, 20 bp, Artificial Sequence
  chemically synthesized
tatctatggaaaaaagagaa

SEQ ID NO: 579296 - DNA, 20 bp, Artificial Sequence
  chemically synthesized
agccttctcttttttccata

SEQ ID NO: 579297 - DNA, 20 bp, Artificial Sequence
  chemically synthesized
gaataaatataaataggcat

SEQ ID NO: 579298 - DNA, 20 bp, Artificial Sequence
  chemically synthesized
gatgagtcttcaaattctac

SEQ ID NO: 579299 - DNA, 20 bp, Artificial Sequence
  chemically synthesized
taatgtttatattttgctgt

SEQ ID NO: 579300 - DNA, 20 bp, Artificial Sequence
  chemically synthesized
gtaaactaatgtttatattt

SEQ ID NO: 579301 - DNA, 20 bp, Artificial Sequence
  chemically synthesized
ttaaacagcaaaatataaac

SEQ ID NO: 579302 - DNA, 20 bp, Artificial Sequence
  chemically synthesized
gacataataaaaaagtaaac

SEQ ID NO: 579303 - DNA, 20 bp, Artificial Sequence
  chemically synthesized
gatatcagacactgccatgt

SEQ ID NO: 579304 - DNA, 20 bp, Artificial Sequence
  chemically synthesized
ataaaatgtacttgaaagaa

SEQ ID NO: 579305 - DNA, 20 bp, Artificial Sequence
  chemically synthesized
ttatatcttatttaacattc

SEQ ID NO: 579306 - DNA, 20 bp, Artificial Sequence
  chemically synthesized
aacattcaacagtttaaaac

SEQ ID NO: 579307 - DNA, 20 bp, Artificial Sequence
  chemically synthesized
tttaaattagtaataaaatc

SEQ ID NO: 579308 - DNA, 20 bp, Artificial Sequence
  chemically synthesized
caagtgtacaaaaattttgc

SEQ ID NO: 579309 - DNA, 20 bp, Artificial Sequence
  chemically synthesized
tctcagtgcaggcaatgcat

SEQ ID NO: 579310 - DNA, 20 bp, Artificial Sequence
  chemically synthesized
gagggattctgtggaaagtt

SEQ ID NO: 579311 - DNA, 20 bp, Artificial Sequence
  chemically synthesized
taggtaggagggattctgtg

SEQ ID NO: 579312 - DNA, 20 bp, Artificial Sequence
  chemically synthesized
aactatagctttttaggtag

SEQ ID NO: 579313 - DNA, 20 bp, Artificial Sequence
  chemically synthesized
ctttgaaaaagttctgtaac

SEQ ID NO: 579314 - DNA, 20 bp, Artificial Sequence
  chemically synthesized
attaaactcatcttaaaaag

SEQ ID NO: 579315 - DNA, 20 bp, Artificial Sequence
  chemically synthesized
attaatctttcctttttaag

SEQ ID NO: 579316 - DNA, 20 bp, Artificial Sequence
  chemically synthesized
aaatgccatcctgtcatagt

SEQ ID NO: 579317 - DNA, 20 bp, Artificial Sequence
  chemically synthesized
atttggttttttgttcctgt

SEQ ID NO: 579318 - DNA, 20 bp, Artificial Sequence
  chemically synthesized
ataaatgagaacatggggta

SEQ ID NO: 579319 - DNA, 20 bp, Artificial Sequence
  chemically synthesized
ggaaagtcaactaacgggta

SEQ ID NO: 579320 - DNA, 20 bp, Artificial Sequence
  chemically synthesized
tgtgtcatgggggtctgttg

SEQ ID NO: 579321 - DNA, 20 bp, Artificial Sequence
  chemically synthesized
gtacaacagacccccatgac

SEQ ID NO: 579322 - DNA, 20 bp, Artificial Sequence
  chemically synthesized
ttaagttcaggggtacatgt

SEQ ID NO: 579323 - DNA, 20 bp, Artificial Sequence
  chemically synthesized
taatgcatttacttgtttct

SEQ ID NO: 579324 - DNA, 20 bp, Artificial Sequence
  chemically synthesized
tggcttgttgtaatgcattt

SEQ ID NO: 579325 - DNA, 20 bp, Artificial Sequence
  chemically synthesized
aaaaagtgttgtctctacac

SEQ ID NO: 579326 - DNA, 20 bp, Artificial Sequence
  chemically synthesized
tttatttataaatagaggca

SEQ ID NO: 579327 - DNA, 20 bp, Artificial Sequence
  chemically synthesized
attattataaatgtacccta

SEQ ID NO: 579328 - DNA, 20 bp, Artificial Sequence
  chemically synthesized
ccttaggcataaatgggtta

SEQ ID NO: 579329 - DNA, 20 bp, Artificial Sequence
  chemically synthesized
tgttcaaggtcctcaccaag

SEQ ID NO: 579330 - DNA, 20 bp, Artificial Sequence
  chemically synthesized
gtagaatataaataattccc

SEQ ID NO: 579331 - DNA, 20 bp, Artificial Sequence
  chemically synthesized
aggactatcagtaaaacttt

SEQ ID NO: 579332 - DNA, 20 bp, Artificial Sequence
  chemically synthesized
tcaggtaaccaccaatcaca

SEQ ID NO: 579333 - DNA, 20 bp, Artificial Sequence
  chemically synthesized
ggtagggggtgaggggatga

SEQ ID NO: 579334 - DNA, 20 bp, Artificial Sequence
  chemically synthesized
ggggtgaggggatgaacttg

SEQ ID NO: 579335 - DNA, 20 bp, Artificial Sequence
  chemically synthesized
ctcacccatatctaatttat

SEQ ID NO: 579336 - DNA, 20 bp, Artificial Sequence
  chemically synthesized
atttatattagattgcactt

SEQ ID NO: 579337 - DNA, 20 bp, Artificial Sequence
  chemically synthesized
acttttgagtttatgctgaa

SEQ ID NO: 579338 - DNA, 20 bp, Artificial Sequence
  chemically synthesized
ttatgctgaaataagatttt

SEQ ID NO: 579339 - DNA, 20 bp, Artificial Sequence
  chemically synthesized
gggaaaagggggcagaatgc

SEQ ID NO: 579340 - DNA, 20 bp, Artificial Sequence
  chemically synthesized
gggggcagaatgctatggtt

SEQ ID NO: 579341 - DNA, 20 bp, Artificial Sequence
  chemically synthesized
aatggcaattaaattttacc

SEQ ID NO: 579342 - DNA, 20 bp, Artificial Sequence
  chemically synthesized
tagtaaatgtgaccttgaag

SEQ ID NO: 579343 - DNA, 20 bp, Artificial Sequence
  chemically synthesized
atgaaggctctgccttcatg

SEQ ID NO: 579344 - DNA, 20 bp, Artificial Sequence
  chemically synthesized
ttagcatcattattgtggga

SEQ ID NO: 579345 - DNA, 20 bp, Artificial Sequence
  chemically synthesized
ggagtgagtttcatataagg

SEQ ID NO: 579346 - DNA, 20 bp, Artificial Sequence
  chemically synthesized
gtaagggccttcttgttgtg

SEQ ID NO: 579347 - DNA, 20 bp, Artificial Sequence
  chemically synthesized
gacacaacaagaaggccctt

SEQ ID NO: 579348 - DNA, 20 bp, Artificial Sequence
  chemically synthesized
actgggtaatttataatgaa

SEQ ID NO: 579349 - DNA, 20 bp, Artificial Sequence
  chemically synthesized
tgtccttgtcttagtccttt

SEQ ID NO: 579350 - DNA, 20 bp, Artificial Sequence
  chemically synthesized
aagtaggttgcatttggaga

SEQ ID NO: 579351 - DNA, 20 bp, Artificial Sequence
  chemically synthesized
gagattggaagaaggcaaag

SEQ ID NO: 579352 - DNA, 20 bp, Artificial Sequence
  chemically synthesized
tggaagaaggcaaagatgag

SEQ ID NO: 579353 - DNA, 20 bp, Artificial Sequence
  chemically synthesized
agttttagacatgtagatcc

SEQ ID NO: 579354 - DNA, 20 bp, Artificial Sequence
  chemically synthesized
ttccagctgagaatgatctt

SEQ ID NO: 579355 - DNA, 20 bp, Artificial Sequence
  chemically synthesized
tgcaagaattcatccacttg

SEQ ID NO: 579356 - DNA, 20 bp, Artificial Sequence
  chemically synthesized
ctttatagacatgagtcaga

SEQ ID NO: 579357 - DNA, 20 bp, Artificial Sequence
  chemically synthesized
tcagaagtagcttggtgaat

SEQ ID NO: 579358 - DNA, 20 bp, Artificial Sequence
  chemically synthesized
tgtacaggctaaaaatgtga

SEQ ID NO: 579359 - DNA, 20 bp, Artificial Sequence
  chemically synthesized
agtatatgcattccttagct

SEQ ID NO: 579360 - DNA, 20 bp, Artificial Sequence
  chemically synthesized
atgacttccagtttatattt

SEQ ID NO: 579361 - DNA, 20 bp, Artificial Sequence
  chemically synthesized
gattcttcatgggaatgact

SEQ ID NO: 579362 - DNA, 20 bp, Artificial Sequence
  chemically synthesized
aaaattgttttatcaaggtc

SEQ ID NO: 579363 - DNA, 20 bp, Artificial Sequence
  chemically synthesized
actctctcagttttttaaaa

SEQ ID NO: 579364 - DNA, 20 bp, Artificial Sequence
  chemically synthesized
attttttaaaaaactgagag

SEQ ID NO: 579365 - DNA, 20 bp, Artificial Sequence
  chemically synthesized
ttgatggcccaagccactct

SEQ ID NO: 579366 - DNA, 20 bp, Artificial Sequence
  chemically synthesized
ctagatcagtgtcctcaagc

SEQ ID NO: 579367 - DNA, 20 bp, Artificial Sequence
  chemically synthesized
gcttgctcatggtatgaaac

SEQ ID NO: 579368 - DNA, 20 bp, Artificial Sequence
  chemically synthesized
gctctagtttcataccatga

SEQ ID NO: 579369 - DNA, 20 bp, Artificial Sequence
  chemically synthesized
ataaactaaggggccaagaa

SEQ ID NO: 579370 - DNA, 20 bp, Artificial Sequence
  chemically synthesized
gcaagcttttttcttggccc

SEQ ID NO: 579371 - DNA, 20 bp, Artificial Sequence
  chemically synthesized
taaagtcagagattaatttg

SEQ ID NO: 579372 - DNA, 20 bp, Artificial Sequence
  chemically synthesized
caaattaatctctgacttta

SEQ ID NO: 579373 - DNA, 20 bp, Artificial Sequence
  chemically synthesized
tggggaaagcaaattaaagt

SEQ ID NO: 579374 - DNA, 20 bp, Artificial Sequence
  chemically synthesized
attagatcttagtgggaaat

SEQ ID NO: 579375 - DNA, 20 bp, Artificial Sequence
  chemically synthesized
atggttgactctctgatacc

SEQ ID NO: 579376 - DNA, 20 bp, Artificial Sequence
  chemically synthesized
tcttcctgaacctaatctgt

SEQ ID NO: 579377 - DNA, 20 bp, Artificial Sequence
  chemically synthesized
tatgtgttcaattaaacagg

SEQ ID NO: 579378 - DNA, 20 bp, Artificial Sequence
  chemically synthesized
taactactttttctcaatgg

SEQ ID NO: 579379 - DNA, 20 bp, Artificial Sequence
  chemically synthesized
tccaaatatcagctccatat

SEQ ID NO: 579380 - DNA, 20 bp, Artificial Sequence
  chemically synthesized
gaagattcaacctaaagttg

SEQ ID NO: 579381 - DNA, 20 bp, Artificial Sequence
  chemically synthesized
gatggaaaagaccatggaaa

SEQ ID NO: 579382 - DNA, 20 bp, Artificial Sequence
  chemically synthesized
atacacctactgtctggaat

SEQ ID NO: 579383 - DNA, 20 bp, Artificial Sequence
  chemically synthesized
ttgctctattccccagggtg

SEQ ID NO: 579384 - DNA, 20 bp, Artificial Sequence
  chemically synthesized
cccagggtgaccagcttaaa

SEQ ID NO: 579385 - DNA, 20 bp, Artificial Sequence
  chemically synthesized
cagcttaaattcagcttcac

SEQ ID NO: 579386 - DNA, 20 bp, Artificial Sequence
  chemically synthesized
ttttactctctaatgtctag

SEQ ID NO: 579387 - DNA, 20 bp, Artificial Sequence
  chemically synthesized
ctcagtttcaaaatttagtt

SEQ ID NO: 579388 - DNA, 20 bp, Artificial Sequence
  chemically synthesized
cttcctactcttagttcaaa

SEQ ID NO: 579389 - DNA, 20 bp, Artificial Sequence
  chemically synthesized
aaagtcaccactggggccaa

SEQ ID NO: 579390 - DNA, 20 bp, Artificial Sequence
  chemically synthesized
ttacttcttgttaaaaatca

SEQ ID NO: 579391 - DNA, 20 bp, Artificial Sequence
  chemically synthesized
aattactgaaaaaataagct

SEQ ID NO: 579392 - DNA, 20 bp, Artificial Sequence
  chemically synthesized
tattgtacaggtgctatttt

SEQ ID NO: 579393 - DNA, 20 bp, Artificial Sequence
  chemically synthesized
tgatataatagggagctagt

SEQ ID NO: 579394 - DNA, 20 bp, Artificial Sequence
  chemically synthesized
taatctaaatgccatgaggg

SEQ ID NO: 579395 - DNA, 20 bp, Artificial Sequence
  chemically synthesized
aaatctctgccctcatggca

SEQ ID NO: 579396 - DNA, 20 bp, Artificial Sequence
  chemically synthesized
tacataatttatatttttat

SEQ ID NO: 579397 - DNA, 20 bp, Artificial Sequence
  chemically synthesized
attatacctctcttgatctc

SEQ ID NO: 579398 - DNA, 20 bp, Artificial Sequence
  chemically synthesized
agagaggtataataaggata

SEQ ID NO: 579399 - DNA, 20 bp, Artificial Sequence
  chemically synthesized
ggtataataaggatacaagg

SEQ ID NO: 579400 - DNA, 20 bp, Artificial Sequence
  chemically synthesized
tatatatgaatggaaattaa

SEQ ID NO: 579401 - DNA, 20 bp, Artificial Sequence
  chemically synthesized
tatctgataaataagtcact

SEQ ID NO: 579402 - DNA, 20 bp, Artificial Sequence
  chemically synthesized
cttctagctataaatcagta

SEQ ID NO: 579403 - DNA, 20 bp, Artificial Sequence
  chemically synthesized
ctataaatcagtattttgct

SEQ ID NO: 579404 - DNA, 20 bp, Artificial Sequence
  chemically synthesized
agattaaacaaaaagcaaaa

SEQ ID NO: 579405 - DNA, 20 bp, Artificial Sequence
  chemically synthesized
acaaaagtagtgacataacc

SEQ ID NO: 579406 - DNA, 20 bp, Artificial Sequence
  chemically synthesized
ggcaaatgagatcttatgtt

SEQ ID NO: 579407 - DNA, 20 bp, Artificial Sequence
  chemically synthesized
tagaagtctgagccaagtcc

SEQ ID NO: 579408 - DNA, 20 bp, Artificial Sequence
  chemically synthesized
cgtcttgaaccctcccaagc

SEQ ID NO: 579409 - DNA, 20 bp, Artificial Sequence
  chemically synthesized
ccctcccaagctccagttta

SEQ ID NO: 579410 - DNA, 20 bp, Artificial Sequence
  chemically synthesized
tttttccaatccagctaaac

SEQ ID NO: 579411 - DNA, 20 bp, Artificial Sequence
  chemically synthesized
aaactggatggaccatgagg

SEQ ID NO: 579412 - DNA, 20 bp, Artificial Sequence
  chemically synthesized
aaacaaatcctcatggtcca

SEQ ID NO: 579413 - DNA, 20 bp, Artificial Sequence
  chemically synthesized
tggtgaaactggatggacca

SEQ ID NO: 579414 - DNA, 20 bp, Artificial Sequence
  chemically synthesized
accccattattacagccaac

SEQ ID NO: 579415 - DNA, 20 bp, Artificial Sequence
  chemically synthesized
atgtaattcataccttttat

SEQ ID NO: 579416 - DNA, 20 bp, Artificial Sequence
  chemically synthesized
catctgcagaataatcccgg

SEQ ID NO: 579417 - DNA, 20 bp, Artificial Sequence
  chemically synthesized
gacttggccctgaaacttct

SEQ ID NO: 579418 - DNA, 20 bp, Artificial Sequence
  chemically synthesized
ggaggtctttggccaactgc

SEQ ID NO: 579419 - DNA, 20 bp, Artificial Sequence
  chemically synthesized
ttatgagaaagagaatgaat

SEQ ID NO: 579420 - DNA, 20 bp, Artificial Sequence
  chemically synthesized
gtattttaagacactccaac

SEQ ID NO: 579421 - DNA, 20 bp, Artificial Sequence
  chemically synthesized
gtgtcttaaaatacttcgta

SEQ ID NO: 579422 - DNA, 20 bp, Artificial Sequence
  chemically synthesized
ttctgacctgaggattcaga

SEQ ID NO: 579423 - DNA, 20 bp, Artificial Sequence
  chemically synthesized
ctaatatatgtattctgacc

SEQ ID NO: 579424 - DNA, 20 bp, Artificial Sequence
  chemically synthesized
cctcaggtcagaatacatat

SEQ ID NO: 579425 - DNA, 20 bp, Artificial Sequence
  chemically synthesized
aggtcagaatacatatatta

SEQ ID NO: 579426 - DNA, 20 bp, Artificial Sequence
  chemically synthesized
tagattgcttttaacctacc

SEQ ID NO: 579427 - DNA, 20 bp, Artificial Sequence
  chemically synthesized
aggtgggttaccttatactg

SEQ ID NO: 579428 - DNA, 20 bp, Artificial Sequence
  chemically synthesized
tgctcaagatgctgcatttg

SEQ ID NO: 579429 - DNA, 20 bp, Artificial Sequence
  chemically synthesized
agcaattaattggcaataaa

SEQ ID NO: 579430 - DNA, 20 bp, Artificial Sequence
  chemically synthesized
attggcaataaagtgggctt

SEQ ID NO: 579431 - DNA, 20 bp, Artificial Sequence
  chemically synthesized
attatatatgagcttatttt

SEQ ID NO: 579432 - DNA, 20 bp, Artificial Sequence
  chemically synthesized
cacatattcaacaattatat

SEQ ID NO: 579433 - DNA, 20 bp, Artificial Sequence
  chemically synthesized
tgaagagggaaagaaatgta

SEQ ID NO: 579434 - DNA, 20 bp, Artificial Sequence
  chemically synthesized
ccctcttcattaacttgttg

SEQ ID NO: 579435 - DNA, 20 bp, Artificial Sequence
  chemically synthesized
ttgttcaatattttctgtat

SEQ ID NO: 579436 - DNA, 20 bp, Artificial Sequence
  chemically synthesized
aatgtaggtgatttggttta

SEQ ID NO: 579437 - DNA, 20 bp, Artificial Sequence
  chemically synthesized
aacgaagaaaatgtaggtga

SEQ ID NO: 579438 - DNA, 20 bp, Artificial Sequence
  chemically synthesized
acaaacaacgaagaaaatgt

SEQ ID NO: 579439 - DNA, 20 bp, Artificial Sequence
  chemically synthesized
caaatcacctacattttctt

SEQ ID NO: 579440 - DNA, 20 bp, Artificial Sequence
  chemically synthesized
gttgtttgtctttggcaatt

SEQ ID NO: 579441 - DNA, 20 bp, Artificial Sequence
  chemically synthesized
atgtttcaagtgatgagata

SEQ ID NO: 579442 - DNA, 20 bp, Artificial Sequence
  chemically synthesized
aattgacttctttctttgaa

SEQ ID NO: 579443 - DNA, 20 bp, Artificial Sequence
  chemically synthesized
aagaaagaagtcaattaatg

SEQ ID NO: 579444 - DNA, 20 bp, Artificial Sequence
  chemically synthesized
ttaatagaaatttcaggttg

SEQ ID NO: 579445 - DNA, 20 bp, Artificial Sequence
  chemically synthesized
cctcctctctgcacttgcag

SEQ ID NO: 579446 - DNA, 20 bp, Artificial Sequence
  chemically synthesized
catttctgcaagtgcagaga

SEQ ID NO: 579447 - DNA, 20 bp, Artificial Sequence
  chemically synthesized
cttaacaattagtattatct

SEQ ID NO: 579448 - DNA, 20 bp, Artificial Sequence
  chemically synthesized
taaaatcatcccactctttc

SEQ ID NO: 579449 - DNA, 20 bp, Artificial Sequence
  chemically synthesized
ttcaaacaagagaaagagtg

SEQ ID NO: 579450 - DNA, 20 bp, Artificial Sequence
  chemically synthesized
gttttactggtcttttcagc

SEQ ID NO: 579451 - DNA, 20 bp, Artificial Sequence
  chemically synthesized
gtgctagttttactggtctt

SEQ ID NO: 579452 - DNA, 20 bp, Artificial Sequence
  chemically synthesized
cagcagtaatacgtgaatgt

SEQ ID NO: 579453 - DNA, 20 bp, Artificial Sequence
  chemically synthesized
atagataccaagtgacatac

SEQ ID NO: 579454 - DNA, 20 bp, Artificial Sequence
  chemically synthesized
atcaggataaagtaccaaaa

SEQ ID NO: 579455 - DNA, 20 bp, Artificial Sequence
  chemically synthesized
atagtatattgatcttcttt

SEQ ID NO: 579456 - DNA, 20 bp, Artificial Sequence
  chemically synthesized
ttttttactgctttggttaa

SEQ ID NO: 579457 - DNA, 20 bp, Artificial Sequence
  chemically synthesized
cggcctgtttctcatttttt

SEQ ID NO: 579458 - DNA, 20 bp, Artificial Sequence
  chemically synthesized
ggcatgagccaccgcacccg

SEQ ID NO: 579459 - DNA, 20 bp, Artificial Sequence
  chemically synthesized
cgccttggcctccctaagtg

SEQ ID NO: 579460 - DNA, 20 bp, Artificial Sequence
  chemically synthesized
ttttatatttttagtagaga

SEQ ID NO: 579461 - DNA, 20 bp, Artificial Sequence
  chemically synthesized
tgcctcagcctcccgagtag

SEQ ID NO: 579462 - DNA, 20 bp, Artificial Sequence
  chemically synthesized
ctcgggaggctgaggcagag

SEQ ID NO: 579463 - DNA, 20 bp, Artificial Sequence
  chemically synthesized
aaaaaaaagagaaacaatgt

SEQ ID NO: 579464 - DNA, 20 bp, Artificial Sequence
  chemically synthesized
gtccctgcattaaacatcga

SEQ ID NO: 579465 - DNA, 20 bp, Artificial Sequence
  chemically synthesized
agaaaattgtgctcttttta

SEQ ID NO: 579466 - DNA, 20 bp, Artificial Sequence
  chemically synthesized
cagtgtagttaaaaattgtg

SEQ ID NO: 579467 - DNA, 20 bp, Artificial Sequence
  chemically synthesized
gaacacaatttttaactaca

SEQ ID NO: 579468 - DNA, 20 bp, Artificial Sequence
  chemically synthesized
tcttccatttcgtgttcagc

SEQ ID NO: 579469 - DNA, 20 bp, Artificial Sequence
  chemically synthesized
gaaatggaagaaattgaaaa

SEQ ID NO: 579470 - DNA, 20 bp, Artificial Sequence
  chemically synthesized
cttctgaggagaaaaatcat

SEQ ID NO: 579471 - DNA, 20 bp, Artificial Sequence
  chemically synthesized
aagaacaaatattaaaacaa

SEQ ID NO: 579472 - DNA, 20 bp, Artificial Sequence
  chemically synthesized
gaaattatgctaagaacact

SEQ ID NO: 579473 - DNA, 20 bp, Artificial Sequence
  chemically synthesized
cgctgaaattatgctaagaa

SEQ ID NO: 579474 - DNA, 20 bp, Artificial Sequence
  chemically synthesized
gtgttcttagcataatttca

SEQ ID NO: 579475 - DNA, 20 bp, Artificial Sequence
  chemically synthesized
aactgagaaattacattata

SEQ ID NO: 579476 - DNA, 20 bp, Artificial Sequence
  chemically synthesized
tattacttggtttgattcta

SEQ ID NO: 579477 - DNA, 20 bp, Artificial Sequence
  chemically synthesized
gcagtaaatactattacttg

SEQ ID NO: 579478 - DNA, 20 bp, Artificial Sequence
  chemically synthesized
atatgcagtaaatactatta

SEQ ID NO: 579479 - DNA, 20 bp, Artificial Sequence
  chemically synthesized
tactgcatatagcaaataga

SEQ ID NO: 579480 - DNA, 20 bp, Artificial Sequence
  chemically synthesized
attggcattagcttcttgat

SEQ ID NO: 579481 - DNA, 20 bp, Artificial Sequence
  chemically synthesized
caaaagtcagtgatattggc

SEQ ID NO: 579482 - DNA, 20 bp, Artificial Sequence
  chemically synthesized
ctgtgcctttagacactgtc

SEQ ID NO: 579483 - DNA, 20 bp, Artificial Sequence
  chemically synthesized
attccacgcggataaatgtt

SEQ ID NO: 579484 - DNA, 20 bp, Artificial Sequence
  chemically synthesized
atactccttttatcaagcat

SEQ ID NO: 579485 - DNA, 20 bp, Artificial Sequence
  chemically synthesized
aaagtggagaatagaaactg

SEQ ID NO: 579486 - DNA, 20 bp, Artificial Sequence
  chemically synthesized
tttggcagaagttccctcag

SEQ ID NO: 579487 - DNA, 20 bp, Artificial Sequence
  chemically synthesized
cttctgagggaacttctgcc

SEQ ID NO: 579488 - DNA, 20 bp, Artificial Sequence
  chemically synthesized
atttcttttatcactttagg

SEQ ID NO: 579489 - DNA, 20 bp, Artificial Sequence
  chemically synthesized
aatacatttcttttatcact

SEQ ID NO: 579490 - DNA, 20 bp, Artificial Sequence
  chemically synthesized
tgctatttgcattttaaaag

SEQ ID NO: 579491 - DNA, 20 bp, Artificial Sequence
  chemically synthesized
aaggtaaccaagttattggt

SEQ ID NO: 579492 - DNA, 20 bp, Artificial Sequence
  chemically synthesized
taagtattttattaacaatt

SEQ ID NO: 579493 - DNA, 20 bp, Artificial Sequence
  chemically synthesized
tttgtttttattttgtattc

SEQ ID NO: 579494 - DNA, 20 bp, Artificial Sequence
  chemically synthesized
aattatatatttactaaaaa

SEQ ID NO: 579495 - DNA, 20 bp, Artificial Sequence
  chemically synthesized
ttaacttgcttgagtaaaat

SEQ ID NO: 579496 - DNA, 20 bp, Artificial Sequence
  chemically synthesized
gtggcttccaaggttattta

SEQ ID NO: 579497 - DNA, 20 bp, Artificial Sequence
  chemically synthesized
acaggaacctatgagtgatg

SEQ ID NO: 579498 - DNA, 20 bp, Artificial Sequence
  chemically synthesized
gccacccatcactcataggt

SEQ ID NO: 579499 - DNA, 20 bp, Artificial Sequence
  chemically synthesized
ataagaggttataccatttg

SEQ ID NO: 579500 - DNA, 20 bp, Artificial Sequence
  chemically synthesized
ttctagcccatataatttta

SEQ ID NO: 579501 - DNA, 20 bp, Artificial Sequence
  chemically synthesized
attttatgttttttaatttt

SEQ ID NO: 579502 - DNA, 20 bp, Artificial Sequence
  chemically synthesized
tcattggcaccttctgcatt

SEQ ID NO: 579503 - DNA, 20 bp, Artificial Sequence
  chemically synthesized
tatgatctattgattatgtt

SEQ ID NO: 579504 - DNA, 20 bp, Artificial Sequence
  chemically synthesized
gcatttttatgatctattga

SEQ ID NO: 579505 - DNA, 20 bp, Artificial Sequence
  chemically synthesized
ttttaggcatttttatgatc

SEQ ID NO: 579506 - DNA, 20 bp, Artificial Sequence
  chemically synthesized
ctctagcttactatttcttt

SEQ ID NO: 579507 - DNA, 20 bp, Artificial Sequence
  chemically synthesized
atagtaagctagagttaaat

SEQ ID NO: 579508 - DNA, 20 bp, Artificial Sequence
  chemically synthesized
taggaaatctgtcatttaac

SEQ ID NO: 579509 - DNA, 20 bp, Artificial Sequence
  chemically synthesized
tcaagcctcactctttacta

SEQ ID NO: 579510 - DNA, 20 bp, Artificial Sequence
  chemically synthesized
ctaaacaaggtagtaaagag

SEQ ID NO: 579511 - DNA, 20 bp, Artificial Sequence
  chemically synthesized
attaaagtacatcaaaaagt

SEQ ID NO: 579512 - DNA, 20 bp, Artificial Sequence
  chemically synthesized
cagaactttttgatgtactt

SEQ ID NO: 579513 - DNA, 20 bp, Artificial Sequence
  chemically synthesized
cagtgagggttagcactcag

SEQ ID NO: 579514 - DNA, 20 bp, Artificial Sequence
  chemically synthesized
taaccctcactgaatactgc

SEQ ID NO: 579515 - DNA, 20 bp, Artificial Sequence
  chemically synthesized
tgcccaggttttgtgaggat

SEQ ID NO: 579516 - DNA, 20 bp, Artificial Sequence
  chemically synthesized
caatgtcagtcaaggtcagt

SEQ ID NO: 579517 - DNA, 20 bp, Artificial Sequence
  chemically synthesized
aaggctacctttgagaacct

SEQ ID NO: 579518 - DNA, 20 bp, Artificial Sequence
  chemically synthesized
ttaaagacattccccacaca

SEQ ID NO: 579519 - DNA, 20 bp, Artificial Sequence
  chemically synthesized
taatattctgcccgcccacc

SEQ ID NO: 579520 - DNA, 20 bp, Artificial Sequence
  chemically synthesized
cactaggaaccatgaccttg

SEQ ID NO: 579521 - DNA, 20 bp, Artificial Sequence
  chemically synthesized
caatggtgtacaccacaggg

SEQ ID NO: 579522 - DNA, 20 bp, Artificial Sequence
  chemically synthesized
aaatttaaaatactgtgagc

SEQ ID NO: 579523 - DNA, 20 bp, Artificial Sequence
  chemically synthesized
tgtgagcactagcttataaa

SEQ ID NO: 579524 - DNA, 20 bp, Artificial Sequence
  chemically synthesized
gtgtgtgtgtgtgtatgtgt

SEQ ID NO: 579525 - DNA, 20 bp, Artificial Sequence
  chemically synthesized
atataaaatgctaaatcccc

SEQ ID NO: 579526 - DNA, 20 bp, Artificial Sequence
  chemically synthesized
aaaatgctaaatccccaaaa

SEQ ID NO: 579527 - DNA, 20 bp, Artificial Sequence
  chemically synthesized
tggttggggaaacaatcttt

SEQ ID NO: 579528 - DNA, 20 bp, Artificial Sequence
  chemically synthesized
tgtttccccaaccaggaaag

SEQ ID NO: 579529 - DNA, 20 bp, Artificial Sequence
  chemically synthesized
catagtgcagtagcagcata

SEQ ID NO: 579530 - DNA, 20 bp, Artificial Sequence
  chemically synthesized
cattatgctgctactgcact

SEQ ID NO: 579531 - DNA, 20 bp, Artificial Sequence
  chemically synthesized
cacagtatcttaggtagaaa

SEQ ID NO: 579532 - DNA, 20 bp, Artificial Sequence
  chemically synthesized
tgagtatttttttctacttt

SEQ ID NO: 579533 - DNA, 20 bp, Artificial Sequence
  chemically synthesized
cagcaggctcattgtattgc

SEQ ID NO: 579534 - DNA, 20 bp, Artificial Sequence
  chemically synthesized
tgagcaatacaatgagcctg

SEQ ID NO: 579535 - DNA, 20 bp, Artificial Sequence
  chemically synthesized
ctgggtttgaatcctggcgt

SEQ ID NO: 579536 - DNA, 20 bp, Artificial Sequence
  chemically synthesized
tttgccactaagcgatcacg

SEQ ID NO: 579537 - DNA, 20 bp, Artificial Sequence
  chemically synthesized
gttaattatcttttctgtgc

SEQ ID NO: 579538 - DNA, 20 bp, Artificial Sequence
  chemically synthesized
ttaacagtatttatgtggaa

SEQ ID NO: 579539 - DNA, 20 bp, Artificial Sequence
  chemically synthesized
caaaggtgcctggcgtgccc

SEQ ID NO: 579540 - DNA, 20 bp, Artificial Sequence
  chemically synthesized
gatgatgatgctgatgctga

SEQ ID NO: 579541 - DNA, 20 bp, Artificial Sequence
  chemically synthesized
ggggctcacactgtggggaa

SEQ ID NO: 579542 - DNA, 20 bp, Artificial Sequence
  chemically synthesized
tgaatgcaaagcaagtagct

SEQ ID NO: 579543 - DNA, 20 bp, Artificial Sequence
  chemically synthesized
tgtccataaaacagcgagct

SEQ ID NO: 579544 - DNA, 20 bp, Artificial Sequence
  chemically synthesized
ttttaatgatagagctatgc

SEQ ID NO: 579545 - DNA, 20 bp, Artificial Sequence
  chemically synthesized
tggttaaatttccttttaaa

SEQ ID NO: 579546 - DNA, 20 bp, Artificial Sequence
  chemically synthesized
tattcacctacaagtaaaat

SEQ ID NO: 579547 - DNA, 20 bp, Artificial Sequence
  chemically synthesized
aacgaaaggacatcttccca

SEQ ID NO: 579548 - DNA, 20 bp, Artificial Sequence
  chemically synthesized
aaggacatcttcccaggaag

SEQ ID NO: 579549 - DNA, 20 bp, Artificial Sequence
  chemically synthesized
gttttgcttgtccattgttc

SEQ ID NO: 579550 - DNA, 20 bp, Artificial Sequence
  chemically synthesized
aagtcattaaccttgtaagt

SEQ ID NO: 579551 - DNA, 20 bp, Artificial Sequence
  chemically synthesized
gtcagagcaagtaaccccat

SEQ ID NO: 579552 - DNA, 20 bp, Artificial Sequence
  chemically synthesized
ttacttgctctgaccatgcc

SEQ ID NO: 579553 - DNA, 20 bp, Artificial Sequence
  chemically synthesized
ttacaattttccgagcaatt

SEQ ID NO: 579554 - DNA, 20 bp, Artificial Sequence
  chemically synthesized
tgttttacaattttccgagc

SEQ ID NO: 579555 - DNA, 20 bp, Artificial Sequence
  chemically synthesized
aattgtaaaacaggatccta

SEQ ID NO: 579556 - DNA, 20 bp, Artificial Sequence
  chemically synthesized
tgttcataagcatattagga

SEQ ID NO: 579557 - DNA, 20 bp, Artificial Sequence
  chemically synthesized
atgaacaaaaagttctacat

SEQ ID NO: 579558 - DNA, 20 bp, Artificial Sequence
  chemically synthesized
tgtatttacattcatgaacc

SEQ ID NO: 579559 - DNA, 20 bp, Artificial Sequence
  chemically synthesized
ctgttagctaaccaccaaga

SEQ ID NO: 579560 - DNA, 20 bp, Artificial Sequence
  chemically synthesized
ccataggaggtcagaatttc

SEQ ID NO: 579561 - DNA, 20 bp, Artificial Sequence
  chemically synthesized
tttcctgggatttcttgcta

SEQ ID NO: 579562 - DNA, 20 bp, Artificial Sequence
  chemically synthesized
agagagaagggggataatta

SEQ ID NO: 579563 - DNA, 20 bp, Artificial Sequence
  chemically synthesized
cttggcagtatctcctttgt

SEQ ID NO: 579564 - DNA, 20 bp, Artificial Sequence
  chemically synthesized
gtgaattagcacccgatggt

SEQ ID NO: 579565 - DNA, 20 bp, Artificial Sequence
  chemically synthesized
gcacccgatggttctggttt

SEQ ID NO: 579566 - DNA, 20 bp, Artificial Sequence
  chemically synthesized
cctcaagggctggggaaccg

SEQ ID NO: 579567 - DNA, 20 bp, Artificial Sequence
  chemically synthesized
tccccagcccttgaggtggt

SEQ ID NO: 579568 - DNA, 20 bp, Artificial Sequence
  chemically synthesized
cagaggacagtgaggcaacc

SEQ ID NO: 579569 - DNA, 20 bp, Artificial Sequence
  chemically synthesized
ggttgcctcactgtcctctg

SEQ ID NO: 579570 - DNA, 20 bp, Artificial Sequence
  chemically synthesized
agtcctctgtattgaatttc

SEQ ID NO: 579571 - DNA, 20 bp, Artificial Sequence
  chemically synthesized
cctctgtttgaaatatcgaa

SEQ ID NO: 579572 - DNA, 20 bp, Artificial Sequence
  chemically synthesized
tgtaggtaggatcatttact

SEQ ID NO: 579573 - DNA, 20 bp, Artificial Sequence
  chemically synthesized
agtctgatatttcatgaaat

SEQ ID NO: 579574 - DNA, 20 bp, Artificial Sequence
  chemically synthesized
gcgacttttctgctattgga

SEQ ID NO: 579575 - DNA, 20 bp, Artificial Sequence
  chemically synthesized
tttaaagatgagagagacac

SEQ ID NO: 579576 - DNA, 20 bp, Artificial Sequence
  chemically synthesized
gtgcagattattgttgttgt

SEQ ID NO: 579577 - DNA, 20 bp, Artificial Sequence
  chemically synthesized
aaggaaagaaaatgatagag

SEQ ID NO: 579578 - DNA, 20 bp, Artificial Sequence
  chemically synthesized
cactctccaattcatgaaaa

SEQ ID NO: 579579 - DNA, 20 bp, Artificial Sequence
  chemically synthesized
gtggaacgatgatggcagaa

SEQ ID NO: 579580 - DNA, 20 bp, Artificial Sequence
  chemically synthesized
gccatagtgacttctgtcag

SEQ ID NO: 579581 - DNA, 20 bp, Artificial Sequence
  chemically synthesized
aagacagcatgcccttgaca

SEQ ID NO: 579582 - DNA, 20 bp, Artificial Sequence
  chemically synthesized
acattgagcttggtcatgcg

SEQ ID NO: 579583 - DNA, 20 bp, Artificial Sequence
  chemically synthesized
ttacttctagtaatatccca

SEQ ID NO: 579584 - DNA, 20 bp, Artificial Sequence
  chemically synthesized
ttactagaagtaacacaagc

SEQ ID NO: 579585 - DNA, 20 bp, Artificial Sequence
  chemically synthesized
tgcataaatacatttcaagc

SEQ ID NO: 579586 - DNA, 20 bp, Artificial Sequence
  chemically synthesized
gatgagtaggctagtccaga

SEQ ID NO: 579587 - DNA, 20 bp, Artificial Sequence
  chemically synthesized
tggcacttcttcatgttgca

SEQ ID NO: 579588 - DNA, 20 bp, Artificial Sequence
  chemically synthesized
catattgcctttcatgaatt

SEQ ID NO: 579589 - DNA, 20 bp, Artificial Sequence
  chemically synthesized
gaaaattcatgaaaggcaat

SEQ ID NO: 579590 - DNA, 20 bp, Artificial Sequence
  chemically synthesized
tcacatttgtgaaaatagtt

SEQ ID NO: 579591 - DNA, 20 bp, Artificial Sequence
  chemically synthesized
accaaaagccaatgcctatg

SEQ ID NO: 579592 - DNA, 20 bp, Artificial Sequence
  chemically synthesized
acttaaatctttccataggc

SEQ ID NO: 579593 - DNA, 20 bp, Artificial Sequence
  chemically synthesized
aaagatttaagttcttattt

SEQ ID NO: 579594 - DNA, 20 bp, Artificial Sequence
  chemically synthesized
actattctcttctcgaagtt

SEQ ID NO: 579595 - DNA, 20 bp, Artificial Sequence
  chemically synthesized
ttctcgaagttctctgcttt

SEQ ID NO: 579596 - DNA, 20 bp, Artificial Sequence
  chemically synthesized
cctctgtattctctgagtgt

SEQ ID NO: 579597 - DNA, 20 bp, Artificial Sequence
  chemically synthesized
acaggcaaaaaaaaaaaaaa

SEQ ID NO: 579598 - DNA, 20 bp, Artificial Sequence
  chemically synthesized
ctccagttgaggaccaacat

SEQ ID NO: 579599 - DNA, 20 bp, Artificial Sequence
  chemically synthesized
actccctgggtagttgtatc

SEQ ID NO: 579600 - DNA, 20 bp, Artificial Sequence
  chemically synthesized
aaggtagtgtcaatggaagt

SEQ ID NO: 579601 - DNA, 20 bp, Artificial Sequence
  chemically synthesized
tggagggagggagccaataa

SEQ ID NO: 579602 - DNA, 20 bp, Artificial Sequence
  chemically synthesized
cagttgtatgtaggtggaag

SEQ ID NO: 579603 - DNA, 20 bp, Artificial Sequence
  chemically synthesized
tcctctgtgtaaaacctttc

SEQ ID NO: 579604 - DNA, 20 bp, Artificial Sequence
  chemically synthesized
caggtaatagcaaaccattg

SEQ ID NO: 579605 - DNA, 20 bp, Artificial Sequence
  chemically synthesized
acaaagtcctaacctctctc

SEQ ID NO: 579606 - DNA, 20 bp, Artificial Sequence
  chemically synthesized
gaaagagtcatcataaaaat

SEQ ID NO: 579607 - DNA, 20 bp, Artificial Sequence
  chemically synthesized
caggtttctggactctcaat

SEQ ID NO: 579608 - DNA, 20 bp, Artificial Sequence
  chemically synthesized
aagaaatttaaggaaaagga

SEQ ID NO: 579609 - DNA, 20 bp, Artificial Sequence
  chemically synthesized
aaggactgggtttattttaa

SEQ ID NO: 579610 - DNA, 20 bp, Artificial Sequence
  chemically synthesized
tgaagaatataaaacaatct

SEQ ID NO: 579611 - DNA, 20 bp, Artificial Sequence
  chemically synthesized
agtcatgctataatcatcaa

SEQ ID NO: 579612 - DNA, 20 bp, Artificial Sequence
  chemically synthesized
ttccagtcatgctataatca

SEQ ID NO: 579613 - DNA, 20 bp, Artificial Sequence
  chemically synthesized
aaaaagacagcagaaaaata

SEQ ID NO: 579614 - DNA, 20 bp, Artificial Sequence
  chemically synthesized
attcttgggaccaaattgtt

SEQ ID NO: 579615 - DNA, 20 bp, Artificial Sequence
  chemically synthesized
ttaattcattcttgggacca

SEQ ID NO: 579616 - DNA, 20 bp, Artificial Sequence
  chemically synthesized
ttgtgcttctcttttcccaa

SEQ ID NO: 579617 - DNA, 20 bp, Artificial Sequence
  chemically synthesized
tcacacaaggagggaagaaa

SEQ ID NO: 579618 - DNA, 20 bp, Artificial Sequence
  chemically synthesized
atccataaagaggttttata

SEQ ID NO: 579619 - DNA, 20 bp, Artificial Sequence
  chemically synthesized
aacgacctataaaacctctt

SEQ ID NO: 579620 - DNA, 20 bp, Artificial Sequence
  chemically synthesized
tttctattataaatccataa

SEQ ID NO: 579621 - DNA, 20 bp, Artificial Sequence
  chemically synthesized
gtgagaggctttacttttga

SEQ ID NO: 579622 - DNA, 20 bp, Artificial Sequence
  chemically synthesized
gagtcttgaagttaatggtg

SEQ ID NO: 579623 - DNA, 20 bp, Artificial Sequence
  chemically synthesized
cagagttgtttggtaatgtc

SEQ ID NO: 579624 - DNA, 20 bp, Artificial Sequence
  chemically synthesized
cctctgacattaccaaacaa

SEQ ID NO: 579625 - DNA, 20 bp, Artificial Sequence
  chemically synthesized
agtgttaccttctgaaacag

SEQ ID NO: 579626 - DNA, 20 bp, Artificial Sequence
  chemically synthesized
taagaaaatggccctcattt

SEQ ID NO: 579627 - DNA, 20 bp, Artificial Sequence
  chemically synthesized
ctcattttccggcttactga

SEQ ID NO: 579628 - DNA, 20 bp, Artificial Sequence
  chemically synthesized
tgaaaatgattaatctttac

SEQ ID NO: 579629 - DNA, 20 bp, Artificial Sequence
  chemically synthesized
tgtagtcttcaaagctattg

SEQ ID NO: 579630 - DNA, 20 bp, Artificial Sequence
  chemically synthesized
aacacatttactagtctgct

SEQ ID NO: 579631 - DNA, 20 bp, Artificial Sequence
  chemically synthesized
ttccattattttctgtctta

SEQ ID NO: 579632 - DNA, 20 bp, Artificial Sequence
  chemically synthesized
ggaaaaatatattgtatgcc

SEQ ID NO: 579633 - DNA, 20 bp, Artificial Sequence
  chemically synthesized
tcaggccccatttctcttcc

SEQ ID NO: 579634 - DNA, 20 bp, Artificial Sequence
  chemically synthesized
tctcttccagctgctttgga

SEQ ID NO: 579635 - DNA, 20 bp, Artificial Sequence
  chemically synthesized
agaagggaggagaggtctcc

SEQ ID NO: 579636 - DNA, 20 bp, Artificial Sequence
  chemically synthesized
agagagagcccagataaaga

SEQ ID NO: 579637 - DNA, 20 bp, Artificial Sequence
  chemically synthesized
ttaatttgctgactttatta

SEQ ID NO: 579638 - DNA, 20 bp, Artificial Sequence
  chemically synthesized
gggtgatttgttaattacag

SEQ ID NO: 579639 - DNA, 20 bp, Artificial Sequence
  chemically synthesized
ctcagatgcctggggtagct

SEQ ID NO: 579640 - DNA, 20 bp, Artificial Sequence
  chemically synthesized
gtgtagaaatggatgggtgg

SEQ ID NO: 579641 - DNA, 20 bp, Artificial Sequence
  chemically synthesized
tcctctggcattgtttctgg

SEQ ID NO: 579642 - DNA, 20 bp, Artificial Sequence
  chemically synthesized
tctggggttctgtcctctgg

SEQ ID NO: 579643 - DNA, 20 bp, Artificial Sequence
  chemically synthesized
gaggacagaaccccagaaaa

SEQ ID NO: 579644 - DNA, 20 bp, Artificial Sequence
  chemically synthesized
atccagtgccttttcacgcc

SEQ ID NO: 579645 - DNA, 20 bp, Artificial Sequence
  chemically synthesized
aactcaggaatggccatgtg

SEQ ID NO: 579646 - DNA, 20 bp, Artificial Sequence
  chemically synthesized
agactgatgagagcattcta

SEQ ID NO: 579647 - DNA, 20 bp, Artificial Sequence
  chemically synthesized
aaaatatagactattaagcc

SEQ ID NO: 579648 - DNA, 20 bp, Artificial Sequence
  chemically synthesized
taataagcaacctcaaatct

SEQ ID NO: 579649 - DNA, 20 bp, Artificial Sequence
  chemically synthesized
tattaagcctctagatttga

SEQ ID NO: 579650 - DNA, 20 bp, Artificial Sequence
  chemically synthesized
gatttgaggttgcttattac

SEQ ID NO: 579651 - DNA, 20 bp, Artificial Sequence
  chemically synthesized
tgttctttatgtgtcattat

SEQ ID NO: 579652 - DNA, 20 bp, Artificial Sequence
  chemically synthesized
aaacatttcctcaacattta

SEQ ID NO: 579653 - DNA, 20 bp, Artificial Sequence
  chemically synthesized
aagccacataaatgttgagg

SEQ ID NO: 579654 - DNA, 20 bp, Artificial Sequence
  chemically synthesized
aatgtttagaacaacaatat

SEQ ID NO: 579655 - DNA, 20 bp, Artificial Sequence
  chemically synthesized
tttcatttctatagctggca

SEQ ID NO: 579656 - DNA, 20 bp, Artificial Sequence
  chemically synthesized
tccatttttctctttcatga

SEQ ID NO: 579657 - DNA, 20 bp, Artificial Sequence
  chemically synthesized
atgaaagagaaaaatggaga

SEQ ID NO: 579658 - DNA, 20 bp, Artificial Sequence
  chemically synthesized
attttttcaagttttatgaa

SEQ ID NO: 579659 - DNA, 20 bp, Artificial Sequence
  chemically synthesized
acagatcttttcttattttt

SEQ ID NO: 579660 - DNA, 20 bp, Artificial Sequence
  chemically synthesized
gaaagggactgttaattggt

SEQ ID NO: 579661 - DNA, 20 bp, Artificial Sequence
  chemically synthesized
ctcctccttcagtctttact

SEQ ID NO: 579662 - DNA, 20 bp, Artificial Sequence
  chemically synthesized
acaatttggggtcttttgtg

SEQ ID NO: 579663 - DNA, 20 bp, Artificial Sequence
  chemically synthesized
gctgctatgaacatctgtat

SEQ ID NO: 579664 - DNA, 20 bp, Artificial Sequence
  chemically synthesized
cagcatacacctgggagtag

SEQ ID NO: 579665 - DNA, 20 bp, Artificial Sequence
  chemically synthesized
gtagaatggttttgtcatat

SEQ ID NO: 579666 - DNA, 20 bp, Artificial Sequence
  chemically synthesized
ggttttgtcatatggtagct

SEQ ID NO: 579667 - DNA, 20 bp, Artificial Sequence
  chemically synthesized
tgaaatttataatacaaaaa

SEQ ID NO: 579668 - DNA, 20 bp, Artificial Sequence
  chemically synthesized
tttattgtgaatttaaaaat

SEQ ID NO: 579669 - DNA, 20 bp, Artificial Sequence
  chemically synthesized
tttaaaaataactgattatt

SEQ ID NO: 579670 - DNA, 20 bp, Artificial Sequence
  chemically synthesized
ataactgattattattagat

SEQ ID NO: 579671 - DNA, 20 bp, Artificial Sequence
  chemically synthesized
tcgtttgtaacagaaaagat

SEQ ID NO: 579672 - DNA, 20 bp, Artificial Sequence
  chemically synthesized
aatatttccaggaacttcca

SEQ ID NO: 579673 - DNA, 20 bp, Artificial Sequence
  chemically synthesized
aacttccaaactgttttcaa

SEQ ID NO: 579674 - DNA, 20 bp, Artificial Sequence
  chemically synthesized
aatggtgaaacaactttgaa

SEQ ID NO: 579675 - DNA, 20 bp, Artificial Sequence
  chemically synthesized
acaagtgttgagaagatgaa

SEQ ID NO: 579676 - DNA, 20 bp, Artificial Sequence
  chemically synthesized
ggtaaaaagtactatctcct

SEQ ID NO: 579677 - DNA, 20 bp, Artificial Sequence
  chemically synthesized
aaaagatggttaacatcatt

SEQ ID NO: 579678 - DNA, 20 bp, Artificial Sequence
  chemically synthesized
catgaaaagatggttaacat

SEQ ID NO: 579679 - DNA, 20 bp, Artificial Sequence
  chemically synthesized
atgatgttaaccatcttttc

SEQ ID NO: 579680 - DNA, 20 bp, Artificial Sequence
  chemically synthesized
tttggagaaatgcctattca

SEQ ID NO: 579681 - DNA, 20 bp, Artificial Sequence
  chemically synthesized
gacttaattacaagtgaaga

SEQ ID NO: 579682 - DNA, 20 bp, Artificial Sequence
  chemically synthesized
atcctttttgttgttgaatt

SEQ ID NO: 579683 - DNA, 20 bp, Artificial Sequence
  chemically synthesized
atacaagtatcttatcaaat

SEQ ID NO: 579684 - DNA, 20 bp, Artificial Sequence
  chemically synthesized
acaaatatttttacccattc

SEQ ID NO: 579685 - DNA, 20 bp, Artificial Sequence
  chemically synthesized
tcttttccctttctttacaa

SEQ ID NO: 579686 - DNA, 20 bp, Artificial Sequence
  chemically synthesized
tacaatattgcttgcagtac

SEQ ID NO: 579687 - DNA, 20 bp, Artificial Sequence
  chemically synthesized
attgtgtatttttcggttac

SEQ ID NO: 579688 - DNA, 20 bp, Artificial Sequence
  chemically synthesized
taggaatacaatggattatg

SEQ ID NO: 579689 - DNA, 20 bp, Artificial Sequence
  chemically synthesized
ctaagaaaatgtaggaatac

SEQ ID NO: 579690 - DNA, 20 bp, Artificial Sequence
  chemically synthesized
gtattcctacattttcttag

SEQ ID NO: 579691 - DNA, 20 bp, Artificial Sequence
  chemically synthesized
acattttcttagaagagttt

SEQ ID NO: 579692 - DNA, 20 bp, Artificial Sequence
  chemically synthesized
tcttattaatatatttagct

SEQ ID NO: 579693 - DNA, 20 bp, Artificial Sequence
  chemically synthesized
ttaaaaatatattattatta

SEQ ID NO: 579694 - DNA, 20 bp, Artificial Sequence
  chemically synthesized
tattataaagtttattttac

SEQ ID NO: 579695 - DNA, 20 bp, Artificial Sequence
  chemically synthesized
gcaaaataaaattaaaaata

SEQ ID NO: 579696 - DNA, 20 bp, Artificial Sequence
  chemically synthesized
acattttatttttaatttta

SEQ ID NO: 579697 - DNA, 20 bp, Artificial Sequence
  chemically synthesized
tgatatatgtatacactgtg

SEQ ID NO: 579698 - DNA, 20 bp, Artificial Sequence
  chemically synthesized
tatttcaaaattgctaaaat

SEQ ID NO: 579699 - DNA, 20 bp, Artificial Sequence
  chemically synthesized
aaaaactttagtcaggagga

SEQ ID NO: 579700 - DNA, 20 bp, Artificial Sequence
  chemically synthesized
aaaaacttattcctcctgac

SEQ ID NO: 579701 - DNA, 20 bp, Artificial Sequence
  chemically synthesized
gaatggtggttaccagaggc

SEQ ID NO: 579702 - DNA, 20 bp, Artificial Sequence
  chemically synthesized
ccattctactctctacttca

SEQ ID NO: 579703 - DNA, 20 bp, Artificial Sequence
  chemically synthesized
acttcaatgagtttgacttt

SEQ ID NO: 579704 - DNA, 20 bp, Artificial Sequence
  chemically synthesized
gcagtatttgactttctgtg

SEQ ID NO: 579705 - DNA, 20 bp, Artificial Sequence
  chemically synthesized
gccttaaataaagaatatcc

SEQ ID NO: 579706 - DNA, 20 bp, Artificial Sequence
  chemically synthesized
catccactgatggaaactta

SEQ ID NO: 579707 - DNA, 20 bp, Artificial Sequence
  chemically synthesized
agccatgatatggaatcaac

SEQ ID NO: 579708 - DNA, 20 bp, Artificial Sequence
  chemically synthesized
aacttaggttgattccatat

SEQ ID NO: 579709 - DNA, 20 bp, Artificial Sequence
  chemically synthesized
tcaaagagatatcttcactc

SEQ ID NO: 579710 - DNA, 20 bp, Artificial Sequence
  chemically synthesized
tgaagatatctctttgacat

SEQ ID NO: 579711 - DNA, 20 bp, Artificial Sequence
  chemically synthesized
ttttggatatatacccggaa

SEQ ID NO: 579712 - DNA, 20 bp, Artificial Sequence
  chemically synthesized
attgctggatcctatggtaa

SEQ ID NO: 579713 - DNA, 20 bp, Artificial Sequence
  chemically synthesized
gatcctatggtaattctgtt

SEQ ID NO: 579714 - DNA, 20 bp, Artificial Sequence
  chemically synthesized
aggtgtaaggtgacatctca

SEQ ID NO: 579715 - DNA, 20 bp, Artificial Sequence
  chemically synthesized
gattgtaatatgcatttccc

SEQ ID NO: 579716 - DNA, 20 bp, Artificial Sequence
  chemically synthesized
agaagatgtacaaatagcta

SEQ ID NO: 579717 - DNA, 20 bp, Artificial Sequence
  chemically synthesized
tttgtacatcttcttttgag

SEQ ID NO: 579718 - DNA, 20 bp, Artificial Sequence
  chemically synthesized
tcttcttttgagaaatgttt

SEQ ID NO: 579719 - DNA, 20 bp, Artificial Sequence
  chemically synthesized
taagtgttttgcccatttta

SEQ ID NO: 579720 - DNA, 20 bp, Artificial Sequence
  chemically synthesized
ttgcccattttaatcagatt

SEQ ID NO: 579721 - DNA, 20 bp, Artificial Sequence
  chemically synthesized
atcataaaagaaaacaaata

SEQ ID NO: 579722 - DNA, 20 bp, Artificial Sequence
  chemically synthesized
acctcacaccatacacaaaa

SEQ ID NO: 579723 - DNA, 20 bp, Artificial Sequence
  chemically synthesized
aaacctttgcatttatggtc

SEQ ID NO: 579724 - DNA, 20 bp, Artificial Sequence
  chemically synthesized
aatcagttgaccataaatgc

SEQ ID NO: 579725 - DNA, 20 bp, Artificial Sequence
  chemically synthesized
taccacattgacttaataat

SEQ ID NO: 579726 - DNA, 20 bp, Artificial Sequence
  chemically synthesized
cttaataattgtagctttgt

SEQ ID NO: 579727 - DNA, 20 bp, Artificial Sequence
  chemically synthesized
caatgttgttcttttttcaa

SEQ ID NO: 579728 - DNA, 20 bp, Artificial Sequence
  chemically synthesized
gaaaaaaaaaaaaaagccag

SEQ ID NO: 579729 - DNA, 20 bp, Artificial Sequence
  chemically synthesized
gaatcattatcaaaatcaca

SEQ ID NO: 579730 - DNA, 20 bp, Artificial Sequence
  chemically synthesized
aaagccagttgtgattttga

SEQ ID NO: 579731 - DNA, 20 bp, Artificial Sequence
  chemically synthesized
ttatctttaatttctttcaa

SEQ ID NO: 579732 - DNA, 20 bp, Artificial Sequence
  chemically synthesized
acttaggaataaaagagatg

SEQ ID NO: 579733 - DNA, 20 bp, Artificial Sequence
  chemically synthesized
gccttgcatctcttttattc

SEQ ID NO: 579734 - DNA, 20 bp, Artificial Sequence
  chemically synthesized
aatattttcttaatttcact

SEQ ID NO: 579735 - DNA, 20 bp, Artificial Sequence
  chemically synthesized
tattatttctaatatttttt

SEQ ID NO: 579736 - DNA, 20 bp, Artificial Sequence
  chemically synthesized
agaaaaataaataaaagaca

SEQ ID NO: 579737 - DNA, 20 bp, Artificial Sequence
  chemically synthesized
tgatcttaggggaaagcatt

SEQ ID NO: 579738 - DNA, 20 bp, Artificial Sequence
  chemically synthesized
taatgttattgtgaaacact

SEQ ID NO: 579739 - DNA, 20 bp, Artificial Sequence
  chemically synthesized
ttgaggaaatcctcttctgt

SEQ ID NO: 579740 - DNA, 20 bp, Artificial Sequence
  chemically synthesized
cccgaggaaacgaatacaga

SEQ ID NO: 579741 - DNA, 20 bp, Artificial Sequence
  chemically synthesized
cctcttctgtattcgtttcc

SEQ ID NO: 579742 - DNA, 20 bp, Artificial Sequence
  chemically synthesized
gcctccagaagtctgagaca

SEQ ID NO: 579743 - DNA, 20 bp, Artificial Sequence
  chemically synthesized
tctggaggctagatccaaaa

SEQ ID NO: 579744 - DNA, 20 bp, Artificial Sequence
  chemically synthesized
ggagtatgggcctgctggaa

SEQ ID NO: 579745 - DNA, 20 bp, Artificial Sequence
  chemically synthesized
gcaaggaaaaattctcccct

SEQ ID NO: 579746 - DNA, 20 bp, Artificial Sequence
  chemically synthesized
agaatttttccttgcctctt

SEQ ID NO: 579747 - DNA, 20 bp, Artificial Sequence
  chemically synthesized
tctaatgatggccgttaatc

SEQ ID NO: 579748 - DNA, 20 bp, Artificial Sequence
  chemically synthesized
agttgcaagacaagtaaaac

SEQ ID NO: 579749 - DNA, 20 bp, Artificial Sequence
  chemically synthesized
acaccatgtgatgttacagt

SEQ ID NO: 579750 - DNA, 20 bp, Artificial Sequence
  chemically synthesized
tctctaactgtaacatcaca

SEQ ID NO: 579751 - DNA, 20 bp, Artificial Sequence
  chemically synthesized
acatttgcagatacctgggc

SEQ ID NO: 579752 - DNA, 20 bp, Artificial Sequence
  chemically synthesized
aaaaaaaaaaaagaaggttt

SEQ ID NO: 579753 - DNA, 20 bp, Artificial Sequence
  chemically synthesized
tctaaaaaaaaaaaaaaaaa

SEQ ID NO: 579754 - DNA, 20 bp, Artificial Sequence
  chemically synthesized
aatggcgcgaaccctggagg

SEQ ID NO: 579755 - DNA, 20 bp, Artificial Sequence
  chemically synthesized
ttttgtatttttagcagaga

SEQ ID NO: 579756 - DNA, 20 bp, Artificial Sequence
  chemically synthesized
ggcagttggatcacgaggtc

SEQ ID NO: 579757 - DNA, 20 bp, Artificial Sequence
  chemically synthesized
tgcctcggcctcccaaagtg

SEQ ID NO: 579758 - DNA, 20 bp, Artificial Sequence
  chemically synthesized
tgttaagtgttctttatttt

SEQ ID NO: 579759 - DNA, 20 bp, Artificial Sequence
  chemically synthesized
tctttatttttcaagcttga

SEQ ID NO: 579760 - DNA, 20 bp, Artificial Sequence
  chemically synthesized
tgacaaagtacaaaaccctt

SEQ ID NO: 579761 - DNA, 20 bp, Artificial Sequence
  chemically synthesized
ctatatttattgtgatgacc

SEQ ID NO: 579762 - DNA, 20 bp, Artificial Sequence
  chemically synthesized
tctattgatatggtataata

SEQ ID NO: 579763 - DNA, 20 bp, Artificial Sequence
  chemically synthesized
atttatcacaggaatgtaag

SEQ ID NO: 579764 - DNA, 20 bp, Artificial Sequence
  chemically synthesized
atgattgctaccataaccag

SEQ ID NO: 579765 - DNA, 20 bp, Artificial Sequence
  chemically synthesized
cctaatacaacaacatatta

SEQ ID NO: 579766 - DNA, 20 bp, Artificial Sequence
  chemically synthesized
catgttaatatgttgttgta

SEQ ID NO: 579767 - DNA, 20 bp, Artificial Sequence
  chemically synthesized
ttaggtttgataattttttg

SEQ ID NO: 579768 - DNA, 20 bp, Artificial Sequence
  chemically synthesized
attcataaggcatattgctc

SEQ ID NO: 579769 - DNA, 20 bp, Artificial Sequence
  chemically synthesized
ataaggcatattgctctgta

SEQ ID NO: 579770 - DNA, 20 bp, Artificial Sequence
  chemically synthesized
tctcttctattttttggaag

SEQ ID NO: 579771 - DNA, 20 bp, Artificial Sequence
  chemically synthesized
attttttggaagagttgttt

SEQ ID NO: 579772 - DNA, 20 bp, Artificial Sequence
  chemically synthesized
ggcctgagcctttcattggg

SEQ ID NO: 579773 - DNA, 20 bp, Artificial Sequence
  chemically synthesized
taggtctatccaggttatct

SEQ ID NO: 579774 - DNA, 20 bp, Artificial Sequence
  chemically synthesized
aacaaaattgacaaagtttt

SEQ ID NO: 579775 - DNA, 20 bp, Artificial Sequence
  chemically synthesized
gaaaaggtcaacaaaattga

SEQ ID NO: 579776 - DNA, 20 bp, Artificial Sequence
  chemically synthesized
ccttttcaaataactaaatt

SEQ ID NO: 579777 - DNA, 20 bp, Artificial Sequence
  chemically synthesized
aaataactaaatttctagat

SEQ ID NO: 579778 - DNA, 20 bp, Artificial Sequence
  chemically synthesized
aaatttctagattttggttt

SEQ ID NO: 579779 - DNA, 20 bp, Artificial Sequence
  chemically synthesized
ctattatattttcttcctct

SEQ ID NO: 579780 - DNA, 20 bp, Artificial Sequence
  chemically synthesized
cactaattgttattacttcc

SEQ ID NO: 579781 - DNA, 20 bp, Artificial Sequence
  chemically synthesized
tattacttcctgctgcttac

SEQ ID NO: 579782 - DNA, 20 bp, Artificial Sequence
  chemically synthesized
atttacttttctcttctttt

SEQ ID NO: 579783 - DNA, 20 bp, Artificial Sequence
  chemically synthesized
tttttctagtttcttaaggt

SEQ ID NO: 579784 - DNA, 20 bp, Artificial Sequence
  chemically synthesized
cttaaggtagaagcttaggc

SEQ ID NO: 579785 - DNA, 20 bp, Artificial Sequence
  chemically synthesized
aaagatctgaaatcagtagc

SEQ ID NO: 579786 - DNA, 20 bp, Artificial Sequence
  chemically synthesized
gttatacattttactctaag

SEQ ID NO: 579787 - DNA, 20 bp, Artificial Sequence
  chemically synthesized
cttatgggaggaggctgaag

SEQ ID NO: 579788 - DNA, 20 bp, Artificial Sequence
  chemically synthesized
cactgcttcagcctcctccc

SEQ ID NO: 579789 - DNA, 20 bp, Artificial Sequence
  chemically synthesized
actcccaaatttacatctgt

SEQ ID NO: 579790 - DNA, 20 bp, Artificial Sequence
  chemically synthesized
atggtcataaaatctgcatt

SEQ ID NO: 579791 - DNA, 20 bp, Artificial Sequence
  chemically synthesized
aagggattaaaatcatacaa

SEQ ID NO: 579792 - DNA, 20 bp, Artificial Sequence
  chemically synthesized
aataagtctcactacattca

SEQ ID NO: 579793 - DNA, 20 bp, Artificial Sequence
  chemically synthesized
agacctaacagatatctata

SEQ ID NO: 579794 - DNA, 20 bp, Artificial Sequence
  chemically synthesized
atagatatctgttaggtctt

SEQ ID NO: 579795 - DNA, 20 bp, Artificial Sequence
  chemically synthesized
ctaattcttctttcagttca

SEQ ID NO: 579796 - DNA, 20 bp, Artificial Sequence
  chemically synthesized
cttctttcagttcagtcagt

SEQ ID NO: 579797 - DNA, 20 bp, Artificial Sequence
  chemically synthesized
aatattttttctttcttttc

SEQ ID NO: 579798 - DNA, 20 bp, Artificial Sequence
  chemically synthesized
tttttctttcttttctttgg

SEQ ID NO: 579799 - DNA, 20 bp, Artificial Sequence
  chemically synthesized
attatcccatttacctattt

SEQ ID NO: 579800 - DNA, 20 bp, Artificial Sequence
  chemically synthesized
catttacctattttcaagtt

SEQ ID NO: 579801 - DNA, 20 bp, Artificial Sequence
  chemically synthesized
agtttgctgattctttcttt

SEQ ID NO: 579802 - DNA, 20 bp, Artificial Sequence
  chemically synthesized
aaattaaattttcacttgac

SEQ ID NO: 579803 - DNA, 20 bp, Artificial Sequence
  chemically synthesized
tgaaaatttaattttagtta

SEQ ID NO: 579804 - DNA, 20 bp, Artificial Sequence
  chemically synthesized
ctatttgttaagacaagcac

SEQ ID NO: 579805 - DNA, 20 bp, Artificial Sequence
  chemically synthesized
cttgcgggatctagaagccc

SEQ ID NO: 579806 - DNA, 20 bp, Artificial Sequence
  chemically synthesized
ctggagaatgaggtgtccat

SEQ ID NO: 579807 - DNA, 20 bp, Artificial Sequence
  chemically synthesized
cctatggacacctcattctc

SEQ ID NO: 579808 - DNA, 20 bp, Artificial Sequence
  chemically synthesized
tcattctccagagcttcact

SEQ ID NO: 579809 - DNA, 20 bp, Artificial Sequence
  chemically synthesized
ctggaagtttttctccagac

SEQ ID NO: 579810 - DNA, 20 bp, Artificial Sequence
  chemically synthesized
atgttaaagaattgctgcta

SEQ ID NO: 579811 - DNA, 20 bp, Artificial Sequence
  chemically synthesized
ttggaccaacaccctggagc

SEQ ID NO: 579812 - DNA, 20 bp, Artificial Sequence
  chemically synthesized
ataaaggcaaggccatgtat

SEQ ID NO: 579813 - DNA, 20 bp, Artificial Sequence
  chemically synthesized
ttttattccaagaaccttgc

SEQ ID NO: 579814 - DNA, 20 bp, Artificial Sequence
  chemically synthesized
tagccaccagagagtgtaga

SEQ ID NO: 579815 - DNA, 20 bp, Artificial Sequence
  chemically synthesized
tctctggtggctaaaaggct

SEQ ID NO: 579816 - DNA, 20 bp, Artificial Sequence
  chemically synthesized
agctattatggttgcaaggc

SEQ ID NO: 579817 - DNA, 20 bp, Artificial Sequence
  chemically synthesized
tcaataaaaatggcaaagtt

SEQ ID NO: 579818 - DNA, 20 bp, Artificial Sequence
  chemically synthesized
ctgactctcaataaaaatgg

SEQ ID NO: 579819 - DNA, 20 bp, Artificial Sequence
  chemically synthesized
tgggcggaacactcgaggtc

SEQ ID NO: 579820 - DNA, 20 bp, Artificial Sequence
  chemically synthesized
tctcgtgtttttagtagaga

SEQ ID NO: 579821 - DNA, 20 bp, Artificial Sequence
  chemically synthesized
ccaccacgcccaactatttc

SEQ ID NO: 579822 - DNA, 20 bp, Artificial Sequence
  chemically synthesized
ctggagtgcagtggcatgat

SEQ ID NO: 579823 - DNA, 20 bp, Artificial Sequence
  chemically synthesized
gaaagaaaagaaaaaagaaa

SEQ ID NO: 579824 - DNA, 20 bp, Artificial Sequence
  chemically synthesized
atttcgaaaattttttgagg

SEQ ID NO: 579825 - DNA, 20 bp, Artificial Sequence
  chemically synthesized
ttttcacaatttaacttatc

SEQ ID NO: 579826 - DNA, 20 bp, Artificial Sequence
  chemically synthesized
attgtaccatattttctcta

SEQ ID NO: 579827 - DNA, 20 bp, Artificial Sequence
  chemically synthesized
tttgattgtaccatattttc

SEQ ID NO: 579828 - DNA, 20 bp, Artificial Sequence
  chemically synthesized
aagccttgaataactttatg

SEQ ID NO: 579829 - DNA, 20 bp, Artificial Sequence
  chemically synthesized
aatcaaagcataaagttatt

SEQ ID NO: 579830 - DNA, 20 bp, Artificial Sequence
  chemically synthesized
tcaccaagccttgaataact

SEQ ID NO: 579831 - DNA, 20 bp, Artificial Sequence
  chemically synthesized
tagaacacaggtagtaatgg

SEQ ID NO: 579832 - DNA, 20 bp, Artificial Sequence
  chemically synthesized
tatcagcaatgtagagagca

SEQ ID NO: 579833 - DNA, 20 bp, Artificial Sequence
  chemically synthesized
atgtagagagcactctgttt

SEQ ID NO: 579834 - DNA, 20 bp, Artificial Sequence
  chemically synthesized
ttgtatgctttgagaacttt

SEQ ID NO: 579835 - DNA, 20 bp, Artificial Sequence
  chemically synthesized
tcttttctctttaatcacat

SEQ ID NO: 579836 - DNA, 20 bp, Artificial Sequence
  chemically synthesized
tgttctcccctaaagcttct

SEQ ID NO: 579837 - DNA, 20 bp, Artificial Sequence
  chemically synthesized
tattcccttttgttctcccc

SEQ ID NO: 579838 - DNA, 20 bp, Artificial Sequence
  chemically synthesized
agaaatggtaggtcctggca

SEQ ID NO: 579839 - DNA, 20 bp, Artificial Sequence
  chemically synthesized
cctggcaagaagatttctaa

SEQ ID NO: 579840 - DNA, 20 bp, Artificial Sequence
  chemically synthesized
ccacactagtagtttgaggt

SEQ ID NO: 579841 - DNA, 20 bp, Artificial Sequence
  chemically synthesized
attgacccacactagtagtt

SEQ ID NO: 579842 - DNA, 20 bp, Artificial Sequence
  chemically synthesized
tcagcaaattgacccacact

SEQ ID NO: 579843 - DNA, 20 bp, Artificial Sequence
  chemically synthesized
actactagtgtgggtcaatt

SEQ ID NO: 579844 - DNA, 20 bp, Artificial Sequence
  chemically synthesized
caaaatatataaaagaaaaa

SEQ ID NO: 579845 - DNA, 20 bp, Artificial Sequence
  chemically synthesized
ttcaacttttaaaattaatt

SEQ ID NO: 579846 - DNA, 20 bp, Artificial Sequence
  chemically synthesized
attatgtgattatagaatgt

SEQ ID NO: 579847 - DNA, 20 bp, Artificial Sequence
  chemically synthesized
gattatagaatgtctgtgtt

SEQ ID NO: 579848 - DNA, 20 bp, Artificial Sequence
  chemically synthesized
aaagaatgccttcaaaaaca

SEQ ID NO: 579849 - DNA, 20 bp, Artificial Sequence
  chemically synthesized
tttctaaggctgcaaaatct

SEQ ID NO: 579850 - DNA, 20 bp, Artificial Sequence
  chemically synthesized
cagagattttgcagccttag

SEQ ID NO: 579851 - DNA, 20 bp, Artificial Sequence
  chemically synthesized
aatttgaaaagtattgaatt

SEQ ID NO: 579852 - DNA, 20 bp, Artificial Sequence
  chemically synthesized
gtattgaatttcttgcttca

SEQ ID NO: 579853 - DNA, 20 bp, Artificial Sequence
  chemically synthesized
gtgaaatcttgtttgagcct

SEQ ID NO: 579854 - DNA, 20 bp, Artificial Sequence
  chemically synthesized
gccaaatcagccaggctcaa

SEQ ID NO: 579855 - DNA, 20 bp, Artificial Sequence
  chemically synthesized
aattcaatagagaagtgaaa

SEQ ID NO: 579856 - DNA, 20 bp, Artificial Sequence
  chemically synthesized
acgtgacagcattagctgtt

SEQ ID NO: 579857 - DNA, 20 bp, Artificial Sequence
  chemically synthesized
gcacaaaacagctaatgctg

SEQ ID NO: 579858 - DNA, 20 bp, Artificial Sequence
  chemically synthesized
ttttcaaacgtgacagcatt

SEQ ID NO: 579859 - DNA, 20 bp, Artificial Sequence
  chemically synthesized
agctaatgctgtcacgtttg

SEQ ID NO: 579860 - DNA, 20 bp, Artificial Sequence
  chemically synthesized
ttttgtgtcaaattcagcgt

SEQ ID NO: 579861 - DNA, 20 bp, Artificial Sequence
  chemically synthesized
cccctttttgtcggctttgt

SEQ ID NO: 579862 - DNA, 20 bp, Artificial Sequence
  chemically synthesized
aaatcccctttttgtcggct

SEQ ID NO: 579863 - DNA, 20 bp, Artificial Sequence
  chemically synthesized
caatcacaaagccgacaaaa

SEQ ID NO: 579864 - DNA, 20 bp, Artificial Sequence
  chemically synthesized
gaaagagaaatccccttttt

SEQ ID NO: 579865 - DNA, 20 bp, Artificial Sequence
  chemically synthesized
tttcatttattttttcccct

SEQ ID NO: 579866 - DNA, 20 bp, Artificial Sequence
  chemically synthesized
aagagagattttcccaggct

SEQ ID NO: 579867 - DNA, 20 bp, Artificial Sequence
  chemically synthesized
actttcttttccagtgtcaa

SEQ ID NO: 579868 - DNA, 20 bp, Artificial Sequence
  chemically synthesized
tctctcttgacactggaaaa

SEQ ID NO: 579869 - DNA, 20 bp, Artificial Sequence
  chemically synthesized
ctttggaaaaattatttctt

SEQ ID NO: 579870 - DNA, 20 bp, Artificial Sequence
  chemically synthesized
tttttccaaagaatccattg

SEQ ID NO: 579871 - DNA, 20 bp, Artificial Sequence
  chemically synthesized
aagattggtccaaacttggc

SEQ ID NO: 579872 - DNA, 20 bp, Artificial Sequence
  chemically synthesized
ataacctgttccctaggctt

SEQ ID NO: 579873 - DNA, 20 bp, Artificial Sequence
  chemically synthesized
ttgagttcataacctgttcc

SEQ ID NO: 579874 - DNA, 20 bp, Artificial Sequence
  chemically synthesized
tcataggatttatttcattt

SEQ ID NO: 579875 - DNA, 20 bp, Artificial Sequence
  chemically synthesized
aactgccaacagtgatcatc

SEQ ID NO: 579876 - DNA, 20 bp, Artificial Sequence
  chemically synthesized
atcctatgatgatcactgtt

SEQ ID NO: 579877 - DNA, 20 bp, Artificial Sequence
  chemically synthesized
tctaaatggcatcatctctc

SEQ ID NO: 579878 - DNA, 20 bp, Artificial Sequence
  chemically synthesized
attctgtcatagcctattgg

SEQ ID NO: 579879 - DNA, 20 bp, Artificial Sequence
  chemically synthesized
tcatagcctattggcaaaga

SEQ ID NO: 579880 - DNA, 20 bp, Artificial Sequence
  chemically synthesized
ttgattagaatgaaaatctt

SEQ ID NO: 579881 - DNA, 20 bp, Artificial Sequence
  chemically synthesized
cagatgttaggcaaaaacat

SEQ ID NO: 579882 - DNA, 20 bp, Artificial Sequence
  chemically synthesized
ttttgttagccacatggctt

SEQ ID NO: 579883 - DNA, 20 bp, Artificial Sequence
  chemically synthesized
gtagttaattttgttagcca

SEQ ID NO: 579884 - DNA, 20 bp, Artificial Sequence
  chemically synthesized
aaattaactactttctaact

SEQ ID NO: 579885 - DNA, 20 bp, Artificial Sequence
  chemically synthesized
actactttctaacttcatgt

SEQ ID NO: 579886 - DNA, 20 bp, Artificial Sequence
  chemically synthesized
gacggccataacatattggt

SEQ ID NO: 579887 - DNA, 20 bp, Artificial Sequence
  chemically synthesized
gatactctatgccatctgca

SEQ ID NO: 579888 - DNA, 20 bp, Artificial Sequence
  chemically synthesized
aagaaacagcaacaggagag

SEQ ID NO: 579889 - DNA, 20 bp, Artificial Sequence
  chemically synthesized
ccaaatcaagactctcctgt

SEQ ID NO: 579890 - DNA, 20 bp, Artificial Sequence
  chemically synthesized
gctgtttctttccactctga

SEQ ID NO: 579891 - DNA, 20 bp, Artificial Sequence
  chemically synthesized
actctgaccacgctttcaag

SEQ ID NO: 579892 - DNA, 20 bp, Artificial Sequence
  chemically synthesized
aaccggagatgtcatgtgga

SEQ ID NO: 579893 - DNA, 20 bp, Artificial Sequence
  chemically synthesized
agctttttccacatgacatc

SEQ ID NO: 579894 - DNA, 20 bp, Artificial Sequence
  chemically synthesized
aacctccgcctcccgggttc

SEQ ID NO: 579895 - DNA, 20 bp, Artificial Sequence
  chemically synthesized
ttgggaggctgaggcagggg

SEQ ID NO: 579896 - DNA, 20 bp, Artificial Sequence
  chemically synthesized
ggcatgcagcaccacgccag

SEQ ID NO: 579897 - DNA, 20 bp, Artificial Sequence
  chemically synthesized
ttttgtatttttagtagaga

SEQ ID NO: 579898 - DNA, 20 bp, Artificial Sequence
  chemically synthesized
ggcaggcagatcacgagatc

SEQ ID NO: 579899 - DNA, 20 bp, Artificial Sequence
  chemically synthesized
tgcctcggcctcccaaagtg

SEQ ID NO: 579900 - DNA, 20 bp, Artificial Sequence
  chemically synthesized
ctttttttctaaataaaagg

SEQ ID NO: 579901 - DNA, 20 bp, Artificial Sequence
  chemically synthesized
aagttaaaataattattaaa

SEQ ID NO: 579902 - DNA, 20 bp, Artificial Sequence
  chemically synthesized
tgataaatatttatgcaata

SEQ ID NO: 579903 - DNA, 20 bp, Artificial Sequence
  chemically synthesized
aatgtaaattaaattttaaa

SEQ ID NO: 579904 - DNA, 20 bp, Artificial Sequence
  chemically synthesized
gaactagaagagactgtcaa

SEQ ID NO: 579905 - DNA, 20 bp, Artificial Sequence
  chemically synthesized
attagcaattatgaatcatt

SEQ ID NO: 579906 - DNA, 20 bp, Artificial Sequence
  chemically synthesized
gcttgataccaaaaagcaat

SEQ ID NO: 579907 - DNA, 20 bp, Artificial Sequence
  chemically synthesized
cgtaaaaagaaaattaccaa

SEQ ID NO: 579908 - DNA, 20 bp, Artificial Sequence
  chemically synthesized
agttataacagtgttggtgg

SEQ ID NO: 579909 - DNA, 20 bp, Artificial Sequence
  chemically synthesized
ctcactactgagcaacaatg

SEQ ID NO: 579910 - DNA, 20 bp, Artificial Sequence
  chemically synthesized
atgtctacagccttggagag

SEQ ID NO: 579911 - DNA, 20 bp, Artificial Sequence
  chemically synthesized
cagctctccaaggctgtaga

SEQ ID NO: 579912 - DNA, 20 bp, Artificial Sequence
  chemically synthesized
ccaaggctgtagacatagct

SEQ ID NO: 579913 - DNA, 20 bp, Artificial Sequence
  chemically synthesized
ttctttctgagtctgtgtgc

SEQ ID NO: 579914 - DNA, 20 bp, Artificial Sequence
  chemically synthesized
gaacttacggagcaaggggg

SEQ ID NO: 579915 - DNA, 20 bp, Artificial Sequence
  chemically synthesized
atcactactaagtgatatta

SEQ ID NO: 579916 - DNA, 20 bp, Artificial Sequence
  chemically synthesized
cttttagaagaattaaacat

SEQ ID NO: 579917 - DNA, 20 bp, Artificial Sequence
  chemically synthesized
tttcatttttaatgaaacga

SEQ ID NO: 579918 - DNA, 20 bp, Artificial Sequence
  chemically synthesized
tcgtttcattaaaaatgaaa

SEQ ID NO: 579919 - DNA, 20 bp, Artificial Sequence
  chemically synthesized
aatgaaatgcagtttgcaat

SEQ ID NO: 579920 - DNA, 20 bp, Artificial Sequence
  chemically synthesized
tttttcgcagtatactattt

SEQ ID NO: 579921 - DNA, 20 bp, Artificial Sequence
  chemically synthesized
attgctttcattttctacct

SEQ ID NO: 579922 - DNA, 20 bp, Artificial Sequence
  chemically synthesized
atgtaattattaattgacaa

SEQ ID NO: 579923 - DNA, 20 bp, Artificial Sequence
  chemically synthesized
taataattacatgagtcttt

SEQ ID NO: 579924 - DNA, 20 bp, Artificial Sequence
  chemically synthesized
gagtctttttcagattctta

SEQ ID NO: 579925 - DNA, 20 bp, Artificial Sequence
  chemically synthesized
ttcagattcttatggggttt

SEQ ID NO: 579926 - DNA, 20 bp, Artificial Sequence
  chemically synthesized
attcttatggggttttcttg

SEQ ID NO: 579927 - DNA, 20 bp, Artificial Sequence
  chemically synthesized
ttactcttgtagatgacctc

SEQ ID NO: 579928 - DNA, 20 bp, Artificial Sequence
  chemically synthesized
acaactctactactttcaaa

SEQ ID NO: 579929 - DNA, 20 bp, Artificial Sequence
  chemically synthesized
gattctgaacttctctagcc

SEQ ID NO: 579930 - DNA, 20 bp, Artificial Sequence
  chemically synthesized
tgaaaagtactcttattatt

SEQ ID NO: 579931 - DNA, 20 bp, Artificial Sequence
  chemically synthesized
taataagagtacttttcaaa

SEQ ID NO: 579932 - DNA, 20 bp, Artificial Sequence
  chemically synthesized
atgctagtcactttatatat

SEQ ID NO: 579933 - DNA, 20 bp, Artificial Sequence
  chemically synthesized
tgttaataataacttttagt

SEQ ID NO: 579934 - DNA, 20 bp, Artificial Sequence
  chemically synthesized
actaaaagttattattaaca

SEQ ID NO: 579935 - DNA, 20 bp, Artificial Sequence
  chemically synthesized
caagaaatggatgaaaaaat

SEQ ID NO: 579936 - DNA, 20 bp, Artificial Sequence
  chemically synthesized
aatttaatgatgtgtattgc

SEQ ID NO: 579937 - DNA, 20 bp, Artificial Sequence
  chemically synthesized
tgacattttttgtttgtgct

SEQ ID NO: 579938 - DNA, 20 bp, Artificial Sequence
  chemically synthesized
tatctatagagattgacatt

SEQ ID NO: 579939 - DNA, 20 bp, Artificial Sequence
  chemically synthesized
aatggctcagccactatcta

SEQ ID NO: 579940 - DNA, 20 bp, Artificial Sequence
  chemically synthesized
tggctgagccatttttatga

SEQ ID NO: 579941 - DNA, 20 bp, Artificial Sequence
  chemically synthesized
tgtagttttagaccattcca

SEQ ID NO: 579942 - DNA, 20 bp, Artificial Sequence
  chemically synthesized
cttttgaaattaaaaaaaaa

SEQ ID NO: 579943 - DNA, 20 bp, Artificial Sequence
  chemically synthesized
cgttttttttttttaatttc

SEQ ID NO: 579944 - DNA, 20 bp, Artificial Sequence
  chemically synthesized
gatagcaattataatacaat

SEQ ID NO: 579945 - DNA, 20 bp, Artificial Sequence
  chemically synthesized
tacaattctggttttatttt

SEQ ID NO: 579946 - DNA, 20 bp, Artificial Sequence
  chemically synthesized
ttaggtgattaaaacatctt

SEQ ID NO: 579947 - DNA, 20 bp, Artificial Sequence
  chemically synthesized
ttgcattgtcaaaacatgta

SEQ ID NO: 579948 - DNA, 20 bp, Artificial Sequence
  chemically synthesized
cttacatgttttgacaatgc

SEQ ID NO: 579949 - DNA, 20 bp, Artificial Sequence
  chemically synthesized
atgttttgacaatgcaattg

SEQ ID NO: 579950 - DNA, 20 bp, Artificial Sequence
  chemically synthesized
taattgctcttagaagagca

SEQ ID NO: 579951 - DNA, 20 bp, Artificial Sequence
  chemically synthesized
aaagtgatggtaagaatggt

SEQ ID NO: 579952 - DNA, 20 bp, Artificial Sequence
  chemically synthesized
taaccattcttaccatcact

SEQ ID NO: 579953 - DNA, 20 bp, Artificial Sequence
  chemically synthesized
agagatgagaggcatacagt

SEQ ID NO: 579954 - DNA, 20 bp, Artificial Sequence
  chemically synthesized
tccagtccaaacttcgtatt

SEQ ID NO: 579955 - DNA, 20 bp, Artificial Sequence
  chemically synthesized
gaaggtataagcagaaaata

SEQ ID NO: 579956 - DNA, 20 bp, Artificial Sequence
  chemically synthesized
ccttcttaccagttaactac

SEQ ID NO: 579957 - DNA, 20 bp, Artificial Sequence
  chemically synthesized
actactttggtttgtgatcc

SEQ ID NO: 579958 - DNA, 20 bp, Artificial Sequence
  chemically synthesized
gctacttctttttcttctct

SEQ ID NO: 579959 - DNA, 20 bp, Artificial Sequence
  chemically synthesized
gactacctcacgaatatgac

SEQ ID NO: 579960 - DNA, 20 bp, Artificial Sequence
  chemically synthesized
tagagctttcaagaataacc

SEQ ID NO: 579961 - DNA, 20 bp, Artificial Sequence
  chemically synthesized
ggaattaggaaaatgaccat

SEQ ID NO: 579962 - DNA, 20 bp, Artificial Sequence
  chemically synthesized
aagagacacatgttaccact

SEQ ID NO: 579963 - DNA, 20 bp, Artificial Sequence
  chemically synthesized
cttgaaagaatttttattca

SEQ ID NO: 579964 - DNA, 20 bp, Artificial Sequence
  chemically synthesized
gataagactgtaaaattcta

SEQ ID NO: 579965 - DNA, 20 bp, Artificial Sequence
  chemically synthesized
agctgctatgaggacaaggt

SEQ ID NO: 579966 - DNA, 20 bp, Artificial Sequence
  chemically synthesized
gacctgagctgctatgagga

SEQ ID NO: 579967 - DNA, 20 bp, Artificial Sequence
  chemically synthesized
cttcgataaaatggctatga

SEQ ID NO: 579968 - DNA, 20 bp, Artificial Sequence
  chemically synthesized
aggaagagttaatggaatta

SEQ ID NO: 579969 - DNA, 20 bp, Artificial Sequence
  chemically synthesized
tcccatcacacagaacttgt

SEQ ID NO: 579970 - DNA, 20 bp, Artificial Sequence
  chemically synthesized
caggcctggccataaaacac

SEQ ID NO: 579971 - DNA, 20 bp, Artificial Sequence
  chemically synthesized
gaatgtggtcagtcaatcca

SEQ ID NO: 579972 - DNA, 20 bp, Artificial Sequence
  chemically synthesized
attctgtcttccttttctgc

SEQ ID NO: 579973 - DNA, 20 bp, Artificial Sequence
  chemically synthesized
tgtcacaaaattggaaaagt

SEQ ID NO: 579974 - DNA, 20 bp, Artificial Sequence
  chemically synthesized
gttgggggacagctcctaag

SEQ ID NO: 579975 - DNA, 20 bp, Artificial Sequence
  chemically synthesized
caatagcttaacacaataaa

SEQ ID NO: 579976 - DNA, 20 bp, Artificial Sequence
  chemically synthesized
gtctttattgtgttaagcta

SEQ ID NO: 579977 - DNA, 20 bp, Artificial Sequence
  chemically synthesized
gaaatgaactctgaaatctc

SEQ ID NO: 579978 - DNA, 20 bp, Artificial Sequence
  chemically synthesized
tttcagagttcatttcttac

SEQ ID NO: 579979 - DNA, 20 bp, Artificial Sequence
  chemically synthesized
cgtatcattttcttggatga

SEQ ID NO: 579980 - DNA, 20 bp, Artificial Sequence
  chemically synthesized
catttcatccaagaaaatga

SEQ ID NO: 579981 - DNA, 20 bp, Artificial Sequence
  chemically synthesized
aaccaatttgagaatcagat

SEQ ID NO: 579982 - DNA, 20 bp, Artificial Sequence
  chemically synthesized
aggccttttgctaaaccagt

SEQ ID NO: 579983 - DNA, 20 bp, Artificial Sequence
  chemically synthesized
tgtcagataaaatatctata

SEQ ID NO: 579984 - DNA, 20 bp, Artificial Sequence
  chemically synthesized
agtaacatggtaggaggttg

SEQ ID NO: 579985 - DNA, 20 bp, Artificial Sequence
  chemically synthesized
cttccctgctcaaaataccc

SEQ ID NO: 579986 - DNA, 20 bp, Artificial Sequence
  chemically synthesized
aaaataccctaaagcttaac

SEQ ID NO: 579987 - DNA, 20 bp, Artificial Sequence
  chemically synthesized
ccttaaatgttaaacaatgg

SEQ ID NO: 579988 - DNA, 20 bp, Artificial Sequence
  chemically synthesized
ttaaccattgtttaacattt

SEQ ID NO: 579989 - DNA, 20 bp, Artificial Sequence
  chemically synthesized
ttcaaacttagtatttacta

SEQ ID NO: 579990 - DNA, 20 bp, Artificial Sequence
  chemically synthesized
ttcaaactgactagtaaata

SEQ ID NO: 579991 - DNA, 20 bp, Artificial Sequence
  chemically synthesized
actagtaaatactaagtttg

SEQ ID NO: 579992 - DNA, 20 bp, Artificial Sequence
  chemically synthesized
cagcatgcatagtgctttgc

SEQ ID NO: 579993 - DNA, 20 bp, Artificial Sequence
  chemically synthesized
cgcatgcaaagcactatgca

SEQ ID NO: 579994 - DNA, 20 bp, Artificial Sequence
  chemically synthesized
gttttatcaagcagcatgca

SEQ ID NO: 579995 - DNA, 20 bp, Artificial Sequence
  chemically synthesized
ggaagaaaattgcttaataa

SEQ ID NO: 579996 - DNA, 20 bp, Artificial Sequence
  chemically synthesized
agaaaaaggaaaaggaagaa

SEQ ID NO: 579997 - DNA, 20 bp, Artificial Sequence
  chemically synthesized
tgaaatttcctcaaatatct

SEQ ID NO: 579998 - DNA, 20 bp, Artificial Sequence
  chemically synthesized
gaaatgggggtgagtgggta

SEQ ID NO: 579999 - DNA, 20 bp, Artificial Sequence
  chemically synthesized
agttgcatgaagtcaaccat

SEQ ID NO: 580000 - DNA, 20 bp, Artificial Sequence
  chemically synthesized
tagtaatctggatatagttg

SEQ ID NO: 580001 - DNA, 20 bp, Artificial Sequence
  chemically synthesized
cagaaaaccagccaactata

SEQ ID NO: 580002 - DNA, 20 bp, Artificial Sequence
  chemically synthesized
aatgtcaatgttaaagttaa

SEQ ID NO: 580003 - DNA, 20 bp, Artificial Sequence
  chemically synthesized
ctaactcatgcctgtaatcc

SEQ ID NO: 580004 - DNA, 20 bp, Artificial Sequence
  chemically synthesized
ttccttggcctcccaaagca

SEQ ID NO: 580005 - DNA, 20 bp, Artificial Sequence
  chemically synthesized
ttgggaggccaaggaaggag

SEQ ID NO: 580006 - DNA, 20 bp, Artificial Sequence
  chemically synthesized
ctggctaattttttaaaaat

SEQ ID NO: 580007 - DNA, 20 bp, Artificial Sequence
  chemically synthesized
tagggaggctgaggcaggag

SEQ ID NO: 580008 - DNA, 20 bp, Artificial Sequence
  chemically synthesized
agagttcaaggctcagtgag

SEQ ID NO: 580009 - DNA, 20 bp, Artificial Sequence
  chemically synthesized
atacaaagtctactgttcat

SEQ ID NO: 580010 - DNA, 20 bp, Artificial Sequence
  chemically synthesized
tactgttcatttcagcttta

SEQ ID NO: 580011 - DNA, 20 bp, Artificial Sequence
  chemically synthesized
taccatagattgtaatttaa

SEQ ID NO: 580012 - DNA, 20 bp, Artificial Sequence
  chemically synthesized
tacatttgataaaattatac

SEQ ID NO: 580013 - DNA, 20 bp, Artificial Sequence
  chemically synthesized
aaggtatctttgatactaac

SEQ ID NO: 580014 - DNA, 20 bp, Artificial Sequence
  chemically synthesized
tttgatactaaccttggttt

SEQ ID NO: 580015 - DNA, 20 bp, Artificial Sequence
  chemically synthesized
cttggtttctgtgattttct

SEQ ID NO: 580016 - DNA, 20 bp, Artificial Sequence
  chemically synthesized
agggaccctccttccatgac

SEQ ID NO: 580017 - DNA, 20 bp, Artificial Sequence
  chemically synthesized
ggtcttaggacaggccagag

SEQ ID NO: 580018 - DNA, 20 bp, Artificial Sequence
  chemically synthesized
ctggcctgtcctaagacctg

SEQ ID NO: 580019 - DNA, 20 bp, Artificial Sequence
  chemically synthesized
aagacctgctcagcttcttc

SEQ ID NO: 580020 - DNA, 20 bp, Artificial Sequence
  chemically synthesized
caacagttgaatgaaatgtt

SEQ ID NO: 580021 - DNA, 20 bp, Artificial Sequence
  chemically synthesized
ggtgttcttgtacttcatcc

SEQ ID NO: 580022 - DNA, 20 bp, Artificial Sequence
  chemically synthesized
taagcaacataaatgtgaga

SEQ ID NO: 580023 - DNA, 20 bp, Artificial Sequence
  chemically synthesized
caaacgttatctcacattta

SEQ ID NO: 580024 - DNA, 20 bp, Artificial Sequence
  chemically synthesized
tatggctaggatgatgaaca

SEQ ID NO: 580025 - DNA, 20 bp, Artificial Sequence
  chemically synthesized
ggatgatgaacaacaggatt

SEQ ID NO: 580026 - DNA, 20 bp, Artificial Sequence
  chemically synthesized
ttgcttttttgatggcaaat

SEQ ID NO: 580027 - DNA, 20 bp, Artificial Sequence
  chemically synthesized
tgctgtagtgcttttctaac

SEQ ID NO: 580028 - DNA, 20 bp, Artificial Sequence
  chemically synthesized
gggatatggatattctgctg

SEQ ID NO: 580029 - DNA, 20 bp, Artificial Sequence
  chemically synthesized
tgccacttcagcacccatca

SEQ ID NO: 580030 - DNA, 20 bp, Artificial Sequence
  chemically synthesized
gtgccagcatttcattgcct

SEQ ID NO: 580031 - DNA, 20 bp, Artificial Sequence
  chemically synthesized
tgaaggctttctgttgccac

SEQ ID NO: 580032 - DNA, 20 bp, Artificial Sequence
  chemically synthesized
ggctttctgttgccacagga

SEQ ID NO: 580033 - DNA, 20 bp, Artificial Sequence
  chemically synthesized
catgtattttacaagggttc

SEQ ID NO: 580034 - DNA, 20 bp, Artificial Sequence
  chemically synthesized
cagctgctgttgtgggtcac

SEQ ID NO: 580035 - DNA, 20 bp, Artificial Sequence
  chemically synthesized
tccagtgacccacaacagca

SEQ ID NO: 580036 - DNA, 20 bp, Artificial Sequence
  chemically synthesized
gtctcatttttccactcttc

SEQ ID NO: 580037 - DNA, 20 bp, Artificial Sequence
  chemically synthesized
ttggaaaaggttttaagagc

SEQ ID NO: 580038 - DNA, 20 bp, Artificial Sequence
  chemically synthesized
tcactcagaagacccttgga

SEQ ID NO: 580039 - DNA, 20 bp, Artificial Sequence
  chemically synthesized
aaaaaaaagaaagaaaaaga

SEQ ID NO: 580040 - DNA, 20 bp, Artificial Sequence
  chemically synthesized
tctttcttttttttttttga

SEQ ID NO: 580041 - DNA, 20 bp, Artificial Sequence
  chemically synthesized
gaggcggaggttgcagtgag

SEQ ID NO: 580042 - DNA, 20 bp, Artificial Sequence
  chemically synthesized
tcgggaggctgagacaggag

SEQ ID NO: 580043 - DNA, 20 bp, Artificial Sequence
  chemically synthesized
ttttgtatttttaatagaga

SEQ ID NO: 580044 - DNA, 20 bp, Artificial Sequence
  chemically synthesized
caggtggatcacctgaggtc

SEQ ID NO: 580045 - DNA, 20 bp, Artificial Sequence
  chemically synthesized
tgcctcggcctcccaaagtg

SEQ ID NO: 580046 - DNA, 20 bp, Artificial Sequence
  chemically synthesized
cgctgggtgcattttgtaag

SEQ ID NO: 580047 - DNA, 20 bp, Artificial Sequence
  chemically synthesized
agtccaagagggaggtacta

SEQ ID NO: 580048 - DNA, 20 bp, Artificial Sequence
  chemically synthesized
gcatagaaaaaataatgtag

SEQ ID NO: 580049 - DNA, 20 bp, Artificial Sequence
  chemically synthesized
tttctatgcaacttctctaa

SEQ ID NO: 580050 - DNA, 20 bp, Artificial Sequence
  chemically synthesized
tattatttttatttcataaa

SEQ ID NO: 580051 - DNA, 20 bp, Artificial Sequence
  chemically synthesized
aagtagatggcagttttatt

SEQ ID NO: 580052 - DNA, 20 bp, Artificial Sequence
  chemically synthesized
gcttaagggataaagtagat

SEQ ID NO: 580053 - DNA, 20 bp, Artificial Sequence
  chemically synthesized
tctagaatgtctatcaggtt

SEQ ID NO: 580054 - DNA, 20 bp, Artificial Sequence
  chemically synthesized
gcatgaaacctgatagacat

SEQ ID NO: 580055 - DNA, 20 bp, Artificial Sequence
  chemically synthesized
gaaagaatctagaatgtcta

SEQ ID NO: 580056 - DNA, 20 bp, Artificial Sequence
  chemically synthesized
taattatatgaggtgttggg

SEQ ID NO: 580057 - DNA, 20 bp, Artificial Sequence
  chemically synthesized
atgtgagggcaaaaaatgat

SEQ ID NO: 580058 - DNA, 20 bp, Artificial Sequence
  chemically synthesized
tcatcctcccagacccaaat

SEQ ID NO: 580059 - DNA, 20 bp, Artificial Sequence
  chemically synthesized
gtagaatttacattctaaaa

SEQ ID NO: 580060 - DNA, 20 bp, Artificial Sequence
  chemically synthesized
aatgtaaattctaccccaat

SEQ ID NO: 580061 - DNA, 20 bp, Artificial Sequence
  chemically synthesized
agtgcagtgatcagatttat

SEQ ID NO: 580062 - DNA, 20 bp, Artificial Sequence
  chemically synthesized
ttataagagggagtgcagtg

SEQ ID NO: 580063 - DNA, 20 bp, Artificial Sequence
  chemically synthesized
ctccctcttataaaaccctt

SEQ ID NO: 580064 - DNA, 20 bp, Artificial Sequence
  chemically synthesized
aagacagtagggaaacattg

SEQ ID NO: 580065 - DNA, 20 bp, Artificial Sequence
  chemically synthesized
gatcttgcctagataatctg

SEQ ID NO: 580066 - DNA, 20 bp, Artificial Sequence
  chemically synthesized
gttgctttgtagataaacct

SEQ ID NO: 580067 - DNA, 20 bp, Artificial Sequence
  chemically synthesized
accctgcttatcttgtgatt

SEQ ID NO: 580068 - DNA, 20 bp, Artificial Sequence
  chemically synthesized
tttcttataccctgcttatc

SEQ ID NO: 580069 - DNA, 20 bp, Artificial Sequence
  chemically synthesized
atctgtgatggtttcttata

SEQ ID NO: 580070 - DNA, 20 bp, Artificial Sequence
  chemically synthesized
aaggttcttgtattatctgt

SEQ ID NO: 580071 - DNA, 20 bp, Artificial Sequence
  chemically synthesized
ggtggtttctcattccaatt

SEQ ID NO: 580072 - DNA, 20 bp, Artificial Sequence
  chemically synthesized
aaggttattgctcttctcag

SEQ ID NO: 580073 - DNA, 20 bp, Artificial Sequence
  chemically synthesized
cccatgccctttggcttcca

SEQ ID NO: 580074 - DNA, 20 bp, Artificial Sequence
  chemically synthesized
atcattgggctcccatgccc

SEQ ID NO: 580075 - DNA, 20 bp, Artificial Sequence
  chemically synthesized
atattcctgtgccatataca

SEQ ID NO: 580076 - DNA, 20 bp, Artificial Sequence
  chemically synthesized
tatggcacaggaatataaaa

SEQ ID NO: 580077 - DNA, 20 bp, Artificial Sequence
  chemically synthesized
ttacataacaaaataagaag

SEQ ID NO: 580078 - DNA, 20 bp, Artificial Sequence
  chemically synthesized
cgctttggcctcccagagac

SEQ ID NO: 580079 - DNA, 20 bp, Artificial Sequence
  chemically synthesized
aactcctgacctcatgatcc

SEQ ID NO: 580080 - DNA, 20 bp, Artificial Sequence
  chemically synthesized
ttttgtatttttagtagaga

SEQ ID NO: 580081 - DNA, 20 bp, Artificial Sequence
  chemically synthesized
tgcctcagcctcctgagtag

SEQ ID NO: 580082 - DNA, 20 bp, Artificial Sequence
  chemically synthesized
aacctctgcctcccgggttc

SEQ ID NO: 580083 - DNA, 20 bp, Artificial Sequence
  chemically synthesized
ctatgtatttatttttgaga

SEQ ID NO: 580084 - DNA, 20 bp, Artificial Sequence
  chemically synthesized
ttgtggggtctttctagtcc

SEQ ID NO: 580085 - DNA, 20 bp, Artificial Sequence
  chemically synthesized
ctagaaagaccccacaaaac

SEQ ID NO: 580086 - DNA, 20 bp, Artificial Sequence
  chemically synthesized
tttgatttcatgttacaatc

SEQ ID NO: 580087 - DNA, 20 bp, Artificial Sequence
  chemically synthesized
aattattctggggactatat

SEQ ID NO: 580088 - DNA, 20 bp, Artificial Sequence
  chemically synthesized
tctataatgtgtgccactta

SEQ ID NO: 580089 - DNA, 20 bp, Artificial Sequence
  chemically synthesized
aagtggcacacattatagac

SEQ ID NO: 580090 - DNA, 20 bp, Artificial Sequence
  chemically synthesized
tatagactactgttttttta

SEQ ID NO: 580091 - DNA, 20 bp, Artificial Sequence
  chemically synthesized
tgtttttttatcaggtttat

SEQ ID NO: 580092 - DNA, 20 bp, Artificial Sequence
  chemically synthesized
tatcaggtttatttctgttt

SEQ ID NO: 580093 - DNA, 20 bp, Artificial Sequence
  chemically synthesized
agttgcaatataatatgtcg

SEQ ID NO: 580094 - DNA, 20 bp, Artificial Sequence
  chemically synthesized
acttcagttaacatgtcaac

SEQ ID NO: 580095 - DNA, 20 bp, Artificial Sequence
  chemically synthesized
tctctctaatctttgaacgc

SEQ ID NO: 580096 - DNA, 20 bp, Artificial Sequence
  chemically synthesized
acacacaaaacaatggcgtt

SEQ ID NO: 580097 - DNA, 20 bp, Artificial Sequence
  chemically synthesized
gttgttccactaggtagtgg

SEQ ID NO: 580098 - DNA, 20 bp, Artificial Sequence
  chemically synthesized
tttcgtagttgaggccttgt

SEQ ID NO: 580099 - DNA, 20 bp, Artificial Sequence
  chemically synthesized
gtttagtcttctaattaatc

SEQ ID NO: 580100 - DNA, 20 bp, Artificial Sequence
  chemically synthesized
acaccatttattttataaac

SEQ ID NO: 580101 - DNA, 20 bp, Artificial Sequence
  chemically synthesized
acattttcatttacacttta

SEQ ID NO: 580102 - DNA, 20 bp, Artificial Sequence
  chemically synthesized
cctgctatgataagttgaaa

SEQ ID NO: 580103 - DNA, 20 bp, Artificial Sequence
  chemically synthesized
tgacattccttaaaaatagt

SEQ ID NO: 580104 - DNA, 20 bp, Artificial Sequence
  chemically synthesized
agtctctgattccaatttgc

SEQ ID NO: 580105 - DNA, 20 bp, Artificial Sequence
  chemically synthesized
caatattttttagaatgcct

SEQ ID NO: 580106 - DNA, 20 bp, Artificial Sequence
  chemically synthesized
cacataaacatagcaagctc

SEQ ID NO: 580107 - DNA, 20 bp, Artificial Sequence
  chemically synthesized
gcatgaatcaaaagagcttg

SEQ ID NO: 580108 - DNA, 20 bp, Artificial Sequence
  chemically synthesized
tatttactggcatgaatcaa

SEQ ID NO: 580109 - DNA, 20 bp, Artificial Sequence
  chemically synthesized
gatggccttttaaaaatata

SEQ ID NO: 580110 - DNA, 20 bp, Artificial Sequence
  chemically synthesized
tcttcctacataataggaag

SEQ ID NO: 580111 - DNA, 20 bp, Artificial Sequence
  chemically synthesized
ataaaagtttccttcttttt

SEQ ID NO: 580112 - DNA, 20 bp, Artificial Sequence
  chemically synthesized
gaaataatggttcaggttat

SEQ ID NO: 580113 - DNA, 20 bp, Artificial Sequence
  chemically synthesized
aaccattatttcaggcaaac

SEQ ID NO: 580114 - DNA, 20 bp, Artificial Sequence
  chemically synthesized
ttcaggcaaacatgggattt

SEQ ID NO: 580115 - DNA, 20 bp, Artificial Sequence
  chemically synthesized
attgagcaagcattcaaatc

SEQ ID NO: 580116 - DNA, 20 bp, Artificial Sequence
  chemically synthesized
tgaatgcttgctcaataata

SEQ ID NO: 580117 - DNA, 20 bp, Artificial Sequence
  chemically synthesized
gggtgtgcatcccactgagg

SEQ ID NO: 580118 - DNA, 20 bp, Artificial Sequence
  chemically synthesized
tggggatgcacagagggata

SEQ ID NO: 580119 - DNA, 20 bp, Artificial Sequence
  chemically synthesized
gataagaacttggaaaacaa

SEQ ID NO: 580120 - DNA, 20 bp, Artificial Sequence
  chemically synthesized
aggtaatctgtcttaaaccc

SEQ ID NO: 580121 - DNA, 20 bp, Artificial Sequence
  chemically synthesized
tggaaaacaaaagggtttaa

SEQ ID NO: 580122 - DNA, 20 bp, Artificial Sequence
  chemically synthesized
aaagggtttaagacagatta

SEQ ID NO: 580123 - DNA, 20 bp, Artificial Sequence
  chemically synthesized
ttaagacagattacctggct

SEQ ID NO: 580124 - DNA, 20 bp, Artificial Sequence
  chemically synthesized
agcatggagaagataatgag

SEQ ID NO: 580125 - DNA, 20 bp, Artificial Sequence
  chemically synthesized
tcagtcctcctgactaaaat

SEQ ID NO: 580126 - DNA, 20 bp, Artificial Sequence
  chemically synthesized
attttgggagagacagaaat

SEQ ID NO: 580127 - DNA, 20 bp, Artificial Sequence
  chemically synthesized
tctctgtagtgacggccaat

SEQ ID NO: 580128 - DNA, 20 bp, Artificial Sequence
  chemically synthesized
gaatgcacttgcatttgagg

SEQ ID NO: 580129 - DNA, 20 bp, Artificial Sequence
  chemically synthesized
aatgagaatgcacttgcatt

SEQ ID NO: 580130 - DNA, 20 bp, Artificial Sequence
  chemically synthesized
tcattcatcttatttgctct

SEQ ID NO: 580131 - DNA, 20 bp, Artificial Sequence
  chemically synthesized
cttttatagaacatggaaaa

SEQ ID NO: 580132 - DNA, 20 bp, Artificial Sequence
  chemically synthesized
aaagattttcaaaaacacaa

SEQ ID NO: 580133 - DNA, 20 bp, Artificial Sequence
  chemically synthesized
tttgaaagtgttaatcactc

SEQ ID NO: 580134 - DNA, 20 bp, Artificial Sequence
  chemically synthesized
tattatgtcttgtgacatct

SEQ ID NO: 580135 - DNA, 20 bp, Artificial Sequence
  chemically synthesized
gatattcaaataaatgttag

SEQ ID NO: 580136 - DNA, 20 bp, Artificial Sequence
  chemically synthesized
aatgcaaggaaagaacaaca

SEQ ID NO: 580137 - DNA, 20 bp, Artificial Sequence
  chemically synthesized
tataggattgtatgatgatt

SEQ ID NO: 580138 - DNA, 20 bp, Artificial Sequence
  chemically synthesized
attatacttataggattgta

SEQ ID NO: 580139 - DNA, 20 bp, Artificial Sequence
  chemically synthesized
tcatacaatcctataagtat

SEQ ID NO: 580140 - DNA, 20 bp, Artificial Sequence
  chemically synthesized
gaacgtaaacaattatactt

SEQ ID NO: 580141 - DNA, 20 bp, Artificial Sequence
  chemically synthesized
ctggtctaaggtcacataga

SEQ ID NO: 580142 - DNA, 20 bp, Artificial Sequence
  chemically synthesized
agtgattgttagagccgaca

SEQ ID NO: 580143 - DNA, 20 bp, Artificial Sequence
  chemically synthesized
agccaatggatacttttggc

SEQ ID NO: 580144 - DNA, 20 bp, Artificial Sequence
  chemically synthesized
agcccatgccaaaagtatcc

SEQ ID NO: 580145 - DNA, 20 bp, Artificial Sequence
  chemically synthesized
ttccctgaagaccatacaca

SEQ ID NO: 580146 - DNA, 20 bp, Artificial Sequence
  chemically synthesized
agtggtagaaatcttactgt

SEQ ID NO: 580147 - DNA, 20 bp, Artificial Sequence
  chemically synthesized
gtattttttaatctcctaca

SEQ ID NO: 580148 - DNA, 20 bp, Artificial Sequence
  chemically synthesized
ttataagaaggaagtcagag

SEQ ID NO: 580149 - DNA, 20 bp, Artificial Sequence
  chemically synthesized
gaggggagtttggtgtcaag

SEQ ID NO: 580150 - DNA, 20 bp, Artificial Sequence
  chemically synthesized
atcaatacctatattcatac

SEQ ID NO: 580151 - DNA, 20 bp, Artificial Sequence
  chemically synthesized
aacttgagtatgaatatagg

SEQ ID NO: 580152 - DNA, 20 bp, Artificial Sequence
  chemically synthesized
taactaactacctccttctc

SEQ ID NO: 580153 - DNA, 20 bp, Artificial Sequence
  chemically synthesized
ccctgttatttttccatttg

SEQ ID NO: 580154 - DNA, 20 bp, Artificial Sequence
  chemically synthesized
tgctctgtggatggtgtgta

SEQ ID NO: 580155 - DNA, 20 bp, Artificial Sequence
  chemically synthesized
acttagttttaactcatctc

SEQ ID NO: 580156 - DNA, 20 bp, Artificial Sequence
  chemically synthesized
tcctagagttgtttcattgg

SEQ ID NO: 580157 - DNA, 20 bp, Artificial Sequence
  chemically synthesized
tcagaaccaatgaaacaact

SEQ ID NO: 580158 - DNA, 20 bp, Artificial Sequence
  chemically synthesized
aacaacaacaaaaatcctag

SEQ ID NO: 580159 - DNA, 20 bp, Artificial Sequence
  chemically synthesized
tttgttgttgttgttgttgt

SEQ ID NO: 580160 - DNA, 20 bp, Artificial Sequence
  chemically synthesized
tgattctaaaagagaaaacc

SEQ ID NO: 580161 - DNA, 20 bp, Artificial Sequence
  chemically synthesized
aaaagagaaaacccattgct

SEQ ID NO: 580162 - DNA, 20 bp, Artificial Sequence
  chemically synthesized
tccatcttaaacaagaagca

SEQ ID NO: 580163 - DNA, 20 bp, Artificial Sequence
  chemically synthesized
tatcaggatactgcagaact

SEQ ID NO: 580164 - DNA, 20 bp, Artificial Sequence
  chemically synthesized
gctctgctccccagtatttg

SEQ ID NO: 580165 - DNA, 20 bp, Artificial Sequence
  chemically synthesized
attaaatagcatgaccagat

SEQ ID NO: 580166 - DNA, 20 bp, Artificial Sequence
  chemically synthesized
ttcaggaattaaatagcatg

SEQ ID NO: 580167 - DNA, 20 bp, Artificial Sequence
  chemically synthesized
acagttgaaagatagacgag

SEQ ID NO: 580168 - DNA, 20 bp, Artificial Sequence
  chemically synthesized
ttaaacagttgaaagataga

SEQ ID NO: 580169 - DNA, 20 bp, Artificial Sequence
  chemically synthesized
tcaagcctcgtctatctttc

SEQ ID NO: 580170 - DNA, 20 bp, Artificial Sequence
  chemically synthesized
gtaagtctaagctactttga

SEQ ID NO: 580171 - DNA, 20 bp, Artificial Sequence
  chemically synthesized
taatggaaaatccatttcaa

SEQ ID NO: 580172 - DNA, 20 bp, Artificial Sequence
  chemically synthesized
gagacctttgtttacatcaa

SEQ ID NO: 580173 - DNA, 20 bp, Artificial Sequence
  chemically synthesized
ttgtacaattcctaggagac

SEQ ID NO: 580174 - DNA, 20 bp, Artificial Sequence
  chemically synthesized
gctattcccatgtacaattc

SEQ ID NO: 580175 - DNA, 20 bp, Artificial Sequence
  chemically synthesized
tcatgggaattgtacatggg

SEQ ID NO: 580176 - DNA, 20 bp, Artificial Sequence
  chemically synthesized
tgggaatagctttcaaatac

SEQ ID NO: 580177 - DNA, 20 bp, Artificial Sequence
  chemically synthesized
agtttaaaagaggactttga

SEQ ID NO: 580178 - DNA, 20 bp, Artificial Sequence
  chemically synthesized
aggactttgatcctgcttaa

SEQ ID NO: 580179 - DNA, 20 bp, Artificial Sequence
  chemically synthesized
ggtatctagataaatacact

SEQ ID NO: 580180 - DNA, 20 bp, Artificial Sequence
  chemically synthesized
ttttggtaagttttggttct

SEQ ID NO: 580181 - DNA, 20 bp, Artificial Sequence
  chemically synthesized
taaatgccataacatttttg

SEQ ID NO: 580182 - DNA, 20 bp, Artificial Sequence
  chemically synthesized
ctgtgagccttatgggtagg

SEQ ID NO: 580183 - DNA, 20 bp, Artificial Sequence
  chemically synthesized
taggaagggatttttgccac

SEQ ID NO: 580184 - DNA, 20 bp, Artificial Sequence
  chemically synthesized
tggccacgcctggttacatc

SEQ ID NO: 580185 - DNA, 20 bp, Artificial Sequence
  chemically synthesized
ggttctcccataacactttg

SEQ ID NO: 580186 - DNA, 20 bp, Artificial Sequence
  chemically synthesized
aaatcatagtagcacacagt

SEQ ID NO: 580187 - DNA, 20 bp, Artificial Sequence
  chemically synthesized
aaaacttgtactgtgtgcta

SEQ ID NO: 580188 - DNA, 20 bp, Artificial Sequence
  chemically synthesized
tgggccctgacagcatcttc

SEQ ID NO: 580189 - DNA, 20 bp, Artificial Sequence
  chemically synthesized
tctcaggtttgcagtagggc

SEQ ID NO: 580190 - DNA, 20 bp, Artificial Sequence
  chemically synthesized
atttgccctactgcaaacct

SEQ ID NO: 580191 - DNA, 20 bp, Artificial Sequence
  chemically synthesized
agcaagctgaggaaaatctc

SEQ ID NO: 580192 - DNA, 20 bp, Artificial Sequence
  chemically synthesized
tgcaaacctgagagattttc

SEQ ID NO: 580193 - DNA, 20 bp, Artificial Sequence
  chemically synthesized
tgcgctggccagaagtgctg

SEQ ID NO: 580194 - DNA, 20 bp, Artificial Sequence
  chemically synthesized
actcttatccatcattggct

SEQ ID NO: 580195 - DNA, 20 bp, Artificial Sequence
  chemically synthesized
ttgtggttgacaactttgag

SEQ ID NO: 580196 - DNA, 20 bp, Artificial Sequence
  chemically synthesized
tgacaactttgaggcatgtt

SEQ ID NO: 580197 - DNA, 20 bp, Artificial Sequence
  chemically synthesized
aactttgaggcatgtttttt

SEQ ID NO: 580198 - DNA, 20 bp, Artificial Sequence
  chemically synthesized
ttgaggcatgttttttgttt

SEQ ID NO: 580199 - DNA, 20 bp, Artificial Sequence
  chemically synthesized
ggcatgttttttgtttgttt

SEQ ID NO: 580200 - DNA, 20 bp, Artificial Sequence
  chemically synthesized
tagttattgctttgggccac

SEQ ID NO: 580201 - DNA, 20 bp, Artificial Sequence
  chemically synthesized
aagccagttatggaactagt

SEQ ID NO: 580202 - DNA, 20 bp, Artificial Sequence
  chemically synthesized
aagcaataactagttccata

SEQ ID NO: 580203 - DNA, 20 bp, Artificial Sequence
  chemically synthesized
gttccataactggcttaatt

SEQ ID NO: 580204 - DNA, 20 bp, Artificial Sequence
  chemically synthesized
aaacaatgattaatggtgaa

SEQ ID NO: 580205 - DNA, 20 bp, Artificial Sequence
  chemically synthesized
aaaccactttcaccattaat

SEQ ID NO: 580206 - DNA, 20 bp, Artificial Sequence
  chemically synthesized
ccattaatcattgtttaaag

SEQ ID NO: 580207 - DNA, 20 bp, Artificial Sequence
  chemically synthesized
ttcagaaacagacctttaaa

SEQ ID NO: 580208 - DNA, 20 bp, Artificial Sequence
  chemically synthesized
tggataaaatactaacttag

SEQ ID NO: 580209 - DNA, 20 bp, Artificial Sequence
  chemically synthesized
gcttcttccgctttgccaga

SEQ ID NO: 580210 - DNA, 20 bp, Artificial Sequence
  chemically synthesized
tatttttattttctagcttc

SEQ ID NO: 580211 - DNA, 20 bp, Artificial Sequence
  chemically synthesized
tttttactttatttttattt

SEQ ID NO: 580212 - DNA, 20 bp, Artificial Sequence
  chemically synthesized
aacactagtttgtgcactaa

SEQ ID NO: 580213 - DNA, 20 bp, Artificial Sequence
  chemically synthesized
aacatccttagtgcacaaac

SEQ ID NO: 580214 - DNA, 20 bp, Artificial Sequence
  chemically synthesized
aggtattccaaatgccaaac

SEQ ID NO: 580215 - DNA, 20 bp, Artificial Sequence
  chemically synthesized
tctgtcaaatgagttgtaca

SEQ ID NO: 580216 - DNA, 20 bp, Artificial Sequence
  chemically synthesized
tttcttcttaagtaaccact

SEQ ID NO: 580217 - DNA, 20 bp, Artificial Sequence
  chemically synthesized
cactatttgtttgttgcatt

SEQ ID NO: 580218 - DNA, 20 bp, Artificial Sequence
  chemically synthesized
tttccttccttattttcctc

SEQ ID NO: 580219 - DNA, 20 bp, Artificial Sequence
  chemically synthesized
acaaatgtcctctgaatttc

SEQ ID NO: 580220 - DNA, 20 bp, Artificial Sequence
  chemically synthesized
tgtataaaacatctttaatg

SEQ ID NO: 580221 - DNA, 20 bp, Artificial Sequence
  chemically synthesized
actagtaaacatgacattaa

SEQ ID NO: 580222 - DNA, 20 bp, Artificial Sequence
  chemically synthesized
ccctcccatatcttttaatt

SEQ ID NO: 580223 - DNA, 20 bp, Artificial Sequence
  chemically synthesized
aagagaggtcattgattagt

SEQ ID NO: 580224 - DNA, 20 bp, Artificial Sequence
  chemically synthesized
tagggaaagagaggtcattg

SEQ ID NO: 580225 - DNA, 20 bp, Artificial Sequence
  chemically synthesized
aaagttagggaaagagaggt

SEQ ID NO: 580226 - DNA, 20 bp, Artificial Sequence
  chemically synthesized
cacaggcaataggatatgcc

SEQ ID NO: 580227 - DNA, 20 bp, Artificial Sequence
  chemically synthesized
ttctaaattatttatctgta

SEQ ID NO: 580228 - DNA, 20 bp, Artificial Sequence
  chemically synthesized
actggcttcaatatatagag

SEQ ID NO: 580229 - DNA, 20 bp, Artificial Sequence
  chemically synthesized
tccctctatatattgaagcc

SEQ ID NO: 580230 - DNA, 20 bp, Artificial Sequence
  chemically synthesized
catgtgggagaccctaatcc

SEQ ID NO: 580231 - DNA, 20 bp, Artificial Sequence
  chemically synthesized
acctcccctactcccagcag

SEQ ID NO: 580232 - DNA, 20 bp, Artificial Sequence
  chemically synthesized
aaggagtcacttctgttgct

SEQ ID NO: 580233 - DNA, 20 bp, Artificial Sequence
  chemically synthesized
tgagtccttccctttaaggt

SEQ ID NO: 580234 - DNA, 20 bp, Artificial Sequence
  chemically synthesized
aagggaaggactcagtccta

SEQ ID NO: 580235 - DNA, 20 bp, Artificial Sequence
  chemically synthesized
ggacttggcctctgagatgt

SEQ ID NO: 580236 - DNA, 20 bp, Artificial Sequence
  chemically synthesized
tggttatggtgaaagacccc

SEQ ID NO: 580237 - DNA, 20 bp, Artificial Sequence
  chemically synthesized
acagaaaggcagagaagcag

SEQ ID NO: 580238 - DNA, 20 bp, Artificial Sequence
  chemically synthesized
gcagagaagcaggcaggctt

SEQ ID NO: 580239 - DNA, 20 bp, Artificial Sequence
  chemically synthesized
ctcagaaatcccagaagcct

SEQ ID NO: 580240 - DNA, 20 bp, Artificial Sequence
  chemically synthesized
taaagcccaagggctcttcc

SEQ ID NO: 580241 - DNA, 20 bp, Artificial Sequence
  chemically synthesized
acaagctgatggaagagccc

SEQ ID NO: 580242 - DNA, 20 bp, Artificial Sequence
  chemically synthesized
ggccctcaccaccatgaggg

SEQ ID NO: 580243 - DNA, 20 bp, Artificial Sequence
  chemically synthesized
ctttatattgtggtgtgagt

SEQ ID NO: 580244 - DNA, 20 bp, Artificial Sequence
  chemically synthesized
tagaacatgaggtaaactgc

SEQ ID NO: 580245 - DNA, 20 bp, Artificial Sequence
  chemically synthesized
tcattggagtcaaaaacctt

SEQ ID NO: 580246 - DNA, 20 bp, Artificial Sequence
  chemically synthesized
tctctggatatgcccggggc

SEQ ID NO: 580247 - DNA, 20 bp, Artificial Sequence
  chemically synthesized
ggagcttcaatacatctggc

SEQ ID NO: 580248 - DNA, 20 bp, Artificial Sequence
  chemically synthesized
aggaaacaaataacatgcag

SEQ ID NO: 580249 - DNA, 20 bp, Artificial Sequence
  chemically synthesized
ttgaagctccactgcatgtt

SEQ ID NO: 580250 - DNA, 20 bp, Artificial Sequence
  chemically synthesized
gttatttgtttcctttctct

SEQ ID NO: 580251 - DNA, 20 bp, Artificial Sequence
  chemically synthesized
tttcctttctcttgctgctt

SEQ ID NO: 580252 - DNA, 20 bp, Artificial Sequence
  chemically synthesized
tttctttatccttgacctgt

SEQ ID NO: 580253 - DNA, 20 bp, Artificial Sequence
  chemically synthesized
tttatccttgacctgtggga

SEQ ID NO: 580254 - DNA, 20 bp, Artificial Sequence
  chemically synthesized
tgaggtagtctctgagataa

SEQ ID NO: 580255 - DNA, 20 bp, Artificial Sequence
  chemically synthesized
acttgaatgttggtatcttt

SEQ ID NO: 580256 - DNA, 20 bp, Artificial Sequence
  chemically synthesized
tccctatctctttctctacc

SEQ ID NO: 580257 - DNA, 20 bp, Artificial Sequence
  chemically synthesized
cctgtttaaggccaataact

SEQ ID NO: 580258 - DNA, 20 bp, Artificial Sequence
  chemically synthesized
tggatcttgtaggtatgctt

SEQ ID NO: 580259 - DNA, 20 bp, Artificial Sequence
  chemically synthesized
tttgtgtctggatcttgtag

SEQ ID NO: 580260 - DNA, 20 bp, Artificial Sequence
  chemically synthesized
tggattcattgatttttttg

SEQ ID NO: 580261 - DNA, 20 bp, Artificial Sequence
  chemically synthesized
aaaaaactggctcctggatt

SEQ ID NO: 580262 - DNA, 20 bp, Artificial Sequence
  chemically synthesized
aaaaatcaatgaatccagga

SEQ ID NO: 580263 - DNA, 20 bp, Artificial Sequence
  chemically synthesized
atcttttcaaaaaactggct

SEQ ID NO: 580264 - DNA, 20 bp, Artificial Sequence
  chemically synthesized
tatcattttttattgcatct

SEQ ID NO: 580265 - DNA, 20 bp, Artificial Sequence
  chemically synthesized
tgtttatagtattctctgat

SEQ ID NO: 580266 - DNA, 20 bp, Artificial Sequence
  chemically synthesized
tttctagtttatttgcgtag

SEQ ID NO: 580267 - DNA, 20 bp, Artificial Sequence
  chemically synthesized
tatccatttcttctagattt

SEQ ID NO: 580268 - DNA, 20 bp, Artificial Sequence
  chemically synthesized
gcaggaatttatccatttct

SEQ ID NO: 580269 - DNA, 20 bp, Artificial Sequence
  chemically synthesized
attcagggattcaacttctt

SEQ ID NO: 580270 - DNA, 20 bp, Artificial Sequence
  chemically synthesized
gagcctgttattggtctatt

SEQ ID NO: 580271 - DNA, 20 bp, Artificial Sequence
  chemically synthesized
ccgtctggtcctggactttt

SEQ ID NO: 580272 - DNA, 20 bp, Artificial Sequence
  chemically synthesized
ccaaaaaaagtccaggacca

SEQ ID NO: 580273 - DNA, 20 bp, Artificial Sequence
  chemically synthesized
cctctttttctattgattgg

SEQ ID NO: 580274 - DNA, 20 bp, Artificial Sequence
  chemically synthesized
gggaggattccctctttttc

SEQ ID NO: 580275 - DNA, 20 bp, Artificial Sequence
  chemically synthesized
ggcctcataaaatgagttag

SEQ ID NO: 580276 - DNA, 20 bp, Artificial Sequence
  chemically synthesized
ctttttttgttgtgtctctg

SEQ ID NO: 580277 - DNA, 20 bp, Artificial Sequence
  chemically synthesized
tcggtttgccagtattttat

SEQ ID NO: 580278 - DNA, 20 bp, Artificial Sequence
  chemically synthesized
ctttttgatgtgctgctgga

SEQ ID NO: 580279 - DNA, 20 bp, Artificial Sequence
  chemically synthesized
gataagctttttgatgtgct

SEQ ID NO: 580280 - DNA, 20 bp, Artificial Sequence
  chemically synthesized
ccgaatccagcagcacatca

SEQ ID NO: 580281 - DNA, 20 bp, Artificial Sequence
  chemically synthesized
agcccacttgatcatggtgg

SEQ ID NO: 580282 - DNA, 20 bp, Artificial Sequence
  chemically synthesized
agcttatccaccatgatcaa

SEQ ID NO: 580283 - DNA, 20 bp, Artificial Sequence
  chemically synthesized
tttatatgctggattacatt

SEQ ID NO: 580284 - DNA, 20 bp, Artificial Sequence
  chemically synthesized
gtcgttggttctgtttatat

SEQ ID NO: 580285 - DNA, 20 bp, Artificial Sequence
  chemically synthesized
catgtggtttttgtcgttgg

SEQ ID NO: 580286 - DNA, 20 bp, Artificial Sequence
  chemically synthesized
tgcatctattgagataacca

SEQ ID NO: 580287 - DNA, 20 bp, Artificial Sequence
  chemically synthesized
ccatcaatacctaatttatc

SEQ ID NO: 580288 - DNA, 20 bp, Artificial Sequence
  chemically synthesized
cattcagtatgatattggct

SEQ ID NO: 580289 - DNA, 20 bp, Artificial Sequence
  chemically synthesized
cagttttcaaagggaatgct

SEQ ID NO: 580290 - DNA, 20 bp, Artificial Sequence
  chemically synthesized
cttgtgccagttttcaaagg

SEQ ID NO: 580291 - DNA, 20 bp, Artificial Sequence
  chemically synthesized
agagggcatccctgtcttgt

SEQ ID NO: 580292 - DNA, 20 bp, Artificial Sequence
  chemically synthesized
aaaagaggaagtcaaattgt

SEQ ID NO: 580293 - DNA, 20 bp, Artificial Sequence
  chemically synthesized
attgtccctgtttgcagacg

SEQ ID NO: 580294 - DNA, 20 bp, Artificial Sequence
  chemically synthesized
gagattttgggctgagacga

SEQ ID NO: 580295 - DNA, 20 bp, Artificial Sequence
  chemically synthesized
tgaagttgcttatcagctta

SEQ ID NO: 580296 - DNA, 20 bp, Artificial Sequence
  chemically synthesized
agactttgctgaagttgctt

SEQ ID NO: 580297 - DNA, 20 bp, Artificial Sequence
  chemically synthesized
atatcctgagactttgctga

SEQ ID NO: 580298 - DNA, 20 bp, Artificial Sequence
  chemically synthesized
gaatgcttgtgatttttgca

SEQ ID NO: 580299 - DNA, 20 bp, Artificial Sequence
  chemically synthesized
ttattggtgtataagaatgc

SEQ ID NO: 580300 - DNA, 20 bp, Artificial Sequence
  chemically synthesized
tgtctgttattggtgtataa

SEQ ID NO: 580301 - DNA, 20 bp, Artificial Sequence
  chemically synthesized
agttcactcatgatttggct

SEQ ID NO: 580302 - DNA, 20 bp, Artificial Sequence
  chemically synthesized
aattgtgaatgagagttcac

SEQ ID NO: 580303 - DNA, 20 bp, Artificial Sequence
  chemically synthesized
atgagtgaactctcattcac

SEQ ID NO: 580304 - DNA, 20 bp, Artificial Sequence
  chemically synthesized
cctcttttatttccttgagc

SEQ ID NO: 580305 - DNA, 20 bp, Artificial Sequence
  chemically synthesized
tgagcatggaatgttcttcc

SEQ ID NO: 580306 - DNA, 20 bp, Artificial Sequence
  chemically synthesized
cagtatggccattttcacga

SEQ ID NO: 580307 - DNA, 20 bp, Artificial Sequence
  chemically synthesized
ccatactgcccaaggaaatt

SEQ ID NO: 580308 - DNA, 20 bp, Artificial Sequence
  chemically synthesized
attctgtgaagaaagtcatt

SEQ ID NO: 580309 - DNA, 20 bp, Artificial Sequence
  chemically synthesized
tggttccatatgaactttaa

SEQ ID NO: 580310 - DNA, 20 bp, Artificial Sequence
  chemically synthesized
tccagctttgttcttttggc

SEQ ID NO: 580311 - DNA, 20 bp, Artificial Sequence
  chemically synthesized
aagtcaggtagcgtgatgcc

SEQ ID NO: 580312 - DNA, 20 bp, Artificial Sequence
  chemically synthesized
tggttaccgtagccttgtag

SEQ ID NO: 580313 - DNA, 20 bp, Artificial Sequence
  chemically synthesized
ctgttttggtaccagtacca

SEQ ID NO: 580314 - DNA, 20 bp, Artificial Sequence
  chemically synthesized
tctgttccattggtgtatat

SEQ ID NO: 580315 - DNA, 20 bp, Artificial Sequence
  chemically synthesized
ttccccatttcttgtttttg

SEQ ID NO: 580316 - DNA, 20 bp, Artificial Sequence
  chemically synthesized
gacaaaaacaagaaatgggg

SEQ ID NO: 580317 - DNA, 20 bp, Artificial Sequence
  chemically synthesized
tagggaatcctttccccatt

SEQ ID NO: 580318 - DNA, 20 bp, Artificial Sequence
  chemically synthesized
cagctctctacatatggcta

SEQ ID NO: 580319 - DNA, 20 bp, Artificial Sequence
  chemically synthesized
tatatggtataaggaaggga

SEQ ID NO: 580320 - DNA, 20 bp, Artificial Sequence
  chemically synthesized
atatacaaaaattaattcaa

SEQ ID NO: 580321 - DNA, 20 bp, Artificial Sequence
  chemically synthesized
aggttttcttctagggtttt

SEQ ID NO: 580322 - DNA, 20 bp, Artificial Sequence
  chemically synthesized
gtattgcctaggttttcttc

SEQ ID NO: 580323 - DNA, 20 bp, Artificial Sequence
  chemically synthesized
tacgtcctgaatggtattgc

SEQ ID NO: 580324 - DNA, 20 bp, Artificial Sequence
  chemically synthesized
gcttttgttgccattgcttt

SEQ ID NO: 580325 - DNA, 20 bp, Artificial Sequence
  chemically synthesized
tccgttttggcttttgttgc

SEQ ID NO: 580326 - DNA, 20 bp, Artificial Sequence
  chemically synthesized
attagatcccatttgtccgt

SEQ ID NO: 580327 - DNA, 20 bp, Artificial Sequence
  chemically synthesized
agtttcattagatcccattt

SEQ ID NO: 580328 - DNA, 20 bp, Artificial Sequence
  chemically synthesized
aatgggatctaatgaaacta

SEQ ID NO: 580329 - DNA, 20 bp, Artificial Sequence
  chemically synthesized
cttttgctgtgcagaagctc

SEQ ID NO: 580330 - DNA, 20 bp, Artificial Sequence
  chemically synthesized
ggctgcctgttcactctgat

SEQ ID NO: 580331 - DNA, 20 bp, Artificial Sequence
  chemically synthesized
tattagccctttgtcagatg

SEQ ID NO: 580332 - DNA, 20 bp, Artificial Sequence
  chemically synthesized
gtaagtttgtttgagttctt

SEQ ID NO: 580333 - DNA, 20 bp, Artificial Sequence
  chemically synthesized
ttgtttgttttttcttgtaa

SEQ ID NO: 580334 - DNA, 20 bp, Artificial Sequence
  chemically synthesized
ggggttgtttgttttttctt

SEQ ID NO: 580335 - DNA, 20 bp, Artificial Sequence
  chemically synthesized
gcccactttttgatggggtt

SEQ ID NO: 580336 - DNA, 20 bp, Artificial Sequence
  chemically synthesized
cttcgcccactttttgatgg

SEQ ID NO: 580337 - DNA, 20 bp, Artificial Sequence
  chemically synthesized
tatctcattgtggttttgat

SEQ ID NO: 580338 - DNA, 20 bp, Artificial Sequence
  chemically synthesized
gagatggtatctcattgtgg

SEQ ID NO: 580339 - DNA, 20 bp, Artificial Sequence
  chemically synthesized
ggtgtgagatggtatctcat

SEQ ID NO: 580340 - DNA, 20 bp, Artificial Sequence
  chemically synthesized
cctgttgtttcctgactttt

SEQ ID NO: 580341 - DNA, 20 bp, Artificial Sequence
  chemically synthesized
tccacatcctctccagcacc

SEQ ID NO: 580342 - DNA, 20 bp, Artificial Sequence
  chemically synthesized
ctgacttccacaatggttga

SEQ ID NO: 580343 - DNA, 20 bp, Artificial Sequence
  chemically synthesized
aaccattgtggaagtcagtg

SEQ ID NO: 580344 - DNA, 20 bp, Artificial Sequence
  chemically synthesized
ccattactgggtatataccc

SEQ ID NO: 580345 - DNA, 20 bp, Artificial Sequence
  chemically synthesized
gtgcatgtatctttacagca

SEQ ID NO: 580346 - DNA, 20 bp, Artificial Sequence
  chemically synthesized
ctgtaaagatacatgcacag

SEQ ID NO: 580347 - DNA, 20 bp, Artificial Sequence
  chemically synthesized
cagtctatcattgatggaca

SEQ ID NO: 580348 - DNA, 20 bp, Artificial Sequence
  chemically synthesized
caaatgtccatcaatgatag

SEQ ID NO: 580349 - DNA, 20 bp, Artificial Sequence
  chemically synthesized
gtttgctgagaaagatgatt

SEQ ID NO: 580350 - DNA, 20 bp, Artificial Sequence
  chemically synthesized
ttgtgatagtttgctgagaa

SEQ ID NO: 580351 - DNA, 20 bp, Artificial Sequence
  chemically synthesized
gtttggttttctgtccttgt

SEQ ID NO: 580352 - DNA, 20 bp, Artificial Sequence
  chemically synthesized
atgagtgagaacatgcggtg

SEQ ID NO: 580353 - DNA, 20 bp, Artificial Sequence
  chemically synthesized
cacctatgagtgagaacatg

SEQ ID NO: 580354 - DNA, 20 bp, Artificial Sequence
  chemically synthesized
agggtacatgtgcacaactt

SEQ ID NO: 580355 - DNA, 20 bp, Artificial Sequence
  chemically synthesized
actctccctcctcccacatt

SEQ ID NO: 580356 - DNA, 20 bp, Artificial Sequence
  chemically synthesized
ataagctgataataacttaa

SEQ ID NO: 580357 - DNA, 20 bp, Artificial Sequence
  chemically synthesized
acaatcaaatttaagttatt

SEQ ID NO: 580358 - DNA, 20 bp, Artificial Sequence
  chemically synthesized
taagttattatcagcttata

SEQ ID NO: 580359 - DNA, 20 bp, Artificial Sequence
  chemically synthesized
tttgtgctttgtggatactc

SEQ ID NO: 580360 - DNA, 20 bp, Artificial Sequence
  chemically synthesized
ttcatgtatgtattataagt

SEQ ID NO: 580361 - DNA, 20 bp, Artificial Sequence
  chemically synthesized
ttatcattcatgtatgtatt

SEQ ID NO: 580362 - DNA, 20 bp, Artificial Sequence
  chemically synthesized
gtagtagtatactttgggtc

SEQ ID NO: 580363 - DNA, 20 bp, Artificial Sequence
  chemically synthesized
gctgtcttcctttgtgtttt

SEQ ID NO: 580364 - DNA, 20 bp, Artificial Sequence
  chemically synthesized
tcctctattgctgtcttcct

SEQ ID NO: 580365 - DNA, 20 bp, Artificial Sequence
  chemically synthesized
tcattgtttcctggttgtct

SEQ ID NO: 580366 - DNA, 20 bp, Artificial Sequence
  chemically synthesized
cttactagtgtcattttgtt

SEQ ID NO: 580367 - DNA, 20 bp, Artificial Sequence
  chemically synthesized
ccatcattattttgaatgta

SEQ ID NO: 580368 - DNA, 20 bp, Artificial Sequence
  chemically synthesized
cactctatgccttttgattg

SEQ ID NO: 580369 - DNA, 20 bp, Artificial Sequence
  chemically synthesized
ccactcaaccactctatgcc

SEQ ID NO: 580370 - DNA, 20 bp, Artificial Sequence
  chemically synthesized
caaaaggcatagagtggttg

SEQ ID NO: 580371 - DNA, 20 bp, Artificial Sequence
  chemically synthesized
gtaggcagcacatatttggg

SEQ ID NO: 580372 - DNA, 20 bp, Artificial Sequence
  chemically synthesized
cactttgaacagatttgacc

SEQ ID NO: 580373 - DNA, 20 bp, Artificial Sequence
  chemically synthesized
tgatgttctttgtcactttg

SEQ ID NO: 580374 - DNA, 20 bp, Artificial Sequence
  chemically synthesized
tatttaggtgctctgatttg

SEQ ID NO: 580375 - DNA, 20 bp, Artificial Sequence
  chemically synthesized
ttgctttatatatttaggtg

SEQ ID NO: 580376 - DNA, 20 bp, Artificial Sequence
  chemically synthesized
ttcccttcagatcccttaat

SEQ ID NO: 580377 - DNA, 20 bp, Artificial Sequence
  chemically synthesized
atgtttcccttcagatccct

SEQ ID NO: 580378 - DNA, 20 bp, Artificial Sequence
  chemically synthesized
tgctattattatgttatagg

SEQ ID NO: 580379 - DNA, 20 bp, Artificial Sequence
  chemically synthesized
ttcttatgaatttttctgtc

SEQ ID NO: 580380 - DNA, 20 bp, Artificial Sequence
  chemically synthesized
tctaaaatgtcattcaagtc

SEQ ID NO: 580381 - DNA, 20 bp, Artificial Sequence
  chemically synthesized
tgccctgaacagtaggaaaa

SEQ ID NO: 580382 - DNA, 20 bp, Artificial Sequence
  chemically synthesized
gtggtcagaaaagatacacg

SEQ ID NO: 580383 - DNA, 20 bp, Artificial Sequence
  chemically synthesized
ttttatatgatttctcatgt

SEQ ID NO: 580384 - DNA, 20 bp, Artificial Sequence
  chemically synthesized
tccacatatttcttaatttt

SEQ ID NO: 580385 - DNA, 20 bp, Artificial Sequence
  chemically synthesized
aattgtttaggagcatattg

SEQ ID NO: 580386 - DNA, 20 bp, Artificial Sequence
  chemically synthesized
ccaataattgtttaggagca

SEQ ID NO: 580387 - DNA, 20 bp, Artificial Sequence
  chemically synthesized
atttcttcttttgacccaat

SEQ ID NO: 580388 - DNA, 20 bp, Artificial Sequence
  chemically synthesized
tttctatgttgtgttttcat

SEQ ID NO: 580389 - DNA, 20 bp, Artificial Sequence
  chemically synthesized
cccccagaagtttttctatg

SEQ ID NO: 580390 - DNA, 20 bp, Artificial Sequence
  chemically synthesized
gcactgcttttgctaccccc

SEQ ID NO: 580391 - DNA, 20 bp, Artificial Sequence
  chemically synthesized
agcaaaagcagtgctaagag

SEQ ID NO: 580392 - DNA, 20 bp, Artificial Sequence
  chemically synthesized
gatataaacttccctcttag

SEQ ID NO: 580393 - DNA, 20 bp, Artificial Sequence
  chemically synthesized
gcttaattcattcttctttt

SEQ ID NO: 580394 - DNA, 20 bp, Artificial Sequence
  chemically synthesized
ttttcttctttctgctaact

SEQ ID NO: 580395 - DNA, 20 bp, Artificial Sequence
  chemically synthesized
agttttattgactttttttc

SEQ ID NO: 580396 - DNA, 20 bp, Artificial Sequence
  chemically synthesized
aaaagtcaataaaactaaaa

SEQ ID NO: 580397 - DNA, 20 bp, Artificial Sequence
  chemically synthesized
agcttttcaaaaaaccaact

SEQ ID NO: 580398 - DNA, 20 bp, Artificial Sequence
  chemically synthesized
ctaaggatttgtcaattgtg

SEQ ID NO: 580399 - DNA, 20 bp, Artificial Sequence
  chemically synthesized
tctagctaaggatttgtcaa

SEQ ID NO: 580400 - DNA, 20 bp, Artificial Sequence
  chemically synthesized
ctcttcattcttagtctagc

SEQ ID NO: 580401 - DNA, 20 bp, Artificial Sequence
  chemically synthesized
tgtcttctctttgatttctg

SEQ ID NO: 580402 - DNA, 20 bp, Artificial Sequence
  chemically synthesized
cataatgtcttctctttgat

SEQ ID NO: 580403 - DNA, 20 bp, Artificial Sequence
  chemically synthesized
tatcagtcataatgtcttct

SEQ ID NO: 580404 - DNA, 20 bp, Artificial Sequence
  chemically synthesized
aattttcattattcagtttt

SEQ ID NO: 580405 - DNA, 20 bp, Artificial Sequence
  chemically synthesized
cagatttccaattttcatta

SEQ ID NO: 580406 - DNA, 20 bp, Artificial Sequence
  chemically synthesized
ccttagctgttactggtctt

SEQ ID NO: 580407 - DNA, 20 bp, Artificial Sequence
  chemically synthesized
aacagctaaggaaagagtta

SEQ ID NO: 580408 - DNA, 20 bp, Artificial Sequence
  chemically synthesized
caaaggaaagctcaagacca

SEQ ID NO: 580409 - DNA, 20 bp, Artificial Sequence
  chemically synthesized
tcccatgaagccatctggtc

SEQ ID NO: 580410 - DNA, 20 bp, Artificial Sequence
  chemically synthesized
atttgtgttaggtcttcttt

SEQ ID NO: 580411 - DNA, 20 bp, Artificial Sequence
  chemically synthesized
agttttccaaaagagtttga

SEQ ID NO: 580412 - DNA, 20 bp, Artificial Sequence
  chemically synthesized
cttcctctttagttttccaa

SEQ ID NO: 580413 - DNA, 20 bp, Artificial Sequence
  chemically synthesized
cttttggaaaactaaagagg

SEQ ID NO: 580414 - DNA, 20 bp, Artificial Sequence
  chemically synthesized
tttggacgaatcccttcctc

SEQ ID NO: 580415 - DNA, 20 bp, Artificial Sequence
  chemically synthesized
ctttccttgtagtgtctttg

SEQ ID NO: 580416 - DNA, 20 bp, Artificial Sequence
  chemically synthesized
tttcattcgtgatattggcc

SEQ ID NO: 580417 - DNA, 20 bp, Artificial Sequence
  chemically synthesized
aatactagtgaaccatattt

SEQ ID NO: 580418 - DNA, 20 bp, Artificial Sequence
  chemically synthesized
ccatatttaatagtttatta

SEQ ID NO: 580419 - DNA, 20 bp, Artificial Sequence
  chemically synthesized
ggattattcaccatgaccaa

SEQ ID NO: 580420 - DNA, 20 bp, Artificial Sequence
  chemically synthesized
gatttatccctgggatagaa

SEQ ID NO: 580421 - DNA, 20 bp, Artificial Sequence
  chemically synthesized
caatatatgcaaattaataa

SEQ ID NO: 580422 - DNA, 20 bp, Artificial Sequence
  chemically synthesized
tgagtttattaaaatgatca

SEQ ID NO: 580423 - DNA, 20 bp, Artificial Sequence
  chemically synthesized
aattttgtcaaatgctcttt

SEQ ID NO: 580424 - DNA, 20 bp, Artificial Sequence
  chemically synthesized
tcttctatacctaatttgct

SEQ ID NO: 580425 - DNA, 20 bp, Artificial Sequence
  chemically synthesized
ttagctgtgggcttgtaatt

SEQ ID NO: 580426 - DNA, 20 bp, Artificial Sequence
  chemically synthesized
tgttgtgcatgatgttagct

SEQ ID NO: 580427 - DNA, 20 bp, Artificial Sequence
  chemically synthesized
atgcacaacagtaaaacgta

SEQ ID NO: 580428 - DNA, 20 bp, Artificial Sequence
  chemically synthesized
tgatcttagagaaaagcctt

SEQ ID NO: 580429 - DNA, 20 bp, Artificial Sequence
  chemically synthesized
aagatgcccactctccccac

SEQ ID NO: 580430 - DNA, 20 bp, Artificial Sequence
  chemically synthesized
ggcaattttacttcatcctt

SEQ ID NO: 580431 - DNA, 20 bp, Artificial Sequence
  chemically synthesized
gagtccttaggatttgctgt

SEQ ID NO: 580432 - DNA, 20 bp, Artificial Sequence
  chemically synthesized
aacagttttcagtggagtcc

SEQ ID NO: 580433 - DNA, 20 bp, Artificial Sequence
  chemically synthesized
taaacttgtgtatgaattct

SEQ ID NO: 580434 - DNA, 20 bp, Artificial Sequence
  chemically synthesized
aaaactgttagaattcatac

SEQ ID NO: 580435 - DNA, 20 bp, Artificial Sequence
  chemically synthesized
tatcgctactgatttttgta

SEQ ID NO: 580436 - DNA, 20 bp, Artificial Sequence
  chemically synthesized
acaataacaattgttatcgc

SEQ ID NO: 580437 - DNA, 20 bp, Artificial Sequence
  chemically synthesized
tcagtagcgataacaattgt

SEQ ID NO: 580438 - DNA, 20 bp, Artificial Sequence
  chemically synthesized
tttccttaatttctatttta

SEQ ID NO: 580439 - DNA, 20 bp, Artificial Sequence
  chemically synthesized
tttcatgctattataagtga

SEQ ID NO: 580440 - DNA, 20 bp, Artificial Sequence
  chemically synthesized
attttttcatgctattataa

SEQ ID NO: 580441 - DNA, 20 bp, Artificial Sequence
  chemically synthesized
aatttctttcgtcagtgtct

SEQ ID NO: 580442 - DNA, 20 bp, Artificial Sequence
  chemically synthesized
gaagatgacacaaataaatg

SEQ ID NO: 580443 - DNA, 20 bp, Artificial Sequence
  chemically synthesized
ttgttaaacataaagcaatc

SEQ ID NO: 580444 - DNA, 20 bp, Artificial Sequence
  chemically synthesized
tgtcgaatctttagattgct

SEQ ID NO: 580445 - DNA, 20 bp, Artificial Sequence
  chemically synthesized
agtattgtgtcgaatcttta

SEQ ID NO: 580446 - DNA, 20 bp, Artificial Sequence
  chemically synthesized
tgttagtattgtgtcgaatc

SEQ ID NO: 580447 - DNA, 20 bp, Artificial Sequence
  chemically synthesized
aaattctataaagaacaata

SEQ ID NO: 580448 - DNA, 20 bp, Artificial Sequence
  chemically synthesized
tttgtggttccatgcaaatt

SEQ ID NO: 580449 - DNA, 20 bp, Artificial Sequence
  chemically synthesized
attttattctttttagtaaa

SEQ ID NO: 580450 - DNA, 20 bp, Artificial Sequence
  chemically synthesized
aaaattggaagtatgtcact

SEQ ID NO: 580451 - DNA, 20 bp, Artificial Sequence
  chemically synthesized
tgccatgctgttttgattat

SEQ ID NO: 580452 - DNA, 20 bp, Artificial Sequence
  chemically synthesized
tttatgtacttgccatgctg

SEQ ID NO: 580453 - DNA, 20 bp, Artificial Sequence
  chemically synthesized
ctgtttttatgtacttgcca

SEQ ID NO: 580454 - DNA, 20 bp, Artificial Sequence
  chemically synthesized
ctctttgtcttattccattg

SEQ ID NO: 580455 - DNA, 20 bp, Artificial Sequence
  chemically synthesized
aatcaattgatcaaaggtgt

SEQ ID NO: 580456 - DNA, 20 bp, Artificial Sequence
  chemically synthesized
aaacctacacacctttgatc

SEQ ID NO: 580457 - DNA, 20 bp, Artificial Sequence
  chemically synthesized
ttttattctgtatgtgaaca

SEQ ID NO: 580458 - DNA, 20 bp, Artificial Sequence
  chemically synthesized
tataaggggtgagataaggg

SEQ ID NO: 580459 - DNA, 20 bp, Artificial Sequence
  chemically synthesized
ttatacaagaatcaactcaa

SEQ ID NO: 580460 - DNA, 20 bp, Artificial Sequence
  chemically synthesized
taaggctttaatccattttg

SEQ ID NO: 580461 - DNA, 20 bp, Artificial Sequence
  chemically synthesized
ttagtttcaggtattacatt

SEQ ID NO: 580462 - DNA, 20 bp, Artificial Sequence
  chemically synthesized
tctcttatgtttttgtagtt

SEQ ID NO: 580463 - DNA, 20 bp, Artificial Sequence
  chemically synthesized
gagctcttctcttatgtttt

SEQ ID NO: 580464 - DNA, 20 bp, Artificial Sequence
  chemically synthesized
aatgtcatggagctcttctc

SEQ ID NO: 580465 - DNA, 20 bp, Artificial Sequence
  chemically synthesized
tccatgacattggtctgggc

SEQ ID NO: 580466 - DNA, 20 bp, Artificial Sequence
  chemically synthesized
cttacctatttttgtgttga

SEQ ID NO: 580467 - DNA, 20 bp, Artificial Sequence
  chemically synthesized
atcttacttacctatttttg

SEQ ID NO: 580468 - DNA, 20 bp, Artificial Sequence
  chemically synthesized
atcaacacaaaaataggtaa

SEQ ID NO: 580469 - DNA, 20 bp, Artificial Sequence
  chemically synthesized
agtaagattgcatcaaacta

SEQ ID NO: 580470 - DNA, 20 bp, Artificial Sequence
  chemically synthesized
tcctttgctgtgcaaagctt

SEQ ID NO: 580471 - DNA, 20 bp, Artificial Sequence
  chemically synthesized
taattgtttcctttgctgtg

SEQ ID NO: 580472 - DNA, 20 bp, Artificial Sequence
  chemically synthesized
ggttgtctctttattccatt

SEQ ID NO: 580473 - DNA, 20 bp, Artificial Sequence
  chemically synthesized
aatggaataaagagacaacc

SEQ ID NO: 580474 - DNA, 20 bp, Artificial Sequence
  chemically synthesized
atattagcaccttatctaat

SEQ ID NO: 580475 - DNA, 20 bp, Artificial Sequence
  chemically synthesized
tatttgttttcttgttattg

SEQ ID NO: 580476 - DNA, 20 bp, Artificial Sequence
  chemically synthesized
cccatttttttattagggtt

SEQ ID NO: 580477 - DNA, 20 bp, Artificial Sequence
  chemically synthesized
tatatatatatatatatata

SEQ ID NO: 580478 - DNA, 20 bp, Artificial Sequence
  chemically synthesized
tgattttaatttgcattttt

SEQ ID NO: 580479 - DNA, 20 bp, Artificial Sequence
  chemically synthesized
agatatgaggtgatatctca

SEQ ID NO: 580480 - DNA, 20 bp, Artificial Sequence
  chemically synthesized
tgagatatcacctcatatct

SEQ ID NO: 580481 - DNA, 20 bp, Artificial Sequence
  chemically synthesized
acaatactaccaatagtgga

SEQ ID NO: 580482 - DNA, 20 bp, Artificial Sequence
  chemically synthesized
ggcctccataaagacagtat

SEQ ID NO: 580483 - DNA, 20 bp, Artificial Sequence
  chemically synthesized
ttttgagtatgtacccagaa

SEQ ID NO: 580484 - DNA, 20 bp, Artificial Sequence
  chemically synthesized
tgtagcactgttcacaacag

SEQ ID NO: 580485 - DNA, 20 bp, Artificial Sequence
  chemically synthesized
cgcatgttgatggacagtta

SEQ ID NO: 580486 - DNA, 20 bp, Artificial Sequence
  chemically synthesized
cattcgcatgttgatggaca

SEQ ID NO: 580487 - DNA, 20 bp, Artificial Sequence
  chemically synthesized
gcagtgattttcgttctgtg

SEQ ID NO: 580488 - DNA, 20 bp, Artificial Sequence
  chemically synthesized
cacaaataagtgagaacatg

SEQ ID NO: 580489 - DNA, 20 bp, Artificial Sequence
  chemically synthesized
tattctgtctccatgagttc

SEQ ID NO: 580490 - DNA, 20 bp, Artificial Sequence
  chemically synthesized
gtgtggaggtaggggatagg

SEQ ID NO: 580491 - DNA, 20 bp, Artificial Sequence
  chemically synthesized
aataactaaaagtacaatta

SEQ ID NO: 580492 - DNA, 20 bp, Artificial Sequence
  chemically synthesized
ttgtttgtagcacaaaggat

SEQ ID NO: 580493 - DNA, 20 bp, Artificial Sequence
  chemically synthesized
tggatgcctcattctccatg

SEQ ID NO: 580494 - DNA, 20 bp, Artificial Sequence
  chemically synthesized
tgcctcattctccatgatgt

SEQ ID NO: 580495 - DNA, 20 bp, Artificial Sequence
  chemically synthesized
atatatttacggggtacatg

SEQ ID NO: 580496 - DNA, 20 bp, Artificial Sequence
  chemically synthesized
attccaaatgacagaatttc

SEQ ID NO: 580497 - DNA, 20 bp, Artificial Sequence
  chemically synthesized
atgatatgtgtctctctgtg

SEQ ID NO: 580498 - DNA, 20 bp, Artificial Sequence
  chemically synthesized
catataatctcatttgtatg

SEQ ID NO: 580499 - DNA, 20 bp, Artificial Sequence
  chemically synthesized
tttttaaactgcacatacaa

SEQ ID NO: 580500 - DNA, 20 bp, Artificial Sequence
  chemically synthesized
tttttccatccacccaccac

SEQ ID NO: 580501 - DNA, 20 bp, Artificial Sequence
  chemically synthesized
tgggtggatggaaaaatgag

SEQ ID NO: 580502 - DNA, 20 bp, Artificial Sequence
  chemically synthesized
tatttccaaatagctaaaaa

SEQ ID NO: 580503 - DNA, 20 bp, Artificial Sequence
  chemically synthesized
aggtgatagatatgctatta

SEQ ID NO: 580504 - DNA, 20 bp, Artificial Sequence
  chemically synthesized
atagatatgctattagcctg

SEQ ID NO: 580505 - DNA, 20 bp, Artificial Sequence
  chemically synthesized
attattccacaatgtatata

SEQ ID NO: 580506 - DNA, 20 bp, Artificial Sequence
  chemically synthesized
ctatattatggggtacattg

SEQ ID NO: 580507 - DNA, 20 bp, Artificial Sequence
  chemically synthesized
tattcattttaaaaatttta

SEQ ID NO: 580508 - DNA, 20 bp, Artificial Sequence
  chemically synthesized
atgctatcaacagtctagta

SEQ ID NO: 580509 - DNA, 20 bp, Artificial Sequence
  chemically synthesized
tagactgttgatagcatggc

SEQ ID NO: 580510 - DNA, 20 bp, Artificial Sequence
  chemically synthesized
ttgatatagatgagaaattg

SEQ ID NO: 580511 - DNA, 20 bp, Artificial Sequence
  chemically synthesized
tccatattattgtatgtagt

SEQ ID NO: 580512 - DNA, 20 bp, Artificial Sequence
  chemically synthesized
ttccccccaacaatatgttt

SEQ ID NO: 580513 - DNA, 20 bp, Artificial Sequence
  chemically synthesized
ctgtatttttccccccaaca

SEQ ID NO: 580514 - DNA, 20 bp, Artificial Sequence
  chemically synthesized
acagacaagtagatatgact

SEQ ID NO: 580515 - DNA, 20 bp, Artificial Sequence
  chemically synthesized
aaaagttttctattactttt

SEQ ID NO: 580516 - DNA, 20 bp, Artificial Sequence
  chemically synthesized
gtgactactatccttacttc

SEQ ID NO: 580517 - DNA, 20 bp, Artificial Sequence
  chemically synthesized
agaagacatgaagggggatc

SEQ ID NO: 580518 - DNA, 20 bp, Artificial Sequence
  chemically synthesized
gagcttctggctatattata

SEQ ID NO: 580519 - DNA, 20 bp, Artificial Sequence
  chemically synthesized
tggctatattatattatgtt

SEQ ID NO: 580520 - DNA, 20 bp, Artificial Sequence
  chemically synthesized
caccatttattaaataggga

SEQ ID NO: 580521 - DNA, 20 bp, Artificial Sequence
  chemically synthesized
atcgtattgtgtttgtagca

SEQ ID NO: 580522 - DNA, 20 bp, Artificial Sequence
  chemically synthesized
atcattctgctacaaacaca

SEQ ID NO: 580523 - DNA, 20 bp, Artificial Sequence
  chemically synthesized
aatgtacagtcaaaatcgta

SEQ ID NO: 580524 - DNA, 20 bp, Artificial Sequence
  chemically synthesized
cttattggacagtgaactgg

SEQ ID NO: 580525 - DNA, 20 bp, Artificial Sequence
  chemically synthesized
tattaaatagcagaatagct

SEQ ID NO: 580526 - DNA, 20 bp, Artificial Sequence
  chemically synthesized
cttttattaaatagcagaat

SEQ ID NO: 580527 - DNA, 20 bp, Artificial Sequence
  chemically synthesized
taaaagaaacaaagcagtac

SEQ ID NO: 580528 - DNA, 20 bp, Artificial Sequence
  chemically synthesized
tataacaatcaattgtactg

SEQ ID NO: 580529 - DNA, 20 bp, Artificial Sequence
  chemically synthesized
actactataacaatcaattg

SEQ ID NO: 580530 - DNA, 20 bp, Artificial Sequence
  chemically synthesized
tatatacaaaagacaatttt

SEQ ID NO: 580531 - DNA, 20 bp, Artificial Sequence
  chemically synthesized
tgatgatcttcagattttag

SEQ ID NO: 580532 - DNA, 20 bp, Artificial Sequence
  chemically synthesized
cgctctgatgatcttcagat

SEQ ID NO: 580533 - DNA, 20 bp, Artificial Sequence
  chemically synthesized
acagcttcgctctgatgatc

SEQ ID NO: 580534 - DNA, 20 bp, Artificial Sequence
  chemically synthesized
cactgatccacttttaggat

SEQ ID NO: 580535 - DNA, 20 bp, Artificial Sequence
  chemically synthesized
tggccaaatacattgccata

SEQ ID NO: 580536 - DNA, 20 bp, Artificial Sequence
  chemically synthesized
tggccactagagcccatatt

SEQ ID NO: 580537 - DNA, 20 bp, Artificial Sequence
  chemically synthesized
tacaaacatgcacagattgt

SEQ ID NO: 580538 - DNA, 20 bp, Artificial Sequence
  chemically synthesized
cataaacccagacaatctgt

SEQ ID NO: 580539 - DNA, 20 bp, Artificial Sequence
  chemically synthesized
gctcttcaattacaaacatg

SEQ ID NO: 580540 - DNA, 20 bp, Artificial Sequence
  chemically synthesized
tctcacaaaggtccgtcatg

SEQ ID NO: 580541 - DNA, 20 bp, Artificial Sequence
  chemically synthesized
tttactgcacaaattagtcg

SEQ ID NO: 580542 - DNA, 20 bp, Artificial Sequence
  chemically synthesized
agactgagacccagcatgtg

SEQ ID NO: 580543 - DNA, 20 bp, Artificial Sequence
  chemically synthesized
tgtggttcttgacatgattg

SEQ ID NO: 580544 - DNA, 20 bp, Artificial Sequence
  chemically synthesized
ctgcaatattgtggttcttg

SEQ ID NO: 580545 - DNA, 20 bp, Artificial Sequence
  chemically synthesized
tgcagagaaagaaacagttc

SEQ ID NO: 580546 - DNA, 20 bp, Artificial Sequence
  chemically synthesized
ggttcgtattcaatcaactg

SEQ ID NO: 580547 - DNA, 20 bp, Artificial Sequence
  chemically synthesized
atacgaaccaatctttcact

SEQ ID NO: 580548 - DNA, 20 bp, Artificial Sequence
  chemically synthesized
tagtctaaaaaacttgaagt

SEQ ID NO: 580549 - DNA, 20 bp, Artificial Sequence
  chemically synthesized
cttcaagttttttagactag

SEQ ID NO: 580550 - DNA, 20 bp, Artificial Sequence
  chemically synthesized
gaatgttatttatacacaag

SEQ ID NO: 580551 - DNA, 20 bp, Artificial Sequence
  chemically synthesized
cgagaattagaagtctgtgt

SEQ ID NO: 580552 - DNA, 20 bp, Artificial Sequence
  chemically synthesized
caagactaactgctagtcaa

SEQ ID NO: 580553 - DNA, 20 bp, Artificial Sequence
  chemically synthesized
agttagtcttgggttataac

SEQ ID NO: 580554 - DNA, 20 bp, Artificial Sequence
  chemically synthesized
ccctggattagcgatgaaat

SEQ ID NO: 580555 - DNA, 20 bp, Artificial Sequence
  chemically synthesized
tagtggatttaaatgggaaa

SEQ ID NO: 580556 - DNA, 20 bp, Artificial Sequence
  chemically synthesized
aaaagttgatttgccacgat

SEQ ID NO: 580557 - DNA, 20 bp, Artificial Sequence
  chemically synthesized
ggttctgcagttgtcattat

SEQ ID NO: 580558 - DNA, 20 bp, Artificial Sequence
  chemically synthesized
ccttgctttagtaggatcct

SEQ ID NO: 580559 - DNA, 20 bp, Artificial Sequence
  chemically synthesized
atcctactaaagcaaggtgc

SEQ ID NO: 580560 - DNA, 20 bp, Artificial Sequence
  chemically synthesized
tatacagagaagcagtagca

SEQ ID NO: 580561 - DNA, 20 bp, Artificial Sequence
  chemically synthesized
gtttgttgataactataatt

SEQ ID NO: 580562 - DNA, 20 bp, Artificial Sequence
  chemically synthesized
tgcactccctagcagatcgt

SEQ ID NO: 580563 - DNA, 20 bp, Artificial Sequence
  chemically synthesized
aggtagaaaatgccaaggtg

SEQ ID NO: 580564 - DNA, 20 bp, Artificial Sequence
  chemically synthesized
tcactcactcaaatgacctc

SEQ ID NO: 580565 - DNA, 20 bp, Artificial Sequence
  chemically synthesized
gatcccaattgcagttaaga

SEQ ID NO: 580566 - DNA, 20 bp, Artificial Sequence
  chemically synthesized
cctttttcctgatcccaaca

SEQ ID NO: 580567 - DNA, 20 bp, Artificial Sequence
  chemically synthesized
gatcatgcctaacatttttt

SEQ ID NO: 580568 - DNA, 20 bp, Artificial Sequence
  chemically synthesized
ataatggtggtttccttgtt

SEQ ID NO: 580569 - DNA, 20 bp, Artificial Sequence
  chemically synthesized
ggttacaataatggtggttt

SEQ ID NO: 580570 - DNA, 20 bp, Artificial Sequence
  chemically synthesized
ttgtacaaggttacaataat

SEQ ID NO: 580571 - DNA, 20 bp, Artificial Sequence
  chemically synthesized
tactctaggtatagttgtgt

SEQ ID NO: 580572 - DNA, 20 bp, Artificial Sequence
  chemically synthesized
agagtaatgtaagcataact

SEQ ID NO: 580573 - DNA, 20 bp, Artificial Sequence
  chemically synthesized
tttgtatgtcaaacattgag

SEQ ID NO: 580574 - DNA, 20 bp, Artificial Sequence
  chemically synthesized
gaggaaagtccaaataataa

SEQ ID NO: 580575 - DNA, 20 bp, Artificial Sequence
  chemically synthesized
tagataggtcttccacagaa

SEQ ID NO: 580576 - DNA, 20 bp, Artificial Sequence
  chemically synthesized
tgtggaagacctatctatag

SEQ ID NO: 580577 - DNA, 20 bp, Artificial Sequence
  chemically synthesized
ctatagttaagctttgcaaa

SEQ ID NO: 580578 - DNA, 20 bp, Artificial Sequence
  chemically synthesized
ttgagttgaaacttcttttg

SEQ ID NO: 580579 - DNA, 20 bp, Artificial Sequence
  chemically synthesized
atatatgtttcttcctcttt

SEQ ID NO: 580580 - DNA, 20 bp, Artificial Sequence
  chemically synthesized
actagctacatggttagcat

SEQ ID NO: 580581 - DNA, 20 bp, Artificial Sequence
  chemically synthesized
atatagaaaaggaggaatgt

SEQ ID NO: 580582 - DNA, 20 bp, Artificial Sequence
  chemically synthesized
gccaataactcccctctgtt

SEQ ID NO: 580583 - DNA, 20 bp, Artificial Sequence
  chemically synthesized
tttatgtgccaataactccc

SEQ ID NO: 580584 - DNA, 20 bp, Artificial Sequence
  chemically synthesized
caacttggtcatcatagtgg

SEQ ID NO: 580585 - DNA, 20 bp, Artificial Sequence
  chemically synthesized
cctggccactatgatgacca

SEQ ID NO: 580586 - DNA, 20 bp, Artificial Sequence
  chemically synthesized
tgtttctgcattctagcttt

SEQ ID NO: 580587 - DNA, 20 bp, Artificial Sequence
  chemically synthesized
atgcttggctgtttctgcat

SEQ ID NO: 580588 - DNA, 20 bp, Artificial Sequence
  chemically synthesized
tgaacttaaccaaaatgctt

SEQ ID NO: 580589 - DNA, 20 bp, Artificial Sequence
  chemically synthesized
ggcttccatgaacttaacca

SEQ ID NO: 580590 - DNA, 20 bp, Artificial Sequence
  chemically synthesized
atttagtcatttgttctggg

SEQ ID NO: 580591 - DNA, 20 bp, Artificial Sequence
  chemically synthesized
atattagcctaacatttaag

SEQ ID NO: 580592 - DNA, 20 bp, Artificial Sequence
  chemically synthesized
tttggaacatggaaaagatc

SEQ ID NO: 580593 - DNA, 20 bp, Artificial Sequence
  chemically synthesized
acagtttagtgctattttca

SEQ ID NO: 580594 - DNA, 20 bp, Artificial Sequence
  chemically synthesized
acattatttccttttatctt

SEQ ID NO: 580595 - DNA, 20 bp, Artificial Sequence
  chemically synthesized
tccaacagtgttaccaaagt

SEQ ID NO: 580596 - DNA, 20 bp, Artificial Sequence
  chemically synthesized
gtaacactgttggacttttc

SEQ ID NO: 580597 - DNA, 20 bp, Artificial Sequence
  chemically synthesized
atcctcctttgctttatgac

SEQ ID NO: 580598 - DNA, 20 bp, Artificial Sequence
  chemically synthesized
tgagtcataaagcaaaggag

SEQ ID NO: 580599 - DNA, 20 bp, Artificial Sequence
  chemically synthesized
ggatcatccaatctatcctc

SEQ ID NO: 580600 - DNA, 20 bp, Artificial Sequence
  chemically synthesized
atagattggatgatccctgg

SEQ ID NO: 580601 - DNA, 20 bp, Artificial Sequence
  chemically synthesized
ctggagatgttttcagctct

SEQ ID NO: 580602 - DNA, 20 bp, Artificial Sequence
  chemically synthesized
cagctctaacagtttgtgaa

SEQ ID NO: 580603 - DNA, 20 bp, Artificial Sequence
  chemically synthesized
agagctgaaagctcacctta

SEQ ID NO: 580604 - DNA, 20 bp, Artificial Sequence
  chemically synthesized
cttcacaaaaaccttgtaag

SEQ ID NO: 580605 - DNA, 20 bp, Artificial Sequence
  chemically synthesized
gcatgactgaatatatgacc

SEQ ID NO: 580606 - DNA, 20 bp, Artificial Sequence
  chemically synthesized
ggaacattttttaggttggc

SEQ ID NO: 580607 - DNA, 20 bp, Artificial Sequence
  chemically synthesized
caggagggaacattttttag

SEQ ID NO: 580608 - DNA, 20 bp, Artificial Sequence
  chemically synthesized
aatctcatgtgtattatgaa

SEQ ID NO: 580609 - DNA, 20 bp, Artificial Sequence
  chemically synthesized
aaactcatttcataatacac

SEQ ID NO: 580610 - DNA, 20 bp, Artificial Sequence
  chemically synthesized
tgttcacatttcttttgttt

SEQ ID NO: 580611 - DNA, 20 bp, Artificial Sequence
  chemically synthesized
tatttgttcacatttctttt

SEQ ID NO: 580612 - DNA, 20 bp, Artificial Sequence
  chemically synthesized
tcaatatttgttcacatttc

SEQ ID NO: 580613 - DNA, 20 bp, Artificial Sequence
  chemically synthesized
gagtgctcatgaacccactc

SEQ ID NO: 580614 - DNA, 20 bp, Artificial Sequence
  chemically synthesized
agcactcactgtacaattct

SEQ ID NO: 580615 - DNA, 20 bp, Artificial Sequence
  chemically synthesized
cacctcggcctcccaaagtg

SEQ ID NO: 580616 - DNA, 20 bp, Artificial Sequence
  chemically synthesized
ggtgaacggatcatgagatc

SEQ ID NO: 580617 - DNA, 20 bp, Artificial Sequence
  chemically synthesized
ttttgtatttttagtacaga

SEQ ID NO: 580618 - DNA, 20 bp, Artificial Sequence
  chemically synthesized
tgcctcagcctcccgagtag

SEQ ID NO: 580619 - DNA, 20 bp, Artificial Sequence
  chemically synthesized
tcgggaggctgaggcaggag

SEQ ID NO: 580620 - DNA, 20 bp, Artificial Sequence
  chemically synthesized
aacctctgccgcccgggttc

SEQ ID NO: 580621 - DNA, 20 bp, Artificial Sequence
  chemically synthesized
gcggcagaggttgcagtgag

SEQ ID NO: 580622 - DNA, 20 bp, Artificial Sequence
  chemically synthesized
tgcttaaataatacactgct

SEQ ID NO: 580623 - DNA, 20 bp, Artificial Sequence
  chemically synthesized
agaaaactgcttaaataata

SEQ ID NO: 580624 - DNA, 20 bp, Artificial Sequence
  chemically synthesized
acaaagcagtgtattattta

SEQ ID NO: 580625 - DNA, 20 bp, Artificial Sequence
  chemically synthesized
gtggtgttagtgattcagaa

SEQ ID NO: 580626 - DNA, 20 bp, Artificial Sequence
  chemically synthesized
tcttcattggaaagtggtgt

SEQ ID NO: 580627 - DNA, 20 bp, Artificial Sequence
  chemically synthesized
aaataccatctgtgggatat

SEQ ID NO: 580628 - DNA, 20 bp, Artificial Sequence
  chemically synthesized
gccatttccactcgtataag

SEQ ID NO: 580629 - DNA, 20 bp, Artificial Sequence
  chemically synthesized
ttatacgagtggaaatggca

SEQ ID NO: 580630 - DNA, 20 bp, Artificial Sequence
  chemically synthesized
acacattgtgactttgagca

SEQ ID NO: 580631 - DNA, 20 bp, Artificial Sequence
  chemically synthesized
taatctggtctttgacagtc

SEQ ID NO: 580632 - DNA, 20 bp, Artificial Sequence
  chemically synthesized
taatcaacagactgtcaaag

SEQ ID NO: 580633 - DNA, 20 bp, Artificial Sequence
  chemically synthesized
cttctaaagaaagctcattc

SEQ ID NO: 580634 - DNA, 20 bp, Artificial Sequence
  chemically synthesized
tttattaccaaaacaggaga

SEQ ID NO: 580635 - DNA, 20 bp, Artificial Sequence
  chemically synthesized
gggaagcaatacatacttcc

SEQ ID NO: 580636 - DNA, 20 bp, Artificial Sequence
  chemically synthesized
ataaaacatagggaagtatg

SEQ ID NO: 580637 - DNA, 20 bp, Artificial Sequence
  chemically synthesized
gaaagatgagctgggtgaga

SEQ ID NO: 580638 - DNA, 20 bp, Artificial Sequence
  chemically synthesized
tgagctgggtgagaggagga

SEQ ID NO: 580639 - DNA, 20 bp, Artificial Sequence
  chemically synthesized
tttaccactggttggaggat

SEQ ID NO: 580640 - DNA, 20 bp, Artificial Sequence
  chemically synthesized
cagtcataatgaaacatgta

SEQ ID NO: 580641 - DNA, 20 bp, Artificial Sequence
  chemically synthesized
tttaattaataaaacaactt

SEQ ID NO: 580642 - DNA, 20 bp, Artificial Sequence
  chemically synthesized
cacccccaaaagagaagtca

SEQ ID NO: 580643 - DNA, 20 bp, Artificial Sequence
  chemically synthesized
cttttgggggtgttggaaac

SEQ ID NO: 580644 - DNA, 20 bp, Artificial Sequence
  chemically synthesized
ttcaggctttcatcttaagc

SEQ ID NO: 580645 - DNA, 20 bp, Artificial Sequence
  chemically synthesized
atcaagcttttctcctaact

SEQ ID NO: 580646 - DNA, 20 bp, Artificial Sequence
  chemically synthesized
tgaaagcctgaagttaggag

SEQ ID NO: 580647 - DNA, 20 bp, Artificial Sequence
  chemically synthesized
tatttttgcatagatataca

SEQ ID NO: 580648 - DNA, 20 bp, Artificial Sequence
  chemically synthesized
gtatatctatgcaaaaatat

SEQ ID NO: 580649 - DNA, 20 bp, Artificial Sequence
  chemically synthesized
taggcctattatcacatcta

SEQ ID NO: 580650 - DNA, 20 bp, Artificial Sequence
  chemically synthesized
attataatggtcccctttag

SEQ ID NO: 580651 - DNA, 20 bp, Artificial Sequence
  chemically synthesized
ctagaattataatggtcccc

SEQ ID NO: 580652 - DNA, 20 bp, Artificial Sequence
  chemically synthesized
gaccattataattctagcac

SEQ ID NO: 580653 - DNA, 20 bp, Artificial Sequence
  chemically synthesized
gtgcaaatttacagtgatga

SEQ ID NO: 580654 - DNA, 20 bp, Artificial Sequence
  chemically synthesized
aaaaaaatgctttttattct

SEQ ID NO: 580655 - DNA, 20 bp, Artificial Sequence
  chemically synthesized
gtgtgtgctaagggagaaaa

SEQ ID NO: 580656 - DNA, 20 bp, Artificial Sequence
  chemically synthesized
ctttgtttttcggggttaat

SEQ ID NO: 580657 - DNA, 20 bp, Artificial Sequence
  chemically synthesized
taaaaataagagtgaggcca

SEQ ID NO: 580658 - DNA, 20 bp, Artificial Sequence
  chemically synthesized
ttgaatagttggatggtgga

SEQ ID NO: 580659 - DNA, 20 bp, Artificial Sequence
  chemically synthesized
gccatagtttctgttcaaga

SEQ ID NO: 580660 - DNA, 20 bp, Artificial Sequence
  chemically synthesized
atggaattgtgctttttagc

SEQ ID NO: 580661 - DNA, 20 bp, Artificial Sequence
  chemically synthesized
ctaaaaagcacaattccata

SEQ ID NO: 580662 - DNA, 20 bp, Artificial Sequence
  chemically synthesized
tcagtaagcaatgtatggaa

SEQ ID NO: 580663 - DNA, 20 bp, Artificial Sequence
  chemically synthesized
ttcttccttacctccttctc

SEQ ID NO: 580664 - DNA, 20 bp, Artificial Sequence
  chemically synthesized
tctcttccatcttctatgag

SEQ ID NO: 580665 - DNA, 20 bp, Artificial Sequence
  chemically synthesized
tcttcaatctccgtctacaa

SEQ ID NO: 580666 - DNA, 20 bp, Artificial Sequence
  chemically synthesized
aaaataaacatggttgtaga

SEQ ID NO: 580667 - DNA, 20 bp, Artificial Sequence
  chemically synthesized
tcttttgtttggttggtttt

SEQ ID NO: 580668 - DNA, 20 bp, Artificial Sequence
  chemically synthesized
actcttttgtcttttgtttg

SEQ ID NO: 580669 - DNA, 20 bp, Artificial Sequence
  chemically synthesized
ggaaataatactcttttgtc

SEQ ID NO: 580670 - DNA, 20 bp, Artificial Sequence
  chemically synthesized
tcccacaaaggaggaagaca

SEQ ID NO: 580671 - DNA, 20 bp, Artificial Sequence
  chemically synthesized
gtcttcctcctttgtgggag

SEQ ID NO: 580672 - DNA, 20 bp, Artificial Sequence
  chemically synthesized
tacaccagtgctacttaaag

SEQ ID NO: 580673 - DNA, 20 bp, Artificial Sequence
  chemically synthesized
cattagctctagagtggagc

SEQ ID NO: 580674 - DNA, 20 bp, Artificial Sequence
  chemically synthesized
atcttattttaaaatgcaga

SEQ ID NO: 580675 - DNA, 20 bp, Artificial Sequence
  chemically synthesized
atcaaaatctgcattttaaa

SEQ ID NO: 580676 - DNA, 20 bp, Artificial Sequence
  chemically synthesized
tgaaaaatcttattttaaaa

SEQ ID NO: 580677 - DNA, 20 bp, Artificial Sequence
  chemically synthesized
attttaaaataagatttttc

SEQ ID NO: 580678 - DNA, 20 bp, Artificial Sequence
  chemically synthesized
tggaaatagtgggtatagac

SEQ ID NO: 580679 - DNA, 20 bp, Artificial Sequence
  chemically synthesized
tcacatacccttctaaacca

SEQ ID NO: 580680 - DNA, 20 bp, Artificial Sequence
  chemically synthesized
acccttctaaaccattacgt

SEQ ID NO: 580681 - DNA, 20 bp, Artificial Sequence
  chemically synthesized
agtggcaaaagccaaaacgt

SEQ ID NO: 580682 - DNA, 20 bp, Artificial Sequence
  chemically synthesized
tattagagagtctaaagtct

SEQ ID NO: 580683 - DNA, 20 bp, Artificial Sequence
  chemically synthesized
accctctttgaaaccttctc

SEQ ID NO: 580684 - DNA, 20 bp, Artificial Sequence
  chemically synthesized
cttccatattaatcaaaaga

SEQ ID NO: 580685 - DNA, 20 bp, Artificial Sequence
  chemically synthesized
ccttctcttttgattaatat

SEQ ID NO: 580686 - DNA, 20 bp, Artificial Sequence
  chemically synthesized
attaatatggaagattcctt

SEQ ID NO: 580687 - DNA, 20 bp, Artificial Sequence
  chemically synthesized
taggggtctccctttgatct

SEQ ID NO: 580688 - DNA, 20 bp, Artificial Sequence
  chemically synthesized
ctggtgagttcatgtatgta

SEQ ID NO: 580689 - DNA, 20 bp, Artificial Sequence
  chemically synthesized
taaaataatcagagtaaaat

SEQ ID NO: 580690 - DNA, 20 bp, Artificial Sequence
  chemically synthesized
agcttaaaacacagatttta

SEQ ID NO: 580691 - DNA, 20 bp, Artificial Sequence
  chemically synthesized
agacaattcttagcttaaaa

SEQ ID NO: 580692 - DNA, 20 bp, Artificial Sequence
  chemically synthesized
acagagttcaagagacaatt

SEQ ID NO: 580693 - DNA, 20 bp, Artificial Sequence
  chemically synthesized
ctatttcatagagatttagt

SEQ ID NO: 580694 - DNA, 20 bp, Artificial Sequence
  chemically synthesized
tggatatgttggctatttca

SEQ ID NO: 580695 - DNA, 20 bp, Artificial Sequence
  chemically synthesized
gaaatagccaacatatccaa

SEQ ID NO: 580696 - DNA, 20 bp, Artificial Sequence
  chemically synthesized
gaagaatgaagatgatgtaa

SEQ ID NO: 580697 - DNA, 20 bp, Artificial Sequence
  chemically synthesized
gtagaggaacagatgtgtat

SEQ ID NO: 580698 - DNA, 20 bp, Artificial Sequence
  chemically synthesized
agaagaatgaaggataattt

SEQ ID NO: 580699 - DNA, 20 bp, Artificial Sequence
  chemically synthesized
tatcattcatctctctcttc

SEQ ID NO: 580700 - DNA, 20 bp, Artificial Sequence
  chemically synthesized
attcatctctctcttcccta

SEQ ID NO: 580701 - DNA, 20 bp, Artificial Sequence
  chemically synthesized
ctgaactagagagaccatca

SEQ ID NO: 580702 - DNA, 20 bp, Artificial Sequence
  chemically synthesized
ctgtgcatttgaatcaagag

SEQ ID NO: 580703 - DNA, 20 bp, Artificial Sequence
  chemically synthesized
cgtagtttttaaagcagccc

SEQ ID NO: 580704 - DNA, 20 bp, Artificial Sequence
  chemically synthesized
cttaatagggcccagacatt

SEQ ID NO: 580705 - DNA, 20 bp, Artificial Sequence
  chemically synthesized
atgtctgggccctattaagg

SEQ ID NO: 580706 - DNA, 20 bp, Artificial Sequence
  chemically synthesized
cctattaaggctctgattta

SEQ ID NO: 580707 - DNA, 20 bp, Artificial Sequence
  chemically synthesized
cattttttttaaactccccc

SEQ ID NO: 580708 - DNA, 20 bp, Artificial Sequence
  chemically synthesized
tgcacgttagaatcactagg

SEQ ID NO: 580709 - DNA, 20 bp, Artificial Sequence
  chemically synthesized
gtgcagccagggatgagaac

SEQ ID NO: 580710 - DNA, 20 bp, Artificial Sequence
  chemically synthesized
aaaaaaaagacttctctgac

SEQ ID NO: 580711 - DNA, 20 bp, Artificial Sequence
  chemically synthesized
tcaggaggctgaggcaggag

SEQ ID NO: 580712 - DNA, 20 bp, Artificial Sequence
  chemically synthesized
tgcctcagcctcctgagtag

SEQ ID NO: 580713 - DNA, 20 bp, Artificial Sequence
  chemically synthesized
ttttgtatttttagtagaga

SEQ ID NO: 580714 - DNA, 20 bp, Artificial Sequence
  chemically synthesized
atttaataagtgatgaaaga

SEQ ID NO: 580715 - DNA, 20 bp, Artificial Sequence
  chemically synthesized
atgtcatgcctcccacccca

SEQ ID NO: 580716 - DNA, 20 bp, Artificial Sequence
  chemically synthesized
aagatcttgtaggataggta

SEQ ID NO: 580717 - DNA, 20 bp, Artificial Sequence
  chemically synthesized
acgtggcctttgtctacttt

SEQ ID NO: 580718 - DNA, 20 bp, Artificial Sequence
  chemically synthesized
tttgtctacttttctagttt

SEQ ID NO: 580719 - DNA, 20 bp, Artificial Sequence
  chemically synthesized
gcctgttgtgatgcctatac

SEQ ID NO: 580720 - DNA, 20 bp, Artificial Sequence
  chemically synthesized
cacatgtatctcacatgtgt

SEQ ID NO: 580721 - DNA, 20 bp, Artificial Sequence
  chemically synthesized
cctacaatgctctctgcctt

SEQ ID NO: 580722 - DNA, 20 bp, Artificial Sequence
  chemically synthesized
ctcaaaagtcactgccacta

SEQ ID NO: 580723 - DNA, 20 bp, Artificial Sequence
  chemically synthesized
tccctttcaccctatcaaag

SEQ ID NO: 580724 - DNA, 20 bp, Artificial Sequence
  chemically synthesized
agcatggaatggcacgtaaa

SEQ ID NO: 580725 - DNA, 20 bp, Artificial Sequence
  chemically synthesized
gtgccattccatgctacctt

SEQ ID NO: 580726 - DNA, 20 bp, Artificial Sequence
  chemically synthesized
tttgtgatgattttcacttt

SEQ ID NO: 580727 - DNA, 20 bp, Artificial Sequence
  chemically synthesized
gtttatatattgcatatttg

SEQ ID NO: 580728 - DNA, 20 bp, Artificial Sequence
  chemically synthesized
tgactaaatgtatgtgttta

SEQ ID NO: 580729 - DNA, 20 bp, Artificial Sequence
  chemically synthesized
tcatagcattgactaaatgt

SEQ ID NO: 580730 - DNA, 20 bp, Artificial Sequence
  chemically synthesized
tgaaaattaagtatgtgatc

SEQ ID NO: 580731 - DNA, 20 bp, Artificial Sequence
  chemically synthesized
aatgttttgaagagtgaaaa

SEQ ID NO: 580732 - DNA, 20 bp, Artificial Sequence
  chemically synthesized
aattgatgaagtgtagcctg

SEQ ID NO: 580733 - DNA, 20 bp, Artificial Sequence
  chemically synthesized
tagcctgaactgatttcttc

SEQ ID NO: 580734 - DNA, 20 bp, Artificial Sequence
  chemically synthesized
tttttttttattattcctct

SEQ ID NO: 580735 - DNA, 20 bp, Artificial Sequence
  chemically synthesized
atattttattttcactgatc

SEQ ID NO: 580736 - DNA, 20 bp, Artificial Sequence
  chemically synthesized
gtctttcatactccttcctt

SEQ ID NO: 580737 - DNA, 20 bp, Artificial Sequence
  chemically synthesized
taggctccattttcagatat

SEQ ID NO: 580738 - DNA, 20 bp, Artificial Sequence
  chemically synthesized
ctccattttcagatattttt

SEQ ID NO: 580739 - DNA, 20 bp, Artificial Sequence
  chemically synthesized
ctataacattcatgaattgc

SEQ ID NO: 580740 - DNA, 20 bp, Artificial Sequence
  chemically synthesized
caattcatgaatgttatagt

SEQ ID NO: 580741 - DNA, 20 bp, Artificial Sequence
  chemically synthesized
aagctgttttgttacttgaa

SEQ ID NO: 580742 - DNA, 20 bp, Artificial Sequence
  chemically synthesized
aatccccattcaagtaacaa

SEQ ID NO: 580743 - DNA, 20 bp, Artificial Sequence
  chemically synthesized
aatttacatattttgtatta

SEQ ID NO: 580744 - DNA, 20 bp, Artificial Sequence
  chemically synthesized
aaaagttcatttacatattt

SEQ ID NO: 580745 - DNA, 20 bp, Artificial Sequence
  chemically synthesized
gtacagcagctccttaaatg

SEQ ID NO: 580746 - DNA, 20 bp, Artificial Sequence
  chemically synthesized
cagctccttaaatgcaatgc

SEQ ID NO: 580747 - DNA, 20 bp, Artificial Sequence
  chemically synthesized
ggagcaattgacagagtgtt

SEQ ID NO: 580748 - DNA, 20 bp, Artificial Sequence
  chemically synthesized
aacagtgggagcaattgaca

SEQ ID NO: 580749 - DNA, 20 bp, Artificial Sequence
  chemically synthesized
aacactctgtcaattgctcc

SEQ ID NO: 580750 - DNA, 20 bp, Artificial Sequence
  chemically synthesized
tttcttctctggatgtatag

SEQ ID NO: 580751 - DNA, 20 bp, Artificial Sequence
  chemically synthesized
tgttcctgtatttcgtagcc

SEQ ID NO: 580752 - DNA, 20 bp, Artificial Sequence
  chemically synthesized
agaatttccctttaaaatta

SEQ ID NO: 580753 - DNA, 20 bp, Artificial Sequence
  chemically synthesized
ttttccttttactatgggaa

SEQ ID NO: 580754 - DNA, 20 bp, Artificial Sequence
  chemically synthesized
aataaggtaatccatgtgaa

SEQ ID NO: 580755 - DNA, 20 bp, Artificial Sequence
  chemically synthesized
agtttacaaagcactgttca

SEQ ID NO: 580756 - DNA, 20 bp, Artificial Sequence
  chemically synthesized
ttattatttgctgacagttt

SEQ ID NO: 580757 - DNA, 20 bp, Artificial Sequence
  chemically synthesized
atcataccttattatttgct

SEQ ID NO: 580758 - DNA, 20 bp, Artificial Sequence
  chemically synthesized
aactgtcagcaaataataag

SEQ ID NO: 580759 - DNA, 20 bp, Artificial Sequence
  chemically synthesized
ccttttaaaacatataaaac

SEQ ID NO: 580760 - DNA, 20 bp, Artificial Sequence
  chemically synthesized
ggttaaaaagcattagtttt

SEQ ID NO: 580761 - DNA, 20 bp, Artificial Sequence
  chemically synthesized
ttttgtttgggttaaaaagc

SEQ ID NO: 580762 - DNA, 20 bp, Artificial Sequence
  chemically synthesized
ctggcaacgtatgtgtgtct

SEQ ID NO: 580763 - DNA, 20 bp, Artificial Sequence
  chemically synthesized
aagaacttagaaaaatatag

SEQ ID NO: 580764 - DNA, 20 bp, Artificial Sequence
  chemically synthesized
agagccatttggtcattcaa

SEQ ID NO: 580765 - DNA, 20 bp, Artificial Sequence
  chemically synthesized
agttatataagagattataa

SEQ ID NO: 580766 - DNA, 20 bp, Artificial Sequence
  chemically synthesized
ttttataatctcttatataa

SEQ ID NO: 580767 - DNA, 20 bp, Artificial Sequence
  chemically synthesized
taactcaatctcagttatat

SEQ ID NO: 580768 - DNA, 20 bp, Artificial Sequence
  chemically synthesized
gtttattacttcttttttag

SEQ ID NO: 580769 - DNA, 20 bp, Artificial Sequence
  chemically synthesized
agaatgtttattacttcttt

SEQ ID NO: 580770 - DNA, 20 bp, Artificial Sequence
  chemically synthesized
aattatgtaatttacttaca

SEQ ID NO: 580771 - DNA, 20 bp, Artificial Sequence
  chemically synthesized
tattcacatgcctttggaat

SEQ ID NO: 580772 - DNA, 20 bp, Artificial Sequence
  chemically synthesized
agtggagtctatcgtgaaag

SEQ ID NO: 580773 - DNA, 20 bp, Artificial Sequence
  chemically synthesized
gagctatgaaaattttcttt

SEQ ID NO: 580774 - DNA, 20 bp, Artificial Sequence
  chemically synthesized
agtggccttgtgagttatgg

SEQ ID NO: 580775 - DNA, 20 bp, Artificial Sequence
  chemically synthesized
agtgcaatgggaatccactg

SEQ ID NO: 580776 - DNA, 20 bp, Artificial Sequence
  chemically synthesized
ttccctgctttaaacctttc

SEQ ID NO: 580777 - DNA, 20 bp, Artificial Sequence
  chemically synthesized
cagattagacggtgtcactt

SEQ ID NO: 580778 - DNA, 20 bp, Artificial Sequence
  chemically synthesized
gggaagtgacaccgtctaat

SEQ ID NO: 580779 - DNA, 20 bp, Artificial Sequence
  chemically synthesized
acatgactaatgttttcaag

SEQ ID NO: 580780 - DNA, 20 bp, Artificial Sequence
  chemically synthesized
tctccaattagcaacatgac

SEQ ID NO: 580781 - DNA, 20 bp, Artificial Sequence
  chemically synthesized
agtcatgttgctaattggag

SEQ ID NO: 580782 - DNA, 20 bp, Artificial Sequence
  chemically synthesized
actcctatgctaacatctta

SEQ ID NO: 580783 - DNA, 20 bp, Artificial Sequence
  chemically synthesized
gtggtagatggaaagataag

SEQ ID NO: 580784 - DNA, 20 bp, Artificial Sequence
  chemically synthesized
ggaaagataagaaaagatta

SEQ ID NO: 580785 - DNA, 20 bp, Artificial Sequence
  chemically synthesized
tgcatcatctggtacatggc

SEQ ID NO: 580786 - DNA, 20 bp, Artificial Sequence
  chemically synthesized
gtacatggcaggtgcttcat

SEQ ID NO: 580787 - DNA, 20 bp, Artificial Sequence
  chemically synthesized
taagaccccttaaaaaattg

SEQ ID NO: 580788 - DNA, 20 bp, Artificial Sequence
  chemically synthesized
aaaagcagtggtcacagtcc

SEQ ID NO: 580789 - DNA, 20 bp, Artificial Sequence
  chemically synthesized
tgaaactaatggactgtgac

SEQ ID NO: 580790 - DNA, 20 bp, Artificial Sequence
  chemically synthesized
agcaaagtacacctaggtca

SEQ ID NO: 580791 - DNA, 20 bp, Artificial Sequence
  chemically synthesized
catgtcgtgtctgaaaatca

SEQ ID NO: 580792 - DNA, 20 bp, Artificial Sequence
  chemically synthesized
ctgaaaatcattttgcttaa

SEQ ID NO: 580793 - DNA, 20 bp, Artificial Sequence
  chemically synthesized
caacaaagcagctttaagca

SEQ ID NO: 580794 - DNA, 20 bp, Artificial Sequence
  chemically synthesized
caagtaatatttcccaacaa

SEQ ID NO: 580795 - DNA, 20 bp, Artificial Sequence
  chemically synthesized
ctgctttgttgggaaatatt

SEQ ID NO: 580796 - DNA, 20 bp, Artificial Sequence
  chemically synthesized
ttgttgggaaatattacttg

SEQ ID NO: 580797 - DNA, 20 bp, Artificial Sequence
  chemically synthesized
aatattacttgcttggcttt

SEQ ID NO: 580798 - DNA, 20 bp, Artificial Sequence
  chemically synthesized
aacaagaaattgtgggtccg

SEQ ID NO: 580799 - DNA, 20 bp, Artificial Sequence
  chemically synthesized
tcatgatgaaatgtaatata

SEQ ID NO: 580800 - DNA, 20 bp, Artificial Sequence
  chemically synthesized
ataggtgagaggccagagct

SEQ ID NO: 580801 - DNA, 20 bp, Artificial Sequence
  chemically synthesized
ttgcccttgttctttaccct

SEQ ID NO: 580802 - DNA, 20 bp, Artificial Sequence
  chemically synthesized
ctgcctcttcagaccattcc

SEQ ID NO: 580803 - DNA, 20 bp, Artificial Sequence
  chemically synthesized
cacctgtcatgctttatctc

SEQ ID NO: 580804 - DNA, 20 bp, Artificial Sequence
  chemically synthesized
cttcgtcaaaggaccacctg

SEQ ID NO: 580805 - DNA, 20 bp, Artificial Sequence
  chemically synthesized
gtgaccacccaagaggttca

SEQ ID NO: 580806 - DNA, 20 bp, Artificial Sequence
  chemically synthesized
tggtcactgatactttacca

SEQ ID NO: 580807 - DNA, 20 bp, Artificial Sequence
  chemically synthesized
gtgattaggacatggctgac

SEQ ID NO: 580808 - DNA, 20 bp, Artificial Sequence
  chemically synthesized
ggatgtaaagaaaatgatag

SEQ ID NO: 580809 - DNA, 20 bp, Artificial Sequence
  chemically synthesized
gaaaatgatagaaatgcttg

SEQ ID NO: 580810 - DNA, 20 bp, Artificial Sequence
  chemically synthesized
tccttaagtttcctgtctgg

SEQ ID NO: 580811 - DNA, 20 bp, Artificial Sequence
  chemically synthesized
catattccttaagtttcctg

SEQ ID NO: 580812 - DNA, 20 bp, Artificial Sequence
  chemically synthesized
aatgaggtagctcatattcc

SEQ ID NO: 580813 - DNA, 20 bp, Artificial Sequence
  chemically synthesized
gttctctacttcttctgagt

SEQ ID NO: 580814 - DNA, 20 bp, Artificial Sequence
  chemically synthesized
ccaagttagtcaacaaaagt

SEQ ID NO: 580815 - DNA, 20 bp, Artificial Sequence
  chemically synthesized
ttttggaaaacgactgaact

SEQ ID NO: 580816 - DNA, 20 bp, Artificial Sequence
  chemically synthesized
tatgtacaatcttcaagttc

SEQ ID NO: 580817 - DNA, 20 bp, Artificial Sequence
  chemically synthesized
tttaataattatataagagt

SEQ ID NO: 580818 - DNA, 20 bp, Artificial Sequence
  chemically synthesized
ctttactaattaaatctcta

SEQ ID NO: 580819 - DNA, 20 bp, Artificial Sequence
  chemically synthesized
tggaaaaaagaaaatcaggt

SEQ ID NO: 580820 - DNA, 20 bp, Artificial Sequence
  chemically synthesized
ttccaaatcctgccatcttt

SEQ ID NO: 580821 - DNA, 20 bp, Artificial Sequence
  chemically synthesized
tagaaaagcaaaaaaagatg

SEQ ID NO: 580822 - DNA, 20 bp, Artificial Sequence
  chemically synthesized
attatgaaagagaggagagg

SEQ ID NO: 580823 - DNA, 20 bp, Artificial Sequence
  chemically synthesized
tctcctctctttcataatct

SEQ ID NO: 580824 - DNA, 20 bp, Artificial Sequence
  chemically synthesized
aaaaaaaatgttgataaact

SEQ ID NO: 580825 - DNA, 20 bp, Artificial Sequence
  chemically synthesized
tttttttggttacgtcagac

SEQ ID NO: 580826 - DNA, 20 bp, Artificial Sequence
  chemically synthesized
actagttacatgtaataagt

SEQ ID NO: 580827 - DNA, 20 bp, Artificial Sequence
  chemically synthesized
gcctacagtgactaacatag

SEQ ID NO: 580828 - DNA, 20 bp, Artificial Sequence
  chemically synthesized
tccaatgataagaatgctcc

SEQ ID NO: 580829 - DNA, 20 bp, Artificial Sequence
  chemically synthesized
attttcaggagcaatatagc

SEQ ID NO: 580830 - DNA, 20 bp, Artificial Sequence
  chemically synthesized
tagtcagtgtatgtaatttc

SEQ ID NO: 580831 - DNA, 20 bp, Artificial Sequence
  chemically synthesized
acgttagctgcaaatttcta

SEQ ID NO: 580832 - DNA, 20 bp, Artificial Sequence
  chemically synthesized
atggattctttcaatctgaa

SEQ ID NO: 580833 - DNA, 20 bp, Artificial Sequence
  chemically synthesized
aagctattacccaaactgta

SEQ ID NO: 580834 - DNA, 20 bp, Artificial Sequence
  chemically synthesized
aatctgaatacagtttgggt

SEQ ID NO: 580835 - DNA, 20 bp, Artificial Sequence
  chemically synthesized
gcaagtttatatcagctatc

SEQ ID NO: 580836 - DNA, 20 bp, Artificial Sequence
  chemically synthesized
ccattggaactggcagcatg

SEQ ID NO: 580837 - DNA, 20 bp, Artificial Sequence
  chemically synthesized
tattactgaccttttaatct

SEQ ID NO: 580838 - DNA, 20 bp, Artificial Sequence
  chemically synthesized
aaaagatttaaaaaaaaaca

SEQ ID NO: 580839 - DNA, 20 bp, Artificial Sequence
  chemically synthesized
gatttagcagagaaaaaata

SEQ ID NO: 580840 - DNA, 20 bp, Artificial Sequence
  chemically synthesized
tctgctaaatctctgcctct

SEQ ID NO: 580841 - DNA, 20 bp, Artificial Sequence
  chemically synthesized
gcttattaaacagcaagagg

SEQ ID NO: 580842 - DNA, 20 bp, Artificial Sequence
  chemically synthesized
tcattaggttccaaataacg

SEQ ID NO: 580843 - DNA, 20 bp, Artificial Sequence
  chemically synthesized
ccgttatttggaacctaatg

SEQ ID NO: 580844 - DNA, 20 bp, Artificial Sequence
  chemically synthesized
ataatgaagaggctatttag

SEQ ID NO: 580845 - DNA, 20 bp, Artificial Sequence
  chemically synthesized
ctcatattagctatttcagc

SEQ ID NO: 580846 - DNA, 20 bp, Artificial Sequence
  chemically synthesized
gaacatctcatattagctat

SEQ ID NO: 580847 - DNA, 20 bp, Artificial Sequence
  chemically synthesized
taggatgatgacgccctgaa

SEQ ID NO: 580848 - DNA, 20 bp, Artificial Sequence
  chemically synthesized
ttcagggcgtcatcatccta

SEQ ID NO: 580849 - DNA, 20 bp, Artificial Sequence
  chemically synthesized
agttcttccactcatcctca

SEQ ID NO: 580850 - DNA, 20 bp, Artificial Sequence
  chemically synthesized
ttccactcatcctcattttg

SEQ ID NO: 580851 - DNA, 20 bp, Artificial Sequence
  chemically synthesized
tatttatgtccatgtgtgct

SEQ ID NO: 580852 - DNA, 20 bp, Artificial Sequence
  chemically synthesized
agtgagcatagtaactgata

SEQ ID NO: 580853 - DNA, 20 bp, Artificial Sequence
  chemically synthesized
gtgggagtattgcatgatgc

SEQ ID NO: 580854 - DNA, 20 bp, Artificial Sequence
  chemically synthesized
ttagatacagaaggtgcatg

SEQ ID NO: 580855 - DNA, 20 bp, Artificial Sequence
  chemically synthesized
ttggttccttttcacaacac

SEQ ID NO: 580856 - DNA, 20 bp, Artificial Sequence
  chemically synthesized
accaacaatgagagaaggat

SEQ ID NO: 580857 - DNA, 20 bp, Artificial Sequence
  chemically synthesized
aaggatataggattttaaaa

SEQ ID NO: 580858 - DNA, 20 bp, Artificial Sequence
  chemically synthesized
ttctggggtcattgttgaag

SEQ ID NO: 580859 - DNA, 20 bp, Artificial Sequence
  chemically synthesized
gacagttagataaaggcctc

SEQ ID NO: 580860 - DNA, 20 bp, Artificial Sequence
  chemically synthesized
aaaattatctacaaggtacc

SEQ ID NO: 580861 - DNA, 20 bp, Artificial Sequence
  chemically synthesized
ctacaaggtaccacgtgttt

SEQ ID NO: 580862 - DNA, 20 bp, Artificial Sequence
  chemically synthesized
tggctattaaaaggtgaact

SEQ ID NO: 580863 - DNA, 20 bp, Artificial Sequence
  chemically synthesized
acatagaattaaagggagat

SEQ ID NO: 580864 - DNA, 20 bp, Artificial Sequence
  chemically synthesized
tccttccacatagaattaaa

SEQ ID NO: 580865 - DNA, 20 bp, Artificial Sequence
  chemically synthesized
aggaaaagtaaagaaataaa

SEQ ID NO: 580866 - DNA, 20 bp, Artificial Sequence
  chemically synthesized
tgtaagtcttttttttcaat

SEQ ID NO: 580867 - DNA, 20 bp, Artificial Sequence
  chemically synthesized
tttagaacaacattcaggaa

SEQ ID NO: 580868 - DNA, 20 bp, Artificial Sequence
  chemically synthesized
taaatcattaaggatttgct

SEQ ID NO: 580869 - DNA, 20 bp, Artificial Sequence
  chemically synthesized
agaaacaaaaagcaaatcct

SEQ ID NO: 580870 - DNA, 20 bp, Artificial Sequence
  chemically synthesized
atatttataaatcattaagg

SEQ ID NO: 580871 - DNA, 20 bp, Artificial Sequence
  chemically synthesized
tttacatatttataaatcat

SEQ ID NO: 580872 - DNA, 20 bp, Artificial Sequence
  chemically synthesized
tagtaataacacaaatgatg

SEQ ID NO: 580873 - DNA, 20 bp, Artificial Sequence
  chemically synthesized
tttgtgttattactaaaaat

SEQ ID NO: 580874 - DNA, 20 bp, Artificial Sequence
  chemically synthesized
acatttttaaaatagagctc

SEQ ID NO: 580875 - DNA, 20 bp, Artificial Sequence
  chemically synthesized
agccaaaagactctgattca

SEQ ID NO: 580876 - DNA, 20 bp, Artificial Sequence
  chemically synthesized
atagttcaagagccaaaaga

SEQ ID NO: 580877 - DNA, 20 bp, Artificial Sequence
  chemically synthesized
cttagctatttctgagtcac

SEQ ID NO: 580878 - DNA, 20 bp, Artificial Sequence
  chemically synthesized
ctttagatctgcccgtatat

SEQ ID NO: 580879 - DNA, 20 bp, Artificial Sequence
  chemically synthesized
tccgtgttttaataccacag

SEQ ID NO: 580880 - DNA, 20 bp, Artificial Sequence
  chemically synthesized
ttttttccttttatatccat

SEQ ID NO: 580881 - DNA, 20 bp, Artificial Sequence
  chemically synthesized
cactcatgaaattgaggtga

SEQ ID NO: 580882 - DNA, 20 bp, Artificial Sequence
  chemically synthesized
actggaaggaaatacatcaa

SEQ ID NO: 580883 - DNA, 20 bp, Artificial Sequence
  chemically synthesized
ttccagttataatttctttt

SEQ ID NO: 580884 - DNA, 20 bp, Artificial Sequence
  chemically synthesized
taatttcttttgctggtttt

SEQ ID NO: 580885 - DNA, 20 bp, Artificial Sequence
  chemically synthesized
atattaaaatgtttaatgga

SEQ ID NO: 580886 - DNA, 20 bp, Artificial Sequence
  chemically synthesized
atacttaccactgaatatta

SEQ ID NO: 580887 - DNA, 20 bp, Artificial Sequence
  chemically synthesized
tttggagaaagtttattata

SEQ ID NO: 580888 - DNA, 20 bp, Artificial Sequence
  chemically synthesized
aatttttggagaaagtttat

SEQ ID NO: 580889 - DNA, 20 bp, Artificial Sequence
  chemically synthesized
ttaaaacattaatttttgga

SEQ ID NO: 580890 - DNA, 20 bp, Artificial Sequence
  chemically synthesized
aataaactttctccaaaaat

SEQ ID NO: 580891 - DNA, 20 bp, Artificial Sequence
  chemically synthesized
attagtattataaaatgcat

SEQ ID NO: 580892 - DNA, 20 bp, Artificial Sequence
  chemically synthesized
tttggttatttatcactgga

SEQ ID NO: 580893 - DNA, 20 bp, Artificial Sequence
  chemically synthesized
aacactttagtgtctatcat

SEQ ID NO: 580894 - DNA, 20 bp, Artificial Sequence
  chemically synthesized
atcttaaatgatagacacta

SEQ ID NO: 580895 - DNA, 20 bp, Artificial Sequence
  chemically synthesized
tttagtgaccaaatttctta

SEQ ID NO: 580896 - DNA, 20 bp, Artificial Sequence
  chemically synthesized
gaaagcagaagataaaatgg

SEQ ID NO: 580897 - DNA, 20 bp, Artificial Sequence
  chemically synthesized
tcaaacaatgccattttatc

SEQ ID NO: 580898 - DNA, 20 bp, Artificial Sequence
  chemically synthesized
ttttatcttctgctttctct

SEQ ID NO: 580899 - DNA, 20 bp, Artificial Sequence
  chemically synthesized
atatgcagacattctagaaa

SEQ ID NO: 580900 - DNA, 20 bp, Artificial Sequence
  chemically synthesized
gctcatatgcagacattcta

SEQ ID NO: 580901 - DNA, 20 bp, Artificial Sequence
  chemically synthesized
tctagaatgtctgcatatga

SEQ ID NO: 580902 - DNA, 20 bp, Artificial Sequence
  chemically synthesized
aggtgtgagccaccacgccc

SEQ ID NO: 580903 - DNA, 20 bp, Artificial Sequence
  chemically synthesized
tgccttgttcccccaaagag

SEQ ID NO: 580904 - DNA, 20 bp, Artificial Sequence
  chemically synthesized
caacctccacctcctgtttc

SEQ ID NO: 580905 - DNA, 20 bp, Artificial Sequence
  chemically synthesized
ggctcactgcaacctccacc

SEQ ID NO: 580906 - DNA, 20 bp, Artificial Sequence
  chemically synthesized
gaggtggaggttgcagtgag

SEQ ID NO: 580907 - DNA, 20 bp, Artificial Sequence
  chemically synthesized
actcgattgattgattgatt

SEQ ID NO: 580908 - DNA, 20 bp, Artificial Sequence
  chemically synthesized
tttgactcgattgattgatt

SEQ ID NO: 580909 - DNA, 20 bp, Artificial Sequence
  chemically synthesized
ttgatttgactcgattgatt

SEQ ID NO: 580910 - DNA, 20 bp, Artificial Sequence
  chemically synthesized
tttcttgatttgactcgatt

SEQ ID NO: 580911 - DNA, 20 bp, Artificial Sequence
  chemically synthesized
ctcttttcttgatttgactc

SEQ ID NO: 580912 - DNA, 20 bp, Artificial Sequence
  chemically synthesized
tgcactcttttcttgatttg

SEQ ID NO: 580913 - DNA, 20 bp, Artificial Sequence
  chemically synthesized
ctttgtactctgcactcttt

SEQ ID NO: 580914 - DNA, 20 bp, Artificial Sequence
  chemically synthesized
agaaaagagtgcagagtaca

SEQ ID NO: 580915 - DNA, 20 bp, Artificial Sequence
  chemically synthesized
ttcgttaaagacccagttct

SEQ ID NO: 580916 - DNA, 20 bp, Artificial Sequence
  chemically synthesized
aattaagtgaaaataaaagg

SEQ ID NO: 580917 - DNA, 20 bp, Artificial Sequence
  chemically synthesized
tttattttcacttaattttc

SEQ ID NO: 580918 - DNA, 20 bp, Artificial Sequence
  chemically synthesized
ttcaattgattcctttgttg

SEQ ID NO: 580919 - DNA, 20 bp, Artificial Sequence
  chemically synthesized
ttgcattgtttatatggcaa

SEQ ID NO: 580920 - DNA, 20 bp, Artificial Sequence
  chemically synthesized
ctcattctattattattttt

SEQ ID NO: 580921 - DNA, 20 bp, Artificial Sequence
  chemically synthesized
ggtgtgtcagagagaaatat

SEQ ID NO: 580922 - DNA, 20 bp, Artificial Sequence
  chemically synthesized
gtttggggtccttatttcat

SEQ ID NO: 580923 - DNA, 20 bp, Artificial Sequence
  chemically synthesized
aaatatgtgcactcttaaaa

SEQ ID NO: 580924 - DNA, 20 bp, Artificial Sequence
  chemically synthesized
ttctatttctatgtatacat

SEQ ID NO: 580925 - DNA, 20 bp, Artificial Sequence
  chemically synthesized
aatttcaaagaaactagaaa

SEQ ID NO: 580926 - DNA, 20 bp, Artificial Sequence
  chemically synthesized
tgcagaagaaaatctttctt

SEQ ID NO: 580927 - DNA, 20 bp, Artificial Sequence
  chemically synthesized
ctgcaattacaataggataa

SEQ ID NO: 580928 - DNA, 20 bp, Artificial Sequence
  chemically synthesized
cccaggctatctgaggctca

SEQ ID NO: 580929 - DNA, 20 bp, Artificial Sequence
  chemically synthesized
gctgagcctcagatagcctg

SEQ ID NO: 580930 - DNA, 20 bp, Artificial Sequence
  chemically synthesized
cctggggagcttgttataaa

SEQ ID NO: 580931 - DNA, 20 bp, Artificial Sequence
  chemically synthesized
ttactggccattcccggaca

SEQ ID NO: 580932 - DNA, 20 bp, Artificial Sequence
  chemically synthesized
ctagaaatctttgtgggaaa

SEQ ID NO: 580933 - DNA, 20 bp, Artificial Sequence
  chemically synthesized
tttcaaaacgacatttccca

SEQ ID NO: 580934 - DNA, 20 bp, Artificial Sequence
  chemically synthesized
tgtgggaaatgtcgttttga

SEQ ID NO: 580935 - DNA, 20 bp, Artificial Sequence
  chemically synthesized
tgacattgctacctgttacc

SEQ ID NO: 580936 - DNA, 20 bp, Artificial Sequence
  chemically synthesized
gttagtataagttaatagtt

SEQ ID NO: 580937 - DNA, 20 bp, Artificial Sequence
  chemically synthesized
attaacttatactaacatat

SEQ ID NO: 580938 - DNA, 20 bp, Artificial Sequence
  chemically synthesized
accaccaccatatacagata

SEQ ID NO: 580939 - DNA, 20 bp, Artificial Sequence
  chemically synthesized
ttccttttagattccctgca

SEQ ID NO: 580940 - DNA, 20 bp, Artificial Sequence
  chemically synthesized
tgtttgctccctggcttcct

SEQ ID NO: 580941 - DNA, 20 bp, Artificial Sequence
  chemically synthesized
ataatagcacatgtttgctc

SEQ ID NO: 580942 - DNA, 20 bp, Artificial Sequence
  chemically synthesized
cagggagcaaacatgtgcta

SEQ ID NO: 580943 - DNA, 20 bp, Artificial Sequence
  chemically synthesized
ggtacaaaaaacataatagc

SEQ ID NO: 580944 - DNA, 20 bp, Artificial Sequence
  chemically synthesized
tgtaccatctgagatgaatt

SEQ ID NO: 580945 - DNA, 20 bp, Artificial Sequence
  chemically synthesized
ctgagatgaattgtctgttt

SEQ ID NO: 580946 - DNA, 20 bp, Artificial Sequence
  chemically synthesized
catctagaatagtaaagatg

SEQ ID NO: 580947 - DNA, 20 bp, Artificial Sequence
  chemically synthesized
tagtaaagatgggtagttta

SEQ ID NO: 580948 - DNA, 20 bp, Artificial Sequence
  chemically synthesized
cttaaggaagcatcctttca

SEQ ID NO: 580949 - DNA, 20 bp, Artificial Sequence
  chemically synthesized
ggtaataaagcattatgaaa

SEQ ID NO: 580950 - DNA, 20 bp, Artificial Sequence
  chemically synthesized
gactatccagaagaccaaat

SEQ ID NO: 580951 - DNA, 20 bp, Artificial Sequence
  chemically synthesized
caccccgaacacattaccat

SEQ ID NO: 580952 - DNA, 20 bp, Artificial Sequence
  chemically synthesized
tgccagtcttgttgtaaaat

SEQ ID NO: 580953 - DNA, 20 bp, Artificial Sequence
  chemically synthesized
aattattatttcttctttca

SEQ ID NO: 580954 - DNA, 20 bp, Artificial Sequence
  chemically synthesized
ggtttataaaccagtgcctt

SEQ ID NO: 580955 - DNA, 20 bp, Artificial Sequence
  chemically synthesized
gctacacaaactcacaaggc

SEQ ID NO: 580956 - DNA, 20 bp, Artificial Sequence
  chemically synthesized
gagatgatcaggctctggga

SEQ ID NO: 580957 - DNA, 20 bp, Artificial Sequence
  chemically synthesized
atagccaacaactaaatttt

SEQ ID NO: 580958 - DNA, 20 bp, Artificial Sequence
  chemically synthesized
agttgttggctatgcaaaac

SEQ ID NO: 580959 - DNA, 20 bp, Artificial Sequence
  chemically synthesized
cgtagatttaatgtccaatc

SEQ ID NO: 580960 - DNA, 20 bp, Artificial Sequence
  chemically synthesized
atatcatatagcagagttgt

SEQ ID NO: 580961 - DNA, 20 bp, Artificial Sequence
  chemically synthesized
tctttatgcagtccttcctg

SEQ ID NO: 580962 - DNA, 20 bp, Artificial Sequence
  chemically synthesized
aatatactctttcttcaggt

SEQ ID NO: 580963 - DNA, 20 bp, Artificial Sequence
  chemically synthesized
ggaaaaagtgctatgtatct

SEQ ID NO: 580964 - DNA, 20 bp, Artificial Sequence
  chemically synthesized
tgagatacatagcacttttt

SEQ ID NO: 580965 - DNA, 20 bp, Artificial Sequence
  chemically synthesized
tcttaatgcctgttaatatt

SEQ ID NO: 580966 - DNA, 20 bp, Artificial Sequence
  chemically synthesized
cctatcaatagtcaaagagt

SEQ ID NO: 580967 - DNA, 20 bp, Artificial Sequence
  chemically synthesized
aggtcatactcaatataaaa

SEQ ID NO: 580968 - DNA, 20 bp, Artificial Sequence
  chemically synthesized
catactcaatataaaatact

SEQ ID NO: 580969 - DNA, 20 bp, Artificial Sequence
  chemically synthesized
tggctccagaccaaaaaaaa

SEQ ID NO: 580970 - DNA, 20 bp, Artificial Sequence
  chemically synthesized
tcatgtctttataaagttcc

SEQ ID NO: 580971 - DNA, 20 bp, Artificial Sequence
  chemically synthesized
gtttatttctgttattctca

SEQ ID NO: 580972 - DNA, 20 bp, Artificial Sequence
  chemically synthesized
ctaatttgtacttaactagt

SEQ ID NO: 580973 - DNA, 20 bp, Artificial Sequence
  chemically synthesized
gaagctaatttgtacttaac

SEQ ID NO: 580974 - DNA, 20 bp, Artificial Sequence
  chemically synthesized
caatcactagttaagtacaa

SEQ ID NO: 580975 - DNA, 20 bp, Artificial Sequence
  chemically synthesized
atgttttcagcatgttttca

SEQ ID NO: 580976 - DNA, 20 bp, Artificial Sequence
  chemically synthesized
atgtatgttttcagcatgtt

SEQ ID NO: 580977 - DNA, 20 bp, Artificial Sequence
  chemically synthesized
ttagcagatgtatgttttca

SEQ ID NO: 580978 - DNA, 20 bp, Artificial Sequence
  chemically synthesized
aaaaccatcttttagcagat

SEQ ID NO: 580979 - DNA, 20 bp, Artificial Sequence
  chemically synthesized
aaaacatacatctgctaaaa

SEQ ID NO: 580980 - DNA, 20 bp, Artificial Sequence
  chemically synthesized
gagtctgttgctatggaaac

SEQ ID NO: 580981 - DNA, 20 bp, Artificial Sequence
  chemically synthesized
aatacagatggtgtcaaatc

SEQ ID NO: 580982 - DNA, 20 bp, Artificial Sequence
  chemically synthesized
ttaaaaaccggagattggct

SEQ ID NO: 580983 - DNA, 20 bp, Artificial Sequence
  chemically synthesized
ctgcaagccttcagccaatc

SEQ ID NO: 580984 - DNA, 20 bp, Artificial Sequence
  chemically synthesized
aggtcttgccaattaaaaac

SEQ ID NO: 580985 - DNA, 20 bp, Artificial Sequence
  chemically synthesized
ctaaaaataaaaaataaaaa

SEQ ID NO: 580986 - DNA, 20 bp, Artificial Sequence
  chemically synthesized
ctttacattgcaatatgctg

SEQ ID NO: 580987 - DNA, 20 bp, Artificial Sequence
  chemically synthesized
gcttgcattgtgaactttct

SEQ ID NO: 580988 - DNA, 20 bp, Artificial Sequence
  chemically synthesized
ctgattttaagataatggaa

SEQ ID NO: 580989 - DNA, 20 bp, Artificial Sequence
  chemically synthesized
ttatcttaaaatcagacttg

SEQ ID NO: 580990 - DNA, 20 bp, Artificial Sequence
  chemically synthesized
aatgctttgaaacttcacaa

SEQ ID NO: 580991 - DNA, 20 bp, Artificial Sequence
  chemically synthesized
aagtaattatcagaaggctg

SEQ ID NO: 580992 - DNA, 20 bp, Artificial Sequence
  chemically synthesized
ttaatgcctaaaatttattg

SEQ ID NO: 580993 - DNA, 20 bp, Artificial Sequence
  chemically synthesized
ccaagtttttttttttgcct

SEQ ID NO: 580994 - DNA, 20 bp, Artificial Sequence
  chemically synthesized
gaggaacttatatcacaata

SEQ ID NO: 580995 - DNA, 20 bp, Artificial Sequence
  chemically synthesized
ttcttaactctgatttctat

SEQ ID NO: 580996 - DNA, 20 bp, Artificial Sequence
  chemically synthesized
ttccaaaattgcattcttaa

SEQ ID NO: 580997 - DNA, 20 bp, Artificial Sequence
  chemically synthesized
catctgtaagagatctatta

SEQ ID NO: 580998 - DNA, 20 bp, Artificial Sequence
  chemically synthesized
gcttcaagaccatgtggatt

SEQ ID NO: 580999 - DNA, 20 bp, Artificial Sequence
  chemically synthesized
agaaatatgcttcaagacca

SEQ ID NO: 581000 - DNA, 20 bp, Artificial Sequence
  chemically synthesized
atacttgatattctggagaa

SEQ ID NO: 581001 - DNA, 20 bp, Artificial Sequence
  chemically synthesized
gttgctaaaattcatagaag

SEQ ID NO: 581002 - DNA, 20 bp, Artificial Sequence
  chemically synthesized
aaaataattattcagagaat

SEQ ID NO: 581003 - DNA, 20 bp, Artificial Sequence
  chemically synthesized
tggatattaaagaaatgtaa

SEQ ID NO: 581004 - DNA, 20 bp, Artificial Sequence
  chemically synthesized
ttctctatcccatcaaaatg

SEQ ID NO: 581005 - DNA, 20 bp, Artificial Sequence
  chemically synthesized
tcgccacaattgagcactgc

SEQ ID NO: 581006 - DNA, 20 bp, Artificial Sequence
  chemically synthesized
ctctggagttctgcaatgta

SEQ ID NO: 581007 - DNA, 20 bp, Artificial Sequence
  chemically synthesized
ggagttctgcaatgtagcaa

SEQ ID NO: 581008 - DNA, 20 bp, Artificial Sequence
  chemically synthesized
taggacagtggtatggtaaa

SEQ ID NO: 581009 - DNA, 20 bp, Artificial Sequence
  chemically synthesized
gtagttggaatgttacctct

SEQ ID NO: 581010 - DNA, 20 bp, Artificial Sequence
  chemically synthesized
aagaggtaacattccaacta

SEQ ID NO: 581011 - DNA, 20 bp, Artificial Sequence
  chemically synthesized
taaataaaattaacaaagac

SEQ ID NO: 581012 - DNA, 20 bp, Artificial Sequence
  chemically synthesized
ttacaatcattacatcattc

SEQ ID NO: 581013 - DNA, 20 bp, Artificial Sequence
  chemically synthesized
acttaatctagtgaatgatg

SEQ ID NO: 581014 - DNA, 20 bp, Artificial Sequence
  chemically synthesized
atacacatgaaggtaatgta

SEQ ID NO: 581015 - DNA, 20 bp, Artificial Sequence
  chemically synthesized
aaaaggaaaggaagactata

SEQ ID NO: 581016 - DNA, 20 bp, Artificial Sequence
  chemically synthesized
ttattcttacacagcataag

SEQ ID NO: 581017 - DNA, 20 bp, Artificial Sequence
  chemically synthesized
agaacagaacaacctacttg

SEQ ID NO: 581018 - DNA, 20 bp, Artificial Sequence
  chemically synthesized
gttcttgggtgaaaatatgg

SEQ ID NO: 581019 - DNA, 20 bp, Artificial Sequence
  chemically synthesized
tgtctcgatatggagcagga

SEQ ID NO: 581020 - DNA, 20 bp, Artificial Sequence
  chemically synthesized
tatgtgagttcagattgaag

SEQ ID NO: 581021 - DNA, 20 bp, Artificial Sequence
  chemically synthesized
acttcaatctgaactcacat

SEQ ID NO: 581022 - DNA, 20 bp, Artificial Sequence
  chemically synthesized
gaagaaatcatatatgtgag

SEQ ID NO: 581023 - DNA, 20 bp, Artificial Sequence
  chemically synthesized
tacctggggtagtgggcatg

SEQ ID NO: 581024 - DNA, 20 bp, Artificial Sequence
  chemically synthesized
gtcactgttagagtgtgact

SEQ ID NO: 581025 - DNA, 20 bp, Artificial Sequence
  chemically synthesized
ctaatgtcaaatatcacttc

SEQ ID NO: 581026 - DNA, 20 bp, Artificial Sequence
  chemically synthesized
cggagctgaaatgtatttct

SEQ ID NO: 581027 - DNA, 20 bp, Artificial Sequence
  chemically synthesized
ttggcacaaagtaggttcag

SEQ ID NO: 581028 - DNA, 20 bp, Artificial Sequence
  chemically synthesized
agattttccagaacctagat

SEQ ID NO: 581029 - DNA, 20 bp, Artificial Sequence
  chemically synthesized
gggactgtgtcttgtttcat

SEQ ID NO: 581030 - DNA, 20 bp, Artificial Sequence
  chemically synthesized
gcatgagagcagggactgtg

SEQ ID NO: 581031 - DNA, 20 bp, Artificial Sequence
  chemically synthesized
tcctttgtactttcattttt

SEQ ID NO: 581032 - DNA, 20 bp, Artificial Sequence
  chemically synthesized
tctttgcttgtacctctaat

SEQ ID NO: 581033 - DNA, 20 bp, Artificial Sequence
  chemically synthesized
ttggtacacatttgtctttc

SEQ ID NO: 581034 - DNA, 20 bp, Artificial Sequence
  chemically synthesized
agattatcaacttctttaga

SEQ ID NO: 581035 - DNA, 20 bp, Artificial Sequence
  chemically synthesized
tactttagtgaccattggaa

SEQ ID NO: 581036 - DNA, 20 bp, Artificial Sequence
  chemically synthesized
atttatcgctctgtacatcc

SEQ ID NO: 581037 - DNA, 20 bp, Artificial Sequence
  chemically synthesized
ttcatacattgttcataaaa

SEQ ID NO: 581038 - DNA, 20 bp, Artificial Sequence
  chemically synthesized
tgatacagcctctttcatta

SEQ ID NO: 581039 - DNA, 20 bp, Artificial Sequence
  chemically synthesized
tgtaatgaaagaggctgtat

SEQ ID NO: 581040 - DNA, 20 bp, Artificial Sequence
  chemically synthesized
acattcatcaaatgttgatt

SEQ ID NO: 581041 - DNA, 20 bp, Artificial Sequence
  chemically synthesized
atattcacacattcatcaaa

SEQ ID NO: 581042 - DNA, 20 bp, Artificial Sequence
  chemically synthesized
aaattatgtgaaggaaaaat

SEQ ID NO: 581043 - DNA, 20 bp, Artificial Sequence
  chemically synthesized
aataaaataatctcactcta

SEQ ID NO: 581044 - DNA, 20 bp, Artificial Sequence
  chemically synthesized
cacaaagaaatcaacctaga

SEQ ID NO: 581045 - DNA, 20 bp, Artificial Sequence
  chemically synthesized
tctattagaaaagggtcaat

SEQ ID NO: 581046 - DNA, 20 bp, Artificial Sequence
  chemically synthesized
gcttatggcagcaaattaaa

SEQ ID NO: 581047 - DNA, 20 bp, Artificial Sequence
  chemically synthesized
tctatgtttaatttgctgcc

SEQ ID NO: 581048 - DNA, 20 bp, Artificial Sequence
  chemically synthesized
tcctaaataaattttcacct

SEQ ID NO: 581049 - DNA, 20 bp, Artificial Sequence
  chemically synthesized
ttatttaggaagcatttgat

SEQ ID NO: 581050 - DNA, 20 bp, Artificial Sequence
  chemically synthesized
gtacctagaaaacagtcatc

SEQ ID NO: 581051 - DNA, 20 bp, Artificial Sequence
  chemically synthesized
aggcaccatcccttaacata

SEQ ID NO: 581052 - DNA, 20 bp, Artificial Sequence
  chemically synthesized
tattcactgctgtacatatt

SEQ ID NO: 581053 - DNA, 20 bp, Artificial Sequence
  chemically synthesized
gaagattaaattatgtccat

SEQ ID NO: 581054 - DNA, 20 bp, Artificial Sequence
  chemically synthesized
tgcactgtgctaataacaca

SEQ ID NO: 581055 - DNA, 20 bp, Artificial Sequence
  chemically synthesized
gatccttatttcattgaaaa

SEQ ID NO: 581056 - DNA, 20 bp, Artificial Sequence
  chemically synthesized
atcttaagataatataataa

SEQ ID NO: 581057 - DNA, 20 bp, Artificial Sequence
  chemically synthesized
atcagcattattatattatc

SEQ ID NO: 581058 - DNA, 20 bp, Artificial Sequence
  chemically synthesized
tattccttaaggatgccaat

SEQ ID NO: 581059 - DNA, 20 bp, Artificial Sequence
  chemically synthesized
caaaaaagtattgaatataa

SEQ ID NO: 581060 - DNA, 20 bp, Artificial Sequence
  chemically synthesized
tcttcatcatgagtatagga

SEQ ID NO: 581061 - DNA, 20 bp, Artificial Sequence
  chemically synthesized
ttctatgtcaaaaacatatt

SEQ ID NO: 581062 - DNA, 20 bp, Artificial Sequence
  chemically synthesized
tcaaaacaggtaaactttaa

SEQ ID NO: 581063 - DNA, 20 bp, Artificial Sequence
  chemically synthesized
caaaaacatatttaaagttt

SEQ ID NO: 581064 - DNA, 20 bp, Artificial Sequence
  chemically synthesized
ttacctgttttgaatggcca

SEQ ID NO: 581065 - DNA, 20 bp, Artificial Sequence
  chemically synthesized
atcatttcattatttttgtg

SEQ ID NO: 581066 - DNA, 20 bp, Artificial Sequence
  chemically synthesized
ttgataatattttgtttaca

SEQ ID NO: 581067 - DNA, 20 bp, Artificial Sequence
  chemically synthesized
atttaataatattgataata

SEQ ID NO: 581068 - DNA, 20 bp, Artificial Sequence
  chemically synthesized
ggaactccgaagtgccctat

SEQ ID NO: 581069 - DNA, 20 bp, Artificial Sequence
  chemically synthesized
aagtgtaaagtcaatgaatg

SEQ ID NO: 581070 - DNA, 20 bp, Artificial Sequence
  chemically synthesized
taagtaacctgttacatata

SEQ ID NO: 581071 - DNA, 20 bp, Artificial Sequence
  chemically synthesized
acaggttacttagtcataca

SEQ ID NO: 581072 - DNA, 20 bp, Artificial Sequence
  chemically synthesized
ctttctttttcttattacca

SEQ ID NO: 581073 - DNA, 20 bp, Artificial Sequence
  chemically synthesized
catcatggtaataagaaaaa

SEQ ID NO: 581074 - DNA, 20 bp, Artificial Sequence
  chemically synthesized
ttgaaagcaggaatttggat

SEQ ID NO: 581075 - DNA, 20 bp, Artificial Sequence
  chemically synthesized
taaaaaaccctaatccaaat

SEQ ID NO: 581076 - DNA, 20 bp, Artificial Sequence
  chemically synthesized
cccaatcttgaaagcaggaa

SEQ ID NO: 581077 - DNA, 20 bp, Artificial Sequence
  chemically synthesized
cctaatccaaattcctgctt

SEQ ID NO: 581078 - DNA, 20 bp, Artificial Sequence
  chemically synthesized
gagctgcgaaactgaacttc

SEQ ID NO: 581079 - DNA, 20 bp, Artificial Sequence
  chemically synthesized
cagctcttaatcttaagaag

SEQ ID NO: 581080 - DNA, 20 bp, Artificial Sequence
  chemically synthesized
cgtctcggcctcccaaagtg

SEQ ID NO: 581081 - DNA, 20 bp, Artificial Sequence
  chemically synthesized
ttttgtatttttagtagaga

SEQ ID NO: 581082 - DNA, 20 bp, Artificial Sequence
  chemically synthesized
aatggcgtgaacccgggagg

SEQ ID NO: 581083 - DNA, 20 bp, Artificial Sequence
  chemically synthesized
ttttttttttttttttgaga

SEQ ID NO: 581084 - DNA, 20 bp, Artificial Sequence
  chemically synthesized
aaaaaaaaaaaaaaaaaatt

SEQ ID NO: 581085 - DNA, 20 bp, Artificial Sequence
  chemically synthesized
cagtttacttttggaggatc

SEQ ID NO: 581086 - DNA, 20 bp, Artificial Sequence
  chemically synthesized
ctaggccatttgaaatgttc

SEQ ID NO: 581087 - DNA, 20 bp, Artificial Sequence
  chemically synthesized
tgtgaactggaatcagacca

SEQ ID NO: 581088 - DNA, 20 bp, Artificial Sequence
  chemically synthesized
cagattttaaaagcaccttg

SEQ ID NO: 581089 - DNA, 20 bp, Artificial Sequence
  chemically synthesized
aggtgcttttaaaatctgtt

SEQ ID NO: 581090 - DNA, 20 bp, Artificial Sequence
  chemically synthesized
acaatctctcataaacatat

SEQ ID NO: 581091 - DNA, 20 bp, Artificial Sequence
  chemically synthesized
aaaatctgttatatgtttat

SEQ ID NO: 581092 - DNA, 20 bp, Artificial Sequence
  chemically synthesized
ggtagtgaattttcagtctt

SEQ ID NO: 581093 - DNA, 20 bp, Artificial Sequence
  chemically synthesized
ctacccattgcaaagtctgg

SEQ ID NO: 581094 - DNA, 20 bp, Artificial Sequence
  chemically synthesized
ccattgcaaagtctgggtct

SEQ ID NO: 581095 - DNA, 20 bp, Artificial Sequence
  chemically synthesized
aaagtctgggtctgtttgct

SEQ ID NO: 581096 - DNA, 20 bp, Artificial Sequence
  chemically synthesized
tctgtttgctttgggtttct

SEQ ID NO: 581097 - DNA, 20 bp, Artificial Sequence
  chemically synthesized
gctttgggtttcttctggct

SEQ ID NO: 581098 - DNA, 20 bp, Artificial Sequence
  chemically synthesized
tgggtttcttctggcttttt

SEQ ID NO: 581099 - DNA, 20 bp, Artificial Sequence
  chemically synthesized
ttttgtttgcttttcaaaca

SEQ ID NO: 581100 - DNA, 20 bp, Artificial Sequence
  chemically synthesized
ctaaagaggttaataaaacg

SEQ ID NO: 581101 - DNA, 20 bp, Artificial Sequence
  chemically synthesized
atggtcatggagatgatgat

SEQ ID NO: 581102 - DNA, 20 bp, Artificial Sequence
  chemically synthesized
gaatgccataaatacttact

SEQ ID NO: 581103 - DNA, 20 bp, Artificial Sequence
  chemically synthesized
acgggaatgccataaatact

SEQ ID NO: 581104 - DNA, 20 bp, Artificial Sequence
  chemically synthesized
taattcaaatataaaggagt

SEQ ID NO: 581105 - DNA, 20 bp, Artificial Sequence
  chemically synthesized
aatataaaggagtaaccgtt

SEQ ID NO: 581106 - DNA, 20 bp, Artificial Sequence
  chemically synthesized
gaggacattctccatgtagt

SEQ ID NO: 581107 - DNA, 20 bp, Artificial Sequence
  chemically synthesized
catctgtaagttacaaatgc

SEQ ID NO: 581108 - DNA, 20 bp, Artificial Sequence
  chemically synthesized
gatacggagatgggagggca

SEQ ID NO: 581109 - DNA, 20 bp, Artificial Sequence
  chemically synthesized
tcccacttttcctactcgaa

SEQ ID NO: 581110 - DNA, 20 bp, Artificial Sequence
  chemically synthesized
cacggctcctggccgctaac

SEQ ID NO: 581111 - DNA, 20 bp, Artificial Sequence
  chemically synthesized
cgcctcggcctcccaaagtg

SEQ ID NO: 581112 - DNA, 20 bp, Artificial Sequence
  chemically synthesized
ttttgtatttttagtagaga

SEQ ID NO: 581113 - DNA, 20 bp, Artificial Sequence
  chemically synthesized
tgcctcagccatctgagtag

SEQ ID NO: 581114 - DNA, 20 bp, Artificial Sequence
  chemically synthesized
tcagatggctgaggcaggag

SEQ ID NO: 581115 - DNA, 20 bp, Artificial Sequence
  chemically synthesized
aacctccgcctcctgggttc

SEQ ID NO: 581116 - DNA, 20 bp, Artificial Sequence
  chemically synthesized
tttgttttgttttgttgaga

SEQ ID NO: 581117 - DNA, 20 bp, Artificial Sequence
  chemically synthesized
gtttgttttgttttgttttg

SEQ ID NO: 581118 - DNA, 20 bp, Artificial Sequence
  chemically synthesized
tttttgtttgttttgttttg

SEQ ID NO: 581119 - DNA, 20 bp, Artificial Sequence
  chemically synthesized
ttttgtttttgtttgttttg

SEQ ID NO: 581120 - DNA, 20 bp, Artificial Sequence
  chemically synthesized
atatgttttgtttttgtttg

SEQ ID NO: 581121 - DNA, 20 bp, Artificial Sequence
  chemically synthesized
ctaacatatgttttgttttt

SEQ ID NO: 581122 - DNA, 20 bp, Artificial Sequence
  chemically synthesized
aaggctaacatatgttttgt

SEQ ID NO: 581123 - DNA, 20 bp, Artificial Sequence
  chemically synthesized
agataaaaggctaacatatg

SEQ ID NO: 581124 - DNA, 20 bp, Artificial Sequence
  chemically synthesized
tagaaagataaaaggctaac

SEQ ID NO: 581125 - DNA, 20 bp, Artificial Sequence
  chemically synthesized
tttaagcaaaataatgttta

SEQ ID NO: 581126 - DNA, 20 bp, Artificial Sequence
  chemically synthesized
ctaaaacgggctaaacatta

SEQ ID NO: 581127 - DNA, 20 bp, Artificial Sequence
  chemically synthesized
ttctatgcctttaagcaaaa

SEQ ID NO: 581128 - DNA, 20 bp, Artificial Sequence
  chemically synthesized
catgagtcaataaataccca

SEQ ID NO: 581129 - DNA, 20 bp, Artificial Sequence
  chemically synthesized
gaaataaactatcacaaatt

SEQ ID NO: 581130 - DNA, 20 bp, Artificial Sequence
  chemically synthesized
tatataaactatcaatttgt

SEQ ID NO: 581131 - DNA, 20 bp, Artificial Sequence
  chemically synthesized
catgtagatagttataaagt

SEQ ID NO: 581132 - DNA, 20 bp, Artificial Sequence
  chemically synthesized
tacatttggagtcagttatt

SEQ ID NO: 581133 - DNA, 20 bp, Artificial Sequence
  chemically synthesized
aaatgtagcctcctttcagc

SEQ ID NO: 581134 - DNA, 20 bp, Artificial Sequence
  chemically synthesized
ctatttttagaatcagagga

SEQ ID NO: 581135 - DNA, 20 bp, Artificial Sequence
  chemically synthesized
accaggatttaatccaactc

SEQ ID NO: 581136 - DNA, 20 bp, Artificial Sequence
  chemically synthesized
agatcacacagatagcggaa

SEQ ID NO: 581137 - DNA, 20 bp, Artificial Sequence
  chemically synthesized
ggaactcttatacatatata

SEQ ID NO: 581138 - DNA, 20 bp, Artificial Sequence
  chemically synthesized
agtaatactttagatttgtg

SEQ ID NO: 581139 - DNA, 20 bp, Artificial Sequence
  chemically synthesized
atctcataaaagagtaatac

SEQ ID NO: 581140 - DNA, 20 bp, Artificial Sequence
  chemically synthesized
tactttaaaatctgaataaa

SEQ ID NO: 581141 - DNA, 20 bp, Artificial Sequence
  chemically synthesized
acaaataaaatctaacttta

SEQ ID NO: 581142 - DNA, 20 bp, Artificial Sequence
  chemically synthesized
cataaagaagtgaaaatttt

SEQ ID NO: 581143 - DNA, 20 bp, Artificial Sequence
  chemically synthesized
tgacagtttcaaattgtctg

SEQ ID NO: 581144 - DNA, 20 bp, Artificial Sequence
  chemically synthesized
atattctggagttccctgga

SEQ ID NO: 581145 - DNA, 20 bp, Artificial Sequence
  chemically synthesized
aaatgcccacgtttcccttc

SEQ ID NO: 581146 - DNA, 20 bp, Artificial Sequence
  chemically synthesized
tggcagggcaaccaaaatgc

SEQ ID NO: 581147 - DNA, 20 bp, Artificial Sequence
  chemically synthesized
gagacatagcaataaataga

SEQ ID NO: 581148 - DNA, 20 bp, Artificial Sequence
  chemically synthesized
ttattgctatgtctcttaaa

SEQ ID NO: 581149 - DNA, 20 bp, Artificial Sequence
  chemically synthesized
acaagaatttgtaaattgct

SEQ ID NO: 581150 - DNA, 20 bp, Artificial Sequence
  chemically synthesized
tgtaaaatggggaattcttt

SEQ ID NO: 581151 - DNA, 20 bp, Artificial Sequence
  chemically synthesized
ctcctcttagtggctcctac

SEQ ID NO: 581152 - DNA, 20 bp, Artificial Sequence
  chemically synthesized
tacctgttcctcatgaagga

SEQ ID NO: 581153 - DNA, 20 bp, Artificial Sequence
  chemically synthesized
gcactttacctgttcctcat

SEQ ID NO: 581154 - DNA, 20 bp, Artificial Sequence
  chemically synthesized
atgaggaacaggtaaagtgc

SEQ ID NO: 581155 - DNA, 20 bp, Artificial Sequence
  chemically synthesized
tgttcacattttcaggttga

SEQ ID NO: 581156 - DNA, 20 bp, Artificial Sequence
  chemically synthesized
tatcacttcatggcacactt

SEQ ID NO: 581157 - DNA, 20 bp, Artificial Sequence
  chemically synthesized
ttctgtttaattacagagaa

SEQ ID NO: 581158 - DNA, 20 bp, Artificial Sequence
  chemically synthesized
tcttattctgtgcatttgag

SEQ ID NO: 581159 - DNA, 20 bp, Artificial Sequence
  chemically synthesized
ttttatcttttcaaacattc

SEQ ID NO: 581160 - DNA, 20 bp, Artificial Sequence
  chemically synthesized
aattgtctgttcaaacaaca

SEQ ID NO: 581161 - DNA, 20 bp, Artificial Sequence
  chemically synthesized
ggaaaggaaaggcagggagt

SEQ ID NO: 581162 - DNA, 20 bp, Artificial Sequence
  chemically synthesized
tttcctttcctcgaccagtt

SEQ ID NO: 581163 - DNA, 20 bp, Artificial Sequence
  chemically synthesized
caataagcctgacaattgga

SEQ ID NO: 581164 - DNA, 20 bp, Artificial Sequence
  chemically synthesized
gaaaaatctgactccaattg

SEQ ID NO: 581165 - DNA, 20 bp, Artificial Sequence
  chemically synthesized
atcctttgtaggggaccccc

SEQ ID NO: 581166 - DNA, 20 bp, Artificial Sequence
  chemically synthesized
tgtttccaattactgcatgg

SEQ ID NO: 581167 - DNA, 20 bp, Artificial Sequence
  chemically synthesized
ttcagtgtttccaattactg

SEQ ID NO: 581168 - DNA, 20 bp, Artificial Sequence
  chemically synthesized
tatacagaattttctatttt

SEQ ID NO: 581169 - DNA, 20 bp, Artificial Sequence
  chemically synthesized
aatagaaaattctgtataca

SEQ ID NO: 581170 - DNA, 20 bp, Artificial Sequence
  chemically synthesized
tgaaaaaaataggttttcca

SEQ ID NO: 581171 - DNA, 20 bp, Artificial Sequence
  chemically synthesized
agtcgagggccttgaaaaaa

SEQ ID NO: 581172 - DNA, 20 bp, Artificial Sequence
  chemically synthesized
aaatttgtctttcctgacag

SEQ ID NO: 581173 - DNA, 20 bp, Artificial Sequence
  chemically synthesized
gaactctcaataatgaggat

SEQ ID NO: 581174 - DNA, 20 bp, Artificial Sequence
  chemically synthesized
cataggttgaggcctccata

SEQ ID NO: 581175 - DNA, 20 bp, Artificial Sequence
  chemically synthesized
aaccgtgaaaaacaactgcc

SEQ ID NO: 581176 - DNA, 20 bp, Artificial Sequence
  chemically synthesized
gggtggcttaaacaacaggc

SEQ ID NO: 581177 - DNA, 20 bp, Artificial Sequence
  chemically synthesized
taaaataatgccatagactg

SEQ ID NO: 581178 - DNA, 20 bp, Artificial Sequence
  chemically synthesized
tggcattattttatagcagc

SEQ ID NO: 581179 - DNA, 20 bp, Artificial Sequence
  chemically synthesized
acttccatactagtttggtg

SEQ ID NO: 581180 - DNA, 20 bp, Artificial Sequence
  chemically synthesized
gggatcctgataacttccat

SEQ ID NO: 581181 - DNA, 20 bp, Artificial Sequence
  chemically synthesized
agtatggaagttatcaggat

SEQ ID NO: 581182 - DNA, 20 bp, Artificial Sequence
  chemically synthesized
gatgagaaaattaactgttg

SEQ ID NO: 581183 - DNA, 20 bp, Artificial Sequence
  chemically synthesized
tgtcactaagggggcagagc

SEQ ID NO: 581184 - DNA, 20 bp, Artificial Sequence
  chemically synthesized
cttggaccaagtgctcttat

SEQ ID NO: 581185 - DNA, 20 bp, Artificial Sequence
  chemically synthesized
gacaggttctacctttatcc

SEQ ID NO: 581186 - DNA, 20 bp, Artificial Sequence
  chemically synthesized
atggttgctgatgttggttt

SEQ ID NO: 581187 - DNA, 20 bp, Artificial Sequence
  chemically synthesized
ggaaacaaatggttgctgat

SEQ ID NO: 581188 - DNA, 20 bp, Artificial Sequence
  chemically synthesized
ataaaccaacatcagcaacc

SEQ ID NO: 581189 - DNA, 20 bp, Artificial Sequence
  chemically synthesized
caaccatttgtttcctgact

SEQ ID NO: 581190 - DNA, 20 bp, Artificial Sequence
  chemically synthesized
gttttatatgagaaaaaagc

SEQ ID NO: 581191 - DNA, 20 bp, Artificial Sequence
  chemically synthesized
tatatgagaaaaaagctcct

SEQ ID NO: 581192 - DNA, 20 bp, Artificial Sequence
  chemically synthesized
cttcagtggctaaaacaaac

SEQ ID NO: 581193 - DNA, 20 bp, Artificial Sequence
  chemically synthesized
tgttttagccactgaagtaa

SEQ ID NO: 581194 - DNA, 20 bp, Artificial Sequence
  chemically synthesized
ttgtgtaatcaggtagatag

SEQ ID NO: 581195 - DNA, 20 bp, Artificial Sequence
  chemically synthesized
agaggaaagctatactatct

SEQ ID NO: 581196 - DNA, 20 bp, Artificial Sequence
  chemically synthesized
cttaatccccattcttgatt

SEQ ID NO: 581197 - DNA, 20 bp, Artificial Sequence
  chemically synthesized
tctaatccagaaatcaagaa

SEQ ID NO: 581198 - DNA, 20 bp, Artificial Sequence
  chemically synthesized
ttaatttccttaatccccat

SEQ ID NO: 581199 - DNA, 20 bp, Artificial Sequence
  chemically synthesized
aacataaaagtaataatcgc

SEQ ID NO: 581200 - DNA, 20 bp, Artificial Sequence
  chemically synthesized
aacaatggtgatgaaagcaa

SEQ ID NO: 581201 - DNA, 20 bp, Artificial Sequence
  chemically synthesized
taattatctcataaccaact

SEQ ID NO: 581202 - DNA, 20 bp, Artificial Sequence
  chemically synthesized
ttgttaggcctccaaaattc

SEQ ID NO: 581203 - DNA, 20 bp, Artificial Sequence
  chemically synthesized
gaaaatatgggtattgtaaa

SEQ ID NO: 581204 - DNA, 20 bp, Artificial Sequence
  chemically synthesized
atcatcatgtcccggagcta

SEQ ID NO: 581205 - DNA, 20 bp, Artificial Sequence
  chemically synthesized
gctataaagttttggtgggt

SEQ ID NO: 581206 - DNA, 20 bp, Artificial Sequence
  chemically synthesized
acgtgcagaataacatgtgt

SEQ ID NO: 581207 - DNA, 20 bp, Artificial Sequence
  chemically synthesized
ggaaacacgtgcagaataac

SEQ ID NO: 581208 - DNA, 20 bp, Artificial Sequence
  chemically synthesized
aaaaacacatgttattctgc

SEQ ID NO: 581209 - DNA, 20 bp, Artificial Sequence
  chemically synthesized
tgcaacttttagggcaaaga

SEQ ID NO: 581210 - DNA, 20 bp, Artificial Sequence
  chemically synthesized
atattcaaagcaacatggga

SEQ ID NO: 581211 - DNA, 20 bp, Artificial Sequence
  chemically synthesized
ttttctgaaacatgatccca

SEQ ID NO: 581212 - DNA, 20 bp, Artificial Sequence
  chemically synthesized
agcaacctatgagttttgcc

SEQ ID NO: 581213 - DNA, 20 bp, Artificial Sequence
  chemically synthesized
aactcagggcaaaactcata

SEQ ID NO: 581214 - DNA, 20 bp, Artificial Sequence
  chemically synthesized
taccccaggacaagcaacct

SEQ ID NO: 581215 - DNA, 20 bp, Artificial Sequence
  chemically synthesized
agtgttcttatgatgtggtg

SEQ ID NO: 581216 - DNA, 20 bp, Artificial Sequence
  chemically synthesized
tcaagtagtcccatggagga

SEQ ID NO: 581217 - DNA, 20 bp, Artificial Sequence
  chemically synthesized
ttgtgagttggtgctgtcta

SEQ ID NO: 581218 - DNA, 20 bp, Artificial Sequence
  chemically synthesized
ctttcacagtgagttacttg

SEQ ID NO: 581219 - DNA, 20 bp, Artificial Sequence
  chemically synthesized
atgatggcttgactggggct

SEQ ID NO: 581220 - DNA, 20 bp, Artificial Sequence
  chemically synthesized
caattaggctgcagtcatat

SEQ ID NO: 581221 - DNA, 20 bp, Artificial Sequence
  chemically synthesized
tctgtaggtcaggattcatg

SEQ ID NO: 581222 - DNA, 20 bp, Artificial Sequence
  chemically synthesized
tcactcataggttctgtagg

SEQ ID NO: 581223 - DNA, 20 bp, Artificial Sequence
  chemically synthesized
cagaacctatgagtgataat

SEQ ID NO: 581224 - DNA, 20 bp, Artificial Sequence
  chemically synthesized
attattgctactttaggaca

SEQ ID NO: 581225 - DNA, 20 bp, Artificial Sequence
  chemically synthesized
actttaggacactaagtttg

SEQ ID NO: 581226 - DNA, 20 bp, Artificial Sequence
  chemically synthesized
taggacactaagtttggggt

SEQ ID NO: 581227 - DNA, 20 bp, Artificial Sequence
  chemically synthesized
ttgttctacttttgtcagga

SEQ ID NO: 581228 - DNA, 20 bp, Artificial Sequence
  chemically synthesized
cctgacaaaagtagaacaag

SEQ ID NO: 581229 - DNA, 20 bp, Artificial Sequence
  chemically synthesized
tctacatgaaaaggggaaag

SEQ ID NO: 581230 - DNA, 20 bp, Artificial Sequence
  chemically synthesized
taaagtaagtaggaaggatt

SEQ ID NO: 581231 - DNA, 20 bp, Artificial Sequence
  chemically synthesized
aacatttataaagtaagtag

SEQ ID NO: 581232 - DNA, 20 bp, Artificial Sequence
  chemically synthesized
atccttcctacttactttat

SEQ ID NO: 581233 - DNA, 20 bp, Artificial Sequence
  chemically synthesized
ttacttatacatgatttgaa

SEQ ID NO: 581234 - DNA, 20 bp, Artificial Sequence
  chemically synthesized
ctttaccaaaatttacttat

SEQ ID NO: 581235 - DNA, 20 bp, Artificial Sequence
  chemically synthesized
tctcaagttatagaaaattg

SEQ ID NO: 581236 - DNA, 20 bp, Artificial Sequence
  chemically synthesized
ttttaggaacagtccatggc

SEQ ID NO: 581237 - DNA, 20 bp, Artificial Sequence
  chemically synthesized
tccatggcacgtgtttaacc

SEQ ID NO: 581238 - DNA, 20 bp, Artificial Sequence
  chemically synthesized
ggcacgtgtttaacccttgg

SEQ ID NO: 581239 - DNA, 20 bp, Artificial Sequence
  chemically synthesized
agcccagaaagagatactct

SEQ ID NO: 581240 - DNA, 20 bp, Artificial Sequence
  chemically synthesized
gtatctctttctgggctcat

SEQ ID NO: 581241 - DNA, 20 bp, Artificial Sequence
  chemically synthesized
ttcttccttttttgtgataa

SEQ ID NO: 581242 - DNA, 20 bp, Artificial Sequence
  chemically synthesized
aagaaaaactattttcttta

SEQ ID NO: 581243 - DNA, 20 bp, Artificial Sequence
  chemically synthesized
taaataaaccaattaaagaa

SEQ ID NO: 581244 - DNA, 20 bp, Artificial Sequence
  chemically synthesized
tttaattggtttatttattt

SEQ ID NO: 581245 - DNA, 20 bp, Artificial Sequence
  chemically synthesized
ttggtttatttatttaatag

SEQ ID NO: 581246 - DNA, 20 bp, Artificial Sequence
  chemically synthesized
ttatttaatagttttgttta

SEQ ID NO: 581247 - DNA, 20 bp, Artificial Sequence
  chemically synthesized
ggggaaagatctgggttaac

SEQ ID NO: 581248 - DNA, 20 bp, Artificial Sequence
  chemically synthesized
actaattgtttttgtcttca

SEQ ID NO: 581249 - DNA, 20 bp, Artificial Sequence
  chemically synthesized
cataaatagtgttttctact

SEQ ID NO: 581250 - DNA, 20 bp, Artificial Sequence
  chemically synthesized
accataattatgaacataaa

SEQ ID NO: 581251 - DNA, 20 bp, Artificial Sequence
  chemically synthesized
ttcctattataaactcactt

SEQ ID NO: 581252 - DNA, 20 bp, Artificial Sequence
  chemically synthesized
tttaattataaatctttcaa

SEQ ID NO: 581253 - DNA, 20 bp, Artificial Sequence
  chemically synthesized
aatataatcgcaacaggtaa

SEQ ID NO: 581254 - DNA, 20 bp, Artificial Sequence
  chemically synthesized
tttaaaatccaaattacctg

SEQ ID NO: 581255 - DNA, 20 bp, Artificial Sequence
  chemically synthesized
ggattttaaatcctattcaa

SEQ ID NO: 581256 - DNA, 20 bp, Artificial Sequence
  chemically synthesized
taatatcaaaacatatttga

SEQ ID NO: 581257 - DNA, 20 bp, Artificial Sequence
  chemically synthesized
tgtatttcatttttaaatta

SEQ ID NO: 581258 - DNA, 20 bp, Artificial Sequence
  chemically synthesized
ctaattacctatcatgaaat

SEQ ID NO: 581259 - DNA, 20 bp, Artificial Sequence
  chemically synthesized
cgtataggaagaaaaaacat

SEQ ID NO: 581260 - DNA, 20 bp, Artificial Sequence
  chemically synthesized
aactgatatataaaaaacaa

SEQ ID NO: 581261 - DNA, 20 bp, Artificial Sequence
  chemically synthesized
aacatacttgttttttatat

SEQ ID NO: 581262 - DNA, 20 bp, Artificial Sequence
  chemically synthesized
actaaaaaaataaaagaacc

SEQ ID NO: 581263 - DNA, 20 bp, Artificial Sequence
  chemically synthesized
atcatgaggttcataatgtc

SEQ ID NO: 581264 - DNA, 20 bp, Artificial Sequence
  chemically synthesized
ttggctgggctatggttccc

SEQ ID NO: 581265 - DNA, 20 bp, Artificial Sequence
  chemically synthesized
cttcacagcaacatctagat

SEQ ID NO: 581266 - DNA, 20 bp, Artificial Sequence
  chemically synthesized
aaaataccttcacagcaaca

SEQ ID NO: 581267 - DNA, 20 bp, Artificial Sequence
  chemically synthesized
gctgtgaaggtattttttag

SEQ ID NO: 581268 - DNA, 20 bp, Artificial Sequence
  chemically synthesized
aatctgctttactcaaagtc

SEQ ID NO: 581269 - DNA, 20 bp, Artificial Sequence
  chemically synthesized
aatcagcagactttgagtaa

SEQ ID NO: 581270 - DNA, 20 bp, Artificial Sequence
  chemically synthesized
cacccacattgtggagggta

SEQ ID NO: 581271 - DNA, 20 bp, Artificial Sequence
  chemically synthesized
ttttctcttaaggacttcaa

SEQ ID NO: 581272 - DNA, 20 bp, Artificial Sequence
  chemically synthesized
gaaaaggaaggaattctgct

SEQ ID NO: 581273 - DNA, 20 bp, Artificial Sequence
  chemically synthesized
ctatcggattacctttggac

SEQ ID NO: 581274 - DNA, 20 bp, Artificial Sequence
  chemically synthesized
ttcccttggtctccatcctg

SEQ ID NO: 581275 - DNA, 20 bp, Artificial Sequence
  chemically synthesized
ggtctccatcctgccaggct

SEQ ID NO: 581276 - DNA, 20 bp, Artificial Sequence
  chemically synthesized
cctgccaggcttttggattt

SEQ ID NO: 581277 - DNA, 20 bp, Artificial Sequence
  chemically synthesized
ctcccacaatcatatgagtt

SEQ ID NO: 581278 - DNA, 20 bp, Artificial Sequence
  chemically synthesized
tgattttaagccattaactc

SEQ ID NO: 581279 - DNA, 20 bp, Artificial Sequence
  chemically synthesized
gagagagagagagagagaga

SEQ ID NO: 581280 - DNA, 20 bp, Artificial Sequence
  chemically synthesized
gagagagagagagagagaga

SEQ ID NO: 581281 - DNA, 20 bp, Artificial Sequence
  chemically synthesized
gagagagagtgagagagaga

SEQ ID NO: 581282 - DNA, 20 bp, Artificial Sequence
  chemically synthesized
tatcaattcaccattatcat

SEQ ID NO: 581283 - DNA, 20 bp, Artificial Sequence
  chemically synthesized
tacaggtgaaatattggact

SEQ ID NO: 581284 - DNA, 20 bp, Artificial Sequence
  chemically synthesized
ttgggcctgagaacatttat

SEQ ID NO: 581285 - DNA, 20 bp, Artificial Sequence
  chemically synthesized
taaatgttctcaggcccaag

SEQ ID NO: 581286 - DNA, 20 bp, Artificial Sequence
  chemically synthesized
ttcttcctgttgaataatta

SEQ ID NO: 581287 - DNA, 20 bp, Artificial Sequence
  chemically synthesized
agctgtaagaattttaacaa

SEQ ID NO: 581288 - DNA, 20 bp, Artificial Sequence
  chemically synthesized
gtcacacatcctttagcaaa

SEQ ID NO: 581289 - DNA, 20 bp, Artificial Sequence
  chemically synthesized
gacagatattatgtcattta

SEQ ID NO: 581290 - DNA, 20 bp, Artificial Sequence
  chemically synthesized
atttatttatttatttacga

SEQ ID NO: 581291 - DNA, 20 bp, Artificial Sequence
  chemically synthesized
tcgggaggctgaggcaggag

SEQ ID NO: 581292 - DNA, 20 bp, Artificial Sequence
  chemically synthesized
tgcctcagcctcccgagtag

SEQ ID NO: 581293 - DNA, 20 bp, Artificial Sequence
  chemically synthesized
ttttgtatttttagtagaga

SEQ ID NO: 581294 - DNA, 20 bp, Artificial Sequence
  chemically synthesized
ggcttcaccatgttagccag

SEQ ID NO: 581295 - DNA, 20 bp, Artificial Sequence
  chemically synthesized
actcctgacctcaggtgatc

SEQ ID NO: 581296 - DNA, 20 bp, Artificial Sequence
  chemically synthesized
aattcttattaaaatttctc

SEQ ID NO: 581297 - DNA, 20 bp, Artificial Sequence
  chemically synthesized
cttgtaggtctaatgaaccc

SEQ ID NO: 581298 - DNA, 20 bp, Artificial Sequence
  chemically synthesized
ataccagggaaattagccat

SEQ ID NO: 581299 - DNA, 20 bp, Artificial Sequence
  chemically synthesized
gattgttgtgtttaggtaga

SEQ ID NO: 581300 - DNA, 20 bp, Artificial Sequence
  chemically synthesized
tagctgaggattaaagattg

SEQ ID NO: 581301 - DNA, 20 bp, Artificial Sequence
  chemically synthesized
gaaactctttagctgaggat

SEQ ID NO: 581302 - DNA, 20 bp, Artificial Sequence
  chemically synthesized
caatctttaatcctcagcta

SEQ ID NO: 581303 - DNA, 20 bp, Artificial Sequence
  chemically synthesized
aagtatagaaactctttagc

SEQ ID NO: 581304 - DNA, 20 bp, Artificial Sequence
  chemically synthesized
tgtacaaccattcaagtaac

SEQ ID NO: 581305 - DNA, 20 bp, Artificial Sequence
  chemically synthesized
aatttatagatgctacactg

SEQ ID NO: 581306 - DNA, 20 bp, Artificial Sequence
  chemically synthesized
cgcctcggcctcccaaagtg

SEQ ID NO: 581307 - DNA, 20 bp, Artificial Sequence
  chemically synthesized
cgggtggatcacctgaagtc

SEQ ID NO: 581308 - DNA, 20 bp, Artificial Sequence
  chemically synthesized
ttttgtatttttagtaggga

SEQ ID NO: 581309 - DNA, 20 bp, Artificial Sequence
  chemically synthesized
tcggtaggctgaggcaagag

SEQ ID NO: 581310 - DNA, 20 bp, Artificial Sequence
  chemically synthesized
tgctcactgcaactccgcct

SEQ ID NO: 581311 - DNA, 20 bp, Artificial Sequence
  chemically synthesized
ttattattcagtgtgtgtct

SEQ ID NO: 581312 - DNA, 20 bp, Artificial Sequence
  chemically synthesized
ccttaaatgtaaaccaactt

SEQ ID NO: 581313 - DNA, 20 bp, Artificial Sequence
  chemically synthesized
acctaggaaaaagcctagaa

SEQ ID NO: 581314 - DNA, 20 bp, Artificial Sequence
  chemically synthesized
tcaaaagttacctggaatgt

SEQ ID NO: 581315 - DNA, 20 bp, Artificial Sequence
  chemically synthesized
taacatcactcctgcaatct

SEQ ID NO: 581316 - DNA, 20 bp, Artificial Sequence
  chemically synthesized
taaagaaatggttgaaaaca

SEQ ID NO: 581317 - DNA, 20 bp, Artificial Sequence
  chemically synthesized
catgaagctagatgaccata

SEQ ID NO: 581318 - DNA, 20 bp, Artificial Sequence
  chemically synthesized
ttaaaatctcagtatggtca

SEQ ID NO: 581319 - DNA, 20 bp, Artificial Sequence
  chemically synthesized
tgattatgggagacaaagta

SEQ ID NO: 581320 - DNA, 20 bp, Artificial Sequence
  chemically synthesized
cccataatcaactccttatc

SEQ ID NO: 581321 - DNA, 20 bp, Artificial Sequence
  chemically synthesized
gagacaaactcaggataagg

SEQ ID NO: 581322 - DNA, 20 bp, Artificial Sequence
  chemically synthesized
agttggagattgaattcttt

SEQ ID NO: 581323 - DNA, 20 bp, Artificial Sequence
  chemically synthesized
gaaggcctgcctctaagagt

SEQ ID NO: 581324 - DNA, 20 bp, Artificial Sequence
  chemically synthesized
ctcttagaggcaggccttct

SEQ ID NO: 581325 - DNA, 20 bp, Artificial Sequence
  chemically synthesized
ggcaggccttctcttagatt

SEQ ID NO: 581326 - DNA, 20 bp, Artificial Sequence
  chemically synthesized
tagaattaacaggattttga

SEQ ID NO: 581327 - DNA, 20 bp, Artificial Sequence
  chemically synthesized
ataaggtggagctagaatta

SEQ ID NO: 581328 - DNA, 20 bp, Artificial Sequence
  chemically synthesized
ttttactccatggtcactgc

SEQ ID NO: 581329 - DNA, 20 bp, Artificial Sequence
  chemically synthesized
tcctgaaatacccttccctc

SEQ ID NO: 581330 - DNA, 20 bp, Artificial Sequence
  chemically synthesized
cccttccctctccagcttcc

SEQ ID NO: 581331 - DNA, 20 bp, Artificial Sequence
  chemically synthesized
ttttaaatgagggcttagtg

SEQ ID NO: 581332 - DNA, 20 bp, Artificial Sequence
  chemically synthesized
ctagaggaggagttttaaat

SEQ ID NO: 581333 - DNA, 20 bp, Artificial Sequence
  chemically synthesized
ccctcatttaaaactcctcc

SEQ ID NO: 581334 - DNA, 20 bp, Artificial Sequence
  chemically synthesized
tgttgagagaaaactagagg

SEQ ID NO: 581335 - DNA, 20 bp, Artificial Sequence
  chemically synthesized
taggcaaggcagtttaggat

SEQ ID NO: 581336 - DNA, 20 bp, Artificial Sequence
  chemically synthesized
ggacaagtatatttaggcaa

SEQ ID NO: 581337 - DNA, 20 bp, Artificial Sequence
  chemically synthesized
atacttgtccaaatacccac

SEQ ID NO: 581338 - DNA, 20 bp, Artificial Sequence
  chemically synthesized
agaggggatacaggaaaaaa

SEQ ID NO: 581339 - DNA, 20 bp, Artificial Sequence
  chemically synthesized
agagttcagttcagttcagc

SEQ ID NO: 581340 - DNA, 20 bp, Artificial Sequence
  chemically synthesized
tagtggatgtgaattttgag

SEQ ID NO: 581341 - DNA, 20 bp, Artificial Sequence
  chemically synthesized
tcaggtattgtctattagat

SEQ ID NO: 581342 - DNA, 20 bp, Artificial Sequence
  chemically synthesized
ggctggcatttcattagcaa

SEQ ID NO: 581343 - DNA, 20 bp, Artificial Sequence
  chemically synthesized
gagcctttttatttcgccat

SEQ ID NO: 581344 - DNA, 20 bp, Artificial Sequence
  chemically synthesized
tatttcgccatgaaggattt

SEQ ID NO: 581345 - DNA, 20 bp, Artificial Sequence
  chemically synthesized
gaattaactgacagttttat

SEQ ID NO: 581346 - DNA, 20 bp, Artificial Sequence
  chemically synthesized
acacgatttttgaattaact

SEQ ID NO: 581347 - DNA, 20 bp, Artificial Sequence
  chemically synthesized
taattcaaaaatcgtgtgag

SEQ ID NO: 581348 - DNA, 20 bp, Artificial Sequence
  chemically synthesized
aataaaaaaaaacatctctc

SEQ ID NO: 581349 - DNA, 20 bp, Artificial Sequence
  chemically synthesized
aattcttagagaaatttagt

SEQ ID NO: 581350 - DNA, 20 bp, Artificial Sequence
  chemically synthesized
tttggaattattttttcagc

SEQ ID NO: 581351 - DNA, 20 bp, Artificial Sequence
  chemically synthesized
aattccaagttttaagaggg

SEQ ID NO: 581352 - DNA, 20 bp, Artificial Sequence
  chemically synthesized
ctccctcttaaaacttggaa

SEQ ID NO: 581353 - DNA, 20 bp, Artificial Sequence
  chemically synthesized
aggacttctgaaacagaatt

SEQ ID NO: 581354 - DNA, 20 bp, Artificial Sequence
  chemically synthesized
tctgtttcagaagtccttcc

SEQ ID NO: 581355 - DNA, 20 bp, Artificial Sequence
  chemically synthesized
ggtacatattgttatggtga

SEQ ID NO: 581356 - DNA, 20 bp, Artificial Sequence
  chemically synthesized
gattaagaaagtaaaataat

SEQ ID NO: 581357 - DNA, 20 bp, Artificial Sequence
  chemically synthesized
taatagtacttatgctggta

SEQ ID NO: 581358 - DNA, 20 bp, Artificial Sequence
  chemically synthesized
cacatgacagatgagagaac

SEQ ID NO: 581359 - DNA, 20 bp, Artificial Sequence
  chemically synthesized
aacacatgtaaaagacaatc

SEQ ID NO: 581360 - DNA, 20 bp, Artificial Sequence
  chemically synthesized
gtgtatttgagtgtctaatc

SEQ ID NO: 581361 - DNA, 20 bp, Artificial Sequence
  chemically synthesized
tggatatacatttttgctgc

SEQ ID NO: 581362 - DNA, 20 bp, Artificial Sequence
  chemically synthesized
ccttttccatttgatgtgcc

SEQ ID NO: 581363 - DNA, 20 bp, Artificial Sequence
  chemically synthesized
ggctttaaaatcatatagac

SEQ ID NO: 581364 - DNA, 20 bp, Artificial Sequence
  chemically synthesized
tagaattcaagcccacgtct

SEQ ID NO: 581365 - DNA, 20 bp, Artificial Sequence
  chemically synthesized
gttacgttagctctccgagt

SEQ ID NO: 581366 - DNA, 20 bp, Artificial Sequence
  chemically synthesized
attttgcagtatttcccaca

SEQ ID NO: 581367 - DNA, 20 bp, Artificial Sequence
  chemically synthesized
cacaaaaggctttcctgaat

SEQ ID NO: 581368 - DNA, 20 bp, Artificial Sequence
  chemically synthesized
ttaaaagaccgacaggagaa

SEQ ID NO: 581369 - DNA, 20 bp, Artificial Sequence
  chemically synthesized
ccccaccaccaccccaaaag

SEQ ID NO: 581370 - DNA, 20 bp, Artificial Sequence
  chemically synthesized
tacttaatgagctttttggt

SEQ ID NO: 581371 - DNA, 20 bp, Artificial Sequence
  chemically synthesized
ggcttaatgcaaaatactta

SEQ ID NO: 581372 - DNA, 20 bp, Artificial Sequence
  chemically synthesized
ataatctattggggtgcttt

SEQ ID NO: 581373 - DNA, 20 bp, Artificial Sequence
  chemically synthesized
ttaagccttcaaagcacccc

SEQ ID NO: 581374 - DNA, 20 bp, Artificial Sequence
  chemically synthesized
attttaattataatctattg

SEQ ID NO: 581375 - DNA, 20 bp, Artificial Sequence
  chemically synthesized
ataacaaatgctaacattca

SEQ ID NO: 581376 - DNA, 20 bp, Artificial Sequence
  chemically synthesized
tataactatctcatgggttg

SEQ ID NO: 581377 - DNA, 20 bp, Artificial Sequence
  chemically synthesized
agagaaggaaactaagagca

SEQ ID NO: 581378 - DNA, 20 bp, Artificial Sequence
  chemically synthesized
atctcagtaaactatctgct

SEQ ID NO: 581379 - DNA, 20 bp, Artificial Sequence
  chemically synthesized
aactaagagcagatagttta

SEQ ID NO: 581380 - DNA, 20 bp, Artificial Sequence
  chemically synthesized
gctgcctagactggccactt

SEQ ID NO: 581381 - DNA, 20 bp, Artificial Sequence
  chemically synthesized
ggatttaagagccttgtttc

SEQ ID NO: 581382 - DNA, 20 bp, Artificial Sequence
  chemically synthesized
gtaacatttggatttaagag

SEQ ID NO: 581383 - DNA, 20 bp, Artificial Sequence
  chemically synthesized
tgaatgtcgttcctgtaaca

SEQ ID NO: 581384 - DNA, 20 bp, Artificial Sequence
  chemically synthesized
acaggaacgacattcaccaa

SEQ ID NO: 581385 - DNA, 20 bp, Artificial Sequence
  chemically synthesized
aaaactgcttccttttatca

SEQ ID NO: 581386 - DNA, 20 bp, Artificial Sequence
  chemically synthesized
taaacagaatgataaaagga

SEQ ID NO: 581387 - DNA, 20 bp, Artificial Sequence
  chemically synthesized
aagaggatttggaaagataa

SEQ ID NO: 581388 - DNA, 20 bp, Artificial Sequence
  chemically synthesized
aataccttgcatagcagtga

SEQ ID NO: 581389 - DNA, 20 bp, Artificial Sequence
  chemically synthesized
cagtattaacagacacgaac

SEQ ID NO: 581390 - DNA, 20 bp, Artificial Sequence
  chemically synthesized
atttaaattcttctaatctt

SEQ ID NO: 581391 - DNA, 20 bp, Artificial Sequence
  chemically synthesized
ggtcaggggaccaaaagcag

SEQ ID NO: 581392 - DNA, 20 bp, Artificial Sequence
  chemically synthesized
ttgcagaagaaaatggccag

SEQ ID NO: 581393 - DNA, 20 bp, Artificial Sequence
  chemically synthesized
gagggagaatttttcatttg

SEQ ID NO: 581394 - DNA, 20 bp, Artificial Sequence
  chemically synthesized
agacaaaatttactctctta

SEQ ID NO: 581395 - DNA, 20 bp, Artificial Sequence
  chemically synthesized
ctcttacctagattattact

SEQ ID NO: 581396 - DNA, 20 bp, Artificial Sequence
  chemically synthesized
aatacaacagataccacggt

SEQ ID NO: 581397 - DNA, 20 bp, Artificial Sequence
  chemically synthesized
ttcatatagtaaaacatggt

SEQ ID NO: 581398 - DNA, 20 bp, Artificial Sequence
  chemically synthesized
attgggtgtgcaagccacca

SEQ ID NO: 581399 - DNA, 20 bp, Artificial Sequence
  chemically synthesized
ggcttgcacacccaattact

SEQ ID NO: 581400 - DNA, 20 bp, Artificial Sequence
  chemically synthesized
gaatatttctagtagacata

SEQ ID NO: 581401 - DNA, 20 bp, Artificial Sequence
  chemically synthesized
gatagactgcaataactatg

SEQ ID NO: 581402 - DNA, 20 bp, Artificial Sequence
  chemically synthesized
caactgttcaaagttatgaa

SEQ ID NO: 581403 - DNA, 20 bp, Artificial Sequence
  chemically synthesized
gggatttaccagagaaagaa

SEQ ID NO: 581404 - DNA, 20 bp, Artificial Sequence
  chemically synthesized
taactattttttctttattt

SEQ ID NO: 581405 - DNA, 20 bp, Artificial Sequence
  chemically synthesized
atttctttttgagcatttct

SEQ ID NO: 581406 - DNA, 20 bp, Artificial Sequence
  chemically synthesized
taaaattgtattttctcatt

SEQ ID NO: 581407 - DNA, 20 bp, Artificial Sequence
  chemically synthesized
agaatttttcttagtaaaga

SEQ ID NO: 581408 - DNA, 20 bp, Artificial Sequence
  chemically synthesized
caaaatagaatttttcttag

SEQ ID NO: 581409 - DNA, 20 bp, Artificial Sequence
  chemically synthesized
ttctattttgaacacgatcg

SEQ ID NO: 581410 - DNA, 20 bp, Artificial Sequence
  chemically synthesized
attgaatttccatcccattt

SEQ ID NO: 581411 - DNA, 20 bp, Artificial Sequence
  chemically synthesized
catttgcagccctgctacac

SEQ ID NO: 581412 - DNA, 20 bp, Artificial Sequence
  chemically synthesized
tgtagcagggctgcaaatga

SEQ ID NO: 581413 - DNA, 20 bp, Artificial Sequence
  chemically synthesized
accaggataattctgacaag

SEQ ID NO: 581414 - DNA, 20 bp, Artificial Sequence
  chemically synthesized
ggctccaggcatatttggaa

SEQ ID NO: 581415 - DNA, 20 bp, Artificial Sequence
  chemically synthesized
ggcatatttggaactaagat

SEQ ID NO: 581416 - DNA, 20 bp, Artificial Sequence
  chemically synthesized
gtgtctgtcgagatgtgtca

SEQ ID NO: 581417 - DNA, 20 bp, Artificial Sequence
  chemically synthesized
tatgacacatctcgacagac

SEQ ID NO: 581418 - DNA, 20 bp, Artificial Sequence
  chemically synthesized
acagacacttgcttttaaga

SEQ ID NO: 581419 - DNA, 20 bp, Artificial Sequence
  chemically synthesized
gaaaatgctttcttggacca

SEQ ID NO: 581420 - DNA, 20 bp, Artificial Sequence
  chemically synthesized
ggtattcattcctaaaagac

SEQ ID NO: 581421 - DNA, 20 bp, Artificial Sequence
  chemically synthesized
atttgaatagttcttctttt

SEQ ID NO: 581422 - DNA, 20 bp, Artificial Sequence
  chemically synthesized
tgtatctctctgccaatatt

SEQ ID NO: 581423 - DNA, 20 bp, Artificial Sequence
  chemically synthesized
taaaattgaatgaccggagg

SEQ ID NO: 581424 - DNA, 20 bp, Artificial Sequence
  chemically synthesized
ttgcattgactttttcatga

SEQ ID NO: 581425 - DNA, 20 bp, Artificial Sequence
  chemically synthesized
tcctcttagggaaaaaattg

SEQ ID NO: 581426 - DNA, 20 bp, Artificial Sequence
  chemically synthesized
atgactctctgtatagtatg

SEQ ID NO: 581427 - DNA, 20 bp, Artificial Sequence
  chemically synthesized
gaaatatggaaatttggcag

SEQ ID NO: 581428 - DNA, 20 bp, Artificial Sequence
  chemically synthesized
tcccattacacaggtaagtg

SEQ ID NO: 581429 - DNA, 20 bp, Artificial Sequence
  chemically synthesized
catattgagtaaatcactca

SEQ ID NO: 581430 - DNA, 20 bp, Artificial Sequence
  chemically synthesized
ccaaaagagtgaatcttagt

SEQ ID NO: 581431 - DNA, 20 bp, Artificial Sequence
  chemically synthesized
atttggtaagatagccatac

SEQ ID NO: 581432 - DNA, 20 bp, Artificial Sequence
  chemically synthesized
ctgttgagcctaggaagagg

SEQ ID NO: 581433 - DNA, 20 bp, Artificial Sequence
  chemically synthesized
ctctggacacaaaagatgga

SEQ ID NO: 581434 - DNA, 20 bp, Artificial Sequence
  chemically synthesized
tcctgaatgacttcatagag

SEQ ID NO: 581435 - DNA, 20 bp, Artificial Sequence
  chemically synthesized
atttctgctgtagtaagcct

SEQ ID NO: 581436 - DNA, 20 bp, Artificial Sequence
  chemically synthesized
gtagtaagcctccaagattt

SEQ ID NO: 581437 - DNA, 20 bp, Artificial Sequence
  chemically synthesized
caggtaatctcccaaatctt

SEQ ID NO: 581438 - DNA, 20 bp, Artificial Sequence
  chemically synthesized
cattagcatacatccacatt

SEQ ID NO: 581439 - DNA, 20 bp, Artificial Sequence
  chemically synthesized
ttgaaagtttaactctttat

SEQ ID NO: 581440 - DNA, 20 bp, Artificial Sequence
  chemically synthesized
aataggctgttcttggtttt

SEQ ID NO: 581441 - DNA, 20 bp, Artificial Sequence
  chemically synthesized
gctaattaaaataggctgtt

SEQ ID NO: 581442 - DNA, 20 bp, Artificial Sequence
  chemically synthesized
gacatgtcttctttcagttg

SEQ ID NO: 581443 - DNA, 20 bp, Artificial Sequence
  chemically synthesized
tttgtctgaaattatgtatg

SEQ ID NO: 581444 - DNA, 20 bp, Artificial Sequence
  chemically synthesized
cttcttttgtctgaaattat

SEQ ID NO: 581445 - DNA, 20 bp, Artificial Sequence
  chemically synthesized
agaagtatttagtcttagta

SEQ ID NO: 581446 - DNA, 20 bp, Artificial Sequence
  chemically synthesized
taccatttcccatcttgttt

SEQ ID NO: 581447 - DNA, 20 bp, Artificial Sequence
  chemically synthesized
agtatgtttaccatttccca

SEQ ID NO: 581448 - DNA, 20 bp, Artificial Sequence
  chemically synthesized
gaaaatctgcgctctttcta

SEQ ID NO: 581449 - DNA, 20 bp, Artificial Sequence
  chemically synthesized
ggtaaacatactagaaagag

SEQ ID NO: 581450 - DNA, 20 bp, Artificial Sequence
  chemically synthesized
tacaaattccaagctctgtt

SEQ ID NO: 581451 - DNA, 20 bp, Artificial Sequence
  chemically synthesized
aattccaagctctgttcttt

SEQ ID NO: 581452 - DNA, 20 bp, Artificial Sequence
  chemically synthesized
gtttacaaacaagcaaagaa

SEQ ID NO: 581453 - DNA, 20 bp, Artificial Sequence
  chemically synthesized
tgggcgacagagcgagactg

SEQ ID NO: 581454 - DNA, 20 bp, Artificial Sequence
  chemically synthesized
gaggcggagcttgcagtgag

SEQ ID NO: 581455 - DNA, 20 bp, Artificial Sequence
  chemically synthesized
aatggcgtgaacccgggagg

SEQ ID NO: 581456 - DNA, 20 bp, Artificial Sequence
  chemically synthesized
ttttgtatttttagtagaga

SEQ ID NO: 581457 - DNA, 20 bp, Artificial Sequence
  chemically synthesized
cgcctcggcctccccaagtg

SEQ ID NO: 581458 - DNA, 20 bp, Artificial Sequence
  chemically synthesized
gccgagtaactgttcttgga

SEQ ID NO: 581459 - DNA, 20 bp, Artificial Sequence
  chemically synthesized
ctgttttctcgtctataaaa

SEQ ID NO: 581460 - DNA, 20 bp, Artificial Sequence
  chemically synthesized
gggattataaaatatagctc

SEQ ID NO: 581461 - DNA, 20 bp, Artificial Sequence
  chemically synthesized
atatagctcacaagattctg

SEQ ID NO: 581462 - DNA, 20 bp, Artificial Sequence
  chemically synthesized
gtgcacatgtgtgtgtttct

SEQ ID NO: 581463 - DNA, 20 bp, Artificial Sequence
  chemically synthesized
tagatggtgtgtgcacatgt

SEQ ID NO: 581464 - DNA, 20 bp, Artificial Sequence
  chemically synthesized
acacatgtgcacacaccatc

SEQ ID NO: 581465 - DNA, 20 bp, Artificial Sequence
  chemically synthesized
attatgaagatatagactct

SEQ ID NO: 581466 - DNA, 20 bp, Artificial Sequence
  chemically synthesized
gatatagactctcatggttt

SEQ ID NO: 581467 - DNA, 20 bp, Artificial Sequence
  chemically synthesized
ttgaaatcttttgtctttta

SEQ ID NO: 581468 - DNA, 20 bp, Artificial Sequence
  chemically synthesized
gtctaagcctggtaaaagac

SEQ ID NO: 581469 - DNA, 20 bp, Artificial Sequence
  chemically synthesized
gagaaaaaaaaagatggctg

SEQ ID NO: 581470 - DNA, 20 bp, Artificial Sequence
  chemically synthesized
tttcctccttcctgcactac

SEQ ID NO: 581471 - DNA, 20 bp, Artificial Sequence
  chemically synthesized
cacacactggtattgaattt

SEQ ID NO: 581472 - DNA, 20 bp, Artificial Sequence
  chemically synthesized
tcaggttctctcagatctct

SEQ ID NO: 581473 - DNA, 20 bp, Artificial Sequence
  chemically synthesized
agaaatgaggtccaagtcag

SEQ ID NO: 581474 - DNA, 20 bp, Artificial Sequence
  chemically synthesized
actcgccacccggtttccct

SEQ ID NO: 581475 - DNA, 20 bp, Artificial Sequence
  chemically synthesized
tctctgagggaaaccgggtg

SEQ ID NO: 581476 - DNA, 20 bp, Artificial Sequence
  chemically synthesized
ggagtaggggaaactcgcca

SEQ ID NO: 581477 - DNA, 20 bp, Artificial Sequence
  chemically synthesized
agtgattgtgtgttgtgtca

SEQ ID NO: 581478 - DNA, 20 bp, Artificial Sequence
  chemically synthesized
ttaatggggagagtgattcg

SEQ ID NO: 581479 - DNA, 20 bp, Artificial Sequence
  chemically synthesized
tcctatccatttaatgggga

SEQ ID NO: 581480 - DNA, 20 bp, Artificial Sequence
  chemically synthesized
ctacggcataaggtacagta

SEQ ID NO: 581481 - DNA, 20 bp, Artificial Sequence
  chemically synthesized
tggcccaggaagaagccact

SEQ ID NO: 581482 - DNA, 20 bp, Artificial Sequence
  chemically synthesized
ggctgttggtccaagcaggc

SEQ ID NO: 581483 - DNA, 20 bp, Artificial Sequence
  chemically synthesized
tggtcaccacacccatcaat

SEQ ID NO: 581484 - DNA, 20 bp, Artificial Sequence
  chemically synthesized
ttgcaactatataagccctg

SEQ ID NO: 581485 - DNA, 20 bp, Artificial Sequence
  chemically synthesized
aatacatttttaaatcaatt

SEQ ID NO: 581486 - DNA, 20 bp, Artificial Sequence
  chemically synthesized
tgtaaatgataacaattgtg

SEQ ID NO: 581487 - DNA, 20 bp, Artificial Sequence
  chemically synthesized
tgtgagggggatatatgaac

SEQ ID NO: 581488 - DNA, 20 bp, Artificial Sequence
  chemically synthesized
ttattgaaacttgtcatgca

SEQ ID NO: 581489 - DNA, 20 bp, Artificial Sequence
  chemically synthesized
cacacaaagcaagatgcatg

SEQ ID NO: 581490 - DNA, 20 bp, Artificial Sequence
  chemically synthesized
tgcatcttgctttgtgtgtc

SEQ ID NO: 581491 - DNA, 20 bp, Artificial Sequence
  chemically synthesized
aacaatcattacggatcgaa

SEQ ID NO: 581492 - DNA, 20 bp, Artificial Sequence
  chemically synthesized
aaaaaacttacttcgatccg

SEQ ID NO: 581493 - DNA, 20 bp, Artificial Sequence
  chemically synthesized
ccgtaatgattgttctagcc

SEQ ID NO: 581494 - DNA, 20 bp, Artificial Sequence
  chemically synthesized
tctagcctcttgattgctgg

SEQ ID NO: 581495 - DNA, 20 bp, Artificial Sequence
  chemically synthesized
ttgttcttacaggcaacaat

SEQ ID NO: 581496 - DNA, 20 bp, Artificial Sequence
  chemically synthesized
aacatcttttttatttctaa

SEQ ID NO: 581497 - DNA, 20 bp, Artificial Sequence
  chemically synthesized
taaaaaagatgttactgtat

SEQ ID NO: 581498 - DNA, 20 bp, Artificial Sequence
  chemically synthesized
atgaaacatatttcctgtta

SEQ ID NO: 581499 - DNA, 20 bp, Artificial Sequence
  chemically synthesized
agaaaacaatttaacaggaa

SEQ ID NO: 581500 - DNA, 20 bp, Artificial Sequence
  chemically synthesized
tttcaaatgaaaatcttgac

SEQ ID NO: 581501 - DNA, 20 bp, Artificial Sequence
  chemically synthesized
taaatgaagaaaatctatag

SEQ ID NO: 581502 - DNA, 20 bp, Artificial Sequence
  chemically synthesized
atggagacattccggagtac

SEQ ID NO: 581503 - DNA, 20 bp, Artificial Sequence
  chemically synthesized
cttactcaaggcattcagac

SEQ ID NO: 581504 - DNA, 20 bp, Artificial Sequence
  chemically synthesized
ttaaatcggttctgtgcttt

SEQ ID NO: 581505 - DNA, 20 bp, Artificial Sequence
  chemically synthesized
taaaaacagaaaaagcacag

SEQ ID NO: 581506 - DNA, 20 bp, Artificial Sequence
  chemically synthesized
taatatctcttaaatcggtt

SEQ ID NO: 581507 - DNA, 20 bp, Artificial Sequence
  chemically synthesized
tatttaacttcattgtaccc

SEQ ID NO: 581508 - DNA, 20 bp, Artificial Sequence
  chemically synthesized
aggtgaagtagacgagctaa

SEQ ID NO: 581509 - DNA, 20 bp, Artificial Sequence
  chemically synthesized
gacaggcagcttaggagaaa

SEQ ID NO: 581510 - DNA, 20 bp, Artificial Sequence
  chemically synthesized
tttggtgattcttacggaca

SEQ ID NO: 581511 - DNA, 20 bp, Artificial Sequence
  chemically synthesized
tggagggaggcaaaaaggtt

SEQ ID NO: 581512 - DNA, 20 bp, Artificial Sequence
  chemically synthesized
ttagttctggagggaggcaa

SEQ ID NO: 581513 - DNA, 20 bp, Artificial Sequence
  chemically synthesized
ttagataatttatttaaaat

SEQ ID NO: 581514 - DNA, 20 bp, Artificial Sequence
  chemically synthesized
ataaattatctaattaactt

SEQ ID NO: 581515 - DNA, 20 bp, Artificial Sequence
  chemically synthesized
aattaacttttatgatttag

SEQ ID NO: 581516 - DNA, 20 bp, Artificial Sequence
  chemically synthesized
tttaggcaagtttggagagc

SEQ ID NO: 581517 - DNA, 20 bp, Artificial Sequence
  chemically synthesized
gaagaaagggaagaatatct

SEQ ID NO: 581518 - DNA, 20 bp, Artificial Sequence
  chemically synthesized
ttctctgtcatcttagtctc

SEQ ID NO: 581519 - DNA, 20 bp, Artificial Sequence
  chemically synthesized
aaatttcttcataaatacct

SEQ ID NO: 581520 - DNA, 20 bp, Artificial Sequence
  chemically synthesized
cccaattaaaataaaattta

SEQ ID NO: 581521 - DNA, 20 bp, Artificial Sequence
  chemically synthesized
aaatacaagtaatatttact

SEQ ID NO: 581522 - DNA, 20 bp, Artificial Sequence
  chemically synthesized
gtttataagcaatatgtgac

SEQ ID NO: 581523 - DNA, 20 bp, Artificial Sequence
  chemically synthesized
tagataaaacatctgtcaca

SEQ ID NO: 581524 - DNA, 20 bp, Artificial Sequence
  chemically synthesized
ccacactagtaaacaagcca

SEQ ID NO: 581525 - DNA, 20 bp, Artificial Sequence
  chemically synthesized
aaaattatacaaacttgctg

SEQ ID NO: 581526 - DNA, 20 bp, Artificial Sequence
  chemically synthesized
atttaaaattatacaaactt

SEQ ID NO: 581527 - DNA, 20 bp, Artificial Sequence
  chemically synthesized
agtaaataactaagtttcat

SEQ ID NO: 581528 - DNA, 20 bp, Artificial Sequence
  chemically synthesized
tcaaagtacagagtaaataa

SEQ ID NO: 581529 - DNA, 20 bp, Artificial Sequence
  chemically synthesized
ttactctgtactttgactcc

SEQ ID NO: 581530 - DNA, 20 bp, Artificial Sequence
  chemically synthesized
ctgctgattttctaacgaat

SEQ ID NO: 581531 - DNA, 20 bp, Artificial Sequence
  chemically synthesized
gccaaattttgatcattctg

SEQ ID NO: 581532 - DNA, 20 bp, Artificial Sequence
  chemically synthesized
ttctgtgaagaggtagggag

SEQ ID NO: 581533 - DNA, 20 bp, Artificial Sequence
  chemically synthesized
aagaggtagggagacaggct

SEQ ID NO: 581534 - DNA, 20 bp, Artificial Sequence
  chemically synthesized
aggctttgtgatttaaactc

SEQ ID NO: 581535 - DNA, 20 bp, Artificial Sequence
  chemically synthesized
tttactattaccaaaagcaa

SEQ ID NO: 581536 - DNA, 20 bp, Artificial Sequence
  chemically synthesized
agtagatgtacaatgtttgg

SEQ ID NO: 581537 - DNA, 20 bp, Artificial Sequence
  chemically synthesized
aagtgcctaaagtagatgta

SEQ ID NO: 581538 - DNA, 20 bp, Artificial Sequence
  chemically synthesized
aaattttccacatttgtaag

SEQ ID NO: 581539 - DNA, 20 bp, Artificial Sequence
  chemically synthesized
ggattttttttctgagcaat

SEQ ID NO: 581540 - DNA, 20 bp, Artificial Sequence
  chemically synthesized
tcagaaaaaaaatccaattt

SEQ ID NO: 581541 - DNA, 20 bp, Artificial Sequence
  chemically synthesized
taaaagttagaaacctgaaa

SEQ ID NO: 581542 - DNA, 20 bp, Artificial Sequence
  chemically synthesized
attttcaggtttctaacttt

SEQ ID NO: 581543 - DNA, 20 bp, Artificial Sequence
  chemically synthesized
tatggtttctttacacaaca

SEQ ID NO: 581544 - DNA, 20 bp, Artificial Sequence
  chemically synthesized
gtaggaaccatatagtagca

SEQ ID NO: 581545 - DNA, 20 bp, Artificial Sequence
  chemically synthesized
caggtagattttatgaaata

SEQ ID NO: 581546 - DNA, 20 bp, Artificial Sequence
  chemically synthesized
cttcccatgtcacagatgac

SEQ ID NO: 581547 - DNA, 20 bp, Artificial Sequence
  chemically synthesized
tgtgacatgggaagctgaaa

SEQ ID NO: 581548 - DNA, 20 bp, Artificial Sequence
  chemically synthesized
aggcaattccaaagcaacct

SEQ ID NO: 581549 - DNA, 20 bp, Artificial Sequence
  chemically synthesized
ctttggaattgcctacccta

SEQ ID NO: 581550 - DNA, 20 bp, Artificial Sequence
  chemically synthesized
catctgaggtttctgggtaa

SEQ ID NO: 581551 - DNA, 20 bp, Artificial Sequence
  chemically synthesized
ggtgaaaatttgacttcatc

SEQ ID NO: 581552 - DNA, 20 bp, Artificial Sequence
  chemically synthesized
tgtgtaactcacatgaaaaa

SEQ ID NO: 581553 - DNA, 20 bp, Artificial Sequence
  chemically synthesized
aaatttccaagtatcgaaaa

SEQ ID NO: 581554 - DNA, 20 bp, Artificial Sequence
  chemically synthesized
acttggaaatttttatataa

SEQ ID NO: 581555 - DNA, 20 bp, Artificial Sequence
  chemically synthesized
ttttaattcactctcacata

SEQ ID NO: 581556 - DNA, 20 bp, Artificial Sequence
  chemically synthesized
ctctcacataaccagatttt

SEQ ID NO: 581557 - DNA, 20 bp, Artificial Sequence
  chemically synthesized
taaccagattttttttgctt

SEQ ID NO: 581558 - DNA, 20 bp, Artificial Sequence
  chemically synthesized
tcagttttagatacattatt

SEQ ID NO: 581559 - DNA, 20 bp, Artificial Sequence
  chemically synthesized
gctatacttttttccttctt

SEQ ID NO: 581560 - DNA, 20 bp, Artificial Sequence
  chemically synthesized
taatttagagcctggtaagg

SEQ ID NO: 581561 - DNA, 20 bp, Artificial Sequence
  chemically synthesized
ataaaagctgttcattgtgg

SEQ ID NO: 581562 - DNA, 20 bp, Artificial Sequence
  chemically synthesized
aattaaacctgaccacaatg

SEQ ID NO: 581563 - DNA, 20 bp, Artificial Sequence
  chemically synthesized
cttgttttgagtctaagttg

SEQ ID NO: 581564 - DNA, 20 bp, Artificial Sequence
  chemically synthesized
gttcattagagaggaaaatg

SEQ ID NO: 581565 - DNA, 20 bp, Artificial Sequence
  chemically synthesized
ttttgttcattagagaggaa

SEQ ID NO: 581566 - DNA, 20 bp, Artificial Sequence
  chemically synthesized
gagaatcacccaactagaga

SEQ ID NO: 581567 - DNA, 20 bp, Artificial Sequence
  chemically synthesized
gtgaaacctgttctctagtt

SEQ ID NO: 581568 - DNA, 20 bp, Artificial Sequence
  chemically synthesized
ctctaattctgctgacagac

SEQ ID NO: 581569 - DNA, 20 bp, Artificial Sequence
  chemically synthesized
acatgctttgtaagcacctg

SEQ ID NO: 581570 - DNA, 20 bp, Artificial Sequence
  chemically synthesized
atctcattaataatcttctc

SEQ ID NO: 581571 - DNA, 20 bp, Artificial Sequence
  chemically synthesized
cctccttagatttttaagga

SEQ ID NO: 581572 - DNA, 20 bp, Artificial Sequence
  chemically synthesized
gtactgcagttgtgaacctc

SEQ ID NO: 581573 - DNA, 20 bp, Artificial Sequence
  chemically synthesized
agtgggataaaaagttgaaa

SEQ ID NO: 581574 - DNA, 20 bp, Artificial Sequence
  chemically synthesized
tacagcttctttgttgaaat

SEQ ID NO: 581575 - DNA, 20 bp, Artificial Sequence
  chemically synthesized
agcaatatacattatcattt

SEQ ID NO: 581576 - DNA, 20 bp, Artificial Sequence
  chemically synthesized
aaatgataatgtatattgct

SEQ ID NO: 581577 - DNA, 20 bp, Artificial Sequence
  chemically synthesized
agcagaatgggaattttctc

SEQ ID NO: 581578 - DNA, 20 bp, Artificial Sequence
  chemically synthesized
tccctttctagaaataaaga

SEQ ID NO: 581579 - DNA, 20 bp, Artificial Sequence
  chemically synthesized
agagagggatttaatatggc

SEQ ID NO: 581580 - DNA, 20 bp, Artificial Sequence
  chemically synthesized
tagcaagaaattcttttaac

SEQ ID NO: 581581 - DNA, 20 bp, Artificial Sequence
  chemically synthesized
aaataatcgttactctcacc

SEQ ID NO: 581582 - DNA, 20 bp, Artificial Sequence
  chemically synthesized
acacaagcatatggtgagag

SEQ ID NO: 581583 - DNA, 20 bp, Artificial Sequence
  chemically synthesized
agagtaacgattatttttca

SEQ ID NO: 581584 - DNA, 20 bp, Artificial Sequence
  chemically synthesized
tatactttctttgacttcaa

SEQ ID NO: 581585 - DNA, 20 bp, Artificial Sequence
  chemically synthesized
tcgaaggaatagaggtgaag

SEQ ID NO: 581586 - DNA, 20 bp, Artificial Sequence
  chemically synthesized
ttgagtaatgattagatcta

SEQ ID NO: 581587 - DNA, 20 bp, Artificial Sequence
  chemically synthesized
ttggaggcaagtagtttgag

SEQ ID NO: 581588 - DNA, 20 bp, Artificial Sequence
  chemically synthesized
agatggatattttggaggca

SEQ ID NO: 581589 - DNA, 20 bp, Artificial Sequence
  chemically synthesized
gagtaacatctggtaggggt

SEQ ID NO: 581590 - DNA, 20 bp, Artificial Sequence
  chemically synthesized
tgaagataatactaggaaca

SEQ ID NO: 581591 - DNA, 20 bp, Artificial Sequence
  chemically synthesized
tcatatgacctctggtcctt

SEQ ID NO: 581592 - DNA, 20 bp, Artificial Sequence
  chemically synthesized
gtccttttctgtttcctcaa

SEQ ID NO: 581593 - DNA, 20 bp, Artificial Sequence
  chemically synthesized
ataagcacaattagcattct

SEQ ID NO: 581594 - DNA, 20 bp, Artificial Sequence
  chemically synthesized
acaaacaagtagaatgctaa

SEQ ID NO: 581595 - DNA, 20 bp, Artificial Sequence
  chemically synthesized
catgtaatgattttagtttt

SEQ ID NO: 581596 - DNA, 20 bp, Artificial Sequence
  chemically synthesized
cgaacaaaactaaaatcatt

SEQ ID NO: 581597 - DNA, 20 bp, Artificial Sequence
  chemically synthesized
actggtaagcatgtaatgat

SEQ ID NO: 581598 - DNA, 20 bp, Artificial Sequence
  chemically synthesized
cttaggtactggtaagcatg

SEQ ID NO: 581599 - DNA, 20 bp, Artificial Sequence
  chemically synthesized
catgtagacacgatccatta

SEQ ID NO: 581600 - DNA, 20 bp, Artificial Sequence
  chemically synthesized
atgataatggatcgtgtcta

SEQ ID NO: 581601 - DNA, 20 bp, Artificial Sequence
  chemically synthesized
gattccttccttctcctgtg

SEQ ID NO: 581602 - DNA, 20 bp, Artificial Sequence
  chemically synthesized
gcattgattccttccttctc

SEQ ID NO: 581603 - DNA, 20 bp, Artificial Sequence
  chemically synthesized
ttatgactccttagaaatag

SEQ ID NO: 581604 - DNA, 20 bp, Artificial Sequence
  chemically synthesized
aaggagtcataagtcagcta

SEQ ID NO: 581605 - DNA, 20 bp, Artificial Sequence
  chemically synthesized
agctactgggctttactaaa

SEQ ID NO: 581606 - DNA, 20 bp, Artificial Sequence
  chemically synthesized
attctcatctccaaggggta

SEQ ID NO: 581607 - DNA, 20 bp, Artificial Sequence
  chemically synthesized
ccttggagatgagaattcat

SEQ ID NO: 581608 - DNA, 20 bp, Artificial Sequence
  chemically synthesized
gacttagtgagattaaagac

SEQ ID NO: 581609 - DNA, 20 bp, Artificial Sequence
  chemically synthesized
ctcaactctggggggactta

SEQ ID NO: 581610 - DNA, 20 bp, Artificial Sequence
  chemically synthesized
agttataatatgtatgattt

SEQ ID NO: 581611 - DNA, 20 bp, Artificial Sequence
  chemically synthesized
aaatgccctagttataatat

SEQ ID NO: 581612 - DNA, 20 bp, Artificial Sequence
  chemically synthesized
catattataactagggcatt

SEQ ID NO: 581613 - DNA, 20 bp, Artificial Sequence
  chemically synthesized
taagcattcaactcaacata

SEQ ID NO: 581614 - DNA, 20 bp, Artificial Sequence
  chemically synthesized
aaaactctatatgttgagtt

SEQ ID NO: 581615 - DNA, 20 bp, Artificial Sequence
  chemically synthesized
aaaatataaaaatatgacca

SEQ ID NO: 581616 - DNA, 20 bp, Artificial Sequence
  chemically synthesized
tagaaaaatataaaaatatg

SEQ ID NO: 581617 - DNA, 20 bp, Artificial Sequence
  chemically synthesized
ggcatttatgctatgtagat

SEQ ID NO: 581618 - DNA, 20 bp, Artificial Sequence
  chemically synthesized
catcatgggcatttatgcta

SEQ ID NO: 581619 - DNA, 20 bp, Artificial Sequence
  chemically synthesized
ctacatagcataaatgccca

SEQ ID NO: 581620 - DNA, 20 bp, Artificial Sequence
  chemically synthesized
tcagttctacattgttacat

SEQ ID NO: 581621 - DNA, 20 bp, Artificial Sequence
  chemically synthesized
ataaagaattcagaaggtaa

SEQ ID NO: 581622 - DNA, 20 bp, Artificial Sequence
  chemically synthesized
atttagtaccttcctgactt

SEQ ID NO: 581623 - DNA, 20 bp, Artificial Sequence
  chemically synthesized
gtagcctttctagttaccga

SEQ ID NO: 581624 - DNA, 20 bp, Artificial Sequence
  chemically synthesized
ggtgaggatgctgtaatcta

SEQ ID NO: 581625 - DNA, 20 bp, Artificial Sequence
  chemically synthesized
agtgagatggttgaaagcta

SEQ ID NO: 581626 - DNA, 20 bp, Artificial Sequence
  chemically synthesized
catctcactgagcatcttct

SEQ ID NO: 581627 - DNA, 20 bp, Artificial Sequence
  chemically synthesized
tggaagacaatgaggatggt

SEQ ID NO: 581628 - DNA, 20 bp, Artificial Sequence
  chemically synthesized
agtaagtggaagacaatgag

SEQ ID NO: 581629 - DNA, 20 bp, Artificial Sequence
  chemically synthesized
acttctcatttccattttat

SEQ ID NO: 581630 - DNA, 20 bp, Artificial Sequence
  chemically synthesized
gatatttatgaagttggtta

SEQ ID NO: 581631 - DNA, 20 bp, Artificial Sequence
  chemically synthesized
cattttatttttatataatt

SEQ ID NO: 581632 - DNA, 20 bp, Artificial Sequence
  chemically synthesized
ctttatcttgcaaatattct

SEQ ID NO: 581633 - DNA, 20 bp, Artificial Sequence
  chemically synthesized
gaactcccaggtaacccttg

SEQ ID NO: 581634 - DNA, 20 bp, Artificial Sequence
  chemically synthesized
tagatatataactgtatatg

SEQ ID NO: 581635 - DNA, 20 bp, Artificial Sequence
  chemically synthesized
gatatctgcaaattattctc

SEQ ID NO: 581636 - DNA, 20 bp, Artificial Sequence
  chemically synthesized
cccctttacccttaaatact

SEQ ID NO: 581637 - DNA, 20 bp, Artificial Sequence
  chemically synthesized
attctcttaaataacctcag

SEQ ID NO: 581638 - DNA, 20 bp, Artificial Sequence
  chemically synthesized
ttcaaagtcaggaaatttag

SEQ ID NO: 581639 - DNA, 20 bp, Artificial Sequence
  chemically synthesized
actctgaatatagagtatgg

SEQ ID NO: 581640 - DNA, 20 bp, Artificial Sequence
  chemically synthesized
tggtctggtccagactcacg

SEQ ID NO: 581641 - DNA, 20 bp, Artificial Sequence
  chemically synthesized
tctttgaactttataacact

SEQ ID NO: 581642 - DNA, 20 bp, Artificial Sequence
  chemically synthesized
ttgagttatagcaatttttt

SEQ ID NO: 581643 - DNA, 20 bp, Artificial Sequence
  chemically synthesized
attgcctgtcatcactactc

SEQ ID NO: 581644 - DNA, 20 bp, Artificial Sequence
  chemically synthesized
ttttattgcctgtcatcact

SEQ ID NO: 581645 - DNA, 20 bp, Artificial Sequence
  chemically synthesized
ataatacctcaggttgttgc

SEQ ID NO: 581646 - DNA, 20 bp, Artificial Sequence
  chemically synthesized
ccatatgctctgataactct

SEQ ID NO: 581647 - DNA, 20 bp, Artificial Sequence
  chemically synthesized
aagactgtcttctgaaggaa

SEQ ID NO: 581648 - DNA, 20 bp, Artificial Sequence
  chemically synthesized
aaaagctgaggactacttaa

SEQ ID NO: 581649 - DNA, 20 bp, Artificial Sequence
  chemically synthesized
ggaatcaagcttaagtagtc

SEQ ID NO: 581650 - DNA, 20 bp, Artificial Sequence
  chemically synthesized
aaagaaaagctgaggactac

SEQ ID NO: 581651 - DNA, 20 bp, Artificial Sequence
  chemically synthesized
tctttatttaaattatacaa

SEQ ID NO: 581652 - DNA, 20 bp, Artificial Sequence
  chemically synthesized
tgaggagcagtggtgtttaa

SEQ ID NO: 581653 - DNA, 20 bp, Artificial Sequence
  chemically synthesized
cacttgggtatgaggagcag

SEQ ID NO: 581654 - DNA, 20 bp, Artificial Sequence
  chemically synthesized
ctgttactgcattttgaaat

SEQ ID NO: 581655 - DNA, 20 bp, Artificial Sequence
  chemically synthesized
tggctttggtgcagtgcaat

SEQ ID NO: 581656 - DNA, 20 bp, Artificial Sequence
  chemically synthesized
atgattgcactgcaccaaag

SEQ ID NO: 581657 - DNA, 20 bp, Artificial Sequence
  chemically synthesized
gaggagaagtctgtgagaag

SEQ ID NO: 581658 - DNA, 20 bp, Artificial Sequence
  chemically synthesized
tgggtgaggagaagtctgtg

SEQ ID NO: 581659 - DNA, 20 bp, Artificial Sequence
  chemically synthesized
ctcacagacttctcctcacc

SEQ ID NO: 581660 - DNA, 20 bp, Artificial Sequence
  chemically synthesized
ctctgcctcaatgacttccc

SEQ ID NO: 581661 - DNA, 20 bp, Artificial Sequence
  chemically synthesized
ttccactagaccgcacactg

SEQ ID NO: 581662 - DNA, 20 bp, Artificial Sequence
  chemically synthesized
ctaacatctcttgcaccttc

SEQ ID NO: 581663 - DNA, 20 bp, Artificial Sequence
  chemically synthesized
atggaactgaagagctgatg

SEQ ID NO: 581664 - DNA, 20 bp, Artificial Sequence
  chemically synthesized
attgaatattaattagtaac

SEQ ID NO: 581665 - DNA, 20 bp, Artificial Sequence
  chemically synthesized
aatggtcatgcaccctacct

SEQ ID NO: 581666 - DNA, 20 bp, Artificial Sequence
  chemically synthesized
aaggattcctggtggcttgc

SEQ ID NO: 581667 - DNA, 20 bp, Artificial Sequence
  chemically synthesized
tctgttaaggattcctggtg

SEQ ID NO: 581668 - DNA, 20 bp, Artificial Sequence
  chemically synthesized
gttatctgttaaggattcct

SEQ ID NO: 581669 - DNA, 20 bp, Artificial Sequence
  chemically synthesized
acctagtggttgttatctgt

SEQ ID NO: 581670 - DNA, 20 bp, Artificial Sequence
  chemically synthesized
tccttaacagataacaacca

SEQ ID NO: 581671 - DNA, 20 bp, Artificial Sequence
  chemically synthesized
atggcaaaaggaactttggg

SEQ ID NO: 581672 - DNA, 20 bp, Artificial Sequence
  chemically synthesized
agatgacggaagacagaaag

SEQ ID NO: 581673 - DNA, 20 bp, Artificial Sequence
  chemically synthesized
agacaaagacctcaaccagg

SEQ ID NO: 581674 - DNA, 20 bp, Artificial Sequence
  chemically synthesized
tacacaaggatctgcattag

SEQ ID NO: 581675 - DNA, 20 bp, Artificial Sequence
  chemically synthesized
tgcattagaagggattcata

SEQ ID NO: 581676 - DNA, 20 bp, Artificial Sequence
  chemically synthesized
tttttttttaaccaagggcc

SEQ ID NO: 581677 - DNA, 20 bp, Artificial Sequence
  chemically synthesized
tttcatttttcactgggctc

SEQ ID NO: 581678 - DNA, 20 bp, Artificial Sequence
  chemically synthesized
ctgggctctacagattacgt

SEQ ID NO: 581679 - DNA, 20 bp, Artificial Sequence
  chemically synthesized
tcttcccatcaacgattaac

SEQ ID NO: 581680 - DNA, 20 bp, Artificial Sequence
  chemically synthesized
tttaaatgtgttcttcccat

SEQ ID NO: 581681 - DNA, 20 bp, Artificial Sequence
  chemically synthesized
tttgattgacgtcatttaat

SEQ ID NO: 581682 - DNA, 20 bp, Artificial Sequence
  chemically synthesized
aatgacgtcaatcaaatgcc

SEQ ID NO: 581683 - DNA, 20 bp, Artificial Sequence
  chemically synthesized
tcaggaattaagcaagaggc

SEQ ID NO: 581684 - DNA, 20 bp, Artificial Sequence
  chemically synthesized
ctcttgcttaattcctgaga

SEQ ID NO: 581685 - DNA, 20 bp, Artificial Sequence
  chemically synthesized
atttcccccaaaatacattt

SEQ ID NO: 581686 - DNA, 20 bp, Artificial Sequence
  chemically synthesized
cctgttcagcttttcctgag

SEQ ID NO: 581687 - DNA, 20 bp, Artificial Sequence
  chemically synthesized
aaccacttctaactgtcctg

SEQ ID NO: 581688 - DNA, 20 bp, Artificial Sequence
  chemically synthesized
agatgattcaccactttctt

SEQ ID NO: 581689 - DNA, 20 bp, Artificial Sequence
  chemically synthesized
ttatctccaatttcttcctc

SEQ ID NO: 581690 - DNA, 20 bp, Artificial Sequence
  chemically synthesized
tggagataaaaaggagaacc

SEQ ID NO: 581691 - DNA, 20 bp, Artificial Sequence
  chemically synthesized
gctaaacctagaaatgtcat

SEQ ID NO: 581692 - DNA, 20 bp, Artificial Sequence
  chemically synthesized
tgaaatctcaaatgacattt

SEQ ID NO: 581693 - DNA, 20 bp, Artificial Sequence
  chemically synthesized
tctaggtttagctaagtgtt

SEQ ID NO: 581694 - DNA, 20 bp, Artificial Sequence
  chemically synthesized
tacataagaaacaactaata

SEQ ID NO: 581695 - DNA, 20 bp, Artificial Sequence
  chemically synthesized
tgtttctaaaacaaattatt

SEQ ID NO: 581696 - DNA, 20 bp, Artificial Sequence
  chemically synthesized
gcaaatagttgcagtttagt

SEQ ID NO: 581697 - DNA, 20 bp, Artificial Sequence
  chemically synthesized
ctgagtgcttggcaaatagt

SEQ ID NO: 581698 - DNA, 20 bp, Artificial Sequence
  chemically synthesized
tttgtctatgtgtactagct

SEQ ID NO: 581699 - DNA, 20 bp, Artificial Sequence
  chemically synthesized
aagttccttgaaaaaagaag

SEQ ID NO: 581700 - DNA, 20 bp, Artificial Sequence
  chemically synthesized
ttgtttatgagtatttgttt

SEQ ID NO: 581701 - DNA, 20 bp, Artificial Sequence
  chemically synthesized
aaaaataattgtttatgagt

SEQ ID NO: 581702 - DNA, 20 bp, Artificial Sequence
  chemically synthesized
tgtattattacacaaaaaat

SEQ ID NO: 581703 - DNA, 20 bp, Artificial Sequence
  chemically synthesized
atgctaacgacaacaacaat

SEQ ID NO: 581704 - DNA, 20 bp, Artificial Sequence
  chemically synthesized
taaaagaatgaactctggag

SEQ ID NO: 581705 - DNA, 20 bp, Artificial Sequence
  chemically synthesized
tgcatactggctgccaccta

SEQ ID NO: 581706 - DNA, 20 bp, Artificial Sequence
  chemically synthesized
gagatactgagtctctacct

SEQ ID NO: 581707 - DNA, 20 bp, Artificial Sequence
  chemically synthesized
taatagagttaatatttgta

SEQ ID NO: 581708 - DNA, 20 bp, Artificial Sequence
  chemically synthesized
catttcatagtaagaacaat

SEQ ID NO: 581709 - DNA, 20 bp, Artificial Sequence
  chemically synthesized
atatgataattacattgact

SEQ ID NO: 581710 - DNA, 20 bp, Artificial Sequence
  chemically synthesized
ttaccatgtgatcctagaca

SEQ ID NO: 581711 - DNA, 20 bp, Artificial Sequence
  chemically synthesized
atattatagttcttaagtgt

SEQ ID NO: 581712 - DNA, 20 bp, Artificial Sequence
  chemically synthesized
gttaatttccccttttgtat

SEQ ID NO: 581713 - DNA, 20 bp, Artificial Sequence
  chemically synthesized
aattaactatttcattcaag

SEQ ID NO: 581714 - DNA, 20 bp, Artificial Sequence
  chemically synthesized
ctatttattgcaagaaccat

SEQ ID NO: 581715 - DNA, 20 bp, Artificial Sequence
  chemically synthesized
gttcattcaaagtgggatga

SEQ ID NO: 581716 - DNA, 20 bp, Artificial Sequence
  chemically synthesized
tcttgtccctgcagccactt

SEQ ID NO: 581717 - DNA, 20 bp, Artificial Sequence
  chemically synthesized
agcattgggcttgcttgtct

SEQ ID NO: 581718 - DNA, 20 bp, Artificial Sequence
  chemically synthesized
caatatggcagtagcattgg

SEQ ID NO: 581719 - DNA, 20 bp, Artificial Sequence
  chemically synthesized
tgaccaatatggcagtagca

SEQ ID NO: 581720 - DNA, 20 bp, Artificial Sequence
  chemically synthesized
cctagggtagaacaacaggt

SEQ ID NO: 581721 - DNA, 20 bp, Artificial Sequence
  chemically synthesized
tgtggtcatttccttcactg

SEQ ID NO: 581722 - DNA, 20 bp, Artificial Sequence
  chemically synthesized
ccatatgtggtcatttcctt

SEQ ID NO: 581723 - DNA, 20 bp, Artificial Sequence
  chemically synthesized
tggcactacagctgaacttt

SEQ ID NO: 581724 - DNA, 20 bp, Artificial Sequence
  chemically synthesized
caggctctaaccagcccatt

SEQ ID NO: 581725 - DNA, 20 bp, Artificial Sequence
  chemically synthesized
ttctttacaaataatggcaa

SEQ ID NO: 581726 - DNA, 20 bp, Artificial Sequence
  chemically synthesized
catagtagaagcagtatata

SEQ ID NO: 581727 - DNA, 20 bp, Artificial Sequence
  chemically synthesized
tttttaaaaagccaactata

SEQ ID NO: 581728 - DNA, 20 bp, Artificial Sequence
  chemically synthesized
atatagttggctttttaaaa

SEQ ID NO: 581729 - DNA, 20 bp, Artificial Sequence
  chemically synthesized
tggctttttaaaaatcagtt

SEQ ID NO: 581730 - DNA, 20 bp, Artificial Sequence
  chemically synthesized
tgataaaattcaaaacctca

SEQ ID NO: 581731 - DNA, 20 bp, Artificial Sequence
  chemically synthesized
tcagtttttttctgcaagtt

SEQ ID NO: 581732 - DNA, 20 bp, Artificial Sequence
  chemically synthesized
gaaagctttgctcctatagc

SEQ ID NO: 581733 - DNA, 20 bp, Artificial Sequence
  chemically synthesized
aaaaactgaggctataggag

SEQ ID NO: 581734 - DNA, 20 bp, Artificial Sequence
  chemically synthesized
tatggaggcacaggattact

SEQ ID NO: 581735 - DNA, 20 bp, Artificial Sequence
  chemically synthesized
tttcagtaatcctgtgcctc

SEQ ID NO: 581736 - DNA, 20 bp, Artificial Sequence
  chemically synthesized
agaacaaaatctatggaggc

SEQ ID NO: 581737 - DNA, 20 bp, Artificial Sequence
  chemically synthesized
agatacccatacgtaaaaag

SEQ ID NO: 581738 - DNA, 20 bp, Artificial Sequence
  chemically synthesized
ctgtttcccttcattgtagt

SEQ ID NO: 581739 - DNA, 20 bp, Artificial Sequence
  chemically synthesized
taattacttgtttcttgtac

SEQ ID NO: 581740 - DNA, 20 bp, Artificial Sequence
  chemically synthesized
tctgccacaagtctctaatt

SEQ ID NO: 581741 - DNA, 20 bp, Artificial Sequence
  chemically synthesized
tgttgagcaccttttcatat

SEQ ID NO: 581742 - DNA, 20 bp, Artificial Sequence
  chemically synthesized
gtgatgttgagcaccttttc

SEQ ID NO: 581743 - DNA, 20 bp, Artificial Sequence
  chemically synthesized
attttcatttctctggttat

SEQ ID NO: 581744 - DNA, 20 bp, Artificial Sequence
  chemically synthesized
gaggtaatatgtcattgtaa

SEQ ID NO: 581745 - DNA, 20 bp, Artificial Sequence
  chemically synthesized
tattacctcactcccgttaa

SEQ ID NO: 581746 - DNA, 20 bp, Artificial Sequence
  chemically synthesized
ttagcacaaccactatggag

SEQ ID NO: 581747 - DNA, 20 bp, Artificial Sequence
  chemically synthesized
tattatatggtagctctatt

SEQ ID NO: 581748 - DNA, 20 bp, Artificial Sequence
  chemically synthesized
gtgcagatatctcttcaata

SEQ ID NO: 581749 - DNA, 20 bp, Artificial Sequence
  chemically synthesized
ttgaagagatatctgcactc

SEQ ID NO: 581750 - DNA, 20 bp, Artificial Sequence
  chemically synthesized
tgcagcgctattcacaatag

SEQ ID NO: 581751 - DNA, 20 bp, Artificial Sequence
  chemically synthesized
catctactgatggacactta

SEQ ID NO: 581752 - DNA, 20 bp, Artificial Sequence
  chemically synthesized
ctactcagccacaaaaaaga

SEQ ID NO: 581753 - DNA, 20 bp, Artificial Sequence
  chemically synthesized
tgcaatgtttgtctttctgt

SEQ ID NO: 581754 - DNA, 20 bp, Artificial Sequence
  chemically synthesized
cacaaataagtgagaacatg

SEQ ID NO: 581755 - DNA, 20 bp, Artificial Sequence
  chemically synthesized
ttgcatgttctcacttattt

SEQ ID NO: 581756 - DNA, 20 bp, Artificial Sequence
  chemically synthesized
ctctctatgtccatgagttc

SEQ ID NO: 581757 - DNA, 20 bp, Artificial Sequence
  chemically synthesized
aacagggggactataaccaa

SEQ ID NO: 581758 - DNA, 20 bp, Artificial Sequence
  chemically synthesized
acattaattaaaagagtata

SEQ ID NO: 581759 - DNA, 20 bp, Artificial Sequence
  chemically synthesized
taattaaaagagtataattg

SEQ ID NO: 581760 - DNA, 20 bp, Artificial Sequence
  chemically synthesized
ttgtttggaacataaagaat

SEQ ID NO: 581761 - DNA, 20 bp, Artificial Sequence
  chemically synthesized
tgaataccccattttacatg

SEQ ID NO: 581762 - DNA, 20 bp, Artificial Sequence
  chemically synthesized
atatatttatttggtacttg

SEQ ID NO: 581763 - DNA, 20 bp, Artificial Sequence
  chemically synthesized
tttgttttatttttatattt

SEQ ID NO: 581764 - DNA, 20 bp, Artificial Sequence
  chemically synthesized
gattctaattacttgtttct

SEQ ID NO: 581765 - DNA, 20 bp, Artificial Sequence
  chemically synthesized
acacatttctgattctaatt

SEQ ID NO: 581766 - DNA, 20 bp, Artificial Sequence
  chemically synthesized
ttctagcaatttccacacat

SEQ ID NO: 581767 - DNA, 20 bp, Artificial Sequence
  chemically synthesized
atttttataatactgataaa

SEQ ID NO: 581768 - DNA, 20 bp, Artificial Sequence
  chemically synthesized
tttaaagctagccaaatgat

SEQ ID NO: 581769 - DNA, 20 bp, Artificial Sequence
  chemically synthesized
taaaaatcactgatcatttg

SEQ ID NO: 581770 - DNA, 20 bp, Artificial Sequence
  chemically synthesized
ttaaaaataaaaaatatgat

SEQ ID NO: 581771 - DNA, 20 bp, Artificial Sequence
  chemically synthesized
ttttaagtttgaatagctaa

SEQ ID NO: 581772 - DNA, 20 bp, Artificial Sequence
  chemically synthesized
actgactgtcttattgtttt

SEQ ID NO: 581773 - DNA, 20 bp, Artificial Sequence
  chemically synthesized
ataaatttcactgactgtct

SEQ ID NO: 581774 - DNA, 20 bp, Artificial Sequence
  chemically synthesized
atttctctatttctttgtag

SEQ ID NO: 581775 - DNA, 20 bp, Artificial Sequence
  chemically synthesized
gaacatgcagtgctaggctt

SEQ ID NO: 581776 - DNA, 20 bp, Artificial Sequence
  chemically synthesized
acgagtgagaacatgcagtg

SEQ ID NO: 581777 - DNA, 20 bp, Artificial Sequence
  chemically synthesized
ggacaaatacctaatgcatt

SEQ ID NO: 581778 - DNA, 20 bp, Artificial Sequence
  chemically synthesized
tatactcatcaacccaacat

SEQ ID NO: 581779 - DNA, 20 bp, Artificial Sequence
  chemically synthesized
cctaggtatacatgtatcat

SEQ ID NO: 581780 - DNA, 20 bp, Artificial Sequence
  chemically synthesized
gggatacatgtgcagaacgt

SEQ ID NO: 581781 - DNA, 20 bp, Artificial Sequence
  chemically synthesized
ttatatttatttatttattt

SEQ ID NO: 581782 - DNA, 20 bp, Artificial Sequence
  chemically synthesized
aagaggtttttttttttttt

SEQ ID NO: 581783 - DNA, 20 bp, Artificial Sequence
  chemically synthesized
caccaaatttggtaggctta

SEQ ID NO: 581784 - DNA, 20 bp, Artificial Sequence
  chemically synthesized
caaagaagtcaccaaatttg

SEQ ID NO: 581785 - DNA, 20 bp, Artificial Sequence
  chemically synthesized
tttaaaaataacacactaat

SEQ ID NO: 581786 - DNA, 20 bp, Artificial Sequence
  chemically synthesized
attatctccctgtgttgaaa

SEQ ID NO: 581787 - DNA, 20 bp, Artificial Sequence
  chemically synthesized
ctttaagttccgtgtggtat

SEQ ID NO: 581788 - DNA, 20 bp, Artificial Sequence
  chemically synthesized
tattataccacacggaactt

SEQ ID NO: 581789 - DNA, 20 bp, Artificial Sequence
  chemically synthesized
ataccacacggaacttaaag

SEQ ID NO: 581790 - DNA, 20 bp, Artificial Sequence
  chemically synthesized
cattttcatttttggatgtt

SEQ ID NO: 581791 - DNA, 20 bp, Artificial Sequence
  chemically synthesized
ttacaccacattatttactt

SEQ ID NO: 581792 - DNA, 20 bp, Artificial Sequence
  chemically synthesized
tttatgctacaatttgttga

SEQ ID NO: 581793 - DNA, 20 bp, Artificial Sequence
  chemically synthesized
ccctttatatcactttagaa

SEQ ID NO: 581794 - DNA, 20 bp, Artificial Sequence
  chemically synthesized
atgccaaatttatagaacaa

SEQ ID NO: 581795 - DNA, 20 bp, Artificial Sequence
  chemically synthesized
attaacaaaggataatcaag

SEQ ID NO: 581796 - DNA, 20 bp, Artificial Sequence
  chemically synthesized
aaaaactggtcttaaacctg

SEQ ID NO: 581797 - DNA, 20 bp, Artificial Sequence
  chemically synthesized
ataatcaagacaggtttaag

SEQ ID NO: 581798 - DNA, 20 bp, Artificial Sequence
  chemically synthesized
gaccagtttttatcatgtgc

SEQ ID NO: 581799 - DNA, 20 bp, Artificial Sequence
  chemically synthesized
ttatcatgtgcatcagattc

SEQ ID NO: 581800 - DNA, 20 bp, Artificial Sequence
  chemically synthesized
tattccaaggcagtcctata

SEQ ID NO: 581801 - DNA, 20 bp, Artificial Sequence
  chemically synthesized
taggactgccttggaatatt

SEQ ID NO: 581802 - DNA, 20 bp, Artificial Sequence
  chemically synthesized
gttccccagtgcattaaatg

SEQ ID NO: 581803 - DNA, 20 bp, Artificial Sequence
  chemically synthesized
ttatgactccctgcaggctc

SEQ ID NO: 581804 - DNA, 20 bp, Artificial Sequence
  chemically synthesized
ggcaagagcctgtaccagca

SEQ ID NO: 581805 - DNA, 20 bp, Artificial Sequence
  chemically synthesized
cttgcctcagtgaggatggc

SEQ ID NO: 581806 - DNA, 20 bp, Artificial Sequence
  chemically synthesized
ttcttaaaataagacaacaa

SEQ ID NO: 581807 - DNA, 20 bp, Artificial Sequence
  chemically synthesized
gacaacaacgaagtttgctg

SEQ ID NO: 581808 - DNA, 20 bp, Artificial Sequence
  chemically synthesized
gattggctctcctttatagc

SEQ ID NO: 581809 - DNA, 20 bp, Artificial Sequence
  chemically synthesized
gatttctttgtagcatgtga

SEQ ID NO: 581810 - DNA, 20 bp, Artificial Sequence
  chemically synthesized
taaattagcatcagggtttg

SEQ ID NO: 581811 - DNA, 20 bp, Artificial Sequence
  chemically synthesized
cttagttgataaattagcat

SEQ ID NO: 581812 - DNA, 20 bp, Artificial Sequence
  chemically synthesized
ccctgatgctaatttatcaa

SEQ ID NO: 581813 - DNA, 20 bp, Artificial Sequence
  chemically synthesized
aacattgttgaaatgacaac

SEQ ID NO: 581814 - DNA, 20 bp, Artificial Sequence
  chemically synthesized
gcttatggatgagcaaagat

SEQ ID NO: 581815 - DNA, 20 bp, Artificial Sequence
  chemically synthesized
agttgctgcttatggatgag

SEQ ID NO: 581816 - DNA, 20 bp, Artificial Sequence
  chemically synthesized
aacttcagcggatccagagt

SEQ ID NO: 581817 - DNA, 20 bp, Artificial Sequence
  chemically synthesized
agcagcaactctggatccgc

SEQ ID NO: 581818 - DNA, 20 bp, Artificial Sequence
  chemically synthesized
ggatccgctgaagttttacc

SEQ ID NO: 581819 - DNA, 20 bp, Artificial Sequence
  chemically synthesized
gtcaaaatatcaacattatc

SEQ ID NO: 581820 - DNA, 20 bp, Artificial Sequence
  chemically synthesized
ccagatgccatgaagaaaat

SEQ ID NO: 581821 - DNA, 20 bp, Artificial Sequence
  chemically synthesized
catctggaatggtgaggact

SEQ ID NO: 581822 - DNA, 20 bp, Artificial Sequence
  chemically synthesized
aatggtgaggactttccgtt

SEQ ID NO: 581823 - DNA, 20 bp, Artificial Sequence
  chemically synthesized
cagctatacctttatgaaat

SEQ ID NO: 581824 - DNA, 20 bp, Artificial Sequence
  chemically synthesized
ctgaggaatatgtccaaaga

SEQ ID NO: 581825 - DNA, 20 bp, Artificial Sequence
  chemically synthesized
gactgcacatctctttacag

SEQ ID NO: 581826 - DNA, 20 bp, Artificial Sequence
  chemically synthesized
atgtgcagtcatctagtctt

SEQ ID NO: 581827 - DNA, 20 bp, Artificial Sequence
  chemically synthesized
gcagtcatctagtctttgtt

SEQ ID NO: 581828 - DNA, 20 bp, Artificial Sequence
  chemically synthesized
ctagcataacctgaagggcc

SEQ ID NO: 581829 - DNA, 20 bp, Artificial Sequence
  chemically synthesized
ttttggaatggtaaacgagc

SEQ ID NO: 581830 - DNA, 20 bp, Artificial Sequence
  chemically synthesized
gactttcagttgaagccagt

SEQ ID NO: 581831 - DNA, 20 bp, Artificial Sequence
  chemically synthesized
tagctagagagaagtcaatg

SEQ ID NO: 581832 - DNA, 20 bp, Artificial Sequence
  chemically synthesized
ggcatccttttccaatagaa

SEQ ID NO: 581833 - DNA, 20 bp, Artificial Sequence
  chemically synthesized
tttcgtctatattgaaaatg

SEQ ID NO: 581834 - DNA, 20 bp, Artificial Sequence
  chemically synthesized
ccacctttattaacttagat

SEQ ID NO: 581835 - DNA, 20 bp, Artificial Sequence
  chemically synthesized
gatgttagtttgatcttctg

SEQ ID NO: 581836 - DNA, 20 bp, Artificial Sequence
  chemically synthesized
tgatcttctggatagtttgc

SEQ ID NO: 581837 - DNA, 20 bp, Artificial Sequence
  chemically synthesized
ttgcacttttatgttataga

SEQ ID NO: 581838 - DNA, 20 bp, Artificial Sequence
  chemically synthesized
aggctcatgaacatacttct

SEQ ID NO: 581839 - DNA, 20 bp, Artificial Sequence
  chemically synthesized
ctagcttccaacttttctgc

SEQ ID NO: 581840 - DNA, 20 bp, Artificial Sequence
  chemically synthesized
agaattgcagagaattagtc

SEQ ID NO: 581841 - DNA, 20 bp, Artificial Sequence
  chemically synthesized
gcagagaattagtcctttgc

SEQ ID NO: 581842 - DNA, 20 bp, Artificial Sequence
  chemically synthesized
tcctttgctttagattagcc

SEQ ID NO: 581843 - DNA, 20 bp, Artificial Sequence
  chemically synthesized
tttgcttaagataatggtgt

SEQ ID NO: 581844 - DNA, 20 bp, Artificial Sequence
  chemically synthesized
gcacttttaattttcttcaa

SEQ ID NO: 581845 - DNA, 20 bp, Artificial Sequence
  chemically synthesized
tggccaactggcacaagagg

SEQ ID NO: 581846 - DNA, 20 bp, Artificial Sequence
  chemically synthesized
aggtctggctttcagcctgt

SEQ ID NO: 581847 - DNA, 20 bp, Artificial Sequence
  chemically synthesized
aaatcaaaagtcagaaatga

SEQ ID NO: 581848 - DNA, 20 bp, Artificial Sequence
  chemically synthesized
caatcttaatcatttctgac

SEQ ID NO: 581849 - DNA, 20 bp, Artificial Sequence
  chemically synthesized
cactttaaatcaaaagtcag

SEQ ID NO: 581850 - DNA, 20 bp, Artificial Sequence
  chemically synthesized
tcatgggaaaaaaaagagtc

SEQ ID NO: 581851 - DNA, 20 bp, Artificial Sequence
  chemically synthesized
agtagccagaacacacaaaa

SEQ ID NO: 581852 - DNA, 20 bp, Artificial Sequence
  chemically synthesized
gccagaacacacaaaacatt

SEQ ID NO: 581853 - DNA, 20 bp, Artificial Sequence
  chemically synthesized
acacacaaaacattgattga

SEQ ID NO: 581854 - DNA, 20 bp, Artificial Sequence
  chemically synthesized
agatggcaaacttaatcaat

SEQ ID NO: 581855 - DNA, 20 bp, Artificial Sequence
  chemically synthesized
aaattaactcaagatggaat

SEQ ID NO: 581856 - DNA, 20 bp, Artificial Sequence
  chemically synthesized
gattcttataatttgagatc

SEQ ID NO: 581857 - DNA, 20 bp, Artificial Sequence
  chemically synthesized
ggtgtttcctaggctttctt

SEQ ID NO: 581858 - DNA, 20 bp, Artificial Sequence
  chemically synthesized
gatgtccagagtggtgtttc

SEQ ID NO: 581859 - DNA, 20 bp, Artificial Sequence
  chemically synthesized
cccaagtctgatgtccagag

SEQ ID NO: 581860 - DNA, 20 bp, Artificial Sequence
  chemically synthesized
tcaatttttggttttgttat

SEQ ID NO: 581861 - DNA, 20 bp, Artificial Sequence
  chemically synthesized
ttaagttccacttgtcaatt

SEQ ID NO: 581862 - DNA, 20 bp, Artificial Sequence
  chemically synthesized
tctttcactgtgaagagctc

SEQ ID NO: 581863 - DNA, 20 bp, Artificial Sequence
  chemically synthesized
attctcttattctgtagact

SEQ ID NO: 581864 - DNA, 20 bp, Artificial Sequence
  chemically synthesized
tattagacctttgtcagatg

SEQ ID NO: 581865 - DNA, 20 bp, Artificial Sequence
  chemically synthesized
gttgaattgtttaagttccc

SEQ ID NO: 581866 - DNA, 20 bp, Artificial Sequence
  chemically synthesized
tatttgtttttgacttgttg

SEQ ID NO: 581867 - DNA, 20 bp, Artificial Sequence
  chemically synthesized
ccattttttttgatggggtt

SEQ ID NO: 581868 - DNA, 20 bp, Artificial Sequence
  chemically synthesized
tatgtcttcttttgagtagt

SEQ ID NO: 581869 - DNA, 20 bp, Artificial Sequence
  chemically synthesized
gagtgatgtggagcattttt

SEQ ID NO: 581870 - DNA, 20 bp, Artificial Sequence
  chemically synthesized
gagacggtatctcgttgtgg

SEQ ID NO: 581871 - DNA, 20 bp, Artificial Sequence
  chemically synthesized
ggtgtgagacggtatctcgt

SEQ ID NO: 581872 - DNA, 20 bp, Artificial Sequence
  chemically synthesized
aattagttcagccacagtga

SEQ ID NO: 581873 - DNA, 20 bp, Artificial Sequence
  chemically synthesized
tcagccacagtgaaacagtt

SEQ ID NO: 581874 - DNA, 20 bp, Artificial Sequence
  chemically synthesized
agtcctttgagaaatcttca

SEQ ID NO: 581875 - DNA, 20 bp, Artificial Sequence
  chemically synthesized
atcactaggttgaacgatag

SEQ ID NO: 581876 - DNA, 20 bp, Artificial Sequence
  chemically synthesized
catatagcccaaataaaaca

SEQ ID NO: 581877 - DNA, 20 bp, Artificial Sequence
  chemically synthesized
tgtggttttttagtaaagca

SEQ ID NO: 581878 - DNA, 20 bp, Artificial Sequence
  chemically synthesized
gaaatgaggatgagaataca

SEQ ID NO: 581879 - DNA, 20 bp, Artificial Sequence
  chemically synthesized
catccatgttgctgcaaagg

SEQ ID NO: 581880 - DNA, 20 bp, Artificial Sequence
  chemically synthesized
agaacacgtggtatttggta

SEQ ID NO: 581881 - DNA, 20 bp, Artificial Sequence
  chemically synthesized
tcattatgtccatgacaacg

SEQ ID NO: 581882 - DNA, 20 bp, Artificial Sequence
  chemically synthesized
ccctccccactctagtagtc

SEQ ID NO: 581883 - DNA, 20 bp, Artificial Sequence
  chemically synthesized
ccgatagttagtttttcaac

SEQ ID NO: 581884 - DNA, 20 bp, Artificial Sequence
  chemically synthesized
actgagcatagtaaccgata

SEQ ID NO: 581885 - DNA, 20 bp, Artificial Sequence
  chemically synthesized
cttgatatattacatgatgc

SEQ ID NO: 581886 - DNA, 20 bp, Artificial Sequence
  chemically synthesized
tagattcagggagtacatgt

SEQ ID NO: 581887 - DNA, 20 bp, Artificial Sequence
  chemically synthesized
aacattttttcaactttgat

SEQ ID NO: 581888 - DNA, 20 bp, Artificial Sequence
  chemically synthesized
atctaaaatcaaagttgaaa

SEQ ID NO: 581889 - DNA, 20 bp, Artificial Sequence
  chemically synthesized
aaagacaaacattttttcaa

SEQ ID NO: 581890 - DNA, 20 bp, Artificial Sequence
  chemically synthesized
ctggagggcactggagtgaa

SEQ ID NO: 581891 - DNA, 20 bp, Artificial Sequence
  chemically synthesized
attttaaagacagggtctca

SEQ ID NO: 581892 - DNA, 20 bp, Artificial Sequence
  chemically synthesized
caggaggatcgtgttagccc

SEQ ID NO: 581893 - DNA, 20 bp, Artificial Sequence
  chemically synthesized
tgccttggcctcccaaagtg

SEQ ID NO: 581894 - DNA, 20 bp, Artificial Sequence
  chemically synthesized
gtgtgagccactgcacccca

SEQ ID NO: 581895 - DNA, 20 bp, Artificial Sequence
  chemically synthesized
acctttgatgttactattgt

SEQ ID NO: 581896 - DNA, 20 bp, Artificial Sequence
  chemically synthesized
aacaaatataataataataa

SEQ ID NO: 581897 - DNA, 20 bp, Artificial Sequence
  chemically synthesized
gctcgctttacgtctctgtg

SEQ ID NO: 581898 - DNA, 20 bp, Artificial Sequence
  chemically synthesized
caatttttccaacagcatgt

SEQ ID NO: 581899 - DNA, 20 bp, Artificial Sequence
  chemically synthesized
tatttcactttttgtaaatt

SEQ ID NO: 581900 - DNA, 20 bp, Artificial Sequence
  chemically synthesized
tacatgcgtatctcgtttta

SEQ ID NO: 581901 - DNA, 20 bp, Artificial Sequence
  chemically synthesized
cccaaatatgtacatgcgta

SEQ ID NO: 581902 - DNA, 20 bp, Artificial Sequence
  chemically synthesized
gagatacgcatgtacatatt

SEQ ID NO: 581903 - DNA, 20 bp, Artificial Sequence
  chemically synthesized
gtcttgataagtggaagttc

SEQ ID NO: 581904 - DNA, 20 bp, Artificial Sequence
  chemically synthesized
acttatgattcaatttgctg

SEQ ID NO: 581905 - DNA, 20 bp, Artificial Sequence
  chemically synthesized
gctttggtattttagtacac

SEQ ID NO: 581906 - DNA, 20 bp, Artificial Sequence
  chemically synthesized
ttcatgtcttgtaatttatc

SEQ ID NO: 581907 - DNA, 20 bp, Artificial Sequence
  chemically synthesized
tatttgagggcattatttgt

SEQ ID NO: 581908 - DNA, 20 bp, Artificial Sequence
  chemically synthesized
aggctagagttgacaggtaa

SEQ ID NO: 581909 - DNA, 20 bp, Artificial Sequence
  chemically synthesized
tttctagctctttgattgac

SEQ ID NO: 581910 - DNA, 20 bp, Artificial Sequence
  chemically synthesized
tcaataaatattttctagct

SEQ ID NO: 581911 - DNA, 20 bp, Artificial Sequence
  chemically synthesized
gatatgtggtctgtagacta

SEQ ID NO: 581912 - DNA, 20 bp, Artificial Sequence
  chemically synthesized
agaccacatatcctacccta

SEQ ID NO: 581913 - DNA, 20 bp, Artificial Sequence
  chemically synthesized
ccctaatgggattctgagag

SEQ ID NO: 581914 - DNA, 20 bp, Artificial Sequence
  chemically synthesized
gaaggaatttcaggacaagg

SEQ ID NO: 581915 - DNA, 20 bp, Artificial Sequence
  chemically synthesized
ctgtattctgacttctacac

SEQ ID NO: 581916 - DNA, 20 bp, Artificial Sequence
  chemically synthesized
ctgagccctcacattctggc

SEQ ID NO: 581917 - DNA, 20 bp, Artificial Sequence
  chemically synthesized
gaaggccatgggaaatcatc

SEQ ID NO: 581918 - DNA, 20 bp, Artificial Sequence
  chemically synthesized
ttcttctgctctcaaacctc

SEQ ID NO: 581919 - DNA, 20 bp, Artificial Sequence
  chemically synthesized
ttaatcaaagaggagataca

SEQ ID NO: 581920 - DNA, 20 bp, Artificial Sequence
  chemically synthesized
aaaagcctcttgtatctcct

SEQ ID NO: 581921 - DNA, 20 bp, Artificial Sequence
  chemically synthesized
aggtaaattagaaatgtttt

SEQ ID NO: 581922 - DNA, 20 bp, Artificial Sequence
  chemically synthesized
gatgcatgaaggtaaattag

SEQ ID NO: 581923 - DNA, 20 bp, Artificial Sequence
  chemically synthesized
aaggaacataaattcaaccc

SEQ ID NO: 581924 - DNA, 20 bp, Artificial Sequence
  chemically synthesized
tttgtttaataattctttgg

SEQ ID NO: 581925 - DNA, 20 bp, Artificial Sequence
  chemically synthesized
aaagaattattaaacaaatt

SEQ ID NO: 581926 - DNA, 20 bp, Artificial Sequence
  chemically synthesized
attacaagtagaatcagcaa

SEQ ID NO: 581927 - DNA, 20 bp, Artificial Sequence
  chemically synthesized
ttttactatataggggtaaa

SEQ ID NO: 581928 - DNA, 20 bp, Artificial Sequence
  chemically synthesized
atataggggtaaaaagggat

SEQ ID NO: 581929 - DNA, 20 bp, Artificial Sequence
  chemically synthesized
gggtaaaaagggattgtagt

SEQ ID NO: 581930 - DNA, 20 bp, Artificial Sequence
  chemically synthesized
agaaaaaaggtaaacattca

SEQ ID NO: 581931 - DNA, 20 bp, Artificial Sequence
  chemically synthesized
agaatttaacaaaacattct

SEQ ID NO: 581932 - DNA, 20 bp, Artificial Sequence
  chemically synthesized
tcttctcacactctgaaagt

SEQ ID NO: 581933 - DNA, 20 bp, Artificial Sequence
  chemically synthesized
tctctctggaaatacaactt

SEQ ID NO: 581934 - DNA, 20 bp, Artificial Sequence
  chemically synthesized
gcatttttaacaaatgtttt

SEQ ID NO: 581935 - DNA, 20 bp, Artificial Sequence
  chemically synthesized
aggttgaatgcatttttaac

SEQ ID NO: 581936 - DNA, 20 bp, Artificial Sequence
  chemically synthesized
taaaaatgcattcaaccttt

SEQ ID NO: 581937 - DNA, 20 bp, Artificial Sequence
  chemically synthesized
ttaaatgaataatatcttca

SEQ ID NO: 581938 - DNA, 20 bp, Artificial Sequence
  chemically synthesized
atttaagtactgaaacaaaa

SEQ ID NO: 581939 - DNA, 20 bp, Artificial Sequence
  chemically synthesized
gttagaaataaaaagcatgg

SEQ ID NO: 581940 - DNA, 20 bp, Artificial Sequence
  chemically synthesized
ctgccgttagaaataaaaag

SEQ ID NO: 581941 - DNA, 20 bp, Artificial Sequence
  chemically synthesized
ggtaacatctcttgctttgc

SEQ ID NO: 581942 - DNA, 20 bp, Artificial Sequence
  chemically synthesized
tatcagcgaatggtaacatc

SEQ ID NO: 581943 - DNA, 20 bp, Artificial Sequence
  chemically synthesized
gggaagtgaagtgaagaaat

SEQ ID NO: 581944 - DNA, 20 bp, Artificial Sequence
  chemically synthesized
agaaatgagtgattatctag

SEQ ID NO: 581945 - DNA, 20 bp, Artificial Sequence
  chemically synthesized
gggttagggggcttgaatta

SEQ ID NO: 581946 - DNA, 20 bp, Artificial Sequence
  chemically synthesized
aagacagcagaagagggtta

SEQ ID NO: 581947 - DNA, 20 bp, Artificial Sequence
  chemically synthesized
aattggcacagctgttcaat

SEQ ID NO: 581948 - DNA, 20 bp, Artificial Sequence
  chemically synthesized
catatagggatagaatcagg

SEQ ID NO: 581949 - DNA, 20 bp, Artificial Sequence
  chemically synthesized
tttatagctgaataaactga

SEQ ID NO: 581950 - DNA, 20 bp, Artificial Sequence
  chemically synthesized
cattcatataaaccactctt

SEQ ID NO: 581951 - DNA, 20 bp, Artificial Sequence
  chemically synthesized
cattgctttaatcacacaag

SEQ ID NO: 581952 - DNA, 20 bp, Artificial Sequence
  chemically synthesized
tgaattcttataaatagatt

SEQ ID NO: 581953 - DNA, 20 bp, Artificial Sequence
  chemically synthesized
aaggtatttgaattcttata

SEQ ID NO: 581954 - DNA, 20 bp, Artificial Sequence
  chemically synthesized
attagtcaaatatggctagt

SEQ ID NO: 581955 - DNA, 20 bp, Artificial Sequence
  chemically synthesized
tatagaatatatttaatcca

SEQ ID NO: 581956 - DNA, 20 bp, Artificial Sequence
  chemically synthesized
aaatcagaaggctgaaacct

SEQ ID NO: 581957 - DNA, 20 bp, Artificial Sequence
  chemically synthesized
taatccatgaggtttcagcc

SEQ ID NO: 581958 - DNA, 20 bp, Artificial Sequence
  chemically synthesized
accttaaacaatgctatatt

SEQ ID NO: 581959 - DNA, 20 bp, Artificial Sequence
  chemically synthesized
tttccaagccattaatatag

SEQ ID NO: 581960 - DNA, 20 bp, Artificial Sequence
  chemically synthesized
ttaatggcttggaaatcctt

SEQ ID NO: 581961 - DNA, 20 bp, Artificial Sequence
  chemically synthesized
acacttatttgtaaaactca

SEQ ID NO: 581962 - DNA, 20 bp, Artificial Sequence
  chemically synthesized
gcacacatacacacatgcac

SEQ ID NO: 581963 - DNA, 20 bp, Artificial Sequence
  chemically synthesized
gacgtacatataaggggaaa

SEQ ID NO: 581964 - DNA, 20 bp, Artificial Sequence
  chemically synthesized
ctgagaaaatgtacaaagga

SEQ ID NO: 581965 - DNA, 20 bp, Artificial Sequence
  chemically synthesized
tcatataagttctgagaaga

SEQ ID NO: 581966 - DNA, 20 bp, Artificial Sequence
  chemically synthesized
ggaaaaagataaaaatctgc

SEQ ID NO: 581967 - DNA, 20 bp, Artificial Sequence
  chemically synthesized
acacatagcacccaatcaag

SEQ ID NO: 581968 - DNA, 20 bp, Artificial Sequence
  chemically synthesized
tctgcccttgattgggtgct

SEQ ID NO: 581969 - DNA, 20 bp, Artificial Sequence
  chemically synthesized
tgggtgctatgtgtttaagc

SEQ ID NO: 581970 - DNA, 20 bp, Artificial Sequence
  chemically synthesized
caaatgatttacagctaaac

SEQ ID NO: 581971 - DNA, 20 bp, Artificial Sequence
  chemically synthesized
taccaagaaatgatcttcac

SEQ ID NO: 581972 - DNA, 20 bp, Artificial Sequence
  chemically synthesized
ggaggtgttagacattgatc

SEQ ID NO: 581973 - DNA, 20 bp, Artificial Sequence
  chemically synthesized
agcaaatttctataataaaa

SEQ ID NO: 581974 - DNA, 20 bp, Artificial Sequence
  chemically synthesized
tttctataataaaacaatga

SEQ ID NO: 581975 - DNA, 20 bp, Artificial Sequence
  chemically synthesized
ttttgacagagaagcagaat

SEQ ID NO: 581976 - DNA, 20 bp, Artificial Sequence
  chemically synthesized
agagctttcatgtcataaaa

SEQ ID NO: 581977 - DNA, 20 bp, Artificial Sequence
  chemically synthesized
tctgttctttgtttactgaa

SEQ ID NO: 581978 - DNA, 20 bp, Artificial Sequence
  chemically synthesized
ttctccaataacagtctgtt

SEQ ID NO: 581979 - DNA, 20 bp, Artificial Sequence
  chemically synthesized
tcagctggaacttacagtat

SEQ ID NO: 581980 - DNA, 20 bp, Artificial Sequence
  chemically synthesized
ggaagggacatattctatgg

SEQ ID NO: 581981 - DNA, 20 bp, Artificial Sequence
  chemically synthesized
gcactgcggcatgaaaggag

SEQ ID NO: 581982 - DNA, 20 bp, Artificial Sequence
  chemically synthesized
gagcccagcttgagggggag

SEQ ID NO: 581983 - DNA, 20 bp, Artificial Sequence
  chemically synthesized
cggcttcatttgtgccatgt

SEQ ID NO: 581984 - DNA, 20 bp, Artificial Sequence
  chemically synthesized
gaatcggcttcatttgtgcc

SEQ ID NO: 581985 - DNA, 20 bp, Artificial Sequence
  chemically synthesized
caaacacatggcacaaatga

SEQ ID NO: 581986 - DNA, 20 bp, Artificial Sequence
  chemically synthesized
aagtttccatattcctcaga

SEQ ID NO: 581987 - DNA, 20 bp, Artificial Sequence
  chemically synthesized
aggaatatggaaactttatg

SEQ ID NO: 581988 - DNA, 20 bp, Artificial Sequence
  chemically synthesized
tttccctatcaaacagtaca

SEQ ID NO: 581989 - DNA, 20 bp, Artificial Sequence
  chemically synthesized
ctgtttgatagggaaatgtg

SEQ ID NO: 581990 - DNA, 20 bp, Artificial Sequence
  chemically synthesized
atgtgcacagcttctaaacg

SEQ ID NO: 581991 - DNA, 20 bp, Artificial Sequence
  chemically synthesized
ttggagcagaactagaagct

SEQ ID NO: 581992 - DNA, 20 bp, Artificial Sequence
  chemically synthesized
acaagtacaatcaattctta

SEQ ID NO: 581993 - DNA, 20 bp, Artificial Sequence
  chemically synthesized
cattacagaaaccacttaag

SEQ ID NO: 581994 - DNA, 20 bp, Artificial Sequence
  chemically synthesized
taatgttgtgttcctaaccg

SEQ ID NO: 581995 - DNA, 20 bp, Artificial Sequence
  chemically synthesized
gtttacattatagggaagtg

SEQ ID NO: 581996 - DNA, 20 bp, Artificial Sequence
  chemically synthesized
gggaagtgttaagtttaatt

SEQ ID NO: 581997 - DNA, 20 bp, Artificial Sequence
  chemically synthesized
ttaattttctgttttattag

SEQ ID NO: 581998 - DNA, 20 bp, Artificial Sequence
  chemically synthesized
tgcagcctttctgcagggat

SEQ ID NO: 581999 - DNA, 20 bp, Artificial Sequence
  chemically synthesized
atggtactgcagcctttctg

SEQ ID NO: 582000 - DNA, 20 bp, Artificial Sequence
  chemically synthesized
aggctgcagtaccatttctc

SEQ ID NO: 582001 - DNA, 20 bp, Artificial Sequence
  chemically synthesized
ttctctagtgattccttttt

SEQ ID NO: 582002 - DNA, 20 bp, Artificial Sequence
  chemically synthesized
tatttgtataaggtgagcaa

SEQ ID NO: 582003 - DNA, 20 bp, Artificial Sequence
  chemically synthesized
gtgttgatttatttatgatt

SEQ ID NO: 582004 - DNA, 20 bp, Artificial Sequence
  chemically synthesized
acccaatagtgttgatttat

SEQ ID NO: 582005 - DNA, 20 bp, Artificial Sequence
  chemically synthesized
atattggaaccacccaatag

SEQ ID NO: 582006 - DNA, 20 bp, Artificial Sequence
  chemically synthesized
taatgatctgtcttaatttt

SEQ ID NO: 582007 - DNA, 20 bp, Artificial Sequence
  chemically synthesized
agaataggtgttactgaggt

SEQ ID NO: 582008 - DNA, 20 bp, Artificial Sequence
  chemically synthesized
taggctacctagttttgtag

SEQ ID NO: 582009 - DNA, 20 bp, Artificial Sequence
  chemically synthesized
gcctctaggctacctagttt

SEQ ID NO: 582010 - DNA, 20 bp, Artificial Sequence
  chemically synthesized
tagctgttgcctctaggcta

SEQ ID NO: 582011 - DNA, 20 bp, Artificial Sequence
  chemically synthesized
cctagaggcaacagctaatt

SEQ ID NO: 582012 - DNA, 20 bp, Artificial Sequence
  chemically synthesized
cagtagcacatgtactgtga

SEQ ID NO: 582013 - DNA, 20 bp, Artificial Sequence
  chemically synthesized
tcttcagtagcacatgtact

SEQ ID NO: 582014 - DNA, 20 bp, Artificial Sequence
  chemically synthesized
tgcatctctcaggttcctaa

SEQ ID NO: 582015 - DNA, 20 bp, Artificial Sequence
  chemically synthesized
ctgagagatgcaactaatta

SEQ ID NO: 582016 - DNA, 20 bp, Artificial Sequence
  chemically synthesized
tgtagtaattgctacgctgt

SEQ ID NO: 582017 - DNA, 20 bp, Artificial Sequence
  chemically synthesized
acaagagtaataactagtta

SEQ ID NO: 582018 - DNA, 20 bp, Artificial Sequence
  chemically synthesized
gtgctagatattgcacatgg

SEQ ID NO: 582019 - DNA, 20 bp, Artificial Sequence
  chemically synthesized
agatattgcacatgggatgg

SEQ ID NO: 582020 - DNA, 20 bp, Artificial Sequence
  chemically synthesized
tgtctgtaagttaatatata

SEQ ID NO: 582021 - DNA, 20 bp, Artificial Sequence
  chemically synthesized
tgggcaaattatgcttcatt

SEQ ID NO: 582022 - DNA, 20 bp, Artificial Sequence
  chemically synthesized
gcttggtgaccttgggcaaa

SEQ ID NO: 582023 - DNA, 20 bp, Artificial Sequence
  chemically synthesized
ttattccaccttcaccacct

SEQ ID NO: 582024 - DNA, 20 bp, Artificial Sequence
  chemically synthesized
tggcccatatcctccttttc

SEQ ID NO: 582025 - DNA, 20 bp, Artificial Sequence
  chemically synthesized
cccagcttcggctacattat

SEQ ID NO: 582026 - DNA, 20 bp, Artificial Sequence
  chemically synthesized
aatgtagccgaagctgggct

SEQ ID NO: 582027 - DNA, 20 bp, Artificial Sequence
  chemically synthesized
gatgactataaagcatctag

SEQ ID NO: 582028 - DNA, 20 bp, Artificial Sequence
  chemically synthesized
ccagctaggtagagttgttg

SEQ ID NO: 582029 - DNA, 20 bp, Artificial Sequence
  chemically synthesized
acatgaggaaataagcacag

SEQ ID NO: 582030 - DNA, 20 bp, Artificial Sequence
  chemically synthesized
ggggaagttggtaatctttt

SEQ ID NO: 582031 - DNA, 20 bp, Artificial Sequence
  chemically synthesized
ccagttaggatcaggatagc

SEQ ID NO: 582032 - DNA, 20 bp, Artificial Sequence
  chemically synthesized
ttaggatcaggatagcattt

SEQ ID NO: 582033 - DNA, 20 bp, Artificial Sequence
  chemically synthesized
tgtttctttttttaattatt

SEQ ID NO: 582034 - DNA, 20 bp, Artificial Sequence
  chemically synthesized
attattattattattatact

SEQ ID NO: 582035 - DNA, 20 bp, Artificial Sequence
  chemically synthesized
cacctatgaatgagaatatg

SEQ ID NO: 582036 - DNA, 20 bp, Artificial Sequence
  chemically synthesized
atgaatgagaatatgcggtg

SEQ ID NO: 582037 - DNA, 20 bp, Artificial Sequence
  chemically synthesized
gtttggttttttgttcttgc

SEQ ID NO: 582038 - DNA, 20 bp, Artificial Sequence
  chemically synthesized
ttgcaatagtttactgagaa

SEQ ID NO: 582039 - DNA, 20 bp, Artificial Sequence
  chemically synthesized
caaatgtccaacaatgatag

SEQ ID NO: 582040 - DNA, 20 bp, Artificial Sequence
  chemically synthesized
ctataaagacacatgcacat

SEQ ID NO: 582041 - DNA, 20 bp, Artificial Sequence
  chemically synthesized
gtgcatgtgtctttatagca

SEQ ID NO: 582042 - DNA, 20 bp, Artificial Sequence
  chemically synthesized
aaccattgtggaagtcagtg

SEQ ID NO: 582043 - DNA, 20 bp, Artificial Sequence
  chemically synthesized
ctgacttccacaatggttga

SEQ ID NO: 582044 - DNA, 20 bp, Artificial Sequence
  chemically synthesized
tccacatcctctccagcacc

SEQ ID NO: 582045 - DNA, 20 bp, Artificial Sequence
  chemically synthesized
cctgttgtttcctgactttt

SEQ ID NO: 582046 - DNA, 20 bp, Artificial Sequence
  chemically synthesized
ggtgtgagatggtatctcat

SEQ ID NO: 582047 - DNA, 20 bp, Artificial Sequence
  chemically synthesized
gagatggtatctcattgtgg

SEQ ID NO: 582048 - DNA, 20 bp, Artificial Sequence
  chemically synthesized
cttcgcccacttttggatgg

SEQ ID NO: 582049 - DNA, 20 bp, Artificial Sequence
  chemically synthesized
gcccacttttggatggggtt

SEQ ID NO: 582050 - DNA, 20 bp, Artificial Sequence
  chemically synthesized
gtaaatttgttggagttcat

SEQ ID NO: 582051 - DNA, 20 bp, Artificial Sequence
  chemically synthesized
catgggagaaaattttcgca

SEQ ID NO: 582052 - DNA, 20 bp, Artificial Sequence
  chemically synthesized
ggttgcctgttcactctgat

SEQ ID NO: 582053 - DNA, 20 bp, Artificial Sequence
  chemically synthesized
cttttgctgtgcagaagctc

SEQ ID NO: 582054 - DNA, 20 bp, Artificial Sequence
  chemically synthesized
aatgggatctaactaaacta

SEQ ID NO: 582055 - DNA, 20 bp, Artificial Sequence
  chemically synthesized
gttagatcccatttgtcaat

SEQ ID NO: 582056 - DNA, 20 bp, Artificial Sequence
  chemically synthesized
tcaattttggcttttgttgc

SEQ ID NO: 582057 - DNA, 20 bp, Artificial Sequence
  chemically synthesized
gcttttgttgcccttgcttt

SEQ ID NO: 582058 - DNA, 20 bp, Artificial Sequence
  chemically synthesized
tatgtcctgaatggtaatgc

SEQ ID NO: 582059 - DNA, 20 bp, Artificial Sequence
  chemically synthesized
gtaatgcctaggttttcttc

SEQ ID NO: 582060 - DNA, 20 bp, Artificial Sequence
  chemically synthesized
aggttttcttctagggtttt

SEQ ID NO: 582061 - DNA, 20 bp, Artificial Sequence
  chemically synthesized
ggtttttatggttttaggtc

SEQ ID NO: 582062 - DNA, 20 bp, Artificial Sequence
  chemically synthesized
taagtctttaatccatcttg

SEQ ID NO: 582063 - DNA, 20 bp, Artificial Sequence
  chemically synthesized
ttatacaaaaatcaattcaa

SEQ ID NO: 582064 - DNA, 20 bp, Artificial Sequence
  chemically synthesized
tataaggtgtaaggaaggga

SEQ ID NO: 582065 - DNA, 20 bp, Artificial Sequence
  chemically synthesized
gtgtaaggaagggatccagt

SEQ ID NO: 582066 - DNA, 20 bp, Artificial Sequence
  chemically synthesized
cagctttctacatatggcta

SEQ ID NO: 582067 - DNA, 20 bp, Artificial Sequence
  chemically synthesized
taaatagggaatcctttccc

SEQ ID NO: 582068 - DNA, 20 bp, Artificial Sequence
  chemically synthesized
tagggaatcctttccccatt

SEQ ID NO: 582069 - DNA, 20 bp, Artificial Sequence
  chemically synthesized
gagaaaaacaagcaatgggg

SEQ ID NO: 582070 - DNA, 20 bp, Artificial Sequence
  chemically synthesized
ttccccattgcttgtttttc

SEQ ID NO: 582071 - DNA, 20 bp, Artificial Sequence
  chemically synthesized
tctgttccattgatctatat

SEQ ID NO: 582072 - DNA, 20 bp, Artificial Sequence
  chemically synthesized
ctgttttggtaccagtacca

SEQ ID NO: 582073 - DNA, 20 bp, Artificial Sequence
  chemically synthesized
cttgtgccagttttcaaagg

SEQ ID NO: 582074 - DNA, 20 bp, Artificial Sequence
  chemically synthesized
agagggcatccctgtcttgt

SEQ ID NO: 582075 - DNA, 20 bp, Artificial Sequence
  chemically synthesized
accctttatttccttctcct

SEQ ID NO: 582076 - DNA, 20 bp, Artificial Sequence
  chemically synthesized
agaagaggaagtcaaattgt

SEQ ID NO: 582077 - DNA, 20 bp, Artificial Sequence
  chemically synthesized
attgtccctgtttgcagacg

SEQ ID NO: 582078 - DNA, 20 bp, Artificial Sequence
  chemically synthesized
gagattttgggctgagacaa

SEQ ID NO: 582079 - DNA, 20 bp, Artificial Sequence
  chemically synthesized
tgaagttgcttatcagctta

SEQ ID NO: 582080 - DNA, 20 bp, Artificial Sequence
  chemically synthesized
agactttgctgaagttgctt

SEQ ID NO: 582081 - DNA, 20 bp, Artificial Sequence
  chemically synthesized
gtatcctgagactttgctga

SEQ ID NO: 582082 - DNA, 20 bp, Artificial Sequence
  chemically synthesized
gaatgcttgtgatttttgta

SEQ ID NO: 582083 - DNA, 20 bp, Artificial Sequence
  chemically synthesized
tcgttggtgtataagaatgc

SEQ ID NO: 582084 - DNA, 20 bp, Artificial Sequence
  chemically synthesized
tgtctgtcgttggtgtataa

SEQ ID NO: 582085 - DNA, 20 bp, Artificial Sequence
  chemically synthesized
agttcactcatgatttggct

SEQ ID NO: 582086 - DNA, 20 bp, Artificial Sequence
  chemically synthesized
aattgtgaatgggagttcac

SEQ ID NO: 582087 - DNA, 20 bp, Artificial Sequence
  chemically synthesized
atgagtgaactcccattcac

SEQ ID NO: 582088 - DNA, 20 bp, Artificial Sequence
  chemically synthesized
gtccttcacatcgcttgtaa

SEQ ID NO: 582089 - DNA, 20 bp, Artificial Sequence
  chemically synthesized
ctccttgaagaggtccttca

SEQ ID NO: 582090 - DNA, 20 bp, Artificial Sequence
  chemically synthesized
cctcttttatttccttgagc

SEQ ID NO: 582091 - DNA, 20 bp, Artificial Sequence
  chemically synthesized
tgagcacggaatgttcttcc

SEQ ID NO: 582092 - DNA, 20 bp, Artificial Sequence
  chemically synthesized
cagtatggccatttacacga

SEQ ID NO: 582093 - DNA, 20 bp, Artificial Sequence
  chemically synthesized
ccatactgcccaaggtaatt

SEQ ID NO: 582094 - DNA, 20 bp, Artificial Sequence
  chemically synthesized
attctgtgaagaaagtcatt

SEQ ID NO: 582095 - DNA, 20 bp, Artificial Sequence
  chemically synthesized
tggttccatatgaactttaa

SEQ ID NO: 582096 - DNA, 20 bp, Artificial Sequence
  chemically synthesized
tccagctttgttcttttggc

SEQ ID NO: 582097 - DNA, 20 bp, Artificial Sequence
  chemically synthesized
gatgcctccagctttgttct

SEQ ID NO: 582098 - DNA, 20 bp, Artificial Sequence
  chemically synthesized
aagtcaggtagcgtgatgcc

SEQ ID NO: 582099 - DNA, 20 bp, Artificial Sequence
  chemically synthesized
gttcaaatgctatcctttag

SEQ ID NO: 582100 - DNA, 20 bp, Artificial Sequence
  chemically synthesized
taaggtctcttcccaagcaa

SEQ ID NO: 582101 - DNA, 20 bp, Artificial Sequence
  chemically synthesized
agtgttagaataggaagcag

SEQ ID NO: 582102 - DNA, 20 bp, Artificial Sequence
  chemically synthesized
caggactgcaaggaagtgtt

SEQ ID NO: 582103 - DNA, 20 bp, Artificial Sequence
  chemically synthesized
ccatcaacacttccttgcag

SEQ ID NO: 582104 - DNA, 20 bp, Artificial Sequence
  chemically synthesized
aattcagtgggttaaacaaa

SEQ ID NO: 582105 - DNA, 20 bp, Artificial Sequence
  chemically synthesized
ttctgctttttaaaatcatg

SEQ ID NO: 582106 - DNA, 20 bp, Artificial Sequence
  chemically synthesized
ttcccttctgctttttaaaa

SEQ ID NO: 582107 - DNA, 20 bp, Artificial Sequence
  chemically synthesized
gccaattgtgtagttttccc

SEQ ID NO: 582108 - DNA, 20 bp, Artificial Sequence
  chemically synthesized
gcagaagggaaaactacaca

SEQ ID NO: 582109 - DNA, 20 bp, Artificial Sequence
  chemically synthesized
aagggaaaactacacaattg

SEQ ID NO: 582110 - DNA, 20 bp, Artificial Sequence
  chemically synthesized
gaggagaagcaagccaattg

SEQ ID NO: 582111 - DNA, 20 bp, Artificial Sequence
  chemically synthesized
tggacacttttccctttttg

SEQ ID NO: 582112 - DNA, 20 bp, Artificial Sequence
  chemically synthesized
tattatttcacacaaataca

SEQ ID NO: 582113 - DNA, 20 bp, Artificial Sequence
  chemically synthesized
gggggcaatgtcatggtcca

SEQ ID NO: 582114 - DNA, 20 bp, Artificial Sequence
  chemically synthesized
agaaaaaataaaccttaata

SEQ ID NO: 582115 - DNA, 20 bp, Artificial Sequence
  chemically synthesized
ttttaatacaagcttcttat

SEQ ID NO: 582116 - DNA, 20 bp, Artificial Sequence
  chemically synthesized
taactttgcacaattttaat

SEQ ID NO: 582117 - DNA, 20 bp, Artificial Sequence
  chemically synthesized
ctgcctgtggctgttgtaac

SEQ ID NO: 582118 - DNA, 20 bp, Artificial Sequence
  chemically synthesized
taacaaatgattacagactt

SEQ ID NO: 582119 - DNA, 20 bp, Artificial Sequence
  chemically synthesized
attgtaagataataaatttg

SEQ ID NO: 582120 - DNA, 20 bp, Artificial Sequence
  chemically synthesized
agctctgccaacacattgtt

SEQ ID NO: 582121 - DNA, 20 bp, Artificial Sequence
  chemically synthesized
agctagaaacaatgtgttgg

SEQ ID NO: 582122 - DNA, 20 bp, Artificial Sequence
  chemically synthesized
gaatgcaagctctgccaaca

SEQ ID NO: 582123 - DNA, 20 bp, Artificial Sequence
  chemically synthesized
ttccctctaagggatgtagg

SEQ ID NO: 582124 - DNA, 20 bp, Artificial Sequence
  chemically synthesized
ggattcttttccatgccttt

SEQ ID NO: 582125 - DNA, 20 bp, Artificial Sequence
  chemically synthesized
atcttccaatctctctttta

SEQ ID NO: 582126 - DNA, 20 bp, Artificial Sequence
  chemically synthesized
atgatacaagcagagtaaaa

SEQ ID NO: 582127 - DNA, 20 bp, Artificial Sequence
  chemically synthesized
cttctctcttaggaggactc

SEQ ID NO: 582128 - DNA, 20 bp, Artificial Sequence
  chemically synthesized
acccaggctatctctccgtg

SEQ ID NO: 582129 - DNA, 20 bp, Artificial Sequence
  chemically synthesized
atatgttaccttacatggca

SEQ ID NO: 582130 - DNA, 20 bp, Artificial Sequence
  chemically synthesized
ggtaacatattcacaggttc

SEQ ID NO: 582131 - DNA, 20 bp, Artificial Sequence
  chemically synthesized
gtaaatgcagaaccattgtg

SEQ ID NO: 582132 - DNA, 20 bp, Artificial Sequence
  chemically synthesized
tgcatttacttagcatgaga

SEQ ID NO: 582133 - DNA, 20 bp, Artificial Sequence
  chemically synthesized
cagtatgtcacattgtgaca

SEQ ID NO: 582134 - DNA, 20 bp, Artificial Sequence
  chemically synthesized
cttttttgcctcctgtgctt

SEQ ID NO: 582135 - DNA, 20 bp, Artificial Sequence
  chemically synthesized
tttgtttgcttttttgcctc

SEQ ID NO: 582136 - DNA, 20 bp, Artificial Sequence
  chemically synthesized
ggtatgactggttgtttttt

SEQ ID NO: 582137 - DNA, 20 bp, Artificial Sequence
  chemically synthesized
gcctggtatgactggttgtt

SEQ ID NO: 582138 - DNA, 20 bp, Artificial Sequence
  chemically synthesized
cacaggagcctggtatgact

SEQ ID NO: 582139 - DNA, 20 bp, Artificial Sequence
  chemically synthesized
tcctgtgtccttgtggcaga

SEQ ID NO: 582140 - DNA, 20 bp, Artificial Sequence
  chemically synthesized
aatgtaacgcttttgtgaac

SEQ ID NO: 582141 - DNA, 20 bp, Artificial Sequence
  chemically synthesized
ttattattatttttttaatg

SEQ ID NO: 582142 - DNA, 20 bp, Artificial Sequence
  chemically synthesized
ctgtgatttcctcagggagt

SEQ ID NO: 582143 - DNA, 20 bp, Artificial Sequence
  chemically synthesized
gtgactccctgaggaaatca

SEQ ID NO: 582144 - DNA, 20 bp, Artificial Sequence
  chemically synthesized
ccctgaggaaatcacagtgt

SEQ ID NO: 582145 - DNA, 20 bp, Artificial Sequence
  chemically synthesized
cttgtcaccaaacagaaaca

SEQ ID NO: 582146 - DNA, 20 bp, Artificial Sequence
  chemically synthesized
tataggattcattcctgaag

SEQ ID NO: 582147 - DNA, 20 bp, Artificial Sequence
  chemically synthesized
gagctttatctgaaattctt

SEQ ID NO: 582148 - DNA, 20 bp, Artificial Sequence
  chemically synthesized
gccttcactccccaaaagat

SEQ ID NO: 582149 - DNA, 20 bp, Artificial Sequence
  chemically synthesized
caaagctgagctaaggggaa

SEQ ID NO: 582150 - DNA, 20 bp, Artificial Sequence
  chemically synthesized
aaaaaccatcttccccttag

SEQ ID NO: 582151 - DNA, 20 bp, Artificial Sequence
  chemically synthesized
agacagctgggaagaaggct

SEQ ID NO: 582152 - DNA, 20 bp, Artificial Sequence
  chemically synthesized
gagaggaagacagctgggaa

SEQ ID NO: 582153 - DNA, 20 bp, Artificial Sequence
  chemically synthesized
aaaagaattcaaaaagtaga

SEQ ID NO: 582154 - DNA, 20 bp, Artificial Sequence
  chemically synthesized
aacaactactactaaaatct

SEQ ID NO: 582155 - DNA, 20 bp, Artificial Sequence
  chemically synthesized
tggtaacaatagaagaagct

SEQ ID NO: 582156 - DNA, 20 bp, Artificial Sequence
  chemically synthesized
ctctccatggtaacaataga

SEQ ID NO: 582157 - DNA, 20 bp, Artificial Sequence
  chemically synthesized
ttgttttgtgtatggaagtg

SEQ ID NO: 582158 - DNA, 20 bp, Artificial Sequence
  chemically synthesized
tgccacccactgtgtgttcc

SEQ ID NO: 582159 - DNA, 20 bp, Artificial Sequence
  chemically synthesized
ccagggatgtgaatgaatca

SEQ ID NO: 582160 - DNA, 20 bp, Artificial Sequence
  chemically synthesized
cagcatattatcacaaagcc

SEQ ID NO: 582161 - DNA, 20 bp, Artificial Sequence
  chemically synthesized
ttgttcattacttttctgtt

SEQ ID NO: 582162 - DNA, 20 bp, Artificial Sequence
  chemically synthesized
gttatcattgttcattactt

SEQ ID NO: 582163 - DNA, 20 bp, Artificial Sequence
  chemically synthesized
gatatagacaattactctgc

SEQ ID NO: 582164 - DNA, 20 bp, Artificial Sequence
  chemically synthesized
tctgcagttgtttgaatata

SEQ ID NO: 582165 - DNA, 20 bp, Artificial Sequence
  chemically synthesized
tgaccttcagaatggcagta

SEQ ID NO: 582166 - DNA, 20 bp, Artificial Sequence
  chemically synthesized
tttgtctacatgtttgtatt

SEQ ID NO: 582167 - DNA, 20 bp, Artificial Sequence
  chemically synthesized
tctgcctgctttgtttgtct

SEQ ID NO: 582168 - DNA, 20 bp, Artificial Sequence
  chemically synthesized
ttattacttccttctgcctg

SEQ ID NO: 582169 - DNA, 20 bp, Artificial Sequence
  chemically synthesized
taaacttattacttccttct

SEQ ID NO: 582170 - DNA, 20 bp, Artificial Sequence
  chemically synthesized
aaagcaggcagaaggaagta

SEQ ID NO: 582171 - DNA, 20 bp, Artificial Sequence
  chemically synthesized
gtgctataagaactgagaga

SEQ ID NO: 582172 - DNA, 20 bp, Artificial Sequence
  chemically synthesized
agaatagaagaaagaaaaag

SEQ ID NO: 582173 - DNA, 20 bp, Artificial Sequence
  chemically synthesized
ctcactgatgtttcaccatc

SEQ ID NO: 582174 - DNA, 20 bp, Artificial Sequence
  chemically synthesized
catctgatggtgaaacatca

SEQ ID NO: 582175 - DNA, 20 bp, Artificial Sequence
  chemically synthesized
agatataattaaaatctcac

SEQ ID NO: 582176 - DNA, 20 bp, Artificial Sequence
  chemically synthesized
tcagtgagattttaattata

SEQ ID NO: 582177 - DNA, 20 bp, Artificial Sequence
  chemically synthesized
atcagcagatttttcctagt

SEQ ID NO: 582178 - DNA, 20 bp, Artificial Sequence
  chemically synthesized
atctcaaactaggaaaaatc

SEQ ID NO: 582179 - DNA, 20 bp, Artificial Sequence
  chemically synthesized
ttgtgaatcagcagattttt

SEQ ID NO: 582180 - DNA, 20 bp, Artificial Sequence
  chemically synthesized
tattttcatgtttgtgaatc

SEQ ID NO: 582181 - DNA, 20 bp, Artificial Sequence
  chemically synthesized
tctgatcttttaaaatattt

SEQ ID NO: 582182 - DNA, 20 bp, Artificial Sequence
  chemically synthesized
tctcctgacatgaaccatat

SEQ ID NO: 582183 - DNA, 20 bp, Artificial Sequence
  chemically synthesized
tatatatgctttattctttc

SEQ ID NO: 582184 - DNA, 20 bp, Artificial Sequence
  chemically synthesized
catcattttaaaaattcaga

SEQ ID NO: 582185 - DNA, 20 bp, Artificial Sequence
  chemically synthesized
gaatttttctttggaaaata

SEQ ID NO: 582186 - DNA, 20 bp, Artificial Sequence
  chemically synthesized
tgtacataaattttgtgtgg

SEQ ID NO: 582187 - DNA, 20 bp, Artificial Sequence
  chemically synthesized
actagtttgcagttcttttc

SEQ ID NO: 582188 - DNA, 20 bp, Artificial Sequence
  chemically synthesized
cattttaaatttatgcttct

SEQ ID NO: 582189 - DNA, 20 bp, Artificial Sequence
  chemically synthesized
tcatcagcaacattttaaat

SEQ ID NO: 582190 - DNA, 20 bp, Artificial Sequence
  chemically synthesized
ttgctgatgatgacatcgag

SEQ ID NO: 582191 - DNA, 20 bp, Artificial Sequence
  chemically synthesized
ttccccttctcaatacccac

SEQ ID NO: 582192 - DNA, 20 bp, Artificial Sequence
  chemically synthesized
ctctagcttttaaaaacaca

SEQ ID NO: 582193 - DNA, 20 bp, Artificial Sequence
  chemically synthesized
agcttttaaaaacacaatga

SEQ ID NO: 582194 - DNA, 20 bp, Artificial Sequence
  chemically synthesized
tgctgtagaaaacaatctca

SEQ ID NO: 582195 - DNA, 20 bp, Artificial Sequence
  chemically synthesized
ggtgtataaaaaatataaag

SEQ ID NO: 582196 - DNA, 20 bp, Artificial Sequence
  chemically synthesized
cactgccgagcgtacgtgtg

SEQ ID NO: 582197 - DNA, 20 bp, Artificial Sequence
  chemically synthesized
cggcagtgtaaaagttacct

SEQ ID NO: 582198 - DNA, 20 bp, Artificial Sequence
  chemically synthesized
gtgtaaaagttacctcactg

SEQ ID NO: 582199 - DNA, 20 bp, Artificial Sequence
  chemically synthesized
aataaaattttatactgaat

SEQ ID NO: 582200 - DNA, 20 bp, Artificial Sequence
  chemically synthesized
ataaaatagcagtgttatta

SEQ ID NO: 582201 - DNA, 20 bp, Artificial Sequence
  chemically synthesized
aaagatttctgacaagtagt

SEQ ID NO: 582202 - DNA, 20 bp, Artificial Sequence
  chemically synthesized
caggcagcacaaactcaaga

SEQ ID NO: 582203 - DNA, 20 bp, Artificial Sequence
  chemically synthesized
aagcaattacaagcggactc

SEQ ID NO: 582204 - DNA, 20 bp, Artificial Sequence
  chemically synthesized
aaactcaagagtccgcttgt

SEQ ID NO: 582205 - DNA, 20 bp, Artificial Sequence
  chemically synthesized
agaaaattaatggtaagttg

SEQ ID NO: 582206 - DNA, 20 bp, Artificial Sequence
  chemically synthesized
tatctatctgtatttttcag

SEQ ID NO: 582207 - DNA, 20 bp, Artificial Sequence
  chemically synthesized
ctggctatctatctgtattt

SEQ ID NO: 582208 - DNA, 20 bp, Artificial Sequence
  chemically synthesized
gagagagagagagacactga

SEQ ID NO: 582209 - DNA, 20 bp, Artificial Sequence
  chemically synthesized
ctgactctgatttataggat

SEQ ID NO: 582210 - DNA, 20 bp, Artificial Sequence
  chemically synthesized
tatctattcctgttagaatt

SEQ ID NO: 582211 - DNA, 20 bp, Artificial Sequence
  chemically synthesized
ctgtaatttgggggtaatac

SEQ ID NO: 582212 - DNA, 20 bp, Artificial Sequence
  chemically synthesized
ttaaataaagataaaaacta

SEQ ID NO: 582213 - DNA, 20 bp, Artificial Sequence
  chemically synthesized
ttacttctcatgaaaatcat

SEQ ID NO: 582214 - DNA, 20 bp, Artificial Sequence
  chemically synthesized
attttcatgagaagtaaaca

SEQ ID NO: 582215 - DNA, 20 bp, Artificial Sequence
  chemically synthesized
tttgtgctgtgtaaaaagct

SEQ ID NO: 582216 - DNA, 20 bp, Artificial Sequence
  chemically synthesized
tcctcagtttgtgctgtgta

SEQ ID NO: 582217 - DNA, 20 bp, Artificial Sequence
  chemically synthesized
gctttttacacagcacaaac

SEQ ID NO: 582218 - DNA, 20 bp, Artificial Sequence
  chemically synthesized
taactttgtgtaatgaaatc

SEQ ID NO: 582219 - DNA, 20 bp, Artificial Sequence
  chemically synthesized
caataacaaagatatcaata

SEQ ID NO: 582220 - DNA, 20 bp, Artificial Sequence
  chemically synthesized
gggtaatagggcatggaatt

SEQ ID NO: 582221 - DNA, 20 bp, Artificial Sequence
  chemically synthesized
ctattatacgagtacatctc

SEQ ID NO: 582222 - DNA, 20 bp, Artificial Sequence
  chemically synthesized
ctcgtataatagcatttcac

SEQ ID NO: 582223 - DNA, 20 bp, Artificial Sequence
  chemically synthesized
atacaaagaaatttttagtt

SEQ ID NO: 582224 - DNA, 20 bp, Artificial Sequence
  chemically synthesized
gaaatttttagttgtgggct

SEQ ID NO: 582225 - DNA, 20 bp, Artificial Sequence
  chemically synthesized
ttttagttgtgggctttgtg

SEQ ID NO: 582226 - DNA, 20 bp, Artificial Sequence
  chemically synthesized
atggcttaactatatcagac

SEQ ID NO: 582227 - DNA, 20 bp, Artificial Sequence
  chemically synthesized
tgagacacttctttcatctt

SEQ ID NO: 582228 - DNA, 20 bp, Artificial Sequence
  chemically synthesized
ttaaaatatttattaattac

SEQ ID NO: 582229 - DNA, 20 bp, Artificial Sequence
  chemically synthesized
ccaccccaggagactggcct

SEQ ID NO: 582230 - DNA, 20 bp, Artificial Sequence
  chemically synthesized
gagcaaaatgaatattagaa

SEQ ID NO: 582231 - DNA, 20 bp, Artificial Sequence
  chemically synthesized
ttagaaatgagttttcactt

SEQ ID NO: 582232 - DNA, 20 bp, Artificial Sequence
  chemically synthesized
agattagtgttacttaagat

SEQ ID NO: 582233 - DNA, 20 bp, Artificial Sequence
  chemically synthesized
tttgagagcaattcctcatc

SEQ ID NO: 582234 - DNA, 20 bp, Artificial Sequence
  chemically synthesized
tgtattctttggaatggtgc

SEQ ID NO: 582235 - DNA, 20 bp, Artificial Sequence
  chemically synthesized
cccaagatttaatgcctaaa

SEQ ID NO: 582236 - DNA, 20 bp, Artificial Sequence
  chemically synthesized
gatttaatgcctaaactatg

SEQ ID NO: 582237 - DNA, 20 bp, Artificial Sequence
  chemically synthesized
gattcaatgtggaaacaaag

SEQ ID NO: 582238 - DNA, 20 bp, Artificial Sequence
  chemically synthesized
ctttgtttccacattgaatc

SEQ ID NO: 582239 - DNA, 20 bp, Artificial Sequence
  chemically synthesized
ggcatcagacaactagaatc

SEQ ID NO: 582240 - DNA, 20 bp, Artificial Sequence
  chemically synthesized
aaggttaactgcatcctgcc

SEQ ID NO: 582241 - DNA, 20 bp, Artificial Sequence
  chemically synthesized
ctggaatattctcatgtctc

SEQ ID NO: 582242 - DNA, 20 bp, Artificial Sequence
  chemically synthesized
ctaacctttacctattatac

SEQ ID NO: 582243 - DNA, 20 bp, Artificial Sequence
  chemically synthesized
gtggaggttattttaaaatt

SEQ ID NO: 582244 - DNA, 20 bp, Artificial Sequence
  chemically synthesized
tggttatatttgttataaag

SEQ ID NO: 582245 - DNA, 20 bp, Artificial Sequence
  chemically synthesized
ttaacgacctagttataaaa

SEQ ID NO: 582246 - DNA, 20 bp, Artificial Sequence
  chemically synthesized
actaggtcgttaaagatctt

SEQ ID NO: 582247 - DNA, 20 bp, Artificial Sequence
  chemically synthesized
gcctcaagatgaaagacaag

SEQ ID NO: 582248 - DNA, 20 bp, Artificial Sequence
  chemically synthesized
actaaattacaaggcctggt

SEQ ID NO: 582249 - DNA, 20 bp, Artificial Sequence
  chemically synthesized
ttgcacatgcataactcata

SEQ ID NO: 582250 - DNA, 20 bp, Artificial Sequence
  chemically synthesized
gcatgtgcaagaaatgttct

SEQ ID NO: 582251 - DNA, 20 bp, Artificial Sequence
  chemically synthesized
gagagacacagagagagagc

SEQ ID NO: 582252 - DNA, 20 bp, Artificial Sequence
  chemically synthesized
cttacacccctcaataatga

SEQ ID NO: 582253 - DNA, 20 bp, Artificial Sequence
  chemically synthesized
cgcagtctcgtatctgaacc

SEQ ID NO: 582254 - DNA, 20 bp, Artificial Sequence
  chemically synthesized
acaagttctcagttgcctgc

SEQ ID NO: 582255 - DNA, 20 bp, Artificial Sequence
  chemically synthesized
aggaaaaatgatacattaaa

SEQ ID NO: 582256 - DNA, 20 bp, Artificial Sequence
  chemically synthesized
aacagtggagattgaaatgg

SEQ ID NO: 582257 - DNA, 20 bp, Artificial Sequence
  chemically synthesized
ataaaaacagtggagattga

SEQ ID NO: 582258 - DNA, 20 bp, Artificial Sequence
  chemically synthesized
agcaaatccatttcaatctc

SEQ ID NO: 582259 - DNA, 20 bp, Artificial Sequence
  chemically synthesized
tgtttggcaaataaaaacag

SEQ ID NO: 582260 - DNA, 20 bp, Artificial Sequence
  chemically synthesized
gtttataattagtatttagg

SEQ ID NO: 582261 - DNA, 20 bp, Artificial Sequence
  chemically synthesized
taattataaacgcagctcaa

SEQ ID NO: 582262 - DNA, 20 bp, Artificial Sequence
  chemically synthesized
acataataaactgcattgag

SEQ ID NO: 582263 - DNA, 20 bp, Artificial Sequence
  chemically synthesized
acgcagctcaatgcagttta

SEQ ID NO: 582264 - DNA, 20 bp, Artificial Sequence
  chemically synthesized
cacgcgcatgcacgcgcaca

SEQ ID NO: 582265 - DNA, 20 bp, Artificial Sequence
  chemically synthesized
gataagtgccagattctatc

SEQ ID NO: 582266 - DNA, 20 bp, Artificial Sequence
  chemically synthesized
aggcaatgccattgataagt

SEQ ID NO: 582267 - DNA, 20 bp, Artificial Sequence
  chemically synthesized
gggcaagtcacttaacctct

SEQ ID NO: 582268 - DNA, 20 bp, Artificial Sequence
  chemically synthesized
tacaagctaactggcgtttt

SEQ ID NO: 582269 - DNA, 20 bp, Artificial Sequence
  chemically synthesized
tcaaaacaagaaaaacgcca

SEQ ID NO: 582270 - DNA, 20 bp, Artificial Sequence
  chemically synthesized
caaaagtggtacaagctaac

SEQ ID NO: 582271 - DNA, 20 bp, Artificial Sequence
  chemically synthesized
gttagcttgtaccacttttg

SEQ ID NO: 582272 - DNA, 20 bp, Artificial Sequence
  chemically synthesized
atatactaccataaaattca

SEQ ID NO: 582273 - DNA, 20 bp, Artificial Sequence
  chemically synthesized
taacattttgggccaaaagg

SEQ ID NO: 582274 - DNA, 20 bp, Artificial Sequence
  chemically synthesized
tttggtcaaagccaaacact

SEQ ID NO: 582275 - DNA, 20 bp, Artificial Sequence
  chemically synthesized
cattatttaaacatacagtg

SEQ ID NO: 582276 - DNA, 20 bp, Artificial Sequence
  chemically synthesized
accatcattatttaaacata

SEQ ID NO: 582277 - DNA, 20 bp, Artificial Sequence
  chemically synthesized
agattttgaaaaatggaaag

SEQ ID NO: 582278 - DNA, 20 bp, Artificial Sequence
  chemically synthesized
aataattgtgaataagaaag

SEQ ID NO: 582279 - DNA, 20 bp, Artificial Sequence
  chemically synthesized
agaatcccaatgctgcacat

SEQ ID NO: 582280 - DNA, 20 bp, Artificial Sequence
  chemically synthesized
ataaacctaaatgtgcagca

SEQ ID NO: 582281 - DNA, 20 bp, Artificial Sequence
  chemically synthesized
ttcttttcatagtgatcact

SEQ ID NO: 582282 - DNA, 20 bp, Artificial Sequence
  chemically synthesized
tttcatagtgatcacttaaa

SEQ ID NO: 582283 - DNA, 20 bp, Artificial Sequence
  chemically synthesized
tagtgatcacttaaagtttg

SEQ ID NO: 582284 - DNA, 20 bp, Artificial Sequence
  chemically synthesized
atttatgctattttaaagat

SEQ ID NO: 582285 - DNA, 20 bp, Artificial Sequence
  chemically synthesized
atattttatatacacatagg

SEQ ID NO: 582286 - DNA, 20 bp, Artificial Sequence
  chemically synthesized
ttcatagatatatatgtggt

SEQ ID NO: 582287 - DNA, 20 bp, Artificial Sequence
  chemically synthesized
tgtttctaaaagtaatatat

SEQ ID NO: 582288 - DNA, 20 bp, Artificial Sequence
  chemically synthesized
aaccagtatgtactacatga

SEQ ID NO: 582289 - DNA, 20 bp, Artificial Sequence
  chemically synthesized
aacaatatcatgtagtacat

SEQ ID NO: 582290 - DNA, 20 bp, Artificial Sequence
  chemically synthesized
aaaatttagtgggatgctga

SEQ ID NO: 582291 - DNA, 20 bp, Artificial Sequence
  chemically synthesized
gctagtccctatttgaaata

SEQ ID NO: 582292 - DNA, 20 bp, Artificial Sequence
  chemically synthesized
gggaatctaggcagcatatt

SEQ ID NO: 582293 - DNA, 20 bp, Artificial Sequence
  chemically synthesized
gaaaagctgtaaatatgctg

SEQ ID NO: 582294 - DNA, 20 bp, Artificial Sequence
  chemically synthesized
aatttataaacaacagaatt

SEQ ID NO: 582295 - DNA, 20 bp, Artificial Sequence
  chemically synthesized
gaactataagcaataaattc

SEQ ID NO: 582296 - DNA, 20 bp, Artificial Sequence
  chemically synthesized
aattccaagatcaagacatc

SEQ ID NO: 582297 - DNA, 20 bp, Artificial Sequence
  chemically synthesized
cttacatggtgggagggcaa

SEQ ID NO: 582298 - DNA, 20 bp, Artificial Sequence
  chemically synthesized
agggcaaggaagctttctgg

SEQ ID NO: 582299 - DNA, 20 bp, Artificial Sequence
  chemically synthesized
cccttataaaagcggctcca

SEQ ID NO: 582300 - DNA, 20 bp, Artificial Sequence
  chemically synthesized
cgcttttataagggcactga

SEQ ID NO: 582301 - DNA, 20 bp, Artificial Sequence
  chemically synthesized
tagaaggtgggggtttgggg

SEQ ID NO: 582302 - DNA, 20 bp, Artificial Sequence
  chemically synthesized
aggtgatggtattagaaggt

SEQ ID NO: 582303 - DNA, 20 bp, Artificial Sequence
  chemically synthesized
taataccatcaccttgagtg

SEQ ID NO: 582304 - DNA, 20 bp, Artificial Sequence
  chemically synthesized
taagggggctgctatggtct

SEQ ID NO: 582305 - DNA, 20 bp, Artificial Sequence
  chemically synthesized
gaaggcaacgaactttagca

SEQ ID NO: 582306 - DNA, 20 bp, Artificial Sequence
  chemically synthesized
ataaagatccagtccccttt

SEQ ID NO: 582307 - DNA, 20 bp, Artificial Sequence
  chemically synthesized
tagcacttctgaagggtcat

SEQ ID NO: 582308 - DNA, 20 bp, Artificial Sequence
  chemically synthesized
atgctcacctcaatctcagg

SEQ ID NO: 582309 - DNA, 20 bp, Artificial Sequence
  chemically synthesized
gggtgactgggaagcatacc

SEQ ID NO: 582310 - DNA, 20 bp, Artificial Sequence
  chemically synthesized
tacttacttaaagataatat

SEQ ID NO: 582311 - DNA, 20 bp, Artificial Sequence
  chemically synthesized
agaaatcagtcccaaatgcc

SEQ ID NO: 582312 - DNA, 20 bp, Artificial Sequence
  chemically synthesized
agtaaaccctaggcatttgg

SEQ ID NO: 582313 - DNA, 20 bp, Artificial Sequence
  chemically synthesized
tgacctacactttggagagt

SEQ ID NO: 582314 - DNA, 20 bp, Artificial Sequence
  chemically synthesized
aagttttgacctacactttg

SEQ ID NO: 582315 - DNA, 20 bp, Artificial Sequence
  chemically synthesized
aaatatgcacactattatgg

SEQ ID NO: 582316 - DNA, 20 bp, Artificial Sequence
  chemically synthesized
atctctcaggggtcaaacac

SEQ ID NO: 582317 - DNA, 20 bp, Artificial Sequence
  chemically synthesized
aagtcagtggccacaaacag

SEQ ID NO: 582318 - DNA, 20 bp, Artificial Sequence
  chemically synthesized
gtgcccaaggccaaagatga

SEQ ID NO: 582319 - DNA, 20 bp, Artificial Sequence
  chemically synthesized
taatagattcaaatttttca

SEQ ID NO: 582320 - DNA, 20 bp, Artificial Sequence
  chemically synthesized
aatttgaatctattaagaaa

SEQ ID NO: 582321 - DNA, 20 bp, Artificial Sequence
  chemically synthesized
ccaaaaaagcgtattttctt

SEQ ID NO: 582322 - DNA, 20 bp, Artificial Sequence
  chemically synthesized
tttcactgtaattgttttct

SEQ ID NO: 582323 - DNA, 20 bp, Artificial Sequence
  chemically synthesized
agagaaacatgtttcactgt

SEQ ID NO: 582324 - DNA, 20 bp, Artificial Sequence
  chemically synthesized
tagaaaacaattacagtgaa

SEQ ID NO: 582325 - DNA, 20 bp, Artificial Sequence
  chemically synthesized
aaagagagagagagagagaa

SEQ ID NO: 582326 - DNA, 20 bp, Artificial Sequence
  chemically synthesized
atttgtaccatcaattggaa

SEQ ID NO: 582327 - DNA, 20 bp, Artificial Sequence
  chemically synthesized
acactatactaccattgccc

SEQ ID NO: 582328 - DNA, 20 bp, Artificial Sequence
  chemically synthesized
tttgattccctctcaaattt

SEQ ID NO: 582329 - DNA, 20 bp, Artificial Sequence
  chemically synthesized
ggctatttttgcatcataaa

SEQ ID NO: 582330 - DNA, 20 bp, Artificial Sequence
  chemically synthesized
ttatgatgcaaaaatagcca

SEQ ID NO: 582331 - DNA, 20 bp, Artificial Sequence
  chemically synthesized
aaaaatagccatcatgatta

SEQ ID NO: 582332 - DNA, 20 bp, Artificial Sequence
  chemically synthesized
tttttcaccaaggataactg

SEQ ID NO: 582333 - DNA, 20 bp, Artificial Sequence
  chemically synthesized
atatgaattttagatgatta

SEQ ID NO: 582334 - DNA, 20 bp, Artificial Sequence
  chemically synthesized
ttaaaacaaatatgaatttt

SEQ ID NO: 582335 - DNA, 20 bp, Artificial Sequence
  chemically synthesized
tttaatcatctaaaattcat

SEQ ID NO: 582336 - DNA, 20 bp, Artificial Sequence
  chemically synthesized
actgataacgtaaaatacta

SEQ ID NO: 582337 - DNA, 20 bp, Artificial Sequence
  chemically synthesized
gaacaaattcaactacagag

SEQ ID NO: 582338 - DNA, 20 bp, Artificial Sequence
  chemically synthesized
ttatttactaagatcttaaa

SEQ ID NO: 582339 - DNA, 20 bp, Artificial Sequence
  chemically synthesized
tcgttatcagaatttaaaaa

SEQ ID NO: 582340 - DNA, 20 bp, Artificial Sequence
  chemically synthesized
ctgataacgaaaatatgaca

SEQ ID NO: 582341 - DNA, 20 bp, Artificial Sequence
  chemically synthesized
tatgacatagagtttgctat

SEQ ID NO: 582342 - DNA, 20 bp, Artificial Sequence
  chemically synthesized
aattttaggatctattctat

SEQ ID NO: 582343 - DNA, 20 bp, Artificial Sequence
  chemically synthesized
gttgtcaataacatacaggg

SEQ ID NO: 582344 - DNA, 20 bp, Artificial Sequence
  chemically synthesized
atttgtagaaatagcatgag

SEQ ID NO: 582345 - DNA, 20 bp, Artificial Sequence
  chemically synthesized
cttgtatttgtagaaatagc

SEQ ID NO: 582346 - DNA, 20 bp, Artificial Sequence
  chemically synthesized
agactatgtgaatatttttt

SEQ ID NO: 582347 - DNA, 20 bp, Artificial Sequence
  chemically synthesized
aaaaaatattcacatagtct

SEQ ID NO: 582348 - DNA, 20 bp, Artificial Sequence
  chemically synthesized
caccccctcctgaaatatag

SEQ ID NO: 582349 - DNA, 20 bp, Artificial Sequence
  chemically synthesized
tttgatcactgataaaaagg

SEQ ID NO: 582350 - DNA, 20 bp, Artificial Sequence
  chemically synthesized
tttttatcagtgatcaaaat

SEQ ID NO: 582351 - DNA, 20 bp, Artificial Sequence
  chemically synthesized
attttataaatatgtaaaag

SEQ ID NO: 582352 - DNA, 20 bp, Artificial Sequence
  chemically synthesized
ttacacatccagagaaatag

SEQ ID NO: 582353 - DNA, 20 bp, Artificial Sequence
  chemically synthesized
ccatctcttttgttatttca

SEQ ID NO: 582354 - DNA, 20 bp, Artificial Sequence
  chemically synthesized
ttctgagtccacattctctt

SEQ ID NO: 582355 - DNA, 20 bp, Artificial Sequence
  chemically synthesized
ccacattctctttccagatt

SEQ ID NO: 582356 - DNA, 20 bp, Artificial Sequence
  chemically synthesized
tcttctaaaaaggattcact

SEQ ID NO: 582357 - DNA, 20 bp, Artificial Sequence
  chemically synthesized
aaagtgaatcctttttagaa

SEQ ID NO: 582358 - DNA, 20 bp, Artificial Sequence
  chemically synthesized
gtactcaaactgtcttctaa

SEQ ID NO: 582359 - DNA, 20 bp, Artificial Sequence
  chemically synthesized
aagagtagtacataatatat

SEQ ID NO: 582360 - DNA, 20 bp, Artificial Sequence
  chemically synthesized
actactctttaaagctctca

SEQ ID NO: 582361 - DNA, 20 bp, Artificial Sequence
  chemically synthesized
ttaattattaaaatctgcat

SEQ ID NO: 582362 - DNA, 20 bp, Artificial Sequence
  chemically synthesized
atagtaatttatatttagaa

SEQ ID NO: 582363 - DNA, 20 bp, Artificial Sequence
  chemically synthesized
ttttatttataaaaatagat

SEQ ID NO: 582364 - DNA, 20 bp, Artificial Sequence
  chemically synthesized
gaaatcattttatttataaa

SEQ ID NO: 582365 - DNA, 20 bp, Artificial Sequence
  chemically synthesized
gtaatctatttttataaata

SEQ ID NO: 582366 - DNA, 20 bp, Artificial Sequence
  chemically synthesized
agttgctctagagaaggaat

SEQ ID NO: 582367 - DNA, 20 bp, Artificial Sequence
  chemically synthesized
tatagacatagtgcgaagag

SEQ ID NO: 582368 - DNA, 20 bp, Artificial Sequence
  chemically synthesized
tgcgaagagaaaagatttct

SEQ ID NO: 582369 - DNA, 20 bp, Artificial Sequence
  chemically synthesized
gagtcacttgatttctctac

SEQ ID NO: 582370 - DNA, 20 bp, Artificial Sequence
  chemically synthesized
tgtgtatgtccctctgagtc

SEQ ID NO: 582371 - DNA, 20 bp, Artificial Sequence
  chemically synthesized
tcctcaagatgctctacaca

SEQ ID NO: 582372 - DNA, 20 bp, Artificial Sequence
  chemically synthesized
attgttagctcagtatttct

SEQ ID NO: 582373 - DNA, 20 bp, Artificial Sequence
  chemically synthesized
cttactatggagatgtacat

SEQ ID NO: 582374 - DNA, 20 bp, Artificial Sequence
  chemically synthesized
ctaggataggcaacgtctat

SEQ ID NO: 582375 - DNA, 20 bp, Artificial Sequence
  chemically synthesized
ggcaacgtctatgcatgttt

SEQ ID NO: 582376 - DNA, 20 bp, Artificial Sequence
  chemically synthesized
atgtatgaacacctgatgaa

SEQ ID NO: 582377 - DNA, 20 bp, Artificial Sequence
  chemically synthesized
aaaatattttttaaccactt

SEQ ID NO: 582378 - DNA, 20 bp, Artificial Sequence
  chemically synthesized
agctgtgttcattaaatgtg

SEQ ID NO: 582379 - DNA, 20 bp, Artificial Sequence
  chemically synthesized
agctatacacatttaatgaa

SEQ ID NO: 582380 - DNA, 20 bp, Artificial Sequence
  chemically synthesized
catttaatgaacacagcttg

SEQ ID NO: 582381 - DNA, 20 bp, Artificial Sequence
  chemically synthesized
acatgtaggacagtggtcct

SEQ ID NO: 582382 - DNA, 20 bp, Artificial Sequence
  chemically synthesized
aatatttttctgtaactttt

SEQ ID NO: 582383 - DNA, 20 bp, Artificial Sequence
  chemically synthesized
tgtaacttttctatgtttag

SEQ ID NO: 582384 - DNA, 20 bp, Artificial Sequence
  chemically synthesized
tcagtacagtcacatgctgt

SEQ ID NO: 582385 - DNA, 20 bp, Artificial Sequence
  chemically synthesized
tgtatagtaggatgtaccat

SEQ ID NO: 582386 - DNA, 20 bp, Artificial Sequence
  chemically synthesized
gtttgtgtaagtacactgta

SEQ ID NO: 582387 - DNA, 20 bp, Artificial Sequence
  chemically synthesized
attcggagaaatgcatggtt

SEQ ID NO: 582388 - DNA, 20 bp, Artificial Sequence
  chemically synthesized
gtttatggcatagattctgg

SEQ ID NO: 582389 - DNA, 20 bp, Artificial Sequence
  chemically synthesized
ggtgatgcataggtttatgg

SEQ ID NO: 582390 - DNA, 20 bp, Artificial Sequence
  chemically synthesized
aaaaattttggaggtgatgc

SEQ ID NO: 582391 - DNA, 20 bp, Artificial Sequence
  chemically synthesized
gtacgataataacaggtaaa

SEQ ID NO: 582392 - DNA, 20 bp, Artificial Sequence
  chemically synthesized
aaaaagatttactctcttag

SEQ ID NO: 582393 - DNA, 20 bp, Artificial Sequence
  chemically synthesized
agcctagggcttgtagttaa

SEQ ID NO: 582394 - DNA, 20 bp, Artificial Sequence
  chemically synthesized
taactacaagccctaggctg

SEQ ID NO: 582395 - DNA, 20 bp, Artificial Sequence
  chemically synthesized
tcctacaaatctgtacagcc

SEQ ID NO: 582396 - DNA, 20 bp, Artificial Sequence
  chemically synthesized
aaaaaaaaaaaaaatactaa

SEQ ID NO: 582397 - DNA, 20 bp, Artificial Sequence
  chemically synthesized
ttttgtatttttagtagaga

SEQ ID NO: 582398 - DNA, 20 bp, Artificial Sequence
  chemically synthesized
ggcgggcggatcacgaggtc

SEQ ID NO: 582399 - DNA, 20 bp, Artificial Sequence
  chemically synthesized
cgcctcatcctcccaaagtg

SEQ ID NO: 582400 - DNA, 20 bp, Artificial Sequence
  chemically synthesized
attttaacggcacaaaacag

SEQ ID NO: 582401 - DNA, 20 bp, Artificial Sequence
  chemically synthesized
ctcttgtctctcataatctc

SEQ ID NO: 582402 - DNA, 20 bp, Artificial Sequence
  chemically synthesized
atagaaggagggcaatatct

SEQ ID NO: 582403 - DNA, 20 bp, Artificial Sequence
  chemically synthesized
acgaatggccatgtaaatat

SEQ ID NO: 582404 - DNA, 20 bp, Artificial Sequence
  chemically synthesized
acttttttttccttcttgag

SEQ ID NO: 582405 - DNA, 20 bp, Artificial Sequence
  chemically synthesized
agaataacatgttttaaaga

SEQ ID NO: 582406 - DNA, 20 bp, Artificial Sequence
  chemically synthesized
aatatagtctgtttagaata

SEQ ID NO: 582407 - DNA, 20 bp, Artificial Sequence
  chemically synthesized
tattctaaacagactatatt

SEQ ID NO: 582408 - DNA, 20 bp, Artificial Sequence
  chemically synthesized
acaagaaaacaagtaatata

SEQ ID NO: 582409 - DNA, 20 bp, Artificial Sequence
  chemically synthesized
acagactatattacttgttt

SEQ ID NO: 582410 - DNA, 20 bp, Artificial Sequence
  chemically synthesized
actatattacttgttttctt

SEQ ID NO: 582411 - DNA, 20 bp, Artificial Sequence
  chemically synthesized
attatcattgctagaactgg

SEQ ID NO: 582412 - DNA, 20 bp, Artificial Sequence
  chemically synthesized
tatactttctcttgaactca

SEQ ID NO: 582413 - DNA, 20 bp, Artificial Sequence
  chemically synthesized
aatatacgtggtattaggtc

SEQ ID NO: 582414 - DNA, 20 bp, Artificial Sequence
  chemically synthesized
acgtatattgatgctaacgg

SEQ ID NO: 582415 - DNA, 20 bp, Artificial Sequence
  chemically synthesized
gagaaagcagtaactttcat

SEQ ID NO: 582416 - DNA, 20 bp, Artificial Sequence
  chemically synthesized
atgtaagctattatgaaagt

SEQ ID NO: 582417 - DNA, 20 bp, Artificial Sequence
  chemically synthesized
agaaagatagacatgaataa

SEQ ID NO: 582418 - DNA, 20 bp, Artificial Sequence
  chemically synthesized
gttttttctccattttattt

SEQ ID NO: 582419 - DNA, 20 bp, Artificial Sequence
  chemically synthesized
gtcttcttagttctgtttaa

SEQ ID NO: 582420 - DNA, 20 bp, Artificial Sequence
  chemically synthesized
ttgttttcctgtcttcttag

SEQ ID NO: 582421 - DNA, 20 bp, Artificial Sequence
  chemically synthesized
aacttagctaaatatgatgt

SEQ ID NO: 582422 - DNA, 20 bp, Artificial Sequence
  chemically synthesized
ttttaacttagctaaatatg

SEQ ID NO: 582423 - DNA, 20 bp, Artificial Sequence
  chemically synthesized
atcatatttagctaagttaa

SEQ ID NO: 582424 - DNA, 20 bp, Artificial Sequence
  chemically synthesized
atttttcttctttggacata

SEQ ID NO: 582425 - DNA, 20 bp, Artificial Sequence
  chemically synthesized
ccttgctagtctgaacagaa

SEQ ID NO: 582426 - DNA, 20 bp, Artificial Sequence
  chemically synthesized
ccaaattctgttcagactag

SEQ ID NO: 582427 - DNA, 20 bp, Artificial Sequence
  chemically synthesized
tgagtgttttaactgaatag

SEQ ID NO: 582428 - DNA, 20 bp, Artificial Sequence
  chemically synthesized
ctaaggatcttgggaggatt

SEQ ID NO: 582429 - DNA, 20 bp, Artificial Sequence
  chemically synthesized
cctaacttctaaggatcttg

SEQ ID NO: 582430 - DNA, 20 bp, Artificial Sequence
  chemically synthesized
tttctggcagccccacacag

SEQ ID NO: 582431 - DNA, 20 bp, Artificial Sequence
  chemically synthesized
tgtggggctgccagaaaagc

SEQ ID NO: 582432 - DNA, 20 bp, Artificial Sequence
  chemically synthesized
ctcctgtttgtaaggaaaac

SEQ ID NO: 582433 - DNA, 20 bp, Artificial Sequence
  chemically synthesized
catattccagctgtgtcagc

SEQ ID NO: 582434 - DNA, 20 bp, Artificial Sequence
  chemically synthesized
caggagctgacacagctgga

SEQ ID NO: 582435 - DNA, 20 bp, Artificial Sequence
  chemically synthesized
tgcctcagcctcccaaagtg

SEQ ID NO: 582436 - DNA, 20 bp, Artificial Sequence
  chemically synthesized
ttttgtatttttagtagaga

SEQ ID NO: 582437 - DNA, 20 bp, Artificial Sequence
  chemically synthesized
tgcctcagcctcctgagtag

SEQ ID NO: 582438 - DNA, 20 bp, Artificial Sequence
  chemically synthesized
aacctctgactccctggttc

SEQ ID NO: 582439 - DNA, 20 bp, Artificial Sequence
  chemically synthesized
tttgttgtttttgtttttgt

SEQ ID NO: 582440 - DNA, 20 bp, Artificial Sequence
  chemically synthesized
ttttgttttgttgtttttgt

SEQ ID NO: 582441 - DNA, 20 bp, Artificial Sequence
  chemically synthesized
tttttgttttgttttgttgt

SEQ ID NO: 582442 - DNA, 20 bp, Artificial Sequence
  chemically synthesized
actttctttttgttttgttt

SEQ ID NO: 582443 - DNA, 20 bp, Artificial Sequence
  chemically synthesized
aacatgagactttctttttg

SEQ ID NO: 582444 - DNA, 20 bp, Artificial Sequence
  chemically synthesized
tctccaacatgagactttct

SEQ ID NO: 582445 - DNA, 20 bp, Artificial Sequence
  chemically synthesized
tggaggaaaaagttgggaca

SEQ ID NO: 582446 - DNA, 20 bp, Artificial Sequence
  chemically synthesized
tcactacagtggcttatcca

SEQ ID NO: 582447 - DNA, 20 bp, Artificial Sequence
  chemically synthesized
cgtgacagcattctcactac

SEQ ID NO: 582448 - DNA, 20 bp, Artificial Sequence
  chemically synthesized
tccagtttactctgttaaga

SEQ ID NO: 582449 - DNA, 20 bp, Artificial Sequence
  chemically synthesized
tttttttccagtttactctg

SEQ ID NO: 582450 - DNA, 20 bp, Artificial Sequence
  chemically synthesized
aaattaaaggattttttttt

SEQ ID NO: 582451 - DNA, 20 bp, Artificial Sequence
  chemically synthesized
ctctaagaattttagaaatt

SEQ ID NO: 582452 - DNA, 20 bp, Artificial Sequence
  chemically synthesized
aattcttagagtgtctaaaa

SEQ ID NO: 582453 - DNA, 20 bp, Artificial Sequence
  chemically synthesized
cttagagtgtctaaaattat

SEQ ID NO: 582454 - DNA, 20 bp, Artificial Sequence
  chemically synthesized
taaatgcaatatgattcatg

SEQ ID NO: 582455 - DNA, 20 bp, Artificial Sequence
  chemically synthesized
tatcttaactgttaaatgca

SEQ ID NO: 582456 - DNA, 20 bp, Artificial Sequence
  chemically synthesized
ttatagagctatattcatat

SEQ ID NO: 582457 - DNA, 20 bp, Artificial Sequence
  chemically synthesized
ttactttatcttcacagatt

SEQ ID NO: 582458 - DNA, 20 bp, Artificial Sequence
  chemically synthesized
ttgttgatttactttatctt

SEQ ID NO: 582459 - DNA, 20 bp, Artificial Sequence
  chemically synthesized
actaggtgctttataaatat

SEQ ID NO: 582460 - DNA, 20 bp, Artificial Sequence
  chemically synthesized
atagccgctaaagatgtact

SEQ ID NO: 582461 - DNA, 20 bp, Artificial Sequence
  chemically synthesized
tgtatgttgtcatttgactt

SEQ ID NO: 582462 - DNA, 20 bp, Artificial Sequence
  chemically synthesized
gaaaagttcaagacaacaga

SEQ ID NO: 582463 - DNA, 20 bp, Artificial Sequence
  chemically synthesized
aactatatattttcttgtaa

SEQ ID NO: 582464 - DNA, 20 bp, Artificial Sequence
  chemically synthesized
aaatatatagttaaaggaca

SEQ ID NO: 582465 - DNA, 20 bp, Artificial Sequence
  chemically synthesized
tatgtattggtctttttcat

SEQ ID NO: 582466 - DNA, 20 bp, Artificial Sequence
  chemically synthesized
tgccttggcctcccaaagtg

SEQ ID NO: 582467 - DNA, 20 bp, Artificial Sequence
  chemically synthesized
ttttttatttttagtagaga

SEQ ID NO: 582468 - DNA, 20 bp, Artificial Sequence
  chemically synthesized
tgcttcagcctcctgagtag

SEQ ID NO: 582469 - DNA, 20 bp, Artificial Sequence
  chemically synthesized
tcaggaggctgaagcaggag

SEQ ID NO: 582470 - DNA, 20 bp, Artificial Sequence
  chemically synthesized
cacctaggttcaagcgattc

SEQ ID NO: 582471 - DNA, 20 bp, Artificial Sequence
  chemically synthesized
aacctccgccacctaggttc

SEQ ID NO: 582472 - DNA, 20 bp, Artificial Sequence
  chemically synthesized
ttgttttgtttttgtttttg

SEQ ID NO: 582473 - DNA, 20 bp, Artificial Sequence
  chemically synthesized
ttgttttgttttgtttttgt

SEQ ID NO: 582474 - DNA, 20 bp, Artificial Sequence
  chemically synthesized
tcgtttttgttttgttttgt

SEQ ID NO: 582475 - DNA, 20 bp, Artificial Sequence
  chemically synthesized
tactggtcgtttttgttttg

SEQ ID NO: 582476 - DNA, 20 bp, Artificial Sequence
  chemically synthesized
gtatgtactggtcgtttttg

SEQ ID NO: 582477 - DNA, 20 bp, Artificial Sequence
  chemically synthesized
ttccagtatgtactggtcgt

SEQ ID NO: 582478 - DNA, 20 bp, Artificial Sequence
  chemically synthesized
tgttaattccagtatgtact

SEQ ID NO: 582479 - DNA, 20 bp, Artificial Sequence
  chemically synthesized
attcctgccttttctgtaaa

SEQ ID NO: 582480 - DNA, 20 bp, Artificial Sequence
  chemically synthesized
aaaaggcaggaataaatctc

SEQ ID NO: 582481 - DNA, 20 bp, Artificial Sequence
  chemically synthesized
tatgtcacagcttgaagcct

SEQ ID NO: 582482 - DNA, 20 bp, Artificial Sequence
  chemically synthesized
tatatagttgactggtatgt

SEQ ID NO: 582483 - DNA, 20 bp, Artificial Sequence
  chemically synthesized
ctccttaaagttgattaata

SEQ ID NO: 582484 - DNA, 20 bp, Artificial Sequence
  chemically synthesized
ggtttcttcacactccttaa

SEQ ID NO: 582485 - DNA, 20 bp, Artificial Sequence
  chemically synthesized
tattaaccataccaatgact

SEQ ID NO: 582486 - DNA, 20 bp, Artificial Sequence
  chemically synthesized
agtcattggtatggttaata

SEQ ID NO: 582487 - DNA, 20 bp, Artificial Sequence
  chemically synthesized
ttggtcagaactcacacctt

SEQ ID NO: 582488 - DNA, 20 bp, Artificial Sequence
  chemically synthesized
gtttgcatggtcctcaccta

SEQ ID NO: 582489 - DNA, 20 bp, Artificial Sequence
  chemically synthesized
catttttatttatttattat

SEQ ID NO: 582490 - DNA, 20 bp, Artificial Sequence
  chemically synthesized
attttattcttttttagaaa

SEQ ID NO: 582491 - DNA, 20 bp, Artificial Sequence
  chemically synthesized
cagtgagctatgatagcgcc

SEQ ID NO: 582492 - DNA, 20 bp, Artificial Sequence
  chemically synthesized
agttagctggctgtgatggt

SEQ ID NO: 582493 - DNA, 20 bp, Artificial Sequence
  chemically synthesized
ataatgagattttacagtac

SEQ ID NO: 582494 - DNA, 20 bp, Artificial Sequence
  chemically synthesized
tactgtaaaatctcattata

SEQ ID NO: 582495 - DNA, 20 bp, Artificial Sequence
  chemically synthesized
caggcaagaagctatatata

SEQ ID NO: 582496 - DNA, 20 bp, Artificial Sequence
  chemically synthesized
ctcattatatatagcttctt

SEQ ID NO: 582497 - DNA, 20 bp, Artificial Sequence
  chemically synthesized
actttaccacacttactcaa

SEQ ID NO: 582498 - DNA, 20 bp, Artificial Sequence
  chemically synthesized
tgccactttaccacacttac

SEQ ID NO: 582499 - DNA, 20 bp, Artificial Sequence
  chemically synthesized
tagaatttctcagaggggac

SEQ ID NO: 582500 - DNA, 20 bp, Artificial Sequence
  chemically synthesized
tatattatacgaaagtaatg

SEQ ID NO: 582501 - DNA, 20 bp, Artificial Sequence
  chemically synthesized
tcgtataatataacatgaca

SEQ ID NO: 582502 - DNA, 20 bp, Artificial Sequence
  chemically synthesized
ctgtagcaacttcattgagg

SEQ ID NO: 582503 - DNA, 20 bp, Artificial Sequence
  chemically synthesized
ttttccctaaatgtgaaaga

SEQ ID NO: 582504 - DNA, 20 bp, Artificial Sequence
  chemically synthesized
ttcacatttagggaaaaaat

SEQ ID NO: 582505 - DNA, 20 bp, Artificial Sequence
  chemically synthesized
aaaagcatatagataaattg

SEQ ID NO: 582506 - DNA, 20 bp, Artificial Sequence
  chemically synthesized
agaatcaactcaatttatct

SEQ ID NO: 582507 - DNA, 20 bp, Artificial Sequence
  chemically synthesized
cttttggcaaaaatcgtctt

SEQ ID NO: 582508 - DNA, 20 bp, Artificial Sequence
  chemically synthesized
aaaaaaaattaaatccatga

SEQ ID NO: 582509 - DNA, 20 bp, Artificial Sequence
  chemically synthesized
ggatttaattttttttaatt

SEQ ID NO: 582510 - DNA, 20 bp, Artificial Sequence
  chemically synthesized
aaaataattctggagttgaa

SEQ ID NO: 582511 - DNA, 20 bp, Artificial Sequence
  chemically synthesized
ggaggggttacattggtcat

SEQ ID NO: 582512 - DNA, 20 bp, Artificial Sequence
  chemically synthesized
acattggtcattacagttta

SEQ ID NO: 582513 - DNA, 20 bp, Artificial Sequence
  chemically synthesized
ttatttcaagaacagaaatg

SEQ ID NO: 582514 - DNA, 20 bp, Artificial Sequence
  chemically synthesized
attatttatttcaagaacag

SEQ ID NO: 582515 - DNA, 20 bp, Artificial Sequence
  chemically synthesized
atttaagaattatatatctc

SEQ ID NO: 582516 - DNA, 20 bp, Artificial Sequence
  chemically synthesized
taattcttaaatattatgtc

SEQ ID NO: 582517 - DNA, 20 bp, Artificial Sequence
  chemically synthesized
atacaattttagtaattcac

SEQ ID NO: 582518 - DNA, 20 bp, Artificial Sequence
  chemically synthesized
atgatttgagtcaatttctt

SEQ ID NO: 582519 - DNA, 20 bp, Artificial Sequence
  chemically synthesized
aaataatgccacggtttcta

SEQ ID NO: 582520 - DNA, 20 bp, Artificial Sequence
  chemically synthesized
gaattcattaaaaataatgc

SEQ ID NO: 582521 - DNA, 20 bp, Artificial Sequence
  chemically synthesized
aacaggatttgattgtgctt

SEQ ID NO: 582522 - DNA, 20 bp, Artificial Sequence
  chemically synthesized
aaaaaagcaacaggatttga

SEQ ID NO: 582523 - DNA, 20 bp, Artificial Sequence
  chemically synthesized
ataaaagcacaatcaaatcc

SEQ ID NO: 582524 - DNA, 20 bp, Artificial Sequence
  chemically synthesized
gaaaaaaaaaaagcaacagg

SEQ ID NO: 582525 - DNA, 20 bp, Artificial Sequence
  chemically synthesized
tttttgaaaaaaaaaaagca

SEQ ID NO: 582526 - DNA, 20 bp, Artificial Sequence
  chemically synthesized
ttccaaggtagtaatggctg

SEQ ID NO: 582527 - DNA, 20 bp, Artificial Sequence
  chemically synthesized
gttgatttttgcatatgttt

SEQ ID NO: 582528 - DNA, 20 bp, Artificial Sequence
  chemically synthesized
gagtgaaagttgatttttgc

SEQ ID NO: 582529 - DNA, 20 bp, Artificial Sequence
  chemically synthesized
ttcaataacttgggagtgaa

SEQ ID NO: 582530 - DNA, 20 bp, Artificial Sequence
  chemically synthesized
gtttatctttccagggatct

SEQ ID NO: 582531 - DNA, 20 bp, Artificial Sequence
  chemically synthesized
aagatccctggaaagataaa

SEQ ID NO: 582532 - DNA, 20 bp, Artificial Sequence
  chemically synthesized
tcatatagatgaaaattaag

SEQ ID NO: 582533 - DNA, 20 bp, Artificial Sequence
  chemically synthesized
ataagaaatcacaattgatc

SEQ ID NO: 582534 - DNA, 20 bp, Artificial Sequence
  chemically synthesized
tgaataaatcaactgatcaa

SEQ ID NO: 582535 - DNA, 20 bp, Artificial Sequence
  chemically synthesized
atttattcattctaatacat

SEQ ID NO: 582536 - DNA, 20 bp, Artificial Sequence
  chemically synthesized
acaaaagaaaaaagtgttat

SEQ ID NO: 582537 - DNA, 20 bp, Artificial Sequence
  chemically synthesized
ggccatgactgccctatctt

SEQ ID NO: 582538 - DNA, 20 bp, Artificial Sequence
  chemically synthesized
taagagcttttgatacaata

SEQ ID NO: 582539 - DNA, 20 bp, Artificial Sequence
  chemically synthesized
aaatatattgactgtctttt

SEQ ID NO: 582540 - DNA, 20 bp, Artificial Sequence
  chemically synthesized
tacctcgagttacagtgtca

SEQ ID NO: 582541 - DNA, 20 bp, Artificial Sequence
  chemically synthesized
agtattttctttcctccttc

SEQ ID NO: 582542 - DNA, 20 bp, Artificial Sequence
  chemically synthesized
tcacacatcactattagtaa

SEQ ID NO: 582543 - DNA, 20 bp, Artificial Sequence
  chemically synthesized
gagtaataatttggatttaa

SEQ ID NO: 582544 - DNA, 20 bp, Artificial Sequence
  chemically synthesized
aagagacactagagtaataa

SEQ ID NO: 582545 - DNA, 20 bp, Artificial Sequence
  chemically synthesized
tagtcttcaacctgactcta

SEQ ID NO: 582546 - DNA, 20 bp, Artificial Sequence
  chemically synthesized
actctagagtgctttgtaac

SEQ ID NO: 582547 - DNA, 20 bp, Artificial Sequence
  chemically synthesized
aatgttaatgttaggtatat

SEQ ID NO: 582548 - DNA, 20 bp, Artificial Sequence
  chemically synthesized
taaagtttaggacctgcctt

SEQ ID NO: 582549 - DNA, 20 bp, Artificial Sequence
  chemically synthesized
tatataatgttattgttccc

SEQ ID NO: 582550 - DNA, 20 bp, Artificial Sequence
  chemically synthesized
attaaaaaaaaaccttatta

SEQ ID NO: 582551 - DNA, 20 bp, Artificial Sequence
  chemically synthesized
cttacaggaaagcaatgtaa

SEQ ID NO: 582552 - DNA, 20 bp, Artificial Sequence
  chemically synthesized
tgtaagaaagttagagaaga

SEQ ID NO: 582553 - DNA, 20 bp, Artificial Sequence
  chemically synthesized
cctttatatggagtgatttt

SEQ ID NO: 582554 - DNA, 20 bp, Artificial Sequence
  chemically synthesized
agttagggctcctttatatg

SEQ ID NO: 582555 - DNA, 20 bp, Artificial Sequence
  chemically synthesized
aattatttatttatttgaga

SEQ ID NO: 582556 - DNA, 20 bp, Artificial Sequence
  chemically synthesized
aacatctgcctcccgggttc

SEQ ID NO: 582557 - DNA, 20 bp, Artificial Sequence
  chemically synthesized
tcctgaggctgaggcaggag

SEQ ID NO: 582558 - DNA, 20 bp, Artificial Sequence
  chemically synthesized
ttttgtatttttagtagaga

SEQ ID NO: 582559 - DNA, 20 bp, Artificial Sequence
  chemically synthesized
cgggtgtatcacctgaggtc

SEQ ID NO: 582560 - DNA, 20 bp, Artificial Sequence
  chemically synthesized
cgcctcagcctcccaaagtg

SEQ ID NO: 582561 - DNA, 20 bp, Artificial Sequence
  chemically synthesized
aaggaagtttatgtttgcca

SEQ ID NO: 582562 - DNA, 20 bp, Artificial Sequence
  chemically synthesized
tgggattctgataaggaagt

SEQ ID NO: 582563 - DNA, 20 bp, Artificial Sequence
  chemically synthesized
taccagtgggattctgataa

SEQ ID NO: 582564 - DNA, 20 bp, Artificial Sequence
  chemically synthesized
gtgttttccataaaatacca

SEQ ID NO: 582565 - DNA, 20 bp, Artificial Sequence
  chemically synthesized
ttctgatggaagtcactgta

SEQ ID NO: 582566 - DNA, 20 bp, Artificial Sequence
  chemically synthesized
aattcatgtaaatatcctgg

SEQ ID NO: 582567 - DNA, 20 bp, Artificial Sequence
  chemically synthesized
atgtaaatatcctggatcag

SEQ ID NO: 582568 - DNA, 20 bp, Artificial Sequence
  chemically synthesized
tcctggatcagttttgcttg

SEQ ID NO: 582569 - DNA, 20 bp, Artificial Sequence
  chemically synthesized
gcttgataagattttgacag

SEQ ID NO: 582570 - DNA, 20 bp, Artificial Sequence
  chemically synthesized
cattcatagactttgaaatg

SEQ ID NO: 582571 - DNA, 20 bp, Artificial Sequence
  chemically synthesized
ctttgaaatgtgtagtttag

SEQ ID NO: 582572 - DNA, 20 bp, Artificial Sequence
  chemically synthesized
tgtgtagtttagtatagttt

SEQ ID NO: 582573 - DNA, 20 bp, Artificial Sequence
  chemically synthesized
tagtatagtttataagttta

SEQ ID NO: 582574 - DNA, 20 bp, Artificial Sequence
  chemically synthesized
tttttatggaaaatgatacc

SEQ ID NO: 582575 - DNA, 20 bp, Artificial Sequence
  chemically synthesized
gtaattaggagacttagaaa

SEQ ID NO: 582576 - DNA, 20 bp, Artificial Sequence
  chemically synthesized
gtgtgtgtgtgtgtgtgtgt

SEQ ID NO: 582577 - DNA, 20 bp, Artificial Sequence
  chemically synthesized
tatgacctttttatttaagg

SEQ ID NO: 582578 - DNA, 20 bp, Artificial Sequence
  chemically synthesized
catccttcgttgaagataat

SEQ ID NO: 582579 - DNA, 20 bp, Artificial Sequence
  chemically synthesized
aaatgtacatgtctctggta

SEQ ID NO: 582580 - DNA, 20 bp, Artificial Sequence
  chemically synthesized
gctgaagatatttacaaatt

SEQ ID NO: 582581 - DNA, 20 bp, Artificial Sequence
  chemically synthesized
tttgtaaatatcttcagcca

SEQ ID NO: 582582 - DNA, 20 bp, Artificial Sequence
  chemically synthesized
attaagaaattaatgttgta

SEQ ID NO: 582583 - DNA, 20 bp, Artificial Sequence
  chemically synthesized
tcttaattggtatttcttaa

SEQ ID NO: 582584 - DNA, 20 bp, Artificial Sequence
  chemically synthesized
atcatttcatttctgcacaa

SEQ ID NO: 582585 - DNA, 20 bp, Artificial Sequence
  chemically synthesized
gaaatgatgagatgagaagg

SEQ ID NO: 582586 - DNA, 20 bp, Artificial Sequence
  chemically synthesized
tagggtgaggagattgatta

SEQ ID NO: 582587 - DNA, 20 bp, Artificial Sequence
  chemically synthesized
cagtcatcttagggtgagga

SEQ ID NO: 582588 - DNA, 20 bp, Artificial Sequence
  chemically synthesized
gtgacagtcatcttagggtg

SEQ ID NO: 582589 - DNA, 20 bp, Artificial Sequence
  chemically synthesized
gtttatttccatgggcatca

SEQ ID NO: 582590 - DNA, 20 bp, Artificial Sequence
  chemically synthesized
ttgatgcccatggaaataaa

SEQ ID NO: 582591 - DNA, 20 bp, Artificial Sequence
  chemically synthesized
tgcccatggaaataaaccat

SEQ ID NO: 582592 - DNA, 20 bp, Artificial Sequence
  chemically synthesized
atggaaataaaccatgtttg

SEQ ID NO: 582593 - DNA, 20 bp, Artificial Sequence
  chemically synthesized
ttataacaaaacaaagcaaa

SEQ ID NO: 582594 - DNA, 20 bp, Artificial Sequence
  chemically synthesized
ccagacctcttgggaataga

SEQ ID NO: 582595 - DNA, 20 bp, Artificial Sequence
  chemically synthesized
ttcccaagaggtctgggggt

SEQ ID NO: 582596 - DNA, 20 bp, Artificial Sequence
  chemically synthesized
cagcagaaagtggctattac

SEQ ID NO: 582597 - DNA, 20 bp, Artificial Sequence
  chemically synthesized
attgtaatagccactttctg

SEQ ID NO: 582598 - DNA, 20 bp, Artificial Sequence
  chemically synthesized
cagaataaaaccaagaaaca

SEQ ID NO: 582599 - DNA, 20 bp, Artificial Sequence
  chemically synthesized
caatacaaaacagaatgttt

SEQ ID NO: 582600 - DNA, 20 bp, Artificial Sequence
  chemically synthesized
ccaagaaacattctgttttg

SEQ ID NO: 582601 - DNA, 20 bp, Artificial Sequence
  chemically synthesized
actaaaagcaatacaaaaca

SEQ ID NO: 582602 - DNA, 20 bp, Artificial Sequence
  chemically synthesized
acattctgttttgtattgct

SEQ ID NO: 582603 - DNA, 20 bp, Artificial Sequence
  chemically synthesized
ttccagggctatactacaca

SEQ ID NO: 582604 - DNA, 20 bp, Artificial Sequence
  chemically synthesized
actacacaagttgtttagta

SEQ ID NO: 582605 - DNA, 20 bp, Artificial Sequence
  chemically synthesized
ggtgaatagattcagtcaaa

SEQ ID NO: 582606 - DNA, 20 bp, Artificial Sequence
  chemically synthesized
tctgattataacttttggtg

SEQ ID NO: 582607 - DNA, 20 bp, Artificial Sequence
  chemically synthesized
ttgaattagctacagaataa

SEQ ID NO: 582608 - DNA, 20 bp, Artificial Sequence
  chemically synthesized
aattattctgtagctaattc

SEQ ID NO: 582609 - DNA, 20 bp, Artificial Sequence
  chemically synthesized
aaatgctttttgtgtataga

SEQ ID NO: 582610 - DNA, 20 bp, Artificial Sequence
  chemically synthesized
aaggtcaaagtacttaaaaa

SEQ ID NO: 582611 - DNA, 20 bp, Artificial Sequence
  chemically synthesized
aatgggacataattacttga

SEQ ID NO: 582612 - DNA, 20 bp, Artificial Sequence
  chemically synthesized
cattatctaaaaattgaatg

SEQ ID NO: 582613 - DNA, 20 bp, Artificial Sequence
  chemically synthesized
cacacattgcactgttacct

SEQ ID NO: 582614 - DNA, 20 bp, Artificial Sequence
  chemically synthesized
caagatgataatagcattgt

SEQ ID NO: 582615 - DNA, 20 bp, Artificial Sequence
  chemically synthesized
acaatgctattatcatcttg

SEQ ID NO: 582616 - DNA, 20 bp, Artificial Sequence
  chemically synthesized
ttatcctccagtaagacctt

SEQ ID NO: 582617 - DNA, 20 bp, Artificial Sequence
  chemically synthesized
attcaatacaagtgcagtgg

SEQ ID NO: 582618 - DNA, 20 bp, Artificial Sequence
  chemically synthesized
attgtagtcttttttttcaa

SEQ ID NO: 582619 - DNA, 20 bp, Artificial Sequence
  chemically synthesized
ttatttttcataatactggt

SEQ ID NO: 582620 - DNA, 20 bp, Artificial Sequence
  chemically synthesized
ttctctctccttcccctttt

SEQ ID NO: 582621 - DNA, 20 bp, Artificial Sequence
  chemically synthesized
tctccttcctttccttaagg

SEQ ID NO: 582622 - DNA, 20 bp, Artificial Sequence
  chemically synthesized
tgtcctgggttttgctttga

SEQ ID NO: 582623 - DNA, 20 bp, Artificial Sequence
  chemically synthesized
agggaaaaatatgtcctggg

SEQ ID NO: 582624 - DNA, 20 bp, Artificial Sequence
  chemically synthesized
aatgaagggaaaaatatgtc

SEQ ID NO: 582625 - DNA, 20 bp, Artificial Sequence
  chemically synthesized
acatatttttcccttcattt

SEQ ID NO: 582626 - DNA, 20 bp, Artificial Sequence
  chemically synthesized
aacaatatttgacaagaatt

SEQ ID NO: 582627 - DNA, 20 bp, Artificial Sequence
  chemically synthesized
tgctaattcttgtcaaatat

SEQ ID NO: 582628 - DNA, 20 bp, Artificial Sequence
  chemically synthesized
ttgtttcagagcaattttac

SEQ ID NO: 582629 - DNA, 20 bp, Artificial Sequence
  chemically synthesized
atctgattaaaaaatgcttt

SEQ ID NO: 582630 - DNA, 20 bp, Artificial Sequence
  chemically synthesized
aacagaaaaagcatttttta

SEQ ID NO: 582631 - DNA, 20 bp, Artificial Sequence
  chemically synthesized
gtcggagaaatctgattaaa

SEQ ID NO: 582632 - DNA, 20 bp, Artificial Sequence
  chemically synthesized
tatagcttagtgtcggagaa

SEQ ID NO: 582633 - DNA, 20 bp, Artificial Sequence
  chemically synthesized
gcagtggatgatttgtactt

SEQ ID NO: 582634 - DNA, 20 bp, Artificial Sequence
  chemically synthesized
aagtacaaatcatccactgc

SEQ ID NO: 582635 - DNA, 20 bp, Artificial Sequence
  chemically synthesized
aattgtgaatcaatagcagt

SEQ ID NO: 582636 - DNA, 20 bp, Artificial Sequence
  chemically synthesized
agtaaagcacacatgaagtt

SEQ ID NO: 582637 - DNA, 20 bp, Artificial Sequence
  chemically synthesized
aattaaactttgaacttcat

SEQ ID NO: 582638 - DNA, 20 bp, Artificial Sequence
  chemically synthesized
ttcatgtgtgctttacttct

SEQ ID NO: 582639 - DNA, 20 bp, Artificial Sequence
  chemically synthesized
ttttctactgtctaaaatga

SEQ ID NO: 582640 - DNA, 20 bp, Artificial Sequence
  chemically synthesized
tactgtctaaaatgaagcag

SEQ ID NO: 582641 - DNA, 20 bp, Artificial Sequence
  chemically synthesized
catttaaaaaaattaagcaa

SEQ ID NO: 582642 - DNA, 20 bp, Artificial Sequence
  chemically synthesized
caattacaactttaattttt

SEQ ID NO: 582643 - DNA, 20 bp, Artificial Sequence
  chemically synthesized
aaaaaaattaaagttgtaat

SEQ ID NO: 582644 - DNA, 20 bp, Artificial Sequence
  chemically synthesized
tattattttagaaaatggtg

SEQ ID NO: 582645 - DNA, 20 bp, Artificial Sequence
  chemically synthesized
ggtcccctttagtatgtatt

SEQ ID NO: 582646 - DNA, 20 bp, Artificial Sequence
  chemically synthesized
ttatggtcccctttagtatg

SEQ ID NO: 582647 - DNA, 20 bp, Artificial Sequence
  chemically synthesized
aatacatactaaaggggacc

SEQ ID NO: 582648 - DNA, 20 bp, Artificial Sequence
  chemically synthesized
gaccataagcttttcaccaa

SEQ ID NO: 582649 - DNA, 20 bp, Artificial Sequence
  chemically synthesized
ctcagaaaacatatttggtg

SEQ ID NO: 582650 - DNA, 20 bp, Artificial Sequence
  chemically synthesized
aagtctaaagctagtgaaag

SEQ ID NO: 582651 - DNA, 20 bp, Artificial Sequence
  chemically synthesized
ttcaagtaagctaacctttc

SEQ ID NO: 582652 - DNA, 20 bp, Artificial Sequence
  chemically synthesized
tatttcaattactgcacgtc

SEQ ID NO: 582653 - DNA, 20 bp, Artificial Sequence
  chemically synthesized
gactcaaggcaaagttagtt

SEQ ID NO: 582654 - DNA, 20 bp, Artificial Sequence
  chemically synthesized
gcattatcttatctatcttc

SEQ ID NO: 582655 - DNA, 20 bp, Artificial Sequence
  chemically synthesized
attcaacaaagactggaatg

SEQ ID NO: 582656 - DNA, 20 bp, Artificial Sequence
  chemically synthesized
attccagtctttgttgaata

SEQ ID NO: 582657 - DNA, 20 bp, Artificial Sequence
  chemically synthesized
attggttctcaataaatgtg

SEQ ID NO: 582658 - DNA, 20 bp, Artificial Sequence
  chemically synthesized
taccaatacctgaaatataa

SEQ ID NO: 582659 - DNA, 20 bp, Artificial Sequence
  chemically synthesized
tgaagttgagtagatgaacc

SEQ ID NO: 582660 - DNA, 20 bp, Artificial Sequence
  chemically synthesized
agatcagctgtatccaatct

SEQ ID NO: 582661 - DNA, 20 bp, Artificial Sequence
  chemically synthesized
cagtgtggcccagggaagcc

SEQ ID NO: 582662 - DNA, 20 bp, Artificial Sequence
  chemically synthesized
aaaaagtcacaaaaagtatc

SEQ ID NO: 582663 - DNA, 20 bp, Artificial Sequence
  chemically synthesized
aaaagtatctcatgttttaa

SEQ ID NO: 582664 - DNA, 20 bp, Artificial Sequence
  chemically synthesized
gtgagccacatgcgtcccag

SEQ ID NO: 582665 - DNA, 20 bp, Artificial Sequence
  chemically synthesized
gctcacaggccatgagttga

SEQ ID NO: 582666 - DNA, 20 bp, Artificial Sequence
  chemically synthesized
acaggccatgagttgaacaa

SEQ ID NO: 582667 - DNA, 20 bp, Artificial Sequence
  chemically synthesized
ggtaattattatgatctaaa

SEQ ID NO: 582668 - DNA, 20 bp, Artificial Sequence
  chemically synthesized
ttggaggatagagcaaataa

SEQ ID NO: 582669 - DNA, 20 bp, Artificial Sequence
  chemically synthesized
gactgagttcagtggacaat

SEQ ID NO: 582670 - DNA, 20 bp, Artificial Sequence
  chemically synthesized
ctattgacaatagaagaagg

SEQ ID NO: 582671 - DNA, 20 bp, Artificial Sequence
  chemically synthesized
ttcttctattgtcaatagaa

SEQ ID NO: 582672 - DNA, 20 bp, Artificial Sequence
  chemically synthesized
attttgagactttgggagga

SEQ ID NO: 582673 - DNA, 20 bp, Artificial Sequence
  chemically synthesized
gggaggagagggatttaaat

SEQ ID NO: 582674 - DNA, 20 bp, Artificial Sequence
  chemically synthesized
agctagaagggagcagaaaa

SEQ ID NO: 582675 - DNA, 20 bp, Artificial Sequence
  chemically synthesized
ttaaaagagagtccagttca

SEQ ID NO: 582676 - DNA, 20 bp, Artificial Sequence
  chemically synthesized
ggctagcaagaagtattcca

SEQ ID NO: 582677 - DNA, 20 bp, Artificial Sequence
  chemically synthesized
cacatgcccagaaaggcatg

SEQ ID NO: 582678 - DNA, 20 bp, Artificial Sequence
  chemically synthesized
ctcagattctttttcctttt

SEQ ID NO: 582679 - DNA, 20 bp, Artificial Sequence
  chemically synthesized
ttacagcacatttactttct

SEQ ID NO: 582680 - DNA, 20 bp, Artificial Sequence
  chemically synthesized
ttctgcctgatttaatcaga

SEQ ID NO: 582681 - DNA, 20 bp, Artificial Sequence
  chemically synthesized
tgcaagcaacagaaatcatt

SEQ ID NO: 582682 - DNA, 20 bp, Artificial Sequence
  chemically synthesized
tttaatcagagaatgatttc

SEQ ID NO: 582683 - DNA, 20 bp, Artificial Sequence
  chemically synthesized
ataggcaactaaactatatg

SEQ ID NO: 582684 - DNA, 20 bp, Artificial Sequence
  chemically synthesized
aggaaaataaaatcatcaca

SEQ ID NO: 582685 - DNA, 20 bp, Artificial Sequence
  chemically synthesized
tatatgtgatgattttattt

SEQ ID NO: 582686 - DNA, 20 bp, Artificial Sequence
  chemically synthesized
tacaggcagtggcaactctg

SEQ ID NO: 582687 - DNA, 20 bp, Artificial Sequence
  chemically synthesized
aaattcctcagtctggcaac

SEQ ID NO: 582688 - DNA, 20 bp, Artificial Sequence
  chemically synthesized
aacagagtatatcagaggaa

SEQ ID NO: 582689 - DNA, 20 bp, Artificial Sequence
  chemically synthesized
atcacaattcctctgatata

SEQ ID NO: 582690 - DNA, 20 bp, Artificial Sequence
  chemically synthesized
atccaggcagagggaacaga

SEQ ID NO: 582691 - DNA, 20 bp, Artificial Sequence
  chemically synthesized
agcacagtctgttccctctg

SEQ ID NO: 582692 - DNA, 20 bp, Artificial Sequence
  chemically synthesized
ccctctgcctggattgccct

SEQ ID NO: 582693 - DNA, 20 bp, Artificial Sequence
  chemically synthesized
ttccaactcattctttaatg

SEQ ID NO: 582694 - DNA, 20 bp, Artificial Sequence
  chemically synthesized
ctcattctttaatgcctggc

SEQ ID NO: 582695 - DNA, 20 bp, Artificial Sequence
  chemically synthesized
cactagcatccattctctct

SEQ ID NO: 582696 - DNA, 20 bp, Artificial Sequence
  chemically synthesized
gcatccattctctctcctgg

SEQ ID NO: 582697 - DNA, 20 bp, Artificial Sequence
  chemically synthesized
tattgtgtgggtgatgctgt

SEQ ID NO: 582698 - DNA, 20 bp, Artificial Sequence
  chemically synthesized
atcagagaagttgaaaacta

SEQ ID NO: 582699 - DNA, 20 bp, Artificial Sequence
  chemically synthesized
gagtcctctcccttaaacct

SEQ ID NO: 582700 - DNA, 20 bp, Artificial Sequence
  chemically synthesized
aatgatgagatgtgaactca

SEQ ID NO: 582701 - DNA, 20 bp, Artificial Sequence
  chemically synthesized
agtacttcacgtgaattctt

SEQ ID NO: 582702 - DNA, 20 bp, Artificial Sequence
  chemically synthesized
acattctatgttgtacaact

SEQ ID NO: 582703 - DNA, 20 bp, Artificial Sequence
  chemically synthesized
taaaaatggataggtgttag

SEQ ID NO: 582704 - DNA, 20 bp, Artificial Sequence
  chemically synthesized
taggtgttagtaaagttttt

SEQ ID NO: 582705 - DNA, 20 bp, Artificial Sequence
  chemically synthesized
aaaattaggcaaaattccaa

SEQ ID NO: 582706 - DNA, 20 bp, Artificial Sequence
  chemically synthesized
tcacacatcaaacattaaag

SEQ ID NO: 582707 - DNA, 20 bp, Artificial Sequence
  chemically synthesized
acatcaaacattaaagttgg

SEQ ID NO: 582708 - DNA, 20 bp, Artificial Sequence
  chemically synthesized
aaataaagcaatcccaactt

SEQ ID NO: 582709 - DNA, 20 bp, Artificial Sequence
  chemically synthesized
aaatcaatatcaattttatg

SEQ ID NO: 582710 - DNA, 20 bp, Artificial Sequence
  chemically synthesized
aaaactttacataaaattga

SEQ ID NO: 582711 - DNA, 20 bp, Artificial Sequence
  chemically synthesized
agaaggataagtaagtatgg

SEQ ID NO: 582712 - DNA, 20 bp, Artificial Sequence
  chemically synthesized
ttatttcccctctcacacac

SEQ ID NO: 582713 - DNA, 20 bp, Artificial Sequence
  chemically synthesized
ccctctcacacacatttgtt

SEQ ID NO: 582714 - DNA, 20 bp, Artificial Sequence
  chemically synthesized
gggccattttaccgacaatt

SEQ ID NO: 582715 - DNA, 20 bp, Artificial Sequence
  chemically synthesized
tcttaaagacattgtcagtt

SEQ ID NO: 582716 - DNA, 20 bp, Artificial Sequence
  chemically synthesized
ctcttgcttgctgaataggg

SEQ ID NO: 582717 - DNA, 20 bp, Artificial Sequence
  chemically synthesized
ctattcagcaagcaagagaa

SEQ ID NO: 582718 - DNA, 20 bp, Artificial Sequence
  chemically synthesized
aaaaaatctaatctcccttc

SEQ ID NO: 582719 - DNA, 20 bp, Artificial Sequence
  chemically synthesized
cagcaagcaagagaagggag

SEQ ID NO: 582720 - DNA, 20 bp, Artificial Sequence
  chemically synthesized
catttctgagacacaaaaat

SEQ ID NO: 582721 - DNA, 20 bp, Artificial Sequence
  chemically synthesized
ctgtatttttgtgtctcaga

SEQ ID NO: 582722 - DNA, 20 bp, Artificial Sequence
  chemically synthesized
ttttgtgtctcagaaatggc

SEQ ID NO: 582723 - DNA, 20 bp, Artificial Sequence
  chemically synthesized
agctcaatggaacctctggt

SEQ ID NO: 582724 - DNA, 20 bp, Artificial Sequence
  chemically synthesized
gaacctctggtccaggattc

SEQ ID NO: 582725 - DNA, 20 bp, Artificial Sequence
  chemically synthesized
tgcctcagcctccctagtag

SEQ ID NO: 582726 - DNA, 20 bp, Artificial Sequence
  chemically synthesized
ttttttattttcagtagaga

SEQ ID NO: 582727 - DNA, 20 bp, Artificial Sequence
  chemically synthesized
caggtggatcacttgaggtc

SEQ ID NO: 582728 - DNA, 20 bp, Artificial Sequence
  chemically synthesized
atgtttcacgcctgcactcc

SEQ ID NO: 582729 - DNA, 20 bp, Artificial Sequence
  chemically synthesized
ctaatgtagagggccaggtg

SEQ ID NO: 582730 - DNA, 20 bp, Artificial Sequence
  chemically synthesized
cattgcacctggccctctac

SEQ ID NO: 582731 - DNA, 20 bp, Artificial Sequence
  chemically synthesized
gtgtccttttcagaaaggac

SEQ ID NO: 582732 - DNA, 20 bp, Artificial Sequence
  chemically synthesized
tggagactactgagcacatc

SEQ ID NO: 582733 - DNA, 20 bp, Artificial Sequence
  chemically synthesized
aaagtccacacttccttgtg

SEQ ID NO: 582734 - DNA, 20 bp, Artificial Sequence
  chemically synthesized
tcctgcagaagttaccagat

SEQ ID NO: 582735 - DNA, 20 bp, Artificial Sequence
  chemically synthesized
gtagcctagtctaccattga

SEQ ID NO: 582736 - DNA, 20 bp, Artificial Sequence
  chemically synthesized
atatggaaatgagagcttgt

SEQ ID NO: 582737 - DNA, 20 bp, Artificial Sequence
  chemically synthesized
aatattatatggaaatgaga

SEQ ID NO: 582738 - DNA, 20 bp, Artificial Sequence
  chemically synthesized
tcataatattatatggaaat

SEQ ID NO: 582739 - DNA, 20 bp, Artificial Sequence
  chemically synthesized
tataatattatgatgtgata

SEQ ID NO: 582740 - DNA, 20 bp, Artificial Sequence
  chemically synthesized
taatacaaatgccatcattg

SEQ ID NO: 582741 - DNA, 20 bp, Artificial Sequence
  chemically synthesized
gcttcccactttgccttgct

SEQ ID NO: 582742 - DNA, 20 bp, Artificial Sequence
  chemically synthesized
gaaaaatgcttcccactttg

SEQ ID NO: 582743 - DNA, 20 bp, Artificial Sequence
  chemically synthesized
taagttggttggtacatgaa

SEQ ID NO: 582744 - DNA, 20 bp, Artificial Sequence
  chemically synthesized
atctgccttgcagtttgtca

SEQ ID NO: 582745 - DNA, 20 bp, Artificial Sequence
  chemically synthesized
gatagttgtactatctgcct

SEQ ID NO: 582746 - DNA, 20 bp, Artificial Sequence
  chemically synthesized
gttattctgcctacctgagc

SEQ ID NO: 582747 - DNA, 20 bp, Artificial Sequence
  chemically synthesized
gaataacttactcaaggtca

SEQ ID NO: 582748 - DNA, 20 bp, Artificial Sequence
  chemically synthesized
aaggtcacacagcttgggag

SEQ ID NO: 582749 - DNA, 20 bp, Artificial Sequence
  chemically synthesized
gaagttacattgtctgggtt

SEQ ID NO: 582750 - DNA, 20 bp, Artificial Sequence
  chemically synthesized
agacaatgtaacttcaaaac

SEQ ID NO: 582751 - DNA, 20 bp, Artificial Sequence
  chemically synthesized
tattttataatgtttaaagc

SEQ ID NO: 582752 - DNA, 20 bp, Artificial Sequence
  chemically synthesized
gggctttaaacattataaaa

SEQ ID NO: 582753 - DNA, 20 bp, Artificial Sequence
  chemically synthesized
ccaaaggaaacaatatttta

SEQ ID NO: 582754 - DNA, 20 bp, Artificial Sequence
  chemically synthesized
gtattgtaaaagaacgtacc

SEQ ID NO: 582755 - DNA, 20 bp, Artificial Sequence
  chemically synthesized
ctgtaactgcagttactatt

SEQ ID NO: 582756 - DNA, 20 bp, Artificial Sequence
  chemically synthesized
attaccgcagcaatagtatg

SEQ ID NO: 582757 - DNA, 20 bp, Artificial Sequence
  chemically synthesized
ctgcagtagcaagtaataac

SEQ ID NO: 582758 - DNA, 20 bp, Artificial Sequence
  chemically synthesized
aatccaagtccatttgattc

SEQ ID NO: 582759 - DNA, 20 bp, Artificial Sequence
  chemically synthesized
aagcttaggaatcaaatgga

SEQ ID NO: 582760 - DNA, 20 bp, Artificial Sequence
  chemically synthesized
aaggattcaaatccaagtcc

SEQ ID NO: 582761 - DNA, 20 bp, Artificial Sequence
  chemically synthesized
attcccagtaagtagcagaa

SEQ ID NO: 582762 - DNA, 20 bp, Artificial Sequence
  chemically synthesized
gtacctaaaatttgttttac

SEQ ID NO: 582763 - DNA, 20 bp, Artificial Sequence
  chemically synthesized
actacatatatgtacctaaa

SEQ ID NO: 582764 - DNA, 20 bp, Artificial Sequence
  chemically synthesized
ataggaaacgaagatccaga

SEQ ID NO: 582765 - DNA, 20 bp, Artificial Sequence
  chemically synthesized
tggtcaagccatctctggat

SEQ ID NO: 582766 - DNA, 20 bp, Artificial Sequence
  chemically synthesized
aattcagtgccatttgcaaa

SEQ ID NO: 582767 - DNA, 20 bp, Artificial Sequence
  chemically synthesized
acaacctgcatttaaaggcc

SEQ ID NO: 582768 - DNA, 20 bp, Artificial Sequence
  chemically synthesized
gctcaaggcctttaaatgca

SEQ ID NO: 582769 - DNA, 20 bp, Artificial Sequence
  chemically synthesized
ttttattcctatggaattgg

SEQ ID NO: 582770 - DNA, 20 bp, Artificial Sequence
  chemically synthesized
cttactctgtctgcctcact

SEQ ID NO: 582771 - DNA, 20 bp, Artificial Sequence
  chemically synthesized
acaactttgtatttctttag

SEQ ID NO: 582772 - DNA, 20 bp, Artificial Sequence
  chemically synthesized
attaaagttttttcacttgt

SEQ ID NO: 582773 - DNA, 20 bp, Artificial Sequence
  chemically synthesized
atgttggaattgttatacat

SEQ ID NO: 582774 - DNA, 20 bp, Artificial Sequence
  chemically synthesized
tatatatcttttatatttgt

SEQ ID NO: 582775 - DNA, 20 bp, Artificial Sequence
  chemically synthesized
ttagaatacattgatgtaaa

SEQ ID NO: 582776 - DNA, 20 bp, Artificial Sequence
  chemically synthesized
atatttacatcaatgtattc

SEQ ID NO: 582777 - DNA, 20 bp, Artificial Sequence
  chemically synthesized
ttgatgtcataattttacca

SEQ ID NO: 582778 - DNA, 20 bp, Artificial Sequence
  chemically synthesized
gcaatgccatgttcaaatga

SEQ ID NO: 582779 - DNA, 20 bp, Artificial Sequence
  chemically synthesized
ctagggtaattttaaatatc

SEQ ID NO: 582780 - DNA, 20 bp, Artificial Sequence
  chemically synthesized
atcaaatataatagtctggg

SEQ ID NO: 582781 - DNA, 20 bp, Artificial Sequence
  chemically synthesized
atcaattcccagactattat

SEQ ID NO: 582782 - DNA, 20 bp, Artificial Sequence
  chemically synthesized
ggctgcgtagtgccaaaaca

SEQ ID NO: 582783 - DNA, 20 bp, Artificial Sequence
  chemically synthesized
gagctatttacatttaaact

SEQ ID NO: 582784 - DNA, 20 bp, Artificial Sequence
  chemically synthesized
aactgagctatttacattta

SEQ ID NO: 582785 - DNA, 20 bp, Artificial Sequence
  chemically synthesized
gagtgacttatttggtataa

SEQ ID NO: 582786 - DNA, 20 bp, Artificial Sequence
  chemically synthesized
aatagatttttaaaatacca

SEQ ID NO: 582787 - DNA, 20 bp, Artificial Sequence
  chemically synthesized
aactgagacaactattcttg

SEQ ID NO: 582788 - DNA, 20 bp, Artificial Sequence
  chemically synthesized
gacaactattcttgtaaggt

SEQ ID NO: 582789 - DNA, 20 bp, Artificial Sequence
  chemically synthesized
ttatttgcattaatttatat

SEQ ID NO: 582790 - DNA, 20 bp, Artificial Sequence
  chemically synthesized
taggctgaatagtgagagta

SEQ ID NO: 582791 - DNA, 20 bp, Artificial Sequence
  chemically synthesized
tttcccaccagttcttaggc

SEQ ID NO: 582792 - DNA, 20 bp, Artificial Sequence
  chemically synthesized
ggaaatggtctaggagagta

SEQ ID NO: 582793 - DNA, 20 bp, Artificial Sequence
  chemically synthesized
gcagaagtttttctttaaaa

SEQ ID NO: 582794 - DNA, 20 bp, Artificial Sequence
  chemically synthesized
aaaaaatgataaaagttggc

SEQ ID NO: 582795 - DNA, 20 bp, Artificial Sequence
  chemically synthesized
ttatcattttttctcatacc

SEQ ID NO: 582796 - DNA, 20 bp, Artificial Sequence
  chemically synthesized
aggtcacccaccatcaccct

SEQ ID NO: 582797 - DNA, 20 bp, Artificial Sequence
  chemically synthesized
agaacttaccgactggcttt

SEQ ID NO: 582798 - DNA, 20 bp, Artificial Sequence
  chemically synthesized
ggcttggacagaacttaccg

SEQ ID NO: 582799 - DNA, 20 bp, Artificial Sequence
  chemically synthesized
cctgctctggcagatttcaa

SEQ ID NO: 582800 - DNA, 20 bp, Artificial Sequence
  chemically synthesized
atgttggaggtacctgctct

SEQ ID NO: 582801 - DNA, 20 bp, Artificial Sequence
  chemically synthesized
acatcaaggaagatggcatt

SEQ ID NO: 582802 - DNA, 20 bp, Artificial Sequence
  chemically synthesized
ggcatttctagtttggagat

SEQ ID NO: 582803 - DNA, 20 bp, Artificial Sequence
  chemically synthesized
tgagtaggagctaaaatatt

SEQ ID NO: 582804 - DNA, 20 bp, Artificial Sequence
  chemically synthesized
attgaaattggctctttagc

SEQ ID NO: 582805 - DNA, 20 bp, Artificial Sequence
  chemically synthesized
attgttattgaaattggctc

SEQ ID NO: 582806 - DNA, 20 bp, Artificial Sequence
  chemically synthesized
agatatataatgtcatgaat

SEQ ID NO: 582807 - DNA, 20 bp, Artificial Sequence
  chemically synthesized
tttttctaacaatgtggata

SEQ ID NO: 582808 - DNA, 20 bp, Artificial Sequence
  chemically synthesized
gcaatacatggtagaaaatg

SEQ ID NO: 582809 - DNA, 20 bp, Artificial Sequence
  chemically synthesized
acatttaacaattttttaaa

SEQ ID NO: 582810 - DNA, 20 bp, Artificial Sequence
  chemically synthesized
ccaggcatgagaatgagcaa

SEQ ID NO: 582811 - DNA, 20 bp, Artificial Sequence
  chemically synthesized
atgtatatgattgttactga

SEQ ID NO: 582812 - DNA, 20 bp, Artificial Sequence
  chemically synthesized
ctttaccacttccacaatgt

SEQ ID NO: 582813 - DNA, 20 bp, Artificial Sequence
  chemically synthesized
gtggaagtggtaaagaaaac

SEQ ID NO: 582814 - DNA, 20 bp, Artificial Sequence
  chemically synthesized
ccctggcaaggtctgaaaac

SEQ ID NO: 582815 - DNA, 20 bp, Artificial Sequence
  chemically synthesized
cttatcccatcttgttttgc

SEQ ID NO: 582816 - DNA, 20 bp, Artificial Sequence
  chemically synthesized
agaaagaagatcttatccca

SEQ ID NO: 582817 - DNA, 20 bp, Artificial Sequence
  chemically synthesized
aagatgggataagatcttct

SEQ ID NO: 582818 - DNA, 20 bp, Artificial Sequence
  chemically synthesized
tggctttgatttccctaggg

SEQ ID NO: 582819 - DNA, 20 bp, Artificial Sequence
  chemically synthesized
agacaagaacgtttcattgg

SEQ ID NO: 582820 - DNA, 20 bp, Artificial Sequence
  chemically synthesized
agctaagacaagaacgtttc

SEQ ID NO: 582821 - DNA, 20 bp, Artificial Sequence
  chemically synthesized
aaaatacagagctaagacaa

SEQ ID NO: 582822 - DNA, 20 bp, Artificial Sequence
  chemically synthesized
gctctgtattttatactggg

SEQ ID NO: 582823 - DNA, 20 bp, Artificial Sequence
  chemically synthesized
tcatatttttttctttttat

SEQ ID NO: 582824 - DNA, 20 bp, Artificial Sequence
  chemically synthesized
ttggtttttcttcactgctg

SEQ ID NO: 582825 - DNA, 20 bp, Artificial Sequence
  chemically synthesized
tttttaagaaaatattgtat

SEQ ID NO: 582826 - DNA, 20 bp, Artificial Sequence
  chemically synthesized
ttttcttaaaaatgcgagtt

SEQ ID NO: 582827 - DNA, 20 bp, Artificial Sequence
  chemically synthesized
ttttctatttagacatgaaa

SEQ ID NO: 582828 - DNA, 20 bp, Artificial Sequence
  chemically synthesized
agtgtccaacactattcata

SEQ ID NO: 582829 - DNA, 20 bp, Artificial Sequence
  chemically synthesized
cagagttcctagggcagaga

SEQ ID NO: 582830 - DNA, 20 bp, Artificial Sequence
  chemically synthesized
actgaaacttagagaggtta

SEQ ID NO: 582831 - DNA, 20 bp, Artificial Sequence
  chemically synthesized
ggtaaagccacataacctct

SEQ ID NO: 582832 - DNA, 20 bp, Artificial Sequence
  chemically synthesized
gcttcccactttgccttgct

SEQ ID NO: 582833 - DNA, 20 bp, Artificial Sequence
  chemically synthesized
gaaaaatgcttcccactttg

SEQ ID NO: 582834 - DNA, 20 bp, Artificial Sequence
  chemically synthesized
ttttaaggtaaatacatgaa

SEQ ID NO: 582835 - DNA, 20 bp, Artificial Sequence
  chemically synthesized
aaatgtcataagggcagttg

SEQ ID NO: 582836 - DNA, 20 bp, Artificial Sequence
  chemically synthesized
ttctggcattgtcatacgtg

SEQ ID NO: 582837 - DNA, 20 bp, Artificial Sequence
  chemically synthesized
taataatattattgtgatga

SEQ ID NO: 582838 - DNA, 20 bp, Artificial Sequence
  chemically synthesized
tgatcaatagtgttaggtat

SEQ ID NO: 582839 - DNA, 20 bp, Artificial Sequence
  chemically synthesized
cactgtgtttcttactagcc

SEQ ID NO: 582840 - DNA, 20 bp, Artificial Sequence
  chemically synthesized
ctcaccacagttgttcatca

SEQ ID NO: 582841 - DNA, 20 bp, Artificial Sequence
  chemically synthesized
tcacattttggggccttatc

SEQ ID NO: 582842 - DNA, 20 bp, Artificial Sequence
  chemically synthesized
aaagtccgtgtgtggcccta

SEQ ID NO: 582843 - DNA, 20 bp, Artificial Sequence
  chemically synthesized
tgaggggaaggaatgcctaa

SEQ ID NO: 582844 - DNA, 20 bp, Artificial Sequence
  chemically synthesized
cttgagtctgttgtctataa

SEQ ID NO: 582845 - DNA, 20 bp, Artificial Sequence
  chemically synthesized
ctcaagagcataatataacc

SEQ ID NO: 582846 - DNA, 20 bp, Artificial Sequence
  chemically synthesized
gtggcaaaattattggacta

SEQ ID NO: 582847 - DNA, 20 bp, Artificial Sequence
  chemically synthesized
ggactatgtagtttggaatg

SEQ ID NO: 582848 - DNA, 20 bp, Artificial Sequence
  chemically synthesized
tctcctgttgagatgtcttt

SEQ ID NO: 582849 - DNA, 20 bp, Artificial Sequence
  chemically synthesized
actcacactggacaaccagt

SEQ ID NO: 582850 - DNA, 20 bp, Artificial Sequence
  chemically synthesized
agttacatagccataaaaat

SEQ ID NO: 582851 - DNA, 20 bp, Artificial Sequence
  chemically synthesized
taatttttatggctatgtaa

SEQ ID NO: 582852 - DNA, 20 bp, Artificial Sequence
  chemically synthesized
agaagatgagtagaatggaa

SEQ ID NO: 582853 - DNA, 20 bp, Artificial Sequence
  chemically synthesized
ggaagaatgtttcttgtctc

SEQ ID NO: 582854 - DNA, 20 bp, Artificial Sequence
  chemically synthesized
gaaaactcttggtgtccctg

SEQ ID NO: 582855 - DNA, 20 bp, Artificial Sequence
  chemically synthesized
tcaagcttctcagggacacc

SEQ ID NO: 582856 - DNA, 20 bp, Artificial Sequence
  chemically synthesized
tcaatgcagacagaaaaaaa

SEQ ID NO: 582857 - DNA, 20 bp, Artificial Sequence
  chemically synthesized
aaaaaatttgtgtcacgaaa

SEQ ID NO: 582858 - DNA, 20 bp, Artificial Sequence
  chemically synthesized
cactgttactgcctttcaat

SEQ ID NO: 582859 - DNA, 20 bp, Artificial Sequence
  chemically synthesized
taacagtgaggcaataaaga

SEQ ID NO: 582860 - DNA, 20 bp, Artificial Sequence
  chemically synthesized
gtgaggcaataaagaaaaag

SEQ ID NO: 582861 - DNA, 20 bp, Artificial Sequence
  chemically synthesized
aaagagcctcagagtagtca

SEQ ID NO: 582862 - DNA, 20 bp, Artificial Sequence
  chemically synthesized
atttctagatctttttgctt

SEQ ID NO: 582863 - DNA, 20 bp, Artificial Sequence
  chemically synthesized
cttttaagatttctagatct

SEQ ID NO: 582864 - DNA, 20 bp, Artificial Sequence
  chemically synthesized
aaaagatctagaaatcttaa

SEQ ID NO: 582865 - DNA, 20 bp, Artificial Sequence
  chemically synthesized
ctcctttcctggaatccctt

SEQ ID NO: 582866 - DNA, 20 bp, Artificial Sequence
  chemically synthesized
aggcaatatacagcaattta

SEQ ID NO: 582867 - DNA, 20 bp, Artificial Sequence
  chemically synthesized
tacagcaatttaggaggatt

SEQ ID NO: 582868 - DNA, 20 bp, Artificial Sequence
  chemically synthesized
agcattttctgacacttccc

SEQ ID NO: 582869 - DNA, 20 bp, Artificial Sequence
  chemically synthesized
agcttatgggaagtgtcaga

SEQ ID NO: 582870 - DNA, 20 bp, Artificial Sequence
  chemically synthesized
cctcaaataagagcagagac

SEQ ID NO: 582871 - DNA, 20 bp, Artificial Sequence
  chemically synthesized
tcagacttcaacaagcagac

SEQ ID NO: 582872 - DNA, 20 bp, Artificial Sequence
  chemically synthesized
gtgcttttcaggaaacagtg

SEQ ID NO: 582873 - DNA, 20 bp, Artificial Sequence
  chemically synthesized
agaccactgtttcctgaaaa

SEQ ID NO: 582874 - DNA, 20 bp, Artificial Sequence
  chemically synthesized
tcctttctgtctttttccaa

SEQ ID NO: 582875 - DNA, 20 bp, Artificial Sequence
  chemically synthesized
cttgtcttgccttgcttttc

SEQ ID NO: 582876 - DNA, 20 bp, Artificial Sequence
  chemically synthesized
tgccttcctgccttgtcttg

SEQ ID NO: 582877 - DNA, 20 bp, Artificial Sequence
  chemically synthesized
cctccttccttcccttactg

SEQ ID NO: 582878 - DNA, 20 bp, Artificial Sequence
  chemically synthesized
ttgcttttcaatagacttcc

SEQ ID NO: 582879 - DNA, 20 bp, Artificial Sequence
  chemically synthesized
ttttgagtctcaggccctgg

SEQ ID NO: 582880 - DNA, 20 bp, Artificial Sequence
  chemically synthesized
acctctccatcatcctctga

SEQ ID NO: 582881 - DNA, 20 bp, Artificial Sequence
  chemically synthesized
ctggcctgacgggtctatag

SEQ ID NO: 582882 - DNA, 20 bp, Artificial Sequence
  chemically synthesized
agagcagtgagaaagtctga

SEQ ID NO: 582883 - DNA, 20 bp, Artificial Sequence
  chemically synthesized
ctggagtataggaggtgctc

SEQ ID NO: 582884 - DNA, 20 bp, Artificial Sequence
  chemically synthesized
ttactgcacattgacttttc

SEQ ID NO: 582885 - DNA, 20 bp, Artificial Sequence
  chemically synthesized
gaagacctctaagttcacta

SEQ ID NO: 582886 - DNA, 20 bp, Artificial Sequence
  chemically synthesized
ggctagaacacaaaacatgc

SEQ ID NO: 582887 - DNA, 20 bp, Artificial Sequence
  chemically synthesized
cctaactagtaaaaacctag

SEQ ID NO: 582888 - DNA, 20 bp, Artificial Sequence
  chemically synthesized
tgcctaggtttttactagtt

SEQ ID NO: 582889 - DNA, 20 bp, Artificial Sequence
  chemically synthesized
gaagataatggaggaagacc

SEQ ID NO: 582890 - DNA, 20 bp, Artificial Sequence
  chemically synthesized
ctttctgattcagagctatt

SEQ ID NO: 582891 - DNA, 20 bp, Artificial Sequence
  chemically synthesized
taaatattctacaccctgct

SEQ ID NO: 582892 - DNA, 20 bp, Artificial Sequence
  chemically synthesized
gaaagcctaaatattctaca

SEQ ID NO: 582893 - DNA, 20 bp, Artificial Sequence
  chemically synthesized
gaaagcagggtgtagaatat

SEQ ID NO: 582894 - DNA, 20 bp, Artificial Sequence
  chemically synthesized
gaatatttaggctttctagg

SEQ ID NO: 582895 - DNA, 20 bp, Artificial Sequence
  chemically synthesized
aaaaaaaaaaaattatagag

SEQ ID NO: 582896 - DNA, 20 bp, Artificial Sequence
  chemically synthesized
ccactttacagaggagtaaa

SEQ ID NO: 582897 - DNA, 20 bp, Artificial Sequence
  chemically synthesized
ccatttactcctctgtaaag

SEQ ID NO: 582898 - DNA, 20 bp, Artificial Sequence
  chemically synthesized
tgtcagtgaacattactttt

SEQ ID NO: 582899 - DNA, 20 bp, Artificial Sequence
  chemically synthesized
caatgaacatcttgaccctc

SEQ ID NO: 582900 - DNA, 20 bp, Artificial Sequence
  chemically synthesized
acacaattccattagattgg

SEQ ID NO: 582901 - DNA, 20 bp, Artificial Sequence
  chemically synthesized
aaaatccgtaacacaattcc

SEQ ID NO: 582902 - DNA, 20 bp, Artificial Sequence
  chemically synthesized
ccaatctaatggaattgtgt

SEQ ID NO: 582903 - DNA, 20 bp, Artificial Sequence
  chemically synthesized
tcatacatgtaagtcacctc

SEQ ID NO: 582904 - DNA, 20 bp, Artificial Sequence
  chemically synthesized
ttctgactgtaagtacacta

SEQ ID NO: 582905 - DNA, 20 bp, Artificial Sequence
  chemically synthesized
tcctcatgttctacattcgt

SEQ ID NO: 582906 - DNA, 20 bp, Artificial Sequence
  chemically synthesized
ttttatgctctgtactctga

SEQ ID NO: 582907 - DNA, 20 bp, Artificial Sequence
  chemically synthesized
tagaaagcgtatgaaaggac

SEQ ID NO: 582908 - DNA, 20 bp, Artificial Sequence
  chemically synthesized
tttcaaacctgtgtcctttc

SEQ ID NO: 582909 - DNA, 20 bp, Artificial Sequence
  chemically synthesized
cttcttgaaaactttttctc

SEQ ID NO: 582910 - DNA, 20 bp, Artificial Sequence
  chemically synthesized
ttgtctggaaacaggagaga

SEQ ID NO: 582911 - DNA, 20 bp, Artificial Sequence
  chemically synthesized
agttgacatttaaagagaaa

SEQ ID NO: 582912 - DNA, 20 bp, Artificial Sequence
  chemically synthesized
ttttctctttaaatgtcaac

SEQ ID NO: 582913 - DNA, 20 bp, Artificial Sequence
  chemically synthesized
taaatgtcaactctagattt

SEQ ID NO: 582914 - DNA, 20 bp, Artificial Sequence
  chemically synthesized
agaaaacgttaaagactaaa

SEQ ID NO: 582915 - DNA, 20 bp, Artificial Sequence
  chemically synthesized
cctaaacactttttagtctt

SEQ ID NO: 582916 - DNA, 20 bp, Artificial Sequence
  chemically synthesized
ttttgtccttcctagtgata

SEQ ID NO: 582917 - DNA, 20 bp, Artificial Sequence
  chemically synthesized
gacaaaatcttgcaccacta

SEQ ID NO: 582918 - DNA, 20 bp, Artificial Sequence
  chemically synthesized
ctccaaaacctaatagtggt

SEQ ID NO: 582919 - DNA, 20 bp, Artificial Sequence
  chemically synthesized
ttgcaccactattaggtttt

SEQ ID NO: 582920 - DNA, 20 bp, Artificial Sequence
  chemically synthesized
atagctgatagtagttgaga

SEQ ID NO: 582921 - DNA, 20 bp, Artificial Sequence
  chemically synthesized
aaagtatattccttgagacc

SEQ ID NO: 582922 - DNA, 20 bp, Artificial Sequence
  chemically synthesized
aagattagcctcttgcttct

SEQ ID NO: 582923 - DNA, 20 bp, Artificial Sequence
  chemically synthesized
gaggtcgatgaagattagcc

SEQ ID NO: 582924 - DNA, 20 bp, Artificial Sequence
  chemically synthesized
gctctaatgtgagaggtcga

SEQ ID NO: 582925 - DNA, 20 bp, Artificial Sequence
  chemically synthesized
aaaacataaaatattttaag

SEQ ID NO: 582926 - DNA, 20 bp, Artificial Sequence
  chemically synthesized
aaaacattacttaaaatatt

SEQ ID NO: 582927 - DNA, 20 bp, Artificial Sequence
  chemically synthesized
gttttctaaaaagacttgcc

SEQ ID NO: 582928 - DNA, 20 bp, Artificial Sequence
  chemically synthesized
tttttttcattttttaatca

SEQ ID NO: 582929 - DNA, 20 bp, Artificial Sequence
  chemically synthesized
aacttctgtcctttgaaaca

SEQ ID NO: 582930 - DNA, 20 bp, Artificial Sequence
  chemically synthesized
atcaaagtgtttcaaaggac

SEQ ID NO: 582931 - DNA, 20 bp, Artificial Sequence
  chemically synthesized
aatcgcttgaacccgcgagg

SEQ ID NO: 582932 - DNA, 20 bp, Artificial Sequence
  chemically synthesized
aatctctgcctcgcgggttc

SEQ ID NO: 582933 - DNA, 20 bp, Artificial Sequence
  chemically synthesized
tcaggaggctgaggcagggg

SEQ ID NO: 582934 - DNA, 20 bp, Artificial Sequence
  chemically synthesized
tttttgtactttagtggaga

SEQ ID NO: 582935 - DNA, 20 bp, Artificial Sequence
  chemically synthesized
tgcctcggcctcccaaagtg

SEQ ID NO: 582936 - DNA, 20 bp, Artificial Sequence
  chemically synthesized
ttattttattgtatatatca

SEQ ID NO: 582937 - DNA, 20 bp, Artificial Sequence
  chemically synthesized
gattcttactgcactttcag

SEQ ID NO: 582938 - DNA, 20 bp, Artificial Sequence
  chemically synthesized
agcctacacttcactgaaaa

SEQ ID NO: 582939 - DNA, 20 bp, Artificial Sequence
  chemically synthesized
tttcagtgaagtgtaggctg

SEQ ID NO: 582940 - DNA, 20 bp, Artificial Sequence
  chemically synthesized
gtaggctggtcagatttgtt

SEQ ID NO: 582941 - DNA, 20 bp, Artificial Sequence
  chemically synthesized
caatattttaaaagactgaa

SEQ ID NO: 582942 - DNA, 20 bp, Artificial Sequence
  chemically synthesized
ttttaaaagactgaaagagg

SEQ ID NO: 582943 - DNA, 20 bp, Artificial Sequence
  chemically synthesized
tttacccgttcgttctagat

SEQ ID NO: 582944 - DNA, 20 bp, Artificial Sequence
  chemically synthesized
ctaactctttacccgttcgt

SEQ ID NO: 582945 - DNA, 20 bp, Artificial Sequence
  chemically synthesized
catccctaaggagcatggga

SEQ ID NO: 582946 - DNA, 20 bp, Artificial Sequence
  chemically synthesized
gattaaatagggtacacggg

SEQ ID NO: 582947 - DNA, 20 bp, Artificial Sequence
  chemically synthesized
aggcatgaacagacttgggg

SEQ ID NO: 582948 - DNA, 20 bp, Artificial Sequence
  chemically synthesized
tgttcatgcctgggcattca

SEQ ID NO: 582949 - DNA, 20 bp, Artificial Sequence
  chemically synthesized
ctgaaccagctaataccaga

SEQ ID NO: 582950 - DNA, 20 bp, Artificial Sequence
  chemically synthesized
ctattaaaggttcctccagt

SEQ ID NO: 582951 - DNA, 20 bp, Artificial Sequence
  chemically synthesized
tcctccagtaacagatttgg

SEQ ID NO: 582952 - DNA, 20 bp, Artificial Sequence
  chemically synthesized
cagtaacagatttgggtggg

SEQ ID NO: 582953 - DNA, 20 bp, Artificial Sequence
  chemically synthesized
aacagatttgggtgggtttt

SEQ ID NO: 582954 - DNA, 20 bp, Artificial Sequence
  chemically synthesized
gatttgggtgggttttgttt

SEQ ID NO: 582955 - DNA, 20 bp, Artificial Sequence
  chemically synthesized
atacatctggttctggcata

SEQ ID NO: 582956 - DNA, 20 bp, Artificial Sequence
  chemically synthesized
tctatctgtctacctagata

SEQ ID NO: 582957 - DNA, 20 bp, Artificial Sequence
  chemically synthesized
taaaatgactctactaaaat

SEQ ID NO: 582958 - DNA, 20 bp, Artificial Sequence
  chemically synthesized
tattttgagcttgattttct

SEQ ID NO: 582959 - DNA, 20 bp, Artificial Sequence
  chemically synthesized
attcatttcaactattttga

SEQ ID NO: 582960 - DNA, 20 bp, Artificial Sequence
  chemically synthesized
ctcaattcatttcaactatt

SEQ ID NO: 582961 - DNA, 20 bp, Artificial Sequence
  chemically synthesized
ctcaaaatagttgaaatgaa

SEQ ID NO: 582962 - DNA, 20 bp, Artificial Sequence
  chemically synthesized
tgtaatatactattgcaaac

SEQ ID NO: 582963 - DNA, 20 bp, Artificial Sequence
  chemically synthesized
caaaatactcagagcaaagc

SEQ ID NO: 582964 - DNA, 20 bp, Artificial Sequence
  chemically synthesized
tattttgttaattaaaaggt

SEQ ID NO: 582965 - DNA, 20 bp, Artificial Sequence
  chemically synthesized
aaggaactcttatttttttc

SEQ ID NO: 582966 - DNA, 20 bp, Artificial Sequence
  chemically synthesized
ttctctagtctgaaaattta

SEQ ID NO: 582967 - DNA, 20 bp, Artificial Sequence
  chemically synthesized
atttaattggtttcaggggt

SEQ ID NO: 582968 - DNA, 20 bp, Artificial Sequence
  chemically synthesized
ggtacatgattagtcagact

SEQ ID NO: 582969 - DNA, 20 bp, Artificial Sequence
  chemically synthesized
gtcagactaacagctttact

SEQ ID NO: 582970 - DNA, 20 bp, Artificial Sequence
  chemically synthesized
acacattgtgtgtgtgtttt

SEQ ID NO: 582971 - DNA, 20 bp, Artificial Sequence
  chemically synthesized
tcttttaaaacacacacaca

SEQ ID NO: 582972 - DNA, 20 bp, Artificial Sequence
  chemically synthesized
atatgccaaacacattgtgt

SEQ ID NO: 582973 - DNA, 20 bp, Artificial Sequence
  chemically synthesized
tttcctttgaagtattcaca

SEQ ID NO: 582974 - DNA, 20 bp, Artificial Sequence
  chemically synthesized
ctagaaatagagtatgtgct

SEQ ID NO: 582975 - DNA, 20 bp, Artificial Sequence
  chemically synthesized
aacaaagctagaaatagagt

SEQ ID NO: 582976 - DNA, 20 bp, Artificial Sequence
  chemically synthesized
caagaagcacatactctatt

SEQ ID NO: 582977 - DNA, 20 bp, Artificial Sequence
  chemically synthesized
gaatgaatgtgggtaacttt

SEQ ID NO: 582978 - DNA, 20 bp, Artificial Sequence
  chemically synthesized
gaatgtgggtaacttttttt

SEQ ID NO: 582979 - DNA, 20 bp, Artificial Sequence
  chemically synthesized
aataacttattttgtaagtt

SEQ ID NO: 582980 - DNA, 20 bp, Artificial Sequence
  chemically synthesized
tttaatactatggggtataa

SEQ ID NO: 582981 - DNA, 20 bp, Artificial Sequence
  chemically synthesized
aaaaagaaaatattctccaa

SEQ ID NO: 582982 - DNA, 20 bp, Artificial Sequence
  chemically synthesized
gaatatttgaaaggatggca

SEQ ID NO: 582983 - DNA, 20 bp, Artificial Sequence
  chemically synthesized
gaagaaaatttgaaatcatg

SEQ ID NO: 582984 - DNA, 20 bp, Artificial Sequence
  chemically synthesized
ttgtctttcttagaatctag

SEQ ID NO: 582985 - DNA, 20 bp, Artificial Sequence
  chemically synthesized
aaattcttccttacctacac

SEQ ID NO: 582986 - DNA, 20 bp, Artificial Sequence
  chemically synthesized
agtgtttatgtgttcatagt

SEQ ID NO: 582987 - DNA, 20 bp, Artificial Sequence
  chemically synthesized
aataagtgtttatgtgttca

SEQ ID NO: 582988 - DNA, 20 bp, Artificial Sequence
  chemically synthesized
acacataaacacttattttt

SEQ ID NO: 582989 - DNA, 20 bp, Artificial Sequence
  chemically synthesized
aaaagaaagcagacaaaaat

SEQ ID NO: 582990 - DNA, 20 bp, Artificial Sequence
  chemically synthesized
aattctcattttagaaaaat

SEQ ID NO: 582991 - DNA, 20 bp, Artificial Sequence
  chemically synthesized
aaggccggagtactggaact

SEQ ID NO: 582992 - DNA, 20 bp, Artificial Sequence
  chemically synthesized
tcatgataaccatttgtatt

SEQ ID NO: 582993 - DNA, 20 bp, Artificial Sequence
  chemically synthesized
ggatttaagaaaaaaaaatg

SEQ ID NO: 582994 - DNA, 20 bp, Artificial Sequence
  chemically synthesized
aaaatgttaagtttgggagc

SEQ ID NO: 582995 - DNA, 20 bp, Artificial Sequence
  chemically synthesized
gtttgggagctatggatttt

SEQ ID NO: 582996 - DNA, 20 bp, Artificial Sequence
  chemically synthesized
ttttaaagcttaatggtgct

SEQ ID NO: 582997 - DNA, 20 bp, Artificial Sequence
  chemically synthesized
aatgtaagcaaatagcacca

SEQ ID NO: 582998 - DNA, 20 bp, Artificial Sequence
  chemically synthesized
gtgctatttgcttacatttt

SEQ ID NO: 582999 - DNA, 20 bp, Artificial Sequence
  chemically synthesized
taagtagtagcaaatattta

SEQ ID NO: 583000 - DNA, 20 bp, Artificial Sequence
  chemically synthesized
catcacccccatcatttact

SEQ ID NO: 583001 - DNA, 20 bp, Artificial Sequence
  chemically synthesized
ttggtaaaggtgaaataaaa

SEQ ID NO: 583002 - DNA, 20 bp, Artificial Sequence
  chemically synthesized
atgataacatctaccctgaa

SEQ ID NO: 583003 - DNA, 20 bp, Artificial Sequence
  chemically synthesized
ttgttaatgtgagatcctga

SEQ ID NO: 583004 - DNA, 20 bp, Artificial Sequence
  chemically synthesized
caggatctcacattaacaag

SEQ ID NO: 583005 - DNA, 20 bp, Artificial Sequence
  chemically synthesized
caagtgatgtttccaagaca

SEQ ID NO: 583006 - DNA, 20 bp, Artificial Sequence
  chemically synthesized
taagaaagatacctgatgtc

SEQ ID NO: 583007 - DNA, 20 bp, Artificial Sequence
  chemically synthesized
tatagctcttagaagtattt

SEQ ID NO: 583008 - DNA, 20 bp, Artificial Sequence
  chemically synthesized
actcaaatacttctaagagc

SEQ ID NO: 583009 - DNA, 20 bp, Artificial Sequence
  chemically synthesized
atttgatatagctataaaaa

SEQ ID NO: 583010 - DNA, 20 bp, Artificial Sequence
  chemically synthesized
tgtgagtggatgccagatgc

SEQ ID NO: 583011 - DNA, 20 bp, Artificial Sequence
  chemically synthesized
aagttgtgagtggatgccag

SEQ ID NO: 583012 - DNA, 20 bp, Artificial Sequence
  chemically synthesized
ttcaagttagtgaaggaagg

SEQ ID NO: 583013 - DNA, 20 bp, Artificial Sequence
  chemically synthesized
gagaaataatcattgccttt

SEQ ID NO: 583014 - DNA, 20 bp, Artificial Sequence
  chemically synthesized
ccaactaaaacaggaaaagg

SEQ ID NO: 583015 - DNA, 20 bp, Artificial Sequence
  chemically synthesized
tacatgcgctcagtgaaaag

SEQ ID NO: 583016 - DNA, 20 bp, Artificial Sequence
  chemically synthesized
atagtgctgagattgagaaa

SEQ ID NO: 583017 - DNA, 20 bp, Artificial Sequence
  chemically synthesized
ggacaaaaatgtcaatagtg

SEQ ID NO: 583018 - DNA, 20 bp, Artificial Sequence
  chemically synthesized
cctgtgcattgtaggatcag

SEQ ID NO: 583019 - DNA, 20 bp, Artificial Sequence
  chemically synthesized
atgtctcctgaggaaagaaa

SEQ ID NO: 583020 - DNA, 20 bp, Artificial Sequence
  chemically synthesized
ggttgagcatgtctcaatta

SEQ ID NO: 583021 - DNA, 20 bp, Artificial Sequence
  chemically synthesized
tacccacccacctctcaaat

SEQ ID NO: 583022 - DNA, 20 bp, Artificial Sequence
  chemically synthesized
aaaaaaaattggataggcat

SEQ ID NO: 583023 - DNA, 20 bp, Artificial Sequence
  chemically synthesized
agaaattaagagaaattgtt

SEQ ID NO: 583024 - DNA, 20 bp, Artificial Sequence
  chemically synthesized
ttccttggcagccataagtt

SEQ ID NO: 583025 - DNA, 20 bp, Artificial Sequence
  chemically synthesized
tttattattccttggcagcc

SEQ ID NO: 583026 - DNA, 20 bp, Artificial Sequence
  chemically synthesized
tctgctggagagtaaatgtc

SEQ ID NO: 583027 - DNA, 20 bp, Artificial Sequence
  chemically synthesized
acacttttgtcaagagatat

SEQ ID NO: 583028 - DNA, 20 bp, Artificial Sequence
  chemically synthesized
ttctcccattaagagccata

SEQ ID NO: 583029 - DNA, 20 bp, Artificial Sequence
  chemically synthesized
ctgtttctccactccttgaa

SEQ ID NO: 583030 - DNA, 20 bp, Artificial Sequence
  chemically synthesized
gaatatggattggtcaagtc

SEQ ID NO: 583031 - DNA, 20 bp, Artificial Sequence
  chemically synthesized
tcagcaaacatgacataagc

SEQ ID NO: 583032 - DNA, 20 bp, Artificial Sequence
  chemically synthesized
ttgttaagcctctgcttatg

SEQ ID NO: 583033 - DNA, 20 bp, Artificial Sequence
  chemically synthesized
tgacataagcagaggcttaa

SEQ ID NO: 583034 - DNA, 20 bp, Artificial Sequence
  chemically synthesized
acacccaagcattgttaagc

SEQ ID NO: 583035 - DNA, 20 bp, Artificial Sequence
  chemically synthesized
aacaatgcttgggtgttggg

SEQ ID NO: 583036 - DNA, 20 bp, Artificial Sequence
  chemically synthesized
gcttggggcttggttcatcg

SEQ ID NO: 583037 - DNA, 20 bp, Artificial Sequence
  chemically synthesized
tcatgattcttgattctgct

SEQ ID NO: 583038 - DNA, 20 bp, Artificial Sequence
  chemically synthesized
ttttagctcatgattcttga

SEQ ID NO: 583039 - DNA, 20 bp, Artificial Sequence
  chemically synthesized
ttttttttttagctcatgat

SEQ ID NO: 583040 - DNA, 20 bp, Artificial Sequence
  chemically synthesized
aatcattttttttttttagc

SEQ ID NO: 583041 - DNA, 20 bp, Artificial Sequence
  chemically synthesized
aatcatgagctaaaaaaaaa

SEQ ID NO: 583042 - DNA, 20 bp, Artificial Sequence
  chemically synthesized
ttttaagtctctacatttgg

SEQ ID NO: 583043 - DNA, 20 bp, Artificial Sequence
  chemically synthesized
ttaaatcctgttttgcgtac

SEQ ID NO: 583044 - DNA, 20 bp, Artificial Sequence
  chemically synthesized
gttaaacacttgtacgcaaa

SEQ ID NO: 583045 - DNA, 20 bp, Artificial Sequence
  chemically synthesized
aatgggaagggaattttaaa

SEQ ID NO: 583046 - DNA, 20 bp, Artificial Sequence
  chemically synthesized
taccacagaaattaaaagaa

SEQ ID NO: 583047 - DNA, 20 bp, Artificial Sequence
  chemically synthesized
aatggaattccacagagaat

SEQ ID NO: 583048 - DNA, 20 bp, Artificial Sequence
  chemically synthesized
tatcctgtcaaatgctggct

SEQ ID NO: 583049 - DNA, 20 bp, Artificial Sequence
  chemically synthesized
aaggtcttagtgcattaata

SEQ ID NO: 583050 - DNA, 20 bp, Artificial Sequence
  chemically synthesized
tggtctttattatggtttca

SEQ ID NO: 583051 - DNA, 20 bp, Artificial Sequence
  chemically synthesized
atcaatagcgtggtctttat

SEQ ID NO: 583052 - DNA, 20 bp, Artificial Sequence
  chemically synthesized
tatatggattttattctgat

SEQ ID NO: 583053 - DNA, 20 bp, Artificial Sequence
  chemically synthesized
tggttatactcaaatggtta

SEQ ID NO: 583054 - DNA, 20 bp, Artificial Sequence
  chemically synthesized
cagaataaattatttaattc

SEQ ID NO: 583055 - DNA, 20 bp, Artificial Sequence
  chemically synthesized
ctcctgaattaaataattta

SEQ ID NO: 583056 - DNA, 20 bp, Artificial Sequence
  chemically synthesized
attaaataatttattctgat

SEQ ID NO: 583057 - DNA, 20 bp, Artificial Sequence
  chemically synthesized
aataatttattctgatttgg

SEQ ID NO: 583058 - DNA, 20 bp, Artificial Sequence
  chemically synthesized
acactgcttacctcattttg

SEQ ID NO: 583059 - DNA, 20 bp, Artificial Sequence
  chemically synthesized
agaaaacactgcttacctca

SEQ ID NO: 583060 - DNA, 20 bp, Artificial Sequence
  chemically synthesized
actaagcaaaatgaggtaag

SEQ ID NO: 583061 - DNA, 20 bp, Artificial Sequence
  chemically synthesized
agactgaattctgtagaaaa

SEQ ID NO: 583062 - DNA, 20 bp, Artificial Sequence
  chemically synthesized
gaattcagtctaaatctctt

SEQ ID NO: 583063 - DNA, 20 bp, Artificial Sequence
  chemically synthesized
cgtagctctcccaaacaaat

SEQ ID NO: 583064 - DNA, 20 bp, Artificial Sequence
  chemically synthesized
ctcttatttgtttgggagag

SEQ ID NO: 583065 - DNA, 20 bp, Artificial Sequence
  chemically synthesized
aaacacatcactaattattt

SEQ ID NO: 583066 - DNA, 20 bp, Artificial Sequence
  chemically synthesized
aagcagaaaaataattagtg

SEQ ID NO: 583067 - DNA, 20 bp, Artificial Sequence
  chemically synthesized
ttatcatctcctctggtgga

SEQ ID NO: 583068 - DNA, 20 bp, Artificial Sequence
  chemically synthesized
tgattctgatacttatctca

SEQ ID NO: 583069 - DNA, 20 bp, Artificial Sequence
  chemically synthesized
tggtcttgtgaggaaggaaa

SEQ ID NO: 583070 - DNA, 20 bp, Artificial Sequence
  chemically synthesized
gggtctcaatcaaaatttgt

SEQ ID NO: 583071 - DNA, 20 bp, Artificial Sequence
  chemically synthesized
attgtgaaaacaacaacaaa

SEQ ID NO: 583072 - DNA, 20 bp, Artificial Sequence
  chemically synthesized
aacgagattacacttaagga

SEQ ID NO: 583073 - DNA, 20 bp, Artificial Sequence
  chemically synthesized
tatatatatttagagagaga

SEQ ID NO: 583074 - DNA, 20 bp, Artificial Sequence
  chemically synthesized
aatataacagagttatgtaa

SEQ ID NO: 583075 - DNA, 20 bp, Artificial Sequence
  chemically synthesized
agagttatgtaactgtgatt

SEQ ID NO: 583076 - DNA, 20 bp, Artificial Sequence
  chemically synthesized
actgtgatttacagtttcct

SEQ ID NO: 583077 - DNA, 20 bp, Artificial Sequence
  chemically synthesized
ttttttctcactgatgaagt

SEQ ID NO: 583078 - DNA, 20 bp, Artificial Sequence
  chemically synthesized
aatattaaatagtcttaaaa

SEQ ID NO: 583079 - DNA, 20 bp, Artificial Sequence
  chemically synthesized
atcttgtgcaaatatattat

SEQ ID NO: 583080 - DNA, 20 bp, Artificial Sequence
  chemically synthesized
ctctggtgtggatagggaaa

SEQ ID NO: 583081 - DNA, 20 bp, Artificial Sequence
  chemically synthesized
gttctataaattgatagtaa

SEQ ID NO: 583082 - DNA, 20 bp, Artificial Sequence
  chemically synthesized
agtattttaatttatctgaa

SEQ ID NO: 583083 - DNA, 20 bp, Artificial Sequence
  chemically synthesized
cagagcctttcttcttaaaa

SEQ ID NO: 583084 - DNA, 20 bp, Artificial Sequence
  chemically synthesized
gaattcaccaaaaacaatta

SEQ ID NO: 583085 - DNA, 20 bp, Artificial Sequence
  chemically synthesized
gcccattttaaaatcaggtt

SEQ ID NO: 583086 - DNA, 20 bp, Artificial Sequence
  chemically synthesized
taacctgattttaaaatggg

SEQ ID NO: 583087 - DNA, 20 bp, Artificial Sequence
  chemically synthesized
acgatgttgagtatgttttc

SEQ ID NO: 583088 - DNA, 20 bp, Artificial Sequence
  chemically synthesized
ccgatgattgacgatgttga

SEQ ID NO: 583089 - DNA, 20 bp, Artificial Sequence
  chemically synthesized
gttcttcatttgcatttccc

SEQ ID NO: 583090 - DNA, 20 bp, Artificial Sequence
  chemically synthesized
gttgtgaggtaatatctcat

SEQ ID NO: 583091 - DNA, 20 bp, Artificial Sequence
  chemically synthesized
ccttgccagcacatgttatt

SEQ ID NO: 583092 - DNA, 20 bp, Artificial Sequence
  chemically synthesized
caccaacaatgcagaagtgt

SEQ ID NO: 583093 - DNA, 20 bp, Artificial Sequence
  chemically synthesized
cattcccaccaacaatgcag

SEQ ID NO: 583094 - DNA, 20 bp, Artificial Sequence
  chemically synthesized
tatgttttgaggaacttcca

SEQ ID NO: 583095 - DNA, 20 bp, Artificial Sequence
  chemically synthesized
attatatgataattctattt

SEQ ID NO: 583096 - DNA, 20 bp, Artificial Sequence
  chemically synthesized
tctatttttattttttgagg

SEQ ID NO: 583097 - DNA, 20 bp, Artificial Sequence
  chemically synthesized
gtacacccagaaatgggatt

SEQ ID NO: 583098 - DNA, 20 bp, Artificial Sequence
  chemically synthesized
gactaaccgtacacccagaa

SEQ ID NO: 583099 - DNA, 20 bp, Artificial Sequence
  chemically synthesized
atggtttcttaatgaatgca

SEQ ID NO: 583100 - DNA, 20 bp, Artificial Sequence
  chemically synthesized
tcaaaattcaaaatttgaag

SEQ ID NO: 583101 - DNA, 20 bp, Artificial Sequence
  chemically synthesized
ctactatgtactgtgttgca

SEQ ID NO: 583102 - DNA, 20 bp, Artificial Sequence
  chemically synthesized
ctttaaatgttatcagaaca

SEQ ID NO: 583103 - DNA, 20 bp, Artificial Sequence
  chemically synthesized
aagtatgctagactaagcaa

SEQ ID NO: 583104 - DNA, 20 bp, Artificial Sequence
  chemically synthesized
tagactaagcaatgatgttt

SEQ ID NO: 583105 - DNA, 20 bp, Artificial Sequence
  chemically synthesized
atgcctaagctaccaaacat

SEQ ID NO: 583106 - DNA, 20 bp, Artificial Sequence
  chemically synthesized
gatattttcaacttatgatg

SEQ ID NO: 583107 - DNA, 20 bp, Artificial Sequence
  chemically synthesized
cagatgctcattgatttaca

SEQ ID NO: 583108 - DNA, 20 bp, Artificial Sequence
  chemically synthesized
cttttggatatacagatgct

SEQ ID NO: 583109 - DNA, 20 bp, Artificial Sequence
  chemically synthesized
gtgcaaatatctctttaaga

SEQ ID NO: 583110 - DNA, 20 bp, Artificial Sequence
  chemically synthesized
attgaagtaactaaaatgtc

SEQ ID NO: 583111 - DNA, 20 bp, Artificial Sequence
  chemically synthesized
aaaatgtccattgattgata

SEQ ID NO: 583112 - DNA, 20 bp, Artificial Sequence
  chemically synthesized
gtcctataccacatttttta

SEQ ID NO: 583113 - DNA, 20 bp, Artificial Sequence
  chemically synthesized
cacccatgttgtagcatagg

SEQ ID NO: 583114 - DNA, 20 bp, Artificial Sequence
  chemically synthesized
gcagtatttgtcattttatg

SEQ ID NO: 583115 - DNA, 20 bp, Artificial Sequence
  chemically synthesized
gtcataaaatgacaaatact

SEQ ID NO: 583116 - DNA, 20 bp, Artificial Sequence
  chemically synthesized
cactctactttctgtctcta

SEQ ID NO: 583117 - DNA, 20 bp, Artificial Sequence
  chemically synthesized
ggagcaatgggagctcttca

SEQ ID NO: 583118 - DNA, 20 bp, Artificial Sequence
  chemically synthesized
tgggagctcttcagtgggtt

SEQ ID NO: 583119 - DNA, 20 bp, Artificial Sequence
  chemically synthesized
ctcttcagtgggtttggagt

SEQ ID NO: 583120 - DNA, 20 bp, Artificial Sequence
  chemically synthesized
tgttattcaacagatctcta

SEQ ID NO: 583121 - DNA, 20 bp, Artificial Sequence
  chemically synthesized
atgtatgtatagttaacact

SEQ ID NO: 583122 - DNA, 20 bp, Artificial Sequence
  chemically synthesized
acataaaacagttaagctgg

SEQ ID NO: 583123 - DNA, 20 bp, Artificial Sequence
  chemically synthesized
aatacaaactttgccagctt

SEQ ID NO: 583124 - DNA, 20 bp, Artificial Sequence
  chemically synthesized
acccacataatacaaacttt

SEQ ID NO: 583125 - DNA, 20 bp, Artificial Sequence
  chemically synthesized
gctggcaaagtttgtattat

SEQ ID NO: 583126 - DNA, 20 bp, Artificial Sequence
  chemically synthesized
caaagtttgtattatgtggg

SEQ ID NO: 583127 - DNA, 20 bp, Artificial Sequence
  chemically synthesized
gggatacatgtgcagaatgt

SEQ ID NO: 583128 - DNA, 20 bp, Artificial Sequence
  chemically synthesized
cgtaggtatacacgtgccat

SEQ ID NO: 583129 - DNA, 20 bp, Artificial Sequence
  chemically synthesized
gggaacatcacacaccagtt

SEQ ID NO: 583130 - DNA, 20 bp, Artificial Sequence
  chemically synthesized
cacttatgagtgagaacatg

SEQ ID NO: 583131 - DNA, 20 bp, Artificial Sequence
  chemically synthesized
atgagtgagaacatgcggtg

SEQ ID NO: 583132 - DNA, 20 bp, Artificial Sequence
  chemically synthesized
gtttggttttctgttcctgt

SEQ ID NO: 583133 - DNA, 20 bp, Artificial Sequence
  chemically synthesized
tgtgttagtttgctgagaat

SEQ ID NO: 583134 - DNA, 20 bp, Artificial Sequence
  chemically synthesized
gtttgctgagaatgatggtt

SEQ ID NO: 583135 - DNA, 20 bp, Artificial Sequence
  chemically synthesized
cacacgtacgtttgttgcag

SEQ ID NO: 583136 - DNA, 20 bp, Artificial Sequence
  chemically synthesized
ctgtaaagacacatgcacac

SEQ ID NO: 583137 - DNA, 20 bp, Artificial Sequence
  chemically synthesized
gtgcatgtgtctttacagta

SEQ ID NO: 583138 - DNA, 20 bp, Artificial Sequence
  chemically synthesized
ccattactgggtatataccc

SEQ ID NO: 583139 - DNA, 20 bp, Artificial Sequence
  chemically synthesized
aaccattgtggaagaccgtg

SEQ ID NO: 583140 - DNA, 20 bp, Artificial Sequence
  chemically synthesized
gagaggatgtggagaaatag

SEQ ID NO: 583141 - DNA, 20 bp, Artificial Sequence
  chemically synthesized
tccacatcctctccagcatc

SEQ ID NO: 583142 - DNA, 20 bp, Artificial Sequence
  chemically synthesized
gatgtgagatggtatctcat

SEQ ID NO: 583143 - DNA, 20 bp, Artificial Sequence
  chemically synthesized
gagatggtatctcattgcgg

SEQ ID NO: 583144 - DNA, 20 bp, Artificial Sequence
  chemically synthesized
ttctctaatgaccagtgatg

SEQ ID NO: 583145 - DNA, 20 bp, Artificial Sequence
  chemically synthesized
aatgtcttcttttgagaaga

SEQ ID NO: 583146 - DNA, 20 bp, Artificial Sequence
  chemically synthesized
cttcccccactttttgatgg

SEQ ID NO: 583147 - DNA, 20 bp, Artificial Sequence
  chemically synthesized
ccccactttttgatggggtt

SEQ ID NO: 583148 - DNA, 20 bp, Artificial Sequence
  chemically synthesized
tgtttgtttttttcttgtaa

SEQ ID NO: 583149 - DNA, 20 bp, Artificial Sequence
  chemically synthesized
aattcccttttaaaataaaa

SEQ ID NO: 583150 - DNA, 20 bp, Artificial Sequence
  chemically synthesized
taaaattcccttctgagtta

SEQ ID NO: 583151 - DNA, 20 bp, Artificial Sequence
  chemically synthesized
tctgagttaaggagatttaa

SEQ ID NO: 583152 - DNA, 20 bp, Artificial Sequence
  chemically synthesized
attaaggcccagtggaaaat

SEQ ID NO: 583153 - DNA, 20 bp, Artificial Sequence
  chemically synthesized
agtagtgaggacataaaata

SEQ ID NO: 583154 - DNA, 20 bp, Artificial Sequence
  chemically synthesized
tacagagaggcactggcata

SEQ ID NO: 583155 - DNA, 20 bp, Artificial Sequence
  chemically synthesized
cctctctgtagtggatactg

SEQ ID NO: 583156 - DNA, 20 bp, Artificial Sequence
  chemically synthesized
atccacactgcagttgctac

SEQ ID NO: 583157 - DNA, 20 bp, Artificial Sequence
  chemically synthesized
cagtagcaactgcagtgtgg

SEQ ID NO: 583158 - DNA, 20 bp, Artificial Sequence
  chemically synthesized
ccagagatacggtgtcagag

SEQ ID NO: 583159 - DNA, 20 bp, Artificial Sequence
  chemically synthesized
tatctctggtctatttacgt

SEQ ID NO: 583160 - DNA, 20 bp, Artificial Sequence
  chemically synthesized
tctggtctatttacgtaata

SEQ ID NO: 583161 - DNA, 20 bp, Artificial Sequence
  chemically synthesized
gtttttaatacatagaagta

SEQ ID NO: 583162 - DNA, 20 bp, Artificial Sequence
  chemically synthesized
tacaggcatgagccacagcg

SEQ ID NO: 583163 - DNA, 20 bp, Artificial Sequence
  chemically synthesized
ttttgtacttttagtagaga

SEQ ID NO: 583164 - DNA, 20 bp, Artificial Sequence
  chemically synthesized
tgcctcagcctcccaagtag

SEQ ID NO: 583165 - DNA, 20 bp, Artificial Sequence
  chemically synthesized
aacctccacctcttagtttc

SEQ ID NO: 583166 - DNA, 20 bp, Artificial Sequence
  chemically synthesized
gctcactgcaacctccacct

SEQ ID NO: 583167 - DNA, 20 bp, Artificial Sequence
  chemically synthesized
ttatttatttagagaatgat

SEQ ID NO: 583168 - DNA, 20 bp, Artificial Sequence
  chemically synthesized
tttttatttatttatttaga

SEQ ID NO: 583169 - DNA, 20 bp, Artificial Sequence
  chemically synthesized
aaaaatgacaaaaagtatgc

SEQ ID NO: 583170 - DNA, 20 bp, Artificial Sequence
  chemically synthesized
cagaggattgttggcatatt

SEQ ID NO: 583171 - DNA, 20 bp, Artificial Sequence
  chemically synthesized
tgttggcatatttattgttt

SEQ ID NO: 583172 - DNA, 20 bp, Artificial Sequence
  chemically synthesized
tattgtttaagggcttataa

SEQ ID NO: 583173 - DNA, 20 bp, Artificial Sequence
  chemically synthesized
tttacactccttgggtatat

SEQ ID NO: 583174 - DNA, 20 bp, Artificial Sequence
  chemically synthesized
tttcaatgtatcatcagagt

SEQ ID NO: 583175 - DNA, 20 bp, Artificial Sequence
  chemically synthesized
ttcctgtaactaaaagaccc

SEQ ID NO: 583176 - DNA, 20 bp, Artificial Sequence
  chemically synthesized
aaatgtaactgctatcttaa

SEQ ID NO: 583177 - DNA, 20 bp, Artificial Sequence
  chemically synthesized
gtgactgtattgaactaaac

SEQ ID NO: 583178 - DNA, 20 bp, Artificial Sequence
  chemically synthesized
ctgacccagaacgttaaaac

SEQ ID NO: 583179 - DNA, 20 bp, Artificial Sequence
  chemically synthesized
ttccatacctgcaattcata

SEQ ID NO: 583180 - DNA, 20 bp, Artificial Sequence
  chemically synthesized
tagttccactatttcagtta

SEQ ID NO: 583181 - DNA, 20 bp, Artificial Sequence
  chemically synthesized
ctagctacatcaaaatcaat

SEQ ID NO: 583182 - DNA, 20 bp, Artificial Sequence
  chemically synthesized
acaagttaaataaaaacata

SEQ ID NO: 583183 - DNA, 20 bp, Artificial Sequence
  chemically synthesized
tgtcgcacttctgggcatag

SEQ ID NO: 583184 - DNA, 20 bp, Artificial Sequence
  chemically synthesized
aagtgttacctgttttctcc

SEQ ID NO: 583185 - DNA, 20 bp, Artificial Sequence
  chemically synthesized
atttttcctacgtaagtgtt

SEQ ID NO: 583186 - DNA, 20 bp, Artificial Sequence
  chemically synthesized
ggtaacacttacgtaggaaa

SEQ ID NO: 583187 - DNA, 20 bp, Artificial Sequence
  chemically synthesized
aaacaccaaatttttatttg

SEQ ID NO: 583188 - DNA, 20 bp, Artificial Sequence
  chemically synthesized
aagcacaacaaataaaaatt

SEQ ID NO: 583189 - DNA, 20 bp, Artificial Sequence
  chemically synthesized
acaacaaataaaaatttggt

SEQ ID NO: 583190 - DNA, 20 bp, Artificial Sequence
  chemically synthesized
tacgttcaaaaagaatttga

SEQ ID NO: 583191 - DNA, 20 bp, Artificial Sequence
  chemically synthesized
aaaggtaatcataaataaaa

SEQ ID NO: 583192 - DNA, 20 bp, Artificial Sequence
  chemically synthesized
ccactgaaaccatgttttat

SEQ ID NO: 583193 - DNA, 20 bp, Artificial Sequence
  chemically synthesized
cataaataaaacatggtttc

SEQ ID NO: 583194 - DNA, 20 bp, Artificial Sequence
  chemically synthesized
ataatttaaaaccactgaaa

SEQ ID NO: 583195 - DNA, 20 bp, Artificial Sequence
  chemically synthesized
gttcctcagagcattagcat

SEQ ID NO: 583196 - DNA, 20 bp, Artificial Sequence
  chemically synthesized
tcatcaaaaggattaagaca

SEQ ID NO: 583197 - DNA, 20 bp, Artificial Sequence
  chemically synthesized
tgtcttaatccttttgatga

SEQ ID NO: 583198 - DNA, 20 bp, Artificial Sequence
  chemically synthesized
aattttaaacccattcatca

SEQ ID NO: 583199 - DNA, 20 bp, Artificial Sequence
  chemically synthesized
gaaaccatttactgtgggct

SEQ ID NO: 583200 - DNA, 20 bp, Artificial Sequence
  chemically synthesized
aaagctgtgagcccacagta

SEQ ID NO: 583201 - DNA, 20 bp, Artificial Sequence
  chemically synthesized
tgaagtagaaacatatccaa

SEQ ID NO: 583202 - DNA, 20 bp, Artificial Sequence
  chemically synthesized
ttctgaataaacagagttgg

SEQ ID NO: 583203 - DNA, 20 bp, Artificial Sequence
  chemically synthesized
ctgtgaagctgtattattac

SEQ ID NO: 583204 - DNA, 20 bp, Artificial Sequence
  chemically synthesized
taatgaagcaactgtaataa

SEQ ID NO: 583205 - DNA, 20 bp, Artificial Sequence
  chemically synthesized
cttcattatgaacttatttt

SEQ ID NO: 583206 - DNA, 20 bp, Artificial Sequence
  chemically synthesized
attatcttagccctgatctg

SEQ ID NO: 583207 - DNA, 20 bp, Artificial Sequence
  chemically synthesized
aggtttaaatatgatttact

SEQ ID NO: 583208 - DNA, 20 bp, Artificial Sequence
  chemically synthesized
aacaaggtttaaatatgatt

SEQ ID NO: 583209 - DNA, 20 bp, Artificial Sequence
  chemically synthesized
atcagtaaatcatatttaaa

SEQ ID NO: 583210 - DNA, 20 bp, Artificial Sequence
  chemically synthesized
ctagtgtaaacaaggtttaa

SEQ ID NO: 583211 - DNA, 20 bp, Artificial Sequence
  chemically synthesized
ggaaaaagtactagtgtaaa

SEQ ID NO: 583212 - DNA, 20 bp, Artificial Sequence
  chemically synthesized
tagtactttttccatgatgg

SEQ ID NO: 583213 - DNA, 20 bp, Artificial Sequence
  chemically synthesized
ggcgttgttttacataaaat

SEQ ID NO: 583214 - DNA, 20 bp, Artificial Sequence
  chemically synthesized
aatgagtcctaacaaattta

SEQ ID NO: 583215 - DNA, 20 bp, Artificial Sequence
  chemically synthesized
acatatgatctaccctgaag

SEQ ID NO: 583216 - DNA, 20 bp, Artificial Sequence
  chemically synthesized
caataagaatgcattggact

SEQ ID NO: 583217 - DNA, 20 bp, Artificial Sequence
  chemically synthesized
cataaagtccaatgcattct

SEQ ID NO: 583218 - DNA, 20 bp, Artificial Sequence
  chemically synthesized
cattcttattgattttttaa

SEQ ID NO: 583219 - DNA, 20 bp, Artificial Sequence
  chemically synthesized
gtcccctactattattgtac

SEQ ID NO: 583220 - DNA, 20 bp, Artificial Sequence
  chemically synthesized
ctttctttttatcactttat

SEQ ID NO: 583221 - DNA, 20 bp, Artificial Sequence
  chemically synthesized
aatgaccttctttgtgtctt

SEQ ID NO: 583222 - DNA, 20 bp, Artificial Sequence
  chemically synthesized
cttctttgtgtctttttagt

SEQ ID NO: 583223 - DNA, 20 bp, Artificial Sequence
  chemically synthesized
ccatacttctattagacaaa

SEQ ID NO: 583224 - DNA, 20 bp, Artificial Sequence
  chemically synthesized
tatggctatccccattctct

SEQ ID NO: 583225 - DNA, 20 bp, Artificial Sequence
  chemically synthesized
gaagagatagaaaaagatat

SEQ ID NO: 583226 - DNA, 20 bp, Artificial Sequence
  chemically synthesized
ggcagcatgtagttgagtct

SEQ ID NO: 583227 - DNA, 20 bp, Artificial Sequence
  chemically synthesized
gtctaaagatagagtggcca

SEQ ID NO: 583228 - DNA, 20 bp, Artificial Sequence
  chemically synthesized
caatatttactttgaatgta

SEQ ID NO: 583229 - DNA, 20 bp, Artificial Sequence
  chemically synthesized
tttactactgccatttaaaa

SEQ ID NO: 583230 - DNA, 20 bp, Artificial Sequence
  chemically synthesized
catttaaaaagttgttttct

SEQ ID NO: 583231 - DNA, 20 bp, Artificial Sequence
  chemically synthesized
ctttttttgttgtcttcttt

SEQ ID NO: 583232 - DNA, 20 bp, Artificial Sequence
  chemically synthesized
gttgtcttcttttatggttt

SEQ ID NO: 583233 - DNA, 20 bp, Artificial Sequence
  chemically synthesized
ctgttttgctcagtagtata

SEQ ID NO: 583234 - DNA, 20 bp, Artificial Sequence
  chemically synthesized
ttaccttttgtatatctact

SEQ ID NO: 583235 - DNA, 20 bp, Artificial Sequence
  chemically synthesized
tttgtatatctactataggt

SEQ ID NO: 583236 - DNA, 20 bp, Artificial Sequence
  chemically synthesized
aggtttttgcttttgctact

SEQ ID NO: 583237 - DNA, 20 bp, Artificial Sequence
  chemically synthesized
ttgcttttgctactataggt

SEQ ID NO: 583238 - DNA, 20 bp, Artificial Sequence
  chemically synthesized
cttttctttacatcttacgt

SEQ ID NO: 583239 - DNA, 20 bp, Artificial Sequence
  chemically synthesized
gcaatcaaagttaagttatt

SEQ ID NO: 583240 - DNA, 20 bp, Artificial Sequence
  chemically synthesized
ttaagctggtaataacttaa

SEQ ID NO: 583241 - DNA, 20 bp, Artificial Sequence
  chemically synthesized
ttgattgcatacaaaactct

SEQ ID NO: 583242 - DNA, 20 bp, Artificial Sequence
  chemically synthesized
ggattagggaagtaagcgtg

SEQ ID NO: 583243 - DNA, 20 bp, Artificial Sequence
  chemically synthesized
gtgacattgaaattacaaaa

SEQ ID NO: 583244 - DNA, 20 bp, Artificial Sequence
  chemically synthesized
aaaagaactctcacatccca

SEQ ID NO: 583245 - DNA, 20 bp, Artificial Sequence
  chemically synthesized
aattttcaatgaagttatat

SEQ ID NO: 583246 - DNA, 20 bp, Artificial Sequence
  chemically synthesized
ttctactaatgaaaaaaata

SEQ ID NO: 583247 - DNA, 20 bp, Artificial Sequence
  chemically synthesized
aaaataataatccttaaaaa

SEQ ID NO: 583248 - DNA, 20 bp, Artificial Sequence
  chemically synthesized
gaaaaaagaaacatcatttt

SEQ ID NO: 583249 - DNA, 20 bp, Artificial Sequence
  chemically synthesized
gttttaaaataatggattaa

SEQ ID NO: 583250 - DNA, 20 bp, Artificial Sequence
  chemically synthesized
gtatctttttgttttaaaat

SEQ ID NO: 583251 - DNA, 20 bp, Artificial Sequence
  chemically synthesized
aattttctcccttcgtatct

SEQ ID NO: 583252 - DNA, 20 bp, Artificial Sequence
  chemically synthesized
tcaagttatgttacaaaatc

SEQ ID NO: 583253 - DNA, 20 bp, Artificial Sequence
  chemically synthesized
tttaatttcatgcaataagc

SEQ ID NO: 583254 - DNA, 20 bp, Artificial Sequence
  chemically synthesized
taggtttattatttctttta

SEQ ID NO: 583255 - DNA, 20 bp, Artificial Sequence
  chemically synthesized
aggagttaatgttgtttcag

SEQ ID NO: 583256 - DNA, 20 bp, Artificial Sequence
  chemically synthesized
aaaccctagataggagttaa

SEQ ID NO: 583257 - DNA, 20 bp, Artificial Sequence
  chemically synthesized
aaacaacattaactcctatc

SEQ ID NO: 583258 - DNA, 20 bp, Artificial Sequence
  chemically synthesized
ttcctttcctttctgttttc

SEQ ID NO: 583259 - DNA, 20 bp, Artificial Sequence
  chemically synthesized
agatgtataattcctttcct

SEQ ID NO: 583260 - DNA, 20 bp, Artificial Sequence
  chemically synthesized
tttccaccagtatttagtag

SEQ ID NO: 583261 - DNA, 20 bp, Artificial Sequence
  chemically synthesized
tggtggaaactatacatgtg

SEQ ID NO: 583262 - DNA, 20 bp, Artificial Sequence
  chemically synthesized
aattcaaaactatgcacatg

SEQ ID NO: 583263 - DNA, 20 bp, Artificial Sequence
  chemically synthesized
aatgaaaaaagtcactaaag

SEQ ID NO: 583264 - DNA, 20 bp, Artificial Sequence
  chemically synthesized
attagtacaaaagtaggaaa

SEQ ID NO: 583265 - DNA, 20 bp, Artificial Sequence
  chemically synthesized
acttttgtactaattcaaag

SEQ ID NO: 583266 - DNA, 20 bp, Artificial Sequence
  chemically synthesized
tacttaaaaattgttaatca

SEQ ID NO: 583267 - DNA, 20 bp, Artificial Sequence
  chemically synthesized
tacattaggtgttaaaatca

SEQ ID NO: 583268 - DNA, 20 bp, Artificial Sequence
  chemically synthesized
atttccaaagagaaagtagg

SEQ ID NO: 583269 - DNA, 20 bp, Artificial Sequence
  chemically synthesized
cccttcaattccacttttac

SEQ ID NO: 583270 - DNA, 20 bp, Artificial Sequence
  chemically synthesized
aggcccccattgtcaatagg

SEQ ID NO: 583271 - DNA, 20 bp, Artificial Sequence
  chemically synthesized
atgaaaggatccgaacttgt

SEQ ID NO: 583272 - DNA, 20 bp, Artificial Sequence
  chemically synthesized
tattttcaaaaatgatattt

SEQ ID NO: 583273 - DNA, 20 bp, Artificial Sequence
  chemically synthesized
gatattttggtgattagtga

SEQ ID NO: 583274 - DNA, 20 bp, Artificial Sequence
  chemically synthesized
catttttatcataataataa

SEQ ID NO: 583275 - DNA, 20 bp, Artificial Sequence
  chemically synthesized
aaaactaagtttttgatagc

SEQ ID NO: 583276 - DNA, 20 bp, Artificial Sequence
  chemically synthesized
aaaacgtaagctatcaaaaa

SEQ ID NO: 583277 - DNA, 20 bp, Artificial Sequence
  chemically synthesized
gcactgaaaactaagttttt

SEQ ID NO: 583278 - DNA, 20 bp, Artificial Sequence
  chemically synthesized
tattttcatggcactgaaaa

SEQ ID NO: 583279 - DNA, 20 bp, Artificial Sequence
  chemically synthesized
atattaccagatgtagcatc

SEQ ID NO: 583280 - DNA, 20 bp, Artificial Sequence
  chemically synthesized
tctggtaatattaagttggg

SEQ ID NO: 583281 - DNA, 20 bp, Artificial Sequence
  chemically synthesized
ttggtttaattgataaatga

SEQ ID NO: 583282 - DNA, 20 bp, Artificial Sequence
  chemically synthesized
aactattcaaccttttctgc

SEQ ID NO: 583283 - DNA, 20 bp, Artificial Sequence
  chemically synthesized
aaccaaggcagaaaaggttg

SEQ ID NO: 583284 - DNA, 20 bp, Artificial Sequence
  chemically synthesized
tctcttgttggctatggttt

SEQ ID NO: 583285 - DNA, 20 bp, Artificial Sequence
  chemically synthesized
tcatttgatctcttgttggc

SEQ ID NO: 583286 - DNA, 20 bp, Artificial Sequence
  chemically synthesized
gatcaaatgaggactagatc

SEQ ID NO: 583287 - DNA, 20 bp, Artificial Sequence
  chemically synthesized
ccaggcactgttaaaagatc

SEQ ID NO: 583288 - DNA, 20 bp, Artificial Sequence
  chemically synthesized
ccagtgatcttttaacagtg

SEQ ID NO: 583289 - DNA, 20 bp, Artificial Sequence
  chemically synthesized
cctggtttacaatatcatga

SEQ ID NO: 583290 - DNA, 20 bp, Artificial Sequence
  chemically synthesized
ataactttatatctagcatg

SEQ ID NO: 583291 - DNA, 20 bp, Artificial Sequence
  chemically synthesized
atattactgaattcagaata

SEQ ID NO: 583292 - DNA, 20 bp, Artificial Sequence
  chemically synthesized
tcacttaaaaaatgtctact

SEQ ID NO: 583293 - DNA, 20 bp, Artificial Sequence
  chemically synthesized
ttgtgggtaatgcatcactc

SEQ ID NO: 583294 - DNA, 20 bp, Artificial Sequence
  chemically synthesized
cagacaacacttgaggtggt

SEQ ID NO: 583295 - DNA, 20 bp, Artificial Sequence
  chemically synthesized
gtcgtactctttactcttag

SEQ ID NO: 583296 - DNA, 20 bp, Artificial Sequence
  chemically synthesized
tctttactcttagagttgat

SEQ ID NO: 583297 - DNA, 20 bp, Artificial Sequence
  chemically synthesized
ttgtcaaatgattgagatat

SEQ ID NO: 583298 - DNA, 20 bp, Artificial Sequence
  chemically synthesized
ctatgccacaacccattgtc

SEQ ID NO: 583299 - DNA, 20 bp, Artificial Sequence
  chemically synthesized
aagagtactctcgcattcca

SEQ ID NO: 583300 - DNA, 20 bp, Artificial Sequence
  chemically synthesized
agggtgcacagtcagaacta

SEQ ID NO: 583301 - DNA, 20 bp, Artificial Sequence
  chemically synthesized
gtcatataggatttttcaac

SEQ ID NO: 583302 - DNA, 20 bp, Artificial Sequence
  chemically synthesized
caggtattggatatggtcat

SEQ ID NO: 583303 - DNA, 20 bp, Artificial Sequence
  chemically synthesized
tcttccactttacttacaga

SEQ ID NO: 583304 - DNA, 20 bp, Artificial Sequence
  chemically synthesized
acttacagaaagtgatttcc

SEQ ID NO: 583305 - DNA, 20 bp, Artificial Sequence
  chemically synthesized
ggtattacataaagagactg

SEQ ID NO: 583306 - DNA, 20 bp, Artificial Sequence
  chemically synthesized
gtctctttatgtaataccca

SEQ ID NO: 583307 - DNA, 20 bp, Artificial Sequence
  chemically synthesized
ttacaaaataaatttatcct

SEQ ID NO: 583308 - DNA, 20 bp, Artificial Sequence
  chemically synthesized
gttgtcaacaaagacttcac

SEQ ID NO: 583309 - DNA, 20 bp, Artificial Sequence
  chemically synthesized
gtcttctttccaaactccta

SEQ ID NO: 583310 - DNA, 20 bp, Artificial Sequence
  chemically synthesized
tgtaagactgaaatcaacat

SEQ ID NO: 583311 - DNA, 20 bp, Artificial Sequence
  chemically synthesized
gatttacaatgctcaaagga

SEQ ID NO: 583312 - DNA, 20 bp, Artificial Sequence
  chemically synthesized
gcattgtaaatcttagactg

SEQ ID NO: 583313 - DNA, 20 bp, Artificial Sequence
  chemically synthesized
tatatgtaaagcatttcagt

SEQ ID NO: 583314 - DNA, 20 bp, Artificial Sequence
  chemically synthesized
tgctttacatataatttagt

SEQ ID NO: 583315 - DNA, 20 bp, Artificial Sequence
  chemically synthesized
agagtctttgcaaatcaaaa

SEQ ID NO: 583316 - DNA, 20 bp, Artificial Sequence
  chemically synthesized
tcagatcatataaatctgct

SEQ ID NO: 583317 - DNA, 20 bp, Artificial Sequence
  chemically synthesized
aagactatcagatcatataa

SEQ ID NO: 583318 - DNA, 20 bp, Artificial Sequence
  chemically synthesized
gatagtcttacttaggagtt

SEQ ID NO: 583319 - DNA, 20 bp, Artificial Sequence
  chemically synthesized
taagggattcatccctgccc

SEQ ID NO: 583320 - DNA, 20 bp, Artificial Sequence
  chemically synthesized
atgatatgtagtgatttcta

SEQ ID NO: 583321 - DNA, 20 bp, Artificial Sequence
  chemically synthesized
ttctaaaggtccatgatatg

SEQ ID NO: 583322 - DNA, 20 bp, Artificial Sequence
  chemically synthesized
actcatatgaagtgataaaa

SEQ ID NO: 583323 - DNA, 20 bp, Artificial Sequence
  chemically synthesized
ttatcacttcatatgagtta

SEQ ID NO: 583324 - DNA, 20 bp, Artificial Sequence
  chemically synthesized
atgagttatttagcttagga

SEQ ID NO: 583325 - DNA, 20 bp, Artificial Sequence
  chemically synthesized
caatgttttgccatttctta

SEQ ID NO: 583326 - DNA, 20 bp, Artificial Sequence
  chemically synthesized
tttcttagtatatcacatca

SEQ ID NO: 583327 - DNA, 20 bp, Artificial Sequence
  chemically synthesized
actcctttatgtttggaaga

SEQ ID NO: 583328 - DNA, 20 bp, Artificial Sequence
  chemically synthesized
ttgaaaactcctttatgttt

SEQ ID NO: 583329 - DNA, 20 bp, Artificial Sequence
  chemically synthesized
gcaaaatcttccaaacataa

SEQ ID NO: 583330 - DNA, 20 bp, Artificial Sequence
  chemically synthesized
aacatattttgaaaactcct

SEQ ID NO: 583331 - DNA, 20 bp, Artificial Sequence
  chemically synthesized
aataggttcatgaatgagaa

SEQ ID NO: 583332 - DNA, 20 bp, Artificial Sequence
  chemically synthesized
ttatcaaagacacgacagaa

SEQ ID NO: 583333 - DNA, 20 bp, Artificial Sequence
  chemically synthesized
agctattctgttagactaaa

SEQ ID NO: 583334 - DNA, 20 bp, Artificial Sequence
  chemically synthesized
atctgaatttagtctaacag

SEQ ID NO: 583335 - DNA, 20 bp, Artificial Sequence
  chemically synthesized
gaataattactaacttagta

SEQ ID NO: 583336 - DNA, 20 bp, Artificial Sequence
  chemically synthesized
acaaaggggtcagggaaata

SEQ ID NO: 583337 - DNA, 20 bp, Artificial Sequence
  chemically synthesized
tgcactccagttcccacctc

SEQ ID NO: 583338 - DNA, 20 bp, Artificial Sequence
  chemically synthesized
ctcatgcactccagttccca

SEQ ID NO: 583339 - DNA, 20 bp, Artificial Sequence
  chemically synthesized
gagcactgtaacacaccctc

SEQ ID NO: 583340 - DNA, 20 bp, Artificial Sequence
  chemically synthesized
tgttagctctgccatccacg

SEQ ID NO: 583341 - DNA, 20 bp, Artificial Sequence
  chemically synthesized
tgaggtcacatgaacaaatt

SEQ ID NO: 583342 - DNA, 20 bp, Artificial Sequence
  chemically synthesized
aattgaaggattgtaaatgt

SEQ ID NO: 583343 - DNA, 20 bp, Artificial Sequence
  chemically synthesized
gaatccggctggacttcagg

SEQ ID NO: 583344 - DNA, 20 bp, Artificial Sequence
  chemically synthesized
taatcttcccctgaagtcca

SEQ ID NO: 583345 - DNA, 20 bp, Artificial Sequence
  chemically synthesized
aagttgtccctctgaagtca

SEQ ID NO: 583346 - DNA, 20 bp, Artificial Sequence
  chemically synthesized
acagctggacatcagagaga

SEQ ID NO: 583347 - DNA, 20 bp, Artificial Sequence
  chemically synthesized
tcctgtctaccagctgagtc

SEQ ID NO: 583348 - DNA, 20 bp, Artificial Sequence
  chemically synthesized
tggggtggggtggggccatg

SEQ ID NO: 583349 - DNA, 20 bp, Artificial Sequence
  chemically synthesized
ctcaaagtgggaacttatat

SEQ ID NO: 583350 - DNA, 20 bp, Artificial Sequence
  chemically synthesized
tataagttcccactttgagc

SEQ ID NO: 583351 - DNA, 20 bp, Artificial Sequence
  chemically synthesized
tcccactttgagctgcggtt

SEQ ID NO: 583352 - DNA, 20 bp, Artificial Sequence
  chemically synthesized
tgagctgcggtttcaggctt

SEQ ID NO: 583353 - DNA, 20 bp, Artificial Sequence
  chemically synthesized
caggctttttggcttgaggg

SEQ ID NO: 583354 - DNA, 20 bp, Artificial Sequence
  chemically synthesized
gggaccatcccttttctgcc

SEQ ID NO: 583355 - DNA, 20 bp, Artificial Sequence
  chemically synthesized
caggtgctcctcaacgtaca

SEQ ID NO: 583356 - DNA, 20 bp, Artificial Sequence
  chemically synthesized
tatgatgttttcaacgtatg

SEQ ID NO: 583357 - DNA, 20 bp, Artificial Sequence
  chemically synthesized
atgatgggtttttcaattta

SEQ ID NO: 583358 - DNA, 20 bp, Artificial Sequence
  chemically synthesized
tatgatgttttcaacttatg

SEQ ID NO: 583359 - DNA, 20 bp, Artificial Sequence
  chemically synthesized
taaatgcatttttcaattta

SEQ ID NO: 583360 - DNA, 20 bp, Artificial Sequence
  chemically synthesized
aagcaatgatgttcagtagg

SEQ ID NO: 583361 - DNA, 20 bp, Artificial Sequence
  chemically synthesized
aaacctaacctactgaacat

SEQ ID NO: 583362 - DNA, 20 bp, Artificial Sequence
  chemically synthesized
aataaaataggctttgtgtt

SEQ ID NO: 583363 - DNA, 20 bp, Artificial Sequence
  chemically synthesized
tgttcaacacctttaataaa

SEQ ID NO: 583364 - DNA, 20 bp, Artificial Sequence
  chemically synthesized
ttcaagtactcatacaactg

SEQ ID NO: 583365 - DNA, 20 bp, Artificial Sequence
  chemically synthesized
cagttgtatgagtacttgaa

SEQ ID NO: 583366 - DNA, 20 bp, Artificial Sequence
  chemically synthesized
aatgttttgatttacaatgg

SEQ ID NO: 583367 - DNA, 20 bp, Artificial Sequence
  chemically synthesized
ccattgtaaatcaaaacatt

SEQ ID NO: 583368 - DNA, 20 bp, Artificial Sequence
  chemically synthesized
agggtcccaatctaaaaatg

SEQ ID NO: 583369 - DNA, 20 bp, Artificial Sequence
  chemically synthesized
tacagagggtcccaatctaa

SEQ ID NO: 583370 - DNA, 20 bp, Artificial Sequence
  chemically synthesized
tcactgtttaataaaaataa

SEQ ID NO: 583371 - DNA, 20 bp, Artificial Sequence
  chemically synthesized
cctttgttagcacatatgtt

SEQ ID NO: 583372 - DNA, 20 bp, Artificial Sequence
  chemically synthesized
ctgtgtaatacaagggcaag

SEQ ID NO: 583373 - DNA, 20 bp, Artificial Sequence
  chemically synthesized
tgtattacacaggaagtgct

SEQ ID NO: 583374 - DNA, 20 bp, Artificial Sequence
  chemically synthesized
tagcatttaactctaaagag

SEQ ID NO: 583375 - DNA, 20 bp, Artificial Sequence
  chemically synthesized
tagagttaaatgctaagaaa

SEQ ID NO: 583376 - DNA, 20 bp, Artificial Sequence
  chemically synthesized
tagattggtataggttacat

SEQ ID NO: 583377 - DNA, 20 bp, Artificial Sequence
  chemically synthesized
gtagtctcagataatacaat

SEQ ID NO: 583378 - DNA, 20 bp, Artificial Sequence
  chemically synthesized
tgagactacagcacagttgg

SEQ ID NO: 583379 - DNA, 20 bp, Artificial Sequence
  chemically synthesized
tttaacaccacttcccttac

SEQ ID NO: 583380 - DNA, 20 bp, Artificial Sequence
  chemically synthesized
ggtaagggaagtggtgttaa

SEQ ID NO: 583381 - DNA, 20 bp, Artificial Sequence
  chemically synthesized
gaagtggtgttaaaattgat

SEQ ID NO: 583382 - DNA, 20 bp, Artificial Sequence
  chemically synthesized
gtgggctttattaatgatgc

SEQ ID NO: 583383 - DNA, 20 bp, Artificial Sequence
  chemically synthesized
gagcaataagtccaagtaga

SEQ ID NO: 583384 - DNA, 20 bp, Artificial Sequence
  chemically synthesized
tattgggtcctgaattttga

SEQ ID NO: 583385 - DNA, 20 bp, Artificial Sequence
  chemically synthesized
catcccgatcacagccccag

SEQ ID NO: 583386 - DNA, 20 bp, Artificial Sequence
  chemically synthesized
cattcctggggctgtgatcg

SEQ ID NO: 583387 - DNA, 20 bp, Artificial Sequence
  chemically synthesized
aaaagtggatgtgaccaggg

SEQ ID NO: 583388 - DNA, 20 bp, Artificial Sequence
  chemically synthesized
atgtgaccagggaatggctt

SEQ ID NO: 583389 - DNA, 20 bp, Artificial Sequence
  chemically synthesized
ctattaaaagattcttcagc

SEQ ID NO: 583390 - DNA, 20 bp, Artificial Sequence
  chemically synthesized
cagcagctgaagaatctttt

SEQ ID NO: 583391 - DNA, 20 bp, Artificial Sequence
  chemically synthesized
gaaaaagtgcctaaactatt

SEQ ID NO: 583392 - DNA, 20 bp, Artificial Sequence
  chemically synthesized
actttttctaaatccttcag

SEQ ID NO: 583393 - DNA, 20 bp, Artificial Sequence
  chemically synthesized
ttaatcggtgaagcataact

SEQ ID NO: 583394 - DNA, 20 bp, Artificial Sequence
  chemically synthesized
taaatccttcagttatgctt

SEQ ID NO: 583395 - DNA, 20 bp, Artificial Sequence
  chemically synthesized
catattttagatgtgagtga

SEQ ID NO: 583396 - DNA, 20 bp, Artificial Sequence
  chemically synthesized
caagaaaccatgaacaatga

SEQ ID NO: 583397 - DNA, 20 bp, Artificial Sequence
  chemically synthesized
ttgaaatcattttcattgtt

SEQ ID NO: 583398 - DNA, 20 bp, Artificial Sequence
  chemically synthesized
cattttcattgttcatggtt

SEQ ID NO: 583399 - DNA, 20 bp, Artificial Sequence
  chemically synthesized
agagattatctcagcgtcct

SEQ ID NO: 583400 - DNA, 20 bp, Artificial Sequence
  chemically synthesized
gtttctgcagacctaataaa

SEQ ID NO: 583401 - DNA, 20 bp, Artificial Sequence
  chemically synthesized
tattcagcatttggtgtatt

SEQ ID NO: 583402 - DNA, 20 bp, Artificial Sequence
  chemically synthesized
taaaaaaaaaaaaaagagga

SEQ ID NO: 583403 - DNA, 20 bp, Artificial Sequence
  chemically synthesized
tttttttttaagttgagcta

SEQ ID NO: 583404 - DNA, 20 bp, Artificial Sequence
  chemically synthesized
ccaattaatgttgttaaacc

SEQ ID NO: 583405 - DNA, 20 bp, Artificial Sequence
  chemically synthesized
ctctggccattttttaaaca

SEQ ID NO: 583406 - DNA, 20 bp, Artificial Sequence
  chemically synthesized
caattgtttaaaaaatggcc

SEQ ID NO: 583407 - DNA, 20 bp, Artificial Sequence
  chemically synthesized
aaaaatggccagaggcttct

SEQ ID NO: 583408 - DNA, 20 bp, Artificial Sequence
  chemically synthesized
gcttttagatggaggccaag

SEQ ID NO: 583409 - DNA, 20 bp, Artificial Sequence
  chemically synthesized
attgggaggctcttcctaaa

SEQ ID NO: 583410 - DNA, 20 bp, Artificial Sequence
  chemically synthesized
aatgtgaatgactaaattgt

SEQ ID NO: 583411 - DNA, 20 bp, Artificial Sequence
  chemically synthesized
aaaaatacttctcgttgtca

SEQ ID NO: 583412 - DNA, 20 bp, Artificial Sequence
  chemically synthesized
tcgttgtcatttagtttata

SEQ ID NO: 583413 - DNA, 20 bp, Artificial Sequence
  chemically synthesized
ccaatggagtgaatattgtt

SEQ ID NO: 583414 - DNA, 20 bp, Artificial Sequence
  chemically synthesized
tagggatatctttgaatgga

SEQ ID NO: 583415 - DNA, 20 bp, Artificial Sequence
  chemically synthesized
tccctacacccactctgaaa

SEQ ID NO: 583416 - DNA, 20 bp, Artificial Sequence
  chemically synthesized
taggagaattccaattgtct

SEQ ID NO: 583417 - DNA, 20 bp, Artificial Sequence
  chemically synthesized
aatccatctccagaactgag

SEQ ID NO: 583418 - DNA, 20 bp, Artificial Sequence
  chemically synthesized
aatccatcctcagttctgga

SEQ ID NO: 583419 - DNA, 20 bp, Artificial Sequence
  chemically synthesized
tcctcagttctggagatgga

SEQ ID NO: 583420 - DNA, 20 bp, Artificial Sequence
  chemically synthesized
ggatttagattcacctaaat

SEQ ID NO: 583421 - DNA, 20 bp, Artificial Sequence
  chemically synthesized
tatcttgactggcttagaat

SEQ ID NO: 583422 - DNA, 20 bp, Artificial Sequence
  chemically synthesized
aagaggatgagattatcttg

SEQ ID NO: 583423 - DNA, 20 bp, Artificial Sequence
  chemically synthesized
tttcttcctgaaccaagagg

SEQ ID NO: 583424 - DNA, 20 bp, Artificial Sequence
  chemically synthesized
catcctcttggttcaggaag

SEQ ID NO: 583425 - DNA, 20 bp, Artificial Sequence
  chemically synthesized
aggaagaaaagtttaaatca

SEQ ID NO: 583426 - DNA, 20 bp, Artificial Sequence
  chemically synthesized
tcagaatggtttcataagct

SEQ ID NO: 583427 - DNA, 20 bp, Artificial Sequence
  chemically synthesized
ttgtactaaagatgattcag

SEQ ID NO: 583428 - DNA, 20 bp, Artificial Sequence
  chemically synthesized
tatatctactattgtactaa

SEQ ID NO: 583429 - DNA, 20 bp, Artificial Sequence
  chemically synthesized
cagtagatacacaattaaaa

SEQ ID NO: 583430 - DNA, 20 bp, Artificial Sequence
  chemically synthesized
aaacacttacctcacagatt

SEQ ID NO: 583431 - DNA, 20 bp, Artificial Sequence
  chemically synthesized
aatctctgaatctgtgaggt

SEQ ID NO: 583432 - DNA, 20 bp, Artificial Sequence
  chemically synthesized
agagacataaacacttacct

SEQ ID NO: 583433 - DNA, 20 bp, Artificial Sequence
  chemically synthesized
gtcctgatttttttctctgc

SEQ ID NO: 583434 - DNA, 20 bp, Artificial Sequence
  chemically synthesized
tttctctatgactttctttg

SEQ ID NO: 583435 - DNA, 20 bp, Artificial Sequence
  chemically synthesized
atagagaaagagtgacagag

SEQ ID NO: 583436 - DNA, 20 bp, Artificial Sequence
  chemically synthesized
ctgcttgtacttcatctgga

SEQ ID NO: 583437 - DNA, 20 bp, Artificial Sequence
  chemically synthesized
gaaagagaatgcactttcaa

SEQ ID NO: 583438 - DNA, 20 bp, Artificial Sequence
  chemically synthesized
ggtgacatatttaatagtta

SEQ ID NO: 583439 - DNA, 20 bp, Artificial Sequence
  chemically synthesized
gcaagtatcataatatttta

SEQ ID NO: 583440 - DNA, 20 bp, Artificial Sequence
  chemically synthesized
ttagtcctccaggggaatgc

SEQ ID NO: 583441 - DNA, 20 bp, Artificial Sequence
  chemically synthesized
ggtaaacttaccattacatt

SEQ ID NO: 583442 - DNA, 20 bp, Artificial Sequence
  chemically synthesized
tataaactgagaatgtaatg

SEQ ID NO: 583443 - DNA, 20 bp, Artificial Sequence
  chemically synthesized
taaagtataaaggcagcaat

SEQ ID NO: 583444 - DNA, 20 bp, Artificial Sequence
  chemically synthesized
ttggtgattagggagttaca

SEQ ID NO: 583445 - DNA, 20 bp, Artificial Sequence
  chemically synthesized
gttacaaatagtttagtatt

SEQ ID NO: 583446 - DNA, 20 bp, Artificial Sequence
  chemically synthesized
gcttggtacacaaggccgtt

SEQ ID NO: 583447 - DNA, 20 bp, Artificial Sequence
  chemically synthesized
ttgtgtaccaagctgaaaaa

SEQ ID NO: 583448 - DNA, 20 bp, Artificial Sequence
  chemically synthesized
ctaggataaaagctaaattt

SEQ ID NO: 583449 - DNA, 20 bp, Artificial Sequence
  chemically synthesized
atacaacctttactaataca

SEQ ID NO: 583450 - DNA, 20 bp, Artificial Sequence
  chemically synthesized
atgattggcatgttaaaaag

SEQ ID NO: 583451 - DNA, 20 bp, Artificial Sequence
  chemically synthesized
atgttaaaaagtgtagtttt

SEQ ID NO: 583452 - DNA, 20 bp, Artificial Sequence
  chemically synthesized
agagacagaaaaactagtga

SEQ ID NO: 583453 - DNA, 20 bp, Artificial Sequence
  chemically synthesized
atcttctacaaaacctcttc

SEQ ID NO: 583454 - DNA, 20 bp, Artificial Sequence
  chemically synthesized
tctcttatttagcactgcaa

SEQ ID NO: 583455 - DNA, 20 bp, Artificial Sequence
  chemically synthesized
taaataagagataagaaatt

SEQ ID NO: 583456 - DNA, 20 bp, Artificial Sequence
  chemically synthesized
tttcgatcttgttaagacaa

SEQ ID NO: 583457 - DNA, 20 bp, Artificial Sequence
  chemically synthesized
tatttgtcttaacaagatcg

SEQ ID NO: 583458 - DNA, 20 bp, Artificial Sequence
  chemically synthesized
aaaggattggtaatttatcg

SEQ ID NO: 583459 - DNA, 20 bp, Artificial Sequence
  chemically synthesized
aagaaagtgccagaaaaact

SEQ ID NO: 583460 - DNA, 20 bp, Artificial Sequence
  chemically synthesized
actggccatgttaaaaatca

SEQ ID NO: 583461 - DNA, 20 bp, Artificial Sequence
  chemically synthesized
atttttaacatggccagtcc

SEQ ID NO: 583462 - DNA, 20 bp, Artificial Sequence
  chemically synthesized
atagggaatatagtaagagg

SEQ ID NO: 583463 - DNA, 20 bp, Artificial Sequence
  chemically synthesized
tacctgtggaacatctacgt

SEQ ID NO: 583464 - DNA, 20 bp, Artificial Sequence
  chemically synthesized
gcttgtcagcaggtgaaaat

SEQ ID NO: 583465 - DNA, 20 bp, Artificial Sequence
  chemically synthesized
tgccaatgattatctctagt

SEQ ID NO: 583466 - DNA, 20 bp, Artificial Sequence
  chemically synthesized
gaactagagataatcattgg

SEQ ID NO: 583467 - DNA, 20 bp, Artificial Sequence
  chemically synthesized
taagactactgaaactatgc

SEQ ID NO: 583468 - DNA, 20 bp, Artificial Sequence
  chemically synthesized
atagtttcagtagtcttaat

SEQ ID NO: 583469 - DNA, 20 bp, Artificial Sequence
  chemically synthesized
aattccatttattagagaat

SEQ ID NO: 583470 - DNA, 20 bp, Artificial Sequence
  chemically synthesized
attgaggatcaaatttcaac

SEQ ID NO: 583471 - DNA, 20 bp, Artificial Sequence
  chemically synthesized
ttgatcctcaatattggagg

SEQ ID NO: 583472 - DNA, 20 bp, Artificial Sequence
  chemically synthesized
atgggggtggatccttcttg

SEQ ID NO: 583473 - DNA, 20 bp, Artificial Sequence
  chemically synthesized
cctggcacttcccctctctc

SEQ ID NO: 583474 - DNA, 20 bp, Artificial Sequence
  chemically synthesized
accaacttctcatgagggcc

SEQ ID NO: 583475 - DNA, 20 bp, Artificial Sequence
  chemically synthesized
atgagaagttggtagtggtg

SEQ ID NO: 583476 - DNA, 20 bp, Artificial Sequence
  chemically synthesized
tgggcaatttataaagaatg

SEQ ID NO: 583477 - DNA, 20 bp, Artificial Sequence
  chemically synthesized
atggtaaattttccgttatg

SEQ ID NO: 583478 - DNA, 20 bp, Artificial Sequence
  chemically synthesized
tgctctatggccagcatctt

SEQ ID NO: 583479 - DNA, 20 bp, Artificial Sequence
  chemically synthesized
gtcacttccaaccatttcta

SEQ ID NO: 583480 - DNA, 20 bp, Artificial Sequence
  chemically synthesized
ttgcacattctctggtttgg

SEQ ID NO: 583481 - DNA, 20 bp, Artificial Sequence
  chemically synthesized
tgagattgcacattctctgg

SEQ ID NO: 583482 - DNA, 20 bp, Artificial Sequence
  chemically synthesized
gtttctgagattgcacattc

SEQ ID NO: 583483 - DNA, 20 bp, Artificial Sequence
  chemically synthesized
attctctattgtgttagttt

SEQ ID NO: 583484 - DNA, 20 bp, Artificial Sequence
  chemically synthesized
caatttaaattctctattgt

SEQ ID NO: 583485 - DNA, 20 bp, Artificial Sequence
  chemically synthesized
actatttaaaggcactgagg

SEQ ID NO: 583486 - DNA, 20 bp, Artificial Sequence
  chemically synthesized
tggacaagattttatttatt

SEQ ID NO: 583487 - DNA, 20 bp, Artificial Sequence
  chemically synthesized
taataaataaaatcttgtcc

SEQ ID NO: 583488 - DNA, 20 bp, Artificial Sequence
  chemically synthesized
aattagtattaatctactgg

SEQ ID NO: 583489 - DNA, 20 bp, Artificial Sequence
  chemically synthesized
ctaacattcttggtaaatat

SEQ ID NO: 583490 - DNA, 20 bp, Artificial Sequence
  chemically synthesized
actctgtctttcttactata

SEQ ID NO: 583491 - DNA, 20 bp, Artificial Sequence
  chemically synthesized
ttctactctgtctttcttac

SEQ ID NO: 583492 - DNA, 20 bp, Artificial Sequence
  chemically synthesized
atagtaagaaagacagagta

SEQ ID NO: 583493 - DNA, 20 bp, Artificial Sequence
  chemically synthesized
gagtagaaagttttcaagtc

SEQ ID NO: 583494 - DNA, 20 bp, Artificial Sequence
  chemically synthesized
tccttaatatatttatctac

SEQ ID NO: 583495 - DNA, 20 bp, Artificial Sequence
  chemically synthesized
tatattaaggaatttggagt

SEQ ID NO: 583496 - DNA, 20 bp, Artificial Sequence
  chemically synthesized
ctttatatgtcccttatctc

SEQ ID NO: 583497 - DNA, 20 bp, Artificial Sequence
  chemically synthesized
aagtgaaatataaagaacca

SEQ ID NO: 583498 - DNA, 20 bp, Artificial Sequence
  chemically synthesized
gtaagaattggaagtgacca

SEQ ID NO: 583499 - DNA, 20 bp, Artificial Sequence
  chemically synthesized
agctcctctcactgaagatt

SEQ ID NO: 583500 - DNA, 20 bp, Artificial Sequence
  chemically synthesized
ctgtcttcagctcctctcac

SEQ ID NO: 583501 - DNA, 20 bp, Artificial Sequence
  chemically synthesized
tttttgttctcaaacaatat

SEQ ID NO: 583502 - DNA, 20 bp, Artificial Sequence
  chemically synthesized
ctataaaagaaaagcaaaaa

SEQ ID NO: 583503 - DNA, 20 bp, Artificial Sequence
  chemically synthesized
cttcaaaagtattagttttc

SEQ ID NO: 583504 - DNA, 20 bp, Artificial Sequence
  chemically synthesized
actgtatgagcttcaaaagt

SEQ ID NO: 583505 - DNA, 20 bp, Artificial Sequence
  chemically synthesized
actaatacttttgaagctca

SEQ ID NO: 583506 - DNA, 20 bp, Artificial Sequence
  chemically synthesized
acttctagaacaaaaactgt

SEQ ID NO: 583507 - DNA, 20 bp, Artificial Sequence
  chemically synthesized
gctcatacagtttttgttct

SEQ ID NO: 583508 - DNA, 20 bp, Artificial Sequence
  chemically synthesized
caacctcctgctgtctcgtt

SEQ ID NO: 583509 - DNA, 20 bp, Artificial Sequence
  chemically synthesized
ctttcaacctcctgctgtct

SEQ ID NO: 583510 - DNA, 20 bp, Artificial Sequence
  chemically synthesized
cttttcattgattttgatgt

SEQ ID NO: 583511 - DNA, 20 bp, Artificial Sequence
  chemically synthesized
acaagactggagccactttt

SEQ ID NO: 583512 - DNA, 20 bp, Artificial Sequence
  chemically synthesized
tttattcctctttatttccc

SEQ ID NO: 583513 - DNA, 20 bp, Artificial Sequence
  chemically synthesized
ttggatcattttgccaactt

SEQ ID NO: 583514 - DNA, 20 bp, Artificial Sequence
  chemically synthesized
tcaaatgattctcagtccag

SEQ ID NO: 583515 - DNA, 20 bp, Artificial Sequence
  chemically synthesized
ctcccagagtgtctgttgtc

SEQ ID NO: 583516 - DNA, 20 bp, Artificial Sequence
  chemically synthesized
aaatatacatttaacatcat

SEQ ID NO: 583517 - DNA, 20 bp, Artificial Sequence
  chemically synthesized
ttacttttttcctggctctg

SEQ ID NO: 583518 - DNA, 20 bp, Artificial Sequence
  chemically synthesized
ctctcttacttttttcctgg

SEQ ID NO: 583519 - DNA, 20 bp, Artificial Sequence
  chemically synthesized
accttcataatgagctaagg

SEQ ID NO: 583520 - DNA, 20 bp, Artificial Sequence
  chemically synthesized
actagcccttagctcattat

SEQ ID NO: 583521 - DNA, 20 bp, Artificial Sequence
  chemically synthesized
aaatttccttagctccccta

SEQ ID NO: 583522 - DNA, 20 bp, Artificial Sequence
  chemically synthesized
ctttgtctctggaacaagat

SEQ ID NO: 583523 - DNA, 20 bp, Artificial Sequence
  chemically synthesized
tttcactcccctttggtact

SEQ ID NO: 583524 - DNA, 20 bp, Artificial Sequence
  chemically synthesized
cgtaattatcttgtgtaact

SEQ ID NO: 583525 - DNA, 20 bp, Artificial Sequence
  chemically synthesized
gatttctatattgaacaata

SEQ ID NO: 583526 - DNA, 20 bp, Artificial Sequence
  chemically synthesized
cctcattcattcccaggtaa

SEQ ID NO: 583527 - DNA, 20 bp, Artificial Sequence
  chemically synthesized
atacaaccaacatcccctct

SEQ ID NO: 583528 - DNA, 20 bp, Artificial Sequence
  chemically synthesized
actgggtaatttatgaagaa

SEQ ID NO: 583529 - DNA, 20 bp, Artificial Sequence
  chemically synthesized
tttatgaagaaaacagtttt

SEQ ID NO: 583530 - DNA, 20 bp, Artificial Sequence
  chemically synthesized
cagaatggtgaatcaattaa

SEQ ID NO: 583531 - DNA, 20 bp, Artificial Sequence
  chemically synthesized
aggtgccttctgccatgatt

SEQ ID NO: 583532 - DNA, 20 bp, Artificial Sequence
  chemically synthesized
ctgtgaagaggtgccttctg

SEQ ID NO: 583533 - DNA, 20 bp, Artificial Sequence
  chemically synthesized
ctgatggttttataagtgtc

SEQ ID NO: 583534 - DNA, 20 bp, Artificial Sequence
  chemically synthesized
ggtgatttcacatgagatct

SEQ ID NO: 583535 - DNA, 20 bp, Artificial Sequence
  chemically synthesized
catgctattctcatgatagt

SEQ ID NO: 583536 - DNA, 20 bp, Artificial Sequence
  chemically synthesized
tagcatgggggaaactgcct

SEQ ID NO: 583537 - DNA, 20 bp, Artificial Sequence
  chemically synthesized
agaggtaattgaatcatgga

SEQ ID NO: 583538 - DNA, 20 bp, Artificial Sequence
  chemically synthesized
tgggtccctcccatgacacc

SEQ ID NO: 583539 - DNA, 20 bp, Artificial Sequence
  chemically synthesized
cccatgacacctggggattt

SEQ ID NO: 583540 - DNA, 20 bp, Artificial Sequence
  chemically synthesized
tttggagattacaattcaag

SEQ ID NO: 583541 - DNA, 20 bp, Artificial Sequence
  chemically synthesized
gaggggccaggagcagaatg

SEQ ID NO: 583542 - DNA, 20 bp, Artificial Sequence
  chemically synthesized
gtgttttgaaatgtgatgac

SEQ ID NO: 583543 - DNA, 20 bp, Artificial Sequence
  chemically synthesized
tgactgttgggaaggcatta

SEQ ID NO: 583544 - DNA, 20 bp, Artificial Sequence
  chemically synthesized
ttaacccaaaagtccaagtc

SEQ ID NO: 583545 - DNA, 20 bp, Artificial Sequence
  chemically synthesized
caggctcataggcggatggg

SEQ ID NO: 583546 - DNA, 20 bp, Artificial Sequence
  chemically synthesized
cctggaagtaactaacttgt

SEQ ID NO: 583547 - DNA, 20 bp, Artificial Sequence
  chemically synthesized
ttgtatcctggaagtaacta

SEQ ID NO: 583548 - DNA, 20 bp, Artificial Sequence
  chemically synthesized
caaagtgtaatgactgccct

SEQ ID NO: 583549 - DNA, 20 bp, Artificial Sequence
  chemically synthesized
gccttgggcagctctgccct

SEQ ID NO: 583550 - DNA, 20 bp, Artificial Sequence
  chemically synthesized
catggctagcactgagtatc

SEQ ID NO: 583551 - DNA, 20 bp, Artificial Sequence
  chemically synthesized
ccagaatagtcagaaatgct

SEQ ID NO: 583552 - DNA, 20 bp, Artificial Sequence
  chemically synthesized
atcagcatttctgactattc

SEQ ID NO: 583553 - DNA, 20 bp, Artificial Sequence
  chemically synthesized
cttctgcactgtcccagcag

SEQ ID NO: 583554 - DNA, 20 bp, Artificial Sequence
  chemically synthesized
aaaagcctaggtgtccaggc

SEQ ID NO: 583555 - DNA, 20 bp, Artificial Sequence
  chemically synthesized
gcaaacttctgcctggacac

SEQ ID NO: 583556 - DNA, 20 bp, Artificial Sequence
  chemically synthesized
gttggacagaagtcaagaat

SEQ ID NO: 583557 - DNA, 20 bp, Artificial Sequence
  chemically synthesized
cttcagagggtgcaggcctt

SEQ ID NO: 583558 - DNA, 20 bp, Artificial Sequence
  chemically synthesized
agccaaagtacagctcaggc

SEQ ID NO: 583559 - DNA, 20 bp, Artificial Sequence
  chemically synthesized
agcaacagcctgagctgtac

SEQ ID NO: 583560 - DNA, 20 bp, Artificial Sequence
  chemically synthesized
acgggccaggcacagggccg

SEQ ID NO: 583561 - DNA, 20 bp, Artificial Sequence
  chemically synthesized
cctgtgcctggcccgtgaaa

SEQ ID NO: 583562 - DNA, 20 bp, Artificial Sequence
  chemically synthesized
ccagaggcctaaaaggaaaa

SEQ ID NO: 583563 - DNA, 20 bp, Artificial Sequence
  chemically synthesized
catgttttccttttaggcct

SEQ ID NO: 583564 - DNA, 20 bp, Artificial Sequence
  chemically synthesized
agacatcttccccattgtct

SEQ ID NO: 583565 - DNA, 20 bp, Artificial Sequence
  chemically synthesized
tacttaagcaaagttctgca

SEQ ID NO: 583566 - DNA, 20 bp, Artificial Sequence
  chemically synthesized
aatacaagctggctgcagaa

SEQ ID NO: 583567 - DNA, 20 bp, Artificial Sequence
  chemically synthesized
cagcttgtatttctcagaaa

SEQ ID NO: 583568 - DNA, 20 bp, Artificial Sequence
  chemically synthesized
tttctatcacattgttaggc

SEQ ID NO: 583569 - DNA, 20 bp, Artificial Sequence
  chemically synthesized
agattttccaaactttgatg

SEQ ID NO: 583570 - DNA, 20 bp, Artificial Sequence
  chemically synthesized
tttaaagggaagcagagcat

SEQ ID NO: 583571 - DNA, 20 bp, Artificial Sequence
  chemically synthesized
gagatgatctgaaattggaa

SEQ ID NO: 583572 - DNA, 20 bp, Artificial Sequence
  chemically synthesized
aatgctgccagtctctttgc

SEQ ID NO: 583573 - DNA, 20 bp, Artificial Sequence
  chemically synthesized
tggagcaaaggacactgttg

SEQ ID NO: 583574 - DNA, 20 bp, Artificial Sequence
  chemically synthesized
caggctgaggtggtctcaga

SEQ ID NO: 583575 - DNA, 20 bp, Artificial Sequence
  chemically synthesized
aacttcctagagacttgttg

SEQ ID NO: 583576 - DNA, 20 bp, Artificial Sequence
  chemically synthesized
aaccattcaacaagtctcta

SEQ ID NO: 583577 - DNA, 20 bp, Artificial Sequence
  chemically synthesized
gggtaagaggcacaggttgg

SEQ ID NO: 583578 - DNA, 20 bp, Artificial Sequence
  chemically synthesized
ccgggtaatttataaagaaa

SEQ ID NO: 583579 - DNA, 20 bp, Artificial Sequence
  chemically synthesized
ttaatagactcacagttccg

SEQ ID NO: 583580 - DNA, 20 bp, Artificial Sequence
  chemically synthesized
aggtgccttcctccatgatt

SEQ ID NO: 583581 - DNA, 20 bp, Artificial Sequence
  chemically synthesized
ctgtgaaaaggtgccttcct

SEQ ID NO: 583582 - DNA, 20 bp, Artificial Sequence
  chemically synthesized
gtgccagcaagggaaatgcc

SEQ ID NO: 583583 - DNA, 20 bp, Artificial Sequence
  chemically synthesized
aatgagttctcatgagatct

SEQ ID NO: 583584 - DNA, 20 bp, Artificial Sequence
  chemically synthesized
cagcatggggggaaacaaac

SEQ ID NO: 583585 - DNA, 20 bp, Artificial Sequence
  chemically synthesized
gggaagtaattgaatcatgg

SEQ ID NO: 583586 - DNA, 20 bp, Artificial Sequence
  chemically synthesized
cagggggaagtaattgaatc

SEQ ID NO: 583587 - DNA, 20 bp, Artificial Sequence
  chemically synthesized
cccacaacacatgggaatta

SEQ ID NO: 583588 - DNA, 20 bp, Artificial Sequence
  chemically synthesized
tacagggattacaattcaag

SEQ ID NO: 583589 - DNA, 20 bp, Artificial Sequence
  chemically synthesized
ttgtgccctttgaccaatga

SEQ ID NO: 583590 - DNA, 20 bp, Artificial Sequence
  chemically synthesized
tccccagacatcttataact

SEQ ID NO: 583591 - DNA, 20 bp, Artificial Sequence
  chemically synthesized
tactatagttaataatactt

SEQ ID NO: 583592 - DNA, 20 bp, Artificial Sequence
  chemically synthesized
tgtgctagatgtattaatta

SEQ ID NO: 583593 - DNA, 20 bp, Artificial Sequence
  chemically synthesized
ttttatatgactatattgtg

SEQ ID NO: 583594 - DNA, 20 bp, Artificial Sequence
  chemically synthesized
tgtattcaaggtatacaaca

SEQ ID NO: 583595 - DNA, 20 bp, Artificial Sequence
  chemically synthesized
tgttgtataccttgaataca

SEQ ID NO: 583596 - DNA, 20 bp, Artificial Sequence
  chemically synthesized
catactctgcctcctcctta

SEQ ID NO: 583597 - DNA, 20 bp, Artificial Sequence
  chemically synthesized
gttgttccccctactcaatt

SEQ ID NO: 583598 - DNA, 20 bp, Artificial Sequence
  chemically synthesized
aaattgtcccacaaataaat

SEQ ID NO: 583599 - DNA, 20 bp, Artificial Sequence
  chemically synthesized
aatagtgccatttacactaa

SEQ ID NO: 583600 - DNA, 20 bp, Artificial Sequence
  chemically synthesized
gccattgcacatattggtct

SEQ ID NO: 583601 - DNA, 20 bp, Artificial Sequence
  chemically synthesized
tcagagagaccaatatgtgc

SEQ ID NO: 583602 - DNA, 20 bp, Artificial Sequence
  chemically synthesized
tgcttatgaaagtgcttatt

SEQ ID NO: 583603 - DNA, 20 bp, Artificial Sequence
  chemically synthesized
tagttttgttttgcttatga

SEQ ID NO: 583604 - DNA, 20 bp, Artificial Sequence
  chemically synthesized
tgacctccctcctagttttg

SEQ ID NO: 583605 - DNA, 20 bp, Artificial Sequence
  chemically synthesized
cacattgacctccctcctag

SEQ ID NO: 583606 - DNA, 20 bp, Artificial Sequence
  chemically synthesized
atctccacattgacctccct

SEQ ID NO: 583607 - DNA, 20 bp, Artificial Sequence
  chemically synthesized
aaatttgatgacagacagaa

SEQ ID NO: 583608 - DNA, 20 bp, Artificial Sequence
  chemically synthesized
ggagagaagaaatgaatgag

SEQ ID NO: 583609 - DNA, 20 bp, Artificial Sequence
  chemically synthesized
aagaaatgaatgaggagaga

SEQ ID NO: 583610 - DNA, 20 bp, Artificial Sequence
  chemically synthesized
ctctgaggcaatgacataaa

SEQ ID NO: 583611 - DNA, 20 bp, Artificial Sequence
  chemically synthesized
tcttgatttgcctagagaaa

SEQ ID NO: 583612 - DNA, 20 bp, Artificial Sequence
  chemically synthesized
ttatattaggatgatcatag

SEQ ID NO: 583613 - DNA, 20 bp, Artificial Sequence
  chemically synthesized
aacagtccaggaaagagatg

SEQ ID NO: 583614 - DNA, 20 bp, Artificial Sequence
  chemically synthesized
ttcttggttcagctttcatt

SEQ ID NO: 583615 - DNA, 20 bp, Artificial Sequence
  chemically synthesized
tgctcctaaatatttcttgg

SEQ ID NO: 583616 - DNA, 20 bp, Artificial Sequence
  chemically synthesized
ggacatccaccactaagttc

SEQ ID NO: 583617 - DNA, 20 bp, Artificial Sequence
  chemically synthesized
gtccagcaggggtgaggtgg

SEQ ID NO: 583618 - DNA, 20 bp, Artificial Sequence
  chemically synthesized
gaaggttttaagaatgaccc

SEQ ID NO: 583619 - DNA, 20 bp, Artificial Sequence
  chemically synthesized
cccctgatatattcctttct

SEQ ID NO: 583620 - DNA, 20 bp, Artificial Sequence
  chemically synthesized
tttcatagcagtaaaagatc

SEQ ID NO: 583621 - DNA, 20 bp, Artificial Sequence
  chemically synthesized
tacccaagtcctcatccagg

SEQ ID NO: 583622 - DNA, 20 bp, Artificial Sequence
  chemically synthesized
ttcattcttgcttcctaggg

SEQ ID NO: 583623 - DNA, 20 bp, Artificial Sequence
  chemically synthesized
tcactcttttggtttttcat

SEQ ID NO: 583624 - DNA, 20 bp, Artificial Sequence
  chemically synthesized
ctccccctctgtctcactct

SEQ ID NO: 583625 - DNA, 20 bp, Artificial Sequence
  chemically synthesized
cattaccttgatgataatac

SEQ ID NO: 583626 - DNA, 20 bp, Artificial Sequence
  chemically synthesized
caaatgtattatcatcaagg

SEQ ID NO: 583627 - DNA, 20 bp, Artificial Sequence
  chemically synthesized
ccgggggcaaggggaattct

SEQ ID NO: 583628 - DNA, 20 bp, Artificial Sequence
  chemically synthesized
tttgtgagctttctcaccct

SEQ ID NO: 583629 - DNA, 20 bp, Artificial Sequence
  chemically synthesized
cccaggagcccacagatttt

SEQ ID NO: 583630 - DNA, 20 bp, Artificial Sequence
  chemically synthesized
tctctgacatcccaggagcc

SEQ ID NO: 583631 - DNA, 20 bp, Artificial Sequence
  chemically synthesized
aagattatcatcacaattgt

SEQ ID NO: 583632 - DNA, 20 bp, Artificial Sequence
  chemically synthesized
aattgtgatgataatctttt

SEQ ID NO: 583633 - DNA, 20 bp, Artificial Sequence
  chemically synthesized
aaaagaaaataaaagcttcc

SEQ ID NO: 583634 - DNA, 20 bp, Artificial Sequence
  chemically synthesized
atttcactgtaaaagaaaat

SEQ ID NO: 583635 - DNA, 20 bp, Artificial Sequence
  chemically synthesized
atgtaatcatctatagataa

SEQ ID NO: 583636 - DNA, 20 bp, Artificial Sequence
  chemically synthesized
gtgaaatctgtcttatctat

SEQ ID NO: 583637 - DNA, 20 bp, Artificial Sequence
  chemically synthesized
ggggttgtatttacataaag

SEQ ID NO: 583638 - DNA, 20 bp, Artificial Sequence
  chemically synthesized
ggtattagcagtattctatt

SEQ ID NO: 583639 - DNA, 20 bp, Artificial Sequence
  chemically synthesized
ggttacttccagggagatgg

SEQ ID NO: 583640 - DNA, 20 bp, Artificial Sequence
  chemically synthesized
ttgtcttcctctctctcttt

SEQ ID NO: 583641 - DNA, 20 bp, Artificial Sequence
  chemically synthesized
tttctttttattttttgaga

SEQ ID NO: 583642 - DNA, 20 bp, Artificial Sequence
  chemically synthesized
gaggtggaggttgcggtgag

SEQ ID NO: 583643 - DNA, 20 bp, Artificial Sequence
  chemically synthesized
aacctccacctcctgggttc

SEQ ID NO: 583644 - DNA, 20 bp, Artificial Sequence
  chemically synthesized
tcgggaggctgaggcaggag

SEQ ID NO: 583645 - DNA, 20 bp, Artificial Sequence
  chemically synthesized
tgcctcagcctcccgagtag

SEQ ID NO: 583646 - DNA, 20 bp, Artificial Sequence
  chemically synthesized
aggcatgcgccaccatgcct

SEQ ID NO: 583647 - DNA, 20 bp, Artificial Sequence
  chemically synthesized
ttttgtatttttagtagaga

SEQ ID NO: 583648 - DNA, 20 bp, Artificial Sequence
  chemically synthesized
tgggtggatcacctgaggtc

SEQ ID NO: 583649 - DNA, 20 bp, Artificial Sequence
  chemically synthesized
cacctcggccccccaaagtg

SEQ ID NO: 583650 - DNA, 20 bp, Artificial Sequence
  chemically synthesized
cctgctgccttctccagcct

SEQ ID NO: 583651 - DNA, 20 bp, Artificial Sequence
  chemically synthesized
ggtgttcttaccctcgagac

SEQ ID NO: 583652 - DNA, 20 bp, Artificial Sequence
  chemically synthesized
tcttaccctcgagacttcag

SEQ ID NO: 583653 - DNA, 20 bp, Artificial Sequence
  chemically synthesized
ctgagcatatgagtcaggag

SEQ ID NO: 583654 - DNA, 20 bp, Artificial Sequence
  chemically synthesized
tgtgagttcaattttagaca

SEQ ID NO: 583655 - DNA, 20 bp, Artificial Sequence
  chemically synthesized
ccctgaaccctaaaatactc

SEQ ID NO: 583656 - DNA, 20 bp, Artificial Sequence
  chemically synthesized
gtaatttctaccacggtcta

SEQ ID NO: 583657 - DNA, 20 bp, Artificial Sequence
  chemically synthesized
gcgaatagaacacccaggca

SEQ ID NO: 583658 - DNA, 20 bp, Artificial Sequence
  chemically synthesized
tggaaacaacaggccctggt

SEQ ID NO: 583659 - DNA, 20 bp, Artificial Sequence
  chemically synthesized
tccaatcagttaccagggcc

SEQ ID NO: 583660 - DNA, 20 bp, Artificial Sequence
  chemically synthesized
aagggaatggagacaaagta

SEQ ID NO: 583661 - DNA, 20 bp, Artificial Sequence
  chemically synthesized
tccattccctttattacttc

SEQ ID NO: 583662 - DNA, 20 bp, Artificial Sequence
  chemically synthesized
actctggctgaagaataggt
